United States Patent 11,640,849 (METHODS FOR HISTOLOGICAL DIAGNOSIS AND TREATMENT OF DISEASES) - sequence listing, part 81

SEQ ID NO: 3085857 - protein, 23 aa, Giardia lamblia
CGNGYFFHYGSCYKFGGSPGANI

SEQ ID NO: 3085858 - protein, 43 aa, Giardia lamblia
CGRMSLCTMLPNIGLIRLPYDILSKMQLSYRKCLLIIGISMSS

SEQ ID NO: 3085859 - protein, 49 aa, Giardia lamblia
CGRSVDEVFLIRSMFYFFLLRFNVVTILRKPLPSQFLLKSLEYSQAARG

SEQ ID NO: 3085860 - protein, 23 aa, Giardia lamblia
CGSARYPGLLPVLAMYTDAYFDT

SEQ ID NO: 3085861 - protein, 17 aa, Giardia lamblia
CHAVCPVAYYEAAGSCI

SEQ ID NO: 3085862 - protein, 18 aa, Giardia lamblia
CHDGFYKDGTTCRKCAAG

SEQ ID NO: 3085863 - protein, 18 aa, Giardia lamblia
CHQLLLPIIPAVIDVMYS

SEQ ID NO: 3085864 - protein, 18 aa, Giardia lamblia
CHTKTYLDNFTISPLRAI

SEQ ID NO: 3085865 - protein, 21 aa, Giardia lamblia
CIAEYLLDLYYRRFDDMSPNF

SEQ ID NO: 3085866 - protein, 26 aa, Giardia lamblia
CIAMVIACILIFFDLSQQKVLQTIFT

SEQ ID NO: 3085867 - protein, 18 aa, Giardia lamblia
CIAPQQAGIALCLDSSEA

SEQ ID NO: 3085868 - protein, 29 aa, Giardia lamblia
CIAYEMCTLRPLYELLDVSELFGLIKDAR

SEQ ID NO: 3085869 - protein, 18 aa, Giardia lamblia
CICECEVGHYLSGNTCLA

SEQ ID NO: 3085870 - protein, 17 aa, Giardia lamblia
CIDSLPGRLLRLCDIPS

SEQ ID NO: 3085871 - protein, 26 aa, Giardia lamblia
CIERIEYILLVLLQPEYQLIIDKAYS

SEQ ID NO: 3085872 - protein, 18 aa, Giardia lamblia
CIFIFTRHRLHDGGSSRL

SEQ ID NO: 3085873 - protein, 18 aa, Giardia lamblia
CIFPRRYGLLEPRDFIIR

SEQ ID NO: 3085874 - protein, 18 aa, Giardia lamblia
CIGCICKTLMNARVLDDI

SEQ ID NO: 3085875 - protein, 26 aa, Giardia lamblia
CIGLSMVLLYIFHSIPIISYTETGIG

SEQ ID NO: 3085876 - protein, 18 aa, Giardia lamblia
CIGRGSFGSVYYCLHRES

SEQ ID NO: 3085877 - protein, 30 aa, Giardia lamblia
CIKESRVPLSLLFVFLTGVGSLCRRTEVSI

SEQ ID NO: 3085878 - protein, 31 aa, Giardia lamblia
CIMVVGLFLAYLPLLRITRDIKFIASILRMI

SEQ ID NO: 3085879 - protein, 18 aa, Giardia lamblia
CIPQPSYTFYLKDIDEIC

SEQ ID NO: 3085880 - protein, 23 aa, Giardia lamblia
CIPSKCIYRRLSDDPPIVCSGMG

SEQ ID NO: 3085881 - protein, 25 aa, Giardia lamblia
CIRASGRYYCQCPNMTTFFNKQCIS

SEQ ID NO: 3085882 - protein, 17 aa, Giardia lamblia
CIRYYLVDKYSTHLKTE

SEQ ID NO: 3085883 - protein, 24 aa, Giardia lamblia
CITPGWFMTVFSNCLKFSVSLRIF

SEQ ID NO: 3085884 - protein, 29 aa, Giardia lamblia
CITYVYDKRFFDLWQPGFLLLCNDIARQS

SEQ ID NO: 3085885 - protein, 18 aa, Giardia lamblia
CKCDSEYGIFGEYLCIPN

SEQ ID NO: 3085886 - protein, 23 aa, Giardia lamblia
CKDYGICEYKRAFLPDESFSDTY

SEQ ID NO: 3085887 - protein, 22 aa, Giardia lamblia
CKHFRIMICIPHRIVSVNKSKI

SEQ ID NO: 3085888 - protein, 38 aa, Giardia lamblia
CKNQNLIPELTYPAVIGIVWYIIMVCGYIPDIATIGKS

SEQ ID NO: 3085889 - protein, 24 aa, Giardia lamblia
CKNSHTAYYYSLAAGNLAIADSLY

SEQ ID NO: 3085890 - protein, 19 aa, Giardia lamblia
CKRGWHLAGDRCLACPSPC

SEQ ID NO: 3085891 - protein, 24 aa, Giardia lamblia
CKRPIGPIILFISGLPIVKLSMSN

SEQ ID NO: 3085892 - protein, 34 aa, Giardia lamblia
CKSRYGLRSLVSSLLYCIIANVIFYQYENDEVYL

SEQ ID NO: 3085893 - protein, 20 aa, Giardia lamblia
CLACHESCAFCTGPSADQCE

SEQ ID NO: 3085894 - protein, 17 aa, Giardia lamblia
CLALPQLIQVPREEITE

SEQ ID NO: 3085895 - protein, 17 aa, Giardia lamblia
CLATLVELCPCLKSFTV

SEQ ID NO: 3085896 - protein, 18 aa, Giardia lamblia
CLCAKDYTLVKTDCIPTR

SEQ ID NO: 3085897 - protein, 42 aa, Giardia lamblia
CLCLSTFPFPSPPDPVTLNFKYLSLFTAIKPFYVLGDRAQYP

SEQ ID NO: 3085898 - protein, 22 aa, Giardia lamblia
CLCVPPFKHIPDHGCAPAGCVS

SEQ ID NO: 3085899 - protein, 17 aa, Giardia lamblia
CLDGLGVCYEGKCLPGQ

SEQ ID NO: 3085900 - protein, 19 aa, Giardia lamblia
CLEFPRRFFTRFAPKILEA

SEQ ID NO: 3085901 - protein, 18 aa, Giardia lamblia
CLFYVLRELHPDSPLLMY

SEQ ID NO: 3085902 - protein, 19 aa, Giardia lamblia
CLGLIWDFILLDFHGGKVY

SEQ ID NO: 3085903 - protein, 42 aa, Giardia lamblia
CLHFSLRRLFPINIKIIWRILLFAIPQWFFLAQMQLVVIIMN

SEQ ID NO: 3085904 - protein, 25 aa, Giardia lamblia
CLIFSQLEIRCNPAFFTCFTYCNQN

SEQ ID NO: 3085905 - protein, 18 aa, Giardia lamblia
CLKFRVFQVLKQRPMARR

SEQ ID NO: 3085906 - protein, 34 aa, Giardia lamblia
CLLDLPVYWLSHNNMRFVFLNFIYLLLKHNETEG

SEQ ID NO: 3085907 - protein, 17 aa, Giardia lamblia
CLLLSLREKGVYQYLPI

SEQ ID NO: 3085908 - protein, 19 aa, Giardia lamblia
CLLTEHKRRKIPVPIAVIL

SEQ ID NO: 3085909 - protein, 18 aa, Giardia lamblia
CLMEGFTAFLRALNNLQS

SEQ ID NO: 3085910 - protein, 26 aa, Giardia lamblia
CLPPSARLILMNTLRDIYNSNTDMAL

SEQ ID NO: 3085911 - protein, 24 aa, Giardia lamblia
CLRCTGTNVFYFKGGCYNTKTEPG

SEQ ID NO: 3085912 - protein, 21 aa, Giardia lamblia
CLRGYMLYMGGCYDPAAIPGS

SEQ ID NO: 3085913 - protein, 20 aa, Giardia lamblia
CLRGYMLYMGGCYDPAATPG

SEQ ID NO: 3085914 - protein, 27 aa, Giardia lamblia
CLRYTALMIAVLLGWNRAVEALAHSKI

SEQ ID NO: 3085915 - protein, 17 aa, Giardia lamblia
CLSGPLQLPLNGDVLPL

SEQ ID NO: 3085916 - protein, 30 aa, Giardia lamblia
CLSTSTQLVQLPPSPLLSSNIIQTSFVDAK

SEQ ID NO: 3085917 - protein, 33 aa, Giardia lamblia
CLTDSAQRIITLYLFCLWLFIKHLKKDDPETLA

SEQ ID NO: 3085918 - protein, 21 aa, Giardia lamblia
CLTLSTFPFPPAPASPDPSRK

SEQ ID NO: 3085919 - protein, 23 aa, Giardia lamblia
CLYNDIFSSFYSSFAILFNACCA

SEQ ID NO: 3085920 - protein, 18 aa, Giardia lamblia
CMAAYDIIYYYFVLSQYE

SEQ ID NO: 3085921 - protein, 19 aa, Giardia lamblia
CMDRLCNNKVFRNCKACVD

SEQ ID NO: 3085922 - protein, 18 aa, Giardia lamblia
CMFTGYIVIILPELIYHE

SEQ ID NO: 3085923 - protein, 18 aa, Giardia lamblia
CMGLMFISIFLTTLICVL

SEQ ID NO: 3085924 - protein, 25 aa, Giardia lamblia
CMGRGQLPVLIVLDTDKKSIMDIKS

SEQ ID NO: 3085925 - protein, 27 aa, Giardia lamblia
CMHYSSRLFWKGLLQSSITFPAAKERV

SEQ ID NO: 3085926 - protein, 19 aa, Giardia lamblia
CMMKLSHTLIVFDFQTFQQ

SEQ ID NO: 3085927 - protein, 20 aa, Giardia lamblia
CMSLLAYYIVQCARKRGPTG

SEQ ID NO: 3085928 - protein, 18 aa, Giardia lamblia
CNALLATFLGVACALSLV

SEQ ID NO: 3085929 - protein, 24 aa, Giardia lamblia
CNERYKGMLPSFIKDLNALSKTRK

SEQ ID NO: 3085930 - protein, 26 aa, Giardia lamblia
CNFHAYASSVLLFFRGRSASCIRLDL

SEQ ID NO: 3085931 - protein, 25 aa, Giardia lamblia
CNHGLFIFVPGMRLIITKEYAYILC

SEQ ID NO: 3085932 - protein, 19 aa, Giardia lamblia
CNILMKRRKYRKVQINLEA

SEQ ID NO: 3085933 - protein, 25 aa, Giardia lamblia
CNLIVPLELGFVPPVSIYSNTSEHG

SEQ ID NO: 3085934 - protein, 21 aa, Giardia lamblia
CNLYCHLKLRYLRPPGSREHF

SEQ ID NO: 3085935 - protein, 21 aa, Giardia lamblia
CNNHWSIYMYIGKQSKLSNVL

SEQ ID NO: 3085936 - protein, 19 aa, Giardia lamblia
CNVFGPFRRILASDTLQAA

SEQ ID NO: 3085937 - protein, 28 aa, Giardia lamblia
CNYLYMIMWPMWKAYLYIFLARLFYNGT

SEQ ID NO: 3085938 - protein, 22 aa, Giardia lamblia
CNYTISVPVLDGRSYMGVAHCT

SEQ ID NO: 3085939 - protein, 26 aa, Giardia lamblia
CPGCLLYLFDFLIHSLLATAARMGVG

SEQ ID NO: 3085940 - protein, 27 aa, Giardia lamblia
CPGGLEAFFFILFNLAERRIALEKDLA

SEQ ID NO: 3085941 - protein, 17 aa, Giardia lamblia
CPMTYYEAADSCIPCAI

SEQ ID NO: 3085942 - protein, 23 aa, Giardia lamblia
CPSELTFLYPRPCIITCIKRLTD

SEQ ID NO: 3085943 - protein, 23 aa, Giardia lamblia
CPSGTFPFVNSTGYNKCFSCSSS

SEQ ID NO: 3085944 - protein, 56 aa, Giardia lamblia
CQDCRDHWIIYLLLAGLLLVIIILFALVIRFYLKFDNLVVTNLLVTRRAFLGFSDW

SEQ ID NO: 3085945 - protein, 17 aa, Giardia lamblia
CQFLYKQILNLACARYR

SEQ ID NO: 3085946 - protein, 21 aa, Giardia lamblia
CQNVTFRYLYSMEFMRSKDYK

SEQ ID NO: 3085947 - protein, 25 aa, Giardia lamblia
CQPIIDLLEFCLVPNPTLRPQIRDV

SEQ ID NO: 3085948 - protein, 23 aa, Giardia lamblia
CRDAACLLLLRAPPVLLHGLAES

SEQ ID NO: 3085949 - protein, 26 aa, Giardia lamblia
CRDPPNLTCLTWIGIDLAVAASQTDR

SEQ ID NO: 3085950 - protein, 20 aa, Giardia lamblia
CRENRCIIVSFREICTQCNE

SEQ ID NO: 3085951 - protein, 19 aa, Giardia lamblia
CRGDFQFVLGHGCVHPACI

SEQ ID NO: 3085952 - protein, 27 aa, Giardia lamblia
CRGNKKYMPLLVYLRTKYHNNLGMSNC

SEQ ID NO: 3085953 - protein, 29 aa, Giardia lamblia
CRIVKLPTFGGWSILLFPSVLLAIVGTNF

SEQ ID NO: 3085954 - protein, 24 aa, Giardia lamblia
CRLKLVFISLCHSSIRRALSYASQ

SEQ ID NO: 3085955 - protein, 18 aa, Giardia lamblia
CRQRLLRLLAKCLQTSYV

SEQ ID NO: 3085956 - protein, 25 aa, Giardia lamblia
CRRISLLARLFIKQILFEDVLNEKV

SEQ ID NO: 3085957 - protein, 25 aa, Giardia lamblia
CRSLEICWNPTLLGPYRFLRYNGII

SEQ ID NO: 3085958 - protein, 27 aa, Giardia lamblia
CSDELIRYSPWYLRSVKLYGLMVARCT

SEQ ID NO: 3085959 - protein, 19 aa, Giardia lamblia
CSDGFAPDFRGACTPCMGG

SEQ ID NO: 3085960 - protein, 20 aa, Giardia lamblia
CSEAAFLMNGGCYTTEYYPG

SEQ ID NO: 3085961 - protein, 19 aa, Giardia lamblia
CSECLPNYKLYDSNGVVHC

SEQ ID NO: 3085962 - protein, 27 aa, Giardia lamblia
CSFTNLFYTFCIFIPNIIFLSDKPREL

SEQ ID NO: 3085963 - protein, 20 aa, Giardia lamblia
CSGAAFLMNGGCYTKAHYPG

SEQ ID NO: 3085964 - protein, 25 aa, Giardia lamblia
CSIDNLFLLRFILSSDLREKAIRVS

SEQ ID NO: 3085965 - protein, 39 aa, Giardia lamblia
CSIKYLVSCFLPLDLMFLVPALLVVALIMSLPIIYDAST

SEQ ID NO: 3085966 - protein, 36 aa, Giardia lamblia
CSLDSILDYYHFLIEDLIWILMADISMALEYIHANG

SEQ ID NO: 3085967 - protein, 20 aa, Giardia lamblia
CSMIYEYYYHVINSLLRSSV

SEQ ID NO: 3085968 - protein, 17 aa, Giardia lamblia
CSMYVVNGMRPFLITKG

SEQ ID NO: 3085969 - protein, 28 aa, Giardia lamblia
CSQPSLHPLIADALFYATGKFFGTFSTD

SEQ ID NO: 3085970 - protein, 34 aa, Giardia lamblia
CSSLDERLVWNIGTLVLKIMTMKPAMSSMYTTDG

SEQ ID NO: 3085971 - protein, 20 aa, Giardia lamblia
CSTDYIYHKGGCYSKTGTGN

SEQ ID NO: 3085972 - protein, 28 aa, Giardia lamblia
CSTLLAPVCSLGYLWVKSYHSLAEIYSA

SEQ ID NO: 3085973 - protein, 21 aa, Giardia lamblia
CSVFSIRCNLFQLSSRGETVC

SEQ ID NO: 3085974 - protein, 29 aa, Giardia lamblia
CTGCKTTGYFLFQGGCYTLASIPGNIICA

SEQ ID NO: 3085975 - protein, 23 aa, Giardia lamblia
CTHCAPGYFLYSGGCYQSDRLPG

SEQ ID NO: 3085976 - protein, 25 aa, Giardia lamblia
CTILSLAVVLLIAILVVTIKSKRWR

SEQ ID NO: 3085977 - protein, 25 aa, Giardia lamblia
CTISPFQRLFRSLPGLYQDSFYHLH

SEQ ID NO: 3085978 - protein, 20 aa, Giardia lamblia
CTLEKPLVFCDEGYTRIGSD

SEQ ID NO: 3085979 - protein, 38 aa, Giardia lamblia
CTLHFGWTYTRAVFLLVFFYGVFCYGSSYFKAIFTSPG

SEQ ID NO: 3085980 - protein, 18 aa, Giardia lamblia
CTLSLLHVLSTLSQIYFW

SEQ ID NO: 3085981 - protein, 18 aa, Giardia lamblia
CTMPIPHDSVRQCLIFSQ

SEQ ID NO: 3085982 - protein, 34 aa, Giardia lamblia
CTNALCLLVLNLISMIVFCSLNFLIKAYPFAEFE

SEQ ID NO: 3085983 - protein, 24 aa, Giardia lamblia
CTPDEYLWSLVIPDEIINLLIVLN

SEQ ID NO: 3085984 - protein, 18 aa, Giardia lamblia
CTPYHLFLNTLGDRQARD

SEQ ID NO: 3085985 - protein, 27 aa, Giardia lamblia
CTQLPPIHILVIHREIFYKAVLAFEAL

SEQ ID NO: 3085986 - protein, 25 aa, Giardia lamblia
CTRCGPRFFLHAGGCYEIGRSPGTV

SEQ ID NO: 3085987 - protein, 26 aa, Giardia lamblia
CTRCYKTHIFHLGGCFTRGGPRAEAV

SEQ ID NO: 3085988 - protein, 21 aa, Giardia lamblia
CTSCYPGFVLDHAGGPAGTCI

SEQ ID NO: 3085989 - protein, 25 aa, Giardia lamblia
CTSSYTVMLLFMPPGADYLSISVYN

SEQ ID NO: 3085990 - protein, 28 aa, Giardia lamblia
CTTCTGGYFLHYGSCYKFDSSPGSIVCP

SEQ ID NO: 3085991 - protein, 17 aa, Giardia lamblia
CTTGFKAIDGKCVSESC

SEQ ID NO: 3085992 - protein, 24 aa, Giardia lamblia
CTTIYYLLQYVLKVSPVSLIYQIE

SEQ ID NO: 3085993 - protein, 25 aa, Giardia lamblia
CTTSLLDLFVSEGCQLFFAINDDGS

SEQ ID NO: 3085994 - protein, 38 aa, Giardia lamblia
CTVCQDAILIWDLYQRKFIAVLRIFAPSSPIVRQLPED

SEQ ID NO: 3085995 - protein, 25 aa, Giardia lamblia
CTVCRYRGMHLPHCLPPSARLILMN

SEQ ID NO: 3085996 - protein, 30 aa, Giardia lamblia
CTVFGRQMRVLLVKNFLVLVRHPAILVFIL

SEQ ID NO: 3085997 - protein, 25 aa, Giardia lamblia
CVAYPVYFLMQCSWFTFYRIDARRR

SEQ ID NO: 3085998 - protein, 22 aa, Giardia lamblia
CVDYPQTLYIHLLKVLRASCRA

SEQ ID NO: 3085999 - protein, 26 aa, Giardia lamblia
CVETGVLIYGLYLDCGFFDLDGGKLL

SEQ ID NO: 3086000 - protein, 17 aa, Giardia lamblia
CVFLVLAIVFIILNCCC

SEQ ID NO: 3086001 - protein, 31 aa, Giardia lamblia
CVHKEVLKALPLCALFPIFLSSNVIEPEIPS

SEQ ID NO: 3086002 - protein, 32 aa, Giardia lamblia
CVHVSKIDKTRRFFCGFLENVTENLPVDNLPT

SEQ ID NO: 3086003 - protein, 18 aa, Giardia lamblia
CVHVSKVDRTRRFYCGFL

SEQ ID NO: 3086004 - protein, 25 aa, Giardia lamblia
CVKCDDSMLWCLSCRGPGACTECKV

SEQ ID NO: 3086005 - protein, 31 aa, Giardia lamblia
CVLAWPALIVVIPTIILYAVIFFMFRRVAPQ

SEQ ID NO: 3086006 - protein, 33 aa, Giardia lamblia
CVLCEKRYFLQPARRICLHSCPIGYAANPITNT

SEQ ID NO: 3086007 - protein, 17 aa, Giardia lamblia
CVLLALAPSMYTITGGP

SEQ ID NO: 3086008 - protein, 19 aa, Giardia lamblia
CVLLIGWGTFANGTKYWII

SEQ ID NO: 3086009 - protein, 19 aa, Giardia lamblia
CVPFGCLDGLGVCYEGKCL

SEQ ID NO: 3086010 - protein, 17 aa, Giardia lamblia
CVPGYVPIDGKCQKYPG

SEQ ID NO: 3086011 - protein, 18 aa, Giardia lamblia
CVPGYVPIDGKCQKYPGA

SEQ ID NO: 3086012 - protein, 20 aa, Giardia lamblia
CVQTDGSLFCQCQRGWSGSA

SEQ ID NO: 3086013 - protein, 22 aa, Giardia lamblia
CVRIIENLLLDKNCRDIKIDVM

SEQ ID NO: 3086014 - protein, 29 aa, Giardia lamblia
CVRIWRRFTRWLLIYLTGHPRRGKGSLGP

SEQ ID NO: 3086015 - protein, 17 aa, Giardia lamblia
CVRLLLQRMVFQEEVLE

SEQ ID NO: 3086016 - protein, 17 aa, Giardia lamblia
CVRYLLGKELGMQDRTG

SEQ ID NO: 3086017 - protein, 23 aa, Giardia lamblia
CVSFFFLNALHRYTFRNNLVKQG

SEQ ID NO: 3086018 - protein, 28 aa, Giardia lamblia
CVSGMVLVKPYLCVSPRCISNSATNEVC

SEQ ID NO: 3086019 - protein, 37 aa, Giardia lamblia
CWRRTTTCYYILQDLLFITFVLSRDKHLPLGTIFFSC

SEQ ID NO: 3086020 - protein, 24 aa, Giardia lamblia
CWVNSYILIYKDYFSVSLEPSRAL

SEQ ID NO: 3086021 - protein, 18 aa, Giardia lamblia
CYGNYYSHRDRMSVCLPL

SEQ ID NO: 3086022 - protein, 26 aa, Giardia lamblia
CYMLSDYVYLVLPLTSSKQQAALLEE

SEQ ID NO: 3086023 - protein, 19 aa, Giardia lamblia
CYNINLIHELLRLCRQRMR

SEQ ID NO: 3086024 - protein, 19 aa, Giardia lamblia
CYSTLFPDTLALTVLSKYI

SEQ ID NO: 3086025 - protein, 23 aa, Giardia lamblia
CYYASICYAGGLAGWMENSDLNE

SEQ ID NO: 3086026 - protein, 27 aa, Giardia lamblia
DAAATLPFLSLPPKSSFRLFISSMPVK

SEQ ID NO: 3086027 - protein, 27 aa, Giardia lamblia
DAADFTVQLLRLFLTRGPFQQTQIGII

SEQ ID NO: 3086028 - protein, 21 aa, Giardia lamblia
DAALFQQRYLPLSSPFTTPEV

SEQ ID NO: 3086029 - protein, 30 aa, Giardia lamblia
DAALLVHFPMFFLPKYLSVRSRRFSSIYTF

SEQ ID NO: 3086030 - protein, 29 aa, Giardia lamblia
DACSRFSDLPFMFFRNGLATTLPERPRDN

SEQ ID NO: 3086031 - protein, 17 aa, Giardia lamblia
DADGYFHTGDLIKLLPD

SEQ ID NO: 3086032 - protein, 18 aa, Giardia lamblia
DADKDYYRLLLQLVSDQT

SEQ ID NO: 3086033 - protein, 30 aa, Giardia lamblia
DADYEVLEHYRLLLSWDHEKKRLVFTPPMK

SEQ ID NO: 3086034 - protein, 17 aa, Giardia lamblia
DAFFKDRFIVDGVWARI

SEQ ID NO: 3086035 - protein, 33 aa, Giardia lamblia
DAFVPAPQRVLTFLQTLIPLACHRRLSILILNM

SEQ ID NO: 3086036 - protein, 28 aa, Giardia lamblia
DAGFKMIAHMMPNLPFTSTFRDIFGFQE

SEQ ID NO: 3086037 - protein, 22 aa, Giardia lamblia
DAIFWPENLTNYLSSLELKEFM

SEQ ID NO: 3086038 - protein, 23 aa, Giardia lamblia
DAIRSSIWLPSAAYGLFISSAPQ

SEQ ID NO: 3086039 - protein, 27 aa, Giardia lamblia
DALPSLQTLLSDVYIPLFERSPTWGKV

SEQ ID NO: 3086040 - protein, 21 aa, Giardia lamblia
DALVAGGIQFALFLSATSFSL

SEQ ID NO: 3086041 - protein, 25 aa, Giardia lamblia
DALYDAMHSPLFFPGASPARQSANA

SEQ ID NO: 3086042 - protein, 26 aa, Giardia lamblia
DAMATFLIYHICSYVYLLIHGADKGA

SEQ ID NO: 3086043 - protein, 31 aa, Giardia lamblia
DANAASCTACYPGYSLLYGSGTAGTCVKECT

SEQ ID NO: 3086044 - protein, 20 aa, Giardia lamblia
DAPGTLCPLLHFLVASQNIN

SEQ ID NO: 3086045 - protein, 24 aa, Giardia lamblia
DAQNYTIPMLLLASHSHILVNQEC

SEQ ID NO: 3086046 - protein, 21 aa, Giardia lamblia
DARYLLLLFHSGKVTHFSEFT

SEQ ID NO: 3086047 - protein, 24 aa, Giardia lamblia
DASNALQLGLLKQAEYDSISLLTH

SEQ ID NO: 3086048 - protein, 47 aa, Giardia lamblia
DASTKMGIFSVFFLPVLLIILGWILSDVFVPWLMGLLNSLAQRVASR

SEQ ID NO: 3086049 - protein, 26 aa, Giardia lamblia
DATFTIPCLELYLAVLQHPVTIFLIP

SEQ ID NO: 3086050 - protein, 34 aa, Giardia lamblia
DATINILEPIPITSIEPLLSIMFTNWERARREDL

SEQ ID NO: 3086051 - protein, 31 aa, Giardia lamblia
DAVCLLHTIILLWYCETMMPLSLIYDITPEI

SEQ ID NO: 3086052 - protein, 25 aa, Giardia lamblia
DAYKFKDWLALLRTMKQQSALQSIL

SEQ ID NO: 3086053 - protein, 38 aa, Giardia lamblia
DAYPQVVWDYGLDFDWQLLNGIRYTPLFTAQTLIIVVV

SEQ ID NO: 3086054 - protein, 25 aa, Giardia lamblia
DCHDGQFGHMWYNYCGGVGDCIQKK

SEQ ID NO: 3086055 - protein, 27 aa, Giardia lamblia
DCHDGRSIYHMWYNYCGGVGDCVKKKD

SEQ ID NO: 3086056 - protein, 22 aa, Giardia lamblia
DCIVKLFTYYFNYTVKGEKEEI

SEQ ID NO: 3086057 - protein, 21 aa, Giardia lamblia
DCLRLLLMNTADLSAAPYSFL

SEQ ID NO: 3086058 - protein, 24 aa, Giardia lamblia
DCMHKQYIYILSNTNVFTHSLPRF

SEQ ID NO: 3086059 - protein, 22 aa, Giardia lamblia
DCNQLGRCLWGKCVCFDGVLGD

SEQ ID NO: 3086060 - protein, 25 aa, Giardia lamblia
DCQQMKCLPTGRYITVCSLCRTGLV

SEQ ID NO: 3086061 - protein, 19 aa, Giardia lamblia
DCRHEIKCMQVIYNMPSYG

SEQ ID NO: 3086062 - protein, 25 aa, Giardia lamblia
DCSTRLLEMPVYPSPFAMLKILAPI

SEQ ID NO: 3086063 - protein, 22 aa, Giardia lamblia
DCWDYTSFWVLSSSGPTTDNNK

SEQ ID NO: 3086064 - protein, 22 aa, Giardia lamblia
DDAALIYYMYNLLDRHILDDIY

SEQ ID NO: 3086065 - protein, 37 aa, Giardia lamblia
DDAQKFICGWIPAIKMLIDLLPLLSYIESTASITDVQ

SEQ ID NO: 3086066 - protein, 46 aa, Giardia lamblia
DDDTCCGRHLLLWTVIVIMAILLLITFILVICLYAQIGSTLTVKNL

SEQ ID NO: 3086067 - protein, 24 aa, Giardia lamblia
DDEYMRAILYFVSNSNLLSQNALE

SEQ ID NO: 3086068 - protein, 24 aa, Giardia lamblia
DDLELLRLVPILRKVLELSSLKRG

SEQ ID NO: 3086069 - protein, 19 aa, Giardia lamblia
DDLISLALELATSGPQLSA

SEQ ID NO: 3086070 - protein, 21 aa, Giardia lamblia
DDLMRVFLPVVSPTNFTRALA

SEQ ID NO: 3086071 - protein, 28 aa, Giardia lamblia
DDLRELRVSLVARLVLLLALGGRHGLDH

SEQ ID NO: 3086072 - protein, 27 aa, Giardia lamblia
DDPMMQVFLTYFVARLAFSSDLVSTFY

SEQ ID NO: 3086073 - protein, 25 aa, Giardia lamblia
DDPNPAALFAYRQALFYTCCQALLT

SEQ ID NO: 3086074 - protein, 30 aa, Giardia lamblia
DDQRRNLWLMIILFYISTTSLKLLFGDSQT

SEQ ID NO: 3086075 - protein, 24 aa, Giardia lamblia
DDSGRWGCHCTGRYMTYGSTCTSY

SEQ ID NO: 3086076 - protein, 22 aa, Giardia lamblia
DDSLGLATLIDALTKRPTDDPC

SEQ ID NO: 3086077 - protein, 32 aa, Giardia lamblia
DDSQTEYFHGMPYHLFLLPAQVSWTEVTKAIK

SEQ ID NO: 3086078 - protein, 26 aa, Giardia lamblia
DDSYYGNFIVIFMNMSEYPEGGETLC

SEQ ID NO: 3086079 - protein, 23 aa, Giardia lamblia
DDTIFVFLLSTRAASLGLNLTRA

SEQ ID NO: 3086080 - protein, 21 aa, Giardia lamblia
DDVLQHLLKYKAGLSGDQTQQ

SEQ ID NO: 3086081 - protein, 19 aa, Giardia lamblia
DDWSILCRGNLYADIILSD

SEQ ID NO: 3086082 - protein, 20 aa, Giardia lamblia
DDYACDCYPIYRGSLCQSCD

SEQ ID NO: 3086083 - protein, 18 aa, Giardia lamblia
DDYLCSCYSLYSGKFCAA

SEQ ID NO: 3086084 - protein, 25 aa, Giardia lamblia
DEATATIPYLPIGVSRVGSFIVTSD

SEQ ID NO: 3086085 - protein, 26 aa, Giardia lamblia
DEEKKIYLTYLLRKLQVSRNLSAEYT

SEQ ID NO: 3086086 - protein, 39 aa, Giardia lamblia
DEERRARAVILYYLFYTYALLQLLPTIRYCEQMYGTLEL

SEQ ID NO: 3086087 - protein, 34 aa, Giardia lamblia
DEGDWHDTLLRLFFLVYILIKLPLCKHKSSSAVG

SEQ ID NO: 3086088 - protein, 24 aa, Giardia lamblia
DEHRLGMVFKNKAFLANIIAELIL

SEQ ID NO: 3086089 - protein, 30 aa, Giardia lamblia
DEKQLYSVGGPLSYPLIGTGTVLPPNDDEG

SEQ ID NO: 3086090 - protein, 25 aa, Giardia lamblia
DELDQQTLWLEAARLYKRCSAFTHA

SEQ ID NO: 3086091 - protein, 29 aa, Giardia lamblia
DELHTSIHPLFIWFLSSGIFNEYSSIADW

SEQ ID NO: 3086092 - protein, 28 aa, Giardia lamblia
DELYKPLLLYRTVVLPKATFKPPPVLLV

SEQ ID NO: 3086093 - protein, 17 aa, Giardia lamblia
DENTLLVGLFIAGSRMN

SEQ ID NO: 3086094 - protein, 24 aa, Giardia lamblia
DEPPLPYLQWSQMGSFKPVPLYII

SEQ ID NO: 3086095 - protein, 27 aa, Giardia lamblia
DEQTQFDGFPLLTMLSMKPNKAIIRID

SEQ ID NO: 3086096 - protein, 23 aa, Giardia lamblia
DERPFIFVPHRNGPNKLRLVMCV

SEQ ID NO: 3086097 - protein, 22 aa, Giardia lamblia
DERSYFDYALKTLATLRETLYV

SEQ ID NO: 3086098 - protein, 24 aa, Giardia lamblia
DERVYGPYLYLGCDPTIWKRLYDA

SEQ ID NO: 3086099 - protein, 21 aa, Giardia lamblia
DESLLNLWQFALPPIAGRISD

SEQ ID NO: 3086100 - protein, 23 aa, Giardia lamblia
DESLPYMCCIPNGFLPISNLDNG

SEQ ID NO: 3086101 - protein, 25 aa, Giardia lamblia
DESQLIVSLLLFFSAMNHKTSRISF

SEQ ID NO: 3086102 - protein, 26 aa, Giardia lamblia
DETKLSVITMLAISCLWLQAHGEEDD

SEQ ID NO: 3086103 - protein, 17 aa, Giardia lamblia
DEVFIWLLTFCISFNFL

SEQ ID NO: 3086104 - protein, 24 aa, Giardia lamblia
DEYSYLLYFASFPIYTSSQSRIDN

SEQ ID NO: 3086105 - protein, 28 aa, Giardia lamblia
DFASVAEFLLLLRLLEYYAEIPIIVIAY

SEQ ID NO: 3086106 - protein, 23 aa, Giardia lamblia
DFATQMFVWALTALRECCRPTMK

SEQ ID NO: 3086107 - protein, 22 aa, Giardia lamblia
DFHDIIMYAPPLSESFLQTGSF

SEQ ID NO: 3086108 - protein, 17 aa, Giardia lamblia
DFLDFYMPSTCYKRAIV

SEQ ID NO: 3086109 - protein, 18 aa, Giardia lamblia
DFLHRFNRFHIPEDNLNL

SEQ ID NO: 3086110 - protein, 23 aa, Giardia lamblia
DFNKAEIYFSQALAVIMCIRYYK

SEQ ID NO: 3086111 - protein, 17 aa, Giardia lamblia
DFNYQCVPFGCLDGLGV

SEQ ID NO: 3086112 - protein, 26 aa, Giardia lamblia
DFPNLGFIVFFLPELSPISCMEDVFY

SEQ ID NO: 3086113 - protein, 19 aa, Giardia lamblia
DFRAPLRLPEAFHPEGLCE

SEQ ID NO: 3086114 - protein, 21 aa, Giardia lamblia
DFRGELLFLLRLMQMHVHQTK

SEQ ID NO: 3086115 - protein, 25 aa, Giardia lamblia
DFSNYFPIVIIVLTILFASNLDRII

SEQ ID NO: 3086116 - protein, 22 aa, Giardia lamblia
DFSVLIFIVFKDKVVIKACGTI

SEQ ID NO: 3086117 - protein, 30 aa, Giardia lamblia
DFTEGFIFLCSQLMTIDPLLRDLLCSAENI

SEQ ID NO: 3086118 - protein, 19 aa, Giardia lamblia
DFTTYFTYGAWFAFTHGPF

SEQ ID NO: 3086119 - protein, 21 aa, Giardia lamblia
DFVEYACSCGKIPYSTTVERY

SEQ ID NO: 3086120 - protein, 38 aa, Giardia lamblia
DFVYDPPISLFPIYHQVGYLFLPKTTPFSKAIAVFRAI

SEQ ID NO: 3086121 - protein, 35 aa, Giardia lamblia
DFYGKTALMCAAKNNYMPILKFLASKECKIKDHKG

SEQ ID NO: 3086122 - protein, 17 aa, Giardia lamblia
DFYVRSLRSFGWPGRTG

SEQ ID NO: 3086123 - protein, 20 aa, Giardia lamblia
DGARSILSFLYPHIKKSAKY

SEQ ID NO: 3086124 - protein, 17 aa, Giardia lamblia
DGCLFSLYEGNLSVYNP

SEQ ID NO: 3086125 - protein, 25 aa, Giardia lamblia
DGDKIYLTLLPKGIAYTSGGRAGRW

SEQ ID NO: 3086126 - protein, 19 aa, Giardia lamblia
DGFYTFMLQGLDKIKKILS

SEQ ID NO: 3086127 - protein, 19 aa, Giardia lamblia
DGICIPCPANCKRCFKRDF

SEQ ID NO: 3086128 - protein, 25 aa, Giardia lamblia
DGIVGVPGCKYCTLPLTNGTNENPV

SEQ ID NO: 3086129 - protein, 21 aa, Giardia lamblia
DGLNRQFKLLLAKQAPSYADL

SEQ ID NO: 3086130 - protein, 21 aa, Giardia lamblia
DGLSSIMWLVTAAKNSDNVAT

SEQ ID NO: 3086131 - protein, 34 aa, Giardia lamblia
DGMTPLLLGLVIPLLMFIVSPLMIFALVEEKSSG

SEQ ID NO: 3086132 - protein, 27 aa, Giardia lamblia
DGPLIAARLLFYPFITSIWGNCVQFEL

SEQ ID NO: 3086133 - protein, 24 aa, Giardia lamblia
DGPMPFYYRTSLFVALKLMIQYFK

SEQ ID NO: 3086134 - protein, 21 aa, Giardia lamblia
DGRMFHIDFGWCFGKDPKLMA

SEQ ID NO: 3086135 - protein, 19 aa, Giardia lamblia
DGRNILFWIGCGTVLISTT

SEQ ID NO: 3086136 - protein, 19 aa, Giardia lamblia
DGSALEMAICVLLYEIGVL

SEQ ID NO: 3086137 - protein, 23 aa, Giardia lamblia
DGSFQLFALILETIVHSSNPLLA

SEQ ID NO: 3086138 - protein, 33 aa, Giardia lamblia
DGSIGLFPLQSYTLFLRYLLRPEAPKTLSDSFK

SEQ ID NO: 3086139 - protein, 23 aa, Giardia lamblia
DGSILLLVLKARGAFTLGFSFLM

SEQ ID NO: 3086140 - protein, 22 aa, Giardia lamblia
DGSPVCRCAFNWNPATQCVTCL

SEQ ID NO: 3086141 - protein, 22 aa, Giardia lamblia
DGTFFHIDFGHFLGNFKKKFNY

SEQ ID NO: 3086142 - protein, 19 aa, Giardia lamblia
DGTLIELATPGSLLAIRAC

SEQ ID NO: 3086143 - protein, 17 aa, Giardia lamblia
DGVLYPYGSPLGRHTDL

SEQ ID NO: 3086144 - protein, 37 aa, Giardia lamblia
DGVSDYLVMNVLVPLLLRLVQMMFARYSSLLEALGVS

SEQ ID NO: 3086145 - protein, 17 aa, Giardia lamblia
DGYFHTGDLIKLLPDGR

SEQ ID NO: 3086146 - protein, 26 aa, Giardia lamblia
DHFLAKYIPDTFYLLNQKRLSVLVPT

SEQ ID NO: 3086147 - protein, 31 aa, Giardia lamblia
DHHNIFPLRALFIMLLSRETYHISRPQQRLF

SEQ ID NO: 3086148 - protein, 25 aa, Giardia lamblia
DHIMDLVFSFLIPQEIICFILSFYR

SEQ ID NO: 3086149 - protein, 26 aa, Giardia lamblia
DHKEFFRTHLANRIIRLLLLAVEQRP

SEQ ID NO: 3086150 - protein, 26 aa, Giardia lamblia
DHLLYNVMCIYLMALAYKCPQSTHNS

SEQ ID NO: 3086151 - protein, 27 aa, Giardia lamblia
DHLTLPKRLFMESSFYYLTVNLHDELS

SEQ ID NO: 3086152 - protein, 17 aa, Giardia lamblia
DHQIVFVGYGYYKGTEA

SEQ ID NO: 3086153 - protein, 20 aa, Giardia lamblia
DHRRSLFIPELMLSVKSPDT

SEQ ID NO: 3086154 - protein, 17 aa, Giardia lamblia
DHTIADMYLDLPLVLMG

SEQ ID NO: 3086155 - protein, 17 aa, Giardia lamblia
DHVLRLRRLIFSSSGGV

SEQ ID NO: 3086156 - protein, 25 aa, Giardia lamblia
DIAHHLILLCEALIRTRKDALALNM

SEQ ID NO: 3086157 - protein, 26 aa, Giardia lamblia
DICESFDFRLELYISLLQESRKYDEK

SEQ ID NO: 3086158 - protein, 24 aa, Giardia lamblia
DICNLLNGLLRYEPGNRYSAEYIC

SEQ ID NO: 3086159 - protein, 25 aa, Giardia lamblia
DIESRTFLWKYLKSLRIRAQQTDKR

SEQ ID NO: 3086160 - protein, 24 aa, Giardia lamblia
DIGARLPKLPGSCLALHGSVVSYG

SEQ ID NO: 3086161 - protein, 17 aa, Giardia lamblia
DIHFYADLLSAFPNRYA

SEQ ID NO: 3086162 - protein, 24 aa, Giardia lamblia
DIHNLLLSVFVLVVTTPATLDFSL

SEQ ID NO: 3086163 - protein, 28 aa, Giardia lamblia
DIHTDWYMNQFFLLPAEYGYLTTADLNY

SEQ ID NO: 3086164 - protein, 30 aa, Giardia lamblia
DIIAIFAIPIGFLYLYIVEMTRLRLNLAFK

SEQ ID NO: 3086165 - protein, 26 aa, Giardia lamblia
DIKIGFWRAVLPFLRLFPIVRGYRCC

SEQ ID NO: 3086166 - protein, 19 aa, Giardia lamblia
DILAILPPHLDVVHFHAGL

SEQ ID NO: 3086167 - protein, 21 aa, Giardia lamblia
DILCLLVYLLYVGRAYEAASG

SEQ ID NO: 3086168 - protein, 24 aa, Giardia lamblia
DILEAPIYRLCITEFAPRSIASLY

SEQ ID NO: 3086169 - protein, 21 aa, Giardia lamblia
DILELPRFLELRKCYAFRLFV

SEQ ID NO: 3086170 - protein, 25 aa, Giardia lamblia
DILGMPLIDCILKDVYRSVSLLQFL

SEQ ID NO: 3086171 - protein, 24 aa, Giardia lamblia
DILKAIISVQLSPSPLLLSGLVLT

SEQ ID NO: 3086172 - protein, 18 aa, Giardia lamblia
DILKLFKLQMCLKYNLEM

SEQ ID NO: 3086173 - protein, 17 aa, Giardia lamblia
DILLVLHSNLLVGKLDI

SEQ ID NO: 3086174 - protein, 40 aa, Giardia lamblia
DIMHKTYIRIPIANAYLKSSIWTLKLIRAIYSSRINMEES

SEQ ID NO: 3086175 - protein, 34 aa, Giardia lamblia
DIMSLLFIIARVPTYIFPLGWNLMLLLNIQFDTA

SEQ ID NO: 3086176 - protein, 17 aa, Giardia lamblia
DIMVTIPMSLFNALLNK

SEQ ID NO: 3086177 - protein, 25 aa, Giardia lamblia
DINDLRLLVDFLSYGIFALDCKDGV

SEQ ID NO: 3086178 - protein, 29 aa, Giardia lamblia
DINGTYLSFLVPTPFFLSIKHKYSIELSE

SEQ ID NO: 3086179 - protein, 30 aa, Giardia lamblia
DINLYVKGLFVLCIFLAFVLTMAGSVYSLV

SEQ ID NO: 3086180 - protein, 24 aa, Giardia lamblia
DIPDPLPDLLFRKIVFEIVNLLVS

SEQ ID NO: 3086181 - protein, 24 aa, Giardia lamblia
DIPELCLKLLTLVKLRLVTTIAHA

SEQ ID NO: 3086182 - protein, 26 aa, Giardia lamblia
DIPLRIVLELVPIIVSLLLADSRYFS

SEQ ID NO: 3086183 - protein, 23 aa, Giardia lamblia
DIQPPFFEDYSYPNSRYAFSPAQ

SEQ ID NO: 3086184 - protein, 22 aa, Giardia lamblia
DISFRDVVFLGEARLKLLIQLV

SEQ ID NO: 3086185 - protein, 17 aa, Giardia lamblia
DISLLLHQGWIIERVDS

SEQ ID NO: 3086186 - protein, 26 aa, Giardia lamblia
DISQSYLYFSFSILPGQYLNYKTMVN

SEQ ID NO: 3086187 - protein, 19 aa, Giardia lamblia
DISRPLFWKAFNQSMIERV

SEQ ID NO: 3086188 - protein, 35 aa, Giardia lamblia
DISVAPTITLLILLLIVGALVIYFGLASCGKVHLP

SEQ ID NO: 3086189 - protein, 18 aa, Giardia lamblia
DITDSFYIFVLREATRSV

SEQ ID NO: 3086190 - protein, 38 aa, Giardia lamblia
DIWSAACFLYELLTGDILFFDSDWIRFFIRVTKDSYQS

SEQ ID NO: 3086191 - protein, 22 aa, Giardia lamblia
DIWSLGCILLELCTLQSVTALA

SEQ ID NO: 3086192 - protein, 17 aa, Giardia lamblia
DIWSRVPNLILFAFAGD

SEQ ID NO: 3086193 - protein, 19 aa, Giardia lamblia
DIYFSAPYLNLHGSSMVSF

SEQ ID NO: 3086194 - protein, 24 aa, Giardia lamblia
DKCINIIYAIRILTSRYLHVDILY

SEQ ID NO: 3086195 - protein, 23 aa, Giardia lamblia
DKCLSFFITVLKDIGPRILTSNG

SEQ ID NO: 3086196 - protein, 18 aa, Giardia lamblia
DKCLTCVSGYVPIDGVCV

SEQ ID NO: 3086197 - protein, 28 aa, Giardia lamblia
DKCVTCRSGFFLASGSWKGQCIPCDLSS

SEQ ID NO: 3086198 - protein, 26 aa, Giardia lamblia
DKDGNTPLMLLIKAGMDQFIPGLVQR

SEQ ID NO: 3086199 - protein, 24 aa, Giardia lamblia
DKDRPSLLAAFRNGLRSITAALRA

SEQ ID NO: 3086200 - protein, 33 aa, Giardia lamblia
DKEIDMRAMNLFWIQFFGAALYSWLGGNSPWTS

SEQ ID NO: 3086201 - protein, 34 aa, Giardia lamblia
DKGMLLGETLLMYVCLYVFALRRSFTQLSANSFT

SEQ ID NO: 3086202 - protein, 19 aa, Giardia lamblia
DKGYCICDSYWGPSGTVCY

SEQ ID NO: 3086203 - protein, 23 aa, Giardia lamblia
DKITKLQLAINWFTSCVVVKTGK

SEQ ID NO: 3086204 - protein, 29 aa, Giardia lamblia
DKKQLAMLCLPFFSVFVFGVHAVRLSVPL

SEQ ID NO: 3086205 - protein, 17 aa, Giardia lamblia
DKLILIGDVLQLPPLIQ

SEQ ID NO: 3086206 - protein, 20 aa, Giardia lamblia
DKLYPLLRDALEQHNEVNAV

SEQ ID NO: 3086207 - protein, 22 aa, Giardia lamblia
DKNLYMFYGSFKQFSLQEHLVP

SEQ ID NO: 3086208 - protein, 26 aa, Giardia lamblia
DKSIMRAQILATDRARGLLFLCDNLN

SEQ ID NO: 3086209 - protein, 26 aa, Giardia lamblia
DKVCERCDGAYFLYKGGCYGVDNEPG

SEQ ID NO: 3086210 - protein, 28 aa, Giardia lamblia
DKYAYVFTSKYLLAPRLPAYANDLCHCA

SEQ ID NO: 3086211 - protein, 19 aa, Giardia lamblia
DLAALSRILGKTLGISADL

SEQ ID NO: 3086212 - protein, 17 aa, Giardia lamblia
DLAYDEVDFREDFERLV

SEQ ID NO: 3086213 - protein, 20 aa, Giardia lamblia
DLDAIRIFVDKRLGIRKHDS

SEQ ID NO: 3086214 - protein, 25 aa, Giardia lamblia
DLDGDIYWVSWDASLLGTIQREYEP

SEQ ID NO: 3086215 - protein, 21 aa, Giardia lamblia
DLEERYKLLGLLYICIEEDYG

SEQ ID NO: 3086216 - protein, 20 aa, Giardia lamblia
DLELIIVSLTLIVGILSDLS

SEQ ID NO: 3086217 - protein, 20 aa, Giardia lamblia
DLEVFWAPVILILSTIIAKK

SEQ ID NO: 3086218 - protein, 31 aa, Giardia lamblia
DLEVHIYHPIFLPLHYILGYTLGAVSTRNAF

SEQ ID NO: 3086219 - protein, 45 aa, Giardia lamblia
DLFKKQRRLIQQMPISQIWLIAAHLLSALSYLHFSYKHGGEVRCV

SEQ ID NO: 3086220 - protein, 18 aa, Giardia lamblia
DLIIYYNRPFTFDEKPAF

SEQ ID NO: 3086221 - protein, 22 aa, Giardia lamblia
DLILSALTLVLQLLLEIYTRVD

SEQ ID NO: 3086222 - protein, 29 aa, Giardia lamblia
DLKLCQISLLLFLHLFSTIPFTQELADAH

SEQ ID NO: 3086223 - protein, 22 aa, Giardia lamblia
DLLALHQFKQHWLIKAANDFLE

SEQ ID NO: 3086224 - protein, 25 aa, Giardia lamblia
DLLGAILLCLQFLFDVKDEALFFTA

SEQ ID NO: 3086225 - protein, 20 aa, Giardia lamblia
DLLGVTRQLLASRRPVIAPT

SEQ ID NO: 3086226 - protein, 19 aa, Giardia lamblia
DLLIWVVLGLSNDLKLWLP

SEQ ID NO: 3086227 - protein, 18 aa, Giardia lamblia
DLLKRLKIGYSKELLHID

SEQ ID NO: 3086228 - protein, 17 aa, Giardia lamblia
DLLLPDRCNIVDALVSF

SEQ ID NO: 3086229 - protein, 19 aa, Giardia lamblia
DLLQLYINKLSRPSFEKTL

SEQ ID NO: 3086230 - protein, 25 aa, Giardia lamblia
DLLRPDVFTILNRPATRFITIIHAL

SEQ ID NO: 3086231 - protein, 30 aa, Giardia lamblia
DLMAPIDSLPIIFKLLEQVTLTPTQIVTSL

SEQ ID NO: 3086232 - protein, 18 aa, Giardia lamblia
DLMGKFILSRYFPKILNK

SEQ ID NO: 3086233 - protein, 46 aa, Giardia lamblia
DLNEWLHDLVMLQTLRKIPIFANFRLWKPLRLLKKAVLKNRRTRAY

SEQ ID NO: 3086234 - protein, 30 aa, Giardia lamblia
DLNLLYLAIINIYYLMELELYFVRAPDVDL

SEQ ID NO: 3086235 - protein, 20 aa, Giardia lamblia
DLPLTEILAQASMELLEFEI

SEQ ID NO: 3086236 - protein, 27 aa, Giardia lamblia
DLPMCPDYFLVAYLQPIFIPHDSVITG

SEQ ID NO: 3086237 - protein, 25 aa, Giardia lamblia
DLPRDRLLPYLVTGVLCLTKQLGPK

SEQ ID NO: 3086238 - protein, 31 aa, Giardia lamblia
DLQFSYTKLFAFLRRFSFTTPATFKNILSTA

SEQ ID NO: 3086239 - protein, 25 aa, Giardia lamblia
DLQNNAFVLKLWKKTSQASKQSTEN

SEQ ID NO: 3086240 - protein, 18 aa, Giardia lamblia
DLQSLVLFDPSAYDSAVE

SEQ ID NO: 3086241 - protein, 20 aa, Giardia lamblia
DLRWHEFPCFAAEGSQGLSS

SEQ ID NO: 3086242 - protein, 31 aa, Giardia lamblia
DLSCRRMYYANFIDFYLSYCLGRYAIISSLT

SEQ ID NO: 3086243 - protein, 18 aa, Giardia lamblia
DLSFSWLHELNYSKYLSN

SEQ ID NO: 3086244 - protein, 26 aa, Giardia lamblia
DLSLPLTQMILKKNYVTFLTDMVSTM

SEQ ID NO: 3086245 - protein, 26 aa, Giardia lamblia
DLSTPWRRFSFSVKRLLLKLSRSTSA

SEQ ID NO: 3086246 - protein, 21 aa, Giardia lamblia
DLSVTIPLVILIVSAIIFKEK

SEQ ID NO: 3086247 - protein, 24 aa, Giardia lamblia
DLTESFLSLLFDDLDLTATSPINA

SEQ ID NO: 3086248 - protein, 32 aa, Giardia lamblia
DLTGYSLSYTLVFSELIRLLYRMGKEADIAHL

SEQ ID NO: 3086249 - protein, 30 aa, Giardia lamblia
DLTMSRFTNIPLFPDIYMTEQLIPQNDSQA

SEQ ID NO: 3086250 - protein, 23 aa, Giardia lamblia
DLTQLKMILVNDIRFLVSHFSDK

SEQ ID NO: 3086251 - protein, 37 aa, Giardia lamblia
DLTSIEFSLVMQYILSTPSIIEYLVESCGLVKFERVY

SEQ ID NO: 3086252 - protein, 18 aa, Giardia lamblia
DLVAQYLDQAGCLLPGFV

SEQ ID NO: 3086253 - protein, 19 aa, Giardia lamblia
DLVLLYILHQTAVIIMLFI

SEQ ID NO: 3086254 - protein, 21 aa, Giardia lamblia
DMALYLQNFILIFSQTNLANI

SEQ ID NO: 3086255 - protein, 18 aa, Giardia lamblia
DMFFKICDTLLTLTQQKL

SEQ ID NO: 3086256 - protein, 18 aa, Giardia lamblia
DMLIAVSGECTSPACMDE

SEQ ID NO: 3086257 - protein, 18 aa, Giardia lamblia
DMLLPLDIPVMSIATESN

SEQ ID NO: 3086258 - protein, 17 aa, Giardia lamblia
DMLLQRQLDLTVDLSQL

SEQ ID NO: 3086259 - protein, 25 aa, Giardia lamblia
DMLMSYNYLIPRYFHVFNMAINDDP

SEQ ID NO: 3086260 - protein, 22 aa, Giardia lamblia
DMQSFLSVTFLYTDISTSLQQQ

SEQ ID NO: 3086261 - protein, 29 aa, Giardia lamblia
DMREYEFLLLLLMIRTAMALALGIKPEAL

SEQ ID NO: 3086262 - protein, 18 aa, Giardia lamblia
DMSFFMKRLLKISCDELS

SEQ ID NO: 3086263 - protein, 38 aa, Giardia lamblia
DMSSRDWCLCWILTGSLRLLQKNFWGATLAFMNARMVN

SEQ ID NO: 3086264 - protein, 20 aa, Giardia lamblia
DMTPNIIVLLTCLGIVFTHL

SEQ ID NO: 3086265 - protein, 20 aa, Giardia lamblia
DMVLAFLMRYAKESLKFAER

SEQ ID NO: 3086266 - protein, 29 aa, Giardia lamblia
DMWAQHLMYFEYLLLVYYGLFPTSDHSNL

SEQ ID NO: 3086267 - protein, 23 aa, Giardia lamblia
DMWNLGAIVYELTTLRRPDFLGG

SEQ ID NO: 3086268 - protein, 18 aa, Giardia lamblia
DMWSLGVIIYELVTLRRP

SEQ ID NO: 3086269 - protein, 26 aa, Giardia lamblia
DNCGKGYILFQGGCYRVDTELGLKAC

SEQ ID NO: 3086270 - protein, 25 aa, Giardia lamblia
DNDGQYALRYLWLNGTSAVQALIDI

SEQ ID NO: 3086271 - protein, 32 aa, Giardia lamblia
DNFITANRFFKNAAPIYPLVPGTYGLSPADVT

SEQ ID NO: 3086272 - protein, 26 aa, Giardia lamblia
DNHGWSALHWAVFYGCANIVQYLAPL

SEQ ID NO: 3086273 - protein, 27 aa, Giardia lamblia
DNISVIVVLFRWKGITPNTIGGWRAYN

SEQ ID NO: 3086274 - protein, 23 aa, Giardia lamblia
DNIYLLESFGLYHTGHMPSNLRM

SEQ ID NO: 3086275 - protein, 21 aa, Giardia lamblia
DNLFKLINHLVRARSYYNDAM

SEQ ID NO: 3086276 - protein, 29 aa, Giardia lamblia
DNLPPFRSMYCRWQYFYDQRLREIAKRYT

SEQ ID NO: 3086277 - protein, 26 aa, Giardia lamblia
DNLSVIINLFLPIYAAVFNALHVLHV

SEQ ID NO: 3086278 - protein, 29 aa, Giardia lamblia
DNLVKTIFSFNIMLAFFIAGCSSALAIAI

SEQ ID NO: 3086279 - protein, 25 aa, Giardia lamblia
DNNILSFFYKQLGSYPVLFSSRASG

SEQ ID NO: 3086280 - protein, 33 aa, Giardia lamblia
DNNPSNVFPFYLPTRPYPTLSIYTLDPLVKLTG

SEQ ID NO: 3086281 - protein, 19 aa, Giardia lamblia
DNPFKYKKLLDYGYDYHGI

SEQ ID NO: 3086282 - protein, 31 aa, Giardia lamblia
DNRLSRLFFLPLAHLSKLIPYPTDLSLLFAM

SEQ ID NO: 3086283 - protein, 28 aa, Giardia lamblia
DNSLNRFFDVYAFFAGLLSKGSLSGCAS

SEQ ID NO: 3086284 - protein, 24 aa, Giardia lamblia
DNTVWLWENAWKSFINAQLTLLQS

SEQ ID NO: 3086285 - protein, 20 aa, Giardia lamblia
DPAALSLFLSRICINEYDNN

SEQ ID NO: 3086286 - protein, 41 aa, Giardia lamblia
DPACLYGDHLGMFFALCSYHIWFRMLLDPLFRRSTLIMSVD

SEQ ID NO: 3086287 - protein, 23 aa, Giardia lamblia
DPALPQSLDLVWRDAICGSCIDP

SEQ ID NO: 3086288 - protein, 22 aa, Giardia lamblia
DPAVIYWHKALLDGMTLRTVDL

SEQ ID NO: 3086289 - protein, 28 aa, Giardia lamblia
DPEKLPSSHILLLLGRDGWPGPRSILLK

SEQ ID NO: 3086290 - protein, 21 aa, Giardia lamblia
DPEMLSRWEKQMRHNHLALQR

SEQ ID NO: 3086291 - protein, 25 aa, Giardia lamblia
DPENGALHVLKLLRRMGVADVSDFL

SEQ ID NO: 3086292 - protein, 22 aa, Giardia lamblia
DPFVRNFMPLQYLVNVATELRV

SEQ ID NO: 3086293 - protein, 25 aa, Giardia lamblia
DPGNLYLLHEGWIQGLSLLLKHHDQ

SEQ ID NO: 3086294 - protein, 19 aa, Giardia lamblia
DPGWWSDFWRQIPVIDKDA

SEQ ID NO: 3086295 - protein, 22 aa, Giardia lamblia
DPHSIPLPSFWDIVCFLKAMTS

SEQ ID NO: 3086296 - protein, 18 aa, Giardia lamblia
DPIFPTRLQILKHASIYA

SEQ ID NO: 3086297 - protein, 29 aa, Giardia lamblia
DPIHTILHLMLLVFLPLVPLDSYHYRRLL

SEQ ID NO: 3086298 - protein, 20 aa, Giardia lamblia
DPINKTGQTALLIVTLCNLV

SEQ ID NO: 3086299 - protein, 33 aa, Giardia lamblia
DPKAPLHYMGIPIFLLAQLKLPFVDNFMIRLTR

SEQ ID NO: 3086300 - protein, 35 aa, Giardia lamblia
DPKDRLPFEIPLGPVHFFQKGLLPILKLANIPRTL

SEQ ID NO: 3086301 - protein, 25 aa, Giardia lamblia
DPLDDKLYELLAILHYDALDYHNGI

SEQ ID NO: 3086302 - protein, 17 aa, Giardia lamblia
DPLFDLLVDRVDTTTFL

SEQ ID NO: 3086303 - protein, 17 aa, Giardia lamblia
DPLLYSENIFITHFLLP

SEQ ID NO: 3086304 - protein, 26 aa, Giardia lamblia
DPMDCYVAIFYLCKIAYSIRKSFLWE

SEQ ID NO: 3086305 - protein, 23 aa, Giardia lamblia
DPNFVRDLGVLDLKVFDCYHEIA

SEQ ID NO: 3086306 - protein, 31 aa, Giardia lamblia
DPNNYDYVALFFSLFELLISHSIDPSTKTYS

SEQ ID NO: 3086307 - protein, 27 aa, Giardia lamblia
DPPIPKWIMFLPFNSIAFSLGDALFIQ

SEQ ID NO: 3086308 - protein, 27 aa, Giardia lamblia
DPPLQISCYLALGSFSYLLLKHARDQT

SEQ ID NO: 3086309 - protein, 26 aa, Giardia lamblia
DPPVPTNWLVVIGSLLLIGLTITAWV

SEQ ID NO: 3086310 - protein, 26 aa, Giardia lamblia
DPQQTPFPLILSFLTANPSLYAFFER

SEQ ID NO: 3086311 - protein, 25 aa, Giardia lamblia
DPTIFLPVIAPYLPAILKGALDESI

SEQ ID NO: 3086312 - protein, 29 aa, Giardia lamblia
DPTRGMLVRLLQGYAIFSVVWSCLGLFGK

SEQ ID NO: 3086313 - protein, 23 aa, Giardia lamblia
DPVAKIYHMGFMYPLSANEPMEH

SEQ ID NO: 3086314 - protein, 33 aa, Giardia lamblia
DPVLTYLFDPNIFSHVYLYQPPPDFDSLPADEV

SEQ ID NO: 3086315 - protein, 28 aa, Giardia lamblia
DPVSKRLLWNIILRIRSHRAILLTTHAM

SEQ ID NO: 3086316 - protein, 27 aa, Giardia lamblia
DPYLQMQPRKLVSELAYLLIISQCLPC

SEQ ID NO: 3086317 - protein, 20 aa, Giardia lamblia
DQALRHLRWKEAFALMVARS

SEQ ID NO: 3086318 - protein, 27 aa, Giardia lamblia
DQCTKCKPGFFMKQPGSAGKCFACDSK

SEQ ID NO: 3086319 - protein, 36 aa, Giardia lamblia
DQHSVLWSMSYYTAKVLLAYFCAFGTDTLELITAIA

SEQ ID NO: 3086320 - protein, 25 aa, Giardia lamblia
DQIKAKYRICFLPSPAVNVEHTSEH

SEQ ID NO: 3086321 - protein, 23 aa, Giardia lamblia
DQKVPLIEILLHTGNLASYDLNN

SEQ ID NO: 3086322 - protein, 21 aa, Giardia lamblia
DQLSTIVFSPNLTIITGHNGA

SEQ ID NO: 3086323 - protein, 24 aa, Giardia lamblia
DQLTMVLISLFKQVFEPLKMWLSP

SEQ ID NO: 3086324 - protein, 18 aa, Giardia lamblia
DQREPPVYPLLYASHDVC

SEQ ID NO: 3086325 - protein, 19 aa, Giardia lamblia
DQSEKLILSLRKKNYDPIN

SEQ ID NO: 3086326 - protein, 29 aa, Giardia lamblia
DQSTIDVILRFLRINALLSISFQIESTEC

SEQ ID NO: 3086327 - protein, 25 aa, Giardia lamblia
DQTGSLIYYLSIPSGSLVAGMPSIG

SEQ ID NO: 3086328 - protein, 32 aa, Giardia lamblia
DQWHTLIAITLARLFLTGPHRTIFAAIKEMQC

SEQ ID NO: 3086329 - protein, 23 aa, Giardia lamblia
DRASFLSMVIPFTGAPSRSVYRT

SEQ ID NO: 3086330 - protein, 17 aa, Giardia lamblia
DRCIELIDILKVETAWS

SEQ ID NO: 3086331 - protein, 24 aa, Giardia lamblia
DRERKTFVLLASRPTAIQQYKIDC

SEQ ID NO: 3086332 - protein, 44 aa, Giardia lamblia
DRFISLTWSCFIYDSVLLLLLGVLFIIIIPWFSQIFSTSELYTM

SEQ ID NO: 3086333 - protein, 31 aa, Giardia lamblia
DRGYYSVECITLLVLLKIKYRNRVTMLRGNH

SEQ ID NO: 3086334 - protein, 20 aa, Giardia lamblia
DRIIAILPVLGYGSHLYALS

SEQ ID NO: 3086335 - protein, 22 aa, Giardia lamblia
DRKIIIWNGIAHTPVSILPTEN

SEQ ID NO: 3086336 - protein, 24 aa, Giardia lamblia
DRLKFVHKLFESLVIILNVISDRA

SEQ ID NO: 3086337 - protein, 21 aa, Giardia lamblia
DRNKCVCYPGFVSIDGKCYSK

SEQ ID NO: 3086338 - protein, 25 aa, Giardia lamblia
DRPQAYLLLVPSTFQSSQFSANIYL

SEQ ID NO: 3086339 - protein, 24 aa, Giardia lamblia
DRRHQVMHIILPKLSPVAPQIVEN

SEQ ID NO: 3086340 - protein, 33 aa, Giardia lamblia
DRRLQSFSNFIYLSVEYLLYLRQLCIGLANEVT

SEQ ID NO: 3086341 - protein, 50 aa, Giardia lamblia
DRRMLSIFAIYLISAQIPRLVPLLPFNYSFIVVLVLEACQRPALFKDLVL

SEQ ID NO: 3086342 - protein, 25 aa, Giardia lamblia
DRRSSIFLLFVDRSPKNPKVTCLTP

SEQ ID NO: 3086343 - protein, 25 aa, Giardia lamblia
DRRTRSLLFLDKYSFEVPTARYICK

SEQ ID NO: 3086344 - protein, 27 aa, Giardia lamblia
DRSISPWFALIPFFGPISVHSQLQSLA

SEQ ID NO: 3086345 - protein, 29 aa, Giardia lamblia
DRSSDLYFRVFFSGIFGLKYLKPINRGDL

SEQ ID NO: 3086346 - protein, 19 aa, Giardia lamblia
DRSTRMIQAWLRGCRARRL

SEQ ID NO: 3086347 - protein, 23 aa, Giardia lamblia
DRTGWTALMWATQGNYATCVKEI

SEQ ID NO: 3086348 - protein, 18 aa, Giardia lamblia
DRTILVEHLFLYDNTDAM

SEQ ID NO: 3086349 - protein, 18 aa, Giardia lamblia
DRTTVLCGGEGRGTCVAN

SEQ ID NO: 3086350 - protein, 31 aa, Giardia lamblia
DSAEIILTLSLDLSLRRLVATSVAWTYSLDY

SEQ ID NO: 3086351 - protein, 28 aa, Giardia lamblia
DSAFTIHFDPMFDPLAQASLEATTEAIK

SEQ ID NO: 3086352 - protein, 26 aa, Giardia lamblia
DSAGHKLCAAALWKASNTYPGTSLRL

SEQ ID NO: 3086353 - protein, 17 aa, Giardia lamblia
DSAIYKAFVAIVERFYP

SEQ ID NO: 3086354 - protein, 24 aa, Giardia lamblia
DSAKCLLFSLQYTGSNIGLLPSDI

SEQ ID NO: 3086355 - protein, 24 aa, Giardia lamblia
DSALPFIFLIINVLTLPLYILRSF

SEQ ID NO: 3086356 - protein, 22 aa, Giardia lamblia
DSDFAVARWLIDGYAYSIHGDW

SEQ ID NO: 3086357 - protein, 24 aa, Giardia lamblia
DSDGWTALIIAALMNNISIVEILR

SEQ ID NO: 3086358 - protein, 26 aa, Giardia lamblia
DSEALLEFNVVPLQLAVLLNSQAHAC

SEQ ID NO: 3086359 - protein, 26 aa, Giardia lamblia
DSEIALLRWYILKVCIKFGDLSNPCR

SEQ ID NO: 3086360 - protein, 29 aa, Giardia lamblia
DSELTALYNAFPLLFNFTCANSICYSVQS

SEQ ID NO: 3086361 - protein, 19 aa, Giardia lamblia
DSFIVQRNLLPLLASKFDI

SEQ ID NO: 3086362 - protein, 17 aa, Giardia lamblia
DSGALLAYYPQANTLSL

SEQ ID NO: 3086363 - protein, 29 aa, Giardia lamblia
DSHVYRTPYLYLLPQFPDLSASIEATCSS

SEQ ID NO: 3086364 - protein, 23 aa, Giardia lamblia
DSIISYIYRCYVFDAIPAYKGPA

SEQ ID NO: 3086365 - protein, 18 aa, Giardia lamblia
DSILKLFNICLRSSLTST

SEQ ID NO: 3086366 - protein, 29 aa, Giardia lamblia
DSIQNYALLYQAILVSSLRELFELDYLDF

SEQ ID NO: 3086367 - protein, 29 aa, Giardia lamblia
DSIVLERPFPSFSYTSTASIPFLCGTGYH

SEQ ID NO: 3086368 - protein, 20 aa, Giardia lamblia
DSLADFFVLLQELSAYGKTI

SEQ ID NO: 3086369 - protein, 30 aa, Giardia lamblia
DSLAFICSFAAPRLLLKPSLVIAKPKTLAA

SEQ ID NO: 3086370 - protein, 19 aa, Giardia lamblia
DSLIKFMELMLTVLPTERP

SEQ ID NO: 3086371 - protein, 24 aa, Giardia lamblia
DSLKQFLGAFYDAAIRRLAYYCSM

SEQ ID NO: 3086372 - protein, 17 aa, Giardia lamblia
DSLLERIGIRPKLITGL

SEQ ID NO: 3086373 - protein, 27 aa, Giardia lamblia
DSLPNIYAYMHLYLKKEIYLEDQNKYY

SEQ ID NO: 3086374 - protein, 23 aa, Giardia lamblia
DSLRELFFCALDSSNYLYIIIKE

SEQ ID NO: 3086375 - protein, 17 aa, Giardia lamblia
DSLTLQRYLTNRRLSRE

SEQ ID NO: 3086376 - protein, 17 aa, Giardia lamblia
DSMTCTILLLGLASSLG

SEQ ID NO: 3086377 - protein, 23 aa, Giardia lamblia
DSNAIQFSLLALKGILLNTQKAN

SEQ ID NO: 3086378 - protein, 24 aa, Giardia lamblia
DSNDSTYKFCIPDEYHPTSCASCT

SEQ ID NO: 3086379 - protein, 21 aa, Giardia lamblia
DSNMILDYYSSLSFPSFHLHC

SEQ ID NO: 3086380 - protein, 24 aa, Giardia lamblia
DSPACLFLLYSILSDEIDSFVASF

SEQ ID NO: 3086381 - protein, 24 aa, Giardia lamblia
DSPQECILLAHQLIAIGLPEVICV

SEQ ID NO: 3086382 - protein, 23 aa, Giardia lamblia
DSQSFFAIFSLSNALKPELIIDT

SEQ ID NO: 3086383 - protein, 23 aa, Giardia lamblia
DSRPYIFECIKASRFWEVLITVT

SEQ ID NO: 3086384 - protein, 27 aa, Giardia lamblia
DSRRGLVDLLLKFIFVFAISSTDDKLC

SEQ ID NO: 3086385 - protein, 32 aa, Giardia lamblia
DSSELYRISLYFLRKLLVVALPMPGLFEVINS

SEQ ID NO: 3086386 - protein, 30 aa, Giardia lamblia
DSSIYYTHTLFLCSILAILISLFSPLAPQL

SEQ ID NO: 3086387 - protein, 42 aa, Giardia lamblia
DSSLIACYLAFYYTKAIIAKLLINLVFLLRCDKSNLLTYTDR

SEQ ID NO: 3086388 - protein, 25 aa, Giardia lamblia
DSSSTIPIIFLLTVGADPLSQLQAL

SEQ ID NO: 3086389 - protein, 27 aa, Giardia lamblia
DSVEFYYEFLRFIGMASILMLDGGMKQ

SEQ ID NO: 3086390 - protein, 22 aa, Giardia lamblia
DSVLACFIILFIYICGRDPPDD

SEQ ID NO: 3086391 - protein, 24 aa, Giardia lamblia
DSVLFTTSPPFPWSSKMKTRSFHS

SEQ ID NO: 3086392 - protein, 24 aa, Giardia lamblia
DSVSSFMCLWPATIALSSDSVPLM

SEQ ID NO: 3086393 - protein, 23 aa, Giardia lamblia
DSYHLLNLLLTRRYLDDQRRNLW

SEQ ID NO: 3086394 - protein, 17 aa, Giardia lamblia
DSYLSVEFLADALCIQL

SEQ ID NO: 3086395 - protein, 26 aa, Giardia lamblia
DSYTLGALLRRLWSLFFDSLGSLTNE

SEQ ID NO: 3086396 - protein, 21 aa, Giardia lamblia
DSYYKFCVIWAIILMGELCVA

SEQ ID NO: 3086397 - protein, 23 aa, Giardia lamblia
DTADWPYTFIFTGHSLGAGVAAL

SEQ ID NO: 3086398 - protein, 20 aa, Giardia lamblia
DTAFLFYGSCYAIDKVPGNL

SEQ ID NO: 3086399 - protein, 21 aa, Giardia lamblia
DTAFLFYGSCYAIDKVPGNLV

SEQ ID NO: 3086400 - protein, 17 aa, Giardia lamblia
DTAPIDDACIPFGRHTC

SEQ ID NO: 3086401 - protein, 27 aa, Giardia lamblia
DTDTIVWNLLLLIFGGGNIYKPCIPVV

SEQ ID NO: 3086402 - protein, 22 aa, Giardia lamblia
DTERLVHCDLRPANVLISADGE

SEQ ID NO: 3086403 - protein, 25 aa, Giardia lamblia
DTERVSDPLLWIMTKCLIISGHDYA

SEQ ID NO: 3086404 - protein, 24 aa, Giardia lamblia
DTGRAFLIDLLLNQRRYLDISSIL

SEQ ID NO: 3086405 - protein, 24 aa, Giardia lamblia
DTGSSQLRLLYSGTYRNGRRRGQG

SEQ ID NO: 3086406 - protein, 26 aa, Giardia lamblia
DTGVKLLQLYLLDRSTLQLPKNTHIT

SEQ ID NO: 3086407 - protein, 27 aa, Giardia lamblia
DTHHMLQFIALLGNFKLVNSLDFMGFI

SEQ ID NO: 3086408 - protein, 29 aa, Giardia lamblia
DTIILLTVPMLISLLNLFQNPYFHEYVLR

SEQ ID NO: 3086409 - protein, 30 aa, Giardia lamblia
DTILVCVMLIAFRVSKFRRLWHLGREIQVC

SEQ ID NO: 3086410 - protein, 24 aa, Giardia lamblia
DTIPQYLYPCYRYTSNYLEPVSRQ

SEQ ID NO: 3086411 - protein, 18 aa, Giardia lamblia
DTIYPFINICLRVPSENA

SEQ ID NO: 3086412 - protein, 25 aa, Giardia lamblia
DTKRIVFRYLSLETILINPVTHAIK

SEQ ID NO: 3086413 - protein, 18 aa, Giardia lamblia
DTKRTETCLYHNGAYSCQ

SEQ ID NO: 3086414 - protein, 19 aa, Giardia lamblia
DTLAAFIRNPLFAGISALY

SEQ ID NO: 3086415 - protein, 17 aa, Giardia lamblia
DTLIIRNLVKRYKDFKA

SEQ ID NO: 3086416 - protein, 17 aa, Giardia lamblia
DTLLYLHQMMSRVAYAL

SEQ ID NO: 3086417 - protein, 27 aa, Giardia lamblia
DTLNDFTSLLPLPKPTYSRQPYDITSD

SEQ ID NO: 3086418 - protein, 23 aa, Giardia lamblia
DTLQPICFLRPELSRCQSTVRDA

SEQ ID NO: 3086419 - protein, 22 aa, Giardia lamblia
DTLYLAAHHLRFSRRGDLSPDF

SEQ ID NO: 3086420 - protein, 30 aa, Giardia lamblia
DTMRISNFMLLLIFVMTMPLMFVCYLVYMA

SEQ ID NO: 3086421 - protein, 30 aa, Giardia lamblia
DTNHIVIRAYLLYLLILTSGSKEDALFYIA

SEQ ID NO: 3086422 - protein, 25 aa, Giardia lamblia
DTNILIMQSPIYTPFLLLSDASETQ

SEQ ID NO: 3086423 - protein, 26 aa, Giardia lamblia
DTNKCIQCHAGYFFNAKTFTCTACKA

SEQ ID NO: 3086424 - protein, 23 aa, Giardia lamblia
DTNYYPIFIAENGLHFVVTGLEY

SEQ ID NO: 3086425 - protein, 24 aa, Giardia lamblia
DTPCPPLLSPPFPATTPQYTDILV

SEQ ID NO: 3086426 - protein, 25 aa, Giardia lamblia
DTPKRIHHLILDLIEYEFTLESNLY

SEQ ID NO: 3086427 - protein, 24 aa, Giardia lamblia
DTPLQHFIIHWSSTMQVALKSNTT

SEQ ID NO: 3086428 - protein, 25 aa, Giardia lamblia
DTQNQYLVRTGSCKAILITTQNEEP

SEQ ID NO: 3086429 - protein, 26 aa, Giardia lamblia
DTRDYNKFRFLPEYFKKFTSSEKATV

SEQ ID NO: 3086430 - protein, 19 aa, Giardia lamblia
DTRGLLAGLLFGYIERLPT

SEQ ID NO: 3086431 - protein, 21 aa, Giardia lamblia
DTRNAYLKLFYLEEAANADVK

SEQ ID NO: 3086432 - protein, 32 aa, Giardia lamblia
DTSMVYVTVFIIIAVFVLLAIVHLGFGLKRIR

SEQ ID NO: 3086433 - protein, 26 aa, Giardia lamblia
DTSPNSVIFPLLDLSGALPGCNNLHV

SEQ ID NO: 3086434 - protein, 21 aa, Giardia lamblia
DTSRIALLGYGLDASANLVTD

SEQ ID NO: 3086435 - protein, 24 aa, Giardia lamblia
DTTAYVLDALLRLPTRPAEFTTAQ

SEQ ID NO: 3086436 - protein, 25 aa, Giardia lamblia
DTTGYPYLRNLPTLSNPSKEGFVDN

SEQ ID NO: 3086437 - protein, 23 aa, Giardia lamblia
DTTILLPLYGNDFDPERARALLA

SEQ ID NO: 3086438 - protein, 25 aa, Giardia lamblia
DTTIMPQHILSTHPLLAIPRWHFHI

SEQ ID NO: 3086439 - protein, 22 aa, Giardia lamblia
DTTIPFFVKIADHVGLYRDDLM

SEQ ID NO: 3086440 - protein, 24 aa, Giardia lamblia
DTTLALIFFNFCGLSIILADELGD

SEQ ID NO: 3086441 - protein, 28 aa, Giardia lamblia
DTTLLDSLIFFLLYVTAYNVLPDFNYLL

SEQ ID NO: 3086442 - protein, 25 aa, Giardia lamblia
DTWGNSDPVFYMLLACDANNDVSQN

SEQ ID NO: 3086443 - protein, 24 aa, Giardia lamblia
DTWYQSLFCLSLSPKTKPKKTSFS

SEQ ID NO: 3086444 - protein, 24 aa, Giardia lamblia
DTYFEDFYYGLISNLNYKNLFDVA

SEQ ID NO: 3086445 - protein, 28 aa, Giardia lamblia
DTYPMATKILKIRYVPLSKPSIYTLSGG

SEQ ID NO: 3086446 - protein, 23 aa, Giardia lamblia
DTYSDLCFFTFSAIDAIVQEIQD

SEQ ID NO: 3086447 - protein, 46 aa, Giardia lamblia
DVARTAIQPYVPIVVGVLVLSVLAGLIGFLSWRFCCKNKKPKHPLD

SEQ ID NO: 3086448 - protein, 18 aa, Giardia lamblia
DVCLTLLIIDLYPTDRSS

SEQ ID NO: 3086449 - protein, 22 aa, Giardia lamblia
DVFIYTCSILKRISRRSPSLLT

SEQ ID NO: 3086450 - protein, 32 aa, Giardia lamblia
DVGLRNYGYFVCSMLGILIYCGWVLTHAVVCF

SEQ ID NO: 3086451 - protein, 33 aa, Giardia lamblia
DVHGGNKFLARLRALILIFNHIDITRVNKLSWA

SEQ ID NO: 3086452 - protein, 26 aa, Giardia lamblia
DVHNAIDRLLLFLRASQDGFSIVGLP

SEQ ID NO: 3086453 - protein, 22 aa, Giardia lamblia
DVIGLRLIFLARAGFLTSEHLQ

SEQ ID NO: 3086454 - protein, 22 aa, Giardia lamblia
DVISIVLLLRVSAVCFGCMFTW

SEQ ID NO: 3086455 - protein, 22 aa, Giardia lamblia
DVKDEALFFTAIETGFIATFHG

SEQ ID NO: 3086456 - protein, 22 aa, Giardia lamblia
DVKLMLISNFAFYPAWEAFIIN

SEQ ID NO: 3086457 - protein, 20 aa, Giardia lamblia
DVKRMPTFVLCNCAYTPQLS

SEQ ID NO: 3086458 - protein, 30 aa, Giardia lamblia
DVKVNYLYISLIYRRLLQLAQLTGPPEIVL

SEQ ID NO: 3086459 - protein, 34 aa, Giardia lamblia
DVLALLRPHITESVPFILPPQRLKDLLVEKSLPL

SEQ ID NO: 3086460 - protein, 31 aa, Giardia lamblia
DVLFSLFTEPLITVPLLARTMQNLLSRAMLA

SEQ ID NO: 3086461 - protein, 21 aa, Giardia lamblia
DVLKCLRALMRYLGTYAFEVV

SEQ ID NO: 3086462 - protein, 19 aa, Giardia lamblia
DVLSIIAMLGYGLKSTLEI

SEQ ID NO: 3086463 - protein, 18 aa, Giardia lamblia
DVMNLEFQPLLRSPAKSI

SEQ ID NO: 3086464 - protein, 36 aa, Giardia lamblia
DVNDYEYVKLLFPRPFDYIFNLFVTFDCDFESSDLI

SEQ ID NO: 3086465 - protein, 19 aa, Giardia lamblia
DVPAYYQTSLFVLIQIVTA

SEQ ID NO: 3086466 - protein, 25 aa, Giardia lamblia
DVPKDRFILIDKTYQYPINRYMIDR

SEQ ID NO: 3086467 - protein, 27 aa, Giardia lamblia
DVPLPVFKVILFPQLSFLRDALSVHCD

SEQ ID NO: 3086468 - protein, 19 aa, Giardia lamblia
DVPSPPPLSIERVREMLLA

SEQ ID NO: 3086469 - protein, 23 aa, Giardia lamblia
DVQDYISLYAKYPKLRRKLRKCG

SEQ ID NO: 3086470 - protein, 35 aa, Giardia lamblia
DVSFYRYLFDLMTNWILIVDVWFLPPTSIQDGETP

SEQ ID NO: 3086471 - protein, 30 aa, Giardia lamblia
DVSSRIYPCYFPIRFIRGPPALTPQLLPSA

SEQ ID NO: 3086472 - protein, 23 aa, Giardia lamblia
DVTIQFPVYALLERFYSSIIVPE

SEQ ID NO: 3086473 - protein, 31 aa, Giardia lamblia
DVTLRNRLSYFLLMLFILSLLDTDTIVHSMQ

SEQ ID NO: 3086474 - protein, 23 aa, Giardia lamblia
DVTSFVDTALYPAINMISDRPST

SEQ ID NO: 3086475 - protein, 22 aa, Giardia lamblia
DVYPWIDPVSFLVFNIMAAATI

SEQ ID NO: 3086476 - protein, 28 aa, Giardia lamblia
DVYRSVSLLQFLWHTAHAFLKKELQLDC

SEQ ID NO: 3086477 - protein, 21 aa, Giardia lamblia
DWDDLLQYIPPAARKYYDPDI

SEQ ID NO: 3086478 - protein, 19 aa, Giardia lamblia
DWFQAWPHEALVSVGKRFL

SEQ ID NO: 3086479 - protein, 26 aa, Giardia lamblia
DWKNRTSLQRLCIIRALRPDRLMTAM

SEQ ID NO: 3086480 - protein, 19 aa, Giardia lamblia
DWPLFHHTFMVASVGVYRF

SEQ ID NO: 3086481 - protein, 23 aa, Giardia lamblia
DWSPLMLWVLRGNRGDVAPDDAV

SEQ ID NO: 3086482 - protein, 17 aa, Giardia lamblia
DYAMFLLTKGTETAPIL

SEQ ID NO: 3086483 - protein, 18 aa, Giardia lamblia
DYCIPQSNLMYQCTVGRD

SEQ ID NO: 3086484 - protein, 28 aa, Giardia lamblia
DYDADQLNFYLSLRDLLMLSAGAQDKDK

SEQ ID NO: 3086485 - protein, 21 aa, Giardia lamblia
DYDFLVLVDMILRYCLPTSSY

SEQ ID NO: 3086486 - protein, 17 aa, Giardia lamblia
DYFLMGGGCYQINKYPG

SEQ ID NO: 3086487 - protein, 19 aa, Giardia lamblia
DYIFVFICGIPITALNFTL

SEQ ID NO: 3086488 - protein, 17 aa, Giardia lamblia
DYIISFVATARLLVELL

SEQ ID NO: 3086489 - protein, 24 aa, Giardia lamblia
DYLLHGIAYLFGIYCTITKKKRLI

SEQ ID NO: 3086490 - protein, 19 aa, Giardia lamblia
DYNPFWPQDIGCRMTTHKS

SEQ ID NO: 3086491 - protein, 25 aa, Giardia lamblia
DYNSYFYNMLPYSWRKKHLIQYEQA

SEQ ID NO: 3086492 - protein, 20 aa, Giardia lamblia
DYQMGLAMRKLFSTKRCGFI

SEQ ID NO: 3086493 - protein, 27 aa, Giardia lamblia
DYSTQILLVEILLRIRNRIPDVSAIAF

SEQ ID NO: 3086494 - protein, 24 aa, Giardia lamblia
DYYTALMISIYRNQTDIARILIPY

SEQ ID NO: 3086495 - protein, 26 aa, Giardia lamblia
EAAERYILVTGIRRTLLPTLSHHDIP

SEQ ID NO: 3086496 - protein, 20 aa, Giardia lamblia
EAAHKLLLFDAHASNSLLLQ

SEQ ID NO: 3086497 - protein, 23 aa, Giardia lamblia
EAAVWKGLFSSNLNKRARLELST

SEQ ID NO: 3086498 - protein, 22 aa, Giardia lamblia
EACRPALWHVVRDTLLCEDMNL

SEQ ID NO: 3086499 - protein, 28 aa, Giardia lamblia
EADAHLWVLIVILFYSLIKVFETTQAQF

SEQ ID NO: 3086500 - protein, 26 aa, Giardia lamblia
EADVLVILIQVLQALAFLHGVREATS

SEQ ID NO: 3086501 - protein, 25 aa, Giardia lamblia
EAEFIKLFFREAFSMIFISAMDNVQ

SEQ ID NO: 3086502 - protein, 22 aa, Giardia lamblia
EAFKRMYPFLIPFSYSDNGRAD

SEQ ID NO: 3086503 - protein, 27 aa, Giardia lamblia
EAFWRQYSVFIVIGAIVVLFILLKIFF

SEQ ID NO: 3086504 - protein, 22 aa, Giardia lamblia
EAFYRVADFMAFLIVRSSSTFL

SEQ ID NO: 3086505 - protein, 27 aa, Giardia lamblia
EAGGIMMKLWHKFGLNLSYLSPASDKV

SEQ ID NO: 3086506 - protein, 28 aa, Giardia lamblia
EAGNGAALLLLLTGKLEGSYILSPQRGA

SEQ ID NO: 3086507 - protein, 31 aa, Giardia lamblia
EAGVLPRRLVYSKYDIILSSFNKLILSIISS

SEQ ID NO: 3086508 - protein, 19 aa, Giardia lamblia
EAGYLLLGAQCWHPSCPIE

SEQ ID NO: 3086509 - protein, 24 aa, Giardia lamblia
EAHLKLLAIYIAVELKILLCDKSQ

SEQ ID NO: 3086510 - protein, 27 aa, Giardia lamblia
EAHSFRLKLMLFVETLYDVFKRLSPEL

SEQ ID NO: 3086511 - protein, 21 aa, Giardia lamblia
EAHVLNFLLALGLDTLITEAN

SEQ ID NO: 3086512 - protein, 23 aa, Giardia lamblia
EAHYPVLFKEILPMYINAASLQV

SEQ ID NO: 3086513 - protein, 24 aa, Giardia lamblia
EAIHLNLPIIRISQFLLRKNKIVG

SEQ ID NO: 3086514 - protein, 17 aa, Giardia lamblia
EALIDRVIFFLDEVIVY

SEQ ID NO: 3086515 - protein, 18 aa, Giardia lamblia
EALKGYIWTELCSYLKGS

SEQ ID NO: 3086516 - protein, 17 aa, Giardia lamblia
EALKSYDALLCSTPIAL

SEQ ID NO: 3086517 - protein, 18 aa, Giardia lamblia
EALQFLKTWLLHSHSDTP

SEQ ID NO: 3086518 - protein, 28 aa, Giardia lamblia
EALSPFLTYPLTYLTKLEYQHLWEYKDL

SEQ ID NO: 3086519 - protein, 22 aa, Giardia lamblia
EANHSWLLRAFSTRLEFRQFAA

SEQ ID NO: 3086520 - protein, 24 aa, Giardia lamblia
EAQAPKLPLLFPSGCHKAKHIWGA

SEQ ID NO: 3086521 - protein, 26 aa, Giardia lamblia
EARLINVFPPELSAGIWHLIHILFST

SEQ ID NO: 3086522 - protein, 25 aa, Giardia lamblia
EARVFIFLIHFNLVNQLLRSLEPFS

SEQ ID NO: 3086523 - protein, 32 aa, Giardia lamblia
EASLIYDILTLLFYNVIFPSPVHPVLLRRCIM

SEQ ID NO: 3086524 - protein, 23 aa, Giardia lamblia
EASNWGILVLGITGGLCSSNGID

SEQ ID NO: 3086525 - protein, 29 aa, Giardia lamblia
EASPYRLKLPFYTLGPEASALFPSRGTLP

SEQ ID NO: 3086526 - protein, 25 aa, Giardia lamblia
EASRRLFEFFRKYPGFTDFGERIYP

SEQ ID NO: 3086527 - protein, 34 aa, Giardia lamblia
EATILKPYLCLALALLFFFDFNTFNVLKNPSTAT

SEQ ID NO: 3086528 - protein, 18 aa, Giardia lamblia
EATKKLLSELLPTSIQDI

SEQ ID NO: 3086529 - protein, 24 aa, Giardia lamblia
EAVAVWMRTAPLSTFDKLYGRFTA

SEQ ID NO: 3086530 - protein, 20 aa, Giardia lamblia
EAVLLCIRVSLTSALSLTDV

SEQ ID NO: 3086531 - protein, 25 aa, Giardia lamblia
EAVLLPLCLLVTSFVKLNQLYKAAP

SEQ ID NO: 3086532 - protein, 27 aa, Giardia lamblia
EAVSLDVLLELFYSTGLLGLSGRAYYC

SEQ ID NO: 3086533 - protein, 17 aa, Giardia lamblia
EAYKVIFPPITLVVQMI

SEQ ID NO: 3086534 - protein, 26 aa, Giardia lamblia
ECALFDARILTIFTHINSLVGNILKE

SEQ ID NO: 3086535 - protein, 24 aa, Giardia lamblia
ECENGFMLTPTKACILRVCFTNQD

SEQ ID NO: 3086536 - protein, 23 aa, Giardia lamblia
ECGGRGTCLYLKSKNAWECGSCP

SEQ ID NO: 3086537 - protein, 23 aa, Giardia lamblia
ECGSCPVGFYQYSGRCVSSYCYG

SEQ ID NO: 3086538 - protein, 25 aa, Giardia lamblia
ECHILITWAFLFKKDYIVVCKKASW

SEQ ID NO: 3086539 - protein, 27 aa, Giardia lamblia
ECHVLGALLSLIASLGVLCTEGDLASF

SEQ ID NO: 3086540 - protein, 20 aa, Giardia lamblia
ECISGFYLINPGTGATCVLC

SEQ ID NO: 3086541 - protein, 27 aa, Giardia lamblia
ECISRRKLLSFLLLPNAADLIGKEALN

SEQ ID NO: 3086542 - protein, 35 aa, Giardia lamblia
ECLSILKTLLLQYPLPRYPLLSTLLVTVLEAVIAP

SEQ ID NO: 3086543 - protein, 22 aa, Giardia lamblia
ECMPDYQLSQDKKSCIALVPIC

SEQ ID NO: 3086544 - protein, 17 aa, Giardia lamblia
ECRELIPELFYAPNMFL

SEQ ID NO: 3086545 - protein, 17 aa, Giardia lamblia
ECSFIRHDNMCAAEVAL

SEQ ID NO: 3086546 - protein, 21 aa, Giardia lamblia
ECTPGYYPGFMSCVPCKVSGC

SEQ ID NO: 3086547 - protein, 26 aa, Giardia lamblia
EDAESLPHFLVYWCKSRYGLRSLVSS

SEQ ID NO: 3086548 - protein, 28 aa, Giardia lamblia
EDAKSFYRLLDWLKQPPTFYNRVLFSAF

SEQ ID NO: 3086549 - protein, 24 aa, Giardia lamblia
EDCLDIFVVLLRYSFEEFTLQNLI

SEQ ID NO: 3086550 - protein, 26 aa, Giardia lamblia
EDCNFILHFLDCVFNYIFINDPTCVH

SEQ ID NO: 3086551 - protein, 20 aa, Giardia lamblia
EDDFFPLQIIQSLILANGPV

SEQ ID NO: 3086552 - protein, 24 aa, Giardia lamblia
EDDRILQLYDGLLLLVMAGFGFIE

SEQ ID NO: 3086553 - protein, 25 aa, Giardia lamblia
EDDYLNLYRLLISTGYNPFSAHGFS

SEQ ID NO: 3086554 - protein, 24 aa, Giardia lamblia
EDEALSLLALLTPAGSTSLSKRML

SEQ ID NO: 3086555 - protein, 19 aa, Giardia lamblia
EDFRLFYENIYASLFLSYC

SEQ ID NO: 3086556 - protein, 25 aa, Giardia lamblia
EDFSYVSYFYFQQIKYVWIDKENKF

SEQ ID NO: 3086557 - protein, 26 aa, Giardia lamblia
EDGTLNFLHIPSLRYGFNILKSLGMS

SEQ ID NO: 3086558 - protein, 43 aa, Giardia lamblia
EDHSMHFAHYLLLLIFLCTIALFVFIIIASKRPDLIKKCIAKM

SEQ ID NO: 3086559 - protein, 21 aa, Giardia lamblia
EDIFQRFILCKGKDAFNALQK

SEQ ID NO: 3086560 - protein, 30 aa, Giardia lamblia
EDITFPTMLFHYIISFYLPCSSSILSTEKL

SEQ ID NO: 3086561 - protein, 17 aa, Giardia lamblia
EDKFLVFVLLQTSRIVV

SEQ ID NO: 3086562 - protein, 28 aa, Giardia lamblia
EDKSSEEPLFLRSLRNANLAPRSSVSAD

SEQ ID NO: 3086563 - protein, 26 aa, Giardia lamblia
EDQLLTYPALYYPISMHPPANLPIFL

SEQ ID NO: 3086564 - protein, 32 aa, Giardia lamblia
EDTIDVSYLYKILLQVMLFLEHYKLGGWLQRY

SEQ ID NO: 3086565 - protein, 32 aa, Giardia lamblia
EDVPPLFIPIKDRDIHRLINAIKLQTIPSVPI

SEQ ID NO: 3086566 - protein, 24 aa, Giardia lamblia
EDVWLRYRLCILSFTFNDILSGVV

SEQ ID NO: 3086567 - protein, 19 aa, Giardia lamblia
EDYCLSCNTSYYMLNGMCV

SEQ ID NO: 3086568 - protein, 19 aa, Giardia lamblia
EDYILSLTHIIPSDLLLTE

SEQ ID NO: 3086569 - protein, 21 aa, Giardia lamblia
EEAWRGLPWNFLCSRSFYRRK

SEQ ID NO: 3086570 - protein, 31 aa, Giardia lamblia
EEAYSRLHTDLLFFKYLMQNVSQAVKLANSE

SEQ ID NO: 3086571 - protein, 32 aa, Giardia lamblia
EECDIRPWLHVYKALRLLPLQPDGAVSAWLSS

SEQ ID NO: 3086572 - protein, 24 aa, Giardia lamblia
EEEACKYFHQIVSALSYCHSRKVC

SEQ ID NO: 3086573 - protein, 28 aa, Giardia lamblia
EEEFVLKLIEFIVLFFNKTIVHEEISTI

SEQ ID NO: 3086574 - protein, 20 aa, Giardia lamblia
EEFFQLGRFLGAVSSLDKQD

SEQ ID NO: 3086575 - protein, 20 aa, Giardia lamblia
EEHALFMHKVTIASVTVTIL

SEQ ID NO: 3086576 - protein, 22 aa, Giardia lamblia
EEHIDRFYSPKPISIVLPCSVT

SEQ ID NO: 3086577 - protein, 36 aa, Giardia lamblia
EEHMALLMTRTVILLIYSTWAVLQRFGHRYSKSMSL

SEQ ID NO: 3086578 - protein, 21 aa, Giardia lamblia
EEIDWSIFFTSTLSKGTVSTT

SEQ ID NO: 3086579 - protein, 24 aa, Giardia lamblia
EELDQAFILLTVTLVVVVICQTSV

SEQ ID NO: 3086580 - protein, 27 aa, Giardia lamblia
EELGPWSPKIYLYGSAVYKKLFSVPGV

SEQ ID NO: 3086581 - protein, 17 aa, Giardia lamblia
EELIHYCVCAQASAFPD

SEQ ID NO: 3086582 - protein, 23 aa, Giardia lamblia
EELIKYDVVIYNLKLIEQKLQVF

SEQ ID NO: 3086583 - protein, 17 aa, Giardia lamblia
EELQRIKDYLILLDKYY

SEQ ID NO: 3086584 - protein, 30 aa, Giardia lamblia
EELVLRVILQLFLLALRRHKRIESIPDEFI

SEQ ID NO: 3086585 - protein, 18 aa, Giardia lamblia
EELWTALMIGAVHGYNSI

SEQ ID NO: 3086586 - protein, 33 aa, Giardia lamblia
EEPDAMALLIFFMLPFQFFYVVTILSTTSNSVF

SEQ ID NO: 3086587 - protein, 34 aa, Giardia lamblia
EEPPDPYIFTLMYMRAYYLLKTHYSMRIVNSPII

SEQ ID NO: 3086588 - protein, 47 aa, Giardia lamblia
EEQVYRFMAAIIWILNQLVHICRTSLLMWIFLGYANLSLNNFCLDEF

SEQ ID NO: 3086589 - protein, 19 aa, Giardia lamblia
EERADFLCFVTGSSRIPPI

SEQ ID NO: 3086590 - protein, 26 aa, Giardia lamblia
EESMIPHHYALPPKPPYYNPRIPVVD

SEQ ID NO: 3086591 - protein, 31 aa, Giardia lamblia
EESTYRYLYLRPYALDFLGWASTVFEVIIWT

SEQ ID NO: 3086592 - protein, 25 aa, Giardia lamblia
EETLHLFILLNYCKGGSLLNLRRSV

SEQ ID NO: 3086593 - protein, 20 aa, Giardia lamblia
EEVAYYKHLLVKRDAHEKEL

SEQ ID NO: 3086594 - protein, 26 aa, Giardia lamblia
EEVVRYFPVVYLTIASLLHVYLLPIY

SEQ ID NO: 3086595 - protein, 29 aa, Giardia lamblia
EFAPRSIASLYFLIRIAHAAYFSYSRLQL

SEQ ID NO: 3086596 - protein, 20 aa, Giardia lamblia
EFASLLILHKVFKRPIFASK

SEQ ID NO: 3086597 - protein, 36 aa, Giardia lamblia
EFCMYGFTFGTLLIANLLAYGLLFGAGSLFKLFPFS

SEQ ID NO: 3086598 - protein, 18 aa, Giardia lamblia
EFFSKSFPLVLQNKIHTK

SEQ ID NO: 3086599 - protein, 24 aa, Giardia lamblia
EFGCTYYQFDIGRGPYFMICVTIS

SEQ ID NO: 3086600 - protein, 27 aa, Giardia lamblia
EFGLHNFVDLYMAFLPIMEHESALDII

SEQ ID NO: 3086601 - protein, 22 aa, Giardia lamblia
EFGTCVMDLVGNKSYCSCDKDV

SEQ ID NO: 3086602 - protein, 17 aa, Giardia lamblia
EFISFTLPDMYSTELKK

SEQ ID NO: 3086603 - protein, 17 aa, Giardia lamblia
EFISIPNAGIHVPVNKE

SEQ ID NO: 3086604 - protein, 18 aa, Giardia lamblia
EFLLQRTSFLQRLCFALS

SEQ ID NO: 3086605 - protein, 25 aa, Giardia lamblia
EFLPGRPYTYFFTSPFSMLSHCGES

SEQ ID NO: 3086606 - protein, 31 aa, Giardia lamblia
EFLTVLMALFYAVFFFFRLATPFSLQETGIP

SEQ ID NO: 3086607 - protein, 27 aa, Giardia lamblia
EFMSKFFVITVFLMQFLLSLSNSIAEK

SEQ ID NO: 3086608 - protein, 36 aa, Giardia lamblia
EFQNSLGPLLLAAVAFFIICLIIDIQLLMLKQRQMM

SEQ ID NO: 3086609 - protein, 42 aa, Giardia lamblia
EFREHMGIYILIIVLAVIVLVLFILVIVLYSRLINLTVRNLL

SEQ ID NO: 3086610 - protein, 26 aa, Giardia lamblia
EFSDNHLFLLYSFSTAMFALVYSNSS

SEQ ID NO: 3086611 - protein, 26 aa, Giardia lamblia
EFSVRSFGLNYLWSPSMAALIEHRFK

SEQ ID NO: 3086612 - protein, 18 aa, Giardia lamblia
EFVVSLVVDAYQNAFEKE

SEQ ID NO: 3086613 - protein, 22 aa, Giardia lamblia
EFYSLLVMRFITGIALTGMNVT

SEQ ID NO: 3086614 - protein, 26 aa, Giardia lamblia
EGARRLLTLKGFERMLRKRRIGYYYE

SEQ ID NO: 3086615 - protein, 26 aa, Giardia lamblia
EGFWGLLITVFIVSPLLMWGVSGPDH

SEQ ID NO: 3086616 - protein, 20 aa, Giardia lamblia
EGLCYFFGNKTPNLFIPFIA

SEQ ID NO: 3086617 - protein, 29 aa, Giardia lamblia
EGLLVYRASEFPLLRPYYTTSHSIVQNIL

SEQ ID NO: 3086618 - protein, 38 aa, Giardia lamblia
EGLRSSLALVFWLFSWVWILLLLVFAVVITLELARDYM

SEQ ID NO: 3086619 - protein, 21 aa, Giardia lamblia
EGNRLALLGGLSMLTMTGKLS

SEQ ID NO: 3086620 - protein, 18 aa, Giardia lamblia
EGSEPRCIKCRFGYGLIE

SEQ ID NO: 3086621 - protein, 29 aa, Giardia lamblia
EGSLDHLIFIPYIHVLLFLHNGTMDSHQN

SEQ ID NO: 3086622 - protein, 26 aa, Giardia lamblia
EGTDNEVYLPPNIKFRLPEEARNIRS

SEQ ID NO: 3086623 - protein, 18 aa, Giardia lamblia
EGVFQYAVGLISRAPRTL

SEQ ID NO: 3086624 - protein, 23 aa, Giardia lamblia
EGYHRDLCDCRVRNIGAVAGVTA

SEQ ID NO: 3086625 - protein, 23 aa, Giardia lamblia
EGYRDELVIPEWVFTLVKSPMLM

SEQ ID NO: 3086626 - protein, 25 aa, Giardia lamblia
EGYREPRVMLGIIKKFFPLSEETTV

SEQ ID NO: 3086627 - protein, 23 aa, Giardia lamblia
EGYSYFVIAGLSLLLNLPQVHPD

SEQ ID NO: 3086628 - protein, 22 aa, Giardia lamblia
EGYTALMLAILAGSTTSATLLL

SEQ ID NO: 3086629 - protein, 28 aa, Giardia lamblia
EHCMMHYMSLFRVVSPWMRGYASSKPNS

SEQ ID NO: 3086630 - protein, 20 aa, Giardia lamblia
EHCRSFVSILAALTALFVLI

SEQ ID NO: 3086631 - protein, 21 aa, Giardia lamblia
EHCRSFVSILAALTALFVLIW

SEQ ID NO: 3086632 - protein, 25 aa, Giardia lamblia
EHFINPYLHILIIANKVFQKLGLRL

SEQ ID NO: 3086633 - protein, 25 aa, Giardia lamblia
EHGPSYVLLPFPGPLEKWKDLLNLL

SEQ ID NO: 3086634 - protein, 26 aa, Giardia lamblia
EHIAETKRWLFLNREAAIYHHLKHPN

SEQ ID NO: 3086635 - protein, 29 aa, Giardia lamblia
EHIDRHVYLDFFCGILLSLALDKDINKEV

SEQ ID NO: 3086636 - protein, 20 aa, Giardia lamblia
EHILRGPLRFATTNSWVTKD

SEQ ID NO: 3086637 - protein, 51 aa, Giardia lamblia
EHIQLRKLCFYFFALLLLSAIVIGGLAFIMNFLFPSLFKFGSSSSESLSPE

SEQ ID NO: 3086638 - protein, 22 aa, Giardia lamblia
EHKRRYLLYKLFGSTHTRDLSD

SEQ ID NO: 3086639 - protein, 22 aa, Giardia lamblia
EHKWAKVLLFGMIILMAISGRE

SEQ ID NO: 3086640 - protein, 18 aa, Giardia lamblia
EHLLTEHKRRKTLVPIAV

SEQ ID NO: 3086641 - protein, 27 aa, Giardia lamblia
EHNTYPVPFFIYYFGSISVDTLLAKYI

SEQ ID NO: 3086642 - protein, 28 aa, Giardia lamblia
EHPMNVRFIFFCKTRPYIRAFHSLALLG

SEQ ID NO: 3086643 - protein, 17 aa, Giardia lamblia
EHSVLRLAILQEERSSY

SEQ ID NO: 3086644 - protein, 24 aa, Giardia lamblia
EHVIRFYSYRRLTDKKWFGNLYKQ

SEQ ID NO: 3086645 - protein, 25 aa, Giardia lamblia
EHYYYVSLRLILGGLFTVPAQSQLV

SEQ ID NO: 3086646 - protein, 21 aa, Giardia lamblia
EIAFYEEALALEARFMRKSAA

SEQ ID NO: 3086647 - protein, 23 aa, Giardia lamblia
EIAIALFAHMHVLAVSKGYIPNS

SEQ ID NO: 3086648 - protein, 23 aa, Giardia lamblia
EIAIHPFLLKLETSIRLSMYEQI

SEQ ID NO: 3086649 - protein, 17 aa, Giardia lamblia
EIANFRERFPHLIGIRA

SEQ ID NO: 3086650 - protein, 18 aa, Giardia lamblia
EICLPNKIRYVFPRHCKV

SEQ ID NO: 3086651 - protein, 28 aa, Giardia lamblia
EIDLSLLIMEFLSTIPLATIALPDLRLY

SEQ ID NO: 3086652 - protein, 20 aa, Giardia lamblia
EIEDFVCLISLHLKNDKAAY

SEQ ID NO: 3086653 - protein, 25 aa, Giardia lamblia
EIEDRLLRVFLLHNISKHLFLGSHI

SEQ ID NO: 3086654 - protein, 17 aa, Giardia lamblia
EIFFNTFSGKSILLEEP

SEQ ID NO: 3086655 - protein, 19 aa, Giardia lamblia
EIGMIFRFGIILSGFGLVV

SEQ ID NO: 3086656 - protein, 42 aa, Giardia lamblia
EIHSLCYQFSLELRFVPFKKYCFEFLPTYLTRLGLDKKRAEA

SEQ ID NO: 3086657 - protein, 24 aa, Giardia lamblia
EIIDTVLYFLQIKGLYIESAADPC

SEQ ID NO: 3086658 - protein, 25 aa, Giardia lamblia
EIITALVPFYPGKGALYFTKVCMLL

SEQ ID NO: 3086659 - protein, 34 aa, Giardia lamblia
EILDNPRRITFLPKWPLFIRGILEAVAIINRFIT

SEQ ID NO: 3086660 - protein, 22 aa, Giardia lamblia
EILFRAAYINAFTLLSGAIHVY

SEQ ID NO: 3086661 - protein, 24 aa, Giardia lamblia
EINGDYWLVLDPLSTRKSSCPDRI

SEQ ID NO: 3086662 - protein, 17 aa, Giardia lamblia
EIPLSMELLSLYSSAKA

SEQ ID NO: 3086663 - protein, 18 aa, Giardia lamblia
EIQLKIAVTVLLVPMEAV

SEQ ID NO: 3086664 - protein, 26 aa, Giardia lamblia
EIQMALFGLLNDALRFSLPPQAYLNE

SEQ ID NO: 3086665 - protein, 25 aa, Giardia lamblia
EISDPYFRNIFGSKIYEYLNAQREV

SEQ ID NO: 3086666 - protein, 25 aa, Giardia lamblia
EITHLSIMSPPFLDGLFNGLCSGHK

SEQ ID NO: 3086667 - protein, 21 aa, Giardia lamblia
EITIFYIRVTMQLMAIQAIIM

SEQ ID NO: 3086668 - protein, 31 aa, Giardia lamblia
EITISSRLLCVYLLAKERLLGAIPNKIIKET

SEQ ID NO: 3086669 - protein, 24 aa, Giardia lamblia
EITNYPELIQIKKDLKMLSSLYNL

SEQ ID NO: 3086670 - protein, 18 aa, Giardia lamblia
EIVILIYEIVMKSASFLY

SEQ ID NO: 3086671 - protein, 18 aa, Giardia lamblia
EIYMTVIKLLYACVLFII

SEQ ID NO: 3086672 - protein, 26 aa, Giardia lamblia
EKALPPTLYAVLLLSKTYQRVRRLTY

SEQ ID NO: 3086673 - protein, 30 aa, Giardia lamblia
EKANKRFLSVLFRLIKRFSRLLFTDICFSG

SEQ ID NO: 3086674 - protein, 25 aa, Giardia lamblia
EKDLTLICLVGIMDPLRPGVTNAVE

SEQ ID NO: 3086675 - protein, 21 aa, Giardia lamblia
EKEHTLTGYGFTYCKKCTLET

SEQ ID NO: 3086676 - protein, 25 aa, Giardia lamblia
EKHKNLFVKFYAPWCGHCKQLAPTW

SEQ ID NO: 3086677 - protein, 23 aa, Giardia lamblia
EKIPPFLLHLYDKSPTRDYTIVV

SEQ ID NO: 3086678 - protein, 21 aa, Giardia lamblia
EKIVNLLLPHEAGQLDPQNRT

SEQ ID NO: 3086679 - protein, 30 aa, Giardia lamblia
EKLAILAKTIFIQQTFLLFGFHIIPESNEN

SEQ ID NO: 3086680 - protein, 24 aa, Giardia lamblia
EKLPNFGFINLPTERIAAALAAKD

SEQ ID NO: 3086681 - protein, 33 aa, Giardia lamblia
EKMASVTLWFSLRLISLFLVAYLKDITTPEVGV

SEQ ID NO: 3086682 - protein, 27 aa, Giardia lamblia
EKMNPSILAKLPFVLPSLAAAMNIRGK

SEQ ID NO: 3086683 - protein, 26 aa, Giardia lamblia
EKNSDIPALLRQLPQTALTELGSQTL

SEQ ID NO: 3086684 - protein, 19 aa, Giardia lamblia
EKPWFQTACMFMAMLVCII

SEQ ID NO: 3086685 - protein, 22 aa, Giardia lamblia
EKRLRLGSKLFGAFITCLTDNL

SEQ ID NO: 3086686 - protein, 26 aa, Giardia lamblia
EKSENIFLIAIRYYLSFFHIPGESQQ

SEQ ID NO: 3086687 - protein, 17 aa, Giardia lamblia
EKSLNGFLANFTHIMRL

SEQ ID NO: 3086688 - protein, 23 aa, Giardia lamblia
EKSSLSYFLISYVSGAILDEYTL

SEQ ID NO: 3086689 - protein, 18 aa, Giardia lamblia
EKYRKFRGVYADTGLKFI

SEQ ID NO: 3086690 - protein, 25 aa, Giardia lamblia
ELALKLFFVIFVRAIFMILVTLVNV

SEQ ID NO: 3086691 - protein, 29 aa, Giardia lamblia
ELAMKYLSKPFTPLFSIIFDRTFNEAVTT

SEQ ID NO: 3086692 - protein, 33 aa, Giardia lamblia
ELAVHKIRLSLTALNFLYMKSMYLELGSVLFYR

SEQ ID NO: 3086693 - protein, 23 aa, Giardia lamblia
ELCSTCYNPAYKLSLRSDQCVPE

SEQ ID NO: 3086694 - protein, 49 aa, Giardia lamblia
ELCTLLYSMLIGIVIPIPLGIKMLYFLLSQFPMTILSYNLSGNLVIVPT

SEQ ID NO: 3086695 - protein, 18 aa, Giardia lamblia
ELCTQCVSGYVPINGKCQ

SEQ ID NO: 3086696 - protein, 25 aa, Giardia lamblia
ELDSLPYLVLLSFLGATDLEDEEES

SEQ ID NO: 3086697 - protein, 22 aa, Giardia lamblia
ELDVYLKLVYTVLDFEHLKIVP

SEQ ID NO: 3086698 - protein, 42 aa, Giardia lamblia
ELEQKVLFPLLISVTVLLLLFTLLKTIFRRTPVAYRLRLHHV

SEQ ID NO: 3086699 - protein, 19 aa, Giardia lamblia
ELFCRRLFTSLEKTINIFQ

SEQ ID NO: 3086700 - protein, 17 aa, Giardia lamblia
ELFFALATVTYSKAKSS

SEQ ID NO: 3086701 - protein, 21 aa, Giardia lamblia
ELFRCQYIDLLNIKPPELRNA

SEQ ID NO: 3086702 - protein, 33 aa, Giardia lamblia
ELHPDSPLLMYFLWIPLQILITYDAINFTIQCT

SEQ ID NO: 3086703 - protein, 18 aa, Giardia lamblia
ELIRDLIGHCACTRNIHG

SEQ ID NO: 3086704 - protein, 27 aa, Giardia lamblia
ELITAYIYPVLLFMPLLLSAFKQYMKT

SEQ ID NO: 3086705 - protein, 20 aa, Giardia lamblia
ELLCQCLYQSIIYALTVVFC

SEQ ID NO: 3086706 - protein, 19 aa, Giardia lamblia
ELLESELLQYLKYVTRQSG

SEQ ID NO: 3086707 - protein, 29 aa, Giardia lamblia
ELLGADWPILMLLKGFRIPWSMGDPAMLG

SEQ ID NO: 3086708 - protein, 18 aa, Giardia lamblia
ELLGKYPLLTHSFVPFVE

SEQ ID NO: 3086709 - protein, 21 aa, Giardia lamblia
ELLLTRLRYKNQFPLNLKSAE

SEQ ID NO: 3086710 - protein, 17 aa, Giardia lamblia
ELLPDFFSKYMPCYTSQ

SEQ ID NO: 3086711 - protein, 34 aa, Giardia lamblia
ELLPGPFLIPIVVFPFIVLLSSLKFFGLNSSQKK

SEQ ID NO: 3086712 - protein, 20 aa, Giardia lamblia
ELLSVRLLHTILSGIQLLYV

SEQ ID NO: 3086713 - protein, 17 aa, Giardia lamblia
ELMKMFYGKPGFYIYQV

SEQ ID NO: 3086714 - protein, 24 aa, Giardia lamblia
ELNELLQDFDFVLGKGAYGSVRAL

SEQ ID NO: 3086715 - protein, 33 aa, Giardia lamblia
ELQRDLCMLVAPLCRFLYVTLSKGIYLTTSTDE

SEQ ID NO: 3086716 - protein, 20 aa, Giardia lamblia
ELRKLSTYTGFGIGISESKW

SEQ ID NO: 3086717 - protein, 24 aa, Giardia lamblia
ELRLIEPIVRTWRSFEFVCDAAAF

SEQ ID NO: 3086718 - protein, 39 aa, Giardia lamblia
ELRRITITAMYLLFYFSNYFYLEPVILRIVSEDLLTIVP

SEQ ID NO: 3086719 - protein, 23 aa, Giardia lamblia
ELSAVAVFLAGLILAGECFALTG

SEQ ID NO: 3086720 - protein, 18 aa, Giardia lamblia
ELSSWPTISKFWSLGLDF

SEQ ID NO: 3086721 - protein, 23 aa, Giardia lamblia
ELSTFCLFLINMLKGRLDQWPHS

SEQ ID NO: 3086722 - protein, 26 aa, Giardia lamblia
ELTASYYYKRFFLTGSVHDYDTFYIL

SEQ ID NO: 3086723 - protein, 31 aa, Giardia lamblia
ELTIKKIVHFIILEWRLYVSVHIRQGFDEDL

SEQ ID NO: 3086724 - protein, 20 aa, Giardia lamblia
ELVAYIRPSIKLGLQSAVEI

SEQ ID NO: 3086725 - protein, 33 aa, Giardia lamblia
ELVETDYMPWLLRRTFSLAYRNLLLSYISEDSQ

SEQ ID NO: 3086726 - protein, 20 aa, Giardia lamblia
ELVLRFHRHYQEAMLLALSA

SEQ ID NO: 3086727 - protein, 26 aa, Giardia lamblia
ELVQKAAFFLLCIHALAKQLQFYFLD

SEQ ID NO: 3086728 - protein, 24 aa, Giardia lamblia
ELVSVIFGWISIACWFTASYPQIR

SEQ ID NO: 3086729 - protein, 20 aa, Giardia lamblia
ELYVLYLNRLDDYCRLIHEC

SEQ ID NO: 3086730 - protein, 24 aa, Giardia lamblia
ELYYNIRAKFDFFNKPRCLLLVTA

SEQ ID NO: 3086731 - protein, 26 aa, Giardia lamblia
EMAICVLLYEIGVLGLQRLATNTLTM

SEQ ID NO: 3086732 - protein, 23 aa, Giardia lamblia
EMGHLLLMYSTKTPIRGFEVGIR

SEQ ID NO: 3086733 - protein, 29 aa, Giardia lamblia
EMIKLLASRLAMCPDLSGVLPIVYAIENK

SEQ ID NO: 3086734 - protein, 17 aa, Giardia lamblia
EMITHMTDLLKELVLGV

SEQ ID NO: 3086735 - protein, 28 aa, Giardia lamblia
EMIVAYALPITIMYFVRSPHLCEHHYKA

SEQ ID NO: 3086736 - protein, 24 aa, Giardia lamblia
EMKLALFELLLTKCRDFISMGPYL

SEQ ID NO: 3086737 - protein, 18 aa, Giardia lamblia
EMLRLCYNLKEVSCASLV

SEQ ID NO: 3086738 - protein, 18 aa, Giardia lamblia
ENALLYFQEAYAQLLEQL

SEQ ID NO: 3086739 - protein, 40 aa, Giardia lamblia
ENDEVYLFARMLFSDLDNDYFLAYLDLRRSLQLNTYIADS

SEQ ID NO: 3086740 - protein, 23 aa, Giardia lamblia
ENDIIPFGIGFQGSLSFGFTEKY

SEQ ID NO: 3086741 - protein, 25 aa, Giardia lamblia
ENFALFVAMVLIGSAIVMSLVVGCC

SEQ ID NO: 3086742 - protein, 18 aa, Giardia lamblia
ENFLLDRNFMYTERISAS

SEQ ID NO: 3086743 - protein, 17 aa, Giardia lamblia
ENHLLALSELPSRLLGD

SEQ ID NO: 3086744 - protein, 29 aa, Giardia lamblia
ENIANFRTLLPHLLLYMSRKREYCPGALK

SEQ ID NO: 3086745 - protein, 25 aa, Giardia lamblia
ENLAYSVFVFLLSSAIRDMGLLFYI

SEQ ID NO: 3086746 - protein, 22 aa, Giardia lamblia
ENLILFYDMKNFSGHVPFAEGY

SEQ ID NO: 3086747 - protein, 21 aa, Giardia lamblia
ENLLGRLLQYEQRTIYLAYII

SEQ ID NO: 3086748 - protein, 18 aa, Giardia lamblia
ENLLIDERVIVLDLLFRC

SEQ ID NO: 3086749 - protein, 20 aa, Giardia lamblia
ENLLLAFYKGFKETYVSSIG

SEQ ID NO: 3086750 - protein, 35 aa, Giardia lamblia
ENMDSGTPCLLSRWPRFFFLFDCDINPDWIEAFNS

SEQ ID NO: 3086751 - protein, 27 aa, Giardia lamblia
ENNNGNYMCLCANYYTLVGRDCIPTRC

SEQ ID NO: 3086752 - protein, 22 aa, Giardia lamblia
ENNVCVCKDGFYSSERKCLQCN

SEQ ID NO: 3086753 - protein, 17 aa, Giardia lamblia
ENPAVVFVALFLSYEVG

SEQ ID NO: 3086754 - protein, 33 aa, Giardia lamblia
ENQRRSIILTELLLIILLKLAKFSYRKKKESID

SEQ ID NO: 3086755 - protein, 27 aa, Giardia lamblia
ENSLFILSALMIHPALICLLEADDRRN

SEQ ID NO: 3086756 - protein, 25 aa, Giardia lamblia
ENVRLSIYFFSLLTGHYLIDNESDL

SEQ ID NO: 3086757 - protein, 37 aa, Giardia lamblia
EPCDILLTVPFEYLDRKKISFLPESCPYFSPTELKFL

SEQ ID NO: 3086758 - protein, 17 aa, Giardia lamblia
EPEFILRRALDPNKVLE

SEQ ID NO: 3086759 - protein, 20 aa, Giardia lamblia
EPFLLGFPQAAVSIIYERFP

SEQ ID NO: 3086760 - protein, 23 aa, Giardia lamblia
EPGYQLMNYPRYCKEKTTTDCSN

SEQ ID NO: 3086761 - protein, 17 aa, Giardia lamblia
EPLLSKYTALFSSALVP

SEQ ID NO: 3086762 - protein, 28 aa, Giardia lamblia
EPNRISYMFALLLRHLITVDLQLRRTLK

SEQ ID NO: 3086763 - protein, 33 aa, Giardia lamblia
EPPKTRCVVVGKLRLFQLYNMLNCSAIPSHFTA

SEQ ID NO: 3086764 - protein, 25 aa, Giardia lamblia
EPQSTLLINFIPRINPYRISHEFLQ

SEQ ID NO: 3086765 - protein, 19 aa, Giardia lamblia
EPTLSRIMLLVAPIGQGAC

SEQ ID NO: 3086766 - protein, 18 aa, Giardia lamblia
EPTNYVFYVARSHGFYML

SEQ ID NO: 3086767 - protein, 21 aa, Giardia lamblia
EPWFDYGYWKDRTQYHLITES

SEQ ID NO: 3086768 - protein, 22 aa, Giardia lamblia
EQALSRFFNEVKKLDPYFETVS

SEQ ID NO: 3086769 - protein, 17 aa, Giardia lamblia
EQGLVQCISLLTVLSRK

SEQ ID NO: 3086770 - protein, 20 aa, Giardia lamblia
EQGVLIFDRLLWSDDASLAL

SEQ ID NO: 3086771 - protein, 21 aa, Giardia lamblia
EQGYTYIYPGRCVPSKLIANG

SEQ ID NO: 3086772 - protein, 37 aa, Giardia lamblia
EQIAYYLSYTVVLQFVFYPFELSLINRHHTFLTSYDL

SEQ ID NO: 3086773 - protein, 23 aa, Giardia lamblia
EQKPLIFSLIAPRYQQVLFSKEV

SEQ ID NO: 3086774 - protein, 35 aa, Giardia lamblia
EQKQQLPEYIIWTIILQLLGLLEWLHDTKRIVFRY

SEQ ID NO: 3086775 - protein, 37 aa, Giardia lamblia
EQKQWILLLNIYFFGHRRLLNAFPILPDGYTGLTAHR

SEQ ID NO: 3086776 - protein, 28 aa, Giardia lamblia
EQLLDDPHFLAINNYHLVILAEPSLYQS

SEQ ID NO: 3086777 - protein, 18 aa, Giardia lamblia
EQLLYYSSTTPLPFVCNE

SEQ ID NO: 3086778 - protein, 23 aa, Giardia lamblia
EQMRKYKILPSDPRIYLYMGVDG

SEQ ID NO: 3086779 - protein, 25 aa, Giardia lamblia
EQNGRCVCLLGYSISFNGLTCVKDS

SEQ ID NO: 3086780 - protein, 23 aa, Giardia lamblia
EQNVFLFYGGCYTIDQSTIGSEI

SEQ ID NO: 3086781 - protein, 19 aa, Giardia lamblia
EQNVFLFYGGCYTIDQSTV

SEQ ID NO: 3086782 - protein, 25 aa, Giardia lamblia
EQPFSPTIILRVVTFIIAFAKDYRQ

SEQ ID NO: 3086783 - protein, 30 aa, Giardia lamblia
EQRNHYFVKDMFWNFPLNASFARTRILLMD

SEQ ID NO: 3086784 - protein, 30 aa, Giardia lamblia
EQRRRALIDSFLQYIDKIFSSLYVDFDRAR

SEQ ID NO: 3086785 - protein, 30 aa, Giardia lamblia
EQSKTPLTLEFIFLRLFKFCGGSEVADGKL

SEQ ID NO: 3086786 - protein, 26 aa, Giardia lamblia
EQSRIARLSILIIAALLTAPHISLME

SEQ ID NO: 3086787 - protein, 20 aa, Giardia lamblia
EQTFTFQEFKTRGLLNLAPS

SEQ ID NO: 3086788 - protein, 27 aa, Giardia lamblia
EQTNHYTYLKFLPYKFGQSLMTSSQTD

SEQ ID NO: 3086789 - protein, 27 aa, Giardia lamblia
EQVDSCTHLWWIDLHLTWGNVDTCTSL

SEQ ID NO: 3086790 - protein, 26 aa, Giardia lamblia
EQVHHSIYLLIFILSNIYSKANDTET

SEQ ID NO: 3086791 - protein, 21 aa, Giardia lamblia
EQWYKYKYLILNYGAPNANGA

SEQ ID NO: 3086792 - protein, 26 aa, Giardia lamblia
EQYDTLLEFYSYLTLTPGGYTRYVPA

SEQ ID NO: 3086793 - protein, 24 aa, Giardia lamblia
ERACHKVFMLALKPLKEFKYSDQG

SEQ ID NO: 3086794 - protein, 19 aa, Giardia lamblia
ERAPRKPGRGLPKPQLTRN

SEQ ID NO: 3086795 - protein, 18 aa, Giardia lamblia
ERCLRIPVLILDNVETGK

SEQ ID NO: 3086796 - protein, 23 aa, Giardia lamblia
ERDEAFLRLLKRLFQNSDAHLTP

SEQ ID NO: 3086797 - protein, 24 aa, Giardia lamblia
ERDFYVAYALVSAIWRSLQCTHEQ

SEQ ID NO: 3086798 - protein, 27 aa, Giardia lamblia
ERENEQYLFILKSRRDIIKRRKKQALI

SEQ ID NO: 3086799 - protein, 20 aa, Giardia lamblia
ERERRYYLELRRNNFFSTFR

SEQ ID NO: 3086800 - protein, 27 aa, Giardia lamblia
ERFNFQTMFTIPYPELLHLALEISRST

SEQ ID NO: 3086801 - protein, 27 aa, Giardia lamblia
ERGDRDMIALLIPYELDLVGVTQLIAN

SEQ ID NO: 3086802 - protein, 24 aa, Giardia lamblia
ERGLPLDVLLQIPSALFVKASVDS

SEQ ID NO: 3086803 - protein, 24 aa, Giardia lamblia
ERGLSFWRPLFEGPAYITVVDPLQ

SEQ ID NO: 3086804 - protein, 23 aa, Giardia lamblia
ERHKLIFISQLCFNVLRKDNNLP

SEQ ID NO: 3086805 - protein, 32 aa, Giardia lamblia
ERIDYQFELITSRVFIICLLQHIQCVHRNCHS

SEQ ID NO: 3086806 - protein, 26 aa, Giardia lamblia
ERKQKHIFAIYKRLLPALADDSILQA

SEQ ID NO: 3086807 - protein, 38 aa, Giardia lamblia
ERKVCTYISAMKLWIYVHGKVELFYDPALRKDNRYSDS

SEQ ID NO: 3086808 - protein, 18 aa, Giardia lamblia
ERLILVRRTIRHDRHALN

SEQ ID NO: 3086809 - protein, 18 aa, Giardia lamblia
ERLLSIRRKRTDSISLQI

SEQ ID NO: 3086810 - protein, 26 aa, Giardia lamblia
ERLNSHLAFFLTPGGVIYALSTSTNA

SEQ ID NO: 3086811 - protein, 17 aa, Giardia lamblia
ERLRNTLLRLQPGYFDN

SEQ ID NO: 3086812 - protein, 19 aa, Giardia lamblia
ERMIAALLLPARIRPTRSG

SEQ ID NO: 3086813 - protein, 20 aa, Giardia lamblia
ERNMEFLNIPRYIVNYFLNT

SEQ ID NO: 3086814 - protein, 18 aa, Giardia lamblia
ERRAQINAFLRKGKLPKK

SEQ ID NO: 3086815 - protein, 24 aa, Giardia lamblia
ERRKFLIQIPVYSEPLSFLTMFTI

SEQ ID NO: 3086816 - protein, 17 aa, Giardia lamblia
ERRYAPALEFADSVLRG

SEQ ID NO: 3086817 - protein, 24 aa, Giardia lamblia
ERSFTIILPVLTAIYYILLDLIST

SEQ ID NO: 3086818 - protein, 25 aa, Giardia lamblia
ERSSYPTFLRLLNVGNVHSSESHSE

SEQ ID NO: 3086819 - protein, 24 aa, Giardia lamblia
ERTYFWILAQFITGKGMSISALRL

SEQ ID NO: 3086820 - protein, 32 aa, Giardia lamblia
ERVLSWLDYFTSNNFMFVSLVTSLDPYKMILG

SEQ ID NO: 3086821 - protein, 21 aa, Giardia lamblia
ERYILLCMIHVQRPVMSVLNS

SEQ ID NO: 3086822 - protein, 28 aa, Giardia lamblia
ERYYDLISAIVYFFLIIHACTGKRYEYV

SEQ ID NO: 3086823 - protein, 23 aa, Giardia lamblia
ESAFSLTILGLMGISRGGNSDLE

SEQ ID NO: 3086824 - protein, 27 aa, Giardia lamblia
ESALTLHKMLLSAGIPFVGIPGFPAVF

SEQ ID NO: 3086825 - protein, 17 aa, Giardia lamblia
ESFEYCYYHVLGGLKRI

SEQ ID NO: 3086826 - protein, 25 aa, Giardia lamblia
ESFKPLLYMAILMVTQPQDLLIDSL

SEQ ID NO: 3086827 - protein, 23 aa, Giardia lamblia
ESFQAFLWRLLSHTKRFSSQQDN

SEQ ID NO: 3086828 - protein, 19 aa, Giardia lamblia
ESFYQNIIDYPSGLEPNES

SEQ ID NO: 3086829 - protein, 18 aa, Giardia lamblia
ESGRYFIVPGASSTDQSV

SEQ ID NO: 3086830 - protein, 23 aa, Giardia lamblia
ESGTFFIYTFPAMVGEPPEPALV

SEQ ID NO: 3086831 - protein, 24 aa, Giardia lamblia
ESIKDFLLNFNPSRFRFAMPLRRQ

SEQ ID NO: 3086832 - protein, 23 aa, Giardia lamblia
ESKQVLIPPSPLELLHNMNVNYE

SEQ ID NO: 3086833 - protein, 29 aa, Giardia lamblia
ESLCFIRCFFSLLPRRLSSYLLCKELQIS

SEQ ID NO: 3086834 - protein, 17 aa, Giardia lamblia
ESLFPLFSITQVTFQYK

SEQ ID NO: 3086835 - protein, 24 aa, Giardia lamblia
ESLLDYFGIFFYAVSTLVPGFLYT

SEQ ID NO: 3086836 - protein, 25 aa, Giardia lamblia
ESLLIIWRSLIVLDAPYLGHKDTKK

SEQ ID NO: 3086837 - protein, 32 aa, Giardia lamblia
ESLYLFPECVLFVFTYFRLLDITPTEALCVSI

SEQ ID NO: 3086838 - protein, 35 aa, Giardia lamblia
ESMQLVFFKFSYAYRTYFKLAFPEDTYLESLFRLV

SEQ ID NO: 3086839 - protein, 24 aa, Giardia lamblia
ESNQISILEIILVYLTCLDSVVQY

SEQ ID NO: 3086840 - protein, 25 aa, Giardia lamblia
ESPDALMMYFPLAVATCDSFSLVLK

SEQ ID NO: 3086841 - protein, 28 aa, Giardia lamblia
ESPFFGQLVCAFYVLQLLLDPSSSDDLY

SEQ ID NO: 3086842 - protein, 25 aa, Giardia lamblia
ESPIHLLTCLLSEDFDLGYGISTKM

SEQ ID NO: 3086843 - protein, 26 aa, Giardia lamblia
ESPLALFSVLYLCAVHMFASSDYDWL

SEQ ID NO: 3086844 - protein, 22 aa, Giardia lamblia
ESPTSVFNIWLNAVVPAEIYND

SEQ ID NO: 3086845 - protein, 32 aa, Giardia lamblia
ESQMVYYLLRGVFLLALQINPILALKSITFME

SEQ ID NO: 3086846 - protein, 22 aa, Giardia lamblia
ESRTPLMFDSLVILITMVSFCK

SEQ ID NO: 3086847 - protein, 26 aa, Giardia lamblia
ESSEVDLIQYFKLAITFSKYSSNVFH

SEQ ID NO: 3086848 - protein, 29 aa, Giardia lamblia
ESSKSALLRLIWLLIAAFPDHADLIFTSF

SEQ ID NO: 3086849 - protein, 33 aa, Giardia lamblia
ESSYYLDMTIPIASFLMCLRVGLSAVISSVYAH

SEQ ID NO: 3086850 - protein, 49 aa, Giardia lamblia
ESTFTPMIVWLFFKQSARVYTYRIAKDQPYLLGRLKLRSSWTDITPCHD

SEQ ID NO: 3086851 - protein, 23 aa, Giardia lamblia
ESWAPYVTMLIAALGFATFFPAS

SEQ ID NO: 3086852 - protein, 26 aa, Giardia lamblia
ESYEDFGFFATIRRGQVFNLSIVLEN

SEQ ID NO: 3086853 - protein, 20 aa, Giardia lamblia
ESYFLALLHAKELPRHAILS

SEQ ID NO: 3086854 - protein, 17 aa, Giardia lamblia
ETATIADILLSFKSLEV

SEQ ID NO: 3086855 - protein, 22 aa, Giardia lamblia
ETDGWTPWFRYVEQGNYPAVQC

SEQ ID NO: 3086856 - protein, 21 aa, Giardia lamblia
ETEEWIYMRLGYDLCTTSLLD

SEQ ID NO: 3086857 - protein, 23 aa, Giardia lamblia
ETHMRLTVYDPPLEYIRGLGQNK

SEQ ID NO: 3086858 - protein, 31 aa, Giardia lamblia
ETHYEIYGEPPWWRSFWGPTIRDKAPDPERP

SEQ ID NO: 3086859 - protein, 43 aa, Giardia lamblia
ETILRIFQHRSQLLRNLVISSLFYLRRHVWHANLIIPHLEPSE

SEQ ID NO: 3086860 - protein, 18 aa, Giardia lamblia
ETIPFPTMPLRVIQCENL

SEQ ID NO: 3086861 - protein, 18 aa, Giardia lamblia
ETIQKVCFQLLNVLTYLH

SEQ ID NO: 3086862 - protein, 19 aa, Giardia lamblia
ETMYPLPEGLFDWEDPHLI

SEQ ID NO: 3086863 - protein, 30 aa, Giardia lamblia
ETNPLIFITYALFFTRTYSLALPSYFTSEY

SEQ ID NO: 3086864 - protein, 18 aa, Giardia lamblia
ETQLIADDPLAFVKATVA

SEQ ID NO: 3086865 - protein, 26 aa, Giardia lamblia
ETRDYVAIQALPFFDLEDYVSTLSLI

SEQ ID NO: 3086866 - protein, 25 aa, Giardia lamblia
ETRLRSLLPLVSLTCKLILLSDDLS

SEQ ID NO: 3086867 - protein, 23 aa, Giardia lamblia
ETRMFPGLILGNARSRDLLDCAR

SEQ ID NO: 3086868 - protein, 32 aa, Giardia lamblia
ETRRISIVVGLLLFWSLYLIHKVLEAKDSTIF

SEQ ID NO: 3086869 - protein, 27 aa, Giardia lamblia
ETSCTACYPGYVLNRSSGDTGTCIKEC

SEQ ID NO: 3086870 - protein, 23 aa, Giardia lamblia
ETSSATYQLLTKFKGRLTEVRYK

SEQ ID NO: 3086871 - protein, 20 aa, Giardia lamblia
ETVISYYYRDVYLGEPDTLH

SEQ ID NO: 3086872 - protein, 30 aa, Giardia lamblia; identical to SEQ ID NO: 3082976

SEQ ID NO: 3086873 - protein, 24 aa, Giardia lamblia
ETYQPLLFIVYALPHVLDFDDVSI

SEQ ID NO: 3086874 - protein, 31 aa, Giardia lamblia
ETYTMVPLATQLLLLLFRRHLHLSNMVGLQQ

SEQ ID NO: 3086875 - protein, 17 aa, Giardia lamblia
EVCIGYPEYLVHPDFRY

SEQ ID NO: 3086876 - protein, 24 aa, Giardia lamblia
EVDALLFTARARALMVYAACEPVL

SEQ ID NO: 3086877 - protein, 18 aa, Giardia lamblia
EVDAPYFAPSFRGLTSFV

SEQ ID NO: 3086878 - protein, 23 aa, Giardia lamblia
EVDPRVRMLLKYGTDKAHPYALT

SEQ ID NO: 3086879 - protein, 34 aa, Giardia lamblia
EVFHLSFASLLVFLLVFAVLLFVLCSQHATTSAI

SEQ ID NO: 3086880 - protein, 32 aa, Giardia lamblia
EVFRPAAYLWRCIYIFASLLDRELSSPDIGFG

SEQ ID NO: 3086881 - protein, 21 aa, Giardia lamblia
EVIHYNACALIPPYCAIQIQN

SEQ ID NO: 3086882 - protein, 18 aa, Giardia lamblia
EVILSFWAGAGAAVQQAA

SEQ ID NO: 3086883 - protein, 24 aa, Giardia lamblia
EVIPTLKGLYSSGAFEAACMYSAL

SEQ ID NO: 3086884 - protein, 34 aa, Giardia lamblia
EVLADKLYFVTGRLLTMLSSLPLLDALRHEFKLT

SEQ ID NO: 3086885 - protein, 20 aa, Giardia lamblia
EVLAYLFYVVYCHRDSYSIQ

SEQ ID NO: 3086886 - protein, 31 aa, Giardia lamblia
EVLFQSIARLFLHTLPHLLFNFGTDVEDPAQ

SEQ ID NO: 3086887 - protein, 26 aa, Giardia lamblia
EVPELLQAILPNWSSKRRYSLCESIY

SEQ ID NO: 3086888 - protein, 20 aa, Giardia lamblia
EVPRLLLLASGPLALATPQP

SEQ ID NO: 3086889 - protein, 23 aa, Giardia lamblia
EVQSLLLNPPLKQSLRQNTATAY

SEQ ID NO: 3086890 - protein, 30 aa, Giardia lamblia
EVRILSRLLHPFIVKYYYSWIETTSDTVQN

SEQ ID NO: 3086891 - protein, 27 aa, Giardia lamblia
EVRKRFQTIYLYDTYLCQLLAVEVDYS

SEQ ID NO: 3086892 - protein, 18 aa, Giardia lamblia
EVRMILTRKLQKTAIYRL

SEQ ID NO: 3086893 - protein, 23 aa, Giardia lamblia
EVRQILVALALLEGLYIGFGQLF

SEQ ID NO: 3086894 - protein, 19 aa, Giardia lamblia
EVSNFFYGGLYGPYPLINS

SEQ ID NO: 3086895 - protein, 25 aa, Giardia lamblia
EVSVKDLFFSIQNNLGKIKDMCLAA

SEQ ID NO: 3086896 - protein, 27 aa, Giardia lamblia
EVSVTRPFPFLTYFGPRSDLAALSRIL

SEQ ID NO: 3086897 - protein, 25 aa, Giardia lamblia
EVTGDYYFLCLQNYTGLNATIMRDY

SEQ ID NO: 3086898 - protein, 18 aa, Giardia lamblia
EVVSWIAPASIGFTPASI

SEQ ID NO: 3086899 - protein, 35 aa, Giardia lamblia
EVVWRVAAYLSSALYYFLFQFQKKSICAIFKRFIT

SEQ ID NO: 3086900 - protein, 17 aa, Giardia lamblia
EWCLIIRQDDRLSVYEL

SEQ ID NO: 3086901 - protein, 17 aa, Giardia lamblia
EWIAYHMSLFFKHTKRL

SEQ ID NO: 3086902 - protein, 25 aa, Giardia lamblia
EYANDYAFLCQLASEFDFRMMTNYA

SEQ ID NO: 3086903 - protein, 25 aa, Giardia lamblia
EYCAECFPGYYWGGAFNRHCVPCAA

SEQ ID NO: 3086904 - protein, 26 aa, Giardia lamblia
EYCIYKNLILVFVNGLFSGQCLFTSQ

SEQ ID NO: 3086905 - protein, 17 aa, Giardia lamblia
EYCVRHLRYWINMQDKY

SEQ ID NO: 3086906 - protein, 18 aa, Giardia lamblia
EYEREFLLSLALKTALPI

SEQ ID NO: 3086907 - protein, 21 aa, Giardia lamblia
EYEYKWDAFKIPLEKDTRGFF

SEQ ID NO: 3086908 - protein, 19 aa, Giardia lamblia
EYFYVYTTMLLAHMCKLIT

SEQ ID NO: 3086909 - protein, 28 aa, Giardia lamblia
EYGIETAPVPFYWWRNGRVYYDEGLVAV

SEQ ID NO: 3086910 - protein, 34 aa, Giardia lamblia
EYGISHFNILHSFTTFTRITSFMGLSLKNVEYDQ

SEQ ID NO: 3086911 - protein, 25 aa, Giardia lamblia
EYIMPFGVLVIMILYTASLVLVAVV

SEQ ID NO: 3086912 - protein, 23 aa, Giardia lamblia
EYKPITMLVGMLVTLSSAALLSL

SEQ ID NO: 3086913 - protein, 25 aa, Giardia lamblia
EYLRFCMPILLDRLPHCFTILTYSM

SEQ ID NO: 3086914 - protein, 32 aa, Giardia lamblia
EYLVDPLLQWLPLYEILKLAALLWIALGNGST

SEQ ID NO: 3086915 - protein, 18 aa, Giardia lamblia
EYLYRVKALIPKLATTDS

SEQ ID NO: 3086916 - protein, 19 aa, Giardia lamblia
EYMIRFYPKPVLSFFSLAY

SEQ ID NO: 3086917 - protein, 29 aa, Giardia lamblia
EYMVPNCVILYYFLTKAPFIHVLGRMANL

SEQ ID NO: 3086918 - protein, 24 aa, Giardia lamblia
EYNNQFWINIQYKTTKRLITTRRF

SEQ ID NO: 3086919 - protein, 20 aa, Giardia lamblia
EYNQFTLVPIRLLAIDVARN

SEQ ID NO: 3086920 - protein, 18 aa, Giardia lamblia
EYPHLRRYSEITMLMDEL

SEQ ID NO: 3086921 - protein, 31 aa, Giardia lamblia
EYPWSGARAIQLLLFLMQLKSVANTKGEVSS

SEQ ID NO: 3086922 - protein, 17 aa, Giardia lamblia
EYRLQRHDGKTALMLAI

SEQ ID NO: 3086923 - protein, 23 aa, Giardia lamblia
EYRYPSNIFVPAYAIFLEEFVKL

SEQ ID NO: 3086924 - protein, 31 aa, Giardia lamblia
EYVEVFLRYALICLLICSIHLLLSASRLADY

SEQ ID NO: 3086925 - protein, 36 aa, Giardia lamblia
EYVLDQFFLWVPYYELFKSLYFYWLGQHDFSCALLL

SEQ ID NO: 3086926 - protein, 32 aa, Giardia lamblia
EYWLNTPFLVNWYTLTMYHFSILSVSIFLSSF

SEQ ID NO: 3086927 - protein, 19 aa, Giardia lamblia
FACLADCIVKLFTYYFNYT

SEQ ID NO: 3086928 - protein, 36 aa, Giardia lamblia
FADKRTRLYSVFRYDLIVLFFKLQRLCYDSLKAILD

SEQ ID NO: 3086929 - protein, 24 aa, Giardia lamblia
FAEGYNLSFFLEDSDDWKKASGEY

SEQ ID NO: 3086930 - protein, 20 aa, Giardia lamblia
FAEWKFLEVYPLFSLFVSVN

SEQ ID NO: 3086931 - protein, 19 aa, Giardia lamblia
FAFICYLVKQLLTAEDITA

SEQ ID NO: 3086932 - protein, 33 aa, Giardia lamblia
FAFITALLAYLHKALTLLLSYASTRMLNLVSKL

SEQ ID NO: 3086933 - protein, 24 aa, Giardia lamblia
FAGDASRYFLSCVKIAYILRKLSQ

SEQ ID NO: 3086934 - protein, 30 aa, Giardia lamblia
FAGLEIHLLSTPYLLPISSDLELALDLNMD

SEQ ID NO: 3086935 - protein, 21 aa, Giardia lamblia
FAIFPFIRPLLYEHCAWFKDV

SEQ ID NO: 3086936 - protein, 22 aa, Giardia lamblia
FAIYRNHHGLLDLLLKVAQSVE

SEQ ID NO: 3086937 - protein, 22 aa, Giardia lamblia
FAKRLLVSILDLQPISKLKAFV

SEQ ID NO: 3086938 - protein, 17 aa, Giardia lamblia
FALTEYYLEYFFCSWKR

SEQ ID NO: 3086939 - protein, 23 aa, Giardia lamblia
FAMPILIISVMFKRQIRWGSRTY

SEQ ID NO: 3086940 - protein, 20 aa, Giardia lamblia
FAPLICDQALHMCICPNNLI

SEQ ID NO: 3086941 - protein, 26 aa, Giardia lamblia
FAPYGGSFLCLCLNGLAVGYLAPQRL

SEQ ID NO: 3086942 - protein, 17 aa, Giardia lamblia
FAQLMMYPPWYGIFYNL

SEQ ID NO: 3086943 - protein, 28 aa, Giardia lamblia
FARDFIAIFPDLFYNIALIALRASDYSI

SEQ ID NO: 3086944 - protein, 25 aa, Giardia lamblia
FATGGELFYHLKKIGRFPEPLAVFY

SEQ ID NO: 3086945 - protein, 28 aa, Giardia lamblia
FAVALNTMALVLWVRLNKDVKALNLMIR

SEQ ID NO: 3086946 - protein, 18 aa, Giardia lamblia
FAVVTFLMGFLGNSYASI

SEQ ID NO: 3086947 - protein, 31 aa, Giardia lamblia
FAYRHDFIYVLTHYLLYISPQQSILFNNLFL

SEQ ID NO: 3086948 - protein, 17 aa, Giardia lamblia
FCFSCNDGYYLNAGACP

SEQ ID NO: 3086949 - protein, 21 aa, Giardia lamblia
FCIMTLLRQFIFPLIMMGIMF

SEQ ID NO: 3086950 - protein, 24 aa, Giardia lamblia
FCLPKQCIFKVPRLDGGAEVDTMC

SEQ ID NO: 3086951 - protein, 19 aa, Giardia lamblia
FCLYFVLDGIYHLRLIGVY

SEQ ID NO: 3086952 - protein, 21 aa, Giardia lamblia
FCNTCTMMLPYISSAYITTAY

SEQ ID NO: 3086953 - protein, 17 aa, Giardia lamblia
FCSLYEPWGYTSPECCC

SEQ ID NO: 3086954 - protein, 29 aa, Giardia lamblia
FDALFSLVDLSMIELLLAIDIDRIEQGGP

SEQ ID NO: 3086955 - protein, 30 aa, Giardia lamblia
FDASPAVLLMSIFWVIAGTTLLLSPQLGSP

SEQ ID NO: 3086956 - protein, 19 aa, Giardia lamblia
FDDCCWIYHFITSSYNLPT

SEQ ID NO: 3086957 - protein, 17 aa, Giardia lamblia
FDEFNAHFAHFYRSAEE

SEQ ID NO: 3086958 - protein, 20 aa, Giardia lamblia
FDFLSNFEQWMNCTIGRLSL

SEQ ID NO: 3086959 - protein, 17 aa, Giardia lamblia
FDFVIHPSLYSSSLCVL

SEQ ID NO: 3086960 - protein, 31 aa, Giardia lamblia
FDIITSLFGFVLYLGLPILVGLKIPVLKARR

SEQ ID NO: 3086961 - protein, 18 aa, Giardia lamblia
FDIWSLGCTMYELAAQKY

SEQ ID NO: 3086962 - protein, 22 aa, Giardia lamblia
FDKDLVLIAYPPLPADQHLEEI

SEQ ID NO: 3086963 - protein, 29 aa, Giardia lamblia
FDKDPVSLIFLIINLVDFCLFYVLRELHP

SEQ ID NO: 3086964 - protein, 17 aa, Giardia lamblia
FDMRISEATFAYRRYRV

SEQ ID NO: 3086965 - protein, 18 aa, Giardia lamblia
FDNLLQRPCCIDWSIFYL

SEQ ID NO: 3086966 - protein, 33 aa, Giardia lamblia
FDNQPVIEFLRFLLEHRYFIYDGVLPGSKDKKK

SEQ ID NO: 3086967 - protein, 17 aa, Giardia lamblia
FDPVFPLEKKDFTLLSD

SEQ ID NO: 3086968 - protein, 22 aa, Giardia lamblia
FDTELFLGKRLVFRALDVAWTT

SEQ ID NO: 3086969 - protein, 31 aa, Giardia lamblia
FDTLQIVIIGFTIVLKLFLCLFCHFVGREAK

SEQ ID NO: 3086970 - protein, 19 aa, Giardia lamblia
FDTYMLREAYGAYAATPSR

SEQ ID NO: 3086971 - protein, 28 aa, Giardia lamblia
FECNMDFLMIITLITDRFSTALAYIIAI

SEQ ID NO: 3086972 - protein, 30 aa, Giardia lamblia
FEEGFWNLVLEVVLLLIIIARLVYKARYGG

SEQ ID NO: 3086973 - protein, 17 aa, Giardia lamblia
FEIAATYLYSFMDLAPA

SEQ ID NO: 3086974 - protein, 28 aa, Giardia lamblia
FEIITNLPFPLRMPAAMKLPSLPACDQS

SEQ ID NO: 3086975 - protein, 19 aa, Giardia lamblia
FELCRFDQHFYRLYLDTTE

SEQ ID NO: 3086976 - protein, 27 aa, Giardia lamblia
FENNPPALPPFYPLYTHCGLESHFSYD

SEQ ID NO: 3086977 - protein, 25 aa, Giardia lamblia
FEPFLLGARNLLMSRTVLICMNNRT

SEQ ID NO: 3086978 - protein, 19 aa, Giardia lamblia
FEQLINLRISKARYQCLCG

SEQ ID NO: 3086979 - protein, 25 aa, Giardia lamblia
FESMPRLLSGYIRSLFISAARNDLE

SEQ ID NO: 3086980 - protein, 20 aa, Giardia lamblia
FETTLYFQGLCKLDGYCFED

SEQ ID NO: 3086981 - protein, 25 aa, Giardia lamblia
FEVGIRYFIPFVTIFGALNSPGSAS

SEQ ID NO: 3086982 - protein, 33 aa, Giardia lamblia
FEVLPRPELVYILMKLLIYSLAYDIRTTQPYPV

SEQ ID NO: 3086983 - protein, 23 aa, Giardia lamblia
FEYGRIDFRVLDNGLKRSRLFGF

SEQ ID NO: 3086984 - protein, 26 aa, Giardia lamblia
FEYIDILTNALFFYEYLSAPSKTKHK

SEQ ID NO: 3086985 - protein, 18 aa, Giardia lamblia
FEYLGVSAKLKAGVQTES

SEQ ID NO: 3086986 - protein, 17 aa, Giardia lamblia
FFALATVTYSKAKSSSI

SEQ ID NO: 3086987 - protein, 36 aa, Giardia lamblia
FFCNIFINYITLFLSTPLFLIVVIYGIYSLSLFILF

SEQ ID NO: 3086988 - protein, 19 aa, Giardia lamblia
FFDNPMLPLENNTLAYDVH

SEQ ID NO: 3086989 - protein, 35 aa, Giardia lamblia
FFDSTLDILTLISFAFEYLVDQLLLTAPVVYKTKP

SEQ ID NO: 3086990 - protein, 49 aa, Giardia lamblia
FFEIVRLFFTTRVGRILLLIMSIILLIIFVPLFVRLCPLCVRCFMCCCK

SEQ ID NO: 3086991 - protein, 17 aa, Giardia lamblia
FFINRVRDNLHIVLCLS

SEQ ID NO: 3086992 - protein, 18 aa, Giardia lamblia
FFKDRFIVDGVWARISIP

SEQ ID NO: 3086993 - protein, 17 aa, Giardia lamblia
FFLMQMLTSLLNTRPDI

SEQ ID NO: 3086994 - protein, 27 aa, Giardia lamblia
FFPTHAFQAMFLISLKTVPFALNNMPS

SEQ ID NO: 3086995 - protein, 22 aa, Giardia lamblia
FFQLNPEYIQMSKLLLGITACV

SEQ ID NO: 3086996 - protein, 17 aa, Giardia lamblia
FFRACQSTFLVLNTATE

SEQ ID NO: 3086997 - protein, 20 aa, Giardia lamblia
FFSNRPRYFYSLVFSDSQVL

SEQ ID NO: 3086998 - protein, 20 aa, Giardia lamblia
FFSQFFTAVALLQIFRALKV

SEQ ID NO: 3086999 - protein, 21 aa, Giardia lamblia
FFVVSIFYRQVILPILCLPFI

SEQ ID NO: 3087000 - protein, 18 aa, Giardia lamblia
FFYMSRFTQIQFPPGYAL

SEQ ID NO: 3087001 - protein, 27 aa, Giardia lamblia
FGANILTIWIFILCYILVLKRRSESLL

SEQ ID NO: 3087002 - protein, 18 aa, Giardia lamblia
FGCACSEGFLAVSTGEQC

SEQ ID NO: 3087003 - protein, 19 aa, Giardia lamblia
FGDIPMKLLKLLDQSSTTA

SEQ ID NO: 3087004 - protein, 27 aa, Giardia lamblia
FGEARMPLHLPVKRLLKDPSATSIKTY

SEQ ID NO: 3087005 - protein, 18 aa, Giardia lamblia
FGEPLISYFLQAQAYDGG

SEQ ID NO: 3087006 - protein, 17 aa, Giardia lamblia
FGERMIAALLLPARIRP

SEQ ID NO: 3087007 - protein, 19 aa, Giardia lamblia
FGFDLMNQLLRNFDYRLNR

SEQ ID NO: 3087008 - protein, 36 aa, Giardia lamblia
FGGFLSVLVLTFVLMLCIILLHRYYLNSVSTASLKY

SEQ ID NO: 3087009 - protein, 17 aa, Giardia lamblia
FGIISIQAIRVIGLYLC

SEQ ID NO: 3087010 - protein, 18 aa, Giardia lamblia
FGINGSIGAYFPFGLCYD

SEQ ID NO: 3087011 - protein, 19 aa, Giardia lamblia
FGKIDPLLRACVAMSCYDG

SEQ ID NO: 3087012 - protein, 17 aa, Giardia lamblia
FGKIKYTPTLLSYLNRT

SEQ ID NO: 3087013 - protein, 23 aa, Giardia lamblia
FGLNKVCPSLLLELARNASGMLF

SEQ ID NO: 3087014 - protein, 18 aa, Giardia lamblia
FGMCILNTTQSSEPYCKC

SEQ ID NO: 3087015 - protein, 20 aa, Giardia lamblia
FGMSFPRMYKGKAGVTWITE

SEQ ID NO: 3087016 - protein, 36 aa, Giardia lamblia
FGPDLISSWPHYLWIALWGILIGTAITLLIVLGGMK

SEQ ID NO: 3087017 - protein, 26 aa, Giardia lamblia
FGPLIDLFTHRVVLLPSIEGSDGCRK

SEQ ID NO: 3087018 - protein, 18 aa, Giardia lamblia
FGPNFKLYGIVLGVFFMA

SEQ ID NO: 3087019 - protein, 18 aa, Giardia lamblia
FGSFKRHRCTLPHELLEL

SEQ ID NO: 3087020 - protein, 27 aa, Giardia lamblia
FGSLRCFRHMYYLTQIVKPCPSTLCSL

SEQ ID NO: 3087021 - protein, 24 aa, Giardia lamblia
FGSVLCPVHFYIESPDALMMYFPL

SEQ ID NO: 3087022 - protein, 24 aa, Giardia lamblia
FGSYYKIMFGLGVFLTPFSIGFGN

SEQ ID NO: 3087023 - protein, 18 aa, Giardia lamblia
FGVDLIAITRILRYPNAE

SEQ ID NO: 3087024 - protein, 24 aa, Giardia lamblia
FGVQRALQMMRIPFIKKLQETRQQ

SEQ ID NO: 3087025 - protein, 28 aa, Giardia lamblia
FGYGRSIEEVYLLRSIIYFNLCRNGVVT

SEQ ID NO: 3087026 - protein, 30 aa, Giardia lamblia
FHCNFQAYLSFIIRYFLYLDDRIENALETA

SEQ ID NO: 3087027 - protein, 36 aa, Giardia lamblia
FHKSHLLPIAIVTVYLWMYYDLPPSNGTILKDQDIN

SEQ ID NO: 3087028 - protein, 23 aa, Giardia lamblia
FHLESLSFYLPLVNFKASMNSIK

SEQ ID NO: 3087029 - protein, 25 aa, Giardia lamblia
FHNDHIAALPYLLRCLRDRAVKEGK

SEQ ID NO: 3087030 - protein, 21 aa, Giardia lamblia
FHNVLTYNFYNAIYVLAAEVD

SEQ ID NO: 3087031 - protein, 18 aa, Giardia lamblia
FHRMQFVIYKIVSLTNSR

SEQ ID NO: 3087032 - protein, 18 aa, Giardia lamblia
FHRPTNILAIFLAIGVMS

SEQ ID NO: 3087033 - protein, 31 aa, Giardia lamblia
FHTKPGVFSPFYYLYCLWISPTLIGQQNKQQ

SEQ ID NO: 3087034 - protein, 25 aa, Giardia lamblia
FIAINVISFYRFTSALETFLLTCCV

SEQ ID NO: 3087035 - protein, 25 aa, Giardia lamblia
FIATFHGILIKPAFPMRIKHHVIYA

SEQ ID NO: 3087036 - protein, 25 aa, Giardia lamblia
FICDTFVLSYRRTVALHRFLSLVEL

SEQ ID NO: 3087037 - protein, 21 aa, Giardia lamblia
FIDGFLRKRILDPIFRAAREY

SEQ ID NO: 3087038 - protein, 23 aa, Giardia lamblia
FIEGLLLVEYHLPVSILRVISEM

SEQ ID NO: 3087039 - protein, 29 aa, Giardia lamblia
FIFEQIVDALVYLHVPFKPHGVIVNGSLS

SEQ ID NO: 3087040 - protein, 22 aa, Giardia lamblia
FIGIFVLRYYIIADSYYKFCVI

SEQ ID NO: 3087041 - protein, 20 aa, Giardia lamblia
FIGVHLAAYVYYEILEHVIM

SEQ ID NO: 3087042 - protein, 17 aa, Giardia lamblia
FIGYFVPQTYILNLVAN

SEQ ID NO: 3087043 - protein, 20 aa, Giardia lamblia
FIIAVVVFLLAYIFSSFPIS

SEQ ID NO: 3087044 - protein, 30 aa, Giardia lamblia
FIKFSHDPRFMLYGMFVLPLKQHIGESKDD

SEQ ID NO: 3087045 - protein, 17 aa, Giardia lamblia
FIKGGNPILFFTEDPIV

SEQ ID NO: 3087046 - protein, 19 aa, Giardia lamblia
FIKSILERIFVLEPERRPT

SEQ ID NO: 3087047 - protein, 23 aa, Giardia lamblia
FILAMPLGCIFIFTRHRLHDGGS

SEQ ID NO: 3087048 - protein, 33 aa, Giardia lamblia
FINICTPFFCAIWNACSLFYLTFTASSNWERLL

SEQ ID NO: 3087049 - protein, 34 aa, Giardia lamblia
FINLPADLRLILYHSLLRLLYKDGERIAYNRAVS

SEQ ID NO: 3087050 - protein, 26 aa, Giardia lamblia
FIPELDLHLFKSVISRILSLSTKQLE

SEQ ID NO: 3087051 - protein, 17 aa, Giardia lamblia
FIPQLPHMATSSHPKAL

SEQ ID NO: 3087052 - protein, 21 aa, Giardia lamblia
FIRAPDYELMYRYMQRFTAFI

SEQ ID NO: 3087053 - protein, 17 aa, Giardia lamblia
FIRFGQELVPYLAQLTL

SEQ ID NO: 3087054 - protein, 28 aa, Giardia lamblia
FIRLMLDMLGFIFLLALRDDSSTQAKQC

SEQ ID NO: 3087055 - protein, 19 aa, Giardia lamblia
FIRNPLFAGISALYNMYFL

SEQ ID NO: 3087056 - protein, 24 aa, Giardia lamblia
FISAMTSLALGYLPGHMRSPCDPY

SEQ ID NO: 3087057 - protein, 24 aa, Giardia lamblia
FISRPKMVLLMTPNVRSLLEYMYD

SEQ ID NO: 3087058 - protein, 28 aa, Giardia lamblia
FISSSWYTLLIDVSLFLLASSGFTIRCI

SEQ ID NO: 3087059 - protein, 17 aa, Giardia lamblia
FIVLIGKDGKCLGTVEG

SEQ ID NO: 3087060 - protein, 20 aa, Giardia lamblia
FIVRDYLVDFLTHIAPRLTN

SEQ ID NO: 3087061 - protein, 23 aa, Giardia lamblia
FIVSSVLLLLMLIGLSSRYPITI

SEQ ID NO: 3087062 - protein, 19 aa, Giardia lamblia
FIVTNLLVLFYIMQKNKKE

SEQ ID NO: 3087063 - protein, 28 aa, Giardia lamblia
FKCVCDPGYVFLPTMNQEKLYGCVPKAC

SEQ ID NO: 3087064 - protein, 25 aa, Giardia lamblia
FKETYLMIVFTIGACLMVGLLGVIY

SEQ ID NO: 3087065 - protein, 18 aa, Giardia lamblia
FKILIYKITRDNFYEAVN

SEQ ID NO: 3087066 - protein, 17 aa, Giardia lamblia
FKKMLRSIFRSPMSFFD

SEQ ID NO: 3087067 - protein, 27 aa, Giardia lamblia
FKQVFEPLKMWLSPYIALPIGKDYGFI

SEQ ID NO: 3087068 - protein, 24 aa, Giardia lamblia
FKRDVYNYRTCYTCELWPYVDMEK

SEQ ID NO: 3087069 - protein, 23 aa, Giardia lamblia
FKRYLDLLNKYYPGWWEFRETQE

SEQ ID NO: 3087070 - protein, 24 aa, Giardia lamblia
FKTDKLFMLILDEADMLLEYGFQQ

SEQ ID NO: 3087071 - protein, 26 aa, Giardia lamblia
FKTRFEPFILVLLHIIKTNIQHSLSI

SEQ ID NO: 3087072 - protein, 17 aa, Giardia lamblia
FKVFGYINLHHELNLCL

SEQ ID NO: 3087073 - protein, 21 aa, Giardia lamblia
FLATFLLPLCYFYISSRNAGE

SEQ ID NO: 3087074 - protein, 20 aa, Giardia lamblia
FLAVSIIRLCSRLKSFVNGS

SEQ ID NO: 3087075 - protein, 17 aa, Giardia lamblia
FLCFTYAFMNLDRPHLL

SEQ ID NO: 3087076 - protein, 19 aa, Giardia lamblia
FLCVVLPHDTHWLTRAAGV

SEQ ID NO: 3087077 - protein, 23 aa, Giardia lamblia
FLDKVLHLHMCLCLSPGTIIAGT

SEQ ID NO: 3087078 - protein, 18 aa, Giardia lamblia
FLDLFRRTCITQCPQNSS

SEQ ID NO: 3087079 - protein, 24 aa, Giardia lamblia
FLENVAIIDVLKWFSSTRTNGSPS

SEQ ID NO: 3087080 - protein, 19 aa, Giardia lamblia
FLESPLVLELLQFVQSALE

SEQ ID NO: 3087081 - protein, 26 aa, Giardia lamblia
FLESYKAPIPQFLSCASVLRSRVLSF

SEQ ID NO: 3087082 - protein, 19 aa, Giardia lamblia
FLESYTLYTLPTILSTTSV

SEQ ID NO: 3087083 - protein, 18 aa, Giardia lamblia
FLFIIGSIFMQSEEQHKE

SEQ ID NO: 3087084 - protein, 17 aa, Giardia lamblia
FLFLAIGEASKAKVSIC

SEQ ID NO: 3087085 - protein, 28 aa, Giardia lamblia
FLGLYDSIAFQWNLYHSLRILGSSSSVS

SEQ ID NO: 3087086 - protein, 18 aa, Giardia lamblia
FLGYAVLQWATLYGINVL

SEQ ID NO: 3087087 - protein, 23 aa, Giardia lamblia
FLHSCDILLQTIKLLNTGIYCQM

SEQ ID NO: 3087088 - protein, 20 aa, Giardia lamblia
FLIVVISVFTLVGAVVLKIY

SEQ ID NO: 3087089 - protein, 18 aa, Giardia lamblia
FLKILISSKVLPFDKNNE

SEQ ID NO: 3087090 - protein, 18 aa, Giardia lamblia
FLKRLGLLMFPYVRFNER

SEQ ID NO: 3087091 - protein, 17 aa, Giardia lamblia
FLLDHGISGILFMNLRN

SEQ ID NO: 3087092 - protein, 18 aa, Giardia lamblia
FLLEALRRLPACRKSWFI

SEQ ID NO: 3087093 - protein, 26 aa, Giardia lamblia
FLLHLVLSMWLVLMGLADFSLEPANT

SEQ ID NO: 3087094 - protein, 17 aa, Giardia lamblia
FLLTFVALTFLFLDPYE

SEQ ID NO: 3087095 - protein, 17 aa, Giardia lamblia
FLLTLIANPFNVIASTD

SEQ ID NO: 3087096 - protein, 17 aa, Giardia lamblia
FLLVLLLHVRDPFLPVL

SEQ ID NO: 3087097 - protein, 17 aa, Giardia lamblia
FLLYVIINDYVDCIFYQ

SEQ ID NO: 3087098 - protein, 24 aa, Giardia lamblia
FLMITLVISLFAAASFSCLTDYDC

SEQ ID NO: 3087099 - protein, 18 aa, Giardia lamblia
FLMQEYVLYLPSGNRMIG

SEQ ID NO: 3087100 - protein, 28 aa, Giardia lamblia
FLMRGMSYAVLFSYALPMSLFVSLELVR

SEQ ID NO: 3087101 - protein, 32 aa, Giardia lamblia
FLNVQLHYRLPAMNYLFNYVKGHLLYQRPELG

SEQ ID NO: 3087102 - protein, 17 aa, Giardia lamblia
FLQSMAGLFSVKFSPNT

SEQ ID NO: 3087103 - protein, 18 aa, Giardia lamblia
FLSPILKANGRLSQSLMV

SEQ ID NO: 3087104 - protein, 23 aa, Giardia lamblia
FLSTIGLLVLGRFYDLAYVSLET

SEQ ID NO: 3087105 - protein, 17 aa, Giardia lamblia
FLSTLRFHIYQDLLQQT

SEQ ID NO: 3087106 - protein, 17 aa, Giardia lamblia
FLSVLLPLKRRLEQYYE

SEQ ID NO: 3087107 - protein, 20 aa, Giardia lamblia
FLTEGKFREFCDTCVTLLNF

SEQ ID NO: 3087108 - protein, 19 aa, Giardia lamblia
FLTSFLFSKSKREWLRGAL

SEQ ID NO: 3087109 - protein, 25 aa, Giardia lamblia
FLVAISYLIMFFVSAATTGHVGGTE

SEQ ID NO: 3087110 - protein, 20 aa, Giardia lamblia
FLVFVLLQTSRIVVPIIFAI

SEQ ID NO: 3087111 - protein, 17 aa, Giardia lamblia
FLVSDKIIRNIAPALMK

SEQ ID NO: 3087112 - protein, 24 aa, Giardia lamblia
FLVSWIPVYLDRISILVPLLTMCV

SEQ ID NO: 3087113 - protein, 29 aa, Giardia lamblia
FLYNCRKQNYLFTIFLPTITSTSSTTGNI

SEQ ID NO: 3087114 - protein, 24 aa, Giardia lamblia
FMDDTRLFYKLKKVLLRAVTKQVQ

SEQ ID NO: 3087115 - protein, 18 aa, Giardia lamblia
FMGEKLARTFPVLPAFNR

SEQ ID NO: 3087116 - protein, 18 aa, Giardia lamblia
FMHELLPLFKQCCTRVHY

SEQ ID NO: 3087117 - protein, 18 aa, Giardia lamblia
FMLQAAMPLFHAFLDVED

SEQ ID NO: 3087118 - protein, 34 aa, Giardia lamblia
FMNLDRPHLLPALKTGWWFATVYESELLYCRTRA

SEQ ID NO: 3087119 - protein, 24 aa, Giardia lamblia
FMNLLDIIALSVVSYIFSLNPLYL

SEQ ID NO: 3087120 - protein, 19 aa, Giardia lamblia
FMNRILYMLIALLEAHITS

SEQ ID NO: 3087121 - protein, 23 aa, Giardia lamblia
FMPVTEICRFLWHQMLSNVRKTS

SEQ ID NO: 3087122 - protein, 18 aa, Giardia lamblia
FMRLNLADFPSDMQSRSN

SEQ ID NO: 3087123 - protein, 25 aa, Giardia lamblia
FMSGTSLMLAAWYGSAECVSILKDS

SEQ ID NO: 3087124 - protein, 33 aa, Giardia lamblia
FNAVDPLRTSMFWFLEVLVLAAIGLAIRFNTIK

SEQ ID NO: 3087125 - protein, 26 aa, Giardia lamblia
FNDKGGHFLVFLMTMDTAMLKLLSVM

SEQ ID NO: 3087126 - protein, 27 aa, Giardia lamblia
FNETNLKWLRRYSCLIFLNTRIKDELS

SEQ ID NO: 3087127 - protein, 20 aa, Giardia lamblia
FNGYYLSYVLWHYISLKMHE

SEQ ID NO: 3087128 - protein, 28 aa, Giardia lamblia
FNHNTLYNVDFLLNLYRSTAATAFTQMG

SEQ ID NO: 3087129 - protein, 21 aa, Giardia lamblia
FNINLLKILINRSLYSHFMNE

SEQ ID NO: 3087130 - protein, 19 aa, Giardia lamblia
FNIWNTDVPVLRTISRFLA

SEQ ID NO: 3087131 - protein, 21 aa, Giardia lamblia
FNKSCFWCYTVQTISVRNPSV

SEQ ID NO: 3087132 - protein, 30 aa, Giardia lamblia
FNLKYRAELLEFWHGLLLAYNVRCSPLETI

SEQ ID NO: 3087133 - protein, 22 aa, Giardia lamblia
FNSLTKMNFLRTINTLICAMND

SEQ ID NO: 3087134 - protein, 19 aa, Giardia lamblia
FNSSLARFASAMPYLLMAF

SEQ ID NO: 3087135 - protein, 25 aa, Giardia lamblia
FNTELWDAVLYIICSYLGDAQAFLA

SEQ ID NO: 3087136 - protein, 17 aa, Giardia lamblia
FNTVILAIPLSLAVSCN

SEQ ID NO: 3087137 - protein, 26 aa, Giardia lamblia
FNVCLIITLLMGAKFVFQHPIVESKL

SEQ ID NO: 3087138 - protein, 25 aa, Giardia lamblia
FNVHALLVKIFKITGLQKIARHIIK

SEQ ID NO: 3087139 - protein, 21 aa, Giardia lamblia
FNVIQICPFCQIMYAYINIVG

SEQ ID NO: 3087140 - protein, 19 aa, Giardia lamblia
FNVPYAYGLKPIGYGMLLG

SEQ ID NO: 3087141 - protein, 30 aa, Giardia lamblia
FNVVSTPFIALLFPAFTFDGAVSNFVGWMI

SEQ ID NO: 3087142 - protein, 22 aa, Giardia lamblia
FNYAIEFFRYIRHAAATILSVS

SEQ ID NO: 3087143 - protein, 43 aa, Giardia lamblia
FPAQIFTFINYLITKYFLFSVLTLLRIPDLLLGLLKLMITKDP

SEQ ID NO: 3087144 - protein, 27 aa, Giardia lamblia
FPDFYNTLRVFPFRTSLTPFLTAISGD

SEQ ID NO: 3087145 - protein, 24 aa, Giardia lamblia
FPDILSVSLWIACPAVIFIVTNLL

SEQ ID NO: 3087146 - protein, 20 aa, Giardia lamblia
FPDTLALTVLSKYIIHTLKT

SEQ ID NO: 3087147 - protein, 28 aa, Giardia lamblia
FPEQGVLCYWRLIIKSLSLVFQEQVEDA

SEQ ID NO: 3087148 - protein, 36 aa, Giardia lamblia
FPFSTTGFYFLFNLVYIILLILTQSVSIGPIGLHVI

SEQ ID NO: 3087149 - protein, 33 aa, Giardia lamblia
FPHIEPTMFYLVTVSLLFVTALGLNVCYKYLLR

SEQ ID NO: 3087150 - protein, 26 aa, Giardia lamblia
FPHSFDSMILPSVPLPEPCPHVANND

SEQ ID NO: 3087151 - protein, 23 aa, Giardia lamblia
FPNPLLTTLFLSATILLFVWTLL

SEQ ID NO: 3087152 - protein, 19 aa, Giardia lamblia
FPNPMFIYAPAHTVPWMAF

SEQ ID NO: 3087153 - protein, 29 aa, Giardia lamblia
FPQFGVCILLFLGLLLLLAELTGSVEIAI

SEQ ID NO: 3087154 - protein, 17 aa, Giardia lamblia
FPSLLDSQMHFAYKSDA

SEQ ID NO: 3087155 - protein, 18 aa, Giardia lamblia
FPSRGTLPPLLSDSAHIS

SEQ ID NO: 3087156 - protein, 20 aa, Giardia lamblia
FPTIYRTNCQPWRYWFEFVT

SEQ ID NO: 3087157 - protein, 17 aa, Giardia lamblia
FQCGVVTDLLVDGHCLA

SEQ ID NO: 3087158 - protein, 22 aa, Giardia lamblia
FQDLLQLHAFIAINVISFYRFT

SEQ ID NO: 3087159 - protein, 18 aa, Giardia lamblia
FQFPCINLLLSTIVRHTE

SEQ ID NO: 3087160 - protein, 20 aa, Giardia lamblia
FQGYTYVLEALYYAALKDEY

SEQ ID NO: 3087161 - protein, 23 aa, Giardia lamblia
FQKLGLRLEIFSTLALSFSDNIL

SEQ ID NO: 3087162 - protein, 39 aa, Giardia lamblia
FQKVQPIIEPWLPSVTAFFKRLCIVTFKKSCKVSDELAG

SEQ ID NO: 3087163 - protein, 18 aa, Giardia lamblia
FQLAVTNPLQFRKMFPIF

SEQ ID NO: 3087164 - protein, 28 aa, Giardia lamblia
FQPPITMRGIVLLALKHSFLSYQSTIFM

SEQ ID NO: 3087165 - protein, 25 aa, Giardia lamblia
FQQELEAILRMLPGPKLRQVCFFSA

SEQ ID NO: 3087166 - protein, 19 aa, Giardia lamblia
FQVNALVVTLALLAAAHNT

SEQ ID NO: 3087167 - protein, 21 aa, Giardia lamblia
FRAVSMVVPDYSLIAEIILFS

SEQ ID NO: 3087168 - protein, 21 aa, Giardia lamblia
FREAWVWIVINLVAQLLTAFF

SEQ ID NO: 3087169 - protein, 19 aa, Giardia lamblia
FRFAMPLRRQDLDPPLLVA

SEQ ID NO: 3087170 - protein, 17 aa, Giardia lamblia
FRGVYADTGLKFIQMKR

SEQ ID NO: 3087171 - protein, 18 aa, Giardia lamblia
FRIHSVGYAFLSMLATIV

SEQ ID NO: 3087172 - protein, 25 aa, Giardia lamblia
FRKSCLRLRSFFSDNLLIVDPDEQK

SEQ ID NO: 3087173 - protein, 26 aa, Giardia lamblia
FRLLSVIFILMTALFSFSRDVLHRVQ

SEQ ID NO: 3087174 - protein, 26 aa, Giardia lamblia
FRLQSPGTCLFWHEARSRLYIGHASG

SEQ ID NO: 3087175 - protein, 20 aa, Giardia lamblia
FRNHFYFILGTAGIGLYCTW

SEQ ID NO: 3087176 - protein, 39 aa, Giardia lamblia
FRNHGYFYIMLLVVTIYISLLILCSLVLVGFLVYDFITI

SEQ ID NO: 3087177 - protein, 18 aa, Giardia lamblia
FRNVAADRLLWTIRSRKR

SEQ ID NO: 3087178 - protein, 20 aa, Giardia lamblia
FRQFFHLDMPVFVSWSPISD

SEQ ID NO: 3087179 - protein, 17 aa, Giardia lamblia
FRQFLKEDTPLISLPTG

SEQ ID NO: 3087180 - protein, 17 aa, Giardia lamblia
FRRGIFYSILIVAIGIC

SEQ ID NO: 3087181 - protein, 24 aa, Giardia lamblia
FRRYKEYFTLVLALAARNTDIAKQ

SEQ ID NO: 3087182 - protein, 19 aa, Giardia lamblia
FRSDYLLHYVKTMSPPDNT

SEQ ID NO: 3087183 - protein, 22 aa, Giardia lamblia
FRSRYRVTLPTSVKFIENEDNL

SEQ ID NO: 3087184 - protein, 20 aa, Giardia lamblia
FSADVRSLLRAALDLRFDEI

SEQ ID NO: 3087185 - protein, 38 aa, Giardia lamblia
FSAKILVLAILFPGFATFFFNIMLPPHVSLHKLENRTA

SEQ ID NO: 3087186 - protein, 23 aa, Giardia lamblia
FSAKQMYLMEYLATLFHLDAHER

SEQ ID NO: 3087187 - protein, 29 aa, Giardia lamblia
FSALIKRLCSITLIPLAFFEEAKAILQQI

SEQ ID NO: 3087188 - protein, 30 aa, Giardia lamblia
FSANIYLCFLSLFFTSYIGLAQLLFERVSD

SEQ ID NO: 3087189 - protein, 29 aa, Giardia lamblia
FSANPILCALYMIIKHLLKRESLYCPGDT

SEQ ID NO: 3087190 - protein, 17 aa, Giardia lamblia
FSASAIVKILFAWCFRM

SEQ ID NO: 3087191 - protein, 26 aa, Giardia lamblia
FSATSSRILMLKALYARLLEHKETLD

SEQ ID NO: 3087192 - protein, 25 aa, Giardia lamblia
FSCICKFFFSEGFSNSIFWSDYDED

SEQ ID NO: 3087193 - protein, 24 aa, Giardia lamblia
FSCKRFVQLILYEGSAIFSTKLMT

SEQ ID NO: 3087194 - protein, 18 aa, Giardia lamblia
FSCRCLSGFVQLTDGHCT

SEQ ID NO: 3087195 - protein, 25 aa, Giardia lamblia
FSDHGLLIFHLPELAPIITADKFFF

SEQ ID NO: 3087196 - protein, 24 aa, Giardia lamblia
FSDKFNSHLPLYNYARQIAASCPT

SEQ ID NO: 3087197 - protein, 19 aa, Giardia lamblia
FSFAMLLNYTAYPNANKRS

SEQ ID NO: 3087198 - protein, 34 aa, Giardia lamblia
FSGISYNRLILFYVRQFIFGLAWSLSCQLPLAER

SEQ ID NO: 3087199 - protein, 30 aa, Giardia lamblia
FSGKTTLLKLAYALLPQNIVSLTSFRVPCG

SEQ ID NO: 3087200 - protein, 19 aa, Giardia lamblia
FSGLDGYIGIIPFEVSQKK

SEQ ID NO: 3087201 - protein, 18 aa, Giardia lamblia
FSISYRLRDLIAIALSYK

SEQ ID NO: 3087202 - protein, 25 aa, Giardia lamblia
FSITAVIVVILLIVAVLPSLLIKDS

SEQ ID NO: 3087203 - protein, 26 aa, Giardia lamblia
FSKARELIFRALSSLRSSFASSVLAK

SEQ ID NO: 3087204 - protein, 18 aa, Giardia lamblia
FSKLLYLSDTCEPSALLR

SEQ ID NO: 3087205 - protein, 22 aa, Giardia lamblia
FSLAVFSLVKTLGSLSSMVINT

SEQ ID NO: 3087206 - protein, 20 aa, Giardia lamblia
FSLNPSLFTKLPAADPLLLQ

SEQ ID NO: 3087207 - protein, 19 aa, Giardia lamblia
FSLVYSSLIVSILYGYVYS

SEQ ID NO: 3087208 - protein, 28 aa, Giardia lamblia
FSMAPDLRGWRILRSTFYYYLVCCKVCV

SEQ ID NO: 3087209 - protein, 17 aa, Giardia lamblia
FSMIFVIVIGSISFYLL

SEQ ID NO: 3087210 - protein, 20 aa, Giardia lamblia
FSMLNVLFQANVLLFVIQLL

SEQ ID NO: 3087211 - protein, 18 aa, Giardia lamblia
FSMTLGNRFLLNNRFTNL

SEQ ID NO: 3087212 - protein, 29 aa, Giardia lamblia
FSNKSRPSPLTFFLLVTAGCFTICMCVIM

SEQ ID NO: 3087213 - protein, 25 aa, Giardia lamblia
FSNSKMLLPLLGIALKILSLQIDSH

SEQ ID NO: 3087214 - protein, 28 aa, Giardia lamblia
FSNVSLTYWPELLIASLTYQRSVTQGEP

SEQ ID NO: 3087215 - protein, 37 aa, Giardia lamblia
FSNVYQYLVPFWIYVSVPLLGFFALAILSIVHLHWSD

SEQ ID NO: 3087216 - protein, 18 aa, Giardia lamblia
FSSINIVGVIRSIFASTS

SEQ ID NO: 3087217 - protein, 22 aa, Giardia lamblia
FSSISVPFWSMEQPNLLTFTCP

SEQ ID NO: 3087218 - protein, 17 aa, Giardia lamblia
FSSVLCSLFFQLLFLLS

SEQ ID NO: 3087219 - protein, 23 aa, Giardia lamblia
FSTDFLVLYRKSTPIDMTALQNT

SEQ ID NO: 3087220 - protein, 22 aa, Giardia lamblia
FSTKPLIFQYSTSTLIVYASIF

SEQ ID NO: 3087221 - protein, 24 aa, Giardia lamblia
FSTLQLTVFNFADLGIVLNPQSVE

SEQ ID NO: 3087222 - protein, 27 aa, Giardia lamblia
FSTREFRLLMLFYDSLQTLLSISASYS

SEQ ID NO: 3087223 - protein, 24 aa, Giardia lamblia
FSTVYLHFTPALYPKRYILHQGTT

SEQ ID NO: 3087224 - protein, 30 aa, Giardia lamblia
FSVEFLKMLALKNTLFSYGRRLTPPEAFVT

SEQ ID NO: 3087225 - protein, 19 aa, Giardia lamblia
FSVGLLIRCLFAGVIAEQV

SEQ ID NO: 3087226 - protein, 30 aa, Giardia lamblia
FSVLRNNNSGFYLGIYARQYIVLRIEISDV

SEQ ID NO: 3087227 - protein, 21 aa, Giardia lamblia
FSVNTILPYPISPGTHDYLMS

SEQ ID NO: 3087228 - protein, 33 aa, Giardia lamblia
FSVQSELLVLLTPTALLAMMHFIGTFSMPASKS

SEQ ID NO: 3087229 - protein, 27 aa, Giardia lamblia
FSVSSNTRLFFYPNGSYYNLNGVIYPD

SEQ ID NO: 3087230 - protein, 25 aa, Giardia lamblia
FSWKLHFFYEFRAWFGTVIVLSILV

SEQ ID NO: 3087231 - protein, 19 aa, Giardia lamblia
FSWLVYRMIDRFLNQKSLA

SEQ ID NO: 3087232 - protein, 20 aa, Giardia lamblia
FSYDGLMLYAVNSIGYIVLF

SEQ ID NO: 3087233 - protein, 26 aa, Giardia lamblia
FSYDPKLPFFQIYVNTLDSVRYSHLI

SEQ ID NO: 3087234 - protein, 18 aa, Giardia lamblia
FTAFLRALNNLQSGAYRT

SEQ ID NO: 3087235 - protein, 17 aa, Giardia lamblia
FTAIMTLIGLILALLST

SEQ ID NO: 3087236 - protein, 38 aa, Giardia lamblia
FTALMHAVISGHYLIVKLLLDYEAYFSTTQLSTWPAGC

SEQ ID NO: 3087237 - protein, 24 aa, Giardia lamblia
FTASSVFLALRFISEITAPTIINI

SEQ ID NO: 3087238 - protein, 17 aa, Giardia lamblia
FTATYPMSGISVTMPIK

SEQ ID NO: 3087239 - protein, 27 aa, Giardia lamblia
FTDAHACQRLLNLLKNLGMKAIRSTSS

SEQ ID NO: 3087240 - protein, 21 aa, Giardia lamblia
FTDPLVLDPQIPLSSTQLGSQ

SEQ ID NO: 3087241 - protein, 23 aa, Giardia lamblia
FTEVPFLLSVVEDLLFHIATAAV

SEQ ID NO: 3087242 - protein, 34 aa, Giardia lamblia
FTGELTTGYICRCGYPYQLVGTAKCLPLNCVSTQ

SEQ ID NO: 3087243 - protein, 17 aa, Giardia lamblia
FTGIPHCAVCAADRARA

SEQ ID NO: 3087244 - protein, 19 aa, Giardia lamblia
FTILACFLIQRSYTQKFIV

SEQ ID NO: 3087245 - protein, 32 aa, Giardia lamblia
FTISVATLALLLQIYLVLLKHNLLNSVLGDIS

SEQ ID NO: 3087246 - protein, 41 aa, Giardia lamblia
FTIVISTLLFLRMLIYFNSFINFTLTNFNYFKTFFLGEFKD

SEQ ID NO: 3087247 - protein, 19 aa, Giardia lamblia
FTIVPLEPCYKFLEDRRLM

SEQ ID NO: 3087248 - protein, 23 aa, Giardia lamblia
FTKYILAELKFVSSLILSATTTP

SEQ ID NO: 3087249 - protein, 26 aa, Giardia lamblia
FTLGFSFLMTYRLQRLALSLHWEDEL

SEQ ID NO: 3087250 - protein, 19 aa, Giardia lamblia
FTLSVLRKDAQLFTYSISK

SEQ ID NO: 3087251 - protein, 19 aa, Giardia lamblia
FTLSYMRFLRDRNDQLYRA

SEQ ID NO: 3087252 - protein, 19 aa, Giardia lamblia
FTNLFKPLNLNNYYFFKII

SEQ ID NO: 3087253 - protein, 26 aa, Giardia lamblia
FTNLVVPLVIAFWNACSLFVTTYDDG

SEQ ID NO: 3087254 - protein, 18 aa, Giardia lamblia
FTPLSPFLLSKEYCPSVV

SEQ ID NO: 3087255 - protein, 26 aa, Giardia lamblia
FTPYDVPEVMLLPLPLELASGNYKSR

SEQ ID NO: 3087256 - protein, 19 aa, Giardia lamblia
FTQSFISRLLLTSNSRHIA

SEQ ID NO: 3087257 - protein, 24 aa, Giardia lamblia
FTQSSFFHPLPAMALLAVISSLTT

SEQ ID NO: 3087258 - protein, 17 aa, Giardia lamblia
FTRGPYKSLPSGPVAEK

SEQ ID NO: 3087259 - protein, 19 aa, Giardia lamblia
FTRLALYTLLSGSSGTIIG

SEQ ID NO: 3087260 - protein, 32 aa, Giardia lamblia
FTSLATLIFSSLLFRWHPLYNSICVSRLIMGI

SEQ ID NO: 3087261 - protein, 17 aa, Giardia lamblia
FTSLFSHMSHHKWNATR

SEQ ID NO: 3087262 - protein, 28 aa, Giardia lamblia
FTSLLNSSYLFVVPLKAATVITDLETAF

SEQ ID NO: 3087263 - protein, 22 aa, Giardia lamblia
FTSLLYEISILTVPNYIYIQHP

SEQ ID NO: 3087264 - protein, 19 aa, Giardia lamblia
FTSTYTLSIPVCTYTYGCW

SEQ ID NO: 3087265 - protein, 25 aa, Giardia lamblia
FTSVRYRLFRDILISLSNTLSDIIE

SEQ ID NO: 3087266 - protein, 25 aa, Giardia lamblia
FTSVYHMVLFLSVCTYLWGPISFLL

SEQ ID NO: 3087267 - protein, 17 aa, Giardia lamblia
FTTVLPLLAFAGGFFCN

SEQ ID NO: 3087268 - protein, 17 aa, Giardia lamblia
FVAMLWVPALRGLDSAM

SEQ ID NO: 3087269 - protein, 26 aa, Giardia lamblia
FVAYAWAYILLSLFMTLSVAFLCTLL

SEQ ID NO: 3087270 - protein, 17 aa, Giardia lamblia
FVDKYRAMLAQLSTIKS

SEQ ID NO: 3087271 - protein, 24 aa, Giardia lamblia
FVERLYEALAYMLSLTDTTATGYS

SEQ ID NO: 3087272 - protein, 71 aa, Giardia lamblia
FVFDIQYRVQVVLYIRLTLLKYTLISPIFVAWLTTIRMLRIRKTFLLLTYDKLLITAFYRWSDLARGRHKL

SEQ ID NO: 3087273 - protein, 25 aa, Giardia lamblia
FVFGSLILMEALNLVKLRLVSRSSR

SEQ ID NO: 3087274 - protein, 22 aa, Giardia lamblia
FVFWELKHPFAILPRAILTNKK

SEQ ID NO: 3087275 - protein, 26 aa, Giardia lamblia
FVGAIQSLLLSLKYLGGAIPEGIWGA

SEQ ID NO: 3087276 - protein, 30 aa, Giardia lamblia; identical to SEQ ID NO: 3071995

SEQ ID NO: 3087277 - protein, 32 aa, Giardia lamblia
FVHYLNLCMVGITLLIMICFKVIDLEAVPNFQ

SEQ ID NO: 3087278 - protein, 19 aa, Giardia lamblia
FVIDIIFANELLKSGRPLL

SEQ ID NO: 3087279 - protein, 24 aa, Giardia lamblia
FVIDTPILMCIIIPDNFDCTAPEL

SEQ ID NO: 3087280 - protein, 18 aa, Giardia lamblia
FVIILIIPVTILTYWVFT

SEQ ID NO: 3087281 - protein, 37 aa, Giardia lamblia
FVIRAIRRIGKIRRDFWLFMHGLNLLIKNDFSRPLCM

SEQ ID NO: 3087282 - protein, 28 aa, Giardia lamblia
FVIVFALGTFLILLLVTISLHCCELKRD

SEQ ID NO: 3087283 - protein, 18 aa, Giardia lamblia
FVKHLIWLFVANVVEFAA

SEQ ID NO: 3087284 - protein, 18 aa, Giardia lamblia
FVKPIPPLDLPRFNDSIR

SEQ ID NO: 3087285 - protein, 17 aa, Giardia lamblia
FVLANPMAPPKAYKLST

SEQ ID NO: 3087286 - protein, 34 aa, Giardia lamblia
FVLKKDGTWLGQTTPLLLVPDIPSDAPLTEIMRN

SEQ ID NO: 3087287 - protein, 18 aa, Giardia lamblia
FVLLTKCDYYMAAAWFVL

SEQ ID NO: 3087288 - protein, 25 aa, Giardia lamblia
FVLYTKFLLIYRRDLLRIQELTHLD

SEQ ID NO: 3087289 - protein, 24 aa, Giardia lamblia
FVNQLIYTLFGTSIVSISWNGAEP

SEQ ID NO: 3087290 - protein, 18 aa, Giardia lamblia
FVPEFQFFEKPGAGGQSY

SEQ ID NO: 3087291 - protein, 17 aa, Giardia lamblia
FVRYGRYLSSNRATLIY

SEQ ID NO: 3087292 - protein, 28 aa, Giardia lamblia
FVSGRFPLYGLAFSPYFPLLACASEDGK

SEQ ID NO: 3087293 - protein, 25 aa, Giardia lamblia
FVSVYALLSSYLIVSFPAVVGRQGY

SEQ ID NO: 3087294 - protein, 24 aa, Giardia lamblia
FVTCIVYVFYAILSTAYVAPFVSS

SEQ ID NO: 3087295 - protein, 31 aa, Giardia lamblia
FVVIVVIAVIVIIVVFLKKGIIKGRKPKHNL

SEQ ID NO: 3087296 - protein, 18 aa, Giardia lamblia
FVVLAIIAVLVAITCIKR

SEQ ID NO: 3087297 - protein, 18 aa, Giardia lamblia
FVVYISFMEPFIHYCASL

SEQ ID NO: 3087298 - protein, 18 aa, Giardia lamblia
FVYDLFACLADCIVKLFT

SEQ ID NO: 3087299 - protein, 21 aa, Giardia lamblia
FVYNMLGLVFVFMPLMMSGIS

SEQ ID NO: 3087300 - protein, 19 aa, Giardia lamblia
FWNFFTAPNIYSVICATVY

SEQ ID NO: 3087301 - protein, 19 aa, Giardia lamblia
FWVRDVFLDLHFESVSGAD

SEQ ID NO: 3087302 - protein, 24 aa, Giardia lamblia
FYANLTFKYTFFSTEKHYIPISAV

SEQ ID NO: 3087303 - protein, 30 aa, Giardia lamblia
FYEYRRLLDKTWFPRLYQDIYNQLTKDYPD

SEQ ID NO: 3087304 - protein, 25 aa, Giardia lamblia
FYGKPGFYIYQVSNLIYFFGTVWSY

SEQ ID NO: 3087305 - protein, 19 aa, Giardia lamblia
FYIQLLDFVNGLATLHYTA

SEQ ID NO: 3087306 - protein, 21 aa, Giardia lamblia
FYIVQTIYPDIFPLSFLYSFS

SEQ ID NO: 3087307 - protein, 19 aa, Giardia lamblia
FYKYLLHQESLIHYLDING

SEQ ID NO: 3087308 - protein, 18 aa, Giardia lamblia
FYLFLGRVHSPGQQVLHK

SEQ ID NO: 3087309 - protein, 19 aa, Giardia lamblia
FYLLVTYVPGKILSSGPPQ

SEQ ID NO: 3087310 - protein, 26 aa, Giardia lamblia
FYLRRWCTAVLWLLTGGILGIGWLVD

SEQ ID NO: 3087311 - protein, 19 aa, Giardia lamblia
FYPNIADPFFIQVYADVIS

SEQ ID NO: 3087312 - protein, 27 aa, Giardia lamblia
FYQFSLSAFITVFYRAIRLSQKSEDVQ

SEQ ID NO: 3087313 - protein, 20 aa, Giardia lamblia
FYSDLFRLNFSLLGVYTSDW

SEQ ID NO: 3087314 - protein, 21 aa, Giardia lamblia
FYSKCIVFFLLRSRIEENSRK

SEQ ID NO: 3087315 - protein, 17 aa, Giardia lamblia
FYSPGPGLCYDLACKTE

SEQ ID NO: 3087316 - protein, 19 aa, Giardia lamblia
FYSSFAILFNACCAQASAG

SEQ ID NO: 3087317 - protein, 29 aa, Giardia lamblia
FYTTGSYRLAISCLYYYELLYTVVAGGSE

SEQ ID NO: 3087318 - protein, 17 aa, Giardia lamblia
FYVARSHGFYMLKKVQE

SEQ ID NO: 3087319 - protein, 26 aa, Giardia lamblia
FYYYKRIHFYFSLLVALLTSLVVSII

SEQ ID NO: 3087320 - protein, 20 aa, Giardia lamblia
FYYYLVCCKVCVFKPPDVRS

SEQ ID NO: 3087321 - protein, 30 aa, Giardia lamblia
GAAAIFAHFIYLYVFLGPDLFKRLDPREDN

SEQ ID NO: 3087322 - protein, 33 aa, Giardia lamblia
GAAFVYVPILKLIALWFPIHKFGLLTGIMVALG

SEQ ID NO: 3087323 - protein, 27 aa, Giardia lamblia
GAAQFRGILFIPKRAPFDMWDAQKKKT

SEQ ID NO: 3087324 - protein, 23 aa, Giardia lamblia
GAASAIILALWRERFPVPTEHPT

SEQ ID NO: 3087325 - protein, 29 aa, Giardia lamblia
GAASGMLFMLLLILGYRAGLDAFIRSANV

SEQ ID NO: 3087326 - protein, 24 aa, Giardia lamblia
GAAVRFWPHLILTRPARASETKQP

SEQ ID NO: 3087327 - protein, 23 aa, Giardia lamblia
GADFDLLVERFAESYLKSVCFPL

SEQ ID NO: 3087328 - protein, 26 aa, Giardia lamblia
GAGFLQFASTCLLANGNYAPKICEVS

SEQ ID NO: 3087329 - protein, 24 aa, Giardia lamblia
GAGGQSYYGGFFGLINGSSSDTPS

SEQ ID NO: 3087330 - protein, 27 aa, Giardia lamblia
GAHYEALVLICPWLEEIFVTNKFLHDS

SEQ ID NO: 3087331 - protein, 41 aa, Giardia lamblia
GAIAAIVIVVLLVLAVAGFLVWWFVFRRGGRPRRGGTKYTS

SEQ ID NO: 3087332 - protein, 31 aa, Giardia lamblia
GAIEERWQVLRPLLLLTFTDFVVLFGTLERT

SEQ ID NO: 3087333 - protein, 28 aa, Giardia lamblia
GAIRTPTELFYYLLNQTNLEGPDVFEAP

SEQ ID NO: 3087334 - protein, 23 aa, Giardia lamblia
GAKIRPCFYLPAEGILINDARYS

SEQ ID NO: 3087335 - protein, 23 aa, Giardia lamblia
GAKPLLKVDLDGSATCVAEGECA

SEQ ID NO: 3087336 - protein, 17 aa, Giardia lamblia
GAKVVTLHLPYLNLQQL

SEQ ID NO: 3087337 - protein, 41 aa, Giardia lamblia
GALCLYLVTIPYQAHYILKFLRQIRIVIYDSLRSLPNNSVM

SEQ ID NO: 3087338 - protein, 25 aa, Giardia lamblia
GALDPTFVCQLLGVLLSLGASHSVL

SEQ ID NO: 3087339 - protein, 26 aa, Giardia lamblia
GALGIIFFVYYILKYKYFAAVEEYRI

SEQ ID NO: 3087340 - protein, 20 aa, Giardia lamblia
GALLAYYPQANTLSLAYSDA

SEQ ID NO: 3087341 - protein, 19 aa, Giardia lamblia
GALLSLFLHKYWMPDAVAH

SEQ ID NO: 3087342 - protein, 46 aa, Giardia lamblia
GALSFVFALLHYAFCQKLPLPPIFVNLFLIVICLGLFVGTLYDLES

SEQ ID NO: 3087343 - protein, 20 aa, Giardia lamblia
GAMNWLPRDMHLTEKTSGSR

SEQ ID NO: 3087344 - protein, 31 aa, Giardia lamblia
GANWPIPSIPVQILIIFSLIEASFLFTNFQF

SEQ ID NO: 3087345 - protein, 17 aa, Giardia lamblia
GAPCKWLAPLQTSYQLK

SEQ ID NO: 3087346 - protein, 17 aa, Giardia lamblia
GAPKYCAALGSHELHCT

SEQ ID NO: 3087347 - protein, 26 aa, Giardia lamblia
GAPLIFPYCWALFYGAQLISHSKMHQ

SEQ ID NO: 3087348 - protein, 17 aa, Giardia lamblia
GAQLHTLRDASGELRET

SEQ ID NO: 3087349 - protein, 37 aa, Giardia lamblia
GASEIRVVMVLILYFSIWTITPTILIAAALTALFKDA

SEQ ID NO: 3087350 - protein, 23 aa, Giardia lamblia
GASKYACDCGQGARWDETIRECV

SEQ ID NO: 3087351 - protein, 31 aa, Giardia lamblia
GASMHLWAPFTLNFWGFIRTPPPPDSHKPGY

SEQ ID NO: 3087352 - protein, 20 aa, Giardia lamblia
GCADVYILLDGKCIPRECVA

SEQ ID NO: 3087353 - protein, 22 aa, Giardia lamblia
GCCWAMASAAFYEISVRLTRNY

SEQ ID NO: 3087354 - protein, 18 aa, Giardia lamblia
GCDFILAMPLGCIFIFTR

SEQ ID NO: 3087355 - protein, 37 aa, Giardia lamblia
GCIIRYCILLPIRAFLFLFMLVFCLFGTLMTSVLVPS

SEQ ID NO: 3087356 - protein, 26 aa, Giardia lamblia
GCKRPPLYVFKFYMAMEKYGDAARTA

SEQ ID NO: 3087357 - protein, 19 aa, Giardia lamblia
GCRFATIALVLLFTIVGYS

SEQ ID NO: 3087358 - protein, 23 aa, Giardia lamblia
GCVSCAPGRYIRYGDSGRSCVEP

SEQ ID NO: 3087359 - protein, 19 aa, Giardia lamblia
GCYTYWMMGSLYLLVGDGE

SEQ ID NO: 3087360 - protein, 23 aa, Giardia lamblia
GDALCRALLFFDSNNRIVQMMME

SEQ ID NO: 3087361 - protein, 25 aa, Giardia lamblia
GDAPQLWAGLLRAALAGAGTLDLGP

SEQ ID NO: 3087362 - protein, 25 aa, Giardia lamblia
GDCVLEGLFAYRCKCHEGYEAHGTN

SEQ ID NO: 3087363 - protein, 17 aa, Giardia lamblia
GDEQGILGGFFRVLVNT

SEQ ID NO: 3087364 - protein, 35 aa, Giardia lamblia
GDGVYAYPPFWAMGAYIFVLWSMKLMDARHIARAL

SEQ ID NO: 3087365 - protein, 24 aa, Giardia lamblia
GDISKILYGIDIYNLLTLEALPYL

SEQ ID NO: 3087366 - protein, 20 aa, Giardia lamblia
GDLDIICNNLYFSGTAQDDQ

SEQ ID NO: 3087367 - protein, 21 aa, Giardia lamblia
GDLLKMIRQSYLAILAATSCN

SEQ ID NO: 3087368 - protein, 25 aa, Giardia lamblia
GDLLPVNSLFLPRVKGLLAANERVI

SEQ ID NO: 3087369 - protein, 24 aa, Giardia lamblia
GDMVCKLCPKFFYGNDCAVNPCGI

SEQ ID NO: 3087370 - protein, 17 aa, Giardia lamblia
GDNLKLNYIKYSSLQDL

SEQ ID NO: 3087371 - protein, 26 aa, Giardia lamblia
GDPCYTAYWIWLCIAMVIACILIFFD

SEQ ID NO: 3087372 - protein, 27 aa, Giardia lamblia
GDRIYKQLVSLQLWKAYILANKERLAK

SEQ ID NO: 3087373 - protein, 24 aa, Giardia lamblia
GDSLALILPILIRGLNDTSDSQDT

SEQ ID NO: 3087374 - protein, 22 aa, Giardia lamblia
GDSRYICPQFLRTGIPDYSADV

SEQ ID NO: 3087375 - protein, 25 aa, Giardia lamblia
GDTSLIQQLLPQYKLTVNDAGDTAL

SEQ ID NO: 3087376 - protein, 17 aa, Giardia lamblia
GDTSRILQLIKLLSRQL

SEQ ID NO: 3087377 - protein, 29 aa, Giardia lamblia
GDTSYCSCLRWYNITTLSSGQCISTRCVN

SEQ ID NO: 3087378 - protein, 29 aa, Giardia lamblia
GDTYGCLCASYYILVDKDCIPTRCLKDGK

SEQ ID NO: 3087379 - protein, 20 aa, Giardia lamblia
GDYLFPFPIGDAISAIIGIC

SEQ ID NO: 3087380 - protein, 20 aa, Giardia lamblia
GDYYLLLMTELARTGTVLSV

SEQ ID NO: 3087381 - protein, 26 aa, Giardia lamblia
GEAIPGLIGNLYLECGFAGAGTCTSD

SEQ ID NO: 3087382 - protein, 24 aa, Giardia lamblia
GEARLFQESLALLSAKRLDRFVEL

SEQ ID NO: 3087383 - protein, 21 aa, Giardia lamblia
GEAWRNITGYMYQPFQVTVFD

SEQ ID NO: 3087384 - protein, 30 aa, Giardia lamblia
GEEIELCFFKKTLALIRLKQARSYVLVLRP

SEQ ID NO: 3087385 - protein, 27 aa, Giardia lamblia
GEHFVITGLGLCKDALWSGSTLMGIMA

SEQ ID NO: 3087386 - protein, 26 aa, Giardia lamblia
GEHVPKLLIKYFPSSFDLLFHGLCDS

SEQ ID NO: 3087387 - protein, 30 aa, Giardia lamblia
GEIEAIVAFIPFIQQTLPVVTLLSGCLAHI

SEQ ID NO: 3087388 - protein, 17 aa, Giardia lamblia
GEIIYSLASRLPFDIMT

SEQ ID NO: 3087389 - protein, 39 aa, Giardia lamblia
GEKGQIIIQLYGLLPQLLYGLLYLMNLTNMMLPGSNPSR

SEQ ID NO: 3087390 - protein, 23 aa, Giardia lamblia
GEKKLNFTYPLQANIKRTADYQI

SEQ ID NO: 3087391 - protein, 21 aa, Giardia lamblia
GEKPYPVGRLLWSADPQSSDF

SEQ ID NO: 3087392 - protein, 39 aa, Giardia lamblia
GEREPYIWNAFLFGVVGWCFVSHAMSFLFTDVNVIMHSH

SEQ ID NO: 3087393 - protein, 21 aa, Giardia lamblia
GERFFLPYTIVIFYNYSRLSN

SEQ ID NO: 3087394 - protein, 23 aa, Giardia lamblia
GERRFTFFDISLSDEFLIEYVYR

SEQ ID NO: 3087395 - protein, 20 aa, Giardia lamblia
GERRLAVIVGWMVCIVDKLG

SEQ ID NO: 3087396 - protein, 21 aa, Giardia lamblia
GETPLPKYITTANDAFNLFRE

SEQ ID NO: 3087397 - protein, 34 aa, Giardia lamblia
GEVFVRYFNYMSLPFLSALLSPDKLRLLFLTEET

SEQ ID NO: 3087398 - protein, 29 aa, Giardia lamblia
GEVISRNCIPLFPRLVLASSFSATTARAS

SEQ ID NO: 3087399 - protein, 33 aa, Giardia lamblia
GEVQTENLLWWYFFTPMMSFAAILGFVGWSAQD

SEQ ID NO: 3087400 - protein, 22 aa, Giardia lamblia
GEVYTSFFMALPSSVRQLYNEE

SEQ ID NO: 3087401 - protein, 18 aa, Giardia lamblia
GEYHCRCPDMLIAVDGEC

SEQ ID NO: 3087402 - protein, 25 aa, Giardia lamblia
GFCHRFLTVLSMKRSLRKGCSELNG

SEQ ID NO: 3087403 - protein, 18 aa, Giardia lamblia
GFFVLIEKEWCSFGHRFS

SEQ ID NO: 3087404 - protein, 24 aa, Giardia lamblia
GFGLLDCSMLCLLLIVGSNKKRLA

SEQ ID NO: 3087405 - protein, 17 aa, Giardia lamblia
GFGSYKGVDGCRYCLPP

SEQ ID NO: 3087406 - protein, 23 aa, Giardia lamblia
GFGSYKGVDGCRYCLPPLTGETS

SEQ ID NO: 3087407 - protein, 26 aa, Giardia lamblia
GFHNFGYFIRFLMFGFICSIMSFSMF

SEQ ID NO: 3087408 - protein, 17 aa, Giardia lamblia
GFICIKTGRVKDGVPYL

SEQ ID NO: 3087409 - protein, 19 aa, Giardia lamblia
GFIISIGLVFPVLMALKIE

SEQ ID NO: 3087410 - protein, 20 aa, Giardia lamblia
GFKDASFSIWFPTDSDPSYK

SEQ ID NO: 3087411 - protein, 34 aa, Giardia lamblia
GFLAYCPLLIAHNAAWPALFPMIAHFPFDTKYET

SEQ ID NO: 3087412 - protein, 22 aa, Giardia lamblia
GFLIKWAHLPLCLSYGLQLMGQ

SEQ ID NO: 3087413 - protein, 21 aa, Giardia lamblia
GFLKHALLPLSDFNSDVQLYG

SEQ ID NO: 3087414 - protein, 17 aa, Giardia lamblia
GFLRRANGYSDFILKMA

SEQ ID NO: 3087415 - protein, 18 aa, Giardia lamblia
GFLWGFDVIMTFGACLQP

SEQ ID NO: 3087416 - protein, 17 aa, Giardia lamblia
GFNDYFFVFSGRRGLHC

SEQ ID NO: 3087417 - protein, 21 aa, Giardia lamblia
GFQLSFNILRAIFKSSSSSAA

SEQ ID NO: 3087418 - protein, 33 aa, Giardia lamblia
GFSLHLLYREFAVVGVPLGIVFIAAARETHRTT

SEQ ID NO: 3087419 - protein, 17 aa, Giardia lamblia
GFTALLYAIENRNLEFA

SEQ ID NO: 3087420 - protein, 19 aa, Giardia lamblia
GFTPGFLTIKFLESSTQAL

SEQ ID NO: 3087421 - protein, 17 aa, Giardia lamblia
GFVLDHAGGPAGTCIPE

SEQ ID NO: 3087422 - protein, 20 aa, Giardia lamblia
GFVLVFVTYSIIINCIVPFC

SEQ ID NO: 3087423 - protein, 19 aa, Giardia lamblia
GFVTLYKIQNLIAALGITR

SEQ ID NO: 3087424 - protein, 26 aa, Giardia lamblia
GGAEPLLDLYLSVGGLIGDLKLGRVS

SEQ ID NO: 3087425 - protein, 29 aa, Giardia lamblia
GGCYPNSCVYLWQNPTDGASYIQLCGGDS

SEQ ID NO: 3087426 - protein, 20 aa, Giardia lamblia
GGEFFTDLFIKTGLIARRAR

SEQ ID NO: 3087427 - protein, 23 aa, Giardia lamblia
GGFPLFKSVLFGAKRQATIPDTW

SEQ ID NO: 3087428 - protein, 25 aa, Giardia lamblia
GGGTPLAHLLLYIKAYQGRIENTKL

SEQ ID NO: 3087429 - protein, 30 aa, Giardia lamblia
GGICIGQNTATCYPGWVADGNSLCAKYDCS

SEQ ID NO: 3087430 - protein, 34 aa, Giardia lamblia
GGIFGYTGIAFCRTCLAPLISGPGHCTSCLDRYL

SEQ ID NO: 3087431 - protein, 31 aa, Giardia lamblia
GGILVTLPFISLLTLYNLFLEKRYAAARDVR

SEQ ID NO: 3087432 - protein, 28 aa, Giardia lamblia
GGILYFGVPIWVYYKLPILRVESKNDVG

SEQ ID NO: 3087433 - protein, 26 aa, Giardia lamblia
GGKDSLLLPSILAPSTLKPIPKRDVD

SEQ ID NO: 3087434 - protein, 27 aa, Giardia lamblia
GGKFRYSFIPCYIHNPAFLIMAIILLI

SEQ ID NO: 3087435 - protein, 26 aa, Giardia lamblia
GGLFRKLNLINLITGYVIDACLGVVA

SEQ ID NO: 3087436 - protein, 31 aa, Giardia lamblia
GGLIALFIILPIVGLILFAFTRLLFSLLSMT

SEQ ID NO: 3087437 - protein, 37 aa, Giardia lamblia
GGLLNTILYMLIKPIRLASLVMFLFSSVLALMSGYTY

SEQ ID NO: 3087438 - protein, 26 aa, Giardia lamblia
GGLLSCLKCKSGSFLDLFRRTCITQC

SEQ ID NO: 3087439 - protein, 32 aa, Giardia lamblia
GGLVVTLAFLLILYYKHLRKTRLRLSRASLSE

SEQ ID NO: 3087440 - protein, 20 aa, Giardia lamblia
GGPMPPGVTATPLLRTMAAT

SEQ ID NO: 3087441 - protein, 35 aa, Giardia lamblia
GGRFKPYLPLDIDSSIFPPLITPGYEPLVDIWSLG

SEQ ID NO: 3087442 - protein, 19 aa, Giardia lamblia
GGSCSDLTCRCRPGYSGPA

SEQ ID NO: 3087443 - protein, 18 aa, Giardia lamblia
GGSLRYRSTIQDSFAVVN

SEQ ID NO: 3087444 - protein, 23 aa, Giardia lamblia
GGTRLFCILLQRLWTLQTLSNQL

SEQ ID NO: 3087445 - protein, 18 aa, Giardia lamblia
GGTTLRIIDPRSGNFILR

SEQ ID NO: 3087446 - protein, 20 aa, Giardia lamblia
GGVYFFFGLPSPATATMAGL

SEQ ID NO: 3087447 - protein, 24 aa, Giardia lamblia
GGYVFLTVLIPLHVFLGVLSGIAT

SEQ ID NO: 3087448 - protein, 18 aa, Giardia lamblia
GHAWPMIHSSLVKTLLAI

SEQ ID NO: 3087449 - protein, 24 aa, Giardia lamblia
GHLATIKLLLPNFVGFRDQDGYTA

SEQ ID NO: 3087450 - protein, 26 aa, Giardia lamblia
GHSTKLVYSFSLMKRLLGSTAMHCID

SEQ ID NO: 3087451 - protein, 25 aa, Giardia lamblia
GHTDANIYPFLRSPGAIVVGATSPQ

SEQ ID NO: 3087452 - protein, 30 aa, Giardia lamblia
GHTVLFHMLITPVLCLCYWVLAAYVDLLLP

SEQ ID NO: 3087453 - protein, 25 aa, Giardia lamblia
GHVEVLVVLLMMYYHDHVTIPFAPL

SEQ ID NO: 3087454 - protein, 18 aa, Giardia lamblia
GHWRISITPPGQALSILP

SEQ ID NO: 3087455 - protein, 25 aa, Giardia lamblia
GIAEKSWLLKLLFLGTALASSSLVL

SEQ ID NO: 3087456 - protein, 28 aa, Giardia lamblia
GICALDTYGYWGCVCEYPYFGSGSSCYP

SEQ ID NO: 3087457 - protein, 29 aa, Giardia lamblia
GICISCESGHLLYRGGCYPSKSALAQSIC

SEQ ID NO: 3087458 - protein, 28 aa, Giardia lamblia
GIDFSNNYCRCALVISLPYPNISDPLLK

SEQ ID NO: 3087459 - protein, 18 aa, Giardia lamblia
GIFGFLDQGTVAAVSLVI

SEQ ID NO: 3087460 - protein, 29 aa, Giardia lamblia
GIFGVPGFLAFPLFARIRSEYRHMHPCYL

SEQ ID NO: 3087461 - protein, 18 aa, Giardia lamblia
GIFPFRGMSSYVAPLLFL

SEQ ID NO: 3087462 - protein, 23 aa, Giardia lamblia
GIGKFVLCLVLYIITQLIQQFMN

SEQ ID NO: 3087463 - protein, 23 aa, Giardia lamblia
GIGLQITLQDLLLLIQRVVVGTG

SEQ ID NO: 3087464 - protein, 20 aa, Giardia lamblia
GIHGCFYWELVKMVSLIQEN

SEQ ID NO: 3087465 - protein, 20 aa, Giardia lamblia
GIHLLLNSVAHSRLIWSLTG

SEQ ID NO: 3087466 - protein, 20 aa, Giardia lamblia
GIIGHLFPLSLWDAVYTTEN

SEQ ID NO: 3087467 - protein, 21 aa, Giardia lamblia
GIIIGLLNFFILCKNSSSLVL

SEQ ID NO: 3087468 - protein, 25 aa, Giardia lamblia
GIIKIIPPVFRYKYPASLVTSTSPD

SEQ ID NO: 3087469 - protein, 25 aa, Giardia lamblia
GIKIYCIFYLVMLGSMIVSSYIPFK

SEQ ID NO: 3087470 - protein, 18 aa, Giardia lamblia
GILLGGLLSGRLFMLQKG

SEQ ID NO: 3087471 - protein, 17 aa, Giardia lamblia
GILLSLGASLLGHTKTW

SEQ ID NO: 3087472 - protein, 20 aa, Giardia lamblia
GILQRSSLFSIPTLYFCFFL

SEQ ID NO: 3087473 - protein, 26 aa, Giardia lamblia
GILQVLAHLPPFAQYFIALQPILQSL

SEQ ID NO: 3087474 - protein, 37 aa, Giardia lamblia
GINFMQKLDFYLTNSFILLFEILIPYIQETLLSNYDQ

SEQ ID NO: 3087475 - protein, 18 aa, Giardia lamblia
GIPFIVLIGKDGKCLGTV

SEQ ID NO: 3087476 - protein, 18 aa, Giardia lamblia
GIPFPYPYSSGLRTNLSE

SEQ ID NO: 3087477 - protein, 24 aa, Giardia lamblia
GIPRPQESMLLNSKFHRITVGSAK

SEQ ID NO: 3087478 - protein, 32 aa, Giardia lamblia
GIQFKILVQHFITQLLLILSLSLMHELNNNVY

SEQ ID NO: 3087479 - protein, 30 aa, Giardia lamblia
GIQHPLLQAYRLFYVGTIILVLTPSCLYQI

SEQ ID NO: 3087480 - protein, 25 aa, Giardia lamblia
GIQLFSLLFIMHGYERFFGISKDIL

SEQ ID NO: 3087481 - protein, 25 aa, Giardia lamblia
GISDKIIFTIDWKQLRPRLFERISN

SEQ ID NO: 3087482 - protein, 27 aa, Giardia lamblia
GISKTCMHFIPRYIPLPVRVQHPMVCN

SEQ ID NO: 3087483 - protein, 22 aa, Giardia lamblia
GITLFLAIYFTEVLARAYALAR

SEQ ID NO: 3087484 - protein, 17 aa, Giardia lamblia
GIVLFLLGIGGIVGFVF

SEQ ID NO: 3087485 - protein, 20 aa, Giardia lamblia
GIVQRVNLDPPPKGWDSLFG

SEQ ID NO: 3087486 - protein, 27 aa, Giardia lamblia
GIVSSRLFFYRTFVDDWLLLTTSIALL

SEQ ID NO: 3087487 - protein, 18 aa, Giardia lamblia
GKEAPLFTEALPGLLADL

SEQ ID NO: 3087488 - protein, 26 aa, Giardia lamblia
GKFTEWLDILPFYNDISDLLDLVQQL

SEQ ID NO: 3087489 - protein, 18 aa, Giardia lamblia
GKILNFSIVSSESADCIN

SEQ ID NO: 3087490 - protein, 36 aa, Giardia lamblia
GKKIDEDLLWAIMIQVLLALSYCHSPFNATGKAVIH

SEQ ID NO: 3087491 - protein, 23 aa, Giardia lamblia
GKLAKLCDVLFTHQLRSQDKDLI

SEQ ID NO: 3087492 - protein, 21 aa, Giardia lamblia
GKNYFIYQGGCYSPESAPGNV

SEQ ID NO: 3087493 - protein, 23 aa, Giardia lamblia
GKPVACALLLPKIPSIFYSIFSL

SEQ ID NO: 3087494 - protein, 20 aa, Giardia lamblia
GKSFLFYGGCYNRDSHVGSK

SEQ ID NO: 3087495 - protein, 29 aa, Giardia lamblia
GKSKIDYVFLLIALGLVLVARILSVLLLT

SEQ ID NO: 3087496 - protein, 27 aa, Giardia lamblia
GKSKTILAYLLFLTNALHFDMYSGDLL

SEQ ID NO: 3087497 - protein, 18 aa, Giardia lamblia
GKSSHMWYNYCGGVGDCI

SEQ ID NO: 3087498 - protein, 34 aa, Giardia lamblia
GKVFPKPRFFHLPSLYHAALLYRQKLNFERATEL

SEQ ID NO: 3087499 - protein, 34 aa, Giardia lamblia
GKVMIGKFLLTYLQLFFSYAMTISLMPFRHEISH

SEQ ID NO: 3087500 - protein, 25 aa, Giardia lamblia
GLAATFLRLVGFGKNLMMIQGIAGA

SEQ ID NO: 3087501 - protein, 25 aa, Giardia lamblia
GLAFTYYLPLCFIVLVSVGRELYDE

SEQ ID NO: 3087502 - protein, 21 aa, Giardia lamblia
GLDLFATFYAIPINISQISRT

SEQ ID NO: 3087503 - protein, 25 aa, Giardia lamblia
GLDPALRMMGGVFNLFHVNPAESFS

SEQ ID NO: 3087504 - protein, 21 aa, Giardia lamblia
GLDYYDLFLRHPKTSAPFVLK

SEQ ID NO: 3087505 - protein, 18 aa, Giardia lamblia
GLEPFWVATYLMSDRYIS

SEQ ID NO: 3087506 - protein, 20 aa, Giardia lamblia
GLERKYLMLRYDANRMFAPP

SEQ ID NO: 3087507 - protein, 21 aa, Giardia lamblia
GLESMYKSLPWYNKKTNLQAT

SEQ ID NO: 3087508 - protein, 19 aa, Giardia lamblia
GLFNKRLIYTTPESFLILH

SEQ ID NO: 3087509 - protein, 29 aa, Giardia lamblia
GLGCVALTWLLFVSVLRRSSPSTLLRLKE

SEQ ID NO: 3087510 - protein, 26 aa, Giardia lamblia
GLGDPRTYFYFMQASPLQNIKSKVMV

SEQ ID NO: 3087511 - protein, 17 aa, Giardia lamblia
GLGFICIKTGRVKDGVP

SEQ ID NO: 3087512 - protein, 21 aa, Giardia lamblia
GLGPQQRLCAALALLHERAPS

SEQ ID NO: 3087513 - protein, 18 aa, Giardia lamblia
GLGVFICYLIYACPEHNL

SEQ ID NO: 3087514 - protein, 49 aa, Giardia lamblia
GLHAFVPVRPQRTLRYYYLWSLQFIASPILFPFRLLTMVLSFIIAFVSL

SEQ ID NO: 3087515 - protein, 27 aa, Giardia lamblia
GLHFEYAWPLMLTVGAFFVSGYYLSEL

SEQ ID NO: 3087516 - protein, 41 aa, Giardia lamblia
GLHKSPMFILIFLGTVGMQLIIMLAPGVRYIFHIFDCSENH

SEQ ID NO: 3087517 - protein, 25 aa, Giardia lamblia
GLHVHNVYVLRLWQPPFVADTVDIL

SEQ ID NO: 3087518 - protein, 18 aa, Giardia lamblia
GLIALFASLLLVIFCNIT

SEQ ID NO: 3087519 - protein, 21 aa, Giardia lamblia
GLILMNSFTLISRLIMLAFSI

SEQ ID NO: 3087520 - protein, 19 aa, Giardia lamblia
GLLHRPLCLVLQESTLVAF

SEQ ID NO: 3087521 - protein, 20 aa, Giardia lamblia
GLLLIMIARVILPTGRRIFP

SEQ ID NO: 3087522 - protein, 23 aa, Giardia lamblia
GLLLVGIAKYYKVIEKNTAVCSS

SEQ ID NO: 3087523 - protein, 18 aa, Giardia lamblia
GLLMAFTVLIRESMFFFS

SEQ ID NO: 3087524 - protein, 20 aa, Giardia lamblia
GLLPAVLPKAINPRSSLSQY

SEQ ID NO: 3087525 - protein, 17 aa, Giardia lamblia
GLLQVSFSSVAFLNMKY

SEQ ID NO: 3087526 - protein, 20 aa, Giardia lamblia
GLLRAFLTYVLTTNCSLYVL

SEQ ID NO: 3087527 - protein, 20 aa, Giardia lamblia
GLLSGRLFMLQKGAEALYAA

SEQ ID NO: 3087528 - protein, 25 aa, Giardia lamblia
GLLTKLPHKLSPIALPIYGRVVSRT

SEQ ID NO: 3087529 - protein, 29 aa, Giardia lamblia
GLLVIITFTYPIFSIPLAFAFAMAFKSVF

SEQ ID NO: 3087530 - protein, 22 aa, Giardia lamblia
GLLVVIWVAIQMYFNTPRIQVY

SEQ ID NO: 3087531 - protein, 49 aa, Giardia lamblia
GLNHPKMAWGVLVLAIALLTLVIFIVPFLLYRFFNRPPETIFKGSYVSA

SEQ ID NO: 3087532 - protein, 25 aa, Giardia lamblia
GLNKALTWELLLKRTAHASIKLLND

SEQ ID NO: 3087533 - protein, 24 aa, Giardia lamblia
GLNLAFADLIPFLRGVFNHGNPLT

SEQ ID NO: 3087534 - protein, 20 aa, Giardia lamblia
GLNLAILASQRWPRAADSAT

SEQ ID NO: 3087535 - protein, 19 aa, Giardia lamblia
GLPEFYPQLKELLPNAATA

SEQ ID NO: 3087536 - protein, 19 aa, Giardia lamblia
GLPLPYPPPVVQGPVLPMV

SEQ ID NO: 3087537 - protein, 24 aa, Giardia lamblia
GLPNKVWIRLISSFVVYAIVTTLN

SEQ ID NO: 3087538 - protein, 17 aa, Giardia lamblia
GLQFHCVPMQLGCPGYI

SEQ ID NO: 3087539 - protein, 18 aa, Giardia lamblia
GLQGLLPAVLPKAINPRS

SEQ ID NO: 3087540 - protein, 23 aa, Giardia lamblia
GLQSRYFYIFFVELFSLNESFIH

SEQ ID NO: 3087541 - protein, 27 aa, Giardia lamblia
GLRAVLFSCYYGICELLFNIACSIVRR

SEQ ID NO: 3087542 - protein, 28 aa, Giardia lamblia
GLRGLVVWIFALIERGIFGAPWGEGIYG

SEQ ID NO: 3087543 - protein, 39 aa, Giardia lamblia
GLRPFVFHLAHYLMLFTLTFSSFLLSWIVSLAAGVKWST

SEQ ID NO: 3087544 - protein, 24 aa, Giardia lamblia
GLRYNPLFPYFKSSYGAKHACWKV

SEQ ID NO: 3087545 - protein, 17 aa, Giardia lamblia
GLSAFALVWILLYSAQY

SEQ ID NO: 3087546 - protein, 24 aa, Giardia lamblia
GLSDLRYITGSPIYLPWASNFSRK

SEQ ID NO: 3087547 - protein, 20 aa, Giardia lamblia
GLSGPSYINMCKILLGLASS

SEQ ID NO: 3087548 - protein, 33 aa, Giardia lamblia
GLSPRPPINPAFPYPLCLLPLPFRHVNDDANHE

SEQ ID NO: 3087549 - protein, 23 aa, Giardia lamblia
GLSRISWGSLALSFLISLLEVFA

SEQ ID NO: 3087550 - protein, 24 aa, Giardia lamblia
GLSRISWGSLALSFLISLLEVFAS

SEQ ID NO: 3087551 - protein, 30 aa, Giardia lamblia
GLSRISWGSLALSFLISLLEVLASLGVLLL

SEQ ID NO: 3087552 - protein, 24 aa, Giardia lamblia
GLSSFLTPFLSLDLDTLLILIREG

SEQ ID NO: 3087553 - protein, 30 aa, Giardia lamblia
GLTVGAFIVLIFVLLISLLMAMFRVEVVTT

SEQ ID NO: 3087554 - protein, 18 aa, Giardia lamblia
GLVLFICARLARSGAEKT

SEQ ID NO: 3087555 - protein, 21 aa, Giardia lamblia
GLVPLIFWAVCKCIGFTELRY

SEQ ID NO: 3087556 - protein, 20 aa, Giardia lamblia
GLVTTALLPSLLKVVELFQT

SEQ ID NO: 3087557 - protein, 34 aa, Giardia lamblia
GLYNTIISAYIYHILTFIPYRFTSNPAKVITAWK

SEQ ID NO: 3087558 - protein, 20 aa, Giardia lamblia
GLYYFTIDRIIPSNVRFIIT

SEQ ID NO: 3087559 - protein, 24 aa, Giardia lamblia
GMAQKYIFYVLMNSSRACSADLLS

SEQ ID NO: 3087560 - protein, 24 aa, Giardia lamblia
GMCCLTFLFYYLQKYKHLSLIEQS

SEQ ID NO: 3087561 - protein, 26 aa, Giardia lamblia
GMHALFFHRCFAVQFLLKAVSLSMGQ

SEQ ID NO: 3087562 - protein, 19 aa, Giardia lamblia
GMHRGLLSAIILFVTGASI

SEQ ID NO: 3087563 - protein, 19 aa, Giardia lamblia
GMKQMYYKLGLSANSGPLS

SEQ ID NO: 3087564 - protein, 19 aa, Giardia lamblia
GMLAIMYAAFTGHLEIVKL

SEQ ID NO: 3087565 - protein, 33 aa, Giardia lamblia
GMLPTLDFSPALLRLFISVLLMIRLQHGPLHMD

SEQ ID NO: 3087566 - protein, 19 aa, Giardia lamblia
GMLVYLPGLVEYLGQSFLK

SEQ ID NO: 3087567 - protein, 22 aa, Giardia lamblia
GMRRRASLIIALLGCRHILCLD

SEQ ID NO: 3087568 - protein, 19 aa, Giardia lamblia
GMTRSQIEKWLYSDAPELV

SEQ ID NO: 3087569 - protein, 34 aa, Giardia lamblia
GMYTNFAIHLLFTRYHRYLINSYQLITLVGILAI

SEQ ID NO: 3087570 - protein, 27 aa, Giardia lamblia
GNCTSPAHDLLWYITGEYIAPDSKKKI

SEQ ID NO: 3087571 - protein, 24 aa, Giardia lamblia
GNDDTITLLPLKLGSNAHQCFAAL

SEQ ID NO: 3087572 - protein, 29 aa, Giardia lamblia
GNDMLDLVLIRFFLALHTYSQECGGDSSA

SEQ ID NO: 3087573 - protein, 25 aa, Giardia lamblia
GNFILRGVIHHKAVLDLTIGISSQQ

SEQ ID NO: 3087574 - protein, 23 aa, Giardia lamblia
GNFILVTAWERYVLNQSINYMTA

SEQ ID NO: 3087575 - protein, 24 aa, Giardia lamblia
GNHRPLILLIAIRDAEEDGAELTQ

SEQ ID NO: 3087576 - protein, 27 aa, Giardia lamblia
GNIIAHLFVSIWLTMLVFRKTVLQVAL

SEQ ID NO: 3087577 - protein, 27 aa, Giardia lamblia
GNILAMNILYVLSILFFNWSGLTVGKS

SEQ ID NO: 3087578 - protein, 20 aa, Giardia lamblia
GNILKWAMLLHQSTGKGRDR

SEQ ID NO: 3087579 - protein, 25 aa, Giardia lamblia
GNILLVCFLVLLFYKRTNHSVISNI

SEQ ID NO: 3087580 - protein, 24 aa, Giardia lamblia
GNIVLPFLAALAYFYMAVSWGGYV

SEQ ID NO: 3087581 - protein, 27 aa, Giardia lamblia
GNKEYLLNPFIIQPFNKPCTAMIFQAT

SEQ ID NO: 3087582 - protein, 27 aa, Giardia lamblia
GNKTFINQIWPCYVWYRDNVLSAAKKY

SEQ ID NO: 3087583 - protein, 23 aa, Giardia lamblia
GNLLGECLIIDSSELRMLIIDVL

SEQ ID NO: 3087584 - protein, 17 aa, Giardia lamblia
GNLYKQICDAILLDYPD

SEQ ID NO: 3087585 - protein, 32 aa, Giardia lamblia
GNNILPGIIGPKNLPLLPSARLLQEAQGKKTR

SEQ ID NO: 3087586 - protein, 34 aa, Giardia lamblia
GNSPWTSVYYVIFFRYLLLFSSVIPISLRVNLDL

SEQ ID NO: 3087587 - protein, 31 aa, Giardia lamblia
GNTGFALLLAYLFYSPALSLVLSAFSVLCFV

SEQ ID NO: 3087588 - protein, 28 aa, Giardia lamblia
GNTMALFRPLMIIKPDIDYIAAGLFLMH

SEQ ID NO: 3087589 - protein, 28 aa, Giardia lamblia
GNTQRALRLCRFLDQKPLWAQMATYCIE

SEQ ID NO: 3087590 - protein, 23 aa, Giardia lamblia
GNYAFREDLLPLTDKKKKLKKER

SEQ ID NO: 3087591 - protein, 32 aa, Giardia lamblia
GPALIPKVKACPAFLYLRARIITNMNISLLMK

SEQ ID NO: 3087592 - protein, 37 aa, Giardia lamblia
GPARITLPFFNTHPYLLKALREGIFIVTAILADKGVI

SEQ ID NO: 3087593 - protein, 36 aa, Giardia lamblia
GPDMYTPMYMCFILPFCFFILTPLFSYRLSQEKGEG

SEQ ID NO: 3087594 - protein, 24 aa, Giardia lamblia
GPGAKPLVLLPKALEEHSRTCPND

SEQ ID NO: 3087595 - protein, 17 aa, Giardia lamblia
GPISRPITRPPPRAQSQ

SEQ ID NO: 3087596 - protein, 21 aa, Giardia lamblia
GPLCTMCEPFYTLRGGKCQLN

SEQ ID NO: 3087597 - protein, 23 aa, Giardia lamblia
GPLQHKVIEFFRVGTGGIFSTVY

SEQ ID NO: 3087598 - protein, 33 aa, Giardia lamblia
GPNRVQIATACGVILIFNFTEILRDSSKIMLLL

SEQ ID NO: 3087599 - protein, 22 aa, Giardia lamblia
GPSATSCFACYGLDGTLFCERC

SEQ ID NO: 3087600 - protein, 21 aa, Giardia lamblia
GPSFTLPLRMESIAGLSSLRY

SEQ ID NO: 3087601 - protein, 18 aa, Giardia lamblia
GPSPIQVTLIFFDKIISI

SEQ ID NO: 3087602 - protein, 20 aa, Giardia lamblia
GPWITLSLSTFILFYSCYNI

SEQ ID NO: 3087603 - protein, 22 aa, Giardia lamblia
GPYFMICVTISMLQDFGPLIDL

SEQ ID NO: 3087604 - protein, 17 aa, Giardia lamblia
GQCTCAELFFNGKSICL

SEQ ID NO: 3087605 - protein, 31 aa, Giardia lamblia
GQEKIPVLPCSLFLPVLYMAETLRHIEETKN

SEQ ID NO: 3087606 - protein, 18 aa, Giardia lamblia
GQGLRYAPLVSQTKLRTQ

SEQ ID NO: 3087607 - protein, 23 aa, Giardia lamblia
GQKDIVKLLIPRQARMRDKIRAT

SEQ ID NO: 3087608 - protein, 29 aa, Giardia lamblia
GQKIPYKWRLLIIMFNVFLPAIVATFVDS

SEQ ID NO: 3087609 - protein, 21 aa, Giardia lamblia
GQLEIVKQILPPNGNYRTQKL

SEQ ID NO: 3087610 - protein, 26 aa, Giardia lamblia
GQLTTAFLFSLFFPNTQLSTLVGNIL

SEQ ID NO: 3087611 - protein, 18 aa, Giardia lamblia
GQQIFLIGSILFIIGCLL

SEQ ID NO: 3087612 - protein, 24 aa, Giardia lamblia
GQRKPLLLNPLYVSSAVLDVQALR

SEQ ID NO: 3087613 - protein, 27 aa, Giardia lamblia
GQTREHLQLLMIFGVKHIMVAVNKLDR

SEQ ID NO: 3087614 - protein, 24 aa, Giardia lamblia
GQWSMLDSILLYTLITSVMHIHPH

SEQ ID NO: 3087615 - protein, 18 aa, Giardia lamblia
GRACNFCDRSFMLINDRC

SEQ ID NO: 3087616 - protein, 27 aa, Giardia lamblia
GRASIRDFFLPEPVDILLVLHSNLLVG

SEQ ID NO: 3087617 - protein, 22 aa, Giardia lamblia
GRATALVYLSPTLAITTSVPLH

SEQ ID NO: 3087618 - protein, 25 aa, Giardia lamblia
GRCTACRGSYFLYQGGCYSAGEYPG

SEQ ID NO: 3087619 - protein, 30 aa, Giardia lamblia
GRDSIFRYVCFLTYFLPSTTSLPLMGFYLY

SEQ ID NO: 3087620 - protein, 21 aa, Giardia lamblia
GRECLSDCVFPLRKYCSNDVC

SEQ ID NO: 3087621 - protein, 23 aa, Giardia lamblia
GREFPHSFVRLHQSILERIIVDT

SEQ ID NO: 3087622 - protein, 24 aa, Giardia lamblia
GREKEFALPLKIELYNPTDILINK

SEQ ID NO: 3087623 - protein, 27 aa, Giardia lamblia
GRELTNMIILAIKLSLGLVHCGRGLMH

SEQ ID NO: 3087624 - protein, 25 aa, Giardia lamblia
GRFDQLPYILETCTEQLLVGRYGLS

SEQ ID NO: 3087625 - protein, 25 aa, Giardia lamblia
GRFITACIMILFFVAAQMVAPFTIQ

SEQ ID NO: 3087626 - protein, 17 aa, Giardia lamblia
GRGIPFIVLIGKDGKCL

SEQ ID NO: 3087627 - protein, 24 aa, Giardia lamblia
GRIGFERWITFLEAFQTCIRDGTL

SEQ ID NO: 3087628 - protein, 23 aa, Giardia lamblia
GRKPVYIVLFAGYILTFGLTTLT

SEQ ID NO: 3087629 - protein, 28 aa, Giardia lamblia
GRLIAMLVMVFFYMLAELIVGIVGNSLT

SEQ ID NO: 3087630 - protein, 25 aa, Giardia lamblia
GRNNLLWFNGFLFFTSVALINTALI

SEQ ID NO: 3087631 - protein, 19 aa, Giardia lamblia
GRPSLIAILYILSAAIAGS

SEQ ID NO: 3087632 - protein, 25 aa, Giardia lamblia
GRSLLSILLPLPRTVTTIVILIITA

SEQ ID NO: 3087633 - protein, 24 aa, Giardia lamblia
GRSWVMTLMLPFTKLLDDKIKQKE

SEQ ID NO: 3087634 - protein, 20 aa, Giardia lamblia
GRSYMGVAHCTLCDSPKIAS

SEQ ID NO: 3087635 - protein, 27 aa, Giardia lamblia
GRTFAEEFLIFILKKSLRTLRNIDGKT

SEQ ID NO: 3087636 - protein, 20 aa, Giardia lamblia
GRVLSRLVCMFYQRLEAVVA

SEQ ID NO: 3087637 - protein, 41 aa, Giardia lamblia
GRVPSSWTKLAYPSLKPLTSWFDDLIQRVAFMRRWLTNGQP

SEQ ID NO: 3087638 - protein, 24 aa, Giardia lamblia
GSACRLVMLTWEENWTKLKSCLDC

SEQ ID NO: 3087639 - protein, 25 aa, Giardia lamblia
GSCFVLTGILLQQGPVSKGVWINNM

SEQ ID NO: 3087640 - protein, 31 aa, Giardia lamblia
GSEHLIKTPIVFARFLRTYYKMFSDRKLKLV

SEQ ID NO: 3087641 - protein, 29 aa, Giardia lamblia
GSESLFLNIPSYPWLSATYPRFLSKIGSS

SEQ ID NO: 3087642 - protein, 23 aa, Giardia lamblia
GSFGLLRGIVRRCPYIIRSLSLH

SEQ ID NO: 3087643 - protein, 23 aa, Giardia lamblia
GSGAFLLMTFVSIVSPFTNQPIK

SEQ ID NO: 3087644 - protein, 24 aa, Giardia lamblia
GSGKSLAFLLPAIDLIHKANMKLH

SEQ ID NO: 3087645 - protein, 59 aa, Giardia lamblia
GSHILYYTLWSFVASFLCILILSVSIPAFLWSNPPTTILCLLFLYLLASFNCTTYSILI

SEQ ID NO: 3087646 - protein, 27 aa, Giardia lamblia
GSIGAYFPFGLCYDFTLLKQRKHSVLD

SEQ ID NO: 3087647 - protein, 30 aa, Giardia lamblia
GSIIFDAIIFLLFLISLTAYLIVGCVFVYK

SEQ ID NO: 3087648 - protein, 25 aa, Giardia lamblia
GSIKLNIFHALYSLGLPVSAQTKAI

SEQ ID NO: 3087649 - protein, 17 aa, Giardia lamblia
GSILLISVSISCGALVI

SEQ ID NO: 3087650 - protein, 29 aa, Giardia lamblia
GSISVLRWILEFVVLAFLIIDIRSLKNLT

SEQ ID NO: 3087651 - protein, 17 aa, Giardia lamblia
GSIVCVLVPLVIRYKLP

SEQ ID NO: 3087652 - protein, 19 aa, Giardia lamblia
GSLCICMEGYILQDDTCVS

SEQ ID NO: 3087653 - protein, 23 aa, Giardia lamblia
GSLHKLCFIIARANGFLHMEPFH

SEQ ID NO: 3087654 - protein, 35 aa, Giardia lamblia
GSLTYMQANPLNITPYCYFLMQTTLDKIFAKYTLS

SEQ ID NO: 3087655 - protein, 18 aa, Giardia lamblia
GSNAMRLIIPQSSKLSCL

SEQ ID NO: 3087656 - protein, 22 aa, Giardia lamblia
GSQYAVALFLRKNLSGTIKNVT

SEQ ID NO: 3087657 - protein, 26 aa, Giardia lamblia
GSRAKYILRMISLDTVFLELTSLNGF

SEQ ID NO: 3087658 - protein, 24 aa, Giardia lamblia
GSRNLVTLPPLLLSKLQNSLTLKI

SEQ ID NO: 3087659 - protein, 27 aa, Giardia lamblia
GSRTILTFYKILTSYLCDILSILIERQ

SEQ ID NO: 3087660 - protein, 36 aa, Giardia lamblia
GSRTVLLYYDEGLAILPYLQAIFSKEIIPKYGFPDY

SEQ ID NO: 3087661 - protein, 17 aa, Giardia lamblia
GSSFYQYSISFSPVFLI

SEQ ID NO: 3087662 - protein, 23 aa, Giardia lamblia
GSSLFFVVQCFPKMALITTISAP

SEQ ID NO: 3087663 - protein, 19 aa, Giardia lamblia
GSSLSCFAGYAPITISLDQ

SEQ ID NO: 3087664 - protein, 26 aa, Giardia lamblia
GSTEQILRLWPIMLTDARRLTGRYIR

SEQ ID NO: 3087665 - protein, 28 aa, Giardia lamblia
GSTSNRWLTVVVLLLSIFPVAAQNVSWS

SEQ ID NO: 3087666 - protein, 23 aa, Giardia lamblia
GSVIGYLHDGVVRRVIVNVSFIG

SEQ ID NO: 3087667 - protein, 22 aa, Giardia lamblia
GSVTLAFQVFLLSSVSEPSTYY

SEQ ID NO: 3087668 - protein, 26 aa, Giardia lamblia
GSVVGFLLWWFLYRRTQPYGAKHVAL

SEQ ID NO: 3087669 - protein, 29 aa, Giardia lamblia
GSVYSLVTFIRWIIILNAIIPLAMKVSLE

SEQ ID NO: 3087670 - protein, 19 aa, Giardia lamblia
GSYGHFYTPIGNNVLCSET

SEQ ID NO: 3087671 - protein, 21 aa, Giardia lamblia
GSYKGVDGCRYCLPPLTGETS

SEQ ID NO: 3087672 - protein, 17 aa, Giardia lamblia
GTAAKWDPNLKACVTDA

SEQ ID NO: 3087673 - protein, 18 aa, Giardia lamblia
GTAAKWDPNLKACVTDAC

SEQ ID NO: 3087674 - protein, 21 aa, Giardia lamblia
GTACDVVAPNFKLISSGSDPK

SEQ ID NO: 3087675 - protein, 26 aa, Giardia lamblia
GTCESCSGGLFLFNGGCYATSRYPGS

SEQ ID NO: 3087676 - protein, 18 aa, Giardia lamblia
GTCVGCRPGYFLFHDGDQ

SEQ ID NO: 3087677 - protein, 37 aa, Giardia lamblia
GTDGDLDVYFYSKFIRLFLWGVSSKRTMDTYWSDIAY

SEQ ID NO: 3087678 - protein, 24 aa, Giardia lamblia
GTEFTFIALFGVALAFALIILSVW

SEQ ID NO: 3087679 - protein, 29 aa, Giardia lamblia
GTGGTKPLLLFALIPSLLTTIANSALSQT

SEQ ID NO: 3087680 - protein, 35 aa, Giardia lamblia
GTGPLNAVLPHKRFLFKTILELSSIIRDSFACYLP

SEQ ID NO: 3087681 - protein, 28 aa, Giardia lamblia
GTGSGFTCSCSYGFFLAEKYCVPNQCTD

SEQ ID NO: 3087682 - protein, 26 aa, Giardia lamblia
GTIDYLLHFLELLMKLYQTEYDALSL

SEQ ID NO: 3087683 - protein, 23 aa, Giardia lamblia
GTIKDMLLSLWLGLATMSSISVF

SEQ ID NO: 3087684 - protein, 20 aa, Giardia lamblia
GTILICYYFGIGSTSNRWLT

SEQ ID NO: 3087685 - protein, 24 aa, Giardia lamblia
GTIYVGGFLDGLYSGAGRLLLPDG

SEQ ID NO: 3087686 - protein, 18 aa, Giardia lamblia
GTLLTGAFLVTNPAEHNG

SEQ ID NO: 3087687 - protein, 27 aa, Giardia lamblia
GTLMNTLFIAFLLHALKRYFVLQLYTT

SEQ ID NO: 3087688 - protein, 26 aa, Giardia lamblia
GTPAAFLRRQLWTAISIVTQLLTANN

SEQ ID NO: 3087689 - protein, 26 aa, Giardia lamblia
GTPIQHFIAVLLMLQLANLSPLTIYK

SEQ ID NO: 3087690 - protein, 26 aa, Giardia lamblia
GTQELAPIPIWTIKAHKDWVTCLCLD

SEQ ID NO: 3087691 - protein, 32 aa, Giardia lamblia
GTQQPLTLIRLHRDYLFWFDREKLTIKEITNC

SEQ ID NO: 3087692 - protein, 25 aa, Giardia lamblia
GTQRWRTIMKYKSRCKVLLSGTPIQ

SEQ ID NO: 3087693 - protein, 25 aa, Giardia lamblia
GTSNWPFLQELKLEQFYNLSCLLRK

SEQ ID NO: 3087694 - protein, 43 aa, Giardia lamblia
GTTAAIVVVVLLVLAAVAGFLVWWFVIRPRKSGVLRERAPRKP

SEQ ID NO: 3087695 - protein, 43 aa, Giardia lamblia
GTTAAIVVVVLLVLAAVAGFLVWWFVIRPRRGGPLRERAPQKG

SEQ ID NO: 3087696 - protein, 42 aa, Giardia lamblia
GTTAAIVVVVLLVLVAVAGFLVWWFVIRPRRGGPLRERAPRK

SEQ ID NO: 3087697 - protein, 43 aa, Giardia lamblia
GTTAAIVVVVLLVLVAVAGFLVWWFVIRPRRGGPLRERVPQKG

SEQ ID NO: 3087698 - protein, 24 aa, Giardia lamblia
GTTALMIAAALNLPLAVSMLVSHE

SEQ ID NO: 3087699 - protein, 38 aa, Giardia lamblia
GTTFVERLLIAKKLILLEIYYIISRYKTVPTKESRIHH

SEQ ID NO: 3087700 - protein, 26 aa, Giardia lamblia
GTTLCFWLMWFCTYAIQINPLIKPQI

SEQ ID NO: 3087701 - protein, 37 aa, Giardia lamblia
GTTMAVLVVGVLVGFLCWWFIFRGRRIDASPSTMTLI

SEQ ID NO: 3087702 - protein, 21 aa, Giardia lamblia
GTTYSVVSFILYSLDGYHLND

SEQ ID NO: 3087703 - protein, 37 aa, Giardia lamblia
GTVNLSYIDPVGSLILCIYILINWTLAARTQIRSMIG

SEQ ID NO: 3087704 - protein, 18 aa, Giardia lamblia
GTVYSPLVRFHLADSEPA

SEQ ID NO: 3087705 - protein, 32 aa, Giardia lamblia
GTVYSVELLTFINLLLLPSPRTRLGAKDLLQV

SEQ ID NO: 3087706 - protein, 20 aa, Giardia lamblia
GTWSFLFDFETGVFPQYLML

SEQ ID NO: 3087707 - protein, 30 aa, Giardia lamblia
GTYHLLILSWVFVILFIPINEESSTPCKVS

SEQ ID NO: 3087708 - protein, 25 aa, Giardia lamblia
GVADRIIWGWNIDITKFKAVEGNPY

SEQ ID NO: 3087709 - protein, 25 aa, Giardia lamblia
GVANHVINYLYKLPLASCRPGLYFL

SEQ ID NO: 3087710 - protein, 33 aa, Giardia lamblia
GVAVIGVLVGFLCWWFLCRGKRIGASPSTTALV

SEQ ID NO: 3087711 - protein, 24 aa, Giardia lamblia
GVCEVCGPTYYLNPVRSSTIQSCI

SEQ ID NO: 3087712 - protein, 27 aa, Giardia lamblia
GVCKLCQDGFFRLPEPAANRQSCMLCN

SEQ ID NO: 3087713 - protein, 30 aa, Giardia lamblia
GVCRANLLYTQYSCFCNDEYILASDGTCQP

SEQ ID NO: 3087714 - protein, 20 aa, Giardia lamblia
GVCSKCQLGYGPLSGSCTPC

SEQ ID NO: 3087715 - protein, 18 aa, Giardia lamblia
GVCTGCLRGYMLYMGGCY

SEQ ID NO: 3087716 - protein, 30 aa, Giardia lamblia
GVCTRCAAGFFLFMGGCYDVSKAPGSHMCK

SEQ ID NO: 3087717 - protein, 23 aa, Giardia lamblia
GVCTRFETLLSSGFICDCPRGSF

SEQ ID NO: 3087718 - protein, 24 aa, Giardia lamblia
GVCYEGKCLPGQGPYPCICDPGFH

SEQ ID NO: 3087719 - protein, 29 aa, Giardia lamblia
GVDAMDFFVFIRVLSRQKLLRKIVENTFT

SEQ ID NO: 3087720 - protein, 18 aa, Giardia lamblia
GVEPFTVRYLSVSSAAAS

SEQ ID NO: 3087721 - protein, 26 aa, Giardia lamblia
GVFDASLLQFLAWLSESTIFELKTVK

SEQ ID NO: 3087722 - protein, 25 aa, Giardia lamblia
GVFSDTILRFPLVSSFTSNLSLEYA

SEQ ID NO: 3087723 - protein, 17 aa, Giardia lamblia
GVFTPYAFCLKNPEFVD

SEQ ID NO: 3087724 - protein, 22 aa, Giardia lamblia
GVGLCEFIVMWSKGDVAVLTDN

SEQ ID NO: 3087725 - protein, 36 aa, Giardia lamblia
GVGVSVVVLVLIGVLIWWLVFQRRRGSGFGGSRDML

SEQ ID NO: 3087726 - protein, 24 aa, Giardia lamblia
GVHFQFPFEPYPSQIEYMSSLITA

SEQ ID NO: 3087727 - protein, 26 aa, Giardia lamblia
GVHLKLHIIQCILRLAFPLNNLEING

SEQ ID NO: 3087728 - protein, 18 aa, Giardia lamblia
GVIFLLSYCIMIPTPYIV

SEQ ID NO: 3087729 - protein, 25 aa, Giardia lamblia
GVIRYLSVVRTLLYALCFVAEDIAP

SEQ ID NO: 3087730 - protein, 20 aa, Giardia lamblia
GVIVYELTILRRPDFLEGKD

SEQ ID NO: 3087731 - protein, 21 aa, Giardia lamblia
GVKHYYLNRITFNYRVMLKEA

SEQ ID NO: 3087732 - protein, 18 aa, Giardia lamblia
GVLKVAMVGGVSSFLCSC

SEQ ID NO: 3087733 - protein, 17 aa, Giardia lamblia
GVLPLYIGIFSLSGHTL

SEQ ID NO: 3087734 - protein, 27 aa, Giardia lamblia
GVLSARCGQLLYIISHLAPLEARHRTS

SEQ ID NO: 3087735 - protein, 37 aa, Giardia lamblia
GVLTKTILDFFLTLLGIVTYWFILSSVVTVPPLLLSI

SEQ ID NO: 3087736 - protein, 49 aa, Giardia lamblia
GVMRDTVFAGSFYRFILYALLPLLARALPVQQYYITVLALIVIGELSAR

SEQ ID NO: 3087737 - protein, 34 aa, Giardia lamblia
GVPEFKVLLSNYLCLLFLDFLSSLLLFYTMYFSK

SEQ ID NO: 3087738 - protein, 20 aa, Giardia lamblia
GVPIVLRYIEPYINSLIDYY

SEQ ID NO: 3087739 - protein, 24 aa, Giardia lamblia
GVPLVFIFSAIFTLSFLNPKSHYN

SEQ ID NO: 3087740 - protein, 29 aa, Giardia lamblia
GVQRHRQILKYLLIENLFDPILSTVESPV

SEQ ID NO: 3087741 - protein, 22 aa, Giardia lamblia
GVRAWVALLCSLIIGFSPIHST

SEQ ID NO: 3087742 - protein, 20 aa, Giardia lamblia
GVRRCWCERGFLPALDRSGC

SEQ ID NO: 3087743 - protein, 18 aa, Giardia lamblia
GVSECTFQLPYLGSLVVT

SEQ ID NO: 3087744 - protein, 25 aa, Giardia lamblia
GVSFKLPWDAITFIFSKIHYGGRVT

SEQ ID NO: 3087745 - protein, 22 aa, Giardia lamblia
GVSFLIILPLSLLKSTKVLSAI

SEQ ID NO: 3087746 - protein, 21 aa, Giardia lamblia
GVSILHIFVDPCGIPILGGGK

SEQ ID NO: 3087747 - protein, 19 aa, Giardia lamblia
GVTATPLLRTMAATLLQTG

SEQ ID NO: 3087748 - protein, 26 aa, Giardia lamblia
GVTKDLFVPWYNSFRFFTQQATRYHE

SEQ ID NO: 3087749 - protein, 20 aa, Giardia lamblia
GVVFYWLAFSVIKDCLIPRQ

SEQ ID NO: 3087750 - protein, 24 aa, Giardia lamblia
GVVLNIILDLIFITALHLGNSGAA

SEQ ID NO: 3087751 - protein, 41 aa, Giardia lamblia
GVVLRGIDYPYFLSQPLLPSIKLSLLRKLTIDIWSRVPNLI

SEQ ID NO: 3087752 - protein, 24 aa, Giardia lamblia
GVVSSLYDFKYASALTKIIEDVVP

SEQ ID NO: 3087753 - protein, 33 aa, Giardia lamblia
GVVVIGVLVGFLCWWFLCRSKHIGASSSTTALV

SEQ ID NO: 3087754 - protein, 18 aa, Giardia lamblia
GVWIAFLLSICLNPTHLQ

SEQ ID NO: 3087755 - protein, 23 aa, Giardia lamblia
GVYPLFFMSNWLDDLFITLFGAR

SEQ ID NO: 3087756 - protein, 19 aa, Giardia lamblia
GVYQYLPILVSTSQYILVE

SEQ ID NO: 3087757 - protein, 17 aa, Giardia lamblia
GVYRLTRHPGYLGWFIW

SEQ ID NO: 3087758 - protein, 19 aa, Giardia lamblia
GWIDFSTFSKPIPASVLRT

SEQ ID NO: 3087759 - protein, 27 aa, Giardia lamblia
GWIISHLVFFGLSFLISVYYIICRPKE

SEQ ID NO: 3087760 - protein, 19 aa, Giardia lamblia
GWTLVCFVISYFLLRYRRF

SEQ ID NO: 3087761 - protein, 24 aa, Giardia lamblia
GYATMFLIFGFLVAYCVISSDYIH

SEQ ID NO: 3087762 - protein, 28 aa, Giardia lamblia
GYCTSCHKTHLFYEYGCYSRHSSTGFAI

SEQ ID NO: 3087763 - protein, 24 aa, Giardia lamblia
GYEFLTPLFLFVIGSLFASKVFKH

SEQ ID NO: 3087764 - protein, 33 aa, Giardia lamblia
GYETVSFYQYLLFFWVFLQLTIMLALMATHKNR

SEQ ID NO: 3087765 - protein, 25 aa, Giardia lamblia
GYFALEVYYLAHLVARYLSSHVLFI

SEQ ID NO: 3087766 - protein, 24 aa, Giardia lamblia
GYGIFWGYILLTLTGNGILQYLGL

SEQ ID NO: 3087767 - protein, 18 aa, Giardia lamblia
GYIWTELCSYLKGSGSSA

SEQ ID NO: 3087768 - protein, 29 aa, Giardia lamblia
GYLSSIFTDSFMFSNLFDFSNRLGKATVH

SEQ ID NO: 3087769 - protein, 23 aa, Giardia lamblia
GYNFPLVCKPAVPAISFIEAHSS

SEQ ID NO: 3087770 - protein, 17 aa, Giardia lamblia
GYNLTHYSYQCICDAGY

SEQ ID NO: 3087771 - protein, 20 aa, Giardia lamblia
GYQRCPLYFIRSILANEKVL

SEQ ID NO: 3087772 - protein, 19 aa, Giardia lamblia
GYVCVPYTRIYVSPRQIVA

SEQ ID NO: 3087773 - protein, 29 aa, Giardia lamblia
GYVFCRFVIWILLIFVFAIGYLAYFEFVV

SEQ ID NO: 3087774 - protein, 25 aa, Giardia lamblia
GYVKYTVCHKVIIGEGIYSEADIGA

SEQ ID NO: 3087775 - protein, 28 aa, Giardia lamblia
GYVTLGYRTLHVLAPYINPLYGNYTVRK

SEQ ID NO: 3087776 - protein, 23 aa, Giardia lamblia
GYVVLVFGLQYLPTPQILELVEL

SEQ ID NO: 3087777 - protein, 19 aa, Giardia lamblia
GYYKVTFGDYSLCRPCHAS

SEQ ID NO: 3087778 - protein, 19 aa, Giardia lamblia
HACYTRALALAREDRRLEI

SEQ ID NO: 3087779 - protein, 23 aa, Giardia lamblia
HAFMLPMDYWPPNLAFSLLLGCA

SEQ ID NO: 3087780 - protein, 20 aa, Giardia lamblia
HAIHPRIMVVRSLLAKLRDM

SEQ ID NO: 3087781 - protein, 24 aa, Giardia lamblia
HAIKIFDFGLSTLYRYPSGRVGSI

SEQ ID NO: 3087782 - protein, 37 aa, Giardia lamblia
HAIRERIAPLYNFVLMALYVLVYSFNIYDEDLAESAR

SEQ ID NO: 3087783 - protein, 17 aa, Giardia lamblia
HAIVIERRKFGPIGYVC

SEQ ID NO: 3087784 - protein, 24 aa, Giardia lamblia
HAKSLPPPPPLPPSSIPLSQHPSQ

SEQ ID NO: 3087785 - protein, 18 aa, Giardia lamblia
HALLLLLLVAQLLLVFHF

SEQ ID NO: 3087786 - protein, 18 aa, Giardia lamblia
HANSRFVPFLFNSVLVSN

SEQ ID NO: 3087787 - protein, 40 aa, Giardia lamblia
HANTLFWQYAQLIDTFFHNLFLSPVSFFRVTLRYAEACSS

SEQ ID NO: 3087788 - protein, 32 aa, Giardia lamblia
HAPPRPAPQAPPHPPLYPAPSTLQAASANTKA

SEQ ID NO: 3087789 - protein, 18 aa, Giardia lamblia
HASLFKVIFNQLASRNFA

SEQ ID NO: 3087790 - protein, 22 aa, Giardia lamblia
HASNSLLLQRLLDAVSAEISAG

SEQ ID NO: 3087791 - protein, 18 aa, Giardia lamblia
HATPRLTIPNTKPIPLRA

SEQ ID NO: 3087792 - protein, 23 aa, Giardia lamblia
HATVPWLMDCGILRTLYEQSFSL

SEQ ID NO: 3087793 - protein, 30 aa, Giardia lamblia
HATWTSWGFGFLRVMKIYDFNFQTLNTTAQ

SEQ ID NO: 3087794 - protein, 18 aa, Giardia lamblia
HCALHYAIRRKNADLTRI

SEQ ID NO: 3087795 - protein, 17 aa, Giardia lamblia
HCHAKIAILLKSTFNFV

SEQ ID NO: 3087796 - protein, 25 aa, Giardia lamblia
HCKKEPLMLLPICGILDDIILFRSH

SEQ ID NO: 3087797 - protein, 22 aa, Giardia lamblia
HCSFTCHLVFFLRQVMKIATFG

SEQ ID NO: 3087798 - protein, 27 aa, Giardia lamblia
HCVADLGCIWISNLHWTQSIGVPKDLT

SEQ ID NO: 3087799 - protein, 30 aa, Giardia lamblia
HDDFLAILPSLYNTLGALFGTTFSWMDPIV

SEQ ID NO: 3087800 - protein, 36 aa, Giardia lamblia
HDDINFLIELLQLLHTLPYPGLPRALFEAAIRNLSP

SEQ ID NO: 3087801 - protein, 24 aa, Giardia lamblia
HDFSCALLLYRVFICPPLQDSYAK

SEQ ID NO: 3087802 - protein, 25 aa, Giardia lamblia
HDHGILWQSWAITLAFALFTVFVHL

SEQ ID NO: 3087803 - protein, 17 aa, Giardia lamblia
HDLSVHRYLLQKDLLFI

SEQ ID NO: 3087804 - protein, 28 aa, Giardia lamblia
HDLTINKFINTLWLLQREPDINRVLKYF

SEQ ID NO: 3087805 - protein, 18 aa, Giardia lamblia
HDMLLQHAMVIVSSGFSN

SEQ ID NO: 3087806 - protein, 30 aa, Giardia lamblia
HDTPCLPGFLIFYLHLYLCPQQYDDASDVN

SEQ ID NO: 3087807 - protein, 25 aa, Giardia lamblia
HECWSNPILLYTDSSIRPIYGLCIS

SEQ ID NO: 3087808 - protein, 23 aa, Giardia lamblia
HEHSIGLPRRYSVAGVYIANHPA

SEQ ID NO: 3087809 - protein, 23 aa, Giardia lamblia
HEKKRLVFTPPMKDSTGSFDMEG

SEQ ID NO: 3087810 - protein, 18 aa, Giardia lamblia
HELAWALTVLLGEELAKS

SEQ ID NO: 3087811 - protein, 24 aa, Giardia lamblia
HELDDFDFLPSYLTWFICSNQSCI

SEQ ID NO: 3087812 - protein, 22 aa, Giardia lamblia
HELEPRTCLYLSTTFLVYLQIL

SEQ ID NO: 3087813 - protein, 19 aa, Giardia lamblia
HELYWCARQLLRLKHSSYK

SEQ ID NO: 3087814 - protein, 35 aa, Giardia lamblia
HENIRTIMYLGSQALLIFIFNPPSGTLARSMLSSI

SEQ ID NO: 3087815 - protein, 25 aa, Giardia lamblia
HESVYTLPFISFLDNLNLLDRRRCG

SEQ ID NO: 3087816 - protein, 28 aa, Giardia lamblia
HEVRRKLLIYLDCHLPPPIFEALLKHAL

SEQ ID NO: 3087817 - protein, 17 aa, Giardia lamblia
HFCQCRRGWAGAACDAP

SEQ ID NO: 3087818 - protein, 25 aa, Giardia lamblia
HFDMLRSQLIFFIAICILGGVSVHL

SEQ ID NO: 3087819 - protein, 22 aa, Giardia lamblia
HFEAFFSDYPLRLSFSANVHKF

SEQ ID NO: 3087820 - protein, 26 aa, Giardia lamblia
HFGIVFRHFLLYYNTSFRYMVEFGVR

SEQ ID NO: 3087821 - protein, 19 aa, Giardia lamblia
HFMMGIVILMYIDVQLLPQ

SEQ ID NO: 3087822 - protein, 25 aa, Giardia lamblia
HFVASLRLALSLRLKFIVGMVINIT

SEQ ID NO: 3087823 - protein, 19 aa, Giardia lamblia
HFVIVLAEPASLLSSPSKA

SEQ ID NO: 3087824 - protein, 21 aa, Giardia lamblia
HFYADLLSAFPNRYALAIVLD

SEQ ID NO: 3087825 - protein, 19 aa, Giardia lamblia
HFYQDFAILQSFQDLATKS

SEQ ID NO: 3087826 - protein, 21 aa, Giardia lamblia
HGAVTLYWKTGSLFDISNVGI

SEQ ID NO: 3087827 - protein, 36 aa, Giardia lamblia
HGDPQLSYCYFPLVVLALVYLYLIRANLPTGLADYS

SEQ ID NO: 3087828 - protein, 37 aa, Giardia lamblia
HGENSYLYKILYTALTYIRFIALSKMWTDMVLEMTKI

SEQ ID NO: 3087829 - protein, 41 aa, Giardia lamblia
HGFTQRLPPMDLLFNVPLLKYWLERLGALTVTLPIASEVIV

SEQ ID NO: 3087830 - protein, 24 aa, Giardia lamblia
HGISGILFMNLRNLTIHKLNQPVS

SEQ ID NO: 3087831 - protein, 25 aa, Giardia lamblia
HGMLRTLTIYLLIGIPAIIVVVVLI

SEQ ID NO: 3087832 - protein, 20 aa, Giardia lamblia
HGNRPVMLSWSPRDDILAVA

SEQ ID NO: 3087833 - protein, 23 aa, Giardia lamblia
HHELNLCLVGRRLNRLDILDTTA

SEQ ID NO: 3087834 - protein, 31 aa, Giardia lamblia
HHKCSKKCLIIWGVIIAVIAIIVISVLSTIF

SEQ ID NO: 3087835 - protein, 26 aa, Giardia lamblia
HHKTLYGVCFLLKPNDSRFTVFLKYC

SEQ ID NO: 3087836 - protein, 24 aa, Giardia lamblia
HHRPTRVLLFDRLEPLIDLFKDQT

SEQ ID NO: 3087837 - protein, 25 aa, Giardia lamblia
HIDEREWLAYLPGYMDTVLSYHTNP

SEQ ID NO: 3087838 - protein, 27 aa, Giardia lamblia
HIDFSHIIDLFFKQLIGADFVLNNYLT

SEQ ID NO: 3087839 - protein, 22 aa, Giardia lamblia
HILVTVWPALFLAKATILLDSL

SEQ ID NO: 3087840 - protein, 25 aa, Giardia lamblia
HIQAFKHFIKFLSLLTDGLDLTRCN

SEQ ID NO: 3087841 - protein, 18 aa, Giardia lamblia
HIRLIFAPNRKIFQDIFF

SEQ ID NO: 3087842 - protein, 19 aa, Giardia lamblia
HISPYYRYIMDKNSPEKFL

SEQ ID NO: 3087843 - protein, 20 aa, Giardia lamblia
HITGRITTILSYLPLGHIYE

SEQ ID NO: 3087844 - protein, 25 aa, Giardia lamblia
HIVNFLIFLILVQYLGIQMVNIFGI

SEQ ID NO: 3087845 - protein, 18 aa, Giardia lamblia
HIYFHVYFNHFGIVFRHF

SEQ ID NO: 3087846 - protein, 27 aa, Giardia lamblia
HKGSHAFRYLPILARDLMLDNVYPVLM

SEQ ID NO: 3087847 - protein, 21 aa, Giardia lamblia
HKKIIFFDILRNQMWTESLYC

SEQ ID NO: 3087848 - protein, 25 aa, Giardia lamblia
HKLSILFVLQQLYPSYLKKLRVESQ

SEQ ID NO: 3087849 - protein, 24 aa, Giardia lamblia
HKQMEYLCNIFLQSKYFACFKERA

SEQ ID NO: 3087850 - protein, 28 aa, Giardia lamblia
HKQMFVTIVLLIYYLTTAFNMYKNKIVS

SEQ ID NO: 3087851 - protein, 23 aa, Giardia lamblia
HKQSIFYGARWMQYHPADVLHVL

SEQ ID NO: 3087852 - protein, 36 aa, Giardia lamblia
HKWMTHRLLTTPIIGPVLNFIFKRFPDATAKRIVYE

SEQ ID NO: 3087853 - protein, 23 aa, Giardia lamblia
HKYIFSTAKLYKRPVRKSTAPYQ

SEQ ID NO: 3087854 - protein, 20 aa, Giardia lamblia
HKYLTFKNGIRAMVFSFLFH

SEQ ID NO: 3087855 - protein, 19 aa, Giardia lamblia
HKYRDVLLDLYIALDFADL

SEQ ID NO: 3087856 - protein, 18 aa, Giardia lamblia
HKYRLLVMWSICFTQICL

SEQ ID NO: 3087857 - protein, 23 aa, Giardia lamblia
HLANNMYYIKRGPFMLRQGSSLI

SEQ ID NO: 3087858 - protein, 24 aa, Giardia lamblia
HLARMLFPVHLYVDSIYPIQLVPC

SEQ ID NO: 3087859 - protein, 25 aa, Giardia lamblia
HLCKILNTCLLIYQVMIQHIPFQGE

SEQ ID NO: 3087860 - protein, 26 aa, Giardia lamblia
HLCRGFFCEKSLYTLSFIKICTGTLM

SEQ ID NO: 3087861 - protein, 18 aa, Giardia lamblia
HLCRIVHAYFKTIFGFTQ

SEQ ID NO: 3087862 - protein, 24 aa, Giardia lamblia
HLDKKTFNLFFTASDLRLPSAVLD

SEQ ID NO: 3087863 - protein, 36 aa, Giardia lamblia
HLDMLHECYIVTLCLYCLVLDLLLQLNLLSISDTSQ

SEQ ID NO: 3087864 - protein, 19 aa, Giardia lamblia
HLDMPVFVSWSPISDILIN

SEQ ID NO: 3087865 - protein, 26 aa, Giardia lamblia
HLFRGAMMLWWGLAQPWYENWSSSMP

SEQ ID NO: 3087866 - protein, 46 aa, Giardia lamblia
HLGPLQSFFMRYIKRHNITALVLFLLSWVFALAIACYYYAPFNPIK

SEQ ID NO: 3087867 - protein, 24 aa, Giardia lamblia
HLHGNILRALFFSHAAALSTLETS

SEQ ID NO: 3087868 - protein, 17 aa, Giardia lamblia
HLIDKSILCSLCRGTSL

SEQ ID NO: 3087869 - protein, 17 aa, Giardia lamblia
HLIDLFEASASSAGPKA

SEQ ID NO: 3087870 - protein, 18 aa, Giardia lamblia
HLKISLIGAVLCFFSKFQ

SEQ ID NO: 3087871 - protein, 25 aa, Giardia lamblia
HLKKQRVLFALPCDLSGDSFTCATF

SEQ ID NO: 3087872 - protein, 24 aa, Giardia lamblia
HLKSPILSLLMRLVTNRKRSDAAD

SEQ ID NO: 3087873 - protein, 18 aa, Giardia lamblia
HLLALSELPSRLLGDRAT

SEQ ID NO: 3087874 - protein, 20 aa, Giardia lamblia
HLLGIFTLHNGIILQIFEGD

SEQ ID NO: 3087875 - protein, 18 aa, Giardia lamblia
HLLQYHPTPLAQLCVKYY

SEQ ID NO: 3087876 - protein, 27 aa, Giardia lamblia
HLLTSLRYYYRAVAIEILFFAYRILSE

SEQ ID NO: 3087877 - protein, 31 aa, Giardia lamblia
HLPDCIIIDLILCRYTLLISNYLLSYSISYK

SEQ ID NO: 3087878 - protein, 25 aa, Giardia lamblia
HLPEKTIWLYAAQILQGVSYLHSRY

SEQ ID NO: 3087879 - protein, 24 aa, Giardia lamblia
HLRTKYRFQLYRYSYKTVVELNSI

SEQ ID NO: 3087880 - protein, 23 aa, Giardia lamblia
HLSDIGFYFMSFGNLSQLNISHL

SEQ ID NO: 3087881 - protein, 18 aa, Giardia lamblia
HLSRPLVALQAVTYALSI

SEQ ID NO: 3087882 - protein, 20 aa, Giardia lamblia
HLTLQAITLLDVLSIELIKL

SEQ ID NO: 3087883 - protein, 36 aa, Giardia lamblia
HLTLTLRHWRIIKALIHLFFRYYGILDVQTGNDSHR

SEQ ID NO: 3087884 - protein, 32 aa, Giardia lamblia
HLVKGFPILAAMDMLYYAFKPQSNLFHPCLSQ

SEQ ID NO: 3087885 - protein, 29 aa, Giardia lamblia
HLWEYKDLALCDPVLLFRLSQSINYKNKD

SEQ ID NO: 3087886 - protein, 17 aa, Giardia lamblia
HMFIEPPEINLVLFGRL

SEQ ID NO: 3087887 - protein, 17 aa, Giardia lamblia
HMSPIATLLFSSSSLVN

SEQ ID NO: 3087888 - protein, 18 aa, Giardia lamblia
HMTAFINICTPFFCAIWN

SEQ ID NO: 3087889 - protein, 32 aa, Giardia lamblia
HNAYLLLSRCYLYVYSRSPPYSLRLPLKRVNG

SEQ ID NO: 3087890 - protein, 24 aa, Giardia lamblia
HNDRLIELLLPYEASICPELLEAA

SEQ ID NO: 3087891 - protein, 27 aa, Giardia lamblia
HNIDLTLFGYYLLNELIFIVTIKICLQ

SEQ ID NO: 3087892 - protein, 26 aa, Giardia lamblia
HNTANITPYQWLPGTVYSPLVRFHLA

SEQ ID NO: 3087893 - protein, 20 aa, Giardia lamblia
HNVPKMLFGMPCKWLADASS

SEQ ID NO: 3087894 - protein, 31 aa, Giardia lamblia
HPAFISYSTFYLLPVFVRTLNILTNLAHCTM

SEQ ID NO: 3087895 - protein, 31 aa, Giardia lamblia
HPCVRIWRRFTRWLLIYLTGHPRRGKGSLGP

SEQ ID NO: 3087896 - protein, 19 aa, Giardia lamblia
HPLKFFSIGWQGWIVTLVL

SEQ ID NO: 3087897 - protein, 29 aa, Giardia lamblia
HPNRVTFLRPCGFLLFSSFINVENLKDIR

SEQ ID NO: 3087898 - protein, 21 aa, Giardia lamblia
HPPLHLCVINLVIGTLYTVRG

SEQ ID NO: 3087899 - protein, 17 aa, Giardia lamblia
HPRAGILPPRSLGGGEW

SEQ ID NO: 3087900 - protein, 31 aa, Giardia lamblia
HPSLYSSSLCVLLLSLFLLLSCDTFVTNWKL

SEQ ID NO: 3087901 - protein, 18 aa, Giardia lamblia
HPVIAFDVLPILQGLSFP

SEQ ID NO: 3087902 - protein, 25 aa, Giardia lamblia
HPVKYHIMGPFTLPKLSFIQQGMRS

SEQ ID NO: 3087903 - protein, 27 aa, Giardia lamblia
HPVVYYLTFFIYYYLVSLAMSVINVFA

SEQ ID NO: 3087904 - protein, 27 aa, Giardia lamblia
HQEELCLIKWLSHGRILVTCDVSGQVI

SEQ ID NO: 3087905 - protein, 22 aa, Giardia lamblia
HQELRLIALRLVSAISHEGELT

SEQ ID NO: 3087906 - protein, 25 aa, Giardia lamblia
HQISMLFFEHNSPYVFIEFLHCYSR

SEQ ID NO: 3087907 - protein, 23 aa, Giardia lamblia
HQLKCFVLRLSEQCAPSMLSLYM

SEQ ID NO: 3087908 - protein, 33 aa, Giardia lamblia
HQTALMLACFYGHLSIVRLLFHKEKSIVSTSGK

SEQ ID NO: 3087909 - protein, 43 aa, Giardia lamblia
HQYENNEIYLFARFLFGDLDFDFYLTYLDIQRALGGLHRDAVD

SEQ ID NO: 3087910 - protein, 23 aa, Giardia lamblia
HRAAFMAPGLLKIITGSIQSISL

SEQ ID NO: 3087911 - protein, 18 aa, Giardia lamblia
HRDLKPDNILLTGDSMIK

SEQ ID NO: 3087912 - protein, 19 aa, Giardia lamblia
HRDVYSNRSFPLCIVSNVI

SEQ ID NO: 3087913 - protein, 18 aa, Giardia lamblia
HREIFYKAVLAFEALAFI

SEQ ID NO: 3087914 - protein, 17 aa, Giardia lamblia
HRELVQKAAFFLLCIHA

SEQ ID NO: 3087915 - protein, 24 aa, Giardia lamblia
HRGEDFCHLWAFYKNKELIEPLPD

SEQ ID NO: 3087916 - protein, 30 aa, Giardia lamblia
HRGRAIFLVMFLCCLLLSLLLTSVVYLITA

SEQ ID NO: 3087917 - protein, 29 aa, Giardia lamblia
HRGVRTGTFLIFMFALVKVLNGSTLLILL

SEQ ID NO: 3087918 - protein, 17 aa, Giardia lamblia
HRIAIDRSLLDRSSADG

SEQ ID NO: 3087919 - protein, 21 aa, Giardia lamblia
HRLANAFLSPILKANGRLSQS

SEQ ID NO: 3087920 - protein, 25 aa, Giardia lamblia
HRLSKLWMKYLSFHSKHTIPLLLSR

SEQ ID NO: 3087921 - protein, 22 aa, Giardia lamblia
HRNYILPHCIFIFATILAYDPS

SEQ ID NO: 3087922 - protein, 23 aa, Giardia lamblia
HRYTRLLHINLLTIASDINTPSF

SEQ ID NO: 3087923 - protein, 24 aa, Giardia lamblia
HSCILEILILLLRAVQVSQEYAEL

SEQ ID NO: 3087924 - protein, 18 aa, Giardia lamblia
HSCLYTCLFIQFLLNDNK

SEQ ID NO: 3087925 - protein, 18 aa, Giardia lamblia
HSFLIAFVAKNVDSEAPG

SEQ ID NO: 3087926 - protein, 22 aa, Giardia lamblia
HSIVALSLFLNSKSFVINGPDN

SEQ ID NO: 3087927 - protein, 19 aa, Giardia lamblia
HSKHTIPLLLSRFSNDKLL

SEQ ID NO: 3087928 - protein, 25 aa, Giardia lamblia
HSKLHVHDILPPELATALPPSLCTQ

SEQ ID NO: 3087929 - protein, 18 aa, Giardia lamblia
HSLAIWTVPASMQNSRIC

SEQ ID NO: 3087930 - protein, 20 aa, Giardia lamblia
HSLFTLGRILATGRPCLLFL

SEQ ID NO: 3087931 - protein, 25 aa, Giardia lamblia
HSLLNPKLLLQYQTREIRYYHTFKL

SEQ ID NO: 3087932 - protein, 20 aa, Giardia lamblia
HSLLRRFCDAGFKNPFLQAA

SEQ ID NO: 3087933 - protein, 24 aa, Giardia lamblia
HSLNERFFRDPLLEDYKDITVVGI

SEQ ID NO: 3087934 - protein, 30 aa, Giardia lamblia
HSNHMEMIWISRVLPINAQLMLLATVLPFL

SEQ ID NO: 3087935 - protein, 33 aa, Giardia lamblia
HSNTELYLITTALSRYLFMRVIYCPFSEYTFAA

SEQ ID NO: 3087936 - protein, 25 aa, Giardia lamblia
HSSHPVIFYFYNLTVLLRAYEQDST

SEQ ID NO: 3087937 - protein, 37 aa, Giardia lamblia
HSSISAYKCMLAMLISYILFIFAHASSGLSIRHPVFL

SEQ ID NO: 3087938 - protein, 17 aa, Giardia lamblia
HSSLLHLFDSILKLFNI

SEQ ID NO: 3087939 - protein, 17 aa, Giardia lamblia
HTDIIDLLAPLENNIRS

SEQ ID NO: 3087940 - protein, 23 aa, Giardia lamblia
HTEHYFKYRTYFSRIVHQVTAPY

SEQ ID NO: 3087941 - protein, 26 aa, Giardia lamblia
HTFENIIFNFNFKLFLQDCNPTKSTL

SEQ ID NO: 3087942 - protein, 20 aa, Giardia lamblia
HTFPCETALLAPVQLPRDSN

SEQ ID NO: 3087943 - protein, 31 aa, Giardia lamblia
HTIRGRQYVILLVRYLYTMVGLGVISLEESQ

SEQ ID NO: 3087944 - protein, 24 aa, Giardia lamblia
HTKESMMPLLNLLKNFGKAIEMEV

SEQ ID NO: 3087945 - protein, 24 aa, Giardia lamblia
HTLEYLLIHNKMYTTYTVYSVTDA

SEQ ID NO: 3087946 - protein, 29 aa, Giardia lamblia
HTSFYLSLPLMDIYLRLTTAVRLLARADM

SEQ ID NO: 3087947 - protein, 17 aa, Giardia lamblia
HTSLPASLVKLSLSTSC

SEQ ID NO: 3087948 - protein, 23 aa, Giardia lamblia
HTVRYPLQYVSRLLPLTKIEPVL

SEQ ID NO: 3087949 - protein, 26 aa, Giardia lamblia
HTVYPDAVIPLPLGYTLGIILASSPA

SEQ ID NO: 3087950 - protein, 37 aa, Giardia lamblia
HVARFTIPVPFEVIWYANAPLVFLSSNTPLGGELSPG

SEQ ID NO: 3087951 - protein, 18 aa, Giardia lamblia
HVFHISSASFIRILTTLK

SEQ ID NO: 3087952 - protein, 20 aa, Giardia lamblia
HVGALMRRAPMRFLIGLLTC

SEQ ID NO: 3087953 - protein, 25 aa, Giardia lamblia
HVGAYLLLITLILEAADRQLVTKEI

SEQ ID NO: 3087954 - protein, 18 aa, Giardia lamblia
HVLAFFLFLGVMLSIIAA

SEQ ID NO: 3087955 - protein, 19 aa, Giardia lamblia
HVLANKVGFSPTLFLNNEL

SEQ ID NO: 3087956 - protein, 18 aa, Giardia lamblia
HVLIIFGATLSAATARHY

SEQ ID NO: 3087957 - protein, 25 aa, Giardia lamblia
HVNRALRELFLLYRVDPPASTIKQD

SEQ ID NO: 3087958 - protein, 23 aa, Giardia lamblia
HVSQLLHILIDTISIGLSADSSE

SEQ ID NO: 3087959 - protein, 21 aa, Giardia lamblia
HVYVRPLKIQLPPIESDLAVA

SEQ ID NO: 3087960 - protein, 29 aa, Giardia lamblia
HWAYYFNHCKKHTYHIAKPSFLLCRSVNS

SEQ ID NO: 3087961 - protein, 27 aa, Giardia lamblia
HWKTLVTFWSRLLREYSLASRLMLLLL

SEQ ID NO: 3087962 - protein, 26 aa, Giardia lamblia
HYAASRVSFFLPVSDTILIVGYDNSV

SEQ ID NO: 3087963 - protein, 32 aa, Giardia lamblia
HYDTTLSFKNFLTKFLPFGAQIVFTVYAVNKK

SEQ ID NO: 3087964 - protein, 19 aa, Giardia lamblia
HYFAEYLDHLIFIIGWEED

SEQ ID NO: 3087965 - protein, 26 aa, Giardia lamblia
HYGHYLLAKIFGFRAVSRQLENFLLD

SEQ ID NO: 3087966 - protein, 20 aa, Giardia lamblia
HYGIRPIVEIVKTPSIMDSS

SEQ ID NO: 3087967 - protein, 18 aa, Giardia lamblia
HYKHWAIIFSIISALIVA

SEQ ID NO: 3087968 - protein, 20 aa, Giardia lamblia
HYLEDPSVLLFYLSCLETRD

SEQ ID NO: 3087969 - protein, 19 aa, Giardia lamblia
HYLIDLPPICRHLNRFHLS

SEQ ID NO: 3087970 - protein, 17 aa, Giardia lamblia
HYRGPLKDGLFHGEGLL

SEQ ID NO: 3087971 - protein, 23 aa, Giardia lamblia
HYSIRLICIALLSSLDLHSAMNG

SEQ ID NO: 3087972 - protein, 39 aa, Giardia lamblia
HYSNKTFIIAMIVLLLVAIAVLVLFVYTLQIAQQRFYMR

SEQ ID NO: 3087973 - protein, 17 aa, Giardia lamblia
IAADLAVPSPYLVAISK

SEQ ID NO: 3087974 - protein, 29 aa, Giardia lamblia
IAAERGYLGIMRLLIPYEAKMQMTGRGWN

SEQ ID NO: 3087975 - protein, 28 aa, Giardia lamblia
IAALGALRIMLMYLPSSYYSSHSKREIT

SEQ ID NO: 3087976 - protein, 26 aa, Giardia lamblia
IAANPLMLPHMFWGISDVAQYIDVLF

SEQ ID NO: 3087977 - protein, 18 aa, Giardia lamblia
IAAPPLLQVLLKEEPYLA

SEQ ID NO: 3087978 - protein, 35 aa, Giardia lamblia
IAAVLIIGAIVGVLCWYFLVYRKKNPRPQWIQNIM

SEQ ID NO: 3087979 - protein, 58 aa, Giardia lamblia
IACISYCSFFLIFKYLYQIKFKKFLIFSLVLLGLSLFLLIVSFIYLIVKVASTRDLTN

SEQ ID NO: 3087980 - protein, 29 aa, Giardia lamblia
IACKQETNIFLFYGSCYKITTTQDRNLGN

SEQ ID NO: 3087981 - protein, 28 aa, Giardia lamblia
IACKQETNIFLFYGSCYTITTAQDRNLG

SEQ ID NO: 3087982 - protein, 25 aa, Giardia lamblia
IACNKLERIFFDCYLHNTFSSCNVL

SEQ ID NO: 3087983 - protein, 35 aa, Giardia lamblia
IADLKGKSTRYLDLILVCFLLKSFGSLRCFRHMYY

SEQ ID NO: 3087984 - protein, 19 aa, Giardia lamblia
IAEIAWKLYEYRVETLSNI

SEQ ID NO: 3087985 - protein, 26 aa, Giardia lamblia
IAEPYPQLSAFLLAFIMGCHLTLAAS

SEQ ID NO: 3087986 - protein, 33 aa, Giardia lamblia
IAFGTVALILLVAFPFLILLEEPSFPTIWTQLV

SEQ ID NO: 3087987 - protein, 33 aa, Giardia lamblia
IAFGTVALILLVAFPFLILLEQPDYPTIWTQFA

SEQ ID NO: 3087988 - protein, 33 aa, Giardia lamblia
IAFGTVALILLVAFPFLILLEQPDYPTIWTQLA

SEQ ID NO: 3087989 - protein, 18 aa, Giardia lamblia
IAFPAHTIPWQAFLEIVR

SEQ ID NO: 3087990 - protein, 21 aa, Giardia lamblia
IAFSVPPFTLRGLYKQLNDVL

SEQ ID NO: 3087991 - protein, 26 aa, Giardia lamblia
IAGGFAYVVRAPISNILSAATISLVP

SEQ ID NO: 3087992 - protein, 27 aa, Giardia lamblia
IAGLSSLRYYPLSFVAHLCRGFFCEKS

SEQ ID NO: 3087993 - protein, 18 aa, Giardia lamblia
IAHLLLDGSLIASIVMIL

SEQ ID NO: 3087994 - protein, 18 aa, Giardia lamblia
IAHRKQLCLLKRACIYIA

SEQ ID NO: 3087995 - protein, 23 aa, Giardia lamblia
IAHYALSLAIYRRRPDINLPFIS

SEQ ID NO: 3087996 - protein, 23 aa, Giardia lamblia
IAIAVIITIVVILIMKKRLKGGE

SEQ ID NO: 3087997 - protein, 27 aa, Giardia lamblia
IAIDPGIFTALLAIEHPCIAKIYDIYH

SEQ ID NO: 3087998 - protein, 25 aa, Giardia lamblia
IAIIVLAILCFPLGMLDFSVLIDVN

SEQ ID NO: 3087999 - protein, 19 aa, Giardia lamblia
IAITSYLSDRLLLTIAKKL

SEQ ID NO: 3088000 - protein, 20 aa, Giardia lamblia
IAKALRFQRPILLEGDPGVG

SEQ ID NO: 3088001 - protein, 29 aa, Giardia lamblia
IAKYALQAITLLFNACKFLEVGQLSVFSF

SEQ ID NO: 3088002 - protein, 26 aa, Giardia lamblia
IALAVNAIIYYLRKISAYHLPALIGY

SEQ ID NO: 3088003 - protein, 17 aa, Giardia lamblia
IALERRLCFDTIIDYYF

SEQ ID NO: 3088004 - protein, 17 aa, Giardia lamblia
IAMILAKQKAELGKQAA

SEQ ID NO: 3088005 - protein, 22 aa, Giardia lamblia
IAMTILLCEAGLAELLIMDEPA

SEQ ID NO: 3088006 - protein, 27 aa, Giardia lamblia
IANGAYLHNGPLTTFLLYVIINDYVDC

SEQ ID NO: 3088007 - protein, 29 aa, Giardia lamblia
IAQNLVLLAFLIFMFLKATMAKVDIDEFI

SEQ ID NO: 3088008 - protein, 25 aa, Giardia lamblia
IAQQFKLFSLLYEVSQLYYQFILFL

SEQ ID NO: 3088009 - protein, 22 aa, Giardia lamblia
IAQYYRLTDIQLNNLRVVLYDY

SEQ ID NO: 3088010 - protein, 26 aa, Giardia lamblia
IARFSGLTLPLMIGSIKLLLQYATHL

SEQ ID NO: 3088011 - protein, 20 aa, Giardia lamblia
IARFVIAIILVFISGVLNGI

SEQ ID NO: 3088012 - protein, 29 aa, Giardia lamblia
IARLVVEEWIFISLAFYIAGYARVIRQIL

SEQ ID NO: 3088013 - protein, 20 aa, Giardia lamblia
IARVLYKPWFSHLVAVMVAI

SEQ ID NO: 3088014 - protein, 19 aa, Giardia lamblia
IASFVLAFLSLVCYLLAYF

SEQ ID NO: 3088015 - protein, 23 aa, Giardia lamblia
IASHSRLFGLYTLIQLSSLYSQF

SEQ ID NO: 3088016 - protein, 18 aa, Giardia lamblia
IASLINLIPLVVAVVFSQ

SEQ ID NO: 3088017 - protein, 34 aa, Giardia lamblia
IASYILENVYFILFLKRLLQYLHFSRAKQRPADY

SEQ ID NO: 3088018 - protein, 25 aa, Giardia lamblia
IATKERVYALLLPQTPILEMSSRHL

SEQ ID NO: 3088019 - protein, 24 aa, Giardia lamblia
IATSLSYLLIPYEAGKLDYSPTCR

SEQ ID NO: 3088020 - protein, 23 aa, Giardia lamblia
IATTIALIVKCQHHRHARMVRQV

SEQ ID NO: 3088021 - protein, 18 aa, Giardia lamblia
IAVALLYAINAENSRLDS

SEQ ID NO: 3088022 - protein, 32 aa, Giardia lamblia
IAVNYHMIYYLVLPSIAMIRFVAVFHGALVSR

SEQ ID NO: 3088023 - protein, 24 aa, Giardia lamblia
IAVQLLCYVCFFTTLLMHVNRRRY

SEQ ID NO: 3088024 - protein, 17 aa, Giardia lamblia
IAWVRYCTPMWFYPVTS

SEQ ID NO: 3088025 - protein, 20 aa, Giardia lamblia
IAYGAVFGFLPRSADTVKNM

SEQ ID NO: 3088026 - protein, 30 aa, Giardia lamblia
IAYQSFLHSLYSFLMSMYSLDDLPTIYNDK

SEQ ID NO: 3088027 - protein, 25 aa, Giardia lamblia
IAYSFSDFFLLSERISPIVLYSGEK

SEQ ID NO: 3088028 - protein, 26 aa, Giardia lamblia
ICDLKKKHFGFMYTALKQPGSSEPIS

SEQ ID NO: 3088029 - protein, 18 aa, Giardia lamblia
ICFDGPVDTLWIESLNTL

SEQ ID NO: 3088030 - protein, 18 aa, Giardia lamblia
ICGLYALTLIEIYSALWS

SEQ ID NO: 3088031 - protein, 17 aa, Giardia lamblia
ICGLYRRWLQTNKMMHV

SEQ ID NO: 3088032 - protein, 27 aa, Giardia lamblia
ICIIHILYSVFYVVTFLVAISYLIMFF

SEQ ID NO: 3088033 - protein, 26 aa, Giardia lamblia
ICKKSFTVVEILGIVFGTFIGIIVIV

SEQ ID NO: 3088034 - protein, 17 aa, Giardia lamblia
ICLADMDIVIAPNSELP

SEQ ID NO: 3088035 - protein, 31 aa, Giardia lamblia
ICLAPYLLDQLFFYQAFTSFWKVVYLNMHIL

SEQ ID NO: 3088036 - protein, 19 aa, Giardia lamblia
ICMYCVSWLFWAFFAGQIA

SEQ ID NO: 3088037 - protein, 32 aa, Giardia lamblia
ICNASSILCVVILLAIFGLLAAIIGKVLVVQA

SEQ ID NO: 3088038 - protein, 29 aa, Giardia lamblia
ICNMEYFMPFISGLRIFYCLQLKTPQTFN

SEQ ID NO: 3088039 - protein, 32 aa, Giardia lamblia
ICRAKVDYFIFKVWFLVVFTSVAIFHKVYSIT

SEQ ID NO: 3088040 - protein, 19 aa, Giardia lamblia
ICSWCLAVVEYATAWDNVK

SEQ ID NO: 3088041 - protein, 17 aa, Giardia lamblia
ICTSCEPGYQLMNYPRY

SEQ ID NO: 3088042 - protein, 18 aa, Giardia lamblia
ICVDLARNLCKICSLGYY

SEQ ID NO: 3088043 - protein, 31 aa, Giardia lamblia
ICVQRAMTILPELLLLLPDLCSISLGSAHPR

SEQ ID NO: 3088044 - protein, 20 aa, Giardia lamblia
IDACTYTRYSTIRSLLIVTW

SEQ ID NO: 3088045 - protein, 18 aa, Giardia lamblia
IDAIDLFIQKCEIIAYCL

SEQ ID NO: 3088046 - protein, 25 aa, Giardia lamblia
IDAKEAANLIFWARLWIGTAVGCLA

SEQ ID NO: 3088047 - protein, 25 aa, Giardia lamblia
IDASTLALFLASTYLRFSAIFLPQC

SEQ ID NO: 3088048 - protein, 18 aa, Giardia lamblia
IDCLAILMHAPLSKISHD

SEQ ID NO: 3088049 - protein, 30 aa, Giardia lamblia
IDDIYFLSTLLHFCRVSFAMYGCVGTKYNL

SEQ ID NO: 3088050 - protein, 20 aa, Giardia lamblia
IDEALVHDLNLAKTAFNDVE

SEQ ID NO: 3088051 - protein, 17 aa, Giardia lamblia
IDEGLCYFFGNKTPNLF

SEQ ID NO: 3088052 - protein, 19 aa, Giardia lamblia
IDERVIVLDLLFRCCAANP

SEQ ID NO: 3088053 - protein, 19 aa, Giardia lamblia
IDESPLIKALTQLVSQFEA

SEQ ID NO: 3088054 - protein, 38 aa, Giardia lamblia
IDFFKGVSLCFIDFLKPIVFILLRNSSHLNWFTSLLTP

SEQ ID NO: 3088055 - protein, 21 aa, Giardia lamblia
IDGQKFFIDDSLALCEGERRI

SEQ ID NO: 3088056 - protein, 24 aa, Giardia lamblia
IDHSFCRLIIWLAGAMPQECSVTT

SEQ ID NO: 3088057 - protein, 17 aa, Giardia lamblia
IDKLAIITTFSYNSTVT

SEQ ID NO: 3088058 - protein, 23 aa, Giardia lamblia
IDKPMSLFLDQVIPYLHLPAAHR

SEQ ID NO: 3088059 - protein, 18 aa, Giardia lamblia
IDLFIQKCEIIAYCLTNN

SEQ ID NO: 3088060 - protein, 31 aa, Giardia lamblia
IDLKEYFISFIVIFLLILCLCLVVINGISAA

SEQ ID NO: 3088061 - protein, 19 aa, Giardia lamblia
IDLLAPLENNIRSFTDATA

SEQ ID NO: 3088062 - protein, 33 aa, Giardia lamblia
IDLSTPWRRFSFSVKRLLLKLSRSTSGGLENDD

SEQ ID NO: 3088063 - protein, 36 aa, Giardia lamblia
IDLVMPKRKGIPNHWLFFLFPIVYKADKIRRKYTKH

SEQ ID NO: 3088064 - protein, 24 aa, Giardia lamblia
IDMTLMVRFLTLQFVANNNSLMIQ

SEQ ID NO: 3088065 - protein, 25 aa, Giardia lamblia
IDPNNYFIAIARLIEFIPDISCFVY

SEQ ID NO: 3088066 - protein, 27 aa, Giardia lamblia
IDPPIPKWIMFLPFNTIALSLGDALFI

SEQ ID NO: 3088067 - protein, 28 aa, Giardia lamblia
IDPVYEVLYIYHSLVILRNLICHSSTMA

SEQ ID NO: 3088068 - protein, 25 aa, Giardia lamblia
IDQLGLACLVHLLRTLRDPPTIHHF

SEQ ID NO: 3088069 - protein, 19 aa, Giardia lamblia
IDRQFMLDLRDSQCTLFVG

SEQ ID NO: 3088070 - protein, 26 aa, Giardia lamblia
IDSILTTRIKFQNYLLIVVATLTIQC

SEQ ID NO: 3088071 - protein, 27 aa, Giardia lamblia
IDSTNVLTFLYAHQKLLMRYEIGAETI

SEQ ID NO: 3088072 - protein, 24 aa, Giardia lamblia
IDSTYLPLCHKLTHLFDGLKGRDL

SEQ ID NO: 3088073 - protein, 30 aa, Giardia lamblia
IDTFFDPQLGLILVYDCNPAMSLSSLCEQR

SEQ ID NO: 3088074 - protein, 29 aa, Giardia lamblia
IDVWCRVQKGYLYLLNIFGSGDIQRQLPN

SEQ ID NO: 3088075 - protein, 26 aa, Giardia lamblia
IDYIAAGLFLMHGFATAQDLGRKFRF

SEQ ID NO: 3088076 - protein, 30 aa, Giardia lamblia
IDYNLDFWCLGVLLFTLYTHKAFCTALSSY

SEQ ID NO: 3088077 - protein, 37 aa, Giardia lamblia
IDYNRLNYVPYSFLQLLLLYSTALAILELLKGQRYAS

SEQ ID NO: 3088078 - protein, 17 aa, Giardia lamblia
IDYVLIPDVRWITDVLM

SEQ ID NO: 3088079 - protein, 19 aa, Giardia lamblia
IEAFNLKSAVAWILGDKEA

SEQ ID NO: 3088080 - protein, 25 aa, Giardia lamblia
IEEAISFLYRLFHVSLEASPDLLLS

SEQ ID NO: 3088081 - protein, 31 aa, Giardia lamblia
IEETLIRTVHANSFFIACIISLCAAADTAVK

SEQ ID NO: 3088082 - protein, 17 aa, Giardia lamblia
IEFLVEGRGLCCVCMAR

SEQ ID NO: 3088083 - protein, 31 aa, Giardia lamblia
IEGLIYLMVITIFFSLIFITPLRQLDGLATF

SEQ ID NO: 3088084 - protein, 17 aa, Giardia lamblia
IEGVFFYSYLFYGENSV

SEQ ID NO: 3088085 - protein, 20 aa, Giardia lamblia
IEISADIFFRIFKVLSKNYS

SEQ ID NO: 3088086 - protein, 28 aa, Giardia lamblia
IEKYLSQIALFPFIKKIALPADATMLRL

SEQ ID NO: 3088087 - protein, 25 aa, Giardia lamblia
IELHETLTLQWIALQQLAMVAIRNV

SEQ ID NO: 3088088 - protein, 20 aa, Giardia lamblia
IELIDILKVETAWSATLIVY

SEQ ID NO: 3088089 - protein, 24 aa, Giardia lamblia
IELSIIVYICAIKFVYSLAPIYFR

SEQ ID NO: 3088090 - protein, 26 aa, Giardia lamblia
IEMRKKLKILLGLKAFRGVKISSQTS

SEQ ID NO: 3088091 - protein, 25 aa, Giardia lamblia
IEQHLEFDLLFLSRSVVPGFDSLLS

SEQ ID NO: 3088092 - protein, 20 aa, Giardia lamblia
IEQRLSQLQLELARNMHNLK

SEQ ID NO: 3088093 - protein, 27 aa, Giardia lamblia
IERFNNLLRFLKTSLDSIRLAIKGLIL

SEQ ID NO: 3088094 - protein, 27 aa, Giardia lamblia
IERHQLTVGLLFSPAARPLDQVADPLK

SEQ ID NO: 3088095 - protein, 17 aa, Giardia lamblia
IERRKFGPIGYVCNLCS

SEQ ID NO: 3088096 - protein, 17 aa, Giardia lamblia
IERWNKLCSLVFIAPDL

SEQ ID NO: 3088097 - protein, 20 aa, Giardia lamblia
IESAVLTLLLLSLYQGQDSK

SEQ ID NO: 3088098 - protein, 25 aa, Giardia lamblia
IETANYFLFKYPDRIMWAIMQRIVR

SEQ ID NO: 3088099 - protein, 23 aa, Giardia lamblia
IETKPHRAPARKPILALPTNSDA

SEQ ID NO: 3088100 - protein, 21 aa, Giardia lamblia
IETSCRCVCMPTFYSSSGTCT

SEQ ID NO: 3088101 - protein, 26 aa, Giardia lamblia
IEVGRSLFQVNLPPLPKGSSFYQYSI

SEQ ID NO: 3088102 - protein, 26 aa, Giardia lamblia
IEVMKTFRHPCLLRLYEVIQSTELDK

SEQ ID NO: 3088103 - protein, 24 aa, Giardia lamblia
IEYIHSDLPTKYWSFHPRYEDIFS

SEQ ID NO: 3088104 - protein, 26 aa, Giardia lamblia
IEYSKHPYVIPKLTNARYKLPPILDS

SEQ ID NO: 3088105 - protein, 40 aa, Giardia lamblia
IFASSVGIVVLVLLVCIGVGLFFVFRRKPAQQLDVTSETR

SEQ ID NO: 3088106 - protein, 17 aa, Giardia lamblia
IFCVMVFSLPAWVDPGY

SEQ ID NO: 3088107 - protein, 24 aa, Giardia lamblia
IFFLSASCFNWLKLSVRVLANIVP

SEQ ID NO: 3088108 - protein, 18 aa, Giardia lamblia
IFFLTVLLCNSIPGLAIV

SEQ ID NO: 3088109 - protein, 22 aa, Giardia lamblia
IFGNFDLFCTRLKKIADIIITN

SEQ ID NO: 3088110 - protein, 17 aa, Giardia lamblia
IFGNILCGVYSLLETLS

SEQ ID NO: 3088111 - protein, 19 aa, Giardia lamblia
IFHLLHHVKTLYVPCLMRP

SEQ ID NO: 3088112 - protein, 19 aa, Giardia lamblia
IFIAIACISYCSFFLIFKY

SEQ ID NO: 3088113 - protein, 20 aa, Giardia lamblia
IFIWLASADTPCWCANDQVL

SEQ ID NO: 3088114 - protein, 29 aa, Giardia lamblia
IFKELRRYISIYSPRYLGIRSTLSQSPLI

SEQ ID NO: 3088115 - protein, 20 aa, Giardia lamblia
IFKYKYIPWIAIPVLGIIGS

SEQ ID NO: 3088116 - protein, 25 aa, Giardia lamblia
IFLELFTRYPKVMAGLALVGLPEAN

SEQ ID NO: 3088117 - protein, 17 aa, Giardia lamblia
IFLHFRYIHRVDFSMIA

SEQ ID NO: 3088118 - protein, 17 aa, Giardia lamblia
IFLQQGVLRFCLSKGFI

SEQ ID NO: 3088119 - protein, 17 aa, Giardia lamblia
IFMIKNRPHFCKQGSHY

SEQ ID NO: 3088120 - protein, 20 aa, Giardia lamblia
IFMRSRWDVFMASNSEDGIM

SEQ ID NO: 3088121 - protein, 17 aa, Giardia lamblia
IFNIHYLSHFDLGSLLY

SEQ ID NO: 3088122 - protein, 24 aa, Giardia lamblia
IFNRVLYYIALVWLGVALGVHLAL

SEQ ID NO: 3088123 - protein, 31 aa, Giardia lamblia
IFPSWVLNIFVCLFLILVVGKRISYLFLIKS

SEQ ID NO: 3088124 - protein, 20 aa, Giardia lamblia
IFREDTIEFLRWVSANALEM

SEQ ID NO: 3088125 - protein, 28 aa, Giardia lamblia
IFSDYTKYSLLFLRPSRVLLPTSGQLHN

SEQ ID NO: 3088126 - protein, 19 aa, Giardia lamblia
IFSGPRRSLSLKPYGSHRG

SEQ ID NO: 3088127 - protein, 22 aa, Giardia lamblia
IFSKKYMIPWNVKVTSFEALNT

SEQ ID NO: 3088128 - protein, 23 aa, Giardia lamblia
IFSSLPMFVYDLVDFYSSCPVFA

SEQ ID NO: 3088129 - protein, 20 aa, Giardia lamblia
IFTCQIWIDLMGKFILSRYF

SEQ ID NO: 3088130 - protein, 17 aa, Giardia lamblia
IFTPVELGLVISGINEL

SEQ ID NO: 3088131 - protein, 17 aa, Giardia lamblia
IGAAIIFPLTIPRSISA

SEQ ID NO: 3088132 - protein, 35 aa, Giardia lamblia
IGAAILAACDLWNFSKALELCRGNKKYMPLLVYLR

SEQ ID NO: 3088133 - protein, 28 aa, Giardia lamblia
IGAYSTTKLLILGLLLAGKHDTARKEII

SEQ ID NO: 3088134 - protein, 30 aa, Giardia lamblia
IGDNLKWGVLCPCFVLFNEAHYTSLFPIDK

SEQ ID NO: 3088135 - protein, 24 aa, Giardia lamblia
IGECIRALAKPYSKLRSFLIKCCS

SEQ ID NO: 3088136 - protein, 19 aa, Giardia lamblia
IGEKYVEALPFSFKNVYAD

SEQ ID NO: 3088137 - protein, 20 aa, Giardia lamblia
IGEVYRCVCAPGWTGYDCSS

SEQ ID NO: 3088138 - protein, 21 aa, Giardia lamblia
IGEYIPIFIASSQLSGAIALF

SEQ ID NO: 3088139 - protein, 38 aa, Giardia lamblia
IGGLIALFIILPIVGLILFAFTRLLFSLLSMTDLRVKK

SEQ ID NO: 3088140 - protein, 22 aa, Giardia lamblia
IGIIFVLVFSFPVVCFALRRAV

SEQ ID NO: 3088141 - protein, 28 aa, Giardia lamblia
IGKLKKYQIIGFSWLVNRFELELNSILS

SEQ ID NO: 3088142 - protein, 24 aa, Giardia lamblia
IGKTYPIFILLGSSLFTFYFTSVY

SEQ ID NO: 3088143 - protein, 28 aa, Giardia lamblia
IGLLEILAQTFLLLKKLSTRPLQTIISY

SEQ ID NO: 3088144 - protein, 23 aa, Giardia lamblia
IGLRNMLPFVVSLLVLCIHSVWC

SEQ ID NO: 3088145 - protein, 24 aa, Giardia lamblia
IGNGIIVIPLMPCNYMAACMSYMR

SEQ ID NO: 3088146 - protein, 20 aa, Giardia lamblia
IGPQRRFLIDPLGDLRRTRE

SEQ ID NO: 3088147 - protein, 32 aa, Giardia lamblia
IGRFPEPLAVFYLAQIVLVIEYLHKHDIVFRD

SEQ ID NO: 3088148 - protein, 23 aa, Giardia lamblia
IGSAPNLVCICSPIYTGENCSTC

SEQ ID NO: 3088149 - protein, 23 aa, Giardia lamblia
IGSDIYLQLNPMVKWTIICYIQK

SEQ ID NO: 3088150 - protein, 24 aa, Giardia lamblia
IGSGDVFKVRYLLYSGGTISYDNT

SEQ ID NO: 3088151 - protein, 17 aa, Giardia lamblia
IGSLYRDLLNKALQTQL

SEQ ID NO: 3088152 - protein, 17 aa, Giardia lamblia
IGSQLMYHCACSNPLFD

SEQ ID NO: 3088153 - protein, 20 aa, Giardia lamblia
IGVAGEMCRCKDGYILQGST

SEQ ID NO: 3088154 - protein, 17 aa, Giardia lamblia
IGWALLLGPLLGLFSKR

SEQ ID NO: 3088155 - protein, 27 aa, Giardia lamblia
IHAIEKLCHPSILAYKIIVLSDSEALL

SEQ ID NO: 3088156 - protein, 17 aa, Giardia lamblia
IHEMVFVGLISLHDPPK

SEQ ID NO: 3088157 - protein, 30 aa, Giardia lamblia
IHGILSSLFYQFYAITAFPSSFIPALVVSV

SEQ ID NO: 3088158 - protein, 28 aa, Giardia lamblia
IHITAYKLLLLFYNKKLTLYEVFTVLLL

SEQ ID NO: 3088159 - protein, 18 aa, Giardia lamblia
IHKRFVHTILPYCHIILG

SEQ ID NO: 3088160 - protein, 27 aa, Giardia lamblia
IHNPAFLIMAIILLIKRTGEQSNRQLY

SEQ ID NO: 3088161 - protein, 19 aa, Giardia lamblia
IHQRYAAALALPETYEGAH

SEQ ID NO: 3088162 - protein, 18 aa, Giardia lamblia
IHSLLHSIDVPEKCDRYA

SEQ ID NO: 3088163 - protein, 18 aa, Giardia lamblia
IHSSLVKTLLAILQDAFR

SEQ ID NO: 3088164 - protein, 17 aa, Giardia lamblia
IHVPYSQLVILLDNLTM

SEQ ID NO: 3088165 - protein, 26 aa, Giardia lamblia
IHYAKDLYCLLYRNPFLHHLAKGISI

SEQ ID NO: 3088166 - protein, 19 aa, Giardia lamblia
IIAAVALTCWFVLRRRRES

SEQ ID NO: 3088167 - protein, 17 aa, Giardia lamblia
IIAGKKRSYQQTVANKE

SEQ ID NO: 3088168 - protein, 31 aa, Giardia lamblia
IIAYTMAIIVLLLIAFFMQSGSLIYYDTLGT

SEQ ID NO: 3088169 - protein, 24 aa, Giardia lamblia
IICGHIPLIFLQISDKEAFTLLYD

SEQ ID NO: 3088170 - protein, 32 aa, Giardia lamblia
IICNTLRYLLLSCSALPPPHILYLLQCRTEDP

SEQ ID NO: 3088171 - protein, 20 aa, Giardia lamblia
IIDAFFTLLNGTVQKSYCVL

SEQ ID NO: 3088172 - protein, 31 aa, Giardia lamblia
IIDSIIFPPIFLLFLVIFSRRFPSTTYSPIF

SEQ ID NO: 3088173 - protein, 18 aa, Giardia lamblia
IIEKLLPFSQSSYMAPLV

SEQ ID NO: 3088174 - protein, 26 aa, Giardia lamblia
IIENMRILISFCWPHKLVLEASKGLN

SEQ ID NO: 3088175 - protein, 33 aa, Giardia lamblia
IIFITSIIILFTIVIQGLPLGFFIKKLRIARER

SEQ ID NO: 3088176 - protein, 27 aa, Giardia lamblia
IIFTPSGSHLLLYIDNYLFSICTNGYA

SEQ ID NO: 3088177 - protein, 39 aa, Giardia lamblia
IIGICVGAVLIMGALIGVLAWWVVSRKKKSASFERSRSL

SEQ ID NO: 3088178 - protein, 17 aa, Giardia lamblia
IIGKRTGALGLKLYKQN

SEQ ID NO: 3088179 - protein, 18 aa, Giardia lamblia
IIIEVECPEVLASGFLSS

SEQ ID NO: 3088180 - protein, 20 aa, Giardia lamblia
IIIFTMEGKIWRLNLLDDKS

SEQ ID NO: 3088181 - protein, 18 aa, Giardia lamblia
IIIGIFTKTVRTSILISF

SEQ ID NO: 3088182 - protein, 17 aa, Giardia lamblia
IIIPACEVYLLEARLED

SEQ ID NO: 3088183 - protein, 26 aa, Giardia lamblia
IIIVLLLTILAIFVPSITLVFDIITS

SEQ ID NO: 3088184 - protein, 28 aa, Giardia lamblia
IILDYKQMFIFMFLQDLLSNSQTNAQRV

SEQ ID NO: 3088185 - protein, 17 aa, Giardia lamblia
IILIGIMASARQLIFID

SEQ ID NO: 3088186 - protein, 18 aa, Giardia lamblia
IILIPTSYSAPALSRVLI

SEQ ID NO: 3088187 - protein, 17 aa, Giardia lamblia
IILLRIFSGYSASGLVA

SEQ ID NO: 3088188 - protein, 27 aa, Giardia lamblia
IILRQEYMYKLNSLLIGLYTSISEFSG

SEQ ID NO: 3088189 - protein, 27 aa, Giardia lamblia
IILRQPLTQIIMGGLWLFLDSTMTAVT

SEQ ID NO: 3088190 - protein, 41 aa, Giardia lamblia
IILSMIPGLLRWAVDPPIPIWLLFLPFNTIALNLGDALIVQ

SEQ ID NO: 3088191 - protein, 18 aa, Giardia lamblia
IILSVWFASWIRQRRAIR

SEQ ID NO: 3088192 - protein, 34 aa, Giardia lamblia
IINDFLSLMYNVILNFIPIFIYALSEQHVKPRYL

SEQ ID NO: 3088193 - protein, 17 aa, Giardia lamblia
IINLFQLATKIYPDTSL

SEQ ID NO: 3088194 - protein, 25 aa, Giardia lamblia
IIREFIEILYLYLARFGRHIVVTLT

SEQ ID NO: 3088195 - protein, 24 aa, Giardia lamblia
IIRILSIFHRDMMSMYNSVLRDDN

SEQ ID NO: 3088196 - protein, 31 aa, Giardia lamblia
IISDQNISFVFLLRLILPANIHIGLIDVTED

SEQ ID NO: 3088197 - protein, 25 aa, Giardia lamblia
IISFCHLPIAFITLSLDTTELFPDF

SEQ ID NO: 3088198 - protein, 28 aa, Giardia lamblia
IISIDHVFTFIHLLPSNPYRTVRANFAK

SEQ ID NO: 3088199 - protein, 19 aa, Giardia lamblia
IISLYDFKLNLLYYDEKGI

SEQ ID NO: 3088200 - protein, 18 aa, Giardia lamblia
IISNIFGPNFKLYGIVLG

SEQ ID NO: 3088201 - protein, 18 aa, Giardia lamblia
IISNIHILMSLKASVQPG

SEQ ID NO: 3088202 - protein, 18 aa, Giardia lamblia
IISQLHINELRKSLEERD

SEQ ID NO: 3088203 - protein, 36 aa, Giardia lamblia
IISSLFGIILVITLILVSLLMLRRCRLRRAAKRHVE

SEQ ID NO: 3088204 - protein, 25 aa, Giardia lamblia
IISSRGKFVSLLLFSFEPKDMQVAY

SEQ ID NO: 3088205 - protein, 20 aa, Giardia lamblia
IIVFSELFHFCNDLAYVVGA

SEQ ID NO: 3088206 - protein, 30 aa, Giardia lamblia
IIWSIMIPIIFIAWHKQLLFFIVSGPYHAD

SEQ ID NO: 3088207 - protein, 21 aa, Giardia lamblia
IIYVGAMLGLFWTATRTKALL

SEQ ID NO: 3088208 - protein, 31 aa, Giardia lamblia
IKAALQLFSLSQIPLPYKLAYRIDPYHNAMM

SEQ ID NO: 3088209 - protein, 20 aa, Giardia lamblia
IKALFEGPFHLFTTLTREST

SEQ ID NO: 3088210 - protein, 26 aa, Giardia lamblia
IKANTLWRAIPYARVTHLLLSEDTES

SEQ ID NO: 3088211 - protein, 19 aa, Giardia lamblia
IKCKPNENVFLFYGGCYTV

SEQ ID NO: 3088212 - protein, 27 aa, Giardia lamblia
IKDIINNRIYISFLSVLLTRHLSQPYQ

SEQ ID NO: 3088213 - protein, 27 aa, Giardia lamblia
IKDKSGPWVLFLHGLTFYTDICAAFLN

SEQ ID NO: 3088214 - protein, 22 aa, Giardia lamblia
IKDLFHCILLIQAGARGFFVRH

SEQ ID NO: 3088215 - protein, 30 aa, Giardia lamblia
IKEFAVFIDPLIQFFYMTSDIEMQQIALIA

SEQ ID NO: 3088216 - protein, 20 aa, Giardia lamblia
IKELFLLSYTSMNGSFCPQR

SEQ ID NO: 3088217 - protein, 17 aa, Giardia lamblia
IKFILRIDISFTEKVHR

SEQ ID NO: 3088218 - protein, 31 aa, Giardia lamblia
IKFSKYIITMIRLLRYHFLKVAQQLSTNTKL

SEQ ID NO: 3088219 - protein, 26 aa, Giardia lamblia
IKGLKEDLHFLLAARDEDNQLLASKN

SEQ ID NO: 3088220 - protein, 19 aa, Giardia lamblia
IKHLVFEVSGLDDFLFTNK

SEQ ID NO: 3088221 - protein, 22 aa, Giardia lamblia
IKHPIKKISILTNPLTSVSSDN

SEQ ID NO: 3088222 - protein, 22 aa, Giardia lamblia
IKHSVFPERLAGYIKDFLSKNG

SEQ ID NO: 3088223 - protein, 24 aa, Giardia lamblia
IKIDVMLGTVLFLAVPAAVPVIVN

SEQ ID NO: 3088224 - protein, 42 aa, Giardia lamblia
IKLLYACVLFIIFVLKMFPIRYVILGWFRLTIDTRKGKIIFY

SEQ ID NO: 3088225 - protein, 24 aa, Giardia lamblia
IKLSLTFVIDIFPSLLTLLSTFID

SEQ ID NO: 3088226 - protein, 26 aa, Giardia lamblia
IKPDLLKALVYFISTQNPVLLSVSFD

SEQ ID NO: 3088227 - protein, 26 aa, Giardia lamblia
IKRAIPWLDLILLLETSISGLVHSTV

SEQ ID NO: 3088228 - protein, 38 aa, Giardia lamblia
IKRFGNMYLPSLYGLKLRALTLMHLLREIEPKIASYLQ

SEQ ID NO: 3088229 - protein, 18 aa, Giardia lamblia
IKSNAMPAIPLPLSFRLS

SEQ ID NO: 3088230 - protein, 24 aa, Giardia lamblia
IKSPTDFEWLRQTRFYWSTDTDNC

SEQ ID NO: 3088231 - protein, 22 aa, Giardia lamblia
IKSVVQLFVLLVDRYYVESQVS

SEQ ID NO: 3088232 - protein, 48 aa, Giardia lamblia
IKTNDTIFIKALKYFLFYHTALVPYSIILATILIYYQYLHNHVVTKLE

SEQ ID NO: 3088233 - protein, 17 aa, Giardia lamblia
IKYSWLYCTVATAAVCL

SEQ ID NO: 3088234 - protein, 24 aa, Giardia lamblia
ILAAILIVPFCFLQEQGMALEPVT

SEQ ID NO: 3088235 - protein, 27 aa, Giardia lamblia
ILAALTALFVLIWMGVRYTLTSVTNIT

SEQ ID NO: 3088236 - protein, 18 aa, Giardia lamblia
ILAELRFILQEICIIQAS

SEQ ID NO: 3088237 - protein, 17 aa, Giardia lamblia
ILAPLRYTTDVPIKGSV

SEQ ID NO: 3088238 - protein, 19 aa, Giardia lamblia
ILASLGFPFGSDGQHLLRN

SEQ ID NO: 3088239 - protein, 18 aa, Giardia lamblia
ILCPFTVQLSCELHMIWP

SEQ ID NO: 3088240 - protein, 31 aa, Giardia lamblia
ILDGIPLSPLIKGSILYFIIKAVAEIIMSPS

SEQ ID NO: 3088241 - protein, 17 aa, Giardia lamblia
ILDIIAIFAIPIGFLYL

SEQ ID NO: 3088242 - protein, 21 aa, Giardia lamblia
ILDILGLPDLLGGLQGLLPAV

SEQ ID NO: 3088243 - protein, 17 aa, Giardia lamblia
ILDLFSQSLLPVAVDFT

SEQ ID NO: 3088244 - protein, 30 aa, Giardia lamblia
ILDRGGMILSISSLFLLYYFCYQIVSEKEA

SEQ ID NO: 3088245 - protein, 20 aa, Giardia lamblia
ILDSILPFVVNCGVPDMMAG

SEQ ID NO: 3088246 - protein, 24 aa, Giardia lamblia
ILEGSLFLIVLQPILLAISSAAPE

SEQ ID NO: 3088247 - protein, 20 aa, Giardia lamblia
ILELYMCILDVHATIQPVLT

SEQ ID NO: 3088248 - protein, 18 aa, Giardia lamblia
ILEWVSGAFFDKTIGRIG

SEQ ID NO: 3088249 - protein, 17 aa, Giardia lamblia
ILFTFIVKAVPLTNAAY

SEQ ID NO: 3088250 - protein, 17 aa, Giardia lamblia
ILFWIGCGTVLISTTCQ

SEQ ID NO: 3088251 - protein, 31 aa, Giardia lamblia
ILGATFTLVAYILIILVGRGGWRSPNFWFEL

SEQ ID NO: 3088252 - protein, 24 aa, Giardia lamblia
ILGEYLMQCNKFLSALYTVTNPHR

SEQ ID NO: 3088253 - protein, 17 aa, Giardia lamblia
ILGGLFTVPAQSQLVQE

SEQ ID NO: 3088254 - protein, 24 aa, Giardia lamblia
ILGGQIMNLFLNALPSRLVPNVMS

SEQ ID NO: 3088255 - protein, 23 aa, Giardia lamblia
ILGIKFDMFSLILESLCYHLQET

SEQ ID NO: 3088256 - protein, 21 aa, Giardia lamblia
ILGSARYCSRCSQGFFPLDGR

SEQ ID NO: 3088257 - protein, 24 aa, Giardia lamblia
ILGVRLFPPFILLGQVILNFFCVG

SEQ ID NO: 3088258 - protein, 19 aa, Giardia lamblia
ILHMHFTVLFLDNGKFEQA

SEQ ID NO: 3088259 - protein, 20 aa, Giardia lamblia
ILHQTAVIIMLFILSSFSVL

SEQ ID NO: 3088260 - protein, 19 aa, Giardia lamblia
ILICFMISVFLTDINPICI

SEQ ID NO: 3088261 - protein, 28 aa, Giardia lamblia
ILILTDLAIYFIPGWRLVSEEIIYGLRE

SEQ ID NO: 3088262 - protein, 22 aa, Giardia lamblia
ILKILLHAPFDTCYALCYFLKT

SEQ ID NO: 3088263 - protein, 24 aa, Giardia lamblia
ILKKLIRSVNFMPPALFQATARSL

SEQ ID NO: 3088264 - protein, 24 aa, Giardia lamblia
ILLDALTFDIYSYAARGLFERHKL

SEQ ID NO: 3088265 - protein, 34 aa, Giardia lamblia
ILLKVADFMSILNTLFIALRLYEALASPSKTKPK

SEQ ID NO: 3088266 - protein, 20 aa, Giardia lamblia
ILLLLSLADPSSDALCLTTL

SEQ ID NO: 3088267 - protein, 18 aa, Giardia lamblia
ILLMSRPAPYNIDDLLLV

SEQ ID NO: 3088268 - protein, 23 aa, Giardia lamblia
ILLTSIVYVIWHPGRLRAYDMLH

SEQ ID NO: 3088269 - protein, 18 aa, Giardia lamblia
ILLVFGLLHSLAGSTHCF

SEQ ID NO: 3088270 - protein, 24 aa, Giardia lamblia
ILNALLPPRTILFHKSQVKFSIPN

SEQ ID NO: 3088271 - protein, 17 aa, Giardia lamblia
ILNALYRLYSCNMFGPI

SEQ ID NO: 3088272 - protein, 27 aa, Giardia lamblia
ILNYNVRLLHSIKFVFFAIEKFTKGVS

SEQ ID NO: 3088273 - protein, 22 aa, Giardia lamblia
ILPFTVTPNYALARYFAFHVLE

SEQ ID NO: 3088274 - protein, 20 aa, Giardia lamblia
ILQATRILYLMAVHEGCHMG

SEQ ID NO: 3088275 - protein, 17 aa, Giardia lamblia
ILQLIKLLSRQLNSDLI

SEQ ID NO: 3088276 - protein, 26 aa, Giardia lamblia
ILQNLKLYLTHVYWAIQRQLQRSPLL

SEQ ID NO: 3088277 - protein, 22 aa, Giardia lamblia
ILQRRVFLRFFVMAASPAKVDA

SEQ ID NO: 3088278 - protein, 19 aa, Giardia lamblia
ILQSLWTMRLTLLRHSYAE

SEQ ID NO: 3088279 - protein, 23 aa, Giardia lamblia
ILQTYVFHVSYPSWPLPDNYIVG

SEQ ID NO: 3088280 - protein, 28 aa, Giardia lamblia
ILRDSSKIMLLLPSNTPDYRPLAACALS

SEQ ID NO: 3088281 - protein, 18 aa, Giardia lamblia
ILRLVLRMMSFSSSDRSI

SEQ ID NO: 3088282 - protein, 23 aa, Giardia lamblia
ILRSIDGILMFIRTISHSRNVGY

SEQ ID NO: 3088283 - protein, 17 aa, Giardia lamblia
ILSAGLVPLFRRHPELL

SEQ ID NO: 3088284 - protein, 23 aa, Giardia lamblia
ILSCWTGLLNLLLSKEHTPSGYP

SEQ ID NO: 3088285 - protein, 39 aa, Giardia lamblia
ILSILSTYLVPQSLRFLAISLLVFCNCILEKAALERVFV

SEQ ID NO: 3088286 - protein, 18 aa, Giardia lamblia
ILSLFRHFSAGISFVRTH

SEQ ID NO: 3088287 - protein, 17 aa, Giardia lamblia
ILSLRKKNYDPINHRLT

SEQ ID NO: 3088288 - protein, 17 aa, Giardia lamblia
ILSNGVYLTFTSLFTIF

SEQ ID NO: 3088289 - protein, 20 aa, Giardia lamblia
ILSTMEFFCRITPPSAIHKF

SEQ ID NO: 3088290 - protein, 33 aa, Giardia lamblia
ILTHQRSYFLGVFPMRPFTLSYTDPRKIMTTCD

SEQ ID NO: 3088291 - protein, 17 aa, Giardia lamblia
ILTLIFAAHFRGPFQTT

SEQ ID NO: 3088292 - protein, 47 aa, Giardia lamblia
ILTMLAILYMDAGKILLYLLLKILQSILSFWYMSTLSITINAYAIAS

SEQ ID NO: 3088293 - protein, 28 aa, Giardia lamblia
ILVHKDTFLIFLVFSGGYATYMLYKSCS

SEQ ID NO: 3088294 - protein, 26 aa, Giardia lamblia
ILVTLPFISLLTLYNLFLEKRYAAAR

SEQ ID NO: 3088295 - protein, 17 aa, Giardia lamblia
ILVVPPPDSPHYEKYRK

SEQ ID NO: 3088296 - protein, 17 aa, Giardia lamblia
ILYLVVLPQFRDKGIGR

SEQ ID NO: 3088297 - protein, 19 aa, Giardia lamblia
ILYMLIALLEAHITSFWSC

SEQ ID NO: 3088298 - protein, 20 aa, Giardia lamblia
ILYNTFLTLHGFSIGLQSKL

SEQ ID NO: 3088299 - protein, 23 aa, Giardia lamblia
IMDGICMSLYLQNEFKTLAFLNA

SEQ ID NO: 3088300 - protein, 25 aa, Giardia lamblia
IMDSLYDLAYLTLNTFFTRLREASK

SEQ ID NO: 3088301 - protein, 18 aa, Giardia lamblia
IMHLIKRNGPDLDHYVGV

SEQ ID NO: 3088302 - protein, 18 aa, Giardia lamblia
IMICVTFGAFIGFLGGYL

SEQ ID NO: 3088303 - protein, 19 aa, Giardia lamblia
IMLLRQMELLTSYVMPFVF

SEQ ID NO: 3088304 - protein, 18 aa, Giardia lamblia
IMMFLMMDCMRRTKVYID

SEQ ID NO: 3088305 - protein, 23 aa, Giardia lamblia
IMMLLCITSFCACLRLYAVDLRW

SEQ ID NO: 3088306 - protein, 33 aa, Giardia lamblia
IMQRYQSLFNAIVGILLPALKKFSQLIGHLAAW

SEQ ID NO: 3088307 - protein, 24 aa, Giardia lamblia
IMSKRYLSKRFFIREFNTQGSEPL

SEQ ID NO: 3088308 - protein, 17 aa, Giardia lamblia
IMSTELLPLVRLQRVDL

SEQ ID NO: 3088309 - protein, 25 aa, Giardia lamblia
IMSYIWVGLMLFAIFLATFLLPLCY

SEQ ID NO: 3088310 - protein, 18 aa, Giardia lamblia
INAFLRKGKLPKKFARQY

SEQ ID NO: 3088311 - protein, 17 aa, Giardia lamblia
INAFVLAALRDPKWELQ

SEQ ID NO: 3088312 - protein, 23 aa, Giardia lamblia
INALTIYRVLTLPGLPVLSLAWS

SEQ ID NO: 3088313 - protein, 17 aa, Giardia lamblia
INAYGWSLGLKQESRTP

SEQ ID NO: 3088314 - protein, 29 aa, Giardia lamblia
INCANSAEYFLFYGGCYYKKSGIGSRLCS

SEQ ID NO: 3088315 - protein, 21 aa, Giardia lamblia
INCYALEVMITWFAKGPVVAF

SEQ ID NO: 3088316 - protein, 23 aa, Giardia lamblia
INFPQFFFMDQCVSLSVMIIDLC

SEQ ID NO: 3088317 - protein, 21 aa, Giardia lamblia
INGFTALMYAAVQGDLRITNT

SEQ ID NO: 3088318 - protein, 26 aa, Giardia lamblia
INGHTDIVKLLFPYEGHLKDNKGNTP

SEQ ID NO: 3088319 - protein, 26 aa, Giardia lamblia
INGPVDLWYPIWVTITLVFALFLGMT

SEQ ID NO: 3088320 - protein, 32 aa, Giardia lamblia
INHLHYMMGLRYIYRWLGDFVYQLVITSIVAL

SEQ ID NO: 3088321 - protein, 17 aa, Giardia lamblia
INIFNLTTGLRSVYFKV

SEQ ID NO: 3088322 - protein, 18 aa, Giardia lamblia
INILSRSFSLVVFADTSV

SEQ ID NO: 3088323 - protein, 19 aa, Giardia lamblia
INISDMFYYFIQTNSIDDV

SEQ ID NO: 3088324 - protein, 18 aa, Giardia lamblia
INKPRGWLRYSTSAFKWP

SEQ ID NO: 3088325 - protein, 19 aa, Giardia lamblia
INLPKLLSERGFSGQLIRI

SEQ ID NO: 3088326 - protein, 27 aa, Giardia lamblia
INLQQPCVTLFLLLRQKISGTLEGRRV

SEQ ID NO: 3088327 - protein, 19 aa, Giardia lamblia
INMYLLEIFSLLMILKSTE

SEQ ID NO: 3088328 - protein, 25 aa, Giardia lamblia
INNEKPLLYLAKWADKYVYSTKSSH

SEQ ID NO: 3088329 - protein, 22 aa, Giardia lamblia
INNIIRRPWESIYNYCPYDSSV

SEQ ID NO: 3088330 - protein, 30 aa, Giardia lamblia
INPHVSQMQYLLWYHGFLQCVFRQYHDKVL

SEQ ID NO: 3088331 - protein, 31 aa, Giardia lamblia
INPICIVISPLYFLVFLQKGTILTNLSTSWL

SEQ ID NO: 3088332 - protein, 23 aa, Giardia lamblia
INSFRHFYRAFIDKLSPADADLV

SEQ ID NO: 3088333 - protein, 22 aa, Giardia lamblia
INSVCLLFNLHLFSNDYVKSQL

SEQ ID NO: 3088334 - protein, 19 aa, Giardia lamblia
INTCYAIKALFEGPFHLFT

SEQ ID NO: 3088335 - protein, 29 aa, Giardia lamblia
INTEVYMVLLIFINFLISNATMISVRRMA

SEQ ID NO: 3088336 - protein, 26 aa, Giardia lamblia
INTGTRFLFSILFPDDLLDTKGNSSQ

SEQ ID NO: 3088337 - protein, 24 aa, Giardia lamblia
INTQLNLFVVTFTKRINLRVTNDI

SEQ ID NO: 3088338 - protein, 19 aa, Giardia lamblia
INVATGCFVGFALIAGATS

SEQ ID NO: 3088339 - protein, 19 aa, Giardia lamblia
INVLKKTPWISWALSNKEI

SEQ ID NO: 3088340 - protein, 50 aa, Giardia lamblia
INVRKFTGVPLYILDGRLPPAPIFNIQLILTMEGLCMYPSRTDFINFIGD

SEQ ID NO: 3088341 - protein, 27 aa, Giardia lamblia
INVVLPEWLLLVLEVAFLLYTTQKMLR

SEQ ID NO: 3088342 - protein, 20 aa, Giardia lamblia
INYPGYLFRQCLFDAAGCMI

SEQ ID NO: 3088343 - protein, 21 aa, Giardia lamblia
INYRHAIYYNLLRRLCSTCTI

SEQ ID NO: 3088344 - protein, 17 aa, Giardia lamblia
IPAIRRKITFRGDISAP

SEQ ID NO: 3088345 - protein, 18 aa, Giardia lamblia
IPATLNPKSYCQTHRYVF

SEQ ID NO: 3088346 - protein, 19 aa, Giardia lamblia
IPCPANCKRCFKRDFCHEC

SEQ ID NO: 3088347 - protein, 18 aa, Giardia lamblia
IPDYDKLYPLLRDALEQH

SEQ ID NO: 3088348 - protein, 18 aa, Giardia lamblia
IPFTNTIIMHLANNIPSR

SEQ ID NO: 3088349 - protein, 20 aa, Giardia lamblia
IPFVLCFCGSLAWRTLLRGF

SEQ ID NO: 3088350 - protein, 17 aa, Giardia lamblia
IPICEKEHTLTGYGFTY

SEQ ID NO: 3088351 - protein, 20 aa, Giardia lamblia
IPLFDGILFALTSFSSNDTL

SEQ ID NO: 3088352 - protein, 23 aa, Giardia lamblia
IPLKEQFIMIMAGLRGAISFALS

SEQ ID NO: 3088353 - protein, 17 aa, Giardia lamblia
IPLLKRKPKMWEIMGVC

SEQ ID NO: 3088354 - protein, 25 aa, Giardia lamblia
IPNILSLSRIPLLFSITACLFAKFP

SEQ ID NO: 3088355 - protein, 23 aa, Giardia lamblia
IPPSVITAFWKTHALETHFALSG

SEQ ID NO: 3088356 - protein, 23 aa, Giardia lamblia
IPRQRNWELYYCKICGLVTHAAD

SEQ ID NO: 3088357 - protein, 25 aa, Giardia lamblia
IPSVSYFLIMLVTTLLREKPSLNSL

SEQ ID NO: 3088358 - protein, 18 aa, Giardia lamblia
IPSYSQWFTQTGDMLLPL

SEQ ID NO: 3088359 - protein, 18 aa, Giardia lamblia
IPTKRRGRRERSAIALIS

SEQ ID NO: 3088360 - protein, 23 aa, Giardia lamblia
IPTLLFCFPFANYELALGVSTGL

SEQ ID NO: 3088361 - protein, 18 aa, Giardia lamblia
IPTLSELYRIPLALNQAS

SEQ ID NO: 3088362 - protein, 18 aa, Giardia lamblia
IPTMVYSFQTSVHKFFFH

SEQ ID NO: 3088363 - protein, 27 aa, Giardia lamblia
IQAFYQLSRWFGFAKCMLRVSVLDARP

SEQ ID NO: 3088364 - protein, 24 aa, Giardia lamblia
IQAIRVIGLYLCVCTTGYILAFDA

SEQ ID NO: 3088365 - protein, 29 aa, Giardia lamblia
IQDLSMSMQLYWLYCTLAIISPQTAEKFH

SEQ ID NO: 3088366 - protein, 18 aa, Giardia lamblia
IQELTTYRPFKFRADFVC

SEQ ID NO: 3088367 - protein, 27 aa, Giardia lamblia
IQEYASSLILLSPYRRFKMNLVCIPHY

SEQ ID NO: 3088368 - protein, 19 aa, Giardia lamblia
IQFALFLSATSFSLGARLY

SEQ ID NO: 3088369 - protein, 18 aa, Giardia lamblia
IQFQYTAGVLVILLTLLS

SEQ ID NO: 3088370 - protein, 24 aa, Giardia lamblia
IQHIFDFMMLVLDDSLRGKFVSIT

SEQ ID NO: 3088371 - protein, 28 aa, Giardia lamblia
IQILATLRPWWYIIGYLVSLVVMYSVLP

SEQ ID NO: 3088372 - protein, 25 aa, Giardia lamblia
IQIMLKNFHVFLNTFIKPNGDAMMN

SEQ ID NO: 3088373 - protein, 40 aa, Giardia lamblia
IQKRFTLFFCHLIVAILSIFYFTIFNYMSLFYASTTFVLT

SEQ ID NO: 3088374 - protein, 18 aa, Giardia lamblia
IQLALWSLGLLLLGAWAL

SEQ ID NO: 3088375 - protein, 21 aa, Giardia lamblia
IQLFLTLGILLSYIMEWGLIS

SEQ ID NO: 3088376 - protein, 30 aa, Giardia lamblia
IQNVLWSYKLIFKVLALLSRSFYTPSKDPD

SEQ ID NO: 3088377 - protein, 23 aa, Giardia lamblia
IQSDILEIYRLLMEVMSLAIEPL

SEQ ID NO: 3088378 - protein, 22 aa, Giardia lamblia
IQSLLPRYRAVPIVAALDMSAF

SEQ ID NO: 3088379 - protein, 24 aa, Giardia lamblia
IQSTLALPLLTLVLLFCKHEPGSQ

SEQ ID NO: 3088380 - protein, 32 aa, Giardia lamblia
IQTGNAYILSFLHLLCMFILTINNSEALSFEP

SEQ ID NO: 3088381 - protein, 39 aa, Giardia lamblia
IQTIRAHFQPVEYMRLLLSFFCPYLFYDSTTKKDLQIAD

SEQ ID NO: 3088382 - protein, 42 aa, Giardia lamblia
IQVEINRFVKLISIIAICIGVLFFILSLSLGIEWLESFLFGV

SEQ ID NO: 3088383 - protein, 19 aa, Giardia lamblia
IQVTLIFFDKIISIDHVFT

SEQ ID NO: 3088384 - protein, 24 aa, Giardia lamblia
IQYVPPVQLMQKWAPSRSASLKVQ

SEQ ID NO: 3088385 - protein, 26 aa, Giardia lamblia
IRCADFHAPLYLAAQLLRLDLRESGE

SEQ ID NO: 3088386 - protein, 24 aa, Giardia lamblia
IRDFNLLTIVFTMSGRYLYSTGFQ

SEQ ID NO: 3088387 - protein, 35 aa, Giardia lamblia
IRDGTLMPAISLYWSFFYFSLFSLTNNVITAMSLL

SEQ ID NO: 3088388 - protein, 21 aa, Giardia lamblia
IRDLCLFVHSLPIKASYSAIS

SEQ ID NO: 3088389 - protein, 33 aa, Giardia lamblia
IRDTLSGLDLLTYLPALLLVTLNHQRNPEQDIG

SEQ ID NO: 3088390 - protein, 34 aa, Giardia lamblia
IREPSRLLAFVFQYVFFALFAGSLFWRLGTTMSE

SEQ ID NO: 3088391 - protein, 18 aa, Giardia lamblia
IRGERLRKLFPMHSLIEI

SEQ ID NO: 3088392 - protein, 25 aa, Giardia lamblia
IRGHGLLFIDLLLGTTYAGKDATYT

SEQ ID NO: 3088393 - protein, 23 aa, Giardia lamblia
IRGPHRIFPGGLAVPRAIGDLPY

SEQ ID NO: 3088394 - protein, 24 aa, Giardia lamblia
IRILAIQRHLLQHPGLLSLISTVM

SEQ ID NO: 3088395 - protein, 28 aa, Giardia lamblia
IRKYDITYPIFIFVPSSSLFPSALNANH

SEQ ID NO: 3088396 - protein, 17 aa, Giardia lamblia
IRLMLFTMGYCVIVRNR

SEQ ID NO: 3088397 - protein, 24 aa, Giardia lamblia
IRLMSFTFLIFRIISIVVMISFPY

SEQ ID NO: 3088398 - protein, 33 aa, Giardia lamblia
IRLTPLECTIILRFFYKHLLMEYPDLFCQAEAL

SEQ ID NO: 3088399 - protein, 17 aa, Giardia lamblia
IRLVDPYLRIPPKEPVS

SEQ ID NO: 3088400 - protein, 18 aa, Giardia lamblia
IRLYTIAASYCMISSIPP

SEQ ID NO: 3088401 - protein, 19 aa, Giardia lamblia
IRMLLPGMTRSQIEKWLYS

SEQ ID NO: 3088402 - protein, 32 aa, Giardia lamblia
IRMVQPIYQGLLPFLFTIDLGIFYPQVYIIRD

SEQ ID NO: 3088403 - protein, 30 aa, Giardia lamblia
IRNISPIIPLSLLLYLSVALYDAGSYMECL

SEQ ID NO: 3088404 - protein, 26 aa, Giardia lamblia
IRNLSPIVSYMLWKSKNTLYAIHAHT

SEQ ID NO: 3088405 - protein, 31 aa, Giardia lamblia
IRPGMVSLPTLPYLTQLAPPTLPLTVEECVS

SEQ ID NO: 3088406 - protein, 34 aa, Giardia lamblia
IRPNDIFLKVTFPWGLYIFFTIVVSLQASFLVMG

SEQ ID NO: 3088407 - protein, 20 aa, Giardia lamblia
IRQCFVQYSCIIITLTDATT

SEQ ID NO: 3088408 - protein, 31 aa, Giardia lamblia
IRQFNVVVFLMYILVFVAQWIIAASLEYIKF

SEQ ID NO: 3088409 - protein, 18 aa, Giardia lamblia
IRSLLQAINFLYSNDTKL

SEQ ID NO: 3088410 - protein, 30 aa, Giardia lamblia
IRSYINPVVFSILPLFTNVICLLLDHSEHS

SEQ ID NO: 3088411 - protein, 31 aa, Giardia lamblia
IRSYTQHFFTLWIPFLLDLELRDAEVGMLFC

SEQ ID NO: 3088412 - protein, 18 aa, Giardia lamblia
IRTLKRLILANKSAFMDK

SEQ ID NO: 3088413 - protein, 31 aa, Giardia lamblia
IRTTPLLIFSLLRIVFGVLFLLMGIPVPTLS

SEQ ID NO: 3088414 - protein, 25 aa, Giardia lamblia
IRTYPAFAEAMMALLPRGLTVFGWN

SEQ ID NO: 3088415 - protein, 18 aa, Giardia lamblia
IRVLKSMPLNKISTALYS

SEQ ID NO: 3088416 - protein, 22 aa, Giardia lamblia
ISACLYEFYLSTSGPNWYSSEG

SEQ ID NO: 3088417 - protein, 20 aa, Giardia lamblia
ISALAVRLGLAGLPLQLFVS

SEQ ID NO: 3088418 - protein, 21 aa, Giardia lamblia
ISAYHLPALIGYSRDFFIIFK

SEQ ID NO: 3088419 - protein, 50 aa, Giardia lamblia
ISCGFIAALLVVIVYLSLITLRYCQLPSTFEKVLLTWASRPRVVHVEPSP

SEQ ID NO: 3088420 - protein, 17 aa, Giardia lamblia
ISCLILLREEKVQHLCN

SEQ ID NO: 3088421 - protein, 17 aa, Giardia lamblia
ISCLISVFGLSPANATT

SEQ ID NO: 3088422 - protein, 24 aa, Giardia lamblia
ISDHMFALLLKSLRMHENLSILKD

SEQ ID NO: 3088423 - protein, 17 aa, Giardia lamblia
ISDPRLIPVINLGPLFP

SEQ ID NO: 3088424 - protein, 25 aa, Giardia lamblia
ISDTLAVSALIPIQKKRWTHTGTAL

SEQ ID NO: 3088425 - protein, 17 aa, Giardia lamblia
ISELMKMFYGKPGFYIY

SEQ ID NO: 3088426 - protein, 29 aa, Giardia lamblia
ISENMGFLVQYLFYRPSSFFSEARKGSAS

SEQ ID NO: 3088427 - protein, 31 aa, Giardia lamblia
ISEPEGVRITRLYSILVAALPAPLVIVYHDG

SEQ ID NO: 3088428 - protein, 26 aa, Giardia lamblia
ISERLCFYDVFILTLSTLSVPEVRSI

SEQ ID NO: 3088429 - protein, 21 aa, Giardia lamblia
ISFGLPLFIVLINGVGHYNVY

SEQ ID NO: 3088430 - protein, 41 aa, Giardia lamblia
ISIIVVVVVALVILAVAIFLIWKFVIKPRSKSRKRSNNDLN

SEQ ID NO: 3088431 - protein, 21 aa, Giardia lamblia
ISIKTMALNRLFLFKERMSAI

SEQ ID NO: 3088432 - protein, 17 aa, Giardia lamblia
ISILLITFGLLPDYTYD

SEQ ID NO: 3088433 - protein, 30 aa, Giardia lamblia
ISISRVSMLLPELLYILPRLTIVRNGVQDM

SEQ ID NO: 3088434 - protein, 25 aa, Giardia lamblia
ISLLQQLHVILNRPTMKTLIMDKYE

SEQ ID NO: 3088435 - protein, 24 aa, Giardia lamblia
ISLQKNLLMLPLREICAKFNSDFF

SEQ ID NO: 3088436 - protein, 25 aa, Giardia lamblia
ISLSKLYFEYYLLPGMVVKRMLIDQ

SEQ ID NO: 3088437 - protein, 45 aa, Giardia lamblia
ISLTLKLTSFYYTDKIYWNARKAIFYSYYPYLPYSTNDQDLATME

SEQ ID NO: 3088438 - protein, 18 aa, Giardia lamblia
ISMAVTCLCVTIPALHAR

SEQ ID NO: 3088439 - protein, 25 aa, Giardia lamblia
ISMHPPANLPIFLSPSPSAFCGTFL

SEQ ID NO: 3088440 - protein, 26 aa, Giardia lamblia
ISMLTLLIEDCLTLLTLIIDGSSATH

SEQ ID NO: 3088441 - protein, 24 aa, Giardia lamblia
ISMLYILIVFLERVAFIKSSVNAT

SEQ ID NO: 3088442 - protein, 37 aa, Giardia lamblia
ISMSLLMTVWAFLQANTLFLKLPFISLEDFSDALDVT

SEQ ID NO: 3088443 - protein, 41 aa, Giardia lamblia
ISNEGFRIISILLLIKFFSESFMILAIPLFIEVVLGPKYSN

SEQ ID NO: 3088444 - protein, 17 aa, Giardia lamblia
ISNILSAATISLVPAAD

SEQ ID NO: 3088445 - protein, 17 aa, Giardia lamblia
ISNLMDIRYSYAEGTLA

SEQ ID NO: 3088446 - protein, 33 aa, Giardia lamblia
ISNMAERYYLVRLYFVEKIIPLILSSTIVALLQ

SEQ ID NO: 3088447 - protein, 31 aa, Giardia lamblia
ISPAIYAQLPLLRYIIDRFVSFISSTLQSKY

SEQ ID NO: 3088448 - protein, 29 aa, Giardia lamblia
ISQAFSAAPTLWIPLLEIYEEFMGNSYSS

SEQ ID NO: 3088449 - protein, 20 aa, Giardia lamblia
ISQFLLIDGPAFTNLNFAKA

SEQ ID NO: 3088450 - protein, 28 aa, Giardia lamblia
ISQRLSTWTIVWIVIGSVLGVIVLALII

SEQ ID NO: 3088451 - protein, 19 aa, Giardia lamblia
ISRILAHCFDLPPSAFSHY

SEQ ID NO: 3088452 - protein, 28 aa, Giardia lamblia
ISRPNTMQLLFFLPSMLVAIVQMIITFT

SEQ ID NO: 3088453 - protein, 34 aa, Giardia lamblia
ISSHYIVMASDLFEWCMPPPIVSLPQPIVCLAKL

SEQ ID NO: 3088454 - protein, 24 aa, Giardia lamblia
ISSIILLLILTFFLSGLYIRQDDS

SEQ ID NO: 3088455 - protein, 21 aa, Giardia lamblia
ISSVLLFLWVSGDISNFSSLI

SEQ ID NO: 3088456 - protein, 26 aa, Giardia lamblia
ISTCKYTWYNFIFKFLIEQYQRPNNI

SEQ ID NO: 3088457 - protein, 26 aa, Giardia lamblia
ISTSGDMFLFGFKTLAVGAYKDILAK

SEQ ID NO: 3088458 - protein, 32 aa, Giardia lamblia
ISTVFSAFMLLYRMEYINGGLLFNSLSYYRLY

SEQ ID NO: 3088459 - protein, 32 aa, Giardia lamblia
ISVFLMAESLLLLYNKIIPYVLMYTESICKRN

SEQ ID NO: 3088460 - protein, 19 aa, Giardia lamblia
ISVFVFLRHHSFDASPAVL

SEQ ID NO: 3088461 - protein, 30 aa, Giardia lamblia
ISVSPVLNDLLWQLLLLGLAVCVCITVELV

SEQ ID NO: 3088462 - protein, 28 aa, Giardia lamblia
ISVVRQCVTWFFINYPQEFENASSFYKR

SEQ ID NO: 3088463 - protein, 24 aa, Giardia lamblia
ISVYTTLPTLIPLDTICVQSCNAT

SEQ ID NO: 3088464 - protein, 21 aa, Giardia lamblia
ISYKRNPLYNLLIKKYQINKI

SEQ ID NO: 3088465 - protein, 18 aa, Giardia lamblia
ISYLRFFGEYTQGPWCCV

SEQ ID NO: 3088466 - protein, 18 aa, Giardia lamblia
ITCFACKNGYYLAKNNKC

SEQ ID NO: 3088467 - protein, 23 aa, Giardia lamblia
ITCLPIVIYTREKAVWPISIQAL

SEQ ID NO: 3088468 - protein, 27 aa, Giardia lamblia
ITDILTSQFFYPFISTFSNTASFFAKV

SEQ ID NO: 3088469 - protein, 29 aa, Giardia lamblia
ITDTNQHIYLLYIYGRLLTFRNPCQRKQL

SEQ ID NO: 3088470 - protein, 28 aa, Giardia lamblia
ITEAAFIPFLRRLGFCSLYLSYGHDVLL

SEQ ID NO: 3088471 - protein, 21 aa, Giardia lamblia
ITEHAMLPFNVASPATLSVAV

SEQ ID NO: 3088472 - protein, 26 aa, Giardia lamblia
ITFLKNPFVCFLNGLLNHIFYSPRLA

SEQ ID NO: 3088473 - protein, 25 aa, Giardia lamblia
ITGEPEWWRDFWGPTIKDNLPDPER

SEQ ID NO: 3088474 - protein, 33 aa, Giardia lamblia
ITGTYQFTGPRRILFKVVPYTGNAYAAALILPT

SEQ ID NO: 3088475 - protein, 20 aa, Giardia lamblia
ITHFLTCLAFILSIFYKINN

SEQ ID NO: 3088476 - protein, 20 aa, Giardia lamblia
ITHMTDLLKELVLGVYNNYY

SEQ ID NO: 3088477 - protein, 24 aa, Giardia lamblia
ITIAQLYIGVALLRSLIESSFGIS

SEQ ID NO: 3088478 - protein, 17 aa, Giardia lamblia
ITICTAIAMMLLSRSAE

SEQ ID NO: 3088479 - protein, 24 aa, Giardia lamblia
ITIWGVFPLVPIPVSILEGSLFLI

SEQ ID NO: 3088480 - protein, 17 aa, Giardia lamblia
ITKSFHVLIVTTTLQRA

SEQ ID NO: 3088481 - protein, 28 aa, Giardia lamblia
ITLDDTYTIFPFRYVMSYLNNVTYDELS

SEQ ID NO: 3088482 - protein, 21 aa, Giardia lamblia
ITLGLVFPLLMTISISSTAPK

SEQ ID NO: 3088483 - protein, 20 aa, Giardia lamblia
ITLLATCKHDHTCHSAVFNC

SEQ ID NO: 3088484 - protein, 23 aa, Giardia lamblia
ITLRDLFRVADRLPRTLTELAMG

SEQ ID NO: 3088485 - protein, 18 aa, Giardia lamblia
ITMFGLFFSSFLGTIKLG

SEQ ID NO: 3088486 - protein, 24 aa, Giardia lamblia
ITMKDFQALYFISSYSRIRGCFHR

SEQ ID NO: 3088487 - protein, 26 aa, Giardia lamblia
ITNNLGAFTCFPINEFISFLMQNNGV

SEQ ID NO: 3088488 - protein, 17 aa, Giardia lamblia
ITNQVALPQLMSLFCLP

SEQ ID NO: 3088489 - protein, 30 aa, Giardia lamblia
ITNTQLYILFSVYAILLSAVLLGSIHRNAF

SEQ ID NO: 3088490 - protein, 33 aa, Giardia lamblia
ITPAGTLFVRGLLLLVARLANWCRDQLLIESYV

SEQ ID NO: 3088491 - protein, 25 aa, Giardia lamblia
ITPGKIALIIPLGWGIKGLTQEQKV

SEQ ID NO: 3088492 - protein, 30 aa, Giardia lamblia
ITPGYEPLVDIWSLGILLLQACAVPRGDLR

SEQ ID NO: 3088493 - protein, 17 aa, Giardia lamblia
ITPIILSSIRLLSDNIV

SEQ ID NO: 3088494 - protein, 18 aa, Giardia lamblia
ITPYEYMIRFYPKPVLSF

SEQ ID NO: 3088495 - protein, 33 aa, Giardia lamblia
ITPYTWEAVFILFDKLLFGVGMLESFGAVFLCL

SEQ ID NO: 3088496 - protein, 24 aa, Giardia lamblia
ITQDQLIHILSSQAYPGCYCSCSD

SEQ ID NO: 3088497 - protein, 22 aa, Giardia lamblia
ITRICTSMLMFITSSHNRALLC

SEQ ID NO: 3088498 - protein, 26 aa, Giardia lamblia
ITTEHLFSLLLLLSCVPVTLLVLHHF

SEQ ID NO: 3088499 - protein, 25 aa, Giardia lamblia
ITVCSLCRTGLVPINGVCVNQTTAH

SEQ ID NO: 3088500 - protein, 18 aa, Giardia lamblia
ITVNFLVSILSPENVRAI

SEQ ID NO: 3088501 - protein, 23 aa, Giardia lamblia
ITVSLIDFKLSLISAFITVRQNI

SEQ ID NO: 3088502 - protein, 22 aa, Giardia lamblia
ITVSLILYLLNGIGSALMFSQV

SEQ ID NO: 3088503 - protein, 17 aa, Giardia lamblia
IVATGPVLLWEALNLAK

SEQ ID NO: 3088504 - protein, 17 aa, Giardia lamblia
IVAYIVNLLLKQIAQFV

SEQ ID NO: 3088505 - protein, 23 aa, Giardia lamblia
IVCLIYFMVMILSFAILSNSSSI

SEQ ID NO: 3088506 - protein, 18 aa, Giardia lamblia
IVCMLLKQQDVVTSGLLN

SEQ ID NO: 3088507 - protein, 31 aa, Giardia lamblia
IVEEPQALQWMTVPPLPGVPSLFAEALRLTE

SEQ ID NO: 3088508 - protein, 26 aa, Giardia lamblia
IVESILIPFNIDAMFAFFEATGQLVH

SEQ ID NO: 3088509 - protein, 17 aa, Giardia lamblia
IVFCKLLHIGQREPSTL

SEQ ID NO: 3088510 - protein, 19 aa, Giardia lamblia
IVFCLVLAIPLLKRKPKMW

SEQ ID NO: 3088511 - protein, 20 aa, Giardia lamblia
IVFCLVLAIPLLKRKPKMWE

SEQ ID NO: 3088512 - protein, 25 aa, Giardia lamblia
IVGAWAMLFFVVQLIKYLKKLDVGK

SEQ ID NO: 3088513 - protein, 34 aa, Giardia lamblia
IVHLSQMILVAYGGYRRSLFESMTLVWSKISTEN

SEQ ID NO: 3088514 - protein, 25 aa, Giardia lamblia
IVILTSFPVMLYPIRANILAWFKID

SEQ ID NO: 3088515 - protein, 36 aa, Giardia lamblia
IVIVVLLVLAVAGFLVWWFVFRRGGRPKRGAKYTSL

SEQ ID NO: 3088516 - protein, 25 aa, Giardia lamblia
IVLAFLHLVLIFLSLPDLRCLEKAP

SEQ ID NO: 3088517 - protein, 19 aa, Giardia lamblia
IVLALIIALVIVRSRQRKL

SEQ ID NO: 3088518 - protein, 32 aa, Giardia lamblia
IVLISSLLPGILPLYLDFLGRTDLRKITHFCL

SEQ ID NO: 3088519 - protein, 26 aa, Giardia lamblia
IVLTNYRMLLFRAISPTEFTPFASIP

SEQ ID NO: 3088520 - protein, 18 aa, Giardia lamblia
IVLYTLRDYSRDMFFKIC

SEQ ID NO: 3088521 - protein, 19 aa, Giardia lamblia
IVMVTFGCVFLVLAIVFII

SEQ ID NO: 3088522 - protein, 18 aa, Giardia lamblia
IVNLLLKQIAQFVTTRRT

SEQ ID NO: 3088523 - protein, 19 aa, Giardia lamblia
IVPRDILLINSKLLTRQLS

SEQ ID NO: 3088524 - protein, 19 aa, Giardia lamblia
IVQVYSLLAKQAKLTDRNG

SEQ ID NO: 3088525 - protein, 18 aa, Giardia lamblia
IVRPCSVSIYLQIPLVTG

SEQ ID NO: 3088526 - protein, 41 aa, Giardia lamblia
IVRRELLPGPFLIPVIAFPFIILLSLLKFFGLNTSQRKILP

SEQ ID NO: 3088527 - protein, 18 aa, Giardia lamblia
IVRYKAIHKGSMGDKVYL

SEQ ID NO: 3088528 - protein, 26 aa, Giardia lamblia
IVSIGYLVFIIMLYVSVAKNMHVLLH

SEQ ID NO: 3088529 - protein, 22 aa, Giardia lamblia
IVSILYIIFVVVGFFVLTTFDK

SEQ ID NO: 3088530 - protein, 19 aa, Giardia lamblia
IVSLLSGHILFIDRTQQLQ

SEQ ID NO: 3088531 - protein, 20 aa, Giardia lamblia
IVSLQSLVLLVAYNGTTTAG

SEQ ID NO: 3088532 - protein, 32 aa, Giardia lamblia
IVSSYIPFKFLFYFFLLLSSYWVPQCYHMYKI

SEQ ID NO: 3088533 - protein, 27 aa, Giardia lamblia
IVSYPIILLPVRASIMRWIPYNKMNGR

SEQ ID NO: 3088534 - protein, 23 aa, Giardia lamblia
IVSYPPHCYLKIVQALYPGSELM

SEQ ID NO: 3088535 - protein, 38 aa, Giardia lamblia
IVVFTVIVIVEIVALVILLVLLVLRIKKSKRAEALEVE

SEQ ID NO: 3088536 - protein, 17 aa, Giardia lamblia
IVVIKILYALVVCVAYP

SEQ ID NO: 3088537 - protein, 19 aa, Giardia lamblia
IVVVGGLVGFLCWWFICRG

SEQ ID NO: 3088538 - protein, 27 aa, Giardia lamblia
IVYANYIQFFFRDFIKYTTTTSCYSLL

SEQ ID NO: 3088539 - protein, 35 aa, Giardia lamblia
IVYILIKLLYCIVVILPFTLLPRGTLHGLTIGCAV

SEQ ID NO: 3088540 - protein, 17 aa, Giardia lamblia
IWEIYRHGPVVASVYAN

SEQ ID NO: 3088541 - protein, 17 aa, Giardia lamblia
IWGKYSDSIKLSVSVLP

SEQ ID NO: 3088542 - protein, 19 aa, Giardia lamblia
IYAILVRLSIFGELCPNYV

SEQ ID NO: 3088543 - protein, 19 aa, Giardia lamblia
IYATLYDKLEIVQLLAAHE

SEQ ID NO: 3088544 - protein, 34 aa, Giardia lamblia
IYDPTFINQFGAFLLQLLFPFTPIIQTTLQMVET

SEQ ID NO: 3088545 - protein, 23 aa, Giardia lamblia
IYDYLLHIDDLLKVLYPTEVSLV

SEQ ID NO: 3088546 - protein, 28 aa, Giardia lamblia
IYFAMLPSLLRWAIDPPIPKWIMFLPFN

SEQ ID NO: 3088547 - protein, 23 aa, Giardia lamblia
IYGYSSHLLLLVSLVYAAASVHT

SEQ ID NO: 3088548 - protein, 24 aa, Giardia lamblia
IYKDPLRGISLHSKPLPPPDGNTF

SEQ ID NO: 3088549 - protein, 28 aa, Giardia lamblia
IYLEAMQLRLPHFLIVNTNLHENHQAEL

SEQ ID NO: 3088550 - protein, 18 aa, Giardia lamblia
IYLELLAISMQLYDRILF

SEQ ID NO: 3088551 - protein, 27 aa, Giardia lamblia
IYLLSLGRFFFCSMLTFSASRSPRFKF

SEQ ID NO: 3088552 - protein, 26 aa, Giardia lamblia
IYLSHFFFIIFIWGILVPICFASPYK

SEQ ID NO: 3088553 - protein, 26 aa, Giardia lamblia
IYMTVIRLLYAFVVALSFAIIMFPIR

SEQ ID NO: 3088554 - protein, 22 aa, Giardia lamblia
IYNKFNFIFGVTADYFASIMSN

SEQ ID NO: 3088555 - protein, 27 aa, Giardia lamblia
IYNLLEKYFFPLLYAGLEKGWLSFDSY

SEQ ID NO: 3088556 - protein, 28 aa, Giardia lamblia
IYPDIFPLSFLYSFSFTWSSLYIAFSAA

SEQ ID NO: 3088557 - protein, 25 aa, Giardia lamblia
IYPTVEFALILLHLRQTLLQNHQAI

SEQ ID NO: 3088558 - protein, 19 aa, Giardia lamblia
IYRSLTYYSKRTSLQILGF

SEQ ID NO: 3088559 - protein, 26 aa, Giardia lamblia
IYSLGISFLVLLFNYEEFAAATTDFG

SEQ ID NO: 3088560 - protein, 26 aa, Giardia lamblia
IYTTPESFLILHDTVWYPLAQSKRLN

SEQ ID NO: 3088561 - protein, 18 aa, Giardia lamblia
KACHKAISKCSLCMVPEG

SEQ ID NO: 3088562 - protein, 20 aa, Giardia lamblia
KACVRHNLIGNTLYCFQCGV

SEQ ID NO: 3088563 - protein, 22 aa, Giardia lamblia
KAEFKALTLSDNLTRELDQLLV

SEQ ID NO: 3088564 - protein, 25 aa, Giardia lamblia
KAEYPLMFMRIFYGKETKLSMQLKV

SEQ ID NO: 3088565 - protein, 17 aa, Giardia lamblia
KAFLAQLLEHYKSADRP

SEQ ID NO: 3088566 - protein, 20 aa, Giardia lamblia
KAFLFTIVFVAICFAINISA

SEQ ID NO: 3088567 - protein, 26 aa, Giardia lamblia
KAGGVPVDGFCRPFGSPQAAAAGCTK

SEQ ID NO: 3088568 - protein, 28 aa, Giardia lamblia
KAHSMCVTSLFWLPDTYILSSGADNTIR

SEQ ID NO: 3088569 - protein, 25 aa, Giardia lamblia
KAISTTCLLPLFKRYAFGDPHNDPS

SEQ ID NO: 3088570 - protein, 19 aa, Giardia lamblia
KAKHLDRLYGPLGDYLMNG

SEQ ID NO: 3088571 - protein, 35 aa, Giardia lamblia
KAKVPWSMRRAYFASTGILPWYDLNYAKPGAQKEE

SEQ ID NO: 3088572 - protein, 17 aa, Giardia lamblia
KALLPYLYVLVAAIVYI

SEQ ID NO: 3088573 - protein, 22 aa, Giardia lamblia
KALPETIIPYPGSVQRTCFSRA

SEQ ID NO: 3088574 - protein, 23 aa, Giardia lamblia
KALSEYFELYRVYARVSTLSAEG

SEQ ID NO: 3088575 - protein, 27 aa, Giardia lamblia
KALTLDGMLLCPRECPTESFWTSGREC

SEQ ID NO: 3088576 - protein, 27 aa, Giardia lamblia
KAMLRVCTTFLLQKYLFKATKQQTNQG

SEQ ID NO: 3088577 - protein, 27 aa, Giardia lamblia
KANEQLPFINTIFALDARYPFIGYNDS

SEQ ID NO: 3088578 - protein, 30 aa, Giardia lamblia
KANLEYRINFLFLIFIVGIIQIMLTSTFNE

SEQ ID NO: 3088579 - protein, 25 aa, Giardia lamblia
KAQCTYLPHIRYLSGLYFMAPPPQA

SEQ ID NO: 3088580 - protein, 41 aa, Giardia lamblia
KARLTSQLYLLLMYGYIILDQFIMVYFYSRKYHDTLQLTCL

SEQ ID NO: 3088581 - protein, 30 aa, Giardia lamblia
KARYQCLCGKIFFIVKPDVKRMPTFVLCNC

SEQ ID NO: 3088582 - protein, 23 aa, Giardia lamblia
KASKYLHDPLTPYRRQPLNTDIC

SEQ ID NO: 3088583 - protein, 23 aa, Giardia lamblia
KASSYGFVFRLLNLSTGSSFDFP

SEQ ID NO: 3088584 - protein, 19 aa, Giardia lamblia
KASWITLLLMVIYHNHRPL

SEQ ID NO: 3088585 - protein, 24 aa, Giardia lamblia
KATELLLLEHFAILVTPTTTGYSD

SEQ ID NO: 3088586 - protein, 26 aa, Giardia lamblia
KATFKPPPVLLVLTKLLTLISSNSFQ

SEQ ID NO: 3088587 - protein, 24 aa, Giardia lamblia
KATQKDYLPAIRILAQHGHGIADR

SEQ ID NO: 3088588 - protein, 17 aa, Giardia lamblia
KAVYNLTFGGPSTVSCD

SEQ ID NO: 3088589 - protein, 20 aa, Giardia lamblia
KAYFKLCALADILTAMDKPG

SEQ ID NO: 3088590 - protein, 29 aa, Giardia lamblia
KCAECFAETPYFNPALTECLSACPPNSVA

SEQ ID NO: 3088591 - protein, 25 aa, Giardia lamblia
KCALGYFLHQGGCYSSLYAPGKLVC

SEQ ID NO: 3088592 - protein, 21 aa, Giardia lamblia
KCELDFGYNLTHYSYQCICDA

SEQ ID NO: 3088593 - protein, 27 aa, Giardia lamblia
KCELSFMELFGDFIDVLYNTAFQGVVT

SEQ ID NO: 3088594 - protein, 27 aa, Giardia lamblia
KCIAMRQLWRRIGYLENNLAGLNKYNA

SEQ ID NO: 3088595 - protein, 19 aa, Giardia lamblia
KCIDNTILSAYFTKSFDLI

SEQ ID NO: 3088596 - protein, 30 aa, Giardia lamblia
KCLCCTIIFSILGLAILILITSGIIRAVKK

SEQ ID NO: 3088597 - protein, 19 aa, Giardia lamblia
KCLDGYFKVTRAKFEVCQA

SEQ ID NO: 3088598 - protein, 25 aa, Giardia lamblia
KCNSKIPTIFLFGGGCYEASKAPGN

SEQ ID NO: 3088599 - protein, 17 aa, Giardia lamblia
KCRACAIPHCRTCNALG

SEQ ID NO: 3088600 - protein, 24 aa, Giardia lamblia
KCVNLYYMGGLERAIHLPQKLQGG

SEQ ID NO: 3088601 - protein, 25 aa, Giardia lamblia
KDAEIARLTLLLDSPSKAKLVVSHS

SEQ ID NO: 3088602 - protein, 18 aa, Giardia lamblia
KDAKIRRLEASLATARQC

SEQ ID NO: 3088603 - protein, 34 aa, Giardia lamblia
KDFMMMMGTISFAIYITLIMVALISFCIKPPVKT

SEQ ID NO: 3088604 - protein, 26 aa, Giardia lamblia
KDILIRVYYAWFIKTPIFSTEIYNSV

SEQ ID NO: 3088605 - protein, 18 aa, Giardia lamblia
KDILLGSGFFVPRRLITE

SEQ ID NO: 3088606 - protein, 25 aa, Giardia lamblia
KDINNYLFKAKFLSILGMDDCLELS

SEQ ID NO: 3088607 - protein, 28 aa, Giardia lamblia
KDKEKDRIILIPYANPWSDLTLRKSVSE

SEQ ID NO: 3088608 - protein, 26 aa, Giardia lamblia
KDKLFLPYYIFLKMQLALPIFELILS

SEQ ID NO: 3088609 - protein, 17 aa, Giardia lamblia
KDLFNLDSRKDQNSMLG

SEQ ID NO: 3088610 - protein, 21 aa, Giardia lamblia
KDLHIWFTRWITSNFVDGPLQ

SEQ ID NO: 3088611 - protein, 30 aa, Giardia lamblia
KDLVYASVELFGMAFYALTNIIHLVAPTNP

SEQ ID NO: 3088612 - protein, 22 aa, Giardia lamblia
KDMLFSCEKFRHWPPKRLRIAF

SEQ ID NO: 3088613 - protein, 18 aa, Giardia lamblia
KDMPSHLFQLKYKYTRPP

SEQ ID NO: 3088614 - protein, 29 aa, Giardia lamblia
KDNLTLLKNYLYPYYKRALVLLRNAPCDC

SEQ ID NO: 3088615 - protein, 37 aa, Giardia lamblia
KDNPKIPIGWSPTAGRLAWVRLIMRRLTTVYEFFRRV

SEQ ID NO: 3088616 - protein, 28 aa, Giardia lamblia
KDPEALYVFLILMDGVLYAREISPLLLS

SEQ ID NO: 3088617 - protein, 28 aa, Giardia lamblia
KDPLVLRTIFPNFYHFAIAGTRFDAQQG

SEQ ID NO: 3088618 - protein, 19 aa, Giardia lamblia
KDQIPVSLLRLLAEMKRLS

SEQ ID NO: 3088619 - protein, 29 aa, Giardia lamblia
KDSLATNLLLYHPNLYFLAKDIAAQNGIG

SEQ ID NO: 3088620 - protein, 17 aa, Giardia lamblia
KDTILHWAVFYLSPGDY

SEQ ID NO: 3088621 - protein, 32 aa, Giardia lamblia
KDVSVLTYYIVRAYLLMALGFSPSLGLKDLSL

SEQ ID NO: 3088622 - protein, 20 aa, Giardia lamblia
KDYYRLLLQLVSDQTKDPGI

SEQ ID NO: 3088623 - protein, 25 aa, Giardia lamblia
KEAIVLLLFEATRLRYLSFQSDSFG

SEQ ID NO: 3088624 - protein, 25 aa, Giardia lamblia
KEGKPELHYIPPVYMTAPTLKIFKE

SEQ ID NO: 3088625 - protein, 26 aa, Giardia lamblia
KEKTLQMQALRRFYTALSINSSVLRG

SEQ ID NO: 3088626 - protein, 27 aa, Giardia lamblia
KELLKGMPIRFYDIAKTLVPTRSSYLI

SEQ ID NO: 3088627 - protein, 23 aa, Giardia lamblia
KENIRAVLIRILLPHLHNKATED

SEQ ID NO: 3088628 - protein, 28 aa, Giardia lamblia
KESFTYLQAFIRCFLVRKSVLAFRSLCI

SEQ ID NO: 3088629 - protein, 24 aa, Giardia lamblia
KESLVYRVMDLIYKLFCISKTSVE

SEQ ID NO: 3088630 - protein, 17 aa, Giardia lamblia
KESMALIKLLAAYPTVA

SEQ ID NO: 3088631 - protein, 45 aa, Giardia lamblia
KESRLVAVLMFPVYRFLFSFVRVNALFRFFFKFESIKRAAISIKE

SEQ ID NO: 3088632 - protein, 35 aa, Giardia lamblia
KESSLILAARLHYPLIAKELLIRELGHLDINGFTA

SEQ ID NO: 3088633 - protein, 30 aa, Giardia lamblia
KETVYCSKNFILIWTLLIHSKLCSKAAVTG

SEQ ID NO: 3088634 - protein, 27 aa, Giardia lamblia
KEVGFQDKWGWSALMWAACAGDADTTK

SEQ ID NO: 3088635 - protein, 27 aa, Giardia lamblia
KEYVYSYMRLTLLYLKSIFSQYVSSNA

SEQ ID NO: 3088636 - protein, 18 aa, Giardia lamblia
KFAGPIFEKLRGEGIIVL

SEQ ID NO: 3088637 - protein, 20 aa, Giardia lamblia
KFALLLPLLRSNSQPCCSCL

SEQ ID NO: 3088638 - protein, 22 aa, Giardia lamblia
KFDAWFLNMYWAIVALSPVAVA

SEQ ID NO: 3088639 - protein, 22 aa, Giardia lamblia
KFEVCQACHGSCKTCVGSEEGK

SEQ ID NO: 3088640 - protein, 19 aa, Giardia lamblia
KFFGSDPYMANHTAISMGI

SEQ ID NO: 3088641 - protein, 19 aa, Giardia lamblia
KFGMVYFFYGILTGATVPI

SEQ ID NO: 3088642 - protein, 30 aa, Giardia lamblia
KFILMELCCLIRLLDRWRVYLLAADCSTRL

SEQ ID NO: 3088643 - protein, 17 aa, Giardia lamblia
KFINGTSNRFRVLERRD

SEQ ID NO: 3088644 - protein, 19 aa, Giardia lamblia
KFIPWSNGKNFPSALFCSS

SEQ ID NO: 3088645 - protein, 17 aa, Giardia lamblia
KFITYLRYNNLFMFINN

SEQ ID NO: 3088646 - protein, 43 aa, Giardia lamblia
KFIVDGLIFEPIYRVFLCNIYHWYYPYLFIGALNNDISEGPWD

SEQ ID NO: 3088647 - protein, 27 aa, Giardia lamblia
KFLEGDRYFFTAGLPLGGYTGAVTDPE

SEQ ID NO: 3088648 - protein, 21 aa, Giardia lamblia
KFLRTMLYDICDIVRYVACTT

SEQ ID NO: 3088649 - protein, 25 aa, Giardia lamblia
KFMRPRAVIFREFAINWLGDIKEVQ

SEQ ID NO: 3088650 - protein, 20 aa, Giardia lamblia
KFVFFAIEKFTKGVSAAVVA

SEQ ID NO: 3088651 - protein, 18 aa, Giardia lamblia
KFVILAKNALTAARSIVT

SEQ ID NO: 3088652 - protein, 19 aa, Giardia lamblia
KGALRYGSPLSLFNLRSLY

SEQ ID NO: 3088653 - protein, 21 aa, Giardia lamblia
KGGALCRLAAKAGTAERILFS

SEQ ID NO: 3088654 - protein, 17 aa, Giardia lamblia
KGHFYAPIGKNSLCTEQ

SEQ ID NO: 3088655 - protein, 20 aa, Giardia lamblia
KGIPHCKSCKVSNGLLVCVA

SEQ ID NO: 3088656 - protein, 27 aa, Giardia lamblia
KGNEFKSILFALIFFHAIVIERRKFGP

SEQ ID NO: 3088657 - protein, 23 aa, Giardia lamblia
KGNTPMSIAFKRGYTELYNVLNE

SEQ ID NO: 3088658 - protein, 33 aa, Giardia lamblia
KGPEIILAGQYRLFLKPLYLRRNGPKTTQVARE

SEQ ID NO: 3088659 - protein, 26 aa, Giardia lamblia
KGRCTACRGSYFLYQGGCYSAGEYPG

SEQ ID NO: 3088660 - protein, 17 aa, Giardia lamblia
KGRELHMFIEPPEINLV

SEQ ID NO: 3088661 - protein, 23 aa, Giardia lamblia
KGSFGKVFLVRRVEDNRFFAMKV

SEQ ID NO: 3088662 - protein, 23 aa, Giardia lamblia
KGSLDALIFPKFDKCWSFSAQRQ

SEQ ID NO: 3088663 - protein, 22 aa, Giardia lamblia
KGTKRCAFLFRLMGPNFSMLNV

SEQ ID NO: 3088664 - protein, 22 aa, Giardia lamblia
KGVAHLMRFFRTAQLTLKGAEI

SEQ ID NO: 3088665 - protein, 25 aa, Giardia lamblia
KGVKYGRWLTAGNPQVFLLPMIYNS

SEQ ID NO: 3088666 - protein, 17 aa, Giardia lamblia
KGVLILNALLPPRTILF

SEQ ID NO: 3088667 - protein, 18 aa, Giardia lamblia
KGVPLSHVISHILLPYIN

SEQ ID NO: 3088668 - protein, 22 aa, Giardia lamblia
KGVTGSLPYWKFVLATTCFAVL

SEQ ID NO: 3088669 - protein, 17 aa, Giardia lamblia
KGVWINNMILATTVKAL

SEQ ID NO: 3088670 - protein, 19 aa, Giardia lamblia
KGWTALMYAAAKGHADCCE

SEQ ID NO: 3088671 - protein, 24 aa, Giardia lamblia
KGYANIIPYLLAAGRELRMVDNLK

SEQ ID NO: 3088672 - protein, 27 aa, Giardia lamblia
KGYASLLMFLALRSWPRTWPVDVTDQI

SEQ ID NO: 3088673 - protein, 23 aa, Giardia lamblia
KGYDMFLDALHSLNERFFRDPLL

SEQ ID NO: 3088674 - protein, 24 aa, Giardia lamblia
KHADAKYIKYEFARHIKGSVRQRL

SEQ ID NO: 3088675 - protein, 17 aa, Giardia lamblia
KHCNYFILNCPQLKTHL

SEQ ID NO: 3088676 - protein, 25 aa, Giardia lamblia
KHDYGLLDFLVFTASFKCPFHDLLL

SEQ ID NO: 3088677 - protein, 24 aa, Giardia lamblia
KHEENLPLYLLVKDMPTAPDANPS

SEQ ID NO: 3088678 - protein, 23 aa, Giardia lamblia
KHGNLPLANLLLKGLEPLQPKIS

SEQ ID NO: 3088679 - protein, 17 aa, Giardia lamblia
KHHIIIRTSLALGLLSF

SEQ ID NO: 3088680 - protein, 19 aa, Giardia lamblia
KHIRENHLLALSELPSRLL

SEQ ID NO: 3088681 - protein, 18 aa, Giardia lamblia
KHLGKYYKIGGNVTAIKS

SEQ ID NO: 3088682 - protein, 18 aa, Giardia lamblia
KHNLRGFLWGFDVIMTFG

SEQ ID NO: 3088683 - protein, 32 aa, Giardia lamblia
KHSHTSRFIAYLYHYLMLYARILSVTADIKAY

SEQ ID NO: 3088684 - protein, 23 aa, Giardia lamblia
KHVTCCPWTILALYSSFHEWDVV

SEQ ID NO: 3088685 - protein, 17 aa, Giardia lamblia
KHYQKELAERLRLFRQL

SEQ ID NO: 3088686 - protein, 20 aa, Giardia lamblia
KHYVPPACYLELLSLYSELL

SEQ ID NO: 3088687 - protein, 38 aa, Giardia lamblia
KIAFQVMTVLFYIFISLEYILMFVAMKLGQYAPLPKLN

SEQ ID NO: 3088688 - protein, 22 aa, Giardia lamblia
KICSSYFWFGRLCVSLGTDSSA

SEQ ID NO: 3088689 - protein, 23 aa, Giardia lamblia
KIDNFLLNHIISLPSLIGNKVIR

SEQ ID NO: 3088690 - protein, 26 aa, Giardia lamblia
KIEDFGTLLPLFQLMSHPAVKQRHWL

SEQ ID NO: 3088691 - protein, 31 aa, Giardia lamblia
KIERNLCQVYLYFLRAFVATGDNLLFAHLDL

SEQ ID NO: 3088692 - protein, 25 aa, Giardia lamblia
KIFHPEILIYVAFSIMLRASKQALA

SEQ ID NO: 3088693 - protein, 22 aa, Giardia lamblia
KIFNHTPLMIAAEAGDLCGVEA

SEQ ID NO: 3088694 - protein, 20 aa, Giardia lamblia
KIFSKFSALIKRLCSITLIP

SEQ ID NO: 3088695 - protein, 24 aa, Giardia lamblia
KIHVERFFLPFLSIATCFLSSAPS

SEQ ID NO: 3088696 - protein, 18 aa, Giardia lamblia
KIKYIYMPDFEVTGGDPW

SEQ ID NO: 3088697 - protein, 19 aa, Giardia lamblia
KILMPGSADWFGAVEAGDT

SEQ ID NO: 3088698 - protein, 19 aa, Giardia lamblia
KILRFELHITFVSLAIEIA

SEQ ID NO: 3088699 - protein, 18 aa, Giardia lamblia
KINYTLRLQLSATSALSF

SEQ ID NO: 3088700 - protein, 30 aa, Giardia lamblia
KIQTLLTFFVGPILLGLLIGGVVGGTLSKT

SEQ ID NO: 3088701 - protein, 19 aa, Giardia lamblia
KIRAFLENFIQYQMYKKLS

SEQ ID NO: 3088702 - protein, 20 aa, Giardia lamblia
KIRIFTISDKLTKIYEGSNT

SEQ ID NO: 3088703 - protein, 20 aa, Giardia lamblia
KISLLQADLLEEEKKFYDMK

SEQ ID NO: 3088704 - protein, 18 aa, Giardia lamblia
KISLSWLEKSIFGSPTSI

SEQ ID NO: 3088705 - protein, 17 aa, Giardia lamblia
KISQVIINLFQLATKIY

SEQ ID NO: 3088706 - protein, 22 aa, Giardia lamblia
KITLYLMLYCKSISAFSILGKR

SEQ ID NO: 3088707 - protein, 21 aa, Giardia lamblia
KITRLLLDYSNNKTWTLLLDE

SEQ ID NO: 3088708 - protein, 25 aa, Giardia lamblia
KIVARVIIIIFGLTYLVAMCIEAIF

SEQ ID NO: 3088709 - protein, 25 aa, Giardia lamblia
KIVLLCREVHYLRQLRIEIPETALA

SEQ ID NO: 3088710 - protein, 17 aa, Giardia lamblia
KIYIDREMDFNRVLYTH

SEQ ID NO: 3088711 - protein, 24 aa, Giardia lamblia
KIYPAFVRMLFPKHLCASCLDGLI

SEQ ID NO: 3088712 - protein, 38 aa, Giardia lamblia
KKASRPFPVYLILSVLVQLLSLCDYLRSCNSWPDFPWH

SEQ ID NO: 3088713 - protein, 19 aa, Giardia lamblia
KKFGTFLMRGMSYAVLFSY

SEQ ID NO: 3088714 - protein, 26 aa, Giardia lamblia
KKFIDIRTFFILEGIQYTIKEHNLDI

SEQ ID NO: 3088715 - protein, 21 aa, Giardia lamblia
KKHDTLLNDLPLLISVGIVSQ

SEQ ID NO: 3088716 - protein, 20 aa, Giardia lamblia
KKIMQVTLKKVNNLLQTLVS

SEQ ID NO: 3088717 - protein, 27 aa, Giardia lamblia
KKLMDFAPRFETLLYKFIVTEEIAFDP

SEQ ID NO: 3088718 - protein, 20 aa, Giardia lamblia
KKLNLRRIIPFIASEFQKDK

SEQ ID NO: 3088719 - protein, 21 aa, Giardia lamblia
KKLTLYEVFTVLLLKRIRGLV

SEQ ID NO: 3088720 - protein, 23 aa, Giardia lamblia
KKMMHIIYMRILRGSLGTMSSAA

SEQ ID NO: 3088721 - protein, 31 aa, Giardia lamblia
KKPDPFVFNWKLFLGIVLGALGPYFGIARLG

SEQ ID NO: 3088722 - protein, 39 aa, Giardia lamblia
KKPNGCVLFLKTQRDFFAILLWVAAIVSIISFLIQKYVQ

SEQ ID NO: 3088723 - protein, 23 aa, Giardia lamblia
KKQQQFSLLIDTLSILIQCNPGL

SEQ ID NO: 3088724 - protein, 32 aa, Giardia lamblia
KKQYRTIRGLLELMRYYLPSFGLPLASCMNFE

SEQ ID NO: 3088725 - protein, 20 aa, Giardia lamblia
KKSIYLKYFSKNYVPQHFFF

SEQ ID NO: 3088726 - protein, 26 aa, Giardia lamblia
KKSLLWGIMTFIILPLCLLPRIDFLN

SEQ ID NO: 3088727 - protein, 27 aa, Giardia lamblia
KKSNEFMLQILLRPSYSLQAKYLLASK

SEQ ID NO: 3088728 - protein, 25 aa, Giardia lamblia
KKSRRLWRRFFTTGFHDSLGSTKSS

SEQ ID NO: 3088729 - protein, 23 aa, Giardia lamblia
KKSSLVIPLLAGAASGMLFMLLL

SEQ ID NO: 3088730 - protein, 29 aa, Giardia lamblia
KKTGIPNHWLFFLLPVVNKVDKLRGRRTK

SEQ ID NO: 3088731 - protein, 35 aa, Giardia lamblia
KKVAAKVPVWQRLISPAMMLVSMFVSQRMKKMQMA

SEQ ID NO: 3088732 - protein, 24 aa, Giardia lamblia
KKVSSYIMFMFKGRARELIQSFYD

SEQ ID NO: 3088733 - protein, 36 aa, Giardia lamblia
KKYDAFSPLLQWDLLILFQPFSLLGALAGSICNAIF

SEQ ID NO: 3088734 - protein, 20 aa, Giardia lamblia
KLACRILVLTGEAFPAALLT

SEQ ID NO: 3088735 - protein, 20 aa, Giardia lamblia
KLAIIIALEQHYLEGFTILL

SEQ ID NO: 3088736 - protein, 19 aa, Giardia lamblia
KLAIITTFSYNSTVTCAST

SEQ ID NO: 3088737 - protein, 25 aa, Giardia lamblia
KLALHYYSLFVYILGPLRQSQVLDR

SEQ ID NO: 3088738 - protein, 25 aa, Giardia lamblia
KLARTFPVLPAFNRPGSSSFAADAA

SEQ ID NO: 3088739 - protein, 20 aa, Giardia lamblia
KLDLFSLFQLSDCKLPTEVV

SEQ ID NO: 3088740 - protein, 30 aa, Giardia lamblia
KLDSFVIALQFIMKGVLRPIFRELRKPAAI

SEQ ID NO: 3088741 - protein, 23 aa, Giardia lamblia
KLDTILLSFTILHYQSLVAEALV

SEQ ID NO: 3088742 - protein, 37 aa, Giardia lamblia
KLDTMFLNFLAACGLYLDWARYRTVLLYLLGQVNSSP

SEQ ID NO: 3088743 - protein, 21 aa, Giardia lamblia
KLDYIMTTIKDYFLTKGATTH

SEQ ID NO: 3088744 - protein, 17 aa, Giardia lamblia
KLHENITLLLKRAELHK

SEQ ID NO: 3088745 - protein, 21 aa, Giardia lamblia
KLHYFNRSFGTLRPRSAWVCS

SEQ ID NO: 3088746 - protein, 24 aa, Giardia lamblia
KLIDELLWPVHFFEQTLLPAIASS

SEQ ID NO: 3088747 - protein, 31 aa, Giardia lamblia
KLISRVTLYLPYLYHNIFLRIRGLPNTTANL

SEQ ID NO: 3088748 - protein, 28 aa, Giardia lamblia
KLKSIVEAGLPFWIFFDEITNVTRSQSE

SEQ ID NO: 3088749 - protein, 20 aa, Giardia lamblia
KLLLEFMAKFSPDLDSGGLA

SEQ ID NO: 3088750 - protein, 21 aa, Giardia lamblia
KLLSAAYLNVLAQPESRFISN

SEQ ID NO: 3088751 - protein, 27 aa, Giardia lamblia
KLMDGPFYMRDLPFGSVLCPVHFYIES

SEQ ID NO: 3088752 - protein, 20 aa, Giardia lamblia
KLNDLSWIHTLAALEEPFYS

SEQ ID NO: 3088753 - protein, 30 aa, Giardia lamblia
KLNTPVAWVPTILLTILMIPVFSAFVAAFF

SEQ ID NO: 3088754 - protein, 18 aa, Giardia lamblia
KLNYIKYSSLQDLMLSDH

SEQ ID NO: 3088755 - protein, 44 aa, Giardia lamblia
KLPGFAAVTLVQLRDLFLASYPRVIRLILWKKVLKNIHSDSRIT

SEQ ID NO: 3088756 - protein, 25 aa, Giardia lamblia
KLPLEPQFLTSMRLFISNNTYPDVY

SEQ ID NO: 3088757 - protein, 20 aa, Giardia lamblia
KLPPLIVSKSIVSGAPLGPG

SEQ ID NO: 3088758 - protein, 31 aa, Giardia lamblia
KLPTTALHRWAFEQVFSWNWSQPFDAVKTPL

SEQ ID NO: 3088759 - protein, 19 aa, Giardia lamblia
KLQKYLMWQMTAVNIIAVI

SEQ ID NO: 3088760 - protein, 18 aa, Giardia lamblia
KLRFISELFQYASADFFR

SEQ ID NO: 3088761 - protein, 21 aa, Giardia lamblia
KLRILNLSMYILALSRRTFAA

SEQ ID NO: 3088762 - protein, 28 aa, Giardia lamblia
KLRILRWELLRPTIVIPVVIYSSLRFFK

SEQ ID NO: 3088763 - protein, 20 aa, Giardia lamblia
KLRQDFISILQPLRQNKEAN

SEQ ID NO: 3088764 - protein, 20 aa, Giardia lamblia
KLRSIYSAELCDLFAIMCSP

SEQ ID NO: 3088765 - protein, 26 aa, Giardia lamblia
KLSKTDPFFWIFKEQEDRTGGGFVPT

SEQ ID NO: 3088766 - protein, 20 aa, Giardia lamblia
KLSMLPPFSQLNDPLLGISS

SEQ ID NO: 3088767 - protein, 28 aa, Giardia lamblia
KLSSCLFTLHRFIIALSSELRSVYATDW

SEQ ID NO: 3088768 - protein, 22 aa, Giardia lamblia
KLTEILGIVFYLDQDQPYYIIA

SEQ ID NO: 3088769 - protein, 31 aa, Giardia lamblia
KLVLSLTTLLYFLWILVSYPFMRISGRAYLN

SEQ ID NO: 3088770 - protein, 21 aa, Giardia lamblia
KLWLCLAYMHFSVRTNLIRGY

SEQ ID NO: 3088771 - protein, 21 aa, Giardia lamblia
KLYESRLRQHFRCVVCLFTEV

SEQ ID NO: 3088772 - protein, 29 aa, Giardia lamblia
KLYGIVLGVFFMAITFLFVCLIAVERHNS

SEQ ID NO: 3088773 - protein, 19 aa, Giardia lamblia
KLYLEMCLQYPIFHQLLST

SEQ ID NO: 3088774 - protein, 29 aa, Giardia lamblia
KMAVIIGILQMIFGIVLKLLNVIYSRDIV

SEQ ID NO: 3088775 - protein, 25 aa, Giardia lamblia
KMCVWALWVLIYTLPLFTFIEVCSI

SEQ ID NO: 3088776 - protein, 17 aa, Giardia lamblia
KMFHSYSSNFQNSQADT

SEQ ID NO: 3088777 - protein, 23 aa, Giardia lamblia
KMILALFMIMCNTALLAFVGFKF

SEQ ID NO: 3088778 - protein, 27 aa, Giardia lamblia
KMLDLLEDYLVFRRYNYVRLDGGDAVN

SEQ ID NO: 3088779 - protein, 26 aa, Giardia lamblia
KMMITELFLLNVYFYLLQGSHAPYTA

SEQ ID NO: 3088780 - protein, 23 aa, Giardia lamblia
KMNIFKKLLPLECKCKDSVGNSI

SEQ ID NO: 3088781 - protein, 75 aa, Giardia lamblia
KMQHLLAALGVPLFFSPLAWLSIKDEEPYFDLRLIQVYLIFDKFRGCVSTLLFKKLKQILFASRSMDPALPQSLD

SEQ ID NO: 3088782 - protein, 23 aa, Giardia lamblia
KMRTLIHIYYLFSILSQALFTRT

SEQ ID NO: 3088783 - protein, 24 aa, Giardia lamblia
KNAAYAIQILSLSVSLILSLVVAI

SEQ ID NO: 3088784 - protein, 20 aa, Giardia lamblia
KNAIIWLSVFITTSENDSQT

SEQ ID NO: 3088785 - protein, 21 aa, Giardia lamblia
KNAILLTSGPYLDIIEMSLPN

SEQ ID NO: 3088786 - protein, 24 aa, Giardia lamblia
KNAQFIVISLRNNTFELADRLVGI

SEQ ID NO: 3088787 - protein, 22 aa, Giardia lamblia
KNCGRFAGYLYSNTNFSYNLAL

SEQ ID NO: 3088788 - protein, 26 aa, Giardia lamblia
KNEGKLFLFIMIVAVICIIYSIVVQI

SEQ ID NO: 3088789 - protein, 25 aa, Giardia lamblia
KNESRCPYYLGRALVPQARVVTAPY

SEQ ID NO: 3088790 - protein, 26 aa, Giardia lamblia
KNESRSIFPTILQLLQELSPHRCELF

SEQ ID NO: 3088791 - protein, 17 aa, Giardia lamblia
KNFSQICISCEGEHLLY

SEQ ID NO: 3088792 - protein, 28 aa, Giardia lamblia
KNFSTYLAIVIWRLFNKPQPELHKDQTI

SEQ ID NO: 3088793 - protein, 24 aa, Giardia lamblia
KNGEVIFLRLKLTGAAHSTVLFVN

SEQ ID NO: 3088794 - protein, 26 aa, Giardia lamblia
KNGLNVLMFGFLYRSSYVSSYVERAS

SEQ ID NO: 3088795 - protein, 31 aa, Giardia lamblia
KNGSSNNYFLFYGGCYLATRWPGNSYCLSAS

SEQ ID NO: 3088796 - protein, 25 aa, Giardia lamblia
KNIIKLDLLLPPEEFSRELDIAIQK

SEQ ID NO: 3088797 - protein, 25 aa, Giardia lamblia
KNKSSVFLIFQLSCADVDRLFGIRI

SEQ ID NO: 3088798 - protein, 18 aa, Giardia lamblia
KNLFLQMNDIPLPQDSEN

SEQ ID NO: 3088799 - protein, 19 aa, Giardia lamblia
KNLRIPSMKFPHVFNFRSV

SEQ ID NO: 3088800 - protein, 19 aa, Giardia lamblia
KNLYSKQLGQAIPAYALDY

SEQ ID NO: 3088801 - protein, 30 aa, Giardia lamblia
KNNMLVFFARLMSLVMMSIWRQCKQHQQTK

SEQ ID NO: 3088802 - protein, 20 aa, Giardia lamblia
KNNRKHCFPYLNGLDHLLSN

SEQ ID NO: 3088803 - protein, 25 aa, Giardia lamblia
KNNSPLELLYYLHHPATNPLETFIT

SEQ ID NO: 3088804 - protein, 18 aa, Giardia lamblia
KNPEIMGALPKYAVRTIM

SEQ ID NO: 3088805 - protein, 18 aa, Giardia lamblia
KNQLLHEIYLRLCAGEKM

SEQ ID NO: 3088806 - protein, 28 aa, Giardia lamblia
KNTTNPRPVFYILIRNMELLGVSYDPVL

SEQ ID NO: 3088807 - protein, 24 aa, Giardia lamblia
KNYSLIVKFLLKRHVTMCNAMGVP

SEQ ID NO: 3088808 - protein, 36 aa, Giardia lamblia
KPDLYKLCNYFNLSRYYRLLELLGSKQLLSCVCSFQ

SEQ ID NO: 3088809 - protein, 29 aa, Giardia lamblia
KPGRGLPKPQLTRNSSLTASMYSTAPLLN

SEQ ID NO: 3088810 - protein, 20 aa, Giardia lamblia
KPIKHIVLLLSSQQATPMHT

SEQ ID NO: 3088811 - protein, 20 aa, Giardia lamblia
KPINVMLAFDSPWAMNSKYY

SEQ ID NO: 3088812 - protein, 17 aa, Giardia lamblia
KPIVIQLGISCSIIILS

SEQ ID NO: 3088813 - protein, 36 aa, Giardia lamblia
KPKDYRGLPFLYSHYKTFLFFYINSEATILKPYLCL

SEQ ID NO: 3088814 - protein, 31 aa, Giardia lamblia
KPKNVAVPLLPLYIINAYFPSLEPFSVLQSS

SEQ ID NO: 3088815 - protein, 19 aa, Giardia lamblia
KPMKFISVFFIATGSAVTA

SEQ ID NO: 3088816 - protein, 25 aa, Giardia lamblia
KPNDSRFTVFLKYCIEELLKHFHRS

SEQ ID NO: 3088817 - protein, 33 aa, Giardia lamblia
KPPCVKLAKFQTFPYLNLLLCIEQLLPFHDLLG

SEQ ID NO: 3088818 - protein, 21 aa, Giardia lamblia
KPPEYVCPQLLYIKQDQPGDQ

SEQ ID NO: 3088819 - protein, 25 aa, Giardia lamblia
KPSTDLFMIKLTGFRLFNIAYDPIE

SEQ ID NO: 3088820 - protein, 27 aa, Giardia lamblia
KPSVTRHLLLLFLSLDLQEHCRSFASI

SEQ ID NO: 3088821 - protein, 34 aa, Giardia lamblia
KQACKVTLLSVFKDVVLWLITNPVEKAKELINSG

SEQ ID NO: 3088822 - protein, 30 aa, Giardia lamblia
KQDLKALVTGLLPLSGFVASLLPSSFSKQL

SEQ ID NO: 3088823 - protein, 23 aa, Giardia lamblia
KQDQLLPQPPVLNLPPVSLPKKE

SEQ ID NO: 3088824 - protein, 41 aa, Giardia lamblia
KQERTSPLYFLPPYIDPHLYRLIRVYLLSPQNLNVILFFYT

SEQ ID NO: 3088825 - protein, 21 aa, Giardia lamblia
KQFHPFEGYSLPPCISLPSIP

SEQ ID NO: 3088826 - protein, 20 aa, Giardia lamblia
KQFLRVYRQLSHRGILSFVG

SEQ ID NO: 3088827 - protein, 27 aa, Giardia lamblia
KQHIQLLYNFFIRQNNLAFAPLMHNFV

SEQ ID NO: 3088828 - protein, 23 aa, Giardia lamblia
KQIIELVAFQPYRFSKNSMELLH

SEQ ID NO: 3088829 - protein, 20 aa, Giardia lamblia
KQLQFYFLDSAAVQMLSILV

SEQ ID NO: 3088830 - protein, 22 aa, Giardia lamblia
KQNAILFNFFDEGIAKTNHIST

SEQ ID NO: 3088831 - protein, 34 aa, Giardia lamblia
KQNLASIFLTLGLIPIIYSLKLYGSLLTGIISTV

SEQ ID NO: 3088832 - protein, 24 aa, Giardia lamblia
KQRRQMFGFILLTIIAVGLLCRVT

SEQ ID NO: 3088833 - protein, 23 aa, Giardia lamblia
KQRRTPVKWKKPSKVFLLSKEIS

SEQ ID NO: 3088834 - protein, 25 aa, Giardia lamblia
KQRTIFIGTLLKYASPRLTLTHLFP

SEQ ID NO: 3088835 - protein, 18 aa, Giardia lamblia
KQSFGWKLAHLCLPSVHS

SEQ ID NO: 3088836 - protein, 26 aa, Giardia lamblia
KQTERKVLIRLRPSSVLFTNAGRLKL

SEQ ID NO: 3088837 - protein, 23 aa, Giardia lamblia
KQWAGYFAVMPYYKSQSLYEQIR

SEQ ID NO: 3088838 - protein, 29 aa, Giardia lamblia
KQYIDKIRLQRYKILLANQFRVKSLVQTY

SEQ ID NO: 3088839 - protein, 23 aa, Giardia lamblia
KRCAKMYLILFSVCVMLHDKRLQ

SEQ ID NO: 3088840 - protein, 25 aa, Giardia lamblia
KRDPGQIRLDLVWNTTVCPLARKVR

SEQ ID NO: 3088841 - protein, 19 aa, Giardia lamblia
KRFITPQDCVVCRTGLVKL

SEQ ID NO: 3088842 - protein, 32 aa, Giardia lamblia
KRKRNFISVSVILFIVKQIAAALAYLHSVSEV

SEQ ID NO: 3088843 - protein, 22 aa, Giardia lamblia
KRLQLIIIVQCSLVLVFVISFS

SEQ ID NO: 3088844 - protein, 23 aa, Giardia lamblia
KRLYHNIFMVMAQKDGFITEGLR

SEQ ID NO: 3088845 - protein, 19 aa, Giardia lamblia
KRMIAKYHRASRNPILSPT

SEQ ID NO: 3088846 - protein, 31 aa, Giardia lamblia
KRMLHYEQFCWLRRLLLPRAFHVFDIDDYVS

SEQ ID NO: 3088847 - protein, 48 aa, Giardia lamblia
KRNRQGYLLLSDVLFVALFAVAILGIGVYLLVKLLSEKKAKRDHELYI

SEQ ID NO: 3088848 - protein, 23 aa, Giardia lamblia
KRNTWLFDVLGPEASIVDSENTT

SEQ ID NO: 3088849 - protein, 23 aa, Giardia lamblia
KRNYYLKLLCILKSYIETNNQDT

SEQ ID NO: 3088850 - protein, 19 aa, Giardia lamblia
KRPILYHLIQAETGKEIPV

SEQ ID NO: 3088851 - protein, 26 aa, Giardia lamblia
KRQSGYLEYIILAYLISRSITEFLSL

SEQ ID NO: 3088852 - protein, 27 aa, Giardia lamblia
KRRIGYYYETLLQWFKKYCGYEEGVTI

SEQ ID NO: 3088853 - protein, 40 aa, Giardia lamblia
KRRKIPVPIAVILSVLRQVAAALAYLYGLSGIGTRGLVHR

SEQ ID NO: 3088854 - protein, 20 aa, Giardia lamblia
KRRLTFITKMHRKILQMRDT

SEQ ID NO: 3088855 - protein, 26 aa, Giardia lamblia
KRSALYYLGRLFAFAVVYNVRFPKVF

SEQ ID NO: 3088856 - protein, 34 aa, Giardia lamblia
KRTGILQILLLFILSCLLIIPAFVKHLIWLFVAN

SEQ ID NO: 3088857 - protein, 17 aa, Giardia lamblia
KRWLFHRPTFSIHHLSR

SEQ ID NO: 3088858 - protein, 24 aa, Giardia lamblia
KRYKTLRYFFRTNVSKLLSVLFEA

SEQ ID NO: 3088859 - protein, 29 aa, Giardia lamblia
KRYSDRFLYFAIKLKALLTKLEALITRNL

SEQ ID NO: 3088860 - protein, 20 aa, Giardia lamblia
KRYVEFHAMAFLKPSESVFY

SEQ ID NO: 3088861 - protein, 28 aa, Giardia lamblia
KSDIWSVGTLTFRLLETLVNLHQGRRGH

SEQ ID NO: 3088862 - protein, 24 aa, Giardia lamblia
KSDLKPSLYIRNYDPRELETGELI

SEQ ID NO: 3088863 - protein, 20 aa, Giardia lamblia
KSDMLSAYLIALIDLACSQP

SEQ ID NO: 3088864 - protein, 30 aa, Giardia lamblia
KSEESGAFKYWYFPHGPQALYTPLFDSPAK

SEQ ID NO: 3088865 - protein, 18 aa, Giardia lamblia
KSFALYCSLLLQNALLKS

SEQ ID NO: 3088866 - protein, 20 aa, Giardia lamblia
KSFHVLIVTTTLQRASPSPG

SEQ ID NO: 3088867 - protein, 21 aa, Giardia lamblia
KSFIPFLITALIVVCTCFIVA

SEQ ID NO: 3088868 - protein, 33 aa, Giardia lamblia
KSGSIIIALVFIPIVVAIVALTSYILCNNKKKK

SEQ ID NO: 3088869 - protein, 20 aa, Giardia lamblia
KSICAIFKRFITPQDCVVCR

SEQ ID NO: 3088870 - protein, 23 aa, Giardia lamblia
KSINDLLKLLSYATATILDRDQL

SEQ ID NO: 3088871 - protein, 21 aa, Giardia lamblia
KSISILPLDLQSTCIYLFCKS

SEQ ID NO: 3088872 - protein, 23 aa, Giardia lamblia
KSLAGPWAPEYCAGPSTFTLECT

SEQ ID NO: 3088873 - protein, 33 aa, Giardia lamblia
KSLELDFISITLPLLLTMLAASIMFNPSALLPF

SEQ ID NO: 3088874 - protein, 25 aa, Giardia lamblia
KSLFISALMVLILQVIMAVAAAFSF

SEQ ID NO: 3088875 - protein, 28 aa, Giardia lamblia
KSLGPFIIIRVIFVHILLDIIDLYLENN

SEQ ID NO: 3088876 - protein, 20 aa, Giardia lamblia
KSLINLFRAFVSCSAQTLAA

SEQ ID NO: 3088877 - protein, 24 aa, Giardia lamblia
KSLKYGLHLFMLRQNLHTSQQAVI

SEQ ID NO: 3088878 - protein, 23 aa, Giardia lamblia
KSLLPEPLALLLLSSKRASDAAE

SEQ ID NO: 3088879 - protein, 34 aa, Giardia lamblia
KSLMHDLHLPPLRILKMTPAIRSLRKLRYLMVGG

SEQ ID NO: 3088880 - protein, 23 aa, Giardia lamblia
KSNFKLKFLYWNAMREHGAMEYL

SEQ ID NO: 3088881 - protein, 17 aa, Giardia lamblia
KSNLIGLFLGLTGVLAG

SEQ ID NO: 3088882 - protein, 17 aa, Giardia lamblia
KSNPWQSFQYYLTYFLY

SEQ ID NO: 3088883 - protein, 29 aa, Giardia lamblia
KSRLIDMARLLFRDLLAPDTFLLNDVQTS

SEQ ID NO: 3088884 - protein, 22 aa, Giardia lamblia
KSRTFRELFIFIFGPVFATIID

SEQ ID NO: 3088885 - protein, 22 aa, Giardia lamblia
KSRTSEFAFYLVMFSHSRASTA

SEQ ID NO: 3088886 - protein, 18 aa, Giardia lamblia
KSSLAIILHNVYIPFSGR

SEQ ID NO: 3088887 - protein, 25 aa, Giardia lamblia
KSTATLYFLLSDLDFYHQKSNGVFS

SEQ ID NO: 3088888 - protein, 26 aa, Giardia lamblia
KSTNRIGYIFLFNNISLCKVLEESFT

SEQ ID NO: 3088889 - protein, 27 aa, Giardia lamblia
KSVSRRLWIFVIIEIALVVLASGVQMG

SEQ ID NO: 3088890 - protein, 31 aa, Giardia lamblia
KSVYERATRYPSFYPRKGELLKDAYLSSVTM

SEQ ID NO: 3088891 - protein, 23 aa, Giardia lamblia
KSYAGEHVLGPFKPSFSCILGAN

SEQ ID NO: 3088892 - protein, 20 aa, Giardia lamblia
KSYHPYAHIPNFLSPSTVSD

SEQ ID NO: 3088893 - protein, 18 aa, Giardia lamblia
KSYIYYTVPMTIMIVLSA

SEQ ID NO: 3088894 - protein, 39 aa, Giardia lamblia
KSYTTLTLAFPLATAFMLLFPLASFTLGLLGAFCKKKSL

SEQ ID NO: 3088895 - protein, 20 aa, Giardia lamblia
KTEYPLNLYCGLLDGHTMYI

SEQ ID NO: 3088896 - protein, 18 aa, Giardia lamblia
KTGLKGIPTMFLFTDTQI

SEQ ID NO: 3088897 - protein, 21 aa, Giardia lamblia
KTILYNATPLSFYQYNNFIML

SEQ ID NO: 3088898 - protein, 24 aa, Giardia lamblia
KTIPVYYIWAPWVSYFAYAFKGFF

SEQ ID NO: 3088899 - protein, 25 aa, Giardia lamblia
KTIQLPLCILLFHEQYNIDESWGFV

SEQ ID NO: 3088900 - protein, 26 aa, Giardia lamblia
KTKFIYYHAYDFPAEIFRTCSFDSGT

SEQ ID NO: 3088901 - protein, 30 aa, Giardia lamblia
KTKLAPQDELLLALLSIALGASAQGLDRLQ

SEQ ID NO: 3088902 - protein, 27 aa, Giardia lamblia
KTKNCGAYIPLPYILRVRLGEKNRPYT

SEQ ID NO: 3088903 - protein, 17 aa, Giardia lamblia
KTMLSLYSLFRSKLKAL

SEQ ID NO: 3088904 - protein, 34 aa, Giardia lamblia
KTNIQSPRSTILFLFLVFATRLPSPYGNLLPLSL

SEQ ID NO: 3088905 - protein, 27 aa, Giardia lamblia
KTPDVICRLLTLAFVPIEQCSEKSAEK

SEQ ID NO: 3088906 - protein, 18 aa, Giardia lamblia
KTPFISAPGWKGAHGANM

SEQ ID NO: 3088907 - protein, 50 aa, Giardia lamblia
KTRKYNWIVFPFVAVLKQFRLFFNQFFLVLAFLQLYRPLQVGLAFTYYLP

SEQ ID NO: 3088908 - protein, 26 aa, Giardia lamblia
KTRPMMGHRLLFSTADLMRLLKRSSE

SEQ ID NO: 3088909 - protein, 24 aa, Giardia lamblia
KTRSLLFRFALVKNPTYNDLAELL

SEQ ID NO: 3088910 - protein, 28 aa, Giardia lamblia
KTSLDLKLKRFWPLKPKIIKTIIVGSLP

SEQ ID NO: 3088911 - protein, 23 aa, Giardia lamblia
KTSNPWLATIKPLTTITKDKLIK

SEQ ID NO: 3088912 - protein, 20 aa, Giardia lamblia
KTTLPLLKPRIKALTIIAPQ

SEQ ID NO: 3088913 - protein, 46 aa, Giardia lamblia
KTTNLFQAVPLLAGLIHLYASYLHYCDFSLVLQRLSCRLAMSGHKH

SEQ ID NO: 3088914 - protein, 17 aa, Giardia lamblia
KTVLLRRSASLPTIETL

SEQ ID NO: 3088915 - protein, 17 aa, Giardia lamblia
KTVTSVFTLLENLYLLL

SEQ ID NO: 3088916 - protein, 24 aa, Giardia lamblia
KTVYLSIIRALPDLFRDLGPSNKH

SEQ ID NO: 3088917 - protein, 23 aa, Giardia lamblia
KTVYYREYDLKSTNLRVIHAPGT

SEQ ID NO: 3088918 - protein, 25 aa, Giardia lamblia
KVAQHNISWPIYSFSVRGCLSNNDE

SEQ ID NO: 3088919 - protein, 24 aa, Giardia lamblia
KVCERCEDAYFLYKGGCYSVDNEP

SEQ ID NO: 3088920 - protein, 21 aa, Giardia lamblia
KVCSNKYYRSGSTCAPCHQSC

SEQ ID NO: 3088921 - protein, 24 aa, Giardia lamblia
KVCYSTHRLLLRRTDYTEKQSLSR

SEQ ID NO: 3088922 - protein, 25 aa, Giardia lamblia
KVDNISLFYVWRVSDYFKKVYADPL

SEQ ID NO: 3088923 - protein, 26 aa, Giardia lamblia
KVDRTRRFYCGFLQGLTDNLQEGVVT

SEQ ID NO: 3088924 - protein, 33 aa, Giardia lamblia
KVFEFAVLWCDASVWFHILKVLLVEGFINTSVD

SEQ ID NO: 3088925 - protein, 24 aa, Giardia lamblia
KVGKLPVDLLFSTPYVHSSTVYFC

SEQ ID NO: 3088926 - protein, 30 aa, Giardia lamblia
KVGLAFTYYLPLIFIFLVSIGRELYTELGC

SEQ ID NO: 3088927 - protein, 20 aa, Giardia lamblia
KVHRIVHTWFPMLVNPERYL

SEQ ID NO: 3088928 - protein, 24 aa, Giardia lamblia
KVICWPMCRWPTYGKVLYSLSDLI

SEQ ID NO: 3088929 - protein, 19 aa, Giardia lamblia
KVIFPPITLVVQMITKLFK

SEQ ID NO: 3088930 - protein, 18 aa, Giardia lamblia
KVILQQHKWAREIRMFMA

SEQ ID NO: 3088931 - protein, 20 aa, Giardia lamblia
KVKWIYLPDYDSNLGLPWWY

SEQ ID NO: 3088932 - protein, 24 aa, Giardia lamblia
KVLAIGLSLIFKTALRMSIESSNF

SEQ ID NO: 3088933 - protein, 20 aa, Giardia lamblia
KVLIVATIGSSLFFVVQCFP

SEQ ID NO: 3088934 - protein, 26 aa, Giardia lamblia
KVLPLNHPILYLWGPSPSHNEVFLRS

SEQ ID NO: 3088935 - protein, 32 aa, Giardia lamblia
KVLVKLLLHIAISFMVYLRVIADYQLYVNTPE

SEQ ID NO: 3088936 - protein, 18 aa, Giardia lamblia
KVNNWMPRPINVLITPWD

SEQ ID NO: 3088937 - protein, 22 aa, Giardia lamblia
KVPMRYLTHMSALEPQITIGFQ

SEQ ID NO: 3088938 - protein, 17 aa, Giardia lamblia
KVPRKLFELDSQLQYDL

SEQ ID NO: 3088939 - protein, 25 aa, Giardia lamblia
KVRPNQMRWLLHKNLLIDLKEYFIS

SEQ ID NO: 3088940 - protein, 26 aa, Giardia lamblia
KVTICGQAFLMYQIRRMMGALVAVLR

SEQ ID NO: 3088941 - protein, 21 aa, Giardia lamblia
KVTLFVCSISKQLKGSPSMIY

SEQ ID NO: 3088942 - protein, 46 aa, Giardia lamblia
KVTRRFFQRVYFSMINATLLYGSFLVSYSFYLQALKQPSPFDNQQS

SEQ ID NO: 3088943 - protein, 24 aa, Giardia lamblia
KVVDFRIIYTMVTKISDWSATKII

SEQ ID NO: 3088944 - protein, 25 aa, Giardia lamblia
KVVGPPLVLLLYLLGILGTFDARTM

SEQ ID NO: 3088945 - protein, 27 aa, Giardia lamblia
KVVMSWIFFCLLGRYNPVIANSLTWFL

SEQ ID NO: 3088946 - protein, 21 aa, Giardia lamblia
KVVQYIFTESFIKDLFFVLLT

SEQ ID NO: 3088947 - protein, 21 aa, Giardia lamblia
KWKDLLNLLPTKSYSFDIVWD

SEQ ID NO: 3088948 - protein, 19 aa, Giardia lamblia
KWLAPLQTSYQLKSGAMAV

SEQ ID NO: 3088949 - protein, 34 aa, Giardia lamblia
KWTKSPGEFPFLNSLPVKVLIDDQDKYIYPTCTQ

SEQ ID NO: 3088950 - protein, 26 aa, Giardia lamblia
KYAQPYYFQFITIYLRFLRFCIREPS

SEQ ID NO: 3088951 - protein, 27 aa, Giardia lamblia
KYAQQSPFLFFNWTPGGLTTYGILPDT

SEQ ID NO: 3088952 - protein, 18 aa, Giardia lamblia
KYCAQCKDGYAPIDGICT

SEQ ID NO: 3088953 - protein, 20 aa, Giardia lamblia
KYCTHRYIKYKGGCYEAGSF

SEQ ID NO: 3088954 - protein, 27 aa, Giardia lamblia
KYETRFSIVLHLYSLIGSQLMSFDRSI

SEQ ID NO: 3088955 - protein, 26 aa, Giardia lamblia
KYFELENLLWIRTGIILLGSRNTFKT

SEQ ID NO: 3088956 - protein, 20 aa, Giardia lamblia
KYFRIPFWVDVCRESHSLEY

SEQ ID NO: 3088957 - protein, 25 aa, Giardia lamblia
KYGPRLLSSPLFQDLLQLHAFIAIN

SEQ ID NO: 3088958 - protein, 27 aa, Giardia lamblia
KYGVTAIVTSLLWSLIVSVCYHQYENN

SEQ ID NO: 3088959 - protein, 51 aa, Giardia lamblia
KYHYHGPFLIIAPNSLLINWIKELKKFVPSLLLWPYWGTQRERMLIKRGWA

SEQ ID NO: 3088960 - protein, 30 aa, Giardia lamblia
KYIKDLRDFKILVGPLLVRLTMQPSYQEKL

SEQ ID NO: 3088961 - protein, 18 aa, Giardia lamblia
KYLELFRRLVRVEARRFN

SEQ ID NO: 3088962 - protein, 31 aa, Giardia lamblia
KYLFYRDCDFAAYYRFYSPRIQKTVSYLFWR

SEQ ID NO: 3088963 - protein, 38 aa, Giardia lamblia
KYNIITFVPKILYQQFKYFFNLYFLGITISQSIPILRV

SEQ ID NO: 3088964 - protein, 17 aa, Giardia lamblia
KYSFEVPTARYICKALL

SEQ ID NO: 3088965 - protein, 19 aa, Giardia lamblia
KYSIFISILHHSAACILPA

SEQ ID NO: 3088966 - protein, 23 aa, Giardia lamblia
KYSLHHALFIYSWCSKLLTAINK

SEQ ID NO: 3088967 - protein, 19 aa, Giardia lamblia
KYTLYSIRWVEIIYKLYWD

SEQ ID NO: 3088968 - protein, 42 aa, Giardia lamblia
LAAEKKLHEIYKWILSLKVWVIKYSLDIPLHTAFKTYVSAKL

SEQ ID NO: 3088969 - protein, 25 aa, Giardia lamblia
LAAKSLCFWVIAIEKYSYTIREVEP

SEQ ID NO: 3088970 - protein, 17 aa, Giardia lamblia
LAALAVLFAPYDPLGNI

SEQ ID NO: 3088971 - protein, 19 aa, Giardia lamblia
LAALFQKRWELPEPMALIE

SEQ ID NO: 3088972 - protein, 18 aa, Giardia lamblia
LAAQGPWRFAQVFVAPGS

SEQ ID NO: 3088973 - protein, 43 aa, Giardia lamblia
LAAYSTRLVPLPPSLQYPSFENIWVALLLIVALRQDLILSTME

SEQ ID NO: 3088974 - protein, 25 aa, Giardia lamblia
LACADGYFQATLLGGPRDCVPCDQT

SEQ ID NO: 3088975 - protein, 26 aa, Giardia lamblia
LACADGYFQATLLGGPRDCVPCDQTA

SEQ ID NO: 3088976 - protein, 17 aa, Giardia lamblia
LACAFKIKLPGPSIGLI

SEQ ID NO: 3088977 - protein, 21 aa, Giardia lamblia
LACESGRKALTLDGMLLCPRD

SEQ ID NO: 3088978 - protein, 22 aa, Giardia lamblia
LACESGRKALTLDGMLLCPREC

SEQ ID NO: 3088979 - protein, 27 aa, Giardia lamblia
LADDRQLFLELLPKALKILFSTTTHPM

SEQ ID NO: 3088980 - protein, 23 aa, Giardia lamblia
LADKRCFVFAFKPFPTLPNVKTE

SEQ ID NO: 3088981 - protein, 25 aa, Giardia lamblia
LADYIDIITFCLFSIGVKNYEEICN

SEQ ID NO: 3088982 - protein, 32 aa, Giardia lamblia
LAECLKILFVPILYIPLEAYKLTPTLSTQTLS

SEQ ID NO: 3088983 - protein, 23 aa, Giardia lamblia
LAEGVSTILLPPASLPSLSAITD

SEQ ID NO: 3088984 - protein, 28 aa, Giardia lamblia
LAEHELALLLLLTFDKLILIGDVLQLPP

SEQ ID NO: 3088985 - protein, 30 aa, Giardia lamblia
LAERLRLFRQLEGVFLLPCASHSALQNIWQ

SEQ ID NO: 3088986 - protein, 30 aa, Giardia lamblia
LAERYPRFMFYTLAWFYPVIRTASKQGALY

SEQ ID NO: 3088987 - protein, 17 aa, Giardia lamblia
LAFLVDIEWSYSAASTS

SEQ ID NO: 3088988 - protein, 21 aa, Giardia lamblia
LAGALAVVISLLRSKHNLKVM

SEQ ID NO: 3088989 - protein, 31 aa, Giardia lamblia
LAGHLVIIFERALPLFIRLSEHLNQHTLFLH

SEQ ID NO: 3088990 - protein, 24 aa, Giardia lamblia
LAGLAFLSFFISTPVIVTVVLVVL

SEQ ID NO: 3088991 - protein, 17 aa, Giardia lamblia
LAGLWNFALIVTVSFQM

SEQ ID NO: 3088992 - protein, 19 aa, Giardia lamblia
LAGMFYAASRLDQGPLRFF

SEQ ID NO: 3088993 - protein, 21 aa, Giardia lamblia
LAGPWAPEYCAGPSTFTLECT

SEQ ID NO: 3088994 - protein, 23 aa, Giardia lamblia
LAGVYIFCVFYRLVRFILNKRAQ

SEQ ID NO: 3088995 - protein, 21 aa, Giardia lamblia
LAHHALYLKRRFQQSGIPNGD

SEQ ID NO: 3088996 - protein, 21 aa, Giardia lamblia
LAHTLDIKPLNPLFATLDMSS

SEQ ID NO: 3088997 - protein, 18 aa, Giardia lamblia
LAICQLWHRLLPHYNPKG

SEQ ID NO: 3088998 - protein, 28 aa, Giardia lamblia
LAICSLGRFLLPMKLKPYNKDFTTVELK

SEQ ID NO: 3088999 - protein, 24 aa, Giardia lamblia
LAIEKLYLNGAIFSPTLFSALIAC

SEQ ID NO: 3089000 - protein, 22 aa, Giardia lamblia
LAIFILQLAWAVQVEDEREEAA

SEQ ID NO: 3089001 - protein, 30 aa, Giardia lamblia
LAIGLTVLLSIILWRISRISGPGSKITTVY

SEQ ID NO: 3089002 - protein, 17 aa, Giardia lamblia
LAILAAILIVPFCFLQE

SEQ ID NO: 3089003 - protein, 19 aa, Giardia lamblia
LAIPLLKRKPKMWEIMGVC

SEQ ID NO: 3089004 - protein, 26 aa, Giardia lamblia
LAISMQLYDRILFLPRLHDKVSTYKA

SEQ ID NO: 3089005 - protein, 29 aa, Giardia lamblia
LAITLSHLYFTPKLPIFIANLLRAEGAPP

SEQ ID NO: 3089006 - protein, 23 aa, Giardia lamblia
LAKNRPKCFLSYPSMPCFNDELN

SEQ ID NO: 3089007 - protein, 19 aa, Giardia lamblia
LAKRGLWLEAVALYTESID

SEQ ID NO: 3089008 - protein, 18 aa, Giardia lamblia
LALITLLDAFEKRVSPTV

SEQ ID NO: 3089009 - protein, 19 aa, Giardia lamblia
LALQSIKGTPLYLAPEIAK

SEQ ID NO: 3089010 - protein, 18 aa, Giardia lamblia
LALRIARIKGFSSVETAT

SEQ ID NO: 3089011 - protein, 27 aa, Giardia lamblia
LALRQNHLACMMLLLDSEEHLHESSKQ

SEQ ID NO: 3089012 - protein, 22 aa, Giardia lamblia
LAMILVTVIIKASIVAGCTSDS

SEQ ID NO: 3089013 - protein, 18 aa, Giardia lamblia
LAMTYYKTAASSAGSAGS

SEQ ID NO: 3089014 - protein, 29 aa, Giardia lamblia
LANFKALGLIIRLYFYDTLHPLDLLFESD

SEQ ID NO: 3089015 - protein, 17 aa, Giardia lamblia
LANLLADCGPGSDCVHG

SEQ ID NO: 3089016 - protein, 33 aa, Giardia lamblia
LANPGRLPSMRLVFPFLAISSPFSKFAAVAFLR

SEQ ID NO: 3089017 - protein, 18 aa, Giardia lamblia
LANTRVLVDFLGGDFSRV

SEQ ID NO: 3089018 - protein, 26 aa, Giardia lamblia
LAPKESMMVIIFAYDRYSASGFVMNF

SEQ ID NO: 3089019 - protein, 41 aa, Giardia lamblia
LAQLTPYELWLCIPFAFYFYWLVTAIFFSKRHKLRHYCLMV

SEQ ID NO: 3089020 - protein, 30 aa, Giardia lamblia
LARIFTDHFFAHFFLYLDEQLETPQWKGVP

SEQ ID NO: 3089021 - protein, 25 aa, Giardia lamblia
LARNLCKICSLGYYLDTQATPQTCK

SEQ ID NO: 3089022 - protein, 17 aa, Giardia lamblia
LARTLLQFITKKRSQLQ

SEQ ID NO: 3089023 - protein, 18 aa, Giardia lamblia
LARVQACMYKVISQAFSA

SEQ ID NO: 3089024 - protein, 24 aa, Giardia lamblia
LASAIIIIVAWIFRFMVADKKYES

SEQ ID NO: 3089025 - protein, 17 aa, Giardia lamblia
LASIYFSQIFRSPLSHE

SEQ ID NO: 3089026 - protein, 29 aa, Giardia lamblia
LASLQYTQFPQRLITFVPDGGLVNNLTFM

SEQ ID NO: 3089027 - protein, 17 aa, Giardia lamblia
LASMFWAVLICAIMVPL

SEQ ID NO: 3089028 - protein, 30 aa, Giardia lamblia
LASQLYPMYTGLWIFCAWLCCSLQKAKFDK

SEQ ID NO: 3089029 - protein, 25 aa, Giardia lamblia
LATLQPYLVQLCNPTSFHPSHWPEF

SEQ ID NO: 3089030 - protein, 27 aa, Giardia lamblia
LAVLTVHTFLRLLPVFGQSPSADKIHE

SEQ ID NO: 3089031 - protein, 20 aa, Giardia lamblia
LAVYSLRCRIALKDPATTVD

SEQ ID NO: 3089032 - protein, 18 aa, Giardia lamblia
LAYDNFMKYLISKVAGYN

SEQ ID NO: 3089033 - protein, 17 aa, Giardia lamblia
LAYIFSSFPISVSGFTF

SEQ ID NO: 3089034 - protein, 19 aa, Giardia lamblia
LAYTPLELPKLLKPTTETL

SEQ ID NO: 3089035 - protein, 20 aa, Giardia lamblia
LCAVMCSCLMLLLVPANAES

SEQ ID NO: 3089036 - protein, 28 aa, Giardia lamblia
LCAVMTTLAFYFLIKRQKRSSAPIKPNS

SEQ ID NO: 3089037 - protein, 19 aa, Giardia lamblia
LCDGLFQYCLICSETKSHW

SEQ ID NO: 3089038 - protein, 18 aa, Giardia lamblia
LCFGGGECTVLPGTPPRL

SEQ ID NO: 3089039 - protein, 22 aa, Giardia lamblia
LCGNGYFLYKGGCYSITHGAPG

SEQ ID NO: 3089040 - protein, 22 aa, Giardia lamblia
LCGSPMVFIFPGMFGYSVTKRF

SEQ ID NO: 3089041 - protein, 20 aa, Giardia lamblia
LCHYRDISLLLHQGWIIERV

SEQ ID NO: 3089042 - protein, 17 aa, Giardia lamblia
LCIDALWSESTIMGVAY

SEQ ID NO: 3089043 - protein, 27 aa, Giardia lamblia
LCIEQLLPFHDLLGKLLVTVFPDLIGG

SEQ ID NO: 3089044 - protein, 32 aa, Giardia lamblia
LCIHLRIYPIIFTPFLLLYALLDRKADQREPL

SEQ ID NO: 3089045 - protein, 26 aa, Giardia lamblia
LCILSDVIFLMLPFPSHAATVELDDT

SEQ ID NO: 3089046 - protein, 18 aa, Giardia lamblia
LCKIFIDEFLATNPNYDQ

SEQ ID NO: 3089047 - protein, 35 aa, Giardia lamblia
LCKVIEFDRYSLRRILLDYKLLLGMYNHQEKAIEK

SEQ ID NO: 3089048 - protein, 27 aa, Giardia lamblia
LCLLQICFTCLYFFTSLVLHTGVLLLG

SEQ ID NO: 3089049 - protein, 28 aa, Giardia lamblia
LCLLQICFTCLYFFTSLVLHTGVLLLGY

SEQ ID NO: 3089050 - protein, 18 aa, Giardia lamblia
LCLPLKIEITTEGSLLYD

SEQ ID NO: 3089051 - protein, 27 aa, Giardia lamblia
LCLPVRMRFYRLHRAIPLGMPAVPVSM

SEQ ID NO: 3089052 - protein, 17 aa, Giardia lamblia
LCNVAVFLSVALLQSII

SEQ ID NO: 3089053 - protein, 25 aa, Giardia lamblia
LCRHGAFSAWLKFSPPSAAAEANAN

SEQ ID NO: 3089054 - protein, 19 aa, Giardia lamblia
LCRQSSITAILLWPRLSPP

SEQ ID NO: 3089055 - protein, 55 aa, Giardia lamblia
LCSIEFRDMKQDPVRLLMQTRAVLCQLLASMLVGIGLIFAVALADACSPSIDGCA

SEQ ID NO: 3089056 - protein, 17 aa, Giardia lamblia
LCTLLQNTLITRLLGDL

SEQ ID NO: 3089057 - protein, 17 aa, Giardia lamblia
LCTQCVSGYVPINGTCQ

SEQ ID NO: 3089058 - protein, 17 aa, Giardia lamblia
LCTVLACLYSRSLLSRK

SEQ ID NO: 3089059 - protein, 26 aa, Giardia lamblia
LCVGPFPDYPLIVAEAFSALIPCTIA

SEQ ID NO: 3089060 - protein, 20 aa, Giardia lamblia
LCVKTYGPIGMFPESSLLYF

SEQ ID NO: 3089061 - protein, 20 aa, Giardia lamblia
LCVPPFKHIPDHGCAPAGCV

SEQ ID NO: 3089062 - protein, 23 aa, Giardia lamblia
LCYTLFPFPTISPPISVANRYSQ

SEQ ID NO: 3089063 - protein, 22 aa, Giardia lamblia
LCYVFSRLYRSFLQFSTLSTDD

SEQ ID NO: 3089064 - protein, 22 aa, Giardia lamblia
LDARYPFIGYNDSLKQFLGAFY

SEQ ID NO: 3089065 - protein, 23 aa, Giardia lamblia
LDCLGFLLQYTLNEVKDAFRRLT

SEQ ID NO: 3089066 - protein, 23 aa, Giardia lamblia
LDCLRSLWTFFQKGTVDVYNDLT

SEQ ID NO: 3089067 - protein, 17 aa, Giardia lamblia
LDDFLAFLIQRVSAQDS

SEQ ID NO: 3089068 - protein, 20 aa, Giardia lamblia
LDDYYDLIFPSAVCLEAVAI

SEQ ID NO: 3089069 - protein, 29 aa, Giardia lamblia
LDEVLKLWDFLFSFGLGLMPLLSCLRIIK

SEQ ID NO: 3089070 - protein, 21 aa, Giardia lamblia
LDGCVPWSCYPMLNGSICGPF

SEQ ID NO: 3089071 - protein, 25 aa, Giardia lamblia
LDGNVDHFFTLKFTIFEQLKRHLVS

SEQ ID NO: 3089072 - protein, 25 aa, Giardia lamblia
LDHFTLMTILRYKLSLKKREIIFIV

SEQ ID NO: 3089073 - protein, 22 aa, Giardia lamblia
LDHPEVVGFFIVTFTDHGLKRL

SEQ ID NO: 3089074 - protein, 19 aa, Giardia lamblia
LDIDLDIPALLPYAQRVYS

SEQ ID NO: 3089075 - protein, 28 aa, Giardia lamblia
LDIEECLPIPLLLRYLRAWKTPSDAYNS

SEQ ID NO: 3089076 - protein, 25 aa, Giardia lamblia
LDIGYVQINLFFKFLDEVCSNKSYF

SEQ ID NO: 3089077 - protein, 21 aa, Giardia lamblia
LDIILSSSWRLTPNDLAIEES

SEQ ID NO: 3089078 - protein, 33 aa, Giardia lamblia
LDIMGPLVLGLGVLLLVIWLAAAFSSNRVHKYI

SEQ ID NO: 3089079 - protein, 28 aa, Giardia lamblia
LDKHSLGLNLVFLGLLDLLHVDSTETRY

SEQ ID NO: 3089080 - protein, 18 aa, Giardia lamblia
LDLSSLLPQFALAEQLKA

SEQ ID NO: 3089081 - protein, 18 aa, Giardia lamblia
LDLYFVGLITFIGSLAAI

SEQ ID NO: 3089082 - protein, 18 aa, Giardia lamblia
LDLYYRRFDDMSPNFSAL

SEQ ID NO: 3089083 - protein, 31 aa, Giardia lamblia
LDMESLSLMYFYINEPFFPIAYAVPEDKIRT

SEQ ID NO: 3089084 - protein, 22 aa, Giardia lamblia
LDMLYVHLFSLMDSYMQTHNLD

SEQ ID NO: 3089085 - protein, 19 aa, Giardia lamblia
LDMPSYVSTSLLPKASATP

SEQ ID NO: 3089086 - protein, 18 aa, Giardia lamblia
LDPELWPITLDPSHMHLG

SEQ ID NO: 3089087 - protein, 26 aa, Giardia lamblia
LDPITINDYFFVLRDLYRCSSRSLQS

SEQ ID NO: 3089088 - protein, 25 aa, Giardia lamblia
LDQDQPYYIIASTLIRTKFSRISEH

SEQ ID NO: 3089089 - protein, 40 aa, Giardia lamblia
LDQHDYKFGKIYKFLTDDLYKRFQFIWDEFSHINDDMTLT

SEQ ID NO: 3089090 - protein, 18 aa, Giardia lamblia
LDQKLLVTGIRYVTSFVS

SEQ ID NO: 3089091 - protein, 27 aa, Giardia lamblia
LDQTRGWFYTLLILSTALFDSPPSMNC

SEQ ID NO: 3089092 - protein, 18 aa, Giardia lamblia
LDRLPHCFTILTYSMLQT

SEQ ID NO: 3089093 - protein, 34 aa, Giardia lamblia
LDRRQNRILSYKVWIAFISVSIKLAALPSGFLGM

SEQ ID NO: 3089094 - protein, 25 aa, Giardia lamblia
LDSFHPYILYNLRAAVLDFDVICGD

SEQ ID NO: 3089095 - protein, 25 aa, Giardia lamblia
LDSSNLIGYLLGLVTRPLAIDSQRI

SEQ ID NO: 3089096 - protein, 27 aa, Giardia lamblia
LDTIKSLLILILRHSQVRRLLPELASL

SEQ ID NO: 3089097 - protein, 32 aa, Giardia lamblia
LDTIWATILNVPYIPGFLLQDDYFVDRITNEL

SEQ ID NO: 3089098 - protein, 22 aa, Giardia lamblia
LDTLMSFLFDDLDISLLRSEEE

SEQ ID NO: 3089099 - protein, 21 aa, Giardia lamblia
LDTLVDIEYFVLRKVPVSNER

SEQ ID NO: 3089100 - protein, 19 aa, Giardia lamblia
LDTNPLLLNKWASLVVLSF

SEQ ID NO: 3089101 - protein, 25 aa, Giardia lamblia
LDTTLDQCFFDPYRLIPVSFAACSK

SEQ ID NO: 3089102 - protein, 22 aa, Giardia lamblia
LDTWKDIHYTNILIGPGLDTEE

SEQ ID NO: 3089103 - protein, 17 aa, Giardia lamblia
LDVCKFGELKEAVSAFI

SEQ ID NO: 3089104 - protein, 22 aa, Giardia lamblia
LDVDKFMIIRKSELSFFHMLLT

SEQ ID NO: 3089105 - protein, 21 aa, Giardia lamblia
LDVVRLLSSPYLNRNRKQKYI

SEQ ID NO: 3089106 - protein, 18 aa, Giardia lamblia
LDVVRRVFKALLPELPME

SEQ ID NO: 3089107 - protein, 18 aa, Giardia lamblia
LDYYNLYHRVLSNALSNK

SEQ ID NO: 3089108 - protein, 18 aa, Giardia lamblia
LEAFLVIATRRELNLAKL

SEQ ID NO: 3089109 - protein, 18 aa, Giardia lamblia
LEAPPACAYPWTYAPESS

SEQ ID NO: 3089110 - protein, 22 aa, Giardia lamblia
LEAQILAPLRSAPLDKIISSTL

SEQ ID NO: 3089111 - protein, 27 aa, Giardia lamblia
LEAQTNLRYLRLLEAALSLLASANSTE

SEQ ID NO: 3089112 - protein, 43 aa, Giardia lamblia
LECNYRTWIPTLRLLVVSLLLYGIQHFSFLSTIRLLFNSNHFA

SEQ ID NO: 3089113 - protein, 28 aa, Giardia lamblia
LEDVCTAFLYLLYLLVNQNNVLPTDGSP

SEQ ID NO: 3089114 - protein, 17 aa, Giardia lamblia
LEEKWLPSLLLSLGRTV

SEQ ID NO: 3089115 - protein, 18 aa, Giardia lamblia
LEELIDFSLPIYLNHLKA

SEQ ID NO: 3089116 - protein, 19 aa, Giardia lamblia
LEFKMDFVKALLKRDRSGR

SEQ ID NO: 3089117 - protein, 27 aa, Giardia lamblia
LEFLGLTYFVNMIGLLPILSILYFIGM

SEQ ID NO: 3089118 - protein, 17 aa, Giardia lamblia
LEFNHRLHILHSPVATL

SEQ ID NO: 3089119 - protein, 26 aa, Giardia lamblia
LEGCGPYAFYKLSGSLALLLKRIAEG

SEQ ID NO: 3089120 - protein, 24 aa, Giardia lamblia
LEGEAYFSYPLVRPLYKGDQIDDS

SEQ ID NO: 3089121 - protein, 18 aa, Giardia lamblia
LEGMPLPRSMPAVIKPEC

SEQ ID NO: 3089122 - protein, 23 aa, Giardia lamblia
LEGNALVRYTGAFSKALIGKSVA

SEQ ID NO: 3089123 - protein, 26 aa, Giardia lamblia
LEHGGEFIDLRIYFGLTNFLSHVNLR

SEQ ID NO: 3089124 - protein, 24 aa, Giardia lamblia
LEIKKIIIDLLRRLFLNNEVRKVF

SEQ ID NO: 3089125 - protein, 29 aa, Giardia lamblia
LEIRLNGLNYLFYFAWKEYPLEGRVMVNS

SEQ ID NO: 3089126 - protein, 30 aa, Giardia lamblia
LEKHLSKIFPGFAHFIFASSSDLCHCAEPC

SEQ ID NO: 3089127 - protein, 25 aa, Giardia lamblia
LEKRMSFLMRMMLSFISAGYQLPPE

SEQ ID NO: 3089128 - protein, 22 aa, Giardia lamblia
LELFFLISIFMSALLRPIVCCC

SEQ ID NO: 3089129 - protein, 28 aa, Giardia lamblia
LELINHDGTFLYHLMKRLGVDVSSIHNR

SEQ ID NO: 3089130 - protein, 17 aa, Giardia lamblia
LELLKAIILERLAFIVE

SEQ ID NO: 3089131 - protein, 24 aa, Giardia lamblia
LELRVVHYILAIFVGLICGRLLHK

SEQ ID NO: 3089132 - protein, 19 aa, Giardia lamblia
LELYFVRAPDVDLFLLVLN

SEQ ID NO: 3089133 - protein, 24 aa, Giardia lamblia
LEMYKQILSCFIVLSFGEVMMDYF

SEQ ID NO: 3089134 - protein, 29 aa, Giardia lamblia
LENEEDWLPIYFQLLSPLMQIAALTDAFT

SEQ ID NO: 3089135 - protein, 18 aa, Giardia lamblia
LENFKLPHRVIPQDNVWT

SEQ ID NO: 3089136 - protein, 32 aa, Giardia lamblia
LENLISHSIHPFLVSSWKLTKQRLTLNASGLN

SEQ ID NO: 3089137 - protein, 31 aa, Giardia lamblia
LEPDLQQSLLRFYKFRGLDLSPDRVAIVTDG

SEQ ID NO: 3089138 - protein, 33 aa, Giardia lamblia
LEPNLELFYLNKQLIYLAWAMTFFCDAENVRAR

SEQ ID NO: 3089139 - protein, 21 aa, Giardia lamblia
LEPRDFIIRLLEQQSPEFNLE

SEQ ID NO: 3089140 - protein, 34 aa, Giardia lamblia
LEQATKILLMFLGIIISAFGLLVHIVRRPKKAIK

SEQ ID NO: 3089141 - protein, 26 aa, Giardia lamblia
LEQMFSTYTLFQPIYVPRDDELATVQ

SEQ ID NO: 3089142 - protein, 23 aa, Giardia lamblia
LEQYPFIYQVALPEKTIQAIYVA

SEQ ID NO: 3089143 - protein, 24 aa, Giardia lamblia
LERGLRYLGLLKKTFNRLASAENE

SEQ ID NO: 3089144 - protein, 23 aa, Giardia lamblia
LERIIVDTLFQNLTFKCYFQGYT

SEQ ID NO: 3089145 - protein, 25 aa, Giardia lamblia
LESDHVLVHDIYLPNTLDGCETYST

SEQ ID NO: 3089146 - protein, 18 aa, Giardia lamblia
LESEGIVDPYLQMQPRKL

SEQ ID NO: 3089147 - protein, 27 aa, Giardia lamblia
LESKGRVYIVLFLKRLNDYHSDLAKDS

SEQ ID NO: 3089148 - protein, 18 aa, Giardia lamblia
LESLVPLLRDVMAASDVK

SEQ ID NO: 3089149 - protein, 18 aa, Giardia lamblia
LETLGPDEMFLLPPTVIS

SEQ ID NO: 3089150 - protein, 30 aa, Giardia lamblia
LETSVMNSFLLFMRSIELEYSLLSSLSKLK

SEQ ID NO: 3089151 - protein, 25 aa, Giardia lamblia
LEVGQLSVFSFGQKFELLLPITDQY

SEQ ID NO: 3089152 - protein, 24 aa, Giardia lamblia
LEYAIKVLIPRFGDTCIKHLDTYP

SEQ ID NO: 3089153 - protein, 20 aa, Giardia lamblia
LEYGVLLLSFTTVRNIFSPE

SEQ ID NO: 3089154 - protein, 20 aa, Giardia lamblia
LEYMPHVPSALLSIAPSLHM

SEQ ID NO: 3089155 - protein, 32 aa, Giardia lamblia
LEYSGRYIGFFTSLYYFIGYSFRFDDFLSTDQ

SEQ ID NO: 3089156 - protein, 17 aa, Giardia lamblia
LEYSMLYCRLASIFTYS

SEQ ID NO: 3089157 - protein, 18 aa, Giardia lamblia
LFAAYLHVRNLRPHIAPP

SEQ ID NO: 3089158 - protein, 26 aa, Giardia lamblia
LFACVYTTRLLYWLFRKNNSLRCILS

SEQ ID NO: 3089159 - protein, 27 aa, Giardia lamblia
LFASDIILCFLKFFNPLNLDDVVHVGA

SEQ ID NO: 3089160 - protein, 25 aa, Giardia lamblia
LFDDLSGLLPYLDYVQELQLHRKEL

SEQ ID NO: 3089161 - protein, 24 aa, Giardia lamblia
LFDQNFIPSLFTTSALFGMSRQSL

SEQ ID NO: 3089162 - protein, 25 aa, Giardia lamblia
LFDTLIKQFSACSFEITYRSIERAW

SEQ ID NO: 3089163 - protein, 18 aa, Giardia lamblia
LFDYKRYLEIMAALVYTV

SEQ ID NO: 3089164 - protein, 19 aa, Giardia lamblia
LFECTQILNHYFKGIIDLL

SEQ ID NO: 3089165 - protein, 18 aa, Giardia lamblia
LFEIHVYSLAYGYEALLA

SEQ ID NO: 3089166 - protein, 19 aa, Giardia lamblia
LFFIVRSSGTNCPAPVPIG

SEQ ID NO: 3089167 - protein, 28 aa, Giardia lamblia
LFGIVTYWLVPLLLVYKRPYLEATSVNT

SEQ ID NO: 3089168 - protein, 22 aa, Giardia lamblia
LFGLFILYCSQTPDAKDSNLSS

SEQ ID NO: 3089169 - protein, 20 aa, Giardia lamblia
LFIEIIKANTLWRAIPYARV

SEQ ID NO: 3089170 - protein, 28 aa, Giardia lamblia
LFKCKQLRSVLLLLLGLSVHSFTAGLSL

SEQ ID NO: 3089171 - protein, 25 aa, Giardia lamblia
LFKVYPSVLLPRLAWLINTTVHQLE

SEQ ID NO: 3089172 - protein, 18 aa, Giardia lamblia
LFLNYILRKYCSQSGESL

SEQ ID NO: 3089173 - protein, 21 aa, Giardia lamblia
LFLTIMLFDLGAIISPLIAGF

SEQ ID NO: 3089174 - protein, 19 aa, Giardia lamblia
LFMDRLHSFLIAFVAKNVD

SEQ ID NO: 3089175 - protein, 18 aa, Giardia lamblia
LFMINNNLSLFYTDCKTF

SEQ ID NO: 3089176 - protein, 18 aa, Giardia lamblia
LFNKLYSFVISTFFLLVL

SEQ ID NO: 3089177 - protein, 19 aa, Giardia lamblia
LFNSNHFASYFLNQCLEHA

SEQ ID NO: 3089178 - protein, 41 aa, Giardia lamblia
LFNYEYVTATLHKFILLVHANYLLFIQPFSLSTAQLVIVAL

SEQ ID NO: 3089179 - protein, 18 aa, Giardia lamblia
LFQALLAGAFPAHKPRER

SEQ ID NO: 3089180 - protein, 36 aa, Giardia lamblia
LFQRRNCFVVCFYWLLFIMSMYSFFKTILGPLTVII

SEQ ID NO: 3089181 - protein, 22 aa, Giardia lamblia
LFQSFIYEIYETKSLPTPTASD

SEQ ID NO: 3089182 - protein, 17 aa, Giardia lamblia
LFRVLIRKLFNPFCVTV

SEQ ID NO: 3089183 - protein, 35 aa, Giardia lamblia
LFSFFNTVFSYYLKTILIPFLASKLFNISESCEET

SEQ ID NO: 3089184 - protein, 30 aa, Giardia lamblia
LFSIEEQYWVVYLIIWIAMISGLSMCTWVI

SEQ ID NO: 3089185 - protein, 19 aa, Giardia lamblia
LFSIIFFICLACAFLISFV

SEQ ID NO: 3089186 - protein, 17 aa, Giardia lamblia
LFSILNRNNTVPVEFYG

SEQ ID NO: 3089187 - protein, 35 aa, Giardia lamblia
LFSIPTLYFCFFLNIAIRIYLPISLVIPHPSLRDF

SEQ ID NO: 3089188 - protein, 46 aa, Giardia lamblia
LFSRQIKVLLIKNILVLIRHPILLALLLLIPPLSVFIITGPSYQVK

SEQ ID NO: 3089189 - protein, 17 aa, Giardia lamblia
LFSSFFYVLIGLELMQS

SEQ ID NO: 3089190 - protein, 17 aa, Giardia lamblia
LFTIMIPSGIPQLTSRE

SEQ ID NO: 3089191 - protein, 17 aa, Giardia lamblia
LFTPEIANFFLQLQEKF

SEQ ID NO: 3089192 - protein, 25 aa, Giardia lamblia
LFVIAWLYFGNFIPFVGSYTYNFAW

SEQ ID NO: 3089193 - protein, 17 aa, Giardia lamblia
LFYLSDYIGCVRSCSLA

SEQ ID NO: 3089194 - protein, 19 aa, Giardia lamblia
LFYQSQVSTLKLPSTLRFI

SEQ ID NO: 3089195 - protein, 23 aa, Giardia lamblia
LGAKKLYLVLVYTSLIGVVMTLA

SEQ ID NO: 3089196 - protein, 47 aa, Giardia lamblia
LGALSFAFALLHYAFCQKLPLPPIFVNLFLIVICLGLFAGTLYDLES

SEQ ID NO: 3089197 - protein, 17 aa, Giardia lamblia
LGALVLTDFKGLVSLVV

SEQ ID NO: 3089198 - protein, 41 aa, Giardia lamblia
LGAVTFLLLLYPVSLSMHSFFPPIFLICPESWAPYVTMLIA

SEQ ID NO: 3089199 - protein, 19 aa, Giardia lamblia
LGCDPTIWKRLYDAIQRSA

SEQ ID NO: 3089200 - protein, 25 aa, Giardia lamblia
LGDITPSPLFINKIERYSYRDYFDF

SEQ ID NO: 3089201 - protein, 24 aa, Giardia lamblia
LGETQPYVLAIKPFAQFVAKFVDS

SEQ ID NO: 3089202 - protein, 25 aa, Giardia lamblia
LGGCSILFALVLLALQRQIAVDSIH

SEQ ID NO: 3089203 - protein, 33 aa, Giardia lamblia
LGGFPLSYFLFCIGLFLMIWLARIGGHPHPHVN

SEQ ID NO: 3089204 - protein, 24 aa, Giardia lamblia
LGGMRICHFIGDLVLKAGLVSGSQ

SEQ ID NO: 3089205 - protein, 17 aa, Giardia lamblia
LGGVLGYGKHRGGTMTN

SEQ ID NO: 3089206 - protein, 26 aa, Giardia lamblia
LGGYLPFYFPLSVPPFSRFLQRGLPE

SEQ ID NO: 3089207 - protein, 18 aa, Giardia lamblia
LGHVFKYLNYHLTDCPQI

SEQ ID NO: 3089208 - protein, 19 aa, Giardia lamblia
LGIGRTLFSLVAPLKTTSL

SEQ ID NO: 3089209 - protein, 24 aa, Giardia lamblia
LGIILHKDSLLASRLYAVAMDRHA

SEQ ID NO: 3089210 - protein, 43 aa, Giardia lamblia
LGINEKELWWVLWDGVWMLLVAILITWIKIFIARTPSCGKCCE

SEQ ID NO: 3089211 - protein, 25 aa, Giardia lamblia
LGIVFGTFIGIIVIVASAILLDMHI

SEQ ID NO: 3089212 - protein, 35 aa, Giardia lamblia
LGKMSFLYIKYFRSLLLMLVAMIFVFFSVVLVLSE

SEQ ID NO: 3089213 - protein, 17 aa, Giardia lamblia
LGLFLTIMLFDLGAIIS

SEQ ID NO: 3089214 - protein, 24 aa, Giardia lamblia
LGLNVCYKYLLRGKLMEILPQLIH

SEQ ID NO: 3089215 - protein, 27 aa, Giardia lamblia
LGLTEALFQRMLLWRAAVGLQVVSLLY

SEQ ID NO: 3089216 - protein, 33 aa, Giardia lamblia
LGNEPIIRTLLRILLPGELYFSLMRPPSAQTGQ

SEQ ID NO: 3089217 - protein, 25 aa, Giardia lamblia
LGNLSPFGMQYILSTLLKALDASSD

SEQ ID NO: 3089218 - protein, 43 aa, Giardia lamblia
LGQFVGWDFCFFINIFIGFFSILFCWLYLPKVPRFKESKFDYV

SEQ ID NO: 3089219 - protein, 23 aa, Giardia lamblia
LGRSALMYAVINKRPACVSILAP

SEQ ID NO: 3089220 - protein, 24 aa, Giardia lamblia
LGRTALMYAAFTGLTLAAQELIPY

SEQ ID NO: 3089221 - protein, 22 aa, Giardia lamblia
LGRTILKIFCENIPFSCVDSSI

SEQ ID NO: 3089222 - protein, 26 aa, Giardia lamblia
LGSGLARAILITRAYGGIINVSSCKN

SEQ ID NO: 3089223 - protein, 24 aa, Giardia lamblia
LGSIRSIEHLLVSGTPYTQLEIDR

SEQ ID NO: 3089224 - protein, 26 aa, Giardia lamblia
LGSLPMGFLFFFSYIPMLQGNYTAQL

SEQ ID NO: 3089225 - protein, 28 aa, Giardia lamblia
LGSQTLQHELILLETLKPLLSRSNPQAE

SEQ ID NO: 3089226 - protein, 25 aa, Giardia lamblia
LGTKENFLLALYNLSGTKTINSFRH

SEQ ID NO: 3089227 - protein, 25 aa, Giardia lamblia
LGVEQPYVLWILDLQPESSECVLNW

SEQ ID NO: 3089228 - protein, 19 aa, Giardia lamblia
LGVIIYELVTLRRPDFLEG

SEQ ID NO: 3089229 - protein, 19 aa, Giardia lamblia
LGVIIYELVTLRRPDFLGG

SEQ ID NO: 3089230 - protein, 32 aa, Giardia lamblia
LGVYAIKIISVGASRPWLLKALSEVTVLEKLR

SEQ ID NO: 3089231 - protein, 34 aa, Giardia lamblia
LGYIVESIVFLFISPAMVLVSPTSPYFIVKRSEG

SEQ ID NO: 3089232 - protein, 17 aa, Giardia lamblia
LGYVTPLPKQRRTPVKW

SEQ ID NO: 3089233 - protein, 33 aa, Giardia lamblia
LHAEMSRRILLLYDSILLAKRHRYLLLSRKQDT

SEQ ID NO: 3089234 - protein, 19 aa, Giardia lamblia
LHARAFVTYFPLQAYGMFL

SEQ ID NO: 3089235 - protein, 20 aa, Giardia lamblia
LHAYNMIRLPISVDFLTFTI

SEQ ID NO: 3089236 - protein, 18 aa, Giardia lamblia
LHCRRMLHLAALYGSLIS

SEQ ID NO: 3089237 - protein, 25 aa, Giardia lamblia
LHDYRIYYVLTTGASLKFLLETGFI

SEQ ID NO: 3089238 - protein, 25 aa, Giardia lamblia
LHEVDLDSFLRFTPDNYKTYLQNKL

SEQ ID NO: 3089239 - protein, 18 aa, Giardia lamblia
LHEYRYYIGLSQGTKFSS

SEQ ID NO: 3089240 - protein, 23 aa, Giardia lamblia
LHFAVGRILIPCVELFISDPNVL

SEQ ID NO: 3089241 - protein, 28 aa, Giardia lamblia
LHFHKDSITGLAWLHRRGLLAACSHDRK

SEQ ID NO: 3089242 - protein, 31 aa, Giardia lamblia
LHFRSILFIVIPNLIILLIGGTRLFCILLQR

SEQ ID NO: 3089243 - protein, 31 aa, Giardia lamblia
LHGFYPDLHIIFKLMTPPDTLLAPPMNSSIQ

SEQ ID NO: 3089244 - protein, 17 aa, Giardia lamblia
LHGVNLLRALPPSQFDS

SEQ ID NO: 3089245 - protein, 24 aa, Giardia lamblia
LHGYRVGRLLYSFLRALLLQKNQR

SEQ ID NO: 3089246 - protein, 17 aa, Giardia lamblia
LHITELYNLFLCDNCLT

SEQ ID NO: 3089247 - protein, 18 aa, Giardia lamblia
LHKSFLYYQVKTAEVLAR

SEQ ID NO: 3089248 - protein, 24 aa, Giardia lamblia
LHLLTNEVFAGCNLLAFTCKVFKD

SEQ ID NO: 3089249 - protein, 21 aa, Giardia lamblia
LHPLLLVFLVGFVQTCVPECS

SEQ ID NO: 3089250 - protein, 23 aa, Giardia lamblia
LHPSCVTLLRLLPGGVCSFFDSL

SEQ ID NO: 3089251 - protein, 18 aa, Giardia lamblia
LHQKTKMFHSYSSNFQNS

SEQ ID NO: 3089252 - protein, 25 aa, Giardia lamblia
LHQRGATIRLLRSFPLPACCYVHRY

SEQ ID NO: 3089253 - protein, 17 aa, Giardia lamblia
LHQRPRVAGLERDNASL

SEQ ID NO: 3089254 - protein, 37 aa, Giardia lamblia
LHRSLSFITPRITYSKDLWLAMLDLIEPDTSLRPSIR

SEQ ID NO: 3089255 - protein, 19 aa, Giardia lamblia
LHSLHLVLFSLPFSQVYDS

SEQ ID NO: 3089256 - protein, 18 aa, Giardia lamblia
LHTLLDIFSLELKESAFL

SEQ ID NO: 3089257 - protein, 27 aa, Giardia lamblia
LHTNSGFHLGFLRFLFDSAFTTEIDRF

SEQ ID NO: 3089258 - protein, 26 aa, Giardia lamblia
LHVDYLTFYKATLPQWLRASPLVSYM

SEQ ID NO: 3089259 - protein, 43 aa, Giardia lamblia
LHVRNLRPHIAPPLPFLDFLHYWFLFRVRPGIKNKDFLYANSS

SEQ ID NO: 3089260 - protein, 27 aa, Giardia lamblia
LHYERLCTRFALLYLQVYTDFCSQQNH

SEQ ID NO: 3089261 - protein, 26 aa, Giardia lamblia
LHYGTNYITLFPATYKKHLPALLEEP

SEQ ID NO: 3089262 - protein, 20 aa, Giardia lamblia
LHYRLQMDIIFLLRDGKNAA

SEQ ID NO: 3089263 - protein, 20 aa, Giardia lamblia
LIAALGFATFFPASFLYTHC

SEQ ID NO: 3089264 - protein, 24 aa, Giardia lamblia
LIAGPLLFLPQILNFVLSVPQLFG

SEQ ID NO: 3089265 - protein, 19 aa, Giardia lamblia
LIAIAVIDVIIAITSRYIS

SEQ ID NO: 3089266 - protein, 40 aa, Giardia lamblia
LIAPGMLRNILIVAFYQIAVILLMIFGVVGDTLLMVPDSV

SEQ ID NO: 3089267 - protein, 20 aa, Giardia lamblia
LIATIYYLRRKAQNAYRSFI

SEQ ID NO: 3089268 - protein, 17 aa, Giardia lamblia
LIDRLTDVLRLARSHEL

SEQ ID NO: 3089269 - protein, 24 aa, Giardia lamblia
LIEEIFMCRACLCFTIFQVDEELV

SEQ ID NO: 3089270 - protein, 21 aa, Giardia lamblia
LIELCYCLLTVLLASGVLYMS

SEQ ID NO: 3089271 - protein, 17 aa, Giardia lamblia
LIELFSTASLKSTRWII

SEQ ID NO: 3089272 - protein, 20 aa, Giardia lamblia
LIEPLPDRYLGREALEKREM

SEQ ID NO: 3089273 - protein, 18 aa, Giardia lamblia
LIESLTPEEARGGRLLLF

SEQ ID NO: 3089274 - protein, 23 aa, Giardia lamblia
LIFAGRYIILLMSIFSIFTGLIY

SEQ ID NO: 3089275 - protein, 19 aa, Giardia lamblia
LIGDVLQLPPLIQDCKLTS

SEQ ID NO: 3089276 - protein, 25 aa, Giardia lamblia
LIGKEALNLLPFLTSFEAIKQLCDL

SEQ ID NO: 3089277 - protein, 23 aa, Giardia lamblia
LIGKTALMFAAEAGSLSAVARLA

SEQ ID NO: 3089278 - protein, 26 aa, Giardia lamblia
LIGSILFIIGCLLFGFFIFLEKRVTH

SEQ ID NO: 3089279 - protein, 17 aa, Giardia lamblia
LIHYCVCAQASAFPDAG

SEQ ID NO: 3089280 - protein, 19 aa, Giardia lamblia
LIIALTRGYTDIAKLLFPL

SEQ ID NO: 3089281 - protein, 17 aa, Giardia lamblia
LIILIVALLRQVFGDVL

SEQ ID NO: 3089282 - protein, 20 aa, Giardia lamblia
LIISSSPFHWNLYPVSQAHD

SEQ ID NO: 3089283 - protein, 19 aa, Giardia lamblia
LIKIDRFILRTFDNLSQFF

SEQ ID NO: 3089284 - protein, 23 aa, Giardia lamblia
LIKKHSMFIGYPIYLYKTREEEV

SEQ ID NO: 3089285 - protein, 30 aa, Giardia lamblia
LIKLLPDGRLVYLRSLHKHLVLGKQILDRD

SEQ ID NO: 3089286 - protein, 36 aa, Giardia lamblia
LIKSFRYDRQMFPALFRLLLLVTIFQPISIEEQQSI

SEQ ID NO: 3089287 - protein, 17 aa, Giardia lamblia
LILFAFAGDATHACTLM

SEQ ID NO: 3089288 - protein, 19 aa, Giardia lamblia
LILFCSFSPLLLAAPRFMH

SEQ ID NO: 3089289 - protein, 18 aa, Giardia lamblia
LILKDYAVIAWKNKILLL

SEQ ID NO: 3089290 - protein, 17 aa, Giardia lamblia
LILQLLHMSSPISTLLA

SEQ ID NO: 3089291 - protein, 19 aa, Giardia lamblia
LILREAFILEWVSGAFFDK

SEQ ID NO: 3089292 - protein, 21 aa, Giardia lamblia
LILSGYYFLSVLLPLKRRLEQ

SEQ ID NO: 3089293 - protein, 18 aa, Giardia lamblia
LIMDKYEFLLNKYIDEIN

SEQ ID NO: 3089294 - protein, 24 aa, Giardia lamblia
LINDLYVKVPLSTIALWIFHNKAV

SEQ ID NO: 3089295 - protein, 23 aa, Giardia lamblia
LIPEICSISPRITYAWLVVTVLA

SEQ ID NO: 3089296 - protein, 20 aa, Giardia lamblia
LIPSTLITFLKNPFVCFLNG

SEQ ID NO: 3089297 - protein, 33 aa, Giardia lamblia
LIPTFPRYSLMRLIWRGYFINLLLDVAYAGYLV

SEQ ID NO: 3089298 - protein, 18 aa, Giardia lamblia
LIPVINLGPLFPKNNRKH

SEQ ID NO: 3089299 - protein, 18 aa, Giardia lamblia
LIPYPTDLSLLFAMVNEL

SEQ ID NO: 3089300 - protein, 25 aa, Giardia lamblia
LIRAFLTIIQGYMGGAIFSLHLLNE

SEQ ID NO: 3089301 - protein, 18 aa, Giardia lamblia
LISDIFWEFDKQPILNEE

SEQ ID NO: 3089302 - protein, 20 aa, Giardia lamblia
LISELLRKMKKINIQIIIIA

SEQ ID NO: 3089303 - protein, 21 aa, Giardia lamblia
LISFLCLPYLCNAIIHSTNVL

SEQ ID NO: 3089304 - protein, 35 aa, Giardia lamblia
LISICIRAYKSSMLIIFCLIPVYTFLGLVPSIALN

SEQ ID NO: 3089305 - protein, 24 aa, Giardia lamblia
LISIDGYPIDRLPLKDARSFLTII

SEQ ID NO: 3089306 - protein, 29 aa, Giardia lamblia
LISLSKLSLFYYLYGSINLINFASQSIIY

SEQ ID NO: 3089307 - protein, 17 aa, Giardia lamblia
LISQLTLIDNWVLSTQD

SEQ ID NO: 3089308 - protein, 17 aa, Giardia lamblia
LISYLQLSNLHNYVEDT

SEQ ID NO: 3089309 - protein, 17 aa, Giardia lamblia
LITGLLEKAIPSVSYFL

SEQ ID NO: 3089310 - protein, 20 aa, Giardia lamblia
LITIYMLLAYVTSATFYGSN

SEQ ID NO: 3089311 - protein, 20 aa, Giardia lamblia
LITPDVCVYPRGVELRDIPH

SEQ ID NO: 3089312 - protein, 25 aa, Giardia lamblia
LITPQYSRPFLCSTLLSVLQDGPLA

SEQ ID NO: 3089313 - protein, 18 aa, Giardia lamblia
LITPVIFILVISAVREII

SEQ ID NO: 3089314 - protein, 18 aa, Giardia lamblia
LIVLTNCRSIYGRYVELG

SEQ ID NO: 3089315 - protein, 23 aa, Giardia lamblia
LIVSIWMVLNIFDLIKGGVLRCK

SEQ ID NO: 3089316 - protein, 33 aa, Giardia lamblia
LIVYASIFSLVIFTIVFIMAYSIIRLSAAEIDL

SEQ ID NO: 3089317 - protein, 26 aa, Giardia lamblia
LIVYPLQVMGSLRFYAPPIVETLLSN

SEQ ID NO: 3089318 - protein, 19 aa, Giardia lamblia
LIWVDNILQCNSMLQYPVD

SEQ ID NO: 3089319 - protein, 27 aa, Giardia lamblia
LIYAFGSSFLLFYNAIQKRFTLFFCHL

SEQ ID NO: 3089320 - protein, 18 aa, Giardia lamblia
LIYFATNKSYLLFMDTTA

SEQ ID NO: 3089321 - protein, 20 aa, Giardia lamblia
LKAIILERLAFIVETIPEQI

SEQ ID NO: 3089322 - protein, 20 aa, Giardia lamblia
LKCIIHRDLKPDNILLTGDS

SEQ ID NO: 3089323 - protein, 23 aa, Giardia lamblia
LKDKRCECSGGAQLHTLRDASGE

SEQ ID NO: 3089324 - protein, 50 aa, Giardia lamblia
LKDTDLRIWEGYPDVLPMPFFLLVLLLNLLWSRHLLATATVFSHVLRNVE

SEQ ID NO: 3089325 - protein, 17 aa, Giardia lamblia
LKELLIKSFRYDRQMFP

SEQ ID NO: 3089326 - protein, 31 aa, Giardia lamblia
LKETNYISFVLIFNFLFKVFSNREMLESCNE

SEQ ID NO: 3089327 - protein, 26 aa, Giardia lamblia
LKETPIQLFVHTLLKKLSDSDLTTSS

SEQ ID NO: 3089328 - protein, 20 aa, Giardia lamblia
LKFLGYLVSFVYGLQHLLSE

SEQ ID NO: 3089329 - protein, 21 aa, Giardia lamblia
LKGIPHCKSCEVSNGLLVCVA

SEQ ID NO: 3089330 - protein, 21 aa, Giardia lamblia
LKGIPHCKSCKVSNGLLVCVA

SEQ ID NO: 3089331 - protein, 26 aa, Giardia lamblia
LKGYCVPKCFRWLFDIDWSTDQDLMT

SEQ ID NO: 3089332 - protein, 25 aa, Giardia lamblia
LKGYCVPKCFRWLFDIDWSTDQELM

SEQ ID NO: 3089333 - protein, 17 aa, Giardia lamblia
LKHIIPNVGLPDMFTVD

SEQ ID NO: 3089334 - protein, 17 aa, Giardia lamblia
LKHQCLEPYDVSLKTPF

SEQ ID NO: 3089335 - protein, 26 aa, Giardia lamblia
LKHVERSLLFKLIVANQFASPRNLCR

SEQ ID NO: 3089336 - protein, 23 aa, Giardia lamblia
LKIMQLTLFRFLYDTFNSLSISI

SEQ ID NO: 3089337 - protein, 18 aa, Giardia lamblia
LKKAFTPARKFIVRDYLV

SEQ ID NO: 3089338 - protein, 28 aa, Giardia lamblia
LKKRRRGTLFPEYAFNRAFKKLEALATP

SEQ ID NO: 3089339 - protein, 39 aa, Giardia lamblia
LKLNSFRFLKHIFAPSFQYLFPLYTYSRKDPSPLAHHAL

SEQ ID NO: 3089340 - protein, 20 aa, Giardia lamblia
LKLSALFHLPSGLYAVVLGA

SEQ ID NO: 3089341 - protein, 23 aa, Giardia lamblia
LKLVPGDVFLATCAIAYLGVFNL

SEQ ID NO: 3089342 - protein, 20 aa, Giardia lamblia
LKNMYMSKVPRIFLPNYLSI

SEQ ID NO: 3089343 - protein, 23 aa, Giardia lamblia
LKPNYYHPVSFSAALRKTALSSS

SEQ ID NO: 3089344 - protein, 24 aa, Giardia lamblia
LKPTKLILLVGWSLAMSSLDMTIV

SEQ ID NO: 3089345 - protein, 25 aa, Giardia lamblia
LKRKYRQYFNLSALLLDVLSGGIFN

SEQ ID NO: 3089346 - protein, 18 aa, Giardia lamblia
LKTITFIQKILSSITLFD

SEQ ID NO: 3089347 - protein, 26 aa, Giardia lamblia
LKTKRLFIISLLHTIIIPPLLCIFGM

SEQ ID NO: 3089348 - protein, 18 aa, Giardia lamblia
LKTPLRTLHFPDKDMDCT

SEQ ID NO: 3089349 - protein, 44 aa, Giardia lamblia
LKTRLDLLLTVRHQGMRLIYEPTSPPYLFYAYCGGGSLQDAFKS

SEQ ID NO: 3089350 - protein, 18 aa, Giardia lamblia
LKVFYNQTSFTVLNFTRI

SEQ ID NO: 3089351 - protein, 24 aa, Giardia lamblia
LLAAPRFMHVLGIPLSVVLMLLSA

SEQ ID NO: 3089352 - protein, 18 aa, Giardia lamblia
LLAFFARLMVSGGISSYT

SEQ ID NO: 3089353 - protein, 18 aa, Giardia lamblia
LLAFIMGCHLTLAASSPT

SEQ ID NO: 3089354 - protein, 17 aa, Giardia lamblia
LLAFLKIVFCVIEHTVR

SEQ ID NO: 3089355 - protein, 28 aa, Giardia lamblia
LLAFMRNKTMLLILKFSVQMTTWSGNNC

SEQ ID NO: 3089356 - protein, 17 aa, Giardia lamblia
LLAGHMLHGFYPDLHII

SEQ ID NO: 3089357 - protein, 18 aa, Giardia lamblia
LLAIMKRVKLISVLDYYS

SEQ ID NO: 3089358 - protein, 17 aa, Giardia lamblia
LLAIVCRSYHLNGGNFD

SEQ ID NO: 3089359 - protein, 24 aa, Giardia lamblia
LLAKVTYSWSFIRPYGNCCKRCFC

SEQ ID NO: 3089360 - protein, 17 aa, Giardia lamblia
LLALRDDSSTQAKQCSS

SEQ ID NO: 3089361 - protein, 24 aa, Giardia lamblia
LLAPACSLGYLWVKSYHSLAEIYS

SEQ ID NO: 3089362 - protein, 20 aa, Giardia lamblia
LLAPHECSFIRHDNMCAAEV

SEQ ID NO: 3089363 - protein, 19 aa, Giardia lamblia
LLCCKKIMYSCLSSKAKEL

SEQ ID NO: 3089364 - protein, 18 aa, Giardia lamblia
LLCKGNMLATDKLLQCIQ

SEQ ID NO: 3089365 - protein, 19 aa, Giardia lamblia
LLCQHPILALAKASARFAG

SEQ ID NO: 3089366 - protein, 26 aa, Giardia lamblia
LLDKFEDFFTPMKGKHFFGFLKSAKE

SEQ ID NO: 3089367 - protein, 18 aa, Giardia lamblia
LLDLIKLIQDTSLTKLQR

SEQ ID NO: 3089368 - protein, 19 aa, Giardia lamblia
LLDVLLCLGIERASFHILG

SEQ ID NO: 3089369 - protein, 17 aa, Giardia lamblia
LLDYFYDGDQYSAYIIT

SEQ ID NO: 3089370 - protein, 26 aa, Giardia lamblia
LLEAVHTLLLFQLRTDQRALQLQTSY

SEQ ID NO: 3089371 - protein, 18 aa, Giardia lamblia
LLEFGIIFVVTLNSVAHA

SEQ ID NO: 3089372 - protein, 17 aa, Giardia lamblia
LLEFNFIKHVIDSLYYL

SEQ ID NO: 3089373 - protein, 38 aa, Giardia lamblia
LLEGLYIGFGQLFEPCLVLVLPYILKLSGSPNKTIAQR

SEQ ID NO: 3089374 - protein, 20 aa, Giardia lamblia
LLEGVFAPLAYWSGGQRTKY

SEQ ID NO: 3089375 - protein, 20 aa, Giardia lamblia
LLEIQEYILSLLIGITRNNI

SEQ ID NO: 3089376 - protein, 25 aa, Giardia lamblia
LLEKTPYIQVIDLVLNFLEELQLLY

SEQ ID NO: 3089377 - protein, 25 aa, Giardia lamblia
LLEMSHSLSVLPLPGALFADEPSLY

SEQ ID NO: 3089378 - protein, 27 aa, Giardia lamblia
LLEQMLLDILYVIIRVLVGSENLLIDE

SEQ ID NO: 3089379 - protein, 18 aa, Giardia lamblia
LLERLETLGLFPVDEEQD

SEQ ID NO: 3089380 - protein, 36 aa, Giardia lamblia
LLETFGAIFFCQYLIWAGLFFGGICQNVTFRYLYSM

SEQ ID NO: 3089381 - protein, 18 aa, Giardia lamblia
LLEVFASLGVLLLRKIRV

SEQ ID NO: 3089382 - protein, 18 aa, Giardia lamblia
LLEYIITTVKQPAPHAGI

SEQ ID NO: 3089383 - protein, 20 aa, Giardia lamblia
LLFIKLNRMVSRKNAWKTSG

SEQ ID NO: 3089384 - protein, 18 aa, Giardia lamblia
LLFSQYDRLETCAIYLLA

SEQ ID NO: 3089385 - protein, 20 aa, Giardia lamblia
LLGGYVPATLDRILRNLYDA

SEQ ID NO: 3089386 - protein, 19 aa, Giardia lamblia
LLGSGFFVPRRLITETVFV

SEQ ID NO: 3089387 - protein, 18 aa, Giardia lamblia
LLICIFCWIKVMKDYPHL

SEQ ID NO: 3089388 - protein, 18 aa, Giardia lamblia
LLIFMMTMPLMFVCYLVY

SEQ ID NO: 3089389 - protein, 27 aa, Giardia lamblia
LLIGLTITAWVYGIRFSKKLETGAFDE

SEQ ID NO: 3089390 - protein, 32 aa, Giardia lamblia
LLIIAAIQFFLMWLFVPWIWSIVFGALLVIHA

SEQ ID NO: 3089391 - protein, 21 aa, Giardia lamblia
LLILFILVWVTAGYGLSHLMK

SEQ ID NO: 3089392 - protein, 23 aa, Giardia lamblia
LLILGLIFIFRYLLVIKNMLPIF

SEQ ID NO: 3089393 - protein, 17 aa, Giardia lamblia
LLIMRIVFGLLSEPSWL

SEQ ID NO: 3089394 - protein, 17 aa, Giardia lamblia
LLITVAYMRAAAADARA

SEQ ID NO: 3089395 - protein, 23 aa, Giardia lamblia
LLKCAKINHIITYKFAFEVVMRN

SEQ ID NO: 3089396 - protein, 29 aa, Giardia lamblia
LLKFILSDYMVYISWLMNHATIVVGTISG

SEQ ID NO: 3089397 - protein, 17 aa, Giardia lamblia
LLKKSIYLKYFSKNYVP

SEQ ID NO: 3089398 - protein, 25 aa, Giardia lamblia
LLLDDLLFRLGYLEPVTSVPFYSGI

SEQ ID NO: 3089399 - protein, 30 aa, Giardia lamblia
LLLHLKHGFIVKTLFKFILKQPIGGGLLRD

SEQ ID NO: 3089400 - protein, 23 aa, Giardia lamblia
LLLLLVFYAGAAAVLYMLGHRRR

SEQ ID NO: 3089401 - protein, 17 aa, Giardia lamblia
LLLNLVLSNVDFIDTIA

SEQ ID NO: 3089402 - protein, 21 aa, Giardia lamblia
LLLSDNIYLTLLSAAIRFKNR

SEQ ID NO: 3089403 - protein, 18 aa, Giardia lamblia
LLLSFTTVRNIFSPEAML

SEQ ID NO: 3089404 - protein, 22 aa, Giardia lamblia
LLLYRRRALLVSALVLSPTLVF

SEQ ID NO: 3089405 - protein, 17 aa, Giardia lamblia
LLMEVMSLAIEPLKSLS

SEQ ID NO: 3089406 - protein, 19 aa, Giardia lamblia
LLMGCIRCSRTGRAICEAC

SEQ ID NO: 3089407 - protein, 20 aa, Giardia lamblia
LLMTLEYLVHKKLITHLADP

SEQ ID NO: 3089408 - protein, 17 aa, Giardia lamblia
LLMVIYHNHRPLDMPSS

SEQ ID NO: 3089409 - protein, 25 aa, Giardia lamblia
LLNASFCHAFFFQTRVLLKSHLSYS

SEQ ID NO: 3089410 - protein, 32 aa, Giardia lamblia
LLNDKELRLGWLLPFRLGTPPAPNLLGKQYIY

SEQ ID NO: 3089411 - protein, 19 aa, Giardia lamblia
LLNFNSVTEVFYAFSVEYK

SEQ ID NO: 3089412 - protein, 17 aa, Giardia lamblia
LLNLLSRTGARFDYRLL

SEQ ID NO: 3089413 - protein, 25 aa, Giardia lamblia
LLNPLRTHLSGYRLLFSAIVEATLY

SEQ ID NO: 3089414 - protein, 21 aa, Giardia lamblia
LLNRQLHLLLDILGNKNTPSI

SEQ ID NO: 3089415 - protein, 21 aa, Giardia lamblia
LLNSVLIYSILFERSFASFER

SEQ ID NO: 3089416 - protein, 24 aa, Giardia lamblia
LLNYSLRMFLQGRNAIFTRRLSRS

SEQ ID NO: 3089417 - protein, 17 aa, Giardia lamblia
LLQNQNILKPFGPSLAA

SEQ ID NO: 3089418 - protein, 22 aa, Giardia lamblia
LLQRPCCIDWSIFYLSSNRAEP

SEQ ID NO: 3089419 - protein, 20 aa, Giardia lamblia
LLRAMMVPYLILSESSFILI

SEQ ID NO: 3089420 - protein, 17 aa, Giardia lamblia
LLRDMTPTVFKLDPLFL

SEQ ID NO: 3089421 - protein, 27 aa, Giardia lamblia
LLRRFHSRILYCAFVENLALMLTSYYC

SEQ ID NO: 3089422 - protein, 19 aa, Giardia lamblia
LLSAIALIFSLMKTSLQGS

SEQ ID NO: 3089423 - protein, 24 aa, Giardia lamblia
LLSALLQLFFTFMLLYISSMYNPV

SEQ ID NO: 3089424 - protein, 39 aa, Giardia lamblia
LLSCSKFDPLLIALQNKIFRIIDYVLRLLTPLPDGTHEV

SEQ ID NO: 3089425 - protein, 18 aa, Giardia lamblia
LLSERGFSGQLIRIVSGC

SEQ ID NO: 3089426 - protein, 18 aa, Giardia lamblia
LLSGDFYARSLKVFGLPE

SEQ ID NO: 3089427 - protein, 27 aa, Giardia lamblia
LLSIGPFVDLVFSSVLRLLARYLDLGE

SEQ ID NO: 3089428 - protein, 18 aa, Giardia lamblia
LLSIVEEFNRLHAWMCNY

SEQ ID NO: 3089429 - protein, 20 aa, Giardia lamblia
LLSKMTVFCLINAGVAQVFN

SEQ ID NO: 3089430 - protein, 29 aa, Giardia lamblia
LLSNANYTILVLSYITRLFNADIRSRTLI

SEQ ID NO: 3089431 - protein, 30 aa, Giardia lamblia
LLSTIVKSMFYPLVLPPLGNHLFQVLTKHC

SEQ ID NO: 3089432 - protein, 37 aa, Giardia lamblia
LLTCWIPEFLFMTCFFGYMVFCIIYKWLNEWPEGSNP

SEQ ID NO: 3089433 - protein, 18 aa, Giardia lamblia
LLTFDRWYKYVLAIFVGP

SEQ ID NO: 3089434 - protein, 26 aa, Giardia lamblia
LLTKAFIQTLLRLRYFHTVETDPRYE

SEQ ID NO: 3089435 - protein, 17 aa, Giardia lamblia
LLTNYFARAYDTLGNKP

SEQ ID NO: 3089436 - protein, 22 aa, Giardia lamblia
LLTTPIMAMLIALLTTSPDALT

SEQ ID NO: 3089437 - protein, 20 aa, Giardia lamblia
LLTVKFVIIVSVNGPKEGSK

SEQ ID NO: 3089438 - protein, 20 aa, Giardia lamblia
LLTVLVLYSYTFVPNSLGAM

SEQ ID NO: 3089439 - protein, 19 aa, Giardia lamblia
LLVLYFLVYICYSVLIILI

SEQ ID NO: 3089440 - protein, 18 aa, Giardia lamblia
LLVNNLHLCFNTQTDLLL

SEQ ID NO: 3089441 - protein, 17 aa, Giardia lamblia
LLVPNVFSIPGCRQRLL

SEQ ID NO: 3089442 - protein, 17 aa, Giardia lamblia
LLVSLISYYFVSFSRKK

SEQ ID NO: 3089443 - protein, 24 aa, Giardia lamblia
LLYEVIGTYLFAITSPLGCVPYSL

SEQ ID NO: 3089444 - protein, 19 aa, Giardia lamblia
LLYFQEAYAQLLEQLVLPD

SEQ ID NO: 3089445 - protein, 17 aa, Giardia lamblia
LLYGIFSECAQNSDCGG

SEQ ID NO: 3089446 - protein, 27 aa, Giardia lamblia
LLYPGLTIMDHLRLFAPLYGYKHSGIY

SEQ ID NO: 3089447 - protein, 25 aa, Giardia lamblia
LLYSENIFITHFLLPQTEISFDRCV

SEQ ID NO: 3089448 - protein, 26 aa, Giardia lamblia
LMAANSPLWLISDLAIMARGAVTVPV

SEQ ID NO: 3089449 - protein, 24 aa, Giardia lamblia
LMAEYALPGFILFVETHKTGRHTL

SEQ ID NO: 3089450 - protein, 18 aa, Giardia lamblia
LMALINYHNKYGPILLVP

SEQ ID NO: 3089451 - protein, 25 aa, Giardia lamblia
LMCHPKLLLCYEMCRFHSDCDLTSG

SEQ ID NO: 3089452 - protein, 23 aa, Giardia lamblia
LMDCPYALFNLILAMIMSQQSSK

SEQ ID NO: 3089453 - protein, 17 aa, Giardia lamblia
LMDGAKIAIGWLVDVLQ

SEQ ID NO: 3089454 - protein, 19 aa, Giardia lamblia
LMDLLLDIVPDMARAYISA

SEQ ID NO: 3089455 - protein, 32 aa, Giardia lamblia
LMEQNSLKVFYYIKYLRNPGLFSKLHSPADAK

SEQ ID NO: 3089456 - protein, 24 aa, Giardia lamblia
LMERVSFFFAFSKDVGHSDFLPVQ

SEQ ID NO: 3089457 - protein, 19 aa, Giardia lamblia
LMIASNYYSTAFAWSIILS

SEQ ID NO: 3089458 - protein, 17 aa, Giardia lamblia
LMIAVQLLDAVSVKALA

SEQ ID NO: 3089459 - protein, 30 aa, Giardia lamblia
LMIIVFTPFFIVPLLYILMGLRSDLFITYG

SEQ ID NO: 3089460 - protein, 29 aa, Giardia lamblia
LMLALDTFQINLPLLLRYADLALEMRFGM

SEQ ID NO: 3089461 - protein, 24 aa, Giardia lamblia
LMLAVAMNSLTLVRLLVGEKGIRR

SEQ ID NO: 3089462 - protein, 19 aa, Giardia lamblia
LMLCCIMIFVIFLNGEINL

SEQ ID NO: 3089463 - protein, 27 aa, Giardia lamblia
LMLYVSGIVMKIPLYSSLPARLGYFPL

SEQ ID NO: 3089464 - protein, 17 aa, Giardia lamblia
LMMAVRKKRHVIIPVLM

SEQ ID NO: 3089465 - protein, 23 aa, Giardia lamblia
LMMLDRRVPAKCGILLCGALETD

SEQ ID NO: 3089466 - protein, 25 aa, Giardia lamblia
LMMVMTIPLLMVRCISFRTAFRCSS

SEQ ID NO: 3089467 - protein, 25 aa, Giardia lamblia
LMNCGWLLGMFFLVLIGVSSALSFY

SEQ ID NO: 3089468 - protein, 27 aa, Giardia lamblia
LMNGIAYMIITLIHKQVFSFFSIARDL

SEQ ID NO: 3089469 - protein, 17 aa, Giardia lamblia
LMNLNLQSGLLSLSHNV

SEQ ID NO: 3089470 - protein, 38 aa, Giardia lamblia
LMNWMSTLFVVIFPFIFYIMLYALKELLYWLTEGAPLR

SEQ ID NO: 3089471 - protein, 29 aa, Giardia lamblia
LMQHGEIPAYFRRASWTYLTLKYTQEAEV

SEQ ID NO: 3089472 - protein, 22 aa, Giardia lamblia
LMQQCIVAFYTYLILEHHAPVS

SEQ ID NO: 3089473 - protein, 18 aa, Giardia lamblia
LMQQWEIIITNWKAHNKT

SEQ ID NO: 3089474 - protein, 19 aa, Giardia lamblia
LMRLIVMMKRGASPLLRPI

SEQ ID NO: 3089475 - protein, 20 aa, Giardia lamblia
LMSSFLFRIHSVGYAFLSML

SEQ ID NO: 3089476 - protein, 18 aa, Giardia lamblia
LMVLKPTQSGLLRIFENC

SEQ ID NO: 3089477 - protein, 19 aa, Giardia lamblia
LMWSLPFLCIDLFGVEWVL

SEQ ID NO: 3089478 - protein, 17 aa, Giardia lamblia
LMYFTIQEDERYKPLLP

SEQ ID NO: 3089479 - protein, 29 aa, Giardia lamblia
LNADYKAMRITILNVLLFATSQSLIAHPD

SEQ ID NO: 3089480 - protein, 19 aa, Giardia lamblia
LNALICIAIFFAAKPTLRK

SEQ ID NO: 3089481 - protein, 17 aa, Giardia lamblia
LNASFRAIGPLPADHGK

SEQ ID NO: 3089482 - protein, 28 aa, Giardia lamblia
LNCVIYYREALLQSPRFLRILMAYEEKV

SEQ ID NO: 3089483 - protein, 29 aa, Giardia lamblia
LNDLDPKLFYATMFMLMDLQKIDSMVLVF

SEQ ID NO: 3089484 - protein, 23 aa, Giardia lamblia
LNDSLALNLCDLKLLVNNLHLCF

SEQ ID NO: 3089485 - protein, 17 aa, Giardia lamblia
LNFDALYPHCNCKHQTE

SEQ ID NO: 3089486 - protein, 28 aa, Giardia lamblia
LNGSTLLILLISIFLITIVSSRFSFEQL

SEQ ID NO: 3089487 - protein, 18 aa, Giardia lamblia
LNILLRLQENYDTSEALL

SEQ ID NO: 3089488 - protein, 20 aa, Giardia lamblia
LNILPLVKYGLFDPSWRVRL

SEQ ID NO: 3089489 - protein, 24 aa, Giardia lamblia
LNKHSLAITVWPLPLNHQTADCSI

SEQ ID NO: 3089490 - protein, 17 aa, Giardia lamblia
LNLAFKSGWIISHLVFF

SEQ ID NO: 3089491 - protein, 23 aa, Giardia lamblia
LNLCKRMVSFLRLADFMIMDSLY

SEQ ID NO: 3089492 - protein, 17 aa, Giardia lamblia
LNLMIRSQHRKGKQQSS

SEQ ID NO: 3089493 - protein, 17 aa, Giardia lamblia
LNLRTPAGETALMAAAA

SEQ ID NO: 3089494 - protein, 33 aa, Giardia lamblia
LNLSIKSLLVIFTIALHYAPISSLSLIVGVRDT

SEQ ID NO: 3089495 - protein, 18 aa, Giardia lamblia
LNLVLSNVDFIDTIAGTV

SEQ ID NO: 3089496 - protein, 23 aa, Giardia lamblia
LNNALRMFSLHFVNMRTECIKVC

SEQ ID NO: 3089497 - protein, 20 aa, Giardia lamblia
LNNWAIRQIFLAARVVIVRR

SEQ ID NO: 3089498 - protein, 17 aa, Giardia lamblia
LNPFARLKLGGSCYSSL

SEQ ID NO: 3089499 - protein, 27 aa, Giardia lamblia
LNPSSILYLPLLILKDILVENAADPLA

SEQ ID NO: 3089500 - protein, 17 aa, Giardia lamblia
LNTLLALYSLTQAPSDD

SEQ ID NO: 3089501 - protein, 29 aa, Giardia lamblia
LNTSHPLLLLRIRGLIYAFSQALTKIQEN

SEQ ID NO: 3089502 - protein, 34 aa, Giardia lamblia
LNTSQRKILPLSAYFLLMILMSFVELGALSFVFA

SEQ ID NO: 3089503 - protein, 30 aa, Giardia lamblia
LNTTEYIPPLSQFAAIFVFGSLILMEALNL

SEQ ID NO: 3089504 - protein, 26 aa, Giardia lamblia
LNVKQLIRAVLSGLLVVIWVAIQMYF

SEQ ID NO: 3089505 - protein, 18 aa, Giardia lamblia
LNVYQFALPPLAGFVSDL

SEQ ID NO: 3089506 - protein, 25 aa, Giardia lamblia
LNYEDTFVKKWRFTNQLFKFDICCN

SEQ ID NO: 3089507 - protein, 22 aa, Giardia lamblia
LPACFIIIYYVSFKYIPEDVWL

SEQ ID NO: 3089508 - protein, 27 aa, Giardia lamblia
LPACRKSWFIPWFTNKAIVPALDLPHE

SEQ ID NO: 3089509 - protein, 19 aa, Giardia lamblia
LPALLRCGQCGSTIPHCLD

SEQ ID NO: 3089510 - protein, 21 aa, Giardia lamblia
LPANFLPEILTTYSMARFGCT

SEQ ID NO: 3089511 - protein, 30 aa, Giardia lamblia
LPASDTSIFTYLDFMKKLFTVRVELGVSLQ

SEQ ID NO: 3089512 - protein, 18 aa, Giardia lamblia
LPCNPGHVPFWSLTDANF

SEQ ID NO: 3089513 - protein, 19 aa, Giardia lamblia
LPCPPMEGCITCKGTLSEC

SEQ ID NO: 3089514 - protein, 17 aa, Giardia lamblia
LPDSIFLTFERFAELSK

SEQ ID NO: 3089515 - protein, 26 aa, Giardia lamblia
LPDVMYTFIRRFYFPNSHDLLYHQYR

SEQ ID NO: 3089516 - protein, 26 aa, Giardia lamblia
LPDYDSNLGLPWWYDDPHDYQSISKV

SEQ ID NO: 3089517 - protein, 23 aa, Giardia lamblia
LPEESLAHWAFRPELYVNLGVTS

SEQ ID NO: 3089518 - protein, 26 aa, Giardia lamblia
LPELFKVFRYVIERLNLCISPEGVVF

SEQ ID NO: 3089519 - protein, 36 aa, Giardia lamblia
LPEPMALIEELLRPIPRIWLPFSLKEYAGTIIELFN

SEQ ID NO: 3089520 - protein, 25 aa, Giardia lamblia
LPEYNRVIIIAPISLLLGTSTLDVL

SEQ ID NO: 3089521 - protein, 23 aa, Giardia lamblia
LPFHMIIQFFRNVAADRLLWTIR

SEQ ID NO: 3089522 - protein, 30 aa, Giardia lamblia
LPFIVLCTREPLFIVFSLTGNMAISDPFRL

SEQ ID NO: 3089523 - protein, 23 aa, Giardia lamblia
LPFPILSIIFYSSLAIYILFCFV

SEQ ID NO: 3089524 - protein, 17 aa, Giardia lamblia
LPFTNLYENPAVVFVAL

SEQ ID NO: 3089525 - protein, 30 aa, Giardia lamblia
LPIISSRTLLGLLIFFVTQSPPPDCPHIRI

SEQ ID NO: 3089526 - protein, 18 aa, Giardia lamblia
LPILSILYFIGMFCYGAS

SEQ ID NO: 3089527 - protein, 26 aa, Giardia lamblia
LPINPRFYINFIMYDTTLMKKQLINK

SEQ ID NO: 3089528 - protein, 31 aa, Giardia lamblia
LPLAGFTVGFLLLLAFLLTLHTAGFSLFLSA

SEQ ID NO: 3089529 - protein, 33 aa, Giardia lamblia
LPLEFHLTAITFFKLLCPLLKSLEKRAIIVTKL

SEQ ID NO: 3089530 - protein, 35 aa, Giardia lamblia
LPLGTIFFSCMSILILLLDCFFLRNSPGKDGDQLV

SEQ ID NO: 3089531 - protein, 25 aa, Giardia lamblia
LPLLVEGVMITFYMAETLLLVTAEA

SEQ ID NO: 3089532 - protein, 26 aa, Giardia lamblia
LPLNNFFEHLFSLLVPNVFSIPGCRQ

SEQ ID NO: 3089533 - protein, 18 aa, Giardia lamblia
LPLPDVLYTRFATYTIKI

SEQ ID NO: 3089534 - protein, 21 aa, Giardia lamblia
LPNCDFFKLIVYNISQYPEDV

SEQ ID NO: 3089535 - protein, 19 aa, Giardia lamblia
LPPCYMFGMSFPRMYKGKA

SEQ ID NO: 3089536 - protein, 19 aa, Giardia lamblia
LPPHPRFSCSCRNKHISIL

SEQ ID NO: 3089537 - protein, 23 aa, Giardia lamblia
LPPPRYVLLLHLPKELRYIQPLQ

SEQ ID NO: 3089538 - protein, 20 aa, Giardia lamblia
LPPQIIFNLDIGGYNLLFLS

SEQ ID NO: 3089539 - protein, 24 aa, Giardia lamblia
LPQEFYYRHLFSSNTTLNTLSTVV

SEQ ID NO: 3089540 - protein, 24 aa, Giardia lamblia
LPQTYPFYNIYTNELLQLSQLEIC

SEQ ID NO: 3089541 - protein, 32 aa, Giardia lamblia
LPQYNRLRELLISRYLVILYGVDTLTKEHLEM

SEQ ID NO: 3089542 - protein, 21 aa, Giardia lamblia
LPRHAILSYRIPCCRVFLIDV

SEQ ID NO: 3089543 - protein, 30 aa, Giardia lamblia
LPSFSIITTMFGVWAAYAAISYLISKEFPI

SEQ ID NO: 3089544 - protein, 29 aa, Giardia lamblia
LPSMIHPRVLLLVFLPHNFLEATPCLPYR

SEQ ID NO: 3089545 - protein, 25 aa, Giardia lamblia
LPSTTTFRVKLWYTAGSGIESASVS

SEQ ID NO: 3089546 - protein, 29 aa, Giardia lamblia
LPTGKIRLFHPTVPVLFLNALDDFITGKN

SEQ ID NO: 3089547 - protein, 20 aa, Giardia lamblia
LPTIIHRYFEEGFWNLVLEV

SEQ ID NO: 3089548 - protein, 21 aa, Giardia lamblia
LPVHDFFGEKPYPVGRLLWSA

SEQ ID NO: 3089549 - protein, 27 aa, Giardia lamblia
LPVKVYQKIWIFAPLANLVTCTITFEP

SEQ ID NO: 3089550 - protein, 20 aa, Giardia lamblia
LPVPDLVPETATIADILLSF

SEQ ID NO: 3089551 - protein, 29 aa, Giardia lamblia
LPVVDYTTLFLLLKLVVNSLLNSAISIQN

SEQ ID NO: 3089552 - protein, 24 aa, Giardia lamblia
LPWSQIQSLKLFDHMFPSLHLSIR

SEQ ID NO: 3089553 - protein, 17 aa, Giardia lamblia
LPYYLASLVATQSTFKG

SEQ ID NO: 3089554 - protein, 18 aa, Giardia lamblia
LQAFTIFSGKYNPALYYS

SEQ ID NO: 3089555 - protein, 24 aa, Giardia lamblia
LQALYLLCHGVVWNFLKTGVHEQN

SEQ ID NO: 3089556 - protein, 25 aa, Giardia lamblia
LQCATLPWSVFLPTYEFKISRFVMP

SEQ ID NO: 3089557 - protein, 29 aa, Giardia lamblia
LQCVFSYLQFGQPTSIVPPSLFTEKHNLD

SEQ ID NO: 3089558 - protein, 34 aa, Giardia lamblia
LQDDTTMMLFITRIVSFLQNYLSNPSFRGLVQAK

SEQ ID NO: 3089559 - protein, 17 aa, Giardia lamblia
LQDLILDTLLVDLSISQ

SEQ ID NO: 3089560 - protein, 21 aa, Giardia lamblia
LQDLNIFLIIRAFICKVADGL

SEQ ID NO: 3089561 - protein, 21 aa, Giardia lamblia
LQEINYYFRRTDITHLSALLE

SEQ ID NO: 3089562 - protein, 25 aa, Giardia lamblia
LQELQTANLPLLPGFNGQVIPPAPC

SEQ ID NO: 3089563 - protein, 23 aa, Giardia lamblia
LQELRFSVKLLGTVKQRTDDRLL

SEQ ID NO: 3089564 - protein, 23 aa, Giardia lamblia
LQFDLLAITYFNTKPSAPEVFAG

SEQ ID NO: 3089565 - protein, 18 aa, Giardia lamblia
LQGLLKALHKFNSGVVKS

SEQ ID NO: 3089566 - protein, 18 aa, Giardia lamblia
LQGWILFGKYSSGAGVLY

SEQ ID NO: 3089567 - protein, 26 aa, Giardia lamblia
LQHLLSETELLWLCSRNLAIVILEGG

SEQ ID NO: 3089568 - protein, 19 aa, Giardia lamblia
LQIPNLCGCTDLQTILSLI

SEQ ID NO: 3089569 - protein, 40 aa, Giardia lamblia
LQITYPYILAVFFGQLIYALSDSILWYLLSDMVSRFLGGT

SEQ ID NO: 3089570 - protein, 25 aa, Giardia lamblia
LQKRLEKLYRWTTIGSLIGSLIIFL

SEQ ID NO: 3089571 - protein, 22 aa, Giardia lamblia
LQLASLLINFWTEQRLGLSTGG

SEQ ID NO: 3089572 - protein, 24 aa, Giardia lamblia
LQLNTEFLPTYPLADIAYGFTFIL

SEQ ID NO: 3089573 - protein, 21 aa, Giardia lamblia
LQLVIAWLRDYETEQLWSLLA

SEQ ID NO: 3089574 - protein, 34 aa, Giardia lamblia
LQMGLRRLRFISSLFYILVLHYFDQATAVFSMAP

SEQ ID NO: 3089575 - protein, 25 aa, Giardia lamblia
LQNKRMSFARLYFLSDEELLDILSQ

SEQ ID NO: 3089576 - protein, 34 aa, Giardia lamblia
LQNLILRDTELARKLLFLPTNPSQLYLKTFKRIV

SEQ ID NO: 3089577 - protein, 18 aa, Giardia lamblia
LQQLPFCLFMGCSSLSHI

SEQ ID NO: 3089578 - protein, 34 aa, Giardia lamblia
LQQMYKHPPTAWLNLALDIIFPALSPELTLPMTP

SEQ ID NO: 3089579 - protein, 26 aa, Giardia lamblia
LQQNIIFSVIYHWNVWQRCMSVTSSD

SEQ ID NO: 3089580 - protein, 53 aa, Giardia lamblia
LQRGVKRHLLLGLIILTVLLTMAILGLTLYFLAKFLIFRRKNKQRIAYIKERK

SEQ ID NO: 3089581 - protein, 18 aa, Giardia lamblia
LQRLALSLHWEDELLLPN

SEQ ID NO: 3089582 - protein, 18 aa, Giardia lamblia
LQRLGYVTPLPKQRRTPV

SEQ ID NO: 3089583 - protein, 17 aa, Giardia lamblia
LQRLIVDGYIEPISITR

SEQ ID NO: 3089584 - protein, 30 aa, Giardia lamblia
LQSAYRTALFISIFMVVVLAIGIYYRYLEN

SEQ ID NO: 3089585 - protein, 23 aa, Giardia lamblia
LQSKDIFVFHGLNLLVTAGTAKP

SEQ ID NO: 3089586 - protein, 25 aa, Giardia lamblia
LQSLYCSCLNPFFTFMSPIIKRSGR

SEQ ID NO: 3089587 - protein, 21 aa, Giardia lamblia
LQSTILYHLCTAKDLYYTLFS

SEQ ID NO: 3089588 - protein, 25 aa, Giardia lamblia
LQSTLSFPLIGASIGFQYPLLANVQ

SEQ ID NO: 3089589 - protein, 28 aa, Giardia lamblia
LQSVIKQNWALLPLLSDFELLNSETLEF

SEQ ID NO: 3089590 - protein, 27 aa, Giardia lamblia
LQSYYVPDAMILCDFELALPSTRLSPS

SEQ ID NO: 3089591 - protein, 25 aa, Giardia lamblia
LQTHPFYNIVPFLDSLREEVVDLVV

SEQ ID NO: 3089592 - protein, 20 aa, Giardia lamblia
LQTLSRVKAYYVKRIKSTPT

SEQ ID NO: 3089593 - protein, 31 aa, Giardia lamblia
LQTYTVYELLDHLLLFLSLSHQSLTSQKGAS

SEQ ID NO: 3089594 - protein, 20 aa, Giardia lamblia
LQVLLKEEPYLATGVLFFVV

SEQ ID NO: 3089595 - protein, 17 aa, Giardia lamblia
LQVLPNPCSVDNPRWRE

SEQ ID NO: 3089596 - protein, 20 aa, Giardia lamblia
LQVMYLYHRLMTKQAISAGW

SEQ ID NO: 3089597 - protein, 24 aa, Giardia lamblia
LQVVSLLYRLIMHSVLYAKRVHWE

SEQ ID NO: 3089598 - protein, 24 aa, Giardia lamblia
LRALSWVSFILGVVLFVSALGTTC

SEQ ID NO: 3089599 - protein, 25 aa, Giardia lamblia
LRDGRVFTCFANGKLSACMAPFPAI

SEQ ID NO: 3089600 - protein, 25 aa, Giardia lamblia
LRDHAEIYTLLYKLGIPHNESRLES

SEQ ID NO: 3089601 - protein, 32 aa, Giardia lamblia
LRDLEPGFLFNLEQMLFILDAALERFTTLAAK

SEQ ID NO: 3089602 - protein, 22 aa, Giardia lamblia
LRDNPLRTFSSPPLSVDLRELG

SEQ ID NO: 3089603 - protein, 36 aa, Giardia lamblia
LRDRHLVLVTLLLFNALCMELLPILLEILVGHFTAI

SEQ ID NO: 3089604 - protein, 25 aa, Giardia lamblia
LRDWNGWCALMWAASKNNISCVRLL

SEQ ID NO: 3089605 - protein, 18 aa, Giardia lamblia
LREFFAIYNISSLEHVWI

SEQ ID NO: 3089606 - protein, 27 aa, Giardia lamblia
LRENNPIIMFLQPYLHILEYTFVFGDR

SEQ ID NO: 3089607 - protein, 27 aa, Giardia lamblia
LREVTRSFVVPLFAKLAALLSTEAVFD

SEQ ID NO: 3089608 - protein, 17 aa, Giardia lamblia
LRFFVMAASPAKVDAAI

SEQ ID NO: 3089609 - protein, 18 aa, Giardia lamblia
LRFTSYLTSFKYKNSYKL

SEQ ID NO: 3089610 - protein, 23 aa, Giardia lamblia
LRGIVELSNLFIRPEALDMLQGV

SEQ ID NO: 3089611 - protein, 20 aa, Giardia lamblia
LRGLIFRLITMIELIQKSKF

SEQ ID NO: 3089612 - protein, 18 aa, Giardia lamblia
LRGYMLYMGGCYDPAAIP

SEQ ID NO: 3089613 - protein, 23 aa, Giardia lamblia
LRHVKLIPKLIAQYLQLSGGAAQ

SEQ ID NO: 3089614 - protein, 20 aa, Giardia lamblia
LRIIFLRAKCELSFMELFGD

SEQ ID NO: 3089615 - protein, 21 aa, Giardia lamblia
LRINFSSEVFLNFIASYPVQV

SEQ ID NO: 3089616 - protein, 30 aa, Giardia lamblia
LRIRGYLPIIFAFLALMYPTTIITKAANVP

SEQ ID NO: 3089617 - protein, 26 aa, Giardia lamblia
LRITEPFMCRFLLKEDFLSLIDVIYT

SEQ ID NO: 3089618 - protein, 22 aa, Giardia lamblia
LRITPLDYSRRYLYKVFPFSYT

SEQ ID NO: 3089619 - protein, 17 aa, Giardia lamblia
LRITRYPQLAHAYAFQN

SEQ ID NO: 3089620 - protein, 18 aa, Giardia lamblia
LRKLNLFEEMKIAPPPLS

SEQ ID NO: 3089621 - protein, 25 aa, Giardia lamblia
LRKMDFGMILLVFTAGAYGQLTTAF

SEQ ID NO: 3089622 - protein, 33 aa, Giardia lamblia
LRKVQKKFEILLFKLLYTYVMEDIYPQWSVFIL

SEQ ID NO: 3089623 - protein, 20 aa, Giardia lamblia
LRLSLFGLLLTSNFEYNMNC

SEQ ID NO: 3089624 - protein, 25 aa, Giardia lamblia
LRMHTPLLVANILVLGSYVIKTILV

SEQ ID NO: 3089625 - protein, 29 aa, Giardia lamblia
LRMQAKHMPTKFRDLLILLHGLEAGKVFS

SEQ ID NO: 3089626 - protein, 28 aa, Giardia lamblia
LRMSYRDIFIARFYPRQFKQSFFFLTKD

SEQ ID NO: 3089627 - protein, 29 aa, Giardia lamblia
LRNCILSTHRQSFPLIISPCYERAADGKY

SEQ ID NO: 3089628 - protein, 26 aa, Giardia lamblia
LRNHYHPLIRKLIRLLESGSAFTAVH

SEQ ID NO: 3089629 - protein, 24 aa, Giardia lamblia
LRNKDIPLWVIDAYVAKFEETTVQ

SEQ ID NO: 3089630 - protein, 25 aa, Giardia lamblia
LRNKTSLLYNILRSTSITPIILSSI

SEQ ID NO: 3089631 - protein, 17 aa, Giardia lamblia
LRNVTWSVAYYERLLNA

SEQ ID NO: 3089632 - protein, 32 aa, Giardia lamblia
LRPHELLKRPLPELYMPFFRVALTSCPVFAHA

SEQ ID NO: 3089633 - protein, 25 aa, Giardia lamblia
LRPPQLVFYEMCMLKHDLSKSHGLA

SEQ ID NO: 3089634 - protein, 30 aa, Giardia lamblia
LRPSQFKALVYAVLSPLLLILGCPGSGKST

SEQ ID NO: 3089635 - protein, 18 aa, Giardia lamblia
LRQHFRCVVCLFTEVYCC

SEQ ID NO: 3089636 - protein, 36 aa, Giardia lamblia
LRRAKLLQVLETLSLHWAAPVFGLPHFEKKFHRFSA

SEQ ID NO: 3089637 - protein, 19 aa, Giardia lamblia
LRRGVVGSLFASLRRETQN

SEQ ID NO: 3089638 - protein, 19 aa, Giardia lamblia
LRRKPGVVVLFNYFSQPGR

SEQ ID NO: 3089639 - protein, 19 aa, Giardia lamblia
LRRLLHIYFHVYFNHFGIV

SEQ ID NO: 3089640 - protein, 24 aa, Giardia lamblia
LRRPRGYGWAFLRGLKDPVVIVLT

SEQ ID NO: 3089641 - protein, 18 aa, Giardia lamblia
LRRSMYEGFMLAFGSMLN

SEQ ID NO: 3089642 - protein, 17 aa, Giardia lamblia
LRRTLLSGLLITGFSMA

SEQ ID NO: 3089643 - protein, 18 aa, Giardia lamblia
LRRVMPTIQIYLATKRRT

SEQ ID NO: 3089644 - protein, 23 aa, Giardia lamblia
LRSICKDLIYSRIQGMSVISQAC

SEQ ID NO: 3089645 - protein, 24 aa, Giardia lamblia
LRSIPLATGVLAILRLFHVLVSDS

SEQ ID NO: 3089646 - protein, 21 aa, Giardia lamblia
LRSMYPEFISIPNAGIHVPVN

SEQ ID NO: 3089647 - protein, 37 aa, Giardia lamblia
LRTNQLLLHALLSVQIYSFFYFLSTLVFTCGTCFMQG

SEQ ID NO: 3089648 - protein, 30 aa, Giardia lamblia
LRVKNIELWYFLAFFLLTPAVVGVSFALPC

SEQ ID NO: 3089649 - protein, 33 aa, Giardia lamblia
LRVTNDIFQFFLYLMKYLKTYRKQLKAFIERDE

SEQ ID NO: 3089650 - protein, 17 aa, Giardia lamblia
LRYFNGKPILRASDLLC

SEQ ID NO: 3089651 - protein, 19 aa, Giardia lamblia
LRYRNTYMVAGKLLDKLTA

SEQ ID NO: 3089652 - protein, 21 aa, Giardia lamblia
LRYSKIPIIHFYSSESMRLNL

SEQ ID NO: 3089653 - protein, 26 aa, Giardia lamblia
LSAAPLPYLLRNYLLLIAGTLDDSEA

SEQ ID NO: 3089654 - protein, 22 aa, Giardia lamblia
LSACVLVYLDGRYESFEYCYYH

SEQ ID NO: 3089655 - protein, 25 aa, Giardia lamblia
LSADRAMFLLFRQLTATIEDYIGYL

SEQ ID NO: 3089656 - protein, 24 aa, Giardia lamblia
LSALDQEIFALKRDNLELAHDKKA

SEQ ID NO: 3089657 - protein, 26 aa, Giardia lamblia
LSALLSICHGLLTPGIFYTTVAVILH

SEQ ID NO: 3089658 - protein, 22 aa, Giardia lamblia
LSAQVYTLYKAFRLAIDFLSLT

SEQ ID NO: 3089659 - protein, 30 aa, Giardia lamblia
LSATREHYPLLLRTLFLYTSTVTGAMTHHT

SEQ ID NO: 3089660 - protein, 25 aa, Giardia lamblia
LSAVTIVQFFLCRLRNILLDLESRS

SEQ ID NO: 3089661 - protein, 17 aa, Giardia lamblia
LSCCNPLYRDTVVSGLI

SEQ ID NO: 3089662 - protein, 25 aa, Giardia lamblia
LSCLELLVRFALVVGFLDFDESCRR

SEQ ID NO: 3089663 - protein, 18 aa, Giardia lamblia
LSCRLLASDVQMIYSRAK

SEQ ID NO: 3089664 - protein, 23 aa, Giardia lamblia
LSCTFVGYAFLHIASREWVFPLH

SEQ ID NO: 3089665 - protein, 28 aa, Giardia lamblia
LSDAELRRQLLPLFTYIANYEGKKLFAD

SEQ ID NO: 3089666 - protein, 26 aa, Giardia lamblia
LSDKMPLTHLLKLLEQFFEIVCDETE

SEQ ID NO: 3089667 - protein, 24 aa, Giardia lamblia
LSDLRSILIRLLAEQCWRSLSAKG

SEQ ID NO: 3089668 - protein, 24 aa, Giardia lamblia
LSDYAIPLAALTRAPDLYDELEPR

SEQ ID NO: 3089669 - protein, 26 aa, Giardia lamblia
LSDYRGITGLMRASLHGFTTIIKTLF

SEQ ID NO: 3089670 - protein, 36 aa, Giardia lamblia
LSECSHNLCALAYAVKQLWTMLDAQEANLPVPDLVP

SEQ ID NO: 3089671 - protein, 28 aa, Giardia lamblia
LSEEILRLILLIIYNQIVFVFSLNYICI

SEQ ID NO: 3089672 - protein, 19 aa, Giardia lamblia
LSEFYLQFFGRDILATFPF

SEQ ID NO: 3089673 - protein, 25 aa, Giardia lamblia
LSEIRRLFTSRCFVERLFTMLDKSC

SEQ ID NO: 3089674 - protein, 35 aa, Giardia lamblia
LSELCRYICSIFSLLPVFFYANVFQSLACLGMYLV

SEQ ID NO: 3089675 - protein, 17 aa, Giardia lamblia
LSELFRIDPLIIREFAG

SEQ ID NO: 3089676 - protein, 18 aa, Giardia lamblia
LSELIIRCFKTKSFIPFL

SEQ ID NO: 3089677 - protein, 28 aa, Giardia lamblia
LSFFGVLPQFRCLLLYVIDLICRIVKLP

SEQ ID NO: 3089678 - protein, 17 aa, Giardia lamblia
LSFILGFSLSLVALTIP

SEQ ID NO: 3089679 - protein, 24 aa, Giardia lamblia
LSFQFPKFQFNANKRLFFFAVTKE

SEQ ID NO: 3089680 - protein, 21 aa, Giardia lamblia
LSGAIALFFRGSNRTKMISIP

SEQ ID NO: 3089681 - protein, 19 aa, Giardia lamblia
LSGIYTFDLAYDEVDFRED

SEQ ID NO: 3089682 - protein, 23 aa, Giardia lamblia
LSGLVLTVASLVLYLLTSIANQR

SEQ ID NO: 3089683 - protein, 35 aa, Giardia lamblia
LSGQVVLFILMIYKLARMLSFNFRYILVTNASNSN

SEQ ID NO: 3089684 - protein, 22 aa, Giardia lamblia
LSHHTLLNFLQFDTSGTAVLNF

SEQ ID NO: 3089685 - protein, 24 aa, Giardia lamblia
LSHISMLLGPRNLGTILLSIRTHC

SEQ ID NO: 3089686 - protein, 28 aa, Giardia lamblia
LSHLRCKYIMPLLPKYGDAPAVSTFNDE

SEQ ID NO: 3089687 - protein, 25 aa, Giardia lamblia
LSHTYATWMFLLQSIGLIISGLAIP

SEQ ID NO: 3089688 - protein, 23 aa, Giardia lamblia
LSIGFPIVILFSAIFNTATICAL

SEQ ID NO: 3089689 - protein, 18 aa, Giardia lamblia
LSIGLLQFFGAPLIFPYC

SEQ ID NO: 3089690 - protein, 34 aa, Giardia lamblia
LSIILGCVMFICGLTLLIIFLERGPRSAKYKTVL

SEQ ID NO: 3089691 - protein, 19 aa, Giardia lamblia
LSIILYGTLFGFVKRDPTS

SEQ ID NO: 3089692 - protein, 17 aa, Giardia lamblia
LSILTMDLVFQQTLLSI

SEQ ID NO: 3089693 - protein, 28 aa, Giardia lamblia
LSISAFTLFLTYLVYTPAFSLILSTIVA

SEQ ID NO: 3089694 - protein, 21 aa, Giardia lamblia
LSIWTEIIYGRLGFSGAFIST

SEQ ID NO: 3089695 - protein, 20 aa, Giardia lamblia
LSIYDLTKALLLKASPRHYT

SEQ ID NO: 3089696 - protein, 24 aa, Giardia lamblia
LSKELYISWIKYGGIGKFVLCLVL

SEQ ID NO: 3089697 - protein, 24 aa, Giardia lamblia
LSKLAFLYSLFYDKSTTDLINYQL

SEQ ID NO: 3089698 - protein, 28 aa, Giardia lamblia
LSKRTLLYCNLIYRILATGAIKENPVVT

SEQ ID NO: 3089699 - protein, 24 aa, Giardia lamblia
LSKSMVMILAFYFDIHTVASFVLP

SEQ ID NO: 3089700 - protein, 20 aa, Giardia lamblia
LSKVLDCEVIPTLKGLYSSG

SEQ ID NO: 3089701 - protein, 27 aa, Giardia lamblia
LSKYRQQFIVLFIIKAALDNTQVGFGY

SEQ ID NO: 3089702 - protein, 27 aa, Giardia lamblia
LSLAIASFIIFLIICIYALCGHCRNKE

SEQ ID NO: 3089703 - protein, 35 aa, Giardia lamblia
LSLEIGLEILRKAWPYLHRETILSLVHRKNPNSAV

SEQ ID NO: 3089704 - protein, 18 aa, Giardia lamblia
LSLFQNLASIFFSVIITF

SEQ ID NO: 3089705 - protein, 17 aa, Giardia lamblia
LSLISKVLLLTKGADSK

SEQ ID NO: 3089706 - protein, 27 aa, Giardia lamblia
LSLKCLLFPGFYLPHELSLLLTAISEL

SEQ ID NO: 3089707 - protein, 17 aa, Giardia lamblia
LSLLIDGIGRFLALFFA

SEQ ID NO: 3089708 - protein, 27 aa, Giardia lamblia
LSLPMHYDAIYPVKRTTALPAALQNLL

SEQ ID NO: 3089709 - protein, 24 aa, Giardia lamblia
LSLSPQFCLSIIKLFANDMDLCLT

SEQ ID NO: 3089710 - protein, 43 aa, Giardia lamblia
LSLTIGLSVTAVALLLIALGILLWKLLSARKLSRTRCMHLPGS

SEQ ID NO: 3089711 - protein, 33 aa, Giardia lamblia
LSMSNPNMRYFFAQILLVSTWQFGARTPECLEY

SEQ ID NO: 3089712 - protein, 30 aa, Giardia lamblia
LSNHILIERVLSPVTPVLLFDYTKGDLDHL

SEQ ID NO: 3089713 - protein, 21 aa, Giardia lamblia
LSNILQACNTILWGANRLNAD

SEQ ID NO: 3089714 - protein, 34 aa, Giardia lamblia
LSNIPEFLQPYYKAPGFELPLSKVLGVLSEYESA

SEQ ID NO: 3089715 - protein, 26 aa, Giardia lamblia
LSNITLRYFPNILPSICTDLISLHQR

SEQ ID NO: 3089716 - protein, 21 aa, Giardia lamblia
LSNPLHILLKARSYTGTFSAC

SEQ ID NO: 3089717 - protein, 18 aa, Giardia lamblia
LSNQFRKLYRSVAQLDVA

SEQ ID NO: 3089718 - protein, 24 aa, Giardia lamblia
LSPALLCGLVFMRNALQLKHKVVR

SEQ ID NO: 3089719 - protein, 30 aa, Giardia lamblia
LSPSDFIAPFLFDLQFQLNLLYSSIIVSSQ

SEQ ID NO: 3089720 - protein, 33 aa, Giardia lamblia
LSQALRIYGTFHELLIFVKKLIRSFDAASSSFS

SEQ ID NO: 3089721 - protein, 27 aa, Giardia lamblia
LSQFIISVWIIFLFTDVTIFGISHEGV

SEQ ID NO: 3089722 - protein, 30 aa, Giardia lamblia
LSQLEICSIYLIGWLRLTQNLTLCYDGALV

SEQ ID NO: 3089723 - protein, 25 aa, Giardia lamblia
LSRFVKYMLPIFRNNFEYSDNRLSR

SEQ ID NO: 3089724 - protein, 17 aa, Giardia lamblia
LSRNLHLSDIGFYFMSF

SEQ ID NO: 3089725 - protein, 33 aa, Giardia lamblia
LSSDAILMRAFDRIWPRFLRTLVEQIKTHIGNI

SEQ ID NO: 3089726 - protein, 28 aa, Giardia lamblia
LSSDFLNTMWLDIYPFLHAHRDGTGAFD

SEQ ID NO: 3089727 - protein, 28 aa, Giardia lamblia
LSSDSVPLMLYLLRGLLLQSSKNIKLFA

SEQ ID NO: 3089728 - protein, 37 aa, Giardia lamblia
LSSEFTPYMYGLLGLYAYPLLNLRRPITTLLRRLESF

SEQ ID NO: 3089729 - protein, 17 aa, Giardia lamblia
LSSHFRICPGRLLSYKR

SEQ ID NO: 3089730 - protein, 23 aa, Giardia lamblia
LSSIIRVLPRKLGALRPPLKNLE

SEQ ID NO: 3089731 - protein, 26 aa, Giardia lamblia
LSSKLYTFYVSPILPSIDHLDSILNK

SEQ ID NO: 3089732 - protein, 26 aa, Giardia lamblia
LSSLSLIFALHCYKPTPLYVMDEIDA

SEQ ID NO: 3089733 - protein, 19 aa, Giardia lamblia
LSSLYFTAPQEFCACFLTN

SEQ ID NO: 3089734 - protein, 26 aa, Giardia lamblia
LSSNRATLIYLPRPALEIQPSLFSQS

SEQ ID NO: 3089735 - protein, 17 aa, Giardia lamblia
LSSRAFLPIFANLLLET

SEQ ID NO: 3089736 - protein, 31 aa, Giardia lamblia
LSSSLLDQAYLFPTSFSLKGVKFAKLLHTGK

SEQ ID NO: 3089737 - protein, 26 aa, Giardia lamblia
LSSSQLVSLFKWIHPPPDVSSSLVSQ

SEQ ID NO: 3089738 - protein, 19 aa, Giardia lamblia
LSTLRTMFPRLAESNLSKL

SEQ ID NO: 3089739 - protein, 32 aa, Giardia lamblia
LSTMILGLFSLLFLTGFLFLSTDIHIYLGISV

SEQ ID NO: 3089740 - protein, 20 aa, Giardia lamblia
LSTSILPPLSPLLQTPTAAE

SEQ ID NO: 3089741 - protein, 21 aa, Giardia lamblia
LSTVHLLLDQLPLSTFQYLDT

SEQ ID NO: 3089742 - protein, 24 aa, Giardia lamblia
LSVACSLILQNTLRYAWMTVQEVT

SEQ ID NO: 3089743 - protein, 19 aa, Giardia lamblia
LSVFEYWTRIGIKGYPPAV

SEQ ID NO: 3089744 - protein, 22 aa, Giardia lamblia
LSVHRYLLQKDLLFIPEDRITF

SEQ ID NO: 3089745 - protein, 19 aa, Giardia lamblia
LSVKVIPSSLWLACAACLA

SEQ ID NO: 3089746 - protein, 47 aa, Giardia lamblia
LSVMREHLLIYIIIIILFLLTIILIILIVVLYIKLVDLKVANLTVTN

SEQ ID NO: 3089747 - protein, 23 aa, Giardia lamblia
LSVPLLRATEWIAKLLIKVDRLE

SEQ ID NO: 3089748 - protein, 34 aa, Giardia lamblia
LSVYLANCFILLYEVLFPFIQESLMLNFSDLAFE

SEQ ID NO: 3089749 - protein, 25 aa, Giardia lamblia
LSWSDVKLFLPTALRGSLSLAESCD

SEQ ID NO: 3089750 - protein, 21 aa, Giardia lamblia
LSYAELVPFRLTALIAQLLGP

SEQ ID NO: 3089751 - protein, 18 aa, Giardia lamblia
LSYQYMFELALLSSGASV

SEQ ID NO: 3089752 - protein, 17 aa, Giardia lamblia
LSYTLDMPSYVSTSLLP

SEQ ID NO: 3089753 - protein, 28 aa, Giardia lamblia
LSYYLQCLVMIIFCLVPDIIYSTLSRLY

SEQ ID NO: 3089754 - protein, 18 aa, Giardia lamblia
LTAKPINVMLAFDSPWAM

SEQ ID NO: 3089755 - protein, 20 aa, Giardia lamblia
LTALFKDAFFIHGPAVAAVA

SEQ ID NO: 3089756 - protein, 19 aa, Giardia lamblia
LTALMIAAIVGAVNCVTLL

SEQ ID NO: 3089757 - protein, 18 aa, Giardia lamblia
LTASALIEALSALNLPVI

SEQ ID NO: 3089758 - protein, 19 aa, Giardia lamblia
LTASMYSTAPLLNGSRQPS

SEQ ID NO: 3089759 - protein, 26 aa, Giardia lamblia
LTCLYKQWLALIQSPQSYIIIFGVPV

SEQ ID NO: 3089760 - protein, 21 aa, Giardia lamblia
LTDFTIIPLSIKQGIRTRART

SEQ ID NO: 3089761 - protein, 24 aa, Giardia lamblia
LTDLMPAITLPSNDRARLLSTEKP

SEQ ID NO: 3089762 - protein, 23 aa, Giardia lamblia
LTDLYQMGFFLYKLLTQECPPSP

SEQ ID NO: 3089763 - protein, 23 aa, Giardia lamblia
LTDTIFNSIFRGLDESLPYMCCI

SEQ ID NO: 3089764 - protein, 18 aa, Giardia lamblia
LTDWARGYFALEVYYLAH

SEQ ID NO: 3089765 - protein, 30 aa, Giardia lamblia
LTEAKRNLLLSWIWSGSGLYYFTIDRIIPS

SEQ ID NO: 3089766 - protein, 21 aa, Giardia lamblia
LTFYFIVNSFAAPCQQKGYHM

SEQ ID NO: 3089767 - protein, 25 aa, Giardia lamblia
LTHANLLEFLSLPLLEHVIYVDISQ

SEQ ID NO: 3089768 - protein, 20 aa, Giardia lamblia
LTHNSSLTASMYSTAPLLSG

SEQ ID NO: 3089769 - protein, 19 aa, Giardia lamblia
LTIFLPDWYNMIPMAMIGF

SEQ ID NO: 3089770 - protein, 19 aa, Giardia lamblia
LTISLYVKDLLSKAQYQLT

SEQ ID NO: 3089771 - protein, 22 aa, Giardia lamblia
LTKQPHFAAVYPQWISETIFRS

SEQ ID NO: 3089772 - protein, 20 aa, Giardia lamblia
LTKYAPMSIVIRTLVKSFAE

SEQ ID NO: 3089773 - protein, 19 aa, Giardia lamblia
LTKYKRKRNFISVSVILFI

SEQ ID NO: 3089774 - protein, 19 aa, Giardia lamblia
LTLGPKVFYLHCLSSPTLM

SEQ ID NO: 3089775 - protein, 20 aa, Giardia lamblia
LTLPGLPVLSLAWSKKISVK

SEQ ID NO: 3089776 - protein, 27 aa, Giardia lamblia
LTLSQSLYSLHGLWFLLVVSDKDHKRY

SEQ ID NO: 3089777 - protein, 24 aa, Giardia lamblia
LTLTHLFPCFSLFTSPKAEKGWFI

SEQ ID NO: 3089778 - protein, 31 aa, Giardia lamblia
LTNMMLTDFNSLVLAFFKALYHNLGSLECKI

SEQ ID NO: 3089779 - protein, 19 aa, Giardia lamblia
LTNPMYNYVLTASFYEGDI

SEQ ID NO: 3089780 - protein, 23 aa, Giardia lamblia
LTNSFLDRAIPIVINCLSIELSP

SEQ ID NO: 3089781 - protein, 32 aa, Giardia lamblia
LTNSSFINAFIDTYIRYVLIYEQVYLSKSHTV

SEQ ID NO: 3089782 - protein, 23 aa, Giardia lamblia
LTNVVLPLCLYNVPSISIMNSGV

SEQ ID NO: 3089783 - protein, 23 aa, Giardia lamblia
LTPEFLVFVFSVYSRFLSVIDLK

SEQ ID NO: 3089784 - protein, 18 aa, Giardia lamblia
LTPGNAGCLPDWVRKHTS

SEQ ID NO: 3089785 - protein, 17 aa, Giardia lamblia
LTPSHVLGFFTILQHEL

SEQ ID NO: 3089786 - protein, 19 aa, Giardia lamblia
LTQPLPPIPSIPILGQPSS

SEQ ID NO: 3089787 - protein, 23 aa, Giardia lamblia
LTRAKLALHYLLTSVTNLTLSRQ

SEQ ID NO: 3089788 - protein, 17 aa, Giardia lamblia
LTRAPHVPATFRKGWLP

SEQ ID NO: 3089789 - protein, 21 aa, Giardia lamblia
LTRSTYWIGLIGAALASDEAT

SEQ ID NO: 3089790 - protein, 17 aa, Giardia lamblia
LTRSYPPFNFYDGPPFA

SEQ ID NO: 3089791 - protein, 24 aa, Giardia lamblia
LTSGILVPVPFVISPTYSALAITG

SEQ ID NO: 3089792 - protein, 20 aa, Giardia lamblia
LTSLYRRFTSVFDSFRADNL

SEQ ID NO: 3089793 - protein, 21 aa, Giardia lamblia
LTSMGWLILLEFRAGNLLDLW

SEQ ID NO: 3089794 - protein, 25 aa, Giardia lamblia
LTSRKFIFVPTEPIKNRALLSSYRG

SEQ ID NO: 3089795 - protein, 26 aa, Giardia lamblia
LTTLRTLQIILYFNQFFMYNSTNLHL

SEQ ID NO: 3089796 - protein, 23 aa, Giardia lamblia
LTTNKLFPYAYLIQYALLTKFTC

SEQ ID NO: 3089797 - protein, 26 aa, Giardia lamblia
LTTSPLLVLFIRRQLWFTKHYMCYKD

SEQ ID NO: 3089798 - protein, 28 aa, Giardia lamblia
LTTVVCIYLIQCFYSIGFYSALNNSINE

SEQ ID NO: 3089799 - protein, 19 aa, Giardia lamblia
LTVILSVILTMQLLTCLTN

SEQ ID NO: 3089800 - protein, 28 aa, Giardia lamblia
LTVPARLIAWLIIAIPVAVIQPLMLYVS

SEQ ID NO: 3089801 - protein, 32 aa, Giardia lamblia
LTVRCSTIVLMAILLLVFSLISIVSIGTYICL

SEQ ID NO: 3089802 - protein, 27 aa, Giardia lamblia
LTYVCTKYFVFSILSLFRPVDILTTIF

SEQ ID NO: 3089803 - protein, 19 aa, Giardia lamblia
LVAESLVKTLFPPLVDKKT

SEQ ID NO: 3089804 - protein, 27 aa, Giardia lamblia
LVAGAPLVLVRLFLAILGSIVFVALAF

SEQ ID NO: 3089805 - protein, 27 aa, Giardia lamblia
LVAGIVTLIVFLLKAKRMGPTSNYMKM

SEQ ID NO: 3089806 - protein, 43 aa, Giardia lamblia
LVAQEKTELWLYMWMMFVLFSGLMLLAFLSTCFKKVLVAKEQS

SEQ ID NO: 3089807 - protein, 26 aa, Giardia lamblia
LVCDSSCIISLLTPYIFERQASISAT

SEQ ID NO: 3089808 - protein, 19 aa, Giardia lamblia
LVCLGLTSRKFIFVPTEPI

SEQ ID NO: 3089809 - protein, 25 aa, Giardia lamblia
LVDDYLLIMVYISTGVFSSTDSSIE

SEQ ID NO: 3089810 - protein, 17 aa, Giardia lamblia
LVDFLTHIAPRLTNFDY

SEQ ID NO: 3089811 - protein, 25 aa, Giardia lamblia
LVDHPLEHYILLADLLFCFTTGCEG

SEQ ID NO: 3089812 - protein, 31 aa, Giardia lamblia
LVDQISANPFLFWELLKLLVLSSINLRRVTG

SEQ ID NO: 3089813 - protein, 20 aa, Giardia lamblia
LVDRFYGISYTLLGSLYAAV

SEQ ID NO: 3089814 - protein, 27 aa, Giardia lamblia
LVDVRYTGFLWGRNLVTLKAGGYTYPF

SEQ ID NO: 3089815 - protein, 22 aa, Giardia lamblia
LVEFRSLSLFAAYLHVRNLRPH

SEQ ID NO: 3089816 - protein, 18 aa, Giardia lamblia
LVELCPCLKSFTVCSAYS

SEQ ID NO: 3089817 - protein, 17 aa, Giardia lamblia
LVELLELHITELYNLFL

SEQ ID NO: 3089818 - protein, 19 aa, Giardia lamblia
LVFFLRQVMKIATFGSQYA

SEQ ID NO: 3089819 - protein, 19 aa, Giardia lamblia
LVFVQACGLEFYRTVLNEL

SEQ ID NO: 3089820 - protein, 25 aa, Giardia lamblia
LVGKSAYVRMTLIFNVAVIVKEFSK

SEQ ID NO: 3089821 - protein, 20 aa, Giardia lamblia
LVGVVYQNAVFRYSVASAAL

SEQ ID NO: 3089822 - protein, 18 aa, Giardia lamblia
LVHAITLVLYPTLSEAVL

SEQ ID NO: 3089823 - protein, 19 aa, Giardia lamblia
LVHPGLLKHYDTLYRLDLG

SEQ ID NO: 3089824 - protein, 18 aa, Giardia lamblia
LVILFFTAAALTYTGIVF

SEQ ID NO: 3089825 - protein, 17 aa, Giardia lamblia
LVISLAMELIWKTRSDS

SEQ ID NO: 3089826 - protein, 19 aa, Giardia lamblia
LVIVAFFMGVLKSDRGKCG

SEQ ID NO: 3089827 - protein, 24 aa, Giardia lamblia
LVKAKSWFTLMHRTDPWSGANMTI

SEQ ID NO: 3089828 - protein, 17 aa, Giardia lamblia
LVKILVALLNYGLSLCI

SEQ ID NO: 3089829 - protein, 17 aa, Giardia lamblia
LVLFKRAGQSREIVDCL

SEQ ID NO: 3089830 - protein, 29 aa, Giardia lamblia
LVLGALVLPCNLLFRLLPMAREYGYRGAG

SEQ ID NO: 3089831 - protein, 18 aa, Giardia lamblia
LVLGIWPSCPELQRVLII

SEQ ID NO: 3089832 - protein, 17 aa, Giardia lamblia
LVLIPKVLSFTPTFMKT

SEQ ID NO: 3089833 - protein, 25 aa, Giardia lamblia
LVLLIGMIIVMRYLTINFSISATTK

SEQ ID NO: 3089834 - protein, 17 aa, Giardia lamblia
LVLLTTITTALCDLHTA

SEQ ID NO: 3089835 - protein, 26 aa, Giardia lamblia
LVLSVRILYVLVIFTAFVCCLFPCRA

SEQ ID NO: 3089836 - protein, 31 aa, Giardia lamblia
LVLVARILSVLLLTALLNIRRKMRNEMIPLK

SEQ ID NO: 3089837 - protein, 19 aa, Giardia lamblia
LVNLLPLLDEIYSNDPSLS

SEQ ID NO: 3089838 - protein, 17 aa, Giardia lamblia
LVNLPFDALKDYVDDTG

SEQ ID NO: 3089839 - protein, 23 aa, Giardia lamblia
LVNNRFIIMFKKGAFELGAEICP

SEQ ID NO: 3089840 - protein, 24 aa, Giardia lamblia
LVPGMLLWRSFSSDKALLGSDAHP

SEQ ID NO: 3089841 - protein, 19 aa, Giardia lamblia
LVPNLLIPEGVPVTEAVLT

SEQ ID NO: 3089842 - protein, 29 aa, Giardia lamblia
LVPYEMCTTHLWLSLRYLPSVADTDAPYY

SEQ ID NO: 3089843 - protein, 26 aa, Giardia lamblia
LVQCFLSHLPAGDLLLLLIACTGASI

SEQ ID NO: 3089844 - protein, 24 aa, Giardia lamblia
LVRDRRFVLYAPPAAELRAQPGSR

SEQ ID NO: 3089845 - protein, 23 aa, Giardia lamblia
LVRLYRTYFFSMDEEFVRLVLCR

SEQ ID NO: 3089846 - protein, 23 aa, Giardia lamblia
LVRQKVIVLLKKPTTMPRILEDG

SEQ ID NO: 3089847 - protein, 20 aa, Giardia lamblia
LVSLLPLHLQTIYQLRPSNT

SEQ ID NO: 3089848 - protein, 23 aa, Giardia lamblia
LVSLQSVYIFLAKALMSNTITNS

SEQ ID NO: 3089849 - protein, 24 aa, Giardia lamblia
LVSSYFSHFILLRDNDRSIRAALI

SEQ ID NO: 3089850 - protein, 24 aa, Giardia lamblia
LVTLAIHLSFYFKHVLAICSLGRF

SEQ ID NO: 3089851 - protein, 24 aa, Giardia lamblia
LVTNIPCQFALFDQLITSCDKLST

SEQ ID NO: 3089852 - protein, 17 aa, Giardia lamblia
LVTRETFFLINSGFSLI

SEQ ID NO: 3089853 - protein, 24 aa, Giardia lamblia
LVVEILLYLFNISTPLWFDEVQIR

SEQ ID NO: 3089854 - protein, 19 aa, Giardia lamblia
LVVIPLLAQIVCVLFACVY

SEQ ID NO: 3089855 - protein, 33 aa, Giardia lamblia
LVVKIHGYDYLFSKSFNIILLSNDFSIISQLSP

SEQ ID NO: 3089856 - protein, 17 aa, Giardia lamblia
LVYSFLSVALKMVHLTA

SEQ ID NO: 3089857 - protein, 34 aa, Giardia lamblia
LVYSIGLLLGFIFLALSPFLMRLLLPANVADSFA

SEQ ID NO: 3089858 - protein, 24 aa, Giardia lamblia
LVYTFFTSITFLTARKILFKTQMA

SEQ ID NO: 3089859 - protein, 17 aa, Giardia lamblia
LWMCCTCGRFFCGYTDN

SEQ ID NO: 3089860 - protein, 25 aa, Giardia lamblia
LYAVNSIGYIVLFDIRARKAVKEVS

SEQ ID NO: 3089861 - protein, 17 aa, Giardia lamblia
LYAYRQRDYRLLGSAIY

SEQ ID NO: 3089862 - protein, 26 aa, Giardia lamblia
LYCKFDPIITLREFTRRFLPDFDLLM

SEQ ID NO: 3089863 - protein, 17 aa, Giardia lamblia
LYCLGSFSVLYLFTPVY

SEQ ID NO: 3089864 - protein, 52 aa, Giardia lamblia
LYCMLQSRCWPAFLFVREVLSNPLFKFDFLSPEYILWIEQLELKQFSPNVLR

SEQ ID NO: 3089865 - protein, 17 aa, Giardia lamblia
LYCPITLDYSTRFRKKY

SEQ ID NO: 3089866 - protein, 20 aa, Giardia lamblia
LYCSLLLQNALLKSDRGRMY

SEQ ID NO: 3089867 - protein, 17 aa, Giardia lamblia
LYDGVLYPYGSPLGRHT

SEQ ID NO: 3089868 - protein, 18 aa, Giardia lamblia
LYDICDIVRYVACTTVTS

SEQ ID NO: 3089869 - protein, 23 aa, Giardia lamblia
LYEEPILLFLCMGHCIDYTHMFN

SEQ ID NO: 3089870 - protein, 22 aa, Giardia lamblia
LYEQQLWMEPAVSHLYNINVIV

SEQ ID NO: 3089871 - protein, 18 aa, Giardia lamblia
LYFYDYFNEKLTAQKEEI

SEQ ID NO: 3089872 - protein, 19 aa, Giardia lamblia
LYFYQCIHLFESTEFFMPE

SEQ ID NO: 3089873 - protein, 45 aa, Giardia lamblia
LYGVFGYCSRARRLFLLALFLDCVACPFLFLKDKSFEYARDLSMQ

SEQ ID NO: 3089874 - protein, 17 aa, Giardia lamblia
LYHLTLNLPYNSVIGLL

SEQ ID NO: 3089875 - protein, 20 aa, Giardia lamblia
LYIFLARLFYNGTLYVFLVL

SEQ ID NO: 3089876 - protein, 18 aa, Giardia lamblia
LYKHSFLTEVLGLRSIMT

SEQ ID NO: 3089877 - protein, 36 aa, Giardia lamblia
LYKTEVPFYYYVMYFIIARIIWFYTTLLGISVEQCT

SEQ ID NO: 3089878 - protein, 18 aa, Giardia lamblia
LYPINSQFYKKYYGSADK

SEQ ID NO: 3089879 - protein, 26 aa, Giardia lamblia
LYPRPVLCALILKMVLFINPDAAASS

SEQ ID NO: 3089880 - protein, 18 aa, Giardia lamblia
LYRFLQEADRRPFLSAID

SEQ ID NO: 3089881 - protein, 17 aa, Giardia lamblia
LYRLVQITRCVTVAVDA

SEQ ID NO: 3089882 - protein, 34 aa, Giardia lamblia
LYSSLPARLGYFPLFVFSLTLIPTAMLISVCCSK

SEQ ID NO: 3089883 - protein, 21 aa, Giardia lamblia
LYTSAPLSPMRMLPQQNDGAV

SEQ ID NO: 3089884 - protein, 24 aa, Giardia lamblia
MAEREFIFGYVLSGLLGVLQSVKG

SEQ ID NO: 3089885 - protein, 26 aa, Giardia lamblia
MAGKRLELAALILLKLTGPSFVLGSP

SEQ ID NO: 3089886 - protein, 26 aa, Giardia lamblia
MAHHWVPLHLLAICLFLSASVLTWYK

SEQ ID NO: 3089887 - protein, 25 aa, Giardia lamblia
MAIDFPTYIILKVLNVEWKPTDPAR

SEQ ID NO: 3089888 - protein, 19 aa, Giardia lamblia
MANIDLGLAVFRYLRDTMS

SEQ ID NO: 3089889 - protein, 34 aa, Giardia lamblia
MATTGIGALLYFMSRTYAFLRLYTKSYHCARDAI

SEQ ID NO: 3089890 - protein, 18 aa, Giardia lamblia
MAVLFVVISLCLVYYTNL

SEQ ID NO: 3089891 - protein, 18 aa, Giardia lamblia
MAVRLVKTVFLPRKQDVQ

SEQ ID NO: 3089892 - protein, 30 aa, Giardia lamblia
MCDKCWRFMELAVPLLILFCRVHGFNDYFF

SEQ ID NO: 3089893 - protein, 24 aa, Giardia lamblia
MCMSLQEFLIGLPLDSCKSSPTKL

SEQ ID NO: 3089894 - protein, 21 aa, Giardia lamblia
MCQLALREWSDYARLRKEVLY

SEQ ID NO: 3089895 - protein, 17 aa, Giardia lamblia
MCTCSNRHHYLHNSNHY

SEQ ID NO: 3089896 - protein, 32 aa, Giardia lamblia
MDAFSAMGYPPFFSTGLPLYPAISTSSNQFPF

SEQ ID NO: 3089897 - protein, 17 aa, Giardia lamblia
MDAIRKALPLLFGRHTA

SEQ ID NO: 3089898 - protein, 26 aa, Giardia lamblia
MDDDPLFNPIIWQTNSFITLGKPATE

SEQ ID NO: 3089899 - protein, 19 aa, Giardia lamblia
MDLCLTNLILLFCNEIIDG

SEQ ID NO: 3089900 - protein, 21 aa, Giardia lamblia
MDLCVQLLIPWELGMVCSGGK

SEQ ID NO: 3089901 - protein, 20 aa, Giardia lamblia
MDLDGFWKKLLSKTQDYPKA

SEQ ID NO: 3089902 - protein, 20 aa, Giardia lamblia
MDLIQRLLFETLPGLMQKYA

SEQ ID NO: 3089903 - protein, 19 aa, Giardia lamblia
MDPVFLSKVLDCEVIPTLK

SEQ ID NO: 3089904 - protein, 31 aa, Giardia lamblia
MDRLCGGLPVLYRYSAHGILPAYLLSISPRT

SEQ ID NO: 3089905 - protein, 25 aa, Giardia lamblia
MDVRRLIWYVSYIDVLAFLFNGVIN

SEQ ID NO: 3089906 - protein, 20 aa, Giardia lamblia
MDVTLFTLFALYNCMAVYCK

SEQ ID NO: 3089907 - protein, 30 aa, Giardia lamblia
MEAAFWMDVSLYRWLHFTTTLLSICVSAVV

SEQ ID NO: 3089908 - protein, 17 aa, Giardia lamblia
MEAFLTRVYQEDLNTAM

SEQ ID NO: 3089909 - protein, 17 aa, Giardia lamblia
MEAIMCILKYFVHKHVE

SEQ ID NO: 3089910 - protein, 24 aa, Giardia lamblia
MEFRNRMEILMTIVAQFFERNDIS

SEQ ID NO: 3089911 - protein, 24 aa, Giardia lamblia
MEFYDQFHIVYIYFRQRALRRSAP

SEQ ID NO: 3089912 - protein, 29 aa, Giardia lamblia
MELLTSYVMPFVFLVPMIIVGIRVAREIE

SEQ ID NO: 3089913 - protein, 24 aa, Giardia lamblia
MELPVLEAPLVMFLTGAEVLVRHL

SEQ ID NO: 3089914 - protein, 18 aa, Giardia lamblia
MEPEYISRSAWSPSLKPR

SEQ ID NO: 3089915 - protein, 20 aa, Giardia lamblia
MEPIFYRYIEAARRLTLFLH

SEQ ID NO: 3089916 - protein, 19 aa, Giardia lamblia
MEPVELILREAFILEWVSG

SEQ ID NO: 3089917 - protein, 43 aa, Giardia lamblia
MEPYKLIERKLAIPLLLVLERILSLWVAVPLFISQFDELFDEL

SEQ ID NO: 3089918 - protein, 18 aa, Giardia lamblia
MERMLWPGLAEIPAYLVR

SEQ ID NO: 3089919 - protein, 26 aa, Giardia lamblia
MFCKYKPRFLQIQRAFAYGPISFSVV

SEQ ID NO: 3089920 - protein, 17 aa, Giardia lamblia
MFIYLKIGKKIPARMSN

SEQ ID NO: 3089921 - protein, 23 aa, Giardia lamblia
MFKGVILLLLASALGCVPRQLTI

SEQ ID NO: 3089922 - protein, 30 aa, Giardia lamblia
MFKLNGVPTWLYWCANFIYQLCFAVLVYSV

SEQ ID NO: 3089923 - protein, 18 aa, Giardia lamblia
MFLLPPTVISLSDALLTP

SEQ ID NO: 3089924 - protein, 24 aa, Giardia lamblia
MFLSNILKKLVTFTLDPPPTGAEN

SEQ ID NO: 3089925 - protein, 18 aa, Giardia lamblia
MFSYYYPHAQKILIASLS

SEQ ID NO: 3089926 - protein, 17 aa, Giardia lamblia
MFTSFGLTYGFVTQIRP

SEQ ID NO: 3089927 - protein, 17 aa, Giardia lamblia
MFVGESICLAIFYIKRC

SEQ ID NO: 3089928 - protein, 22 aa, Giardia lamblia
MGFSLIRYRLRFRNLLLYNSIV

SEQ ID NO: 3089929 - protein, 22 aa, Giardia lamblia
MGRAFFPYRLSHITGRITTILS

SEQ ID NO: 3089930 - protein, 23 aa, Giardia lamblia
MGRRFLLFLGTFILTAMLIMLIP

SEQ ID NO: 3089931 - protein, 24 aa, Giardia lamblia
MGSLKFLVYAIRKALETMPQPWEA

SEQ ID NO: 3089932 - protein, 18 aa, Giardia lamblia
MGSLYLLVGDGEFEDFMV

SEQ ID NO: 3089933 - protein, 23 aa, Giardia lamblia
MGTFTRLIYLAYEYMACSFSQVD

SEQ ID NO: 3089934 - protein, 17 aa, Giardia lamblia
MGYACQSVLRFLYDQQE

SEQ ID NO: 3089935 - protein, 20 aa, Giardia lamblia
MHAILILQMIFIVPLCNGNT

SEQ ID NO: 3089936 - protein, 19 aa, Giardia lamblia
MHLGLDLLVLVPASSVSLL

SEQ ID NO: 3089937 - protein, 26 aa, Giardia lamblia
MHNIYLGIALILINIMSGLITYFQEA

SEQ ID NO: 3089938 - protein, 18 aa, Giardia lamblia
MHSAARLVLLLLATLLPS

SEQ ID NO: 3089939 - protein, 34 aa, Giardia lamblia
MHVSRHSMSLLYKTILFFVLALKNTSVTSFLCGI

SEQ ID NO: 3089940 - protein, 29 aa, Giardia lamblia
MIAVPLKLLMIVLFLVFQIDRSALAGFGG

SEQ ID NO: 3089941 - protein, 25 aa, Giardia lamblia
MICSQVVWCVCLACMCVCSSFTQYL

SEQ ID NO: 3089942 - protein, 38 aa, Giardia lamblia
MICVLAWPALIVVIPTIILYAVIFFMFRRVAPQVKRLE

SEQ ID NO: 3089943 - protein, 18 aa, Giardia lamblia
MIEYIGLLTYRSISERIR

SEQ ID NO: 3089944 - protein, 20 aa, Giardia lamblia
MIGNTITGLLYPTDNDWLRL

SEQ ID NO: 3089945 - protein, 42 aa, Giardia lamblia
MIIAIAVIVIVVIVGVLVGVLCWYFLRNKRKRSIRPRTVSKM

SEQ ID NO: 3089946 - protein, 19 aa, Giardia lamblia
MIIGACSIFFILAIIMGTD

SEQ ID NO: 3089947 - protein, 21 aa, Giardia lamblia
MIIGICVLIVFTFVNLLTKST

SEQ ID NO: 3089948 - protein, 19 aa, Giardia lamblia
MIMRQTLSFILHPMTNDNL

SEQ ID NO: 3089949 - protein, 18 aa, Giardia lamblia
MIPMYSESAVRHGKGRGG

SEQ ID NO: 3089950 - protein, 17 aa, Giardia lamblia
MIPNCIECYMTKTYGPL

SEQ ID NO: 3089951 - protein, 17 aa, Giardia lamblia
MIPVFSAFVAAFFETGR

SEQ ID NO: 3089952 - protein, 25 aa, Giardia lamblia
MISEIPLHALPLHYVRSENLIEAHR

SEQ ID NO: 3089953 - protein, 18 aa, Giardia lamblia
MISQLLYVNLHSQLPASV

SEQ ID NO: 3089954 - protein, 17 aa, Giardia lamblia
MIVYLDTYAFYVTTQTE

SEQ ID NO: 3089955 - protein, 20 aa, Giardia lamblia
MIYAKVLLELAKFDPVTTAL

SEQ ID NO: 3089956 - protein, 18 aa, Giardia lamblia
MKEHPILYRLVQITRCVT

SEQ ID NO: 3089957 - protein, 18 aa, Giardia lamblia
MKILSTFALLVSRCAGIF

SEQ ID NO: 3089958 - protein, 27 aa, Giardia lamblia
MKKKSTIFFYYYKKYSQKFNALYSPLI

SEQ ID NO: 3089959 - protein, 21 aa, Giardia lamblia
MKLFQSYMKKTKVPASVCILT

SEQ ID NO: 3089960 - protein, 38 aa, Giardia lamblia
MKRASLLERSIQKLLFLIFYALFLRDLTELYLSLAAAM

SEQ ID NO: 3089961 - protein, 43 aa, Giardia lamblia
MKRTNILRIILLLSSLVIGGVVVFLIVYFVTRKPQLIPPPSGQ

SEQ ID NO: 3089962 - protein, 18 aa, Giardia lamblia
MKVTGYLSSIFTDSFMFS

SEQ ID NO: 3089963 - protein, 18 aa, Giardia lamblia
MLAAIYGHADACKVLAPY

SEQ ID NO: 3089964 - protein, 18 aa, Giardia lamblia
MLASFLSINLAVIIVDDL

SEQ ID NO: 3089965 - protein, 31 aa, Giardia lamblia
MLEHALYCLQGCILVYDYLKKFTPVPPSSDH

SEQ ID NO: 3089966 - protein, 25 aa, Giardia lamblia
MLEPLLDIILPIISQYRASPRKSPL

SEQ ID NO: 3089967 - protein, 17 aa, Giardia lamblia
MLGLFWTATRTKALLPY

SEQ ID NO: 3089968 - protein, 28 aa, Giardia lamblia
MLHIIADVILFIRLTSVLEKLLQSYTDA

SEQ ID NO: 3089969 - protein, 17 aa, Giardia lamblia
MLIAINGECTSPACMDE

SEQ ID NO: 3089970 - protein, 17 aa, Giardia lamblia
MLLLNVVTNERLLLEYN

SEQ ID NO: 3089971 - protein, 29 aa, Giardia lamblia
MLLSIAFVCVWLFHPVFAGAAVLGSVSGW

SEQ ID NO: 3089972 - protein, 18 aa, Giardia lamblia
MLLYLPKKQQILTYSVTT

SEQ ID NO: 3089973 - protein, 18 aa, Giardia lamblia
MLNYRLLVQVLYDPDGLF

SEQ ID NO: 3089974 - protein, 22 aa, Giardia lamblia
MLQPFLQQLVTTAFLAKIRAYH

SEQ ID NO: 3089975 - protein, 19 aa, Giardia lamblia
MLRSELDLYRSLHGDIKER

SEQ ID NO: 3089976 - protein, 17 aa, Giardia lamblia
MLRYADQLGATPREKML

SEQ ID NO: 3089977 - protein, 18 aa, Giardia lamblia
MLSHRQMLRYADQLGATP

SEQ ID NO: 3089978 - protein, 19 aa, Giardia lamblia
MLSLYSLFRSKLKALRKNH

SEQ ID NO: 3089979 - protein, 27 aa, Giardia lamblia
MLSRLPECCWIYLLLVRAMETPEQLEA

SEQ ID NO: 3089980 - protein, 27 aa, Giardia lamblia
MLTQVHLDLALFILTQMMNGFRQKNIK

SEQ ID NO: 3089981 - protein, 18 aa, Giardia lamblia
MLTSNGVVFYWLAFSVIK

SEQ ID NO: 3089982 - protein, 19 aa, Giardia lamblia
MLVCFPPPQALDKLSLWNI

SEQ ID NO: 3089983 - protein, 17 aa, Giardia lamblia
MLVVLTTPALFAWKDFC

SEQ ID NO: 3089984 - protein, 32 aa, Giardia lamblia
MMAVQRNDIVAVYCLLPLQAGVQDRNGYTALM

SEQ ID NO: 3089985 - protein, 17 aa, Giardia lamblia
MMLASIFDLTWTTEYYS

SEQ ID NO: 3089986 - protein, 30 aa, Giardia lamblia
MMVTMYNIVLTFFPIFIYALTEHDIKDRVL

SEQ ID NO: 3089987 - protein, 26 aa, Giardia lamblia
MNEVLTIVFSFFLPALNALYQIRRAI

SEQ ID NO: 3089988 - protein, 30 aa, Giardia lamblia
MNIHALLTTVYLPNCFYFHKSAPGYVSARA

SEQ ID NO: 3089989 - protein, 21 aa, Giardia lamblia
MNKCHGVMLPCIFKLQSFSSG

SEQ ID NO: 3089990 - protein, 24 aa, Giardia lamblia
MNKVHSFPIYTAKLSLTCRLSVAR

SEQ ID NO: 3089991 - protein, 24 aa, Giardia lamblia
MNTCKKHKILTTNRPPLISVPAND

SEQ ID NO: 3089992 - protein, 27 aa, Giardia lamblia
MNTPEAYPRLLILLDFIVCVTSVVICK

SEQ ID NO: 3089993 - protein, 24 aa, Giardia lamblia
MPANLILRIRSSVGLIPTLYNEYK

SEQ ID NO: 3089994 - protein, 19 aa, Giardia lamblia
MPDDMLAPHVLLHKAYSNQ

SEQ ID NO: 3089995 - protein, 25 aa, Giardia lamblia
MPDKAVWMMRCVIEHFSVASSPFLV

SEQ ID NO: 3089996 - protein, 18 aa, Giardia lamblia
MPEPLAAYLLNPDTFLPL

SEQ ID NO: 3089997 - protein, 29 aa, Giardia lamblia
MPHKAFKKLRRPLKQILFKMGVTSYYSPT

SEQ ID NO: 3089998 - protein, 17 aa, Giardia lamblia
MPIILFSLILLMTSYLI

SEQ ID NO: 3089999 - protein, 23 aa, Giardia lamblia
MPIYIYFIVFACFLGSIIFVLFL

SEQ ID NO: 3090000 - protein, 25 aa, Giardia lamblia
MPMLNMMILTKLALLIESRLTKRNA

SEQ ID NO: 3090001 - protein, 26 aa, Giardia lamblia
MPPVLPVHIVLILLVHIMSTFRGSII

SEQ ID NO: 3090002 - protein, 19 aa, Giardia lamblia
MPRLELIILLRIFSGYSAS

SEQ ID NO: 3090003 - protein, 18 aa, Giardia lamblia
MPRPINVLITPWDHKDKT

SEQ ID NO: 3090004 - protein, 28 aa, Giardia lamblia
MPSNLQQSLPLPLPLHPASPHQVISPRV

SEQ ID NO: 3090005 - protein, 23 aa, Giardia lamblia
MPTPLNRIFLLDDPGIDSFSELM

SEQ ID NO: 3090006 - protein, 28 aa, Giardia lamblia
MPWSKLPSTLSIPILLFSGKLSHIEAVI

SEQ ID NO: 3090007 - protein, 31 aa, Giardia lamblia
MQDKLWQAFVLYLVITIFFTILSWFIIPETK

SEQ ID NO: 3090008 - protein, 17 aa, Giardia lamblia
MQITPHPLLLPTQKSRD

SEQ ID NO: 3090009 - protein, 18 aa, Giardia lamblia
MQLYLPQALMTIPSKCAL

SEQ ID NO: 3090010 - protein, 25 aa, Giardia lamblia
MQRLPAPLIYYSISIAIMAVSFVLA

SEQ ID NO: 3090011 - protein, 20 aa, Giardia lamblia
MQRLRLVFKKRIRDLRCFIE

SEQ ID NO: 3090012 - protein, 26 aa, Giardia lamblia
MRCSIPTRYIPTRISGARRLERLLSI

SEQ ID NO: 3090013 - protein, 21 aa, Giardia lamblia
MRDEAGWPALFYAVVSGDSIS

SEQ ID NO: 3090014 - protein, 21 aa, Giardia lamblia
MRDFLHSLLHLIKREIMVMEA

SEQ ID NO: 3090015 - protein, 19 aa, Giardia lamblia
MRDKFIYSVAIKCLKYYAS

SEQ ID NO: 3090016 - protein, 18 aa, Giardia lamblia
MRDYYLCMYGAKASVSGV

SEQ ID NO: 3090017 - protein, 22 aa, Giardia lamblia
MRKLVDTMLYIKRQLTVSLQDD

SEQ ID NO: 3090018 - protein, 22 aa, Giardia lamblia
MRMTIFYNLYKNTMLAIICGFY

SEQ ID NO: 3090019 - protein, 26 aa, Giardia lamblia
MRQIEAMGVLYTMLRVVWVDICQFAS

SEQ ID NO: 3090020 - protein, 34 aa, Giardia lamblia
MRSLALSILFVLFDQLYYFYFKMVYPEGTFILHA

SEQ ID NO: 3090021 - protein, 18 aa, Giardia lamblia
MRSNWLSSHFRICPGRLL

SEQ ID NO: 3090022 - protein, 28 aa, Giardia lamblia
MSAKAQLILSFFRLTPLYIQQDLVQLAS

SEQ ID NO: 3090023 - protein, 27 aa, Giardia lamblia
MSALSYGLLPLLIPMIICSFLRQEALE

SEQ ID NO: 3090024 - protein, 29 aa, Giardia lamblia
MSDFHKFMLLIFGLLVGLIFNVLVLVYVY

SEQ ID NO: 3090025 - protein, 19 aa, Giardia lamblia
MSFNYYWRHRNNALALTGN

SEQ ID NO: 3090026 - protein, 26 aa, Giardia lamblia
MSFSMFIHAFVRIFFFDNDIQMYAIV

SEQ ID NO: 3090027 - protein, 19 aa, Giardia lamblia
MSFYDAHPIGRILNRLIAD

SEQ ID NO: 3090028 - protein, 26 aa, Giardia lamblia
MSGHYKCIKLLSLEIGLNGVTPLMYY

SEQ ID NO: 3090029 - protein, 20 aa, Giardia lamblia
MSIHALVSLVPPGSMLLPRL

SEQ ID NO: 3090030 - protein, 36 aa, Giardia lamblia
MSISALRLIYVLVFLPTVYLIFLYYDRHARKCQTQH

SEQ ID NO: 3090031 - protein, 20 aa, Giardia lamblia
MSLICGPFDVVLQDELYKVA

SEQ ID NO: 3090032 - protein, 24 aa, Giardia lamblia
MSPMTFSPNFLFLTSAQTLASAQQ

SEQ ID NO: 3090033 - protein, 19 aa, Giardia lamblia
MSSLSINSPFHVKLREAQQ

SEQ ID NO: 3090034 - protein, 28 aa, Giardia lamblia
MSSPDAMALYLFLWKMGLHSTMRQNASS

SEQ ID NO: 3090035 - protein, 24 aa, Giardia lamblia
MSSRFLMLELDYKELPLFEILSPE

SEQ ID NO: 3090036 - protein, 17 aa, Giardia lamblia
MSSTQAFHILKLQPQSA

SEQ ID NO: 3090037 - protein, 32 aa, Giardia lamblia
MSTFRGSIIGQYLYRIFFLDKGSVEQLQELIV

SEQ ID NO: 3090038 - protein, 26 aa, Giardia lamblia
MSTNPVIRSIFYYTTYNLGCYNGTVV

SEQ ID NO: 3090039 - protein, 19 aa, Giardia lamblia
MTALMHAVLHEKLSCVNIL

SEQ ID NO: 3090040 - protein, 24 aa, Giardia lamblia
MTDFTYRYRYPFMIAFTGSSRYEG

SEQ ID NO: 3090041 - protein, 18 aa, Giardia lamblia
MTDTYTTELLILSLVRIL

SEQ ID NO: 3090042 - protein, 26 aa, Giardia lamblia
MTEEEVLFLLFQAASGLAHLHAIGFL

SEQ ID NO: 3090043 - protein, 19 aa, Giardia lamblia
MTLFRTKHYQKELAERLRL

SEQ ID NO: 3090044 - protein, 25 aa, Giardia lamblia
MTLPKGMKYMYQAVENRWMPIHMPN

SEQ ID NO: 3090045 - protein, 22 aa, Giardia lamblia
MTLVNQHLFMINNNLSLFYTDC

SEQ ID NO: 3090046 - protein, 23 aa, Giardia lamblia
MTRAPVLRRRMRCQRASGVTTKL

SEQ ID NO: 3090047 - protein, 18 aa, Giardia lamblia
MTRLRLNLAFKSGWIISH

SEQ ID NO: 3090048 - protein, 27 aa, Giardia lamblia
MTSYSIRTIWKALLLSLACDREARSDA

SEQ ID NO: 3090049 - protein, 23 aa, Giardia lamblia
MTTMLMVIIIVCAAVPLLKSTIR

SEQ ID NO: 3090050 - protein, 25 aa, Giardia lamblia
MTYECIFFMALLFDAYIVITESKLI

SEQ ID NO: 3090051 - protein, 29 aa, Giardia lamblia
MVCDAFVLLLSLCFFSYAKSILYKTTLIN

SEQ ID NO: 3090052 - protein, 17 aa, Giardia lamblia
MVCYGIIPCFAVLSGVN

SEQ ID NO: 3090053 - protein, 25 aa, Giardia lamblia
MVDIVLMHFSLMFDTFYGTTTFCAS

SEQ ID NO: 3090054 - protein, 28 aa, Giardia lamblia
MVDIWALGALLFEMLVGSAPFSYASSTS

SEQ ID NO: 3090055 - protein, 27 aa, Giardia lamblia
MVDTHIAHRLLLIDYPTFLTGIHHLFL

SEQ ID NO: 3090056 - protein, 18 aa, Giardia lamblia
MVEICISAVKLLPLDVAK

SEQ ID NO: 3090057 - protein, 45 aa, Giardia lamblia
MVGAALLSLPFTIVRLGWVVALFIMAFAFTYSLFGFYAIIDTAHF

SEQ ID NO: 3090058 - protein, 20 aa, Giardia lamblia
MVHPFVLTALSLLIEEELSL

SEQ ID NO: 3090059 - protein, 23 aa, Giardia lamblia
MVKQKLHILFVVSSTLEGSGITF

SEQ ID NO: 3090060 - protein, 17 aa, Giardia lamblia
MVKRMLSIRLSFNDIHI

SEQ ID NO: 3090061 - protein, 17 aa, Giardia lamblia
MVLEMTKIHAILANTRV

SEQ ID NO: 3090062 - protein, 43 aa, Giardia lamblia
MVNAGLASFLIRMAIKEFPTFGYPLYWAFRCEMRLNLVFSSAY

SEQ ID NO: 3090063 - protein, 25 aa, Giardia lamblia
MVPKAWGMPVCDLMSLIFSCALSEC

SEQ ID NO: 3090064 - protein, 22 aa, Giardia lamblia
MVRHLRIMLLFPTEIIRRFYDG

SEQ ID NO: 3090065 - protein, 17 aa, Giardia lamblia
MVSLIFAGRYIILLMSI

SEQ ID NO: 3090066 - protein, 19 aa, Giardia lamblia
MVVFQLFERLLQHQSVREY

SEQ ID NO: 3090067 - protein, 18 aa, Giardia lamblia
MVYAACEPVLWRPAIEKG

SEQ ID NO: 3090068 - protein, 32 aa, Giardia lamblia
MVYSFQTSVHKFFFHLISKYLHRYEPSFASPI

SEQ ID NO: 3090069 - protein, 18 aa, Giardia lamblia
MWAVHKREETFLAELADA

SEQ ID NO: 3090070 - protein, 17 aa, Giardia lamblia
MWTDMVLEMTKIHAILA

SEQ ID NO: 3090071 - protein, 17 aa, Giardia lamblia
MWVFHYVKRLFETLFVH

SEQ ID NO: 3090072 - protein, 25 aa, Giardia lamblia
MYDTHPLFRNLLLLEAKRDVIREVL

SEQ ID NO: 3090073 - protein, 33 aa, Giardia lamblia
MYGLTFGTLLIANLLAYGLLFGAGSLFKLFPFS

SEQ ID NO: 3090074 - protein, 25 aa, Giardia lamblia
MYKARPGTYYIILHPHLMCLNTGKM

SEQ ID NO: 3090075 - protein, 24 aa, Giardia lamblia
MYLELGSVLFYRTLANMTIDDVLR

SEQ ID NO: 3090076 - protein, 25 aa, Giardia lamblia
MYPRTAFNMVAWPDGWTISDDLGLL

SEQ ID NO: 3090077 - protein, 24 aa, Giardia lamblia
MYRRAFFIPAVIASIPLWICASSL

SEQ ID NO: 3090078 - protein, 39 aa, Giardia lamblia
MYSTYLMKEYPEFLTCLMFYLTPSWKKFSYKSLNIVPLE

SEQ ID NO: 3090079 - protein, 57 aa, Giardia lamblia
NAALTIKMPPLTEPFLRSLFLKVYPHHTESWIFQFINGYFLIKGSLPVGLINSFTVF

SEQ ID NO: 3090080 - protein, 19 aa, Giardia lamblia
NAAQFFFTAPLGTGDIVGP

SEQ ID NO: 3090081 - protein, 20 aa, Giardia lamblia
NACLDNCPAGTYADNINGVS

SEQ ID NO: 3090082 - protein, 18 aa, Giardia lamblia
NACRIAKALRFQRPILLE

SEQ ID NO: 3090083 - protein, 23 aa, Giardia lamblia
NADVLYPTLLLLDSHPDAAGELS

SEQ ID NO: 3090084 - protein, 26 aa, Giardia lamblia
NAEICQYLIAYLPPILQHVTTEIANF

SEQ ID NO: 3090085 - protein, 26 aa, Giardia lamblia
NAENVLLLFVPPVTLLHQVSSDSLRP

SEQ ID NO: 3090086 - protein, 18 aa, Giardia lamblia
NAEYYEFLVRILSSAYGY

SEQ ID NO: 3090087 - protein, 17 aa, Giardia lamblia
NAFDIACFFLEFTGIDC

SEQ ID NO: 3090088 - protein, 31 aa, Giardia lamblia
NAFRSYYGGRGYTIPIILIAAHSHRLYNDAC

SEQ ID NO: 3090089 - protein, 20 aa, Giardia lamblia
NAFTPLIPGDLIPNSAFAHE

SEQ ID NO: 3090090 - protein, 24 aa, Giardia lamblia
NAIDKYYLNRLPGQNIRELQARLT

SEQ ID NO: 3090091 - protein, 19 aa, Giardia lamblia
NAIYDLPITYAAGVVHILI

SEQ ID NO: 3090092 - protein, 23 aa, Giardia lamblia
NAKAAFELLLPKEYHLSQPPSSQ

SEQ ID NO: 3090093 - protein, 17 aa, Giardia lamblia
NAKLACRILVLTGEAFP

SEQ ID NO: 3090094 - protein, 27 aa, Giardia lamblia
NALFDAFLFLSIFTLLKIVFSAAAVDK

SEQ ID NO: 3090095 - protein, 20 aa, Giardia lamblia
NALFILAYFGLTNNFLQNEL

SEQ ID NO: 3090096 - protein, 28 aa, Giardia lamblia
NALHVLHVMYFKRPLNKLSKIYKKGLVE

SEQ ID NO: 3090097 - protein, 25 aa, Giardia lamblia
NALISGLLMCVLPRSTTDQSGAYLL

SEQ ID NO: 3090098 - protein, 24 aa, Giardia lamblia
NALLFLQVLLGILCAFKPAEPFVV

SEQ ID NO: 3090099 - protein, 22 aa, Giardia lamblia
NAMAIVLWVRLNKDVKALNLKI

SEQ ID NO: 3090100 - protein, 34 aa, Giardia lamblia
NAMMMAAGYGAHAVVLALLPFFSYETDREGNTAL

SEQ ID NO: 3090101 - protein, 26 aa, Giardia lamblia
NAMSSIMILLVDVFSDIWPAFAMAYE

SEQ ID NO: 3090102 - protein, 24 aa, Giardia lamblia
NANRLNLISFFPGSRLVIPLSLDQ

SEQ ID NO: 3090103 - protein, 22 aa, Giardia lamblia
NAPAFINVFYPLAIVRASLGYV

SEQ ID NO: 3090104 - protein, 21 aa, Giardia lamblia
NAQLMLLATVLPFLPPNESIV

SEQ ID NO: 3090105 - protein, 23 aa, Giardia lamblia
NARVKDCYLFTEGSLHSQHIVHN

SEQ ID NO: 3090106 - protein, 25 aa, Giardia lamblia
NASPRDRFYYTNHFNFLLSTHFNEI

SEQ ID NO: 3090107 - protein, 17 aa, Giardia lamblia
NATPIYMEGHLLGIFTL

SEQ ID NO: 3090108 - protein, 31 aa, Giardia lamblia
NAVDFIKRCWTFNLDLRWSPELMLTHPWLVS

SEQ ID NO: 3090109 - protein, 24 aa, Giardia lamblia
NAVEEYFFVQPDIKPLALSSFNTS

SEQ ID NO: 3090110 - protein, 19 aa, Giardia lamblia
NAVPVGQFCTYPACTDSAA

SEQ ID NO: 3090111 - protein, 25 aa, Giardia lamblia
NAYEYSILFMNLLNAIPGNIANCAD

SEQ ID NO: 3090112 - protein, 21 aa, Giardia lamblia
NAYLSVFDTFQSLWLDDKNET

SEQ ID NO: 3090113 - protein, 24 aa, Giardia lamblia
NCDSCRIGEYFTKTINSCTPYGCI

SEQ ID NO: 3090114 - protein, 19 aa, Giardia lamblia
NCFKDPLVVILWDRISVSL

SEQ ID NO: 3090115 - protein, 25 aa, Giardia lamblia
NCFLDPQVWLYPNAVQIQLTPSPLR

SEQ ID NO: 3090116 - protein, 26 aa, Giardia lamblia
NCIVPFCSFLTPVIIAILCLLSGLNL

SEQ ID NO: 3090117 - protein, 25 aa, Giardia lamblia
NCLDPGYYRRGGLGGGAIAAIVIVV

SEQ ID NO: 3090118 - protein, 18 aa, Giardia lamblia
NCLLTYGISIRSGGSMSS

SEQ ID NO: 3090119 - protein, 25 aa, Giardia lamblia
NCNLFIVVLCFIDLSLIVYKASGIL

SEQ ID NO: 3090120 - protein, 28 aa, Giardia lamblia
NCPQLKTHLISHLNFPTLGLWNKVTGVF

SEQ ID NO: 3090121 - protein, 26 aa, Giardia lamblia
NCPQLKVHLISHLNFPTLGLWNKVTG

SEQ ID NO: 3090122 - protein, 17 aa, Giardia lamblia
NCSLFCPTPSFSAMIVN

SEQ ID NO: 3090123 - protein, 17 aa, Giardia lamblia
NCTKCLDGYFKVTRAKF

SEQ ID NO: 3090124 - protein, 25 aa, Giardia lamblia
NCTLLYVMFLMFGVGSLLPFNCYIT

SEQ ID NO: 3090125 - protein, 23 aa, Giardia lamblia
NCTYGDGAYFCQCRRGWAGAACD

SEQ ID NO: 3090126 - protein, 25 aa, Giardia lamblia
NDAPPEPLWNLAYAEFWDVFLSHDV

SEQ ID NO: 3090127 - protein, 24 aa, Giardia lamblia
NDCLRYGIILYSRETRRIFHSMVS

SEQ ID NO: 3090128 - protein, 31 aa, Giardia lamblia
NDDRRLQIIKYLRYLWFLAQSYRDKVLCMHQ

SEQ ID NO: 3090129 - protein, 23 aa, Giardia lamblia
NDFLLWQEIGMVYPRIVYRLGTL

SEQ ID NO: 3090130 - protein, 20 aa, Giardia lamblia
NDFLPADYAFIAKSAGPGAK

SEQ ID NO: 3090131 - protein, 26 aa, Giardia lamblia
NDFPKLLGLDFMLIQHRLAPDANRTA

SEQ ID NO: 3090132 - protein, 27 aa, Giardia lamblia
NDHHTWDIIIPNTLVNLLPLLDEIYSN

SEQ ID NO: 3090133 - protein, 20 aa, Giardia lamblia
NDINLYHTGFGAFNGRFNEL

SEQ ID NO: 3090134 - protein, 23 aa, Giardia lamblia
NDIRSVITFDLMLPLSTSTITDL

SEQ ID NO: 3090135 - protein, 24 aa, Giardia lamblia
NDLAELLDFFQNLILAVKINSMQK

SEQ ID NO: 3090136 - protein, 30 aa, Giardia lamblia
NDLLILKHATLFRLLLYKYAESSASGKLCK

SEQ ID NO: 3090137 - protein, 25 aa, Giardia lamblia
NDPDSPFAFPPLSTNRTTLILSITL

SEQ ID NO: 3090138 - protein, 18 aa, Giardia lamblia
NDQLLLRASLHSLFSSLR

SEQ ID NO: 3090139 - protein, 23 aa, Giardia lamblia
NDRIKGSWLDFNDKIFLSIQGVF

SEQ ID NO: 3090140 - protein, 17 aa, Giardia lamblia
NDSQSLLPVEKPATGKT

SEQ ID NO: 3090141 - protein, 24 aa, Giardia lamblia
NDTILTFLRALFNQGTCFIPCTDH

SEQ ID NO: 3090142 - protein, 24 aa, Giardia lamblia
NDVIPLLLGILYSEAVAPALQETA

SEQ ID NO: 3090143 - protein, 40 aa, Giardia lamblia
NDVWAFGVTLFMLLFGRHPASLCLHILVSKLPPPEDGGII

SEQ ID NO: 3090144 - protein, 26 aa, Giardia lamblia
NEAHRSWGDFIYKKKKYGVPCPGFGD

SEQ ID NO: 3090145 - protein, 25 aa, Giardia lamblia
NEANYKWFLFALISAIHMYFLGLLD

SEQ ID NO: 3090146 - protein, 23 aa, Giardia lamblia
NEDPTCLILSPIVVQPALPFIEQ

SEQ ID NO: 3090147 - protein, 25 aa, Giardia lamblia
NEGRSLLMYAMFGVPPQHLSNIIQE

SEQ ID NO: 3090148 - protein, 35 aa, Giardia lamblia
NEHGAKAYRYTCIYNFFIFAQLFNEISSRRINNEL

SEQ ID NO: 3090149 - protein, 26 aa, Giardia lamblia
NEILVYTFFLMSIYSAIYTIYGIIDF

SEQ ID NO: 3090150 - protein, 29 aa, Giardia lamblia
NEKQPLFKIHLNLTPYRKKMPNLAYCILE

SEQ ID NO: 3090151 - protein, 25 aa, Giardia lamblia
NEKSCPLMFFMYQEIMFYNRMVKDL

SEQ ID NO: 3090152 - protein, 18 aa, Giardia lamblia
NEKTLMWSLPFLCIDLFG

SEQ ID NO: 3090153 - protein, 38 aa, Giardia lamblia
NELGNRKVIATTLLPVICFFIGIAIIVIFAMAFNRNDV

SEQ ID NO: 3090154 - protein, 27 aa, Giardia lamblia
NELIYQVLLPLILYSTQRISTLCAFIC

SEQ ID NO: 3090155 - protein, 32 aa, Giardia lamblia
NELLRQSPLLCYKLFCRVVISKFQEAYLHDLN

SEQ ID NO: 3090156 - protein, 23 aa, Giardia lamblia
NELMLLLPEQLAIPYYNAILYAN

SEQ ID NO: 3090157 - protein, 25 aa, Giardia lamblia
NELVDILKLCGLNLRTPAGETALMA

SEQ ID NO: 3090158 - protein, 27 aa, Giardia lamblia
NEMLLLYVHLISQLKTLPLANQGRRLF

SEQ ID NO: 3090159 - protein, 25 aa, Giardia lamblia
NEPDLLQLFGRVFTIFFGSFPLEFS

SEQ ID NO: 3090160 - protein, 32 aa, Giardia lamblia
NESDRFTVILRILPIFFKLKIKYHKQLEKVAS

SEQ ID NO: 3090161 - protein, 30 aa, Giardia lamblia
NESIYHPCIITSIYLLQFLKEQLSLIEDSE

SEQ ID NO: 3090162 - protein, 23 aa, Giardia lamblia
NETDVGWLAYSASWVELRESSLE

SEQ ID NO: 3090163 - protein, 25 aa, Giardia lamblia
NFAFYPAWEAFIINHGIRLGHKSLA

SEQ ID NO: 3090164 - protein, 22 aa, Giardia lamblia
NFELLMSIIFVLRLDPVSEVRT

SEQ ID NO: 3090165 - protein, 26 aa, Giardia lamblia
NFESLLLLSHVLFDISMIVLDIMRHT

SEQ ID NO: 3090166 - protein, 24 aa, Giardia lamblia
NFGIHYLRRRLSMGTTLEVTLLHS

SEQ ID NO: 3090167 - protein, 19 aa, Giardia lamblia
NFHHATLTTFLLTETAHLK

SEQ ID NO: 3090168 - protein, 19 aa, Giardia lamblia
NFIKAFVPLKEQFIRFGQE

SEQ ID NO: 3090169 - protein, 36 aa, Giardia lamblia
NFIKHVIDSLYYLRSFHTLYYALVTMVFFAMHPQDS

SEQ ID NO: 3090170 - protein, 19 aa, Giardia lamblia
NFIPLMDGAKIAIGWLVDV

SEQ ID NO: 3090171 - protein, 32 aa, Giardia lamblia
NFLGHTKNSIRMLCLLALEFVVSLVVDAYQNA

SEQ ID NO: 3090172 - protein, 20 aa, Giardia lamblia
NFLRPFLFRSIYPGSLDNPP

SEQ ID NO: 3090173 - protein, 18 aa, Giardia lamblia
NFLSLVPSTSHTPVNVVP

SEQ ID NO: 3090174 - protein, 25 aa, Giardia lamblia
NFNSFFRVFPVFNYSGYEDPAEICF

SEQ ID NO: 3090175 - protein, 18 aa, Giardia lamblia
NFRLRDNPLRTFSSPPLS

SEQ ID NO: 3090176 - protein, 33 aa, Giardia lamblia
NFVKSWIPTGLVLVDLLMEMRLLESGYLDFLSV

SEQ ID NO: 3090177 - protein, 26 aa, Giardia lamblia
NFVRSAFLRLITELNPYLFRSRIDSI

SEQ ID NO: 3090178 - protein, 17 aa, Giardia lamblia
NGAIPAVFYPTRSTPCL

SEQ ID NO: 3090179 - protein, 25 aa, Giardia lamblia
NGCVKNFLYKRKSPIGLFLNDSYGV

SEQ ID NO: 3090180 - protein, 22 aa, Giardia lamblia
NGDSYLPLLRVLGMMHYSVHTY

SEQ ID NO: 3090181 - protein, 25 aa, Giardia lamblia
NGFSKAFYFKSIPQYNLTLSVSPAS

SEQ ID NO: 3090182 - protein, 24 aa, Giardia lamblia
NGFSMGLPVFLLTAATRSIYTQEP

SEQ ID NO: 3090183 - protein, 19 aa, Giardia lamblia
NGFTGIPHCAVCAADLTRA

SEQ ID NO: 3090184 - protein, 27 aa, Giardia lamblia
NGFYRLKNDIVLTQPWTPVSSFTGVLD

SEQ ID NO: 3090185 - protein, 29 aa, Giardia lamblia
NGGFEFYWLMCSLFFGFITILFGLCHLDL

SEQ ID NO: 3090186 - protein, 33 aa, Giardia lamblia
NGGLLFNSLSYYRLYASLLSYIPTFSLTLESEF

SEQ ID NO: 3090187 - protein, 24 aa, Giardia lamblia
NGIDLLHFLRNMPPYRVQAPLTAD

SEQ ID NO: 3090188 - protein, 21 aa, Giardia lamblia
NGIMHLFRYDFDSNARLPSRR

SEQ ID NO: 3090189 - protein, 30 aa, Giardia lamblia
NGIRAMVFSFLFHGMLYEYGHTKPPAQVIK

SEQ ID NO: 3090190 - protein, 17 aa, Giardia lamblia
NGKYLWLHANGTYACEP

SEQ ID NO: 3090191 - protein, 17 aa, Giardia lamblia
NGLCIPYDDPRAVASGC

SEQ ID NO: 3090192 - protein, 28 aa, Giardia lamblia
NGLFVRSYLSLLITLLPHGANLFDQRGM

SEQ ID NO: 3090193 - protein, 21 aa, Giardia lamblia
NGLLNHIFYSPRLALNATPIS

SEQ ID NO: 3090194 - protein, 23 aa, Giardia lamblia
NGLLVCVACEQFYRPMNGGTECV

SEQ ID NO: 3090195 - protein, 22 aa, Giardia lamblia
NGMIRSTFYYVTYNLGCYNGTV

SEQ ID NO: 3090196 - protein, 29 aa, Giardia lamblia
NGPLRVDRMVILLFLYEQELNLVERKRQV

SEQ ID NO: 3090197 - protein, 27 aa, Giardia lamblia
NGQPATFWMSGLYFPQGFITGVLQMHA

SEQ ID NO: 3090198 - protein, 28 aa, Giardia lamblia
NGSDKEYLFNVYFLRARALAIINRLERA

SEQ ID NO: 3090199 - protein, 17 aa, Giardia lamblia
NGSLNLDWLLIALVASL

SEQ ID NO: 3090200 - protein, 21 aa, Giardia lamblia
NGTFMQYYLKHRLGAASPKYR

SEQ ID NO: 3090201 - protein, 23 aa, Giardia lamblia
NGTKYWIILNSWGESWNDRGTMK

SEQ ID NO: 3090202 - protein, 17 aa, Giardia lamblia
NGTLFMRKFTGPGKKNL

SEQ ID NO: 3090203 - protein, 23 aa, Giardia lamblia
NGVTPLMYYASLGNVAYVGHCLE

SEQ ID NO: 3090204 - protein, 29 aa, Giardia lamblia
NGYCTSCYKTHLLYKLGCYSRHSSTGLAI

SEQ ID NO: 3090205 - protein, 21 aa, Giardia lamblia
NHCEISCWTNGLAPGSCKSDH

SEQ ID NO: 3090206 - protein, 17 aa, Giardia lamblia
NHDSMFLDDILSMGKNI

SEQ ID NO: 3090207 - protein, 24 aa, Giardia lamblia
NHEQYNFSLPFHVPSPVANHISCS

SEQ ID NO: 3090208 - protein, 37 aa, Giardia lamblia
NHLRKWIIQAVINSLFLLLTLLFSFGHAIFPTNAQVN

SEQ ID NO: 3090209 - protein, 20 aa, Giardia lamblia
NHLYLQCPPLTLGSVQGLAA

SEQ ID NO: 3090210 - protein, 25 aa, Giardia lamblia
NHNYSLIVCLLAFGIKHRILVSEQN

SEQ ID NO: 3090211 - protein, 23 aa, Giardia lamblia
NHQRLLPMLASASKLRILYQSNE

SEQ ID NO: 3090212 - protein, 18 aa, Giardia lamblia
NHSPMNFLSLVPSTSHTP

SEQ ID NO: 3090213 - protein, 24 aa, Giardia lamblia
NHSYTVLFKLLPTGPVRELRLYIV

SEQ ID NO: 3090214 - protein, 19 aa, Giardia lamblia
NHTLIYRRTLLRTDGDLVI

SEQ ID NO: 3090215 - protein, 21 aa, Giardia lamblia
NHVTAAFQYLGIRSGDMVGLM

SEQ ID NO: 3090216 - protein, 17 aa, Giardia lamblia
NICVFPKSNSQTNTGLI

SEQ ID NO: 3090217 - protein, 21 aa, Giardia lamblia
NIDLEVPFFKKIELQQAILDK

SEQ ID NO: 3090218 - protein, 25 aa, Giardia lamblia
NIDSTISLFFITSTVNFLPNTLKRN

SEQ ID NO: 3090219 - protein, 17 aa, Giardia lamblia
NIDYAMFLLTKGTETAP

SEQ ID NO: 3090220 - protein, 24 aa, Giardia lamblia
NIDYLIIVHTLCRYFGMRYEFVFC

SEQ ID NO: 3090221 - protein, 27 aa, Giardia lamblia
NIEAEVVVMYWAPYPDFLHPEEYFLTV

SEQ ID NO: 3090222 - protein, 21 aa, Giardia lamblia
NIFCYKPFIEFPSPPETFGQV

SEQ ID NO: 3090223 - protein, 24 aa, Giardia lamblia
NIFSPEAMLFLTTKMANPIPFYNY

SEQ ID NO: 3090224 - protein, 26 aa, Giardia lamblia
NIGDLKYLYFLAWEDVPDSSTVHSMC

SEQ ID NO: 3090225 - protein, 24 aa, Giardia lamblia
NIGRWFYFMGLCFMTLIASVSFSH

SEQ ID NO: 3090226 - protein, 19 aa, Giardia lamblia
NIHYSILSGVVYMAAAGKG

SEQ ID NO: 3090227 - protein, 23 aa, Giardia lamblia
NIKAPAPPRLLPSTLRRLSELSI

SEQ ID NO: 3090228 - protein, 27 aa, Giardia lamblia
NIKLFAQLLTPDFWLQYIHGMMDAFLI

SEQ ID NO: 3090229 - protein, 20 aa, Giardia lamblia
NILFLRRRVRLYQWIAIIGT

SEQ ID NO: 3090230 - protein, 24 aa, Giardia lamblia
NILSTIFDIYFRSLLKARRKSGNH

SEQ ID NO: 3090231 - protein, 19 aa, Giardia lamblia
NILVPMSIFFITVALYNGF

SEQ ID NO: 3090232 - protein, 29 aa, Giardia lamblia
NILVTPSRVLEFIIQMLLCFCYTDELADD

SEQ ID NO: 3090233 - protein, 17 aa, Giardia lamblia
NIMFIGPLVFVIELAMA

SEQ ID NO: 3090234 - protein, 34 aa, Giardia lamblia
NINQTINPIILLGFVFVVLGLALLAAGCMFVYQL

SEQ ID NO: 3090235 - protein, 20 aa, Giardia lamblia
NIPSSFFYYDIHTKYKFMRP

SEQ ID NO: 3090236 - protein, 19 aa, Giardia lamblia
NIRHIKPEALQFLKTWLLH

SEQ ID NO: 3090237 - protein, 18 aa, Giardia lamblia
NISLLYPHSERVLSWLDY

SEQ ID NO: 3090238 - protein, 31 aa, Giardia lamblia
NISTYTIVMLLLLFLQSADFAPPLRFNKFVS

SEQ ID NO: 3090239 - protein, 26 aa, Giardia lamblia
NIVKDRYFLLYAPHDSPLRSMPGSRA

SEQ ID NO: 3090240 - protein, 23 aa, Giardia lamblia
NIVLTTFWDIYDWARDKGAFSVR

SEQ ID NO: 3090241 - protein, 25 aa, Giardia lamblia
NIVSLILGWIFSELDTPGQILGAIS

SEQ ID NO: 3090242 - protein, 18 aa, Giardia lamblia
NIWLYTFEFDLPNPLTEA

SEQ ID NO: 3090243 - protein, 24 aa, Giardia lamblia
NIYLDFAGTLLQKLPNIKLSPSIL

SEQ ID NO: 3090244 - protein, 25 aa, Giardia lamblia
NIYSLAPDSLLILMRDMRTIAVINQ

SEQ ID NO: 3090245 - protein, 22 aa, Giardia lamblia
NKAYIKGYFRPYSPETNWIYYK

SEQ ID NO: 3090246 - protein, 30 aa, Giardia lamblia
NKDFLYANSSYFRQILFKPTPTFEQLINLR

SEQ ID NO: 3090247 - protein, 28 aa, Giardia lamblia
NKEINQRYLYWFFLRNTGTVQDRTQGTK

SEQ ID NO: 3090248 - protein, 25 aa, Giardia lamblia
NKERKRLLSRLLFNIVTHTLAITVS

SEQ ID NO: 3090249 - protein, 54 aa, Giardia lamblia
NKHKDKYKWVWLGLCVFLMLTRKWVYAVLLSKYCLCITILLLSVGLFVYQRTTP

SEQ ID NO: 3090250 - protein, 18 aa, Giardia lamblia
NKLLALLVGHTERYLFTS

SEQ ID NO: 3090251 - protein, 29 aa, Giardia lamblia
NKLQQYVMSLLQFSWLRDYTSNYTKIVLC

SEQ ID NO: 3090252 - protein, 20 aa, Giardia lamblia
NKPIVVIRRDATRLYLAPPD

SEQ ID NO: 3090253 - protein, 28 aa, Giardia lamblia
NKSKRILAHYLFIIFLLLASTLGGYALL

SEQ ID NO: 3090254 - protein, 29 aa, Giardia lamblia
NKSVEWLVQLFISKPVRPKHGLIILIPTS

SEQ ID NO: 3090255 - protein, 21 aa, Giardia lamblia
NKSWKSLWMCCTCGRFFCGYT

SEQ ID NO: 3090256 - protein, 30 aa, Giardia lamblia
NKVFEDTVFPLWLGLIHSLLHSIDVPEKCD

SEQ ID NO: 3090257 - protein, 21 aa, Giardia lamblia
NKVYLYLLMSRIYGELLCLDP

SEQ ID NO: 3090258 - protein, 27 aa, Giardia lamblia
NKWNVILYDIWRPMVLRKSFLSREFKK

SEQ ID NO: 3090259 - protein, 19 aa, Giardia lamblia
NKYPGRFVCGWADDGKCIE

SEQ ID NO: 3090260 - protein, 33 aa, Giardia lamblia
NKYRLNSVFVSAFLMLLLSTLTPSHVLGFFTIL

SEQ ID NO: 3090261 - protein, 18 aa, Giardia lamblia
NLAFAPLMHNFVIWNEWG

SEQ ID NO: 3090262 - protein, 19 aa, Giardia lamblia
NLAPDNILHFGGFVGSCIC

SEQ ID NO: 3090263 - protein, 20 aa, Giardia lamblia
NLDLIEDNVWIYGPKKDENG

SEQ ID NO: 3090264 - protein, 29 aa, Giardia lamblia
NLDMKFTIYSCFALSPSIGFIECILPSES

SEQ ID NO: 3090265 - protein, 27 aa, Giardia lamblia
NLEATLQYLNLPLPKYIEASLLRKEAN

SEQ ID NO: 3090266 - protein, 27 aa, Giardia lamblia
NLFRAVIIAISTWLLEKTRSLLFRFAL

SEQ ID NO: 3090267 - protein, 27 aa, Giardia lamblia
NLHSAIYFLSIILCIVRVLFGQLDLYH

SEQ ID NO: 3090268 - protein, 18 aa, Giardia lamblia
NLIPLVVAVVFSQFPRRI

SEQ ID NO: 3090269 - protein, 27 aa, Giardia lamblia
NLKMIYNMPFKGIFLSMFTIASARVAM

SEQ ID NO: 3090270 - protein, 24 aa, Giardia lamblia
NLKSSLLYFDAIIKASKRTAGLLE

SEQ ID NO: 3090271 - protein, 17 aa, Giardia lamblia
NLKTILVNISIGNGNNL

SEQ ID NO: 3090272 - protein, 24 aa, Giardia lamblia
NLKVLEEIILPGLTGYMMRFRRQI

SEQ ID NO: 3090273 - protein, 25 aa, Giardia lamblia
NLLHINPLQMLPLPKGKWKDSNADF

SEQ ID NO: 3090274 - protein, 20 aa, Giardia lamblia
NLLIISYNRQFFRQFDQLLS

SEQ ID NO: 3090275 - protein, 28 aa, Giardia lamblia
NLLVDMEYMRILPLGLFVQTITNWTPQD

SEQ ID NO: 3090276 - protein, 19 aa, Giardia lamblia
NLMGLCPTLLSISEDTLSE

SEQ ID NO: 3090277 - protein, 41 aa, Giardia lamblia
NLMKIDDCPIYLYPIPVTIVICIEVLLTNGYFLPLEADDDT

SEQ ID NO: 3090278 - protein, 20 aa, Giardia lamblia
NLMLYILRQYSEKSPKHIHN

SEQ ID NO: 3090279 - protein, 20 aa, Giardia lamblia
NLNELLGHVFKYLNYHLTDC

SEQ ID NO: 3090280 - protein, 24 aa, Giardia lamblia
NLNNYSAIKFGYPGVLLSGDVLLN

SEQ ID NO: 3090281 - protein, 22 aa, Giardia lamblia
NLNVILFFYTRRCFNLKVLEEI

SEQ ID NO: 3090282 - protein, 17 aa, Giardia lamblia
NLQIFGCFLVVISQLIQ

SEQ ID NO: 3090283 - protein, 24 aa, Giardia lamblia
NLRSLLIWVIMVIIYYSTRHYNRP

SEQ ID NO: 3090284 - protein, 17 aa, Giardia lamblia
NLSALPQLIYAAHTNDM

SEQ ID NO: 3090285 - protein, 21 aa, Giardia lamblia
NLSGGLYPRFSQHMYDTVLME

SEQ ID NO: 3090286 - protein, 24 aa, Giardia lamblia
NLSGLWPKLCTHVDFFDPSRNVAK

SEQ ID NO: 3090287 - protein, 26 aa, Giardia lamblia
NLSPFISGYIFPYSNPFITRLKHFQF

SEQ ID NO: 3090288 - protein, 22 aa, Giardia lamblia
NLSRFNIMLLDIGQTLNSYAWV

SEQ ID NO: 3090289 - protein, 17 aa, Giardia lamblia
NLTDFVLHLPRAPYQQW

SEQ ID NO: 3090290 - protein, 19 aa, Giardia lamblia
NLTEKLLPFIQKSILRSNS

SEQ ID NO: 3090291 - protein, 18 aa, Giardia lamblia
NLTMLQFDLSLNSSDIDA

SEQ ID NO: 3090292 - protein, 26 aa, Giardia lamblia
NLTRSYSADWLMRVMNRWLSFRVNVI

SEQ ID NO: 3090293 - protein, 21 aa, Giardia lamblia
NLTSSLLCRLDHSTARHQCLC

SEQ ID NO: 3090294 - protein, 24 aa, Giardia lamblia
NLTTTTIFVKYFAVGGTIGRVQGG

SEQ ID NO: 3090295 - protein, 28 aa, Giardia lamblia
NLVALHDFLHLYLLKKENALLYFQEAYA

SEQ ID NO: 3090296 - protein, 22 aa, Giardia lamblia
NLVKSIFRIYPLVAPQVRTVFN

SEQ ID NO: 3090297 - protein, 19 aa, Giardia lamblia
NLVLVFSPGWICHISNHVL

SEQ ID NO: 3090298 - protein, 26 aa, Giardia lamblia
NLVPIAVILSIVRQLAAALAYLHGVN

SEQ ID NO: 3090299 - protein, 37 aa, Giardia lamblia
NLYLYEEELWAIFGQLLLFCTYLLSISLQIAEVVCTH

SEQ ID NO: 3090300 - protein, 26 aa, Giardia lamblia
NMFVKGMFIFCLLLSALVTFATTTRS

SEQ ID NO: 3090301 - protein, 27 aa, Giardia lamblia
NMFVKGMFIFCLLLSALVTFATTTRSI

SEQ ID NO: 3090302 - protein, 25 aa, Giardia lamblia
NMGLPIPMHHMLLSTLRFAQPEQTS

SEQ ID NO: 3090303 - protein, 19 aa, Giardia lamblia
NMHLYLEELLFATSSIRID

SEQ ID NO: 3090304 - protein, 18 aa, Giardia lamblia
NMHYQCVGILPLPSICNS

SEQ ID NO: 3090305 - protein, 34 aa, Giardia lamblia
NMLNTFGCLFSLWYLLVLKIYATGDFFVSVYALL

SEQ ID NO: 3090306 - protein, 18 aa, Giardia lamblia
NMQRKTSIQFLKKSRRKG

SEQ ID NO: 3090307 - protein, 30 aa, Giardia lamblia
NMQSVVLARRWLPFLRESSLPPSALPKLLN

SEQ ID NO: 3090308 - protein, 20 aa, Giardia lamblia
NMRLFDLMERACYQPPVCDS

SEQ ID NO: 3090309 - protein, 22 aa, Giardia lamblia
NMRQLMLVIIQDIFLKLDTIST

SEQ ID NO: 3090310 - protein, 18 aa, Giardia lamblia
NMTLFWLSQPNEPTDTPS

SEQ ID NO: 3090311 - protein, 26 aa, Giardia lamblia
NNDNVIRYLIPFESRMTDFYGKTALM

SEQ ID NO: 3090312 - protein, 39 aa, Giardia lamblia
NNELSRIFLKRLYKLLYHLRTFFFTKIIALEPSVQAAYD

SEQ ID NO: 3090313 - protein, 24 aa, Giardia lamblia
NNESTLIKILPAAGIILNTIYSKD

SEQ ID NO: 3090314 - protein, 22 aa, Giardia lamblia
NNEWLIDRGVYILHIPHLFLKR

SEQ ID NO: 3090315 - protein, 24 aa, Giardia lamblia
NNFPNYMMAIFYIPSFISSFAGSS

SEQ ID NO: 3090316 - protein, 17 aa, Giardia lamblia
NNGLLLIMIARVILPTG

SEQ ID NO: 3090317 - protein, 29 aa, Giardia lamblia
NNKIKDCIGIELRFLFSTSDDLPGSLTKM

SEQ ID NO: 3090318 - protein, 30 aa, Giardia lamblia
NNKIRPQGMFPRLVFWVVHENMHYQCVGIL

SEQ ID NO: 3090319 - protein, 20 aa, Giardia lamblia
NNKPANMTLFWLSQPNEPTD

SEQ ID NO: 3090320 - protein, 33 aa, Giardia lamblia
NNMGNTALILAAYTGSLPFATLLSSYEKGIKNK

SEQ ID NO: 3090321 - protein, 26 aa, Giardia lamblia
NNNGNYMCLCANYYTLVGRDCIPTRC

SEQ ID NO: 3090322 - protein, 23 aa, Giardia lamblia
NNQFDFDFLVANAGLHKKRQPDA

SEQ ID NO: 3090323 - protein, 24 aa, Giardia lamblia
NNQNIWLLLNAIKTVIEKKDSQDA

SEQ ID NO: 3090324 - protein, 22 aa, Giardia lamblia
NNRRDCVQLLLKAEGMLKCPGG

SEQ ID NO: 3090325 - protein, 23 aa, Giardia lamblia
NNSCVFYDCKVGFYLDPLAYERT

SEQ ID NO: 3090326 - protein, 22 aa, Giardia lamblia
NNTWSMLRIPVDLPSYKHEPYY

SEQ ID NO: 3090327 - protein, 29 aa, Giardia lamblia
NNVPFIAMVMLILTLFSIAFYQIVSMDAN

SEQ ID NO: 3090328 - protein, 18 aa, Giardia lamblia
NNVVIGVRILVTLTTVVC

SEQ ID NO: 3090329 - protein, 23 aa, Giardia lamblia
NNYYFFKIIDFTKDWRWGKDTPG

SEQ ID NO: 3090330 - protein, 25 aa, Giardia lamblia
NPAPLIVLILVFFFADTHVATTIAN

SEQ ID NO: 3090331 - protein, 22 aa, Giardia lamblia
NPCLIIEILTLLLSASAGGLAA

SEQ ID NO: 3090332 - protein, 24 aa, Giardia lamblia
NPDYCIVCQRGYWPTKNGNECACS

SEQ ID NO: 3090333 - protein, 25 aa, Giardia lamblia
NPEFPFLFVSGLRKTYRKAKRCTVV

SEQ ID NO: 3090334 - protein, 26 aa, Giardia lamblia
NPFVQIGYARLLRPYSPQIDRLQHVY

SEQ ID NO: 3090335 - protein, 25 aa, Giardia lamblia
NPGSTFLFYGGCYDATDVPGRLICS

SEQ ID NO: 3090336 - protein, 33 aa, Giardia lamblia
NPGVILIMSLLFTGSIIFLIISAIAFSFNSAQA

SEQ ID NO: 3090337 - protein, 22 aa, Giardia lamblia
NPISFIYVQRWDVYLVIALIAA

SEQ ID NO: 3090338 - protein, 27 aa, Giardia lamblia
NPIVEYMTMMFLLKFGAISVELPADVS

SEQ ID NO: 3090339 - protein, 22 aa, Giardia lamblia
NPKNISALVFKVIIVIIATKER

SEQ ID NO: 3090340 - protein, 23 aa, Giardia lamblia
NPKVVDRIFAEIPRPFRSNVPGK

SEQ ID NO: 3090341 - protein, 20 aa, Giardia lamblia
NPLDNIYRYIAPEALVVNFD

SEQ ID NO: 3090342 - protein, 30 aa, Giardia lamblia
NPLKYYLLLVLGIFFLIVSVLWYIQIIAAA

SEQ ID NO: 3090343 - protein, 25 aa, Giardia lamblia
NPLQFRKMFPIFSKNIEIPYLETMY

SEQ ID NO: 3090344 - protein, 25 aa, Giardia lamblia
NPMINYLWIDFVARSLQITNDVRTE

SEQ ID NO: 3090345 - protein, 25 aa, Giardia lamblia
NPNISTYLILTFPKDKVLGTIVNSA

SEQ ID NO: 3090346 - protein, 27 aa, Giardia lamblia
NPNIVTTLLLRWIGPRIKDFSFNRYRH

SEQ ID NO: 3090347 - protein, 25 aa, Giardia lamblia
NPNKGWVILSIIDVAHFLQGIAKII

SEQ ID NO: 3090348 - protein, 17 aa, Giardia lamblia
NPQFVVLGLSNGKIKIY

SEQ ID NO: 3090349 - protein, 24 aa, Giardia lamblia
NPQVFLLPMIYNSGTHFEHKIDHA

SEQ ID NO: 3090350 - protein, 24 aa, Giardia lamblia
NPSRRQYLIKYENEYPGLQVLPNP

SEQ ID NO: 3090351 - protein, 20 aa, Giardia lamblia
NPSVCFAPLICDQALHMCIC

SEQ ID NO: 3090352 - protein, 24 aa, Giardia lamblia
NPVDDYINYWPPGGSRYMDHTTYL

SEQ ID NO: 3090353 - protein, 22 aa, Giardia lamblia
NPVSEDIYYFATLGYKHLQNAV

SEQ ID NO: 3090354 - protein, 28 aa, Giardia lamblia
NQDKLTILLDSPPLYRGVLEQAPNMNST

SEQ ID NO: 3090355 - protein, 27 aa, Giardia lamblia
NQFADSVLLQFLLELTFKIDLDESLCI

SEQ ID NO: 3090356 - protein, 19 aa, Giardia lamblia
NQLCRLHLPQSVYLEINFS

SEQ ID NO: 3090357 - protein, 36 aa, Giardia lamblia
NQLMLMIVLTFFAFFIPLPVFATIGLLLVALFPVYN

SEQ ID NO: 3090358 - protein, 29 aa, Giardia lamblia
NQMRRDYTILLHLFIKLPVEIRKEVASYW

SEQ ID NO: 3090359 - protein, 26 aa, Giardia lamblia
NQNSPIRSVFLYEGGCYNTNDVLGST

SEQ ID NO: 3090360 - protein, 24 aa, Giardia lamblia
NQSYTILHLLSMRTQNFNFLLSHI

SEQ ID NO: 3090361 - protein, 29 aa, Giardia lamblia
NQTDVLLSELLLGLYPAAYLKYLNETASD

SEQ ID NO: 3090362 - protein, 28 aa, Giardia lamblia
NQTFSQDLLLLVSSTLHISLYGFYGNSQ

SEQ ID NO: 3090363 - protein, 23 aa, Giardia lamblia
NQTFYFVSLVNQPIRFEFMGYII

SEQ ID NO: 3090364 - protein, 22 aa, Giardia lamblia
NQTNFCLYVSLLAIVEYHRRIV

SEQ ID NO: 3090365 - protein, 25 aa, Giardia lamblia
NRALSHRYLLYRIGDFIWNVFNEKI

SEQ ID NO: 3090366 - protein, 31 aa, Giardia lamblia
NRCQLISISRMPIYFLVLKGTGHVQALAFPK

SEQ ID NO: 3090367 - protein, 24 aa, Giardia lamblia
NRCWRFLDFILTAKRHQLARGNVP

SEQ ID NO: 3090368 - protein, 24 aa, Giardia lamblia
NRILNYIRKEILPINPRFYINFIM

SEQ ID NO: 3090369 - protein, 20 aa, Giardia lamblia
NRLGIKLTLDLGTRSNSRRS

SEQ ID NO: 3090370 - protein, 56 aa, Giardia lamblia
NRLSSFMLMSLRDPVRILLPFVLVTFLKRLLFIIPFISHYVVEWFYPSIIDEALLA

SEQ ID NO: 3090371 - protein, 39 aa, Giardia lamblia
NRNFLYLSKTIYLGILSLLLLYVSYYISAAKLPGFGTSK

SEQ ID NO: 3090372 - protein, 34 aa, Giardia lamblia
NRNLTIWTVVLLVILIVGTCWWMMAMDEAKPDDL

SEQ ID NO: 3090373 - protein, 24 aa, Giardia lamblia
NRNMDWFISLWHNLKFDASNNCID

SEQ ID NO: 3090374 - protein, 21 aa, Giardia lamblia
NRQMVFYIYIMLDGKLVRSTE

SEQ ID NO: 3090375 - protein, 26 aa, Giardia lamblia
NRVCCRKCVDPLFFINNGACVSETFT

SEQ ID NO: 3090376 - protein, 30 aa, Giardia lamblia
NRVPFTDHLILYLTMKFPTYVELLELLCRQ

SEQ ID NO: 3090377 - protein, 24 aa, Giardia lamblia
NSADWLPIPLFSMSVSHNITLQFA

SEQ ID NO: 3090378 - protein, 29 aa, Giardia lamblia
NSDTLDFLALIMILRVSFAMALGIKPEIL

SEQ ID NO: 3090379 - protein, 22 aa, Giardia lamblia
NSEALSYLLGEYRLQRHDGKTA

SEQ ID NO: 3090380 - protein, 27 aa, Giardia lamblia
NSEPLYPMVYVLFRMGHYESLTFLLER

SEQ ID NO: 3090381 - protein, 17 aa, Giardia lamblia
NSEQPHFIKGGNPILFF

SEQ ID NO: 3090382 - protein, 24 aa, Giardia lamblia
NSHHVPIILPPQPGTFIAARGGAL

SEQ ID NO: 3090383 - protein, 27 aa, Giardia lamblia
NSHKRQLFFLLYFTTVFYVLAGVPLLL

SEQ ID NO: 3090384 - protein, 20 aa, Giardia lamblia
NSIHPRLLAYLALLVDPTDQ

SEQ ID NO: 3090385 - protein, 27 aa, Giardia lamblia
NSLAHFNIYYWLTYPDSVALDCISNFS

SEQ ID NO: 3090386 - protein, 21 aa, Giardia lamblia
NSLDFMGFITGLYYSPHDGTV

SEQ ID NO: 3090387 - protein, 17 aa, Giardia lamblia
NSLLLFTSHIKRVAITD

SEQ ID NO: 3090388 - protein, 17 aa, Giardia lamblia
NSLVRYIPLLIMFNQQN

SEQ ID NO: 3090389 - protein, 23 aa, Giardia lamblia
NSLWLTSLLSIVCLIYFMVMILS

SEQ ID NO: 3090390 - protein, 19 aa, Giardia lamblia
NSMVSQQLRRIFLRQKQTK

SEQ ID NO: 3090391 - protein, 19 aa, Giardia lamblia
NSNVLFAKQRRPVSRAINS

SEQ ID NO: 3090392 - protein, 26 aa, Giardia lamblia
NSPNILRYYLQMAEYILLLSVSYDES

SEQ ID NO: 3090393 - protein, 22 aa, Giardia lamblia
NSPTIWSIPMHALVDGARSILS

SEQ ID NO: 3090394 - protein, 42 aa, Giardia lamblia
NSQTYLVSPCRLIVLIRAHASFLYYPTLLTLLGQKVQMIDNT

SEQ ID NO: 3090395 - protein, 25 aa, Giardia lamblia
NSRLHYILIVQRILEVMSLLASDSF

SEQ ID NO: 3090396 - protein, 22 aa, Giardia lamblia
NSRLSCIAALILLLASNSRVMV

SEQ ID NO: 3090397 - protein, 21 aa, Giardia lamblia
NSRTLYTFRLSGKAMPYLPCV

SEQ ID NO: 3090398 - protein, 26 aa, Giardia lamblia
NSSHLNWFTSLLTPILSYLVGTDLST

SEQ ID NO: 3090399 - protein, 25 aa, Giardia lamblia
NSSLQIFELVRFLTTLRRYISGAAH

SEQ ID NO: 3090400 - protein, 29 aa, Giardia lamblia
NSTDRSLRFLAYPYIVFPVNNTTHYSRIY

SEQ ID NO: 3090401 - protein, 23 aa, Giardia lamblia
NSTILDVMWSPNGAYFAVLCSGS

SEQ ID NO: 3090402 - protein, 24 aa, Giardia lamblia
NSTLPFNLTAFPSAFLGICLDSFY

SEQ ID NO: 3090403 - protein, 34 aa, Giardia lamblia
NSTPRSNICLLLGVIHTLFVTLDITMSLMVCMHH

SEQ ID NO: 3090404 - protein, 23 aa, Giardia lamblia
NSVVTFYYVITNRLVVLANLYLR

SEQ ID NO: 3090405 - protein, 28 aa, Giardia lamblia
NSYLRGLSPLLEAYLSRLLARTAGIIDK

SEQ ID NO: 3090406 - protein, 24 aa, Giardia lamblia
NSYNQLVRLFAALGNYTILSSDRF

SEQ ID NO: 3090407 - protein, 42 aa, Giardia lamblia
NSYRLALLAMVSRKPLYSLYFNTRFLYRRRPNHWAYYFNHCK

SEQ ID NO: 3090408 - protein, 26 aa, Giardia lamblia
NTANMSSFLLINKVPMRYLTHMSALE

SEQ ID NO: 3090409 - protein, 19 aa, Giardia lamblia
NTCTACRAGYYLQSTSCIA

SEQ ID NO: 3090410 - protein, 17 aa, Giardia lamblia
NTDFYVRSLRSFGWPGR

SEQ ID NO: 3090411 - protein, 35 aa, Giardia lamblia
NTDSLPSYISPLDKLWYSLLYLKRTQTLQDSMAIG

SEQ ID NO: 3090412 - protein, 29 aa, Giardia lamblia
NTELLPLRVHIALLKLRLFDESGYHDLKA

SEQ ID NO: 3090413 - protein, 27 aa, Giardia lamblia
NTEVKGSFIYFGLLAATATDSYFSQVV

SEQ ID NO: 3090414 - protein, 27 aa, Giardia lamblia
NTFAAWLPMFLLFSANVAIFSAFIAAF

SEQ ID NO: 3090415 - protein, 26 aa, Giardia lamblia
NTFKVPIILCLLITLVYLIAGSYAPQ

SEQ ID NO: 3090416 - protein, 40 aa, Giardia lamblia
NTGLIVGVIVFIIVLILIVVTVVLLIRLRKRMDREDAIFC

SEQ ID NO: 3090417 - protein, 23 aa, Giardia lamblia
NTIDFYKPIRLINTAEPPVPLMI

SEQ ID NO: 3090418 - protein, 25 aa, Giardia lamblia
NTIIAESLPWFAQHHSSFVALALTE

SEQ ID NO: 3090419 - protein, 24 aa, Giardia lamblia
NTKTLFSLFNSRFTLDYPSDEAHN

SEQ ID NO: 3090420 - protein, 23 aa, Giardia lamblia
NTLILSLLCHKIAADELPITLSS

SEQ ID NO: 3090421 - protein, 31 aa, Giardia lamblia
NTLSTSLLYNAFLYFLNPSRYLGSSYTSRMK

SEQ ID NO: 3090422 - protein, 19 aa, Giardia lamblia
NTLWRPYVPKKTAVRLDEL

SEQ ID NO: 3090423 - protein, 18 aa, Giardia lamblia
NTMLAIICGFYSGESLFS

SEQ ID NO: 3090424 - protein, 18 aa, Giardia lamblia
NTPKYDFSLIFQPAHPQE

SEQ ID NO: 3090425 - protein, 19 aa, Giardia lamblia
NTRFCPFGFNRFVSSALLE

SEQ ID NO: 3090426 - protein, 20 aa, Giardia lamblia
NTRLFNCLKLGKAHAIVEDD

SEQ ID NO: 3090427 - protein, 28 aa, Giardia lamblia
NTRNQRSLRFFPLKPVGLGCIFMRAGRT

SEQ ID NO: 3090428 - protein, 32 aa, Giardia lamblia
NTSSPIHWCHTYLASFLWNTSKYYLTAQNTSI

SEQ ID NO: 3090429 - protein, 21 aa, Giardia lamblia
NTSYPCSLAINLYSNPLHVFL

SEQ ID NO: 3090430 - protein, 27 aa, Giardia lamblia
NVAVLRRLVFLLADLDPENGALHVLKL

SEQ ID NO: 3090431 - protein, 24 aa, Giardia lamblia
NVCTFTMACLFIRQYCEAQSGTLT

SEQ ID NO: 3090432 - protein, 20 aa, Giardia lamblia
NVCVPILCTIKHPTDISLSQ

SEQ ID NO: 3090433 - protein, 26 aa, Giardia lamblia
NVDKGPILPFLQPLASAILSYFLSLA

SEQ ID NO: 3090434 - protein, 22 aa, Giardia lamblia
NVDRFYVILSESLSPCIYPESF

SEQ ID NO: 3090435 - protein, 29 aa, Giardia lamblia
NVFHHLFINVKIDGFWRILSKVLTIPVTN

SEQ ID NO: 3090436 - protein, 25 aa, Giardia lamblia
NVGEFPVRLKLLYTLSALLSNIEEL

SEQ ID NO: 3090437 - protein, 27 aa, Giardia lamblia
NVHPNILRFISWYQSNDEIWLITELCE

SEQ ID NO: 3090438 - protein, 23 aa, Giardia lamblia
NVIFKVFLMPRYISHNNYSDYSD

SEQ ID NO: 3090439 - protein, 24 aa, Giardia lamblia
NVIKLPVKIKYFQTLYVKQKDVRT

SEQ ID NO: 3090440 - protein, 18 aa, Giardia lamblia
NVIRDYNPFWPQDIGCRM

SEQ ID NO: 3090441 - protein, 21 aa, Giardia lamblia
NVKMLLIERGIRTSTGRTALM

SEQ ID NO: 3090442 - protein, 25 aa, Giardia lamblia
NVKSFLHTFYLAIALLVAGLVFSCF

SEQ ID NO: 3090443 - protein, 26 aa, Giardia lamblia
NVLFSQIVMPIWASALIFSKTMKLQA

SEQ ID NO: 3090444 - protein, 29 aa, Giardia lamblia
NVLKQAFCIPLRSIMVMCLKLVIRVVELL

SEQ ID NO: 3090445 - protein, 18 aa, Giardia lamblia
NVLLFVIQLLVLRDNTHD

SEQ ID NO: 3090446 - protein, 29 aa, Giardia lamblia
NVPIYSLSPELLIFGFKSPLEPARFVSPV

SEQ ID NO: 3090447 - protein, 18 aa, Giardia lamblia
NVRMDWRLLHQNRTFAYV

SEQ ID NO: 3090448 - protein, 17 aa, Giardia lamblia
NVSAILYQLCDVHPLKR

SEQ ID NO: 3090449 - protein, 22 aa, Giardia lamblia
NVTSYNPYRKLFYAYCAPTTQG

SEQ ID NO: 3090450 - protein, 26 aa, Giardia lamblia
NVVILFWESLSLSPYFYTDAFLQGQE

SEQ ID NO: 3090451 - protein, 20 aa, Giardia lamblia
NVYTILLFSYLCRAGFSLSD

SEQ ID NO: 3090452 - protein, 27 aa, Giardia lamblia
NWCANKVWYVMILSFFLGTSLSLLSLT

SEQ ID NO: 3090453 - protein, 24 aa, Giardia lamblia
NWEHDPKGWYLPKGMPVANSAINN

SEQ ID NO: 3090454 - protein, 21 aa, Giardia lamblia
NWKAWMAIDKLLNDLIPIPEI

SEQ ID NO: 3090455 - protein, 17 aa, Giardia lamblia
NWVAMDILHDVFAQYND

SEQ ID NO: 3090456 - protein, 27 aa, Giardia lamblia
NYAFSPHSFYYFSCTLTASGLINTMIG

SEQ ID NO: 3090457 - protein, 24 aa, Giardia lamblia
NYDFLTAFAYGLYMGLRSALALNS

SEQ ID NO: 3090458 - protein, 26 aa, Giardia lamblia
NYERERGPFFFIPDMAFVLKHHDYVN

SEQ ID NO: 3090459 - protein, 28 aa, Giardia lamblia
NYFIHEGGCYNILYSPGNLICVDLARNL

SEQ ID NO: 3090460 - protein, 27 aa, Giardia lamblia
NYGLPSRLLMLCEDLMWPRWRTQLTCS

SEQ ID NO: 3090461 - protein, 20 aa, Giardia lamblia
NYHKLAILLALKRVDEELVK

SEQ ID NO: 3090462 - protein, 33 aa, Giardia lamblia
NYILSAMFLVRDIFLFAKITIDKWLKCIGSQVA

SEQ ID NO: 3090463 - protein, 20 aa, Giardia lamblia
NYISGLILFLRDASPSELRS

SEQ ID NO: 3090464 - protein, 26 aa, Giardia lamblia
NYKEYVSYDALLNNLPFLATIDVEAM

SEQ ID NO: 3090465 - protein, 20 aa, Giardia lamblia
NYKGYISPELTLCGKSIVIS

SEQ ID NO: 3090466 - protein, 21 aa, Giardia lamblia
NYKRHIRVFSRVLLVFSDWLS

SEQ ID NO: 3090467 - protein, 29 aa, Giardia lamblia
NYLVWLVVVLLMMLWLVYLRIEYGPTVVP

SEQ ID NO: 3090468 - protein, 27 aa, Giardia lamblia
NYMNIDISLTFRPSALFTAFRAQACYI

SEQ ID NO: 3090469 - protein, 31 aa, Giardia lamblia
NYNLEGPVLLDPLFLLGLETRSMSIATEAPL

SEQ ID NO: 3090470 - protein, 22 aa, Giardia lamblia
NYRSILLHSSLKDRLLITAEKR

SEQ ID NO: 3090471 - protein, 37 aa, Giardia lamblia
NYSIHSLHLILRIADGYYLLIVDFYDTLHTATYSSLT

SEQ ID NO: 3090472 - protein, 20 aa, Giardia lamblia
NYSIVYVITFTLGGCLVLVN

SEQ ID NO: 3090473 - protein, 18 aa, Giardia lamblia
NYTLTFSAYTEHVWRFCY

SEQ ID NO: 3090474 - protein, 28 aa, Giardia lamblia
PAAHEPTFILGYLWCIMSRIAVDNADIK

SEQ ID NO: 3090475 - protein, 40 aa, Giardia lamblia
PAASSSLALFIIMLSLIILWIVVILIVRYKEGARQHITTS

SEQ ID NO: 3090476 - protein, 23 aa, Giardia lamblia
PAAYKMLWYDDTVYDKLFSPSRQ

SEQ ID NO: 3090477 - protein, 38 aa, Giardia lamblia
PADHPVKLRMWLRLQTISFIYRTLHIVISYDAACFFVS

SEQ ID NO: 3090478 - protein, 20 aa, Giardia lamblia
PADPVWMQMANKLRADILTL

SEQ ID NO: 3090479 - protein, 26 aa, Giardia lamblia
PAELCLKCTPGLLLIDGACVEQDSHE

SEQ ID NO: 3090480 - protein, 20 aa, Giardia lamblia
PAERFIVVIALSVAATMKEG

SEQ ID NO: 3090481 - protein, 31 aa, Giardia lamblia
PAEVSYVFERYLWKFVFELTAYEVKNPVFEL

SEQ ID NO: 3090482 - protein, 18 aa, Giardia lamblia
PAFVFVQQLLGYVWEVYP

SEQ ID NO: 3090483 - protein, 18 aa, Giardia lamblia
PAGFVSYEGECLPRGCFN

SEQ ID NO: 3090484 - protein, 36 aa, Giardia lamblia
PAGIALIVFVSLLLLATILVVIIVPIVCNRRQRQAA

SEQ ID NO: 3090485 - protein, 28 aa, Giardia lamblia
PAIASSLATLILKLIKAIPRIFKDLTLA

SEQ ID NO: 3090486 - protein, 18 aa, Giardia lamblia
PAIINSPYIVMFSIFPGR

SEQ ID NO: 3090487 - protein, 18 aa, Giardia lamblia
PAILYPSAAVVIPSALPI

SEQ ID NO: 3090488 - protein, 29 aa, Giardia lamblia
PALIGYSRDFFIIFKITLVKAVSSFQGHL

SEQ ID NO: 3090489 - protein, 23 aa, Giardia lamblia
PALTSLLIQMFLSPGSISPESYL

SEQ ID NO: 3090490 - protein, 31 aa, Giardia lamblia
PALVPPPITWIFVAIAPYLTNFALYDNLLVI

SEQ ID NO: 3090491 - protein, 20 aa, Giardia lamblia
PALVRSLPAPVCAALFGLPG

SEQ ID NO: 3090492 - protein, 18 aa, Giardia lamblia
PAMRSRLTEFWMPHIRDI

SEQ ID NO: 3090493 - protein, 19 aa, Giardia lamblia
PAMTFTYNNTFLVGIDSGQ

SEQ ID NO: 3090494 - protein, 17 aa, Giardia lamblia
PANLPLRPIPSNVSFVS

SEQ ID NO: 3090495 - protein, 25 aa, Giardia lamblia
PANSKVILFPLGPLLLAINNTFGTN

SEQ ID NO: 3090496 - protein, 25 aa, Giardia lamblia
PAPICKALLVFLFSNNMPLSLCSDY

SEQ ID NO: 3090497 - protein, 17 aa, Giardia lamblia
PAPIFKIIDGKATHWRT

SEQ ID NO: 3090498 - protein, 27 aa, Giardia lamblia
PAQHKCYFLPHIAFNIRHIKPEALQFL

SEQ ID NO: 3090499 - protein, 29 aa, Giardia lamblia
PAQVTLLAIQLLWTMWIEAGLRQARQDKK

SEQ ID NO: 3090500 - protein, 22 aa, Giardia lamblia
PARQTFCLIIDEINLVDKDCFD

SEQ ID NO: 3090501 - protein, 29 aa, Giardia lamblia
PASRLMNLKLSIERLISLDGFDPLFSNDP

SEQ ID NO: 3090502 - protein, 21 aa, Giardia lamblia
PASTYFCFAALSLSGATASDT

SEQ ID NO: 3090503 - protein, 21 aa, Giardia lamblia
PATFIYRTNSFWFLSNAALVY

SEQ ID NO: 3090504 - protein, 20 aa, Giardia lamblia
PAVDGIFVKPIPPLDLPRFN

SEQ ID NO: 3090505 - protein, 22 aa, Giardia lamblia
PAVLSVLFRQSAVWVLVVVVAR

SEQ ID NO: 3090506 - protein, 29 aa, Giardia lamblia
PAYTSKYFIPTLFQYLYKYPNNAIDITKT

SEQ ID NO: 3090507 - protein, 17 aa, Giardia lamblia
PCDASAFTALYTSTDRP

SEQ ID NO: 3090508 - protein, 19 aa, Giardia lamblia
PCIDLAIPDQALPGSLADF

SEQ ID NO: 3090509 - protein, 18 aa, Giardia lamblia
PCLLTVSVSTEMELRKAL

SEQ ID NO: 3090510 - protein, 21 aa, Giardia lamblia
PCPFETLQGLVYHKLAKTQLL

SEQ ID NO: 3090511 - protein, 18 aa, Giardia lamblia
PCRPSIVPLLSLSCPAQQ

SEQ ID NO: 3090512 - protein, 18 aa, Giardia lamblia
PCRTRLLYLLVSGPIICF

SEQ ID NO: 3090513 - protein, 22 aa, Giardia lamblia
PCTKCYKGYYLTGQTCTLCSVD

SEQ ID NO: 3090514 - protein, 26 aa, Giardia lamblia
PDAEDWISMMYIPRSILPGITDSSWQ

SEQ ID NO: 3090515 - protein, 22 aa, Giardia lamblia
PDALFVPVRQLYSTHKVMSGIT

SEQ ID NO: 3090516 - protein, 27 aa, Giardia lamblia
PDCASFLNMILPLCINLPLGKRKYRES

SEQ ID NO: 3090517 - protein, 17 aa, Giardia lamblia
PDCITYVYDKRFFDLWQ

SEQ ID NO: 3090518 - protein, 18 aa, Giardia lamblia
PDDPNICITLQGYNTKCG

SEQ ID NO: 3090519 - protein, 23 aa, Giardia lamblia
PDDPVYRFDVRAAVLQLPDLSVS

SEQ ID NO: 3090520 - protein, 17 aa, Giardia lamblia
PDELLSTELARCLHSDA

SEQ ID NO: 3090521 - protein, 20 aa, Giardia lamblia
PDFFSKYMPCYTSQSVDGVS

SEQ ID NO: 3090522 - protein, 20 aa, Giardia lamblia
PDFKWIMNYDTLLFDHIFYT

SEQ ID NO: 3090523 - protein, 28 aa, Giardia lamblia
PDFVGESVLWSLIFTVISTLVMLVVGMY

SEQ ID NO: 3090524 - protein, 20 aa, Giardia lamblia
PDHQGLLYLQTRLSSPSIYF

SEQ ID NO: 3090525 - protein, 47 aa, Giardia lamblia
PDIEVLARYLECGAWLMLYVYKALFRITHIIYALLCVTKYGICISLS

SEQ ID NO: 3090526 - protein, 41 aa, Giardia lamblia
PDINLPFISPHYTHLIAFLPWLSARKLLRVYKRVFISRRHD

SEQ ID NO: 3090527 - protein, 26 aa, Giardia lamblia
PDLALPLAHLFLRYLKVYCSEEEKHT

SEQ ID NO: 3090528 - protein, 26 aa, Giardia lamblia
PDMYSTELKKFIEWCLIIRQDDRLSV

SEQ ID NO: 3090529 - protein, 23 aa, Giardia lamblia
PDQPLTHKLLLECTSMHRDFTDF

SEQ ID NO: 3090530 - protein, 19 aa, Giardia lamblia
PDSHMWYNYCGGVGDCVKK

SEQ ID NO: 3090531 - protein, 24 aa, Giardia lamblia
PDVSNRVFYLFGLSSLHHDNIKTG

SEQ ID NO: 3090532 - protein, 22 aa, Giardia lamblia
PECRFLLDPYIVKYARVLKYSD

SEQ ID NO: 3090533 - protein, 23 aa, Giardia lamblia
PECRFLLDPYIVKYARVLKYSDK

SEQ ID NO: 3090534 - protein, 27 aa, Giardia lamblia
PEDISKMVAFLLILGATFTLVAYILII

SEQ ID NO: 3090535 - protein, 18 aa, Giardia lamblia
PEDQKDLLKRLKIGYSKE

SEQ ID NO: 3090536 - protein, 30 aa, Giardia lamblia
PEDYMNAPNKLDYLRDLTIVQKILAVTWMV

SEQ ID NO: 3090537 - protein, 23 aa, Giardia lamblia
PEEAHFYFTILSIYIDEIDSILD

SEQ ID NO: 3090538 - protein, 31 aa, Giardia lamblia
PEEDILLLEALFRPFLESHLLDPTVITDCVL

SEQ ID NO: 3090539 - protein, 25 aa, Giardia lamblia
PEETYSYLMYLLGRIVDAHNQNTSK

SEQ ID NO: 3090540 - protein, 25 aa, Giardia lamblia
PEEYTILYTFPFTSTTKRMAIVLES

SEQ ID NO: 3090541 - protein, 17 aa, Giardia lamblia
PEGLFDWEDPHLINYQT

SEQ ID NO: 3090542 - protein, 24 aa, Giardia lamblia
PEIHKKLPYALDPDLFCPLQADFS

SEQ ID NO: 3090543 - protein, 20 aa, Giardia lamblia
PEKTIIIFSAGRLEYKNKGY

SEQ ID NO: 3090544 - protein, 28 aa, Giardia lamblia
PENGAFSIFFLIPFLHSVQSIMLMSLRA

SEQ ID NO: 3090545 - protein, 26 aa, Giardia lamblia
PENGGFSGFWLFFPTHAFQAMFLISL

SEQ ID NO: 3090546 - protein, 20 aa, Giardia lamblia
PENLFELLGLSLEYVDPVAY

SEQ ID NO: 3090547 - protein, 29 aa, Giardia lamblia
PEPADYFHSLLFYKLCEFFPETISSFIVS

SEQ ID NO: 3090548 - protein, 25 aa, Giardia lamblia
PESISPLVFIIKLLKTEPLEKLVQM

SEQ ID NO: 3090549 - protein, 34 aa, Giardia lamblia
PESRFISNFGVSPIRPFIIKNKASTRKFFGSDPY

SEQ ID NO: 3090550 - protein, 23 aa, Giardia lamblia
PEVRYYFSNYGYLGSYYGNTNAQ

SEQ ID NO: 3090551 - protein, 31 aa, Giardia lamblia
PEVSMLTPFFLCQFLMMCATTGTIYITRNEC

SEQ ID NO: 3090552 - protein, 23 aa, Giardia lamblia
PEYNYIPFCTKLVGMKLYGMLYD

SEQ ID NO: 3090553 - protein, 19 aa, Giardia lamblia
PFAVMSWSEYLIKIEQYSK

SEQ ID NO: 3090554 - protein, 17 aa, Giardia lamblia
PFCQCDPGFIGLQVEEH

SEQ ID NO: 3090555 - protein, 25 aa, Giardia lamblia
PFDTCYALCYFLKTFGFSRPSLYLA

SEQ ID NO: 3090556 - protein, 32 aa, Giardia lamblia
PFEEASIWIFLASMLDLFVLLHGSSNIESLSC

SEQ ID NO: 3090557 - protein, 17 aa, Giardia lamblia
PFGNVMPKFSYDPKLPF

SEQ ID NO: 3090558 - protein, 27 aa, Giardia lamblia
PFHDMALSVRILLIALLLAPEASGTVD

SEQ ID NO: 3090559 - protein, 27 aa, Giardia lamblia
PFHLRLNLRNMELVTIVLMLCDYSRAH

SEQ ID NO: 3090560 - protein, 37 aa, Giardia lamblia
PFLDMLAIHFASTLCFLWLYFTYCTLLLNVGEANINY

SEQ ID NO: 3090561 - protein, 26 aa, Giardia lamblia
PFLNAIYEITWLLSSLSYYSSTAERI

SEQ ID NO: 3090562 - protein, 44 aa, Giardia lamblia
PFNSRPFGRYFITPLFVIIGPFVAIFRLLSFLVLQTIVWICSIV

SEQ ID NO: 3090563 - protein, 29 aa, Giardia lamblia
PFSKFAAVAFLRLLTARLSKLLLEEAIPK

SEQ ID NO: 3090564 - protein, 19 aa, Giardia lamblia
PFVLKRLRVFLRDLQSHRN

SEQ ID NO: 3090565 - protein, 17 aa, Giardia lamblia
PFVVIVPMTIISARVAR

SEQ ID NO: 3090566 - protein, 18 aa, Giardia lamblia
PFYEVSIPNFHPYVQFFL

SEQ ID NO: 3090567 - protein, 30 aa, Giardia lamblia
PFYVPESLSPFYILFASSAAIFLACLVSLC

SEQ ID NO: 3090568 - protein, 19 aa, Giardia lamblia
PGELYLFVHAFKASHVLSA

SEQ ID NO: 3090569 - protein, 25 aa, Giardia lamblia
PGEPYMLSLTQFKKLWRGVIVSVVA

SEQ ID NO: 3090570 - protein, 33 aa, Giardia lamblia
PGEVSLLCMPLTYAQLYLNRLPRYMPDGQKFME

SEQ ID NO: 3090571 - protein, 23 aa, Giardia lamblia
PGEVTIFSLLTGRPSRIYDIARI

SEQ ID NO: 3090572 - protein, 22 aa, Giardia lamblia
PGIKFCRESPLPLILTLVLGEV

SEQ ID NO: 3090573 - protein, 26 aa, Giardia lamblia
PGISGYVLCWLIIAFARNGLQEMGEE

SEQ ID NO: 3090574 - protein, 23 aa, Giardia lamblia
PGKRIIRHFLQNYMEVFNDNGAN

SEQ ID NO: 3090575 - protein, 26 aa, Giardia lamblia
PGLGVFFVFFITLAFFPSITGKIPYV

SEQ ID NO: 3090576 - protein, 35 aa, Giardia lamblia
PGMPLCTILFVMGCLLPPVLWLVGPILSASPTVHP

SEQ ID NO: 3090577 - protein, 22 aa, Giardia lamblia
PGPRSILLKQLRRNSYSLYAKL

SEQ ID NO: 3090578 - protein, 29 aa, Giardia lamblia
PGQALSILPRFFGFYDYVYIKPDFTSVIS

SEQ ID NO: 3090579 - protein, 25 aa, Giardia lamblia
PGQHYVRQNFMCGLLQGKTAPLEIR

SEQ ID NO: 3090580 - protein, 18 aa, Giardia lamblia
PGSRLVIPLSLDQKPNIS

SEQ ID NO: 3090581 - protein, 20 aa, Giardia lamblia
PGTYHFCFEVILKEAPETNT

SEQ ID NO: 3090582 - protein, 20 aa, Giardia lamblia
PGVLLIAEIAWKLYEYRVET

SEQ ID NO: 3090583 - protein, 19 aa, Giardia lamblia
PGYTLKDSFACEADVARTA

SEQ ID NO: 3090584 - protein, 17 aa, Giardia lamblia
PHCLACHSTYFGINVMS

SEQ ID NO: 3090585 - protein, 18 aa, Giardia lamblia
PHDLLIHKIPHKVAWGIV

SEQ ID NO: 3090586 - protein, 23 aa, Giardia lamblia
PHHRSKYIIKFDSRWRRIAHMIK

SEQ ID NO: 3090587 - protein, 18 aa, Giardia lamblia
PHILSPLGFGLDSVAIID

SEQ ID NO: 3090588 - protein, 19 aa, Giardia lamblia
PHPIYLDMPYDLKTGAISL

SEQ ID NO: 3090589 - protein, 22 aa, Giardia lamblia
PIAFGILLYIFANTSWLRSVSV

SEQ ID NO: 3090590 - protein, 32 aa, Giardia lamblia
PIASALLPIMIKLLQFVRLSIPKTILIVAKNC

SEQ ID NO: 3090591 - protein, 18 aa, Giardia lamblia
PICCNNHWSIYMYIGKQS

SEQ ID NO: 3090592 - protein, 17 aa, Giardia lamblia
PICCQFFCDNLLCMMKL

SEQ ID NO: 3090593 - protein, 20 aa, Giardia lamblia
PICIFVTIELLNILNRLFVR

SEQ ID NO: 3090594 - protein, 22 aa, Giardia lamblia
PIDFFALKLERDLLPNTSPFIS

SEQ ID NO: 3090595 - protein, 23 aa, Giardia lamblia
PIDGICTTVAAAGRDASVCTAAD

SEQ ID NO: 3090596 - protein, 27 aa, Giardia lamblia
PIDKQAWVQYLLSWPGSRYKLKDANNA

SEQ ID NO: 3090597 - protein, 27 aa, Giardia lamblia
PIERNLLHKMFSSILPIIDVSKPNFVP

SEQ ID NO: 3090598 - protein, 25 aa, Giardia lamblia
PIFECYDYIILLGDLNYRIDKATKE

SEQ ID NO: 3090599 - protein, 21 aa, Giardia lamblia
PIFLAIQQDLAVRTPLFLAYT

SEQ ID NO: 3090600 - protein, 18 aa, Giardia lamblia
PILLEILVGHFTAILISV

SEQ ID NO: 3090601 - protein, 27 aa, Giardia lamblia
PIMTLTSVCMQLFPYKHFAFCTQSHND

SEQ ID NO: 3090602 - protein, 17 aa, Giardia lamblia
PIPKKYTMSLAAVSVVP

SEQ ID NO: 3090603 - protein, 17 aa, Giardia lamblia
PIQKKRWTHTGTALIQA

SEQ ID NO: 3090604 - protein, 19 aa, Giardia lamblia
PIRIGRMLGYFIKYSYSAY

SEQ ID NO: 3090605 - protein, 18 aa, Giardia lamblia
PISKLFNDPASFGSILGL

SEQ ID NO: 3090606 - protein, 24 aa, Giardia lamblia
PISSAILMCQFLCAVAARFAHNET

SEQ ID NO: 3090607 - protein, 28 aa, Giardia lamblia
PITALNMSLALLFYLTVLMWTEETATNQ

SEQ ID NO: 3090608 - protein, 29 aa, Giardia lamblia
PIVYPANPKDFRYISLLTYGRQTPIHVVY

SEQ ID NO: 3090609 - protein, 22 aa, Giardia lamblia
PIVYVRANPLPILSKLPPSVDF

SEQ ID NO: 3090610 - protein, 20 aa, Giardia lamblia
PIYYLEELGPWSPKIYLYGS

SEQ ID NO: 3090611 - protein, 23 aa, Giardia lamblia
PKEYLFGPVMPRKSYIQADSQNR

SEQ ID NO: 3090612 - protein, 19 aa, Giardia lamblia
PKIPSIFYSIFSLQENLNT

SEQ ID NO: 3090613 - protein, 24 aa, Giardia lamblia
PKKQTLCRAPFLEQAYSSRAVLSM

SEQ ID NO: 3090614 - protein, 36 aa, Giardia lamblia
PKLIQEIIILLQYIKFGFKFLFVTSDLARIIIPACE

SEQ ID NO: 3090615 - protein, 29 aa, Giardia lamblia
PKNQRIIHQLLLLGASLFFYQQKAVSAVE

SEQ ID NO: 3090616 - protein, 23 aa, Giardia lamblia
PKPKFQHIWISPWLDGQHGSMDT

SEQ ID NO: 3090617 - protein, 23 aa, Giardia lamblia
PKSSFRLFISSMPVKHFPASVLQ

SEQ ID NO: 3090618 - protein, 17 aa, Giardia lamblia
PKVFQPITARVFAARGI

SEQ ID NO: 3090619 - protein, 38 aa, Giardia lamblia
PKVKLVLSHLIYYTAWSFVPILIAMLIVSANFPELLWE

SEQ ID NO: 3090620 - protein, 23 aa, Giardia lamblia
PKVSSFIVSLFTLSKHPISMTLS

SEQ ID NO: 3090621 - protein, 21 aa, Giardia lamblia
PKYVKFVWRLRGIDFATQMFV

SEQ ID NO: 3090622 - protein, 29 aa, Giardia lamblia
PLADIAYGFTFILIHLLRSIAEPYPQLSA

SEQ ID NO: 3090623 - protein, 18 aa, Giardia lamblia
PLAIGDKVTMVFYKQELT

SEQ ID NO: 3090624 - protein, 21 aa, Giardia lamblia
PLAMQFLSLGLILETYTAVIK

SEQ ID NO: 3090625 - protein, 21 aa, Giardia lamblia
PLASFLVASIIILVFTKDAEG

SEQ ID NO: 3090626 - protein, 25 aa, Giardia lamblia
PLCTHNLLLPLVMKNKLVDARPVLA

SEQ ID NO: 3090627 - protein, 19 aa, Giardia lamblia
PLDGRCISAFSAASALAGC

SEQ ID NO: 3090628 - protein, 24 aa, Giardia lamblia
PLDHLHLINIFRSDNLTLIHPDVT

SEQ ID NO: 3090629 - protein, 18 aa, Giardia lamblia
PLEAEKLAWIWTVALTRE

SEQ ID NO: 3090630 - protein, 19 aa, Giardia lamblia
PLEKKILYCFDSEIVRLLA

SEQ ID NO: 3090631 - protein, 18 aa, Giardia lamblia
PLELLRSLVRLSLHVQLG

SEQ ID NO: 3090632 - protein, 17 aa, Giardia lamblia
PLFINMIVSHLPRVSNQ

SEQ ID NO: 3090633 - protein, 26 aa, Giardia lamblia
PLGALYTLLVWGPIKWLSDTIACTLD

SEQ ID NO: 3090634 - protein, 25 aa, Giardia lamblia
PLGIGAGCYLLFQLGSLFARKRRIQ

SEQ ID NO: 3090635 - protein, 19 aa, Giardia lamblia
PLHGGLGFSFRRLFPLNGK

SEQ ID NO: 3090636 - protein, 18 aa, Giardia lamblia
PLHMLKQESNLMDDLRKT

SEQ ID NO: 3090637 - protein, 19 aa, Giardia lamblia
PLHVFLHSVTQDKILTSSP

SEQ ID NO: 3090638 - protein, 24 aa, Giardia lamblia
PLKFHPELPHILFSGSWDTTIRAW

SEQ ID NO: 3090639 - protein, 19 aa, Giardia lamblia
PLLLSLKTADGAFNYKCLF

SEQ ID NO: 3090640 - protein, 22 aa, Giardia lamblia
PLMQHRLSIPILALPPTATITT

SEQ ID NO: 3090641 - protein, 20 aa, Giardia lamblia
PLMSLFGFLFFMTSSSFDVA

SEQ ID NO: 3090642 - protein, 27 aa, Giardia lamblia
PLNGRILLKVFLIGMLHWFLESIDDVL

SEQ ID NO: 3090643 - protein, 25 aa, Giardia lamblia
PLNRPYCVLLFLSLMGSGDVSSAFS

SEQ ID NO: 3090644 - protein, 22 aa, Giardia lamblia
PLQFVRVRCPPLPGIYAYFRNE

SEQ ID NO: 3090645 - protein, 18 aa, Giardia lamblia
PLQTIISYIIQYSSLHAQ

SEQ ID NO: 3090646 - protein, 17 aa, Giardia lamblia
PLQVGLAFTYYLPLCFI

SEQ ID NO: 3090647 - protein, 20 aa, Giardia lamblia
PLRFHRISLVLAHILYTALS

SEQ ID NO: 3090648 - protein, 25 aa, Giardia lamblia
PLRHVTFELTPLPYPSDFLADITDA

SEQ ID NO: 3090649 - protein, 17 aa, Giardia lamblia
PLSDILSFTPNFLSDVQ

SEQ ID NO: 3090650 - protein, 19 aa, Giardia lamblia
PLSFITKLFMQLIVALSFS

SEQ ID NO: 3090651 - protein, 21 aa, Giardia lamblia
PLSIIVYIFVSWKFFSDRIRY

SEQ ID NO: 3090652 - protein, 28 aa, Giardia lamblia
PLSLCARLKGLLFYNSNSAFPHIIQAAS

SEQ ID NO: 3090653 - protein, 18 aa, Giardia lamblia
PLSLWDAVYTTENSSLFL

SEQ ID NO: 3090654 - protein, 22 aa, Giardia lamblia
PLSSTMLTLLSPAFVFSERSGK

SEQ ID NO: 3090655 - protein, 23 aa, Giardia lamblia
PLSVILLCYGILFFIVRSRDKSV

SEQ ID NO: 3090656 - protein, 26 aa, Giardia lamblia
PLSVRNYLFSPYLFVHTSKVAFKVTD

SEQ ID NO: 3090657 - protein, 25 aa, Giardia lamblia
PLTALQMLYVNLLMDSLGALALATE

SEQ ID NO: 3090658 - protein, 30 aa, Giardia lamblia
PLTASQFEYLCLLLRYFFNSKGAIPPEVYQ

SEQ ID NO: 3090659 - protein, 17 aa, Giardia lamblia
PLTTFNKVNAPCFNTAD

SEQ ID NO: 3090660 - protein, 25 aa, Giardia lamblia
PLVLVFGFLFTLELLHLEPRVAYTS

SEQ ID NO: 3090661 - protein, 18 aa, Giardia lamblia
PLVPLNPISYPHFTLVFS

SEQ ID NO: 3090662 - protein, 21 aa, Giardia lamblia
PLVQEFYTWLIIQSITDECLD

SEQ ID NO: 3090663 - protein, 17 aa, Giardia lamblia
PLVYNYAYRVFGLGLLK

SEQ ID NO: 3090664 - protein, 22 aa, Giardia lamblia
PMFIPRIHVFARMTPEQKADII

SEQ ID NO: 3090665 - protein, 21 aa, Giardia lamblia
PMFNFIFLLICLVTYVPLYLL

SEQ ID NO: 3090666 - protein, 21 aa, Giardia lamblia
PMKGRVHRFLRLCINISSATS

SEQ ID NO: 3090667 - protein, 27 aa, Giardia lamblia
PMNNTKEFLLLLLKRNFQHPSLSNLDS

SEQ ID NO: 3090668 - protein, 25 aa, Giardia lamblia
PMNVGIFCHIWFIVTTIIMPFIQHN

SEQ ID NO: 3090669 - protein, 40 aa, Giardia lamblia
PMQLGCPGYILVRPGYYRWCQIYHVDFLYRRAVLLMKREV

SEQ ID NO: 3090670 - protein, 26 aa, Giardia lamblia
PMQSAINLIKLLDGSPTQLCVFIAWN

SEQ ID NO: 3090671 - protein, 20 aa, Giardia lamblia
PMTMPFYRAYKAKQGSFFVV

SEQ ID NO: 3090672 - protein, 23 aa, Giardia lamblia
PMTPAWVDAMISRFAFEYPAAGV

SEQ ID NO: 3090673 - protein, 37 aa, Giardia lamblia
PMVGLWKFLYFGWLAFNWAVIFLYKQLLKSGHWNFWG

SEQ ID NO: 3090674 - protein, 23 aa, Giardia lamblia
PNACDYYLFFSISNTTRPIKGHT

SEQ ID NO: 3090675 - protein, 33 aa, Giardia lamblia
PNDATFFGHTFSPGRRYAYRRSLESVNICIECA

SEQ ID NO: 3090676 - protein, 17 aa, Giardia lamblia
PNDDYVLYSFMGSTLRA

SEQ ID NO: 3090677 - protein, 21 aa, Giardia lamblia
PNGLLLQQYLDPSVWQVYSSA

SEQ ID NO: 3090678 - protein, 27 aa, Giardia lamblia
PNKLVIQQTFLICLFVADIVSAAVSIL

SEQ ID NO: 3090679 - protein, 26 aa, Giardia lamblia
PNMASLIWVIIINLNKYRLNSVFVSA

SEQ ID NO: 3090680 - protein, 25 aa, Giardia lamblia
PNMDLRINPLIPSIVRWTSGVPYVP

SEQ ID NO: 3090681 - protein, 27 aa, Giardia lamblia
PNMSIANLFFYHCPVDAQYYIVLVSKA

SEQ ID NO: 3090682 - protein, 38 aa, Giardia lamblia
PNNFAKTDIFWLLLPSFMVPILLTLIFVMIAEADTSLK

SEQ ID NO: 3090683 - protein, 17 aa, Giardia lamblia
PNPLLIAFPAHTIPWQA

SEQ ID NO: 3090684 - protein, 27 aa, Giardia lamblia
PNSGPLMLLAIYVLRRLGPYSLLLHFL

SEQ ID NO: 3090685 - protein, 23 aa, Giardia lamblia
PNTCVFFIFVLFTGLTMASTFTN

SEQ ID NO: 3090686 - protein, 20 aa, Giardia lamblia
PNTEVQGLLAFFARLMVSGG

SEQ ID NO: 3090687 - protein, 26 aa, Giardia lamblia
PNTITLALLYFKLLAQTDVYSNIFYT

SEQ ID NO: 3090688 - protein, 31 aa, Giardia lamblia
PNTRQYFYELRIMQFLILQLSVDNIDQNSGW

SEQ ID NO: 3090689 - protein, 18 aa, Giardia lamblia
PNWELRVLKAVFKRSFCN

SEQ ID NO: 3090690 - protein, 38 aa, Giardia lamblia
PNYLRLTSWKECFQKPIPFTPYLPSHLEMIPLTSSLNL

SEQ ID NO: 3090691 - protein, 24 aa, Giardia lamblia
PPATNIIDGFLWIGSVSVLRHAEH

SEQ ID NO: 3090692 - protein, 17 aa, Giardia lamblia
PPEGPLLQFVGGTFEAL

SEQ ID NO: 3090693 - protein, 25 aa, Giardia lamblia
PPEINLVLFGRLISGYKLSINFIPT

SEQ ID NO: 3090694 - protein, 25 aa, Giardia lamblia
PPGAHMRLLLQLFGQAMHTYISSAE

SEQ ID NO: 3090695 - protein, 17 aa, Giardia lamblia
PPHIARQFLGITDLSWI

SEQ ID NO: 3090696 - protein, 20 aa, Giardia lamblia
PPHILYLLQCRTEDPNFKAS

SEQ ID NO: 3090697 - protein, 34 aa, Giardia lamblia
PPKSFCRLFFETFKDVTIIILLIASIVSIIVGSI

SEQ ID NO: 3090698 - protein, 21 aa, Giardia lamblia
PPKSSLLKAFTKSPTLLNFEK

SEQ ID NO: 3090699 - protein, 18 aa, Giardia lamblia
PPLGLLRSLGLPEAFPVL

SEQ ID NO: 3090700 - protein, 19 aa, Giardia lamblia
PPLLLSRAVGCYIKSRQYG

SEQ ID NO: 3090701 - protein, 26 aa, Giardia lamblia
PPMTYTVPFALMFSYAFSSLQYIRAS

SEQ ID NO: 3090702 - protein, 24 aa, Giardia lamblia
PPNDTICIACLKDLRLINGACVDS

SEQ ID NO: 3090703 - protein, 24 aa, Giardia lamblia
PPPIFEALLKHALLQDKPIVFLNF

SEQ ID NO: 3090704 - protein, 26 aa, Giardia lamblia
PPPPLNLDGLSPWQWSKFSTISSELV

SEQ ID NO: 3090705 - protein, 40 aa, Giardia lamblia
PPPPTNWASVIFSLVMIAAVIFLWVYGIKNASYMAKLDEY

SEQ ID NO: 3090706 - protein, 34 aa, Giardia lamblia
PPPRIVIDWRPLMKLFIRQVFIGTSILLTDNYDT

SEQ ID NO: 3090707 - protein, 32 aa, Giardia lamblia
PPQFEQQYIPYCKVFFIFSQICSPRVTIEKGN

SEQ ID NO: 3090708 - protein, 24 aa, Giardia lamblia
PPSDYLYQGLPVCAYVNVKQGEGG

SEQ ID NO: 3090709 - protein, 48 aa, Giardia lamblia
PPSKSALNTYLYIEFCRLLQRQMTFLLFLLLGGIYKKAVLQSVIPSSV

SEQ ID NO: 3090710 - protein, 25 aa, Giardia lamblia
PPSNYLFRAITAITGTPLLGIYKNR

SEQ ID NO: 3090711 - protein, 30 aa, Giardia lamblia
PPTIQPLFTPLCVALLLLAIGRLEDGIFLL

SEQ ID NO: 3090712 - protein, 31 aa, Giardia lamblia
PPTNPPSPTPPPYIPPFLPTDDLLYDNSTDV

SEQ ID NO: 3090713 - protein, 21 aa, Giardia lamblia
PPVAPALPSFPPLKTSQASSR

SEQ ID NO: 3090714 - protein, 19 aa, Giardia lamblia
PQDDLLYPGLTIMDHLRLF

SEQ ID NO: 3090715 - protein, 23 aa, Giardia lamblia
PQEIICFILSFYRRSQLSVRQLG

SEQ ID NO: 3090716 - protein, 25 aa, Giardia lamblia
PQKIKKYLRYNLTTATPNRIQRQLL

SEQ ID NO: 3090717 - protein, 18 aa, Giardia lamblia
PQKMRPTHTLLPTGKLSI

SEQ ID NO: 3090718 - protein, 20 aa, Giardia lamblia
PQLKKVVSQLLPALGSFVAQ

SEQ ID NO: 3090719 - protein, 18 aa, Giardia lamblia
PQLYLICGAYRTVIELCF

SEQ ID NO: 3090720 - protein, 17 aa, Giardia lamblia
PQPSRLLFAKELYRYLS

SEQ ID NO: 3090721 - protein, 25 aa, Giardia lamblia
PQQAIPWFYNLLLTKQPRVSHTQLQ

SEQ ID NO: 3090722 - protein, 25 aa, Giardia lamblia
PQQCSGCFPGYYKSGDKCVKCDASA

SEQ ID NO: 3090723 - protein, 17 aa, Giardia lamblia
PQRFLSVLLKRQSDQQQ

SEQ ID NO: 3090724 - protein, 18 aa, Giardia lamblia
PQRRLSRGILDRVNLLLI

SEQ ID NO: 3090725 - protein, 24 aa, Giardia lamblia
PQSTCRIIRTVYINFLRAICKKAL

SEQ ID NO: 3090726 - protein, 26 aa, Giardia lamblia
PQTIRKLHFLLIFSPIAVFETVPYTE

SEQ ID NO: 3090727 - protein, 22 aa, Giardia lamblia
PRACFPQYNPRASLCGGNGLCD

SEQ ID NO: 3090728 - protein, 20 aa, Giardia lamblia
PRCIKCRFGYGLIEKTAAVS

SEQ ID NO: 3090729 - protein, 18 aa, Giardia lamblia
PRCKIMAQLYGAILTDFL

SEQ ID NO: 3090730 - protein, 24 aa, Giardia lamblia
PREKPRVLKLLLQRGYSLSVSGDD

SEQ ID NO: 3090731 - protein, 17 aa, Giardia lamblia
PRFHYPKVFQPITARVF

SEQ ID NO: 3090732 - protein, 30 aa, Giardia lamblia
PRGHKLAPLPLLSRLVQYPTYRDGSPIYPA

SEQ ID NO: 3090733 - protein, 21 aa, Giardia lamblia
PRHFKMLTREYLRSPNLLLEY

SEQ ID NO: 3090734 - protein, 31 aa, Giardia lamblia
PRIQKTVSYLFWRYYLRTQMQLLNITPSSPC

SEQ ID NO: 3090735 - protein, 19 aa, Giardia lamblia
PRKCIYVHSTLAEPKVCGG

SEQ ID NO: 3090736 - protein, 36 aa, Giardia lamblia
PRLVITPLTDLCYLTLMIAHRFYLGGAPQGPAGTGK

SEQ ID NO: 3090737 - protein, 24 aa, Giardia lamblia
PRQLYRLDFPISSFLSIASLSIEG

SEQ ID NO: 3090738 - protein, 38 aa, Giardia lamblia
PRTGWRKVMLYLLPILIPWNMLVLVLSSLLNIPPLPIG

SEQ ID NO: 3090739 - protein, 30 aa, Giardia lamblia
PRTVDFLLDPLILPMLRRRTLKSPHIYVEK

SEQ ID NO: 3090740 - protein, 24 aa, Giardia lamblia
PRVLNFLNVKLPLHMAYSVIFVSV

SEQ ID NO: 3090741 - protein, 24 aa, Giardia lamblia
PSCSNLLGDIFLLSVNIVLVMQNY

SEQ ID NO: 3090742 - protein, 23 aa, Giardia lamblia
PSDFDFELCLLDPLAGAAVRLLR

SEQ ID NO: 3090743 - protein, 22 aa, Giardia lamblia
PSFRATHPWFYAAATNDVQYVQ

SEQ ID NO: 3090744 - protein, 27 aa, Giardia lamblia
PSGITYFSLLSYILGLLRLGHESLAYD

SEQ ID NO: 3090745 - protein, 22 aa, Giardia lamblia
PSGTVCYPLGCLTLGTVCNGNG

SEQ ID NO: 3090746 - protein, 23 aa, Giardia lamblia
PSGTVCYPLGCLTLGTVCNGNGR

SEQ ID NO: 3090747 - protein, 22 aa, Giardia lamblia
PSHLFQLKYKYTRPPDTPLYAP

SEQ ID NO: 3090748 - protein, 27 aa, Giardia lamblia
PSHQKEMPVYYRKAPLLPSIIKYINPD

SEQ ID NO: 3090749 - protein, 19 aa, Giardia lamblia
PSHTEGFLPRVRLSMLTVG

SEQ ID NO: 3090750 - protein, 19 aa, Giardia lamblia
PSIISWMDSLSALELIYIK

SEQ ID NO: 3090751 - protein, 33 aa, Giardia lamblia
PSIKFLYVCSGLSILYYRIPFVRDLVSRAVVSM

SEQ ID NO: 3090752 - protein, 19 aa, Giardia lamblia
PSIRTWRKKWKSQLDRIDR

SEQ ID NO: 3090753 - protein, 26 aa, Giardia lamblia
PSIVFESLLVLTYFVLREPTNVRKFD

SEQ ID NO: 3090754 - protein, 26 aa, Giardia lamblia
PSLGDTILSFNFFSSVILLLDIISMT

SEQ ID NO: 3090755 - protein, 17 aa, Giardia lamblia
PSLMKYFTDSGIRLPLE

SEQ ID NO: 3090756 - protein, 37 aa, Giardia lamblia
PSLPRKICLLIDTALLILMTMRSSYLYLIHQLIKDEQ

SEQ ID NO: 3090757 - protein, 21 aa, Giardia lamblia
PSLSFMPRLTAQLLRAFDAAE

SEQ ID NO: 3090758 - protein, 17 aa, Giardia lamblia
PSLTLYPIDGFTPIEVS

SEQ ID NO: 3090759 - protein, 22 aa, Giardia lamblia
PSLTSLLTLMLAIPQVTVSIKQ

SEQ ID NO: 3090760 - protein, 24 aa, Giardia lamblia
PSMASSLYHIGLFNGAKTSDSSTS

SEQ ID NO: 3090761 - protein, 22 aa, Giardia lamblia
PSMKFPHVFNFRSVLDPTYLNT

SEQ ID NO: 3090762 - protein, 26 aa, Giardia lamblia
PSNFQDLLKRPGRLLTFLAIDPSEHE

SEQ ID NO: 3090763 - protein, 21 aa, Giardia lamblia
PSPLPIRPSSTAVLAITNSGT

SEQ ID NO: 3090764 - protein, 29 aa, Giardia lamblia
PSQNVRVRMLLVSCLFLLSALCIFEGYQQ

SEQ ID NO: 3090765 - protein, 21 aa, Giardia lamblia
PSQPPPLPPPPRSAGPPAPAP

SEQ ID NO: 3090766 - protein, 20 aa, Giardia lamblia
PSRLLFAKELYRYLSIKQSG

SEQ ID NO: 3090767 - protein, 21 aa, Giardia lamblia
PSRLLLYPLLAYCLSGVVVTV

SEQ ID NO: 3090768 - protein, 17 aa, Giardia lamblia
PSRLRVIDLKRAITEFG

SEQ ID NO: 3090769 - protein, 19 aa, Giardia lamblia
PSRMLVLYDGPEIASKDLQ

SEQ ID NO: 3090770 - protein, 17 aa, Giardia lamblia
PSRQIHLKLTIPNTGLL

SEQ ID NO: 3090771 - protein, 44 aa, Giardia lamblia
PSSGIQPVYTGYPLVLCFLSANYVVALLSFYEYIVSHDGSYAVS

SEQ ID NO: 3090772 - protein, 24 aa, Giardia lamblia
PSSLHFMIYAAFPITLYLVHSSIP

SEQ ID NO: 3090773 - protein, 17 aa, Giardia lamblia
PSSNWYMDEGRLPFLSP

SEQ ID NO: 3090774 - protein, 25 aa, Giardia lamblia
PSSTVGPWMLPFSKTRSLVLTYTER

SEQ ID NO: 3090775 - protein, 23 aa, Giardia lamblia
PSSVLSYIKAFLAQLLEHYKSAD

SEQ ID NO: 3090776 - protein, 39 aa, Giardia lamblia
PSSYRGFPLSANFKDLLYKLLQPFPFKRITWNELASHPF

SEQ ID NO: 3090777 - protein, 26 aa, Giardia lamblia
PSTKLEKLFTLPYVSGIRTPISVVIS

SEQ ID NO: 3090778 - protein, 27 aa, Giardia lamblia
PSTSDVILLLKLWPLSRYMGYQTNSSS

SEQ ID NO: 3090779 - protein, 19 aa, Giardia lamblia
PSTSLLLRKSHNVLLNMHR

SEQ ID NO: 3090780 - protein, 24 aa, Giardia lamblia
PSTTTFKVKLWYTAGSGIESASVS

SEQ ID NO: 3090781 - protein, 19 aa, Giardia lamblia
PSVLPLLVKLCRTNPDIND

SEQ ID NO: 3090782 - protein, 25 aa, Giardia lamblia
PSYTNFVKFQFFLSKQYFAHWQQLH

SEQ ID NO: 3090783 - protein, 17 aa, Giardia lamblia
PTAALAGGLILGFVGFC

SEQ ID NO: 3090784 - protein, 27 aa, Giardia lamblia
PTAAVYVLLALFYSCTLLESAYSSGAA

SEQ ID NO: 3090785 - protein, 24 aa, Giardia lamblia
PTASRVDYFLYNAFLNVVTDTIVS

SEQ ID NO: 3090786 - protein, 30 aa, Giardia lamblia
PTCQRPYMLAQLYFKLLQTAVESSRRSYYK

SEQ ID NO: 3090787 - protein, 36 aa, Giardia lamblia
PTCTFTVAMDYDIGWTVWPLALTVTVGILVTVAISV

SEQ ID NO: 3090788 - protein, 24 aa, Giardia lamblia
PTDLRKFISFHYKSFLKLYNDCEV

SEQ ID NO: 3090789 - protein, 23 aa, Giardia lamblia
PTDQFTLTYLRGNALKSLLEAYM

SEQ ID NO: 3090790 - protein, 17 aa, Giardia lamblia
PTELKFLGYLVSFVYGL

SEQ ID NO: 3090791 - protein, 28 aa, Giardia lamblia
PTERPIVGLGGILWAWAYRVLRAAFQFS

SEQ ID NO: 3090792 - protein, 24 aa, Giardia lamblia
PTGFYIIDINYFSGPKKADWLNLK

SEQ ID NO: 3090793 - protein, 29 aa, Giardia lamblia
PTGRRIFPGKTLWKFNFAGTLQSSMVLST

SEQ ID NO: 3090794 - protein, 26 aa, Giardia lamblia
PTIAGQLVFIYLFNSALGSNSSLKKN

SEQ ID NO: 3090795 - protein, 41 aa, Giardia lamblia
PTIWTQLVVPTWLTKVFYVLFPPLGLVAICDMLVALRPERT

SEQ ID NO: 3090796 - protein, 22 aa, Giardia lamblia
PTLVQHLIRLIETLRAPLNFET

SEQ ID NO: 3090797 - protein, 26 aa, Giardia lamblia
PTNDRAFFRRGFSLRALGMIDEAALD

SEQ ID NO: 3090798 - protein, 17 aa, Giardia lamblia
PTNPLDLNKYPASFVVV

SEQ ID NO: 3090799 - protein, 23 aa, Giardia lamblia
PTPALLTAFFNILHINLGEALAI

SEQ ID NO: 3090800 - protein, 31 aa, Giardia lamblia
PTPIENLGLYSPLLVSYILAILPEAFRTRRL

SEQ ID NO: 3090801 - protein, 17 aa, Giardia lamblia
PTQQMVLPAMKIKRLKD

SEQ ID NO: 3090802 - protein, 21 aa, Giardia lamblia
PTSFCVHLPSLLFASNKALLA

SEQ ID NO: 3090803 - protein, 24 aa, Giardia lamblia
PTSFHPSHWPEFLAELRFVCGTQA

SEQ ID NO: 3090804 - protein, 26 aa, Giardia lamblia
PTSRKSVLYVLYTLAEFFAIENVDLY

SEQ ID NO: 3090805 - protein, 17 aa, Giardia lamblia
PTTLYWIPHNPVSSQPQ

SEQ ID NO: 3090806 - protein, 24 aa, Giardia lamblia
PTTVCFLLNILIWDEAVEARVMVS

SEQ ID NO: 3090807 - protein, 20 aa, Giardia lamblia
PVACTTPGQHYVRQNFMCGL

SEQ ID NO: 3090808 - protein, 34 aa, Giardia lamblia
PVADIRSILPFLFLNHPPTFLIDMIELSLSLTYR

SEQ ID NO: 3090809 - protein, 18 aa, Giardia lamblia
PVAIVVLAGLIIGLSFVI

SEQ ID NO: 3090810 - protein, 24 aa, Giardia lamblia
PVDGKLSYTCMCGFGYSLVNKTCV

SEQ ID NO: 3090811 - protein, 29 aa, Giardia lamblia
PVEAFSNLITIYIQYGLFDLAADLIAGNR

SEQ ID NO: 3090812 - protein, 25 aa, Giardia lamblia
PVEDFVAWPALSFPGPEYLACQTRV

SEQ ID NO: 3090813 - protein, 17 aa, Giardia lamblia
PVFDSSPDLLYFVTATN

SEQ ID NO: 3090814 - protein, 30 aa, Giardia lamblia
PVFNGDLISPILYLVMSRLVSLLYDGEEEI

SEQ ID NO: 3090815 - protein, 17 aa, Giardia lamblia
PVFPLEKKDFTLLSDIS

SEQ ID NO: 3090816 - protein, 18 aa, Giardia lamblia
PVHLLHSSVSRLLRISSM

SEQ ID NO: 3090817 - protein, 43 aa, Giardia lamblia
PVIITNGYLLLPHLFLCVFIKLFEILHYPYYYGHSEILMSVLL

SEQ ID NO: 3090818 - protein, 21 aa, Giardia lamblia
PVINWNPLLSDTYRDTLQAIE

SEQ ID NO: 3090819 - protein, 26 aa, Giardia lamblia
PVISHVISVLFACIFSGPVYTETLTH

SEQ ID NO: 3090820 - protein, 22 aa, Giardia lamblia
PVITTPYLLHIIHCLMAFTDVS

SEQ ID NO: 3090821 - protein, 18 aa, Giardia lamblia
PVIVGYNKFLQRVAPRNY

SEQ ID NO: 3090822 - protein, 27 aa, Giardia lamblia
PVKGPCLAFLVKFMEEILGFKTVPADL

SEQ ID NO: 3090823 - protein, 18 aa, Giardia lamblia
PVLAFLAVAFEMSILVFA

SEQ ID NO: 3090824 - protein, 24 aa, Giardia lamblia
PVNYLYLIIMRFLVGVPSTSFLIV

SEQ ID NO: 3090825 - protein, 29 aa, Giardia lamblia
PVPVSTLWLVTLQPLLLLLSALRHRHYKS

SEQ ID NO: 3090826 - protein, 19 aa, Giardia lamblia
PVQLPVLSNLGGAKLLLTH

SEQ ID NO: 3090827 - protein, 21 aa, Giardia lamblia
PVRPKHGLIILIPTSYSAPAL

SEQ ID NO: 3090828 - protein, 25 aa, Giardia lamblia
PVTKLKHHQILLRAGLDEDARLIDD

SEQ ID NO: 3090829 - protein, 24 aa, Giardia lamblia
PVTKRYTLFYLSGTQTAWRSAPQT

SEQ ID NO: 3090830 - protein, 17 aa, Giardia lamblia
PVTLKTYFEDRTLFPDL

SEQ ID NO: 3090831 - protein, 19 aa, Giardia lamblia
PVTWIITYLRNIARTLAFE

SEQ ID NO: 3090832 - protein, 21 aa, Giardia lamblia
PVYKCLCRGDFQFVLGHGCVH

SEQ ID NO: 3090833 - protein, 19 aa, Giardia lamblia
PWFIDVFIRPLEEFARRGD

SEQ ID NO: 3090834 - protein, 23 aa, Giardia lamblia
PWGGCLVFYYFMYELWTTIQQQK

SEQ ID NO: 3090835 - protein, 19 aa, Giardia lamblia
PWQRLLSHPSLLSSLVIIV

SEQ ID NO: 3090836 - protein, 27 aa, Giardia lamblia
PWQSFQYYLTYFLYTKGIYLDETNLIP

SEQ ID NO: 3090837 - protein, 23 aa, Giardia lamblia
PYEADAFHHLVLNRNWCSPEVEH

SEQ ID NO: 3090838 - protein, 20 aa, Giardia lamblia
PYFISGLAPLLHPGTTITTC

SEQ ID NO: 3090839 - protein, 20 aa, Giardia lamblia
PYGEPLTFYSLLELFGFGVM

SEQ ID NO: 3090840 - protein, 17 aa, Giardia lamblia
PYGFARDKYILYVDNCE

SEQ ID NO: 3090841 - protein, 19 aa, Giardia lamblia
PYGVFDFPGLLPTLSTEQG

SEQ ID NO: 3090842 - protein, 41 aa, Giardia lamblia
PYIAPSGCFPPRGFDFPLLSLSFPLRYALDQFHLNSAGFRA

SEQ ID NO: 3090843 - protein, 18 aa, Giardia lamblia
PYIRAFHSLALLGSATAI

SEQ ID NO: 3090844 - protein, 34 aa, Giardia lamblia
PYISTVELFVRALLPFGLFLFCVHVTLRLRTYTS

SEQ ID NO: 3090845 - protein, 29 aa, Giardia lamblia
PYLATGVLFFVVWVLVAALFKVLSAFHTL

SEQ ID NO: 3090846 - protein, 26 aa, Giardia lamblia
PYNNELELLSFLRTLWGRITAYPPNS

SEQ ID NO: 3090847 - protein, 26 aa, Giardia lamblia
PYRNELSYFVRGLPLRITIHAIRKLM

SEQ ID NO: 3090848 - protein, 33 aa, Giardia lamblia
PYRQILLASLPIMGSLFLVSFYTIVDTIIISRH

SEQ ID NO: 3090849 - protein, 31 aa, Giardia lamblia
PYSLRDREFCRLWSIFDWEYKVAVSTLAPPE

SEQ ID NO: 3090850 - protein, 27 aa, Giardia lamblia
PYTPFVCDWMYLQLRPVMNLPGVFDKV

SEQ ID NO: 3090851 - protein, 20 aa, Giardia lamblia
PYVIKAGVSFLIILPLSLLK

SEQ ID NO: 3090852 - protein, 21 aa, Giardia lamblia
PYVMRDVIYPELLLDEPPGAA

SEQ ID NO: 3090853 - protein, 28 aa, Giardia lamblia
QADLPRRGHFIITIPQVCYIFDGMSLPG

SEQ ID NO: 3090854 - protein, 31 aa, Giardia lamblia
QADMYSLGITLLELWFLPTASDNLSNLRVLV

SEQ ID NO: 3090855 - protein, 23 aa, Giardia lamblia
QAEGLLFTTYIAKNMYHVVFYYL

SEQ ID NO: 3090856 - protein, 24 aa, Giardia lamblia
QAEYDSISLLTHRKGRDSRSAGST

SEQ ID NO: 3090857 - protein, 19 aa, Giardia lamblia
QAFHILKLQPQSATNGATF

SEQ ID NO: 3090858 - protein, 20 aa, Giardia lamblia
QAFLVLYNVFVDVIAEDVDR

SEQ ID NO: 3090859 - protein, 30 aa, Giardia lamblia
QAHHTCHTLNLPFLLYGRGHMNIYIRQCFV

SEQ ID NO: 3090860 - protein, 21 aa, Giardia lamblia
QAISMLLYKKLIRIPNVAATH

SEQ ID NO: 3090861 - protein, 29 aa, Giardia lamblia
QAKSPRTDLYWLIVQWYILTEKVSQEQFE

SEQ ID NO: 3090862 - protein, 27 aa, Giardia lamblia
QALERVYMPVPFYVATMPKPLNLKFCH

SEQ ID NO: 3090863 - protein, 24 aa, Giardia lamblia
QALKYISYWPVIAIFMASCLVLLA

SEQ ID NO: 3090864 - protein, 23 aa, Giardia lamblia
QARGVFLRPMSVPLINAAKDLKG

SEQ ID NO: 3090865 - protein, 22 aa, Giardia lamblia
QASFLVMGFVLSLALHISLTKG

SEQ ID NO: 3090866 - protein, 24 aa, Giardia lamblia
QASTLPLITKMRAFKKLFTRELYE

SEQ ID NO: 3090867 - protein, 23 aa, Giardia lamblia
QATEYLVTFISLLSSATLLHGDT

SEQ ID NO: 3090868 - protein, 24 aa, Giardia lamblia
QATLHEPLIVLRGMLQDLHTAIVP

SEQ ID NO: 3090869 - protein, 24 aa, Giardia lamblia
QAVPSYELLPFRIAIADFGESMVF

SEQ ID NO: 3090870 - protein, 31 aa, Giardia lamblia
QAVRVLQYHMLAYSLLSFLRLLADAERIFKL

SEQ ID NO: 3090871 - protein, 23 aa, Giardia lamblia
QAYAALFGYFYSLSADYQQVLSL

SEQ ID NO: 3090872 - protein, 26 aa, Giardia lamblia
QCAEKKFVYHYGGCYHRYSTLARSIC

SEQ ID NO: 3090873 - protein, 27 aa, Giardia lamblia
QCANGDLTCKLLLSNAFRLTNLDSMIL

SEQ ID NO: 3090874 - protein, 17 aa, Giardia lamblia
QCAPQECVFPRSANGHD

SEQ ID NO: 3090875 - protein, 33 aa, Giardia lamblia
QCAYGYRGLLNGCYPVPLFGVLDGNVSAASAFY

SEQ ID NO: 3090876 - protein, 20 aa, Giardia lamblia
QCCKELIYFATNKSYLLFMD

SEQ ID NO: 3090877 - protein, 21 aa, Giardia lamblia
QCFAALFQDLLSQGSPGASGS

SEQ ID NO: 3090878 - protein, 18 aa, Giardia lamblia
QCFLAAYIDLILPAAHGA

SEQ ID NO: 3090879 - protein, 23 aa, Giardia lamblia
QCHVLRFCNEVCAYIEFSKAAPG

SEQ ID NO: 3090880 - protein, 20 aa, Giardia lamblia
QCKDGYAPIDGICTTVAAAG

SEQ ID NO: 3090881 - protein, 18 aa, Giardia lamblia
QCMRAVEGYFYDATKKQI

SEQ ID NO: 3090882 - protein, 18 aa, Giardia lamblia
QCRYGLYGLPYELVQSVK

SEQ ID NO: 3090883 - protein, 25 aa, Giardia lamblia
QCSSQLLSFFLSFFSIISKNVQLQI

SEQ ID NO: 3090884 - protein, 32 aa, Giardia lamblia
QCTRYHIRFLTWYYIMWTVSRISAVVSVIVVP

SEQ ID NO: 3090885 - protein, 17 aa, Giardia lamblia
QCTVCERGYLLTENHCE

SEQ ID NO: 3090886 - protein, 17 aa, Giardia lamblia
QCYTCMDGYYGLAKKCP

SEQ ID NO: 3090887 - protein, 18 aa, Giardia lamblia
QDAKGAPVPILVQGTKFY

SEQ ID NO: 3090888 - protein, 47 aa, Giardia lamblia
QDFKSFMNSPMRWLILGMWVEGTIFFLLTIYFDYIIPRESNGVPLPW

SEQ ID NO: 3090889 - protein, 25 aa, Giardia lamblia
QDIDKFIDYLKRKIKLTINWTVALA

SEQ ID NO: 3090890 - protein, 24 aa, Giardia lamblia
QDIRRFQKLFSLLVYVNRDTSSKE

SEQ ID NO: 3090891 - protein, 17 aa, Giardia lamblia
QDITPVLLNRIALIKAS

SEQ ID NO: 3090892 - protein, 27 aa, Giardia lamblia
QDKHERLIMRIRKLQDELFQRDSSGIN

SEQ ID NO: 3090893 - protein, 27 aa, Giardia lamblia
QDKKSCIALVPICPLGCTCVPGTSTCN

SEQ ID NO: 3090894 - protein, 25 aa, Giardia lamblia
QDKLGWTALMWLSVMGGADTANLLV

SEQ ID NO: 3090895 - protein, 22 aa, Giardia lamblia
QDKPIVFLNFGSAAMPMLNMMI

SEQ ID NO: 3090896 - protein, 22 aa, Giardia lamblia
QDLDGFVYFYLMSIGLGYCALV

SEQ ID NO: 3090897 - protein, 17 aa, Giardia lamblia
QDLRIRLTTLKGNYTEA

SEQ ID NO: 3090898 - protein, 21 aa, Giardia lamblia
QDPFSSWDSAFGRYARPSKNL

SEQ ID NO: 3090899 - protein, 29 aa, Giardia lamblia
QDVYLNYLNFFYYNLTILASRRVFNMYAF

SEQ ID NO: 3090900 - protein, 25 aa, Giardia lamblia
QDWTLSHFWFRTLNLPLPMLKQITF

SEQ ID NO: 3090901 - protein, 25 aa, Giardia lamblia
QDYNTTYIITFSVAAAFAVALNAMA

SEQ ID NO: 3090902 - protein, 25 aa, Giardia lamblia
QDYNTTYIITFSVAAAFAVALNTMA

SEQ ID NO: 3090903 - protein, 21 aa, Giardia lamblia
QEAFIWSPLASALIVDFIILT

SEQ ID NO: 3090904 - protein, 27 aa, Giardia lamblia
QEDLRMYLQYLISLKNKYFYLDMKAAS

SEQ ID NO: 3090905 - protein, 22 aa, Giardia lamblia
QEEIQLFIQSFSQLIQTDVISI

SEQ ID NO: 3090906 - protein, 23 aa, Giardia lamblia
QEGLFAYHQFLRLVLTDFTDAAT

SEQ ID NO: 3090907 - protein, 26 aa, Giardia lamblia
QEHIDVLPLFVKLSVYLNLSLYNSIE

SEQ ID NO: 3090908 - protein, 35 aa, Giardia lamblia
QEKKYTLVRNKFTLALELLLADDPLFLAASCSARG

SEQ ID NO: 3090909 - protein, 18 aa, Giardia lamblia
QEKNAALILLLRIVYRII

SEQ ID NO: 3090910 - protein, 30 aa, Giardia lamblia
QELCTEMFYAYLLAFLYQCSNFYNEESSHM

SEQ ID NO: 3090911 - protein, 24 aa, Giardia lamblia
QELDGLTLPLIPYTGTLSTDHASL

SEQ ID NO: 3090912 - protein, 35 aa, Giardia lamblia
QELLMLDLCDYKFNILDFIQLLASIKALMRRADRN

SEQ ID NO: 3090913 - protein, 28 aa, Giardia lamblia
QELLQALLSCRLIFSPNYMPSQVLQSVA

SEQ ID NO: 3090914 - protein, 24 aa, Giardia lamblia
QELSFSLAINGVVKPLFCNYRLTS

SEQ ID NO: 3090915 - protein, 17 aa, Giardia lamblia
QELVPYLAQLTLDKELS

SEQ ID NO: 3090916 - protein, 19 aa, Giardia lamblia
QENYALIERLTFLTIDDLT

SEQ ID NO: 3090917 - protein, 20 aa, Giardia lamblia
QEQCISFLSLVTSLLKKCKA

SEQ ID NO: 3090918 - protein, 22 aa, Giardia lamblia
QESEWLLFMQSQGVFNYFRKNP

SEQ ID NO: 3090919 - protein, 20 aa, Giardia lamblia
QETFILYLAAVKALTETQSE

SEQ ID NO: 3090920 - protein, 18 aa, Giardia lamblia
QETPLLRAELSLAALGGL

SEQ ID NO: 3090921 - protein, 23 aa, Giardia lamblia
QETPYLLFGKNPTFPGITGYPVN

SEQ ID NO: 3090922 - protein, 24 aa, Giardia lamblia
QEVPLKAFSWEKQTYWLFCETDTC

SEQ ID NO: 3090923 - protein, 24 aa, Giardia lamblia
QEWHRIMIIPKLRSAMVHCAATPA

SEQ ID NO: 3090924 - protein, 25 aa, Giardia lamblia
QFDARLCWDILLLYGRNRGLVLSGL

SEQ ID NO: 3090925 - protein, 17 aa, Giardia lamblia
QFFEKLLHEICFGNRIS

SEQ ID NO: 3090926 - protein, 18 aa, Giardia lamblia
QFFRQFDQLLSNIYSAAF

SEQ ID NO: 3090927 - protein, 21 aa, Giardia lamblia
QFILERQIVFNTELWDAVLYI

SEQ ID NO: 3090928 - protein, 18 aa, Giardia lamblia
QFMIYITIFIAIACISYC

SEQ ID NO: 3090929 - protein, 24 aa, Giardia lamblia
QFQKYHRDSLWPLEQHILPSHIQK

SEQ ID NO: 3090930 - protein, 31 aa, Giardia lamblia
QFRCLLRRSNLIPHRLFYVLPNDCLRLSFIT

SEQ ID NO: 3090931 - protein, 27 aa, Giardia lamblia
QFSKTKLLIPRPGDTVLYLRHSALHVR

SEQ ID NO: 3090932 - protein, 26 aa, Giardia lamblia
QFSYRGVFLLEYIGPLVIWVVVAMNT

SEQ ID NO: 3090933 - protein, 19 aa, Giardia lamblia
QFVQLFQPAPIMEGDKHED

SEQ ID NO: 3090934 - protein, 18 aa, Giardia lamblia
QFVVFYAVSLDPSLPGLL

SEQ ID NO: 3090935 - protein, 18 aa, Giardia lamblia
QFYKKYYGSADKLFKFTL

SEQ ID NO: 3090936 - protein, 22 aa, Giardia lamblia
QFYRDFLEQLLKLLDYGESSRL

SEQ ID NO: 3090937 - protein, 25 aa, Giardia lamblia
QGAMLVMAELICEGIFGVPGFLAFP

SEQ ID NO: 3090938 - protein, 27 aa, Giardia lamblia
QGFSTLKWTLVLLQGLVRFDHCVHLHS

SEQ ID NO: 3090939 - protein, 33 aa, Giardia lamblia
QGFTLTFRVLASKRLWGLILLVGLMAWLVRLLL

SEQ ID NO: 3090940 - protein, 25 aa, Giardia lamblia
QGHVSPFFFIQFNNISLKVVGNIAS

SEQ ID NO: 3090941 - protein, 30 aa, Giardia lamblia
QGIQPLSFYCLTGSLIKPLINYNVTTHYVQ

SEQ ID NO: 3090942 - protein, 32 aa, Giardia lamblia
QGISLSFMHNKFTSCLFLSLPSLKLFQKTHCS

SEQ ID NO: 3090943 - protein, 27 aa, Giardia lamblia
QGISPLMYAIQVGFTDAALLLIDLSAG

SEQ ID NO: 3090944 - protein, 20 aa, Giardia lamblia
QGISYYPLPTAAFIPPISSA

SEQ ID NO: 3090945 - protein, 17 aa, Giardia lamblia
QGKHYGHYLLAKIFGFR

SEQ ID NO: 3090946 - protein, 26 aa, Giardia lamblia
QGLGKICLLLQVYISTGPCYGTTSVA

SEQ ID NO: 3090947 - protein, 23 aa, Giardia lamblia
QGLIKYIISVRNTLSLLANKRVS

SEQ ID NO: 3090948 - protein, 20 aa, Giardia lamblia
QGLTYLCGVTLLYSRTLYEA

SEQ ID NO: 3090949 - protein, 22 aa, Giardia lamblia
QGLVPLQRWPHWCSLLRLHALK

SEQ ID NO: 3090950 - protein, 39 aa, Giardia lamblia
QGMNCPAAILLIYIRDIPLAFWCFYRFIKRFGNMYLPSL

SEQ ID NO: 3090951 - protein, 25 aa, Giardia lamblia
QGMSPAFRQLLIDLFLQVVVSCFFI

SEQ ID NO: 3090952 - protein, 24 aa, Giardia lamblia
QGNYDLHRIAITKGPIITKQYSYQ

SEQ ID NO: 3090953 - protein, 23 aa, Giardia lamblia
QGPKTAHDLLLKRYTKVIAELSE

SEQ ID NO: 3090954 - protein, 19 aa, Giardia lamblia
QGPLRFFYDDFVVTKNTYT

SEQ ID NO: 3090955 - protein, 17 aa, Giardia lamblia
QGRRLFFTKKQGAASHI

SEQ ID NO: 3090956 - protein, 37 aa, Giardia lamblia
QGSKRLLMKRLFIGIFSRLFVIALTASAGYLLVTFYP

SEQ ID NO: 3090957 - protein, 27 aa, Giardia lamblia
QGSYLVLLFIGHIVIPLITVLLVTQAC

SEQ ID NO: 3090958 - protein, 24 aa, Giardia lamblia
QGSYTMVYGFLPYVSRDGGQMVTM

SEQ ID NO: 3090959 - protein, 22 aa, Giardia lamblia
QGTTFLILVYNGGSKLECCDCV

SEQ ID NO: 3090960 - protein, 17 aa, Giardia lamblia
QGTTLLMYCCKRNLHSF

SEQ ID NO: 3090961 - protein, 17 aa, Giardia lamblia
QGVCGCCWAMASAVMLE

SEQ ID NO: 3090962 - protein, 25 aa, Giardia lamblia
QGVISTYLLPLFGPADHISTLGKAS

SEQ ID NO: 3090963 - protein, 17 aa, Giardia lamblia
QGWTPHGTLCYPSACVS

SEQ ID NO: 3090964 - protein, 24 aa, Giardia lamblia
QGYSKIRLLDLSNNNFKGLMEGVQ

SEQ ID NO: 3090965 - protein, 25 aa, Giardia lamblia
QHAQPTILSLLRDILSALLSICHGL

SEQ ID NO: 3090966 - protein, 26 aa, Giardia lamblia
QHEGLTSLWLAYLQGNSAIVRLLAPY

SEQ ID NO: 3090967 - protein, 22 aa, Giardia lamblia
QHINRILFRNHAKPLLDEYTSI

SEQ ID NO: 3090968 - protein, 45 aa, Giardia lamblia
QHKIVPLELSLYALLVFINAYYIELLLNFQIIQMTRLLKTIKLCR

SEQ ID NO: 3090969 - protein, 18 aa, Giardia lamblia
QHPGNRAALSLLAFCNYS

SEQ ID NO: 3090970 - protein, 19 aa, Giardia lamblia
QHVFYRKDGFRLSKWMHLF

SEQ ID NO: 3090971 - protein, 28 aa, Giardia lamblia
QHVSDCLWAYLILPLLHEIFIVNNRKKH

SEQ ID NO: 3090972 - protein, 23 aa, Giardia lamblia
QIAFSVLLRLAVTLTITIDPATR

SEQ ID NO: 3090973 - protein, 20 aa, Giardia lamblia
QICDAILLDYPDMPAGIGAA

SEQ ID NO: 3090974 - protein, 20 aa, Giardia lamblia
QICISCEGEHLLYSGGCYAT

SEQ ID NO: 3090975 - protein, 26 aa, Giardia lamblia
QIDAINFIMRFFQQSQIRSFAAAGLA

SEQ ID NO: 3090976 - protein, 17 aa, Giardia lamblia
QIDKDCLRLLLMNTADL

SEQ ID NO: 3090977 - protein, 44 aa, Giardia lamblia
QIDNFLVLMQRIISWFLVIHVILLVLLYVYLQFAPTRTGLVVFK

SEQ ID NO: 3090978 - protein, 20 aa, Giardia lamblia
QIETLLSFDYERCLKIKEIK

SEQ ID NO: 3090979 - protein, 17 aa, Giardia lamblia
QIFHRGISLFSVVDSEL

SEQ ID NO: 3090980 - protein, 21 aa, Giardia lamblia
QIGILGVLLRNKDIPLWVIDA

SEQ ID NO: 3090981 - protein, 17 aa, Giardia lamblia
QIGVFTPYAFCLKNPEF

SEQ ID NO: 3090982 - protein, 33 aa, Giardia lamblia
QILRGFVMVFVLLFSYLFLKRKPTKWQVVGVVF

SEQ ID NO: 3090983 - protein, 26 aa, Giardia lamblia
QILRKMFLFFPQNYLTYSYIPLSILL

SEQ ID NO: 3090984 - protein, 23 aa, Giardia lamblia
QINIFAAIVLYDFPLGERSQLIL

SEQ ID NO: 3090985 - protein, 18 aa, Giardia lamblia
QIQIPFAKELPLFEQIGD

SEQ ID NO: 3090986 - protein, 21 aa, Giardia lamblia
QIRRMMGALVAVLRGWIPASF

SEQ ID NO: 3090987 - protein, 24 aa, Giardia lamblia
QISYLKTFASILAAVRGWRMHYCF

SEQ ID NO: 3090988 - protein, 20 aa, Giardia lamblia
QIVGILLHGISLECISLLKN

SEQ ID NO: 3090989 - protein, 21 aa, Giardia lamblia
QIVLYAEFFYYWLKSKLTHKS

SEQ ID NO: 3090990 - protein, 38 aa, Giardia lamblia
QKAPDSFVHLLFFKTHSLLFLTLLHKITHLPSVGSMIN

SEQ ID NO: 3090991 - protein, 26 aa, Giardia lamblia
QKDDLFMSYYSYLAPLQDSLLQYTGQ

SEQ ID NO: 3090992 - protein, 25 aa, Giardia lamblia
QKDKSVLCAAFRKLPRNNSYRLALL

SEQ ID NO: 3090993 - protein, 20 aa, Giardia lamblia
QKEYALLFKFFFGGADRDTA

SEQ ID NO: 3090994 - protein, 28 aa, Giardia lamblia
QKFRKAYMMYLPFIPYISTLQSTHEFRT

SEQ ID NO: 3090995 - protein, 18 aa, Giardia lamblia
QKGPAYALPPSLSSSRLN

SEQ ID NO: 3090996 - protein, 23 aa, Giardia lamblia
QKIKMLSTHWNCSILTAGVVAYG

SEQ ID NO: 3090997 - protein, 24 aa, Giardia lamblia
QKKPYYYLFDNAYAAYYYEYHGQI

SEQ ID NO: 3090998 - protein, 25 aa, Giardia lamblia
QKNMTALHRLAINGFLRVSTACWLD

SEQ ID NO: 3090999 - protein, 26 aa, Giardia lamblia
QKPVDFYFATMRYFIDGLGFLVRTIP

SEQ ID NO: 3091000 - protein, 21 aa, Giardia lamblia
QKRFDFLQRSFAYLKDHISDK

SEQ ID NO: 3091001 - protein, 23 aa, Giardia lamblia
QKRSFIPWKVIEGLIYLMVITIF

SEQ ID NO: 3091002 - protein, 19 aa, Giardia lamblia
QKRWELPEPMALIEELLRP

SEQ ID NO: 3091003 - protein, 29 aa, Giardia lamblia
QKTGKMKRWILWLQNLAINNISLAINNVA

SEQ ID NO: 3091004 - protein, 26 aa, Giardia lamblia
QKVCFQLLNVLTYLHSRRIAHRDIKS

SEQ ID NO: 3091005 - protein, 18 aa, Giardia lamblia
QKVRTLILAKEKVLEAYS

SEQ ID NO: 3091006 - protein, 18 aa, Giardia lamblia
QLAAFFSSKPVFVGADDL

SEQ ID NO: 3091007 - protein, 17 aa, Giardia lamblia
QLAFAHLIHTFPPTQDA

SEQ ID NO: 3091008 - protein, 18 aa, Giardia lamblia
QLCLLKRACIYIAELKEA

SEQ ID NO: 3091009 - protein, 18 aa, Giardia lamblia
QLCLVCHDGFYKDGTTCR

SEQ ID NO: 3091010 - protein, 22 aa, Giardia lamblia
QLDNSYLCACPAGYRGVETHGN

SEQ ID NO: 3091011 - protein, 20 aa, Giardia lamblia
QLFMKRYVSLPLADQYLLIT

SEQ ID NO: 3091012 - protein, 19 aa, Giardia lamblia
QLFSLDIFDKTCRPLVASV

SEQ ID NO: 3091013 - protein, 20 aa, Giardia lamblia
QLGGLLTLVKKFIDIRTFFI

SEQ ID NO: 3091014 - protein, 18 aa, Giardia lamblia
QLGPLPDPGALPALVRSL

SEQ ID NO: 3091015 - protein, 28 aa, Giardia lamblia
QLHSIHVEWWKRLLSKLRTHCMLEYSTL

SEQ ID NO: 3091016 - protein, 24 aa, Giardia lamblia
QLIDNYYHYGLDKYQLYSDTNYYP

SEQ ID NO: 3091017 - protein, 19 aa, Giardia lamblia
QLIMVYRMINMISFSFTRV

SEQ ID NO: 3091018 - protein, 21 aa, Giardia lamblia
QLITVAALSNLTPGLRVQIYA

SEQ ID NO: 3091019 - protein, 22 aa, Giardia lamblia
QLKDAILELRLYRKYRLSCNIT

SEQ ID NO: 3091020 - protein, 20 aa, Giardia lamblia
QLLIDRDLLRLVRAKAAIAD

SEQ ID NO: 3091021 - protein, 21 aa, Giardia lamblia
QLLNVLLGIYLALVKNKISLL

SEQ ID NO: 3091022 - protein, 23 aa, Giardia lamblia
QLLPAFIGAWKGLLDPKYNLDIC

SEQ ID NO: 3091023 - protein, 31 aa, Giardia lamblia
QLMGPTCPFIFIEVPFFYRYVIESSTSKGIL

SEQ ID NO: 3091024 - protein, 21 aa, Giardia lamblia
QLMMYPPWYGIFYNLMAVIAG

SEQ ID NO: 3091025 - protein, 24 aa, Giardia lamblia
QLNRLLDILIGPKGLVTPYVLEVV

SEQ ID NO: 3091026 - protein, 37 aa, Giardia lamblia
QLPLTNFVLYLKTFGSPTIFYCIIAFMVTELMEPYKL

SEQ ID NO: 3091027 - protein, 19 aa, Giardia lamblia
QLREFACFITMNPSYKGRR

SEQ ID NO: 3091028 - protein, 23 aa, Giardia lamblia
QLRGYAHNYLILSFIEKILNFRR

SEQ ID NO: 3091029 - protein, 17 aa, Giardia lamblia
QLRHALFQKYILCEEIR

SEQ ID NO: 3091030 - protein, 27 aa, Giardia lamblia
QLRQRIGPCRIIFYMDTKTFAPELRKQ

SEQ ID NO: 3091031 - protein, 20 aa, Giardia lamblia
QLRRLQGILAPFVLRRVKGD

SEQ ID NO: 3091032 - protein, 26 aa, Giardia lamblia
QLSALFTCPLVPLVWDPRGHFEEFLI

SEQ ID NO: 3091033 - protein, 17 aa, Giardia lamblia
QLSCFSIFPSDAVFFEM

SEQ ID NO: 3091034 - protein, 35 aa, Giardia lamblia
QLSRYVPILNLMGQLMALSYYRGLYSSVSALPNYV

SEQ ID NO: 3091035 - protein, 25 aa, Giardia lamblia
QLVASLFLKFCLFKGSKKLDDFLHN

SEQ ID NO: 3091036 - protein, 26 aa, Giardia lamblia
QLVMAFLPYHETVIFSYLVTCLFSMN

SEQ ID NO: 3091037 - protein, 25 aa, Giardia lamblia
QLVSLPPDFWLINFSFSILLAVCES

SEQ ID NO: 3091038 - protein, 26 aa, Giardia lamblia
QLYKLSKAYWDFIKASLFSLNLLHDH

SEQ ID NO: 3091039 - protein, 26 aa, Giardia lamblia
QMNLRDFLLCIFSAMIYKLASLCTPI

SEQ ID NO: 3091040 - protein, 30 aa, Giardia lamblia
QMPVQMSMPMQIPVQFPLQIPKPGSMDDVG

SEQ ID NO: 3091041 - protein, 20 aa, Giardia lamblia
QMVSTYQTAPPLMGMLGHYC

SEQ ID NO: 3091042 - protein, 26 aa, Giardia lamblia
QMVYANRYFYFPSNPMYDLTLMDKIV

SEQ ID NO: 3091043 - protein, 29 aa, Giardia lamblia
QNDTYLTILIRCLLRYYTNINLFQPTMVH

SEQ ID NO: 3091044 - protein, 25 aa, Giardia lamblia
QNELRRRLPLFLYTPPADGKEKPGS

SEQ ID NO: 3091045 - protein, 17 aa, Giardia lamblia
QNFILIFSQTNLANIST

SEQ ID NO: 3091046 - protein, 18 aa, Giardia lamblia
QNFLLLLTDYNSGFSQQV

SEQ ID NO: 3091047 - protein, 23 aa, Giardia lamblia
QNGKLIHAFLQLCDFARDTSQAH

SEQ ID NO: 3091048 - protein, 30 aa, Giardia lamblia
QNGRFLPDYIVKLGLLPKLKDLLRTTGSLA

SEQ ID NO: 3091049 - protein, 25 aa, Giardia lamblia
QNIGIYPWMILNLLSTDASNKLIYS

SEQ ID NO: 3091050 - protein, 17 aa, Giardia lamblia
QNIIDYPSGLEPNESLD

SEQ ID NO: 3091051 - protein, 25 aa, Giardia lamblia
QNKVDIVHLLAPREAKLRGSMQRTA

SEQ ID NO: 3091052 - protein, 28 aa, Giardia lamblia
QNLIYSAWYIMFSDLILYNTFLTLHGFS

SEQ ID NO: 3091053 - protein, 26 aa, Giardia lamblia
QNNATNLYFVVWRQPQNKTLSNKDLF

SEQ ID NO: 3091054 - protein, 25 aa, Giardia lamblia
QNQCPFYVVLRNLELFRISYDAVLE

SEQ ID NO: 3091055 - protein, 23 aa, Giardia lamblia
QNRTALMLATLASSPGSAQLLAQ

SEQ ID NO: 3091056 - protein, 30 aa, Giardia lamblia
QNSAKVIPLLLPYEHEMVLLNGATALHVAV

SEQ ID NO: 3091057 - protein, 23 aa, Giardia lamblia
QNSLEELWALLHFVMPELFERKD

SEQ ID NO: 3091058 - protein, 17 aa, Giardia lamblia
QNTIIQMLLVGGVSQDN

SEQ ID NO: 3091059 - protein, 24 aa, Giardia lamblia
QNVLPNLTIVPPASSVRFVMASKT

SEQ ID NO: 3091060 - protein, 24 aa, Giardia lamblia
QPASSPLLPPPPPPALESKRTIEE

SEQ ID NO: 3091061 - protein, 22 aa, Giardia lamblia
QPATNDLLIVTSLNNVSPTDSK

SEQ ID NO: 3091062 - protein, 25 aa, Giardia lamblia
QPDISPSHPFLTSPLARDLATKVTS

SEQ ID NO: 3091063 - protein, 25 aa, Giardia lamblia
QPEALPCYISLQFQPQNQCPQPMHT

SEQ ID NO: 3091064 - protein, 27 aa, Giardia lamblia
QPGNKRFISTSLRFNYSILYKDTEFRI

SEQ ID NO: 3091065 - protein, 29 aa, Giardia lamblia
QPGTVFHDIRYWQMVLKLDIDKKRYRELR

SEQ ID NO: 3091066 - protein, 30 aa, Giardia lamblia
QPIDPVMSLALFFNGITLPSALLHQMVPMQ

SEQ ID NO: 3091067 - protein, 21 aa, Giardia lamblia
QPIRFEFMGYIILAKSIKDLG

SEQ ID NO: 3091068 - protein, 21 aa, Giardia lamblia
QPIVPQVPFFISAAPCSNPST

SEQ ID NO: 3091069 - protein, 33 aa, Giardia lamblia
QPKKKRIVGLTLLLFVALLIFGSLAVICACIGL

SEQ ID NO: 3091070 - protein, 30 aa, Giardia lamblia
QPLASAILSYFLSLAPHILLQSIYGRYALQ

SEQ ID NO: 3091071 - protein, 39 aa, Giardia lamblia
QPLHEYFPRCLYYTYHWLSPIIKLIKRQGAIYPRDVYIL

SEQ ID NO: 3091072 - protein, 25 aa, Giardia lamblia
QPMHTKLPGVPYPSALHKTLTFRNI

SEQ ID NO: 3091073 - protein, 32 aa, Giardia lamblia
QPRLRMKAHFYIYNPPIFSSRRYTPTGMLSLL

SEQ ID NO: 3091074 - protein, 27 aa, Giardia lamblia
QPSHAKWLAFIPSFAVRLFFSIFRENS

SEQ ID NO: 3091075 - protein, 30 aa, Giardia lamblia
QPSLFVVMLIVLIFSEALALYGLIIALILS

SEQ ID NO: 3091076 - protein, 31 aa, Giardia lamblia
QPSPKAYHILNLVDLFLIGAFVAVYLTLRYA

SEQ ID NO: 3091077 - protein, 20 aa, Giardia lamblia
QPVLLYIVPSLLSTTYGLMY

SEQ ID NO: 3091078 - protein, 18 aa, Giardia lamblia
QPVPYDFVSLRFSARAIQ

SEQ ID NO: 3091079 - protein, 25 aa, Giardia lamblia
QQASPLTIRPYIPSTIRAFTSFSYI

SEQ ID NO: 3091080 - protein, 28 aa, Giardia lamblia
QQDLAVRTPLFLAYTYCSFAKAMMTSDS

SEQ ID NO: 3091081 - protein, 25 aa, Giardia lamblia
QQFSPILIYTAIDGSLRYTHFPNGY

SEQ ID NO: 3091082 - protein, 41 aa, Giardia lamblia
QQGPVLTRLRNLLPLLFLINKLVALYFDFLSNFEQWMNCTI

SEQ ID NO: 3091083 - protein, 26 aa, Giardia lamblia
QQLANCFLVNSRFPLTKIYTRSQIKA

SEQ ID NO: 3091084 - protein, 18 aa, Giardia lamblia
QQMVLPAMKIKRLKDSSF

SEQ ID NO: 3091085 - protein, 23 aa, Giardia lamblia
QQNIYCWSDFLLYVGLRPKELIR

SEQ ID NO: 3091086 - protein, 23 aa, Giardia lamblia
QQNLAIFICILGLVIIAVASYLA

SEQ ID NO: 3091087 - protein, 18 aa, Giardia lamblia
QQPVLSHSALLASGGPAG

SEQ ID NO: 3091088 - protein, 17 aa, Giardia lamblia
QQRYSIGTLLTGAFLVT

SEQ ID NO: 3091089 - protein, 25 aa, Giardia lamblia
QQVKKPIAPLYLLAKPHELITKAML

SEQ ID NO: 3091090 - protein, 24 aa, Giardia lamblia
QQVLSLLTPRFFAGWLDNMIELIH

SEQ ID NO: 3091091 - protein, 29 aa, Giardia lamblia
QQYQTFGSFFWRWFLERGIITQKPAHTIV

SEQ ID NO: 3091092 - protein, 22 aa, Giardia lamblia
QRCVSPILVFQYTRNEYDILLF

SEQ ID NO: 3091093 - protein, 23 aa, Giardia lamblia
QRELELSAFWPPPMLYYSGEQIM

SEQ ID NO: 3091094 - protein, 23 aa, Giardia lamblia
QRENHLHFLFTTHATTLGRHLSA

SEQ ID NO: 3091095 - protein, 27 aa, Giardia lamblia
QRFAKIYDSFRPALIKFPEKALGMQQE

SEQ ID NO: 3091096 - protein, 25 aa, Giardia lamblia
QRILATILITPLKRLYHNIFMVMAQ

SEQ ID NO: 3091097 - protein, 31 aa, Giardia lamblia
QRILNKYLAVLLPKIHLFVLSLGSIGDTDLH

SEQ ID NO: 3091098 - protein, 18 aa, Giardia lamblia
QRMQSFVELLPIVIRDTE

SEQ ID NO: 3091099 - protein, 19 aa, Giardia lamblia
QRNTIASNIFQLANALQAA

SEQ ID NO: 3091100 - protein, 28 aa, Giardia lamblia
QRPMARRSFLRFALLLQAGDRIYKQLVS

SEQ ID NO: 3091101 - protein, 18 aa, Giardia lamblia
QRQLLNRFISEEKKSVYL

SEQ ID NO: 3091102 - protein, 23 aa, Giardia lamblia
QRSIRTILLLRRFEKRCQDRSGK

SEQ ID NO: 3091103 - protein, 21 aa, Giardia lamblia
QRTRSFFPLQSVLLDLYVISL

SEQ ID NO: 3091104 - protein, 20 aa, Giardia lamblia
QRVHHLWLMNPFVIALSVRG

SEQ ID NO: 3091105 - protein, 19 aa, Giardia lamblia
QRWDVYLVIALIAATLGNI

SEQ ID NO: 3091106 - protein, 27 aa, Giardia lamblia
QSALVYAILTLRFLTTFMGGSLALQEA

SEQ ID NO: 3091107 - protein, 31 aa, Giardia lamblia
QSASIVEFMTYILLRFAYSVLTRLSIARQIC

SEQ ID NO: 3091108 - protein, 26 aa, Giardia lamblia
QSCGRESFFSPFMCNCLHGCPDLKNG

SEQ ID NO: 3091109 - protein, 23 aa, Giardia lamblia
QSDNLRLFKSVIHLLFSSHISLR

SEQ ID NO: 3091110 - protein, 30 aa, Giardia lamblia
QSERCPFILYYTFLWMTPFVARARKQRVLK

SEQ ID NO: 3091111 - protein, 29 aa, Giardia lamblia
QSFFNLTQLFFCPLWLWLSEIIGRRPVYI

SEQ ID NO: 3091112 - protein, 25 aa, Giardia lamblia
QSFQECLFILRSVQTEVLCENIKCI

SEQ ID NO: 3091113 - protein, 26 aa, Giardia lamblia
QSGRAHLLYMLFTIVLTDIQVIFSQF

SEQ ID NO: 3091114 - protein, 28 aa, Giardia lamblia
QSGSSLLDGYWFLGLGFICIKTGRVKDG

SEQ ID NO: 3091115 - protein, 31 aa, Giardia lamblia
QSGYYEVSVLARFIMRLRKTDVHCKKCLANC

SEQ ID NO: 3091116 - protein, 23 aa, Giardia lamblia
QSIELACLYNLIRGYPLSPVELS

SEQ ID NO: 3091117 - protein, 23 aa, Giardia lamblia
QSISLCILAILSLLEHATLFVSR

SEQ ID NO: 3091118 - protein, 25 aa, Giardia lamblia
QSLQLHNYYPSTVPSILLLTELEEL

SEQ ID NO: 3091119 - protein, 28 aa, Giardia lamblia
QSPDISLCSIIVPWLMTGFAGYLMPREY

SEQ ID NO: 3091120 - protein, 18 aa, Giardia lamblia
QSPTDAAILLYPLALYRL

SEQ ID NO: 3091121 - protein, 24 aa, Giardia lamblia
QSQAIILAALLIKRYLSSKYFDLA

SEQ ID NO: 3091122 - protein, 27 aa, Giardia lamblia
QSSAFLLGFIWWYALTIRLLYVSKVKT

SEQ ID NO: 3091123 - protein, 25 aa, Giardia lamblia
QSSFNLAPLIYSLFIGIHNIARNYT

SEQ ID NO: 3091124 - protein, 22 aa, Giardia lamblia
QSSLFAVQLFERLPNSLNGSQI

SEQ ID NO: 3091125 - protein, 18 aa, Giardia lamblia
QSTRFLHRYFGRNFMTIE

SEQ ID NO: 3091126 - protein, 22 aa, Giardia lamblia
QSTSCIACHPACKTCDGMGADK

SEQ ID NO: 3091127 - protein, 22 aa, Giardia lamblia
QSTSCIACHPACKTCDGMGADR

SEQ ID NO: 3091128 - protein, 25 aa, Giardia lamblia
QSTTRFIYSFPHKSLLSDPLSCHNV

SEQ ID NO: 3091129 - protein, 20 aa, Giardia lamblia
QTAPPLMGMLGHYCGAQTMT

SEQ ID NO: 3091130 - protein, 23 aa, Giardia lamblia
QTASALPIPLRFSGANKTLQQFV

SEQ ID NO: 3091131 - protein, 25 aa, Giardia lamblia
QTAVQSLRFLVATTLVMVLHACFII

SEQ ID NO: 3091132 - protein, 25 aa, Giardia lamblia
QTCSVCLSGYYLSTNKCFRCTAGDG

SEQ ID NO: 3091133 - protein, 27 aa, Giardia lamblia
QTEPLPLALLLEPYICQYHVDAFVVGH

SEQ ID NO: 3091134 - protein, 18 aa, Giardia lamblia
QTFKYLRGLTEFSNYLSM

SEQ ID NO: 3091135 - protein, 25 aa, Giardia lamblia
QTGVYSPHLYAFLESLSLSTYGKAL

SEQ ID NO: 3091136 - protein, 20 aa, Giardia lamblia
QTHTYPLAIGDKVTMVFYKQ

SEQ ID NO: 3091137 - protein, 18 aa, Giardia lamblia
QTHYLWCAVLGLTGLLIS

SEQ ID NO: 3091138 - protein, 27 aa, Giardia lamblia
QTITNYLALLIFLLSSLSHHVILRSRT

SEQ ID NO: 3091139 - protein, 19 aa, Giardia lamblia
QTIVWICSIVILAGYPRDQ

SEQ ID NO: 3091140 - protein, 20 aa, Giardia lamblia
QTLNTLFLVLLNGQLEMNSR

SEQ ID NO: 3091141 - protein, 28 aa, Giardia lamblia
QTNLQLALFAICIISVLWLAVAKPVYEV

SEQ ID NO: 3091142 - protein, 21 aa, Giardia lamblia
QTNPMMISCNYNPSSYPSAFF

SEQ ID NO: 3091143 - protein, 35 aa, Giardia lamblia
QTNYRKRPTLSYILNLPLLMGARRSFEERHGIVRT

SEQ ID NO: 3091144 - protein, 17 aa, Giardia lamblia
QTPAPVTTYDKHPLHYV

SEQ ID NO: 3091145 - protein, 27 aa, Giardia lamblia
QTRDKWTALMLCAKYNRYEVATELVPH

SEQ ID NO: 3091146 - protein, 19 aa, Giardia lamblia
QTRHLLTHSSISCLVTSLC

SEQ ID NO: 3091147 - protein, 25 aa, Giardia lamblia
QTSAKDFIALYSFGLVVAGMGVKTV

SEQ ID NO: 3091148 - protein, 24 aa, Giardia lamblia
QTSDRLVVFIGSNLYYVSWSETDG

SEQ ID NO: 3091149 - protein, 24 aa, Giardia lamblia
QTSKNTFYLLVKSNYIIGVTLHKD

SEQ ID NO: 3091150 - protein, 36 aa, Giardia lamblia
QTSLEEELIWLYMGQILLALAYLHCPFKSGIQQHGR

SEQ ID NO: 3091151 - protein, 24 aa, Giardia lamblia
QTSLMLAVLRRNAPLVTVLAPYEA

SEQ ID NO: 3091152 - protein, 18 aa, Giardia lamblia
QTSMYLDDFPFQCYALLR

SEQ ID NO: 3091153 - protein, 24 aa, Giardia lamblia
QTSPLTCALLLRSVLVVNSQLFVH

SEQ ID NO: 3091154 - protein, 18 aa, Giardia lamblia
QTYAFRVIALGARIHIHC

SEQ ID NO: 3091155 - protein, 20 aa, Giardia lamblia
QVCNFQAYYALKQFSKLPPV

SEQ ID NO: 3091156 - protein, 32 aa, Giardia lamblia
QVDCYLRAITPRLFLLCFLTSPDAIEEDLAGF

SEQ ID NO: 3091157 - protein, 25 aa, Giardia lamblia
QVDRTRRFYCGFAEGLTDGITTNGP

SEQ ID NO: 3091158 - protein, 19 aa, Giardia lamblia
QVFTSYNALLFLLSDTSIQ

SEQ ID NO: 3091159 - protein, 17 aa, Giardia lamblia
QVGDLWRSLICGNYIIL

SEQ ID NO: 3091160 - protein, 28 aa, Giardia lamblia
QVGLAFTYYLPLCFIVLVSVGRELYDEL

SEQ ID NO: 3091161 - protein, 25 aa, Giardia lamblia
QVGTIIWFLLYVLPWALAAMNPSRW

SEQ ID NO: 3091162 - protein, 17 aa, Giardia lamblia
QVKLFRSIKDKSGPWVL

SEQ ID NO: 3091163 - protein, 19 aa, Giardia lamblia
QVLITLLFDHNTKGLLDSI

SEQ ID NO: 3091164 - protein, 28 aa, Giardia lamblia
QVLVRLRHIYENIFLLAASRIDDYIYLA

SEQ ID NO: 3091165 - protein, 24 aa, Giardia lamblia
QVMRTFFDMILTDQYFESMPRLLS

SEQ ID NO: 3091166 - protein, 23 aa, Giardia lamblia
QVMSMDIRKLIYLTTFTSMLHDA

SEQ ID NO: 3091167 - protein, 18 aa, Giardia lamblia
QVQILRKSYLLRPEISRA

SEQ ID NO: 3091168 - protein, 18 aa, Giardia lamblia
QVVLFLQRTFSEDLDMIQ

SEQ ID NO: 3091169 - protein, 17 aa, Giardia lamblia
QVYYGARRALASFLTEL

SEQ ID NO: 3091170 - protein, 19 aa, Giardia lamblia
QWEYKHILLTLLHRQCTIT

SEQ ID NO: 3091171 - protein, 19 aa, Giardia lamblia
QWFTQTGDMLLPLDIPVMS

SEQ ID NO: 3091172 - protein, 24 aa, Giardia lamblia
QWIQNIMDKFKFRAPGKSKSTTKV

SEQ ID NO: 3091173 - protein, 24 aa, Giardia lamblia
QWLGVFLKNWTLFCASFGGFLSVL

SEQ ID NO: 3091174 - protein, 23 aa, Giardia lamblia
QYALRPLALIGMIFIGALAFFCR

SEQ ID NO: 3091175 - protein, 31 aa, Giardia lamblia
QYDNIPYLHYEMLLSLVLILRRYASLCIKDH

SEQ ID NO: 3091176 - protein, 28 aa, Giardia lamblia
QYEQRTIYLAYIILINKLVCSYTTVEDS

SEQ ID NO: 3091177 - protein, 30 aa, Giardia lamblia
QYFSGFITNLVAIPLSILILLSRLEEIESL

SEQ ID NO: 3091178 - protein, 18 aa, Giardia lamblia
QYIGELLSSIIRVLPRKL

SEQ ID NO: 3091179 - protein, 27 aa, Giardia lamblia
QYIQMITLFMDTLLLRVSRIQAAFRGC

SEQ ID NO: 3091180 - protein, 18 aa, Giardia lamblia
QYLILTPELLTHLQDTFI

SEQ ID NO: 3091181 - protein, 26 aa, Giardia lamblia
QYLTYVRGSSFFRKVLGHYAYVERSS

SEQ ID NO: 3091182 - protein, 33 aa, Giardia lamblia
QYRELTIPFSRVVAIIFYAYSSFRKTLYQALQT

SEQ ID NO: 3091183 - protein, 26 aa, Giardia lamblia
QYRLIIAYVVVMLLSGQFFAHFGLYN

SEQ ID NO: 3091184 - protein, 27 aa, Giardia lamblia
QYSCAYHMFVLVFSLLSMLQDGYRLPD

SEQ ID NO: 3091185 - protein, 43 aa, Giardia lamblia
QYSDTLRYAFLYSKLFALFITDVVPLISALFFRDFNLNKIQES

SEQ ID NO: 3091186 - protein, 36 aa, Giardia lamblia
QYSICRPFFVSVLLNQIFFYLLLAFCITSYIRPNDI

SEQ ID NO: 3091187 - protein, 18 aa, Giardia lamblia
QYSISFSPVFLIVEEDDP

SEQ ID NO: 3091188 - protein, 42 aa, Giardia lamblia
QYVDMIQGGWLILFLRFALPLILVLVLYLNPLVAYYQSSDNL

SEQ ID NO: 3091189 - protein, 22 aa, Giardia lamblia
QYVTLQEPFPLTRPIQPCTPTS

SEQ ID NO: 3091190 - protein, 20 aa, Giardia lamblia
RAAAGLRRSMYEGFMLAFGS

SEQ ID NO: 3091191 - protein, 46 aa, Giardia lamblia
RAAAQVIMLVSFYFTRFLAVPRRVYVDFLPVPLGTSQPRQAASRRK

SEQ ID NO: 3091192 - protein, 25 aa, Giardia lamblia
RAAETLMRYALLAIYQIVYLSCRPS

SEQ ID NO: 3091193 - protein, 19 aa, Giardia lamblia
RAAILLHEPLDRLVSKVDD

SEQ ID NO: 3091194 - protein, 19 aa, Giardia lamblia
RACAIPHCRTCNALGKCTV

SEQ ID NO: 3091195 - protein, 23 aa, Giardia lamblia
RACGKPALKCKLSWCASATRAEG

SEQ ID NO: 3091196 - protein, 33 aa, Giardia lamblia
RACGQMVIVSTLPILFKRYWRVANSRQDTGEPV

SEQ ID NO: 3091197 - protein, 59 aa, Giardia lamblia
RAEIARYYSIYRPISIRGALIYFIVSDMSLVEPMYLFALSYYIRLFVTAINSIADYRGD

SEQ ID NO: 3091198 - protein, 24 aa, Giardia lamblia
RAEIRMHLEKISLLQADLLEEEKK

SEQ ID NO: 3091199 - protein, 24 aa, Giardia lamblia
RAELRHILLRLLLNGMGHTELFSY

SEQ ID NO: 3091200 - protein, 21 aa, Giardia lamblia
RAEMIVFAKLRRKQLRRAAKE

SEQ ID NO: 3091201 - protein, 22 aa, Giardia lamblia
RAERAILIALLITFVIAIVCTL

SEQ ID NO: 3091202 - protein, 23 aa, Giardia lamblia
RAFLGHFFHAYIGLVHQELRLIA

SEQ ID NO: 3091203 - protein, 17 aa, Giardia lamblia
RAFLPIFANLLLETQAP

SEQ ID NO: 3091204 - protein, 20 aa, Giardia lamblia
RAFSTDYLFLNYILRKYCSQ

SEQ ID NO: 3091205 - protein, 22 aa, Giardia lamblia
RAFTSFSYINTYNAPYSSPLHI

SEQ ID NO: 3091206 - protein, 29 aa, Giardia lamblia
RAGALFFNDRLFNLAFLCFTYAFMNLDRP

SEQ ID NO: 3091207 - protein, 17 aa, Giardia lamblia
RAGFSWLVYRMIDRFLN

SEQ ID NO: 3091208 - protein, 17 aa, Giardia lamblia
RAHAAPISLLSPAGSNS

SEQ ID NO: 3091209 - protein, 23 aa, Giardia lamblia
RAHLCLYICMIVMPVVVMAAVAL

SEQ ID NO: 3091210 - protein, 26 aa, Giardia lamblia
RAIFQDILVSFYLFTVVFSPLQMSSK

SEQ ID NO: 3091211 - protein, 32 aa, Giardia lamblia
RAISAPYTFYLFYFYVDLWYSNSIRQQDENAQ

SEQ ID NO: 3091212 - protein, 26 aa, Giardia lamblia
RAITLGHWLGFLVFGARYAPLKQDIN

SEQ ID NO: 3091213 - protein, 29 aa, Giardia lamblia
RAKRLVFYFLTSIRLIYAFGSSFLLFYNA

SEQ ID NO: 3091214 - protein, 18 aa, Giardia lamblia
RALALAREDRRLEITINT

SEQ ID NO: 3091215 - protein, 19 aa, Giardia lamblia
RALITETLSHWKKRWDLRL

SEQ ID NO: 3091216 - protein, 31 aa, Giardia lamblia
RALLAAYHLYDGFWCLTVMPTECFFGTLKLD

SEQ ID NO: 3091217 - protein, 17 aa, Giardia lamblia
RALLLLTAIICPSFFVE

SEQ ID NO: 3091218 - protein, 28 aa, Giardia lamblia
RALLMSAGYTQLMFAVLADDIHAVKRYI

SEQ ID NO: 3091219 - protein, 36 aa, Giardia lamblia
RALLVYDDRRFNSMPSPFLFIPPSYMLCITITELYD

SEQ ID NO: 3091220 - protein, 17 aa, Giardia lamblia
RALMLRLITLFDADLST

SEQ ID NO: 3091221 - protein, 18 aa, Giardia lamblia
RALMRYLGTYAFEVVQPT

SEQ ID NO: 3091222 - protein, 23 aa, Giardia lamblia
RANLSMLLIQELTLLYAEAEKHI

SEQ ID NO: 3091223 - protein, 22 aa, Giardia lamblia
RAPHVPATFRKGWLPSPGAASD

SEQ ID NO: 3091224 - protein, 38 aa, Giardia lamblia
RAPPPVVYLVFMLLDTILYFLITWFVSEAVPSHSSLCR

SEQ ID NO: 3091225 - protein, 25 aa, Giardia lamblia
RAQNPVLMGLLPPPLVLSLAEHDHV

SEQ ID NO: 3091226 - protein, 22 aa, Giardia lamblia
RARGLLFLCDNLNPQIVRAIDM

SEQ ID NO: 3091227 - protein, 19 aa, Giardia lamblia
RASQWLFGAILGVMAVIGA

SEQ ID NO: 3091228 - protein, 19 aa, Giardia lamblia
RAVLLLISLRISELLCQCL

SEQ ID NO: 3091229 - protein, 25 aa, Giardia lamblia
RAVTHKFLTLLYKTQTLLSTAQSNG

SEQ ID NO: 3091230 - protein, 19 aa, Giardia lamblia
RAYSFDKLEPLILAKEKYG

SEQ ID NO: 3091231 - protein, 22 aa, Giardia lamblia
RCACFLRHKPGLIAIGFSSGII

SEQ ID NO: 3091232 - protein, 17 aa, Giardia lamblia
RCDCGPSATWNEGLKAC

SEQ ID NO: 3091233 - protein, 17 aa, Giardia lamblia
RCFEYLRLLVAAAGHAF

SEQ ID NO: 3091234 - protein, 20 aa, Giardia lamblia
RCIFIISYVRAHANKLFYYV

SEQ ID NO: 3091235 - protein, 19 aa, Giardia lamblia
RCLEDQYYGLWSFTLSRQF

SEQ ID NO: 3091236 - protein, 25 aa, Giardia lamblia
RCPEDIIKVYMLFVRILANICADEY

SEQ ID NO: 3091237 - protein, 32 aa, Giardia lamblia
RCRRCSKGYLLYYGGCYNTIKPVIPICEKEHT

SEQ ID NO: 3091238 - protein, 31 aa, Giardia lamblia
RCSRDYPILLTRLYVIFKRLINFKNGIKLDE

SEQ ID NO: 3091239 - protein, 24 aa, Giardia lamblia
RCTECPPRYFPYKGGCYEKGTPIG

SEQ ID NO: 3091240 - protein, 24 aa, Giardia lamblia
RCTRCLGNYFLYEGGCYSSSRLPG

SEQ ID NO: 3091241 - protein, 19 aa, Giardia lamblia
RCVFMGWEELCTQCVSGYV

SEQ ID NO: 3091242 - protein, 17 aa, Giardia lamblia
RDAAWQCDCPQGDYLTY

SEQ ID NO: 3091243 - protein, 23 aa, Giardia lamblia
RDACGLCKDSYKLIPETNKCEAC

SEQ ID NO: 3091244 - protein, 23 aa, Giardia lamblia
RDFNLITAFYQYVGSLIPLHAML

SEQ ID NO: 3091245 - protein, 29 aa, Giardia lamblia
RDFTTSNFVFFFFLIITTWSSITTELSPL

SEQ ID NO: 3091246 - protein, 23 aa, Giardia lamblia
RDGVCVLQARRASSVPIAVGVAA

SEQ ID NO: 3091247 - protein, 26 aa, Giardia lamblia
RDHREFLVFRALVLAYAQPPFVQPVY

SEQ ID NO: 3091248 - protein, 36 aa, Giardia lamblia
RDLEALAQLMLFLITIFKRMPFVLQDLLTYQANANL

SEQ ID NO: 3091249 - protein, 31 aa, Giardia lamblia
RDLTTQLPILLFRSMSFYHRNAAGPITYLRG

SEQ ID NO: 3091250 - protein, 25 aa, Giardia lamblia
RDMTPTVFKLDPLFLDGNTSELLEA

SEQ ID NO: 3091251 - protein, 32 aa, Giardia lamblia
RDNPEIVGLGLLFKWLKLLVTYHKRFSTSVGD

SEQ ID NO: 3091252 - protein, 24 aa, Giardia lamblia
RDPPTIHHFFTIINKEPLITVVRK

SEQ ID NO: 3091253 - protein, 40 aa, Giardia lamblia
RDPVILAVVLLTPALMALVLHWLLFYILNANLIASEVALP

SEQ ID NO: 3091254 - protein, 21 aa, Giardia lamblia
RDQLQILPASNIYLQISGFGA

SEQ ID NO: 3091255 - protein, 26 aa, Giardia lamblia
RDSRLPLKFLATFEPRLKYASLLTKQ

SEQ ID NO: 3091256 - protein, 23 aa, Giardia lamblia
RDSSDILSYKPLLRFARERNSEK

SEQ ID NO: 3091257 - protein, 21 aa, Giardia lamblia
RDVIMYRNIRFTLSYMRFLRD

SEQ ID NO: 3091258 - protein, 27 aa, Giardia lamblia
RDWSISRNRFWGCPIPIWMSADKTQLK

SEQ ID NO: 3091259 - protein, 17 aa, Giardia lamblia
RDYETEQLWSLLAAQLD

SEQ ID NO: 3091260 - protein, 27 aa, Giardia lamblia
REAVEAELAILPLLNHPHIQTCDQVLL

SEQ ID NO: 3091261 - protein, 24 aa, Giardia lamblia
RECNKLWHLLSPGGYFLESNFFIA

SEQ ID NO: 3091262 - protein, 24 aa, Giardia lamblia
REDAMVWFSAIEEKNYSKIIELAA

SEQ ID NO: 3091263 - protein, 20 aa, Giardia lamblia
REENGYFKRDGTCNLCNASI

SEQ ID NO: 3091264 - protein, 26 aa, Giardia lamblia
REENLAIYLLYRVVYNMVICRAHGNI

SEQ ID NO: 3091265 - protein, 18 aa, Giardia lamblia
REFRALFLEIILATDMST

SEQ ID NO: 3091266 - protein, 26 aa, Giardia lamblia
REFTRRFLPDFDLLMSILSSLFGILL

SEQ ID NO: 3091267 - protein, 19 aa, Giardia lamblia
REGTKIRIFTISDKLTKIY

SEQ ID NO: 3091268 - protein, 28 aa, Giardia lamblia
REHNALLQYYFVLLSTLGRFIAYTATSV

SEQ ID NO: 3091269 - protein, 17 aa, Giardia lamblia
REIASVLNFLPFEQILT

SEQ ID NO: 3091270 - protein, 19 aa, Giardia lamblia
REIRMFMACTLWNPSQVNI

SEQ ID NO: 3091271 - protein, 42 aa, Giardia lamblia
REKDFRKVQLICFFGLLLPLFLVCTMGWLIAVMVTCRKIPEQ

SEQ ID NO: 3091272 - protein, 23 aa, Giardia lamblia
REKRNRRMFNACKAKIFTDMRKG

SEQ ID NO: 3091273 - protein, 17 aa, Giardia lamblia
RELEKRAFEPHKFCSSI

SEQ ID NO: 3091274 - protein, 17 aa, Giardia lamblia
RELKSALAGLISKPRKG

SEQ ID NO: 3091275 - protein, 27 aa, Giardia lamblia
RELNPSIPVLKLVRKAFKRFSDKPYLG

SEQ ID NO: 3091276 - protein, 19 aa, Giardia lamblia
RELVRLSTIQRPPEPTLAE

SEQ ID NO: 3091277 - protein, 23 aa, Giardia lamblia
REMNVFVYIKKSINMWIVIAVIA

SEQ ID NO: 3091278 - protein, 24 aa, Giardia lamblia
RENINLFNLYKITPSHKLSILFVL

SEQ ID NO: 3091279 - protein, 18 aa, Giardia lamblia
REPVNGFSLPLTGLRLDF

SEQ ID NO: 3091280 - protein, 22 aa, Giardia lamblia
REQLLFLIFNMTNAFLGGNVIP

SEQ ID NO: 3091281 - protein, 26 aa, Giardia lamblia
RERGLYINLFISIYNLCFKLGHPDDL

SEQ ID NO: 3091282 - protein, 26 aa, Giardia lamblia
RERNRMYGILIAPIFSKLFHDVIIGG

SEQ ID NO: 3091283 - protein, 29 aa, Giardia lamblia
RESWASEPIAAFLYLSLSNSERLVTGLFL

SEQ ID NO: 3091284 - protein, 38 aa, Giardia lamblia
RETKLFFAPSFIPLQRFRLLYLISLIVQQFFENIVFSI

SEQ ID NO: 3091285 - protein, 24 aa, Giardia lamblia
RETPQFKLVWPNMNLTLKIRLQSP

SEQ ID NO: 3091286 - protein, 19 aa, Giardia lamblia
RETRCFLTALMIAAIVGAV

SEQ ID NO: 3091287 - protein, 25 aa, Giardia lamblia
REVTNPREYLRYDNPRHLRGVDVSC

SEQ ID NO: 3091288 - protein, 17 aa, Giardia lamblia
REWLRGALRGGFKEIFA

SEQ ID NO: 3091289 - protein, 28 aa, Giardia lamblia
REYLRSPNLLLEYKLMSSRFLMLELDYK

SEQ ID NO: 3091290 - protein, 31 aa, Giardia lamblia
REYSLASRLMLLLLTAFSTPAIFLASKTVIS

SEQ ID NO: 3091291 - protein, 18 aa, Giardia lamblia
RFCDAGFKNPFLQAASCK

SEQ ID NO: 3091292 - protein, 17 aa, Giardia lamblia
RFDFVHNALFTQKSHLS

SEQ ID NO: 3091293 - protein, 18 aa, Giardia lamblia
RFDHHCFWLGTDVGFRNH

SEQ ID NO: 3091294 - protein, 37 aa, Giardia lamblia
RFFDSRLLRYCIFLSKYILLYLYPSSILVFSIVQNNN

SEQ ID NO: 3091295 - protein, 19 aa, Giardia lamblia
RFKVDIWRNAMQRHQFYKA

SEQ ID NO: 3091296 - protein, 21 aa, Giardia lamblia
RFKYKDWFPPILDSPTVERSQ

SEQ ID NO: 3091297 - protein, 20 aa, Giardia lamblia
RFLHRYFGRNFMTIEALSNG

SEQ ID NO: 3091298 - protein, 17 aa, Giardia lamblia
RFLRDRNDQLYRAAAPA

SEQ ID NO: 3091299 - protein, 26 aa, Giardia lamblia
RFLRFHCFLPLFSLINSLTQFNMSTG

SEQ ID NO: 3091300 - protein, 18 aa, Giardia lamblia
RFLRTVLHSFYTTPSIVT

SEQ ID NO: 3091301 - protein, 19 aa, Giardia lamblia
RFLSAIIISSLFGIILVIT

SEQ ID NO: 3091302 - protein, 17 aa, Giardia lamblia
RFNYSILYKDTEFRIRG

SEQ ID NO: 3091303 - protein, 17 aa, Giardia lamblia
RFPWFIDVFIRPLEEFA

SEQ ID NO: 3091304 - protein, 20 aa, Giardia lamblia
RFSLELLLFRVENVTEKFND

SEQ ID NO: 3091305 - protein, 31 aa, Giardia lamblia
RFSSIYTFLHYVPWYFPLDLAKIYCCLTDLT

SEQ ID NO: 3091306 - protein, 27 aa, Giardia lamblia
RFSTALAYIIAILFSFATTAVKLFLLC

SEQ ID NO: 3091307 - protein, 23 aa, Giardia lamblia
RFTVPMIYDLIIGDHIKNTCYRV

SEQ ID NO: 3091308 - protein, 25 aa, Giardia lamblia
RFVHCLCFRIFPSLVYSPDDSTIQI

SEQ ID NO: 3091309 - protein, 19 aa, Giardia lamblia
RFVPFLFNSVLVSNLKVRE

SEQ ID NO: 3091310 - protein, 21 aa, Giardia lamblia
RFWHELVDDFPPFTKIVTAKE

SEQ ID NO: 3091311 - protein, 21 aa, Giardia lamblia
RFYHKLLKMRPRNARLHAASF

SEQ ID NO: 3091312 - protein, 25 aa, Giardia lamblia
RGEGETLFIDPLPRLVPNDIVYIDA

SEQ ID NO: 3091313 - protein, 19 aa, Giardia lamblia
RGFIFSALYSIFRPIFGNV

SEQ ID NO: 3091314 - protein, 17 aa, Giardia lamblia
RGFLPAPDKSGCVPAPE

SEQ ID NO: 3091315 - protein, 29 aa, Giardia lamblia
RGFTSYLRDTAFKDIIIGSSASLSKQLAS

SEQ ID NO: 3091316 - protein, 17 aa, Giardia lamblia
RGFYLLPPHPRFSCSCR

SEQ ID NO: 3091317 - protein, 17 aa, Giardia lamblia
RGFYPSNVFALDYSSVH

SEQ ID NO: 3091318 - protein, 39 aa, Giardia lamblia
RGGWRSPNFWFELLFYLFILISVLLYAFNIQRVVDFLSN

SEQ ID NO: 3091319 - protein, 23 aa, Giardia lamblia
RGHADCLFHLFAEAFIRNRDGQL

SEQ ID NO: 3091320 - protein, 26 aa, Giardia lamblia
RGILDRVNLLLIHRTPRDRTAEDRKK

SEQ ID NO: 3091321 - protein, 24 aa, Giardia lamblia
RGIPGRLVIVLWTGYMDTSPLKES

SEQ ID NO: 3091322 - protein, 19 aa, Giardia lamblia
RGLLQILLSCLRAELYQGR

SEQ ID NO: 3091323 - protein, 30 aa, Giardia lamblia
RGMLWAMVCLIVFPLSLLPRIDFLNFTSLV

SEQ ID NO: 3091324 - protein, 18 aa, Giardia lamblia
RGMLYKMASKLVERVRCS

SEQ ID NO: 3091325 - protein, 27 aa, Giardia lamblia
RGMSSYVAPLLFLYKEESVLPHLQILY

SEQ ID NO: 3091326 - protein, 21 aa, Giardia lamblia
RGNHLLLDLIKQTSAAAFSLA

SEQ ID NO: 3091327 - protein, 19 aa, Giardia lamblia
RGPFHSGLRRLGVPEFKVL

SEQ ID NO: 3091328 - protein, 45 aa, Giardia lamblia
RGQIAAYVSLLYLVGFVILTVICWLMGFYLYRRFIKSFEACTMLP

SEQ ID NO: 3091329 - protein, 37 aa, Giardia lamblia
RGQLPELLEWINRVLLGPFISYMCYELLVMSVDLANL

SEQ ID NO: 3091330 - protein, 17 aa, Giardia lamblia
RGSFGSVYYCLHRESRN

SEQ ID NO: 3091331 - protein, 26 aa, Giardia lamblia
RGSTQLLVLRLYRWYNNQLNEIRRLP

SEQ ID NO: 3091332 - protein, 21 aa, Giardia lamblia
RGTASLKDPWDLPANEKLNAT

SEQ ID NO: 3091333 - protein, 59 aa, Giardia lamblia
RGTELYERWRLNKYLRNLPTHKLIYLLTIIYVLAPPWVRIYRIMRDIPLPLISAGVDSS

SEQ ID NO: 3091334 - protein, 34 aa, Giardia lamblia
RGTESFVIVFALGTFLILLLVTISLHCCELKRDK

SEQ ID NO: 3091335 - protein, 28 aa, Giardia lamblia
RGTEYCSMSLFTNSPWLLAFSTESIAAM

SEQ ID NO: 3091336 - protein, 17 aa, Giardia lamblia
RGTLILACTIGYAICLQ

SEQ ID NO: 3091337 - protein, 23 aa, Giardia lamblia
RGTPAIVFAARKNHLDCVSLLAP

SEQ ID NO: 3091338 - protein, 21 aa, Giardia lamblia
RGVICFPKYYEGRPMTDCLSG

SEQ ID NO: 3091339 - protein, 20 aa, Giardia lamblia
RGVRHRVILVLRGHSLHAIR

SEQ ID NO: 3091340 - protein, 33 aa, Giardia lamblia
RGWLRYSTSAFKWPLFKPFLRPLTCKPILEEHV

SEQ ID NO: 3091341 - protein, 17 aa, Giardia lamblia
RGWPQKIKKYLRYNLTT

SEQ ID NO: 3091342 - protein, 18 aa, Giardia lamblia
RGYCKPCNDPVATITIVG

SEQ ID NO: 3091343 - protein, 19 aa, Giardia lamblia
RGYCKPCNDPVATITIVGV

SEQ ID NO: 3091344 - protein, 26 aa, Giardia lamblia
RGYLDITRILLPHESRMYNLAGETAL

SEQ ID NO: 3091345 - protein, 22 aa, Giardia lamblia
RGYTDIAKLLFPLEAAIKAYDG

SEQ ID NO: 3091346 - protein, 17 aa, Giardia lamblia
RGYYFNTLTSFMTTCPQ

SEQ ID NO: 3091347 - protein, 24 aa, Giardia lamblia
RHALALILIALLPVPFNVFVVASV

SEQ ID NO: 3091348 - protein, 17 aa, Giardia lamblia
RHALLGAVDTRRFYYEV

SEQ ID NO: 3091349 - protein, 22 aa, Giardia lamblia
RHALMNFLIKDSYCAGLSLLSL

SEQ ID NO: 3091350 - protein, 24 aa, Giardia lamblia
RHESTKVLLIASAKYSPFVAVFFG

SEQ ID NO: 3091351 - protein, 22 aa, Giardia lamblia
RHHLFRLLSAIVELGTYLYTEA

SEQ ID NO: 3091352 - protein, 31 aa, Giardia lamblia
RHHLLAYFVVYLMDFVILPALYQSFSAVSMH

SEQ ID NO: 3091353 - protein, 19 aa, Giardia lamblia
RHHTFLTSYDLFKQRSKAF

SEQ ID NO: 3091354 - protein, 27 aa, Giardia lamblia
RHKLMTKYLGLWKQYIDKIRLQRYKIL

SEQ ID NO: 3091355 - protein, 30 aa, Giardia lamblia
RHLGSSFLFILFDYIIYFISSFYSSKIPEL

SEQ ID NO: 3091356 - protein, 17 aa, Giardia lamblia
RHRVSLNSFLRSALQVI

SEQ ID NO: 3091357 - protein, 26 aa, Giardia lamblia
RHSIKVTLIFILSAAIRWTILFSCVA

SEQ ID NO: 3091358 - protein, 28 aa, Giardia lamblia
RHTNTFGQLILYWAILLSPRTTISTLVG

SEQ ID NO: 3091359 - protein, 21 aa, Giardia lamblia
RHWDKAFEFLKSALESKAVRL

SEQ ID NO: 3091360 - protein, 24 aa, Giardia lamblia
RHYLYSALYSWQQPLRAALLSVDE

SEQ ID NO: 3091361 - protein, 18 aa, Giardia lamblia
RIASFATLYLAPTALSTI

SEQ ID NO: 3091362 - protein, 23 aa, Giardia lamblia
RIDPVFRDVLGTKLSYAHTSCFL

SEQ ID NO: 3091363 - protein, 42 aa, Giardia lamblia
RIFGAILSLFYPVDAGILQLMKLFDYLLFASTDVFSPKRVVT

SEQ ID NO: 3091364 - protein, 17 aa, Giardia lamblia
RIFWKQVSPGRLSFVYK

SEQ ID NO: 3091365 - protein, 18 aa, Giardia lamblia
RIGIFSTLFIMITVASTA

SEQ ID NO: 3091366 - protein, 27 aa, Giardia lamblia
RIHPLKLPWIGHNNVVYLFIPESISSI

SEQ ID NO: 3091367 - protein, 17 aa, Giardia lamblia
RIIDCLAILMHAPLSKI

SEQ ID NO: 3091368 - protein, 25 aa, Giardia lamblia
RIINAHFYLTSLSINLVLVFSPGWI

SEQ ID NO: 3091369 - protein, 26 aa, Giardia lamblia
RIKDYLILLDKYYPGWRAFRDEHDPG

SEQ ID NO: 3091370 - protein, 28 aa, Giardia lamblia
RILATLYSFFNHSILPYMQQCRLSDAIA

SEQ ID NO: 3091371 - protein, 22 aa, Giardia lamblia
RILIPVPRYKKTLSSRAFLPIF

SEQ ID NO: 3091372 - protein, 22 aa, Giardia lamblia
RILQLSIRKFSLSRNLHLSDIG

SEQ ID NO: 3091373 - protein, 24 aa, Giardia lamblia
RILTYYNCYLLSEIVAILSTTVVT

SEQ ID NO: 3091374 - protein, 17 aa, Giardia lamblia
RILYPLFANDRTVYDDR

SEQ ID NO: 3091375 - protein, 24 aa, Giardia lamblia
RIMNPFLFNLSWPAIIYRGQLWRL

SEQ ID NO: 3091376 - protein, 24 aa, Giardia lamblia
RIMSIYLELLSYFGINSKCTSVFT

SEQ ID NO: 3091377 - protein, 25 aa, Giardia lamblia
RIPTLPVYCKVAGSFKKRGIVKVLQ

SEQ ID NO: 3091378 - protein, 28 aa, Giardia lamblia
RIPVGLLSFQILFGVLLHMRRQIELLCS

SEQ ID NO: 3091379 - protein, 25 aa, Giardia lamblia
RIRGMTDLMLLTIRNDVDAVALLAE

SEQ ID NO: 3091380 - protein, 21 aa, Giardia lamblia
RIRTRLRLLQSRAERAILIAL

SEQ ID NO: 3091381 - protein, 19 aa, Giardia lamblia
RIRVFIRSLLQAINFLYSN

SEQ ID NO: 3091382 - protein, 18 aa, Giardia lamblia
RISSENLCLLPQVKQALS

SEQ ID NO: 3091383 - protein, 20 aa, Giardia lamblia
RISVHYLPELFKVFRYVIER

SEQ ID NO: 3091384 - protein, 33 aa, Giardia lamblia
RITDFLAFIPMFTAVPFRLVYSIVILSTTINPL

SEQ ID NO: 3091385 - protein, 38 aa, Giardia lamblia
RITGRFLYTLYESALYYLGRFLPAIYLDIAIRISGQIV

SEQ ID NO: 3091386 - protein, 34 aa, Giardia lamblia
RITHKYRNFLFYKPPLYMFYDSIKLTLPGSSLSS

SEQ ID NO: 3091387 - protein, 28 aa, Giardia lamblia
RIVGVIGFPLFMHYLGQLLACFDLLHPG

SEQ ID NO: 3091388 - protein, 23 aa, Giardia lamblia
RIYKHCNYFILNCPQLKVHLISH

SEQ ID NO: 3091389 - protein, 28 aa, Giardia lamblia
RKALTLDGMLLCPRDCPAEGFWTSGREC

SEQ ID NO: 3091390 - protein, 17 aa, Giardia lamblia
RKCLLIIGISMSSLSIN

SEQ ID NO: 3091391 - protein, 24 aa, Giardia lamblia
RKDQVVSQMFLLLRSEFSRQRLLK

SEQ ID NO: 3091392 - protein, 22 aa, Giardia lamblia
RKERLEAYKARYPNRAPLADVA

SEQ ID NO: 3091393 - protein, 22 aa, Giardia lamblia
RKFCYRTCGTSGPIQYCTGCRE

SEQ ID NO: 3091394 - protein, 17 aa, Giardia lamblia
RKIVLYTLRDYSRDMFF

SEQ ID NO: 3091395 - protein, 30 aa, Giardia lamblia
RKLAKLWVQPNLYLMSWEALVDRFVDQYFG

SEQ ID NO: 3091396 - protein, 27 aa, Giardia lamblia
RKLGALNEPLFFTPDNVLLLERENPGK

SEQ ID NO: 3091397 - protein, 19 aa, Giardia lamblia
RKLHLDFVSLLRASGKAAD

SEQ ID NO: 3091398 - protein, 20 aa, Giardia lamblia
RKMKKINIQIIIIAIPPDKD

SEQ ID NO: 3091399 - protein, 30 aa, Giardia lamblia
RKNKIDFDKLYRKEIQPPFKPKLEQSCILA

SEQ ID NO: 3091400 - protein, 19 aa, Giardia lamblia
RKRVLACLPLLLVSTATAM

SEQ ID NO: 3091401 - protein, 26 aa, Giardia lamblia
RKSELSFFHMLLTDQELWPTVSEAAL

SEQ ID NO: 3091402 - protein, 20 aa, Giardia lamblia
RKSVLSSIPLLLLSENQRYF

SEQ ID NO: 3091403 - protein, 26 aa, Giardia lamblia
RKTSVWILALLIRCVLIWLGTYISDP

SEQ ID NO: 3091404 - protein, 20 aa, Giardia lamblia
RKVLVKAGRDLSLLEKEILG

SEQ ID NO: 3091405 - protein, 49 aa, Giardia lamblia
RKYNWIVFPFVAVLKQFRLFFNQFFLVLAFLQLYRPLQVGLAFTYYLPL

SEQ ID NO: 3091406 - protein, 23 aa, Giardia lamblia
RKYRPKEFFGLKRYCKEQPQYVA

SEQ ID NO: 3091407 - protein, 35 aa, Giardia lamblia
RLACLSIPYTSLLPILWAFSQLYSLYLYSNVLTSQ

SEQ ID NO: 3091408 - protein, 24 aa, Giardia lamblia
RLAEKYHFAFFESLLLKLDSSVHL

SEQ ID NO: 3091409 - protein, 23 aa, Giardia lamblia
RLAGALMKILTLTVRSFDLSTQD

SEQ ID NO: 3091410 - protein, 20 aa, Giardia lamblia
RLCFDTIIDYYFEKGKMDIK

SEQ ID NO: 3091411 - protein, 22 aa, Giardia lamblia
RLCVQHFPYMCSSGIFADASFE

SEQ ID NO: 3091412 - protein, 20 aa, Giardia lamblia
RLDIPRFEFISFLSDLTDDT

SEQ ID NO: 3091413 - protein, 23 aa, Giardia lamblia
RLEKRIILSYWLSVVIAVLSLVI

SEQ ID NO: 3091414 - protein, 22 aa, Giardia lamblia
RLERLLQLTAILSKPMLNLKTL

SEQ ID NO: 3091415 - protein, 21 aa, Giardia lamblia
RLEVGMLLRYTLKEGAYHKVM

SEQ ID NO: 3091416 - protein, 26 aa, Giardia lamblia
RLEYIKVIIGVLLIPTTILKSPAALS

SEQ ID NO: 3091417 - protein, 18 aa, Giardia lamblia
RLFAPLYGYKHSGIYVNG

SEQ ID NO: 3091418 - protein, 18 aa, Giardia lamblia
RLGFPIMTLTSVCMQLFP

SEQ ID NO: 3091419 - protein, 25 aa, Giardia lamblia
RLGLNRVFLAGAFLFAVVTFLMGFL

SEQ ID NO: 3091420 - protein, 27 aa, Giardia lamblia
RLGPYSLLLHFLWPVTLDLVVGALYEH

SEQ ID NO: 3091421 - protein, 34 aa, Giardia lamblia
RLGSWMVTILLFVAYLFATGVLFAVNRLSSFMLM

SEQ ID NO: 3091422 - protein, 18 aa, Giardia lamblia
RLGYIAVLLLDATLLIFK

SEQ ID NO: 3091423 - protein, 26 aa, Giardia lamblia
RLHYQHWIIVFGILAILTVAAIVALV

SEQ ID NO: 3091424 - protein, 25 aa, Giardia lamblia
RLISFKTFCLWLLASIVISFMIFVS

SEQ ID NO: 3091425 - protein, 20 aa, Giardia lamblia
RLITMYNKGWRAASLLIVLI

SEQ ID NO: 3091426 - protein, 17 aa, Giardia lamblia
RLLAKCLQTSYVASAIQ

SEQ ID NO: 3091427 - protein, 19 aa, Giardia lamblia
RLLELLRHDFPSFISFYKM

SEQ ID NO: 3091428 - protein, 18 aa, Giardia lamblia
RLLHQNRTFAYVKAILGV

SEQ ID NO: 3091429 - protein, 18 aa, Giardia lamblia
RLLLPKDMLFSCEKFRHW

SEQ ID NO: 3091430 - protein, 21 aa, Giardia lamblia
RLLSFFRGKIPVIVTPIFAAI

SEQ ID NO: 3091431 - protein, 17 aa, Giardia lamblia
RLLSMRARYSKLLGAYN

SEQ ID NO: 3091432 - protein, 28 aa, Giardia lamblia
RLMQMKAMRFFIQLSPLVLAFCADACLL

SEQ ID NO: 3091433 - protein, 18 aa, Giardia lamblia
RLNEAGALVYMITAEIYT

SEQ ID NO: 3091434 - protein, 24 aa, Giardia lamblia
RLNHKLVLLYHRYTRLLHINLLTI

SEQ ID NO: 3091435 - protein, 21 aa, Giardia lamblia
RLNLYYCLLDFLSECIGVQKI

SEQ ID NO: 3091436 - protein, 24 aa, Giardia lamblia
RLPKNIVPVPLKIGGYCAPIVYIP

SEQ ID NO: 3091437 - protein, 18 aa, Giardia lamblia
RLPSPYGNLLPLSLPSTA

SEQ ID NO: 3091438 - protein, 23 aa, Giardia lamblia
RLPTIPLENTRWPIPVRFVFDGV

SEQ ID NO: 3091439 - protein, 19 aa, Giardia lamblia
RLRDLIAIALSYKHLCGRR

SEQ ID NO: 3091440 - protein, 17 aa, Giardia lamblia
RLRGIYILSSTGRHFFN

SEQ ID NO: 3091441 - protein, 20 aa, Giardia lamblia
RLRNVFGMTALMLAAKYGNQ

SEQ ID NO: 3091442 - protein, 19 aa, Giardia lamblia
RLSENILFLLETTSLRLEA

SEQ ID NO: 3091443 - protein, 26 aa, Giardia lamblia
RLSRLLYEVLVQIGSPLYCLWTASNL

SEQ ID NO: 3091444 - protein, 22 aa, Giardia lamblia
RLSSFRLLVRVAYALELKEFNL

SEQ ID NO: 3091445 - protein, 32 aa, Giardia lamblia
RLSTLDEILILWLQVQQNWIYLEAVFSGGDIS

SEQ ID NO: 3091446 - protein, 22 aa, Giardia lamblia
RLSVYELLSYPPIKAIIAESAI

SEQ ID NO: 3091447 - protein, 19 aa, Giardia lamblia
RLTDVLRLARSHELAFMAQ

SEQ ID NO: 3091448 - protein, 28 aa, Giardia lamblia
RLTGTGAMFYQFPDTRLAVLATGSFADG

SEQ ID NO: 3091449 - protein, 17 aa, Giardia lamblia
RLTLFLHGYEDIISYPE

SEQ ID NO: 3091450 - protein, 22 aa, Giardia lamblia
RLTLLTVKHRFHKSHLLPIAIV

SEQ ID NO: 3091451 - protein, 29 aa, Giardia lamblia
RLTPLIELYLNKCVQPLLYNKLPSGKIMG

SEQ ID NO: 3091452 - protein, 25 aa, Giardia lamblia
RLTRHPGYLGWFIWAVSTQVMLANP

SEQ ID NO: 3091453 - protein, 24 aa, Giardia lamblia
RLTSRWFVLFFLRVAPPIFAGEKR

SEQ ID NO: 3091454 - protein, 21 aa, Giardia lamblia
RLVRIHVCVDTWALDRAEKFV

SEQ ID NO: 3091455 - protein, 20 aa, Giardia lamblia
RLVYRGILETSVMNSFLLFM

SEQ ID NO: 3091456 - protein, 17 aa, Giardia lamblia
RLWFNRELYIRMALYPL

SEQ ID NO: 3091457 - protein, 18 aa, Giardia lamblia
RLYALIKYSWLYCTVATA

SEQ ID NO: 3091458 - protein, 17 aa, Giardia lamblia
RLYLAPPDWPKNDNYSS

SEQ ID NO: 3091459 - protein, 17 aa, Giardia lamblia
RLYSQLTNYCRIANIDS

SEQ ID NO: 3091460 - protein, 23 aa, Giardia lamblia
RMCHVFIAQFISKALICCIDQCE

SEQ ID NO: 3091461 - protein, 19 aa, Giardia lamblia
RMFLLVVDSFARFLASGQL

SEQ ID NO: 3091462 - protein, 20 aa, Giardia lamblia
RMGARIILLLCLAAMLSVAI

SEQ ID NO: 3091463 - protein, 18 aa, Giardia lamblia
RMGMYSGFAITLYTLANN

SEQ ID NO: 3091464 - protein, 38 aa, Giardia lamblia
RMIKCERIIKIVLWSASVLFLGLSALGFYVYHHNVPHN

SEQ ID NO: 3091465 - protein, 19 aa, Giardia lamblia
RMLYGFPNNSDVAFFVSTL

SEQ ID NO: 3091466 - protein, 33 aa, Giardia lamblia
RMSETDLLRRLSILLILLVRALGDGLLAFSTYV

SEQ ID NO: 3091467 - protein, 30 aa, Giardia lamblia
RMSFEEHVFMPHIFLEILLDLVVNARQYSK

SEQ ID NO: 3091468 - protein, 24 aa, Giardia lamblia
RMSNIIVFIIWIVCLTVVPCLAFL

SEQ ID NO: 3091469 - protein, 18 aa, Giardia lamblia
RNAPTGDYFTFLYANSVE

SEQ ID NO: 3091470 - protein, 19 aa, Giardia lamblia
RNELAKHIHILEAELALER

SEQ ID NO: 3091471 - protein, 25 aa, Giardia lamblia
RNEQLEFSYFPYISEYRSVLRPNEP

SEQ ID NO: 3091472 - protein, 32 aa, Giardia lamblia
RNEYDILLFVAHTIYLMLSPNAPLNAPSNEYS

SEQ ID NO: 3091473 - protein, 34 aa, Giardia lamblia
RNGYTALMYAAEKGAYPIVRILAELGDEAGKQNL

SEQ ID NO: 3091474 - protein, 18 aa, Giardia lamblia
RNIRLVFASSPDASAIGQ

SEQ ID NO: 3091475 - protein, 32 aa, Giardia lamblia
RNKKLGSIALKLLLIYRVDSPDFLQLFGCIYY

SEQ ID NO: 3091476 - protein, 24 aa, Giardia lamblia
RNKYLVPYLDTFFEKQWAGYFAVM

SEQ ID NO: 3091477 - protein, 17 aa, Giardia lamblia
RNKYYRSGSTCAPCHQS

SEQ ID NO: 3091478 - protein, 28 aa, Giardia lamblia
RNLIFDELLLFTGYLRQPAVVTALCQFY

SEQ ID NO: 3091479 - protein, 42 aa, Giardia lamblia
RNLLRKALHGIKRLFFLVHRFCAVLYYKLLSTPLNPSEASVE

SEQ ID NO: 3091480 - protein, 17 aa, Giardia lamblia
RNLMLDLLDAGLTKGMC

SEQ ID NO: 3091481 - protein, 27 aa, Giardia lamblia
RNNFFSTFRQRKYLSLWKHSIATTARN

SEQ ID NO: 3091482 - protein, 25 aa, Giardia lamblia
RNNRRRCACLLWPLEHAIADRDGIS

SEQ ID NO: 3091483 - protein, 26 aa, Giardia lamblia
RNQRGLLTNLLFTPSPNDIFSSLPMF

SEQ ID NO: 3091484 - protein, 18 aa, Giardia lamblia
RNRRLLSMRARYSKLLGA

SEQ ID NO: 3091485 - protein, 17 aa, Giardia lamblia
RNTAECRAAFSTTAIVR

SEQ ID NO: 3091486 - protein, 17 aa, Giardia lamblia
RNTLLRLQPGYFDNRRA

SEQ ID NO: 3091487 - protein, 17 aa, Giardia lamblia
RNTLSAVIFFNDVPYKV

SEQ ID NO: 3091488 - protein, 17 aa, Giardia lamblia
RNVDTILVCVMLIAFRV

SEQ ID NO: 3091489 - protein, 17 aa, Giardia lamblia
RNYCIASYNLLMEKKKE

SEQ ID NO: 3091490 - protein, 17 aa, Giardia lamblia
RPALILCPCNFRGADDF

SEQ ID NO: 3091491 - protein, 24 aa, Giardia lamblia
RPAPGFLLFATQNPSGSYAGRKML

SEQ ID NO: 3091492 - protein, 20 aa, Giardia lamblia
RPATRFITIIHALNAQHIRR

SEQ ID NO: 3091493 - protein, 33 aa, Giardia lamblia
RPCIVRRRRKLMRPPRVALPGSLTFVADVSYTL

SEQ ID NO: 3091494 - protein, 19 aa, Giardia lamblia
RPDQALFSAVRRLLPSISS

SEQ ID NO: 3091495 - protein, 17 aa, Giardia lamblia
RPFFIHSLADLHENIRT

SEQ ID NO: 3091496 - protein, 17 aa, Giardia lamblia
RPFLKQVRRPKDVYSFK

SEQ ID NO: 3091497 - protein, 21 aa, Giardia lamblia
RPIAFFSMEPIFYRYIEAARR

SEQ ID NO: 3091498 - protein, 21 aa, Giardia lamblia
RPIIDPPELMPIVSAIRSLIS

SEQ ID NO: 3091499 - protein, 21 aa, Giardia lamblia
RPLLTLLGYIMAIAGFVLTIF

SEQ ID NO: 3091500 - protein, 19 aa, Giardia lamblia
RPMKWIPNCRPWVVTLIGI

SEQ ID NO: 3091501 - protein, 33 aa, Giardia lamblia
RPNVSPFYEALFSPYFLSLPLQLVHVDNDFSMT

SEQ ID NO: 3091502 - protein, 36 aa, Giardia lamblia
RPPNTFIYILCYLTQIFMFLWLEGCGPYAFYKLSGS

SEQ ID NO: 3091503 - protein, 34 aa, Giardia lamblia
RPRSPVWVDLYSYRSLPRFFAVLASLIAAVIITI

SEQ ID NO: 3091504 - protein, 23 aa, Giardia lamblia
RPSSPFRLARPLANQFAPLTKTG

SEQ ID NO: 3091505 - protein, 18 aa, Giardia lamblia
RPSYSLQAKYLLASKAIL

SEQ ID NO: 3091506 - protein, 27 aa, Giardia lamblia
RPTEFLLFLFFLWASILLISFIYSMFY

SEQ ID NO: 3091507 - protein, 47 aa, Giardia lamblia
RPVDCYGIYLPSWFSFIHAGRILRGLYYVKTLLLAKTYFPYDTASDR

SEQ ID NO: 3091508 - protein, 40 aa, Giardia lamblia
RPYIAKYLYRDILNMIPHDYPLSFILPFITNSIGHRVVEQ

SEQ ID NO: 3091509 - protein, 24 aa, Giardia lamblia
RQAIAIIPQEPFLFSGTLRQSLCA

SEQ ID NO: 3091510 - protein, 19 aa, Giardia lamblia
RQCAPQECVFPRSANGHDV

SEQ ID NO: 3091511 - protein, 18 aa, Giardia lamblia
RQDKKIMQVTLKKVNNLL

SEQ ID NO: 3091512 - protein, 28 aa, Giardia lamblia
RQEAESLPHFLLYYAKNKYGVTAIVTSL

SEQ ID NO: 3091513 - protein, 23 aa, Giardia lamblia
RQELRSFYPPKALNVPAQCSSND

SEQ ID NO: 3091514 - protein, 17 aa, Giardia lamblia
RQFFFAIDADKTGWRRK

SEQ ID NO: 3091515 - protein, 27 aa, Giardia lamblia
RQGDTKVIQILLPYEAGLANDDNQTAL

SEQ ID NO: 3091516 - protein, 18 aa, Giardia lamblia
RQGVINSILLGEPAFREQ

SEQ ID NO: 3091517 - protein, 26 aa, Giardia lamblia
RQHRQTFLFLTFINYAEAFADTLASE

SEQ ID NO: 3091518 - protein, 17 aa, Giardia lamblia
RQIHLKLTIPNTGLLFE

SEQ ID NO: 3091519 - protein, 17 aa, Giardia lamblia
RQISIALIVFIVTAPEA

SEQ ID NO: 3091520 - protein, 21 aa, Giardia lamblia
RQLEVQLLLLRSALISISRVS

SEQ ID NO: 3091521 - protein, 31 aa, Giardia lamblia
RQLQRSPLLKRALNQLLLTYARHLAYNEREL

SEQ ID NO: 3091522 - protein, 20 aa, Giardia lamblia
RQLTTFDIFFAGGADHFARA

SEQ ID NO: 3091523 - protein, 20 aa, Giardia lamblia
RQPTAFLTFLVESLSHWHTY

SEQ ID NO: 3091524 - protein, 24 aa, Giardia lamblia
RQQLSLIIMIIVHLSLLVKHAPNC

SEQ ID NO: 3091525 - protein, 24 aa, Giardia lamblia
RQSDNLLNFLLSMGVEPFTVRYLS

SEQ ID NO: 3091526 - protein, 20 aa, Giardia lamblia
RQVILPILCLPFIGTTIVLY

SEQ ID NO: 3091527 - protein, 25 aa, Giardia lamblia
RQVSRFIKILSGNRLVYSLSVTLTG

SEQ ID NO: 3091528 - protein, 18 aa, Giardia lamblia
RQYFRQFFHLDMPVFVSW

SEQ ID NO: 3091529 - protein, 46 aa, Giardia lamblia
RRAAPVNIAFTSIFAILLVGAVAALIFFLLRIYVCKSGTGRMKSSS

SEQ ID NO: 3091530 - protein, 27 aa, Giardia lamblia
RRARTAAADILLLVPASCPAAELGKYI

SEQ ID NO: 3091531 - protein, 18 aa, Giardia lamblia
RRCLAISIILPFLQQFTG

SEQ ID NO: 3091532 - protein, 18 aa, Giardia lamblia
RRCPLIRSAVLYNNIYTS

SEQ ID NO: 3091533 - protein, 25 aa, Giardia lamblia
RRCPLRFAPLTQLMKRKIVPDKQSM

SEQ ID NO: 3091534 - protein, 26 aa, Giardia lamblia
RREIETTLMRLLETKTHLQGVSPSLE

SEQ ID NO: 3091535 - protein, 18 aa, Giardia lamblia
RRERSAIALISYANFRGR

SEQ ID NO: 3091536 - protein, 18 aa, Giardia lamblia
RRFLRFTVPPNLDICLIQ

SEQ ID NO: 3091537 - protein, 32 aa, Giardia lamblia
RRGGPLRERAPRKPPGLPKPQLTHNSSLTASM

SEQ ID NO: 3091538 - protein, 41 aa, Giardia lamblia
RRIKRKNAFLTLLRILMITLAILLCFMMASAAQLFGADFLY

SEQ ID NO: 3091539 - protein, 17 aa, Giardia lamblia
RRKFLESYTLYTLPTIL

SEQ ID NO: 3091540 - protein, 35 aa, Giardia lamblia
RRKKQALIHMVVFCSYLLSADTLVHGPRGSSLVRP

SEQ ID NO: 3091541 - protein, 42 aa, Giardia lamblia
RRKRFKLLQTYLSHELRFLPTYTMSLFLLTSLANLHADLFHQ

SEQ ID NO: 3091542 - protein, 34 aa, Giardia lamblia
RRKTLVPIAVILSVLRQVAAALAYLYGASGADTE

SEQ ID NO: 3091543 - protein, 17 aa, Giardia lamblia
RRLLLSIRDMLISERVF

SEQ ID NO: 3091544 - protein, 19 aa, Giardia lamblia
RRLNHLVIVILKDLASTDQ

SEQ ID NO: 3091545 - protein, 17 aa, Giardia lamblia
RRLQGLLKDDLVPSLSA

SEQ ID NO: 3091546 - protein, 23 aa, Giardia lamblia
RRLQSNDLFLLLANPIKVAAEDN

SEQ ID NO: 3091547 - protein, 19 aa, Giardia lamblia
RRPPAAYMINDACTAAACV

SEQ ID NO: 3091548 - protein, 26 aa, Giardia lamblia
RRRATALLWEYRLGFKRTRNMLLQFM

SEQ ID NO: 3091549 - protein, 19 aa, Giardia lamblia
RRRCAFGMCLNLGPAELCL

SEQ ID NO: 3091550 - protein, 23 aa, Giardia lamblia
RRRMVKLTLPPFYVEANLQPDQA

SEQ ID NO: 3091551 - protein, 32 aa, Giardia lamblia
RRRVLIRNIGLLKIMHLTFSNLSPLPFHMIIQ

SEQ ID NO: 3091552 - protein, 29 aa, Giardia lamblia
RRSIYYAYAFCFLMYMLMGCFGALLYGHD

SEQ ID NO: 3091553 - protein, 32 aa, Giardia lamblia
RRSLRSRESIAIPILLLIPPGAQPGKLIVEYY

SEQ ID NO: 3091554 - protein, 17 aa, Giardia lamblia
RRTCRFICDTFVLSYRR

SEQ ID NO: 3091555 - protein, 28 aa, Giardia lamblia
RRTFVALQFAYIFFSSLYALLMELAFNI

SEQ ID NO: 3091556 - protein, 17 aa, Giardia lamblia
RRTLYICLTDLLYYDKT

SEQ ID NO: 3091557 - protein, 25 aa, Giardia lamblia
RRTYSLTEITLLPRSWPAAVRNEIM

SEQ ID NO: 3091558 - protein, 26 aa, Giardia lamblia
RSAEPGSFFIPLPGPAISSQHLEMVF

SEQ ID NO: 3091559 - protein, 21 aa, Giardia lamblia
RSAIALISYANFRGRNANEAM

SEQ ID NO: 3091560 - protein, 20 aa, Giardia lamblia
RSAKPFTRLIHAIEKLCHPS

SEQ ID NO: 3091561 - protein, 29 aa, Giardia lamblia
RSARFPAVPFAFMPLIQGAAQFGREFVTI

SEQ ID NO: 3091562 - protein, 25 aa, Giardia lamblia
RSDAFLLLSLFMRLAARPIDGLAEF

SEQ ID NO: 3091563 - protein, 50 aa, Giardia lamblia
RSDEKRLDRFFAMKYYVSAKPFRSLVLNPSPWQKIYECPILVKVLSYSHV

SEQ ID NO: 3091564 - protein, 20 aa, Giardia lamblia
RSEMYLYRGACRECNFAGSN

SEQ ID NO: 3091565 - protein, 20 aa, Giardia lamblia
RSFLIKCCSIDPLRFFKALK

SEQ ID NO: 3091566 - protein, 22 aa, Giardia lamblia
RSFPLCIVSNVIDASFACTLSL

SEQ ID NO: 3091567 - protein, 29 aa, Giardia lamblia
RSGHTALMIACIYGGLDAALMLAEKERCI

SEQ ID NO: 3091568 - protein, 35 aa, Giardia lamblia
RSIINLFMSIYGLRLGRILWAFLPARDVVSNWKTD

SEQ ID NO: 3091569 - protein, 18 aa, Giardia lamblia
RSILATIKPDLLKALVYF

SEQ ID NO: 3091570 - protein, 24 aa, Giardia lamblia
RSINKWYALIPVFGPVSILTQLQA

SEQ ID NO: 3091571 - protein, 23 aa, Giardia lamblia
RSKNLLSILFCEAIALYGVIMSI

SEQ ID NO: 3091572 - protein, 29 aa, Giardia lamblia
RSKSALLFSLLRIPLFNTTPSRVVDAMLN

SEQ ID NO: 3091573 - protein, 21 aa, Giardia lamblia
RSLARLLRSLLTLVNSPLPQP

SEQ ID NO: 3091574 - protein, 20 aa, Giardia lamblia
RSLGFSLLFDDLSSSLNFLN

SEQ ID NO: 3091575 - protein, 19 aa, Giardia lamblia
RSLLKFELLATQDPANPSE

SEQ ID NO: 3091576 - protein, 17 aa, Giardia lamblia
RSLLRAALDLRFDEIKL

SEQ ID NO: 3091577 - protein, 26 aa, Giardia lamblia
RSLQHKNYFKLAIANLIIGDALAAVE

SEQ ID NO: 3091578 - protein, 24 aa, Giardia lamblia
RSLQMFDLLLARFADKRTRLYSVF

SEQ ID NO: 3091579 - protein, 26 aa, Giardia lamblia
RSLQSYNFIPPLLSYIFELTSIHILP

SEQ ID NO: 3091580 - protein, 24 aa, Giardia lamblia
RSLSVFDVLYYILKFVLSICTAYM

SEQ ID NO: 3091581 - protein, 24 aa, Giardia lamblia
RSNAFRIMGFYENALRDIEFCAHR

SEQ ID NO: 3091582 - protein, 17 aa, Giardia lamblia
RSNALNKLSHLALNTSE

SEQ ID NO: 3091583 - protein, 36 aa, Giardia lamblia
RSPDFMQYFSFEPRLRITRPMRLSLLYNLASQSVLF

SEQ ID NO: 3091584 - protein, 25 aa, Giardia lamblia
RSPHGIIICIDLLYREIAAYGSVPT

SEQ ID NO: 3091585 - protein, 17 aa, Giardia lamblia
RSPLTTFNKVNAPCFNT

SEQ ID NO: 3091586 - protein, 23 aa, Giardia lamblia
RSQLADILNRLREKHKEMHLCEV

SEQ ID NO: 3091587 - protein, 34 aa, Giardia lamblia
RSQNYCIDFFVILFMYITFSIILRVTKFNTMAVI

SEQ ID NO: 3091588 - protein, 24 aa, Giardia lamblia
RSRHSRLLARHSSISAYKCMLAML

SEQ ID NO: 3091589 - protein, 20 aa, Giardia lamblia
RSRHVFSIELLGVLLVRSSV

SEQ ID NO: 3091590 - protein, 17 aa, Giardia lamblia
RSRRFLRFTVPPNLDIC

SEQ ID NO: 3091591 - protein, 34 aa, Giardia lamblia
RSSFLSLNYRSTNPFWFVHLMSMVKLYGQDLDPF

SEQ ID NO: 3091592 - protein, 29 aa, Giardia lamblia
RSSPYTPLNFVPLFLKAQFSRPSNVIFVG

SEQ ID NO: 3091593 - protein, 19 aa, Giardia lamblia
RSTRILLMISEYVSTHGLF

SEQ ID NO: 3091594 - protein, 19 aa, Giardia lamblia
RSVGWWVGIVVFVFGVIMD

SEQ ID NO: 3091595 - protein, 32 aa, Giardia lamblia
RSVIFLQRQIRLLRRSAAILRLLESAHRRALV

SEQ ID NO: 3091596 - protein, 20 aa, Giardia lamblia
RSWYGLVIVVGIVAILMGVI

SEQ ID NO: 3091597 - protein, 19 aa, Giardia lamblia
RSYKFLLNLLMIDTDEDLD

SEQ ID NO: 3091598 - protein, 21 aa, Giardia lamblia
RSYRLPFILGYNLGAKKLYLV

SEQ ID NO: 3091599 - protein, 17 aa, Giardia lamblia
RSYVLRILAGEGVSLVG

SEQ ID NO: 3091600 - protein, 19 aa, Giardia lamblia
RTAQILAVRYNYQLGMHGF

SEQ ID NO: 3091601 - protein, 20 aa, Giardia lamblia
RTASLEWLGGAWSALCDAGI

SEQ ID NO: 3091602 - protein, 22 aa, Giardia lamblia
RTCSKPQRGYYFNTLTSFMTTC

SEQ ID NO: 3091603 - protein, 34 aa, Giardia lamblia
RTDAFYKHYADWPLFVGLGCVLLLAVYAGILLLT

SEQ ID NO: 3091604 - protein, 31 aa, Giardia lamblia
RTFPSLVTNLTIDWFKNWPKAALMDVANSVL

SEQ ID NO: 3091605 - protein, 25 aa, Giardia lamblia
RTGCPMIFGFLATLIEYVQTQGNIQ

SEQ ID NO: 3091606 - protein, 17 aa, Giardia lamblia
RTIFMIKNRPHFCKQGS

SEQ ID NO: 3091607 - protein, 44 aa, Giardia lamblia
RTIMEISVAMVAIGALVGFLCWWFIFRGRRIDASPSTMTLIPSK

SEQ ID NO: 3091608 - protein, 30 aa, Giardia lamblia
RTKLGLYISYFNFLVFNFVMFISTEIGAHL

SEQ ID NO: 3091609 - protein, 18 aa, Giardia lamblia
RTKQFLPCTTVTCLRDMN

SEQ ID NO: 3091610 - protein, 17 aa, Giardia lamblia
RTLHFPDKDMDCTFHEI

SEQ ID NO: 3091611 - protein, 19 aa, Giardia lamblia
RTLLQFITKKRSQLQLFFI

SEQ ID NO: 3091612 - protein, 24 aa, Giardia lamblia
RTLLSVYELLWKLSERFEALSVAF

SEQ ID NO: 3091613 - protein, 30 aa, Giardia lamblia
RTLLVSFTYIFSDSLFRFTVVPWKSTSVPD

SEQ ID NO: 3091614 - protein, 23 aa, Giardia lamblia
RTLVCLIYLYVYIFRGNVRMDWR

SEQ ID NO: 3091615 - protein, 20 aa, Giardia lamblia
RTMDTYWSDIAYLLYNNMNY

SEQ ID NO: 3091616 - protein, 24 aa, Giardia lamblia
RTNAFWIDILISSLCIMVVGLFLA

SEQ ID NO: 3091617 - protein, 30 aa, Giardia lamblia
RTRIALELVLLPFKTLIAIALNFSEMFVRS

SEQ ID NO: 3091618 - protein, 25 aa, Giardia lamblia
RTRILLMDQGLRPPQLVFYEMCMLK

SEQ ID NO: 3091619 - protein, 33 aa, Giardia lamblia
RTRRRYSNILFANPFLLLFAGSHYILIEKELEL

SEQ ID NO: 3091620 - protein, 25 aa, Giardia lamblia
RTTGAFYIPTFQPLPNILSENSLKE

SEQ ID NO: 3091621 - protein, 26 aa, Giardia lamblia
RTVDSTRFWFADVLAIFGLNLVKCRI

SEQ ID NO: 3091622 - protein, 18 aa, Giardia lamblia
RTVFLYEGGCYNTTDPVG

SEQ ID NO: 3091623 - protein, 25 aa, Giardia lamblia
RTVGDTLFLIYIKKTEQQATTMTIA

SEQ ID NO: 3091624 - protein, 26 aa, Giardia lamblia
RTVGWKVFLGLLAFAVPCVSLLTSAL

SEQ ID NO: 3091625 - protein, 26 aa, Giardia lamblia
RTVKEFKHMLLKKLNSKLQSLWNQCY

SEQ ID NO: 3091626 - protein, 18 aa, Giardia lamblia
RTVLISSVSATVLVLLAC

SEQ ID NO: 3091627 - protein, 18 aa, Giardia lamblia
RTVRLQCATLPWSVFLPT

SEQ ID NO: 3091628 - protein, 28 aa, Giardia lamblia
RTVVPAPYRNLTYLALRMAPGSLHLAPE

SEQ ID NO: 3091629 - protein, 23 aa, Giardia lamblia
RTYEYMMPLVFLLPSSQEEASEP

SEQ ID NO: 3091630 - protein, 33 aa, Giardia lamblia
RTYNWISFPFIVLLLQFKPFFSQFFTAVALLQI

SEQ ID NO: 3091631 - protein, 18 aa, Giardia lamblia
RTYYKMFSDRKLKLVEQE

SEQ ID NO: 3091632 - protein, 24 aa, Giardia lamblia
RVAEYKWFLLSILAHTKSSGTEFL

SEQ ID NO: 3091633 - protein, 17 aa, Giardia lamblia
RVAFMRRWLTNGQPATF

SEQ ID NO: 3091634 - protein, 23 aa, Giardia lamblia
RVEDNRFFAMKVLKKRNVLDRRQ

SEQ ID NO: 3091635 - protein, 28 aa, Giardia lamblia
RVERYMQWNYLFIDDLLVHLRPHPKQSL

SEQ ID NO: 3091636 - protein, 24 aa, Giardia lamblia
RVGARILYVLYADGTPVQTVLTAK

SEQ ID NO: 3091637 - protein, 34 aa, Giardia lamblia
RVGLPWYESPNSILLYFVFIFKPSERRTVRKLLQ

SEQ ID NO: 3091638 - protein, 18 aa, Giardia lamblia
RVGYSLYTRFYALASLLS

SEQ ID NO: 3091639 - protein, 23 aa, Giardia lamblia
RVHLCLYICMIVMPVVVMAAVAL

SEQ ID NO: 3091640 - protein, 19 aa, Giardia lamblia
RVKAYYVKRIKSTPTQLAA

SEQ ID NO: 3091641 - protein, 20 aa, Giardia lamblia
RVLDLLLYIHAKQTNQGGFA

SEQ ID NO: 3091642 - protein, 25 aa, Giardia lamblia
RVLSVEELIFPFGSIAGMLEAVMLS

SEQ ID NO: 3091643 - protein, 21 aa, Giardia lamblia
RVPVNGDCRLLSLSRGICIVP

SEQ ID NO: 3091644 - protein, 26 aa, Giardia lamblia
RVQNLIGFIFTFFQAVLYVLAGIYGS

SEQ ID NO: 3091645 - protein, 29 aa, Giardia lamblia
RVRATFLVLITAPIIRLMLFTMGYCVIVR

SEQ ID NO: 3091646 - protein, 23 aa, Giardia lamblia
RVRLRQQLLHLLLEKMLGITCST

SEQ ID NO: 3091647 - protein, 20 aa, Giardia lamblia
RVSEHVCFLFAIVLWTYLGG

SEQ ID NO: 3091648 - protein, 22 aa, Giardia lamblia
RVSHVVLFVQAPLYSTAEFSGV

SEQ ID NO: 3091649 - protein, 18 aa, Giardia lamblia
RVSTACWLDLVCVLNLDT

SEQ ID NO: 3091650 - protein, 25 aa, Giardia lamblia
RVTHPLIPLKILTGPLKALLSIHLL

SEQ ID NO: 3091651 - protein, 29 aa, Giardia lamblia
RVTNKFTLRLMLNFYKIQSSIILGSGLPP

SEQ ID NO: 3091652 - protein, 27 aa, Giardia lamblia
RVTVAGYSFIILAISRLSRLLYEVLVQ

SEQ ID NO: 3091653 - protein, 18 aa, Giardia lamblia
RVVALRLLLPAMHVVLDK

SEQ ID NO: 3091654 - protein, 33 aa, Giardia lamblia
RVVLGACAAVFPPFFLKWIRMRISPTDAEKLRR

SEQ ID NO: 3091655 - protein, 18 aa, Giardia lamblia
RVVPLEALPLVILNAELG

SEQ ID NO: 3091656 - protein, 21 aa, Giardia lamblia
RVYLLMSRCIFIISYVRAHAN

SEQ ID NO: 3091657 - protein, 23 aa, Giardia lamblia
RVYRANYIPIYITAGVAGACIVI

SEQ ID NO: 3091658 - protein, 27 aa, Giardia lamblia
RWYKYVLAIFVGPILIFAPFRGVFAII

SEQ ID NO: 3091659 - protein, 26 aa, Giardia lamblia
RYCINIWLIFALFKINAMDLSEPFSF

SEQ ID NO: 3091660 - protein, 20 aa, Giardia lamblia
RYEPFFDLLVPYNPEKTFLE

SEQ ID NO: 3091661 - protein, 17 aa, Giardia lamblia
RYGYSRLAGFLSTNHSG

SEQ ID NO: 3091662 - protein, 18 aa, Giardia lamblia
RYIPLLIMFNQQNAIGYP

SEQ ID NO: 3091663 - protein, 23 aa, Giardia lamblia
RYIPTEALYAYKLISYANETSEV

SEQ ID NO: 3091664 - protein, 28 aa, Giardia lamblia
RYKKLSSHMLLLLLLVISILTTSERGEL

SEQ ID NO: 3091665 - protein, 20 aa, Giardia lamblia
RYLENFPTIYRTNCQPWRYW

SEQ ID NO: 3091666 - protein, 20 aa, Giardia lamblia
RYLMAIHRGIPILTETYLQR

SEQ ID NO: 3091667 - protein, 20 aa, Giardia lamblia
RYLSYDRPIVYFARVGYLSL

SEQ ID NO: 3091668 - protein, 27 aa, Giardia lamblia
RYMQRFTAFIRDFKYYQSFYANLSSKL

SEQ ID NO: 3091669 - protein, 20 aa, Giardia lamblia
RYNFKLVLMSATKDPLVLRT

SEQ ID NO: 3091670 - protein, 28 aa, Giardia lamblia
RYNVTANLLPVLTQLPTLSASRTLFTST

SEQ ID NO: 3091671 - protein, 23 aa, Giardia lamblia
RYSMPQVLQLLLPHELHGRDSNG

SEQ ID NO: 3091672 - protein, 24 aa, Giardia lamblia
RYVSPRLFFLTDDNILSVITALSS

SEQ ID NO: 3091673 - protein, 18 aa, Giardia lamblia
RYYFPIHILIFNALISFS

SEQ ID NO: 3091674 - protein, 34 aa, Giardia lamblia
RYYRGWCVRWTLKRIAPSLAYLMLNRGFLRTTDA

SEQ ID NO: 3091675 - protein, 25 aa, Giardia lamblia
SAADVLYRVIKWLVTDARVKPEEVA

SEQ ID NO: 3091676 - protein, 32 aa, Giardia lamblia
SAAEISFAAFFDRWRRFYPPLLSLSDAEMLQL

SEQ ID NO: 3091677 - protein, 29 aa, Giardia lamblia
SAAIRWTILFSCVAWLLNLLVRNAPSTIA

SEQ ID NO: 3091678 - protein, 17 aa, Giardia lamblia
SAALIRPAPSASSVTQL

SEQ ID NO: 3091679 - protein, 43 aa, Giardia lamblia
SAAMLHLLIDLYKSGPYPGLFFILLPLTPYIALADKDLVYEHL

SEQ ID NO: 3091680 - protein, 23 aa, Giardia lamblia
SAANMFALYPRSAIGHMSEPSPQ

SEQ ID NO: 3091681 - protein, 24 aa, Giardia lamblia
SAAQLLYINLVIDALAAFAFGGEP

SEQ ID NO: 3091682 - protein, 17 aa, Giardia lamblia
SAASRWVLNSFLPDVRG

SEQ ID NO: 3091683 - protein, 17 aa, Giardia lamblia
SAATLAIRMFNSRFPVC

SEQ ID NO: 3091684 - protein, 25 aa, Giardia lamblia
SACAVTHIFFKYGCYDRYGSIAQRY

SEQ ID NO: 3091685 - protein, 23 aa, Giardia lamblia
SADDLFIPQYIPFTNISVDCGKG

SEQ ID NO: 3091686 - protein, 18 aa, Giardia lamblia
SADFAPPLRFNKFVSKFF

SEQ ID NO: 3091687 - protein, 23 aa, Giardia lamblia
SADLLPNTLPMAGPIELSGPSKP

SEQ ID NO: 3091688 - protein, 35 aa, Giardia lamblia
SADVLLEYPYLTKAILPYIGPFPLVLTQKKFDRRY

SEQ ID NO: 3091689 - protein, 27 aa, Giardia lamblia
SAEASLKPFLYLIEPYILSIGDTLLTN

SEQ ID NO: 3091690 - protein, 34 aa, Giardia lamblia
SAENRLLEIYYWLHNIDIFITYYTINLHLNDEIA

SEQ ID NO: 3091691 - protein, 28 aa, Giardia lamblia
SAFCDEFKYLFLDFYNSYGSDFAKPSMT

SEQ ID NO: 3091692 - protein, 24 aa, Giardia lamblia
SAFIDCIEYIFWFEKHKEGKIRLL

SEQ ID NO: 3091693 - protein, 25 aa, Giardia lamblia
SAFSVLCFVIIPFLILSHSDTKVSL

SEQ ID NO: 3091694 - protein, 26 aa, Giardia lamblia
SAFYISTHVLLNGQILFTGCFANNEL

SEQ ID NO: 3091695 - protein, 25 aa, Giardia lamblia
SAGCTTCLLGYYIAAEGKRQPGQCV

SEQ ID NO: 3091696 - protein, 24 aa, Giardia lamblia
SAGEILFTVRGYKIAYYSGNTKNL

SEQ ID NO: 3091697 - protein, 28 aa, Giardia lamblia
SAGKNPFYNFFLHYFRSLPQSYEKLAVP

SEQ ID NO: 3091698 - protein, 22 aa, Giardia lamblia
SAGTELYLAPELYCAISGTLQA

SEQ ID NO: 3091699 - protein, 17 aa, Giardia lamblia
SAHAFWAAGLSAALFLA

SEQ ID NO: 3091700 - protein, 25 aa, Giardia lamblia
SAHDLPPIVIALMALLSINSNQAEA

SEQ ID NO: 3091701 - protein, 29 aa, Giardia lamblia
SAHNYQFMPFIVTPLMFGGDFIGIVACSL

SEQ ID NO: 3091702 - protein, 31 aa, Giardia lamblia
SAHRGTFILLVVFFRSFLRHSLDSPGLPATS

SEQ ID NO: 3091703 - protein, 41 aa, Giardia lamblia
SAHRRALVIPGIVFRLWRVYTFIIRMYRHVLHRKVFSTWRT

SEQ ID NO: 3091704 - protein, 19 aa, Giardia lamblia
SAIALISYANFRGRNANEA

SEQ ID NO: 3091705 - protein, 26 aa, Giardia lamblia
SAICSCRQGWTLHGTLCYPSACVSSG

SEQ ID NO: 3091706 - protein, 24 aa, Giardia lamblia
SAIKNLLHKLGYTSLRPIQLACFE

SEQ ID NO: 3091707 - protein, 24 aa, Giardia lamblia
SAILGILMFIFYKSVAQLFYPILA

SEQ ID NO: 3091708 - protein, 17 aa, Giardia lamblia
SAILYQLCDVHPLKRLT

SEQ ID NO: 3091709 - protein, 24 aa, Giardia lamblia
SAIQKLPFSSLLPAHFHLLARTMD

SEQ ID NO: 3091710 - protein, 26 aa, Giardia lamblia
SAIRDMGLLFYIPQTFILQDMSSAEK

SEQ ID NO: 3091711 - protein, 25 aa, Giardia lamblia
SAIVKILFAWCFRMQRLLKGVCLGP

SEQ ID NO: 3091712 - protein, 24 aa, Giardia lamblia
SAIYTIAILVYSQTLTRLLDVHGC

SEQ ID NO: 3091713 - protein, 19 aa, Giardia lamblia
SAKIFPMTLSGKQFLRVYR

SEQ ID NO: 3091714 - protein, 36 aa, Giardia lamblia
SAKPGCVFISKIDKTRRFFCGFLEGLTDSLQDDRMP

SEQ ID NO: 3091715 - protein, 37 aa, Giardia lamblia
SAKPGCVFISKIDKTRRFFCGFLENITENLSTGNLPT

SEQ ID NO: 3091716 - protein, 37 aa, Giardia lamblia
SAKPGCVFISKIDKTRRFFCGFLENVTENLPANDLPT

SEQ ID NO: 3091717 - protein, 31 aa, Giardia lamblia
SAKSLTYYVELVFTLINWYKGAMESIKQELE

SEQ ID NO: 3091718 - protein, 37 aa, Giardia lamblia
SAKYSPFVAVFFGTYLALFEVMPLSLCARLKGLLFYN

SEQ ID NO: 3091719 - protein, 24 aa, Giardia lamblia
SALCIRILYIIHSASKLQKETSQT

SEQ ID NO: 3091720 - protein, 35 aa, Giardia lamblia
SALFAFSTIPLFTGWLMLGYTVVFTSLPVTIICFD

SEQ ID NO: 3091721 - protein, 17 aa, Giardia lamblia
SALFAPFYQYMGSLPVC

SEQ ID NO: 3091722 - protein, 33 aa, Giardia lamblia
SALLDLKRLLSITPVVFRILLLAGHLVIIFERA

SEQ ID NO: 3091723 - protein, 20 aa, Giardia lamblia
SALLGRSGIIMPLVASLLIG

SEQ ID NO: 3091724 - protein, 28 aa, Giardia lamblia
SALLKSLPPTIYNFLFARPTTCSTCGNT

SEQ ID NO: 3091725 - protein, 26 aa, Giardia lamblia
SALLLKMYAMLPPLGPQGKAYRDWVI

SEQ ID NO: 3091726 - protein, 27 aa, Giardia lamblia
SALLLKMYAMLPPLGPQRKAYRDWVIT

SEQ ID NO: 3091727 - protein, 22 aa, Giardia lamblia
SALLPHILVAIRDTYTLVPNLL

SEQ ID NO: 3091728 - protein, 22 aa, Giardia lamblia
SALMNTYLVSSIVPLNCYVYVK

SEQ ID NO: 3091729 - protein, 19 aa, Giardia lamblia
SALNCNFLINFTGCSSVGK

SEQ ID NO: 3091730 - protein, 28 aa, Giardia lamblia
SALPGLYPMKPIVLSLLDAVANNLNTYM

SEQ ID NO: 3091731 - protein, 20 aa, Giardia lamblia
SALPIIAFEYFLSSTVPTDI

SEQ ID NO: 3091732 - protein, 26 aa, Giardia lamblia
SALPKLLNTLLNNLLIISPGTHSLPT

SEQ ID NO: 3091733 - protein, 25 aa, Giardia lamblia
SALREYLPMVTARYTRIGIVLKDLQ

SEQ ID NO: 3091734 - protein, 26 aa, Giardia lamblia
SALRSKSVALLLTDWARGYFALEVYY

SEQ ID NO: 3091735 - protein, 19 aa, Giardia lamblia
SALVLLIEKLITATIHSIS

SEQ ID NO: 3091736 - protein, 26 aa, Giardia lamblia
SANPNGGLSPLYPLFPVEGSSQAAVP

SEQ ID NO: 3091737 - protein, 27 aa, Giardia lamblia
SANPPLERFLFPLAYSRSLPVNIDCNL

SEQ ID NO: 3091738 - protein, 24 aa, Giardia lamblia
SAPDGLSPLLLFSPKDVFSALDDT

SEQ ID NO: 3091739 - protein, 21 aa, Giardia lamblia
SAPHCKLSYALLSAFGPVEIA

SEQ ID NO: 3091740 - protein, 17 aa, Giardia lamblia
SAPSTSLLLRKSHNVLL

SEQ ID NO: 3091741 - protein, 23 aa, Giardia lamblia
SAPTPAPFVLTSGDTKPFFAMKS

SEQ ID NO: 3091742 - protein, 24 aa, Giardia lamblia
SAQDLYRYGIHTCPFPYICKCGKT

SEQ ID NO: 3091743 - protein, 23 aa, Giardia lamblia
SARLSMNVFLLSGYVYNQLSESL

SEQ ID NO: 3091744 - protein, 21 aa, Giardia lamblia
SARNLYACDLIPIMSTAATSS

SEQ ID NO: 3091745 - protein, 25 aa, Giardia lamblia
SARQLLETFILSPFITTSCITVLYE

SEQ ID NO: 3091746 - protein, 21 aa, Giardia lamblia
SARYLIDNFLVITTADTLLTL

SEQ ID NO: 3091747 - protein, 32 aa, Giardia lamblia
SASIIIVLVIIVVLLVVFLLRCKKTAKDLKAV

SEQ ID NO: 3091748 - protein, 21 aa, Giardia lamblia
SASPLLVVDYVYRFVAGLANS

SEQ ID NO: 3091749 - protein, 26 aa, Giardia lamblia
SASTLRLSVQFLLDNLIGGNYCNGGN

SEQ ID NO: 3091750 - protein, 26 aa, Giardia lamblia
SASVHFPFVYFQPGANKIFITSEHGT

SEQ ID NO: 3091751 - protein, 39 aa, Giardia lamblia
SATARPYQRLLYLNNILLNIHLLAKLDIALVVRTLYQHC

SEQ ID NO: 3091752 - protein, 22 aa, Giardia lamblia
SATILLFVWTLLRACIIPRKPA

SEQ ID NO: 3091753 - protein, 23 aa, Giardia lamblia
SATMLRLLVLELVKFRQMCLLAG

SEQ ID NO: 3091754 - protein, 25 aa, Giardia lamblia
SATQFRGWRIKYIHGAGYIKSVAVD

SEQ ID NO: 3091755 - protein, 17 aa, Giardia lamblia
SATRPLSSPLNPGYPMQ

SEQ ID NO: 3091756 - protein, 19 aa, Giardia lamblia
SAVCSFLVGMLRSCPLVSV

SEQ ID NO: 3091757 - protein, 18 aa, Giardia lamblia
SAVRMIMFILSTVLIMTC

SEQ ID NO: 3091758 - protein, 20 aa, Giardia lamblia
SAVSWNAVFSRRALECLSDE

SEQ ID NO: 3091759 - protein, 20 aa, Giardia lamblia
SAYFCRPFCLAASLFGVQNT

SEQ ID NO: 3091760 - protein, 27 aa, Giardia lamblia
SAYIAYLVLIFLLIGINIWALVLSTNV

SEQ ID NO: 3091761 - protein, 28 aa, Giardia lamblia
SAYLPSLIINLYLPLSRTALSKELALLC

SEQ ID NO: 3091762 - protein, 29 aa, Giardia lamblia
SAYWMQISLPRWLSFRLNVIGAFFCGFIA

SEQ ID NO: 3091763 - protein, 18 aa, Giardia lamblia
SCAFSLFKSTDFTFLCEL

SEQ ID NO: 3091764 - protein, 21 aa, Giardia lamblia
SCAIGHCTAFEGTLCTKCAYE

SEQ ID NO: 3091765 - protein, 24 aa, Giardia lamblia
SCARRLMASYWNYVPAAVINQLQT

SEQ ID NO: 3091766 - protein, 23 aa, Giardia lamblia
SCASCTGPYYYDPNTYSCFECHE

SEQ ID NO: 3091767 - protein, 26 aa, Giardia lamblia
SCATTHILYMGGCYNPAAPPGSKACV

SEQ ID NO: 3091768 - protein, 23 aa, Giardia lamblia
SCDLQKIALILKGLSDLLPDGED

SEQ ID NO: 3091769 - protein, 17 aa, Giardia lamblia
SCFAGYAPITISLDQAE

SEQ ID NO: 3091770 - protein, 19 aa, Giardia lamblia
SCFLTGDYGFPKSSLFLAR

SEQ ID NO: 3091771 - protein, 19 aa, Giardia lamblia
SCFRDSKIGRWVNFVAKYP

SEQ ID NO: 3091772 - protein, 29 aa, Giardia lamblia
SCGNTALMYLLENMYLRKYDKYLELFRRL

SEQ ID NO: 3091773 - protein, 21 aa, Giardia lamblia
SCHQLAHICSDLFLCSNNNVL

SEQ ID NO: 3091774 - protein, 21 aa, Giardia lamblia
SCISFSIFVAGIHRFLSESGV

SEQ ID NO: 3091775 - protein, 24 aa, Giardia lamblia
SCKCNGTTILYMNGCVPRACFPQY

SEQ ID NO: 3091776 - protein, 22 aa, Giardia lamblia
SCLFYMRFCFAVTYDLLGFPSL

SEQ ID NO: 3091777 - protein, 17 aa, Giardia lamblia
SCMLKKTLAGPSIVPNT

SEQ ID NO: 3091778 - protein, 24 aa, Giardia lamblia
SCPSAVCNCPCDNSIFVSASDHVC

SEQ ID NO: 3091779 - protein, 17 aa, Giardia lamblia
SCPYFSPTELKFLGYLV

SEQ ID NO: 3091780 - protein, 24 aa, Giardia lamblia
SCRDYFLPIHHPIASYLQGDMMDK

SEQ ID NO: 3091781 - protein, 27 aa, Giardia lamblia
SCTGCIRDFLFYRGGCYRTASLINAIC

SEQ ID NO: 3091782 - protein, 34 aa, Giardia lamblia
SCTKGLLVLFTRFINLILILYSCSWKILTAEVDF

SEQ ID NO: 3091783 - protein, 30 aa, Giardia lamblia
SCTVLTSHLLYLLLVCFRDLHIVKPGRSRI

SEQ ID NO: 3091784 - protein, 28 aa, Giardia lamblia
SCVRGQAIFYLLLIYSNLMGDVLRLNAN

SEQ ID NO: 3091785 - protein, 34 aa, Giardia lamblia
SCYYELDFLLCDQELMWLLSRNFSILVLNDTVSI

SEQ ID NO: 3091786 - protein, 23 aa, Giardia lamblia
SDACSLLLRICPLCNVTDTVKEY

SEQ ID NO: 3091787 - protein, 26 aa, Giardia lamblia
SDAIGKTLLLYSFSPAQREFLSKFLS

SEQ ID NO: 3091788 - protein, 23 aa, Giardia lamblia
SDALFALFAYSQRCGALLNAISF

SEQ ID NO: 3091789 - protein, 22 aa, Giardia lamblia
SDAVFMGIPNFYTIPCFSSEES

SEQ ID NO: 3091790 - protein, 29 aa, Giardia lamblia
SDCWDQIHSLFWPTCRWKVPPIDSLKGST

SEQ ID NO: 3091791 - protein, 24 aa, Giardia lamblia
SDCYKVLTHFIYMHSLLSARRLLQ

SEQ ID NO: 3091792 - protein, 26 aa, Giardia lamblia
SDDARLCFLLQLLDFVQSLCLPVRMR

SEQ ID NO: 3091793 - protein, 41 aa, Giardia lamblia
SDDFSFTFMVRLFYEAYLSLYKRLIPFLITTKDRDVLYVMR

SEQ ID NO: 3091794 - protein, 29 aa, Giardia lamblia
SDDLYSIMKVAFFIIDTYPHHKKLRAHQQ

SEQ ID NO: 3091795 - protein, 29 aa, Giardia lamblia
SDDPNAETTYFLFYGGCYSKDEWPGSHIC

SEQ ID NO: 3091796 - protein, 24 aa, Giardia lamblia
SDEEILFPPIPLYFGQESASQCLE

SEQ ID NO: 3091797 - protein, 26 aa, Giardia lamblia
SDFARLLDSCYMIPYLLAHHGAFTGV

SEQ ID NO: 3091798 - protein, 17 aa, Giardia lamblia
SDFLYDVLPQLVKGMQG

SEQ ID NO: 3091799 - protein, 26 aa, Giardia lamblia
SDGEYHCRCPDMLIAINGECTSPACM

SEQ ID NO: 3091800 - protein, 27 aa, Giardia lamblia
SDGPRCACDLLYILSAQYGCVPLNCYD

SEQ ID NO: 3091801 - protein, 23 aa, Giardia lamblia
SDGQALFFFHAKTVFPISEQVGS

SEQ ID NO: 3091802 - protein, 20 aa, Giardia lamblia
SDIFFTKTSDIWAAGATLFE

SEQ ID NO: 3091803 - protein, 28 aa, Giardia lamblia
SDISCLLPPYGYQLYRANNLLSTSMCGD

SEQ ID NO: 3091804 - protein, 24 aa, Giardia lamblia
SDKLGVIFPFVMLKNHQTTASDDA

SEQ ID NO: 3091805 - protein, 17 aa, Giardia lamblia
SDLARIIIPACEVYLLE

SEQ ID NO: 3091806 - protein, 28 aa, Giardia lamblia
SDLESVLITFFRILAHELVFNDNCLVLY

SEQ ID NO: 3091807 - protein, 22 aa, Giardia lamblia
SDLKRHPIILNNVLSALYSSLY

SEQ ID NO: 3091808 - protein, 26 aa, Giardia lamblia
SDLTWGWWWICWCSLSLREGLLGISR

SEQ ID NO: 3091809 - protein, 21 aa, Giardia lamblia
SDLVSYFILGLQSSILLFCRN

SEQ ID NO: 3091810 - protein, 23 aa, Giardia lamblia
SDNKFRARIMTAEREQIAVRLNL

SEQ ID NO: 3091811 - protein, 25 aa, Giardia lamblia
SDNVFLHLFPVIPEAVFLPDVLLPN

SEQ ID NO: 3091812 - protein, 23 aa, Giardia lamblia
SDRTPFFVSYNSLLRYVRDFTGK

SEQ ID NO: 3091813 - protein, 27 aa, Giardia lamblia
SDRYRFDDLVPLIKTPVLITINAITES

SEQ ID NO: 3091814 - protein, 25 aa, Giardia lamblia
SDSEMLYSIYFYVLVGDIISTHHAC

SEQ ID NO: 3091815 - protein, 29 aa, Giardia lamblia
SDSIVHLPSMYLFQIVSIMVDAVEADKAV

SEQ ID NO: 3091816 - protein, 27 aa, Giardia lamblia
SDSRFLTSLLHLIGMKKAEGMLSLSSQ

SEQ ID NO: 3091817 - protein, 23 aa, Giardia lamblia
SDTLQRLLRHFSLTSFRSSGSEI

SEQ ID NO: 3091818 - protein, 23 aa, Giardia lamblia
SDVFKLIYMNNLHDFLLSVTMHS

SEQ ID NO: 3091819 - protein, 24 aa, Giardia lamblia
SDVFPFSLSLTTALPWDVRYGLVQ

SEQ ID NO: 3091820 - protein, 25 aa, Giardia lamblia
SDVLRKRFGFTYPSLVHGITIMGAI

SEQ ID NO: 3091821 - protein, 24 aa, Giardia lamblia
SDYPGMFNFLTWNAKLIAIRLLDS

SEQ ID NO: 3091822 - protein, 24 aa, Giardia lamblia
SEAGPYVPVVPPASNARLSLTIGL

SEQ ID NO: 3091823 - protein, 29 aa, Giardia lamblia
SEAPPYFLAALVFLTLNFQLDLSIDDLSA

SEQ ID NO: 3091824 - protein, 26 aa, Giardia lamblia
SEAQMHELLNFLLLRGSKLSLHLANS

SEQ ID NO: 3091825 - protein, 26 aa, Giardia lamblia
SEATRLENMLPLRASPTVLTEEDNPG

SEQ ID NO: 3091826 - protein, 27 aa, Giardia lamblia
SEAYKHQFLIALKLFVALGDVPCMMEL

SEQ ID NO: 3091827 - protein, 27 aa, Giardia lamblia
SEDDGPSLMLPPPLPGPSVSHAAKQTS

SEQ ID NO: 3091828 - protein, 21 aa, Giardia lamblia
SEFIYLTYDIPSVRQMILSHA

SEQ ID NO: 3091829 - protein, 33 aa, Giardia lamblia
SEFKCLLDKLTYIFVIFKLRASMRPYGFSGSYS

SEQ ID NO: 3091830 - protein, 27 aa, Giardia lamblia
SEGILDNFLFNLLMPITFVTLRSCIYL

SEQ ID NO: 3091831 - protein, 26 aa, Giardia lamblia
SEGSRPYLLALSILHILPLDRMSSTH

SEQ ID NO: 3091832 - protein, 24 aa, Giardia lamblia
SEGVYWFVRWISTVVMSFFSSVIL

SEQ ID NO: 3091833 - protein, 17 aa, Giardia lamblia
SEHLSKYLAPRLLNYVT

SEQ ID NO: 3091834 - protein, 18 aa, Giardia lamblia
SEIASFLRDSRIPGLGGR

SEQ ID NO: 3091835 - protein, 27 aa, Giardia lamblia
SEIHALHTLFFSFMLDPELLRDIDKVK

SEQ ID NO: 3091836 - protein, 18 aa, Giardia lamblia
SEILGITLAIEEPSFRDI

SEQ ID NO: 3091837 - protein, 21 aa, Giardia lamblia
SEILYKLIDSFEARYGIKGVK

SEQ ID NO: 3091838 - protein, 27 aa, Giardia lamblia
SEKLATIALFIEFVYLSSCPLKDNDRI

SEQ ID NO: 3091839 - protein, 44 aa, Giardia lamblia
SEKSVYIHFVHFYMTYHFIRLVWSTIRAFDPLETSFLFGAGAIS

SEQ ID NO: 3091840 - protein, 18 aa, Giardia lamblia
SELCNLYCHLKLRYLRPP

SEQ ID NO: 3091841 - protein, 22 aa, Giardia lamblia
SELEAFVMAFDSALELLQQKYD

SEQ ID NO: 3091842 - protein, 26 aa, Giardia lamblia
SELFYLHFGGRMFIPFVLCFCGSLAW

SEQ ID NO: 3091843 - protein, 52 aa, Giardia lamblia
SELRAIHTIRRLPSFIILHFIPLLVNKAMSSYLLPLLLLPTGENATIDESKR

SEQ ID NO: 3091844 - protein, 22 aa, Giardia lamblia
SELRMLIIDVLYAGIAGIYLKV

SEQ ID NO: 3091845 - protein, 26 aa, Giardia lamblia
SELVAKLALIIFGLAFSACKLKTIVP

SEQ ID NO: 3091846 - protein, 18 aa, Giardia lamblia
SELYIYCVLKGRTEMCSL

SEQ ID NO: 3091847 - protein, 24 aa, Giardia lamblia
SENISFIFQYLGSCTKKYAHKNKI

SEQ ID NO: 3091848 - protein, 25 aa, Giardia lamblia
SENTFLIEYLNTFKKQLAMCYCFLP

SEQ ID NO: 3091849 - protein, 18 aa, Giardia lamblia
SEPLPYPFGKYLAALAQL

SEQ ID NO: 3091850 - protein, 24 aa, Giardia lamblia
SEQSTLILCVISYILCFAIVQYEE

SEQ ID NO: 3091851 - protein, 27 aa, Giardia lamblia
SESCYFQIDSLSKYYVCGKLGNFGECV

SEQ ID NO: 3091852 - protein, 26 aa, Giardia lamblia
SESLDYRIMGRFFAGLSQVGAWICFD

SEQ ID NO: 3091853 - protein, 24 aa, Giardia lamblia
SESTEVSCRCVCKPTFYNSSGTCI

SEQ ID NO: 3091854 - protein, 24 aa, Giardia lamblia
SESTEVSCRCVCKPTFYNSSGTCT

SEQ ID NO: 3091855 - protein, 24 aa, Giardia lamblia
SESTIWRLAYGILKALAFMHTPSS

SEQ ID NO: 3091856 - protein, 26 aa, Giardia lamblia
SETDGYYDLYYIYSQPILGIHRINSV

SEQ ID NO: 3091857 - protein, 32 aa, Giardia lamblia
SETSLLSSRILWTPSPRLLKLFFLGEESRRVV

SEQ ID NO: 3091858 - protein, 28 aa, Giardia lamblia
SEVEWHPNFRLYLVTKLANPSFSPEVHA

SEQ ID NO: 3091859 - protein, 26 aa, Giardia lamblia
SEVKRSIYITMRLFDRLKSLSEEASK

SEQ ID NO: 3091860 - protein, 18 aa, Giardia lamblia
SEVNHCVLLIGWGTFANG

SEQ ID NO: 3091861 - protein, 23 aa, Giardia lamblia
SEYIKIYFLVSLGANYYPVFPYY

SEQ ID NO: 3091862 - protein, 21 aa, Giardia lamblia
SFACYLPDELLSTELARCLHS

SEQ ID NO: 3091863 - protein, 22 aa, Giardia lamblia
SFCLLFSFLAMNAFILTAIFAI

SEQ ID NO: 3091864 - protein, 21 aa, Giardia lamblia
SFCPFANQFFEKLLHEICFGN

SEQ ID NO: 3091865 - protein, 25 aa, Giardia lamblia
SFDIPTTLLRRILGLSFKAQDIMLS

SEQ ID NO: 3091866 - protein, 24 aa, Giardia lamblia
SFDLLFEIITYPEGLSEYLQYGIN

SEQ ID NO: 3091867 - protein, 27 aa, Giardia lamblia
SFEFLGGRFLAFRFAHKLTIFQIVLPF

SEQ ID NO: 3091868 - protein, 18 aa, Giardia lamblia
SFEICRESFFSSPQLHGI

SEQ ID NO: 3091869 - protein, 22 aa, Giardia lamblia
SFESFYFKINLRRPTPYFVERK

SEQ ID NO: 3091870 - protein, 27 aa, Giardia lamblia
SFFISTIPWFTLAAQLLVAFFLIFNSH

SEQ ID NO: 3091871 - protein, 33 aa, Giardia lamblia
SFGAVFLCLYFIWAGFFFAVFGQNNSWIFLSHT

SEQ ID NO: 3091872 - protein, 34 aa, Giardia lamblia
SFGELWGQRYLVQLKPYLLSNITEFTWGSTNLYR

SEQ ID NO: 3091873 - protein, 26 aa, Giardia lamblia
SFGHSLVKYLLLPVSGYMVTRGSSVS

SEQ ID NO: 3091874 - protein, 20 aa, Giardia lamblia
SFGIFSIVVSMLTWYTRAKL

SEQ ID NO: 3091875 - protein, 27 aa, Giardia lamblia
SFGLTYGFVTQIRPLTDIFLKQDFYPR

SEQ ID NO: 3091876 - protein, 19 aa, Giardia lamblia
SFGTPLFYSIATGIGLIPA

SEQ ID NO: 3091877 - protein, 17 aa, Giardia lamblia
SFHCVRNYQIINVGPPL

SEQ ID NO: 3091878 - protein, 17 aa, Giardia lamblia
SFHFAHDLGLRSIRMAL

SEQ ID NO: 3091879 - protein, 24 aa, Giardia lamblia
SFHSICSMFLHKPLSLFTIDDINM

SEQ ID NO: 3091880 - protein, 17 aa, Giardia lamblia
SFILLNTYGLAAANNTD

SEQ ID NO: 3091881 - protein, 28 aa, Giardia lamblia
SFINTYPLIYILFPLSVILLCYGILFFI

SEQ ID NO: 3091882 - protein, 23 aa, Giardia lamblia
SFIPARLIGFTTIKRISTLDAAL

SEQ ID NO: 3091883 - protein, 19 aa, Giardia lamblia
SFISVLCEFIRLTPEKESV

SEQ ID NO: 3091884 - protein, 28 aa, Giardia lamblia
SFKEALLAVIYRYVVSPSPRDVLPYYDF

SEQ ID NO: 3091885 - protein, 19 aa, Giardia lamblia
SFKPLVALLYMIALSEENV

SEQ ID NO: 3091886 - protein, 20 aa, Giardia lamblia
SFLCNTLLGRLIMSNAFGCR

SEQ ID NO: 3091887 - protein, 23 aa, Giardia lamblia
SFLTSSLLYFAPATDFCLCMDKH

SEQ ID NO: 3091888 - protein, 21 aa, Giardia lamblia
SFLYKTVLSIFAHRIKTFTDY

SEQ ID NO: 3091889 - protein, 25 aa, Giardia lamblia
SFNLSQLIFAFPRVQDLYLGGNNLT

SEQ ID NO: 3091890 - protein, 25 aa, Giardia lamblia
SFNTRGIFPVVEPTALMIAAMVDDC

SEQ ID NO: 3091891 - protein, 26 aa, Giardia lamblia
SFNVMLPAWDLLQHTVLSAKIFPMTL

SEQ ID NO: 3091892 - protein, 24 aa, Giardia lamblia
SFQKIFTHLPSRHLISLQSKFDNA

SEQ ID NO: 3091893 - protein, 25 aa, Giardia lamblia
SFQTRTRLFLVTTFATGGELFYHLK

SEQ ID NO: 3091894 - protein, 32 aa, Giardia lamblia
SFRCSPTVVYSWKLFSLLSIYNPRRFSDWYEY

SEQ ID NO: 3091895 - protein, 26 aa, Giardia lamblia
SFSDNILYFYRHLLDIFTVSLLGSDK

SEQ ID NO: 3091896 - protein, 19 aa, Giardia lamblia
SFSLVLKMRDSYSISFRTA

SEQ ID NO: 3091897 - protein, 17 aa, Giardia lamblia
SFVEENFFQALGIDYEE

SEQ ID NO: 3091898 - protein, 20 aa, Giardia lamblia
SFVSWYFIGILKSVLSFFIL

SEQ ID NO: 3091899 - protein, 27 aa, Giardia lamblia
SFYENPRLLIVPHYRIMLGISKYVFDH

SEQ ID NO: 3091900 - protein, 17 aa, Giardia lamblia
SFYNYDKLCYAYASNAF

SEQ ID NO: 3091901 - protein, 29 aa, Giardia lamblia
SGAWCQDCVFPFTIVFVNGVAQCVPGSCV

SEQ ID NO: 3091902 - protein, 25 aa, Giardia lamblia
SGCCTIFDDIPWLSTAMSDGATTNS

SEQ ID NO: 3091903 - protein, 20 aa, Giardia lamblia
SGCLCFYCFCDQRCRCMKNT

SEQ ID NO: 3091904 - protein, 25 aa, Giardia lamblia
SGCNLCAPGYFWTSSVHGCIRCDNS

SEQ ID NO: 3091905 - protein, 36 aa, Giardia lamblia
SGEARFMWSSIPPKLIPFLIGLMSRCYAQLGKLSDL

SEQ ID NO: 3091906 - protein, 24 aa, Giardia lamblia
SGESLEILLSLLSAFLSALSFSED

SEQ ID NO: 3091907 - protein, 25 aa, Giardia lamblia
SGFERLYFEYGLRAPQELFLLSGML

SEQ ID NO: 3091908 - protein, 17 aa, Giardia lamblia
SGFIIAVVVFLLAYIFS

SEQ ID NO: 3091909 - protein, 26 aa, Giardia lamblia
SGFTFFSFAILLWSELCLILVTTHRF

SEQ ID NO: 3091910 - protein, 23 aa, Giardia lamblia
SGFTRIVSILLQKEGRKLNKTGA

SEQ ID NO: 3091911 - protein, 27 aa, Giardia lamblia
SGGDESLFRLLDDFNIFAFQLLGDYLH

SEQ ID NO: 3091912 - protein, 29 aa, Giardia lamblia
SGGKRNLLQVTPLFPFQSAINLVEHPDKY

SEQ ID NO: 3091913 - protein, 23 aa, Giardia lamblia
SGGVRRCWCERGFLPALDRSGCV

SEQ ID NO: 3091914 - protein, 23 aa, Giardia lamblia
SGHEQLYLVFLAASVVAVDMLYE

SEQ ID NO: 3091915 - protein, 21 aa, Giardia lamblia
SGIGDCFYNPVTGSYECHCGE

SEQ ID NO: 3091916 - protein, 31 aa, Giardia lamblia
SGIQFLMAILSLLFPPFANSSYFTAASMVFA

SEQ ID NO: 3091917 - protein, 27 aa, Giardia lamblia
SGIRDMVFIYSFVFYACSELLSCILAS

SEQ ID NO: 3091918 - protein, 26 aa, Giardia lamblia
SGIYMAVIIYFCTAFMFGNSAILGTS

SEQ ID NO: 3091919 - protein, 26 aa, Giardia lamblia
SGKDIFFYVRIFLNNYHPLRDDKAAG

SEQ ID NO: 3091920 - protein, 22 aa, Giardia lamblia
SGKIDMFNLLYNESVKRLNSPG

SEQ ID NO: 3091921 - protein, 31 aa, Giardia lamblia
SGKSNVIDSLLFVFGWRARALRHSRLADLIH

SEQ ID NO: 3091922 - protein, 24 aa, Giardia lamblia
SGLIFDYYVDWQPVIDYQQKMLTT

SEQ ID NO: 3091923 - protein, 25 aa, Giardia lamblia
SGLLSYADFILLAKSLPGVLDALPI

SEQ ID NO: 3091924 - protein, 31 aa, Giardia lamblia
SGLLVRVSSKLLAMLVYFLRNVNGLEQMDPV

SEQ ID NO: 3091925 - protein, 27 aa, Giardia lamblia
SGLTNRLPLLLDPVVFHYISGSLSCGS

SEQ ID NO: 3091926 - protein, 43 aa, Giardia lamblia
SGLVATSVIVPLLIIGAVAGFLCWWFLCHKKNGGNCFGGGGGS

SEQ ID NO: 3091927 - protein, 28 aa, Giardia lamblia
SGMSQKLFLIALYLRKRWIARDSVLERK

SEQ ID NO: 3091928 - protein, 28 aa, Giardia lamblia
SGNPLFIDDLFFKRQPLAYNITRINLLR

SEQ ID NO: 3091929 - protein, 24 aa, Giardia lamblia
SGNRFTPLGLCMILTAVRATLTYQ

SEQ ID NO: 3091930 - protein, 19 aa, Giardia lamblia
SGPFLLFEVAILPQAKGLY

SEQ ID NO: 3091931 - protein, 19 aa, Giardia lamblia
SGPTEDYCLSCNTSYYMLN

SEQ ID NO: 3091932 - protein, 20 aa, Giardia lamblia
SGQVILYKFSTDTYSFESIT

SEQ ID NO: 3091933 - protein, 23 aa, Giardia lamblia
SGRALADFLLYPGGALEYASLLH

SEQ ID NO: 3091934 - protein, 21 aa, Giardia lamblia
SGREFLNPALFIINAMQTYGR

SEQ ID NO: 3091935 - protein, 24 aa, Giardia lamblia
SGRYKYLVLPTGLRVLMLGFLFHT

SEQ ID NO: 3091936 - protein, 28 aa, Giardia lamblia
SGSIMLNIKLLILTLYGISGITGSQARY

SEQ ID NO: 3091937 - protein, 23 aa, Giardia lamblia
SGTFKYRLLAADSQYSRPFLMND

SEQ ID NO: 3091938 - protein, 25 aa, Giardia lamblia
SGTLKTPAFYYVGAFTKGVFHGSGE

SEQ ID NO: 3091939 - protein, 17 aa, Giardia lamblia
SGTSQWTFGGFAGFVDH

SEQ ID NO: 3091940 - protein, 19 aa, Giardia lamblia
SGVDARFLRLVKEPGVRPY

SEQ ID NO: 3091941 - protein, 42 aa, Giardia lamblia
SGVFGAFFIVLVMLMIVSVPAYLYLFQRRYVFVRTLATSKSY

SEQ ID NO: 3091942 - protein, 30 aa, Giardia lamblia
SGVHRYHFPLFYERLMLNSLINGYPQAPLS

SEQ ID NO: 3091943 - protein, 25 aa, Giardia lamblia
SGVKPAYLVYVLVPLSCCQKFGTES

SEQ ID NO: 3091944 - protein, 25 aa, Giardia lamblia
SGYTDLMTAVLKRDRVGLSVYIDQA

SEQ ID NO: 3091945 - protein, 23 aa, Giardia lamblia
SHAKAPYLVFFNTLKTNATHKAA

SEQ ID NO: 3091946 - protein, 18 aa, Giardia lamblia
SHDISSLAFILLGGCDCA

SEQ ID NO: 3091947 - protein, 32 aa, Giardia lamblia
SHDPRQLVHYIIRSMLLMALGFSPLLGFVDLS

SEQ ID NO: 3091948 - protein, 17 aa, Giardia lamblia
SHDVPFEAKIPLISKER

SEQ ID NO: 3091949 - protein, 26 aa, Giardia lamblia
SHGPRDDFFVGLDRLFSILNRNNTVP

SEQ ID NO: 3091950 - protein, 30 aa, Giardia lamblia
SHIVWTLYRQLLVLFLTSFRVLVLSPCHPE

SEQ ID NO: 3091951 - protein, 25 aa, Giardia lamblia
SHLAEALVPTLWRSRRRQLAFEDGV

SEQ ID NO: 3091952 - protein, 22 aa, Giardia lamblia
SHLIRMAYRVFRLRPTAVTLGG

SEQ ID NO: 3091953 - protein, 25 aa, Giardia lamblia
SHRNLNQSPLIIRKLRTCSLRNLDH

SEQ ID NO: 3091954 - protein, 25 aa, Giardia lamblia
SHRWSSFSLAIFKVKCAARTTLLAY

SEQ ID NO: 3091955 - protein, 23 aa, Giardia lamblia
SHSDLISFKNLIYTQQQQLSTKE

SEQ ID NO: 3091956 - protein, 25 aa, Giardia lamblia
SHSNLFELGLFTHLDHFATMSGPHI

SEQ ID NO: 3091957 - protein, 36 aa, Giardia lamblia
SHSTYNVFVFILILLLPVKFFPYITSGYASAKSASR

SEQ ID NO: 3091958 - protein, 28 aa, Giardia lamblia
SHTFKRWLYIFRENAYIKSLLIGDKANS

SEQ ID NO: 3091959 - protein, 27 aa, Giardia lamblia
SHTLTPQITWLLNLTFDRVSFIVTQNA

SEQ ID NO: 3091960 - protein, 21 aa, Giardia lamblia
SHTPSWRMFLLVVDSFARFLA

SEQ ID NO: 3091961 - protein, 23 aa, Giardia lamblia
SHTRVLLPYFSKAGHMLYFKTDL

SEQ ID NO: 3091962 - protein, 18 aa, Giardia lamblia
SHVLFIPITDASFLPQYN

SEQ ID NO: 3091963 - protein, 31 aa, Giardia lamblia
SHVQKRLDRVLLLEILFLVAGVIICGAIAAA

SEQ ID NO: 3091964 - protein, 65 aa, Giardia lamblia
SHYIYNVIMSMLLIKDVYFFPSKASVLLLLIPLLNLLPLFMIILIRFFTPRPPNTFIYILCYLTQ

SEQ ID NO: 3091965 - protein, 28 aa, Giardia lamblia
SIAICMRYPLLFNKLSFFFNRSEAILSS

SEQ ID NO: 3091966 - protein, 28 aa, Giardia lamblia
SIAKSYIPYLRRQLFVLKTYHTHYEKIA

SEQ ID NO: 3091967 - protein, 32 aa, Giardia lamblia
SIAYIFSRIGFTLTFFIIPISLGISLYLILGY

SEQ ID NO: 3091968 - protein, 30 aa, Giardia lamblia
SICGVLIYFVVPILLWHKLPKLKARSPIID

SEQ ID NO: 3091969 - protein, 21 aa, Giardia lamblia
SICIFPCREAIFAVTRRAGID

SEQ ID NO: 3091970 - protein, 18 aa, Giardia lamblia
SICLDYHVAFTECSRVRG

SEQ ID NO: 3091971 - protein, 19 aa, Giardia lamblia
SICPVFSKNYLLQILSIHI

SEQ ID NO: 3091972 - protein, 30 aa, Giardia lamblia
SIDSIYVVLLLRTLIPYTCLFLSSLIPPHI

SEQ ID NO: 3091973 - protein, 26 aa, Giardia lamblia
SIDSSKIWLKYYKVITALAGCPWRHQ

SEQ ID NO: 3091974 - protein, 19 aa, Giardia lamblia
SIEDLFKQMTPIYDLVCKC

SEQ ID NO: 3091975 - protein, 18 aa, Giardia lamblia
SIESFTHLCACEKSLTAF

SEQ ID NO: 3091976 - protein, 23 aa, Giardia lamblia
SIFANYYRVLLEYLDYATTLDTS

SEQ ID NO: 3091977 - protein, 23 aa, Giardia lamblia
SIFCSDFIYVLASTWPVMLFIQK

SEQ ID NO: 3091978 - protein, 26 aa, Giardia lamblia
SIFIEYIDIVIFGIESHLTIAWPSSI

SEQ ID NO: 3091979 - protein, 17 aa, Giardia lamblia
SIFIFDDLNIMDSKAVL

SEQ ID NO: 3091980 - protein, 27 aa, Giardia lamblia
SIFSPDMPLLYVTRKFEQVILKYVPVD

SEQ ID NO: 3091981 - protein, 17 aa, Giardia lamblia
SIFYLSMPMVRKASYWT

SEQ ID NO: 3091982 - protein, 19 aa, Giardia lamblia
SIFYSIFSLQENLNTLYYC

SEQ ID NO: 3091983 - protein, 33 aa, Giardia lamblia
SIGDEFILSLAYLDWLFSLPPTLPLSSLQTGQL

SEQ ID NO: 3091984 - protein, 19 aa, Giardia lamblia
SIGDLWNPNFWTTLSYTVN

SEQ ID NO: 3091985 - protein, 17 aa, Giardia lamblia
SIGLLMVLLGSLLHRHY

SEQ ID NO: 3091986 - protein, 24 aa, Giardia lamblia
SIGPLQICRHKLLWKRIVSKTVDY

SEQ ID NO: 3091987 - protein, 20 aa, Giardia lamblia
SIGPRKFIPWSNGKNFPSAL

SEQ ID NO: 3091988 - protein, 28 aa, Giardia lamblia
SIIAMNILYVLSILFFNWSGLTVGKSLT

SEQ ID NO: 3091989 - protein, 19 aa, Giardia lamblia
SIIELPFFGYVTTEIRGVA

SEQ ID NO: 3091990 - protein, 17 aa, Giardia lamblia
SIIFLRGLASTPLTPDI

SEQ ID NO: 3091991 - protein, 26 aa, Giardia lamblia
SIILHSDLVLIIPPWKTKTPISTINT

SEQ ID NO: 3091992 - protein, 17 aa, Giardia lamblia
SIIVPELSIWNLKEAGA

SEQ ID NO: 3091993 - protein, 26 aa, Giardia lamblia
SIIYSLLTCIILFAKGRPMDHIVRNI

SEQ ID NO: 3091994 - protein, 24 aa, Giardia lamblia
SIKLNQKLLLEYAALRSNPVMNQG

SEQ ID NO: 3091995 - protein, 27 aa, Giardia lamblia
SILNLKTFFLWTFSGFIIAVVVFLLAY

SEQ ID NO: 3091996 - protein, 37 aa, Giardia lamblia
SILNLKTFFLWTFSGFIIAVVVFLLAYIFSSFPISVS

SEQ ID NO: 3091997 - protein, 25 aa, Giardia lamblia
SILNPILGCYFWNDLLAIIGPAEIR

SEQ ID NO: 3091998 - protein, 39 aa, Giardia lamblia
SILQHLTGFARYFISLTLNVFYLKLQSLSLHPLIDVEKT

SEQ ID NO: 3091999 - protein, 29 aa, Giardia lamblia
SILQMDVLEFPWYALLQNASISAGTLSMH

SEQ ID NO: 3092000 - protein, 19 aa, Giardia lamblia
SILVLRQVFIFLAMLQKGS

SEQ ID NO: 3092001 - protein, 27 aa, Giardia lamblia
SILYKTTLINRLLQMAYLIACNGCCCH

SEQ ID NO: 3092002 - protein, 24 aa, Giardia lamblia
SIMKKLTHLLDNIGNKIRAAQYDA

SEQ ID NO: 3092003 - protein, 31 aa, Giardia lamblia
SIMTIIAVVAVILLVLVALGKVSFTCCKANG

SEQ ID NO: 3092004 - protein, 21 aa, Giardia lamblia
SINPLLITPILHLNRFSYSNA

SEQ ID NO: 3092005 - protein, 46 aa, Giardia lamblia
SINPTNLILILYSRLSLDVQFYHIILKKKLIIKEYTRILPNAVSVS

SEQ ID NO: 3092006 - protein, 19 aa, Giardia lamblia
SINTFLKKAFTPARKFIVR

SEQ ID NO: 3092007 - protein, 27 aa, Giardia lamblia
SIPNFHPYVQFFLSTTLVYPNETHNSL

SEQ ID NO: 3092008 - protein, 20 aa, Giardia lamblia
SIPWIVRGIVEVIFLEFYAV

SEQ ID NO: 3092009 - protein, 22 aa, Giardia lamblia
SIPYIITCCLFANPNTNYTVCI

SEQ ID NO: 3092010 - protein, 23 aa, Giardia lamblia
SIRDFLIKVVAFAFRLTSAQVSH

SEQ ID NO: 3092011 - protein, 28 aa, Giardia lamblia
SIRISGFVLIMKVLGLSSSLMTSASKAD

SEQ ID NO: 3092012 - protein, 21 aa, Giardia lamblia
SIRKDPLFWLRSIFAGQRGSL

SEQ ID NO: 3092013 - protein, 29 aa, Giardia lamblia
SIRNHATLILISWMNYLYTKLNNLSRAGP

SEQ ID NO: 3092014 - protein, 25 aa, Giardia lamblia
SISECTFQLPYLGSLVVMSLIQSTL

SEQ ID NO: 3092015 - protein, 19 aa, Giardia lamblia
SISFPLARLLDLISGKPKE

SEQ ID NO: 3092016 - protein, 27 aa, Giardia lamblia
SISLLRQIKYWEILLVLLCEADAYTKE

SEQ ID NO: 3092017 - protein, 17 aa, Giardia lamblia
SISLRGLSLLCLKQAFL

SEQ ID NO: 3092018 - protein, 24 aa, Giardia lamblia
SISRILIRSLYPLKPLCKNYGYKI

SEQ ID NO: 3092019 - protein, 25 aa, Giardia lamblia
SISRIRLFLINALQASASAPADASD

SEQ ID NO: 3092020 - protein, 20 aa, Giardia lamblia
SISSLYKQLPSLLNTLERSK

SEQ ID NO: 3092021 - protein, 28 aa, Giardia lamblia
SITDATLPLLPLLLLRVTGADAARPSGP

SEQ ID NO: 3092022 - protein, 22 aa, Giardia lamblia
SITIFCLLLLADIHISPLPSQV

SEQ ID NO: 3092023 - protein, 25 aa, Giardia lamblia
SITLLFLCISIYASAVKFLLLGGVA

SEQ ID NO: 3092024 - protein, 32 aa, Giardia lamblia
SITLLPVIVQVIFMALLPLVIKYLSMLAFCTS

SEQ ID NO: 3092025 - protein, 30 aa, Giardia lamblia
SITLVAFFFYDIYFVFFTPIMLTVAKKVVI

SEQ ID NO: 3092026 - protein, 32 aa, Giardia lamblia
SITRFLPVLLLHSNGLTIHWLEKVLLKAPHDS

SEQ ID NO: 3092027 - protein, 26 aa, Giardia lamblia
SITVVTRIFYLLDRTFKQHITHHDLT

SEQ ID NO: 3092028 - protein, 27 aa, Giardia lamblia
SIVDVLLVSLGFTFGRVLSRLVCMFYQ

SEQ ID NO: 3092029 - protein, 35 aa, Giardia lamblia
SIVFNYVTLILLQVLIWTPLICTLIPSLKTYSHTF

SEQ ID NO: 3092030 - protein, 22 aa, Giardia lamblia
SIVFVALAFLVNLGTDAAKPLP

SEQ ID NO: 3092031 - protein, 18 aa, Giardia lamblia
SIVSNLCGFGSFIESMVS

SEQ ID NO: 3092032 - protein, 28 aa, Giardia lamblia
SIYELLPPCYNLLPLPYRLRCSVQGLLR

SEQ ID NO: 3092033 - protein, 17 aa, Giardia lamblia
SIYFAIGWALLLGPLLG

SEQ ID NO: 3092034 - protein, 26 aa, Giardia lamblia
SIYSGLLCFIFDLVDFYSATPTLVNV

SEQ ID NO: 3092035 - protein, 22 aa, Giardia lamblia
SIYSKYLLSTKILEPIYSVSYS

SEQ ID NO: 3092036 - protein, 20 aa, Giardia lamblia
SIYVFLMIRRHKAILHLIHT

SEQ ID NO: 3092037 - protein, 26 aa, Giardia lamblia
SKALRDTFWAAVALRVTVAGYSFIIL

SEQ ID NO: 3092038 - protein, 22 aa, Giardia lamblia
SKALVLQHILSSLFLPSHQKEM

SEQ ID NO: 3092039 - protein, 22 aa, Giardia lamblia
SKATVEPCLIEDLGPLLNDCTE

SEQ ID NO: 3092040 - protein, 25 aa, Giardia lamblia
SKDTYWYDQALRYLLSRINESDRFT

SEQ ID NO: 3092041 - protein, 24 aa, Giardia lamblia
SKDYLYWHVAKALTKYLKALISNP

SEQ ID NO: 3092042 - protein, 27 aa, Giardia lamblia
SKELQVFTIILYYLVASLLSVILAVVV

SEQ ID NO: 3092043 - protein, 32 aa, Giardia lamblia
SKEMMLPIFGSLYFYFYAFLQPFVGITVDAIK

SEQ ID NO: 3092044 - protein, 20 aa, Giardia lamblia
SKFIAAFYRSQLWSQDFPPS

SEQ ID NO: 3092045 - protein, 31 aa, Giardia lamblia
SKGHELEHSLQLFTPLLTSKSPHDATEKQVK

SEQ ID NO: 3092046 - protein, 21 aa, Giardia lamblia
SKHFLAYLQDAKGAPVPILVQ

SEQ ID NO: 3092047 - protein, 29 aa, Giardia lamblia
SKHQDPLPFILIPLPQRIIDAISTVLACC

SEQ ID NO: 3092048 - protein, 29 aa, Giardia lamblia
SKIALHYQIPWLVPRRQKSKPRNAHLRIS

SEQ ID NO: 3092049 - protein, 21 aa, Giardia lamblia
SKLQWIIQQLSPQFLRDLVFD

SEQ ID NO: 3092050 - protein, 34 aa, Giardia lamblia
SKMHILLYTFACMVFFFFFIVNMTFPLHFRSPFV

SEQ ID NO: 3092051 - protein, 33 aa, Giardia lamblia
SKNAAQRFLTIWMPAVFVCLLALPKMSYLESYR

SEQ ID NO: 3092052 - protein, 17 aa, Giardia lamblia
SKNIKLFAQLLTPDFWL

SEQ ID NO: 3092053 - protein, 28 aa, Giardia lamblia
SKPEFSWRGIPWYFLVSKRFWAVQKDHR

SEQ ID NO: 3092054 - protein, 31 aa, Giardia lamblia
SKPEVMELWVHIIILLHYSITHEAWFSVLTA

SEQ ID NO: 3092055 - protein, 19 aa, Giardia lamblia
SKPRRKLTFVVPMVSRATE

SEQ ID NO: 3092056 - protein, 44 aa, Giardia lamblia
SKQAYIRIPITACYLKSLIWTLKIIRMVLYKRQIATETIIIARH

SEQ ID NO: 3092057 - protein, 32 aa, Giardia lamblia
SKRFRLVMRSIFLVLLLSLFIGYFVPQTYILN

SEQ ID NO: 3092058 - protein, 27 aa, Giardia lamblia
SKRLSPDTWLYSKRPLLALAEASAMSM

SEQ ID NO: 3092059 - protein, 23 aa, Giardia lamblia
SKSGMLTRLPYAELQRLGYVTPL

SEQ ID NO: 3092060 - protein, 18 aa, Giardia lamblia
SKSNLLIISYNRQFFRQF

SEQ ID NO: 3092061 - protein, 21 aa, Giardia lamblia
SKTFCTRCFGGYSISYHDCVP

SEQ ID NO: 3092062 - protein, 41 aa, Giardia lamblia
SKTHGFLIRPMLYQSLPEFILQNPWLTRGHKVLYSIQMILA

SEQ ID NO: 3092063 - protein, 26 aa, Giardia lamblia
SKTPGPGLLPCFYYRDSFTVECTECA

SEQ ID NO: 3092064 - protein, 30 aa, Giardia lamblia
SKVLPFRINILAWFLPFSSLSYITSSITIE

SEQ ID NO: 3092065 - protein, 24 aa, Giardia lamblia
SKVQHYLILLAQKDGRRPLHVTAF

SEQ ID NO: 3092066 - protein, 24 aa, Giardia lamblia
SKVQPLKKPLHYVKSYTISVGVKQ

SEQ ID NO: 3092067 - protein, 24 aa, Giardia lamblia
SLADPYESLYLLEFNHRLHILHSP

SEQ ID NO: 3092068 - protein, 20 aa, Giardia lamblia
SLAEPTLRAHWPKFNGKPYG

SEQ ID NO: 3092069 - protein, 24 aa, Giardia lamblia
SLALIVVIIVGWVFGIKNAKKYEQ

SEQ ID NO: 3092070 - protein, 45 aa, Giardia lamblia
SLAQLFYRSFTHVIVILLFALGNWRCYPLGQFLYLPAERISQLQG

SEQ ID NO: 3092071 - protein, 27 aa, Giardia lamblia
SLCCLYRDFFIPPLSTMLSSRVKIDLF

SEQ ID NO: 3092072 - protein, 34 aa, Giardia lamblia
SLCCNGCVVCWVSLFLMLFGIVAVVLQKFALEYY

SEQ ID NO: 3092073 - protein, 26 aa, Giardia lamblia
SLCFRYTDMLILFSNASISVFLMAES

SEQ ID NO: 3092074 - protein, 30 aa, Giardia lamblia
SLCLVYYTNLLLYIEKLLYVITRLVHDTSM

SEQ ID NO: 3092075 - protein, 28 aa, Giardia lamblia
SLCSPVFLQFLELVYYLLSAYPSEFEFT

SEQ ID NO: 3092076 - protein, 22 aa, Giardia lamblia
SLCTVLYCLVGFFGALIFGKTI

SEQ ID NO: 3092077 - protein, 28 aa, Giardia lamblia
SLDEYNKLFRMSFINMFANILVTPSRVL

SEQ ID NO: 3092078 - protein, 22 aa, Giardia lamblia
SLDLQTQFMLLETIIALVGMLP

SEQ ID NO: 3092079 - protein, 32 aa, Giardia lamblia
SLDMRVLAPSLYKYWRLATTTLPLINTSLGER

SEQ ID NO: 3092080 - protein, 20 aa, Giardia lamblia
SLEAYQLAQSILRPAGISLE

SEQ ID NO: 3092081 - protein, 24 aa, Giardia lamblia
SLEKWAMLVGIKLSISKPTFLEVT

SEQ ID NO: 3092082 - protein, 17 aa, Giardia lamblia
SLELLYKWMNTCLGYKT

SEQ ID NO: 3092083 - protein, 18 aa, Giardia lamblia
SLESLLSREYHYWPEVSV

SEQ ID NO: 3092084 - protein, 24 aa, Giardia lamblia
SLESQRFLTWLRAEIPKRTGKSLS

SEQ ID NO: 3092085 - protein, 22 aa, Giardia lamblia
SLEVALDFIFPSPLAVLSELEQ

SEQ ID NO: 3092086 - protein, 22 aa, Giardia lamblia
SLFFLFMLPVMIPLDRANSSTF

SEQ ID NO: 3092087 - protein, 17 aa, Giardia lamblia
SLFFQTVGFLYARYGRN

SEQ ID NO: 3092088 - protein, 20 aa, Giardia lamblia
SLFIGIIVIIYTFGSIASYC

SEQ ID NO: 3092089 - protein, 19 aa, Giardia lamblia
SLFNGVNICVFPKSNSQTN

SEQ ID NO: 3092090 - protein, 28 aa, Giardia lamblia
SLFVDYDIYWDVWVLVLSISVSVIAITL

SEQ ID NO: 3092091 - protein, 19 aa, Giardia lamblia
SLFVKLFISEIFAEAIALI

SEQ ID NO: 3092092 - protein, 23 aa, Giardia lamblia
SLGAGRLLTFLKALSVIPTQERL

SEQ ID NO: 3092093 - protein, 21 aa, Giardia lamblia
SLGGFAYLSFALSILAIVAIV

SEQ ID NO: 3092094 - protein, 17 aa, Giardia lamblia
SLGILPPQGIDAPQTFD

SEQ ID NO: 3092095 - protein, 21 aa, Giardia lamblia
SLGIQKLYYKVFQRLSPVDMF

SEQ ID NO: 3092096 - protein, 25 aa, Giardia lamblia
SLGMIIYRFLAISFPFYINGVSSSV

SEQ ID NO: 3092097 - protein, 24 aa, Giardia lamblia
SLGPFCNEFILRLLCLSESRIYLS

SEQ ID NO: 3092098 - protein, 24 aa, Giardia lamblia
SLHGFTTIIKTLFSYEGELNATLK

SEQ ID NO: 3092099 - protein, 33 aa, Giardia lamblia
SLHIMQDLLAPLNLRTYFLVISLYGAHYQYKSV

SEQ ID NO: 3092100 - protein, 19 aa, Giardia lamblia
SLHTYPFALGILGPYCKTI

SEQ ID NO: 3092101 - protein, 21 aa, Giardia lamblia
SLICCSTALRKLRLLNKCDYC

SEQ ID NO: 3092102 - protein, 25 aa, Giardia lamblia
SLIGSLIIFLVMAVRFFLAGTANDN

SEQ ID NO: 3092103 - protein, 20 aa, Giardia lamblia
SLIPTLQPLLNDPPLQISCY

SEQ ID NO: 3092104 - protein, 26 aa, Giardia lamblia
SLKKREIIFIVPNYKGIYLSEHVFVA

SEQ ID NO: 3092105 - protein, 20 aa, Giardia lamblia
SLKRKIITLANYELTRNPTL

SEQ ID NO: 3092106 - protein, 26 aa, Giardia lamblia
SLKSTRWIIAFINTLSYFSTLRLVIP

SEQ ID NO: 3092107 - protein, 35 aa, Giardia lamblia
SLLASILPHTIMAYGLKSPFVASLLKLLTDRRSEI

SEQ ID NO: 3092108 - protein, 18 aa, Giardia lamblia
SLLCLKQAFLFTRDTIAA

SEQ ID NO: 3092109 - protein, 17 aa, Giardia lamblia
SLLDSQMHFAYKSDAEG

SEQ ID NO: 3092110 - protein, 25 aa, Giardia lamblia
SLLEELLTIPNWIRRLTAASTLIHV

SEQ ID NO: 3092111 - protein, 18 aa, Giardia lamblia
SLLHLVMSVFRALAPSEF

SEQ ID NO: 3092112 - protein, 31 aa, Giardia lamblia
SLLHVLSTLSQIYFWLLATTALCACTHYSHF

SEQ ID NO: 3092113 - protein, 26 aa, Giardia lamblia
SLLINPKTIWLFLRDNRAVLRSLLST

SEQ ID NO: 3092114 - protein, 21 aa, Giardia lamblia
SLLIWVIMVIIYYSTRHYNRP

SEQ ID NO: 3092115 - protein, 25 aa, Giardia lamblia
SLLKSIIFSMLPRVIPVVLDIIVSE

SEQ ID NO: 3092116 - protein, 38 aa, Giardia lamblia
SLLLPEELLYLRLHLHLLIFYFITAYSKKRLRTVMPDR

SEQ ID NO: 3092117 - protein, 17 aa, Giardia lamblia
SLLLTSVVYLITAVIRA

SEQ ID NO: 3092118 - protein, 19 aa, Giardia lamblia
SLLPNLRLGTPLKAIWNAY

SEQ ID NO: 3092119 - protein, 30 aa, Giardia lamblia
SLLPSTWTSKSLLIGVLWSAGELADTTKIC

SEQ ID NO: 3092120 - protein, 30 aa, Giardia lamblia
SLLQSLVVIPLLLLLLTHSKPEFSWRGIPW

SEQ ID NO: 3092121 - protein, 27 aa, Giardia lamblia
SLLRPPIQQHWLIGRVVLLLRGKECEQ

SEQ ID NO: 3092122 - protein, 21 aa, Giardia lamblia
SLLSAAWLGAISNSLAVRDTT

SEQ ID NO: 3092123 - protein, 27 aa, Giardia lamblia
SLLTQGIFVLIVRILNCTILQNVAKIV

SEQ ID NO: 3092124 - protein, 20 aa, Giardia lamblia
SLLTWALICNASSILCVVIL

SEQ ID NO: 3092125 - protein, 21 aa, Giardia lamblia
SLLVFYLFRHIFMISSRSFAT

SEQ ID NO: 3092126 - protein, 17 aa, Giardia lamblia
SLMLAAEKNYMSLIPLL

SEQ ID NO: 3092127 - protein, 27 aa, Giardia lamblia
SLMVCMHHGFRISFITSPLATSWGLGA

SEQ ID NO: 3092128 - protein, 17 aa, Giardia lamblia
SLNILSYRQIQQIRYIV

SEQ ID NO: 3092129 - protein, 19 aa, Giardia lamblia
SLNLDWLLIALVASLACYY

SEQ ID NO: 3092130 - protein, 20 aa, Giardia lamblia
SLPAPVCAALFGLPGPCPAC

SEQ ID NO: 3092131 - protein, 25 aa, Giardia lamblia
SLPGLLIEYLIKRSLFDLSASISTY

SEQ ID NO: 3092132 - protein, 23 aa, Giardia lamblia
SLPKDFFSSLLLHLVDTLSNEAF

SEQ ID NO: 3092133 - protein, 23 aa, Giardia lamblia
SLQKFFQMAILSCIWMSPYYIVI

SEQ ID NO: 3092134 - protein, 20 aa, Giardia lamblia
SLRILDMTASLLYMKALEPI

SEQ ID NO: 3092135 - protein, 32 aa, Giardia lamblia
SLRPTVVLCLCNTFFLLHHYTIRDVPEHAGAG

SEQ ID NO: 3092136 - protein, 26 aa, Giardia lamblia
SLRTHPTICHFLVALLAHQKNDSYIS

SEQ ID NO: 3092137 - protein, 19 aa, Giardia lamblia
SLRYLVGYSIIIIGDSSTK

SEQ ID NO: 3092138 - protein, 22 aa, Giardia lamblia
SLRYTHFPNGYLFRSGLYESGE

SEQ ID NO: 3092139 - protein, 25 aa, Giardia lamblia
SLSHWHTYVIASVKLRDYLLSLLFD

SEQ ID NO: 3092140 - protein, 19 aa, Giardia lamblia
SLSKPFVVYIYSALEFCSA

SEQ ID NO: 3092141 - protein, 18 aa, Giardia lamblia
SLSLTYRNILRVLRDPLS

SEQ ID NO: 3092142 - protein, 17 aa, Giardia lamblia
SLSMRTIMEISVAMVAI

SEQ ID NO: 3092143 - protein, 26 aa, Giardia lamblia
SLSQYLETFIVPDIDPFLSGIRNAFL

SEQ ID NO: 3092144 - protein, 17 aa, Giardia lamblia
SLSSIFVTAPPAACLTP

SEQ ID NO: 3092145 - protein, 26 aa, Giardia lamblia
SLSSYFCNVLLTFSYLFATATLAQGY

SEQ ID NO: 3092146 - protein, 19 aa, Giardia lamblia
SLSWYVQYYSDILANDALN

SEQ ID NO: 3092147 - protein, 20 aa, Giardia lamblia
SLTASMYSTAPLLSGSRQSS

SEQ ID NO: 3092148 - protein, 23 aa, Giardia lamblia
SLTLYRIVDLPRGHKLAPLPLLS

SEQ ID NO: 3092149 - protein, 22 aa, Giardia lamblia
SLTVAKRRFLLSYAGYSILSYL

SEQ ID NO: 3092150 - protein, 24 aa, Giardia lamblia
SLTVYMKALWFKVPAEFTGAVPEL

SEQ ID NO: 3092151 - protein, 27 aa, Giardia lamblia
SLVAVWMLFIMFRKSILDMPLKGVLKL

SEQ ID NO: 3092152 - protein, 17 aa, Giardia lamblia
SLVGLLMTLFRTKHYQK

SEQ ID NO: 3092153 - protein, 17 aa, Giardia lamblia
SLVLFDPSAYDSAVEVY

SEQ ID NO: 3092154 - protein, 20 aa, Giardia lamblia
SLVLLVAYNGTTTAGPYLIC

SEQ ID NO: 3092155 - protein, 29 aa, Giardia lamblia
SLVLTLNSFLLLIYSVTSAALYISQIQIY

SEQ ID NO: 3092156 - protein, 24 aa, Giardia lamblia
SLVLTYTERLIVSAISYLSLRSGI

SEQ ID NO: 3092157 - protein, 17 aa, Giardia lamblia
SLVLYLLTSIANQRDPI

SEQ ID NO: 3092158 - protein, 26 aa, Giardia lamblia
SLVQSILALPLLTLVLLFCKHEPGSQ

SEQ ID NO: 3092159 - protein, 36 aa, Giardia lamblia
SLVSLLRHIRIPQFMKVLYRILDPKYVKFVWRLRGI

SEQ ID NO: 3092160 - protein, 34 aa, Giardia lamblia
SLWQPIVVPKEVTWIFIVLIPLFCSFSLVDMLLM

SEQ ID NO: 3092161 - protein, 19 aa, Giardia lamblia
SLYFASYGLAGLLPFNDKG

SEQ ID NO: 3092162 - protein, 27 aa, Giardia lamblia
SLYFGERFFFPYIIVRYYERKSIENGL

SEQ ID NO: 3092163 - protein, 32 aa, Giardia lamblia
SLYVKPSFFGHFRLAFPLAFNVSKTGSVTFTD

SEQ ID NO: 3092164 - protein, 23 aa, Giardia lamblia
SLYVYRMVDWLPITRLALLIACF

SEQ ID NO: 3092165 - protein, 22 aa, Giardia lamblia
SMALQYLVLLPDQLKKRLCSHF

SEQ ID NO: 3092166 - protein, 20 aa, Giardia lamblia
SMCCLPYAVLLNIVFSDLGR

SEQ ID NO: 3092167 - protein, 18 aa, Giardia lamblia
SMENIELALRFLREQRRG

SEQ ID NO: 3092168 - protein, 25 aa, Giardia lamblia
SMKLTILIILPIVTVIYAAAAIEGS

SEQ ID NO: 3092169 - protein, 17 aa, Giardia lamblia
SMLLFPAIDAPAPVSNN

SEQ ID NO: 3092170 - protein, 20 aa, Giardia lamblia
SMLMQNVLFRMGCSAVLFSN

SEQ ID NO: 3092171 - protein, 18 aa, Giardia lamblia
SMLRITLVRYVHAYRYYS

SEQ ID NO: 3092172 - protein, 18 aa, Giardia lamblia
SMLYLLTATLGIAASLVS

SEQ ID NO: 3092173 - protein, 24 aa, Giardia lamblia
SMMAQFLYYFRRAIGSSFKHIVVL

SEQ ID NO: 3092174 - protein, 36 aa, Giardia lamblia
SMPIVSLIIKCIRLEELFLISALAVLRRMPLAFKRT

SEQ ID NO: 3092175 - protein, 20 aa, Giardia lamblia
SMQFTMRIFLQQGVLRFCLS

SEQ ID NO: 3092176 - protein, 23 aa, Giardia lamblia
SMQRTAMMIATRSACSRIVSELS

SEQ ID NO: 3092177 - protein, 41 aa, Giardia lamblia
SMSTAILQQSKFLDSIPYSIQFIAQTDLLCMLISESQSLPQ

SEQ ID NO: 3092178 - protein, 25 aa, Giardia lamblia
SMTCREFFSWMRKAAKKKTLVATII

SEQ ID NO: 3092179 - protein, 24 aa, Giardia lamblia
SMVDSCLDILSGLVLFICARLARS

SEQ ID NO: 3092180 - protein, 20 aa, Giardia lamblia
SMVFSLLELVHTPSAAYILA

SEQ ID NO: 3092181 - protein, 26 aa, Giardia lamblia
SNAEALVFMMAYVTHLFTLPLNESKQ

SEQ ID NO: 3092182 - protein, 26 aa, Giardia lamblia
SNANWHWRFLASPQGLIKYIISVRNT

SEQ ID NO: 3092183 - protein, 17 aa, Giardia lamblia
SNCEFCMDGAYPAPYRC

SEQ ID NO: 3092184 - protein, 18 aa, Giardia lamblia
SNDAFRVLFPQLEMFRQA

SEQ ID NO: 3092185 - protein, 25 aa, Giardia lamblia
SNDLKLWLPLSMTQWNPCLFGFQGS

SEQ ID NO: 3092186 - protein, 53 aa, Giardia lamblia
SNDLLYLLVNLLVIMLLSWPTIVFIIPLGILYIFIFNTFRLIAPQLKRITPIL

SEQ ID NO: 3092187 - protein, 17 aa, Giardia lamblia
SNDPAALSLFLSRICIN

SEQ ID NO: 3092188 - protein, 19 aa, Giardia lamblia
SNDQNICLHISISLGMCDN

SEQ ID NO: 3092189 - protein, 26 aa, Giardia lamblia
SNEVYKHYWLGLIWEWTLGMIQSNKP

SEQ ID NO: 3092190 - protein, 41 aa, Giardia lamblia
SNFFITIRNMLYWEDALLTEVLLFCINFLTANLPDNAPALA

SEQ ID NO: 3092191 - protein, 23 aa, Giardia lamblia
SNFVPSLLLYLAVDGVILSLYSS

SEQ ID NO: 3092192 - protein, 25 aa, Giardia lamblia
SNGKDLFSYCRLPDILARDGIHSWV

SEQ ID NO: 3092193 - protein, 24 aa, Giardia lamblia
SNHKKLFRLLFSCIQYFELSHYKI

SEQ ID NO: 3092194 - protein, 22 aa, Giardia lamblia
SNHLPILRLQWPASAKRVSLDD

SEQ ID NO: 3092195 - protein, 20 aa, Giardia lamblia
SNICTLCESLFYMCAECSKT

SEQ ID NO: 3092196 - protein, 24 aa, Giardia lamblia
SNIFYTSDVYLWLASKLSTLSCEE

SEQ ID NO: 3092197 - protein, 24 aa, Giardia lamblia
SNILLVILKIIAYSLSLSMSVLAS

SEQ ID NO: 3092198 - protein, 33 aa, Giardia lamblia
SNIPRMIAVPLKLLMIVLFLVFQIDRSALAGFG

SEQ ID NO: 3092199 - protein, 26 aa, Giardia lamblia
SNISGFCILFILITVLSVFGYFIAGL

SEQ ID NO: 3092200 - protein, 24 aa, Giardia lamblia
SNITQTVFFIEPLFRGCAYSFSST

SEQ ID NO: 3092201 - protein, 23 aa, Giardia lamblia
SNKCTFCMPGYALTSDSTCQACQ

SEQ ID NO: 3092202 - protein, 22 aa, Giardia lamblia
SNKMVSFIPTPIPTRIYGTIVF

SEQ ID NO: 3092203 - protein, 27 aa, Giardia lamblia
SNKSYYNFTYFILHSRSLAIYKRSLPA

SEQ ID NO: 3092204 - protein, 23 aa, Giardia lamblia
SNLDRNILCPPGQSYKTFCGSQS

SEQ ID NO: 3092205 - protein, 27 aa, Giardia lamblia
SNLHFSKDVLFPFKLQDVTLQNITPSW

SEQ ID NO: 3092206 - protein, 33 aa, Giardia lamblia
SNLLIDSLCLFFVPLACLFWAAWSSGVDGIDVY

SEQ ID NO: 3092207 - protein, 18 aa, Giardia lamblia
SNMDLLNILLRLQENYDT

SEQ ID NO: 3092208 - protein, 29 aa, Giardia lamblia
SNMSYYIHGILVPLLYRQKVPSNVSVLPH

SEQ ID NO: 3092209 - protein, 34 aa, Giardia lamblia
SNNKTWTLLLDELFIIHYKYGFAGVVLRGIDYPY

SEQ ID NO: 3092210 - protein, 26 aa, Giardia lamblia
SNNRQIIEILLYNKDTRNLLLRACDD

SEQ ID NO: 3092211 - protein, 24 aa, Giardia lamblia
SNRDKFLLFYTAFYTTTLSDINEY

SEQ ID NO: 3092212 - protein, 17 aa, Giardia lamblia
SNRFLSAIIISSLFGII

SEQ ID NO: 3092213 - protein, 24 aa, Giardia lamblia
SNRIIYLVYAAWQGAFLRPYIGVD

SEQ ID NO: 3092214 - protein, 30 aa, Giardia lamblia
SNRVKTPLYTFLLRCLYAYAFTSLNFLACG

SEQ ID NO: 3092215 - protein, 26 aa, Giardia lamblia
SNSFFALLHFLAIRDRYRFAQTLIAK

SEQ ID NO: 3092216 - protein, 24 aa, Giardia lamblia
SNSLLNCPVYSKSVLRLIKDSGKL

SEQ ID NO: 3092217 - protein, 21 aa, Giardia lamblia
SNSLVRMYTVLSRYPLRVERY

SEQ ID NO: 3092218 - protein, 34 aa, Giardia lamblia
SNSRVMVRPKFINYFFLIAGALRPKYLVTVDAAN

SEQ ID NO: 3092219 - protein, 20 aa, Giardia lamblia
SNSTFLQRSIPLKPLRVSTL

SEQ ID NO: 3092220 - protein, 24 aa, Giardia lamblia
SNVKIKYSIFIIPVGRENINPVPT

SEQ ID NO: 3092221 - protein, 32 aa, Giardia lamblia
SNVPESFHTLRFPPHSFQTLQHYLPETNTKLD

SEQ ID NO: 3092222 - protein, 30 aa, Giardia lamblia
SNWYMDEGRLPFLSPMPYRAARLSNVQGAD

SEQ ID NO: 3092223 - protein, 45 aa, Giardia lamblia
SNWYTPGYFVLYEGELWPTYFTIYTILLYKFALPFSTKALKYVMD

SEQ ID NO: 3092224 - protein, 17 aa, Giardia lamblia
SNYGRFLRTVLHSFYTT

SEQ ID NO: 3092225 - protein, 23 aa, Giardia lamblia
SNYSYYGLISYASLASQLMSDFQ

SEQ ID NO: 3092226 - protein, 24 aa, Giardia lamblia
SPDGYMPNYTLYEAAIAMLKIVGT

SEQ ID NO: 3092227 - protein, 19 aa, Giardia lamblia
SPDLLYFVTATNSKAKTKD

SEQ ID NO: 3092228 - protein, 23 aa, Giardia lamblia
SPDRAHIFAALFQDPVAAIITSL

SEQ ID NO: 3092229 - protein, 18 aa, Giardia lamblia
SPDYLYDVFISRELDRVQ

SEQ ID NO: 3092230 - protein, 25 aa, Giardia lamblia
SPESYLFNNIPLQTNLQLALFAICI

SEQ ID NO: 3092231 - protein, 21 aa, Giardia lamblia
SPETNWIYYKGTKTQFRSVLD

SEQ ID NO: 3092232 - protein, 22 aa, Giardia lamblia
SPFHWNLYPVSQAHDRIRLCRQ

SEQ ID NO: 3092233 - protein, 19 aa, Giardia lamblia
SPFMFLGPYNSIASTFYHN

SEQ ID NO: 3092234 - protein, 32 aa, Giardia lamblia
SPFSLVQHIILLFNLLLIPLDMLLVTAKEEHR

SEQ ID NO: 3092235 - protein, 27 aa, Giardia lamblia
SPGFASYFLTNLAFLLRTVCTYASAVP

SEQ ID NO: 3092236 - protein, 28 aa, Giardia lamblia
SPITALCFLGQWPLLFSASASGACYIHA

SEQ ID NO: 3092237 - protein, 29 aa, Giardia lamblia
SPIVTSVIIILLLAIISAVLGLVIRTVIH

SEQ ID NO: 3092238 - protein, 19 aa, Giardia lamblia
SPIYLPWASNFSRKTQIIC

SEQ ID NO: 3092239 - protein, 23 aa, Giardia lamblia
SPIYPALQLLRLLTQPVALKEGF

SEQ ID NO: 3092240 - protein, 22 aa, Giardia lamblia
SPLEQSWLRFLHTVHLSDPTYS

SEQ ID NO: 3092241 - protein, 22 aa, Giardia lamblia
SPLHLQEFVAIYSSIVFARTTP

SEQ ID NO: 3092242 - protein, 19 aa, Giardia lamblia
SPLLLSGLVLTVASLVLYL

SEQ ID NO: 3092243 - protein, 27 aa, Giardia lamblia
SPMHIPTTLFVPSGLLSYADFILLAKS

SEQ ID NO: 3092244 - protein, 33 aa, Giardia lamblia
SPQSYIIIFGVPVLTIFVLYIVQTAIYSQSSFL

SEQ ID NO: 3092245 - protein, 35 aa, Giardia lamblia
SPRTVPHILIRYNLLRDRSNPIRRIPFRELMNNHA

SEQ ID NO: 3092246 - protein, 21 aa, Giardia lamblia
SPSFLVTCTFPHSFDSMILPS

SEQ ID NO: 3092247 - protein, 20 aa, Giardia lamblia
SPSFLYKDIGQYLALLMTRG

SEQ ID NO: 3092248 - protein, 26 aa, Giardia lamblia
SPSKAYIACLLMLLQRRNPGAALKGS

SEQ ID NO: 3092249 - protein, 37 aa, Giardia lamblia
SPTCTFTVAMDYDIGWTVWPLALTVTVGVLVTVAISV

SEQ ID NO: 3092250 - protein, 25 aa, Giardia lamblia
SPTLEPVIQVLFHPGSNDQFVTLSA

SEQ ID NO: 3092251 - protein, 18 aa, Giardia lamblia
SPTLFLNNELFCLGGVKC

SEQ ID NO: 3092252 - protein, 21 aa, Giardia lamblia
SPTLVFLALFGIFEIITNLPF

SEQ ID NO: 3092253 - protein, 32 aa, Giardia lamblia
SPTQLCVFIAWNRSCPYLYSNKLIASTLVVHS

SEQ ID NO: 3092254 - protein, 18 aa, Giardia lamblia
SPTTGVPIVLRYIEPYIN

SEQ ID NO: 3092255 - protein, 28 aa, Giardia lamblia
SQALNYVELLNLNLAFYLATEGRIPLPI

SEQ ID NO: 3092256 - protein, 18 aa, Giardia lamblia
SQAQYLLHYMALSLVDLS

SEQ ID NO: 3092257 - protein, 23 aa, Giardia lamblia
SQDALLFSFFLNDNLNQYVNIRL

SEQ ID NO: 3092258 - protein, 31 aa, Giardia lamblia
SQDKDLIWKYRYYMRKYPRGLIKVISSIPQS

SEQ ID NO: 3092259 - protein, 19 aa, Giardia lamblia
SQFHCDYPYLYTATAQLQT

SEQ ID NO: 3092260 - protein, 19 aa, Giardia lamblia
SQFMRLGDNPAMRELINIK

SEQ ID NO: 3092261 - protein, 21 aa, Giardia lamblia
SQGRFMTPYLSEVITLLCILC

SEQ ID NO: 3092262 - protein, 44 aa, Giardia lamblia
SQHIRLTVHVIALMLALISVIIMLVYIVGKLIAIRRLKAASRKQ

SEQ ID NO: 3092263 - protein, 19 aa, Giardia lamblia
SQHKGMTLHPPLASLARLP

SEQ ID NO: 3092264 - protein, 22 aa, Giardia lamblia
SQIINLILKNLSVFKLYESRLR

SEQ ID NO: 3092265 - protein, 25 aa, Giardia lamblia
SQIPNRRFALWWSPTINRSSVYIGY

SEQ ID NO: 3092266 - protein, 24 aa, Giardia lamblia
SQKDPLTIDFLLSQATLAANSGLL

SEQ ID NO: 3092267 - protein, 34 aa, Giardia lamblia
SQKKILPLSAYFLLMILMSFVELGALSFAFALLH

SEQ ID NO: 3092268 - protein, 19 aa, Giardia lamblia
SQLLDLPSLAAFLSAQVSA

SEQ ID NO: 3092269 - protein, 18 aa, Giardia lamblia
SQLSPPPPRIHTTLQFFI

SEQ ID NO: 3092270 - protein, 18 aa, Giardia lamblia
SQLWLRKACLEKGIDLSR

SEQ ID NO: 3092271 - protein, 19 aa, Giardia lamblia
SQMFPGMRFLGHSSHLVVG

SEQ ID NO: 3092272 - protein, 30 aa, Giardia lamblia
SQMGSFKPVPLYIICLVSFGIFSIVVSMLT

SEQ ID NO: 3092273 - protein, 24 aa, Giardia lamblia
SQNIVPLRKQLIGVTARLSTIRQS

SEQ ID NO: 3092274 - protein, 22 aa, Giardia lamblia
SQNMWPLFIVGCNDIRCIYENV

SEQ ID NO: 3092275 - protein, 24 aa, Giardia lamblia
SQNYGILIKYLFANTELVHVTFPF

SEQ ID NO: 3092276 - protein, 31 aa, Giardia lamblia
SQPAGFLFDWVMSIYGFLKIKAKVQPLEQAL

SEQ ID NO: 3092277 - protein, 33 aa, Giardia lamblia
SQPQVHIRFILRALLFLVAGLCGLSVIGLLIAI

SEQ ID NO: 3092278 - protein, 24 aa, Giardia lamblia
SQQKGLIKLIIPSLSKQPALDLNI

SEQ ID NO: 3092279 - protein, 29 aa, Giardia lamblia
SQSDRFRRILSTFVFYLCLGFFTGDGKRA

SEQ ID NO: 3092280 - protein, 32 aa, Giardia lamblia
SQSIPILRVGFLFTYLAPLVLVLAVTMIKEFV

SEQ ID NO: 3092281 - protein, 20 aa, Giardia lamblia
SQSKFFLECAEKEKEIAFYE

SEQ ID NO: 3092282 - protein, 21 aa, Giardia lamblia
SQSPLIFTTYPVQYSLCYAAK

SEQ ID NO: 3092283 - protein, 24 aa, Giardia lamblia
SQSTLHCFCTLPLKIRRVIKDCLA

SEQ ID NO: 3092284 - protein, 21 aa, Giardia lamblia
SQYPRLCFNLLRDANNLKKDS

SEQ ID NO: 3092285 - protein, 32 aa, Giardia lamblia
SRCSVQYFFPVLLAVNSVGILTVIYLLRLLLR

SEQ ID NO: 3092286 - protein, 28 aa, Giardia lamblia
SRDEILDMLYQLASLCIFLYESQTGILD

SEQ ID NO: 3092287 - protein, 19 aa, Giardia lamblia
SREHFLPRGLLFDRITCPN

SEQ ID NO: 3092288 - protein, 25 aa, Giardia lamblia
SRELPKPSFWYPTTPVSTPAYPITY

SEQ ID NO: 3092289 - protein, 29 aa, Giardia lamblia
SRELVILWFAYLFQMFSSQLPFSSSTYIV

SEQ ID NO: 3092290 - protein, 21 aa, Giardia lamblia
SRFSPSYFVSFFNASADNLET

SEQ ID NO: 3092291 - protein, 22 aa, Giardia lamblia
SRIFFQHRIPYLRVVIESLLQG

SEQ ID NO: 3092292 - protein, 26 aa, Giardia lamblia
SRIRALEWVLTILRVLFETISQHIAY

SEQ ID NO: 3092293 - protein, 21 aa, Giardia lamblia
SRKYFSVLSPIKSFYVISDPS

SEQ ID NO: 3092294 - protein, 28 aa, Giardia lamblia
SRLCVYFPSFTYHDYISLGLYNNKLHYL

SEQ ID NO: 3092295 - protein, 21 aa, Giardia lamblia
SRLESLYGTAYRLPATQQAGR

SEQ ID NO: 3092296 - protein, 27 aa, Giardia lamblia
SRLLRISSMLIPVDYMFVSVSTPKRWT

SEQ ID NO: 3092297 - protein, 29 aa, Giardia lamblia
SRLLYDALQPLCPVLLALSASTSVLAGVV

SEQ ID NO: 3092298 - protein, 18 aa, Giardia lamblia
SRLSIFYGTYKLLSYVRQ

SEQ ID NO: 3092299 - protein, 22 aa, Giardia lamblia
SRMERLIYLFQKEDITLSHILH

SEQ ID NO: 3092300 - protein, 22 aa, Giardia lamblia
SRMYICCMLLALWISIVGPVGG

SEQ ID NO: 3092301 - protein, 25 aa, Giardia lamblia
SRMYKAMLFAFMFMTIASTLVCVIL

SEQ ID NO: 3092302 - protein, 19 aa, Giardia lamblia
SRNCLLCNAVIFGTAYCSQ

SEQ ID NO: 3092303 - protein, 19 aa, Giardia lamblia
SRNLLVQPGLTAGVYQLID

SEQ ID NO: 3092304 - protein, 20 aa, Giardia lamblia
SRPRSVTKLVRRPLHMLKQE

SEQ ID NO: 3092305 - protein, 22 aa, Giardia lamblia
SRRFMAQYFRPAEAMLIRNVTS

SEQ ID NO: 3092306 - protein, 34 aa, Giardia lamblia
SRRIIREDFIWRVAAVIVFVLEYLHTHLTPQYCS

SEQ ID NO: 3092307 - protein, 39 aa, Giardia lamblia
SRRVFNMYAFTIRDWRVLKALITLFLVYDNVLNIKHYMD

SEQ ID NO: 3092308 - protein, 19 aa, Giardia lamblia
SRSPAALLYEVLRRLDICH

SEQ ID NO: 3092309 - protein, 26 aa, Giardia lamblia
SRSSYTMLPPLPLKYSTSPTPSSTFT

SEQ ID NO: 3092310 - protein, 19 aa, Giardia lamblia
SRTGLAFTMPPYDALVDAV

SEQ ID NO: 3092311 - protein, 24 aa, Giardia lamblia
SRTLIEVYPLLREVTRSFVVPLFA

SEQ ID NO: 3092312 - protein, 28 aa, Giardia lamblia
SRVHSVLFAIFMHLLRLSYLVDSMLNKE

SEQ ID NO: 3092313 - protein, 36 aa, Giardia lamblia
SRVRAMIRLVDYMMVKFMLELLLQANDDLMDLFFGV

SEQ ID NO: 3092314 - protein, 43 aa, Giardia lamblia
SRYTLNRLVLLAFTFLAVGLFIPLYYLSFQRVQRRLLKAKLDR

SEQ ID NO: 3092315 - protein, 17 aa, Giardia lamblia
SSAFLMNGGCYTKAHYP

SEQ ID NO: 3092316 - protein, 22 aa, Giardia lamblia
SSAFVVFAYATKKGIFLSVTNL

SEQ ID NO: 3092317 - protein, 21 aa, Giardia lamblia
SSAIFNHRPYLKAAASILLNI

SEQ ID NO: 3092318 - protein, 25 aa, Giardia lamblia
SSALKNLILKYPHLGQAWASFSLTQ

SEQ ID NO: 3092319 - protein, 24 aa, Giardia lamblia
SSALYILSVLLKHLPPPADTVSEQ

SEQ ID NO: 3092320 - protein, 17 aa, Giardia lamblia
SSALYSIGILMLELYAI

SEQ ID NO: 3092321 - protein, 26 aa, Giardia lamblia
SSAMAFLYHIFTYLDTERVSDPLLWI

SEQ ID NO: 3092322 - protein, 20 aa, Giardia lamblia
SSASFIRILTTLKGTTRHLE

SEQ ID NO: 3092323 - protein, 28 aa, Giardia lamblia
SSAYSLFMLKILLHLPENQRRSIILTEL

SEQ ID NO: 3092324 - protein, 31 aa, Giardia lamblia
SSAYWMQISLPRWLSFRLNVIGAFFCGFIAL

SEQ ID NO: 3092325 - protein, 23 aa, Giardia lamblia
SSCTIINLLYRTSDPVAAHHGMG

SEQ ID NO: 3092326 - protein, 30 aa, Giardia lamblia
SSDCVFQFPMVWWLVLVSLLQSLVVIPLLL

SEQ ID NO: 3092327 - protein, 25 aa, Giardia lamblia
SSDEYAWSLVIPNSLIDLLIVLHDI

SEQ ID NO: 3092328 - protein, 35 aa, Giardia lamblia
SSDGYLHTGLLGLILHYPLAFYAMGITKEEILQLS

SEQ ID NO: 3092329 - protein, 29 aa, Giardia lamblia
SSDKDVSIYKPLFTPLKAPKIVSVQTDVY

SEQ ID NO: 3092330 - protein, 31 aa, Giardia lamblia
SSDLFSFGCLLYRILFRRYPFEQFMDKSSAE

SEQ ID NO: 3092331 - protein, 25 aa, Giardia lamblia
SSDTSMYPVFPWLADDRNLAKTVME

SEQ ID NO: 3092332 - protein, 24 aa, Giardia lamblia
SSDVFYFRPIEAVTPIYYLEELGP

SEQ ID NO: 3092333 - protein, 29 aa, Giardia lamblia
SSEEVLPSRSPLITIPVSTPITSKSTGST

SEQ ID NO: 3092334 - protein, 34 aa, Giardia lamblia
SSFDYDSFLLYLLLTTAFFYVSVPASLNAVQSDV

SEQ ID NO: 3092335 - protein, 17 aa, Giardia lamblia
SSFLCSCSHIYTGENCS

SEQ ID NO: 3092336 - protein, 38 aa, Giardia lamblia
SSFLRSNGIIVVFVLIPILVAVIALVSYIFCCGKKKDR

SEQ ID NO: 3092337 - protein, 25 aa, Giardia lamblia
SSFSKITLMALNKRKINNAHFGGFV

SEQ ID NO: 3092338 - protein, 38 aa, Giardia lamblia
SSGQQVLLSILLRLSFSYISMSPFSFIVLDEPTNYLDK

SEQ ID NO: 3092339 - protein, 21 aa, Giardia lamblia
SSGYFLMGGGCYQVSKYPGRF

SEQ ID NO: 3092340 - protein, 29 aa, Giardia lamblia
SSHNLWYLAFVLTIVYLVGLLIFCFFIPE

SEQ ID NO: 3092341 - protein, 19 aa, Giardia lamblia
SSIFVTAPPAACLTPTTYS

SEQ ID NO: 3092342 - protein, 34 aa, Giardia lamblia
SSILQMYGSLITPELLLLAAWTIQPSLDANFSLT

SEQ ID NO: 3092343 - protein, 23 aa, Giardia lamblia
SSIMSLLCFMIDAADVHVIEHVV

SEQ ID NO: 3092344 - protein, 27 aa, Giardia lamblia
SSINPDYALSPSLPFHLTSPTQMMSHL

SEQ ID NO: 3092345 - protein, 26 aa, Giardia lamblia
SSISIGILFFIHELLSMTYVDSSCLV

SEQ ID NO: 3092346 - protein, 26 aa, Giardia lamblia
SSITAILLWPRLSPPMRDTFCRSATL

SEQ ID NO: 3092347 - protein, 23 aa, Giardia lamblia
SSKCTFCMPGYALTSDSTCQACQ

SEQ ID NO: 3092348 - protein, 31 aa, Giardia lamblia
SSKGYNMITPIRTLFFALHAICIKCAATPGL

SEQ ID NO: 3092349 - protein, 20 aa, Giardia lamblia
SSKNFNVDLILSALTLVLQL

SEQ ID NO: 3092350 - protein, 24 aa, Giardia lamblia
SSKQIRILIEGFIQWSDSLIKFME

SEQ ID NO: 3092351 - protein, 26 aa, Giardia lamblia
SSLLKKTAPILVRTFEPDPLLSDRAT

SEQ ID NO: 3092352 - protein, 27 aa, Giardia lamblia
SSLLLFYTMYFSKQYPIAAFDGWLPLI

SEQ ID NO: 3092353 - protein, 18 aa, Giardia lamblia
SSLLLYHGRLNYIRGYAM

SEQ ID NO: 3092354 - protein, 19 aa, Giardia lamblia
SSLLNIPPLPIGGTPILVP

SEQ ID NO: 3092355 - protein, 17 aa, Giardia lamblia
SSLLRWRHKVEGYSSTQ

SEQ ID NO: 3092356 - protein, 21 aa, Giardia lamblia
SSLPMICHFLAESYINTLETI

SEQ ID NO: 3092357 - protein, 27 aa, Giardia lamblia
SSLPVGLFKILLTVAFDLDIPELCLKL

SEQ ID NO: 3092358 - protein, 45 aa, Giardia lamblia
SSLSPYSHPLIPLPLLACRLVITGLLLHRGFARYNSTPRSNICLL

SEQ ID NO: 3092359 - protein, 28 aa, Giardia lamblia
SSLSTLFNCNILPVLKLLLDQVASDEVL

SEQ ID NO: 3092360 - protein, 17 aa, Giardia lamblia
SSLTKQPHFAAVYPQWI

SEQ ID NO: 3092361 - protein, 41 aa, Giardia lamblia
SSLTSMIFAWPTIFAFLPVGIIFILLLRRYRMITPQVKRLS

SEQ ID NO: 3092362 - protein, 43 aa, Giardia lamblia
SSMICCDIFLTLLLLRRVFHSFTLPQYIFGSISVLRWILEFVV

SEQ ID NO: 3092363 - protein, 24 aa, Giardia lamblia
SSMLILTRTFVLYEYFRGLRDFTT

SEQ ID NO: 3092364 - protein, 20 aa, Giardia lamblia
SSMYILKHIIPNVGLPDMFT

SEQ ID NO: 3092365 - protein, 24 aa, Giardia lamblia
SSNGWTALMWAAHFGRTEVVRLLL

SEQ ID NO: 3092366 - protein, 29 aa, Giardia lamblia
SSNINKFYIVPIITRLFSLCIKSNHYNTL

SEQ ID NO: 3092367 - protein, 27 aa, Giardia lamblia
SSNLYLTGFYIVNLNFIKFFVTNETFE

SEQ ID NO: 3092368 - protein, 30 aa, Giardia lamblia
SSNRCLGYLSILILHTCLAILLETASSHKQ

SEQ ID NO: 3092369 - protein, 36 aa, Giardia lamblia
SSPPYIVIGDVRCFLNFRGWNFDPVFPLEKKDFTLL

SEQ ID NO: 3092370 - protein, 29 aa, Giardia lamblia
SSQFGRLNLALIRFLQPGPATTGYWARAL

SEQ ID NO: 3092371 - protein, 32 aa, Giardia lamblia
SSQLQYLKLLERFIRYLFTQVVSRFESNLIEL

SEQ ID NO: 3092372 - protein, 19 aa, Giardia lamblia
SSQTVFALLSDGSLAVLYP

SEQ ID NO: 3092373 - protein, 24 aa, Giardia lamblia
SSQWNTLHFILHSMKIVTLAFYDF

SEQ ID NO: 3092374 - protein, 60 aa, Giardia lamblia
SSREPCISVCSLAFTAHGVFNCLLLLDIGLIDFFHTARMFRWIGVVITIVLAGVLASILK

SEQ ID NO: 3092375 - protein, 25 aa, Giardia lamblia
SSRPTKPLWVRLVSFHTFPKDDTRF

SEQ ID NO: 3092376 - protein, 23 aa, Giardia lamblia
SSSLQLIRVFSGRLTYKLPDSIP

SEQ ID NO: 3092377 - protein, 20 aa, Giardia lamblia
SSSLVSFFMLRHPNKTINTK

SEQ ID NO: 3092378 - protein, 22 aa, Giardia lamblia
SSSLYSLWIKDVVPSQLFSLDI

SEQ ID NO: 3092379 - protein, 17 aa, Giardia lamblia
SSSSCFRDSKIGRWVNF

SEQ ID NO: 3092380 - protein, 22 aa, Giardia lamblia
SSSSFWLRGEARRRYMHRTRTM

SEQ ID NO: 3092381 - protein, 18 aa, Giardia lamblia
SSSTFLQLIQSALRCISK

SEQ ID NO: 3092382 - protein, 25 aa, Giardia lamblia
SSSVHFYTNMFPLVFKSLEALFQTG

SEQ ID NO: 3092383 - protein, 17 aa, Giardia lamblia
SSSYLGGVLGYGKHRGG

SEQ ID NO: 3092384 - protein, 28 aa, Giardia lamblia
SSTTTFLTIHWQLKRLPEQFKKHYSTLC

SEQ ID NO: 3092385 - protein, 29 aa, Giardia lamblia
SSVCYIHEAPLYLFSKYYAQGFNRVAFIY

SEQ ID NO: 3092386 - protein, 24 aa, Giardia lamblia
SSVFGTIFDMRWLTSALNYSNDDV

SEQ ID NO: 3092387 - protein, 25 aa, Giardia lamblia
SSVGPFMLYFFISQSRWCQGTKYLE

SEQ ID NO: 3092388 - protein, 41 aa, Giardia lamblia
SSVIALAVIVPILLVLTVGGLCIYFLACRGKRREPAKQASS

SEQ ID NO: 3092389 - protein, 17 aa, Giardia lamblia
SSVLRLLARYLDLGEYS

SEQ ID NO: 3092390 - protein, 26 aa, Giardia lamblia
SSVQLPLAHYLLFWEAAEALLSKQCS

SEQ ID NO: 3092391 - protein, 24 aa, Giardia lamblia
SSVRDWPRQIKLLTRPSFQQFTGS

SEQ ID NO: 3092392 - protein, 20 aa, Giardia lamblia
SSVSLLYSALVLSNDFVTEG

SEQ ID NO: 3092393 - protein, 20 aa, Giardia lamblia
SSWVYQVLAVFWEYSTYPCE

SEQ ID NO: 3092394 - protein, 22 aa, Giardia lamblia
SSYELSLYYLVLLAATRDFNDE

SEQ ID NO: 3092395 - protein, 19 aa, Giardia lamblia
SSYKCVCNLGYSPGTEPNR

SEQ ID NO: 3092396 - protein, 24 aa, Giardia lamblia
SSYLSFFYRLYYTNNVSFFTHLLS

SEQ ID NO: 3092397 - protein, 23 aa, Giardia lamblia
SSYNIKLIDFGLSNILMSDEAKF

SEQ ID NO: 3092398 - protein, 24 aa, Giardia lamblia
SSYTMLFISLCSGILRLIDASRKG

SEQ ID NO: 3092399 - protein, 24 aa, Giardia lamblia
STADYVCMYPYFFANDTLSASGNG

SEQ ID NO: 3092400 - protein, 45 aa, Giardia lamblia
STAFAWSIILSIALYYFTLVGINYTFFFTQYFFNTLTVASASLSY

SEQ ID NO: 3092401 - protein, 37 aa, Giardia lamblia
STAKKLLFLEIVVSLFFSLVVLITLQYNVFSIQSVLK

SEQ ID NO: 3092402 - protein, 25 aa, Giardia lamblia
STATQTLLAFSNYLARLSVRYPALS

SEQ ID NO: 3092403 - protein, 24 aa, Giardia lamblia
STAYIGHTLFYNLKTRLSEDYCID

SEQ ID NO: 3092404 - protein, 21 aa, Giardia lamblia
STCLLLSVEAKLRDSRKRVAI

SEQ ID NO: 3092405 - protein, 25 aa, Giardia lamblia
STCYECVAGYRLSLFNGVNICVFPK

SEQ ID NO: 3092406 - protein, 30 aa, Giardia lamblia
STDTLLASFSLFWSRLYKLLLHTDTIHSTY

SEQ ID NO: 3092407 - protein, 26 aa, Giardia lamblia
STEAHGLLLLLCPVLPAALEGIISDY

SEQ ID NO: 3092408 - protein, 25 aa, Giardia lamblia
STEAIAILYVLYDLEIKRVLRTDLP

SEQ ID NO: 3092409 - protein, 25 aa, Giardia lamblia
STEDYLIFQSYLPSLQKFFQMAILS

SEQ ID NO: 3092410 - protein, 26 aa, Giardia lamblia
STELDKLLMIMDLAEGPISSVAPNAS

SEQ ID NO: 3092411 - protein, 17 aa, Giardia lamblia
STFILQATRILYLMAVH

SEQ ID NO: 3092412 - protein, 24 aa, Giardia lamblia
STGCTTCLLGYYIAAEGKRQPGQC

SEQ ID NO: 3092413 - protein, 18 aa, Giardia lamblia
STGLFLSVPTYPGEIMYG

SEQ ID NO: 3092414 - protein, 18 aa, Giardia lamblia
STGNFFGIFKGHENIFYQ

SEQ ID NO: 3092415 - protein, 33 aa, Giardia lamblia
STGNLLVFSNFYKRNFVLRLPQGTGSALSFGIC

SEQ ID NO: 3092416 - protein, 18 aa, Giardia lamblia
STINLLDYIIVGTALVFG

SEQ ID NO: 3092417 - protein, 26 aa, Giardia lamblia
STIPGPWLMIQLVLAAAYAVKLQNKV

SEQ ID NO: 3092418 - protein, 19 aa, Giardia lamblia
STIRLLFNSNHFASYFLNQ

SEQ ID NO: 3092419 - protein, 18 aa, Giardia lamblia
STITWYGGLSTSKTRPTP

SEQ ID NO: 3092420 - protein, 23 aa, Giardia lamblia
STKDRLPFYIGLQAKDHAQLSRA

SEQ ID NO: 3092421 - protein, 22 aa, Giardia lamblia
STKILSCRCVCRPTFYNSSGTC

SEQ ID NO: 3092422 - protein, 22 aa, Giardia lamblia
STKSLIELAFQTTFTIFRDSLC

SEQ ID NO: 3092423 - protein, 27 aa, Giardia lamblia
STKVDIWSLGKILLDLATLGTGLSSLT

SEQ ID NO: 3092424 - protein, 25 aa, Giardia lamblia
STKYYPNLLLLVLSSIISGLAYFAL

SEQ ID NO: 3092425 - protein, 23 aa, Giardia lamblia
STLELTIYCYVNIPFIGHNSRLS

SEQ ID NO: 3092426 - protein, 35 aa, Giardia lamblia
STLPIYSEILDKLLFYKLLFIVSPINDGPACNSPL

SEQ ID NO: 3092427 - protein, 32 aa, Giardia lamblia
STLPSTIIVRFIPPIFLTATRPSLSVLREYQA

SEQ ID NO: 3092428 - protein, 24 aa, Giardia lamblia
STLSGYIYFDVCNTSLFLSNQSNK

SEQ ID NO: 3092429 - protein, 31 aa, Giardia lamblia
STLSSRVLITRLILGLVFDVPFICLSKTGHS

SEQ ID NO: 3092430 - protein, 19 aa, Giardia lamblia
STLTGLYRQGFKEFLRVTA

SEQ ID NO: 3092431 - protein, 20 aa, Giardia lamblia
STNAILWRTAVTDFIPTSLN

SEQ ID NO: 3092432 - protein, 23 aa, Giardia lamblia
STNALYVPFQFKHTDYAYMQEAL

SEQ ID NO: 3092433 - protein, 38 aa, Giardia lamblia
STNPYIITMRLRCSYLLKYMWRLFSSEYTLPQNILLAV

SEQ ID NO: 3092434 - protein, 43 aa, Giardia lamblia
STNRTTLILSITLPLAVLLLAATVITLAIILVKKRKTTKHGLS

SEQ ID NO: 3092435 - protein, 17 aa, Giardia lamblia
STNVIDIATFFYEALRL

SEQ ID NO: 3092436 - protein, 22 aa, Giardia lamblia
STPPLTMQLSLSNPPDDAYEPE

SEQ ID NO: 3092437 - protein, 24 aa, Giardia lamblia
STQGVFMNWLIHSLDILSRQLTDN

SEQ ID NO: 3092438 - protein, 33 aa, Giardia lamblia
STQTLSGILTIYLYLLQLYSVLTARPKLGALRA

SEQ ID NO: 3092439 - protein, 23 aa, Giardia lamblia
STQYLGMSPLAFLPTAVAEASKG

SEQ ID NO: 3092440 - protein, 25 aa, Giardia lamblia
STRATVMPAFKLLEAVHTLLLFQLR

SEQ ID NO: 3092441 - protein, 23 aa, Giardia lamblia
STRDIYENFLFFSNDRNFDTISQ

SEQ ID NO: 3092442 - protein, 24 aa, Giardia lamblia
STRLQGTLLFLLNTTQNPATTLAN

SEQ ID NO: 3092443 - protein, 25 aa, Giardia lamblia
STRLSLPNLFLFSQASFAGGNLQSL

SEQ ID NO: 3092444 - protein, 17 aa, Giardia lamblia
STRPPYAYNARCPERGL

SEQ ID NO: 3092445 - protein, 29 aa, Giardia lamblia
STRRFITFAILFYSLFTHNPFLASNFLAE

SEQ ID NO: 3092446 - protein, 25 aa, Giardia lamblia
STRRLVCQIYFYERIISLQELPGTG

SEQ ID NO: 3092447 - protein, 34 aa, Giardia lamblia
STSIDGTFFDKTLFHFAWFLLKDYDANVEERVVK

SEQ ID NO: 3092448 - protein, 23 aa, Giardia lamblia
STSLANIALMAPGSIAAKIFNHT

SEQ ID NO: 3092449 - protein, 36 aa, Giardia lamblia
STSNALFHQLYYAPLEPLILVVFKHILTLSQSLYSL

SEQ ID NO: 3092450 - protein, 25 aa, Giardia lamblia
STSSKIPGQLWPPSSSLSGSASNAA

SEQ ID NO: 3092451 - protein, 33 aa, Giardia lamblia
STSSNQFPFQIPLLPPPGLTQPLPPIPSIPILG

SEQ ID NO: 3092452 - protein, 29 aa, Giardia lamblia
STSTCVCPTNFKLVEFIYGKNKGKHTCIH

SEQ ID NO: 3092453 - protein, 24 aa, Giardia lamblia
STSVPFLCIVINMNVLKTLSKHML

SEQ ID NO: 3092454 - protein, 23 aa, Giardia lamblia
STSWLDFVIGFFITTTQLIIVLN

SEQ ID NO: 3092455 - protein, 31 aa, Giardia lamblia
STSYTLFQHIFVRGLLLSKIFGKDISYLIEA

SEQ ID NO: 3092456 - protein, 43 aa, Giardia lamblia
STTAAIVVVVLLVLVAVAGFLIWWFVIRPRRGGPLRERAPQKG

SEQ ID NO: 3092457 - protein, 40 aa, Giardia lamblia
STTIIVAVVVSLLIIAAVALTCWFVLRRRRESRAALKKRV

SEQ ID NO: 3092458 - protein, 31 aa, Giardia lamblia
STTITGKFKLSIPSIIMIVTGILGSAGVAGI

SEQ ID NO: 3092459 - protein, 36 aa, Giardia lamblia
STTQFIYVLIIVSVCCIFVVFIYYCILLCKFYRRLL

SEQ ID NO: 3092460 - protein, 25 aa, Giardia lamblia
STVKAPGRLIIWDPSLIAAASEPVV

SEQ ID NO: 3092461 - protein, 18 aa, Giardia lamblia
STVTHMRPLLKLSADGDM

SEQ ID NO: 3092462 - protein, 30 aa, Giardia lamblia
STWRKRHLLLVFIGILIFCLFSIMQILGCI

SEQ ID NO: 3092463 - protein, 34 aa, Giardia lamblia
STYDSYLPVEFLYTIALILFSSINIVGVIRSIFA

SEQ ID NO: 3092464 - protein, 20 aa, Giardia lamblia
STYDYLLKVLGYQLNTITSS

SEQ ID NO: 3092465 - protein, 20 aa, Giardia lamblia
STYFGINVMSDSGATLLQCT

SEQ ID NO: 3092466 - protein, 24 aa, Giardia lamblia
STYVDFIHFVLGSNLYNLICTTKD

SEQ ID NO: 3092467 - protein, 17 aa, Giardia lamblia
SVARLLTKIVGINLPTQ

SEQ ID NO: 3092468 - protein, 26 aa, Giardia lamblia
SVASRLIDMLLYPAGPRVQQKEEAGD

SEQ ID NO: 3092469 - protein, 25 aa, Giardia lamblia
SVCAQGFYLTLDTTSSPITMICQQC

SEQ ID NO: 3092470 - protein, 29 aa, Giardia lamblia
SVCCVTLLLLLVMSLILYSIIKERRAKNK

SEQ ID NO: 3092471 - protein, 20 aa, Giardia lamblia
SVCLQFIRNLSPIVSYMLWK

SEQ ID NO: 3092472 - protein, 22 aa, Giardia lamblia
SVCNVGYYLQQIGFYSVCTKCP

SEQ ID NO: 3092473 - protein, 25 aa, Giardia lamblia
SVDDTLKSLLPYLIEQLELCQKSLS

SEQ ID NO: 3092474 - protein, 21 aa, Giardia lamblia
SVDFLTFTINIFKLRLRKVYN

SEQ ID NO: 3092475 - protein, 18 aa, Giardia lamblia
SVDFPRARKYLISVSREE

SEQ ID NO: 3092476 - protein, 25 aa, Giardia lamblia
SVDLDLLILNAAKPAPLRPGLLYGT

SEQ ID NO: 3092477 - protein, 17 aa, Giardia lamblia
SVEDHFLAKYIPDTFYL

SEQ ID NO: 3092478 - protein, 29 aa, Giardia lamblia
SVEDYIVTWLLIGSVCFGFYLSFKTRTCL

SEQ ID NO: 3092479 - protein, 28 aa, Giardia lamblia
SVEFPIIYGCLLCIWLSSFVEKRSLLTQ

SEQ ID NO: 3092480 - protein, 19 aa, Giardia lamblia
SVERALKFGFTLIIEDGDS

SEQ ID NO: 3092481 - protein, 21 aa, Giardia lamblia
SVEVYPITRDAFIKTTTLAEI

SEQ ID NO: 3092482 - protein, 48 aa, Giardia lamblia
SVFKVAPYVLLLQALLCLFIFKYVKPFLISYILIMKAKVSILLNWYQS

SEQ ID NO: 3092483 - protein, 29 aa, Giardia lamblia
SVGRGFLVYRADMLAPFVYSPALPDTIRQ

SEQ ID NO: 3092484 - protein, 28 aa, Giardia lamblia
SVGSIILLTAVALSIYFGVRACQKKNRS

SEQ ID NO: 3092485 - protein, 24 aa, Giardia lamblia
SVGVRLFLCEFIFALVTCSYYHHL

SEQ ID NO: 3092486 - protein, 27 aa, Giardia lamblia
SVHDYDTFYILLGCVLLAAKVSGAPRT

SEQ ID NO: 3092487 - protein, 27 aa, Giardia lamblia
SVHLPSAPVAIPLFEPTEVHQGLAISV

SEQ ID NO: 3092488 - protein, 28 aa, Giardia lamblia
SVHPGIINLLIVLLCELDKRTDIFFDPL

SEQ ID NO: 3092489 - protein, 24 aa, Giardia lamblia
SVHSIPKIYLPDLSLLKDQEQEEL

SEQ ID NO: 3092490 - protein, 39 aa, Giardia lamblia
SVISNIQFFFAFASFPLIIPVLNLFYPSFLILSRIGSRN

SEQ ID NO: 3092491 - protein, 30 aa, Giardia lamblia
SVISSLLFIARLLVLARHPTFLIPNVTNAI

SEQ ID NO: 3092492 - protein, 23 aa, Giardia lamblia
SVKLRDYLLSLLFDAYLEDKPRV

SEQ ID NO: 3092493 - protein, 24 aa, Giardia lamblia
SVLALTGLLWARAVGLPAILTEHS

SEQ ID NO: 3092494 - protein, 19 aa, Giardia lamblia
SVLCSLFFQLLFLLSRTNI

SEQ ID NO: 3092495 - protein, 24 aa, Giardia lamblia
SVLFAFLLCHCIHSNHMEMIWISR

SEQ ID NO: 3092496 - protein, 18 aa, Giardia lamblia
SVLFIASGVVRDIGISPD

SEQ ID NO: 3092497 - protein, 31 aa, Giardia lamblia
SVLISRIMTTRLIYALLILREQFLGDSNALQ

SEQ ID NO: 3092498 - protein, 18 aa, Giardia lamblia
SVLKRAIYNILTTGVYLG

SEQ ID NO: 3092499 - protein, 25 aa, Giardia lamblia
SVLQTYVFHVAYPSWPLPDNYIVGR

SEQ ID NO: 3092500 - protein, 20 aa, Giardia lamblia
SVLVLIPVYWRGTMQGSLGS

SEQ ID NO: 3092501 - protein, 19 aa, Giardia lamblia
SVLVRLQMDLAFGRVYGSI

SEQ ID NO: 3092502 - protein, 28 aa, Giardia lamblia
SVMITIRRILLILMAVLFVVISLCLVYY

SEQ ID NO: 3092503 - protein, 18 aa, Giardia lamblia
SVMQAVFSALFAFSTIPL

SEQ ID NO: 3092504 - protein, 17 aa, Giardia lamblia
SVMQRLRLVFKKRIRDL

SEQ ID NO: 3092505 - protein, 27 aa, Giardia lamblia
SVMRTEALIKLLVLNSFKLSSATANHM

SEQ ID NO: 3092506 - protein, 24 aa, Giardia lamblia
SVNTFFKPYFVAVLINIPKNQVSI

SEQ ID NO: 3092507 - protein, 25 aa, Giardia lamblia
SVNTFLLLFALKRKRERYAAHMLRS

SEQ ID NO: 3092508 - protein, 27 aa, Giardia lamblia
SVPFKISGLFPKYRSLKAAGLLQEYEK

SEQ ID NO: 3092509 - protein, 30 aa, Giardia lamblia
SVPFLQSMLFYGLLLFLWVLPSVHKLFVHR

SEQ ID NO: 3092510 - protein, 28 aa, Giardia lamblia
SVPFYSGISLLMLLIQTLTKVPIVSSLE

SEQ ID NO: 3092511 - protein, 28 aa, Giardia lamblia
SVPGCYLICQYLCKGHWRISITPPGQAL

SEQ ID NO: 3092512 - protein, 23 aa, Giardia lamblia
SVPGINAVFCSCKMTFKLTSSEE

SEQ ID NO: 3092513 - protein, 19 aa, Giardia lamblia
SVPVFFYTSGGIVAFSVCI

SEQ ID NO: 3092514 - protein, 29 aa, Giardia lamblia
SVRGIPMEVLLKILFILSRTTYNSFDILP

SEQ ID NO: 3092515 - protein, 21 aa, Giardia lamblia
SVRRYYAITSTLFIVAYGSHV

SEQ ID NO: 3092516 - protein, 25 aa, Giardia lamblia
SVSHVFTPSLYFRSKEIERNTREML

SEQ ID NO: 3092517 - protein, 27 aa, Giardia lamblia
SVSRFTFFSFAILLWSELCLILVTTHR

SEQ ID NO: 3092518 - protein, 22 aa, Giardia lamblia
SVTERFLLIKYGITHLMIAATS

SEQ ID NO: 3092519 - protein, 21 aa, Giardia lamblia
SVTGFAWLQQSLRELSFCLYT

SEQ ID NO: 3092520 - protein, 32 aa, Giardia lamblia
SVVGIMVVALVCWLVLRRRRGPKSLSTMAGSR

SEQ ID NO: 3092521 - protein, 28 aa, Giardia lamblia
SVVSYIFSLNPLYLSRFHKLEPPFSLQN

SEQ ID NO: 3092522 - protein, 40 aa, Giardia lamblia
SVVVAVPCILGIFLFVFLLYILFARLCGCGSKRCRICLRC

SEQ ID NO: 3092523 - protein, 27 aa, Giardia lamblia
SVVVTNLLCIVTYIGVTVWQLKTIKRY

SEQ ID NO: 3092524 - protein, 37 aa, Giardia lamblia
SVWNARVEPLMRFLSSCISPRLIVSYTGSIKAGVLDG

SEQ ID NO: 3092525 - protein, 20 aa, Giardia lamblia
SVYLYFPLSFCFYVITVQTV

SEQ ID NO: 3092526 - protein, 22 aa, Giardia lamblia
SWDPQLLPFRQASPKYVAIRAN

SEQ ID NO: 3092527 - protein, 18 aa, Giardia lamblia
SWFKTLCMHYGLSGTSCT

SEQ ID NO: 3092528 - protein, 26 aa, Giardia lamblia
SWIEGFIEHVLLLMGTVPITLPSTVP

SEQ ID NO: 3092529 - protein, 22 aa, Giardia lamblia
SWSSAINYILFYSGSGNYTTQN

SEQ ID NO: 3092530 - protein, 23 aa, Giardia lamblia
SYAKFKMSMLDFFVCGTPVAYLT

SEQ ID NO: 3092531 - protein, 29 aa, Giardia lamblia
SYANLIDFKVLVPDLRRIFSGLTAKIMEY

SEQ ID NO: 3092532 - protein, 19 aa, Giardia lamblia
SYCKCDNWYNIVQINTGMC

SEQ ID NO: 3092533 - protein, 22 aa, Giardia lamblia
SYCQTHRYVFVQLASSIGGEGE

SEQ ID NO: 3092534 - protein, 19 aa, Giardia lamblia
SYDALLCSTPIALSYKLQS

SEQ ID NO: 3092535 - protein, 20 aa, Giardia lamblia
SYDCLPVGVTAADARKLTLD

SEQ ID NO: 3092536 - protein, 26 aa, Giardia lamblia
SYEHFYVIFCKFWELDTDHDQLISAQ

SEQ ID NO: 3092537 - protein, 24 aa, Giardia lamblia
SYGSMYIAYSALLPFQVCNFQAYY

SEQ ID NO: 3092538 - protein, 51 aa, Giardia lamblia
SYIDGVIDFNPLLFGLVCLSFISSKLIYVLLKYINLVFDPPLGLLRSLGLP

SEQ ID NO: 3092539 - protein, 30 aa, Giardia lamblia
SYIKDIYGKLPSMLISRLFKQSIKCTCGAQ

SEQ ID NO: 3092540 - protein, 29 aa, Giardia lamblia
SYKEINPAFFYLYQFPFTFAVMYGDIGHG

SEQ ID NO: 3092541 - protein, 17 aa, Giardia lamblia
SYKPVLVVVPQISYLKT

SEQ ID NO: 3092542 - protein, 17 aa, Giardia lamblia
SYLGGVLGYGKHRGGTM

SEQ ID NO: 3092543 - protein, 20 aa, Giardia lamblia
SYLLFTYDCSLKVPLVSVLY

SEQ ID NO: 3092544 - protein, 19 aa, Giardia lamblia
SYLPLKLYDQKYVSNSLLN

SEQ ID NO: 3092545 - protein, 20 aa, Giardia lamblia
SYNVMPFKNSFVYIANLTAE

SEQ ID NO: 3092546 - protein, 28 aa, Giardia lamblia
SYQITSSPLHYLLFKRGFSSIDLSNPYS

SEQ ID NO: 3092547 - protein, 24 aa, Giardia lamblia
SYQKIAFYTLLNVKDKRLQQLKLV

SEQ ID NO: 3092548 - protein, 18 aa, Giardia lamblia
SYRDSFISGIYTGLTGHI

SEQ ID NO: 3092549 - protein, 20 aa, Giardia lamblia
SYSDYYSYYSDSYPSDYFDD

SEQ ID NO: 3092550 - protein, 20 aa, Giardia lamblia
SYSERICNALKTPCLLKSFV

SEQ ID NO: 3092551 - protein, 34 aa, Giardia lamblia
SYSLGLYRMIQNLPFLPLCTFLRSVAARSYQTTD

SEQ ID NO: 3092552 - protein, 25 aa, Giardia lamblia
SYSRLQLIFVQLYRPASGHKETTFM

SEQ ID NO: 3092553 - protein, 29 aa, Giardia lamblia
SYSSICVLWILVVILMQSPSFLYKDIGQY

SEQ ID NO: 3092554 - protein, 21 aa, Giardia lamblia
SYSTIFKETLLPQILLDNTSV

SEQ ID NO: 3092555 - protein, 24 aa, Giardia lamblia
SYSYVHPITGKYLWLLVPKDVNYN

SEQ ID NO: 3092556 - protein, 22 aa, Giardia lamblia
SYTAPVLFYYSPATEKAERLAF

SEQ ID NO: 3092557 - protein, 23 aa, Giardia lamblia
SYTLLVPLCVVLGLFRLADGEKG

SEQ ID NO: 3092558 - protein, 32 aa, Giardia lamblia
SYVALIFSNPQFLPMNRLLLDGNFLITNCAFD

SEQ ID NO: 3092559 - protein, 18 aa, Giardia lamblia
SYVCMLLSSWHVFRAIYE

SEQ ID NO: 3092560 - protein, 22 aa, Giardia lamblia
SYVDDLTLWLSPRYNCFKLVDL

SEQ ID NO: 3092561 - protein, 23 aa, Giardia lamblia
SYVINYMLQFKELSRFPPSYRVP

SEQ ID NO: 3092562 - protein, 24 aa, Giardia lamblia
SYVSQLIMYTLLDTAIRERDLEEI

SEQ ID NO: 3092563 - protein, 21 aa, Giardia lamblia
SYVVTFPRYAGFGSPVHPAFA

SEQ ID NO: 3092564 - protein, 28 aa, Giardia lamblia
SYYARNWLYVLLYLKWRRAASLCRIAFI

SEQ ID NO: 3092565 - protein, 23 aa, Giardia lamblia
SYYNVLIETILFPFTIKVDDTQT

SEQ ID NO: 3092566 - protein, 19 aa, Giardia lamblia
SYYQIYRYYSNQDLNYRTF

SEQ ID NO: 3092567 - protein, 22 aa, Giardia lamblia
TAALRLCFKRSSFYRYLLDENK

SEQ ID NO: 3092568 - protein, 19 aa, Giardia lamblia
TACLCAGYVVLVFGLQYLP

SEQ ID NO: 3092569 - protein, 19 aa, Giardia lamblia
TACPASAKSFLFYGGCYDE

SEQ ID NO: 3092570 - protein, 30 aa, Giardia lamblia
TACYSTVIVLLYLKPVILTNILSLMNKCHG

SEQ ID NO: 3092571 - protein, 27 aa, Giardia lamblia
TADGTPEFFLFYGGCYDITHPIGKSIC

SEQ ID NO: 3092572 - protein, 27 aa, Giardia lamblia
TADNTPEFFLFYSGCYDITHPIGKSIC

SEQ ID NO: 3092573 - protein, 25 aa, Giardia lamblia
TADRCRPYCFPPHSAGSLSVCAEIY

SEQ ID NO: 3092574 - protein, 24 aa, Giardia lamblia
TAEFLSRILLHEISLPIADIIASA

SEQ ID NO: 3092575 - protein, 24 aa, Giardia lamblia
TAERWPLIIDPQLQGIAWIKAREE

SEQ ID NO: 3092576 - protein, 44 aa, Giardia lamblia
TAFRSFSLLLLRVLNTELLLVAPALMWLFTSVVFRVMYHLSIEG

SEQ ID NO: 3092577 - protein, 20 aa, Giardia lamblia
TAGTFLLTPAALKVGQPLDQ

SEQ ID NO: 3092578 - protein, 29 aa, Giardia lamblia
TAGVLLIFSLFKYLLPMVFCPFYMRRQRK

SEQ ID NO: 3092579 - protein, 17 aa, Giardia lamblia
TAGYFFHGNGCYSIAAV

SEQ ID NO: 3092580 - protein, 23 aa, Giardia lamblia
TAHLHTTLFRRFITNVLTSSHYL

SEQ ID NO: 3092581 - protein, 23 aa, Giardia lamblia
TAIKFHYMFNLRDLTNITEGLMR

SEQ ID NO: 3092582 - protein, 25 aa, Giardia lamblia
TAIVIMSPCLRLLQSFTGYHLHSQH

SEQ ID NO: 3092583 - protein, 24 aa, Giardia lamblia
TAIYGSCLFVLQGFSPNLENPLCA

SEQ ID NO: 3092584 - protein, 23 aa, Giardia lamblia
TAKPSLYHTLKAYVPRLLDAGRT

SEQ ID NO: 3092585 - protein, 21 aa, Giardia lamblia
TAKRNIFLLTLIANPFNVIAS

SEQ ID NO: 3092586 - protein, 21 aa, Giardia lamblia
TALIVAALCDKAKACRFLVAS

SEQ ID NO: 3092587 - protein, 43 aa, Giardia lamblia
TALIYAIECRNRRVIPFLLREAWLIDFHGKTPLEYALEQELYE

SEQ ID NO: 3092588 - protein, 19 aa, Giardia lamblia
TALLPVSPRFHYPKVFQPI

SEQ ID NO: 3092589 - protein, 17 aa, Giardia lamblia
TALLYAIENRNLEFARL

SEQ ID NO: 3092590 - protein, 20 aa, Giardia lamblia
TALMFAAWNGYTDCVKLLKD

SEQ ID NO: 3092591 - protein, 17 aa, Giardia lamblia
TALMIAVQLLDAVSVKA

SEQ ID NO: 3092592 - protein, 21 aa, Giardia lamblia
TALMLAIRYGYTSVAKVLVPI

SEQ ID NO: 3092593 - protein, 24 aa, Giardia lamblia
TALPTVFIYMFKKTMARAVGQITL

SEQ ID NO: 3092594 - protein, 30 aa, Giardia lamblia
TAMEYCAYNNLLPQLSLLVKHGSYTIEDLK

SEQ ID NO: 3092595 - protein, 33 aa, Giardia lamblia
TAMFTLASLISIYFLVMLSLQRNIRGGIATNRF

SEQ ID NO: 3092596 - protein, 31 aa, Giardia lamblia
TAMNITRICYIGFVYLLYYLAEDIFNRTHKL

SEQ ID NO: 3092597 - protein, 25 aa, Giardia lamblia
TANRRVFDLLIDETWMVLASDGTNI

SEQ ID NO: 3092598 - protein, 25 aa, Giardia lamblia
TAQNEVMILKDKLAYMQNCIMANKT

SEQ ID NO: 3092599 - protein, 26 aa, Giardia lamblia
TARAHLYLYICMIVMPVVVMAAVALF

SEQ ID NO: 3092600 - protein, 40 aa, Giardia lamblia
TARLRLYYNATLVYTLFRGSLPLIFSQPPTYKFTPAIRFP

SEQ ID NO: 3092601 - protein, 20 aa, Giardia lamblia
TASALFHEFLGKTLPNTSTS

SEQ ID NO: 3092602 - protein, 28 aa, Giardia lamblia
TASCLRLMTIYLHIIFNSSNLVRDITVS

SEQ ID NO: 3092603 - protein, 21 aa, Giardia lamblia
TASIPFLCGTGYHKTVHPDSC

SEQ ID NO: 3092604 - protein, 32 aa, Giardia lamblia
TASIPPSIFVLFSNALILRVSLDRSKVGFNLS

SEQ ID NO: 3092605 - protein, 24 aa, Giardia lamblia
TASIQSLMLLCSRYAYELLHIPIH

SEQ ID NO: 3092606 - protein, 26 aa, Giardia lamblia
TASQDYIVYPPIFVLAPHTAQEICVS

SEQ ID NO: 3092607 - protein, 28 aa, Giardia lamblia
TATGKTFAYLFPLLLREGFFNTTQVTSS

SEQ ID NO: 3092608 - protein, 29 aa, Giardia lamblia
TATLLYASLAYLFLTPRSFINGGSIFSRE

SEQ ID NO: 3092609 - protein, 25 aa, Giardia lamblia
TATSSLFSLSWVRSLSLYSSSPGVS

SEQ ID NO: 3092610 - protein, 25 aa, Giardia lamblia
TATYDLPVFLPPLFIPKQKLEYVEV

SEQ ID NO: 3092611 - protein, 25 aa, Giardia lamblia
TAVSLLLHFPTLINGVIRQLASPDR

SEQ ID NO: 3092612 - protein, 21 aa, Giardia lamblia
TAYMHWNLLKLFLNNDMPGIV

SEQ ID NO: 3092613 - protein, 26 aa, Giardia lamblia
TCANGYYLASVRKYKLCRPCSPLCKT

SEQ ID NO: 3092614 - protein, 19 aa, Giardia lamblia
TCDRRMLASFLSINLAVII

SEQ ID NO: 3092615 - protein, 24 aa, Giardia lamblia
TCFAWLENMVVFAKSFFFGQLDVD

SEQ ID NO: 3092616 - protein, 18 aa, Giardia lamblia
TCFCGPGSTYFKGTCVSN

SEQ ID NO: 3092617 - protein, 18 aa, Giardia lamblia
TCFFTTSPYISSTSHCKC

SEQ ID NO: 3092618 - protein, 17 aa, Giardia lamblia
TCGKCGGEYFLFMGGCY

SEQ ID NO: 3092619 - protein, 20 aa, Giardia lamblia
TCHAVCPMTYYEAADSCIPC

SEQ ID NO: 3092620 - protein, 23 aa, Giardia lamblia
TCHAVCPMTYYEAADSCIPCAID

SEQ ID NO: 3092621 - protein, 23 aa, Giardia lamblia
TCILCVTLYLLAGITDPGYMPVC

SEQ ID NO: 3092622 - protein, 20 aa, Giardia lamblia
TCIYLFCKSVYIPSVQLSDD

SEQ ID NO: 3092623 - protein, 17 aa, Giardia lamblia
TCLLLNCSKCRPSNGQQ

SEQ ID NO: 3092624 - protein, 30 aa, Giardia lamblia
TCLRCAATHLLYYGGCYKITQPVIEICKQD

SEQ ID NO: 3092625 - protein, 28 aa, Giardia lamblia
TCPISLKYSLLYTLSLSLPDLGTFTQNH

SEQ ID NO: 3092626 - protein, 17 aa, Giardia lamblia
TCPSIKFLYVCSGLSIL

SEQ ID NO: 3092627 - protein, 17 aa, Giardia lamblia
TCPYFISGLAPLLHPGT

SEQ ID NO: 3092628 - protein, 17 aa, Giardia lamblia
TCSCSQGWTPHGTLCYP

SEQ ID NO: 3092629 - protein, 22 aa, Giardia lamblia
TCSGAAFLMNGGCYTTEHYPGS

SEQ ID NO: 3092630 - protein, 22 aa, Giardia lamblia
TCSGAAFLMNGGCYTTVHYPGS

SEQ ID NO: 3092631 - protein, 26 aa, Giardia lamblia
TCTGCAGLFFYYKNGCYNPKTYPGNA

SEQ ID NO: 3092632 - protein, 27 aa, Giardia lamblia
TCTGCAPTYFLWQNGCYPCNMIPNCIE

SEQ ID NO: 3092633 - protein, 30 aa, Giardia lamblia
TCTQCTADYFLYMNGCYKVGQVPGSHMCKK

SEQ ID NO: 3092634 - protein, 18 aa, Giardia lamblia
TCYCSHILPLAGFTVGFL

SEQ ID NO: 3092635 - protein, 27 aa, Giardia lamblia
TCYYCSSDYFLMLGSCVSAERAPGNTV

SEQ ID NO: 3092636 - protein, 27 aa, Giardia lamblia
TDAAILLYPLALYRLASKHYGSNAMRL

SEQ ID NO: 3092637 - protein, 23 aa, Giardia lamblia
TDEDNVFSYYFPKTILSVARYEC

SEQ ID NO: 3092638 - protein, 23 aa, Giardia lamblia
TDEERAYYMGYAEGYLLAPQIQD

SEQ ID NO: 3092639 - protein, 22 aa, Giardia lamblia
TDEMRYLIWEQNKYWSEVRRVS

SEQ ID NO: 3092640 - protein, 24 aa, Giardia lamblia
TDESYLIRITPYMDLLPPTEYAKS

SEQ ID NO: 3092641 - protein, 18 aa, Giardia lamblia
TDFWKTMKVLRNQVFALT

SEQ ID NO: 3092642 - protein, 30 aa, Giardia lamblia
TDGLKELFIDLFYYMLHYCTMYDTHPLFRN

SEQ ID NO: 3092643 - protein, 23 aa, Giardia lamblia
TDGTELLPILPPQGIDAPQSLGI

SEQ ID NO: 3092644 - protein, 26 aa, Giardia lamblia
TDHRKQFTKFWKTEFSKGITFPAIGE

SEQ ID NO: 3092645 - protein, 17 aa, Giardia lamblia
TDILFHLHFFAEGLESQ

SEQ ID NO: 3092646 - protein, 19 aa, Giardia lamblia
TDILNYWKAVNANPAMLLE

SEQ ID NO: 3092647 - protein, 20 aa, Giardia lamblia
TDIPIYIILVLVYGAITYFM

SEQ ID NO: 3092648 - protein, 26 aa, Giardia lamblia
TDIYDILCISPYLLDPLVHENISSLL

SEQ ID NO: 3092649 - protein, 20 aa, Giardia lamblia
TDKLFPMLNSADAYEVFGAI

SEQ ID NO: 3092650 - protein, 26 aa, Giardia lamblia
TDKPARRYMLLKDSERYRLTVQQQQQ

SEQ ID NO: 3092651 - protein, 31 aa, Giardia lamblia
TDNSLPESIFTPPLFLYQSPAKLVVEEQADM

SEQ ID NO: 3092652 - protein, 23 aa, Giardia lamblia
TDQFDIILLNMTTGLTDCLKDTC

SEQ ID NO: 3092653 - protein, 29 aa, Giardia lamblia
TDQNNSIFTIYWLGYIRLLLEHSGETLTQ

SEQ ID NO: 3092654 - protein, 26 aa, Giardia lamblia
TDRFYRNFIHLPIVSLLSSFRTRHKD

SEQ ID NO: 3092655 - protein, 32 aa, Giardia lamblia
TDVQNTLIVIIWLPILVELLIAVIYSAIYLSL

SEQ ID NO: 3092656 - protein, 17 aa, Giardia lamblia
TDYTLIREFAKAAPRTT

SEQ ID NO: 3092657 - protein, 42 aa, Giardia lamblia
TDYVDCSLLFLLEIADNLYRALPLSIFLPALIMVIIVSEITR

SEQ ID NO: 3092658 - protein, 24 aa, Giardia lamblia
TEAAPGYFVPPNVAGSDQSVIACN

SEQ ID NO: 3092659 - protein, 24 aa, Giardia lamblia
TEAAPGYFVPPQAIRSDQSVIACN

SEQ ID NO: 3092660 - protein, 26 aa, Giardia lamblia
TEARLAFFPALPFLLREIGIKGVLAL

SEQ ID NO: 3092661 - protein, 19 aa, Giardia lamblia
TEDPVAYKSLFSEASYVVN

SEQ ID NO: 3092662 - protein, 28 aa, Giardia lamblia
TEEERWINFSWILSPRLLQSPHVSRQTS

SEQ ID NO: 3092663 - protein, 30 aa, Giardia lamblia
TEEQKIELIMLLRLFGINLQMHFYLRRGVE

SEQ ID NO: 3092664 - protein, 31 aa, Giardia lamblia
TEFAYPWFGNFLMFFAMSLVGIGWAYQAAKA

SEQ ID NO: 3092665 - protein, 24 aa, Giardia lamblia
TEGAPVFHSFLVHAFLSALNSHLG

SEQ ID NO: 3092666 - protein, 24 aa, Giardia lamblia
TEHELLTILLQIAEALKYLHTLDS

SEQ ID NO: 3092667 - protein, 24 aa, Giardia lamblia
TEHLDPLTWFRLSTSTYALNGSIC

SEQ ID NO: 3092668 - protein, 33 aa, Giardia lamblia
TEHTLLLIKYVLCRLFTIILALDKNFPSVSKLK

SEQ ID NO: 3092669 - protein, 27 aa, Giardia lamblia
TEHYPTYEFVLPLAVNYKLLPSSFVPN

SEQ ID NO: 3092670 - protein, 22 aa, Giardia lamblia
TEKVAYITILKELNLHRSGTLL

SEQ ID NO: 3092671 - protein, 20 aa, Giardia lamblia
TELFVKPWFQTSSMFAGECM

SEQ ID NO: 3092672 - protein, 24 aa, Giardia lamblia
TELREHLCSLPIWEYKQTAIACLE

SEQ ID NO: 3092673 - protein, 25 aa, Giardia lamblia
TELSVLLIIILVVAIIHITAYKLLL

SEQ ID NO: 3092674 - protein, 23 aa, Giardia lamblia
TENTIQYLLPYLTADQICTFLKA

SEQ ID NO: 3092675 - protein, 27 aa, Giardia lamblia
TEPKDLIHRYYFFKVNPQDPEFLSVHD

SEQ ID NO: 3092676 - protein, 23 aa, Giardia lamblia
TEPQLCDCNPNFAKGSFSISRPE

SEQ ID NO: 3092677 - protein, 18 aa, Giardia lamblia
TEQLLVGRYGLSTAKLNA

SEQ ID NO: 3092678 - protein, 38 aa, Giardia lamblia
TEREALEYIPLATPLCFQYLHLLFTTTTIAFINHCLSL

SEQ ID NO: 3092679 - protein, 24 aa, Giardia lamblia
TERVRFNLRFSPLTDLYQMGFFLY

SEQ ID NO: 3092680 - protein, 26 aa, Giardia lamblia
TESFIKDLFFVLLTETCYLNKAYSLL

SEQ ID NO: 3092681 - protein, 25 aa, Giardia lamblia
TETLSHWKKRWDLRLSLIEETLIRT

SEQ ID NO: 3092682 - protein, 20 aa, Giardia lamblia
TEVYIFFTKGANSTLLLGEP

SEQ ID NO: 3092683 - protein, 30 aa, Giardia lamblia
TEYHVGWQLPYQGYRWPYLYSRPCPDSVSE

SEQ ID NO: 3092684 - protein, 17 aa, Giardia lamblia
TEYLTTLGLNPAFAGEF

SEQ ID NO: 3092685 - protein, 25 aa, Giardia lamblia
TEYYPSLLLTGLVAQLFFELLQIYT

SEQ ID NO: 3092686 - protein, 20 aa, Giardia lamblia
TEYYSFYQKHTHCMLLNIIE

SEQ ID NO: 3092687 - protein, 18 aa, Giardia lamblia
TFAAFDMLLQRQLDLTVD

SEQ ID NO: 3092688 - protein, 19 aa, Giardia lamblia
TFCASPFMFLGPYNSIAST

SEQ ID NO: 3092689 - protein, 18 aa, Giardia lamblia
TFCSIFIAISLVLEKYIA

SEQ ID NO: 3092690 - protein, 25 aa, Giardia lamblia
TFDAAYLHSYLLENFKLPHRVIPQD

SEQ ID NO: 3092691 - protein, 32 aa, Giardia lamblia
TFESIQILCLIEFLPLILSKKTIKEKIGELTS

SEQ ID NO: 3092692 - protein, 18 aa, Giardia lamblia
TFEYLVETIKHLPSRTIT

SEQ ID NO: 3092693 - protein, 20 aa, Giardia lamblia
TFGSLLIELFSTASLKSTRW

SEQ ID NO: 3092694 - protein, 29 aa, Giardia lamblia
TFIENAFFCQLKYNLRGLFALASLNEVGD

SEQ ID NO: 3092695 - protein, 19 aa, Giardia lamblia
TFIQKILSSITLFDNGIRN

SEQ ID NO: 3092696 - protein, 33 aa, Giardia lamblia
TFKDSFPLTFTLLYDLLYLGAATLYAIGFNSTY

SEQ ID NO: 3092697 - protein, 26 aa, Giardia lamblia
TFKKQLAMCYCFLPFAYIQSDEKEVF

SEQ ID NO: 3092698 - protein, 19 aa, Giardia lamblia
TFLARPGCVHVSKVDRTRR

SEQ ID NO: 3092699 - protein, 17 aa, Giardia lamblia
TFLNLICKFIDAVPLSI

SEQ ID NO: 3092700 - protein, 24 aa, Giardia lamblia
TFLQNLQIFPCELVIHINLSNELG

SEQ ID NO: 3092701 - protein, 18 aa, Giardia lamblia
TFNMILTDILFHLHFFAE

SEQ ID NO: 3092702 - protein, 23 aa, Giardia lamblia
TFNSMLNFILMPPSVFYMECGPA

SEQ ID NO: 3092703 - protein, 17 aa, Giardia lamblia
TFPLNHEDRLALTGILR

SEQ ID NO: 3092704 - protein, 17 aa, Giardia lamblia
TFQLRLYALYGQPGLRH

SEQ ID NO: 3092705 - protein, 27 aa, Giardia lamblia
TFQTDWLFDSWNRAIHTLYPLRPDNNL

SEQ ID NO: 3092706 - protein, 18 aa, Giardia lamblia
TFRKGWLPSPGAASDTPH

SEQ ID NO: 3092707 - protein, 65 aa, Giardia lamblia
TFSEYAYLFPFPESSPLYHLFLPYLLSFPNTFIYKVSNPALYLLVLNNFFVLRMGKYREWLQHID

SEQ ID NO: 3092708 - protein, 23 aa, Giardia lamblia
TFSLNGTIYLVASLFAGIDISLL

SEQ ID NO: 3092709 - protein, 24 aa, Giardia lamblia
TFSNESMLAFILLTGLVVSINAYG

SEQ ID NO: 3092710 - protein, 18 aa, Giardia lamblia
TFVKGVISFYYDVITKIF

SEQ ID NO: 3092711 - protein, 24 aa, Giardia lamblia
TFVLTPIQYLLTAAVPYIISFVMG

SEQ ID NO: 3092712 - protein, 24 aa, Giardia lamblia
TFVSLPLAVVVAYLLTIIASVNIE

SEQ ID NO: 3092713 - protein, 29 aa, Giardia lamblia
TGAITCESCFLYYYKKVDNGVLSCVPLDE

SEQ ID NO: 3092714 - protein, 17 aa, Giardia lamblia
TGAVPELVFHLYRLCDY

SEQ ID NO: 3092715 - protein, 19 aa, Giardia lamblia
TGCVTLINLILVCILFSQL

SEQ ID NO: 3092716 - protein, 22 aa, Giardia lamblia
TGDARWRRPGLEHLSYWAVEEP

SEQ ID NO: 3092717 - protein, 18 aa, Giardia lamblia
TGDNLLFAHLDLLDDRTA

SEQ ID NO: 3092718 - protein, 25 aa, Giardia lamblia
TGEDFQLIRNRLALIVFDELHLIGD

SEQ ID NO: 3092719 - protein, 29 aa, Giardia lamblia
TGFFIFLLFHLSFTLWMALIDSNPIPNVT

SEQ ID NO: 3092720 - protein, 43 aa, Giardia lamblia
TGGCIGLFLSFSFAFMVILFVGQLFYMLFTRKAAEKLYYSMEE

SEQ ID NO: 3092721 - protein, 21 aa, Giardia lamblia
TGGGFFSFSYTFFATRPTRMY

SEQ ID NO: 3092722 - protein, 17 aa, Giardia lamblia
TGILRPFLELLVGNFTD

SEQ ID NO: 3092723 - protein, 38 aa, Giardia lamblia
TGINDIFELMYAKVFPRLKFCQYFIKQPGTVFHDIRYW

SEQ ID NO: 3092724 - protein, 24 aa, Giardia lamblia
TGKILLALVPILLVDKFSLQFSND

SEQ ID NO: 3092725 - protein, 18 aa, Giardia lamblia
TGKTLSLLIPAIAYQEQC

SEQ ID NO: 3092726 - protein, 26 aa, Giardia lamblia
TGLITLIAFVILFIVPLLTGSARGCP

SEQ ID NO: 3092727 - protein, 17 aa, Giardia lamblia
TGLLYPTDNDWLRLKNK

SEQ ID NO: 3092728 - protein, 26 aa, Giardia lamblia
TGLRVLMLGFLFHTSPYDGVYTIPAR

SEQ ID NO: 3092729 - protein, 19 aa, Giardia lamblia
TGMPPWLPSPDLTTKQHIQ

SEQ ID NO: 3092730 - protein, 21 aa, Giardia lamblia
TGPVLLWEALNLAKLCMKSLT

SEQ ID NO: 3092731 - protein, 21 aa, Giardia lamblia
TGRFLAVVAYLLRLSGDSDYC

SEQ ID NO: 3092732 - protein, 24 aa, Giardia lamblia
TGSEPLLLRDAPLDRRNALKGAEE

SEQ ID NO: 3092733 - protein, 28 aa, Giardia lamblia
TGSSTAVLPLLWNLYLATAEILEPSVLS

SEQ ID NO: 3092734 - protein, 26 aa, Giardia lamblia
TGTTPLLYLCMFSYSSNVFQLNIYTV

SEQ ID NO: 3092735 - protein, 32 aa, Giardia lamblia
TGTVLLLTMMGGLYQFRQILKSNLNAPVHAIN

SEQ ID NO: 3092736 - protein, 30 aa, Giardia lamblia
TGVTVTFNFYYPLQLNLFIPVGQNPQAIVD

SEQ ID NO: 3092737 - protein, 30 aa, Giardia lamblia
THILTRYLLKGIFLLLFYTICSKIGRERGG

SEQ ID NO: 3092738 - protein, 20 aa, Giardia lamblia
THKCLSCSQLWWCNSGVLCD

SEQ ID NO: 3092739 - protein, 26 aa, Giardia lamblia
THLGFLFGVYIYGSLLLTFLLSMLQQ

SEQ ID NO: 3092740 - protein, 21 aa, Giardia lamblia
THLRLLPRRLVASTKPLADLV

SEQ ID NO: 3092741 - protein, 38 aa, Giardia lamblia
THMPLVFLCREAHWNYFTYIPVLLFIGSQRYADHLHRQ

SEQ ID NO: 3092742 - protein, 25 aa, Giardia lamblia
THQSTLKLLLILAMGIAGHEVLSHV

SEQ ID NO: 3092743 - protein, 28 aa, Giardia lamblia
THSLPRFSLECKFKFWFHRDPAAALGKI

SEQ ID NO: 3092744 - protein, 27 aa, Giardia lamblia
THVDCSFFRLILPKLVADRLEVGMLLR

SEQ ID NO: 3092745 - protein, 26 aa, Giardia lamblia
THVDEYLPLLSFYKAGRRAYKMYMKL

SEQ ID NO: 3092746 - protein, 25 aa, Giardia lamblia
THYEKIANRLLLIAALGAFLSVDSM

SEQ ID NO: 3092747 - protein, 20 aa, Giardia lamblia
TIADLQVQILRKSYLLRPEI

SEQ ID NO: 3092748 - protein, 18 aa, Giardia lamblia
TIAKYFNIWNTDVPVLRT

SEQ ID NO: 3092749 - protein, 26 aa, Giardia lamblia
TIALLMLHSRLFVYARQILKVEEFSS

SEQ ID NO: 3092750 - protein, 21 aa, Giardia lamblia
TIALWIFHNKAVSGDSVLACF

SEQ ID NO: 3092751 - protein, 42 aa, Giardia lamblia
TIASLLHVYLLPIYVYICRFLVLLRRDIKFLFTTRVEIKLES

SEQ ID NO: 3092752 - protein, 20 aa, Giardia lamblia
TIAVLQALTWQIIRKVIVIN

SEQ ID NO: 3092753 - protein, 42 aa, Giardia lamblia
TICNTFLNMIYMRLHIHYKALYSYALFFTPAGNSPIEGSTVS

SEQ ID NO: 3092754 - protein, 27 aa, Giardia lamblia
TIDALVELVVLFFSFVFPTCLQRKDRL

SEQ ID NO: 3092755 - protein, 18 aa, Giardia lamblia
TIECKCRFLKGPTPSLDQ

SEQ ID NO: 3092756 - protein, 17 aa, Giardia lamblia
TIEFLRWVSANALEMGL

SEQ ID NO: 3092757 - protein, 33 aa, Giardia lamblia
TIELLERIETLLPQFKFISSIAFQPRHFKMLTR

SEQ ID NO: 3092758 - protein, 18 aa, Giardia lamblia
TIELLNILNRLFVRSDLN

SEQ ID NO: 3092759 - protein, 25 aa, Giardia lamblia
TIESFSRMIFAIQVDTLHGGELKLH

SEQ ID NO: 3092760 - protein, 24 aa, Giardia lamblia
TIETYRLHYMLERLVKNGHPVLFC

SEQ ID NO: 3092761 - protein, 36 aa, Giardia lamblia
TIFILRTMAMVILFSWNMAWISLFFDTAEPSWVPYV

SEQ ID NO: 3092762 - protein, 26 aa, Giardia lamblia
TIFRDSLCYYVYLYANLFSMTLGNRF

SEQ ID NO: 3092763 - protein, 18 aa, Giardia lamblia
TIFVDIHRLLFQCIKHAS

SEQ ID NO: 3092764 - protein, 18 aa, Giardia lamblia
TIFWLGVSFARVENIDSL

SEQ ID NO: 3092765 - protein, 18 aa, Giardia lamblia
TIGCAVAGFLFIIVFLCV

SEQ ID NO: 3092766 - protein, 25 aa, Giardia lamblia
TIGGFFNASFLLSTAFFLVTEAVQK

SEQ ID NO: 3092767 - protein, 18 aa, Giardia lamblia
TIGKTILYNATPLSFYQY

SEQ ID NO: 3092768 - protein, 37 aa, Giardia lamblia
TIGKVIASLLLLDIRTLLYSGFFLLGSCHRLASHFPP

SEQ ID NO: 3092769 - protein, 33 aa, Giardia lamblia
TIHLIMVLSLTCQVFMLLTYIQRQHLKSLGLDV

SEQ ID NO: 3092770 - protein, 23 aa, Giardia lamblia
TIIALVGMLPLPAGAYPNSLPPE

SEQ ID NO: 3092771 - protein, 29 aa, Giardia lamblia
TIICSKIRLLLHKSFYWVPTAREEDLRLQ

SEQ ID NO: 3092772 - protein, 23 aa, Giardia lamblia
TIIDTINAFFDKLILAAKGLEST

SEQ ID NO: 3092773 - protein, 18 aa, Giardia lamblia
TIIDYYFEKGKMDIKEVL

SEQ ID NO: 3092774 - protein, 17 aa, Giardia lamblia
TIILKNLFTYLKSIRKG

SEQ ID NO: 3092775 - protein, 24 aa, Giardia lamblia
TIKDLVLLSLVRRVSVFAGSVEES

SEQ ID NO: 3092776 - protein, 25 aa, Giardia lamblia
TIKICLQTKYWSWATLIALIFTVTV

SEQ ID NO: 3092777 - protein, 28 aa, Giardia lamblia
TIKNAYVKLLLFMKLYLSHILSTLTIVF

SEQ ID NO: 3092778 - protein, 18 aa, Giardia lamblia
TILDSLPLNYKQLAVVAK

SEQ ID NO: 3092779 - protein, 21 aa, Giardia lamblia
TILHWAVFYLSPGDYHRFHAP

SEQ ID NO: 3092780 - protein, 17 aa, Giardia lamblia
TILKWDNVELLTNSSFI

SEQ ID NO: 3092781 - protein, 18 aa, Giardia lamblia
TILSAYFTKSFDLINLDP

SEQ ID NO: 3092782 - protein, 23 aa, Giardia lamblia
TILYCVDYFINQKFFPSNKEDNE

SEQ ID NO: 3092783 - protein, 18 aa, Giardia lamblia
TIMHIPNIIALYLPAHEI

SEQ ID NO: 3092784 - protein, 20 aa, Giardia lamblia
TIMRRSLIFTNYPAITYASY

SEQ ID NO: 3092785 - protein, 26 aa, Giardia lamblia
TINFTAGLFRQLIYGKSITIAGNARA

SEQ ID NO: 3092786 - protein, 25 aa, Giardia lamblia
TINGRLVQYLLHSGGLLVDCLLRIK

SEQ ID NO: 3092787 - protein, 18 aa, Giardia lamblia
TINLFGLHDFSKLGDAAE

SEQ ID NO: 3092788 - protein, 33 aa, Giardia lamblia
TINTKIMARCSQGFWWKVFNNSVFLAVQLESIS

SEQ ID NO: 3092789 - protein, 19 aa, Giardia lamblia
TIPDYLLHYINRGSLEINA

SEQ ID NO: 3092790 - protein, 19 aa, Giardia lamblia
TIPTVFGSYSLRGFIIVVW

SEQ ID NO: 3092791 - protein, 29 aa, Giardia lamblia
TIQNFEAFLILFFSLPIFELTYHTRVRYM

SEQ ID NO: 3092792 - protein, 24 aa, Giardia lamblia
TIQNLSMLPTPSGVSFMPRTEEHT

SEQ ID NO: 3092793 - protein, 33 aa, Giardia lamblia
TIRAYLATLTWYSLATAIVALQLVIAWLRDYET

SEQ ID NO: 3092794 - protein, 17 aa, Giardia lamblia
TIRECVAETCKIDKLIY

SEQ ID NO: 3092795 - protein, 25 aa, Giardia lamblia
TISTYLQLLRILIASLRDPLDSNSV

SEQ ID NO: 3092796 - protein, 25 aa, Giardia lamblia
TITNLLEWIIPYLITLDQDSLSASE

SEQ ID NO: 3092797 - protein, 34 aa, Giardia lamblia
TITSAVPQLLPFLLFVLFGFPNAMSSIMILLVDV

SEQ ID NO: 3092798 - protein, 26 aa, Giardia lamblia
TITVGRTPFPIRYTGLRIYTSAISDV

SEQ ID NO: 3092799 - protein, 23 aa, Giardia lamblia
TITYMVIFVITSLILFMCGSYFG

SEQ ID NO: 3092800 - protein, 20 aa, Giardia lamblia
TIVALIWKYVLMEGNASHQE

SEQ ID NO: 3092801 - protein, 22 aa, Giardia lamblia
TIVFTWYMETIEYRRFKDECVA

SEQ ID NO: 3092802 - protein, 18 aa, Giardia lamblia
TIVIFYNYSRLSNGGFLV

SEQ ID NO: 3092803 - protein, 37 aa, Giardia lamblia
TIWTQFAIPTWLTKVFYVLFPPLGLVAICDMMITLRP

SEQ ID NO: 3092804 - protein, 38 aa, Giardia lamblia
TIWTQLAIPTWLTKVFYVLFPPLGLVAICDMMITLRPE

SEQ ID NO: 3092805 - protein, 25 aa, Giardia lamblia
TIYVFLHILVLCKANLRAIAVFSSP

SEQ ID NO: 3092806 - protein, 26 aa, Giardia lamblia
TKACRRPLCTYIDPFDGQAKICYNMG

SEQ ID NO: 3092807 - protein, 27 aa, Giardia lamblia
TKAIPPSFPALWKNPESFLACTPQSCG

SEQ ID NO: 3092808 - protein, 30 aa, Giardia lamblia
TKAKAMWKRLFYAIVFFHGILLERRKFGPQ

SEQ ID NO: 3092809 - protein, 22 aa, Giardia lamblia
TKCDYYMAAAWFVLAADFEHMV

SEQ ID NO: 3092810 - protein, 22 aa, Giardia lamblia
TKCEICNLGYTLTGTACQPNVA

SEQ ID NO: 3092811 - protein, 18 aa, Giardia lamblia
TKCLACKTSYTLDSSGQC

SEQ ID NO: 3092812 - protein, 38 aa, Giardia lamblia
TKDKNLLTIVIISVVVIIVLVVVFVVFCILCKKKRTQT

SEQ ID NO: 3092813 - protein, 36 aa, Giardia lamblia
TKEYMSLYRQYPYLNPRYLRSVYFMTLGCLDSAHKH

SEQ ID NO: 3092814 - protein, 54 aa, Giardia lamblia
TKFNTMAVIFFFNSKVYFSSIKFIYWTMLGINILWQISFSIYLRYYDGVRRAVK

SEQ ID NO: 3092815 - protein, 26 aa, Giardia lamblia
TKGDTRLMSIFLWNLQQKQSLDGFTG

SEQ ID NO: 3092816 - protein, 23 aa, Giardia lamblia
TKGLYTFLALIVYLTASQVPLYG

SEQ ID NO: 3092817 - protein, 17 aa, Giardia lamblia
TKIIRMLFCGTTDPLAD

SEQ ID NO: 3092818 - protein, 24 aa, Giardia lamblia
TKKGYWISPDGKLLECDPTCLACT

SEQ ID NO: 3092819 - protein, 27 aa, Giardia lamblia
TKKRSQLQLFFILKSSLYKINFIQSPN

SEQ ID NO: 3092820 - protein, 26 aa, Giardia lamblia
TKLKLHTLLPVITFLRNTQYALTNRN

SEQ ID NO: 3092821 - protein, 24 aa, Giardia lamblia
TKNCVLKWVISLFNGIKSGDAFKK

SEQ ID NO: 3092822 - protein, 23 aa, Giardia lamblia
TKQYSYQYKLYNGAGLTALMLRA

SEQ ID NO: 3092823 - protein, 25 aa, Giardia lamblia
TKRIDWVVVAPISIAAVLIAICAAI

SEQ ID NO: 3092824 - protein, 19 aa, Giardia lamblia
TKRISLLVFYLFRHIFMIS

SEQ ID NO: 3092825 - protein, 28 aa, Giardia lamblia
TKRKYTLRKLMLLHIVLLQSIKDMAHSS

SEQ ID NO: 3092826 - protein, 28 aa, Giardia lamblia
TKSLIHLMVTWRRVELMSWNGFFSRVHT

SEQ ID NO: 3092827 - protein, 22 aa, Giardia lamblia
TKSVVWLGHYYTSAFVTSLLSS

SEQ ID NO: 3092828 - protein, 33 aa, Giardia lamblia
TKVPASVCILTFIFLIIVWSSKAFCSWGFTWQC

SEQ ID NO: 3092829 - protein, 25 aa, Giardia lamblia
TKVRDIQILLLFGAKEYCILCKHVA

SEQ ID NO: 3092830 - protein, 33 aa, Giardia lamblia
TLACSFRWWSFTLIVTSIYLIQRAAAFLGTLVF

SEQ ID NO: 3092831 - protein, 25 aa, Giardia lamblia
TLADKPAVVLPPRKKSRPAPHTASS

SEQ ID NO: 3092832 - protein, 26 aa, Giardia lamblia
TLAFALFTVFVHLFGRLKKLKPEFKV

SEQ ID NO: 3092833 - protein, 20 aa, Giardia lamblia
TLAIRMFNSRFPVCLSNLSV

SEQ ID NO: 3092834 - protein, 18 aa, Giardia lamblia
TLCSVINKVYRWPDLYST

SEQ ID NO: 3092835 - protein, 22 aa, Giardia lamblia
TLCTPPVFAGEVLCLSKEVIED

SEQ ID NO: 3092836 - protein, 25 aa, Giardia lamblia
TLDAMLIVLYFGFLTSYIIIASQSV

SEQ ID NO: 3092837 - protein, 24 aa, Giardia lamblia
TLDYHELLSVYFFKTLHSDFSSTS

SEQ ID NO: 3092838 - protein, 35 aa, Giardia lamblia
TLEALIYDHFMLLIFKLFAIFIPVGMEFYSRNCSD

SEQ ID NO: 3092839 - protein, 24 aa, Giardia lamblia
TLEEFIELPILQNALPEVPRDVID

SEQ ID NO: 3092840 - protein, 33 aa, Giardia lamblia
TLELWLIWIFTLPLFPLILFFTLVIAFQPLEYG

SEQ ID NO: 3092841 - protein, 17 aa, Giardia lamblia
TLERLFVRMSGETEYKR

SEQ ID NO: 3092842 - protein, 18 aa, Giardia lamblia
TLESQFMRLGDNPAMREL

SEQ ID NO: 3092843 - protein, 20 aa, Giardia lamblia
TLEVTLLHSFEFFYDSLHDK

SEQ ID NO: 3092844 - protein, 18 aa, Giardia lamblia
TLFGLMTPILLLSVGVVS

SEQ ID NO: 3092845 - protein, 18 aa, Giardia lamblia
TLFMRKFTGPGKKNLVNC

SEQ ID NO: 3092846 - protein, 21 aa, Giardia lamblia
TLGEYLHEVVKFLHDKFDPVH

SEQ ID NO: 3092847 - protein, 25 aa, Giardia lamblia
TLGGYRFFYLLNWIYRTVKGVRMGW

SEQ ID NO: 3092848 - protein, 17 aa, Giardia lamblia
TLGVAYFGINTGYYLRR

SEQ ID NO: 3092849 - protein, 23 aa, Giardia lamblia
TLGVFAPIFLFVPATNASLGVRG

SEQ ID NO: 3092850 - protein, 25 aa, Giardia lamblia
TLHVYLFVTANLLPDSIFLTFERFA

SEQ ID NO: 3092851 - protein, 20 aa, Giardia lamblia
TLIAIPAFLITMCYVLVQIS

SEQ ID NO: 3092852 - protein, 18 aa, Giardia lamblia
TLILNEDLLKRLDATNES

SEQ ID NO: 3092853 - protein, 19 aa, Giardia lamblia
TLIMTYKTLALKCIVGAYS

SEQ ID NO: 3092854 - protein, 18 aa, Giardia lamblia
TLIVVSVIHYYLEAIRTH

SEQ ID NO: 3092855 - protein, 25 aa, Giardia lamblia
TLKKLTFRLRMVTFPVINYSNCCLF

SEQ ID NO: 3092856 - protein, 30 aa, Giardia lamblia
TLKSLFNAGWWSFIMMILDALTGIGIMVMP

SEQ ID NO: 3092857 - protein, 17 aa, Giardia lamblia
TLKSWYNKKLLGSLYDL

SEQ ID NO: 3092858 - protein, 18 aa, Giardia lamblia
TLLAILQDAFRGLPLDTI

SEQ ID NO: 3092859 - protein, 30 aa, Giardia lamblia
TLLQIWFSMLYYFVTLVIYTGVLLLGFATF

SEQ ID NO: 3092860 - protein, 20 aa, Giardia lamblia
TLLTLLNFSTVYLHFTPALY

SEQ ID NO: 3092861 - protein, 18 aa, Giardia lamblia
TLLYSWWCRHYGVITSEI

SEQ ID NO: 3092862 - protein, 19 aa, Giardia lamblia
TLMTCCYVSLFLEYVHRKQ

SEQ ID NO: 3092863 - protein, 23 aa, Giardia lamblia
TLNCFGIEIVNWFSILLSVVIIL

SEQ ID NO: 3092864 - protein, 35 aa, Giardia lamblia
TLNEGMFAVIFGYILPFLALCSLYFYTTHFTRRYT

SEQ ID NO: 3092865 - protein, 18 aa, Giardia lamblia
TLNNRKRWLFHRPTFSIH

SEQ ID NO: 3092866 - protein, 17 aa, Giardia lamblia
TLNWILSDMLPSIISFV

SEQ ID NO: 3092867 - protein, 17 aa, Giardia lamblia
TLPLANQGRRLFFTKKQ

SEQ ID NO: 3092868 - protein, 17 aa, Giardia lamblia
TLPSLMKYFTDSGIRLP

SEQ ID NO: 3092869 - protein, 23 aa, Giardia lamblia
TLQNILYRLIVMATAYLTDGMEL

SEQ ID NO: 3092870 - protein, 18 aa, Giardia lamblia
TLQSVTILLIYRAYGTYY

SEQ ID NO: 3092871 - protein, 25 aa, Giardia lamblia
TLQYMQAMYLLFVRTLTSQVKTLNS

SEQ ID NO: 3092872 - protein, 26 aa, Giardia lamblia
TLRATLEQLFFRLQTTDQLQTDPVFG

SEQ ID NO: 3092873 - protein, 24 aa, Giardia lamblia
TLRELNVTCYNRILRECRWARDAS

SEQ ID NO: 3092874 - protein, 30 aa, Giardia lamblia
TLRNLDSFLFTRNSFYRLVLGLIVEFGHFP

SEQ ID NO: 3092875 - protein, 17 aa, Giardia lamblia
TLRPLVPSTFNLGKRER

SEQ ID NO: 3092876 - protein, 23 aa, Giardia lamblia
TLRRVAGLAYLGFFSEIASDSNS

SEQ ID NO: 3092877 - protein, 20 aa, Giardia lamblia
TLRYLLSWIIWIVFATDTQG

SEQ ID NO: 3092878 - protein, 24 aa, Giardia lamblia
TLSIPCQGCFLLTSGFLGCVMATG

SEQ ID NO: 3092879 - protein, 22 aa, Giardia lamblia
TLSLLIPAIAYQEQCISFLSLV

SEQ ID NO: 3092880 - protein, 19 aa, Giardia lamblia
TLSLRLSTLVLMPYSISAC

SEQ ID NO: 3092881 - protein, 22 aa, Giardia lamblia
TLSTCYMFVPEFQFFEKPGAGG

SEQ ID NO: 3092882 - protein, 24 aa, Giardia lamblia
TLSWRMYYIIAKLCSRSSFIDTPE

SEQ ID NO: 3092883 - protein, 35 aa, Giardia lamblia
TLSYALFHWLELPATELALFYNTLEKLPNFGFINL

SEQ ID NO: 3092884 - protein, 26 aa, Giardia lamblia
TLTDSIFLFAYLYPKEAIEFVLKSTI

SEQ ID NO: 3092885 - protein, 29 aa, Giardia lamblia
TLTFDCERILFIVYLSSFIMAKLSVCLIG

SEQ ID NO: 3092886 - protein, 21 aa, Giardia lamblia
TLTFFKVVYTLISKFHIKNES

SEQ ID NO: 3092887 - protein, 22 aa, Giardia lamblia
TLTFLCPFDEFTCRGLAAEIVS

SEQ ID NO: 3092888 - protein, 25 aa, Giardia lamblia
TLTLHTPGSLLILELLHAQASPPCP

SEQ ID NO: 3092889 - protein, 34 aa, Giardia lamblia
TLTRTMTVLLFESLLFLIVLSIRHILFPRTTNME

SEQ ID NO: 3092890 - protein, 44 aa, Giardia lamblia
TLTVSARFLLIDWLLLIVYIIGLLAYGFYGILIKVLARTEKLTI

SEQ ID NO: 3092891 - protein, 24 aa, Giardia lamblia
TLVDLRVPVFYALLNNMGDFVLTR

SEQ ID NO: 3092892 - protein, 19 aa, Giardia lamblia
TLVISLVVLVLALFSSLIL

SEQ ID NO: 3092893 - protein, 34 aa, Giardia lamblia
TLVKSFAEGLLLIRPLLPISLLELLCSMKQNVYF

SEQ ID NO: 3092894 - protein, 24 aa, Giardia lamblia
TLVNMLEIYLFLTKAMISTVDVMR

SEQ ID NO: 3092895 - protein, 17 aa, Giardia lamblia
TLVSNMLLRKGSISWAT

SEQ ID NO: 3092896 - protein, 28 aa, Giardia lamblia
TLVVQMITKLFKLYPSMSIHALVSLVPP

SEQ ID NO: 3092897 - protein, 17 aa, Giardia lamblia
TLVYLFPTIAGLSLDMD

SEQ ID NO: 3092898 - protein, 22 aa, Giardia lamblia
TLWLLPYRFKGATDPAPCITGA

SEQ ID NO: 3092899 - protein, 18 aa, Giardia lamblia
TLYCRSLTPRHLEISKTA

SEQ ID NO: 3092900 - protein, 18 aa, Giardia lamblia
TLYKKIISGVFHIPDHVS

SEQ ID NO: 3092901 - protein, 23 aa, Giardia lamblia
TLYTEIPAYFPLAGYEMYRPYVQ

SEQ ID NO: 3092902 - protein, 23 aa, Giardia lamblia
TMARRLHIFLSAARIFAATVERV

SEQ ID NO: 3092903 - protein, 17 aa, Giardia lamblia
TMDLVFQQTLLSIDAIG

SEQ ID NO: 3092904 - protein, 32 aa, Giardia lamblia
TMECTFLFQRIVISLFCSWILSCAIHTHAKIF

SEQ ID NO: 3092905 - protein, 23 aa, Giardia lamblia
TMGHLLGRALFPSNYPIYGAYNI

SEQ ID NO: 3092906 - protein, 24 aa, Giardia lamblia
TMGIYALHKLKIMVGYFTMRHLLV

SEQ ID NO: 3092907 - protein, 19 aa, Giardia lamblia
TMIMRLPRYIDCAPALPSN

SEQ ID NO: 3092908 - protein, 26 aa, Giardia lamblia
TMIPFSSVIFFYFVASTFKLGNITCI

SEQ ID NO: 3092909 - protein, 18 aa, Giardia lamblia
TMKLSYNETAVYGLSSIR

SEQ ID NO: 3092910 - protein, 29 aa, Giardia lamblia
TMLEAINYYLQPPSLLTLTIELLERIETL

SEQ ID NO: 3092911 - protein, 23 aa, Giardia lamblia
TMLRIFRHSPYDLLRVYFYKHFP

SEQ ID NO: 3092912 - protein, 23 aa, Giardia lamblia
TMRRLFVQLMRLTNKTDYPTCIR

SEQ ID NO: 3092913 - protein, 17 aa, Giardia lamblia
TMRSLGFSLLFDDLSSS

SEQ ID NO: 3092914 - protein, 25 aa, Giardia lamblia
TMSNNLLSLFPLRLQKHLALVVFAK

SEQ ID NO: 3092915 - protein, 24 aa, Giardia lamblia
TMVMVVPLPVELQRLIFNHIECNL

SEQ ID NO: 3092916 - protein, 19 aa, Giardia lamblia
TMYEISFRKWFKHLMRTVV

SEQ ID NO: 3092917 - protein, 27 aa, Giardia lamblia
TNAQRVPWKINWPVRFMVLLHHASAEI

SEQ ID NO: 3092918 - protein, 18 aa, Giardia lamblia
TNARHIMHLIKRNGPDLD

SEQ ID NO: 3092919 - protein, 28 aa, Giardia lamblia
TNASSFFAIFIDLFLKLLQKGVTQKNIK

SEQ ID NO: 3092920 - protein, 28 aa, Giardia lamblia
TNCQPWRYWFEFVTFYVSGIYMAVIIYF

SEQ ID NO: 3092921 - protein, 30 aa, Giardia lamblia
TNFKRVKIMLRPPSFLLYKIGPVCTSDDLT

SEQ ID NO: 3092922 - protein, 22 aa, Giardia lamblia
TNGECFIIPSANDAYRCLTIFS

SEQ ID NO: 3092923 - protein, 17 aa, Giardia lamblia
TNINFWKWYITYFVGKC

SEQ ID NO: 3092924 - protein, 25 aa, Giardia lamblia
TNKCIQCHAGYFFNAKTFTCTKCKD

SEQ ID NO: 3092925 - protein, 23 aa, Giardia lamblia
TNKIVCNYLLYESNLFSCIDTVG

SEQ ID NO: 3092926 - protein, 23 aa, Giardia lamblia
TNKKIIYSLLAGLWNFALIVTVS

SEQ ID NO: 3092927 - protein, 30 aa, Giardia lamblia
TNLRKPVTGSLPYWKFVFATACFAILDLVQ

SEQ ID NO: 3092928 - protein, 24 aa, Giardia lamblia
TNLRSLQYIRWLSGSNSFRPHTFE

SEQ ID NO: 3092929 - protein, 28 aa, Giardia lamblia
TNNFSKVVLCLYIIAFLGNLPIFVRNST

SEQ ID NO: 3092930 - protein, 23 aa, Giardia lamblia
TNNILGCLTLFSASTIFDEEITA

SEQ ID NO: 3092931 - protein, 24 aa, Giardia lamblia
TNPEHWICVCGTLYTGETCDQCNP

SEQ ID NO: 3092932 - protein, 27 aa, Giardia lamblia
TNPFHSLFTFRILSVEALFGHICTKLK

SEQ ID NO: 3092933 - protein, 23 aa, Giardia lamblia
TNPNTYYCQCPMSYSSGDYCEVC

SEQ ID NO: 3092934 - protein, 21 aa, Giardia lamblia
TNPSQLYLKTFKRIVTSLLIT

SEQ ID NO: 3092935 - protein, 24 aa, Giardia lamblia
TNQLSAVILLRKGSMQICRSQQHE

SEQ ID NO: 3092936 - protein, 31 aa, Giardia lamblia
TNRYGMPSHFYPLLYTAALVLLIGMIIVMRY

SEQ ID NO: 3092937 - protein, 22 aa, Giardia lamblia
TNSFPYLGAAYGPDPFPFTDIF

SEQ ID NO: 3092938 - protein, 31 aa, Giardia lamblia
TNSQMFALPIFILILVFINVIICCIKPKAVG

SEQ ID NO: 3092939 - protein, 24 aa, Giardia lamblia
TNSRSFYIFAGVLFGMDLHEASGR

SEQ ID NO: 3092940 - protein, 37 aa, Giardia lamblia
TNSSLILITLFYIFLVCYLLFIYSYSLTNHVIAKSLL

SEQ ID NO: 3092941 - protein, 35 aa, Giardia lamblia
TNTLTMVCIWALVPLLVLMAVFLDALYSAKPLQNN

SEQ ID NO: 3092942 - protein, 18 aa, Giardia lamblia
TNWELFHGRCFCKIRNCN

SEQ ID NO: 3092943 - protein, 20 aa, Giardia lamblia
TNYVNVMMLLLNVVTNERLL

SEQ ID NO: 3092944 - protein, 25 aa, Giardia lamblia
TPAAWYSLVTFVLKSSIDLITLAAL

SEQ ID NO: 3092945 - protein, 17 aa, Giardia lamblia
TPALFAWKDFCSLSSSA

SEQ ID NO: 3092946 - protein, 28 aa, Giardia lamblia
TPDNVSLLAFIFAASYAYSLCFRYTDML

SEQ ID NO: 3092947 - protein, 18 aa, Giardia lamblia
TPEICRRDYWANGGWETF

SEQ ID NO: 3092948 - protein, 21 aa, Giardia lamblia
TPEMLYNSLLLFTSHIKRVAI

SEQ ID NO: 3092949 - protein, 18 aa, Giardia lamblia
TPHPILGYILMLLSELCN

SEQ ID NO: 3092950 - protein, 18 aa, Giardia lamblia
TPKPQTLVLFVKLSDTAI

SEQ ID NO: 3092951 - protein, 20 aa, Giardia lamblia
TPLYLQTEMAAIMKVTGYLS

SEQ ID NO: 3092952 - protein, 25 aa, Giardia lamblia
TPQCAEISGCLLCPSPPACGTCLSD

SEQ ID NO: 3092953 - protein, 24 aa, Giardia lamblia
TPQDLLFVLSVSFLDYFTVGHLHQ

SEQ ID NO: 3092954 - protein, 22 aa, Giardia lamblia
TPRCALLYHCLNHYCIIVGYII

SEQ ID NO: 3092955 - protein, 19 aa, Giardia lamblia
TPRDIPYPSFLQIKDSVIY

SEQ ID NO: 3092956 - protein, 29 aa, Giardia lamblia
TPSLQLVRAIPYFILSNIPYNLDPKPFIT

SEQ ID NO: 3092957 - protein, 24 aa, Giardia lamblia
TPSNWYWYLEYPVLALSALAPALQ

SEQ ID NO: 3092958 - protein, 19 aa, Giardia lamblia
TPTCTDGLCRCSCGVGSYL

SEQ ID NO: 3092959 - protein, 18 aa, Giardia lamblia
TPTKCICDFGYGLAENKN

SEQ ID NO: 3092960 - protein, 18 aa, Giardia lamblia
TPVLLNRIALIKASIYKT

SEQ ID NO: 3092961 - protein, 18 aa, Giardia lamblia
TPYLINRPSYHLFSVMAV

SEQ ID NO: 3092962 - protein, 29 aa, Giardia lamblia
TQCAQGYFLYMGGCYKVASPPGNLMCTEA

SEQ ID NO: 3092963 - protein, 21 aa, Giardia lamblia
TQCLPCHADCKTCQGPQSTQC

SEQ ID NO: 3092964 - protein, 17 aa, Giardia lamblia
TQCLSCHSNKYLKKEGT

SEQ ID NO: 3092965 - protein, 20 aa, Giardia lamblia
TQCTACVEGKFLKDGNTCVE

SEQ ID NO: 3092966 - protein, 17 aa, Giardia lamblia
TQEIFACFTDLVITSNP

SEQ ID NO: 3092967 - protein, 22 aa, Giardia lamblia
TQELGWWDNFWTQIPDLRDLER

SEQ ID NO: 3092968 - protein, 30 aa, Giardia lamblia
TQEQKDKVILLLQNLLYKSKYNSSILQVFD

SEQ ID NO: 3092969 - protein, 34 aa, Giardia lamblia
TQFTEFITQSAYFYTIPPVAVVIMILRSMYRRLI

SEQ ID NO: 3092970 - protein, 27 aa, Giardia lamblia
TQGVTPPQFYVRPVNRFESDKTLVTIE

SEQ ID NO: 3092971 - protein, 22 aa, Giardia lamblia
TQIVLLVFLILAGGFNIGSVLA

SEQ ID NO: 3092972 - protein, 18 aa, Giardia lamblia
TQMRHMCMFISSVSLVVS

SEQ ID NO: 3092973 - protein, 21 aa, Giardia lamblia
TQNFDEFLILTNRLHQPENEH

SEQ ID NO: 3092974 - protein, 26 aa, Giardia lamblia
TQQFDQKFGLFVPMVCWQCGILYEMG

SEQ ID NO: 3092975 - protein, 18 aa, Giardia lamblia
TQRLVFNNIGLSLPSVPT

SEQ ID NO: 3092976 - protein, 19 aa, Giardia lamblia
TQSNLEIDWLYNAETMQFL

SEQ ID NO: 3092977 - protein, 43 aa, Giardia lamblia
TQVLHFEEFVELLAGLVIAPPTTIDPLLLQAKAGFAAAEQQAV

SEQ ID NO: 3092978 - protein, 25 aa, Giardia lamblia
TQWSSTFDFIFPKTDTSSGDRYLCG

SEQ ID NO: 3092979 - protein, 25 aa, Giardia lamblia
TRCTKGYFLHYGSCFNISTDSAGSL

SEQ ID NO: 3092980 - protein, 19 aa, Giardia lamblia
TREPVLIYCQMTKMLDLLE

SEQ ID NO: 3092981 - protein, 20 aa, Giardia lamblia
TRFCTIVKNYSLIVKFLLKR

SEQ ID NO: 3092982 - protein, 26 aa, Giardia lamblia
TRGHDAFPYVPWTLNGHRYLVTKEVR

SEQ ID NO: 3092983 - protein, 23 aa, Giardia lamblia
TRGSGHCLGFFDGIFPEHNVLST

SEQ ID NO: 3092984 - protein, 18 aa, Giardia lamblia
TRINLLRIPADVPMSLYS

SEQ ID NO: 3092985 - protein, 29 aa, Giardia lamblia
TRIRSDWMRLLFKMYKYAKLTYDYIDVDT

SEQ ID NO: 3092986 - protein, 18 aa, Giardia lamblia
TRLFIGSCMHSLLSGYTV

SEQ ID NO: 3092987 - protein, 19 aa, Giardia lamblia
TRLLYLLVSGPIICFTLAL

SEQ ID NO: 3092988 - protein, 38 aa, Giardia lamblia
TRLNSIFKQKMNWMMLGGLFLQIGLAAAFAYIPIFHVA

SEQ ID NO: 3092989 - protein, 23 aa, Giardia lamblia
TRMCIIAGPCAPLDGLPIAFNEI

SEQ ID NO: 3092990 - protein, 24 aa, Giardia lamblia
TRMQYLYSIVWEQGVLIFDRLLWS

SEQ ID NO: 3092991 - protein, 23 aa, Giardia lamblia
TRNIYISALFTLVSCILALIPDV

SEQ ID NO: 3092992 - protein, 17 aa, Giardia lamblia
TRNNLMLYILRQYSEKS

SEQ ID NO: 3092993 - protein, 29 aa, Giardia lamblia
TRPDALPLARPPLLRAVAVPPGFAGPVPL

SEQ ID NO: 3092994 - protein, 18 aa, Giardia lamblia
TRRAFLDILRLSLNIHEE

SEQ ID NO: 3092995 - protein, 23 aa, Giardia lamblia
TRSIAKHLYLLALVARGFTQFSE

SEQ ID NO: 3092996 - protein, 28 aa, Giardia lamblia
TRSIKVHPNFRLFISYAPTSDISRALRN

SEQ ID NO: 3092997 - protein, 25 aa, Giardia lamblia
TRSRRNLLQWLPPLHLTLEDLRRVQ

SEQ ID NO: 3092998 - protein, 18 aa, Giardia lamblia
TRTILPNYEPYLAPEVLA

SEQ ID NO: 3092999 - protein, 23 aa, Giardia lamblia
TRTRLRLIGWRLLQSAVCAAPTI

SEQ ID NO: 3093000 - protein, 25 aa, Giardia lamblia
TRVIQRIAVLPTFINSIIGFLYDTM

SEQ ID NO: 3093001 - protein, 19 aa, Giardia lamblia
TRYLFFQQIPNRNDLVLLV

SEQ ID NO: 3093002 - protein, 31 aa, Giardia lamblia
TSAETDLFLLDFLHFFKPYSIQALLDSLQHV

SEQ ID NO: 3093003 - protein, 23 aa, Giardia lamblia
TSALWFAASIWYSVPTSSASSSF

SEQ ID NO: 3093004 - protein, 24 aa, Giardia lamblia
TSAPEPFVWEVLSQMAYGLRDLHR

SEQ ID NO: 3093005 - protein, 24 aa, Giardia lamblia
TSCTACYPGYVLSRSSDDTGTCIK

SEQ ID NO: 3093006 - protein, 20 aa, Giardia lamblia
TSEELQLLLRKHKDFYVLNL

SEQ ID NO: 3093007 - protein, 30 aa, Giardia lamblia
TSEGSLLRWEVILIAVTLGIVGFFALHCSS

SEQ ID NO: 3093008 - protein, 24 aa, Giardia lamblia
TSELLIHILELGAYLYGGCPALTG

SEQ ID NO: 3093009 - protein, 33 aa, Giardia lamblia
TSETLFSFIINILQTRYWPAIINSPYIVMFSIF

SEQ ID NO: 3093010 - protein, 24 aa, Giardia lamblia
TSFRSPLIILDKLLKDAFHRRLPS

SEQ ID NO: 3093011 - protein, 21 aa, Giardia lamblia
TSFWKVVYLNMHILTLLIILC

SEQ ID NO: 3093012 - protein, 31 aa, Giardia lamblia
TSGQGRLKYMLWLVFFYLGVAITAVFAILMP

SEQ ID NO: 3093013 - protein, 22 aa, Giardia lamblia
TSGQRVLSGIPLLSVLRNELGK

SEQ ID NO: 3093014 - protein, 23 aa, Giardia lamblia
TSHAYRSFSRWLQQFQSKRAATA

SEQ ID NO: 3093015 - protein, 52 aa, Giardia lamblia
TSILACLHLLSFWCLIIVTFQTRLYFLLLSSTLKLLPIVTLFGLMTPILLLS

SEQ ID NO: 3093016 - protein, 27 aa, Giardia lamblia
TSITSFEFQKLLRYYWNTSDNQVHIHQ

SEQ ID NO: 3093017 - protein, 23 aa, Giardia lamblia
TSKPTFFHSLVYRNFVYDHLIQD

SEQ ID NO: 3093018 - protein, 22 aa, Giardia lamblia
TSKSRQVLLPKYTFSRTSVSAD

SEQ ID NO: 3093019 - protein, 21 aa, Giardia lamblia
TSKVFLFYNGCYDANSAIGKL

SEQ ID NO: 3093020 - protein, 29 aa, Giardia lamblia
TSLKCPVCIPCYLCWIEDNSTYFVTDLAH

SEQ ID NO: 3093021 - protein, 21 aa, Giardia lamblia
TSLKHPISFFLSLINIYATYA

SEQ ID NO: 3093022 - protein, 34 aa, Giardia lamblia
TSLKYLMFSGFVFKSSFYAFFDCRKMSYMTLMGM

SEQ ID NO: 3093023 - protein, 26 aa, Giardia lamblia
TSLLVYQAFVQWLSTIMAKGVSMFST

SEQ ID NO: 3093024 - protein, 22 aa, Giardia lamblia
TSLPLMGFYLYKKNLTEKRLKF

SEQ ID NO: 3093025 - protein, 17 aa, Giardia lamblia
TSLQIPATVKEKILKQA

SEQ ID NO: 3093026 - protein, 31 aa, Giardia lamblia
TSLSPIKVPIVPFSVLLLLSDTLGKAHESPN

SEQ ID NO: 3093027 - protein, 21 aa, Giardia lamblia
TSLTFKLAAYAPPYEIMDSDM

SEQ ID NO: 3093028 - protein, 18 aa, Giardia lamblia
TSLYAYLRALIAAHIRRL

SEQ ID NO: 3093029 - protein, 31 aa, Giardia lamblia
TSMCTIMDRIWIYIYNPWTQKYEIPSFTRLQ

SEQ ID NO: 3093030 - protein, 54 aa, Giardia lamblia
TSMGEKWYVKYLLLPCYLPLSPFVLLLRIMIIIPLFLLLALACFFLNLGTDPTR

SEQ ID NO: 3093031 - protein, 27 aa, Giardia lamblia
TSMLLPVFSFILYKGTKRCAFLFRLMG

SEQ ID NO: 3093032 - protein, 20 aa, Giardia lamblia
TSMLSYYVSILFVTALVSND

SEQ ID NO: 3093033 - protein, 18 aa, Giardia lamblia
TSMQFLHLPLLENFSQVF

SEQ ID NO: 3093034 - protein, 23 aa, Giardia lamblia
TSNFIKGILKRIFVLDPEERLTA

SEQ ID NO: 3093035 - protein, 24 aa, Giardia lamblia
TSNKLAIEILYQRLSLSSTNVCKH

SEQ ID NO: 3093036 - protein, 35 aa, Giardia lamblia
TSNQSPPIFICFLLMFIFHVLLRSNSVIRHPVHVF

SEQ ID NO: 3093037 - protein, 29 aa, Giardia lamblia
TSNRFTVMDIFYILRSLLASSLVIQYDTT

SEQ ID NO: 3093038 - protein, 29 aa, Giardia lamblia
TSPDYTLLPIIIYTIISSLKVILSSAIHS

SEQ ID NO: 3093039 - protein, 29 aa, Giardia lamblia
TSPLAIYIQNFEKMLLDLIKLIQDTSLTK

SEQ ID NO: 3093040 - protein, 25 aa, Giardia lamblia
TSQIDWFFNLLRALSNPFAVHRIDF

SEQ ID NO: 3093041 - protein, 30 aa, Giardia lamblia
TSQLKPETLIPPMSQRRLQPGAAGDSDLII

SEQ ID NO: 3093042 - protein, 17 aa, Giardia lamblia
TSRFKVDIWRNAMQRHQ

SEQ ID NO: 3093043 - protein, 25 aa, Giardia lamblia
TSRYKPFWQYFQWSVMESLPKNAAD

SEQ ID NO: 3093044 - protein, 18 aa, Giardia lamblia
TSSFFLKILISSKVLPFD

SEQ ID NO: 3093045 - protein, 17 aa, Giardia lamblia
TSSGFQLSFNILRAIFK

SEQ ID NO: 3093046 - protein, 30 aa, Giardia lamblia
TSSLSEFLITYGPHWIGAPTPLDIISAIPL

SEQ ID NO: 3093047 - protein, 25 aa, Giardia lamblia
TSSRAIPVFLLYENALRAKDSKQIA

SEQ ID NO: 3093048 - protein, 27 aa, Giardia lamblia
TSTDHRLKKLLHIFWPLVECYHGGQLK

SEQ ID NO: 3093049 - protein, 25 aa, Giardia lamblia
TSTESFIIKCLLYCINVSFCMGTTA

SEQ ID NO: 3093050 - protein, 30 aa, Giardia lamblia
TSTPSFLHNFLYWGLIRRRFHLSDYVPLSD

SEQ ID NO: 3093051 - protein, 27 aa, Giardia lamblia
TSVALFQFIGSWLQFNFSLYGQDSPVT

SEQ ID NO: 3093052 - protein, 21 aa, Giardia lamblia
TSVDKVLIRRLAQSIINHLDE

SEQ ID NO: 3093053 - protein, 33 aa, Giardia lamblia
TSVGGVVLLIAIIVGVFFCVKKARKGKAPEGRA

SEQ ID NO: 3093054 - protein, 26 aa, Giardia lamblia
TSYAAPFSIYLINKLIITIGGADLFI

SEQ ID NO: 3093055 - protein, 24 aa, Giardia lamblia
TSYNIILSLLISSPTLRLANLHLL

SEQ ID NO: 3093056 - protein, 21 aa, Giardia lamblia
TTACQACFPGYYHSGTKCFKC

SEQ ID NO: 3093057 - protein, 26 aa, Giardia lamblia
TTAGPYLICVPIKALIQGAATPVTLS

SEQ ID NO: 3093058 - protein, 33 aa, Giardia lamblia
TTAPVILLLVLFLDSYLVFIPYSVIFLSYDMPQ

SEQ ID NO: 3093059 - protein, 25 aa, Giardia lamblia
TTASVLLLHMLFYNTSVAIAFGTVA

SEQ ID NO: 3093060 - protein, 24 aa, Giardia lamblia
TTAYSKILPLVYSPALANTSHRFT

SEQ ID NO: 3093061 - protein, 25 aa, Giardia lamblia
TTCASGYFFHYGSCYKFGGSPGSTV

SEQ ID NO: 3093062 - protein, 27 aa, Giardia lamblia
TTCGNGYFLHYGSCYKFDSSPGSIVCP

SEQ ID NO: 3093063 - protein, 23 aa, Giardia lamblia
TTDNLVHFFSFLGGVEACTSKIL

SEQ ID NO: 3093064 - protein, 18 aa, Giardia lamblia
TTDRKIVLYTLRDYSRDM

SEQ ID NO: 3093065 - protein, 27 aa, Giardia lamblia
TTEMQMSIIRYLLRRTPLQIEHDAILD

SEQ ID NO: 3093066 - protein, 18 aa, Giardia lamblia
TTFNPEKTIIIFSAGRLE

SEQ ID NO: 3093067 - protein, 20 aa, Giardia lamblia
TTFPSLYQWCRLLFGDKQNS

SEQ ID NO: 3093068 - protein, 20 aa, Giardia lamblia
TTFSVLFPFLAKNDAMIDQL

SEQ ID NO: 3093069 - protein, 24 aa, Giardia lamblia
TTGNLGPSLYGALLAFMNPVPHLS

SEQ ID NO: 3093070 - protein, 23 aa, Giardia lamblia
TTGPLMLTLALTTLALAGYLDNA

SEQ ID NO: 3093071 - protein, 17 aa, Giardia lamblia
TTGTRPLFPTITRQDYE

SEQ ID NO: 3093072 - protein, 34 aa, Giardia lamblia
TTIHSHPTLVRLSFIFVLLVVSYQLFSLASDPVK

SEQ ID NO: 3093073 - protein, 39 aa, Giardia lamblia
TTIIVAVVVSLLIIVAVALACWFVLRRRRESRAALKTRV

SEQ ID NO: 3093074 - protein, 25 aa, Giardia lamblia
TTKDSYLLLYLIELSQHLATDPNNY

SEQ ID NO: 3093075 - protein, 17 aa, Giardia lamblia
TTLFSVLRNNNSGFYLG

SEQ ID NO: 3093076 - protein, 30 aa, Giardia lamblia
TTLLDGSLFQKLIAYILRPLCLTDSAQRII

SEQ ID NO: 3093077 - protein, 17 aa, Giardia lamblia
TTLTILLISRRSLKSAG

SEQ ID NO: 3093078 - protein, 26 aa, Giardia lamblia
TTNCSLYVLGLFPKTLENLLGRLLQY

SEQ ID NO: 3093079 - protein, 24 aa, Giardia lamblia
TTNSWIYVSFPCGKTLTFKQKIST

SEQ ID NO: 3093080 - protein, 19 aa, Giardia lamblia
TTPYLIDFPTLDKFVEFTH

SEQ ID NO: 3093081 - protein, 17 aa, Giardia lamblia
TTQLIIVLNKGWLSYVD

SEQ ID NO: 3093082 - protein, 22 aa, Giardia lamblia
TTRIRPLVVYILGSGISTNNQS

SEQ ID NO: 3093083 - protein, 17 aa, Giardia lamblia
TTRLLLCLVCAHLLDAT

SEQ ID NO: 3093084 - protein, 21 aa, Giardia lamblia
TTRMALPLPSPNLSPLLSSSK

SEQ ID NO: 3093085 - protein, 28 aa, Giardia lamblia
TTRSIIVFVRWIIILSSIIPLAMQVSYN

SEQ ID NO: 3093086 - protein, 24 aa, Giardia lamblia
TTRSIPCSIFIFHADMRQMILLGD

SEQ ID NO: 3093087 - protein, 17 aa, Giardia lamblia
TTRSLMYFTIQEDERYK

SEQ ID NO: 3093088 - protein, 31 aa, Giardia lamblia
TTRTLILAVEVPTYISKFLPLLVEASSSPSQ

SEQ ID NO: 3093089 - protein, 48 aa, Giardia lamblia
TTSAIVPYLIIFLFGLVSFALTCSLFSRWYVRWPRYQLSQYVRIYGER

SEQ ID NO: 3093090 - protein, 22 aa, Giardia lamblia
TTSCIYANLALDLLPYNCNSGI

SEQ ID NO: 3093091 - protein, 23 aa, Giardia lamblia
TTSETCFYLFVLDAHRGTADVSL

SEQ ID NO: 3093092 - protein, 24 aa, Giardia lamblia
TTSHRLIITQLLQPGLAASIVNED

SEQ ID NO: 3093093 - protein, 22 aa, Giardia lamblia
TTTGWTALMFAAAGGFTLCVNL

SEQ ID NO: 3093094 - protein, 24 aa, Giardia lamblia
TTTQLCARLSWNQACPYLSTNQIV

SEQ ID NO: 3093095 - protein, 23 aa, Giardia lamblia
TTTRRFPLILDPQSQALTWIKGM

SEQ ID NO: 3093096 - protein, 30 aa, Giardia lamblia
TTTRSIIVFVRWIIILSSIIPLAMQVSYDF

SEQ ID NO: 3093097 - protein, 17 aa, Giardia lamblia
TTVFICMGLIYWGLAML

SEQ ID NO: 3093098 - protein, 22 aa, Giardia lamblia
TTVLILYGVIGLFLCPRRPAQR

SEQ ID NO: 3093099 - protein, 40 aa, Giardia lamblia
TTVTVAVVVSLLIIAAVALACWLVLRRRRGSKIVSRKRTA

SEQ ID NO: 3093100 - protein, 28 aa, Giardia lamblia
TVAFALLELILRIYCFHISAKCIKAYFE

SEQ ID NO: 3093101 - protein, 28 aa, Giardia lamblia
TVALCILLDFLVLLLQSRTLCRAAVQDC

SEQ ID NO: 3093102 - protein, 17 aa, Giardia lamblia
TVAQRIKNKWLFLHIFS

SEQ ID NO: 3093103 - protein, 19 aa, Giardia lamblia
TVAVKLSRSVVISPVICVA

SEQ ID NO: 3093104 - protein, 23 aa, Giardia lamblia
TVCGGVGICKRNGRSYSCDCGDV

SEQ ID NO: 3093105 - protein, 27 aa, Giardia lamblia
TVDGRDFYLLYFKRFIKSSIISNLGQR

SEQ ID NO: 3093106 - protein, 28 aa, Giardia lamblia
TVDKHRIIMTTLLSVLGVGTLTVIIVGL

SEQ ID NO: 3093107 - protein, 18 aa, Giardia lamblia
TVDNLYLRIVTLEDVWTV

SEQ ID NO: 3093108 - protein, 23 aa, Giardia lamblia
TVENQLALLYLPRLVDASPDDTV

SEQ ID NO: 3093109 - protein, 27 aa, Giardia lamblia
TVESQIYLLYFALTNPLDNAALIRRLL

SEQ ID NO: 3093110 - protein, 22 aa, Giardia lamblia
TVFSFIIITVITFVSLARLMIA

SEQ ID NO: 3093111 - protein, 29 aa, Giardia lamblia
TVFSICFLKVFRPDAFFSILTLLAEGATD

SEQ ID NO: 3093112 - protein, 20 aa, Giardia lamblia
TVFSPHHCAIIVALGCAMLS

SEQ ID NO: 3093113 - protein, 25 aa, Giardia lamblia
TVGLSNFVLPFPIPCRNLNQYSTLK

SEQ ID NO: 3093114 - protein, 29 aa, Giardia lamblia
TVHHAFLLLPSILFGLHRQRYRLSGSTIE

SEQ ID NO: 3093115 - protein, 20 aa, Giardia lamblia
TVHYFLRFFERDLNTSESVC

SEQ ID NO: 3093116 - protein, 25 aa, Giardia lamblia
TVIRQNVMTPLMIAAQQGSLRECKN

SEQ ID NO: 3093117 - protein, 17 aa, Giardia lamblia
TVISQRLSTWTIVWIVI

SEQ ID NO: 3093118 - protein, 27 aa, Giardia lamblia
TVIYLLRPLYLIRYISLLILGLIFIFR

SEQ ID NO: 3093119 - protein, 20 aa, Giardia lamblia
TVKALVLVLNTPRGISVGDV

SEQ ID NO: 3093120 - protein, 25 aa, Giardia lamblia
TVKDYIEHLFASIPIPSTCGQQASS

SEQ ID NO: 3093121 - protein, 19 aa, Giardia lamblia
TVKHWCIQARGVFLRPMSV

SEQ ID NO: 3093122 - protein, 24 aa, Giardia lamblia
TVKQNLLQVPWASELYPRPVLCAL

SEQ ID NO: 3093123 - protein, 25 aa, Giardia lamblia
TVKSFLHTFYLAIALLVAGLVFSCF

SEQ ID NO: 3093124 - protein, 18 aa, Giardia lamblia
TVLKYLLLIYKEVVADRA

SEQ ID NO: 3093125 - protein, 17 aa, Giardia lamblia
TVLLERLNFMANPSDKT

SEQ ID NO: 3093126 - protein, 24 aa, Giardia lamblia
TVLNVLPIIQLIPIPGIKISADSL

SEQ ID NO: 3093127 - protein, 17 aa, Giardia lamblia
TVLPLLAFAGGFFCNIF

SEQ ID NO: 3093128 - protein, 18 aa, Giardia lamblia
TVLSSSIPVLIFLVSQEG

SEQ ID NO: 3093129 - protein, 23 aa, Giardia lamblia
TVLVFLYLIRIVWAIIGLTLVAY

SEQ ID NO: 3093130 - protein, 19 aa, Giardia lamblia
TVLVTILHGVLQTPYAMQA

SEQ ID NO: 3093131 - protein, 19 aa, Giardia lamblia
TVMSIIILAPISSTVFKTS

SEQ ID NO: 3093132 - protein, 20 aa, Giardia lamblia
TVMVIKYYMSFKGNPEWSWF

SEQ ID NO: 3093133 - protein, 19 aa, Giardia lamblia
TVPHKLVGALLRHGIEKHY

SEQ ID NO: 3093134 - protein, 24 aa, Giardia lamblia
TVPIFFYTVFFSLCLILTLLKEIL

SEQ ID NO: 3093135 - protein, 17 aa, Giardia lamblia
TVPITLPSTVPYASLRP

SEQ ID NO: 3093136 - protein, 21 aa, Giardia lamblia
TVRGVIGTYLCIPQACVVSET

SEQ ID NO: 3093137 - protein, 23 aa, Giardia lamblia
TVRLWFKLIFTGLELLLASNYIT

SEQ ID NO: 3093138 - protein, 32 aa, Giardia lamblia
TVRNAILTLLIVFLAIIFPAIVILVIIKKNHG

SEQ ID NO: 3093139 - protein, 24 aa, Giardia lamblia
TVRPRYILMKKLGSGGFSTVYKAM

SEQ ID NO: 3093140 - protein, 26 aa, Giardia lamblia
TVRSLVHAVFPMPFLSSILSSQLSSM

SEQ ID NO: 3093141 - protein, 36 aa, Giardia lamblia
TVSEQTFLLCLRPFFTLLSLLHCTLLRQTRPICRAV

SEQ ID NO: 3093142 - protein, 24 aa, Giardia lamblia
TVSLALLFNFRQTANLYASTKLST

SEQ ID NO: 3093143 - protein, 30 aa, Giardia lamblia
TVSLCTHIWANTIFLLDATNYFAPVLRIFT

SEQ ID NO: 3093144 - protein, 32 aa, Giardia lamblia
TVSPILLRYPIICDGLLLPTVIFREVMLKHVI

SEQ ID NO: 3093145 - protein, 19 aa, Giardia lamblia
TVSPTCSIRYLPSSEDILK

SEQ ID NO: 3093146 - protein, 31 aa, Giardia lamblia
TVSRLDACLLYLKLILDPHDSWNLILHGVLS

SEQ ID NO: 3093147 - protein, 25 aa, Giardia lamblia
TVTCDSFPLLIPQLEYQSADCCTII

SEQ ID NO: 3093148 - protein, 27 aa, Giardia lamblia
TVTESVKFMFVTLLGAASSFRAEVRTD

SEQ ID NO: 3093149 - protein, 21 aa, Giardia lamblia
TVTQYFLAFSLTSLLEVRYSE

SEQ ID NO: 3093150 - protein, 18 aa, Giardia lamblia
TVVLAQSLSFTGDIPAGK

SEQ ID NO: 3093151 - protein, 19 aa, Giardia lamblia
TVVPQHDLYWPQLTVRYHV

SEQ ID NO: 3093152 - protein, 23 aa, Giardia lamblia
TVVRACFYTQIAIQWVQYMLYDS

SEQ ID NO: 3093153 - protein, 34 aa, Giardia lamblia
TVVRFEDHLLLLFIKHFRPAFLRIAVNNYIVRSI

SEQ ID NO: 3093154 - protein, 22 aa, Giardia lamblia
TVWISLLLMRVNLYGIVYNNNL

SEQ ID NO: 3093155 - protein, 23 aa, Giardia lamblia
TVYDSFIIYLKHSHPFTGHLHIM

SEQ ID NO: 3093156 - protein, 17 aa, Giardia lamblia
TVYDVLFCNDLLRSYKP

SEQ ID NO: 3093157 - protein, 17 aa, Giardia lamblia
TVYFCCICDLLPTTDEQ

SEQ ID NO: 3093158 - protein, 25 aa, Giardia lamblia
TVYPGRILFFVRPVKRNVQIANAET

SEQ ID NO: 3093159 - protein, 26 aa, Giardia lamblia
TWAKYIRQQYFSKLYLPSVNLEINRL

SEQ ID NO: 3093160 - protein, 24 aa, Giardia lamblia
TWEEILYQGLIARAFNDVDHLALL

SEQ ID NO: 3093161 - protein, 18 aa, Giardia lamblia
TWERFARIIYDSLEGMEE

SEQ ID NO: 3093162 - protein, 17 aa, Giardia lamblia
TWIKQLIDGLLLVKDQI

SEQ ID NO: 3093163 - protein, 23 aa, Giardia lamblia
TWNAKLIAIRLLDSTLDLLPDSA

SEQ ID NO: 3093164 - protein, 22 aa, Giardia lamblia
TWPVMLFIQKFSTNMFLSHSSS

SEQ ID NO: 3093165 - protein, 24 aa, Giardia lamblia
TYADGFCKIYLPKEAFMGGDVRVT

SEQ ID NO: 3093166 - protein, 19 aa, Giardia lamblia
TYFLLCERDIQVNGYKWNF

SEQ ID NO: 3093167 - protein, 26 aa, Giardia lamblia
TYGLSILLWLRLIFIDPGRLPRGCRS

SEQ ID NO: 3093168 - protein, 28 aa, Giardia lamblia
TYKGLYNIHCLLPEIIFLQSVVSLEATQ

SEQ ID NO: 3093169 - protein, 30 aa, Giardia lamblia
TYKHIRHLGWRRVFLGRYMPQLIDLSAQEA

SEQ ID NO: 3093170 - protein, 25 aa, Giardia lamblia
TYKVLFQRDGRLYAMKKKRSATSED

SEQ ID NO: 3093171 - protein, 22 aa, Giardia lamblia
TYLEFYLIYFFTGQYKVSHGLV

SEQ ID NO: 3093172 - protein, 19 aa, Giardia lamblia
TYLQAMGLSFRNLLTFVGL

SEQ ID NO: 3093173 - protein, 22 aa, Giardia lamblia
TYLYVQMSGLLKFLPATFAYSH

SEQ ID NO: 3093174 - protein, 23 aa, Giardia lamblia
TYNRLELDPILYDLLCDPNVQSS

SEQ ID NO: 3093175 - protein, 19 aa, Giardia lamblia
TYRPYTIYFMALKVINPTQ

SEQ ID NO: 3093176 - protein, 33 aa, Giardia lamblia
TYSCETFVRYLLIIIYYVRLCNLETCISRFVDY

SEQ ID NO: 3093177 - protein, 24 aa, Giardia lamblia
TYSDRIIRCMLTFTTLPDARLLTS

SEQ ID NO: 3093178 - protein, 24 aa, Giardia lamblia
TYTFILAIIHRMLFRRPLGGPDSF

SEQ ID NO: 3093179 - protein, 20 aa, Giardia lamblia
TYTGYHMLLLSKGSVCESPY

SEQ ID NO: 3093180 - protein, 25 aa, Giardia lamblia
TYTTELLILSLVRILTDFQLSSNTL

SEQ ID NO: 3093181 - protein, 39 aa, Giardia lamblia
TYVVFVCSHGFFYLYNFLREELVFKFQLPRNAIATYMSA

SEQ ID NO: 3093182 - protein, 22 aa, Giardia lamblia
VAAAIRIMLAQSTRWNAGKTSS

SEQ ID NO: 3093183 - protein, 26 aa, Giardia lamblia
VAAALPLLLIYWLSDNWIVMNFLAAL

SEQ ID NO: 3093184 - protein, 26 aa, Giardia lamblia
VAALLGYFFRPLLGDRVRVYGFGAPP

SEQ ID NO: 3093185 - protein, 17 aa, Giardia lamblia
VACIAYEMCTLRPLYEL

SEQ ID NO: 3093186 - protein, 18 aa, Giardia lamblia
VADDIFYYGQTASFISVI

SEQ ID NO: 3093187 - protein, 22 aa, Giardia lamblia
VADGYFLFNGGCYNANEHPGSA

SEQ ID NO: 3093188 - protein, 25 aa, Giardia lamblia
VADITIGLILLFKRAMQLARIEIAD

SEQ ID NO: 3093189 - protein, 17 aa, Giardia lamblia
VADLNLTAFIGYNKHYY

SEQ ID NO: 3093190 - protein, 29 aa, Giardia lamblia
VADNPLILVFVLIYFVSILFLNWAGMTVT

SEQ ID NO: 3093191 - protein, 18 aa, Giardia lamblia
VAEIFEPFLLGARNLLMS

SEQ ID NO: 3093192 - protein, 23 aa, Giardia lamblia
VAEPFRIGFLLVLALGSLMKCTK

SEQ ID NO: 3093193 - protein, 18 aa, Giardia lamblia
VAETCKIDKLIYGPSERE

SEQ ID NO: 3093194 - protein, 28 aa, Giardia lamblia
VAFIFCYAGLFQIFNFPLGTFSISTIDA

SEQ ID NO: 3093195 - protein, 23 aa, Giardia lamblia
VAFTDTFFFSLVTSVIVDLQGVD

SEQ ID NO: 3093196 - protein, 30 aa, Giardia lamblia
VAGDPNKCDTCMPGYFLVTTTDPQGKKCVA

SEQ ID NO: 3093197 - protein, 37 aa, Giardia lamblia
VAGNYSGSLLFRKIAHMFKFCSSPFRMSTLGVVKILK

SEQ ID NO: 3093198 - protein, 25 aa, Giardia lamblia
VAGRLLHIVILQLVLIAVLIVPFAL

SEQ ID NO: 3093199 - protein, 22 aa, Giardia lamblia
VAHSQFAVLLLAASHRLVYHEG

SEQ ID NO: 3093200 - protein, 24 aa, Giardia lamblia
VAIASFTVILPIAGVRLPTQVACL

SEQ ID NO: 3093201 - protein, 23 aa, Giardia lamblia
VAIDYRLQRKLSLIVPVKANNEN

SEQ ID NO: 3093202 - protein, 24 aa, Giardia lamblia
VAIFLVHLGFCFVAIYFIDGCATC

SEQ ID NO: 3093203 - protein, 21 aa, Giardia lamblia
VAILWSAPELGGVSGALCLQS

SEQ ID NO: 3093204 - protein, 24 aa, Giardia lamblia
VAISVITFYIRLNIRLLKVFHEMK

SEQ ID NO: 3093205 - protein, 37 aa, Giardia lamblia
VAIYTYSTPLKLPLPIIPIFCRSSIIKQILLNGIECP

SEQ ID NO: 3093206 - protein, 29 aa, Giardia lamblia
VAKLPFNNPLYILSILTGLELTFQLSGEL

SEQ ID NO: 3093207 - protein, 25 aa, Giardia lamblia
VALAMLMLDPYYRSMNGFFVLIEKE

SEQ ID NO: 3093208 - protein, 41 aa, Giardia lamblia
VALNIFPSYLTPLFIETFHSTVLLFLRYYPCDPKSISGKAE

SEQ ID NO: 3093209 - protein, 21 aa, Giardia lamblia
VALTCWFVLRRRRESRAALKK

SEQ ID NO: 3093210 - protein, 24 aa, Giardia lamblia
VANNKILRLVPLDSPTTLSLPEPV

SEQ ID NO: 3093211 - protein, 26 aa, Giardia lamblia
VANSTVFYLLLLLSPLFNPFTAVGGA

SEQ ID NO: 3093212 - protein, 31 aa, Giardia lamblia
VAPSFQFSHFLLTLLLSILDLTILLHYDEQP

SEQ ID NO: 3093213 - protein, 32 aa, Giardia lamblia
VAQDIKWFNVAYALIPPLSFFGVLPQFRCLLL

SEQ ID NO: 3093214 - protein, 24 aa, Giardia lamblia
VAQLEPQFIQLLHTFLSSSGQGSS

SEQ ID NO: 3093215 - protein, 21 aa, Giardia lamblia
VAQLSLILAVFLGVTCITTGA

SEQ ID NO: 3093216 - protein, 25 aa, Giardia lamblia
VARELHGPYALFLADGGFLIEGPGG

SEQ ID NO: 3093217 - protein, 44 aa, Giardia lamblia
VARTAIQPYVPIVVGVLVLSVLAGLIGFLSWRFCCKNKKPKHPL

SEQ ID NO: 3093218 - protein, 17 aa, Giardia lamblia
VASFFRIIHQALALQQI

SEQ ID NO: 3093219 - protein, 33 aa, Giardia lamblia
VASVAIVAVIIGCLVWFLLRRKNSGSLNREPSL

SEQ ID NO: 3093220 - protein, 20 aa, Giardia lamblia
VATCNACDPKYFFTGTACVA

SEQ ID NO: 3093221 - protein, 26 aa, Giardia lamblia
VATFIYMFIILFYYTQLRSFCVRIQQ

SEQ ID NO: 3093222 - protein, 37 aa, Giardia lamblia
VATRIIMAMSNYLLRLALSYPAVLYPLICIQSKPFAH

SEQ ID NO: 3093223 - protein, 24 aa, Giardia lamblia
VATRLAAPWPLLLSPDLLLAVRVS

SEQ ID NO: 3093224 - protein, 32 aa, Giardia lamblia
VAVIGVLVGFLCWWFIFRGKRTSAPSNATSIT

SEQ ID NO: 3093225 - protein, 21 aa, Giardia lamblia
VAVLIVVIPIIVSKRRRPRAS

SEQ ID NO: 3093226 - protein, 26 aa, Giardia lamblia
VAVSLAEIIILPVAIVVLAGLIIGLS

SEQ ID NO: 3093227 - protein, 20 aa, Giardia lamblia
VAVYLTLRYATIKSSVPIVR

SEQ ID NO: 3093228 - protein, 23 aa, Giardia lamblia
VAYPLVLYPLKLSIFSYIKIDKD

SEQ ID NO: 3093229 - protein, 23 aa, Giardia lamblia
VCELLAPYEANIYCDRGRDCLMI

SEQ ID NO: 3093230 - protein, 18 aa, Giardia lamblia
VCFILPALLQTSITVVIV

SEQ ID NO: 3093231 - protein, 24 aa, Giardia lamblia
VCIAYPLIQYPLKVSLIAYCQLNP

SEQ ID NO: 3093232 - protein, 24 aa, Giardia lamblia
VCIILMYIIVWVITYYQGAELEDG

SEQ ID NO: 3093233 - protein, 24 aa, Giardia lamblia
VCIPRMLLLMAYKHLVISTKGKEH

SEQ ID NO: 3093234 - protein, 23 aa, Giardia lamblia
VCKQWRSNFNFTFSKAEGGDRYL

SEQ ID NO: 3093235 - protein, 17 aa, Giardia lamblia
VCLCKRGWTGTACDVVA

SEQ ID NO: 3093236 - protein, 25 aa, Giardia lamblia
VCLYVVPNFCLFPKAATRAATATLK

SEQ ID NO: 3093237 - protein, 35 aa, Giardia lamblia
VCMIVFFGSMLWYPFYLPYTLLLLSFCTYYEILHT

SEQ ID NO: 3093238 - protein, 32 aa, Giardia lamblia
VCMRCYMHAYSVWNDPVLVFTKGLFGILSGFT

SEQ ID NO: 3093239 - protein, 22 aa, Giardia lamblia
VCPYGGCFVIGLQACLFLEHVV

SEQ ID NO: 3093240 - protein, 31 aa, Giardia lamblia
VCQVFCGCFPLKKSLFKLVTSLSYEVFHGMD

SEQ ID NO: 3093241 - protein, 23 aa, Giardia lamblia
VCSTQLFFTSNLVIWVVPDPVAG

SEQ ID NO: 3093242 - protein, 22 aa, Giardia lamblia
VCTKCGFSSFLFNGGCVSKSSS

SEQ ID NO: 3093243 - protein, 18 aa, Giardia lamblia
VCVHPLLFNRPGGAYHCL

SEQ ID NO: 3093244 - protein, 17 aa, Giardia lamblia
VCVYNQLTGRYGCECEG

SEQ ID NO: 3093245 - protein, 25 aa, Giardia lamblia
VDAIKPRWTIFMAGIFMTAGSLVIA

SEQ ID NO: 3093246 - protein, 18 aa, Giardia lamblia
VDCLLRIKELLGGDLKVQ

SEQ ID NO: 3093247 - protein, 34 aa, Giardia lamblia
VDEASPMLHFAMLYIRLFGLFARELTPVICSLFA

SEQ ID NO: 3093248 - protein, 21 aa, Giardia lamblia
VDFLTNFYKFPTTLQHMTRNH

SEQ ID NO: 3093249 - protein, 18 aa, Giardia lamblia
VDGLALKNALLSAGVPVS

SEQ ID NO: 3093250 - protein, 19 aa, Giardia lamblia
VDGVCIMPRLSSAAIAGIS

SEQ ID NO: 3093251 - protein, 23 aa, Giardia lamblia
VDGYIDYLPLLHNTSFFDTDESY

SEQ ID NO: 3093252 - protein, 21 aa, Giardia lamblia
VDHLALLNASFRAIGPLPADH

SEQ ID NO: 3093253 - protein, 24 aa, Giardia lamblia
VDILIEGMRYFFLSKTVTISSEGH

SEQ ID NO: 3093254 - protein, 40 aa, Giardia lamblia
VDISRSCILYPPPTLWKGQSLYLNIMRPFKQLISNDISSF

SEQ ID NO: 3093255 - protein, 27 aa, Giardia lamblia
VDITEPCLQFLLMKLQMMQLRSMKANM

SEQ ID NO: 3093256 - protein, 24 aa, Giardia lamblia
VDKNSLLLTIEDLNILVLSLSGNH

SEQ ID NO: 3093257 - protein, 23 aa, Giardia lamblia
VDLSPLLDILMSLLSNKLTTNES

SEQ ID NO: 3093258 - protein, 19 aa, Giardia lamblia
VDLVILSEFKGRCFFCLPD

SEQ ID NO: 3093259 - protein, 17 aa, Giardia lamblia
VDLVSLYLDKVFTLLAE

SEQ ID NO: 3093260 - protein, 25 aa, Giardia lamblia
VDMYVRILLIYLELITLLDCTQSDL

SEQ ID NO: 3093261 - protein, 24 aa, Giardia lamblia
VDNRFLCVAGFIDGLPIFRSGNPI

SEQ ID NO: 3093262 - protein, 27 aa, Giardia lamblia
VDNYVFFLGVIRIFGYNFPLVCKPAVP

SEQ ID NO: 3093263 - protein, 17 aa, Giardia lamblia
VDPLNSVSFHTAALELV

SEQ ID NO: 3093264 - protein, 26 aa, Giardia lamblia
VDRTTLFQTILLQKVFKYYARTKALD

SEQ ID NO: 3093265 - protein, 22 aa, Giardia lamblia
VDRYVYVRILNSMLPTAQTIAA

SEQ ID NO: 3093266 - protein, 41 aa, Giardia lamblia
VDVMAALKPYLPLLVAMGVLLVLPFVLGLCFNIALVCIAPC

SEQ ID NO: 3093267 - protein, 31 aa, Giardia lamblia
VDVPVEIYTLLRGVFLLLTYTITVQSLASRS

SEQ ID NO: 3093268 - protein, 25 aa, Giardia lamblia
VDYFGALHPILRRTGLTWTNLNFAN

SEQ ID NO: 3093269 - protein, 30 aa, Giardia lamblia
VDYFKDILEYFFIFATIWASGGTMFKDQLT

SEQ ID NO: 3093270 - protein, 31 aa, Giardia lamblia
VEDILRLEVKLLKHKYIQQHLKHGAAIKKVQ

SEQ ID NO: 3093271 - protein, 28 aa, Giardia lamblia
VEFAAYFATPIPLYLITAAEVSIFVIYS

SEQ ID NO: 3093272 - protein, 44 aa, Giardia lamblia
VEHILSPFFMFQLFTSILWLFDDFAVYSFFTSVMLLFMEGGNIL

SEQ ID NO: 3093273 - protein, 24 aa, Giardia lamblia
VEHKLIPAFLGYIPLASSEVVPRL

SEQ ID NO: 3093274 - protein, 27 aa, Giardia lamblia
VEHMSLRIPWQSFWKENISIKVSTVYV

SEQ ID NO: 3093275 - protein, 18 aa, Giardia lamblia
VEICSILISYEFGLTTHH

SEQ ID NO: 3093276 - protein, 18 aa, Giardia lamblia
VEITISVIVLLMSVGFMV

SEQ ID NO: 3093277 - protein, 18 aa, Giardia lamblia
VEKNYFIHEGGCYNILYS

SEQ ID NO: 3093278 - protein, 28 aa, Giardia lamblia
VEKSEVVRLLLLKLLLRIIHTCNESNPS

SEQ ID NO: 3093279 - protein, 17 aa, Giardia lamblia
VELLELLCRQSSITAIL

SEQ ID NO: 3093280 - protein, 22 aa, Giardia lamblia
VEREFTAFLNQPAILYPSAAVV

SEQ ID NO: 3093281 - protein, 26 aa, Giardia lamblia
VESAIFLFGFPLYRGIPTVISYISSH

SEQ ID NO: 3093282 - protein, 25 aa, Giardia lamblia
VETRVLPIFFSFLRSLFQGEPVVNK

SEQ ID NO: 3093283 - protein, 28 aa, Giardia lamblia
VETYVDQLTLWTLLPDVEGRLAIKGIFT

SEQ ID NO: 3093284 - protein, 19 aa, Giardia lamblia
VEVVVSWPLQAVLYNTGHC

SEQ ID NO: 3093285 - protein, 18 aa, Giardia lamblia
VEWAHCTPYHLFLNTLGD

SEQ ID NO: 3093286 - protein, 31 aa, Giardia lamblia
VEYAVRLLQPGRMLLEFLLLGAESLESEYIY

SEQ ID NO: 3093287 - protein, 27 aa, Giardia lamblia
VEYQTIFLFLIIIQGALQIVLPSLLSN

SEQ ID NO: 3093288 - protein, 17 aa, Giardia lamblia
VFAAYDVVLPYLEALPN

SEQ ID NO: 3093289 - protein, 18 aa, Giardia lamblia
VFALLSDGSLAVLYPNDN

SEQ ID NO: 3093290 - protein, 28 aa, Giardia lamblia
VFDKVAYRSIHFWAVPSLAPNTFKFQAQ

SEQ ID NO: 3093291 - protein, 18 aa, Giardia lamblia
VFDLLESWQYHKLDTILL

SEQ ID NO: 3093292 - protein, 24 aa, Giardia lamblia
VFDSRLISCLIGGRLYLDNEINNK

SEQ ID NO: 3093293 - protein, 27 aa, Giardia lamblia
VFDYLVSSPTYVRYALPSSANILKILI

SEQ ID NO: 3093294 - protein, 26 aa, Giardia lamblia
VFEKDKLVFAFLLATRILQIQGDIGL

SEQ ID NO: 3093295 - protein, 28 aa, Giardia lamblia
VFESFTVLDNIYLCALYRGALDTTRACM

SEQ ID NO: 3093296 - protein, 17 aa, Giardia lamblia
VFFASACGTGPACVNGD

SEQ ID NO: 3093297 - protein, 21 aa, Giardia lamblia
VFFISYNFIALMVATLVLVIA

SEQ ID NO: 3093298 - protein, 20 aa, Giardia lamblia
VFFLLAIVCFAAVLAILAIL

SEQ ID NO: 3093299 - protein, 17 aa, Giardia lamblia
VFFRQTRHLLTHSSISC

SEQ ID NO: 3093300 - protein, 18 aa, Giardia lamblia
VFFTPIQLCTVPGNPFLL

SEQ ID NO: 3093301 - protein, 26 aa, Giardia lamblia
VFGEALALYGLIIALILNFSGSNGGN

SEQ ID NO: 3093302 - protein, 18 aa, Giardia lamblia
VFGFLPRSADTVKNMVEC

SEQ ID NO: 3093303 - protein, 20 aa, Giardia lamblia
VFGFYMFRRLYSLARSYFSP

SEQ ID NO: 3093304 - protein, 23 aa, Giardia lamblia
VFGLFLTVGVAFPIAWAIPGDDH

SEQ ID NO: 3093305 - protein, 26 aa, Giardia lamblia
VFGVIIFQLFPLMVVYKLPLLKKNSV

SEQ ID NO: 3093306 - protein, 22 aa, Giardia lamblia
VFGWFSIICWIIATYPQMRMSF

SEQ ID NO: 3093307 - protein, 32 aa, Giardia lamblia
VFICMGLIYWGLAMLILLPLLPNILSMFNATN

SEQ ID NO: 3093308 - protein, 20 aa, Giardia lamblia
VFICYLIYACPEHNLSCSYN

SEQ ID NO: 3093309 - protein, 19 aa, Giardia lamblia
VFIFRAFSHIFELGVSIFM

SEQ ID NO: 3093310 - protein, 32 aa, Giardia lamblia
VFISAMGYGPWLPTAMMITVVLRNARLFDILS

SEQ ID NO: 3093311 - protein, 21 aa, Giardia lamblia
VFIWLLTFCISFNFLSAPSLS

SEQ ID NO: 3093312 - protein, 32 aa, Giardia lamblia
VFKGLSTYNRTVIPYYYWWDGTNNNVLQSLGT

SEQ ID NO: 3093313 - protein, 19 aa, Giardia lamblia
VFLHLLRIYGSSVAVTEPF

SEQ ID NO: 3093314 - protein, 19 aa, Giardia lamblia
VFLNDFYIQILTNELLHSN

SEQ ID NO: 3093315 - protein, 21 aa, Giardia lamblia
VFLNIFVLPMLQLNTEFLPTY

SEQ ID NO: 3093316 - protein, 17 aa, Giardia lamblia
VFLQHIVLDKSLLAGHM

SEQ ID NO: 3093317 - protein, 26 aa, Giardia lamblia
VFLSVALLQSIIFPIEAFLTNLTAID

SEQ ID NO: 3093318 - protein, 20 aa, Giardia lamblia
VFSQHFVHLFSLLPDDMKNG

SEQ ID NO: 3093319 - protein, 23 aa, Giardia lamblia
VFTIVVLLYQKKPVPWKLYLWTR

SEQ ID NO: 3093320 - protein, 30 aa, Giardia lamblia
VFTTILRVVPIWYFYCYPKNFLGYETVSFY

SEQ ID NO: 3093321 - protein, 17 aa, Giardia lamblia
VFVLLAEGISFIPTALN

SEQ ID NO: 3093322 - protein, 17 aa, Giardia lamblia
VFVQQLLGYVWEVYPFI

SEQ ID NO: 3093323 - protein, 35 aa, Giardia lamblia
VGAWLCPVVFIIHLCVALIIVYFLDAGRKRHTCKR

SEQ ID NO: 3093324 - protein, 26 aa, Giardia lamblia
VGCHYFFFLGVHFFVRMRILASSIFA

SEQ ID NO: 3093325 - protein, 31 aa, Giardia lamblia
VGDISPMLVLLLVCYFLKIAFKTSSEEKDLN

SEQ ID NO: 3093326 - protein, 22 aa, Giardia lamblia
VGECMAYIFSGFYEQWMIGPSS

SEQ ID NO: 3093327 - protein, 37 aa, Giardia lamblia
VGELKTLLYTWNDPAIDQLLLLLSQEYSLYNLNTNVI

SEQ ID NO: 3093328 - protein, 19 aa, Giardia lamblia
VGFLQRLVFVQACGLEFYR

SEQ ID NO: 3093329 - protein, 24 aa, Giardia lamblia
VGFTAFLMVIVLAGLGLMTSTHRV

SEQ ID NO: 3093330 - protein, 23 aa, Giardia lamblia
VGFVQRKPIFIYSDKLRGYNLLD

SEQ ID NO: 3093331 - protein, 17 aa, Giardia lamblia
VGGFRSDYLLHYVKTMS

SEQ ID NO: 3093332 - protein, 39 aa, Giardia lamblia
VGGSVAGVLVWFFLFRNRKGPMKKSPRRRFHPDETSTSL

SEQ ID NO: 3093333 - protein, 19 aa, Giardia lamblia
VGGVSSFLCSCSHIYTGEN

SEQ ID NO: 3093334 - protein, 18 aa, Giardia lamblia
VGIPGFPAVFIQLPESIT

SEQ ID NO: 3093335 - protein, 29 aa, Giardia lamblia
VGKAQIPLTIFFINDSINPLLPPPECIEN

SEQ ID NO: 3093336 - protein, 17 aa, Giardia lamblia
VGKDLFFNELVNLNHVM

SEQ ID NO: 3093337 - protein, 19 aa, Giardia lamblia
VGKLRPFFIHSLADLHENI

SEQ ID NO: 3093338 - protein, 24 aa, Giardia lamblia
VGKSRTLLKLLVALQGAFGMIIKK

SEQ ID NO: 3093339 - protein, 26 aa, Giardia lamblia
VGLFNYWKITNLPRFLLVLPSTFLCL

SEQ ID NO: 3093340 - protein, 26 aa, Giardia lamblia
VGLIFNVLVLVYVYHSGVPAPMRMGI

SEQ ID NO: 3093341 - protein, 28 aa, Giardia lamblia
VGLRNHGYFLRFLLFGVLGSLTSCLINI

SEQ ID NO: 3093342 - protein, 19 aa, Giardia lamblia
VGLYFLLAIVCRSYHLNGG

SEQ ID NO: 3093343 - protein, 27 aa, Giardia lamblia
VGNYSFLLARKILFKITPHSGKAYAAA

SEQ ID NO: 3093344 - protein, 25 aa, Giardia lamblia
VGPAVPGPILCLSEAGPYVPVVPPA

SEQ ID NO: 3093345 - protein, 34 aa, Giardia lamblia
VGRNYVLISMAPFLLALALLLVPIGTFICGIVGA

SEQ ID NO: 3093346 - protein, 25 aa, Giardia lamblia
VGSGGQYRCSCSDGFFLITPTQCVS

SEQ ID NO: 3093347 - protein, 24 aa, Giardia lamblia
VGSPDSLLAPHQTALMLACFYGHL

SEQ ID NO: 3093348 - protein, 24 aa, Giardia lamblia
VGTCQIYQRIYKAGLTYLTELGNK

SEQ ID NO: 3093349 - protein, 32 aa, Giardia lamblia
VGTLETYVLVHILLSIYTSRRTVFNMHLIDLF

SEQ ID NO: 3093350 - protein, 34 aa, Giardia lamblia
VGVAMLVAVVVFIILWFTVIKKKLEERKRRRFDG

SEQ ID NO: 3093351 - protein, 26 aa, Giardia lamblia
VGVNMTLILFVLYYGVTHSISWFQCL

SEQ ID NO: 3093352 - protein, 25 aa, Giardia lamblia
VGYHYSFFDVLMTFSFNLSICVITG

SEQ ID NO: 3093353 - protein, 25 aa, Giardia lamblia
VGYMTWPAMLLCAFLSMLKAGTFTT

SEQ ID NO: 3093354 - protein, 24 aa, Giardia lamblia
VGYMTWPAMLLCAFLSVLSGHPYD

SEQ ID NO: 3093355 - protein, 27 aa, Giardia lamblia
VGYPHRLHRLLIFLLGGAYKLKGEAVI

SEQ ID NO: 3093356 - protein, 24 aa, Giardia lamblia
VGYVKAFLYMHGNYNKRGYNALHL

SEQ ID NO: 3093357 - protein, 31 aa, Giardia lamblia
VHATFYAKLCIPPLCVIYLLGLIYEFNSEPN

SEQ ID NO: 3093358 - protein, 26 aa, Giardia lamblia
VHAVSFFIWFLFVDKILTQTLFWTPE

SEQ ID NO: 3093359 - protein, 24 aa, Giardia lamblia
VHCLSTCILLNYTTRDYSFIAEAP

SEQ ID NO: 3093360 - protein, 19 aa, Giardia lamblia
VHGWPWMVVIIAAPMGVMY

SEQ ID NO: 3093361 - protein, 35 aa, Giardia lamblia
VHHQPSFLSHLPLSMPFERVLEHLAYIRGYQIYYS

SEQ ID NO: 3093362 - protein, 20 aa, Giardia lamblia
VHIYLLYLVAFVIAIYRLCC

SEQ ID NO: 3093363 - protein, 17 aa, Giardia lamblia
VHMARYLEFLDNQKYLQ

SEQ ID NO: 3093364 - protein, 17 aa, Giardia lamblia
VHNALFTQKSHLSFLYS

SEQ ID NO: 3093365 - protein, 17 aa, Giardia lamblia
VHNGPWITLSLSTFILF

SEQ ID NO: 3093366 - protein, 26 aa, Giardia lamblia
VHNYRKAALLFLNERYREALLFCTYQ

SEQ ID NO: 3093367 - protein, 25 aa, Giardia lamblia
VHSEHIYFTWLIEAFSTMQRGWATL

SEQ ID NO: 3093368 - protein, 24 aa, Giardia lamblia
VHSHIVLPDHLLTKVFSCFLESEV

SEQ ID NO: 3093369 - protein, 24 aa, Giardia lamblia
VHVLGALCLKTPAAWYSLVTFVLK

SEQ ID NO: 3093370 - protein, 20 aa, Giardia lamblia
VHYSGGYIIIFTMEGKIWRL

SEQ ID NO: 3093371 - protein, 40 aa, Giardia lamblia
VIAGSVIAVLLVLGGVIGFCVWWFLVRGKKGQAAQKGRRG

SEQ ID NO: 3093372 - protein, 26 aa, Giardia lamblia
VIANSLTWFLKHHAAFVCFSRCEQPF

SEQ ID NO: 3093373 - protein, 21 aa, Giardia lamblia
VIDIATFFYEALRLTGSPQPT

SEQ ID NO: 3093374 - protein, 17 aa, Giardia lamblia
VIDLKLCQISLLLFLHL

SEQ ID NO: 3093375 - protein, 22 aa, Giardia lamblia
VIDVYWMVMIIRMIAGIFRLEV

SEQ ID NO: 3093376 - protein, 24 aa, Giardia lamblia
VIEMTTIHYYKLPLVLTQIINPTS

SEQ ID NO: 3093377 - protein, 24 aa, Giardia lamblia
VIFHITMVMMCPYILGLYESESEK

SEQ ID NO: 3093378 - protein, 19 aa, Giardia lamblia
VIFLGFLACMFYVGAYFEP

SEQ ID NO: 3093379 - protein, 19 aa, Giardia lamblia
VIFVGIMILNYMPGITIVS

SEQ ID NO: 3093380 - protein, 20 aa, Giardia lamblia
VIITFVCFLHLAYGANWPIP

SEQ ID NO: 3093381 - protein, 17 aa, Giardia lamblia
VIIYIINIVIFALAVGA

SEQ ID NO: 3093382 - protein, 23 aa, Giardia lamblia
VIKYVSLCSPFYASILKLFIEGK

SEQ ID NO: 3093383 - protein, 33 aa, Giardia lamblia
VILGHLYGFFFYLLFHYVSWPYIWSRFFGMTFA

SEQ ID NO: 3093384 - protein, 27 aa, Giardia lamblia
VIMILRSMYRRLILIFSQNVEEIWSFC

SEQ ID NO: 3093385 - protein, 18 aa, Giardia lamblia
VIPLELNRWTTLAVDMDQ

SEQ ID NO: 3093386 - protein, 17 aa, Giardia lamblia
VIPLSLDQKPNISPDRE

SEQ ID NO: 3093387 - protein, 23 aa, Giardia lamblia
VIPSGHVFLLINLSGVLLSAATK

SEQ ID NO: 3093388 - protein, 18 aa, Giardia lamblia
VIQLIEPTGLIITTIFSV

SEQ ID NO: 3093389 - protein, 23 aa, Giardia lamblia
VISALIGFLCWWFICRGKRRYYR

SEQ ID NO: 3093390 - protein, 24 aa, Giardia lamblia
VISFIGNLFSYCNPLFIQRVISVY

SEQ ID NO: 3093391 - protein, 25 aa, Giardia lamblia
VISHILLPYINARVYRMVPKAWGMP

SEQ ID NO: 3093392 - protein, 21 aa, Giardia lamblia
VISQPLALCLYATSAFLSFRN

SEQ ID NO: 3093393 - protein, 24 aa, Giardia lamblia
VISVWILCVLFKRTAFDIPIKTSL

SEQ ID NO: 3093394 - protein, 30 aa, Giardia lamblia
VITQILTPMFAKFPKVRRYFSVSFTSTVEP

SEQ ID NO: 3093395 - protein, 25 aa, Giardia lamblia
VIVAILLVPFMFLRDASKLSRIGIF

SEQ ID NO: 3093396 - protein, 18 aa, Giardia lamblia
VIVELPKLPLPAVAAVYR

SEQ ID NO: 3093397 - protein, 20 aa, Giardia lamblia
VIVFVQMEYCSHGCLSGFIQ

SEQ ID NO: 3093398 - protein, 23 aa, Giardia lamblia
VIVLLLNQVLRPALLKLAKCEIP

SEQ ID NO: 3093399 - protein, 25 aa, Giardia lamblia
VIVLPFNIIIACSCNPPTDAGRSLL

SEQ ID NO: 3093400 - protein, 23 aa, Giardia lamblia
VIVLSILVLYFFVSHLMLCCSCS

SEQ ID NO: 3093401 - protein, 20 aa, Giardia lamblia
VIVVPFILRAGVSQLYHYHM

SEQ ID NO: 3093402 - protein, 21 aa, Giardia lamblia
VIYCKICATNYLPINGKCVDS

SEQ ID NO: 3093403 - protein, 24 aa, Giardia lamblia
VKCDDSMLWCLSCRGPGACTECKA

SEQ ID NO: 3093404 - protein, 18 aa, Giardia lamblia
VKDHSWEILRRYLRQRDV

SEQ ID NO: 3093405 - protein, 24 aa, Giardia lamblia
VKGCLNCVPPIGSNTGSVLCYLMK

SEQ ID NO: 3093406 - protein, 23 aa, Giardia lamblia
VKKDDYLLLSQFVKSCASDLSRI

SEQ ID NO: 3093407 - protein, 25 aa, Giardia lamblia
VKKVYVMFVCCMCARLLYSNLRRRA

SEQ ID NO: 3093408 - protein, 22 aa, Giardia lamblia
VKLIPLLDKDVPDDAALLQALD

SEQ ID NO: 3093409 - protein, 25 aa, Giardia lamblia
VKLSIPLPDFKPSTLYYLAVFCVLT

SEQ ID NO: 3093410 - protein, 18 aa, Giardia lamblia
VKMLMYSGLFVYLVIRGA

SEQ ID NO: 3093411 - protein, 26 aa, Giardia lamblia
VKNPLLINILFIVMVTFGCVFLVLAI

SEQ ID NO: 3093412 - protein, 18 aa, Giardia lamblia
VKNYLLTFLASCSDMQAL

SEQ ID NO: 3093413 - protein, 24 aa, Giardia lamblia
VKRVTLSFDLFSSVSALCIRILYI

SEQ ID NO: 3093414 - protein, 25 aa, Giardia lamblia
VKSDGEYHCRCPDMLIAVSGECTSP

SEQ ID NO: 3093415 - protein, 20 aa, Giardia lamblia
VKSFIIWHEAKHLGTLASHM

SEQ ID NO: 3093416 - protein, 23 aa, Giardia lamblia
VKSKKCILNYPDLPKLRREKKIK

SEQ ID NO: 3093417 - protein, 25 aa, Giardia lamblia
VKSLLGNYITTISEILLVLGKQVQQ

SEQ ID NO: 3093418 - protein, 26 aa, Giardia lamblia
VKVMPPKLALLFLETIVLAGQYVFVI

SEQ ID NO: 3093419 - protein, 21 aa, Giardia lamblia
VLAGLSLCIDALWSESTIMGV

SEQ ID NO: 3093420 - protein, 18 aa, Giardia lamblia
VLAILRLFHVLVSDSTKP

SEQ ID NO: 3093421 - protein, 17 aa, Giardia lamblia
VLALSQAIQADDSSTPY

SEQ ID NO: 3093422 - protein, 22 aa, Giardia lamblia
VLCCLCVTTVLLITVAYMRAAA

SEQ ID NO: 3093423 - protein, 19 aa, Giardia lamblia
VLCDELSFFLKPKKRFCMH

SEQ ID NO: 3093424 - protein, 24 aa, Giardia lamblia
VLCPIGFIFILISCILTAAMFSSS

SEQ ID NO: 3093425 - protein, 23 aa, Giardia lamblia
VLCTTLSSYKWLIGFSKLEDSFL

SEQ ID NO: 3093426 - protein, 27 aa, Giardia lamblia
VLDDIISKTPLLTRLRPYHDLVRSYLR

SEQ ID NO: 3093427 - protein, 29 aa, Giardia lamblia
VLDEKRHIIYIFLSPYWSSPTDYRYTPVF

SEQ ID NO: 3093428 - protein, 26 aa, Giardia lamblia
VLDPCLSLLTRLLPYIPYCIDTEYPS

SEQ ID NO: 3093429 - protein, 33 aa, Giardia lamblia
VLDPTIMPSPLTWILSLLFPSFNIQHIFDFMML

SEQ ID NO: 3093430 - protein, 27 aa, Giardia lamblia
VLENQITLPGSIRSFGFLAGDAVDPYL

SEQ ID NO: 3093431 - protein, 25 aa, Giardia lamblia
VLFSSPFCLVYYVSFSYKLDFLGML

SEQ ID NO: 3093432 - protein, 21 aa, Giardia lamblia
VLGIWAGRYLLDPLAAYACLA

SEQ ID NO: 3093433 - protein, 25 aa, Giardia lamblia
VLGYFVFKLSLLRKMDFGMILLVFT

SEQ ID NO: 3093434 - protein, 18 aa, Giardia lamblia
VLHVLHNFIFLCVHYKMT

SEQ ID NO: 3093435 - protein, 18 aa, Giardia lamblia
VLIELACTYLLQAKLIDA

SEQ ID NO: 3093436 - protein, 18 aa, Giardia lamblia
VLKDLQSLVLFDPSAYDS

SEQ ID NO: 3093437 - protein, 24 aa, Giardia lamblia
VLKKTFLHRIVVRGLYDLAAEQNQ

SEQ ID NO: 3093438 - protein, 17 aa, Giardia lamblia
VLKKYDGLRAKNIFDRR

SEQ ID NO: 3093439 - protein, 17 aa, Giardia lamblia
VLLCAVMTTLAFYFLIK

SEQ ID NO: 3093440 - protein, 19 aa, Giardia lamblia
VLLELFKYPIVLTSTVSGK

SEQ ID NO: 3093441 - protein, 17 aa, Giardia lamblia
VLLGYPIYAPESKMFAL

SEQ ID NO: 3093442 - protein, 20 aa, Giardia lamblia
VLLQNIHLMKIWQVKLEKMM

SEQ ID NO: 3093443 - protein, 26 aa, Giardia lamblia
VLLVSLNFHVWDYPLAPRKTINPPLG

SEQ ID NO: 3093444 - protein, 23 aa, Giardia lamblia
VLLWSTALPYICGFLLEGLAFIG

SEQ ID NO: 3093445 - protein, 20 aa, Giardia lamblia
VLMEVAVQSMRWIFHRLALS

SEQ ID NO: 3093446 - protein, 17 aa, Giardia lamblia
VLMMLQSLRNPHGFRKQ

SEQ ID NO: 3093447 - protein, 18 aa, Giardia lamblia
VLPCVKLPRHVHIQLDCS

SEQ ID NO: 3093448 - protein, 18 aa, Giardia lamblia
VLPHDPIEYSPAGKLVSF

SEQ ID NO: 3093449 - protein, 17 aa, Giardia lamblia
VLRDVPFPTGSLAEPWS

SEQ ID NO: 3093450 - protein, 17 aa, Giardia lamblia
VLRFCLSKGFITLFLDP

SEQ ID NO: 3093451 - protein, 24 aa, Giardia lamblia
VLRGSLLLNFWRTGETAQSGVAKY

SEQ ID NO: 3093452 - protein, 19 aa, Giardia lamblia
VLRLSWPGRFSEFPFFSKL

SEQ ID NO: 3093453 - protein, 18 aa, Giardia lamblia
VLRMGKYREWLQHIDVLH

SEQ ID NO: 3093454 - protein, 21 aa, Giardia lamblia
VLRVYVLLPSLLTETVRIKIK

SEQ ID NO: 3093455 - protein, 17 aa, Giardia lamblia
VLRYYKHIMGLIEAYNS

SEQ ID NO: 3093456 - protein, 37 aa, Giardia lamblia
VLSAFHTLYKLLIKPPLIILLFLASRLRHLIYSLCAA

SEQ ID NO: 3093457 - protein, 24 aa, Giardia lamblia
VLSELKARLKPMNATALMVAAASN

SEQ ID NO: 3093458 - protein, 27 aa, Giardia lamblia
VLSHFLRAFWIPPHYHYVVYSVLNFGL

SEQ ID NO: 3093459 - protein, 24 aa, Giardia lamblia
VLSKWLSMLLKQLSSPEIHKKLPY

SEQ ID NO: 3093460 - protein, 32 aa, Giardia lamblia
VLSLQSAVFPWERLLLRLAGWQRGVPILKNVY

SEQ ID NO: 3093461 - protein, 23 aa, Giardia lamblia
VLSPYYVFFSLFQYAICYAITEI

SEQ ID NO: 3093462 - protein, 24 aa, Giardia lamblia
VLSTSLNLLFVGSSMLFALKTGTF

SEQ ID NO: 3093463 - protein, 21 aa, Giardia lamblia
VLSWITHVLFIQSSLVYVSAG

SEQ ID NO: 3093464 - protein, 26 aa, Giardia lamblia
VLTFRHVFNCLLLYTQALFSGDSYGA

SEQ ID NO: 3093465 - protein, 23 aa, Giardia lamblia
VLTLAHSYIILLKTLLSNEVTIA

SEQ ID NO: 3093466 - protein, 37 aa, Giardia lamblia
VLTSGDTKPFFAMKSYMSLFFAVLGLVIVNSIAYNVI

SEQ ID NO: 3093467 - protein, 30 aa, Giardia lamblia
VLVGFLVYDFITIPFRIGFAISLIGEAIIL

SEQ ID NO: 3093468 - protein, 33 aa, Giardia lamblia
VLVRHPAILVFILLYPALLILFLSSASVKKPLL

SEQ ID NO: 3093469 - protein, 19 aa, Giardia lamblia
VLVSENLHVWRSLATLCIQ

SEQ ID NO: 3093470 - protein, 17 aa, Giardia lamblia
VLYVSISMLYILIVFLE

SEQ ID NO: 3093471 - protein, 19 aa, Giardia lamblia
VMAGVLYRFLQEADRRPFL

SEQ ID NO: 3093472 - protein, 18 aa, Giardia lamblia
VMFLYRRSRSLRKVTELS

SEQ ID NO: 3093473 - protein, 21 aa, Giardia lamblia
VMFLYSIVILTSFPVMLYPIR

SEQ ID NO: 3093474 - protein, 18 aa, Giardia lamblia
VMGAVMCLLDTPGKLPKD

SEQ ID NO: 3093475 - protein, 20 aa, Giardia lamblia
VMIVALYSSLGFSVDFPDPE

SEQ ID NO: 3093476 - protein, 25 aa, Giardia lamblia
VMKEDKTKCFGSCLALGLGYYNDAG

SEQ ID NO: 3093477 - protein, 18 aa, Giardia lamblia
VMLFLEIYLTARGIAKRK

SEQ ID NO: 3093478 - protein, 17 aa, Giardia lamblia
VMLSWSPRDDILAVAAR

SEQ ID NO: 3093479 - protein, 25 aa, Giardia lamblia
VMQLYDAYTFSFRVLERYNAKVQEI

SEQ ID NO: 3093480 - protein, 30 aa, Giardia lamblia
VMRDFAFERIMGYALICLKSAYSHGDLIST

SEQ ID NO: 3093481 - protein, 19 aa, Giardia lamblia
VMSVFRALAPSEFLYRMMP

SEQ ID NO: 3093482 - protein, 18 aa, Giardia lamblia
VMTFGLLDVLLCLGIERA

SEQ ID NO: 3093483 - protein, 20 aa, Giardia lamblia
VMTGLLTALFFSIIPGFIQR

SEQ ID NO: 3093484 - protein, 27 aa, Giardia lamblia
VMTNKPGDFRFILGPLAYAAQSGRWIS

SEQ ID NO: 3093485 - protein, 26 aa, Giardia lamblia
VMYRMMTYLPFYSRYFNRAKASYGHL

SEQ ID NO: 3093486 - protein, 29 aa, Giardia lamblia
VNGAAPLMSLFGFLFFMTSSSFDVANAYT

SEQ ID NO: 3093487 - protein, 23 aa, Giardia lamblia
VNIALGAIMLRKVRAEMIVFAKL

SEQ ID NO: 3093488 - protein, 17 aa, Giardia lamblia
VNIDCNLLLPACRALII

SEQ ID NO: 3093489 - protein, 19 aa, Giardia lamblia
VNINGLLKTLPLLCTRLLS

SEQ ID NO: 3093490 - protein, 23 aa, Giardia lamblia
VNLDRRLFYLVISALAGLQMSRY

SEQ ID NO: 3093491 - protein, 29 aa, Giardia lamblia
VNLSAGHALLYKLYYWSCSDTCCAISTSG

SEQ ID NO: 3093492 - protein, 24 aa, Giardia lamblia
VNMQTPYCICFPRYYIVSADEGMA

SEQ ID NO: 3093493 - protein, 18 aa, Giardia lamblia
VNPILPVLAFLAVAFEMS

SEQ ID NO: 3093494 - protein, 26 aa, Giardia lamblia
VNPNKAAMFPGFSLAAMMCLRPAKYT

SEQ ID NO: 3093495 - protein, 43 aa, Giardia lamblia
VNSKYYKLWFKAGGTWRFVIYVVMWVFCILMLQLASLLINFWT

SEQ ID NO: 3093496 - protein, 27 aa, Giardia lamblia
VNSQLFVHWKHLSVRFFFNVFEETKAS

SEQ ID NO: 3093497 - protein, 17 aa, Giardia lamblia
VNSRFTCVCVSSSFIVD

SEQ ID NO: 3093498 - protein, 25 aa, Giardia lamblia
VNSVYYPLNIGSFFGRFESDTPLQH

SEQ ID NO: 3093499 - protein, 20 aa, Giardia lamblia
VNWSTLFKHLAFHTEPVPFV

SEQ ID NO: 3093500 - protein, 26 aa, Giardia lamblia
VPAPAPPFPFYPQPPSVKIPPPMHYG

SEQ ID NO: 3093501 - protein, 34 aa, Giardia lamblia
VPCMMELFKYLRADKYLTMLMPLLPTPEARQELA

SEQ ID NO: 3093502 - protein, 18 aa, Giardia lamblia
VPDLLAFLKIVFCVIEHT

SEQ ID NO: 3093503 - protein, 25 aa, Giardia lamblia
VPDTKYTDFLLYNSFFEVASNSMVA

SEQ ID NO: 3093504 - protein, 27 aa, Giardia lamblia
VPFGCDMPGFFVLSSWVYQVLAVFWEY

SEQ ID NO: 3093505 - protein, 28 aa, Giardia lamblia
VPGGVRRCWCERGFLPALDRSECVLPIE

SEQ ID NO: 3093506 - protein, 25 aa, Giardia lamblia
VPGGVRRCWCERGFLPAPDKSGCVP

SEQ ID NO: 3093507 - protein, 20 aa, Giardia lamblia
VPHQTLALTALLYAKSYNEA

SEQ ID NO: 3093508 - protein, 20 aa, Giardia lamblia
VPKMCYAPNPDGMMAVCGGV

SEQ ID NO: 3093509 - protein, 17 aa, Giardia lamblia
VPLPWNFIFTCCCKRSK

SEQ ID NO: 3093510 - protein, 18 aa, Giardia lamblia
VPNLILFAFAGDATHACT

SEQ ID NO: 3093511 - protein, 17 aa, Giardia lamblia
VPPLLNASMIKSLCAVM

SEQ ID NO: 3093512 - protein, 20 aa, Giardia lamblia
VPPVLLLTIEICGFLLRAQN

SEQ ID NO: 3093513 - protein, 17 aa, Giardia lamblia
VPRMTACAHILAVLGGQ

SEQ ID NO: 3093514 - protein, 19 aa, Giardia lamblia
VPSLQRLPQTLLGHIDLGL

SEQ ID NO: 3093515 - protein, 22 aa, Giardia lamblia
VPSSCQSFLMLYGWDVMNPRTR

SEQ ID NO: 3093516 - protein, 17 aa, Giardia lamblia
VPTARYICKALLSNVKQ

SEQ ID NO: 3093517 - protein, 21 aa, Giardia lamblia
VPTIVVCLLCAIGSLFGICFS

SEQ ID NO: 3093518 - protein, 25 aa, Giardia lamblia
VPTRQFIFIFAHTLSFHYTTQQCYI

SEQ ID NO: 3093519 - protein, 27 aa, Giardia lamblia
VPVHSPIQRFMYTLKCLNIDSSRISSE

SEQ ID NO: 3093520 - protein, 17 aa, Giardia lamblia
VPVSLLSAAWLGAISNS

SEQ ID NO: 3093521 - protein, 24 aa, Giardia lamblia
VPVTKYVIMCWSAISFYIGTDNIR

SEQ ID NO: 3093522 - protein, 32 aa, Giardia lamblia
VPYIISFVMGPLYIVFIGFMRGLSNWMIASRC

SEQ ID NO: 3093523 - protein, 28 aa, Giardia lamblia
VQAFLQDNRFPFFPELGPSNFQDLLKRP

SEQ ID NO: 3093524 - protein, 21 aa, Giardia lamblia
VQAKYLAHLAARKAWITKSEA

SEQ ID NO: 3093525 - protein, 21 aa, Giardia lamblia
VQALFRHFNLENGIMAMCNKY

SEQ ID NO: 3093526 - protein, 28 aa, Giardia lamblia
VQDDACPYALLLKFLHPESSPVLFMLVA

SEQ ID NO: 3093527 - protein, 19 aa, Giardia lamblia
VQGCRICIAPQQAGIALCL

SEQ ID NO: 3093528 - protein, 17 aa, Giardia lamblia
VQGVWCIFLTSIGSPYK

SEQ ID NO: 3093529 - protein, 27 aa, Giardia lamblia
VQHTPLLTPRQFPVLPGPPDRDANCSN

SEQ ID NO: 3093530 - protein, 17 aa, Giardia lamblia
VQKILAVTWMVRGNYAF

SEQ ID NO: 3093531 - protein, 25 aa, Giardia lamblia
VQLEAFLNSIFLTLNKFIQDKVNTL

SEQ ID NO: 3093532 - protein, 23 aa, Giardia lamblia
VQQQYPIRLLYASSTPMMIISTL

SEQ ID NO: 3093533 - protein, 23 aa, Giardia lamblia
VQREVHILFNSWVGISKPPPLLP

SEQ ID NO: 3093534 - protein, 23 aa, Giardia lamblia
VQRLYQKLLNYLPTLRNLDSFLF

SEQ ID NO: 3093535 - protein, 31 aa, Giardia lamblia
VQSADGAAYFCACSFPYTSVGGLCVHQRCVV

SEQ ID NO: 3093536 - protein, 25 aa, Giardia lamblia
VQSMRWIFHRLALSLADPIGSPFSL

SEQ ID NO: 3093537 - protein, 24 aa, Giardia lamblia
VQSTLALPLLTLVLLFCKHEPGSQ

SEQ ID NO: 3093538 - protein, 30 aa, Giardia lamblia
VQVLLSRIYRPIAALIFPPALKPLTMEQQI

SEQ ID NO: 3093539 - protein, 27 aa, Giardia lamblia
VQVLSGRSYMGIAHCTLCDSPKIASDP

SEQ ID NO: 3093540 - protein, 25 aa, Giardia lamblia
VRASALLFLGFFMDAAYGVNRDLQE

SEQ ID NO: 3093541 - protein, 18 aa, Giardia lamblia
VRCSPLETILQNGIFPLV

SEQ ID NO: 3093542 - protein, 18 aa, Giardia lamblia
VRDPFLPVLNFCGWVMGG

SEQ ID NO: 3093543 - protein, 17 aa, Giardia lamblia
VRFTTKGLYTFLALIVY

SEQ ID NO: 3093544 - protein, 20 aa, Giardia lamblia
VRIIAGMEAFLTRVYQEDLN

SEQ ID NO: 3093545 - protein, 25 aa, Giardia lamblia
VRISNLFYILIALHEYTINNGSMLL

SEQ ID NO: 3093546 - protein, 23 aa, Giardia lamblia
VRKLLPELIALTNAIYDGIADLT

SEQ ID NO: 3093547 - protein, 19 aa, Giardia lamblia
VRLIRIYSCAAYSNTVNAT

SEQ ID NO: 3093548 - protein, 23 aa, Giardia lamblia
VRLLLKHEKDVARWSPLICAAAT

SEQ ID NO: 3093549 - protein, 18 aa, Giardia lamblia
VRLYLFCSPVVPVKAGAS

SEQ ID NO: 3093550 - protein, 27 aa, Giardia lamblia
VRMGTSSFILLLFCLLDHFCTSSLHNA

SEQ ID NO: 3093551 - protein, 20 aa, Giardia lamblia
VRNLRLNYAATMSSPLTNPV

SEQ ID NO: 3093552 - protein, 25 aa, Giardia lamblia
VRQDLPGSLVFILPGLVKTYHEHNI

SEQ ID NO: 3093553 - protein, 29 aa, Giardia lamblia
VRSSPKLSILALLPYFYVGPDPQDNFLQN

SEQ ID NO: 3093554 - protein, 20 aa, Giardia lamblia
VSAFFALVLQLMLQGQPGAE

SEQ ID NO: 3093555 - protein, 22 aa, Giardia lamblia
VSAFLQMFEIIISVSLGFPVLT

SEQ ID NO: 3093556 - protein, 17 aa, Giardia lamblia
VSAIRSLISRGIQFKIL

SEQ ID NO: 3093557 - protein, 36 aa, Giardia lamblia
VSATVLVLLACIGIGLFFIFRRRSPRLDAASEALSV

SEQ ID NO: 3093558 - protein, 23 aa, Giardia lamblia
VSCFFKWLCVSIFQGSVLLMFSQ

SEQ ID NO: 3093559 - protein, 23 aa, Giardia lamblia
VSCLLEYIIYSLSGVTGATVGVG

SEQ ID NO: 3093560 - protein, 18 aa, Giardia lamblia
VSCYAACPIGTYGDAYSM

SEQ ID NO: 3093561 - protein, 36 aa, Giardia lamblia
VSDGFKTIMIKNLKSKPAARLLLRVGSDSLERNDAS

SEQ ID NO: 3093562 - protein, 27 aa, Giardia lamblia
VSDGSLQFWDMLYGKLLRSVSHVFTPS

SEQ ID NO: 3093563 - protein, 23 aa, Giardia lamblia
VSDLLIINVWNHDIGRHSAANYN

SEQ ID NO: 3093564 - protein, 25 aa, Giardia lamblia
VSEDTLERFLLYKKINLNSISQNVD

SEQ ID NO: 3093565 - protein, 24 aa, Giardia lamblia
VSELPIYGTAISPSGRIAACYTAN

SEQ ID NO: 3093566 - protein, 42 aa, Giardia lamblia
VSERAILPLIMKYSLDKALGYYWHFMLGLPYTGMAVFSFNAI

SEQ ID NO: 3093567 - protein, 29 aa, Giardia lamblia
VSFDIHGLVPVYYTLFAIMAAICKELENE

SEQ ID NO: 3093568 - protein, 17 aa, Giardia lamblia
VSFILYSLDGYHLNDIH

SEQ ID NO: 3093569 - protein, 42 aa, Giardia lamblia
VSFLITLTSGYLLRIFFDILFYIIFLFMLFGAHEITDTNQHI

SEQ ID NO: 3093570 - protein, 19 aa, Giardia lamblia
VSFVYGLQHLLSETELLWL

SEQ ID NO: 3093571 - protein, 18 aa, Giardia lamblia
VSGCRLCEAPKVAGPALC

SEQ ID NO: 3093572 - protein, 28 aa, Giardia lamblia
VSGDTYLGFLLMMIATIAFLIVLNETIT

SEQ ID NO: 3093573 - protein, 27 aa, Giardia lamblia
VSGHDLPLFTLFSYNPTHVSADMAESL

SEQ ID NO: 3093574 - protein, 34 aa, Giardia lamblia
VSGRASFKIMWLVWLGQLISLSYSFCPLRNCIKC

SEQ ID NO: 3093575 - protein, 22 aa, Giardia lamblia
VSHFRFLILELNEELESLFDKN

SEQ ID NO: 3093576 - protein, 19 aa, Giardia lamblia
VSIFLALFGCQISIAPLLA

SEQ ID NO: 3093577 - protein, 24 aa, Giardia lamblia
VSIFLYFLAFNFSIGPLIFTVCGE

SEQ ID NO: 3093578 - protein, 26 aa, Giardia lamblia
VSIFQGSVLLMFSQFLINGGLHGSLD

SEQ ID NO: 3093579 - protein, 21 aa, Giardia lamblia
VSILAMCFALLSGTSIFEADK

SEQ ID NO: 3093580 - protein, 24 aa, Giardia lamblia
VSINLISGALRYFRQYNGTVVKQE

SEQ ID NO: 3093581 - protein, 18 aa, Giardia lamblia
VSIPDILMKIFDYGKELL

SEQ ID NO: 3093582 - protein, 28 aa, Giardia lamblia
VSIVALIIIILVITTIVKRLKYAKALKN

SEQ ID NO: 3093583 - protein, 28 aa, Giardia lamblia
VSIVGMFFILTIILLNPTFSFPNLIDYS

SEQ ID NO: 3093584 - protein, 22 aa, Giardia lamblia
VSLCFDLLIGAHVNLYRMRSLE

SEQ ID NO: 3093585 - protein, 26 aa, Giardia lamblia
VSLDPYLIKLVSLVYFELSRDNPEIV

SEQ ID NO: 3093586 - protein, 23 aa, Giardia lamblia
VSLIGQFGVGFYSAYLVAEKVEV

SEQ ID NO: 3093587 - protein, 26 aa, Giardia lamblia
VSLIPLLIYYFFFSGANYTISAFLGV

SEQ ID NO: 3093588 - protein, 21 aa, Giardia lamblia
VSLISYYFVSFSRKKSFFSIE

SEQ ID NO: 3093589 - protein, 24 aa, Giardia lamblia
VSLKRQIILWTITSLFIITNSTSF

SEQ ID NO: 3093590 - protein, 26 aa, Giardia lamblia
VSLKTMLFHYSLVMLWDLVDSILEAD

SEQ ID NO: 3093591 - protein, 19 aa, Giardia lamblia
VSLPCYSLEILWLSKLHRE

SEQ ID NO: 3093592 - protein, 26 aa, Giardia lamblia
VSNFVGWMIYHFLLGYVKSGGLEGML

SEQ ID NO: 3093593 - protein, 22 aa, Giardia lamblia
VSNRIRFFPKKAKISSIVLLMG

SEQ ID NO: 3093594 - protein, 23 aa, Giardia lamblia
VSPSSIITYLIELCTLLYSMLIG

SEQ ID NO: 3093595 - protein, 22 aa, Giardia lamblia
VSPTCVSCQRGYFTLSTPSAEN

SEQ ID NO: 3093596 - protein, 17 aa, Giardia lamblia
VSQAISMLLYKKLIRIP

SEQ ID NO: 3093597 - protein, 33 aa, Giardia lamblia
VSRKTGITLFIDTAILLLLEILMHSATNVMQSA

SEQ ID NO: 3093598 - protein, 29 aa, Giardia lamblia
VSSDFHARFKLCFSFIAHYALSLAIYRRR

SEQ ID NO: 3093599 - protein, 24 aa, Giardia lamblia
VSSDIYLLKIYDISTRRLVCQIYF

SEQ ID NO: 3093600 - protein, 22 aa, Giardia lamblia
VSSFEYLLPIPLSVATELRRLA

SEQ ID NO: 3093601 - protein, 29 aa, Giardia lamblia
VSSQLPPFHLLFPCLFPEPLSKPEVMELW

SEQ ID NO: 3093602 - protein, 24 aa, Giardia lamblia
VSSYIQFFLLSFGALLSLFLHKYW

SEQ ID NO: 3093603 - protein, 31 aa, Giardia lamblia
VSTCVSYFYHLFFHVVFIFMASFPVVRTKRA

SEQ ID NO: 3093604 - protein, 27 aa, Giardia lamblia
VSTEQELVLFWSLLEDFSLRVYMALKL

SEQ ID NO: 3093605 - protein, 22 aa, Giardia lamblia
VSTIKLPHKPLVKLDFVCFRKP

SEQ ID NO: 3093606 - protein, 24 aa, Giardia lamblia
VSTKQRRFIPLNELSLMEGKAPHD

SEQ ID NO: 3093607 - protein, 24 aa, Giardia lamblia
VSTLKLPSTLRFINAQAFGGNTTH

SEQ ID NO: 3093608 - protein, 26 aa, Giardia lamblia
VSTTYFYELLHQLLNLDYKTILHTTE

SEQ ID NO: 3093609 - protein, 31 aa, Giardia lamblia
VSVLDSMFRFMWVPFFLILCIETANYFLFKY

SEQ ID NO: 3093610 - protein, 17 aa, Giardia lamblia
VSVLLTVLVLYSYTFVP

SEQ ID NO: 3093611 - protein, 23 aa, Giardia lamblia
VSVTYILWFFLGVFGAHRFYLRR

SEQ ID NO: 3093612 - protein, 26 aa, Giardia lamblia
VSYDKKIFDFLLKKFSIVDDAYYLNA

SEQ ID NO: 3093613 - protein, 25 aa, Giardia lamblia
VSYTLLMRAVIARNSEWFKALCPYE

SEQ ID NO: 3093614 - protein, 28 aa, Giardia lamblia
VTAFNPSLFLTYIDTIFLCSRKMHVAER

SEQ ID NO: 3093615 - protein, 29 aa, Giardia lamblia
VTAILLVTGLVSFLLRWLLCRRTQSHETK

SEQ ID NO: 3093616 - protein, 25 aa, Giardia lamblia
VTAVLALTLVIFFNLIVVLATHNCT

SEQ ID NO: 3093617 - protein, 30 aa, Giardia lamblia
VTCENIIKSAFLYAFIWSFATTAMQNTKKR

SEQ ID NO: 3093618 - protein, 17 aa, Giardia lamblia
VTCVCRELLYEDVTIDK

SEQ ID NO: 3093619 - protein, 32 aa, Giardia lamblia
VTDEGKVLFAVGLLALCLMTVTPFADTPKRIH

SEQ ID NO: 3093620 - protein, 24 aa, Giardia lamblia
VTDTLEVFLLTRDMKTLWVNKELG

SEQ ID NO: 3093621 - protein, 30 aa, Giardia lamblia
VTDVEKMFTTLRILPRYVKQTDIAPLFKKA

SEQ ID NO: 3093622 - protein, 18 aa, Giardia lamblia
VTEGWRPLASTVATVCKC

SEQ ID NO: 3093623 - protein, 17 aa, Giardia lamblia
VTFLIGKRQYSICRPFF

SEQ ID NO: 3093624 - protein, 25 aa, Giardia lamblia
VTFMRERGMDLSSHRFLILQGEIEQ

SEQ ID NO: 3093625 - protein, 17 aa, Giardia lamblia
VTFVLFALTFFIARIVV

SEQ ID NO: 3093626 - protein, 17 aa, Giardia lamblia
VTGIIIVLLLTILAIFV

SEQ ID NO: 3093627 - protein, 22 aa, Giardia lamblia
VTGTLVYLYMAITALKTIECKC

SEQ ID NO: 3093628 - protein, 46 aa, Giardia lamblia
VTHGPHYLIVFSPSFLPDIIGYPLIKSICHRLILLPSIEGADGSKK

SEQ ID NO: 3093629 - protein, 25 aa, Giardia lamblia
VTHGRMLIHLFLQPEDFRLYVQDDA

SEQ ID NO: 3093630 - protein, 17 aa, Giardia lamblia
VTHPLCVLLALAPSMYT

SEQ ID NO: 3093631 - protein, 32 aa, Giardia lamblia
VTICFILAIVFFILFVFWNKQWCKNPLFPPTA

SEQ ID NO: 3093632 - protein, 24 aa, Giardia lamblia
VTIGTFQFHAINFHGLYNIPGANW

SEQ ID NO: 3093633 - protein, 22 aa, Giardia lamblia
VTILFCNIVLPGIGTMFSAIAP

SEQ ID NO: 3093634 - protein, 35 aa, Giardia lamblia
VTILLNKPVCEACHPDYYLLSRGDSAMCLSSQECT

SEQ ID NO: 3093635 - protein, 22 aa, Giardia lamblia
VTILSYFPQLRYGIQRDTPEEP

SEQ ID NO: 3093636 - protein, 17 aa, Giardia lamblia
VTIPARYKVHPFPSRGS

SEQ ID NO: 3093637 - protein, 20 aa, Giardia lamblia
VTIPVYYFISLGRNGQVCPR

SEQ ID NO: 3093638 - protein, 32 aa, Giardia lamblia
VTKEVRSYKMFYLYVILILYNEYNRVRNRRPI

SEQ ID NO: 3093639 - protein, 21 aa, Giardia lamblia
VTKLVRRPLHMLKQESNLMDD

SEQ ID NO: 3093640 - protein, 18 aa, Giardia lamblia
VTLHLPYLNLQQLSDELH

SEQ ID NO: 3093641 - protein, 18 aa, Giardia lamblia
VTLKAGGYTYPFLDAGAD

SEQ ID NO: 3093642 - protein, 18 aa, Giardia lamblia
VTLKNANRRLLNELSHER

SEQ ID NO: 3093643 - protein, 27 aa, Giardia lamblia
VTLLEGLGMILPPVMTLFCEKFNQEKT

SEQ ID NO: 3093644 - protein, 32 aa, Giardia lamblia
VTLNDDITLKLPWMPVPAYGKVFDGKGHTIRN

SEQ ID NO: 3093645 - protein, 18 aa, Giardia lamblia
VTLRFSATAELWVCNMHL

SEQ ID NO: 3093646 - protein, 27 aa, Giardia lamblia
VTLSYLPIITYMFLNLLQNAGVFISEM

SEQ ID NO: 3093647 - protein, 23 aa, Giardia lamblia
VTLTDVELFLAYIKHIHAELQKL

SEQ ID NO: 3093648 - protein, 23 aa, Giardia lamblia
VTLVLVALIYNVSLLVYTACLFF

SEQ ID NO: 3093649 - protein, 25 aa, Giardia lamblia
VTMESRLWGMLNVESLSSIFVTAPP

SEQ ID NO: 3093650 - protein, 17 aa, Giardia lamblia
VTNARALILKTAISFLC

SEQ ID NO: 3093651 - protein, 54 aa, Giardia lamblia
VTNSPDLQLLRYNTTAIYALLPCHVKIKSISWLTRLIRLLIEEITSQGPVSALL

SEQ ID NO: 3093652 - protein, 27 aa, Giardia lamblia
VTPRRKASIFLFYDKGVRKLRIESGCT

SEQ ID NO: 3093653 - protein, 26 aa, Giardia lamblia
VTQTELLPLVLGIWPSCPSLQRVVLL

SEQ ID NO: 3093654 - protein, 36 aa, Giardia lamblia
VTRTSPLLSLLQRSLPTSLPLVTRGLLGPSGITKYS

SEQ ID NO: 3093655 - protein, 27 aa, Giardia lamblia
VTSVFTLLENLYLLLASKHIALDNCNE

SEQ ID NO: 3093656 - protein, 34 aa, Giardia lamblia
VTTKQTTIFLLSCTFTLLVLSRYSSKRNLRQAIE

SEQ ID NO: 3093657 - protein, 28 aa, Giardia lamblia
VTTLFILTKVLWIILLTGGALVMILGIA

SEQ ID NO: 3093658 - protein, 30 aa, Giardia lamblia
VTTNRKLEAALFFLYVLRVFDDSKEGGEGV

SEQ ID NO: 3093659 - protein, 18 aa, Giardia lamblia
VTTRTYLCFVSCTMQVII

SEQ ID NO: 3093660 - protein, 18 aa, Giardia lamblia
VTTTFRVKTLQGLAPDNF

SEQ ID NO: 3093661 - protein, 27 aa, Giardia lamblia
VTTTRNYFRMLFLHLDFNSIKRSSNQK

SEQ ID NO: 3093662 - protein, 23 aa, Giardia lamblia
VTTYLLWLFLGIFGGHRFYLYQY

SEQ ID NO: 3093663 - protein, 28 aa, Giardia lamblia
VTVLCWACFTFLLSYTFVIRKYRREQAA

SEQ ID NO: 3093664 - protein, 24 aa, Giardia lamblia
VTVPAFLVCIFIAIISGWKAFLFT

SEQ ID NO: 3093665 - protein, 19 aa, Giardia lamblia
VTWSVAYYERLLNAKVQCH

SEQ ID NO: 3093666 - protein, 39 aa, Giardia lamblia
VVAIVVVVLVLLVVAGVLCWFFLKKKKVIKNKPTHSLEN

SEQ ID NO: 3093667 - protein, 30 aa, Giardia lamblia
VVALSFAIIMFPIRVIIMSWWNIDKQTRKG

SEQ ID NO: 3093668 - protein, 17 aa, Giardia lamblia
VVAPFRIRRVISLEIES

SEQ ID NO: 3093669 - protein, 32 aa, Giardia lamblia
VVAPPTSHALLRMFDQLFGASLHYPIILDEFG

SEQ ID NO: 3093670 - protein, 24 aa, Giardia lamblia
VVATNLAILRPIGRSPAECPVAEG

SEQ ID NO: 3093671 - protein, 34 aa, Giardia lamblia
VVCRTGLVKLLLTDLIFIVNPNYAKLMSHQKQCY

SEQ ID NO: 3093672 - protein, 31 aa, Giardia lamblia
VVDAFHEGDYLYILMPIYSHGDLVAYRKKKT

SEQ ID NO: 3093673 - protein, 17 aa, Giardia lamblia
VVDFLSNNFPFVTSRKG

SEQ ID NO: 3093674 - protein, 22 aa, Giardia lamblia
VVDLYIFLGLECPCAITISRYL

SEQ ID NO: 3093675 - protein, 26 aa, Giardia lamblia
VVEAPHLLLPLYDPYTSESLVDAVML

SEQ ID NO: 3093676 - protein, 36 aa, Giardia lamblia
VVESSYLYDFFLASELTFVLPPMNNTKEFLLLLLKR

SEQ ID NO: 3093677 - protein, 17 aa, Giardia lamblia
VVGKRISYLFLIKSDIE

SEQ ID NO: 3093678 - protein, 21 aa, Giardia lamblia
VVIASFLMRLTQTNPAPLIVL

SEQ ID NO: 3093679 - protein, 23 aa, Giardia lamblia
VVILFWESLSLSPYFYTDAFLQG

SEQ ID NO: 3093680 - protein, 25 aa, Giardia lamblia
VVIPLYFEVGLDKRGLLSAAPVVAC

SEQ ID NO: 3093681 - protein, 25 aa, Giardia lamblia
VVLEELLLNNFYSLEDVWAFIDSTN

SEQ ID NO: 3093682 - protein, 27 aa, Giardia lamblia
VVLESLLLHPYLLNIPFSMLSKFIEEY

SEQ ID NO: 3093683 - protein, 17 aa, Giardia lamblia
VVLGLSNGKIKIYEVDN

SEQ ID NO: 3093684 - protein, 17 aa, Giardia lamblia
VVMYGVALVGTIRAYLA

SEQ ID NO: 3093685 - protein, 26 aa, Giardia lamblia
VVNKFIRRQVGIFGYIRVGIPDESNN

SEQ ID NO: 3093686 - protein, 25 aa, Giardia lamblia
VVNTALEVKASFLRTLYPGYDETQA

SEQ ID NO: 3093687 - protein, 23 aa, Giardia lamblia
VVNVLLLLFLLVASDFLYRLTEL

SEQ ID NO: 3093688 - protein, 26 aa, Giardia lamblia
VVPDYSLIAEIILFSEGFTTAKVLSR

SEQ ID NO: 3093689 - protein, 26 aa, Giardia lamblia
VVPSSYLRVRYVHRAHAAPISLLSPA

SEQ ID NO: 3093690 - protein, 30 aa, Giardia lamblia
VVQSVKRFFLWFWNLYYMKFDQISCVFTDQ

SEQ ID NO: 3093691 - protein, 23 aa, Giardia lamblia
VVRRFCPEFLWARDVSSAGQPNQ

SEQ ID NO: 3093692 - protein, 19 aa, Giardia lamblia
VVSCFFISMAVTCLCVTIP

SEQ ID NO: 3093693 - protein, 19 aa, Giardia lamblia
VVSIFRIIGMLIMTCNNES

SEQ ID NO: 3093694 - protein, 22 aa, Giardia lamblia
VVSNGLLMDLYMAYNVFGFCRY

SEQ ID NO: 3093695 - protein, 24 aa, Giardia lamblia
VVSRLMLMMLSLISLLLVLIEAFF

SEQ ID NO: 3093696 - protein, 19 aa, Giardia lamblia
VVTNRLLLLSDLEPLRTNE

SEQ ID NO: 3093697 - protein, 18 aa, Giardia lamblia
VVVITHSLEFRDALIAAT

SEQ ID NO: 3093698 - protein, 21 aa, Giardia lamblia
VVVSLLIIAAVALTCWFVLRR

SEQ ID NO: 3093699 - protein, 27 aa, Giardia lamblia
VVVVAAIVGVLVWKYVCKKKSSKRIKM

SEQ ID NO: 3093700 - protein, 36 aa, Giardia lamblia
VVWKQQWGWRFLIGILFFIFWISLAFLDDMRYINQR

SEQ ID NO: 3093701 - protein, 17 aa, Giardia lamblia
VVYIYSALEFCSAYEKG

SEQ ID NO: 3093702 - protein, 25 aa, Giardia lamblia
VWTTDRYWFLCRDNQTCLSLVHNAY

SEQ ID NO: 3093703 - protein, 30 aa, Giardia lamblia
VWTVLQDYFRYPLLVYHIVLSIVIRQFNVV

SEQ ID NO: 3093704 - protein, 24 aa, Giardia lamblia
VYANLLRYRIQVSRMLFANQGLLP

SEQ ID NO: 3093705 - protein, 19 aa, Giardia lamblia
VYCATFYFLKNRTVSVMTS

SEQ ID NO: 3093706 - protein, 22 aa, Giardia lamblia
VYCLSWTFLVPRASTRRYRNYI

SEQ ID NO: 3093707 - protein, 24 aa, Giardia lamblia
VYFAMFPSLLRWAVDPPIPKWIMF

SEQ ID NO: 3093708 - protein, 28 aa, Giardia lamblia
VYFIFKNFATFYPKWRDYYAWFNDVSVC

SEQ ID NO: 3093709 - protein, 19 aa, Giardia lamblia
VYFTKLTRIYMKKSLIDFF

SEQ ID NO: 3093710 - protein, 22 aa, Giardia lamblia
VYFTYYLSYQITSSPLHYLLFK

SEQ ID NO: 3093711 - protein, 26 aa, Giardia lamblia
VYIPAYLMHVWTVSFLLSPGSLRNVL

SEQ ID NO: 3093712 - protein, 28 aa, Giardia lamblia
VYKQYTDIYLFSTLPALLSPLPRAYNTV

SEQ ID NO: 3093713 - protein, 26 aa, Giardia lamblia
VYKRLFYECFSFISSSWYTLLIDVSL

SEQ ID NO: 3093714 - protein, 17 aa, Giardia lamblia
VYLKLNCNRQLPAWPGY

SEQ ID NO: 3093715 - protein, 27 aa, Giardia lamblia
VYLLATAKRLLYLALGKRDSEVFRGCI

SEQ ID NO: 3093716 - protein, 17 aa, Giardia lamblia
VYNLTFGGPSTVSCDAL

SEQ ID NO: 3093717 - protein, 27 aa, Giardia lamblia
VYPIGLLITVLIVTLVYLFPTIAGLSL

SEQ ID NO: 3093718 - protein, 18 aa, Giardia lamblia
VYQDLQKTLLFLEPVDRC

SEQ ID NO: 3093719 - protein, 24 aa, Giardia lamblia
VYQLALLFWMVITLISDFGTGFGD

SEQ ID NO: 3093720 - protein, 25 aa, Giardia lamblia
VYRLGWVISAVLLAGAFLYSVLGFN

SEQ ID NO: 3093721 - protein, 27 aa, Giardia lamblia
VYSALPDILNRLLRPGLLSRATTQSLS

SEQ ID NO: 3093722 - protein, 20 aa, Giardia lamblia
VYSMGRYFNLFLFACGHVVG

SEQ ID NO: 3093723 - protein, 27 aa, Giardia lamblia
VYSRKHDFGYIPFGRRLFVLKVVANEE

SEQ ID NO: 3093724 - protein, 20 aa, Giardia lamblia
VYSVMVVLGYFVFKLSLLRK

SEQ ID NO: 3093725 - protein, 20 aa, Giardia lamblia
VYTSCILNTLLALYSLTQAP

SEQ ID NO: 3093726 - protein, 28 aa, Giardia lamblia
VYTSLAIILALLIGSLTGYFIFRCVKYS

SEQ ID NO: 3093727 - protein, 18 aa, Giardia lamblia
VYVCQAVIHLLIVSVSPL

SEQ ID NO: 3093728 - protein, 24 aa, Giardia lamblia
VYYLTFFCIIWESLILLTSIVYVI

SEQ ID NO: 3093729 - protein, 24 aa, Giardia lamblia
WADTLLQRLLCIVPALEGKYSRIL

SEQ ID NO: 3093730 - protein, 32 aa, Giardia lamblia
WAGSQFPMLHICKFLLTLMDLVGRLKHHIIIR

SEQ ID NO: 3093731 - protein, 18 aa, Giardia lamblia
WAPVILILSTIIAKKQYR

SEQ ID NO: 3093732 - protein, 20 aa, Giardia lamblia
WASLNNLCYPAACVSSGTLC

SEQ ID NO: 3093733 - protein, 25 aa, Giardia lamblia
WASRHAGFTVFPFGHVPQSLEKDPE

SEQ ID NO: 3093734 - protein, 17 aa, Giardia lamblia
WASRPRVVHVEPSPCPK

SEQ ID NO: 3093735 - protein, 26 aa, Giardia lamblia
WCANRVWYVMILSFILGFSLSLVALT

SEQ ID NO: 3093736 - protein, 21 aa, Giardia lamblia
WCAPDLETLWVESHVAKYVDV

SEQ ID NO: 3093737 - protein, 17 aa, Giardia lamblia
WCIFLTSIGSPYKMVCN

SEQ ID NO: 3093738 - protein, 17 aa, Giardia lamblia
WDAGHIPLLFNVDQYKA

SEQ ID NO: 3093739 - protein, 19 aa, Giardia lamblia
WDQSIYILIRHVLDYIIVR

SEQ ID NO: 3093740 - protein, 22 aa, Giardia lamblia
WETYYLLGMCHMKLQNYSKALE

SEQ ID NO: 3093741 - protein, 17 aa, Giardia lamblia
WFIYDPFAEYCRQGVGT

SEQ ID NO: 3093742 - protein, 32 aa, Giardia lamblia
WFSILLSVVIILPFFIFFGAAAPQFTTERIFA

SEQ ID NO: 3093743 - protein, 18 aa, Giardia lamblia
WGATLAFMNARMVNPLQI

SEQ ID NO: 3093744 - protein, 24 aa, Giardia lamblia
WGTFYYSEKLLLTYYKRLPKSHKD

SEQ ID NO: 3093745 - protein, 20 aa, Giardia lamblia
WGYAILYVFIGLVGGTMIVV

SEQ ID NO: 3093746 - protein, 18 aa, Giardia lamblia
WHLSLLPSQCLTAFYQAN

SEQ ID NO: 3093747 - protein, 26 aa, Giardia lamblia
WIDDELVVVITLRPFYEVSIPNFHPY

SEQ ID NO: 3093748 - protein, 26 aa, Giardia lamblia
WIDGVITLVMLLLLLSINAAIVYHKD

SEQ ID NO: 3093749 - protein, 18 aa, Giardia lamblia
WIGCFFYTRGHSIPCLNG

SEQ ID NO: 3093750 - protein, 24 aa, Giardia lamblia
WIGKSALPILYIQPVIISLISSNI

SEQ ID NO: 3093751 - protein, 19 aa, Giardia lamblia
WILSNLFTDIPTYVLDYIL

SEQ ID NO: 3093752 - protein, 18 aa, Giardia lamblia
WINNMILATTVKALVLVL

SEQ ID NO: 3093753 - protein, 19 aa, Giardia lamblia
WISSLSFLVFFVGGAARIT

SEQ ID NO: 3093754 - protein, 18 aa, Giardia lamblia
WITTFFMFVGESICLAIF

SEQ ID NO: 3093755 - protein, 17 aa, Giardia lamblia
WIVINLVAQLLTAFFQS

SEQ ID NO: 3093756 - protein, 17 aa, Giardia lamblia
WIYERYPLAVTTPGASF

SEQ ID NO: 3093757 - protein, 26 aa, Giardia lamblia
WLQRYPLTITFLPTSLYFENNGSLAF

SEQ ID NO: 3093758 - protein, 18 aa, Giardia lamblia
WLRGALRGGFKEIFAEFI

SEQ ID NO: 3093759 - protein, 19 aa, Giardia lamblia
WLRRIFHTNLSLLSGSLTE

SEQ ID NO: 3093760 - protein, 24 aa, Giardia lamblia
WLSSILHHIFNISRILITSAAYNE

SEQ ID NO: 3093761 - protein, 18 aa, Giardia lamblia
WLTSVPFLPSLVITILVA

SEQ ID NO: 3093762 - protein, 17 aa, Giardia lamblia
WMAFLEIVRRVSVFMPL

SEQ ID NO: 3093763 - protein, 19 aa, Giardia lamblia
WNKLCSLVFIAPDLAKEWV

SEQ ID NO: 3093764 - protein, 28 aa, Giardia lamblia
WNWRNGSIFFLLYGFASLLFLCFVKPPL

SEQ ID NO: 3093765 - protein, 28 aa, Giardia lamblia
WNWRNGSIFFLLYGFTSLLLLCFVKPPL

SEQ ID NO: 3093766 - protein, 27 aa, Giardia lamblia
WNWRNGSLLFMLYGSVSLIFLCFVRPI

SEQ ID NO: 3093767 - protein, 32 aa, Giardia lamblia
WPANLSYLKSKLLPLKNLKYLLNFKVWTQTRD

SEQ ID NO: 3093768 - protein, 20 aa, Giardia lamblia
WPGRFSEFPFFSKLSIWMSL

SEQ ID NO: 3093769 - protein, 19 aa, Giardia lamblia
WQCDCPQGDYLTYNRTCIL

SEQ ID NO: 3093770 - protein, 18 aa, Giardia lamblia
WQCNCIGDYVTYNKTCIP

SEQ ID NO: 3093771 - protein, 17 aa, Giardia lamblia
WQWKVYKHILLSSIPHY

SEQ ID NO: 3093772 - protein, 20 aa, Giardia lamblia
WQYIYILIGCLSAVHAAYSV

SEQ ID NO: 3093773 - protein, 24 aa, Giardia lamblia
WSGSACDAAKPGFRILRTGADSSG

SEQ ID NO: 3093774 - protein, 20 aa, Giardia lamblia
WSLGCILYELCTLKRFIEDP

SEQ ID NO: 3093775 - protein, 24 aa, Giardia lamblia
WSLGLIVYELCTFERLVSGATVAD

SEQ ID NO: 3093776 - protein, 31 aa, Giardia lamblia
WSLGVVVYEMAYGRVPDFLRGMPPKSVYVNT

SEQ ID NO: 3093777 - protein, 19 aa, Giardia lamblia
WSMDKLIETLSILTAPEKA

SEQ ID NO: 3093778 - protein, 17 aa, Giardia lamblia
WSNLPPNNRSRLFVSTK

SEQ ID NO: 3093779 - protein, 21 aa, Giardia lamblia
WSPKRLIMICVTFGAFIGFLG

SEQ ID NO: 3093780 - protein, 17 aa, Giardia lamblia
WSVLARNLGISQKPGSI

SEQ ID NO: 3093781 - protein, 23 aa, Giardia lamblia
WTALMWAAFIGHAEVVRLLLRTE

SEQ ID NO: 3093782 - protein, 19 aa, Giardia lamblia
WTCECLDGYRVTDAGCLNH

SEQ ID NO: 3093783 - protein, 17 aa, Giardia lamblia
WTLSFLDEMLPQLDYTS

SEQ ID NO: 3093784 - protein, 32 aa, Giardia lamblia
WTQFSLMYYSLFPLLYFVHCLLYYRNVNRPKI

SEQ ID NO: 3093785 - protein, 24 aa, Giardia lamblia
WTSGRECIPCALGCLRCTSATTCS

SEQ ID NO: 3093786 - protein, 25 aa, Giardia lamblia
WTSGRECIPCVPGCLRCTSATTCSA

SEQ ID NO: 3093787 - protein, 17 aa, Giardia lamblia
WTVPASMQNSRICYRKT

SEQ ID NO: 3093788 - protein, 19 aa, Giardia lamblia
WVTDLLIYYLFAPNSVYGE

SEQ ID NO: 3093789 - protein, 17 aa, Giardia lamblia
WVVLGLSNDLKLWLPLS

SEQ ID NO: 3093790 - protein, 26 aa, Giardia lamblia
WVYHELYNTIWPLNQLSIFPLISHIQ

SEQ ID NO: 3093791 - protein, 26 aa, Giardia lamblia
YAADFFVLTMSIIPELRKYSQELSLS

SEQ ID NO: 3093792 - protein, 18 aa, Giardia lamblia
YAAFAPRRGETGKCILCN

SEQ ID NO: 3093793 - protein, 19 aa, Giardia lamblia
YAAIWATISAIRRYDPERA

SEQ ID NO: 3093794 - protein, 25 aa, Giardia lamblia
YAAYCNFVYLCSKYCIITVVPVIQN

SEQ ID NO: 3093795 - protein, 17 aa, Giardia lamblia
YAAYYYEYHGQIPRLII

SEQ ID NO: 3093796 - protein, 28 aa, Giardia lamblia
YADNAVQTVLYFPKLAIFAETTTIYSTS

SEQ ID NO: 3093797 - protein, 22 aa, Giardia lamblia
YADYIIDCLFPPSSGLARSKLV

SEQ ID NO: 3093798 - protein, 22 aa, Giardia lamblia
YADYYKELLPTGKIRLFHPTVP

SEQ ID NO: 3093799 - protein, 19 aa, Giardia lamblia
YAELRLVYISNFPIKQVVV

SEQ ID NO: 3093800 - protein, 18 aa, Giardia lamblia
YAFRLFVDEAHSIGCLGP

SEQ ID NO: 3093801 - protein, 18 aa, Giardia lamblia
YAHILFGYRFRTADDDAY

SEQ ID NO: 3093802 - protein, 18 aa, Giardia lamblia
YAIFKPQVLSELKARLKP

SEQ ID NO: 3093803 - protein, 21 aa, Giardia lamblia
YAIHAHTLLDTLMSFLFDDLD

SEQ ID NO: 3093804 - protein, 20 aa, Giardia lamblia
YALVTVLFTLFLRSIVHAKG

SEQ ID NO: 3093805 - protein, 24 aa, Giardia lamblia
YAPLSVLHFLFVQGGLDCFTTSLQ

SEQ ID NO: 3093806 - protein, 24 aa, Giardia lamblia
YARFAFHQLFSWDIKTHDWKSYTP

SEQ ID NO: 3093807 - protein, 24 aa, Giardia lamblia
YASSSKVHRLCRPKDMYAVLDVHP

SEQ ID NO: 3093808 - protein, 34 aa, Giardia lamblia
YATALDCLLNEIFPLPPSIYNNTLTSSAFLQSYV

SEQ ID NO: 3093809 - protein, 20 aa, Giardia lamblia
YAVHTIRLPVLEQPFRLPSL

SEQ ID NO: 3093810 - protein, 27 aa, Giardia lamblia
YAVIAWKNKILLLHLPEAVLLKTYIVS

SEQ ID NO: 3093811 - protein, 26 aa, Giardia lamblia
YAYIRAVTFCILCYTRNIRYSESLRT

SEQ ID NO: 3093812 - protein, 35 aa, Giardia lamblia
YAYMQEALPIILSRGRIPLLIWDMSNSKELNSVYE

SEQ ID NO: 3093813 - protein, 21 aa, Giardia lamblia
YAYTDIPQYFPLDKADKDKPY

SEQ ID NO: 3093814 - protein, 24 aa, Giardia lamblia
YCCNRWASFNYSCISVLLSLALSI

SEQ ID NO: 3093815 - protein, 17 aa, Giardia lamblia
YCDSLLDFLLEHLNIST

SEQ ID NO: 3093816 - protein, 17 aa, Giardia lamblia
YCFHISAKCIKAYFEHT

SEQ ID NO: 3093817 - protein, 17 aa, Giardia lamblia
YCFQCGVVTDLLVDGHC

SEQ ID NO: 3093818 - protein, 24 aa, Giardia lamblia
YCGVSPFVTLLLLEANSPLVHPGL

SEQ ID NO: 3093819 - protein, 18 aa, Giardia lamblia
YCNPLACMSTRLSRTHLR

SEQ ID NO: 3093820 - protein, 23 aa, Giardia lamblia
YCPVCKLLRVPSDLRLTQRAMAL

SEQ ID NO: 3093821 - protein, 18 aa, Giardia lamblia
YCSGDLLANCELLESIYQ

SEQ ID NO: 3093822 - protein, 18 aa, Giardia lamblia
YCTFSVMYLTHMDTHLFC

SEQ ID NO: 3093823 - protein, 19 aa, Giardia lamblia
YCTYCYKTHIYHNGGCYDR

SEQ ID NO: 3093824 - protein, 24 aa, Giardia lamblia
YCWRSDTPLIYRAIPSWFVRVEQI

SEQ ID NO: 3093825 - protein, 25 aa, Giardia lamblia
YDDEPCTNLFFSEHLTPLCVHHHGL

SEQ ID NO: 3093826 - protein, 20 aa, Giardia lamblia
YDFLPLVVELLRLYSHDEHE

SEQ ID NO: 3093827 - protein, 23 aa, Giardia lamblia
YDGVCLACLPGYSSPAMGCFVEC

SEQ ID NO: 3093828 - protein, 21 aa, Giardia lamblia
YDHIRSIILIGIMASARQLIF

SEQ ID NO: 3093829 - protein, 27 aa, Giardia lamblia
YDIHTKYKFMRPMGALFNIYRRLSENY

SEQ ID NO: 3093830 - protein, 28 aa, Giardia lamblia
YDKPQGYSFIRIVLPLTVTAIYRNRVLE

SEQ ID NO: 3093831 - protein, 19 aa, Giardia lamblia
YDKTCVCVFINLPADLRLI

SEQ ID NO: 3093832 - protein, 26 aa, Giardia lamblia
YDLLRVYFYKHFPAAQALPDVPAENK

SEQ ID NO: 3093833 - protein, 20 aa, Giardia lamblia
YDLNNPYRKGSMRLSYGPAR

SEQ ID NO: 3093834 - protein, 17 aa, Giardia lamblia
YDNDMSIQWLPDLEYYT

SEQ ID NO: 3093835 - protein, 20 aa, Giardia lamblia
YDNMIIVPVYYVSLTILNCL

SEQ ID NO: 3093836 - protein, 25 aa, Giardia lamblia
YDPTYLCVVVLPRACDLPTRLPVSF

SEQ ID NO: 3093837 - protein, 29 aa, Giardia lamblia
YDRTPVTTLFLFLSPFLTSCLYYSRNNSL

SEQ ID NO: 3093838 - protein, 28 aa, Giardia lamblia
YDSDECCRILLPLEQDLRLRDGGTAIMV

SEQ ID NO: 3093839 - protein, 19 aa, Giardia lamblia
YDVCTKCHSTCYTCFGPLE

SEQ ID NO: 3093840 - protein, 32 aa, Giardia lamblia
YDVGYSFITIKKRIFFLLKSFSTETVSLVDYY

SEQ ID NO: 3093841 - protein, 18 aa, Giardia lamblia
YDVLFCNDLLRSYKPVLV

SEQ ID NO: 3093842 - protein, 25 aa, Giardia lamblia
YDYSTILWSILKLNADQLKTTTYDL

SEQ ID NO: 3093843 - protein, 27 aa, Giardia lamblia
YEACTFGYLAYQYFGLFVLDQDEKDNK

SEQ ID NO: 3093844 - protein, 19 aa, Giardia lamblia
YEAEGHVWSVFYVRGNRLL

SEQ ID NO: 3093845 - protein, 20 aa, Giardia lamblia
YEAFMLIHLDTLPDAYLNIT

SEQ ID NO: 3093846 - protein, 18 aa, Giardia lamblia
YECHCGEGYYATGPYCTL

SEQ ID NO: 3093847 - protein, 18 aa, Giardia lamblia
YEEFLLSIVEEFNRLHAW

SEQ ID NO: 3093848 - protein, 19 aa, Giardia lamblia
YEHQFVHLHFFSTQNPRLM

SEQ ID NO: 3093849 - protein, 18 aa, Giardia lamblia
YELLPYEISVMKAALRTG

SEQ ID NO: 3093850 - protein, 22 aa, Giardia lamblia
YELPDPLRLVGCALFGTYLAIA

SEQ ID NO: 3093851 - protein, 20 aa, Giardia lamblia
YELSVIFLTELLKLANNMPD

SEQ ID NO: 3093852 - protein, 35 aa, Giardia lamblia
YERLRCLLGCWALEFGLLPYYRLFEPAGYLYKTEV

SEQ ID NO: 3093853 - protein, 31 aa, Giardia lamblia
YESALSFVCALWPLWVYLSQVFDKAICDVVS

SEQ ID NO: 3093854 - protein, 28 aa, Giardia lamblia
YESAPAWFEFLLFLFLALMVILGGFGIG

SEQ ID NO: 3093855 - protein, 29 aa, Giardia lamblia
YETSYLLRYFIYIFINRLTPLYSRTILEY

SEQ ID NO: 3093856 - protein, 29 aa, Giardia lamblia
YETYDFIGPTFWLTLYSLFLVIIATKNGD

SEQ ID NO: 3093857 - protein, 23 aa, Giardia lamblia
YEVRFHCCLIGSQTILRCSEQTF

SEQ ID NO: 3093858 - protein, 27 aa, Giardia lamblia
YEVSQLYYQFILFLISNFELEGVKEFQ

SEQ ID NO: 3093859 - protein, 17 aa, Giardia lamblia
YEYFRGLRDFTTSNFVF

SEQ ID NO: 3093860 - protein, 25 aa, Giardia lamblia
YEYLKFVVFTVHLFGRPTQVIQLVP

SEQ ID NO: 3093861 - protein, 25 aa, Giardia lamblia
YEYSDSYLLQFIEGLLLVEYHLPVS

SEQ ID NO: 3093862 - protein, 23 aa, Giardia lamblia
YFADFPYIMFSVFAILFVCMDQS

SEQ ID NO: 3093863 - protein, 24 aa, Giardia lamblia
YFAPVLRIFTELKCVYLAISYYIS

SEQ ID NO: 3093864 - protein, 25 aa, Giardia lamblia
YFAQFYGNYIYLRKEKGEALISDLC

SEQ ID NO: 3093865 - protein, 29 aa, Giardia lamblia
YFDKRSIVTLTFWFRVVLGACAAVFPPFF

SEQ ID NO: 3093866 - protein, 25 aa, Giardia lamblia
YFDMRHKAIFPPMLKKLNSVLEKLL

SEQ ID NO: 3093867 - protein, 35 aa, Giardia lamblia
YFIGILKSVLSFFILWLLAIIYLYSIELWQIRIPN

SEQ ID NO: 3093868 - protein, 29 aa, Giardia lamblia
YFIHVGMMVLLHQLLFVLGGIFCSTCNVA

SEQ ID NO: 3093869 - protein, 18 aa, Giardia lamblia
YFIYQSEQIADCLSTLQS

SEQ ID NO: 3093870 - protein, 24 aa, Giardia lamblia
YFMITYFLYVYILVAFVAFITPFE

SEQ ID NO: 3093871 - protein, 18 aa, Giardia lamblia
YFNLFLFACGHVVGALRD

SEQ ID NO: 3093872 - protein, 22 aa, Giardia lamblia
YFNSLIRVVRSLLLWLEQDGKI

SEQ ID NO: 3093873 - protein, 17 aa, Giardia lamblia
YFSLYTLIPTIPSLYAE

SEQ ID NO: 3093874 - protein, 24 aa, Giardia lamblia
YFSTLRLVIPAYTLIVYSLDDARP

SEQ ID NO: 3093875 - protein, 26 aa, Giardia lamblia
YFSTTQLSTWPAGCTALMLAAHSGSV

SEQ ID NO: 3093876 - protein, 18 aa, Giardia lamblia
YFVSFFNASADNLETVVA

SEQ ID NO: 3093877 - protein, 43 aa, Giardia lamblia
YFYRYRIHPITGSLLPLPLILKAWRYFVRFLYVYFTGKAKSGK

SEQ ID NO: 3093878 - protein, 24 aa, Giardia lamblia
YGALTLMYCICTFNSAVISHSLLK

SEQ ID NO: 3093879 - protein, 25 aa, Giardia lamblia
YGATLDSLLLQLIWERTVPNHFNSV

SEQ ID NO: 3093880 - protein, 29 aa, Giardia lamblia
YGESWTTYSWMQLAGFLLLIYSSQVYNGY

SEQ ID NO: 3093881 - protein, 24 aa, Giardia lamblia
YGGLFLFIMIVAVICIIYGIVVQI

SEQ ID NO: 3093882 - protein, 35 aa, Giardia lamblia
YGHELSYMKYIRIYLLIFIKFLRHLEYLHTAGVNH

SEQ ID NO: 3093883 - protein, 18 aa, Giardia lamblia
YGISWCYKGALATSALQV

SEQ ID NO: 3093884 - protein, 18 aa, Giardia lamblia
YGLLMALLVTIFDRPYKF

SEQ ID NO: 3093885 - protein, 31 aa, Giardia lamblia
YGLTFGTLLIANLLAYGLLFGAGSLFKLFPF

SEQ ID NO: 3093886 - protein, 31 aa, Giardia lamblia
YGNEKWNFTRLMYSVATRNYSLFFKTQPQAG

SEQ ID NO: 3093887 - protein, 22 aa, Giardia lamblia
YGPKLYEISLFLNTAGLSTPQL

SEQ ID NO: 3093888 - protein, 26 aa, Giardia lamblia
YGQDLDPFITCRALEAFLVIATRREL

SEQ ID NO: 3093889 - protein, 20 aa, Giardia lamblia
YGQLRQYVLARLKPLVDNVR

SEQ ID NO: 3093890 - protein, 29 aa, Giardia lamblia
YGSLDANLFYLNPLLRQALYGVYDNCINI

SEQ ID NO: 3093891 - protein, 26 aa, Giardia lamblia
YGTAIQRLLLLIKDFSTIVSGERNDT

SEQ ID NO: 3093892 - protein, 28 aa, Giardia lamblia
YGTYDSPVIPVLLYNPVKLKPVADELRR

SEQ ID NO: 3093893 - protein, 20 aa, Giardia lamblia
YGVFKLPDYHMAYPCSNTSA

SEQ ID NO: 3093894 - protein, 19 aa, Giardia lamblia
YGVPPAYLKDLLPLHIYSY

SEQ ID NO: 3093895 - protein, 25 aa, Giardia lamblia
YGVVAFACFVGNINLFLAPNNFAEI

SEQ ID NO: 3093896 - protein, 17 aa, Giardia lamblia
YGYFTFPLNHEDRLALT

SEQ ID NO: 3093897 - protein, 35 aa, Giardia lamblia
YHCYPVTQTLLYKLQPALPLPFNLLETLSVLPQTT

SEQ ID NO: 3093898 - protein, 20 aa, Giardia lamblia
YHDEFCLKFRVFQVLKQRPM

SEQ ID NO: 3093899 - protein, 31 aa, Giardia lamblia
YHDVGIHFRVVLFLLLVPIAVHIITILIEFW

SEQ ID NO: 3093900 - protein, 33 aa, Giardia lamblia
YHGPSIDVWAIGIILFAMICGHLPFDHDNTETL

SEQ ID NO: 3093901 - protein, 32 aa, Giardia lamblia; identical to SEQ ID NO: 3082130

SEQ ID NO: 3093902 - protein, 20 aa, Giardia lamblia
YHIIMDLCEGGDLRQFIDKR

SEQ ID NO: 3093903 - protein, 30 aa, Giardia lamblia
YHPSSLFFCNTPILYCGEFLIRRNCFKAVQ

SEQ ID NO: 3093904 - protein, 17 aa, Giardia lamblia
YHRVDSGLLFPLTNSNS

SEQ ID NO: 3093905 - protein, 49 aa, Giardia lamblia
YHSKMSIALIVVFWSVATLILLLFITVLSLFLKYRYKYTLASKRAKAVQ

SEQ ID NO: 3093906 - protein, 18 aa, Giardia lamblia
YHTGLYILEPINSDARYL

SEQ ID NO: 3093907 - protein, 27 aa, Giardia lamblia
YHTRVRYMLFAFPQIISLICCSTALRK

SEQ ID NO: 3093908 - protein, 33 aa, Giardia lamblia
YIAKNMYHVVFYYLTSKRFLQRRALLYNTHMLP

SEQ ID NO: 3093909 - protein, 24 aa, Giardia lamblia
YIATKIGVYVIAGYIARRIKTYLH

SEQ ID NO: 3093910 - protein, 21 aa, Giardia lamblia
YIAVLLLDATLLIFKLETKER

SEQ ID NO: 3093911 - protein, 17 aa, Giardia lamblia
YIAYGVVLNVALVACVK

SEQ ID NO: 3093912 - protein, 28 aa, Giardia lamblia
YICGEVCLPMMMLFGFAALASYGLLTDA

SEQ ID NO: 3093913 - protein, 27 aa, Giardia lamblia
YIDEKVQMYAILYYFPRNSDINRDMHL

SEQ ID NO: 3093914 - protein, 20 aa, Giardia lamblia
YIDIILCVFPTTLLTKLFAT

SEQ ID NO: 3093915 - protein, 18 aa, Giardia lamblia
YIDPLYFAYVAVGALNVG

SEQ ID NO: 3093916 - protein, 22 aa, Giardia lamblia
YIESILSFRLLKDYNSPHRGTV

SEQ ID NO: 3093917 - protein, 25 aa, Giardia lamblia
YIETIIALFILAFDESSAMAFLYHI

SEQ ID NO: 3093918 - protein, 17 aa, Giardia lamblia
YIFIKHMQRLPAPLIYY

SEQ ID NO: 3093919 - protein, 27 aa, Giardia lamblia
YIGYLTLTPDLLLVTGIPFYPKVSPDI

SEQ ID NO: 3093920 - protein, 27 aa, Giardia lamblia
YIHDNTKVYFLMMFNEKIKFVSGRDLT

SEQ ID NO: 3093921 - protein, 18 aa, Giardia lamblia
YIHVIFKVISVYSGFRYQ

SEQ ID NO: 3093922 - protein, 17 aa, Giardia lamblia
YIIASFVLAFLSLVCYL

SEQ ID NO: 3093923 - protein, 29 aa, Giardia lamblia
YIICPPEQRFLLLYTFMKRRSDKKIIVFL

SEQ ID NO: 3093924 - protein, 19 aa, Giardia lamblia
YIIMHKYVTSLRDLRLKLF

SEQ ID NO: 3093925 - protein, 28 aa, Giardia lamblia
YIIQLFELIRAYWAPRLLGLTILSIVMG

SEQ ID NO: 3093926 - protein, 25 aa, Giardia lamblia
YIKAGYAFLIAQILKHGVQFSTEVL

SEQ ID NO: 3093927 - protein, 24 aa, Giardia lamblia
YIKHKDLLPRLRATLVLTANEQSM

SEQ ID NO: 3093928 - protein, 17 aa, Giardia lamblia
YIKRDIVFIVHPSKLRT

SEQ ID NO: 3093929 - protein, 18 aa, Giardia lamblia
YIKSLSDKPFPQISALVV

SEQ ID NO: 3093930 - protein, 38 aa, Giardia lamblia
YILAQFSFQLLIFMITWLPYFIIAYMMPGGTDVYPWID

SEQ ID NO: 3093931 - protein, 18 aa, Giardia lamblia
YILIRHVLDYIIVRDVNK

SEQ ID NO: 3093932 - protein, 43 aa, Giardia lamblia
YIPIFHVAFLTRSISGMSWVWTLPFCAFMFFYDEMRKLVLRLC

SEQ ID NO: 3093933 - protein, 19 aa, Giardia lamblia
YIPWIAIPVLGIIGSLTGY

SEQ ID NO: 3093934 - protein, 19 aa, Giardia lamblia
YITFFLYFCVGLVSTVLCW

SEQ ID NO: 3093935 - protein, 18 aa, Giardia lamblia
YITTANDAFNLFREKYRN

SEQ ID NO: 3093936 - protein, 32 aa, Giardia lamblia
YITTAYLHVVLILATFWFFDLDAHTHLTDWYN

SEQ ID NO: 3093937 - protein, 29 aa, Giardia lamblia
YIVSDWALKFLRLFRQKTQLYFPTSYLTN

SEQ ID NO: 3093938 - protein, 29 aa, Giardia lamblia
YIVTLSSYIKFLLRILQFFSDESPTLLLP

SEQ ID NO: 3093939 - protein, 17 aa, Giardia lamblia
YIVVDGVVIRYRRSYYY

SEQ ID NO: 3093940 - protein, 34 aa, Giardia lamblia
YIYNTIGFICAYLDILLRLIENNLIKRSLRILDM

SEQ ID NO: 3093941 - protein, 17 aa, Giardia lamblia
YKAKKTFHFLLDSHSST

SEQ ID NO: 3093942 - protein, 27 aa, Giardia lamblia
YKARENTPLFFFTLSTDSDALHYIISN

SEQ ID NO: 3093943 - protein, 22 aa, Giardia lamblia
YKCRPAQLVVYVAPLKALVHEI

SEQ ID NO: 3093944 - protein, 17 aa, Giardia lamblia
YKCVAYPVYFLMQCSWF

SEQ ID NO: 3093945 - protein, 18 aa, Giardia lamblia
YKDLAYCLLTIVFVPEVG

SEQ ID NO: 3093946 - protein, 18 aa, Giardia lamblia
YKDMLVCFPPPQALDKLS

SEQ ID NO: 3093947 - protein, 19 aa, Giardia lamblia
YKKTLSSRAFLPIFANLLL

SEQ ID NO: 3093948 - protein, 21 aa, Giardia lamblia
YKLIVPSITLLPLVGAYSGSG

SEQ ID NO: 3093949 - protein, 25 aa, Giardia lamblia
YKLYGGRALIKLLLRVPSSGMEYTL

SEQ ID NO: 3093950 - protein, 21 aa, Giardia lamblia
YKNFKWQTFKYLRGLTEFSNY

SEQ ID NO: 3093951 - protein, 18 aa, Giardia lamblia
YKNTWIVSPDGIGSVATA

SEQ ID NO: 3093952 - protein, 19 aa, Giardia lamblia
YKRLGNIFIGLFQIVSVAN

SEQ ID NO: 3093953 - protein, 18 aa, Giardia lamblia
YKRLGNILIGLFQIVSVA

SEQ ID NO: 3093954 - protein, 18 aa, Giardia lamblia
YKRYLQMLKELNTTLISV

SEQ ID NO: 3093955 - protein, 24 aa, Giardia lamblia
YKSFISHLFSNVLNIILSFTPILN

SEQ ID NO: 3093956 - protein, 30 aa, Giardia lamblia
YKSRFQSDIPPLLQFYDWIAVGFDNVKAND

SEQ ID NO: 3093957 - protein, 24 aa, Giardia lamblia
YKSVIVQVYFGVLAVLLERDSASI

SEQ ID NO: 3093958 - protein, 27 aa, Giardia lamblia
YKTDHDGLSLWLYLLHVRGNSSEARAS

SEQ ID NO: 3093959 - protein, 26 aa, Giardia lamblia
YKTMNLLFMESVWWVFKELYDKGLVY

SEQ ID NO: 3093960 - protein, 23 aa, Giardia lamblia
YKTPLQILKAYLSSAKALLHHVN

SEQ ID NO: 3093961 - protein, 18 aa, Giardia lamblia
YKVASPPGNLMCTEATTA

SEQ ID NO: 3093962 - protein, 29 aa, Giardia lamblia
YLAFVRQTYQFLPVPYHIGDGLFSNPALS

SEQ ID NO: 3093963 - protein, 17 aa, Giardia lamblia
YLAPPDWPKNDNYSSTD

SEQ ID NO: 3093964 - protein, 18 aa, Giardia lamblia
YLAPRLLNYVTLFGQMHQ

SEQ ID NO: 3093965 - protein, 24 aa, Giardia lamblia
YLAQSLLDIIYRSTGFKGAYKRMA

SEQ ID NO: 3093966 - protein, 19 aa, Giardia lamblia
YLDIPYTYEEGRRLLAQYP

SEQ ID NO: 3093967 - protein, 17 aa, Giardia lamblia
YLDMPYDLKTGAISLSD

SEQ ID NO: 3093968 - protein, 22 aa, Giardia lamblia
YLEIIDCLLPYEGLLMDVKAID

SEQ ID NO: 3093969 - protein, 19 aa, Giardia lamblia
YLELRRNNFFSTFRQRKYL

SEQ ID NO: 3093970 - protein, 29 aa, Giardia lamblia
YLEQKRNLFARFYFVSDPVLLEILGQQSD

SEQ ID NO: 3093971 - protein, 18 aa, Giardia lamblia
YLEVIRSITLVLLVAELF

SEQ ID NO: 3093972 - protein, 17 aa, Giardia lamblia
YLFGIDLHQNVLSLVVT

SEQ ID NO: 3093973 - protein, 20 aa, Giardia lamblia
YLFRLLPFPERVKLGLFLTI

SEQ ID NO: 3093974 - protein, 20 aa, Giardia lamblia
YLHFSDPRYLSYDRPIVYFA

SEQ ID NO: 3093975 - protein, 19 aa, Giardia lamblia
YLIALRLVCQLLPEQVLHA

SEQ ID NO: 3093976 - protein, 18 aa, Giardia lamblia
YLIHSFVFDIQYRVQVVL

SEQ ID NO: 3093977 - protein, 18 aa, Giardia lamblia
YLIPTLFQYMNESLKNAV

SEQ ID NO: 3093978 - protein, 19 aa, Giardia lamblia
YLIVGCVFVYKSVLLTVRM

SEQ ID NO: 3093979 - protein, 30 aa, Giardia lamblia
YLLISLVCYVLLFISLFIPFSESGLAALSA

SEQ ID NO: 3093980 - protein, 19 aa, Giardia lamblia
YLLKAIREALFMVSTVLGD

SEQ ID NO: 3093981 - protein, 34 aa, Giardia lamblia
YLLNPDTFLPLLQALPSGAFWKWAILLKNVSTYE

SEQ ID NO: 3093982 - protein, 17 aa, Giardia lamblia
YLMLRYDANRMFAPPRA

SEQ ID NO: 3093983 - protein, 28 aa, Giardia lamblia
YLNGAALFMLSFDDKLFMFRHLMRLGSN

SEQ ID NO: 3093984 - protein, 17 aa, Giardia lamblia
YLNNELSRIFLKRLYKL

SEQ ID NO: 3093985 - protein, 18 aa, Giardia lamblia
YLNPLRAILPKNSKVFTL

SEQ ID NO: 3093986 - protein, 17 aa, Giardia lamblia
YLNVLAQPESRFISNFG

SEQ ID NO: 3093987 - protein, 39 aa, Giardia lamblia
YLNYVAEIFCMLRQDVYIIISLLYILQGGGMAYLDEAAQ

SEQ ID NO: 3093988 - protein, 25 aa, Giardia lamblia
YLPDTWKHIYDMLIYFCRFGNTKKK

SEQ ID NO: 3093989 - protein, 17 aa, Giardia lamblia
YLPRSPVPRFPPDPSDT

SEQ ID NO: 3093990 - protein, 24 aa, Giardia lamblia
YLPSWQLLQLCTLANDLRVKQGAL

SEQ ID NO: 3093991 - protein, 19 aa, Giardia lamblia
YLQQIGFYSVCTKCPDTHK

SEQ ID NO: 3093992 - protein, 17 aa, Giardia lamblia
YLRALIAAHIRRLQEKI

SEQ ID NO: 3093993 - protein, 19 aa, Giardia lamblia
YLRQLRIEIPETALAITMH

SEQ ID NO: 3093994 - protein, 29 aa, Giardia lamblia
YLRSCNSWPDFPWHIFSDCLTPSNIWLTP

SEQ ID NO: 3093995 - protein, 23 aa, Giardia lamblia
YLSGLYFMAPPPQALSPASNVFL

SEQ ID NO: 3093996 - protein, 17 aa, Giardia lamblia
YLSSHVLFIPITDASFL

SEQ ID NO: 3093997 - protein, 18 aa, Giardia lamblia
YLSTNKCFRCTAGDGASA

SEQ ID NO: 3093998 - protein, 31 aa, Giardia lamblia
YLSVTLLTRFLTFLNVFLPVKVYQKIWIFAP

SEQ ID NO: 3093999 - protein, 18 aa, Giardia lamblia
YLTLTPGGYTRYVPAAFN

SEQ ID NO: 3094000 - protein, 19 aa, Giardia lamblia
YLTNFALYDNLLVIAKHGD

SEQ ID NO: 3094001 - protein, 17 aa, Giardia lamblia
YLVLLAATRDFNDEIRP

SEQ ID NO: 3094002 - protein, 18 aa, Giardia lamblia
YLVNVYSIFRDSALNYLY

SEQ ID NO: 3094003 - protein, 21 aa, Giardia lamblia
YLWCAVLGLTGLLISLLVALV

SEQ ID NO: 3094004 - protein, 20 aa, Giardia lamblia
YLWTETLNTTIIYPSFEQII

SEQ ID NO: 3094005 - protein, 24 aa, Giardia lamblia
YMCYRDNLAFARPLPLFKTNAIIR

SEQ ID NO: 3094006 - protein, 39 aa, Giardia lamblia
YMDAAFIHTAPNNIFFWLIYPIQILFDTIYVFLHILVLC

SEQ ID NO: 3094007 - protein, 27 aa, Giardia lamblia
YMDELVQTPFLYAFDYIKDHTKLVVSL

SEQ ID NO: 3094008 - protein, 19 aa, Giardia lamblia
YMEGHLLGIFTLHNGIILQ

SEQ ID NO: 3094009 - protein, 26 aa, Giardia lamblia
YMILQLSIFLECILTLIFAAHFRGPF

SEQ ID NO: 3094010 - protein, 27 aa, Giardia lamblia
YMILQLSIFLECILTLIFAAHFRGPFQ

SEQ ID NO: 3094011 - protein, 29 aa, Giardia lamblia
YMILQLSIFLECILTLIFAAHFRGPFQTT

SEQ ID NO: 3094012 - protein, 17 aa, Giardia lamblia
YMNGCVPRACFPQYNPR

SEQ ID NO: 3094013 - protein, 17 aa, Giardia lamblia
YMQTLTCKGLVYSASDL

SEQ ID NO: 3094014 - protein, 17 aa, Giardia lamblia
YMRFLRDRNDQLYRAAA

SEQ ID NO: 3094015 - protein, 20 aa, Giardia lamblia
YMVCLSINMLLLNTASQSST

SEQ ID NO: 3094016 - protein, 22 aa, Giardia lamblia
YNEIYKIVLPLREAAAEAAMQL

SEQ ID NO: 3094017 - protein, 28 aa, Giardia lamblia
YNFAWLPALLFQCQIIMTLIYYVSAARE

SEQ ID NO: 3094018 - protein, 24 aa, Giardia lamblia
YNFNDMSFWAIFGPTLGTHNDLPK

SEQ ID NO: 3094019 - protein, 32 aa, Giardia lamblia
YNLLGNVTVSYPWLPVPSFTGVFNGNGYALKG

SEQ ID NO: 3094020 - protein, 19 aa, Giardia lamblia
YNPPKILISYLQLSNLHNY

SEQ ID NO: 3094021 - protein, 25 aa, Giardia lamblia
YNQINYTIPIIIIAGHYHQIKNTYC

SEQ ID NO: 3094022 - protein, 23 aa, Giardia lamblia
YNRQKYVVTLLESLSFVLHYADC

SEQ ID NO: 3094023 - protein, 27 aa, Giardia lamblia
YNSCNFTFRYLYDLDTLRLILASKFSM

SEQ ID NO: 3094024 - protein, 27 aa, Giardia lamblia
YNSNLFYVHMQLSYLLSKMTVFCLINA

SEQ ID NO: 3094025 - protein, 19 aa, Giardia lamblia
YNSVISALNCNFLINFTGC

SEQ ID NO: 3094026 - protein, 17 aa, Giardia lamblia
YNVFMVCYGIIPCFAVL

SEQ ID NO: 3094027 - protein, 25 aa, Giardia lamblia
YNVLPELLRFIDDLTKWYIRFNRDT

SEQ ID NO: 3094028 - protein, 30 aa, Giardia lamblia
YNVTNLYYSNIFLLNFTQIAPLNVSELIAQ

SEQ ID NO: 3094029 - protein, 25 aa, Giardia lamblia
YNVVTGLPCLLPYVVALSIDTKILG

SEQ ID NO: 3094030 - protein, 26 aa, Giardia lamblia
YNYTMAFNYLLLVGSYLYADYTVYPL

SEQ ID NO: 3094031 - protein, 21 aa, Giardia lamblia
YNYVYFVCHLFSPLSHNIDST

SEQ ID NO: 3094032 - protein, 28 aa, Giardia lamblia
YPASFVVVSFYKMFGYPSGVGALLVRND

SEQ ID NO: 3094033 - protein, 28 aa, Giardia lamblia
YPIAAFDGWLPLILSIVTSLSISAFTLF

SEQ ID NO: 3094034 - protein, 21 aa, Giardia lamblia
YPLPTAAFIPPISSAVSCLLE

SEQ ID NO: 3094035 - protein, 18 aa, Giardia lamblia
YPNFSLVCAFYHGSYHPL

SEQ ID NO: 3094036 - protein, 26 aa, Giardia lamblia
YPRQFKQSFFFLTKDLNISFLDDNFE

SEQ ID NO: 3094037 - protein, 31 aa, Giardia lamblia
YPVLNRSAFNNLILWCITASRAPCMATGIMQ

SEQ ID NO: 3094038 - protein, 32 aa, Giardia lamblia
YPYLINHSYVIQLFPLLLASVARLSGGDPALK

SEQ ID NO: 3094039 - protein, 20 aa, Giardia lamblia
YQCGKLPNLYSDCASILYGV

SEQ ID NO: 3094040 - protein, 19 aa, Giardia lamblia
YQCQCRAHFTGVFCQEFNC

SEQ ID NO: 3094041 - protein, 26 aa, Giardia lamblia
YQDSRLTLLVRLDFIVAILTGNRDHV

SEQ ID NO: 3094042 - protein, 32 aa, Giardia lamblia
YQEAYTYWYDCFMLDLLFNIPDTFSLKLFNEY

SEQ ID NO: 3094043 - protein, 36 aa, Giardia lamblia
YQLERIIFSMFLVHVFLFEIFKRTIFMIKNRPHFCK

SEQ ID NO: 3094044 - protein, 24 aa, Giardia lamblia
YQMLQGAIIIFTALLSRCFLKRKT

SEQ ID NO: 3094045 - protein, 32 aa, Giardia lamblia
YQRHNQWAIKWPPLGWASGISWYMKPITKQRN

SEQ ID NO: 3094046 - protein, 35 aa, Giardia lamblia
YQRILEYYIKLYSSVRLRIYRMKTSFDRPSQSTIL

SEQ ID NO: 3094047 - protein, 26 aa, Giardia lamblia
YQSANAVTFLLILQYMTKRIVERKDL

SEQ ID NO: 3094048 - protein, 24 aa, Giardia lamblia
YQSYTKPHVPFYLSRRMVLNLESC

SEQ ID NO: 3094049 - protein, 28 aa, Giardia lamblia
YQVCETYPYLLFLPNQAIIRPNTFVDNR

SEQ ID NO: 3094050 - protein, 19 aa, Giardia lamblia
YQVKPFVAALTDGRLLMVV

SEQ ID NO: 3094051 - protein, 35 aa, Giardia lamblia
YQVYLLAAILQPGLLYLAPFYLLVSRTQQLRYRSL

SEQ ID NO: 3094052 - protein, 25 aa, Giardia lamblia
YQYLQQLSYLFTRSFIHPKAPSCSL

SEQ ID NO: 3094053 - protein, 19 aa, Giardia lamblia
YQYNNFIMLVLTLGNSTNK

SEQ ID NO: 3094054 - protein, 24 aa, Giardia lamblia
YRAEMVRAFGRNLWYFRRSFEDAS

SEQ ID NO: 3094055 - protein, 25 aa, Giardia lamblia
YRCINGACNLGYRFDPRTSSCMKCP

SEQ ID NO: 3094056 - protein, 26 aa, Giardia lamblia
YRCVCLDFYTLVNKDCIPTRCLKDGK

SEQ ID NO: 3094057 - protein, 25 aa, Giardia lamblia
YRDRLSHLLPLILQMLFAFYNMYSS

SEQ ID NO: 3094058 - protein, 19 aa, Giardia lamblia
YRFIVTFDIDGANPLVYCI

SEQ ID NO: 3094059 - protein, 21 aa, Giardia lamblia
YRHPPFLSFTMAKKLKERLFE

SEQ ID NO: 3094060 - protein, 17 aa, Giardia lamblia
YRLALSLILIILGVFYS

SEQ ID NO: 3094061 - protein, 25 aa, Giardia lamblia
YRPQPNLFALFDLPQVRIADILLKL

SEQ ID NO: 3094062 - protein, 29 aa, Giardia lamblia
YRPVAARAAMLYFLLNSLNVIDHFYQFSL

SEQ ID NO: 3094063 - protein, 20 aa, Giardia lamblia
YRQDVWPRLLNAQNLYQQNE

SEQ ID NO: 3094064 - protein, 29 aa, Giardia lamblia
YRQPLASLFTFMTLLLLQLSPNSDEDGFV

SEQ ID NO: 3094065 - protein, 25 aa, Giardia lamblia
YRSDITYPLFVLIPSSLTPHNIFVP

SEQ ID NO: 3094066 - protein, 33 aa, Giardia lamblia
YRSYYRRYLELLPSFLHLVHKFFCPAYLFHSNP

SEQ ID NO: 3094067 - protein, 19 aa, Giardia lamblia
YRVFRLRPTAVTLGGVAYL

SEQ ID NO: 3094068 - protein, 25 aa, Giardia lamblia
YRVKPLYLNLQLFQQYIMEPSTDVN

SEQ ID NO: 3094069 - protein, 17 aa, Giardia lamblia
YSAEDAILEPGACKVCK

SEQ ID NO: 3094070 - protein, 26 aa, Giardia lamblia
YSALMLAVMSPLAMTYYKTAASSAGS

SEQ ID NO: 3094071 - protein, 18 aa, Giardia lamblia
YSAYLKETKLPRDLLQSS

SEQ ID NO: 3094072 - protein, 20 aa, Giardia lamblia
YSCDPCPAGFVSYEGECLPR

SEQ ID NO: 3094073 - protein, 19 aa, Giardia lamblia
YSCHLAFISALERYEELLQ

SEQ ID NO: 3094074 - protein, 21 aa, Giardia lamblia
YSCYNILITIFPLIVGKVSRY

SEQ ID NO: 3094075 - protein, 24 aa, Giardia lamblia
YSDALNMLFFRITAEKEIAADIND

SEQ ID NO: 3094076 - protein, 23 aa, Giardia lamblia
YSDSTVHLKWRPATCGLTYASTV

SEQ ID NO: 3094077 - protein, 22 aa, Giardia lamblia
YSDYITRVRQLQSPLFQCVTTM

SEQ ID NO: 3094078 - protein, 25 aa, Giardia lamblia
YSEFIRPYCCAFIVLLDVCAYLNKR

SEQ ID NO: 3094079 - protein, 34 aa, Giardia lamblia
YSEPLSFLTMFTIVIVLFLFCIALGFTILACFLI

SEQ ID NO: 3094080 - protein, 28 aa, Giardia lamblia
YSEQCFYIPIFFFLMIPRLQPVSSVIQA

SEQ ID NO: 3094081 - protein, 25 aa, Giardia lamblia
YSEQLLVSALLAYDNFMKYLISKVA

SEQ ID NO: 3094082 - protein, 33 aa, Giardia lamblia
YSERRLLQLQRKALLLLHWKIFISRRQYDWMCR

SEQ ID NO: 3094083 - protein, 18 aa, Giardia lamblia
YSFNLAVKRLLNPSYILL

SEQ ID NO: 3094084 - protein, 28 aa, Giardia lamblia
YSHPVVRLRMRYLFRFFIDCEASENPVY

SEQ ID NO: 3094085 - protein, 17 aa, Giardia lamblia
YSILYKDTEFRIRGGIT

SEQ ID NO: 3094086 - protein, 23 aa, Giardia lamblia
YSISIFLLYLLGGVFVCILIGTC

SEQ ID NO: 3094087 - protein, 25 aa, Giardia lamblia
YSIVFTLLDPTYYRDWFLRYDGQNC

SEQ ID NO: 3094088 - protein, 25 aa, Giardia lamblia
YSLMNMYIIRIMSGFINFTVSRLAS

SEQ ID NO: 3094089 - protein, 31 aa, Giardia lamblia
YSNGFRFLRNTLGFMGFIDLSYRIATIDTEG

SEQ ID NO: 3094090 - protein, 27 aa, Giardia lamblia
YSRSAKLFLLAFLRKDELVYSCCQELF

SEQ ID NO: 3094091 - protein, 20 aa, Giardia lamblia
YSRYLLFRKSTVHSFLCHTL

SEQ ID NO: 3094092 - protein, 17 aa, Giardia lamblia
YSSIGMYTIFKGDTILA

SEQ ID NO: 3094093 - protein, 17 aa, Giardia lamblia
YSSIIVPELSIWNLKEA

SEQ ID NO: 3094094 - protein, 20 aa, Giardia lamblia
YSSIRICLRYNILSVACSLI

SEQ ID NO: 3094095 - protein, 27 aa, Giardia lamblia
YSSKGNPLLRILYRSLLQLDSQKQTST

SEQ ID NO: 3094096 - protein, 24 aa, Giardia lamblia
YSSKWGHLEAVKLLLPVEGRKTNK

SEQ ID NO: 3094097 - protein, 20 aa, Giardia lamblia
YSSLIVSILYGYVYSNDPLE

SEQ ID NO: 3094098 - protein, 21 aa, Giardia lamblia
YSSLWAQTYLTYSLPITMGEN

SEQ ID NO: 3094099 - protein, 22 aa, Giardia lamblia
YSTLLMICLPISLAVSVGVTVT

SEQ ID NO: 3094100 - protein, 24 aa, Giardia lamblia
YSTVVRIFMGMAATGSILCLDEFN

SEQ ID NO: 3094101 - protein, 25 aa, Giardia lamblia
YSVAIHLLRCFLTSFSAISSKALET

SEQ ID NO: 3094102 - protein, 23 aa, Giardia lamblia
YSVVSFYNVRYSTHSYGFIACNK

SEQ ID NO: 3094103 - protein, 27 aa, Giardia lamblia
YTAAYLFNIFARVIIDLPYLISSLSSA

SEQ ID NO: 3094104 - protein, 32 aa, Giardia lamblia
YTANDCFLSFLILAAEYKYIWSNTVYLKARSS

SEQ ID NO: 3094105 - protein, 28 aa, Giardia lamblia
YTAPEPVISLFLSRFAHTLRLGATTASS

SEQ ID NO: 3094106 - protein, 25 aa, Giardia lamblia
YTEHLHLLDKLFSTLQLTVFNFADL

SEQ ID NO: 3094107 - protein, 19 aa, Giardia lamblia
YTEIPRYFPLNKKAADQLY

SEQ ID NO: 3094108 - protein, 21 aa, Giardia lamblia
YTEPYFNFYSVQAVLTYSCET

SEQ ID NO: 3094109 - protein, 27 aa, Giardia lamblia
YTGYEFVAFKLLYPTGVYVYYIDGILQ

SEQ ID NO: 3094110 - protein, 18 aa, Giardia lamblia
YTHAYCCMLTHAAELRVS

SEQ ID NO: 3094111 - protein, 37 aa, Giardia lamblia
YTICSSCTDDFYLDSLFFGCFSCHSSCSTCSGPSHFD

SEQ ID NO: 3094112 - protein, 27 aa, Giardia lamblia
YTIGEILILFLHYYAHVFNYDLYYLQV

SEQ ID NO: 3094113 - protein, 22 aa, Giardia lamblia
YTKFPIEYRIRRLADLLLQCNL

SEQ ID NO: 3094114 - protein, 25 aa, Giardia lamblia
YTLESLVGIIYWINAAQNVATFNLE

SEQ ID NO: 3094115 - protein, 21 aa, Giardia lamblia
YTLESYRLLKQLLLSSSPLEA

SEQ ID NO: 3094116 - protein, 30 aa, Giardia lamblia
YTLSDELNYLGLLNLLFSTLDYILSSFFSP

SEQ ID NO: 3094117 - protein, 20 aa, Giardia lamblia
YTQKFIVLTSLNRAATNYAY

SEQ ID NO: 3094118 - protein, 20 aa, Giardia lamblia
YTQLLSFWINETYYSVSHIQ

SEQ ID NO: 3094119 - protein, 19 aa, Giardia lamblia
YTREGISGLLLVGIAKYYK

SEQ ID NO: 3094120 - protein, 18 aa, Giardia lamblia
YTRGKYLDPKPFPSNYFC

SEQ ID NO: 3094121 - protein, 61 aa, Giardia lamblia
YTRIYVSPRQIVAVCLRFLLPTVCFMATGVGLSLYPQSRLLMLLLALLECMFVAKISKFSI

SEQ ID NO: 3094122 - protein, 25 aa, Giardia lamblia
YTSDSYINLRLTWSNSRSLGSGNRV

SEQ ID NO: 3094123 - protein, 19 aa, Giardia lamblia
YTSLLITELLTLGIGIYEW

SEQ ID NO: 3094124 - protein, 22 aa, Giardia lamblia
YTTEILSWMSFAMFTRSWVCAV

SEQ ID NO: 3094125 - protein, 28 aa, Giardia lamblia
YTTPKSFLELISLYIKLLHGRRREIYDQ

SEQ ID NO: 3094126 - protein, 27 aa, Giardia lamblia
YTVLLDLINFNIYYLRKMHALTDQFFA

SEQ ID NO: 3094127 - protein, 19 aa, Giardia lamblia
YTYVVFTTILRVVPIWYFY

SEQ ID NO: 3094128 - protein, 30 aa, Giardia lamblia
YVDCIKWLQYVSGIIDMRPSYDADLLVATN

SEQ ID NO: 3094129 - protein, 17 aa, Giardia lamblia
YVFPIETFMPPAVDGIF

SEQ ID NO: 3094130 - protein, 17 aa, Giardia lamblia
YVGAFTKGVFHGSGELQ

SEQ ID NO: 3094131 - protein, 17 aa, Giardia lamblia
YVGGKLQYSECGALSPF

SEQ ID NO: 3094132 - protein, 20 aa, Giardia lamblia
YVGKSLFRVLIRKLFNPFCV

SEQ ID NO: 3094133 - protein, 18 aa, Giardia lamblia
YVITFTLGGCLVLVNIAL

SEQ ID NO: 3094134 - protein, 25 aa, Giardia lamblia
YVLSNLYSLIYRKSSAILIGSPINA

SEQ ID NO: 3094135 - protein, 18 aa, Giardia lamblia
YVLSYFMSALRQVFSFNS

SEQ ID NO: 3094136 - protein, 30 aa, Giardia lamblia
YVMEDIYPQWSVFILLLFHGADRDMRYIAQ

SEQ ID NO: 3094137 - protein, 17 aa, Giardia lamblia
YVMFCTPGMLQSGVSKE

SEQ ID NO: 3094138 - protein, 21 aa, Giardia lamblia
YVRFEYIYVPRISTGSIDEIL

SEQ ID NO: 3094139 - protein, 17 aa, Giardia lamblia
YVRLRGIYILSSTGRHF

SEQ ID NO: 3094140 - protein, 17 aa, Giardia lamblia
YVRSLRSFGWPGRTGSP

SEQ ID NO: 3094141 - protein, 21 aa, Giardia lamblia
YVRYHFPSFNLAVISFEDPLR

SEQ ID NO: 3094142 - protein, 26 aa, Giardia lamblia
YVSFSYKLDFLGMLVSPVTLVLVALI

SEQ ID NO: 3094143 - protein, 18 aa, Giardia lamblia
YVSLIGLIIVVSQQFVQT

SEQ ID NO: 3094144 - protein, 30 aa, Giardia lamblia
YVSLNVLFYVLFMLCRLMAPYTPFVCDWMY

SEQ ID NO: 3094145 - protein, 19 aa, Giardia lamblia
YVSLPLADQYLLITRKHNE

SEQ ID NO: 3094146 - protein, 27 aa, Giardia lamblia
YVTFCLTLLWHSPASRLRIFRTLFATC

SEQ ID NO: 3094147 - protein, 18 aa, Giardia lamblia
YVTHNYYTYLKEHKRRYL

SEQ ID NO: 3094148 - protein, 17 aa, Giardia lamblia
YVTPLPKQRRTPVKWKK

SEQ ID NO: 3094149 - protein, 19 aa, Giardia lamblia
YVVFLGRVVCMLSTMPPAA

SEQ ID NO: 3094150 - protein, 25 aa, Giardia lamblia
YVVSFIRRYMPILEVPYRVGEEIFV

SEQ ID NO: 3094151 - protein, 20 aa, Giardia lamblia
YVVSLIMMFLMMDCMRRTKV

SEQ ID NO: 3094152 - protein, 27 aa, Giardia lamblia
YVVSSSYLPDLLLRAALQDLKKQMATT

SEQ ID NO: 3094153 - protein, 20 aa, Giardia lamblia
YWLSNIVIGVALSALLSVLV

SEQ ID NO: 3094154 - protein, 32 aa, Giardia lamblia
YYAEIPIIVIAYLLEIITPAFFKLLSMNLMQE

SEQ ID NO: 3094155 - protein, 25 aa, Giardia lamblia
YYCSSDYFLMLGSCVSAERAPGNTV

SEQ ID NO: 3094156 - protein, 20 aa, Giardia lamblia
YYCTGCTTGFKAIDGKCVSE

SEQ ID NO: 3094157 - protein, 19 aa, Giardia lamblia
YYDNYLYMNFTGPGVEYSK

SEQ ID NO: 3094158 - protein, 24 aa, Giardia lamblia
YYEGRLHHPYLCPTFVAGVVRISR

SEQ ID NO: 3094159 - protein, 17 aa, Giardia lamblia
YYGARRALASFLTELTG

SEQ ID NO: 3094160 - protein, 27 aa, Giardia lamblia
YYHDHVTIPFAPLLKRGSALLDQMADT

SEQ ID NO: 3094161 - protein, 23 aa, Giardia lamblia
YYHGKILDFCRGHFYGTTFNPEK

SEQ ID NO: 3094162 - protein, 19 aa, Giardia lamblia
YYHSQKPFFISRSSALQEE

SEQ ID NO: 3094163 - protein, 26 aa, Giardia lamblia
YYIRFKDFDFADLLEYIITTVKQPAP

SEQ ID NO: 3094164 - protein, 20 aa, Giardia lamblia
YYLIMRDPVISSPRPIRVEV

SEQ ID NO: 3094165 - protein, 35 aa, Giardia lamblia
YYMSFKGNPEWSWFFSYPFSPLISDLALYTACTGS

SEQ ID NO: 3094166 - protein, 25 aa, Giardia lamblia
YYNILRIVSVFFLVLFRSPYTPSLG

SEQ ID NO: 3094167 - protein, 23 aa, Giardia lamblia
YYQRFTSWDLAAQQFLWGGFCAS

SEQ ID NO: 3094168 - protein, 25 aa, Giardia lamblia
YYSILKMKMAILRLLSMTSVISGLA

SEQ ID NO: 3094169 - protein, 29 aa, Giardia lamblia
YYSLVSSPFVFLYMTFNISLGNKYAILTN

SEQ ID NO: 3094170 - protein, 18 aa, Giardia lamblia
YYTYLKEHKRRYLLYKLF

SEQ ID NO: 3094171 - protein, 27 aa, Giardia lamblia
YYYEYHGQIPRLIISPTIDSYRQIFLD

SEQ ID NO: 3094172 - protein, 33 aa, Giardia lamblia
IVVLLVLAVAGFLVWWFVFRRGGRPKRGAKYTS

SEQ ID NO: 3094173 - protein, 25 aa, Giardia lamblia
IMSDYYLVFLLLLGSVIVAGRAARE

SEQ ID NO: 3094174 - protein, 22 aa, Giardia lamblia
AAIVILVLLLIGVCAAIPFIVK

SEQ ID NO: 3094175 - protein, 23 aa, Giardia lamblia
AALTALFVLIWMGVHYTLTSVKS

SEQ ID NO: 3094176 - protein, 22 aa, Giardia lamblia
ASVLLLHMFFYNTSVAIAFGTV

SEQ ID NO: 3094177 - protein, 19 aa, Giardia lamblia
CEDGYYVTWYGGCGACAEG

SEQ ID NO: 3094178 - protein, 18 aa, Giardia lamblia
GPRFFLHAGGCYEIGRSP

SEQ ID NO: 3094179 - protein, 27 aa, Giardia lamblia
IVILGLIIVGFIVATPFLVKLAKKRGV

SEQ ID NO: 3094180 - protein, 17 aa, Giardia lamblia
KDTHLLYYGGCYAKGAA

SEQ ID NO: 3094181 - protein, 18 aa, Giardia lamblia
LLLLFLSLDLQEHCRSFV

SEQ ID NO: 3094182 - protein, 18 aa, Giardia lamblia
SVTRHLLLLFLSLDLQEH

SEQ ID NO: 3094183 - protein, 22 aa, Giardia lamblia
TRIFRTFISYPYHLARLGASFS

SEQ ID NO: 3094184 - protein, 23 aa, Giardia lamblia
TWLTKVFYVLFPPLGLVAICDMM

SEQ ID NO: 3094185 - protein, 34 aa, Giardia lamblia
VVLLVLVAVAGFLVWWFVIRPRKSGELRERAPRK

SEQ ID NO: 3094186 - protein, 20 aa, Giardia lamblia
AAILAACDLWNFSKALELCR

SEQ ID NO: 3094187 - protein, 34 aa, Giardia lamblia
AALKPYLPLLVAMGVLLVLPFVLGLCFNIALVCI

SEQ ID NO: 3094188 - protein, 23 aa, Giardia lamblia
AALTALFVLIWMGVRYTLTSVTN

SEQ ID NO: 3094189 - protein, 23 aa, Giardia lamblia
AALTLFYYHFFFNPHIVGSAGAS

SEQ ID NO: 3094190 - protein, 18 aa, Giardia lamblia
AAPTLWIPLLEIYEEFMG

SEQ ID NO: 3094191 - protein, 23 aa, Giardia lamblia
AATLPFLSLPPKSSFRLFISSMP

SEQ ID NO: 3094192 - protein, 21 aa, Giardia lamblia
AAYLWRCIYIFASLLDRELSS

SEQ ID NO: 3094193 - protein, 24 aa, Giardia lamblia
ADDRQLFLELLPKALKILFSTTTH

SEQ ID NO: 3094194 - protein, 23 aa, Giardia lamblia
ADYKAMRITILNVLLFATSQSLI

SEQ ID NO: 3094195 - protein, 24 aa, Giardia lamblia
AELFQIKVRWPMHIRSLYASTQST

SEQ ID NO: 3094196 - protein, 25 aa, Giardia lamblia
AERGYLGIMRLLIPYEAKMQMTGRG

SEQ ID NO: 3094197 - protein, 22 aa, Giardia lamblia
AERYILVTGIRRTLLPTLSHHD

SEQ ID NO: 3094198 - protein, 18 aa, Giardia lamblia
AFFIVLVMLMIVSVPAYL

SEQ ID NO: 3094199 - protein, 17 aa, Giardia lamblia
AGFFLFMGGCYDVSKAP

SEQ ID NO: 3094200 - protein, 20 aa, Giardia lamblia
AGFLVWWFVFRRGGRPKRGA

SEQ ID NO: 3094201 - protein, 22 aa, Giardia lamblia
AGHALLYKLYYWSCSDTCCAIS

SEQ ID NO: 3094202 - protein, 24 aa, Giardia lamblia
AGILQLMKLFDYLLFASTDVFSPK

SEQ ID NO: 3094203 - protein, 24 aa, Giardia lamblia
AGIVTLIVFLLKAKRMGPTSNYMK

SEQ ID NO: 3094204 - protein, 17 aa, Giardia lamblia
AGLFFYYKNGCYNPKTY

SEQ ID NO: 3094205 - protein, 20 aa, Giardia lamblia
AGQYRLFLKPLYLRRNGPKT

SEQ ID NO: 3094206 - protein, 17 aa, Giardia lamblia
AGRILRGLYYVKTLLLA

SEQ ID NO: 3094207 - protein, 18 aa, Giardia lamblia
AHYLLFWEAAEALLSKQC

SEQ ID NO: 3094208 - protein, 23 aa, Giardia lamblia
AICMRYPLLFNKLSFFFNRSEAI

SEQ ID NO: 3094209 - protein, 22 aa, Giardia lamblia
AIDKYYLNRLPGQNIRELQARL

SEQ ID NO: 3094210 - protein, 18 aa, Giardia lamblia
AIFPDLFYNIALIALRAS

SEQ ID NO: 3094211 - protein, 19 aa, Giardia lamblia
AILLYPLALYRLASKHYGS

SEQ ID NO: 3094212 - protein, 21 aa, Giardia lamblia
AIQLLLFLMQLKSVANTKGEV

SEQ ID NO: 3094213 - protein, 27 aa, Giardia lamblia
AISAPYTFYLFYFYVDLWYSNSIRQQD

SEQ ID NO: 3094214 - protein, 19 aa, Giardia lamblia
AITFFKLLCPLLKSLEKRA

SEQ ID NO: 3094215 - protein, 32 aa, Giardia lamblia
AITVPILVLFVVGFLTYILVKRAIAKREQAKV

SEQ ID NO: 3094216 - protein, 19 aa, Giardia lamblia
AIYALLPCHVKIKSISWLT

SEQ ID NO: 3094217 - protein, 25 aa, Giardia lamblia
AKNMYHVVFYYLTSKRFLQRRALLY

SEQ ID NO: 3094218 - protein, 23 aa, Giardia lamblia
AKRNLLLSWIWSGSGLYYFTIDR

SEQ ID NO: 3094219 - protein, 26 aa, Giardia lamblia
AKVDYFIFKVWFLVVFTSVAIFHKVY

SEQ ID NO: 3094220 - protein, 22 aa, Giardia lamblia
ALDCLLNEIFPLPPSIYNNTLT

SEQ ID NO: 3094221 - protein, 17 aa, Giardia lamblia
ALFINKLVKRRLEMQCR

SEQ ID NO: 3094222 - protein, 28 aa, Giardia lamblia
ALIYDHFMLLIFKLFAIFIPVGMEFYSR

SEQ ID NO: 3094223 - protein, 24 aa, Giardia lamblia
ALSILPRFFGFYDYVYIKPDFTSV

SEQ ID NO: 3094224 - protein, 22 aa, Giardia lamblia
ALVPLLVLMAVFLDALYSAKPL

SEQ ID NO: 3094225 - protein, 21 aa, Giardia lamblia
ALYCLQGCILVYDYLKKFTPV

SEQ ID NO: 3094226 - protein, 18 aa, Giardia lamblia
AMFPGFSLAAMMCLRPAK

SEQ ID NO: 3094227 - protein, 17 aa, Giardia lamblia
AMILCDFELALPSTRLS

SEQ ID NO: 3094228 - protein, 19 aa, Giardia lamblia
AMLCLPFFSVFVFGVHAVR

SEQ ID NO: 3094229 - protein, 24 aa, Giardia lamblia
AMSSYLLPLLLLPTGENATIDESK

SEQ ID NO: 3094230 - protein, 19 aa, Giardia lamblia
AMTILPELLLLLPDLCSIS

SEQ ID NO: 3094231 - protein, 18 aa, Giardia lamblia
AMVSRKPLYSLYFNTRFL

SEQ ID NO: 3094232 - protein, 20 aa, Giardia lamblia
AMWINYFLSLIVHVLYLVHK

SEQ ID NO: 3094233 - protein, 24 aa, Giardia lamblia
AMWKRLFYAIVFFHGILLERRKFG

SEQ ID NO: 3094234 - protein, 22 aa, Giardia lamblia
ANFRTLLPHLLLYMSRKREYCP

SEQ ID NO: 3094235 - protein, 18 aa, Giardia lamblia
APAPPFPFYPQPPSVKIP

SEQ ID NO: 3094236 - protein, 22 aa, Giardia lamblia
APDLRGWRILRSTFYYYLVCCK

SEQ ID NO: 3094237 - protein, 35 aa, Giardia lamblia
APDSFVHLLFFKTHSLLFLTLLHKITHLPSVGSMI

SEQ ID NO: 3094238 - protein, 20 aa, Giardia lamblia
APEPVISLFLSRFAHTLRLG

SEQ ID NO: 3094239 - protein, 24 aa, Giardia lamblia
APIDSLPIIFKLLEQVTLTPTQIV

SEQ ID NO: 3094240 - protein, 24 aa, Giardia lamblia
APLIFPYCWALFYGAQLISHSKMH

SEQ ID NO: 3094241 - protein, 21 aa, Giardia lamblia
APSLYKYWRLATTTLPLINTS

SEQ ID NO: 3094242 - protein, 23 aa, Giardia lamblia
APVVWIMIFMTFSISFPLARLLD

SEQ ID NO: 3094243 - protein, 20 aa, Giardia lamblia
AQFRGILFIPKRAPFDMWDA

SEQ ID NO: 3094244 - protein, 23 aa, Giardia lamblia
AQHLMYFEYLLLVYYGLFPTSDH

SEQ ID NO: 3094245 - protein, 23 aa, Giardia lamblia
AQKFICGWIPAIKMLIDLLPLLS

SEQ ID NO: 3094246 - protein, 19 aa, Giardia lamblia
ARENTPLFFFTLSTDSDAL

SEQ ID NO: 3094247 - protein, 20 aa, Giardia lamblia
ARLIAWLIIAIPVAVIQPLM

SEQ ID NO: 3094248 - protein, 21 aa, Giardia lamblia
ASCTACYPGYSLLYGSGTAGT

SEQ ID NO: 3094249 - protein, 25 aa, Giardia lamblia
ASFLIRMAIKEFPTFGYPLYWAFRC

SEQ ID NO: 3094250 - protein, 19 aa, Giardia lamblia
ASMLVGIGLIFAVALADAC

SEQ ID NO: 3094251 - protein, 23 aa, Giardia lamblia
ASRPFPVYLILSVLVQLLSLCDY

SEQ ID NO: 3094252 - protein, 33 aa, Giardia lamblia
ASSSLALFIIMLSLIILWIVVILIVRYKEGARQ

SEQ ID NO: 3094253 - protein, 23 aa, Giardia lamblia
ASTRKWYWLPRYKFSLMTDDYTY

SEQ ID NO: 3094254 - protein, 24 aa, Giardia lamblia
ASVLLLLIPLLNLLPLFMIILIRF

SEQ ID NO: 3094255 - protein, 23 aa, Giardia lamblia
ASYPRVIRLILWKKVLKNIHSDS

SEQ ID NO: 3094256 - protein, 24 aa, Giardia lamblia
ATFIYMFIILFYYTQLRSFCVRIQ

SEQ ID NO: 3094257 - protein, 22 aa, Giardia lamblia
ATLIFSSLLFRWHPLYNSICVS

SEQ ID NO: 3094258 - protein, 17 aa, Giardia lamblia
ATSSRILMLKALYARLL

SEQ ID NO: 3094259 - protein, 23 aa, Giardia lamblia
ATTLLPVICFFIGIAIIVIFAMA

SEQ ID NO: 3094260 - protein, 27 aa, Giardia lamblia
AVDPPIPIWLLFLPFNTIALNLGDALI

SEQ ID NO: 3094261 - protein, 24 aa, Giardia lamblia
AVFPWERLLLRLAGWQRGVPILKN

SEQ ID NO: 3094262 - protein, 24 aa, Giardia lamblia
AVIVPILLVLTVGGLCIYFLACRG

SEQ ID NO: 3094263 - protein, 21 aa, Giardia lamblia
AVLCQLLASMLVGIGLIFAVA

SEQ ID NO: 3094264 - protein, 18 aa, Giardia lamblia
AVLLPKIHLFVLSLGSIG

SEQ ID NO: 3094265 - protein, 22 aa, Giardia lamblia
AVPLLPLYIINAYFPSLEPFSV

SEQ ID NO: 3094266 - protein, 28 aa, Giardia lamblia
AVPQLLPFLLFVLFGFPNAMSSIMILLV

SEQ ID NO: 3094267 - protein, 25 aa, Giardia lamblia
AVTLVQLRDLFLASYPRVIRLILWK

SEQ ID NO: 3094268 - protein, 17 aa, Giardia lamblia
AVVLPPRKKSRPAPHTA

SEQ ID NO: 3094269 - protein, 17 aa, Giardia lamblia
AVWMMRCVIEHFSVASS

SEQ ID NO: 3094270 - protein, 19 aa, Giardia lamblia
AYFCACSFPYTSVGGLCVH

SEQ ID NO: 3094271 - protein, 22 aa, Giardia lamblia
AYIYHILTFIPYRFTSNPAKVI

SEQ ID NO: 3094272 - protein, 17 aa, Giardia lamblia
AYKSSMLIIFCLIPVYT

SEQ ID NO: 3094273 - protein, 21 aa, Giardia lamblia
AYLHVVLILATFWFFDLDAHT

SEQ ID NO: 3094274 - protein, 26 aa, Giardia lamblia
AYSRLHTDLLFFKYLMQNVSQAVKLA

SEQ ID NO: 3094275 - protein, 23 aa, Giardia lamblia
CAAVFPPFFLKWIRMRISPTDAE

SEQ ID NO: 3094276 - protein, 24 aa, Giardia lamblia
CANGDLTCKLLLSNAFRLTNLDSM

SEQ ID NO: 3094277 - protein, 23 aa, Giardia lamblia
CANSAEYFLFYGGCYYKKSGIGS

SEQ ID NO: 3094278 - protein, 23 aa, Giardia lamblia
CASFLNMILPLCINLPLGKRKYR

SEQ ID NO: 3094279 - protein, 22 aa, Giardia lamblia
CAYHMFVLVFSLLSMLQDGYRL

SEQ ID NO: 3094280 - protein, 20 aa, Giardia lamblia
CAYNNLLPQLSLLVKHGSYT

SEQ ID NO: 3094281 - protein, 25 aa, Giardia lamblia
CDYKFNILDFIQLLASIKALMRRAD

SEQ ID NO: 3094282 - protein, 19 aa, Giardia lamblia
CFDPLLFLMLDAGASYFFS

SEQ ID NO: 3094283 - protein, 17 aa, Giardia lamblia
CFLSLFFTSYIGLAQLL

SEQ ID NO: 3094284 - protein, 18 aa, Giardia lamblia
CFYWLLFIMSMYSFFKTI

SEQ ID NO: 3094285 - protein, 22 aa, Giardia lamblia
CGRESFFSPFMCNCLHGCPDLK

SEQ ID NO: 3094286 - protein, 25 aa, Giardia lamblia
CIDFFVILFMYITFSIILRVTKFNT

SEQ ID NO: 3094287 - protein, 26 aa, Giardia lamblia
CISYCSFFLIFKYLYQIKFKKFLIFS

SEQ ID NO: 3094288 - protein, 21 aa, Giardia lamblia
CIYNFFIFAQLFNEISSRRIN

SEQ ID NO: 3094289 - protein, 20 aa, Giardia lamblia
CLGYLSILILHTCLAILLET

SEQ ID NO: 3094290 - protein, 17 aa, Giardia lamblia
CLLFLDFLSSLLLFYTM

SEQ ID NO: 3094291 - protein, 17 aa, Giardia lamblia
CLLYLFDFLIHSLLATA

SEQ ID NO: 3094292 - protein, 24 aa, Giardia lamblia
CLPGFLIFYLHLYLCPQQYDDASD

SEQ ID NO: 3094293 - protein, 18 aa, Giardia lamblia
CLSGYYLSTNKCFRCTAG

SEQ ID NO: 3094294 - protein, 17 aa, Giardia lamblia
CLVWFLLRRKNSGSLNR

SEQ ID NO: 3094295 - protein, 21 aa, Giardia lamblia
CPFILYYTFLWMTPFVARARK

SEQ ID NO: 3094296 - protein, 18 aa, Giardia lamblia
CPTNFKLVEFIYGKNKGK

SEQ ID NO: 3094297 - protein, 24 aa, Giardia lamblia
CQRPYMLAQLYFKLLQTAVESSRR

SEQ ID NO: 3094298 - protein, 18 aa, Giardia lamblia
CSIFSLLPVFFYANVFQS

SEQ ID NO: 3094299 - protein, 25 aa, Giardia lamblia
CTILFVMGCLLPPVLWLVGPILSAS

SEQ ID NO: 3094300 - protein, 20 aa, Giardia lamblia
CWACFTFLLSYTFVIRKYRR

SEQ ID NO: 3094301 - protein, 21 aa, Giardia lamblia
DACLLYLKLILDPHDSWNLIL

SEQ ID NO: 3094302 - protein, 23 aa, Giardia lamblia
DADQLNFYLSLRDLLMLSAGAQD

SEQ ID NO: 3094303 - protein, 23 aa, Giardia lamblia
DAEDWISMMYIPRSILPGITDSS

SEQ ID NO: 3094304 - protein, 23 aa, Giardia lamblia
DAESLPHFLVYWCKSRYGLRSLV

SEQ ID NO: 3094305 - protein, 27 aa, Giardia lamblia
DAGKILLYLLLKILQSILSFWYMSTLS

SEQ ID NO: 3094306 - protein, 24 aa, Giardia lamblia
DAHLWVLIVILFYSLIKVFETTQA

SEQ ID NO: 3094307 - protein, 25 aa, Giardia lamblia
DAILMRAFDRIWPRFLRTLVEQIKT

SEQ ID NO: 3094308 - protein, 21 aa, Giardia lamblia
DAINFIMRFFQQSQIRSFAAA

SEQ ID NO: 3094309 - protein, 27 aa, Giardia lamblia
DAMALLIFFMLPFQFFYVVTILSTTSN

SEQ ID NO: 3094310 - protein, 22 aa, Giardia lamblia
DANLFYLNPLLRQALYGVYDNC

SEQ ID NO: 3094311 - protein, 18 aa, Giardia lamblia
DCIGIELRFLFSTSDDLP

SEQ ID NO: 3094312 - protein, 21 aa, Giardia lamblia
DCLWAYLILPLLHEIFIVNNR

SEQ ID NO: 3094313 - protein, 37 aa, Giardia lamblia
DCRDHWIIYLLLAGLLLVIIILFALVIRFYLKFDNLV

SEQ ID NO: 3094314 - protein, 25 aa, Giardia lamblia
DCWDQIHSLFWPTCRWKVPPIDSLK

SEQ ID NO: 3094315 - protein, 25 aa, Giardia lamblia
DDPNAETTYFLFYGGCYSKDEWPGS

SEQ ID NO: 3094316 - protein, 43 aa, Giardia lamblia
DDTCCGRHLLLWTVIVIMAILLLITFILVICLYAQIGSTLTVK

SEQ ID NO: 3094317 - protein, 17 aa, Giardia lamblia
DDYLLIMVYISTGVFSS

SEQ ID NO: 3094318 - protein, 20 aa, Giardia lamblia
DEAIFSAFFPPVVSSWTGVA

SEQ ID NO: 3094319 - protein, 26 aa, Giardia lamblia
DEDLLWAIMIQVLLALSYCHSPFNAT

SEQ ID NO: 3094320 - protein, 19 aa, Giardia lamblia
DFFVFIRVLSRQKLLRKIV

SEQ ID NO: 3094321 - protein, 20 aa, Giardia lamblia
DFIGPTFWLTLYSLFLVIIA

SEQ ID NO: 3094322 - protein, 34 aa, Giardia lamblia
DFRKVQLICFFGLLLPLFLVCTMGWLIAVMVTCR

SEQ ID NO: 3094323 - protein, 18 aa, Giardia lamblia
DFWCLGVLLFTLYTHKAF

SEQ ID NO: 3094324 - protein, 21 aa, Giardia lamblia
DGPFYMRDLPFGSVLCPVHFY

SEQ ID NO: 3094325 - protein, 22 aa, Giardia lamblia
DGSLQFWDMLYGKLLRSVSHVF

SEQ ID NO: 3094326 - protein, 17 aa, Giardia lamblia
DGVLFSVMPPRKSWKQI

SEQ ID NO: 3094327 - protein, 18 aa, Giardia lamblia
DGYFLFMGGCYKTTDGPG

SEQ ID NO: 3094328 - protein, 33 aa, Giardia lamblia
DHSMHFAHYLLLLIFLCTIALFVFIIIASKRPD

SEQ ID NO: 3094329 - protein, 21 aa, Giardia lamblia
DIFQPIFLCLLFTSFAFSPVH

SEQ ID NO: 3094330 - protein, 17 aa, Giardia lamblia
DIILPIISQYRASPRKS

SEQ ID NO: 3094331 - protein, 26 aa, Giardia lamblia
DIKRRQFMRFFFLSDNELLIVLSAQD

SEQ ID NO: 3094332 - protein, 17 aa, Giardia lamblia
DINPLLQKTFFGGGAVV

SEQ ID NO: 3094333 - protein, 17 aa, Giardia lamblia
DIPALLRQLPQTALTEL

SEQ ID NO: 3094334 - protein, 20 aa, Giardia lamblia
DIPPYPLYTALMIAVTRRKL

SEQ ID NO: 3094335 - protein, 22 aa, Giardia lamblia
DIRSILPFLFLNHPPTFLIDMI

SEQ ID NO: 3094336 - protein, 23 aa, Giardia lamblia
DIVAVYCLLPLQAGVQDRNGYTA

SEQ ID NO: 3094337 - protein, 19 aa, Giardia lamblia
DIVKLLFPYEGHLKDNKGN

SEQ ID NO: 3094338 - protein, 17 aa, Giardia lamblia
DKAVWMMRCVIEHFSVA

SEQ ID NO: 3094339 - protein, 23 aa, Giardia lamblia
DKPARRYMLLKDSERYRLTVQQQ

SEQ ID NO: 3094340 - protein, 24 aa, Giardia lamblia
DKQAWVQYLLSWPGSRYKLKDANN

SEQ ID NO: 3094341 - protein, 22 aa, Giardia lamblia
DKSGPWVLFLHGLTFYTDICAA

SEQ ID NO: 3094342 - protein, 21 aa, Giardia lamblia
DKTRRFFCGFLENITENLSTG

SEQ ID NO: 3094343 - protein, 20 aa, Giardia lamblia
DKTRRFFCGFLENVTENLPA

SEQ ID NO: 3094344 - protein, 20 aa, Giardia lamblia
DKTRRFFCGFLENVTENLPV

SEQ ID NO: 3094345 - protein, 19 aa, Giardia lamblia
DKTRRFYCGFLENVTENLP

SEQ ID NO: 3094346 - protein, 26 aa, Giardia lamblia
DKYKWVWLGLCVFLMLTRKWVYAVLL

SEQ ID NO: 3094347 - protein, 30 aa, Giardia lamblia; identical to SEQ ID NO: 3070391

SEQ ID NO: 3094348 - protein, 23 aa, Giardia lamblia
DLFLLDFLHFFKPYSIQALLDSL

SEQ ID NO: 3094349 - protein, 17 aa, Giardia lamblia
DLKALVTGLLPLSGFVA

SEQ ID NO: 3094350 - protein, 20 aa, Giardia lamblia
DLLKIIKLYALFLIEGDAPT

SEQ ID NO: 3094351 - protein, 29 aa, Giardia lamblia
DMYTPMYMCFILPFCFFILTPLFSYRLSQ

SEQ ID NO: 3094352 - protein, 24 aa, Giardia lamblia
DNIPYLHYEMLLSLVLILRRYASL

SEQ ID NO: 3094353 - protein, 26 aa, Giardia lamblia
DNLTLLKNYLYPYYKRALVLLRNAPC

SEQ ID NO: 3094354 - protein, 20 aa, Giardia lamblia
DPRFMLYGMFVLPLKQHIGE

SEQ ID NO: 3094355 - protein, 26 aa, Giardia lamblia
DQNNSIFTIYWLGYIRLLLEHSGETL

SEQ ID NO: 3094356 - protein, 19 aa, Giardia lamblia
DRIILIPYANPWSDLTLRK

SEQ ID NO: 3094357 - protein, 25 aa, Giardia lamblia
DRQMFPALFRLLLLVTIFQPISIEE

SEQ ID NO: 3094358 - protein, 21 aa, Giardia lamblia
DRTRRFYCGFLQGLTDNLQEG

SEQ ID NO: 3094359 - protein, 26 aa, Giardia lamblia
DSILDYYHFLIEDLIWILMADISMAL

SEQ ID NO: 3094360 - protein, 17 aa, Giardia lamblia
DSLLLPSILAPSTLKPI

SEQ ID NO: 3094361 - protein, 33 aa, Giardia lamblia
DSRLLRYCIFLSKYILLYLYPSSILVFSIVQNN

SEQ ID NO: 3094362 - protein, 23 aa, Giardia lamblia
DSRSFLLWPIAMLGSRRIFCINE

SEQ ID NO: 3094363 - protein, 24 aa, Giardia lamblia
DSSYLLLLTYIPVLTKLFIKRTRL

SEQ ID NO: 3094364 - protein, 23 aa, Giardia lamblia
DSVPLMLYLLRGLLLQSSKNIKL

SEQ ID NO: 3094365 - protein, 31 aa, Giardia lamblia
DTVFAGSFYRFILYALLPLLARALPVQQYYI

SEQ ID NO: 3094366 - protein, 22 aa, Giardia lamblia
DTVFPLWLGLIHSLLHSIDVPE

SEQ ID NO: 3094367 - protein, 21 aa, Giardia lamblia
DVILRFLRINALLSISFQIES

SEQ ID NO: 3094368 - protein, 21 aa, Giardia lamblia
DVSIYKPLFTPLKAPKIVSVQ

SEQ ID NO: 3094369 - protein, 21 aa, Giardia lamblia
DVSLYRWLHFTTTLLSICVSA

SEQ ID NO: 3094370 - protein, 29 aa, Giardia lamblia
DWHDTLLRLFFLVYILIKLPLCKHKSSSA

SEQ ID NO: 3094371 - protein, 23 aa, Giardia lamblia
DYTLLPIIIYTIISSLKVILSSA

SEQ ID NO: 3094372 - protein, 22 aa, Giardia lamblia
EALYVFLILMDGVLYAREISPL

SEQ ID NO: 3094373 - protein, 23 aa, Giardia lamblia
EASRILLIILTTALPTVFIYMFK

SEQ ID NO: 3094374 - protein, 24 aa, Giardia lamblia
EAYTYWYDCFMLDLLFNIPDTFSL

SEQ ID NO: 3094375 - protein, 26 aa, Giardia lamblia
ECDIRPWLHVYKALRLLPLQPDGAVS

SEQ ID NO: 3094376 - protein, 21 aa, Giardia lamblia
ECFAETPYFNPALTECLSACP

SEQ ID NO: 3094377 - protein, 25 aa, Giardia lamblia
ECLKILFVPILYIPLEAYKLTPTLS

SEQ ID NO: 3094378 - protein, 28 aa, Giardia lamblia
ECRNRRVIPFLLREAWLIDFHGKTPLEY

SEQ ID NO: 3094379 - protein, 25 aa, Giardia lamblia
EDHLLLLFIKHFRPAFLRIAVNNYI

SEQ ID NO: 3094380 - protein, 23 aa, Giardia lamblia
EDIYPQWSVFILLLFHGADRDMR

SEQ ID NO: 3094381 - protein, 24 aa, Giardia lamblia
EEASIWIFLASMLDLFVLLHGSSN

SEQ ID NO: 3094382 - protein, 22 aa, Giardia lamblia
EECLPIPLLLRYLRAWKTPSDA

SEQ ID NO: 3094383 - protein, 29 aa, Giardia lamblia
EELLYLRLHLHLLIFYFITAYSKKRLRTV

SEQ ID NO: 3094384 - protein, 29 aa, Giardia lamblia
EELWAIFGQLLLFCTYLLSISLQIAEVVC

SEQ ID NO: 3094385 - protein, 19 aa, Giardia lamblia
EEPLFLRSLRNANLAPRSS

SEQ ID NO: 3094386 - protein, 23 aa, Giardia lamblia
EERWINFSWILSPRLLQSPHVSR

SEQ ID NO: 3094387 - protein, 17 aa, Giardia lamblia
EFLLLLRLLEYYAEIPI

SEQ ID NO: 3094388 - protein, 17 aa, Giardia lamblia
EFLMLLSPLIVLLVMLL

SEQ ID NO: 3094389 - protein, 17 aa, Giardia lamblia
EFPFLFVSGLRKTYRKA

SEQ ID NO: 3094390 - protein, 18 aa, Giardia lamblia
EFSWRGIPWYFLVSKRFW

SEQ ID NO: 3094391 - protein, 18 aa, Giardia lamblia
EFYWLMCSLFFGFITILF

SEQ ID NO: 3094392 - protein, 28 aa, Giardia lamblia
EGFRIISILLLIKFFSESFMILAIPLFI

SEQ ID NO: 3094393 - protein, 23 aa, Giardia lamblia
EGPVLLDPLFLLGLETRSMSIAT

SEQ ID NO: 3094394 - protein, 23 aa, Giardia lamblia
EGSLLRWEVILIAVTLGIVGFFA

SEQ ID NO: 3094395 - protein, 22 aa, Giardia lamblia
EGTIFFLLTIYFDYIIPRESNG

SEQ ID NO: 3094396 - protein, 33 aa, Giardia lamblia
EGYPDVLPMPFFLLVLLLNLLWSRHLLATATVF

SEQ ID NO: 3094397 - protein, 34 aa, Giardia lamblia
EHILSPFFMFQLFTSILWLFDDFAVYSFFTSVML

SEQ ID NO: 3094398 - protein, 27 aa, Giardia lamblia
EHMGIYILIIVLAVIVLVLFILVIVLY

SEQ ID NO: 3094399 - protein, 20 aa, Giardia lamblia
EICQYLIAYLPPILQHVTTE

SEQ ID NO: 3094400 - protein, 23 aa, Giardia lamblia
EILRLILLIIYNQIVFVFSLNYI

SEQ ID NO: 3094401 - protein, 25 aa, Giardia lamblia
EINQRYLYWFFLRNTGTVQDRTQGT

SEQ ID NO: 3094402 - protein, 17 aa, Giardia lamblia
EIRVVMVLILYFSIWTI

SEQ ID NO: 3094403 - protein, 18 aa, Giardia lamblia
EISGCLLCPSPPACGTCL

SEQ ID NO: 3094404 - protein, 24 aa, Giardia lamblia
EIVALVILLVLLVLRIKKSKRAEA

SEQ ID NO: 3094405 - protein, 17 aa, Giardia lamblia
EKLLLSALLFPIDSIFA

SEQ ID NO: 3094406 - protein, 24 aa, Giardia lamblia
EKSEVVRLLLLKLLLRIIHTCNES

SEQ ID NO: 3094407 - protein, 17 aa, Giardia lamblia
EKYFFPLLYAGLEKGWL

SEQ ID NO: 3094408 - protein, 17 aa, Giardia lamblia
ELALLLLLTFDKLILIG

SEQ ID NO: 3094409 - protein, 24 aa, Giardia lamblia
ELDALLRIFLVSLIWLKGSSRVSE

SEQ ID NO: 3094410 - protein, 24 aa, Giardia lamblia
ELFEVILLAYLFYYSTTPLLQEKL

SEQ ID NO: 3094411 - protein, 22 aa, Giardia lamblia
ELKTLLYTWNDPAIDQLLLLLS

SEQ ID NO: 3094412 - protein, 26 aa, Giardia lamblia
ELLPGPFLIPIVVFPFIVLLSSLKFF

SEQ ID NO: 3094413 - protein, 17 aa, Giardia lamblia
ELRIMQFLILQLSVDNI

SEQ ID NO: 3094414 - protein, 23 aa, Giardia lamblia
ELTTGYICRCGYPYQLVGTAKCL

SEQ ID NO: 3094415 - protein, 28 aa, Giardia lamblia
ELWPTYFTIYTILLYKFALPFSTKALKY

SEQ ID NO: 3094416 - protein, 25 aa, Giardia lamblia
ELYQHLRLFYYFRCNWTFGKQSLEI

SEQ ID NO: 3094417 - protein, 17 aa, Giardia lamblia
EMRVVMVLILYFSIWTI

SEQ ID NO: 3094418 - protein, 32 aa, Giardia lamblia
EMRVVMVLILYFSIWTIIPTILIAAALTALFK

SEQ ID NO: 3094419 - protein, 22 aa, Giardia lamblia
ENMRILISFCWPHKLVLEASKG

SEQ ID NO: 3094420 - protein, 27 aa, Giardia lamblia
ENNEIYLFARFLFGDLDFDFYLTYLDI

SEQ ID NO: 3094421 - protein, 26 aa, Giardia lamblia
ENRLLEIYYWLHNIDIFITYYTINLH

SEQ ID NO: 3094422 - protein, 27 aa, Giardia lamblia
ENSYLYKILYTALTYIRFIALSKMWTD

SEQ ID NO: 3094423 - protein, 17 aa, Giardia lamblia
EQKDKVILLLQNLLYKS

SEQ ID NO: 3094424 - protein, 23 aa, Giardia lamblia
EQKIELIMLLRLFGINLQMHFYL

SEQ ID NO: 3094425 - protein, 21 aa, Giardia lamblia
EQWNSAFKWIFSKNGDNNKNG

SEQ ID NO: 3094426 - protein, 22 aa, Giardia lamblia
EQWNSAFKWIFSKNGDNNKNGY

SEQ ID NO: 3094427 - protein, 18 aa, Giardia lamblia
ERAPRKPPGLPKPQLTHN

SEQ ID NO: 3094428 - protein, 25 aa, Giardia lamblia
EREPYIWNAFLFGVVGWCFVSHAMS

SEQ ID NO: 3094429 - protein, 24 aa, Giardia lamblia
ERIETLLPQFKFISSIAFQPRHFK

SEQ ID NO: 3094430 - protein, 20 aa, Giardia lamblia
ERILFIVYLSSFIMAKLSVC

SEQ ID NO: 3094431 - protein, 17 aa, Giardia lamblia
ERLLIAKKLILLEIYYI

SEQ ID NO: 3094432 - protein, 26 aa, Giardia lamblia
ERNLCQVYLYFLRAFVATGDNLLFAH

SEQ ID NO: 3094433 - protein, 27 aa, Giardia lamblia
ERSIQKLLFLIFYALFLRDLTELYLSL

SEQ ID NO: 3094434 - protein, 23 aa, Giardia lamblia
ERYYLVRLYFVEKIIPLILSSTI

SEQ ID NO: 3094435 - protein, 29 aa, Giardia lamblia
ESDRFTVILRILPIFFKLKIKYHKQLEKV

SEQ ID NO: 3094436 - protein, 18 aa, Giardia lamblia
ESLLLLSHVLFDISMIVL

SEQ ID NO: 3094437 - protein, 17 aa, Giardia lamblia
ESRLWGMLNVESLSSIF

SEQ ID NO: 3094438 - protein, 17 aa, Giardia lamblia
ESRSIFPTILQLLQELS

SEQ ID NO: 3094439 - protein, 23 aa, Giardia lamblia
ESSPLYHLFLPYLLSFPNTFIYK

SEQ ID NO: 3094440 - protein, 25 aa, Giardia lamblia
ETNYISFVLIFNFLFKVFSNREMLE

SEQ ID NO: 3094441 - protein, 22 aa, Giardia lamblia
ETYPYLLFLPNQAIIRPNTFVD

SEQ ID NO: 3094442 - protein, 26 aa, Giardia lamblia
EVPFYYYVMYFIIARIIWFYTTLLGI

SEQ ID NO: 3094443 - protein, 25 aa, Giardia lamblia
EVRSYKMFYLYVILILYNEYNRVRN

SEQ ID NO: 3094444 - protein, 18 aa, Giardia lamblia
EVTNPREYLRYDNPRHLR

SEQ ID NO: 3094445 - protein, 24 aa, Giardia lamblia
EVTRSFVVPLFAKLAALLSTEAVF

SEQ ID NO: 3094446 - protein, 26 aa, Giardia lamblia
EYFHGMPYHLFLLPAQVSWTEVTKAI

SEQ ID NO: 3094447 - protein, 22 aa, Giardia lamblia
EYFISFIVIFLLILCLCLVVIN

SEQ ID NO: 3094448 - protein, 24 aa, Giardia lamblia
EYPYLTKAILPYIGPFPLVLTQKK

SEQ ID NO: 3094449 - protein, 23 aa, Giardia lamblia
EYVKLLFPRPFDYIFNLFVTFDC

SEQ ID NO: 3094450 - protein, 22 aa, Giardia lamblia
FACMVFFFFFIVNMTFPLHFRS

SEQ ID NO: 3094451 - protein, 19 aa, Giardia lamblia
FAIFIDLFLKLLQKGVTQK

SEQ ID NO: 3094452 - protein, 18 aa, Giardia lamblia
FCFFINIFIGFFSILFCW

SEQ ID NO: 3094453 - protein, 17 aa, Giardia lamblia
FCGFLENITENLSTGNL

SEQ ID NO: 3094454 - protein, 19 aa, Giardia lamblia
FDGFPLLTMLSMKPNKAII

SEQ ID NO: 3094455 - protein, 27 aa, Giardia lamblia
FDYDSFLLYLLLTTAFFYVSVPASLNA

SEQ ID NO: 3094456 - protein, 17 aa, Giardia lamblia
FEFAVLWCDASVWFHIL

SEQ ID NO: 3094457 - protein, 24 aa, Giardia lamblia
FEPIYRVFLCNIYHWYYPYLFIGA

SEQ ID NO: 3094458 - protein, 18 aa, Giardia lamblia
FFAHFFLYLDEQLETPQW

SEQ ID NO: 3094459 - protein, 20 aa, Giardia lamblia
FFAMKSYMSLFFAVLGLVIV

SEQ ID NO: 3094460 - protein, 19 aa, Giardia lamblia
FFDKTLFHFAWFLLKDYDA

SEQ ID NO: 3094461 - protein, 17 aa, Giardia lamblia
FFDSDWIRFFIRVTKDS

SEQ ID NO: 3094462 - protein, 19 aa, Giardia lamblia
FFGHTFSPGRRYAYRRSLE

SEQ ID NO: 3094463 - protein, 17 aa, Giardia lamblia
FFHLISKYLHRYEPSFA

SEQ ID NO: 3094464 - protein, 18 aa, Giardia lamblia
FFNDRLFNLAFLCFTYAF

SEQ ID NO: 3094465 - protein, 17 aa, Giardia lamblia
FFVIFVRAIFMILVTLV

SEQ ID NO: 3094466 - protein, 21 aa, Giardia lamblia
FFVSVLLNQIFFYLLLAFCIT

SEQ ID NO: 3094467 - protein, 17 aa, Giardia lamblia
FGAFLLQLLFPFTPIIQ

SEQ ID NO: 3094468 - protein, 25 aa, Giardia lamblia
FGAIFFCQYLIWAGLFFGGICQNVT

SEQ ID NO: 3094469 - protein, 18 aa, Giardia lamblia
FGFVLYLGLPILVGLKIP

SEQ ID NO: 3094470 - protein, 19 aa, Giardia lamblia
FGHFRLAFPLAFNVSKTGS

SEQ ID NO: 3094471 - protein, 20 aa, Giardia lamblia
FGHLSIIRLLSPLEAGICDN

SEQ ID NO: 3094472 - protein, 17 aa, Giardia lamblia
FGTLLIANLLAYGLLFG

SEQ ID NO: 3094473 - protein, 20 aa, Giardia lamblia
FGYPLYWAFRCEMRLNLVFS

SEQ ID NO: 3094474 - protein, 18 aa, Giardia lamblia
FHEGDYLYILMPIYSHGD

SEQ ID NO: 3094475 - protein, 17 aa, Giardia lamblia
FHNLFLSPVSFFRVTLR

SEQ ID NO: 3094476 - protein, 21 aa, Giardia lamblia
FIAPFLFDLQFQLNLLYSSII

SEQ ID NO: 3094477 - protein, 18 aa, Giardia lamblia
FIAWNRSCPYLYSNKLIA

SEQ ID NO: 3094478 - protein, 27 aa, Giardia lamblia
FIGFFSILFCWLYLPKVPRFKESKFDY

SEQ ID NO: 3094479 - protein, 20 aa, Giardia lamblia
FIHEGGCYNILYSPGNLICV

SEQ ID NO: 3094480 - protein, 20 aa, Giardia lamblia
FILRALLFLVAGLCGLSVIG

SEQ ID NO: 3094481 - protein, 26 aa, Giardia lamblia
FILSLAYLDWLFSLPPTLPLSSLQTG

SEQ ID NO: 3094482 - protein, 17 aa, Giardia lamblia
FINYLITKYFLFSVLTL

SEQ ID NO: 3094483 - protein, 18 aa, Giardia lamblia
FIRCFFSLLPRRLSSYLL

SEQ ID NO: 3094484 - protein, 23 aa, Giardia lamblia
FITFYPMYLIYVNAPRLLAALYL

SEQ ID NO: 3094485 - protein, 19 aa, Giardia lamblia
FIVSVLVGFLYWWFICRGR

SEQ ID NO: 3094486 - protein, 20 aa, Giardia lamblia
FKLEIKFILTPGERFQLWIL

SEQ ID NO: 3094487 - protein, 21 aa, Giardia lamblia
FKSILFALIFFHAIVIERRKF

SEQ ID NO: 3094488 - protein, 19 aa, Giardia lamblia
FLARLRALILIFNHIDITR

SEQ ID NO: 3094489 - protein, 17 aa, Giardia lamblia
FLFIMIVAVICIIYSIV

SEQ ID NO: 3094490 - protein, 18 aa, Giardia lamblia
FLLFVDRSPKNPKVTCLT

SEQ ID NO: 3094491 - protein, 19 aa, Giardia lamblia
FLLGFIWWYALTIRLLYVS

SEQ ID NO: 3094492 - protein, 19 aa, Giardia lamblia
FLMITLVISLFAAASFSCL

SEQ ID NO: 3094493 - protein, 18 aa, Giardia lamblia
FLRKLLVVALPMPGLFEV

SEQ ID NO: 3094494 - protein, 20 aa, Giardia lamblia
FLSTLLHFCRVSFAMYGCVG

SEQ ID NO: 3094495 - protein, 20 aa, Giardia lamblia
FLTLLLLRRVFHSFTLPQYI

SEQ ID NO: 3094496 - protein, 17 aa, Giardia lamblia
FLTLLYKTQTLLSTAQS

SEQ ID NO: 3094497 - protein, 25 aa, Giardia lamblia
FLTMFTIVIVLFLFCIALGFTILAC

SEQ ID NO: 3094498 - protein, 22 aa, Giardia lamblia
FLVHRFCAVLYYKLLSTPLNPS

SEQ ID NO: 3094499 - protein, 17 aa, Giardia lamblia
FLWVLPLFWVIVLIINI

SEQ ID NO: 3094500 - protein, 17 aa, Giardia lamblia
FLWVPYYELFKSLYFYW

SEQ ID NO: 3094501 - protein, 17 aa, Giardia lamblia
FMALLPLVIKYLSMLAF

SEQ ID NO: 3094502 - protein, 17 aa, Giardia lamblia
FMSILNTLFIALRLYEA

SEQ ID NO: 3094503 - protein, 28 aa, Giardia lamblia
FMWSSIPPKLIPFLIGLMSRCYAQLGKL

SEQ ID NO: 3094504 - protein, 19 aa, Giardia lamblia
FNLLLLPRLIRAAHTNDME

SEQ ID NO: 3094505 - protein, 23 aa, Giardia lamblia
FNLTQLFFCPLWLWLSEIIGRRP

SEQ ID NO: 3094506 - protein, 25 aa, Giardia lamblia
FNTVFSYYLKTILIPFLASKLFNIS

SEQ ID NO: 3094507 - protein, 17 aa, Giardia lamblia
FPFLTYFGPRSDLAALS

SEQ ID NO: 3094508 - protein, 17 aa, Giardia lamblia
FPKPRFFHLPSLYHAAL

SEQ ID NO: 3094509 - protein, 23 aa, Giardia lamblia
FPLFKCCAVALFYSILLVFEYGD

SEQ ID NO: 3094510 - protein, 17 aa, Giardia lamblia
FPPIFLLFLVIFSRRFP

SEQ ID NO: 3094511 - protein, 18 aa, Giardia lamblia
FQTFPYLNLLLCIEQLLP

SEQ ID NO: 3094512 - protein, 22 aa, Giardia lamblia
FRERFPHLIGIRASGNNFFCTK

SEQ ID NO: 3094513 - protein, 24 aa, Giardia lamblia
FRKAYMMYLPFIPYISTLQSTHEF

SEQ ID NO: 3094514 - protein, 18 aa, Giardia lamblia
FRLILPKLVADRLEVGML

SEQ ID NO: 3094515 - protein, 25 aa, Giardia lamblia
FSCMSILILLLDCFFLRNSPGKDGD

SEQ ID NO: 3094516 - protein, 25 aa, Giardia lamblia
FSFQLLIFMITWLPYFIIAYMMPGG

SEQ ID NO: 3094517 - protein, 17 aa, Giardia lamblia
FSFVRVNALFRFFFKFE

SEQ ID NO: 3094518 - protein, 17 aa, Giardia lamblia
FSHIGFSALMLAAELNQ

SEQ ID NO: 3094519 - protein, 21 aa, Giardia lamblia
FSLLPVFFYANVFQSLACLGM

SEQ ID NO: 3094520 - protein, 22 aa, Giardia lamblia
FSLSAFITVFYRAIRLSQKSED

SEQ ID NO: 3094521 - protein, 24 aa, Giardia lamblia
FSNPQFLPMNRLLLDGNFLITNCA

SEQ ID NO: 3094522 - protein, 21 aa, Giardia lamblia
FSPHSFYYFSCTLTASGLINT

SEQ ID NO: 3094523 - protein, 17 aa, Giardia lamblia
FSPILIYTAIDGSLRYT

SEQ ID NO: 3094524 - protein, 23 aa, Giardia lamblia
FSSAPIFFFLHITLCIYSCLVAG

SEQ ID NO: 3094525 - protein, 18 aa, Giardia lamblia
FTCSCSYGFFLAEKYCVP

SEQ ID NO: 3094526 - protein, 18 aa, Giardia lamblia
FTFLIHKLGIMPNYISIA

SEQ ID NO: 3094527 - protein, 22 aa, Giardia lamblia
FTHVIVILLFALGNWRCYPLGQ

SEQ ID NO: 3094528 - protein, 24 aa, Giardia lamblia
FTIPVPFEVIWYANAPLVFLSSNT

SEQ ID NO: 3094529 - protein, 18 aa, Giardia lamblia
FTNIPLFPDIYMTEQLIP

SEQ ID NO: 3094530 - protein, 18 aa, Giardia lamblia
FTTRVGRILLLIMSIILL

SEQ ID NO: 3094531 - protein, 35 aa, Giardia lamblia
FVAVLKQFRLFFNQFFLVLAFLQLYRPLQVGLAFT

SEQ ID NO: 3094532 - protein, 20 aa, Giardia lamblia
FVAWLTTIRMLRIRKTFLLL

SEQ ID NO: 3094533 - protein, 18 aa, Giardia lamblia
FVFLYMTFNISLGNKYAI

SEQ ID NO: 3094534 - protein, 17 aa, Giardia lamblia
FVGLGCVLLLAVYAGIL

SEQ ID NO: 3094535 - protein, 18 aa, Giardia lamblia
FVRSAFLRLITELNPYLF

SEQ ID NO: 3094536 - protein, 17 aa, Giardia lamblia
FYYEFLRFIGMASILML

SEQ ID NO: 3094537 - protein, 19 aa, Giardia lamblia
GAFKYWYFPHGPQALYTPL

SEQ ID NO: 3094538 - protein, 25 aa, Giardia lamblia
GAVFLCLYFIWAGFFFAVFGQNNSW

SEQ ID NO: 3094539 - protein, 19 aa, Giardia lamblia
GCWALEFGLLPYYRLFEPA

SEQ ID NO: 3094540 - protein, 17 aa, Giardia lamblia
GCYNILYSPGNLICVDL

SEQ ID NO: 3094541 - protein, 22 aa, Giardia lamblia
GDAFLYSLLLPSFSMEPMTYEG

SEQ ID NO: 3094542 - protein, 22 aa, Giardia lamblia
GDRDMIALLIPYELDLVGVTQL

SEQ ID NO: 3094543 - protein, 19 aa, Giardia lamblia
GDYLYILMPIYSHGDLVAY

SEQ ID NO: 3094544 - protein, 27 aa, Giardia lamblia
GELCCNIMLWILLIGTSLKSLMESLES

SEQ ID NO: 3094545 - protein, 21 aa, Giardia lamblia
GELWGQRYLVQLKPYLLSNIT

SEQ ID NO: 3094546 - protein, 23 aa, Giardia lamblia
GFALLLAYLFYSPALSLVLSAFS

SEQ ID NO: 3094547 - protein, 18 aa, Giardia lamblia
GFERLYFEYGLRAPQELF

SEQ ID NO: 3094548 - protein, 25 aa, Giardia lamblia
GGTKPLLLFALIPSLLTTIANSALS

SEQ ID NO: 3094549 - protein, 25 aa, Giardia lamblia
GIDYPYFLSQPLLPSIKLSLLRKLT

SEQ ID NO: 3094550 - protein, 22 aa, Giardia lamblia
GIETAPVPFYWWRNGRVYYDEG

SEQ ID NO: 3094551 - protein, 20 aa, Giardia lamblia
GIGVYLLVKLLSEKKAKRDH

SEQ ID NO: 3094552 - protein, 21 aa, Giardia lamblia
GILQILLLFILSCLLIIPAFV

SEQ ID NO: 3094553 - protein, 17 aa, Giardia lamblia
GISYNRLILFYVRQFIF

SEQ ID NO: 3094554 - protein, 18 aa, Giardia lamblia
GKFLLTYLQLFFSYAMTI

SEQ ID NO: 3094555 - protein, 24 aa, Giardia lamblia
GKIRRDFWLFMHGLNLLIKNDFSR

SEQ ID NO: 3094556 - protein, 18 aa, Giardia lamblia
GLFLAFCATALFVVRHRL

SEQ ID NO: 3094557 - protein, 28 aa, Giardia lamblia
GLIALFIILPIVGLILFAFTRLLFSLLS

SEQ ID NO: 3094558 - protein, 21 aa, Giardia lamblia
GLVKLLLTDLIFIVNPNYAKL

SEQ ID NO: 3094559 - protein, 21 aa, Giardia lamblia
GMLVRLLQGYAIFSVVWSCLG

SEQ ID NO: 3094560 - protein, 21 aa, Giardia lamblia
GMQLIIMLAPGVRYIFHIFDC

SEQ ID NO: 3094561 - protein, 25 aa, Giardia lamblia
GNKYGFGLIWMFYEFLLKQWKAGPP

SEQ ID NO: 3094562 - protein, 21 aa, Giardia lamblia
GPFIIIRVIFVHILLDIIDLY

SEQ ID NO: 3094563 - protein, 19 aa, Giardia lamblia
GPRRILFKVVPYTGNAYAA

SEQ ID NO: 3094564 - protein, 24 aa, Giardia lamblia
GQVVLFILMIYKLARMLSFNFRYI

SEQ ID NO: 3094565 - protein, 27 aa, Giardia lamblia
GRASFKIMWLVWLGQLISLSYSFCPLR

SEQ ID NO: 3094566 - protein, 21 aa, Giardia lamblia
GRLNLALIRFLQPGPATTGYW

SEQ ID NO: 3094567 - protein, 25 aa, Giardia lamblia
GRQYVILLVRYLYTMVGLGVISLEE

SEQ ID NO: 3094568 - protein, 35 aa, Giardia lamblia
GRSVDEVFLIRSMFYFFLLRFNVVTILRKPLPSQF

SEQ ID NO: 3094569 - protein, 24 aa, Giardia lamblia
GRVARRFWVLGALLRVIVDGVARE

SEQ ID NO: 3094570 - protein, 23 aa, Giardia lamblia
GSLLPLPLILKAWRYFVRFLYVY

SEQ ID NO: 3094571 - protein, 24 aa, Giardia lamblia
GSQTLQHELILLETLKPLLSRSNP

SEQ ID NO: 3094572 - protein, 28 aa, Giardia lamblia
GSRCSLLCYLVFVLLWQGSTQYQGVLIN

SEQ ID NO: 3094573 - protein, 28 aa, Giardia lamblia
GSVAGVLVWFFLFRNRKGPMKKSPRRRF

SEQ ID NO: 3094574 - protein, 29 aa, Giardia lamblia
GSVYFALPTLFVLASILLVLLIYLVSFVI

SEQ ID NO: 3094575 - protein, 27 aa, Giardia lamblia
GTYHLLILSWVFVILFIPINEESSTPC

SEQ ID NO: 3094576 - protein, 24 aa, Giardia lamblia
GVIVFIIVLILIVVTVVLLIRLRK

SEQ ID NO: 3094577 - protein, 49 aa, Giardia lamblia
GVKRHLLLGLIILTVLLTMAILGLTLYFLAKFLIFRRKNKQRIAYIKER

SEQ ID NO: 3094578 - protein, 27 aa, Giardia lamblia
GVLVGFLCWWFLCRGKRIGASPSTTAL

SEQ ID NO: 3094579 - protein, 27 aa, Giardia lamblia
GVLVGFLCWWFLCRSKHIGASSSTTAL

SEQ ID NO: 3094580 - protein, 21 aa, Giardia lamblia
GVVLLIAIIVGVFFCVKKARK

SEQ ID NO: 3094581 - protein, 21 aa, Giardia lamblia
GVWMLLVAILITWIKIFIART

SEQ ID NO: 3094582 - protein, 31 aa, Giardia lamblia
GVYAYPPFWAMGAYIFVLWSMKLMDARHIAR

SEQ ID NO: 3094583 - protein, 18 aa, Giardia lamblia
GYCVPKCFRWLFDIDWST

SEQ ID NO: 3094584 - protein, 24 aa, Giardia lamblia
GYVLELLLMKLIRKDTNLPILVIS

SEQ ID NO: 3094585 - protein, 22 aa, Giardia lamblia
HALFFHRCFAVQFLLKAVSLSM

SEQ ID NO: 3094586 - protein, 18 aa, Giardia lamblia
HECYIVTLCLYCLVLDLL

SEQ ID NO: 3094587 - protein, 17 aa, Giardia lamblia
HELLIFVKKLIRSFDAA

SEQ ID NO: 3094588 - protein, 28 aa, Giardia lamblia
HFASTLCFLWLYFTYCTLLLNVGEANIN

SEQ ID NO: 3094589 - protein, 18 aa, Giardia lamblia
HFIPRYIPLPVRVQHPMV

SEQ ID NO: 3094590 - protein, 17 aa, Giardia lamblia
HFPFVYFQPGANKIFIT

SEQ ID NO: 3094591 - protein, 17 aa, Giardia lamblia
HFQPVEYMRLLLSFFCP

SEQ ID NO: 3094592 - protein, 20 aa, Giardia lamblia
HFYVIFCKFWELDTDHDQLI

SEQ ID NO: 3094593 - protein, 19 aa, Giardia lamblia
HGFLIRPMLYQSLPEFILQ

SEQ ID NO: 3094594 - protein, 25 aa, Giardia lamblia
HIRFLTWYYIMWTVSRISAVVSVIV

SEQ ID NO: 3094595 - protein, 22 aa, Giardia lamblia
HIRHLGWRRVFLGRYMPQLIDL

SEQ ID NO: 3094596 - protein, 22 aa, Giardia lamblia
HKDTFLIFLVFSGGYATYMLYK

SEQ ID NO: 3094597 - protein, 23 aa, Giardia lamblia
HKRQLFFLLYFTTVFYVLAGVPL

SEQ ID NO: 3094598 - protein, 17 aa, Giardia lamblia
HLFYEYGCYSRHSSTGF

SEQ ID NO: 3094599 - protein, 18 aa, Giardia lamblia
HLFYEYGCYSRHSSTGFA

SEQ ID NO: 3094600 - protein, 25 aa, Giardia lamblia
HLLAALGVPLFFSPLAWLSIKDEEP

SEQ ID NO: 3094601 - protein, 19 aa, Giardia lamblia
HLPPLRILKMTPAIRSLRK

SEQ ID NO: 3094602 - protein, 18 aa, Giardia lamblia
HLYFTPKLPIFIANLLRA

SEQ ID NO: 3094603 - protein, 22 aa, Giardia lamblia
HMEMIWISRVLPINAQLMLLAT

SEQ ID NO: 3094604 - protein, 27 aa, Giardia lamblia
HPDSPLLMYFLWIPLQILITYDAINFT

SEQ ID NO: 3094605 - protein, 17 aa, Giardia lamblia
HPFTFLIHKLGIMPNYI

SEQ ID NO: 3094606 - protein, 20 aa, Giardia lamblia
HPLLQAYRLFYVGTIILVLT

SEQ ID NO: 3094607 - protein, 19 aa, Giardia lamblia
HPRVLLLVFLPHNFLEATP

SEQ ID NO: 3094608 - protein, 24 aa, Giardia lamblia
HPVKLRMWLRLQTISFIYRTLHIV

SEQ ID NO: 3094609 - protein, 25 aa, Giardia lamblia
HQDPLPFILIPLPQRIIDAISTVLA

SEQ ID NO: 3094610 - protein, 23 aa, Giardia lamblia
HQRSYFLGVFPMRPFTLSYTDPR

SEQ ID NO: 3094611 - protein, 24 aa, Giardia lamblia
HRGTFILLVVFFRSFLRHSLDSPG

SEQ ID NO: 3094612 - protein, 29 aa, Giardia lamblia
HSHPTLVRLSFIFVLLVVSYQLFSLASDP

SEQ ID NO: 3094613 - protein, 24 aa, Giardia lamblia
HSIHPFLVSSWKLTKQRLTLNASG

SEQ ID NO: 3094614 - protein, 23 aa, Giardia lamblia
HSIKVTLIFILSAAIRWTILFSC

SEQ ID NO: 3094615 - protein, 20 aa, Giardia lamblia
HSLFTFRILSVEALFGHICT

SEQ ID NO: 3094616 - protein, 20 aa, Giardia lamblia
HSLQLFTPLLTSKSPHDATE

SEQ ID NO: 3094617 - protein, 20 aa, Giardia lamblia
HSYVIQLFPLLLASVARLSG

SEQ ID NO: 3094618 - protein, 27 aa, Giardia lamblia
HTAPNNIFFWLIYPIQILFDTIYVFLH

SEQ ID NO: 3094619 - protein, 26 aa, Giardia lamblia
HTESWIFQFINGYFLIKGSLPVGLIN

SEQ ID NO: 3094620 - protein, 24 aa, Giardia lamblia
HTILHLMLLVFLPLVPLDSYHYRR

SEQ ID NO: 3094621 - protein, 19 aa, Giardia lamblia
HTLNLPFLLYGRGHMNIYI

SEQ ID NO: 3094622 - protein, 25 aa, Giardia lamblia
HTSIHPLFIWFLSSGIFNEYSSIAD

SEQ ID NO: 3094623 - protein, 24 aa, Giardia lamblia
HVDEYLPLLSFYKAGRRAYKMYMK

SEQ ID NO: 3094624 - protein, 18 aa, Giardia lamblia
HVFMPHIFLEILLDLVVN

SEQ ID NO: 3094625 - protein, 29 aa, Giardia lamblia
HVSRHSMSLLYKTILFFVLALKNTSVTSF

SEQ ID NO: 3094626 - protein, 24 aa, Giardia lamblia
HVYRTPYLYLLPQFPDLSASIEAT

SEQ ID NO: 3094627 - protein, 19 aa, Giardia lamblia
HWCHTYLASFLWNTSKYYL

SEQ ID NO: 3094628 - protein, 23 aa, Giardia lamblia
HYEALVLICPWLEEIFVTNKFLH

SEQ ID NO: 3094629 - protein, 25 aa, Giardia lamblia
HYEQFCWLRRLLLPRAFHVFDIDDY

SEQ ID NO: 3094630 - protein, 21 aa, Giardia lamblia
HYMSLFRVVSPWMRGYASSKP

SEQ ID NO: 3094631 - protein, 22 aa, Giardia lamblia
HYPTYEFVLPLAVNYKLLPSSF

SEQ ID NO: 3094632 - protein, 19 aa, Giardia lamblia
HYRLPAMNYLFNYVKGHLL

SEQ ID NO: 3094633 - protein, 22 aa, Giardia lamblia
IAGQLVFIYLFNSALGSNSSLK

SEQ ID NO: 3094634 - protein, 23 aa, Giardia lamblia
IAKDQPYLLGRLKLRSSWTDITP

SEQ ID NO: 3094635 - protein, 17 aa, Giardia lamblia
IAMVMLILTLFSIAFYQ

SEQ ID NO: 3094636 - protein, 27 aa, Giardia lamblia
IASALLPIMIKLLQFVRLSIPKTILIV

SEQ ID NO: 3094637 - protein, 18 aa, Giardia lamblia
IATACGVILIFNFTEILR

SEQ ID NO: 3094638 - protein, 19 aa, Giardia lamblia
IAVILSVLRQVAAALAYLY

SEQ ID NO: 3094639 - protein, 23 aa, Giardia lamblia
IAVIVIIVVFLKKGIIKGRKPKH

SEQ ID NO: 3094640 - protein, 19 aa, Giardia lamblia
ICCDIFLTLLLLRRVFHSF

SEQ ID NO: 3094641 - protein, 23 aa, Giardia lamblia
ICIGVLFFILSLSLGIEWLESFL

SEQ ID NO: 3094642 - protein, 17 aa, Giardia lamblia
ICRPFFVSVLLNQIFFY

SEQ ID NO: 3094643 - protein, 23 aa, Giardia lamblia
ICSIYLIGWLRLTQNLTLCYDGA

SEQ ID NO: 3094644 - protein, 21 aa, Giardia lamblia
IDKTRRFFCGFLEGLTDSLQD

SEQ ID NO: 3094645 - protein, 17 aa, Giardia lamblia
IDMLLYPAGPRVQQKEE

SEQ ID NO: 3094646 - protein, 18 aa, Giardia lamblia
IEDKLIFCRNFVIAIGNV

SEQ ID NO: 3094647 - protein, 18 aa, Giardia lamblia
IELLQLLHTLPYPGLPRA

SEQ ID NO: 3094648 - protein, 23 aa, Giardia lamblia
IELWYFLAFFLLTPAVVGVSFAL

SEQ ID NO: 3094649 - protein, 22 aa, Giardia lamblia
IETFHSTVLLFLRYYPCDPKSI

SEQ ID NO: 3094650 - protein, 23 aa, Giardia lamblia
IFAHFIYLYVFLGPDLFKRLDPR

SEQ ID NO: 3094651 - protein, 18 aa, Giardia lamblia
IFERALPLFIRLSEHLNQ

SEQ ID NO: 3094652 - protein, 25 aa, Giardia lamblia
IFPLRALFIMLLSRETYHISRPQQR

SEQ ID NO: 3094653 - protein, 21 aa, Giardia lamblia
IFRYVCFLTYFLPSTTSLPLM

SEQ ID NO: 3094654 - protein, 18 aa, Giardia lamblia
IFSLFKYLLPMVFCPFYM

SEQ ID NO: 3094655 - protein, 19 aa, Giardia lamblia
IFVLFSNALILRVSLDRSK

SEQ ID NO: 3094656 - protein, 18 aa, Giardia lamblia
IGALLYFMSRTYAFLRLY

SEQ ID NO: 3094657 - protein, 25 aa, Giardia lamblia
IGGLAFIMNFLFPSLFKFGSSSSES

SEQ ID NO: 3094658 - protein, 27 aa, Giardia lamblia
IGKCVWITIILVLLGIVGIWIYRIAIN

SEQ ID NO: 3094659 - protein, 23 aa, Giardia lamblia
IHFVHFYMTYHFIRLVWSTIRAF

SEQ ID NO: 3094660 - protein, 18 aa, Giardia lamblia
IHILVIHREIFYKAVLAF

SEQ ID NO: 3094661 - protein, 20 aa, Giardia lamblia
IHLYASYLHYCDFSLVLQRL

SEQ ID NO: 3094662 - protein, 18 aa, Giardia lamblia
IHVEWWKRLLSKLRTHCM

SEQ ID NO: 3094663 - protein, 20 aa, Giardia lamblia
IIAKLLINLVFLLRCDKSNL

SEQ ID NO: 3094664 - protein, 26 aa, Giardia lamblia
IIFDAIIFLLFLISLTAYLIVGCVFV

SEQ ID NO: 3094665 - protein, 26 aa, Giardia lamblia
IIGAVAGFLCWWFLCHKKNGGNCFGG

SEQ ID NO: 3094666 - protein, 17 aa, Giardia lamblia
IIKYLRYLWFLAQSYRD

SEQ ID NO: 3094667 - protein, 22 aa, Giardia lamblia
IILLGFVFVVLGLALLAAGCMF

SEQ ID NO: 3094668 - protein, 19 aa, Giardia lamblia
IILVITLILVSLLMLRRCR

SEQ ID NO: 3094669 - protein, 17 aa, Giardia lamblia
IIRLYFYDTLHPLDLLF

SEQ ID NO: 3094670 - protein, 17 aa, Giardia lamblia
IIRMVLYKRQIATETII

SEQ ID NO: 3094671 - protein, 19 aa, Giardia lamblia
IITMRLRCSYLLKYMWRLF

SEQ ID NO: 3094672 - protein, 23 aa, Giardia lamblia
IITNLPFPLRMPAAMKLPSLPAC

SEQ ID NO: 3094673 - protein, 23 aa, Giardia lamblia
IIVRFIPPIFLTATRPSLSVLRE

SEQ ID NO: 3094674 - protein, 20 aa, Giardia lamblia
IIVVGGLVGFLCWWFIYRGR

SEQ ID NO: 3094675 - protein, 25 aa, Giardia lamblia
IKCERIIKIVLWSASVLFLGLSALG

SEQ ID NO: 3094676 - protein, 29 aa, Giardia lamblia
IKMPPLTEPFLRSLFLKVYPHHTESWIFQ

SEQ ID NO: 3094677 - protein, 24 aa, Giardia lamblia
IKNKWLFLHIFSFPFCHEKFLHKI

SEQ ID NO: 3094678 - protein, 18 aa, Giardia lamblia
ILCIYILINWTLAARTQI

SEQ ID NO: 3094679 - protein, 20 aa, Giardia lamblia
ILDFFLTLLGIVTYWFILSS

SEQ ID NO: 3094680 - protein, 18 aa, Giardia lamblia
ILKAWRYFVRFLYVYFTG

SEQ ID NO: 3094681 - protein, 17 aa, Giardia lamblia
ILLCFMMASAAQLFGAD

SEQ ID NO: 3094682 - protein, 18 aa, Giardia lamblia
ILLDSPPLYRGVLEQAPN

SEQ ID NO: 3094683 - protein, 17 aa, Giardia lamblia
ILLLLSLADPSSDALCL

SEQ ID NO: 3094684 - protein, 20 aa, Giardia lamblia
ILLLNIYFFGHRRLLNAFPI

SEQ ID NO: 3094685 - protein, 18 aa, Giardia lamblia
ILLLYDSILLAKRHRYLL

SEQ ID NO: 3094686 - protein, 17 aa, Giardia lamblia
ILLSPYRRFKMNLVCIP

SEQ ID NO: 3094687 - protein, 23 aa, Giardia lamblia
ILMELCCLIRLLDRWRVYLLAAD

SEQ ID NO: 3094688 - protein, 19 aa, Giardia lamblia
ILPNLLTASLLLFSRSRHV

SEQ ID NO: 3094689 - protein, 23 aa, Giardia lamblia
ILQDLLFITFVLSRDKHLPLGTI

SEQ ID NO: 3094690 - protein, 19 aa, Giardia lamblia
ILRGLYYVKTLLLAKTYFP

SEQ ID NO: 3094691 - protein, 19 aa, Giardia lamblia
ILSYFLSLAPHILLQSIYG

SEQ ID NO: 3094692 - protein, 17 aa, Giardia lamblia
ILVRPGYYRWCQIYHVD

SEQ ID NO: 3094693 - protein, 18 aa, Giardia lamblia
IMLVSFYFTRFLAVPRRV

SEQ ID NO: 3094694 - protein, 27 aa, Giardia lamblia
IMSIILLIIFVPLFVRLCPLCVRCFMC

SEQ ID NO: 3094695 - protein, 26 aa, Giardia lamblia
IMVVALVCWLVLRRRRGPKSLSTMAG

SEQ ID NO: 3094696 - protein, 25 aa, Giardia lamblia
INEKELWWVLWDGVWMLLVAILITW

SEQ ID NO: 3094697 - protein, 24 aa, Giardia lamblia
INTYPLIYILFPLSVILLCYGILF

SEQ ID NO: 3094698 - protein, 17 aa, Giardia lamblia
INYLWIDFVARSLQITN

SEQ ID NO: 3094699 - protein, 22 aa, Giardia lamblia
INYTFFFTQYFFNTLTVASASL

SEQ ID NO: 3094700 - protein, 19 aa, Giardia lamblia
IPILLLIPPGAQPGKLIVE

SEQ ID NO: 3094701 - protein, 21 aa, Giardia lamblia
IPLQRFRLLYLISLIVQQFFE

SEQ ID NO: 3094702 - protein, 19 aa, Giardia lamblia
IPVFKNCPYFRRYPSVKFY

SEQ ID NO: 3094703 - protein, 24 aa, Giardia lamblia
IPVTIVICIEVLLTNGYFLPLEAD

SEQ ID NO: 3094704 - protein, 22 aa, Giardia lamblia
IQEIIILLQYIKFGFKFLFVTS

SEQ ID NO: 3094705 - protein, 34 aa, Giardia lamblia
IQGGWLILFLRFALPLILVLVLYLNPLVAYYQSS

SEQ ID NO: 3094706 - protein, 21 aa, Giardia lamblia
IQILCLIEFLPLILSKKTIKE

SEQ ID NO: 3094707 - protein, 25 aa, Giardia lamblia
IQTLLTFFVGPILLGLLIGGVVGGT

SEQ ID NO: 3094708 - protein, 21 aa, Giardia lamblia
IRIPQFMKVLYRILDPKYVKF

SEQ ID NO: 3094709 - protein, 18 aa, Giardia lamblia
IRLLLHKSFYWVPTAREE

SEQ ID NO: 3094710 - protein, 23 aa, Giardia lamblia
IRLSLTALNFLYMKSMYLELGSV

SEQ ID NO: 3094711 - protein, 19 aa, Giardia lamblia
IRPMLYQSLPEFILQNPWL

SEQ ID NO: 3094712 - protein, 24 aa, Giardia lamblia
IRSDWMRLLFKMYKYAKLTYDYID

SEQ ID NO: 3094713 - protein, 26 aa, Giardia lamblia
ISALRLIYVLVFLPTVYLIFLYYDRH

SEQ ID NO: 3094714 - protein, 30 aa, Giardia lamblia
ISAYKCMLAMLISYILFIFAHASSGLSIRH

SEQ ID NO: 3094715 - protein, 29 aa, Giardia lamblia
ISEMFYYYIRTIFLFIDIFQPIFLCLLFT

SEQ ID NO: 3094716 - protein, 21 aa, Giardia lamblia
ISFAAFFDRWRRFYPPLLSLS

SEQ ID NO: 3094717 - protein, 24 aa, Giardia lamblia
ISGHYLIVKLLLDYEAYFSTTQLS

SEQ ID NO: 3094718 - protein, 19 aa, Giardia lamblia
ISITLPLLLTMLAASIMFN

SEQ ID NO: 3094719 - protein, 24 aa, Giardia lamblia
ISITVILIIGGVAGFLCWWFFCHK

SEQ ID NO: 3094720 - protein, 17 aa, Giardia lamblia
ISLLILCSLVLVGFLVY

SEQ ID NO: 3094721 - protein, 26 aa, Giardia lamblia
ISPMLVLLLVCYFLKIAFKTSSEEKD

SEQ ID NO: 3094722 - protein, 23 aa, Giardia lamblia
ISQIWLIAAHLLSALSYLHFSYK

SEQ ID NO: 3094723 - protein, 22 aa, Giardia lamblia
ISRNCIPLFPRLVLASSFSATT

SEQ ID NO: 3094724 - protein, 21 aa, Giardia lamblia
ISRRKLLSFLLLPNAADLIGK

SEQ ID NO: 3094725 - protein, 27 aa, Giardia lamblia
ISTVELFVRALLPFGLFLFCVHVTLRL

SEQ ID NO: 3094726 - protein, 26 aa, Giardia lamblia
ISVTVLLLLFTLLKTIFRRTPVAYRL

SEQ ID NO: 3094727 - protein, 23 aa, Giardia lamblia
ITEPCLQFLLMKLQMMQLRSMKA

SEQ ID NO: 3094728 - protein, 20 aa, Giardia lamblia
ITEPFMCRFLLKEDFLSLID

SEQ ID NO: 3094729 - protein, 31 aa, Giardia lamblia
ITHKYRNFLFYKPPLYMFYDSIKLTLPGSSL

SEQ ID NO: 3094730 - protein, 19 aa, Giardia lamblia
IVFPLICIFLSHIKPEEAW

SEQ ID NO: 3094731 - protein, 24 aa, Giardia lamblia
IVHLPSMYLFQIVSIMVDAVEADK

SEQ ID NO: 3094732 - protein, 22 aa, Giardia lamblia
IVIRAYLLYLLILTSGSKEDAL

SEQ ID NO: 3094733 - protein, 25 aa, Giardia lamblia
IVISPLYFLVFLQKGTILTNLSTSW

SEQ ID NO: 3094734 - protein, 18 aa, Giardia lamblia
IVLAAVVAALIGLILFCC

SEQ ID NO: 3094735 - protein, 21 aa, Giardia lamblia
IVLTFFPIFIYALTEHDIKDR

SEQ ID NO: 3094736 - protein, 23 aa, Giardia lamblia
IVLVIIVVLLVVFLLRCKKTAKD

SEQ ID NO: 3094737 - protein, 17 aa, Giardia lamblia
IVTTLLLRWIGPRIKDF

SEQ ID NO: 3094738 - protein, 19 aa, Giardia lamblia
IVTYWLVPLLLVYKRPYLE

SEQ ID NO: 3094739 - protein, 37 aa, Giardia lamblia
IVVFWSVATLILLLFITVLSLFLKYRYKYTLASKRAK

SEQ ID NO: 3094740 - protein, 18 aa, Giardia lamblia
IWMPAVFVCLLALPKMSY

SEQ ID NO: 3094741 - protein, 17 aa, Giardia lamblia
IWRVAAVIVFVLEYLHT

SEQ ID NO: 3094742 - protein, 25 aa, Giardia lamblia
IYGEPPWWRSFWGPTIRDKAPDPER

SEQ ID NO: 3094743 - protein, 25 aa, Giardia lamblia
IYGLALLTVPIFTSYLAIFLLVRRS

SEQ ID NO: 3094744 - protein, 22 aa, Giardia lamblia
IYHPIFLPLHYILGYTLGAVST

SEQ ID NO: 3094745 - protein, 18 aa, Giardia lamblia
IYLLIFILSNIYSKANDT

SEQ ID NO: 3094746 - protein, 19 aa, Giardia lamblia
IYQGLLPFLFTIDLGIFYP

SEQ ID NO: 3094747 - protein, 26 aa, Giardia lamblia
IYSEILDKLLFYKLLFIVSPINDGPA

SEQ ID NO: 3094748 - protein, 19 aa, Giardia lamblia
IYWGLAMLILLPLLPNILS

SEQ ID NO: 3094749 - protein, 24 aa, Giardia lamblia
KAIPPSFPALWKNPESFLACTPQS

SEQ ID NO: 3094750 - protein, 21 aa, Giardia lamblia
KALFRITHIIYALLCVTKYGI

SEQ ID NO: 3094751 - protein, 24 aa, Giardia lamblia
KAQIPLTIFFINDSINPLLPPPEC

SEQ ID NO: 3094752 - protein, 21 aa, Giardia lamblia
KAYRYTCIYNFFIFAQLFNEI

SEQ ID NO: 3094753 - protein, 17 aa, Giardia lamblia
KDKSVLCAAFRKLPRNN

SEQ ID NO: 3094754 - protein, 22 aa, Giardia lamblia
KDKVILLLQNLLYKSKYNSSIL

SEQ ID NO: 3094755 - protein, 20 aa, Giardia lamblia
KDLLYKLLQPFPFKRITWNE

SEQ ID NO: 3094756 - protein, 29 aa, Giardia lamblia
KDSFPLTFTLLYDLLYLGAATLYAIGFNS

SEQ ID NO: 3094757 - protein, 19 aa, Giardia lamblia
KEMPVYYRKAPLLPSIIKY

SEQ ID NO: 3094758 - protein, 25 aa, Giardia lamblia
KFDFLSPEYILWIEQLELKQFSPNV

SEQ ID NO: 3094759 - protein, 27 aa, Giardia lamblia
KFERMFCYFVILGLCALLFSQWIVNPW

SEQ ID NO: 3094760 - protein, 18 aa, Giardia lamblia
KFILLVHANYLLFIQPFS

SEQ ID NO: 3094761 - protein, 25 aa, Giardia lamblia
KFKKFLIFSLVLLGLSLFLLIVSFI

SEQ ID NO: 3094762 - protein, 18 aa, Giardia lamblia
KFKLSIPSIIMIVTGILG

SEQ ID NO: 3094763 - protein, 18 aa, Giardia lamblia
KFRFLPEYFKKFTSSEKA

SEQ ID NO: 3094764 - protein, 20 aa, Giardia lamblia
KFRYSFIPCYIHNPAFLIMA

SEQ ID NO: 3094765 - protein, 20 aa, Giardia lamblia
KFTLRLMLNFYKIQSSIILG

SEQ ID NO: 3094766 - protein, 21 aa, Giardia lamblia
KFVPSLLLWPYWGTQRERMLI

SEQ ID NO: 3094767 - protein, 19 aa, Giardia lamblia
KFYIVPIITRLFSLCIKSN

SEQ ID NO: 3094768 - protein, 17 aa, Giardia lamblia
KGMFIFCLLLSALVTFA

SEQ ID NO: 3094769 - protein, 18 aa, Giardia lamblia
KGRVYIVLFLKRLNDYHS

SEQ ID NO: 3094770 - protein, 18 aa, Giardia lamblia
KHGFIVKTLFKFILKQPI

SEQ ID NO: 3094771 - protein, 26 aa, Giardia lamblia
KIDDCPIYLYPIPVTIVICIEVLLTN

SEQ ID NO: 3094772 - protein, 17 aa, Giardia lamblia
KILMPGSADWFGAVEAG

SEQ ID NO: 3094773 - protein, 22 aa, Giardia lamblia
KILVLAILFPGFATFFFNIMLP

SEQ ID NO: 3094774 - protein, 20 aa, Giardia lamblia
KITIVLMCLAIFCLLFLDYI

SEQ ID NO: 3094775 - protein, 19 aa, Giardia lamblia
KKLRRAFLVPLRDGVIMLT

SEQ ID NO: 3094776 - protein, 19 aa, Giardia lamblia
KKRHVIIPVLMPNAITLCN

SEQ ID NO: 3094777 - protein, 23 aa, Giardia lamblia
KLAFVDIILIRFLTDILGSGNAE

SEQ ID NO: 3094778 - protein, 17 aa, Giardia lamblia
KLEAALFFLYVLRVFDD

SEQ ID NO: 3094779 - protein, 20 aa, Giardia lamblia
KLFAFLRRFSFTTPATFKNI

SEQ ID NO: 3094780 - protein, 18 aa, Giardia lamblia
KLFTLPYVSGIRTPISVV

SEQ ID NO: 3094781 - protein, 20 aa, Giardia lamblia
KLGFLPSIVIFFVAAMAVVA

SEQ ID NO: 3094782 - protein, 26 aa, Giardia lamblia
KLGSIALKLLLIYRVDSPDFLQLFGC

SEQ ID NO: 3094783 - protein, 21 aa, Giardia lamblia
KLLFLEIVVSLFFSLVVLITL

SEQ ID NO: 3094784 - protein, 18 aa, Giardia lamblia
KLPPVRYYCDCNAGFYGH

SEQ ID NO: 3094785 - protein, 18 aa, Giardia lamblia
KMLALKNTLFSYGRRLTP

SEQ ID NO: 3094786 - protein, 18 aa, Giardia lamblia
KMSIALIVVFWSVATLIL

SEQ ID NO: 3094787 - protein, 31 aa, Giardia lamblia
KNAFLTLLRILMITLAILLCFMMASAAQLFG

SEQ ID NO: 3094788 - protein, 22 aa, Giardia lamblia
KNAYVKLLLFMKLYLSHILSTL

SEQ ID NO: 3094789 - protein, 23 aa, Giardia lamblia
KNCGAYIPLPYILRVRLGEKNRP

SEQ ID NO: 3094790 - protein, 23 aa, Giardia lamblia
KNSIRMLCLLALEFVVSLVVDAY

SEQ ID NO: 3094791 - protein, 30 aa, Giardia lamblia
KQQWGWRFLIGILFFIFWISLAFLDDMRYI

SEQ ID NO: 3094792 - protein, 24 aa, Giardia lamblia
KRFLSVLFRLIKRFSRLLFTDICF

SEQ ID NO: 3094793 - protein, 27 aa, Giardia lamblia
KRKGIPNHWLFFLFPIVYKADKIRRKY

SEQ ID NO: 3094794 - protein, 21 aa, Giardia lamblia
KRNLLQVTPLFPFQSAINLVE

SEQ ID NO: 3094795 - protein, 24 aa, Giardia lamblia
KRTNILRIILLLSSLVIGGVVVFL

SEQ ID NO: 3094796 - protein, 17 aa, Giardia lamblia
KSAFLYAFIWSFATTAM

SEQ ID NO: 3094797 - protein, 23 aa, Giardia lamblia
KSIMRAQILATDRARGLLFLCDN

SEQ ID NO: 3094798 - protein, 26 aa, Giardia lamblia
KSLTYYVELVFTLINWYKGAMESIKQ

SEQ ID NO: 3094799 - protein, 22 aa, Giardia lamblia
KSTLLEALLYLLSQERPVYDRI

SEQ ID NO: 3094800 - protein, 25 aa, Giardia lamblia
KSVLSFFILWLLAIIYLYSIELWQI

SEQ ID NO: 3094801 - protein, 21 aa, Giardia lamblia
KTILAYLLFLTNALHFDMYSG

SEQ ID NO: 3094802 - protein, 27 aa, Giardia lamblia
KTLLLQYPLPRYPLLSTLLVTVLEAVI

SEQ ID NO: 3094803 - protein, 23 aa, Giardia lamblia
KTPLTLEFIFLRLFKFCGGSEVA

SEQ ID NO: 3094804 - protein, 24 aa, Giardia lamblia
KTPLYTFLLRCLYAYAFTSLNFLA

SEQ ID NO: 3094805 - protein, 26 aa, Giardia lamblia
KTQRDFFAILLWVAAIVSIISFLIQK

SEQ ID NO: 3094806 - protein, 22 aa, Giardia lamblia
KVAYRSIHFWAVPSLAPNTFKF

SEQ ID NO: 3094807 - protein, 24 aa, Giardia lamblia
KVFPRLKFCQYFIKQPGTVFHDIR

SEQ ID NO: 3094808 - protein, 26 aa, Giardia lamblia
KVMLYLLPILIPWNMLVLVLSSLLNI

SEQ ID NO: 3094809 - protein, 24 aa, Giardia lamblia
KVTTYFNEIWLSGILFLDLLIDEV

SEQ ID NO: 3094810 - protein, 18 aa, Giardia lamblia
KVWVIKYSLDIPLHTAFK

SEQ ID NO: 3094811 - protein, 25 aa, Giardia lamblia
KYDITYPIFIFVPSSSLFPSALNAN

SEQ ID NO: 3094812 - protein, 34 aa, Giardia lamblia
KYLRNLPTHKLIYLLTIIYVLAPPWVRIYRIMRD

SEQ ID NO: 3094813 - protein, 24 aa, Giardia lamblia
KYRQQFIVLFIIKAALDNTQVGFG

SEQ ID NO: 3094814 - protein, 26 aa, Giardia lamblia
LAIAGVIGFLVWWFVCKKKTNKVNMP

SEQ ID NO: 3094815 - protein, 19 aa, Giardia lamblia
LAIFILQLAWAVQVEDERE

SEQ ID NO: 3094816 - protein, 19 aa, Giardia lamblia
LAILPYLQAIFSKEIIPKY

SEQ ID NO: 3094817 - protein, 28 aa, Giardia lamblia
LALVFWLFSWVWILLLLVFAVVITLELA

SEQ ID NO: 3094818 - protein, 24 aa, Giardia lamblia
LAQLMLFLITIFKRMPFVLQDLLT

SEQ ID NO: 3094819 - protein, 18 aa, Giardia lamblia
LCHPSILAYKIIVLSDSE

SEQ ID NO: 3094820 - protein, 19 aa, Giardia lamblia
LCQISLLLFLHLFSTIPFT

SEQ ID NO: 3094821 - protein, 24 aa, Giardia lamblia
LCSYHIWFRMLLDPLFRRSTLIMS

SEQ ID NO: 3094822 - protein, 18 aa, Giardia lamblia
LCVLLLSLFLLLSCDTFV

SEQ ID NO: 3094823 - protein, 19 aa, Giardia lamblia
LCYTLFPFPTISPPISVAN

SEQ ID NO: 3094824 - protein, 25 aa, Giardia lamblia
LDKLTYIFVIFKLRASMRPYGFSGS

SEQ ID NO: 3094825 - protein, 22 aa, Giardia lamblia
LDLVLIRFFLALHTYSQECGGD

SEQ ID NO: 3094826 - protein, 20 aa, Giardia lamblia
LDQAYLFPTSFSLKGVKFAK

SEQ ID NO: 3094827 - protein, 24 aa, Giardia lamblia
LDYKQMFIFMFLQDLLSNSQTNAQ

SEQ ID NO: 3094828 - protein, 25 aa, Giardia lamblia
LECGAWLMLYVYKALFRITHIIYAL

SEQ ID NO: 3094829 - protein, 23 aa, Giardia lamblia
LECTIILRFFYKHLLMEYPDLFC

SEQ ID NO: 3094830 - protein, 27 aa, Giardia lamblia
LEEELIWLYMGQILLALAYLHCPFKSG

SEQ ID NO: 3094831 - protein, 17 aa, Giardia lamblia
LERFLFPLAYSRSLPVN

SEQ ID NO: 3094832 - protein, 17 aa, Giardia lamblia
LERIFFDCYLHNTFSSC

SEQ ID NO: 3094833 - protein, 23 aa, Giardia lamblia
LESLLLHPYLLNIPFSMLSKFIE

SEQ ID NO: 3094834 - protein, 24 aa, Giardia lamblia
LETGQLCMRLLLYLVLCNKGPNGR

SEQ ID NO: 3094835 - protein, 18 aa, Giardia lamblia
LFAVWSFLPSQKGMKDDQ

SEQ ID NO: 3094836 - protein, 20 aa, Giardia lamblia
LFGLFILYCSQTPDAKDSNL

SEQ ID NO: 3094837 - protein, 17 aa, Giardia lamblia
LFIFYKPASFVADETAF

SEQ ID NO: 3094838 - protein, 20 aa, Giardia lamblia
LFIILPIVGLILFAFTRLLF

SEQ ID NO: 3094839 - protein, 17 aa, Giardia lamblia
LFNLEQMLFILDAALER

SEQ ID NO: 3094840 - protein, 25 aa, Giardia lamblia
LFNVPLLKYWLERLGALTVTLPIAS

SEQ ID NO: 3094841 - protein, 26 aa, Giardia lamblia
LFPLQSYTLFLRYLLRPEAPKTLSDS

SEQ ID NO: 3094842 - protein, 18 aa, Giardia lamblia
LFTPLCVALLLLAIGRLE

SEQ ID NO: 3094843 - protein, 27 aa, Giardia lamblia
LFVVIFPFIFYIMLYALKELLYWLTEG

SEQ ID NO: 3094844 - protein, 25 aa, Giardia lamblia
LGADWPILMLLKGFRIPWSMGDPAM

SEQ ID NO: 3094845 - protein, 21 aa, Giardia lamblia
LGALRIMLMYLPSSYYSSHSK

SEQ ID NO: 3094846 - protein, 17 aa, Giardia lamblia
LGGLFLQIGLAAAFAYI

SEQ ID NO: 3094847 - protein, 20 aa, Giardia lamblia
LGLVIPLLMFIVSPLMIFAL

SEQ ID NO: 3094848 - protein, 24 aa, Giardia lamblia
LGPYSLLLHFLWPVTLDLVVGALY

SEQ ID NO: 3094849 - protein, 20 aa, Giardia lamblia
LGQLFFCPLWLWLSEIIGRK

SEQ ID NO: 3094850 - protein, 17 aa, Giardia lamblia
LGQLISLSYSFCPLRNC

SEQ ID NO: 3094851 - protein, 17 aa, Giardia lamblia
LGRKFRFFFTNLDAILI

SEQ ID NO: 3094852 - protein, 18 aa, Giardia lamblia
LHDLVMLQTLRKIPIFAN

SEQ ID NO: 3094853 - protein, 25 aa, Giardia lamblia
LHEIYKWILSLKVWVIKYSLDIPLH

SEQ ID NO: 3094854 - protein, 17 aa, Giardia lamblia
LHPLLLVFLVGFVQTCV

SEQ ID NO: 3094855 - protein, 17 aa, Giardia lamblia
LHTLPYPGLPRALFEAA

SEQ ID NO: 3094856 - protein, 21 aa, Giardia lamblia
LHYTILRIVLLLIIVPETGTL

SEQ ID NO: 3094857 - protein, 17 aa, Giardia lamblia
LICVPIKALIQGAATPV

SEQ ID NO: 3094858 - protein, 19 aa, Giardia lamblia
LIHRYYFFKVNPQDPEFLS

SEQ ID NO: 3094859 - protein, 19 aa, Giardia lamblia
LIKSICHRLILLPSIEGAD

SEQ ID NO: 3094860 - protein, 28 aa, Giardia lamblia
LILITLFYIFLVCYLLFIYSYSLTNHVI

SEQ ID NO: 3094861 - protein, 22 aa, Giardia lamblia
LIMGALIGVLAWWVVSRKKKSA

SEQ ID NO: 3094862 - protein, 17 aa, Giardia lamblia
LIMRIRKLQDELFQRDS

SEQ ID NO: 3094863 - protein, 18 aa, Giardia lamblia
LINLVFLLRCDKSNLLTY

SEQ ID NO: 3094864 - protein, 20 aa, Giardia lamblia
LIQQMPISQIWLIAAHLLSA

SEQ ID NO: 3094865 - protein, 20 aa, Giardia lamblia
LIYVLLKYINLVFDPPLGLL

SEQ ID NO: 3094866 - protein, 18 aa, Giardia lamblia
LKALPLCALFPIFLSSNV

SEQ ID NO: 3094867 - protein, 21 aa, Giardia lamblia
LKHATLFRLLLYKYAESSASG

SEQ ID NO: 3094868 - protein, 19 aa, Giardia lamblia
LKLLMIVLFLVFQIDRSAL

SEQ ID NO: 3094869 - protein, 19 aa, Giardia lamblia
LKLMLFVETLYDVFKRLSP

SEQ ID NO: 3094870 - protein, 20 aa, Giardia lamblia
LLAHPRLCPYIKRLLGPSVT

SEQ ID NO: 3094871 - protein, 18 aa, Giardia lamblia
LLCYKLFCRVVISKFQEA

SEQ ID NO: 3094872 - protein, 18 aa, Giardia lamblia
LLDLINFNIYYLRKMHAL

SEQ ID NO: 3094873 - protein, 21 aa, Giardia lamblia
LLDPLILPMLRRRTLKSPHIY

SEQ ID NO: 3094874 - protein, 23 aa, Giardia lamblia
LLGVLFIIIIPWFSQIFSTSELY

SEQ ID NO: 3094875 - protein, 23 aa, Giardia lamblia
LLHVYLLPIYVYICRFLVLLRRD

SEQ ID NO: 3094876 - protein, 17 aa, Giardia lamblia
LLIANLLAYGLLFGAGS

SEQ ID NO: 3094877 - protein, 18 aa, Giardia lamblia
LLIANLLAYGLLFGAGSL

SEQ ID NO: 3094878 - protein, 27 aa, Giardia lamblia
LLIDSLCLFFVPLACLFWAAWSSGVDG

SEQ ID NO: 3094879 - protein, 27 aa, Giardia lamblia
LLIIVAVALACWFVLRRRRESRAALKT

SEQ ID NO: 3094880 - protein, 25 aa, Giardia lamblia
LLIKPPLIILLFLASRLRHLIYSLC

SEQ ID NO: 3094881 - protein, 18 aa, Giardia lamblia
LLIYSTWAVLQRFGHRYS

SEQ ID NO: 3094882 - protein, 17 aa, Giardia lamblia
LLLFLQSADFAPPLRFN

SEQ ID NO: 3094883 - protein, 17 aa, Giardia lamblia
LLLFLSLDLQEHCRSFA

SEQ ID NO: 3094884 - protein, 17 aa, Giardia lamblia
LLLLFYNKKLTLYEVFT

SEQ ID NO: 3094885 - protein, 21 aa, Giardia lamblia
LLLLLVFYAGAAAVLYMLGHR

SEQ ID NO: 3094886 - protein, 21 aa, Giardia lamblia
LLLPHLFLCVFIKLFEILHYP

SEQ ID NO: 3094887 - protein, 18 aa, Giardia lamblia
LLLYLIELSQHLATDPNN

SEQ ID NO: 3094888 - protein, 21 aa, Giardia lamblia
LLPCHVKIKSISWLTRLIRLL

SEQ ID NO: 3094889 - protein, 32 aa, Giardia lamblia
LLPGPFLIPVIAFPFIILLSLLKFFGLNTSQR

SEQ ID NO: 3094890 - protein, 28 aa, Giardia lamblia
LLPIAIVTVYLWMYYDLPPSNGTILKDQ

SEQ ID NO: 3094891 - protein, 18 aa, Giardia lamblia
LLPPCYNLLPLPYRLRCS

SEQ ID NO: 3094892 - protein, 20 aa, Giardia lamblia
LLRNLVISSLFYLRRHVWHA

SEQ ID NO: 3094893 - protein, 23 aa, Giardia lamblia
LLRPIPRIWLPFSLKEYAGTIIE

SEQ ID NO: 3094894 - protein, 25 aa, Giardia lamblia
LLSIAFVCVWLFHPVFAGAAVLGSV

SEQ ID NO: 3094895 - protein, 21 aa, Giardia lamblia
LLSSRILWTPSPRLLKLFFLG

SEQ ID NO: 3094896 - protein, 25 aa, Giardia lamblia
LLSVQIYSFFYFLSTLVFTCGTCFM

SEQ ID NO: 3094897 - protein, 35 aa, Giardia lamblia
LLSWPTIVFIIPLGILYIFIFNTFRLIAPQLKRIT

SEQ ID NO: 3094898 - protein, 20 aa, Giardia lamblia
LLTYLQLFFSYAMTISLMPF

SEQ ID NO: 3094899 - protein, 19 aa, Giardia lamblia
LLVIFTIALHYAPISSLSL

SEQ ID NO: 3094900 - protein, 31 aa, Giardia lamblia
LLVLAAVAGFLVWWFVIRPRKSGVLRERAPR

SEQ ID NO: 3094901 - protein, 30 aa, Giardia lamblia
LLVLAAVAGFLVWWFVIRPRRGGPLRERAP

SEQ ID NO: 3094902 - protein, 28 aa, Giardia lamblia
LLVLFTRFINLILILYSCSWKILTAEVD

SEQ ID NO: 3094903 - protein, 20 aa, Giardia lamblia
LLVNLLVIMLLSWPTIVFII

SEQ ID NO: 3094904 - protein, 18 aa, Giardia lamblia
LLVVIVYLSLITLRYCQL

SEQ ID NO: 3094905 - protein, 17 aa, Giardia lamblia
LLWEYRLGFKRTRNMLL

SEQ ID NO: 3094906 - protein, 17 aa, Giardia lamblia
LLYMLFTIVLTDIQVIF

SEQ ID NO: 3094907 - protein, 22 aa, Giardia lamblia
LLYNVMCIYLMALAYKCPQSTH

SEQ ID NO: 3094908 - protein, 17 aa, Giardia lamblia
LMACAMNCIGVVKLIME

SEQ ID NO: 3094909 - protein, 25 aa, Giardia lamblia
LMAESLLLLYNKIIPYVLMYTESIC

SEQ ID NO: 3094910 - protein, 18 aa, Giardia lamblia
LMKLFIRQVFIGTSILLT

SEQ ID NO: 3094911 - protein, 26 aa, Giardia lamblia
LMLACFYGHLSIVRLLFHKEKSIVST

SEQ ID NO: 3094912 - protein, 20 aa, Giardia lamblia
LMNTLFIAFLLHALKRYFVL

SEQ ID NO: 3094913 - protein, 27 aa, Giardia lamblia
LMPAISLYWSFFYFSLFSLTNNVITAM

SEQ ID NO: 3094914 - protein, 20 aa, Giardia lamblia
LMVITIFFSLIFITPLRQLD

SEQ ID NO: 3094915 - protein, 19 aa, Giardia lamblia
LMYVCLYVFALRRSFTQLS

SEQ ID NO: 3094916 - protein, 20 aa, Giardia lamblia
LNAVLPHKRFLFKTILELSS

SEQ ID NO: 3094917 - protein, 28 aa, Giardia lamblia
LNDDITLKLPWMPVPAYGKVFDGKGHTI

SEQ ID NO: 3094918 - protein, 19 aa, Giardia lamblia
LNFMYLLHLDILMFTKYNL

SEQ ID NO: 3094919 - protein, 17 aa, Giardia lamblia
LNGIRYTPLFTAQTLII

SEQ ID NO: 3094920 - protein, 22 aa, Giardia lamblia
LNLKTFFLWTFSGFIIAVVVFL

SEQ ID NO: 3094921 - protein, 23 aa, Giardia lamblia
LNLKTFFLWTFSGFIIAVVVFLL

SEQ ID NO: 3094922 - protein, 26 aa, Giardia lamblia
LNLLPLFMIILIRFFTPRPPNTFIYI

SEQ ID NO: 3094923 - protein, 22 aa, Giardia lamblia
LNMSLALLFYLTVLMWTEETAT

SEQ ID NO: 3094924 - protein, 20 aa, Giardia lamblia
LNQIFFYLLLAFCITSYIRP

SEQ ID NO: 3094925 - protein, 28 aa, Giardia lamblia
LNTFGCLFSLWYLLVLKIYATGDFFVSV

SEQ ID NO: 3094926 - protein, 17 aa, Giardia lamblia
LNVLMFGFLYRSSYVSS

SEQ ID NO: 3094927 - protein, 28 aa, Giardia lamblia
LPADLRLILYHSLLRLLYKDGERIAYNR

SEQ ID NO: 3094928 - protein, 22 aa, Giardia lamblia
LPESIFTPPLFLYQSPAKLVVE

SEQ ID NO: 3094929 - protein, 23 aa, Giardia lamblia
LPIRAFLFLFMLVFCLFGTLMTS

SEQ ID NO: 3094930 - protein, 19 aa, Giardia lamblia
LPLALLLEPYICQYHVDAF

SEQ ID NO: 3094931 - protein, 21 aa, Giardia lamblia
LPNIYAYMHLYLKKEIYLEDQ

SEQ ID NO: 3094932 - protein, 22 aa, Giardia lamblia
LQALLSCRLIFSPNYMPSQVLQ

SEQ ID NO: 3094933 - protein, 17 aa, Giardia lamblia
LQGYAIFSVVWSCLGLF

SEQ ID NO: 3094934 - protein, 24 aa, Giardia lamblia
LQNALGQVLILSIIFAIAACSKLL

SEQ ID NO: 3094935 - protein, 18 aa, Giardia lamblia
LQNLLYKSKYNSSILQVF

SEQ ID NO: 3094936 - protein, 21 aa, Giardia lamblia
LQQSLPLPLPLHPASPHQVIS

SEQ ID NO: 3094937 - protein, 22 aa, Giardia lamblia
LQSMLFYGLLLFLWVLPSVHKL

SEQ ID NO: 3094938 - protein, 19 aa, Giardia lamblia
LRFISSLFYILVLHYFDQA

SEQ ID NO: 3094939 - protein, 22 aa, Giardia lamblia
LRFLPTYTMSLFLLTSLANLHA

SEQ ID NO: 3094940 - protein, 18 aa, Giardia lamblia
LRHIVWADYITVTAVLAL

SEQ ID NO: 3094941 - protein, 20 aa, Giardia lamblia
LRILIEWIAIYAPSLLCYYD

SEQ ID NO: 3094942 - protein, 22 aa, Giardia lamblia
LRLGWLLPFRLGTPPAPNLLGK

SEQ ID NO: 3094943 - protein, 20 aa, Giardia lamblia
LRMYLQYLISLKNKYFYLDM

SEQ ID NO: 3094944 - protein, 17 aa, Giardia lamblia
LRQSPLLCYKLFCRVVI

SEQ ID NO: 3094945 - protein, 18 aa, Giardia lamblia
LRSFHTLYYALVTMVFFA

SEQ ID NO: 3094946 - protein, 21 aa, Giardia lamblia
LRVILQLFLLALRRHKRIESI

SEQ ID NO: 3094947 - protein, 24 aa, Giardia lamblia
LRYALICLLICSIHLLLSASRLAD

SEQ ID NO: 3094948 - protein, 24 aa, Giardia lamblia
LSFKNFLTKFLPFGAQIVFTVYAV

SEQ ID NO: 3094949 - protein, 26 aa, Giardia lamblia
LSFVCALWPLWVYLSQVFDKAICDVV

SEQ ID NO: 3094950 - protein, 24 aa, Giardia lamblia
LSITLPLAVLLLAATVITLAIILV

SEQ ID NO: 3094951 - protein, 20 aa, Giardia lamblia
LSKLSLFYYLYGSINLINFA

SEQ ID NO: 3094952 - protein, 22 aa, Giardia lamblia
LSLFLLIVSFIYLIVKVASTRD

SEQ ID NO: 3094953 - protein, 27 aa, Giardia lamblia
LSLTTLLYFLWILVSYPFMRISGRAYL

SEQ ID NO: 3094954 - protein, 23 aa, Giardia lamblia
LSMLLGFGFLLFVFAYSIYRIST

SEQ ID NO: 3094955 - protein, 17 aa, Giardia lamblia
LSPDTWLYSKRPLLALA

SEQ ID NO: 3094956 - protein, 24 aa, Giardia lamblia
LSTHMLYIFNCTFYILLLLSQNKL

SEQ ID NO: 3094957 - protein, 25 aa, Giardia lamblia
LSTLSQIYFWLLATTALCACTHYSH

SEQ ID NO: 3094958 - protein, 24 aa, Giardia lamblia
LSVLAGLIGFLSWRFCCKNKKPKH

SEQ ID NO: 3094959 - protein, 35 aa, Giardia lamblia
LSVTAVALLLIALGILLWKLLSARKLSRTRCMHLP

SEQ ID NO: 3094960 - protein, 19 aa, Giardia lamblia
LSYTLVFSELIRLLYRMGK

SEQ ID NO: 3094961 - protein, 18 aa, Giardia lamblia
LSYTVVLQFVFYPFELSL

SEQ ID NO: 3094962 - protein, 20 aa, Giardia lamblia
LSYYRLYASLLSYIPTFSLT

SEQ ID NO: 3094963 - protein, 22 aa, Giardia lamblia
LTCQVFMLLTYIQRQHLKSLGL

SEQ ID NO: 3094964 - protein, 19 aa, Giardia lamblia
LTFYFIVNSFAAPCQQKGY

SEQ ID NO: 3094965 - protein, 19 aa, Giardia lamblia
LTGLLFLYLIFVALRLISN

SEQ ID NO: 3094966 - protein, 17 aa, Giardia lamblia
LTITAWVYGIRFSKKLE

SEQ ID NO: 3094967 - protein, 22 aa, Giardia lamblia
LTLNVFYLKLQSLSLHPLIDVE

SEQ ID NO: 3094968 - protein, 21 aa, Giardia lamblia
LTMMGGLYQFRQILKSNLNAP

SEQ ID NO: 3094969 - protein, 27 aa, Giardia lamblia
LTPALMALVLHWLLFYILNANLIASEV

SEQ ID NO: 3094970 - protein, 33 aa, Giardia lamblia
LTPYELWLCIPFAFYFYWLVTAIFFSKRHKLRH

SEQ ID NO: 3094971 - protein, 19 aa, Giardia lamblia
LTWLLFVSVLRRSSPSTLL

SEQ ID NO: 3094972 - protein, 18 aa, Giardia lamblia
LTYFLYTKGIYLDETNLI

SEQ ID NO: 3094973 - protein, 17 aa, Giardia lamblia
LTYLVYTPAFSLILSTI

SEQ ID NO: 3094974 - protein, 17 aa, Giardia lamblia
LVFFKFSYAYRTYFKLA

SEQ ID NO: 3094975 - protein, 18 aa, Giardia lamblia
LVFIPIVVAIVALTSYIL

SEQ ID NO: 3094976 - protein, 27 aa, Giardia lamblia
LVHICRTSLLMWIFLGYANLSLNNFCL

SEQ ID NO: 3094977 - protein, 17 aa, Giardia lamblia
LVIHVILLVLLYVYLQF

SEQ ID NO: 3094978 - protein, 17 aa, Giardia lamblia
LVLERILSLWVAVPLFI

SEQ ID NO: 3094979 - protein, 25 aa, Giardia lamblia
LVLGLGVLLLVIWLAAAFSSNRVHK

SEQ ID NO: 3094980 - protein, 26 aa, Giardia lamblia
LVLIRHPILLALLLLIPPLSVFIITG

SEQ ID NO: 3094981 - protein, 17 aa, Giardia lamblia
LVLLFNYEEFAAATTDF

SEQ ID NO: 3094982 - protein, 25 aa, Giardia lamblia
LVMRSIFLVLLLSLFIGYFVPQTYI

SEQ ID NO: 3094983 - protein, 25 aa, Giardia lamblia
LVQHIILLFNLLLIPLDMLLVTAKE

SEQ ID NO: 3094984 - protein, 19 aa, Giardia lamblia
LVQYLFYRPSSFFSEARKG

SEQ ID NO: 3094985 - protein, 17 aa, Giardia lamblia
LVRAIPYFILSNIPYNL

SEQ ID NO: 3094986 - protein, 17 aa, Giardia lamblia
LVTAIFFSKRHKLRHYC

SEQ ID NO: 3094987 - protein, 18 aa, Giardia lamblia
LVTGLLPLSGFVASLLPS

SEQ ID NO: 3094988 - protein, 25 aa, Giardia lamblia
LVVTLAFLLILYYKHLRKTRLRLSR

SEQ ID NO: 3094989 - protein, 18 aa, Giardia lamblia
LWLVTLQPLLLLLSALRH

SEQ ID NO: 3094990 - protein, 18 aa, Giardia lamblia
LYALCRLRRLPRGGGGRF

SEQ ID NO: 3094991 - protein, 18 aa, Giardia lamblia
LYFRVFFSGIFGLKYLKP

SEQ ID NO: 3094992 - protein, 19 aa, Giardia lamblia
LYFVFIFKPSERRTVRKLL

SEQ ID NO: 3094993 - protein, 17 aa, Giardia lamblia
LYFYRHLLDIFTVSLLG

SEQ ID NO: 3094994 - protein, 18 aa, Giardia lamblia
LYMLIKPIRLASLVMFLF

SEQ ID NO: 3094995 - protein, 19 aa, Giardia lamblia
LYNAFPLLFNFTCANSICY

SEQ ID NO: 3094996 - protein, 25 aa, Giardia lamblia
LYQQFKYFFNLYFLGITISQSIPIL

SEQ ID NO: 3094997 - protein, 18 aa, Giardia lamblia
LYRLIRVYLLSPQNLNVI

SEQ ID NO: 3094998 - protein, 17 aa, Giardia lamblia
MAFLPYHETVIFSYLVT

SEQ ID NO: 3094999 - protein, 23 aa, Giardia lamblia
MALFYAVFFFFRLATPFSLQETG

SEQ ID NO: 3095000 - protein, 23 aa, Giardia lamblia
MASDLFEWCMPPPIVSLPQPIVC

SEQ ID NO: 3095001 - protein, 20 aa, Giardia lamblia
MASLIWVIIINLNKYRLNSV

SEQ ID NO: 3095002 - protein, 25 aa, Giardia lamblia
MASVTLWFSLRLISLFLVAYLKDIT

SEQ ID NO: 3095003 - protein, 17 aa, Giardia lamblia
MCLCANYYTLVGRDCIP

SEQ ID NO: 3095004 - protein, 18 aa, Giardia lamblia
MCLCANYYTLVGRDCIPT

SEQ ID NO: 3095005 - protein, 22 aa, Giardia lamblia
MCPDYFLVAYLQPIFIPHDSVI

SEQ ID NO: 3095006 - protein, 18 aa, Giardia lamblia
MCRFLLKEDFLSLIDVIY

SEQ ID NO: 3095007 - protein, 19 aa, Giardia lamblia
MELWVHIIILLHYSITHEA

SEQ ID NO: 3095008 - protein, 24 aa, Giardia lamblia
MESLSLMYFYINEPFFPIAYAVPE

SEQ ID NO: 3095009 - protein, 21 aa, Giardia lamblia
MFKGVILLLLASALGCVPRQL

SEQ ID NO: 3095010 - protein, 21 aa, Giardia lamblia
MFPIRYVILGWFRLTIDTRKG

SEQ ID NO: 3095011 - protein, 30 aa, Giardia lamblia
MGIFSVFFLPVLLIILGWILSDVFVPWLMG

SEQ ID NO: 3095012 - protein, 17 aa, Giardia lamblia
MGNTALILAAYTGSLPF

SEQ ID NO: 3095013 - protein, 22 aa, Giardia lamblia
MGTSSFILLLFCLLDHFCTSSL

SEQ ID NO: 3095014 - protein, 17 aa, Giardia lamblia
MHELLNFLLLRGSKLSL

SEQ ID NO: 3095015 - protein, 24 aa, Giardia lamblia
MIDKKLLLYILFTLIYGLLMALLV

SEQ ID NO: 3095016 - protein, 35 aa, Giardia lamblia
MIFAWPTIFAFLPVGIIFILLLRRYRMITPQVKRL

SEQ ID NO: 3095017 - protein, 23 aa, Giardia lamblia
MILGLFSLLFLTGFLFLSTDIHI

SEQ ID NO: 3095018 - protein, 20 aa, Giardia lamblia
MKAMRFFIQLSPLVLAFCAD

SEQ ID NO: 3095019 - protein, 18 aa, Giardia lamblia
MLAYIFFQYFLVQVCGEK

SEQ ID NO: 3095020 - protein, 19 aa, Giardia lamblia
MLCIILLHRYYLNSVSTAS

SEQ ID NO: 3095021 - protein, 20 aa, Giardia lamblia
MLCVMMVICIIVLIVSIVDL

SEQ ID NO: 3095022 - protein, 18 aa, Giardia lamblia
MLFHYIISFYLPCSSSIL

SEQ ID NO: 3095023 - protein, 17 aa, Giardia lamblia
MLIGIVIPIPLGIKMLY

SEQ ID NO: 3095024 - protein, 28 aa, Giardia lamblia
MNCPAAILLIYIRDIPLAFWCFYRFIKR

SEQ ID NO: 3095025 - protein, 20 aa, Giardia lamblia
MNSFLLFMRSIELEYSLLSS

SEQ ID NO: 3095026 - protein, 18 aa, Giardia lamblia
MQMSIIRYLLRRTPLQIE

SEQ ID NO: 3095027 - protein, 25 aa, Giardia lamblia
MRAMNLFWIQFFGAALYSWLGGNSP

SEQ ID NO: 3095028 - protein, 40 aa, Giardia lamblia
MREHLLIYIIIIILFLLTIILIILIVVLYIKLVDLKVANL

SEQ ID NO: 3095029 - protein, 23 aa, Giardia lamblia
MRIVFFSLSFIVLAAVVAALIGL

SEQ ID NO: 3095030 - protein, 17 aa, Giardia lamblia
MSIFLWNLQQKQSLDGF

SEQ ID NO: 3095031 - protein, 17 aa, Giardia lamblia
MSLFFAVLGLVIVNSIA

SEQ ID NO: 3095032 - protein, 18 aa, Giardia lamblia
MSLVEPMYLFALSYYIRL

SEQ ID NO: 3095033 - protein, 24 aa, Giardia lamblia
MSQKLFLIALYLRKRWIARDSVLE

SEQ ID NO: 3095034 - protein, 25 aa, Giardia lamblia
MSSRDWCLCWILTGSLRLLQKNFWG

SEQ ID NO: 3095035 - protein, 17 aa, Giardia lamblia
MSTLFVVIFPFIFYIML

SEQ ID NO: 3095036 - protein, 17 aa, Giardia lamblia
MTILRYKLSLKKREIIF

SEQ ID NO: 3095037 - protein, 20 aa, Giardia lamblia
MTTRLIYALLILREQFLGDS

SEQ ID NO: 3095038 - protein, 31 aa, Giardia lamblia
MVAIGALVGFLCWWFIFRGRRIDASPSTMTL

SEQ ID NO: 3095039 - protein, 18 aa, Giardia lamblia
MVCMHHGFRISFITSPLA

SEQ ID NO: 3095040 - protein, 25 aa, Giardia lamblia
MVDLRILLLALINLLSNANYTILVL

SEQ ID NO: 3095041 - protein, 20 aa, Giardia lamblia
MYLGSQALLIFIFNPPSGTL

SEQ ID NO: 3095042 - protein, 18 aa, Giardia lamblia
NALLQYYFVLLSTLGRFI

SEQ ID NO: 3095043 - protein, 19 aa, Giardia lamblia
NARNFYLPRFFYTGITTSS

SEQ ID NO: 3095044 - protein, 23 aa, Giardia lamblia
NATNLYFVVWRQPQNKTLSNKDL

SEQ ID NO: 3095045 - protein, 22 aa, Giardia lamblia
NCTSPAHDLLWYITGEYIAPDS

SEQ ID NO: 3095046 - protein, 22 aa, Giardia lamblia
NDCFLSFLILAAEYKYIWSNTV

SEQ ID NO: 3095047 - protein, 25 aa, Giardia lamblia
NEEDWLPIYFQLLSPLMQIAALTDA

SEQ ID NO: 3095048 - protein, 31 aa, Giardia lamblia
NFAKTDIFWLLLPSFMVPILLTLIFVMIAEA

SEQ ID NO: 3095049 - protein, 25 aa, Giardia lamblia
NFSTYLAIVIWRLFNKPQPELHKDQ

SEQ ID NO: 3095050 - protein, 18 aa, Giardia lamblia
NFVDLYMAFLPIMEHESA

SEQ ID NO: 3095051 - protein, 17 aa, Giardia lamblia
NFYYPLQLNLFIPVGQN

SEQ ID NO: 3095052 - protein, 24 aa, Giardia lamblia
NGAFSIFFLIPFLHSVQSIMLMSL

SEQ ID NO: 3095053 - protein, 20 aa, Giardia lamblia
NHGYFLRFLLFGVLGSLTSC

SEQ ID NO: 3095054 - protein, 23 aa, Giardia lamblia
NICTPFFCAIWNACSLFYLTFTA

SEQ ID NO: 3095055 - protein, 20 aa, Giardia lamblia
NIGLLKIMHLTFSNLSPLPF

SEQ ID NO: 3095056 - protein, 23 aa, Giardia lamblia
NIIKLDLLLPPEEFSRELDIAIQ

SEQ ID NO: 3095057 - protein, 23 aa, Giardia lamblia
NISFVFLLRLILPANIHIGLIDV

SEQ ID NO: 3095058 - protein, 19 aa, Giardia lamblia
NIYHWYYPYLFIGALNNDI

SEQ ID NO: 3095059 - protein, 19 aa, Giardia lamblia
NKCDTCMPGYFLVTTTDPQ

SEQ ID NO: 3095060 - protein, 24 aa, Giardia lamblia
NKFTLALELLLADDPLFLAASCSA

SEQ ID NO: 3095061 - protein, 24 aa, Giardia lamblia
NLDRPHLLPALKTGWWFATVYESE

SEQ ID NO: 3095062 - protein, 20 aa, Giardia lamblia
NLITIYIQYGLFDLAADLIA

SEQ ID NO: 3095063 - protein, 37 aa, Giardia lamblia
NLRPHIAPPLPFLDFLHYWFLFRVRPGIKNKDFLYAN

SEQ ID NO: 3095064 - protein, 23 aa, Giardia lamblia
NLSRYYRLLELLGSKQLLSCVCS

SEQ ID NO: 3095065 - protein, 25 aa, Giardia lamblia
NLVLLAFLIFMFLKATMAKVDIDEF

SEQ ID NO: 3095066 - protein, 21 aa, Giardia lamblia
NLYRALPLSIFLPALIMVIIV

SEQ ID NO: 3095067 - protein, 18 aa, Giardia lamblia
NNPLYILSILTGLELTFQ

SEQ ID NO: 3095068 - protein, 18 aa, Giardia lamblia
NPRFYINFIMYDTTLMKK

SEQ ID NO: 3095069 - protein, 22 aa, Giardia lamblia
NPSWYILRYLHVSGPFLLFEVA

SEQ ID NO: 3095070 - protein, 21 aa, Giardia lamblia
NQHIYLLYIYGRLLTFRNPCQ

SEQ ID NO: 3095071 - protein, 17 aa, Giardia lamblia
NQRIIHQLLLLGASLFF

SEQ ID NO: 3095072 - protein, 28 aa, Giardia lamblia
NQSPPIFICFLLMFIFHVLLRSNSVIRH

SEQ ID NO: 3095073 - protein, 24 aa, Giardia lamblia
NSAKVIPLLLPYEHEMVLLNGATA

SEQ ID NO: 3095074 - protein, 27 aa, Giardia lamblia
NSFRFLKHIFAPSFQYLFPLYTYSRKD

SEQ ID NO: 3095075 - protein, 24 aa, Giardia lamblia
NSLKVFYYIKYLRNPGLFSKLHSP

SEQ ID NO: 3095076 - protein, 28 aa, Giardia lamblia
NSPAYRMLWLYTPFFLELLNTLASIVNM

SEQ ID NO: 3095077 - protein, 28 aa, Giardia lamblia
NSPWTSVYYVIFFRYLLLFSSVIPISLR

SEQ ID NO: 3095078 - protein, 17 aa, Giardia lamblia
NTFLNMIYMRLHIHYKA

SEQ ID NO: 3095079 - protein, 18 aa, Giardia lamblia
NTLWRAIPYARVTHLLLS

SEQ ID NO: 3095080 - protein, 20 aa, Giardia lamblia
NTPEFFLFYSGCYDITHPIG

SEQ ID NO: 3095081 - protein, 18 aa, Giardia lamblia
NVFPFYLPTRPYPTLSIY

SEQ ID NO: 3095082 - protein, 24 aa, Giardia lamblia
NVLFYVLFMLCRLMAPYTPFVCDW

SEQ ID NO: 3095083 - protein, 23 aa, Giardia lamblia
NVTVSYPWLPVPSFTGVFNGNGY

SEQ ID NO: 3095084 - protein, 25 aa, Giardia lamblia
NVVVFLMYILVFVAQWIIAASLEYI

SEQ ID NO: 3095085 - protein, 25 aa, Giardia lamblia
NVYQYLVPFWIYVSVPLLGFFALAI

SEQ ID NO: 3095086 - protein, 18 aa, Giardia lamblia
NWRCYPLGQFLYLPAERI

SEQ ID NO: 3095087 - protein, 19 aa, Giardia lamblia
NYLNFFYYNLTILASRRVF

SEQ ID NO: 3095088 - protein, 22 aa, Giardia lamblia
PADYFHSLLFYKLCEFFPETIS

SEQ ID NO: 3095089 - protein, 24 aa, Giardia lamblia
PAPQAPPHPPLYPAPSTLQAASAN

SEQ ID NO: 3095090 - protein, 17 aa, Giardia lamblia
PAYLYLFQRRYVFVRTL

SEQ ID NO: 3095091 - protein, 19 aa, Giardia lamblia
PCLNTLRHGLFDFIVIQEG

SEQ ID NO: 3095092 - protein, 27 aa, Giardia lamblia
PEIVGLGLLFKWLKLLVTYHKRFSTSV

SEQ ID NO: 3095093 - protein, 22 aa, Giardia lamblia
PELVYILMKLLIYSLAYDIRTT

SEQ ID NO: 3095094 - protein, 24 aa, Giardia lamblia
PESLSPFYILFASSAAIFLACLVS

SEQ ID NO: 3095095 - protein, 23 aa, Giardia lamblia
PEWSWFFSYPFSPLISDLALYTA

SEQ ID NO: 3095096 - protein, 19 aa, Giardia lamblia
PFEIPLGPVHFFQKGLLPI

SEQ ID NO: 3095097 - protein, 21 aa, Giardia lamblia
PFIFIEVPFFYRYVIESSTSK

SEQ ID NO: 3095098 - protein, 20 aa, Giardia lamblia
PFNYSFIVVLVLEACQRPAL

SEQ ID NO: 3095099 - protein, 17 aa, Giardia lamblia
PFSRVVAIIFYAYSSFR

SEQ ID NO: 3095100 - protein, 18 aa, Giardia lamblia
PFTLNFWGFIRTPPPPDS

SEQ ID NO: 3095101 - protein, 23 aa, Giardia lamblia
PGCYLICQYLCKGHWRISITPPG

SEQ ID NO: 3095102 - protein, 19 aa, Giardia lamblia
PGFLAFPLFARIRSEYRHM

SEQ ID NO: 3095103 - protein, 25 aa, Giardia lamblia
PGGLEAFFFILFNLAERRIALEKDL

SEQ ID NO: 3095104 - protein, 24 aa, Giardia lamblia
PGIIGPKNLPLLPSARLLQEAQGK

SEQ ID NO: 3095105 - protein, 17 aa, Giardia lamblia
PGPWLMIQLVLAAAYAV

SEQ ID NO: 3095106 - protein, 24 aa, Giardia lamblia
PGVILIMSLLFTGSIIFLIISAIA

SEQ ID NO: 3095107 - protein, 18 aa, Giardia lamblia
PHILIRYNLLRDRSNPIR

SEQ ID NO: 3095108 - protein, 24 aa, Giardia lamblia
PHVSQMQYLLWYHGFLQCVFRQYH

SEQ ID NO: 3095109 - protein, 18 aa, Giardia lamblia
PHYLWIALWGILIGTAIT

SEQ ID NO: 3095110 - protein, 18 aa, Giardia lamblia
PIIMFLQPYLHILEYTFV

SEQ ID NO: 3095111 - protein, 24 aa, Giardia lamblia
PIIRTLLRILLPGELYFSLMRPPS

SEQ ID NO: 3095112 - protein, 19 aa, Giardia lamblia
PILCALYMIIKHLLKRESL

SEQ ID NO: 3095113 - protein, 24 aa, Giardia lamblia
PILRVGFLFTYLAPLVLVLAVTMI

SEQ ID NO: 3095114 - protein, 19 aa, Giardia lamblia
PINPAFPYPLCLLPLPFRH

SEQ ID NO: 3095115 - protein, 23 aa, Giardia lamblia
PISLFPIYHQVGYLFLPKTTPFS

SEQ ID NO: 3095116 - protein, 18 aa, Giardia lamblia
PLCLLVTSFVKLNQLYKA

SEQ ID NO: 3095117 - protein, 25 aa, Giardia lamblia
PLGIKMLYFLLSQFPMTILSYNLSG

SEQ ID NO: 3095118 - protein, 19 aa, Giardia lamblia
PLGPVHFFQKGLLPILKLA

SEQ ID NO: 3095119 - protein, 18 aa, Giardia lamblia
PLHLLAICLFLSASVLTW

SEQ ID NO: 3095120 - protein, 24 aa, Giardia lamblia
PLIAARLLFYPFITSIWGNCVQFE

SEQ ID NO: 3095121 - protein, 17 aa, Giardia lamblia
PLLMFIVSPLMIFALVE

SEQ ID NO: 3095122 - protein, 25 aa, Giardia lamblia
PLLQWDLLILFQPFSLLGALAGSIC

SEQ ID NO: 3095123 - protein, 17 aa, Giardia lamblia
PLMPYMRLVFEIGDLKY

SEQ ID NO: 3095124 - protein, 25 aa, Giardia lamblia
PLNITPYCYFLMQTTLDKIFAKYTL

SEQ ID NO: 3095125 - protein, 19 aa, Giardia lamblia
PLPIIPIFCRSSIIKQILL

SEQ ID NO: 3095126 - protein, 25 aa, Giardia lamblia
PLRVDRMVILLFLYEQELNLVERKR

SEQ ID NO: 3095127 - protein, 24 aa, Giardia lamblia
PLSYFLFCIGLFLMIWLARIGGHP

SEQ ID NO: 3095128 - protein, 23 aa, Giardia lamblia
PLTSWFDDLIQRVAFMRRWLTNG

SEQ ID NO: 3095129 - protein, 18 aa, Giardia lamblia
PLVLVRLFLAILGSIVFV

SEQ ID NO: 3095130 - protein, 18 aa, Giardia lamblia
PMDLLFNVPLLKYWLERL

SEQ ID NO: 3095131 - protein, 24 aa, Giardia lamblia
PMLHFAMLYIRLFGLFARELTPVI

SEQ ID NO: 3095132 - protein, 17 aa, Giardia lamblia
PNKAAMFPGFSLAAMMC

SEQ ID NO: 3095133 - protein, 18 aa, Giardia lamblia
PNLGFIVFFLPELSPISC

SEQ ID NO: 3095134 - protein, 24 aa, Giardia lamblia
PNMRYFFAQILLVSTWQFGARTPE

SEQ ID NO: 3095135 - protein, 17 aa, Giardia lamblia
PNRRFALWWSPTINRSS

SEQ ID NO: 3095136 - protein, 19 aa, Giardia lamblia
PNSILLYFVFIFKPSERRT

SEQ ID NO: 3095137 - protein, 21 aa, Giardia lamblia
PNSVIFPLLDLSGALPGCNNL

SEQ ID NO: 3095138 - protein, 24 aa, Giardia lamblia
PNVSPFYEALFSPYFLSLPLQLVH

SEQ ID NO: 3095139 - protein, 25 aa, Giardia lamblia
PPDPYIFTLMYMRAYYLLKTHYSMR

SEQ ID NO: 3095140 - protein, 24 aa, Giardia lamblia
PPIPKWIMFLPFNSIAFSLGDALF

SEQ ID NO: 3095141 - protein, 24 aa, Giardia lamblia
PPIPKWIMFLPFNTIALSLGDALF

SEQ ID NO: 3095142 - protein, 24 aa, Giardia lamblia
PPITMRGIVLLALKHSFLSYQSTI

SEQ ID NO: 3095143 - protein, 21 aa, Giardia lamblia
PPTAWLNLALDIIFPALSPEL

SEQ ID NO: 3095144 - protein, 24 aa, Giardia lamblia
PPTTILCLLFLYLLASFNCTTYSI

SEQ ID NO: 3095145 - protein, 18 aa, Giardia lamblia
PPVVYLVFMLLDTILYFL

SEQ ID NO: 3095146 - protein, 26 aa, Giardia lamblia
PRRITFLPKWPLFIRGILEAVAIINR

SEQ ID NO: 3095147 - protein, 23 aa, Giardia lamblia
PRRKASIFLFYDKGVRKLRIESG

SEQ ID NO: 3095148 - protein, 24 aa, Giardia lamblia
PRTDLYWLIVQWYILTEKVSQEQF

SEQ ID NO: 3095149 - protein, 23 aa, Giardia lamblia
PSFENIWVALLLIVALRQDLILS

SEQ ID NO: 3095150 - protein, 24 aa, Giardia lamblia
PSNDYYIMWPVFIVRNSFIPLDME

SEQ ID NO: 3095151 - protein, 24 aa, Giardia lamblia
PSPKAYHILNLVDLFLIGAFVAVY

SEQ ID NO: 3095152 - protein, 22 aa, Giardia lamblia
PSSILYLPLLILKDILVENAAD

SEQ ID NO: 3095153 - protein, 25 aa, Giardia lamblia
PTEFLLFLFFLWASILLISFIYSMF

SEQ ID NO: 3095154 - protein, 20 aa, Giardia lamblia
PTFILGYLWCIMSRIAVDNA

SEQ ID NO: 3095155 - protein, 21 aa, Giardia lamblia
PTLSYILNLPLLMGARRSFEE

SEQ ID NO: 3095156 - protein, 20 aa, Giardia lamblia
PTNWLVVIGSLLLIGLTITA

SEQ ID NO: 3095157 - protein, 17 aa, Giardia lamblia
PVCEACHPDYYLLSRGD

SEQ ID NO: 3095158 - protein, 24 aa, Giardia lamblia
PVLNDLLWQLLLLGLAVCVCITVE

SEQ ID NO: 3095159 - protein, 30 aa, Giardia lamblia
PVLTRLRNLLPLLFLINKLVALYFDFLSNF

SEQ ID NO: 3095160 - protein, 40 aa, Giardia lamblia
PVNIAFTSIFAILLVGAVAALIFFLLRIYVCKSGTGRMKS

SEQ ID NO: 3095161 - protein, 17 aa, Giardia lamblia
PVPTNWLVVIGSLLLIG

SEQ ID NO: 3095162 - protein, 18 aa, Giardia lamblia
PWKINWPVRFMVLLHHAS

SEQ ID NO: 3095163 - protein, 28 aa, Giardia lamblia
PYSHPLIPLPLLACRLVITGLLLHRGFA

SEQ ID NO: 3095164 - protein, 20 aa, Giardia lamblia
QALLIFIFNPPSGTLARSML

SEQ ID NO: 3095165 - protein, 34 aa, Giardia lamblia
QAYIRIPITACYLKSLIWTLKIIRMVLYKRQIAT

SEQ ID NO: 3095166 - protein, 20 aa, Giardia lamblia
QAYLSFIIRYFLYLDDRIEN

SEQ ID NO: 3095167 - protein, 17 aa, Giardia lamblia
QCFYIPIFFFLMIPRLQ

SEQ ID NO: 3095168 - protein, 17 aa, Giardia lamblia
QCSGCFPGYYKSGDKCV

SEQ ID NO: 3095169 - protein, 22 aa, Giardia lamblia
QDAILIWDLYQRKFIAVLRIFA

SEQ ID NO: 3095170 - protein, 20 aa, Giardia lamblia
QDELLLALLSIALGASAQGL

SEQ ID NO: 3095171 - protein, 21 aa, Giardia lamblia
QDIVWTPSMIRLFALLFTSVS

SEQ ID NO: 3095172 - protein, 25 aa, Giardia lamblia
QEAESLPHFLLYYAKNKYGVTAIVT

SEQ ID NO: 3095173 - protein, 25 aa, Giardia lamblia
QEKMRFYLLPNYPFVYVIRGHRVPV

SEQ ID NO: 3095174 - protein, 31 aa, Giardia lamblia
QEKTELWLYMWMMFVLFSGLMLLAFLSTCFK

SEQ ID NO: 3095175 - protein, 21 aa, Giardia lamblia
QELEAILRMLPGPKLRQVCFF

SEQ ID NO: 3095176 - protein, 20 aa, Giardia lamblia
QETNIFLFYGSCYKITTTQD

SEQ ID NO: 3095177 - protein, 19 aa, Giardia lamblia
QFFFAFASFPLIIPVLNLF

SEQ ID NO: 3095178 - protein, 19 aa, Giardia lamblia
QFQAFFSHIGFSALMLAAE

SEQ ID NO: 3095179 - protein, 21 aa, Giardia lamblia
QFSHFLLTLLLSILDLTILLH

SEQ ID NO: 3095180 - protein, 27 aa, Giardia lamblia
QGRLKYMLWLVFFYLGVAITAVFAILM

SEQ ID NO: 3095181 - protein, 21 aa, Giardia lamblia
QGYSFIRIVLPLTVTAIYRNR

SEQ ID NO: 3095182 - protein, 20 aa, Giardia lamblia
QIIEILLYNKDTRNLLLRAC

SEQ ID NO: 3095183 - protein, 17 aa, Giardia lamblia
QILRLWPIMLTDARRLT

SEQ ID NO: 3095184 - protein, 23 aa, Giardia lamblia
QINKRYFGLRQFLLDPPIRKSDG

SEQ ID NO: 3095185 - protein, 18 aa, Giardia lamblia
QIRLDLVWNTTVCPLARK

SEQ ID NO: 3095186 - protein, 26 aa, Giardia lamblia
QISANPFLFWELLKLLVLSSINLRRV

SEQ ID NO: 3095187 - protein, 25 aa, Giardia lamblia
QITSSPLHYLLFKRGFSSIDLSNPY

SEQ ID NO: 3095188 - protein, 17 aa, Giardia lamblia
QITWLLNLTFDRVSFIV

SEQ ID NO: 3095189 - protein, 24 aa, Giardia lamblia
QKQQLPEYIIWTIILQLLGLLEWL

SEQ ID NO: 3095190 - protein, 23 aa, Giardia lamblia
QKRLDRVLLLEILFLVAGVIICG

SEQ ID NO: 3095191 - protein, 23 aa, Giardia lamblia
QKRNLFARFYFVSDPVLLEILGQ

SEQ ID NO: 3095192 - protein, 26 aa, Giardia lamblia
QKTVSYLFWRYYLRTQMQLLNITPSS

SEQ ID NO: 3095193 - protein, 20 aa, Giardia lamblia
QLILSFFRLTPLYIQQDLVQ

SEQ ID NO: 3095194 - protein, 26 aa, Giardia lamblia
QLRKLCFYFFALLLLSAIVIGGLAFI

SEQ ID NO: 3095195 - protein, 20 aa, Giardia lamblia
QLVHYIIRSMLLMALGFSPL

SEQ ID NO: 3095196 - protein, 20 aa, Giardia lamblia
QLVQLPPSPLLSSNIIQTSF

SEQ ID NO: 3095197 - protein, 23 aa, Giardia lamblia
QLYGLLPQLLYGLLYLMNLTNMM

SEQ ID NO: 3095198 - protein, 26 aa, Giardia lamblia
QMFALPIFILILVFINVIICCIKPKA

SEQ ID NO: 3095199 - protein, 23 aa, Giardia lamblia
QMFVTIVLLIYYLTTAFNMYKNK

SEQ ID NO: 3095200 - protein, 18 aa, Giardia lamblia
QNTATCYPGWVADGNSLC

SEQ ID NO: 3095201 - protein, 22 aa, Giardia lamblia
QPWRYWFEFVTFYVSGIYMAVI

SEQ ID NO: 3095202 - protein, 21 aa, Giardia lamblia
QQSPFLFFNWTPGGLTTYGIL

SEQ ID NO: 3095203 - protein, 19 aa, Giardia lamblia
QQYIPYCKVFFIFSQICSP

SEQ ID NO: 3095204 - protein, 22 aa, Giardia lamblia
QRALRLCRFLDQKPLWAQMATY

SEQ ID NO: 3095205 - protein, 22 aa, Giardia lamblia
QRQIRLLRRSAAILRLLESAHR

SEQ ID NO: 3095206 - protein, 26 aa, Giardia lamblia
QRRNLWLMIILFYISTTSLKLLFGDS

SEQ ID NO: 3095207 - protein, 19 aa, Giardia lamblia
QRSLRFFPLKPVGLGCIFM

SEQ ID NO: 3095208 - protein, 23 aa, Giardia lamblia
QTALMIAVLLARLTLIPLLLEER

SEQ ID NO: 3095209 - protein, 22 aa, Giardia lamblia
QTIFLFLIIIQGALQIVLPSLL

SEQ ID NO: 3095210 - protein, 17 aa, Giardia lamblia
QTIYLYDTYLCQLLAVE

SEQ ID NO: 3095211 - protein, 31 aa, Giardia lamblia
QTLRKIPIFANFRLWKPLRLLKKAVLKNRRT

SEQ ID NO: 3095212 - protein, 17 aa, Giardia lamblia
QTRDIPPYPLYTALMIA

SEQ ID NO: 3095213 - protein, 23 aa, Giardia lamblia
QTRGWFYTLLILSTALFDSPPSM

SEQ ID NO: 3095214 - protein, 24 aa, Giardia lamblia
QVDSCTHLWWIDLHLTWGNVDTCT

SEQ ID NO: 3095215 - protein, 22 aa, Giardia lamblia
QVLLSILLRLSFSYISMSPFSF

SEQ ID NO: 3095216 - protein, 28 aa, Giardia lamblia
QWKMRWCKKLTYIIIGVDYGLLLTYIFL

SEQ ID NO: 3095217 - protein, 19 aa, Giardia lamblia
QYHMLAYSLLSFLRLLADA

SEQ ID NO: 3095218 - protein, 22 aa, Giardia lamblia
QYTQFPQRLITFVPDGGLVNNL

SEQ ID NO: 3095219 - protein, 17 aa, Giardia lamblia
RAIFLVMFLCCLLLSLL

SEQ ID NO: 3095220 - protein, 17 aa, Giardia lamblia
RCLLRRSNLIPHRLFYV

SEQ ID NO: 3095221 - protein, 17 aa, Giardia lamblia
RCTACRGSYFLYQGGCY

SEQ ID NO: 3095222 - protein, 21 aa, Giardia lamblia
RDLCMLVAPLCRFLYVTLSKG

SEQ ID NO: 3095223 - protein, 17 aa, Giardia lamblia
RDSLCYYVYLYANLFSM

SEQ ID NO: 3095224 - protein, 25 aa, Giardia lamblia
RDSSKIMLLLPSNTPDYRPLAACAL

SEQ ID NO: 3095225 - protein, 22 aa, Giardia lamblia
RDYTILLHLFIKLPVEIRKEVA

SEQ ID NO: 3095226 - protein, 28 aa, Giardia lamblia
REAHWNYFTYIPVLLFIGSQRYADHLHR

SEQ ID NO: 3095227 - protein, 21 aa, Giardia lamblia
REFRLLMLFYDSLQTLLSISA

SEQ ID NO: 3095228 - protein, 21 aa, Giardia lamblia
REHYPLLLRTLFLYTSTVTGA

SEQ ID NO: 3095229 - protein, 20 aa, Giardia lamblia
RESIAIPILLLIPPGAQPGK

SEQ ID NO: 3095230 - protein, 25 aa, Giardia lamblia
REYEFLLLLLMIRTAMALALGIKPE

SEQ ID NO: 3095231 - protein, 17 aa, Giardia lamblia
REYLRYDNPRHLRGVDV

SEQ ID NO: 3095232 - protein, 20 aa, Giardia lamblia
RFSDLPFMFFRNGLATTLPE

SEQ ID NO: 3095233 - protein, 22 aa, Giardia lamblia
RFTVMDIFYILRSLLASSLVIQ

SEQ ID NO: 3095234 - protein, 18 aa, Giardia lamblia
RGFDFPLLSLSFPLRYAL

SEQ ID NO: 3095235 - protein, 19 aa, Giardia lamblia
RGLLNGCYPVPLFGVLDGN

SEQ ID NO: 3095236 - protein, 18 aa, Giardia lamblia
RGPFFFIPDMAFVLKHHD

SEQ ID NO: 3095237 - protein, 23 aa, Giardia lamblia
RGQAIFYLLLIYSNLMGDVLRLN

SEQ ID NO: 3095238 - protein, 22 aa, Giardia lamblia
RGSIIGQYLYRIFFLDKGSVEQ

SEQ ID NO: 3095239 - protein, 19 aa, Giardia lamblia
RHIIYIFLSPYWSSPTDYR

SEQ ID NO: 3095240 - protein, 19 aa, Giardia lamblia
RHLLLVFIGILIFCLFSIM

SEQ ID NO: 3095241 - protein, 27 aa, Giardia lamblia
RHPAILVFILLYPALLILFLSSASVKK

SEQ ID NO: 3095242 - protein, 20 aa, Giardia lamblia
RIIHQLLLLGASLFFYQQKA

SEQ ID NO: 3095243 - protein, 25 aa, Giardia lamblia
RIIKALIHLFFRYYGILDVQTGNDS

SEQ ID NO: 3095244 - protein, 20 aa, Giardia lamblia
RIMIIIPLFLLLALACFFLN

SEQ ID NO: 3095245 - protein, 17 aa, Giardia lamblia
RIPWQSFWKENISIKVS

SEQ ID NO: 3095246 - protein, 19 aa, Giardia lamblia
RIRLFLINALQASASAPAD

SEQ ID NO: 3095247 - protein, 18 aa, Giardia lamblia
RISIVVGLLLFWSLYLIH

SEQ ID NO: 3095248 - protein, 19 aa, Giardia lamblia
RISLYFLRKLLVVALPMPG

SEQ ID NO: 3095249 - protein, 20 aa, Giardia lamblia
RISYMFALLLRHLITVDLQL

SEQ ID NO: 3095250 - protein, 26 aa, Giardia lamblia
RITITAMYLLFYFSNYFYLEPVILRI

SEQ ID NO: 3095251 - protein, 17 aa, Giardia lamblia
RIYKQLVSLQLWKAYIL

SEQ ID NO: 3095252 - protein, 25 aa, Giardia lamblia
RKKQALIHMVVFCSYLLSADTLVHG

SEQ ID NO: 3095253 - protein, 17 aa, Giardia lamblia
RKYNWIVFPFVAVLKQF

SEQ ID NO: 3095254 - protein, 22 aa, Giardia lamblia
RKYNWIVFPFVAVLKQFRLFFN

SEQ ID NO: 3095255 - protein, 18 aa, Giardia lamblia
RLDRFFAMKYYVSAKPFR

SEQ ID NO: 3095256 - protein, 17 aa, Giardia lamblia
RLFISVLLMIRLQHGPL

SEQ ID NO: 3095257 - protein, 21 aa, Giardia lamblia
RLFRQLEGVFLLPCASHSALQ

SEQ ID NO: 3095258 - protein, 17 aa, Giardia lamblia
RLKGLLFYNSNSAFPHI

SEQ ID NO: 3095259 - protein, 19 aa, Giardia lamblia
RLKLPFYTLGPEASALFPS

SEQ ID NO: 3095260 - protein, 23 aa, Giardia lamblia
RLLLSFFCPYLFYDSTTKKDLQI

SEQ ID NO: 3095261 - protein, 28 aa, Giardia lamblia
RLLQRQMTFLLFLLLGGIYKKAVLQSVI

SEQ ID NO: 3095262 - protein, 22 aa, Giardia lamblia
RLNGLNYLFYFAWKEYPLEGRV

SEQ ID NO: 3095263 - protein, 28 aa, Giardia lamblia
RLNYVPYSFLQLLLLYSTALAILELLKG

SEQ ID NO: 3095264 - protein, 25 aa, Giardia lamblia
RLPSMRLVFPFLAISSPFSKFAAVA

SEQ ID NO: 3095265 - protein, 22 aa, Giardia lamblia
RLRALRYMGFLSSTFLAYVFVA

SEQ ID NO: 3095266 - protein, 18 aa, Giardia lamblia
RLRLYYNATLVYTLFRGS

SEQ ID NO: 3095267 - protein, 21 aa, Giardia lamblia
RLVPLLPFNYSFIVVLVLEAC

SEQ ID NO: 3095268 - protein, 18 aa, Giardia lamblia
RLVWNIGTLVLKIMTMKP

SEQ ID NO: 3095269 - protein, 28 aa, Giardia lamblia
RMLRIRKTFLLLTYDKLLITAFYRWSDL

SEQ ID NO: 3095270 - protein, 25 aa, Giardia lamblia
RMYYANFIDFYLSYCLGRYAIISSL

SEQ ID NO: 3095271 - protein, 25 aa, Giardia lamblia
RNRLSYFLLMLFILSLLDTDTIVHS

SEQ ID NO: 3095272 - protein, 17 aa, Giardia lamblia
RPFFVSVLLNQIFFYLL

SEQ ID NO: 3095273 - protein, 18 aa, Giardia lamblia
RPSPLTFFLLVTAGCFTI

SEQ ID NO: 3095274 - protein, 29 aa, Giardia lamblia
RQGYLLLSDVLFVALFAVAILGIGVYLLV

SEQ ID NO: 3095275 - protein, 29 aa, Giardia lamblia
RRALVIPGIVFRLWRVYTFIIRMYRHVLH

SEQ ID NO: 3095276 - protein, 30 aa, Giardia lamblia
RRARAVILYYLFYTYALLQLLPTIRYCEQM

SEQ ID NO: 3095277 - protein, 17 aa, Giardia lamblia
RRILSTFVFYLCLGFFT

SEQ ID NO: 3095278 - protein, 17 aa, Giardia lamblia
RRKLMRPPRVALPGSLT

SEQ ID NO: 3095279 - protein, 26 aa, Giardia lamblia
RRSIILTELLLIILLKLAKFSYRKKK

SEQ ID NO: 3095280 - protein, 18 aa, Giardia lamblia
RRSSIFLLFVDRSPKNPK

SEQ ID NO: 3095281 - protein, 24 aa, Giardia lamblia
RSISPWFALIPFFGPISVHSQLQS

SEQ ID NO: 3095282 - protein, 20 aa, Giardia lamblia
RSIYITMRLFDRLKSLSEEA

SEQ ID NO: 3095283 - protein, 17 aa, Giardia lamblia
RSQLQLFFILKSSLYKI

SEQ ID NO: 3095284 - protein, 23 aa, Giardia lamblia
RTHPTICHFLVALLAHQKNDSYI

SEQ ID NO: 3095285 - protein, 18 aa, Giardia lamblia
RTIYLAYIILINKLVCSY

SEQ ID NO: 3095286 - protein, 21 aa, Giardia lamblia
RTLLGLLIFFVTQSPPPDCPH

SEQ ID NO: 3095287 - protein, 18 aa, Giardia lamblia
RTLSNLRHIVWADYITVT

SEQ ID NO: 3095288 - protein, 24 aa, Giardia lamblia
RTSPLLSLLQRSLPTSLPLVTRGL

SEQ ID NO: 3095289 - protein, 23 aa, Giardia lamblia
RVGRILLLIMSIILLIIFVPLFV

SEQ ID NO: 3095290 - protein, 28 aa, Giardia lamblia
RVMVRPKFINYFFLIAGALRPKYLVTVD

SEQ ID NO: 3095291 - protein, 19 aa, Giardia lamblia
RVRMLLVSCLFLLSALCIF

SEQ ID NO: 3095292 - protein, 29 aa, Giardia lamblia
RVVMVLILYFSIWTIIPTILIAAALTALF

SEQ ID NO: 3095293 - protein, 26 aa, Giardia lamblia
RVVMVLILYFSIWTITPTILIAAALT

SEQ ID NO: 3095294 - protein, 22 aa, Giardia lamblia
RVVPIWYFYCYPKNFLGYETVS

SEQ ID NO: 3095295 - protein, 17 aa, Giardia lamblia
RWIGVVITIVLAGVLAS

SEQ ID NO: 3095296 - protein, 19 aa, Giardia lamblia
RWLYIFRENAYIKSLLIGD

SEQ ID NO: 3095297 - protein, 17 aa, Giardia lamblia
RWYILKVCIKFGDLSNP

SEQ ID NO: 3095298 - protein, 18 aa, Giardia lamblia
RYPIICDGLLLPTVIFRE

SEQ ID NO: 3095299 - protein, 25 aa, Giardia lamblia
RYSTSAFKWPLFKPFLRPLTCKPIL

SEQ ID NO: 3095300 - protein, 18 aa, Giardia lamblia
RYYYLWSLQFIASPILFP

SEQ ID NO: 3095301 - protein, 24 aa, Giardia lamblia
SAGHKLCAAALWKASNTYPGTSLR

SEQ ID NO: 3095302 - protein, 26 aa, Giardia lamblia
SAIVPYLIIFLFGLVSFALTCSLFSR

SEQ ID NO: 3095303 - protein, 23 aa, Giardia lamblia
SAKLFLLAFLRKDELVYSCCQEL

SEQ ID NO: 3095304 - protein, 21 aa, Giardia lamblia
SALLRLIWLLIAAFPDHADLI

SEQ ID NO: 3095305 - protein, 26 aa, Giardia lamblia
SAQRIITLYLFCLWLFIKHLKKDDPE

SEQ ID NO: 3095306 - protein, 18 aa, Giardia lamblia
SASVLFLGLSALGFYVYH

SEQ ID NO: 3095307 - protein, 27 aa, Giardia lamblia
SCETFVRYLLIIIYYVRLCNLETCISR

SEQ ID NO: 3095308 - protein, 17 aa, Giardia lamblia
SCFALSPSIGFIECILP

SEQ ID NO: 3095309 - protein, 17 aa, Giardia lamblia
SCFLYYYKKVDNGVLSC

SEQ ID NO: 3095310 - protein, 17 aa, Giardia lamblia
SCLRWYNITTLSSGQCI

SEQ ID NO: 3095311 - protein, 22 aa, Giardia lamblia
SCTDDFYLDSLFFGCFSCHSSC

SEQ ID NO: 3095312 - protein, 18 aa, Giardia lamblia
SCVYLWQNPTDGASYIQL

SEQ ID NO: 3095313 - protein, 21 aa, Giardia lamblia
SDIILCFLKFFNPLNLDDVVH

SEQ ID NO: 3095314 - protein, 20 aa, Giardia lamblia
SDNTFFLFYGGCYDTKDFPG

SEQ ID NO: 3095315 - protein, 26 aa, Giardia lamblia
SFAEGLLLIRPLLPISLLELLCSMKQ

SEQ ID NO: 3095316 - protein, 26 aa, Giardia lamblia
SFASLLVFLLVFAVLLFVLCSQHATT

SEQ ID NO: 3095317 - protein, 20 aa, Giardia lamblia
SFDFRLELYISLLQESRKYD

SEQ ID NO: 3095318 - protein, 23 aa, Giardia lamblia
SFGCLLYRILFRRYPFEQFMDKS

SEQ ID NO: 3095319 - protein, 18 aa, Giardia lamblia
SFIILHFIPLLVNKAMSS

SEQ ID NO: 3095320 - protein, 19 aa, Giardia lamblia
SFQYYLTYFLYTKGIYLDE

SEQ ID NO: 3095321 - protein, 27 aa, Giardia lamblia
SFRDYFCLRFWFIPHRRYMKSLYDEKI

SEQ ID NO: 3095322 - protein, 18 aa, Giardia lamblia
SGGLFLFNGGCYATSRYP

SEQ ID NO: 3095323 - protein, 23 aa, Giardia lamblia
SGHDLPLFTLFSYNPTHVSADMA

SEQ ID NO: 3095324 - protein, 22 aa, Giardia lamblia
SGILTIYLYLLQLYSVLTARPK

SEQ ID NO: 3095325 - protein, 25 aa, Giardia lamblia
SGMLFMLLLILGYRAGLDAFIRSAN

SEQ ID NO: 3095326 - protein, 27 aa, Giardia lamblia
SGPYPGLFFILLPLTPYIALADKDLVY

SEQ ID NO: 3095327 - protein, 25 aa, Giardia lamblia
SIEEQYWVVYLIIWIAMISGLSMCT

SEQ ID NO: 3095328 - protein, 20 aa, Giardia lamblia
SIEFSLVMQYILSTPSIIEY

SEQ ID NO: 3095329 - protein, 19 aa, Giardia lamblia
SIEWPYFALPFASVGEEGL

SEQ ID NO: 3095330 - protein, 25 aa, Giardia lamblia
SIFLTLGLIPIIYSLKLYGSLLTGI

SEQ ID NO: 3095331 - protein, 19 aa, Giardia lamblia
SIFTYLDFMKKLFTVRVEL

SEQ ID NO: 3095332 - protein, 22 aa, Giardia lamblia
SIIVFVRWIIILSSIIPLAMQV

SEQ ID NO: 3095333 - protein, 23 aa, Giardia lamblia
SIIVFVRWIIILSSIIPLAMQVS

SEQ ID NO: 3095334 - protein, 18 aa, Giardia lamblia
SILLLLRQMSLIHPSIAT

SEQ ID NO: 3095335 - protein, 25 aa, Giardia lamblia
SIPYTSLLPILWAFSQLYSLYLYSN

SEQ ID NO: 3095336 - protein, 18 aa, Giardia lamblia
SISWLTRLIRLLIEEITS

SEQ ID NO: 3095337 - protein, 19 aa, Giardia lamblia
SIVTLTFWFRVVLGACAAV

SEQ ID NO: 3095338 - protein, 18 aa, Giardia lamblia
SIYFLVMLSLQRNIRGGI

SEQ ID NO: 3095339 - protein, 18 aa, Giardia lamblia
SKFFVITVFLMQFLLSLS

SEQ ID NO: 3095340 - protein, 24 aa, Giardia lamblia
SKKCLIIWGVIIAVIAIIVISVLS

SEQ ID NO: 3095341 - protein, 22 aa, Giardia lamblia
SKTDPFFWIFKEQEDRTGGGFV

SEQ ID NO: 3095342 - protein, 17 aa, Giardia lamblia
SLFFGCFSCHSSCSTCS

SEQ ID NO: 3095343 - protein, 21 aa, Giardia lamblia
SLGISFLVLLFNYEEFAAATT

SEQ ID NO: 3095344 - protein, 22 aa, Giardia lamblia
SLGITLLELWFLPTASDNLSNL

SEQ ID NO: 3095345 - protein, 17 aa, Giardia lamblia
SLIFLIINLVDFCLFYV

SEQ ID NO: 3095346 - protein, 17 aa, Giardia lamblia
SLNPLYLSRFHKLEPPF

SEQ ID NO: 3095347 - protein, 19 aa, Giardia lamblia
SLSPELLIFGFKSPLEPAR

SEQ ID NO: 3095348 - protein, 27 aa, Giardia lamblia
SLYPQSRLLMLLLALLECMFVAKISKF

SEQ ID NO: 3095349 - protein, 17 aa, Giardia lamblia
SLYTLPYYIIRSLNDTE

SEQ ID NO: 3095350 - protein, 17 aa, Giardia lamblia
SMRWIFHRLALSLADPI

SEQ ID NO: 3095351 - protein, 20 aa, Giardia lamblia
SNFMLLLIFVMTMPLMFVCY

SEQ ID NO: 3095352 - protein, 23 aa, Giardia lamblia
SNILFANPFLLLFAGSHYILIEK

SEQ ID NO: 3095353 - protein, 17 aa, Giardia lamblia
SNLIPHRLFYVLPNDCL

SEQ ID NO: 3095354 - protein, 24 aa, Giardia lamblia
SNNYFLFYGGCYLATRWPGNSYCL

SEQ ID NO: 3095355 - protein, 25 aa, Giardia lamblia
SNQFPFQIPLLPPPGLTQPLPPIPS

SEQ ID NO: 3095356 - protein, 24 aa, Giardia lamblia
SPDAMALYLFLWKMGLHSTMRQNA

SEQ ID NO: 3095357 - protein, 18 aa, Giardia lamblia
SPGRRYAYRRSLESVNIC

SEQ ID NO: 3095358 - protein, 17 aa, Giardia lamblia
SPHPFTFLIHKLGIMPN

SEQ ID NO: 3095359 - protein, 27 aa, Giardia lamblia
SPHYTHLIAFLPWLSARKLLRVYKRVF

SEQ ID NO: 3095360 - protein, 17 aa, Giardia lamblia
SPIRPFIIKNKASTRKF

SEQ ID NO: 3095361 - protein, 17 aa, Giardia lamblia
SPLAWLSIKDEEPYFDL

SEQ ID NO: 3095362 - protein, 19 aa, Giardia lamblia
SPLEQSWLRFLHTVHLSDP

SEQ ID NO: 3095363 - protein, 21 aa, Giardia lamblia
SPLYFLPPYIDPHLYRLIRVY

SEQ ID NO: 3095364 - protein, 24 aa, Giardia lamblia
SPRSTILFLFLVFATRLPSPYGNL

SEQ ID NO: 3095365 - protein, 23 aa, Giardia lamblia
SPYTPLNFVPLFLKAQFSRPSNV

SEQ ID NO: 3095366 - protein, 24 aa, Giardia lamblia
SQFEYLCLLLRYFFNSKGAIPPEV

SEQ ID NO: 3095367 - protein, 25 aa, Giardia lamblia
SQLPPFHLLFPCLFPEPLSKPEVME

SEQ ID NO: 3095368 - protein, 18 aa, Giardia lamblia
SQSYLYFSFSILPGQYLN

SEQ ID NO: 3095369 - protein, 26 aa, Giardia lamblia
SRCSLLCYLVFVLLWQGSTQYQGVLI

SEQ ID NO: 3095370 - protein, 19 aa, Giardia lamblia
SRDFFIIFKITLVKAVSSF

SEQ ID NO: 3095371 - protein, 19 aa, Giardia lamblia
SRFIAYLYHYLMLYARILS

SEQ ID NO: 3095372 - protein, 22 aa, Giardia lamblia
SRLPLKFLATFEPRLKYASLLT

SEQ ID NO: 3095373 - protein, 23 aa, Giardia lamblia
SRVPLSLLFVFLTGVGSLCRRTE

SEQ ID NO: 3095374 - protein, 22 aa, Giardia lamblia
SSIICMFVIALLIRFYQFQLSR

SEQ ID NO: 3095375 - protein, 24 aa, Giardia lamblia
SSIKFIYWTMLGINILWQISFSIY

SEQ ID NO: 3095376 - protein, 26 aa, Giardia lamblia
SSIYTFLHYVPWYFPLDLAKIYCCLT

SEQ ID NO: 3095377 - protein, 22 aa, Giardia lamblia
SSKLLAMLVYFLRNVNGLEQMD

SEQ ID NO: 3095378 - protein, 17 aa, Giardia lamblia
SSNTRLFFYPNGSYYNL

SEQ ID NO: 3095379 - protein, 24 aa, Giardia lamblia
SSPKLSILALLPYFYVGPDPQDNF

SEQ ID NO: 3095380 - protein, 20 aa, Giardia lamblia
SSRILMLKALYARLLEHKET

SEQ ID NO: 3095381 - protein, 19 aa, Giardia lamblia
SSRLFFYRTFVDDWLLLTT

SEQ ID NO: 3095382 - protein, 23 aa, Giardia lamblia
SSRLLCVYLLAKERLLGAIPNKI

SEQ ID NO: 3095383 - protein, 28 aa, Giardia lamblia
SSYIPFKFLFYFFLLLSSYWVPQCYHMY

SEQ ID NO: 3095384 - protein, 25 aa, Giardia lamblia
STFTPMIVWLFFKQSARVYTYRIAK

SEQ ID NO: 3095385 - protein, 17 aa, Giardia lamblia
STPLKLPLPIIPIFCRS

SEQ ID NO: 3095386 - protein, 22 aa, Giardia lamblia
STQILLVEILLRIRNRIPDVSA

SEQ ID NO: 3095387 - protein, 27 aa, Giardia lamblia
STTGFYFLFNLVYIILLILTQSVSIGP

SEQ ID NO: 3095388 - protein, 18 aa, Giardia lamblia
STTQLSTWPAGCTALMLA

SEQ ID NO: 3095389 - protein, 25 aa, Giardia lamblia
SVCILTFIFLIIVWSSKAFCSWGFT

SEQ ID NO: 3095390 - protein, 19 aa, Giardia lamblia
SVHKFFFHLISKYLHRYEP

SEQ ID NO: 3095391 - protein, 19 aa, Giardia lamblia
SVILFIVKQIAAALAYLHS

SEQ ID NO: 3095392 - protein, 18 aa, Giardia lamblia
SVITMLAISCLWLQAHGE

SEQ ID NO: 3095393 - protein, 19 aa, Giardia lamblia
SVKFMFVTLLGAASSFRAE

SEQ ID NO: 3095394 - protein, 21 aa, Giardia lamblia
SVLAGLIGFLSWRFCCKNKKP

SEQ ID NO: 3095395 - protein, 21 aa, Giardia lamblia
SVLITFFRILAHELVFNDNCL

SEQ ID NO: 3095396 - protein, 24 aa, Giardia lamblia
SVSRRLWIFVIIEIALVVLASGVQ

SEQ ID NO: 3095397 - protein, 18 aa, Giardia lamblia
SVVVIIVVGGLAGFLCWW

SEQ ID NO: 3095398 - protein, 20 aa, Giardia lamblia
SWDPKLQPLPLPPGNRFYDD

SEQ ID NO: 3095399 - protein, 19 aa, Giardia lamblia
SYHVPIVEKLLLSALLFPI

SEQ ID NO: 3095400 - protein, 18 aa, Giardia lamblia
SYLMLFLVVAIYPGSLTR

SEQ ID NO: 3095401 - protein, 28 aa, Giardia lamblia
SYMKYIRIYLLIFIKFLRHLEYLHTAGV

SEQ ID NO: 3095402 - protein, 27 aa, Giardia lamblia
SYNRLILFYVRQFIFGLAWSLSCQLPL

SEQ ID NO: 3095403 - protein, 21 aa, Giardia lamblia
SYRDIFIARFYPRQFKQSFFF

SEQ ID NO: 3095404 - protein, 23 aa, Giardia lamblia
SYSTFYLLPVFVRTLNILTNLAH

SEQ ID NO: 3095405 - protein, 24 aa, Giardia lamblia
SYYIHGILVPLLYRQKVPSNVSVL

SEQ ID NO: 3095406 - protein, 25 aa, Giardia lamblia
TAFMLLFPLASFTLGLLGAFCKKKS

SEQ ID NO: 3095407 - protein, 25 aa, Giardia lamblia
TAHGVFNCLLLLDIGLIDFFHTARM

SEQ ID NO: 3095408 - protein, 25 aa, Giardia lamblia
TALILAAYTGSLPFATLLSSYEKGI

SEQ ID NO: 3095409 - protein, 21 aa, Giardia lamblia
TAVLPLLWNLYLATAEILEPS

SEQ ID NO: 3095410 - protein, 24 aa, Giardia lamblia
TCVSYFYHLFFHVVFIFMASFPVV

SEQ ID NO: 3095411 - protein, 25 aa, Giardia lamblia
TEMFYAYLLAFLYQCSNFYNEESSH

SEQ ID NO: 3095412 - protein, 24 aa, Giardia lamblia
TFAAWLPMFLLFSANVAIFSAFIA

SEQ ID NO: 3095413 - protein, 24 aa, Giardia lamblia
TFAEEFLIFILKKSLRTLRNIDGK

SEQ ID NO: 3095414 - protein, 18 aa, Giardia lamblia
TFAYLFPLLLREGFFNTT

SEQ ID NO: 3095415 - protein, 23 aa, Giardia lamblia
TFGSFFWRWFLERGIITQKPAHT

SEQ ID NO: 3095416 - protein, 26 aa, Giardia lamblia
TFLLCLRPFFTLLSLLHCTLLRQTRP

SEQ ID NO: 3095417 - protein, 18 aa, Giardia lamblia
TFRHVFNCLLLYTQALFS

SEQ ID NO: 3095418 - protein, 28 aa, Giardia lamblia
TFVLVPLLGLFLWMFMGFRAVSPLLRRT

SEQ ID NO: 3095419 - protein, 23 aa, Giardia lamblia
TGFFIFLLFHLSFTLWMALIDSN

SEQ ID NO: 3095420 - protein, 24 aa, Giardia lamblia
TGKMKRWILWLQNLAINNISLAIN

SEQ ID NO: 3095421 - protein, 22 aa, Giardia lamblia
TGTFLIFMFALVKVLNGSTLLI

SEQ ID NO: 3095422 - protein, 18 aa, Giardia lamblia
TGVPLYILDGRLPPAPIF

SEQ ID NO: 3095423 - protein, 20 aa, Giardia lamblia
TGWLMLGYTVVFTSLPVTII

SEQ ID NO: 3095424 - protein, 19 aa, Giardia lamblia
THLFYEYGCYSRHSSTGFA

SEQ ID NO: 3095425 - protein, 19 aa, Giardia lamblia
THLLYKLGCYSRHSSTGLA

SEQ ID NO: 3095426 - protein, 28 aa, Giardia lamblia
TIFIKALKYFLFYHTALVPYSIILATIL

SEQ ID NO: 3095427 - protein, 23 aa, Giardia lamblia
TIKKIVHFIILEWRLYVSVHIRQ

SEQ ID NO: 3095428 - protein, 25 aa, Giardia lamblia
TILKPYLCLALALLFFFDFNTFNVL

SEQ ID NO: 3095429 - protein, 24 aa, Giardia lamblia
TILPYCHIILGRYYFRGLFPSSSD

SEQ ID NO: 3095430 - protein, 21 aa, Giardia lamblia
TIMDRIWIYIYNPWTQKYEIP

SEQ ID NO: 3095431 - protein, 24 aa, Giardia lamblia
TINAFWFGHFLLLASRLPIYDPYM

SEQ ID NO: 3095432 - protein, 19 aa, Giardia lamblia
TIRGLLELMRYYLPSFGLP

SEQ ID NO: 3095433 - protein, 20 aa, Giardia lamblia
TKDSYLLLYLIELSQHLATD

SEQ ID NO: 3095434 - protein, 18 aa, Giardia lamblia
TKLSVITMLAISCLWLQA

SEQ ID NO: 3095435 - protein, 23 aa, Giardia lamblia
TKQTTIFLLSCTFTLLVLSRYSS

SEQ ID NO: 3095436 - protein, 23 aa, Giardia lamblia
TKSPGEFPFLNSLPVKVLIDDQD

SEQ ID NO: 3095437 - protein, 20 aa, Giardia lamblia
TKVIQILLPYEAGLANDDNQ

SEQ ID NO: 3095438 - protein, 23 aa, Giardia lamblia
TLDEILILWLQVQQNWIYLEAVF

SEQ ID NO: 3095439 - protein, 20 aa, Giardia lamblia
TLHDALVVAILFLTVLYADT

SEQ ID NO: 3095440 - protein, 17 aa, Giardia lamblia
TLIKQFSACSFEITYRS

SEQ ID NO: 3095441 - protein, 17 aa, Giardia lamblia
TLIPPMSQRRLQPGAAG

SEQ ID NO: 3095442 - protein, 22 aa, Giardia lamblia
TLLAIQLLWTMWIEAGLRQARQ

SEQ ID NO: 3095443 - protein, 25 aa, Giardia lamblia
TLLDSLIFFLLYVTAYNVLPDFNYL

SEQ ID NO: 3095444 - protein, 19 aa, Giardia lamblia
TLLFLRMLIYFNSFINFTL

SEQ ID NO: 3095445 - protein, 19 aa, Giardia lamblia
TLLIANLLAYGLLFGAGSL

SEQ ID NO: 3095446 - protein, 20 aa, Giardia lamblia
TLLLLLVMSLILYSIIKERR

SEQ ID NO: 3095447 - protein, 19 aa, Giardia lamblia
TLNFLHIPSLRYGFNILKS

SEQ ID NO: 3095448 - protein, 22 aa, Giardia lamblia
TLPLLPLLLLRVTGADAARPSG

SEQ ID NO: 3095449 - protein, 33 aa, Giardia lamblia
TLTSGYLLRIFFDILFYIIFLFMLFGAHEITDT

SEQ ID NO: 3095450 - protein, 20 aa, Giardia lamblia
TLWLLPYRFKGATDPAPCIT

SEQ ID NO: 3095451 - protein, 25 aa, Giardia lamblia
TMALFRPLMIIKPDIDYIAAGLFLM

SEQ ID NO: 3095452 - protein, 18 aa, Giardia lamblia
TMQLLFFLPSMLVAIVQM

SEQ ID NO: 3095453 - protein, 24 aa, Giardia lamblia
TNHYTYLKFLPYKFGQSLMTSSQT

SEQ ID NO: 3095454 - protein, 19 aa, Giardia lamblia
TNLRYLRLLEAALSLLASA

SEQ ID NO: 3095455 - protein, 20 aa, Giardia lamblia
TNPFWFVHLMSMVKLYGQDL

SEQ ID NO: 3095456 - protein, 20 aa, Giardia lamblia
TNYLALLIFLLSSLSHHVIL

SEQ ID NO: 3095457 - protein, 19 aa, Giardia lamblia
TPCLLSRWPRFFFLFDCDI

SEQ ID NO: 3095458 - protein, 19 aa, Giardia lamblia
TPEFFLFYGGCYDITHPIG

SEQ ID NO: 3095459 - protein, 20 aa, Giardia lamblia
TPFFLCQFLMMCATTGTIYI

SEQ ID NO: 3095460 - protein, 21 aa, Giardia lamblia
TPFIALLFPAFTFDGAVSNFV

SEQ ID NO: 3095461 - protein, 23 aa, Giardia lamblia
TPKSFLELISLYIKLLHGRRREI

SEQ ID NO: 3095462 - protein, 20 aa, Giardia lamblia
TPLLYLCMFSYSSNVFQLNI

SEQ ID NO: 3095463 - protein, 25 aa, Giardia lamblia
TPSFLHNFLYWGLIRRRFHLSDYVP

SEQ ID NO: 3095464 - protein, 22 aa, Giardia lamblia
TPTELFYYLLNQTNLEGPDVFE

SEQ ID NO: 3095465 - protein, 20 aa, Giardia lamblia
TPYMYGLLGLYAYPLLNLRR

SEQ ID NO: 3095466 - protein, 25 aa, Giardia lamblia
TQHFFTLWIPFLLDLELRDAEVGML

SEQ ID NO: 3095467 - protein, 21 aa, Giardia lamblia
TQSHHWYSLRPLWNVTEDVVK

SEQ ID NO: 3095468 - protein, 19 aa, Giardia lamblia
TREHLQLLMIFGVKHIMVA

SEQ ID NO: 3095469 - protein, 17 aa, Giardia lamblia
TREPLFIVFSLTGNMAI

SEQ ID NO: 3095470 - protein, 23 aa, Giardia lamblia
TRICYIGFVYLLYYLAEDIFNRT

SEQ ID NO: 3095471 - protein, 19 aa, Giardia lamblia
TSCYKTHLLYKLGCYSRHS

SEQ ID NO: 3095472 - protein, 23 aa, Giardia lamblia
TSDVILLLKLWPLSRYMGYQTNS

SEQ ID NO: 3095473 - protein, 24 aa, Giardia lamblia
TSHPLLLLRIRGLIYAFSQALTKI

SEQ ID NO: 3095474 - protein, 24 aa, Giardia lamblia
TSLLYNAFLYFLNPSRYLGSSYTS

SEQ ID NO: 3095475 - protein, 22 aa, Giardia lamblia
TSNRWLTVVVLLLSIFPVAAQN

SEQ ID NO: 3095476 - protein, 20 aa, Giardia lamblia
TSPPVLYALCRLRRLPRGGG

SEQ ID NO: 3095477 - protein, 18 aa, Giardia lamblia
TSRKSVLYVLYTLAEFFA

SEQ ID NO: 3095478 - protein, 21 aa, Giardia lamblia
TSVIIILLLAIISAVLGLVIR

SEQ ID NO: 3095479 - protein, 18 aa, Giardia lamblia
TSYLAIFLLVRRSGVLDD

SEQ ID NO: 3095480 - protein, 19 aa, Giardia lamblia
TTGYFLFQGGCYTLASIPG

SEQ ID NO: 3095481 - protein, 19 aa, Giardia lamblia
TTLFLLLKLVVNSLLNSAI

SEQ ID NO: 3095482 - protein, 18 aa, Giardia lamblia
TTLLLRWIGPRIKDFSFN

SEQ ID NO: 3095483 - protein, 18 aa, Giardia lamblia
TTMMLFITRIVSFLQNYL

SEQ ID NO: 3095484 - protein, 25 aa, Giardia lamblia
TTNPRPVFYILIRNMELLGVSYDPV

SEQ ID NO: 3095485 - protein, 23 aa, Giardia lamblia
TTRNYFRMLFLHLDFNSIKRSSN

SEQ ID NO: 3095486 - protein, 25 aa, Giardia lamblia
TTSNFVFFFFLIITTWSSITTELSP

SEQ ID NO: 3095487 - protein, 20 aa, Giardia lamblia
TVICWLMGFYLYRRFIKSFE

SEQ ID NO: 3095488 - protein, 21 aa, Giardia lamblia
TVIVLLYLKPVILTNILSLMN

SEQ ID NO: 3095489 - protein, 23 aa, Giardia lamblia
TVRKFMIAVFIVTILYSTILLIL

SEQ ID NO: 3095490 - protein, 28 aa, Giardia lamblia
TVSFYQYLLFFWVFLQLTIMLALMATHK

SEQ ID NO: 3095491 - protein, 27 aa, Giardia lamblia
TVYCSKNFILIWTLLIHSKLCSKAAVT

SEQ ID NO: 3095492 - protein, 18 aa, Giardia lamblia
TWLYSKRPLLALAEASAM

SEQ ID NO: 3095493 - protein, 23 aa, Giardia lamblia
TYDSPVIPVLLYNPVKLKPVADE

SEQ ID NO: 3095494 - protein, 23 aa, Giardia lamblia
TYFRSLLCMLVLGAIIVITSEVA

SEQ ID NO: 3095495 - protein, 20 aa, Giardia lamblia
TYLVSPCRLIVLIRAHASFL

SEQ ID NO: 3095496 - protein, 21 aa, Giardia lamblia
TYNRTVIPYYYWWDGTNNNVL

SEQ ID NO: 3095497 - protein, 31 aa, Giardia lamblia
TYNVFVFILILLLPVKFFPYITSGYASAKSA

SEQ ID NO: 3095498 - protein, 21 aa, Giardia lamblia
TYPVPFFIYYFGSISVDTLLA

SEQ ID NO: 3095499 - protein, 25 aa, Giardia lamblia
TYRIPAMWILILISLIQSLIVFPLI

SEQ ID NO: 3095500 - protein, 19 aa, Giardia lamblia
TYYIVRAYLLMALGFSPSL

SEQ ID NO: 3095501 - protein, 20 aa, Giardia lamblia
TYYLPLIFIFLVSIGRELYT

SEQ ID NO: 3095502 - protein, 27 aa, Giardia lamblia
VAAYLSSALYYFLFQFQKKSICAIFKR

SEQ ID NO: 3095503 - protein, 22 aa, Giardia lamblia
VAFLVFIIILVVTFLGLTQSSP

SEQ ID NO: 3095504 - protein, 28 aa, Giardia lamblia
VAMLVAVVVFIILWFTVIKKKLEERKRR

SEQ ID NO: 3095505 - protein, 28 aa, Giardia lamblia
VAPTITLLILLLIVGALVIYFGLASCGK

SEQ ID NO: 3095506 - protein, 21 aa, Giardia lamblia
VAVIIGCLVWFLLRRKNSGSL

SEQ ID NO: 3095507 - protein, 33 aa, Giardia lamblia
VAVLKQFRLFFNQFFLVLAFLQLYRPLQVGLAF

SEQ ID NO: 3095508 - protein, 17 aa, Giardia lamblia
VCERCDGAYFLYKGGCY

SEQ ID NO: 3095509 - protein, 26 aa, Giardia lamblia
VCLLHTIILLWYCETMMPLSLIYDIT

SEQ ID NO: 3095510 - protein, 23 aa, Giardia lamblia
VCSGLSILYYRIPFVRDLVSRAV

SEQ ID NO: 3095511 - protein, 19 aa, Giardia lamblia
VCTAFLYLLYLLVNQNNVL

SEQ ID NO: 3095512 - protein, 17 aa, Giardia lamblia
VCWSEIIVIITFSAGLV

SEQ ID NO: 3095513 - protein, 22 aa, Giardia lamblia
VCWVSLFLMLFGIVAVVLQKFA

SEQ ID NO: 3095514 - protein, 29 aa, Giardia lamblia
VDCYLRAITPRLFLLCFLTSPDAIEEDLA

SEQ ID NO: 3095515 - protein, 20 aa, Giardia lamblia
VDEFLSKLLALLDRVRLQFA

SEQ ID NO: 3095516 - protein, 23 aa, Giardia lamblia
VDPLLQWLPLYEILKLAALLWIA

SEQ ID NO: 3095517 - protein, 17 aa, Giardia lamblia
VEAGLPFWIFFDEITNV

SEQ ID NO: 3095518 - protein, 21 aa, Giardia lamblia
VEFMTYILLRFAYSVLTRLSI

SEQ ID NO: 3095519 - protein, 25 aa, Giardia lamblia
VELLTFINLLLLPSPRTRLGAKDLL

SEQ ID NO: 3095520 - protein, 26 aa, Giardia lamblia
VETDYMPWLLRRTFSLAYRNLLLSYI

SEQ ID NO: 3095521 - protein, 25 aa, Giardia lamblia
VFALGTFLILLLVTISLHCCELKRD

SEQ ID NO: 3095522 - protein, 18 aa, Giardia lamblia
VFFLGVIRIFGYNFPLVC

SEQ ID NO: 3095523 - protein, 17 aa, Giardia lamblia
VFLLADLDPENGALHVL

SEQ ID NO: 3095524 - protein, 22 aa, Giardia lamblia
VFMIVYVIVLLFPNTFKRPYFD

SEQ ID NO: 3095525 - protein, 18 aa, Giardia lamblia
VFMMAYVTHLFTLPLNES

SEQ ID NO: 3095526 - protein, 21 aa, Giardia lamblia
VFQFPMVWWLVLVSLLQSLVV

SEQ ID NO: 3095527 - protein, 18 aa, Giardia lamblia
VFSFLFHGMLYEYGHTKP

SEQ ID NO: 3095528 - protein, 17 aa, Giardia lamblia
VFSILPLFTNVICLLLD

SEQ ID NO: 3095529 - protein, 19 aa, Giardia lamblia
VFSPFYYLYCLWISPTLIG

SEQ ID NO: 3095530 - protein, 25 aa, Giardia lamblia
VFVCSHGFFYLYNFLREELVFKFQL

SEQ ID NO: 3095531 - protein, 24 aa, Giardia lamblia
VFVSAFLMLLLSTLTPSHVLGFFT

SEQ ID NO: 3095532 - protein, 26 aa, Giardia lamblia
VGIHFRVVLFLLLVPIAVHIITILIE

SEQ ID NO: 3095533 - protein, 34 aa, Giardia lamblia
VGIVVLVLLVCIGVGLFFVFRRKPAQQLDVTSET

SEQ ID NO: 3095534 - protein, 18 aa, Giardia lamblia
VGMFFILTIILLNPTFSF

SEQ ID NO: 3095535 - protein, 25 aa, Giardia lamblia
VGVLVGVLCWYFLRNKRKRSIRPRT

SEQ ID NO: 3095536 - protein, 32 aa, Giardia lamblia
VGVSVVVLVLIGVLIWWLVFQRRRGSGFGGSR

SEQ ID NO: 3095537 - protein, 23 aa, Giardia lamblia
VHFPMFFLPKYLSVRSRRFSSIY

SEQ ID NO: 3095538 - protein, 19 aa, Giardia lamblia
VHHSIYLLIFILSNIYSKA

SEQ ID NO: 3095539 - protein, 23 aa, Giardia lamblia
VIDSLLFVFGWRARALRHSRLAD

SEQ ID NO: 3095540 - protein, 28 aa, Giardia lamblia
VIEFDRYSLRRILLDYKLLLGMYNHQEK

SEQ ID NO: 3095541 - protein, 25 aa, Giardia lamblia
VIFGYILPFLALCSLYFYTTHFTRR

SEQ ID NO: 3095542 - protein, 28 aa, Giardia lamblia
VIGVLVGFLCWWFIFRGKRTSAPSNATS

SEQ ID NO: 3095543 - protein, 20 aa, Giardia lamblia
VIIMLVYIVGKLIAIRRLKA

SEQ ID NO: 3095544 - protein, 17 aa, Giardia lamblia
VIIPVLMPNAITLCNNE

SEQ ID NO: 3095545 - protein, 20 aa, Giardia lamblia
VIIVVGGLAGFLCWWFIGRR

SEQ ID NO: 3095546 - protein, 26 aa, Giardia lamblia
VINSLFLLLTLLFSFGHAIFPTNAQV

SEQ ID NO: 3095547 - protein, 23 aa, Giardia lamblia
VIPDSLWELLLDGALLSLDNEQS

SEQ ID NO: 3095548 - protein, 18 aa, Giardia lamblia
VISSLFYLRRHVWHANLI

SEQ ID NO: 3095549 - protein, 20 aa, Giardia lamblia
VITLFLLLRIHLEKHIFSSV

SEQ ID NO: 3095550 - protein, 22 aa, Giardia lamblia
VIVLVLFILVIVLYSRLINLTV

SEQ ID NO: 3095551 - protein, 20 aa, Giardia lamblia
VIVQVIFMALLPLVIKYLSM

SEQ ID NO: 3095552 - protein, 22 aa, Giardia lamblia
VIVSTLPILFKRYWRVANSRQD

SEQ ID NO: 3095553 - protein, 21 aa, Giardia lamblia
VIVVVGGLVGFLCWWFLYRGK

SEQ ID NO: 3095554 - protein, 20 aa, Giardia lamblia
VIYYREALLQSPRFLRILMA

SEQ ID NO: 3095555 - protein, 22 aa, Giardia lamblia
VKGSFIYFGLLAATATDSYFSQ

SEQ ID NO: 3095556 - protein, 24 aa, Giardia lamblia
VKYLLLPCYLPLSPFVLLLRIMII

SEQ ID NO: 3095557 - protein, 19 aa, Giardia lamblia
VLCLCNTFFLLHHYTIRDV

SEQ ID NO: 3095558 - protein, 17 aa, Giardia lamblia
VLCRLFTIILALDKNFP

SEQ ID NO: 3095559 - protein, 26 aa, Giardia lamblia
VLDSMFRFMWVPFFLILCIETANYFL

SEQ ID NO: 3095560 - protein, 19 aa, Giardia lamblia
VLFSCYYGICELLFNIACS

SEQ ID NO: 3095561 - protein, 20 aa, Giardia lamblia
VLFYIFISLEYILMFVAMKL

SEQ ID NO: 3095562 - protein, 23 aa, Giardia lamblia
VLIPILVAVIALVSYIFCCGKKK

SEQ ID NO: 3095563 - protein, 27 aa, Giardia lamblia
VLLLQALLCLFIFKYVKPFLISYILIM

SEQ ID NO: 3095564 - protein, 29 aa, Giardia lamblia
VLLVLGGVIGFCVWWFLVRGKKGQAAQKG

SEQ ID NO: 3095565 - protein, 28 aa, Giardia lamblia
VLLVVAGVLCWFFLKKKKVIKNKPTHSL

SEQ ID NO: 3095566 - protein, 20 aa, Giardia lamblia
VLMAILLLVFSLISIVSIGT

SEQ ID NO: 3095567 - protein, 18 aa, Giardia lamblia
VLNIFVCLFLILVVGKRI

SEQ ID NO: 3095568 - protein, 20 aa, Giardia lamblia
VLPCSLFLPVLYMAETLRHI

SEQ ID NO: 3095569 - protein, 31 aa, Giardia lamblia
VLVLLACIGIGLFFIFRRRSPRLDAASEALS

SEQ ID NO: 3095570 - protein, 30 aa, Giardia lamblia
VLVVGVLVGFLCWWFIFRGRRIDASPSTMT

SEQ ID NO: 3095571 - protein, 25 aa, Giardia lamblia
VLWCDASVWFHILKVLLVEGFINTS

SEQ ID NO: 3095572 - protein, 22 aa, Giardia lamblia
VMSWIFFCLLGRYNPVIANSLT

SEQ ID NO: 3095573 - protein, 23 aa, Giardia lamblia
VNKFIRRQVGIFGYIRVGIPDES

SEQ ID NO: 3095574 - protein, 28 aa, Giardia lamblia
VPCILGIFLFVFLLYILFARLCGCGSKR

SEQ ID NO: 3095575 - protein, 23 aa, Giardia lamblia
VPESFHTLRFPPHSFQTLQHYLP

SEQ ID NO: 3095576 - protein, 24 aa, Giardia lamblia
VPFKKYCFEFLPTYLTRLGLDKKR

SEQ ID NO: 3095577 - protein, 24 aa, Giardia lamblia
VPIAVILSVLRQVAAALAYLYGAS

SEQ ID NO: 3095578 - protein, 20 aa, Giardia lamblia
VPIVPFSVLLLLSDTLGKAH

SEQ ID NO: 3095579 - protein, 24 aa, Giardia lamblia
VPLATQLLLLLFRRHLHLSNMVGL

SEQ ID NO: 3095580 - protein, 23 aa, Giardia lamblia
VPNCVILYYFLTKAPFIHVLGRM

SEQ ID NO: 3095581 - protein, 19 aa, Giardia lamblia
VPTWLYWCANFIYQLCFAV

SEQ ID NO: 3095582 - protein, 23 aa, Giardia lamblia
VQKKFEILLFKLLYTYVMEDIYP

SEQ ID NO: 3095583 - protein, 20 aa, Giardia lamblia
VQLPLAHYLLFWEAAEALLS

SEQ ID NO: 3095584 - protein, 24 aa, Giardia lamblia
VQNTLIVIIWLPILVELLIAVIYS

SEQ ID NO: 3095585 - protein, 22 aa, Giardia lamblia
VQPIIEPWLPSVTAFFKRLCIV

SEQ ID NO: 3095586 - protein, 27 aa, Giardia lamblia
VQSVKRFFLWFWNLYYMKFDQISCVFT

SEQ ID NO: 3095587 - protein, 26 aa, Giardia lamblia
VQTENLLWWYFFTPMMSFAAILGFVG

SEQ ID NO: 3095588 - protein, 34 aa, Giardia lamblia
VRILLPFVLVTFLKRLLFIIPFISHYVVEWFYPS

SEQ ID NO: 3095589 - protein, 26 aa, Giardia lamblia
VRLFYEAYLSLYKRLIPFLITTKDRD

SEQ ID NO: 3095590 - protein, 32 aa, Giardia lamblia
VSARFLLIDWLLLIVYIIGLLAYGFYGILIKV

SEQ ID NO: 3095591 - protein, 23 aa, Giardia lamblia
VSASYFLFFFKVLRASSLDDKDF

SEQ ID NO: 3095592 - protein, 26 aa, Giardia lamblia
VSCFLPLDLMFLVPALLVVALIMSLP

SEQ ID NO: 3095593 - protein, 23 aa, Giardia lamblia
VSDYLVMNVLVPLLLRLVQMMFA

SEQ ID NO: 3095594 - protein, 23 aa, Giardia lamblia
VSLDVLLELFYSTGLLGLSGRAY

SEQ ID NO: 3095595 - protein, 22 aa, Giardia lamblia
VSLPTLPYLTQLAPPTLPLTVE

SEQ ID NO: 3095596 - protein, 23 aa, Giardia lamblia
VSSSYLPDLLLRAALQDLKKQMA

SEQ ID NO: 3095597 - protein, 18 aa, Giardia lamblia
VSVPAYLYLFQRRYVFVR

SEQ ID NO: 3095598 - protein, 23 aa, Giardia lamblia
VTCRSGFFLASGSWKGQCIPCDL

SEQ ID NO: 3095599 - protein, 25 aa, Giardia lamblia
VTFCLTLLWHSPASRLRIFRTLFAT

SEQ ID NO: 3095600 - protein, 21 aa, Giardia lamblia
VTFLRPCGFLLFSSFINVENL

SEQ ID NO: 3095601 - protein, 25 aa, Giardia lamblia
VTFQTRLYFLLLSSTLKLLPIVTLF

SEQ ID NO: 3095602 - protein, 27 aa, Giardia lamblia
VTNDIFQFFLYLMKYLKTYRKQLKAFI

SEQ ID NO: 3095603 - protein, 17 aa, Giardia lamblia
VTRHLLLLFLSLDLQEH

SEQ ID NO: 3095604 - protein, 20 aa, Giardia lamblia
VTTLFLFLSPFLTSCLYYSR

SEQ ID NO: 3095605 - protein, 20 aa, Giardia lamblia
VVAVILLVLVALGKVSFTCC

SEQ ID NO: 3095606 - protein, 23 aa, Giardia lamblia
VVGFLCWWFICRSKSRPTENPVH

SEQ ID NO: 3095607 - protein, 22 aa, Giardia lamblia
VVIILPFFIFFGAAAPQFTTER

SEQ ID NO: 3095608 - protein, 25 aa, Giardia lamblia
VVILLILFFFTWYLALVKQLSRYVP

SEQ ID NO: 3095609 - protein, 32 aa, Giardia lamblia
VVLLVLAVAGFLVWWFVFRRGGRPRRGGTKYT

SEQ ID NO: 3095610 - protein, 32 aa, Giardia lamblia
VVLLVLVAVAGFLIWWFVIRPRRGGPLRERAP

SEQ ID NO: 3095611 - protein, 32 aa, Giardia lamblia
VVLLVLVAVAGFLVWWFVIRPRRGGPLRERAP

SEQ ID NO: 3095612 - protein, 17 aa, Giardia lamblia
VVSLLIIVAVALACWFV

SEQ ID NO: 3095613 - protein, 18 aa, Giardia lamblia
VVSTPFIALLFPAFTFDG

SEQ ID NO: 3095614 - protein, 18 aa, Giardia lamblia
VVVGGLVGFLCWWFICRG

SEQ ID NO: 3095615 - protein, 22 aa, Giardia lamblia
VVVSLLIIAAVALACWLVLRRR

SEQ ID NO: 3095616 - protein, 19 aa, Giardia lamblia
VVVSLLIIAAVALTCWFVL

SEQ ID NO: 3095617 - protein, 32 aa, Giardia lamblia
VVVVALVILAVAIFLIWKFVIKPRSKSRKRSN

SEQ ID NO: 3095618 - protein, 19 aa, Giardia lamblia
VVVVGGLVGFLCWWFICRG

SEQ ID NO: 3095619 - protein, 34 aa, Giardia lamblia
VVVVLLVLVAVAGFLVWWFVIRPRRGGPLRERVP

SEQ ID NO: 3095620 - protein, 25 aa, Giardia lamblia
VWAFGVTLFMLLFGRHPASLCLHIL

SEQ ID NO: 3095621 - protein, 24 aa, Giardia lamblia
VYYLLRGVFLLALQINPILALKSI

SEQ ID NO: 3095622 - protein, 22 aa, Giardia lamblia
WALKFLRLFRQKTQLYFPTSYL

SEQ ID NO: 3095623 - protein, 22 aa, Giardia lamblia
WEAVFILFDKLLFGVGMLESFG

SEQ ID NO: 3095624 - protein, 17 aa, Giardia lamblia
WFIPWFTNKAIVPALDL

SEQ ID NO: 3095625 - protein, 19 aa, Giardia lamblia
WFSVIFVPQMILLLSKVLP

SEQ ID NO: 3095626 - protein, 38 aa, Giardia lamblia
WGVLVLAIALLTLVIFIVPFLLYRFFNRPPETIFKGSY

SEQ ID NO: 3095627 - protein, 17 aa, Giardia lamblia
WHWRFLASPQGLIKYII

SEQ ID NO: 3095628 - protein, 17 aa, Giardia lamblia
WILIVDVWFLPPTSIQD

SEQ ID NO: 3095629 - protein, 17 aa, Giardia lamblia
WIRLSVLYAFLPKLVGP

SEQ ID NO: 3095630 - protein, 23 aa, Giardia lamblia
WISFPFIVLLLQFKPFFSQFFTA

SEQ ID NO: 3095631 - protein, 18 aa, Giardia lamblia
WIVFPFVAVLKQFRLFFN

SEQ ID NO: 3095632 - protein, 17 aa, Giardia lamblia
WLDILPFYNDISDLLDL

SEQ ID NO: 3095633 - protein, 18 aa, Giardia lamblia
WLDLILLLETSISGLVHS

SEQ ID NO: 3095634 - protein, 22 aa, Giardia lamblia
WLTKVFYVLFPPLGLVAICDML

SEQ ID NO: 3095635 - protein, 18 aa, Giardia lamblia
WMMRCVIEHFSVASSPFL

SEQ ID NO: 3095636 - protein, 22 aa, Giardia lamblia
WMVTILLFVAYLFATGVLFAVN

SEQ ID NO: 3095637 - protein, 17 aa, Giardia lamblia
WPLFVGLGCVLLLAVYA

SEQ ID NO: 3095638 - protein, 31 aa, Giardia lamblia
WRSPNFWFELLFYLFILISVLLYAFNIQRVV

SEQ ID NO: 3095639 - protein, 23 aa, Giardia lamblia
WSNPYVIALLYYSLLLSICNNRA

SEQ ID NO: 3095640 - protein, 17 aa, Giardia lamblia
WTFLWVLPLFWVIVLII

SEQ ID NO: 3095641 - protein, 24 aa, Giardia lamblia
WTLYRQLLVLFLTSFRVLVLSPCH

SEQ ID NO: 3095642 - protein, 17 aa, Giardia lamblia
WVIIINLNKYRLNSVFV

SEQ ID NO: 3095643 - protein, 21 aa, Giardia lamblia
WVWTLPFCAFMFFYDEMRKLV

SEQ ID NO: 3095644 - protein, 19 aa, Giardia lamblia
YAILTLRFLTTFMGGSLAL

SEQ ID NO: 3095645 - protein, 20 aa, Giardia lamblia
YAKDLYCLLYRNPFLHHLAK

SEQ ID NO: 3095646 - protein, 20 aa, Giardia lamblia
YASSLILLSPYRRFKMNLVC

SEQ ID NO: 3095647 - protein, 24 aa, Giardia lamblia
YCSRARRLFLLALFLDCVACPFLF

SEQ ID NO: 3095648 - protein, 17 aa, Giardia lamblia
YCVPKCFRWLFDIDWST

SEQ ID NO: 3095649 - protein, 21 aa, Giardia lamblia
YDIGWTVWPLALTVTVGILVT

SEQ ID NO: 3095650 - protein, 19 aa, Giardia lamblia
YDIGWTVWPLALTVTVGVL

SEQ ID NO: 3095651 - protein, 23 aa, Giardia lamblia
YDKKIFDFLLKKFSIVDDAYYLN

SEQ ID NO: 3095652 - protein, 19 aa, Giardia lamblia
YDLISAIVYFFLIIHACTG

SEQ ID NO: 3095653 - protein, 26 aa, Giardia lamblia
YDSYLPVEFLYTIALILFSSINIVGV

SEQ ID NO: 3095654 - protein, 25 aa, Giardia lamblia
YFDLRLIQVYLIFDKFRGCVSTLLF

SEQ ID NO: 3095655 - protein, 25 aa, Giardia lamblia
YFKDILEYFFIFATIWASGGTMFKD

SEQ ID NO: 3095656 - protein, 20 aa, Giardia lamblia
YFLAALVFLTLNFQLDLSID

SEQ ID NO: 3095657 - protein, 19 aa, Giardia lamblia
YFMPFISGLRIFYCLQLKT

SEQ ID NO: 3095658 - protein, 29 aa, Giardia lamblia
YGLQQLVTNLLWHLYCSLLFHRRTDVEVD

SEQ ID NO: 3095659 - protein, 17 aa, Giardia lamblia
YGYFVCSMLGILIYCGW

SEQ ID NO: 3095660 - protein, 20 aa, Giardia lamblia
YHPCIITSIYLLQFLKEQLS

SEQ ID NO: 3095661 - protein, 20 aa, Giardia lamblia
YIGFFTSLYYFIGYSFRFDD

SEQ ID NO: 3095662 - protein, 28 aa, Giardia lamblia
YILENVYFILFLKRLLQYLHFSRAKQRP

SEQ ID NO: 3095663 - protein, 17 aa, Giardia lamblia
YILLSLFMTLSVAFLCT

SEQ ID NO: 3095664 - protein, 27 aa, Giardia lamblia
YISPLDKLWYSLLYLKRTQTLQDSMAI

SEQ ID NO: 3095665 - protein, 18 aa, Giardia lamblia
YKLLTYQRLCGCAYVVSL

SEQ ID NO: 3095666 - protein, 18 aa, Giardia lamblia
YKVWIAFISVSIKLAALP

SEQ ID NO: 3095667 - protein, 20 aa, Giardia lamblia
YLLDQLFFYQAFTSFWKVVY

SEQ ID NO: 3095668 - protein, 17 aa, Giardia lamblia
YLPSLYGLKLRALTLMH

SEQ ID NO: 3095669 - protein, 22 aa, Giardia lamblia
YLTQIFMFLWLEGCGPYAFYKL

SEQ ID NO: 3095670 - protein, 18 aa, Giardia lamblia
YLVFMLLDTILYFLITWF

SEQ ID NO: 3095671 - protein, 18 aa, Giardia lamblia
YLVIVANYKLKYIQLFTV

SEQ ID NO: 3095672 - protein, 26 aa, Giardia lamblia
YLVPQSLRFLAISLLVFCNCILEKAA

SEQ ID NO: 3095673 - protein, 20 aa, Giardia lamblia
YLYFSFSILPGQYLNYKTMV

SEQ ID NO: 3095674 - protein, 19 aa, Giardia lamblia
YLYLFQRRYVFVRTLATSK

SEQ ID NO: 3095675 - protein, 24 aa, Giardia lamblia
YMDEGRLPFLSPMPYRAARLSNVQ

SEQ ID NO: 3095676 - protein, 17 aa, Giardia lamblia
YMNQFFLLPAEYGYLTT

SEQ ID NO: 3095677 - protein, 19 aa, Giardia lamblia
YMVLLIFINFLISNATMIS

SEQ ID NO: 3095678 - protein, 24 aa, Giardia lamblia
YPDLHIIFKLMTPPDTLLAPPMNS

SEQ ID NO: 3095679 - protein, 28 aa, Giardia lamblia
YPEFLTCLMFYLTPSWKKFSYKSLNIVP

SEQ ID NO: 3095680 - protein, 23 aa, Giardia lamblia
YPRFMFYTLAWFYPVIRTASKQG

SEQ ID NO: 3095681 - protein, 18 aa, Giardia lamblia
YPRLLILLDFIVCVTSVV

SEQ ID NO: 3095682 - protein, 21 aa, Giardia lamblia
YPWFGNFLMFFAMSLVGIGWA

SEQ ID NO: 3095683 - protein, 19 aa, Giardia lamblia
YRDFFIPPLSTMLSSRVKI

SEQ ID NO: 3095684 - protein, 23 aa, Giardia lamblia
YRINFLFLIFIVGIIQIMLTSTF

SEQ ID NO: 3095685 - protein, 20 aa, Giardia lamblia
YRPIAALIFPPALKPLTMEQ

SEQ ID NO: 3095686 - protein, 28 aa, Giardia lamblia
YRTWIPTLRLLVVSLLLYGIQHFSFLST

SEQ ID NO: 3095687 - protein, 31 aa, Giardia lamblia
YRVQVVLYIRLTLLKYTLISPIFVAWLTTIR

SEQ ID NO: 3095688 - protein, 19 aa, Giardia lamblia
YSFLLARKILFKITPHSGK

SEQ ID NO: 3095689 - protein, 21 aa, Giardia lamblia
YSGSLLFRKIAHMFKFCSSPF

SEQ ID NO: 3095690 - protein, 24 aa, Giardia lamblia
YSLVTFIRWIIILNAIIPLAMKVS

SEQ ID NO: 3095691 - protein, 17 aa, Giardia lamblia
YSRPWNWTFPLWVTWAT

SEQ ID NO: 3095692 - protein, 26 aa, Giardia lamblia
YSVFRYDLIVLFFKLQRLCYDSLKAI

SEQ ID NO: 3095693 - protein, 19 aa, Giardia lamblia
YTHTLFLCSILAILISLFS

SEQ ID NO: 3095694 - protein, 19 aa, Giardia lamblia
YTIVMLLLLFLQSADFAPP

SEQ ID NO: 3095695 - protein, 20 aa, Giardia lamblia
YVFERYLWKFVFELTAYEVK

SEQ ID NO: 3095696 - protein, 24 aa, Giardia lamblia
YVPILKLIALWFPIHKFGLLTGIM

SEQ ID NO: 3095697 - protein, 25 aa, Giardia lamblia
YVTLILLQVLIWTPLICTLIPSLKT

SEQ ID NO: 3095698 - protein, 17 aa, Giardia lamblia
YVVLRNLELFRISYDAV

SEQ ID NO: 3095699 - protein, 25 aa, Giardia lamblia
YVYICRFLVLLRRDIKFLFTTRVEI

SEQ ID NO: 3095700 - protein, 30 aa, Giardia lamblia
YWINSPWIINFVIIWLLYFGAVSFSFVMAS

SEQ ID NO: 3095701 - protein, 17 aa, Giardia lamblia
YYSIYRPISIRGALIYF

SEQ ID NO: 3095702 - protein, 20 aa, Giardia lamblia
YYSNIFLLNFTQIAPLNVSE

SEQ ID NO: 3095703 - protein, 18 aa, Giardia lamblia
YYVPDAMILCDFELALPS

SEQ ID NO: 3095704 - protein, 11 aa, Giardia lamblia
GNSMPGQVGPS

SEQ ID NO: 3095705 - protein, 8 aa, Giardia lamblia
IPEPPADE

SEQ ID NO: 3095706 - protein, 5 aa, Giardia lamblia
DLSGV

SEQ ID NO: 3095707 - protein, 5 aa, Giardia lamblia
NSPLS

SEQ ID NO: 3095708 - protein, 5 aa, Giardia lamblia
PGISG

SEQ ID NO: 3095709 - protein, 6 aa, Giardia lamblia
SKPAAH

SEQ ID NO: 3095710 - protein, 5 aa, Giardia lamblia
LNGAN

SEQ ID NO: 3095711 - protein, 7 aa, Giardia lamblia
GGKEPAE

SEQ ID NO: 3095712 - protein, 4 aa, Giardia lamblia
AGHT

SEQ ID NO: 3095713 - protein, 8 aa, Giardia lamblia
ERRPTARE

SEQ ID NO: 3095714 - protein, 5 aa, Giardia lamblia
NGRTE

SEQ ID NO: 3095715 - protein, 4 aa, Giardia lamblia
AGGY

SEQ ID NO: 3095716 - protein, 10 aa, Giardia lamblia
AKKSQQAEVK

SEQ ID NO: 3095717 - protein, 4 aa, Giardia lamblia
CGNQ

SEQ ID NO: 3095718 - protein, 9 aa, Giardia lamblia
EGRLRDAGK

SEQ ID NO: 3095719 - protein, 7 aa, Giardia lamblia
GLVSNDG

SEQ ID NO: 3095720 - protein, 8 aa, Giardia lamblia
HASRAKQF

SEQ ID NO: 3095721 - protein, 4 aa, Giardia lamblia
HDKT

SEQ ID NO: 3095722 - protein, 9 aa, Giardia lamblia
IDPTDENGV

SEQ ID NO: 3095723 - protein, 4 aa, Giardia lamblia
KRGN

SEQ ID NO: 3095724 - protein, 4 aa, Giardia lamblia
NGHQ

SEQ ID NO: 3095725 - protein, 5 aa, Giardia lamblia
NGHTE

SEQ ID NO: 3095726 - protein, 5 aa, Giardia lamblia
QRRGI

SEQ ID NO: 3095727 - protein, 4 aa, Giardia lamblia
RPSP

SEQ ID NO: 3095728 - protein, 7 aa, Giardia lamblia
TRGTCPG

SEQ ID NO: 3095729 - protein, 6 aa, Giardia lamblia
AENGHT

SEQ ID NO: 3095730 - protein, 5 aa, Giardia lamblia
AETGN

SEQ ID NO: 3095731 - protein, 5 aa, Giardia lamblia
AGGRY

SEQ ID NO: 3095732 - protein, 4 aa, Giardia lamblia
AGHA

SEQ ID NO: 3095733 - protein, 5 aa, Giardia lamblia
AGHGT

SEQ ID NO: 3095734 - protein, 5 aa, Giardia lamblia
AGKTT

SEQ ID NO: 3095735 - protein, 7 aa, Giardia lamblia
ALSEDRS

SEQ ID NO: 3095736 - protein, 5 aa, Giardia lamblia
APDRI

SEQ ID NO: 3095737 - protein, 5 aa, Giardia lamblia
APKQQ

SEQ ID NO: 3095738 - protein, 4 aa, Giardia lamblia
AQPN

SEQ ID NO: 3095739 - protein, 6 aa, Giardia lamblia
ARGDTE

SEQ ID NO: 3095740 - protein, 8 aa, Giardia lamblia
ASDPRHGR

SEQ ID NO: 3095741 - protein, 4 aa, Giardia lamblia
ASLP

SEQ ID NO: 3095742 - protein, 13 aa, Giardia lamblia
ASPDVNKGTRDPV

SEQ ID NO: 3095743 - protein, 4 aa, Giardia lamblia
ASRL

SEQ ID NO: 3095744 - protein, 8 aa, Giardia lamblia
CSTGSPSL

SEQ ID NO: 3095745 - protein, 6 aa, Giardia lamblia
DAAEGA

SEQ ID NO: 3095746 - protein, 7 aa, Giardia lamblia
DAKTKLD

SEQ ID NO: 3095747 - protein, 23 aa, Giardia lamblia
DARSAETASLKGTLEDQGKGHLA

SEQ ID NO: 3095748 - protein, 6 aa, Giardia lamblia
DHESNK

SEQ ID NO: 3095749 - protein, 24 aa, Giardia lamblia
DHPAHSPRDPSADSDFYIPGVDVC

SEQ ID NO: 3095750 - protein, 5 aa, Giardia lamblia
DNGCS

SEQ ID NO: 3095751 - protein, 9 aa, Giardia lamblia
DRIGSEGKT

SEQ ID NO: 3095752 - protein, 7 aa, Giardia lamblia
DSTLERP

SEQ ID NO: 3095753 - protein, 7 aa, Giardia lamblia
EAESNMN

SEQ ID NO: 3095754 - protein, 8 aa, Giardia lamblia
EASPASDV

SEQ ID NO: 3095755 - protein, 9 aa, Giardia lamblia
EDGMKTNNG

SEQ ID NO: 3095756 - protein, 17 aa, Giardia lamblia
EDPPGSTAPLFASIRPA

SEQ ID NO: 3095757 - protein, 13 aa, Giardia lamblia
EERALKEKGGSIM

SEQ ID NO: 3095758 - protein, 4 aa, Giardia lamblia
EEYP

SEQ ID NO: 3095759 - protein, 4 aa, Giardia lamblia
EGHT

SEQ ID NO: 3095760 - protein, 7 aa, Giardia lamblia
EKGMQTT

SEQ ID NO: 3095761 - protein, 6 aa, Giardia lamblia
EQAGTG

SEQ ID NO: 3095762 - protein, 8 aa, Giardia lamblia
ERRPTASE

SEQ ID NO: 3095763 - protein, 24 aa, Giardia lamblia
FGATDDGDSPNPGILQRVKRPQVL

SEQ ID NO: 3095764 - protein, 7 aa, Giardia lamblia
GAPTTTS

SEQ ID NO: 3095765 - protein, 4 aa, Giardia lamblia
GDGP

SEQ ID NO: 3095766 - protein, 8 aa, Giardia lamblia
GGGTGAGM

SEQ ID NO: 3095767 - protein, 15 aa, Giardia lamblia
GGQQGPATPSWSATT

SEQ ID NO: 3095768 - protein, 4 aa, Giardia lamblia
GGVK

SEQ ID NO: 3095769 - protein, 9 aa, Giardia lamblia
GHSPGTTAL

SEQ ID NO: 3095770 - protein, 7 aa, Giardia lamblia
GHYTEGA

SEQ ID NO: 3095771 - protein, 15 aa, Giardia lamblia
GIDQGAEISEEQLNK

SEQ ID NO: 3095772 - protein, 6 aa, Giardia lamblia
GKCENP

SEQ ID NO: 3095773 - protein, 5 aa, Giardia lamblia
GKDVA

SEQ ID NO: 3095774 - protein, 9 aa, Giardia lamblia
GQALQGKGT

SEQ ID NO: 3095775 - protein, 4 aa, Giardia lamblia
GRRE

SEQ ID NO: 3095776 - protein, 6 aa, Giardia lamblia
GVVPGP

SEQ ID NO: 3095777 - protein, 14 aa, Giardia lamblia
HGVDPSGEYRGDSE

SEQ ID NO: 3095778 - protein, 9 aa, Giardia lamblia
HLSDQNQKP

SEQ ID NO: 3095779 - protein, 4 aa, Giardia lamblia
HTAQ

SEQ ID NO: 3095780 - protein, 4 aa, Giardia lamblia
ISDG

SEQ ID NO: 3095781 - protein, 14 aa, Giardia lamblia
KAADAGQRDADGKT

SEQ ID NO: 3095782 - protein, 10 aa, Giardia lamblia
KEGGMRANSG

SEQ ID NO: 3095783 - protein, 8 aa, Giardia lamblia
KESDGYRP

SEQ ID NO: 3095784 - protein, 5 aa, Giardia lamblia
KESEA

SEQ ID NO: 3095785 - protein, 4 aa, Giardia lamblia
KGHA

SEQ ID NO: 3095786 - protein, 4 aa, Giardia lamblia
KGHP

SEQ ID NO: 3095787 - protein, 7 aa, Giardia lamblia
KGKEPAE

SEQ ID NO: 3095788 - protein, 4 aa, Giardia lamblia
KGYT

SEQ ID NO: 3095789 - protein, 7 aa, Giardia lamblia
KKKDRKE

SEQ ID NO: 3095790 - protein, 10 aa, Giardia lamblia
KNEVGTLTPE

SEQ ID NO: 3095791 - protein, 5 aa, Giardia lamblia
KRGRI

SEQ ID NO: 3095792 - protein, 6 aa, Giardia lamblia
KRNDVD

SEQ ID NO: 3095793 - protein, 16 aa, Giardia lamblia
KSKRHSKEKDTLGGIT

SEQ ID NO: 3095794 - protein, 4 aa, Giardia lamblia
LDPD

SEQ ID NO: 3095795 - protein, 6 aa, Giardia lamblia
LDPSGC

SEQ ID NO: 3095796 - protein, 7 aa, Giardia lamblia
LTSRGSQ

SEQ ID NO: 3095797 - protein, 4 aa, Giardia lamblia
NDVE

SEQ ID NO: 3095798 - protein, 8 aa, Giardia lamblia
NEPSPASD

SEQ ID NO: 3095799 - protein, 4 aa, Giardia lamblia
NGDI

SEQ ID NO: 3095800 - protein, 4 aa, Giardia lamblia
NGEL

SEQ ID NO: 3095801 - protein, 4 aa, Giardia lamblia
NGHA

SEQ ID NO: 3095802 - protein, 4 aa, Giardia lamblia
NGHP

SEQ ID NO: 3095803 - protein, 4 aa, Giardia lamblia
NGHT

SEQ ID NO: 3095804 - protein, 5 aa, Giardia lamblia
NKNSS

SEQ ID NO: 3095805 - protein, 4 aa, Giardia lamblia
NNHP

SEQ ID NO: 3095806 - protein, 4 aa, Giardia lamblia
NSSI

SEQ ID NO: 3095807 - protein, 7 aa, Giardia lamblia
NTAGPQS

SEQ ID NO: 3095808 - protein, 4 aa, Giardia lamblia
NTQS

SEQ ID NO: 3095809 - protein, 4 aa, Giardia lamblia
PDLS

SEQ ID NO: 3095810 - protein, 5 aa, Giardia lamblia
PGTMD

SEQ ID NO: 3095811 - protein, 4 aa, Giardia lamblia
PNPL

SEQ ID NO: 3095812 - protein, 6 aa, Giardia lamblia
PPGTTA

SEQ ID NO: 3095813 - protein, 4 aa, Giardia lamblia
PPRG

SEQ ID NO: 3095814 - protein, 4 aa, Giardia lamblia
PPSL

SEQ ID NO: 3095815 - protein, 9 aa, Giardia lamblia
PSCRRTGTT

SEQ ID NO: 3095816 - protein, 7 aa, Giardia lamblia
PSPKVSD

SEQ ID NO: 3095817 - protein, 7 aa, Giardia lamblia
PTDEDGV

SEQ ID NO: 3095818 - protein, 7 aa, Giardia lamblia
PTDENGV

SEQ ID NO: 3095819 - protein, 7 aa, Giardia lamblia
QQGHGGP

SEQ ID NO: 3095820 - protein, 24 aa, Giardia lamblia
QQYQEAGVDEGEEFEEEEDFGDEY

SEQ ID NO: 3095821 - protein, 14 aa, Giardia lamblia
QRPSDSGGPPYKSV

SEQ ID NO: 3095822 - protein, 7 aa, Giardia lamblia
QSETREM

SEQ ID NO: 3095823 - protein, 8 aa, Giardia lamblia
QSGAGNNW

SEQ ID NO: 3095824 - protein, 4 aa, Giardia lamblia
RAGP

SEQ ID NO: 3095825 - protein, 5 aa, Giardia lamblia
RGHTP

SEQ ID NO: 3095826 - protein, 4 aa, Giardia lamblia
RGSV

SEQ ID NO: 3095827 - protein, 4 aa, Giardia lamblia
RGYS

SEQ ID NO: 3095828 - protein, 10 aa, Giardia lamblia
RGYTAGNVAD

SEQ ID NO: 3095829 - protein, 7 aa, Giardia lamblia
RKTPVSP

SEQ ID NO: 3095830 - protein, 4 aa, Giardia lamblia
RSGE

SEQ ID NO: 3095831 - protein, 4 aa, Giardia lamblia
RTQD

SEQ ID NO: 3095832 - protein, 9 aa, Giardia lamblia
RTRGITASE

SEQ ID NO: 3095833 - protein, 17 aa, Giardia lamblia
RTSHPPRGASPSTAYTS

SEQ ID NO: 3095834 - protein, 6 aa, Giardia lamblia
SGANTR

SEQ ID NO: 3095835 - protein, 4 aa, Giardia lamblia
SKKY

SEQ ID NO: 3095836 - protein, 12 aa, Giardia lamblia
SKTADTEPFPGE

SEQ ID NO: 3095837 - protein, 20 aa, Giardia lamblia
SRASDAVSSSLAGRFSDDEL

SEQ ID NO: 3095838 - protein, 4 aa, Giardia lamblia
SSLD

SEQ ID NO: 3095839 - protein, 4 aa, Giardia lamblia
SSTA

SEQ ID NO: 3095840 - protein, 6 aa, Giardia lamblia
TGEDRR

SEQ ID NO: 3095841 - protein, 5 aa, Giardia lamblia
TKEVD

SEQ ID NO: 3095842 - protein, 18 aa, Giardia lamblia
TKKYASQAVEEDQNRLGQ

SEQ ID NO: 3095843 - protein, 4 aa, Giardia lamblia
TNGM

SEQ ID NO: 3095844 - protein, 4 aa, Giardia lamblia
TSRL

SEQ ID NO: 3095845 - protein, 7 aa, Giardia lamblia
TTLNSAN

SEQ ID NO: 3095846 - protein, 8 aa, Giardia lamblia
VGQRDAQG

SEQ ID NO: 3095847 - protein, 4 aa, Giardia lamblia
VPPE

SEQ ID NO: 3095848 - protein, 5 aa, Giardia lamblia
VPSQT

SEQ ID NO: 3095849 - protein, 4 aa, Giardia lamblia
VPVP

SEQ ID NO: 3095850 - protein, 7 aa, Giardia lamblia
YAGLQET

SEQ ID NO: 3095851 - protein, 5 aa, Giardia lamblia
YISSR

SEQ ID NO: 3095852 - protein, 13 aa, Giardia lamblia
YTEHGQRKTVTSQ

SEQ ID NO: 3095853 - protein, 21 aa, Giardia lamblia
AAAEARYAEKVRDTQAMEEEV

SEQ ID NO: 3095854 - protein, 7 aa, Giardia lamblia
AAAEDRV

SEQ ID NO: 3095855 - protein, 7 aa, Giardia lamblia
AAAEPAI

SEQ ID NO: 3095856 - protein, 28 aa, Giardia lamblia
AAAGTEALADAAEKFRAKAQQAQGGDEA

SEQ ID NO: 3095857 - protein, 8 aa, Giardia lamblia
AAAPADDD

SEQ ID NO: 3095858 - protein, 13 aa, Giardia lamblia
AAARQEVEAARGE

SEQ ID NO: 3095859 - protein, 6 aa, Giardia lamblia
AADARR

SEQ ID NO: 3095860 - protein, 4 aa, Giardia lamblia
AAEA

SEQ ID NO: 3095861 - protein, 9 aa, Giardia lamblia
AAESQAQAL

SEQ ID NO: 3095862 - protein, 4 aa, Giardia lamblia
AAET

SEQ ID NO: 3095863 - protein, 9 aa, Giardia lamblia
AAGPGGLGE

SEQ ID NO: 3095864 - protein, 10 aa, Giardia lamblia
AANNEPPDQR

SEQ ID NO: 3095865 - protein, 17 aa, Giardia lamblia
AAQDPRSLESEEPGAAA

SEQ ID NO: 3095866 - protein, 9 aa, Giardia lamblia
AASPAETQV

SEQ ID NO: 3095867 - protein, 9 aa, Giardia lamblia
AATNSPAKT

SEQ ID NO: 3095868 - protein, 9 aa, Giardia lamblia
ADAKKPDAA

SEQ ID NO: 3095869 - protein, 8 aa, Giardia lamblia
ADAVRSNL

SEQ ID NO: 3095870 - protein, 9 aa, Giardia lamblia
ADGDAEDIG

SEQ ID NO: 3095871 - protein, 21 aa, Giardia lamblia
ADGLRGSATWAPSEAQPALGP

SEQ ID NO: 3095872 - protein, 11 aa, Giardia lamblia
ADHGDAAQQLQ

SEQ ID NO: 3095873 - protein, 10 aa, Giardia lamblia
ADIADSRGRT

SEQ ID NO: 3095874 - protein, 14 aa, Giardia lamblia
ADKDGISAVPSDAY

SEQ ID NO: 3095875 - protein, 8 aa, Giardia lamblia
ADSAPSEV

SEQ ID NO: 3095876 - protein, 4 aa, Giardia lamblia
ADSG

SEQ ID NO: 3095877 - protein, 5 aa, Giardia lamblia
ADYPG

SEQ ID NO: 3095878 - protein, 8 aa, Giardia lamblia
AEAPGRDL

SEQ ID NO: 3095879 - protein, 11 aa, Giardia lamblia
AEAQDALQTAR

SEQ ID NO: 3095880 - protein, 9 aa, Giardia lamblia
AEGGAPAVA

SEQ ID NO: 3095881 - protein, 7 aa, Giardia lamblia
AEGNPLE

SEQ ID NO: 3095882 - protein, 4 aa, Giardia lamblia
AEKT

SEQ ID NO: 3095883 - protein, 16 aa, Giardia lamblia
AELEAQAKAAEERLAD

SEQ ID NO: 3095884 - protein, 10 aa, Giardia lamblia
AELGSGAHGT

SEQ ID NO: 3095885 - protein, 6 aa, Giardia lamblia
AERGEP

SEQ ID NO: 3095886 - protein, 4 aa, Giardia lamblia
AESL

SEQ ID NO: 3095887 - protein, 12 aa, Giardia lamblia
AEYGGSPAPGLA

SEQ ID NO: 3095888 - protein, 4 aa, Giardia lamblia
AGAQ

SEQ ID NO: 3095889 - protein, 8 aa, Giardia lamblia
AGAQTRDC

SEQ ID NO: 3095890 - protein, 4 aa, Giardia lamblia
AGDL

SEQ ID NO: 3095891 - protein, 10 aa, Giardia lamblia
AGFQKNDGTA

SEQ ID NO: 3095892 - protein, 11 aa, Giardia lamblia
AGGPAEAAQGP

SEQ ID NO: 3095893 - protein, 8 aa, Giardia lamblia
AGGRPPFL

SEQ ID NO: 3095894 - protein, 4 aa, Giardia lamblia
AGHD

SEQ ID NO: 3095895 - protein, 5 aa, Giardia lamblia
AGKYA

SEQ ID NO: 3095896 - protein, 5 aa, Giardia lamblia
AGMQK

SEQ ID NO: 3095897 - protein, 4 aa, Giardia lamblia
AGNE

SEQ ID NO: 3095898 - protein, 4 aa, Giardia lamblia
AGNM

SEQ ID NO: 3095899 - protein, 7 aa, Giardia lamblia
AGPCAGH

SEQ ID NO: 3095900 - protein, 4 aa, Giardia lamblia
AGPT

SEQ ID NO: 3095901 - protein, 7 aa, Giardia lamblia
AGSARPG

SEQ ID NO: 3095902 - protein, 9 aa, Giardia lamblia
AGSITNSRT

SEQ ID NO: 3095903 - protein, 4 aa, Giardia lamblia
AGSY

SEQ ID NO: 3095904 - protein, 4 aa, Giardia lamblia
AGTL

SEQ ID NO: 3095905 - protein, 4 aa, Giardia lamblia
AIAA

SEQ ID NO: 3095906 - protein, 22 aa, Giardia lamblia
AKAPAVSSTSSSELKAQGNAAF

SEQ ID NO: 3095907 - protein, 6 aa, Giardia lamblia
AKPGAI

SEQ ID NO: 3095908 - protein, 4 aa, Giardia lamblia
AKPL

SEQ ID NO: 3095909 - protein, 6 aa, Giardia lamblia
AKPRGR

SEQ ID NO: 3095910 - protein, 7 aa, Giardia lamblia
AKRNDVD

SEQ ID NO: 3095911 - protein, 7 aa, Giardia lamblia
AKSRNNR

SEQ ID NO: 3095912 - protein, 4 aa, Giardia lamblia
ALDP

SEQ ID NO: 3095913 - protein, 8 aa, Giardia lamblia
ALNSANAR

SEQ ID NO: 3095914 - protein, 5 aa, Giardia lamblia
ALPPM

SEQ ID NO: 3095915 - protein, 7 aa, Giardia lamblia
ALQESAE

SEQ ID NO: 3095916 - protein, 4 aa, Giardia lamblia
ANVT

SEQ ID NO: 3095917 - protein, 4 aa, Giardia lamblia
ANYE

SEQ ID NO: 3095918 - protein, 9 aa, Giardia lamblia
APASEADAG

SEQ ID NO: 3095919 - protein, 5 aa, Giardia lamblia
APDPG

SEQ ID NO: 3095920 - protein, 8 aa, Giardia lamblia
APDRGAAL

SEQ ID NO: 3095921 - protein, 4 aa, Giardia lamblia
APEL

SEQ ID NO: 3095922 - protein, 9 aa, Giardia lamblia
APPPTSQEL

SEQ ID NO: 3095923 - protein, 40 aa, Giardia lamblia
APPSSSAAGVAQARQIESAASRDPHAEVQDSSSGSNSDAL

SEQ ID NO: 3095924 - protein, 10 aa, Giardia lamblia
APQSAGAATC

SEQ ID NO: 3095925 - protein, 9 aa, Giardia lamblia
APSARPCNA

SEQ ID NO: 3095926 - protein, 4 aa, Giardia lamblia
APSK

SEQ ID NO: 3095927 - protein, 5 aa, Giardia lamblia
APVEP

SEQ ID NO: 3095928 - protein, 9 aa, Giardia lamblia
APVQPTPIA

SEQ ID NO: 3095929 - protein, 8 aa, Giardia lamblia
APYQAGRQ

SEQ ID NO: 3095930 - protein, 10 aa, Giardia lamblia
AQAPGGAETE

SEQ ID NO: 3095931 - protein, 6 aa, Giardia lamblia
AQNGYT

SEQ ID NO: 3095932 - protein, 4 aa, Giardia lamblia
ARDA

SEQ ID NO: 3095933 - protein, 8 aa, Giardia lamblia
ARKPSPKG

SEQ ID NO: 3095934 - protein, 10 aa, Giardia lamblia
ARMKDSDGKT

SEQ ID NO: 3095935 - protein, 4 aa, Giardia lamblia
ARNT

SEQ ID NO: 3095936 - protein, 8 aa, Giardia lamblia
ARSGAGEW

SEQ ID NO: 3095937 - protein, 8 aa, Giardia lamblia
ARSPTEIQ

SEQ ID NO: 3095938 - protein, 8 aa, Giardia lamblia
ASAPPAGP

SEQ ID NO: 3095939 - protein, 16 aa, Giardia lamblia
ASARGGGEESDASRQI

SEQ ID NO: 3095940 - protein, 5 aa, Giardia lamblia
ASFSN

SEQ ID NO: 3095941 - protein, 5 aa, Giardia lamblia
ASKDV

SEQ ID NO: 3095942 - protein, 5 aa, Giardia lamblia
ASPSA

SEQ ID NO: 3095943 - protein, 7 aa, Giardia lamblia
ASRNDVK

SEQ ID NO: 3095944 - protein, 9 aa, Giardia lamblia
ASRPCATQD

SEQ ID NO: 3095945 - protein, 5 aa, Giardia lamblia
ATADR

SEQ ID NO: 3095946 - protein, 9 aa, Giardia lamblia
ATEGNPKHA

SEQ ID NO: 3095947 - protein, 4 aa, Giardia lamblia
ATSS

SEQ ID NO: 3095948 - protein, 7 aa, Giardia lamblia
AVEDTDN

SEQ ID NO: 3095949 - protein, 7 aa, Giardia lamblia
AVGHPSQ

SEQ ID NO: 3095950 - protein, 4 aa, Giardia lamblia
AYSQ

SEQ ID NO: 3095951 - protein, 4 aa, Giardia lamblia
AYSR

SEQ ID NO: 3095952 - protein, 8 aa, Giardia lamblia
CDAKGSPA

SEQ ID NO: 3095953 - protein, 16 aa, Giardia lamblia
CGSGNDKYADEATRTC

SEQ ID NO: 3095954 - protein, 4 aa, Giardia lamblia
CPSG

SEQ ID NO: 3095955 - protein, 6 aa, Giardia lamblia
DAADPR

SEQ ID NO: 3095956 - protein, 12 aa, Giardia lamblia
DAGYPNVPPPER

SEQ ID NO: 3095957 - protein, 6 aa, Giardia lamblia
DALEDQ

SEQ ID NO: 3095958 - protein, 9 aa, Giardia lamblia
DALEDQSKE

SEQ ID NO: 3095959 - protein, 4 aa, Giardia lamblia
DAQS

SEQ ID NO: 3095960 - protein, 18 aa, Giardia lamblia
DARSTEMVSQSTETASLK

SEQ ID NO: 3095961 - protein, 19 aa, Giardia lamblia
DAVASGAASPRLAQTTTDY

SEQ ID NO: 3095962 - protein, 4 aa, Giardia lamblia
DDAV

SEQ ID NO: 3095963 - protein, 4 aa, Giardia lamblia
DDGL

SEQ ID NO: 3095964 - protein, 15 aa, Giardia lamblia
DDGQVKYSKERYDEI

SEQ ID NO: 3095965 - protein, 16 aa, Giardia lamblia
DDKTNTSSPPNKGLKD

SEQ ID NO: 3095966 - protein, 7 aa, Giardia lamblia
DDSNARR

SEQ ID NO: 3095967 - protein, 4 aa, Giardia lamblia
DDTE

SEQ ID NO: 3095968 - protein, 7 aa, Giardia lamblia
DDTTKDL

SEQ ID NO: 3095969 - protein, 8 aa, Giardia lamblia
DEGSPDHG

SEQ ID NO: 3095970 - protein, 7 aa, Giardia lamblia
DENDQSA

SEQ ID NO: 3095971 - protein, 4 aa, Giardia lamblia
DENG

SEQ ID NO: 3095972 - protein, 5 aa, Giardia lamblia
DENLS

SEQ ID NO: 3095973 - protein, 4 aa, Giardia lamblia
DEPS

SEQ ID NO: 3095974 - protein, 17 aa, Giardia lamblia
DEPTKKRSKSRAQGSAK

SEQ ID NO: 3095975 - protein, 9 aa, Giardia lamblia
DETNSQALR

SEQ ID NO: 3095976 - protein, 10 aa, Giardia lamblia
DFADNDSQRK

SEQ ID NO: 3095977 - protein, 5 aa, Giardia lamblia
DFKGK

SEQ ID NO: 3095978 - protein, 10 aa, Giardia lamblia
DFSESEAKQI

SEQ ID NO: 3095979 - protein, 4 aa, Giardia lamblia
DGDL

SEQ ID NO: 3095980 - protein, 15 aa, Giardia lamblia
DGQMPSDKTIGGGDD

SEQ ID NO: 3095981 - protein, 4 aa, Giardia lamblia
DGSL

SEQ ID NO: 3095982 - protein, 4 aa, Giardia lamblia
DGSV

SEQ ID NO: 3095983 - protein, 12 aa, Giardia lamblia
DGYYKNSQTCER

SEQ ID NO: 3095984 - protein, 8 aa, Giardia lamblia
DKETGKPV

SEQ ID NO: 3095985 - protein, 10 aa, Giardia lamblia
DKETRTDSAG

SEQ ID NO: 3095986 - protein, 8 aa, Giardia lamblia
DKPNPRGE

SEQ ID NO: 3095987 - protein, 5 aa, Giardia lamblia
DKRGY

SEQ ID NO: 3095988 - protein, 5 aa, Giardia lamblia
DKRQD

SEQ ID NO: 3095989 - protein, 9 aa, Giardia lamblia
DKSKVPTKA

SEQ ID NO: 3095990 - protein, 9 aa, Giardia lamblia
DLQNSDDSV

SEQ ID NO: 3095991 - protein, 4 aa, Giardia lamblia
DNCS

SEQ ID NO: 3095992 - protein, 8 aa, Giardia lamblia
DNGKSTLT

SEQ ID NO: 3095993 - protein, 14 aa, Giardia lamblia
DNSTNNPANINTAG

SEQ ID NO: 3095994 - protein, 4 aa, Giardia lamblia
DPDA

SEQ ID NO: 3095995 - protein, 4 aa, Giardia lamblia
DPDT

SEQ ID NO: 3095996 - protein, 4 aa, Giardia lamblia
DPEM

SEQ ID NO: 3095997 - protein, 4 aa, Giardia lamblia
DPET

SEQ ID NO: 3095998 - protein, 7 aa, Giardia lamblia
DPKKPIG

SEQ ID NO: 3095999 - protein, 4 aa, Giardia lamblia
DPLQ

SEQ ID NO: 3096000 - protein, 7 aa, Giardia lamblia
DPLSPGV

SEQ ID NO: 3096001 - protein, 8 aa, Giardia lamblia
DPVSNNSD

SEQ ID NO: 3096002 - protein, 6 aa, Giardia lamblia
DQEDPH

SEQ ID NO: 3096003 - protein, 4 aa, Giardia lamblia
DQQA

SEQ ID NO: 3096004 - protein, 18 aa, Giardia lamblia
DQRTIDEYEKRATEMGKG

SEQ ID NO: 3096005 - protein, 4 aa, Giardia lamblia
DQSD

SEQ ID NO: 3096006 - protein, 4 aa, Giardia lamblia
DRDG

SEQ ID NO: 3096007 - protein, 8 aa, Giardia lamblia
DRNRTVAA

SEQ ID NO: 3096008 - protein, 7 aa, Giardia lamblia
DSANREE

SEQ ID NO: 3096009 - protein, 4 aa, Giardia lamblia
DSAV

SEQ ID NO: 3096010 - protein, 5 aa, Giardia lamblia
DSHGH

SEQ ID NO: 3096011 - protein, 4 aa, Giardia lamblia
DSIN

SEQ ID NO: 3096012 - protein, 4 aa, Giardia lamblia
DSQG

SEQ ID NO: 3096013 - protein, 4 aa, Giardia lamblia
DSRS

SEQ ID NO: 3096014 - protein, 6 aa, Giardia lamblia
DTTTDG

SEQ ID NO: 3096015 - protein, 5 aa, Giardia lamblia
DVKPS

SEQ ID NO: 3096016 - protein, 23 aa, Giardia lamblia
DYEEIGAETLGDGEGEDMEEDDA

SEQ ID NO: 3096017 - protein, 17 aa, Giardia lamblia
EADKALSKFTSSKESTK

SEQ ID NO: 3096018 - protein, 4 aa, Giardia lamblia
EAEL

SEQ ID NO: 3096019 - protein, 4 aa, Giardia lamblia
EAGN

SEQ ID NO: 3096020 - protein, 8 aa, Giardia lamblia
EAISAEAP

SEQ ID NO: 3096021 - protein, 8 aa, Giardia lamblia
EANKATRA

SEQ ID NO: 3096022 - protein, 24 aa, Giardia lamblia
EAPAPPPSPDAPQQRPMPPSPGAR

SEQ ID NO: 3096023 - protein, 5 aa, Giardia lamblia
EAPSW

SEQ ID NO: 3096024 - protein, 12 aa, Giardia lamblia
EAQTDGTQRSCS

SEQ ID NO: 3096025 - protein, 4 aa, Giardia lamblia
EASE

SEQ ID NO: 3096026 - protein, 7 aa, Giardia lamblia
EASPASD

SEQ ID NO: 3096027 - protein, 7 aa, Giardia lamblia
EATKQEG

SEQ ID NO: 3096028 - protein, 4 aa, Giardia lamblia
EATP

SEQ ID NO: 3096029 - protein, 4 aa, Giardia lamblia
EDGN

SEQ ID NO: 3096030 - protein, 6 aa, Giardia lamblia
EDGPRY

SEQ ID NO: 3096031 - protein, 9 aa, Giardia lamblia
EDPTEEDLE

SEQ ID NO: 3096032 - protein, 14 aa, Giardia lamblia
EEARAADEARHQQA

SEQ ID NO: 3096033 - protein, 4 aa, Giardia lamblia
EEDR

SEQ ID NO: 3096034 - protein, 4 aa, Giardia lamblia
EEET

SEQ ID NO: 3096035 - protein, 4 aa, Giardia lamblia
EEHA

SEQ ID NO: 3096036 - protein, 4 aa, Giardia lamblia
EEKR

SEQ ID NO: 3096037 - protein, 4 aa, Giardia lamblia
EELR

SEQ ID NO: 3096038 - protein, 4 aa, Giardia lamblia
EEPI

SEQ ID NO: 3096039 - protein, 4 aa, Giardia lamblia
EEPL

SEQ ID NO: 3096040 - protein, 8 aa, Giardia lamblia
EEPTPASD

SEQ ID NO: 3096041 - protein, 7 aa, Giardia lamblia
EEQHRAA

SEQ ID NO: 3096042 - protein, 9 aa, Giardia lamblia
EERDPSPGL

SEQ ID NO: 3096043 - protein, 5 aa, Giardia lamblia
EEVEA

SEQ ID NO: 3096044 - protein, 11 aa, Giardia lamblia
EGGMKTDDGKT

SEQ ID NO: 3096045 - protein, 12 aa, Giardia lamblia
EGGMQDNKGRTA

SEQ ID NO: 3096046 - protein, 11 aa, Giardia lamblia
EGGMQKSDGST

SEQ ID NO: 3096047 - protein, 11 aa, Giardia lamblia
EGGMRDRNGKT

SEQ ID NO: 3096048 - protein, 22 aa, Giardia lamblia
EGGVARSAKEGREGKGSHRSQD

SEQ ID NO: 3096049 - protein, 9 aa, Giardia lamblia
EGKEASSAK

SEQ ID NO: 3096050 - protein, 5 aa, Giardia lamblia
EGVGL

SEQ ID NO: 3096051 - protein, 6 aa, Giardia lamblia
EGYPAG

SEQ ID NO: 3096052 - protein, 6 aa, Giardia lamblia
EHEKAA

SEQ ID NO: 3096053 - protein, 6 aa, Giardia lamblia
EINQNR

SEQ ID NO: 3096054 - protein, 5 aa, Giardia lamblia
EKAYH

SEQ ID NO: 3096055 - protein, 7 aa, Giardia lamblia
EKDREIK

SEQ ID NO: 3096056 - protein, 7 aa, Giardia lamblia
EKDSAEA

SEQ ID NO: 3096057 - protein, 10 aa, Giardia lamblia
EKGLKDKNGW

SEQ ID NO: 3096058 - protein, 4 aa, Giardia lamblia
EKGS

SEQ ID NO: 3096059 - protein, 19 aa, Giardia lamblia
EKTQKPVAESDSPDKKPRR

SEQ ID NO: 3096060 - protein, 4 aa, Giardia lamblia
ELDG

SEQ ID NO: 3096061 - protein, 5 aa, Giardia lamblia
ELEEK

SEQ ID NO: 3096062 - protein, 21 aa, Giardia lamblia
ELSGSSDGTGEPPDEPPIKRA

SEQ ID NO: 3096063 - protein, 4 aa, Giardia lamblia
ELST

SEQ ID NO: 3096064 - protein, 11 aa, Giardia lamblia
ENAQPNKTGTT

SEQ ID NO: 3096065 - protein, 5 aa, Giardia lamblia
ENGHT

SEQ ID NO: 3096066 - protein, 9 aa, Giardia lamblia
ENGLRDKSG

SEQ ID NO: 3096067 - protein, 14 aa, Giardia lamblia
ENIRSEADTDLGIS

SEQ ID NO: 3096068 - protein, 12 aa, Giardia lamblia
EPAPKPHPPEYT

SEQ ID NO: 3096069 - protein, 11 aa, Giardia lamblia
EPISPRLPGSI

SEQ ID NO: 3096070 - protein, 4 aa, Giardia lamblia
EPLP

SEQ ID NO: 3096071 - protein, 7 aa, Giardia lamblia
EPSPASD

SEQ ID NO: 3096072 - protein, 11 aa, Giardia lamblia
EPTLAPGPSRV

SEQ ID NO: 3096073 - protein, 19 aa, Giardia lamblia
EQAAEDAVRARDAEALAER

SEQ ID NO: 3096074 - protein, 4 aa, Giardia lamblia
EQDL

SEQ ID NO: 3096075 - protein, 12 aa, Giardia lamblia
EQEGHTSPPTQR

SEQ ID NO: 3096076 - protein, 4 aa, Giardia lamblia
EQQG

SEQ ID NO: 3096077 - protein, 8 aa, Giardia lamblia
EQVSEEQR

SEQ ID NO: 3096078 - protein, 22 aa, Giardia lamblia
ERAPPQPAEQPPPLTADDEDNI

SEQ ID NO: 3096079 - protein, 15 aa, Giardia lamblia
ERDDLRAKVDEQAAA

SEQ ID NO: 3096080 - protein, 4 aa, Giardia lamblia
ERET

SEQ ID NO: 3096081 - protein, 4 aa, Giardia lamblia
ERGS

SEQ ID NO: 3096082 - protein, 4 aa, Giardia lamblia
ERIS

SEQ ID NO: 3096083 - protein, 4 aa, Giardia lamblia
ERPP

SEQ ID NO: 3096084 - protein, 6 aa, Giardia lamblia
ERPTYT

SEQ ID NO: 3096085 - protein, 8 aa, Giardia lamblia
ERSLSRDE

SEQ ID NO: 3096086 - protein, 6 aa, Giardia lamblia
ERSTDE

SEQ ID NO: 3096087 - protein, 10 aa, Giardia lamblia
ERVDGTPAVS

SEQ ID NO: 3096088 - protein, 6 aa, Giardia lamblia
ESGMKD

SEQ ID NO: 3096089 - protein, 4 aa, Giardia lamblia
ESLP

SEQ ID NO: 3096090 - protein, 4 aa, Giardia lamblia
ESLQ

SEQ ID NO: 3096091 - protein, 5 aa, Giardia lamblia
ESNQV

SEQ ID NO: 3096092 - protein, 4 aa, Giardia lamblia
ESRF

SEQ ID NO: 3096093 - protein, 8 aa, Giardia lamblia
ESTHKGTG

SEQ ID NO: 3096094 - protein, 8 aa, Giardia lamblia
ESVTPTSL

SEQ ID NO: 3096095 - protein, 12 aa, Giardia lamblia
ETDFNTDPEPRI

SEQ ID NO: 3096096 - protein, 8 aa, Giardia lamblia
ETGAGKHV

SEQ ID NO: 3096097 - protein, 6 aa, Giardia lamblia
ETSHAS

SEQ ID NO: 3096098 - protein, 10 aa, Giardia lamblia
ETSNQDFQGK

SEQ ID NO: 3096099 - protein, 5 aa, Giardia lamblia
ETTSL

SEQ ID NO: 3096100 - protein, 11 aa, Giardia lamblia
FAPTPSAAPNV

SEQ ID NO: 3096101 - protein, 10 aa, Giardia lamblia
FESDEEAREF

SEQ ID NO: 3096102 - protein, 13 aa, Giardia lamblia
FGDSHGRAALIIA

SEQ ID NO: 3096103 - protein, 14 aa, Giardia lamblia
FGGDSSSSEEESSS

SEQ ID NO: 3096104 - protein, 8 aa, Giardia lamblia
FPDSPSGE

SEQ ID NO: 3096105 - protein, 4 aa, Giardia lamblia
FPPE

SEQ ID NO: 3096106 - protein, 13 aa, Giardia lamblia
FPSSDGSACPQRT

SEQ ID NO: 3096107 - protein, 4 aa, Giardia lamblia
FRAN

SEQ ID NO: 3096108 - protein, 13 aa, Giardia lamblia
FSPDTEGRKGEQF

SEQ ID NO: 3096109 - protein, 16 aa, Giardia lamblia
GADPFSNSYGGSSGGR

SEQ ID NO: 3096110 - protein, 17 aa, Giardia lamblia
GAGRISPPLSANTPTPI

SEQ ID NO: 3096111 - protein, 8 aa, Giardia lamblia
GAPSPAMT

SEQ ID NO: 3096112 - protein, 4 aa, Giardia lamblia
GAVP

SEQ ID NO: 3096113 - protein, 9 aa, Giardia lamblia
GCATDNVDG

SEQ ID NO: 3096114 - protein, 6 aa, Giardia lamblia
GCPPRS

SEQ ID NO: 3096115 - protein, 10 aa, Giardia lamblia
GCQMSGEGFS

SEQ ID NO: 3096116 - protein, 4 aa, Giardia lamblia
GDAT

SEQ ID NO: 3096117 - protein, 6 aa, Giardia lamblia
GDEFPH

SEQ ID NO: 3096118 - protein, 4 aa, Giardia lamblia
GDET

SEQ ID NO: 3096119 - protein, 4 aa, Giardia lamblia
GDIS

SEQ ID NO: 3096120 - protein, 4 aa, Giardia lamblia
GDTV

SEQ ID NO: 3096121 - protein, 5 aa, Giardia lamblia
GEEAG

SEQ ID NO: 3096122 - protein, 4 aa, Giardia lamblia
GEFR

SEQ ID NO: 3096123 - protein, 5 aa, Giardia lamblia
GERRY

SEQ ID NO: 3096124 - protein, 4 aa, Giardia lamblia
GESA

SEQ ID NO: 3096125 - protein, 6 aa, Giardia lamblia
GEYDRS

SEQ ID NO: 3096126 - protein, 6 aa, Giardia lamblia
GFSSLS

SEQ ID NO: 3096127 - protein, 4 aa, Giardia lamblia
GGGL

SEQ ID NO: 3096128 - protein, 4 aa, Giardia lamblia
GGID

SEQ ID NO: 3096129 - protein, 6 aa, Giardia lamblia
GGKEPA

SEQ ID NO: 3096130 - protein, 10 aa, Giardia lamblia
GGMNTSSSQI

SEQ ID NO: 3096131 - protein, 7 aa, Giardia lamblia
GGSEQKV

SEQ ID NO: 3096132 - protein, 8 aa, Giardia lamblia
GGSHTPAA

SEQ ID NO: 3096133 - protein, 7 aa, Giardia lamblia
GGTGAGF

SEQ ID NO: 3096134 - protein, 4 aa, Giardia lamblia
GGTI

SEQ ID NO: 3096135 - protein, 9 aa, Giardia lamblia
GGVKDRNEM

SEQ ID NO: 3096136 - protein, 4 aa, Giardia lamblia
GHAE

SEQ ID NO: 3096137 - protein, 4 aa, Giardia lamblia
GHAK

SEQ ID NO: 3096138 - protein, 5 aa, Giardia lamblia
GHSLP

SEQ ID NO: 3096139 - protein, 7 aa, Giardia lamblia
GKDDDDL

SEQ ID NO: 3096140 - protein, 4 aa, Giardia lamblia
GKGD

SEQ ID NO: 3096141 - protein, 8 aa, Giardia lamblia
GKKYPRQE

SEQ ID NO: 3096142 - protein, 4 aa, Giardia lamblia
GKTD

SEQ ID NO: 3096143 - protein, 7 aa, Giardia lamblia
GKTPPDR

SEQ ID NO: 3096144 - protein, 4 aa, Giardia lamblia
GKTT

SEQ ID NO: 3096145 - protein, 15 aa, Giardia lamblia
GLGSGEAGLAEGPVQ

SEQ ID NO: 3096146 - protein, 8 aa, Giardia lamblia
GLPPTHDQ

SEQ ID NO: 3096147 - protein, 10 aa, Giardia lamblia
GMKDKDGNTA

SEQ ID NO: 3096148 - protein, 8 aa, Giardia lamblia
GMQKGRGY

SEQ ID NO: 3096149 - protein, 7 aa, Giardia lamblia
GMRDSEE

SEQ ID NO: 3096150 - protein, 9 aa, Giardia lamblia
GMYDTAPEQ

SEQ ID NO: 3096151 - protein, 8 aa, Giardia lamblia
GNEKSDNV

SEQ ID NO: 3096152 - protein, 4 aa, Giardia lamblia
GNVA

SEQ ID NO: 3096153 - protein, 12 aa, Giardia lamblia
GPAPPSRAPSVH

SEQ ID NO: 3096154 - protein, 12 aa, Giardia lamblia
GPPGTGKTLTAR

SEQ ID NO: 3096155 - protein, 5 aa, Giardia lamblia
GPTLR

SEQ ID NO: 3096156 - protein, 19 aa, Giardia lamblia
GQGEFEAGISKDGQTREHA

SEQ ID NO: 3096157 - protein, 4 aa, Giardia lamblia
GQKI

SEQ ID NO: 3096158 - protein, 10 aa, Giardia lamblia
GQTGSGKSYS

SEQ ID NO: 3096159 - protein, 29 aa, Giardia lamblia
GRAAALGDGVARGRREAEARGSRPLDPRE

SEQ ID NO: 3096160 - protein, 5 aa, Giardia lamblia
GRAPG

SEQ ID NO: 3096161 - protein, 15 aa, Giardia lamblia
GRCKKERDDAASTCS

SEQ ID NO: 3096162 - protein, 6 aa, Giardia lamblia
GRDAQG

SEQ ID NO: 3096163 - protein, 5 aa, Giardia lamblia
GRFET

SEQ ID NO: 3096164 - protein, 9 aa, Giardia lamblia
GRRNKNSRT

SEQ ID NO: 3096165 - protein, 14 aa, Giardia lamblia
GRSDAFPSAGTRAR

SEQ ID NO: 3096166 - protein, 7 aa, Giardia lamblia
GRVPGDC

SEQ ID NO: 3096167 - protein, 7 aa, Giardia lamblia
GSAISPE

SEQ ID NO: 3096168 - protein, 18 aa, Giardia lamblia
GSERQGKTGATGDRLTEG

SEQ ID NO: 3096169 - protein, 8 aa, Giardia lamblia
GSHNAAER

SEQ ID NO: 3096170 - protein, 4 aa, Giardia lamblia
GSPT

SEQ ID NO: 3096171 - protein, 6 aa, Giardia lamblia
GSRKGL

SEQ ID NO: 3096172 - protein, 5 aa, Giardia lamblia
GTHET

SEQ ID NO: 3096173 - protein, 4 aa, Giardia lamblia
GTIG

SEQ ID NO: 3096174 - protein, 4 aa, Giardia lamblia
GTTA

SEQ ID NO: 3096175 - protein, 15 aa, Giardia lamblia
GTVPAGRVETGELAP

SEQ ID NO: 3096176 - protein, 5 aa, Giardia lamblia
GVDEK

SEQ ID NO: 3096177 - protein, 10 aa, Giardia lamblia
GVLAGGKRRR

SEQ ID NO: 3096178 - protein, 7 aa, Giardia lamblia
GVQDSLQ

SEQ ID NO: 3096179 - protein, 4 aa, Giardia lamblia
GYAG

SEQ ID NO: 3096180 - protein, 10 aa, Giardia lamblia
GYAGRTELPD

SEQ ID NO: 3096181 - protein, 6 aa, Giardia lamblia
GYPAGA

SEQ ID NO: 3096182 - protein, 6 aa, Giardia lamblia
HARDGV

SEQ ID NO: 3096183 - protein, 10 aa, Giardia lamblia
HDETPPRDGE

SEQ ID NO: 3096184 - protein, 6 aa, Giardia lamblia
HDNNDK

SEQ ID NO: 3096185 - protein, 4 aa, Giardia lamblia
HDRQ

SEQ ID NO: 3096186 - protein, 4 aa, Giardia lamblia
HDRT

SEQ ID NO: 3096187 - protein, 6 aa, Giardia lamblia
HEGRRP

SEQ ID NO: 3096188 - protein, 4 aa, Giardia lamblia
HEQL

SEQ ID NO: 3096189 - protein, 4 aa, Giardia lamblia
HGHT

SEQ ID NO: 3096190 - protein, 9 aa, Giardia lamblia
HGKKSLQDL

SEQ ID NO: 3096191 - protein, 13 aa, Giardia lamblia
HIGQKTGEPDTAA

SEQ ID NO: 3096192 - protein, 10 aa, Giardia lamblia
HKTDSERNTS

SEQ ID NO: 3096193 - protein, 4 aa, Giardia lamblia
HNGR

SEQ ID NO: 3096194 - protein, 7 aa, Giardia lamblia
HNQSPRN

SEQ ID NO: 3096195 - protein, 5 aa, Giardia lamblia
HPAEE

SEQ ID NO: 3096196 - protein, 4 aa, Giardia lamblia
HPER

SEQ ID NO: 3096197 - protein, 9 aa, Giardia lamblia
HPSSAEQCL

SEQ ID NO: 3096198 - protein, 10 aa, Giardia lamblia
HRDKKSQKRI

SEQ ID NO: 3096199 - protein, 20 aa, Giardia lamblia
HRGPPRDCPEAAKVSVKGPC

SEQ ID NO: 3096200 - protein, 7 aa, Giardia lamblia
HSPGPHS

SEQ ID NO: 3096201 - protein, 9 aa, Giardia lamblia
HSSSPRPKH

SEQ ID NO: 3096202 - protein, 7 aa, Giardia lamblia
HTDVPPV

SEQ ID NO: 3096203 - protein, 6 aa, Giardia lamblia
HTNSTE

SEQ ID NO: 3096204 - protein, 4 aa, Giardia lamblia
IAPA

SEQ ID NO: 3096205 - protein, 12 aa, Giardia lamblia
IASSKPPHTTKQ

SEQ ID NO: 3096206 - protein, 4 aa, Giardia lamblia
IEDK

SEQ ID NO: 3096207 - protein, 6 aa, Giardia lamblia
IENGRP

SEQ ID NO: 3096208 - protein, 14 aa, Giardia lamblia
IENTVTKNESAQEK

SEQ ID NO: 3096209 - protein, 6 aa, Giardia lamblia
IGNESA

SEQ ID NO: 3096210 - protein, 17 aa, Giardia lamblia
IPPETRPEIVEMINLYR

SEQ ID NO: 3096211 - protein, 7 aa, Giardia lamblia
IPPRQPE

SEQ ID NO: 3096212 - protein, 7 aa, Giardia lamblia
IPPSEDN

SEQ ID NO: 3096213 - protein, 4 aa, Giardia lamblia
IPYR

SEQ ID NO: 3096214 - protein, 4 aa, Giardia lamblia
IREA

SEQ ID NO: 3096215 - protein, 10 aa, Giardia lamblia
IRRRTNDGRT

SEQ ID NO: 3096216 - protein, 6 aa, Giardia lamblia
IRSDTG

SEQ ID NO: 3096217 - protein, 4 aa, Giardia lamblia
ISAD

SEQ ID NO: 3096218 - protein, 10 aa, Giardia lamblia
ISNESLEEHP

SEQ ID NO: 3096219 - protein, 4 aa, Giardia lamblia
ISSE

SEQ ID NO: 3096220 - protein, 15 aa, Giardia lamblia
KAESGLNNDIPDEPV

SEQ ID NO: 3096221 - protein, 5 aa, Giardia lamblia
KAETT

SEQ ID NO: 3096222 - protein, 8 aa, Giardia lamblia
KARGHPTV

SEQ ID NO: 3096223 - protein, 4 aa, Giardia lamblia
KARQ

SEQ ID NO: 3096224 - protein, 9 aa, Giardia lamblia
KCKSTMAGE

SEQ ID NO: 3096225 - protein, 7 aa, Giardia lamblia
KDERERG

SEQ ID NO: 3096226 - protein, 7 aa, Giardia lamblia
KDGETYS

SEQ ID NO: 3096227 - protein, 7 aa, Giardia lamblia
KDVGGES

SEQ ID NO: 3096228 - protein, 4 aa, Giardia lamblia
KEAE

SEQ ID NO: 3096229 - protein, 8 aa, Giardia lamblia
KEASAALK

SEQ ID NO: 3096230 - protein, 20 aa, Giardia lamblia
KEEEEHLSKSKRDRYGGKRA

SEQ ID NO: 3096231 - protein, 4 aa, Giardia lamblia
KEFE

SEQ ID NO: 3096232 - protein, 14 aa, Giardia lamblia
KEGDVRRTQYNTEP

SEQ ID NO: 3096233 - protein, 4 aa, Giardia lamblia
KEGV

SEQ ID NO: 3096234 - protein, 15 aa, Giardia lamblia
KEIPTDGLPPDAQAS

SEQ ID NO: 3096235 - protein, 7 aa, Giardia lamblia
KEKNINR

SEQ ID NO: 3096236 - protein, 7 aa, Giardia lamblia
KERENAS

SEQ ID NO: 3096237 - protein, 4 aa, Giardia lamblia
KERL

SEQ ID NO: 3096238 - protein, 4 aa, Giardia lamblia
KETD

SEQ ID NO: 3096239 - protein, 4 aa, Giardia lamblia
KETL

SEQ ID NO: 3096240 - protein, 5 aa, Giardia lamblia
KGDLD

SEQ ID NO: 3096241 - protein, 5 aa, Giardia lamblia
KGHAE

SEQ ID NO: 3096242 - protein, 5 aa, Giardia lamblia
KGHTE

SEQ ID NO: 3096243 - protein, 5 aa, Giardia lamblia
KGHVE

SEQ ID NO: 3096244 - protein, 7 aa, Giardia lamblia
KGKDPKD

SEQ ID NO: 3096245 - protein, 8 aa, Giardia lamblia
KGLRDKQH

SEQ ID NO: 3096246 - protein, 11 aa, Giardia lamblia
KGMKDKDGNTA

SEQ ID NO: 3096247 - protein, 9 aa, Giardia lamblia
KGMRRPDDR

SEQ ID NO: 3096248 - protein, 4 aa, Giardia lamblia
KGSL

SEQ ID NO: 3096249 - protein, 10 aa, Giardia lamblia
KGTPDEAEQA

SEQ ID NO: 3096250 - protein, 15 aa, Giardia lamblia
KHRAERAQQEAERRR

SEQ ID NO: 3096251 - protein, 6 aa, Giardia lamblia
KINEAG

SEQ ID NO: 3096252 - protein, 7 aa, Giardia lamblia
KIPATKD

SEQ ID NO: 3096253 - protein, 7 aa, Giardia lamblia
KIQDPAG

SEQ ID NO: 3096254 - protein, 7 aa, Giardia lamblia
KIQPGYT

SEQ ID NO: 3096255 - protein, 9 aa, Giardia lamblia
KKAGPGDNV

SEQ ID NO: 3096256 - protein, 8 aa, Giardia lamblia
KKRASSLH

SEQ ID NO: 3096257 - protein, 6 aa, Giardia lamblia
KKYRDG

SEQ ID NO: 3096258 - protein, 7 aa, Giardia lamblia
KKYSRQE

SEQ ID NO: 3096259 - protein, 6 aa, Giardia lamblia
KLSDYK

SEQ ID NO: 3096260 - protein, 7 aa, Giardia lamblia
KMSEKEK

SEQ ID NO: 3096261 - protein, 9 aa, Giardia lamblia
KNLEAERDA

SEQ ID NO: 3096262 - protein, 4 aa, Giardia lamblia
KNSL

SEQ ID NO: 3096263 - protein, 4 aa, Giardia lamblia
KNTE

SEQ ID NO: 3096264 - protein, 5 aa, Giardia lamblia
KPLTE

SEQ ID NO: 3096265 - protein, 7 aa, Giardia lamblia
KPTSFST

SEQ ID NO: 3096266 - protein, 4 aa, Giardia lamblia
KQAE

SEQ ID NO: 3096267 - protein, 6 aa, Giardia lamblia
KQEIGK

SEQ ID NO: 3096268 - protein, 19 aa, Giardia lamblia
KQNAANDITAPGVAFCSAA

SEQ ID NO: 3096269 - protein, 6 aa, Giardia lamblia
KQREKE

SEQ ID NO: 3096270 - protein, 13 aa, Giardia lamblia
KQRGSKSDNTGTM

SEQ ID NO: 3096271 - protein, 14 aa, Giardia lamblia
KQTIQQQQKQHEAY

SEQ ID NO: 3096272 - protein, 5 aa, Giardia lamblia
KREPW

SEQ ID NO: 3096273 - protein, 6 aa, Giardia lamblia
KRNDVK

SEQ ID NO: 3096274 - protein, 4 aa, Giardia lamblia
KRRE

SEQ ID NO: 3096275 - protein, 4 aa, Giardia lamblia
KRRK

SEQ ID NO: 3096276 - protein, 6 aa, Giardia lamblia
KRTAKD

SEQ ID NO: 3096277 - protein, 8 aa, Giardia lamblia
KSAPDRAV

SEQ ID NO: 3096278 - protein, 9 aa, Giardia lamblia
KSERDASGW

SEQ ID NO: 3096279 - protein, 4 aa, Giardia lamblia
KSKD

SEQ ID NO: 3096280 - protein, 4 aa, Giardia lamblia
KSTK

SEQ ID NO: 3096281 - protein, 20 aa, Giardia lamblia
KTEAGDKGDAKRKHKRHETY

SEQ ID NO: 3096282 - protein, 8 aa, Giardia lamblia
KTKAEDPV

SEQ ID NO: 3096283 - protein, 4 aa, Giardia lamblia
KTMS

SEQ ID NO: 3096284 - protein, 5 aa, Giardia lamblia
KTYTA

SEQ ID NO: 3096285 - protein, 12 aa, Giardia lamblia
KYPNLEDTAPNR

SEQ ID NO: 3096286 - protein, 5 aa, Giardia lamblia
KYPRQ

SEQ ID NO: 3096287 - protein, 6 aa, Giardia lamblia
KYQKST

SEQ ID NO: 3096288 - protein, 4 aa, Giardia lamblia
LADE

SEQ ID NO: 3096289 - protein, 9 aa, Giardia lamblia
LADGRTAQT

SEQ ID NO: 3096290 - protein, 10 aa, Giardia lamblia
LAPPAPAGLG

SEQ ID NO: 3096291 - protein, 23 aa, Giardia lamblia
LAPPRSLPAARPSSPLQPPPLPG

SEQ ID NO: 3096292 - protein, 9 aa, Giardia lamblia
LAQKEEEVA

SEQ ID NO: 3096293 - protein, 15 aa, Giardia lamblia
LDARRSTPSTKSPAV

SEQ ID NO: 3096294 - protein, 13 aa, Giardia lamblia
LDASGQEARKASA

SEQ ID NO: 3096295 - protein, 6 aa, Giardia lamblia
LDATDP

SEQ ID NO: 3096296 - protein, 4 aa, Giardia lamblia
LDEA

SEQ ID NO: 3096297 - protein, 9 aa, Giardia lamblia
LDENGGKLT

SEQ ID NO: 3096298 - protein, 11 aa, Giardia lamblia
LEREKDDTAAL

SEQ ID NO: 3096299 - protein, 17 aa, Giardia lamblia
LETKAEPRGAGLTPEEH

SEQ ID NO: 3096300 - protein, 4 aa, Giardia lamblia
LGEL

SEQ ID NO: 3096301 - protein, 9 aa, Giardia lamblia
LGETAESLA

SEQ ID NO: 3096302 - protein, 4 aa, Giardia lamblia
LGGN

SEQ ID NO: 3096303 - protein, 4 aa, Giardia lamblia
LGSD

SEQ ID NO: 3096304 - protein, 11 aa, Giardia lamblia
LKAPKRPTDKP

SEQ ID NO: 3096305 - protein, 4 aa, Giardia lamblia
LKEE

SEQ ID NO: 3096306 - protein, 4 aa, Giardia lamblia
LKER

SEQ ID NO: 3096307 - protein, 7 aa, Giardia lamblia
LPDGPGL

SEQ ID NO: 3096308 - protein, 5 aa, Giardia lamblia
LPPQN

SEQ ID NO: 3096309 - protein, 4 aa, Giardia lamblia
LPPS

SEQ ID NO: 3096310 - protein, 7 aa, Giardia lamblia
LPRPKTG

SEQ ID NO: 3096311 - protein, 5 aa, Giardia lamblia
LPSRR

SEQ ID NO: 3096312 - protein, 4 aa, Giardia lamblia
LQDL

SEQ ID NO: 3096313 - protein, 8 aa, Giardia lamblia
LQNKRGET

SEQ ID NO: 3096314 - protein, 4 aa, Giardia lamblia
LQPT

SEQ ID NO: 3096315 - protein, 8 aa, Giardia lamblia
LREEGVSG

SEQ ID NO: 3096316 - protein, 4 aa, Giardia lamblia
LRGA

SEQ ID NO: 3096317 - protein, 8 aa, Giardia lamblia
LRNNRGRT

SEQ ID NO: 3096318 - protein, 4 aa, Giardia lamblia
LRPR

SEQ ID NO: 3096319 - protein, 16 aa, Giardia lamblia
LRRTRSVEEAADRRSQ

SEQ ID NO: 3096320 - protein, 8 aa, Giardia lamblia
LSADPGSG

SEQ ID NO: 3096321 - protein, 4 aa, Giardia lamblia
LSKE

SEQ ID NO: 3096322 - protein, 4 aa, Giardia lamblia
LSNS

SEQ ID NO: 3096323 - protein, 16 aa, Giardia lamblia
LSQSSTHKYSPEAASF

SEQ ID NO: 3096324 - protein, 4 aa, Giardia lamblia
LSSK

SEQ ID NO: 3096325 - protein, 4 aa, Giardia lamblia
LSTS

SEQ ID NO: 3096326 - protein, 5 aa, Giardia lamblia
LTEEQ

SEQ ID NO: 3096327 - protein, 6 aa, Giardia lamblia
LTGDPD

SEQ ID NO: 3096328 - protein, 5 aa, Giardia lamblia
LVPPV

SEQ ID NO: 3096329 - protein, 30 aa, Giardia lamblia
MAAQSGAKAASDRPWTPPSAEGCARPASSY

SEQ ID NO: 3096330 - protein, 12 aa, Giardia lamblia
MEEGEFSEARED

SEQ ID NO: 3096331 - protein, 9 aa, Giardia lamblia
MKSRSARAG

SEQ ID NO: 3096332 - protein, 8 aa, Giardia lamblia
MNTTDPQS

SEQ ID NO: 3096333 - protein, 51 aa, Giardia lamblia
MSSTDDSDHCSQEHDDTPPLMSEKDTDEEDVGENSPARPPRAIGEDEDGVT

SEQ ID NO: 3096334 - protein, 9 aa, Giardia lamblia
NDAGEEVGR

SEQ ID NO: 3096335 - protein, 12 aa, Giardia lamblia
NDDAKTKETLTE

SEQ ID NO: 3096336 - protein, 4 aa, Giardia lamblia
NDHP

SEQ ID NO: 3096337 - protein, 9 aa, Giardia lamblia
NDKGDEKRM

SEQ ID NO: 3096338 - protein, 4 aa, Giardia lamblia
NDNG

SEQ ID NO: 3096339 - protein, 4 aa, Giardia lamblia
NDSN

SEQ ID NO: 3096340 - protein, 4 aa, Giardia lamblia
NDTV

SEQ ID NO: 3096341 - protein, 6 aa, Giardia lamblia
NEDRGE

SEQ ID NO: 3096342 - protein, 4 aa, Giardia lamblia
NEEV

SEQ ID NO: 3096343 - protein, 11 aa, Giardia lamblia
NEPGSPRDSRT

SEQ ID NO: 3096344 - protein, 4 aa, Giardia lamblia
NEPS

SEQ ID NO: 3096345 - protein, 4 aa, Giardia lamblia
NERQ

SEQ ID NO: 3096346 - protein, 4 aa, Giardia lamblia
NESL

SEQ ID NO: 3096347 - protein, 6 aa, Giardia lamblia
NGANTR

SEQ ID NO: 3096348 - protein, 5 aa, Giardia lamblia
NGHPD

SEQ ID NO: 3096349 - protein, 4 aa, Giardia lamblia
NGST

SEQ ID NO: 3096350 - protein, 4 aa, Giardia lamblia
NHPE

SEQ ID NO: 3096351 - protein, 4 aa, Giardia lamblia
NITQ

SEQ ID NO: 3096352 - protein, 4 aa, Giardia lamblia
NKEG

SEQ ID NO: 3096353 - protein, 10 aa, Giardia lamblia
NKEGSLPEDA

SEQ ID NO: 3096354 - protein, 6 aa, Giardia lamblia
NKGGRA

SEQ ID NO: 3096355 - protein, 4 aa, Giardia lamblia
NKPD

SEQ ID NO: 3096356 - protein, 10 aa, Giardia lamblia
NMNATSSRSH

SEQ ID NO: 3096357 - protein, 5 aa, Giardia lamblia
NNHPE

SEQ ID NO: 3096358 - protein, 10 aa, Giardia lamblia
NPAAPSEKGS

SEQ ID NO: 3096359 - protein, 4 aa, Giardia lamblia
NPET

SEQ ID NO: 3096360 - protein, 4 aa, Giardia lamblia
NPKS

SEQ ID NO: 3096361 - protein, 27 aa, Giardia lamblia
NPVTKKPKCTACSDKKVKTELDGTTTC

SEQ ID NO: 3096362 - protein, 4 aa, Giardia lamblia
NQTV

SEQ ID NO: 3096363 - protein, 6 aa, Giardia lamblia
NREGKT

SEQ ID NO: 3096364 - protein, 7 aa, Giardia lamblia
NRSNDPL

SEQ ID NO: 3096365 - protein, 4 aa, Giardia lamblia
NSEH

SEQ ID NO: 3096366 - protein, 4 aa, Giardia lamblia
NSKT

SEQ ID NO: 3096367 - protein, 27 aa, Giardia lamblia
NSRRAYRSHDGQSLPRGSCILRSADLT

SEQ ID NO: 3096368 - protein, 4 aa, Giardia lamblia
NTDQ

SEQ ID NO: 3096369 - protein, 9 aa, Giardia lamblia
NTIGSTPTV

SEQ ID NO: 3096370 - protein, 15 aa, Giardia lamblia
NTTAEGRRKPQHVPY

SEQ ID NO: 3096371 - protein, 7 aa, Giardia lamblia
NVDPPDC

SEQ ID NO: 3096372 - protein, 15 aa, Giardia lamblia
NVQDGDGPQDEEQIS

SEQ ID NO: 3096373 - protein, 4 aa, Giardia lamblia
NYAT

SEQ ID NO: 3096374 - protein, 6 aa, Giardia lamblia
NYPEAL

SEQ ID NO: 3096375 - protein, 4 aa, Giardia lamblia
NYVE

SEQ ID NO: 3096376 - protein, 4 aa, Giardia lamblia
PAAV

SEQ ID NO: 3096377 - protein, 10 aa, Giardia lamblia
PALQPSPRVD

SEQ ID NO: 3096378 - protein, 9 aa, Giardia lamblia
PANVDPPDC

SEQ ID NO: 3096379 - protein, 6 aa, Giardia lamblia
PAPGAV

SEQ ID NO: 3096380 - protein, 6 aa, Giardia lamblia
PAPRAE

SEQ ID NO: 3096381 - protein, 4 aa, Giardia lamblia
PAPV

SEQ ID NO: 3096382 - protein, 10 aa, Giardia lamblia
PARLEIPNGE

SEQ ID NO: 3096383 - protein, 20 aa, Giardia lamblia
PASPTPASLAPKAIAGAETA

SEQ ID NO: 3096384 - protein, 13 aa, Giardia lamblia
PASQGIRPPGGQA

SEQ ID NO: 3096385 - protein, 4 aa, Giardia lamblia
PDAD

SEQ ID NO: 3096386 - protein, 4 aa, Giardia lamblia
PDAL

SEQ ID NO: 3096387 - protein, 7 aa, Giardia lamblia
PDAYRGA

SEQ ID NO: 3096388 - protein, 4 aa, Giardia lamblia
PDPL

SEQ ID NO: 3096389 - protein, 5 aa, Giardia lamblia
PEDRQ

SEQ ID NO: 3096390 - protein, 4 aa, Giardia lamblia
PEET

SEQ ID NO: 3096391 - protein, 4 aa, Giardia lamblia
PEGE

SEQ ID NO: 3096392 - protein, 4 aa, Giardia lamblia
PEST

SEQ ID NO: 3096393 - protein, 4 aa, Giardia lamblia
PGAT

SEQ ID NO: 3096394 - protein, 4 aa, Giardia lamblia
PGEN

SEQ ID NO: 3096395 - protein, 4 aa, Giardia lamblia
PGES

SEQ ID NO: 3096396 - protein, 4 aa, Giardia lamblia
PGGG

SEQ ID NO: 3096397 - protein, 4 aa, Giardia lamblia
PGGS

SEQ ID NO: 3096398 - protein, 4 aa, Giardia lamblia
PGLP

SEQ ID NO: 3096399 - protein, 6 aa, Giardia lamblia
PGTGKS

SEQ ID NO: 3096400 - protein, 7 aa, Giardia lamblia
PKAEGRR

SEQ ID NO: 3096401 - protein, 4 aa, Giardia lamblia
PKDV

SEQ ID NO: 3096402 - protein, 4 aa, Giardia lamblia
PNSE

SEQ ID NO: 3096403 - protein, 4 aa, Giardia lamblia
PNTT

SEQ ID NO: 3096404 - protein, 4 aa, Giardia lamblia
PNYR

SEQ ID NO: 3096405 - protein, 9 aa, Giardia lamblia
PPAVPGDGA

SEQ ID NO: 3096406 - protein, 4 aa, Giardia lamblia
PPDE

SEQ ID NO: 3096407 - protein, 4 aa, Giardia lamblia
PPEI

SEQ ID NO: 3096408 - protein, 15 aa, Giardia lamblia
PPGLEGRDVELPAPR

SEQ ID NO: 3096409 - protein, 7 aa, Giardia lamblia
PPGTSKY

SEQ ID NO: 3096410 - protein, 11 aa, Giardia lamblia
PPNNNVTQDDV

SEQ ID NO: 3096411 - protein, 15 aa, Giardia lamblia
PQCPPQSSARSPLDA

SEQ ID NO: 3096412 - protein, 6 aa, Giardia lamblia
PQGDPL

SEQ ID NO: 3096413 - protein, 4 aa, Giardia lamblia
PQID

SEQ ID NO: 3096414 - protein, 12 aa, Giardia lamblia
PQSPFPGIPRGI

SEQ ID NO: 3096415 - protein, 4 aa, Giardia lamblia
PRHG

SEQ ID NO: 3096416 - protein, 7 aa, Giardia lamblia
PRPARPR

SEQ ID NO: 3096417 - protein, 4 aa, Giardia lamblia
PSAA

SEQ ID NO: 3096418 - protein, 5 aa, Giardia lamblia
PSEMG

SEQ ID NO: 3096419 - protein, 4 aa, Giardia lamblia
PSLG

SEQ ID NO: 3096420 - protein, 4 aa, Giardia lamblia
PSNP

SEQ ID NO: 3096421 - protein, 4 aa, Giardia lamblia
PSPM

SEQ ID NO: 3096422 - protein, 4 aa, Giardia lamblia
PSQV

SEQ ID NO: 3096423 - protein, 7 aa, Giardia lamblia
PSRLRST

SEQ ID NO: 3096424 - protein, 4 aa, Giardia lamblia
PSRP

SEQ ID NO: 3096425 - protein, 4 aa, Giardia lamblia
PSTG

SEQ ID NO: 3096426 - protein, 4 aa, Giardia lamblia
PSVS

SEQ ID NO: 3096427 - protein, 4 aa, Giardia lamblia
PSVT

SEQ ID NO: 3096428 - protein, 7 aa, Giardia lamblia
PTDKDGV

SEQ ID NO: 3096429 - protein, 4 aa, Giardia lamblia
PTIP

SEQ ID NO: 3096430 - protein, 4 aa, Giardia lamblia
PTKY

SEQ ID NO: 3096431 - protein, 4 aa, Giardia lamblia
PTLA

SEQ ID NO: 3096432 - protein, 4 aa, Giardia lamblia
PTPE

SEQ ID NO: 3096433 - protein, 6 aa, Giardia lamblia
PTRAAH

SEQ ID NO: 3096434 - protein, 5 aa, Giardia lamblia
PTSPL

SEQ ID NO: 3096435 - protein, 13 aa, Giardia lamblia
PVEQPVDDSQKYR

SEQ ID NO: 3096436 - protein, 4 aa, Giardia lamblia
PVIT

SEQ ID NO: 3096437 - protein, 9 aa, Giardia lamblia
PVLSGSTQS

SEQ ID NO: 3096438 - protein, 5 aa, Giardia lamblia
QAAGG

SEQ ID NO: 3096439 - protein, 5 aa, Giardia lamblia
QADNQ

SEQ ID NO: 3096440 - protein, 4 aa, Giardia lamblia
QAPV

SEQ ID NO: 3096441 - protein, 6 aa, Giardia lamblia
QARDEE

SEQ ID NO: 3096442 - protein, 4 aa, Giardia lamblia
QDEL

SEQ ID NO: 3096443 - protein, 6 aa, Giardia lamblia
QEASNY

SEQ ID NO: 3096444 - protein, 11 aa, Giardia lamblia
QEISTKDDEIQ

SEQ ID NO: 3096445 - protein, 4 aa, Giardia lamblia
QESC

SEQ ID NO: 3096446 - protein, 5 aa, Giardia lamblia
QETAN

SEQ ID NO: 3096447 - protein, 4 aa, Giardia lamblia
QEYA

SEQ ID NO: 3096448 - protein, 7 aa, Giardia lamblia
QGGHTGT

SEQ ID NO: 3096449 - protein, 4 aa, Giardia lamblia
QGHA

SEQ ID NO: 3096450 - protein, 4 aa, Giardia lamblia
QGHI

SEQ ID NO: 3096451 - protein, 4 aa, Giardia lamblia
QGHV

SEQ ID NO: 3096452 - protein, 6 aa, Giardia lamblia
QGLPGY

SEQ ID NO: 3096453 - protein, 4 aa, Giardia lamblia
QGQI

SEQ ID NO: 3096454 - protein, 4 aa, Giardia lamblia
QGSL

SEQ ID NO: 3096455 - protein, 9 aa, Giardia lamblia
QHSSRRSRS

SEQ ID NO: 3096456 - protein, 14 aa, Giardia lamblia
QHTTNPSVTENSPY

SEQ ID NO: 3096457 - protein, 9 aa, Giardia lamblia
QKGQGIRSE

SEQ ID NO: 3096458 - protein, 5 aa, Giardia lamblia
QLKEK

SEQ ID NO: 3096459 - protein, 8 aa, Giardia lamblia
QLPDPTHT

SEQ ID NO: 3096460 - protein, 5 aa, Giardia lamblia
QLPDR

SEQ ID NO: 3096461 - protein, 7 aa, Giardia lamblia
QNEGGIG

SEQ ID NO: 3096462 - protein, 6 aa, Giardia lamblia
QNGRDE

SEQ ID NO: 3096463 - protein, 5 aa, Giardia lamblia
QPALS

SEQ ID NO: 3096464 - protein, 5 aa, Giardia lamblia
QPFRR

SEQ ID NO: 3096465 - protein, 9 aa, Giardia lamblia
QPPTVIPGG

SEQ ID NO: 3096466 - protein, 4 aa, Giardia lamblia
QPSS

SEQ ID NO: 3096467 - protein, 5 aa, Giardia lamblia
QPTPY

SEQ ID NO: 3096468 - protein, 5 aa, Giardia lamblia
QQGHV

SEQ ID NO: 3096469 - protein, 15 aa, Giardia lamblia
QQKGHRQTRNPCGRH

SEQ ID NO: 3096470 - protein, 4 aa, Giardia lamblia
QQQP

SEQ ID NO: 3096471 - protein, 8 aa, Giardia lamblia
QQSYQSQT

SEQ ID NO: 3096472 - protein, 4 aa, Giardia lamblia
QRGR

SEQ ID NO: 3096473 - protein, 20 aa, Giardia lamblia
QRPTRRRRPPETERAGLSSS

SEQ ID NO: 3096474 - protein, 4 aa, Giardia lamblia
QRTV

SEQ ID NO: 3096475 - protein, 6 aa, Giardia lamblia
QSAGQT

SEQ ID NO: 3096476 - protein, 17 aa, Giardia lamblia
QSQCDGPNQQGHANGKS

SEQ ID NO: 3096477 - protein, 4 aa, Giardia lamblia
QSRQ

SEQ ID NO: 3096478 - protein, 9 aa, Giardia lamblia
QSSGTSPLD

SEQ ID NO: 3096479 - protein, 16 aa, Giardia lamblia
QSTAPLGHSPGKATAL

SEQ ID NO: 3096480 - protein, 7 aa, Giardia lamblia
QSYTEKA

SEQ ID NO: 3096481 - protein, 4 aa, Giardia lamblia
QTAE

SEQ ID NO: 3096482 - protein, 15 aa, Giardia lamblia
QTEKGRHFSNEPGPM

SEQ ID NO: 3096483 - protein, 4 aa, Giardia lamblia
QTPE

SEQ ID NO: 3096484 - protein, 13 aa, Giardia lamblia
QTQPAQAPEPLTQ

SEQ ID NO: 3096485 - protein, 8 aa, Giardia lamblia
QTSDVRDQ

SEQ ID NO: 3096486 - protein, 4 aa, Giardia lamblia
QTVE

SEQ ID NO: 3096487 - protein, 5 aa, Giardia lamblia
QVPGH

SEQ ID NO: 3096488 - protein, 16 aa, Giardia lamblia
QVQGDRCGRHPAPPDG

SEQ ID NO: 3096489 - protein, 5 aa, Giardia lamblia
QVRRD

SEQ ID NO: 3096490 - protein, 4 aa, Giardia lamblia
QVSD

SEQ ID NO: 3096491 - protein, 13 aa, Giardia lamblia
RAAEAERDEARAA

SEQ ID NO: 3096492 - protein, 8 aa, Giardia lamblia
RAAPGEPL

SEQ ID NO: 3096493 - protein, 19 aa, Giardia lamblia
RAEAAGGNAARELDETRRE

SEQ ID NO: 3096494 - protein, 5 aa, Giardia lamblia
RAGHK

SEQ ID NO: 3096495 - protein, 4 aa, Giardia lamblia
RAGS

SEQ ID NO: 3096496 - protein, 19 aa, Giardia lamblia
RAKETAEAIRANQPQARFE

SEQ ID NO: 3096497 - protein, 20 aa, Giardia lamblia
RAKQIKNKPRINEDPKDAQI

SEQ ID NO: 3096498 - protein, 4 aa, Giardia lamblia
RALR

SEQ ID NO: 3096499 - protein, 11 aa, Giardia lamblia
RANEQADRAAI

SEQ ID NO: 3096500 - protein, 5 aa, Giardia lamblia
RAPAE

SEQ ID NO: 3096501 - protein, 9 aa, Giardia lamblia
RAPGSGDGL

SEQ ID NO: 3096502 - protein, 27 aa, Giardia lamblia
RAPLPDNTTEQSQSKADPDPEKARRRI

SEQ ID NO: 3096503 - protein, 9 aa, Giardia lamblia
RDAAENAAA

SEQ ID NO: 3096504 - protein, 6 aa, Giardia lamblia
RDAMPA

SEQ ID NO: 3096505 - protein, 4 aa, Giardia lamblia
RDAT

SEQ ID NO: 3096506 - protein, 10 aa, Giardia lamblia
RDESTTEAER

SEQ ID NO: 3096507 - protein, 5 aa, Giardia lamblia
RDISG

SEQ ID NO: 3096508 - protein, 4 aa, Giardia lamblia
RDIY

SEQ ID NO: 3096509 - protein, 12 aa, Giardia lamblia
REAHAGPARFSY

SEQ ID NO: 3096510 - protein, 16 aa, Giardia lamblia
REAREQAAAHQEDAQL

SEQ ID NO: 3096511 - protein, 10 aa, Giardia lamblia
REDQDDWDRS

SEQ ID NO: 3096512 - protein, 7 aa, Giardia lamblia
REGPGGL

SEQ ID NO: 3096513 - protein, 6 aa, Giardia lamblia
REGRPS

SEQ ID NO: 3096514 - protein, 4 aa, Giardia lamblia
RENA

SEQ ID NO: 3096515 - protein, 7 aa, Giardia lamblia
REPVRSS

SEQ ID NO: 3096516 - protein, 6 aa, Giardia lamblia
RESQAY

SEQ ID NO: 3096517 - protein, 7 aa, Giardia lamblia
RETTTAT

SEQ ID NO: 3096518 - protein, 5 aa, Giardia lamblia
RGGHK

SEQ ID NO: 3096519 - protein, 4 aa, Giardia lamblia
RGHA

SEQ ID NO: 3096520 - protein, 4 aa, Giardia lamblia
RGHE

SEQ ID NO: 3096521 - protein, 4 aa, Giardia lamblia
RGHG

SEQ ID NO: 3096522 - protein, 6 aa, Giardia lamblia
RGHLST

SEQ ID NO: 3096523 - protein, 4 aa, Giardia lamblia
RGHV

SEQ ID NO: 3096524 - protein, 4 aa, Giardia lamblia
RGKR

SEQ ID NO: 3096525 - protein, 12 aa, Giardia lamblia
RGNGTPGQLGPS

SEQ ID NO: 3096526 - protein, 19 aa, Giardia lamblia
RGPQRPDSYREGVDAGSPG

SEQ ID NO: 3096527 - protein, 4 aa, Giardia lamblia
RGRK

SEQ ID NO: 3096528 - protein, 10 aa, Giardia lamblia
RGRKTYKEVT

SEQ ID NO: 3096529 - protein, 13 aa, Giardia lamblia
RGRREEGPRAHQR

SEQ ID NO: 3096530 - protein, 12 aa, Giardia lamblia
RGSTPSVNGCND

SEQ ID NO: 3096531 - protein, 11 aa, Giardia lamblia
RGTRDASGKTP

SEQ ID NO: 3096532 - protein, 9 aa, Giardia lamblia
RGTRTEEHS

SEQ ID NO: 3096533 - protein, 6 aa, Giardia lamblia
RHGNGD

SEQ ID NO: 3096534 - protein, 4 aa, Giardia lamblia
RKIP

SEQ ID NO: 3096535 - protein, 13 aa, Giardia lamblia
RKKGYEEIVAILT

SEQ ID NO: 3096536 - protein, 9 aa, Giardia lamblia
RKRNRDSRT

SEQ ID NO: 3096537 - protein, 9 aa, Giardia lamblia
RKVAEDGSL

SEQ ID NO: 3096538 - protein, 12 aa, Giardia lamblia
RLAEEDLRKTAQ

SEQ ID NO: 3096539 - protein, 5 aa, Giardia lamblia
RLETE

SEQ ID NO: 3096540 - protein, 12 aa, Giardia lamblia
RNAEEKNNEQLR

SEQ ID NO: 3096541 - protein, 6 aa, Giardia lamblia
RNDAGA

SEQ ID NO: 3096542 - protein, 9 aa, Giardia lamblia
RNDAGQSAY

SEQ ID NO: 3096543 - protein, 5 aa, Giardia lamblia
RNDVD

SEQ ID NO: 3096544 - protein, 4 aa, Giardia lamblia
RNGA

SEQ ID NO: 3096545 - protein, 6 aa, Giardia lamblia
RNLPSS

SEQ ID NO: 3096546 - protein, 9 aa, Giardia lamblia
RNRSTETSL

SEQ ID NO: 3096547 - protein, 4 aa, Giardia lamblia
RPAR

SEQ ID NO: 3096548 - protein, 4 aa, Giardia lamblia
RPDL

SEQ ID NO: 3096549 - protein, 17 aa, Giardia lamblia
RPGGAVGGRPGTAGEGT

SEQ ID NO: 3096550 - protein, 4 aa, Giardia lamblia
RPGK

SEQ ID NO: 3096551 - protein, 13 aa, Giardia lamblia
RPGKTDAAGAPLP

SEQ ID NO: 3096552 - protein, 5 aa, Giardia lamblia
RPGTV

SEQ ID NO: 3096553 - protein, 7 aa, Giardia lamblia
RQDFDGD

SEQ ID NO: 3096554 - protein, 5 aa, Giardia lamblia
RQDPA

SEQ ID NO: 3096555 - protein, 4 aa, Giardia lamblia
RQRF

SEQ ID NO: 3096556 - protein, 4 aa, Giardia lamblia
RQRR

SEQ ID NO: 3096557 - protein, 19 aa, Giardia lamblia
RRAGGQDPQPPQRPEPEAR

SEQ ID NO: 3096558 - protein, 8 aa, Giardia lamblia
RRARDRGV

SEQ ID NO: 3096559 - protein, 18 aa, Giardia lamblia
RRAYQPGTDATQGFQNPQ

SEQ ID NO: 3096560 - protein, 7 aa, Giardia lamblia
RREKNSC

SEQ ID NO: 3096561 - protein, 6 aa, Giardia lamblia
RRNDVD

SEQ ID NO: 3096562 - protein, 4 aa, Giardia lamblia
RRQA

SEQ ID NO: 3096563 - protein, 4 aa, Giardia lamblia
RRRY

SEQ ID NO: 3096564 - protein, 15 aa, Giardia lamblia
RRSDRTDHTSHMHHP

SEQ ID NO: 3096565 - protein, 7 aa, Giardia lamblia
RRTSQHV

SEQ ID NO: 3096566 - protein, 4 aa, Giardia lamblia
RSEE

SEQ ID NO: 3096567 - protein, 10 aa, Giardia lamblia
RSSSPADQAG

SEQ ID NO: 3096568 - protein, 8 aa, Giardia lamblia
RSTEGPRL

SEQ ID NO: 3096569 - protein, 4 aa, Giardia lamblia
RTEY

SEQ ID NO: 3096570 - protein, 10 aa, Giardia lamblia
RTHEPQDITD

SEQ ID NO: 3096571 - protein, 4 aa, Giardia lamblia
RTLK

SEQ ID NO: 3096572 - protein, 16 aa, Giardia lamblia
RTLKPEMENPPDAGRG

SEQ ID NO: 3096573 - protein, 4 aa, Giardia lamblia
RTPS

SEQ ID NO: 3096574 - protein, 9 aa, Giardia lamblia
RTPVDPGPM

SEQ ID NO: 3096575 - protein, 6 aa, Giardia lamblia
RTRQGK

SEQ ID NO: 3096576 - protein, 4 aa, Giardia lamblia
RTSP

SEQ ID NO: 3096577 - protein, 4 aa, Giardia lamblia
RTTN

SEQ ID NO: 3096578 - protein, 11 aa, Giardia lamblia
SAAGTDDTGPI

SEQ ID NO: 3096579 - protein, 7 aa, Giardia lamblia
SAEHEDA

SEQ ID NO: 3096580 - protein, 5 aa, Giardia lamblia
SAGHN

SEQ ID NO: 3096581 - protein, 4 aa, Giardia lamblia
SAGK

SEQ ID NO: 3096582 - protein, 4 aa, Giardia lamblia
SAGN

SEQ ID NO: 3096583 - protein, 10 aa, Giardia lamblia
SAKARTSGCS

SEQ ID NO: 3096584 - protein, 4 aa, Giardia lamblia
SALA

SEQ ID NO: 3096585 - protein, 4 aa, Giardia lamblia
SANK

SEQ ID NO: 3096586 - protein, 4 aa, Giardia lamblia
SANV

SEQ ID NO: 3096587 - protein, 7 aa, Giardia lamblia
SAPLSQK

SEQ ID NO: 3096588 - protein, 14 aa, Giardia lamblia
SAPPTAGSMIHVMG

SEQ ID NO: 3096589 - protein, 4 aa, Giardia lamblia
SAPS

SEQ ID NO: 3096590 - protein, 8 aa, Giardia lamblia
SAPTPSVD

SEQ ID NO: 3096591 - protein, 34 aa, Giardia lamblia
SAQSAGQAQPKCNEDGGGGSHRRRAVGRVARCSA

SEQ ID NO: 3096592 - protein, 4 aa, Giardia lamblia
SATE

SEQ ID NO: 3096593 - protein, 9 aa, Giardia lamblia
SDDRKNKPI

SEQ ID NO: 3096594 - protein, 4 aa, Giardia lamblia
SDEE

SEQ ID NO: 3096595 - protein, 7 aa, Giardia lamblia
SDQVGRD

SEQ ID NO: 3096596 - protein, 10 aa, Giardia lamblia
SDRGADDAAP

SEQ ID NO: 3096597 - protein, 4 aa, Giardia lamblia
SDSS

SEQ ID NO: 3096598 - protein, 25 aa, Giardia lamblia
SDTLKKATESSKALEDGDAGPRGSQ

SEQ ID NO: 3096599 - protein, 4 aa, Giardia lamblia
SEAK

SEQ ID NO: 3096600 - protein, 9 aa, Giardia lamblia
SEASNLAKI

SEQ ID NO: 3096601 - protein, 5 aa, Giardia lamblia
SEDIK

SEQ ID NO: 3096602 - protein, 8 aa, Giardia lamblia
SEGISRNS

SEQ ID NO: 3096603 - protein, 8 aa, Giardia lamblia
SEKAGEVY

SEQ ID NO: 3096604 - protein, 4 aa, Giardia lamblia
SELP

SEQ ID NO: 3096605 - protein, 4 aa, Giardia lamblia
SERI

SEQ ID NO: 3096606 - protein, 5 aa, Giardia lamblia
SFDPG

SEQ ID NO: 3096607 - protein, 5 aa, Giardia lamblia
SGAQN

SEQ ID NO: 3096608 - protein, 4 aa, Giardia lamblia
SGHA

SEQ ID NO: 3096609 - protein, 12 aa, Giardia lamblia
SGKEDAANNYAR

SEQ ID NO: 3096610 - protein, 5 aa, Giardia lamblia
SGKTT

SEQ ID NO: 3096611 - protein, 4 aa, Giardia lamblia
SGLE

SEQ ID NO: 3096612 - protein, 8 aa, Giardia lamblia
SGLSKSDI

SEQ ID NO: 3096613 - protein, 10 aa, Giardia lamblia
SGMKDSDGQT

SEQ ID NO: 3096614 - protein, 6 aa, Giardia lamblia
SGMSNG

SEQ ID NO: 3096615 - protein, 4 aa, Giardia lamblia
SGNK

SEQ ID NO: 3096616 - protein, 4 aa, Giardia lamblia
SGNL

SEQ ID NO: 3096617 - protein, 5 aa, Giardia lamblia
SGPLK

SEQ ID NO: 3096618 - protein, 5 aa, Giardia lamblia
SGPTT

SEQ ID NO: 3096619 - protein, 4 aa, Giardia lamblia
SGSI

SEQ ID NO: 3096620 - protein, 13 aa, Giardia lamblia
SGSLGRSAVGGDL

SEQ ID NO: 3096621 - protein, 5 aa, Giardia lamblia
SGTYG

SEQ ID NO: 3096622 - protein, 9 aa, Giardia lamblia
SHAQRSMTR

SEQ ID NO: 3096623 - protein, 4 aa, Giardia lamblia
SHRT

SEQ ID NO: 3096624 - protein, 4 aa, Giardia lamblia
SIAP

SEQ ID NO: 3096625 - protein, 4 aa, Giardia lamblia
SKAE

SEQ ID NO: 3096626 - protein, 7 aa, Giardia lamblia
SKDESPV

SEQ ID NO: 3096627 - protein, 9 aa, Giardia lamblia
SKPENITGS

SEQ ID NO: 3096628 - protein, 14 aa, Giardia lamblia
SKRNTIGKKDIESA

SEQ ID NO: 3096629 - protein, 5 aa, Giardia lamblia
SLASD

SEQ ID NO: 3096630 - protein, 7 aa, Giardia lamblia
SLGGNSK

SEQ ID NO: 3096631 - protein, 4 aa, Giardia lamblia
SLGS

SEQ ID NO: 3096632 - protein, 5 aa, Giardia lamblia
SLTPD

SEQ ID NO: 3096633 - protein, 6 aa, Giardia lamblia
SLTSEN

SEQ ID NO: 3096634 - protein, 4 aa, Giardia lamblia
SNAV

SEQ ID NO: 3096635 - protein, 4 aa, Giardia lamblia
SNDP

SEQ ID NO: 3096636 - protein, 5 aa, Giardia lamblia
SNIEA

SEQ ID NO: 3096637 - protein, 4 aa, Giardia lamblia
SNNE

SEQ ID NO: 3096638 - protein, 4 aa, Giardia lamblia
SNNT

SEQ ID NO: 3096639 - protein, 4 aa, Giardia lamblia
SNPD

SEQ ID NO: 3096640 - protein, 10 aa, Giardia lamblia
SPASTNYDES

SEQ ID NO: 3096641 - protein, 5 aa, Giardia lamblia
SPDGA

SEQ ID NO: 3096642 - protein, 4 aa, Giardia lamblia
SPER

SEQ ID NO: 3096643 - protein, 23 aa, Giardia lamblia
SPGHTGGWPVGTGDGPLGRPTRQ

SEQ ID NO: 3096644 - protein, 5 aa, Giardia lamblia
SPNDP

SEQ ID NO: 3096645 - protein, 7 aa, Giardia lamblia
SPRDPTV

SEQ ID NO: 3096646 - protein, 4 aa, Giardia lamblia
SPSL

SEQ ID NO: 3096647 - protein, 7 aa, Giardia lamblia
SPSLPNA

SEQ ID NO: 3096648 - protein, 7 aa, Giardia lamblia
SPTPGQH

SEQ ID NO: 3096649 - protein, 4 aa, Giardia lamblia
SQAN

SEQ ID NO: 3096650 - protein, 4 aa, Giardia lamblia
SQDT

SEQ ID NO: 3096651 - protein, 4 aa, Giardia lamblia
SQQE

SEQ ID NO: 3096652 - protein, 5 aa, Giardia lamblia
SQSAE

SEQ ID NO: 3096653 - protein, 4 aa, Giardia lamblia
SQVT

SEQ ID NO: 3096654 - protein, 6 aa, Giardia lamblia
SRAAEW

SEQ ID NO: 3096655 - protein, 8 aa, Giardia lamblia
SRKVTEAN

SEQ ID NO: 3096656 - protein, 4 aa, Giardia lamblia
SRSY

SEQ ID NO: 3096657 - protein, 8 aa, Giardia lamblia
SSASPAGE

SEQ ID NO: 3096658 - protein, 4 aa, Giardia lamblia
SSDA

SEQ ID NO: 3096659 - protein, 4 aa, Giardia lamblia
SSEI

SEQ ID NO: 3096660 - protein, 13 aa, Giardia lamblia
SSGAAKAGDPAYM

SEQ ID NO: 3096661 - protein, 4 aa, Giardia lamblia
SSGL

SEQ ID NO: 3096662 - protein, 6 aa, Giardia lamblia
SSGNAG

SEQ ID NO: 3096663 - protein, 7 aa, Giardia lamblia
SSGQPAQ

SEQ ID NO: 3096664 - protein, 5 aa, Giardia lamblia
SSITT

SEQ ID NO: 3096665 - protein, 10 aa, Giardia lamblia
SSLPQSHEAH

SEQ ID NO: 3096666 - protein, 4 aa, Giardia lamblia
SSPE

SEQ ID NO: 3096667 - protein, 13 aa, Giardia lamblia
SSPSASANYAEPE

SEQ ID NO: 3096668 - protein, 4 aa, Giardia lamblia
SSRL

SEQ ID NO: 3096669 - protein, 8 aa, Giardia lamblia
SSRRPLGR

SEQ ID NO: 3096670 - protein, 4 aa, Giardia lamblia
SSRS

SEQ ID NO: 3096671 - protein, 8 aa, Giardia lamblia
SSSPDEAL

SEQ ID NO: 3096672 - protein, 4 aa, Giardia lamblia
STEE

SEQ ID NO: 3096673 - protein, 6 aa, Giardia lamblia
STEYGR

SEQ ID NO: 3096674 - protein, 4 aa, Giardia lamblia
STIS

SEQ ID NO: 3096675 - protein, 4 aa, Giardia lamblia
STPS

SEQ ID NO: 3096676 - protein, 4 aa, Giardia lamblia
STSL

SEQ ID NO: 3096677 - protein, 4 aa, Giardia lamblia
STST

SEQ ID NO: 3096678 - protein, 4 aa, Giardia lamblia
STTL

SEQ ID NO: 3096679 - protein, 6 aa, Giardia lamblia
STTTAI

SEQ ID NO: 3096680 - protein, 4 aa, Giardia lamblia
STYT

SEQ ID NO: 3096681 - protein, 16 aa, Giardia lamblia
SVGPARALSAPYQPAS

SEQ ID NO: 3096682 - protein, 4 aa, Giardia lamblia
SVSG

SEQ ID NO: 3096683 - protein, 4 aa, Giardia lamblia
TAAD

SEQ ID NO: 3096684 - protein, 9 aa, Giardia lamblia
TAGGQPFKN

SEQ ID NO: 3096685 - protein, 20 aa, Giardia lamblia
TAGIEGDLDSRDQEAHGNDR

SEQ ID NO: 3096686 - protein, 29 aa, Giardia lamblia
TAKRESTPFPAEEANNVSRRGRKDMTTGI

SEQ ID NO: 3096687 - protein, 4 aa, Giardia lamblia
TALP

SEQ ID NO: 3096688 - protein, 10 aa, Giardia lamblia
TAPGSGKTAA

SEQ ID NO: 3096689 - protein, 12 aa, Giardia lamblia
TATEKERWPRTT

SEQ ID NO: 3096690 - protein, 4 aa, Giardia lamblia
TDPG

SEQ ID NO: 3096691 - protein, 6 aa, Giardia lamblia
TDPTQF

SEQ ID NO: 3096692 - protein, 6 aa, Giardia lamblia
TDRSSS

SEQ ID NO: 3096693 - protein, 4 aa, Giardia lamblia
TEER

SEQ ID NO: 3096694 - protein, 4 aa, Giardia lamblia
TEGV

SEQ ID NO: 3096695 - protein, 21 aa, Giardia lamblia
TERGLSSAPGEQVLSRAAQKH

SEQ ID NO: 3096696 - protein, 6 aa, Giardia lamblia
TERQQQ

SEQ ID NO: 3096697 - protein, 8 aa, Giardia lamblia
TGANGYKG

SEQ ID NO: 3096698 - protein, 5 aa, Giardia lamblia
TGSGK

SEQ ID NO: 3096699 - protein, 4 aa, Giardia lamblia
TGSP

SEQ ID NO: 3096700 - protein, 7 aa, Giardia lamblia
TGSTPIP

SEQ ID NO: 3096701 - protein, 6 aa, Giardia lamblia
TGTSQA

SEQ ID NO: 3096702 - protein, 6 aa, Giardia lamblia
THAPEE

SEQ ID NO: 3096703 - protein, 6 aa, Giardia lamblia
TKGGAH

SEQ ID NO: 3096704 - protein, 9 aa, Giardia lamblia
TKNALNSLP

SEQ ID NO: 3096705 - protein, 4 aa, Giardia lamblia
TKNI

SEQ ID NO: 3096706 - protein, 4 aa, Giardia lamblia
TKQR

SEQ ID NO: 3096707 - protein, 8 aa, Giardia lamblia
TKRTHYGT

SEQ ID NO: 3096708 - protein, 4 aa, Giardia lamblia
TKTA

SEQ ID NO: 3096709 - protein, 6 aa, Giardia lamblia
TLGPRG

SEQ ID NO: 3096710 - protein, 7 aa, Giardia lamblia
TNDPPVG

SEQ ID NO: 3096711 - protein, 4 aa, Giardia lamblia
TNPT

SEQ ID NO: 3096712 - protein, 4 aa, Giardia lamblia
TPAE

SEQ ID NO: 3096713 - protein, 25 aa, Giardia lamblia
TPASGQSGGVLTEEERALKERDGSI

SEQ ID NO: 3096714 - protein, 22 aa, Giardia lamblia
TPEDVGAAIPDNPSCGDHEGST

SEQ ID NO: 3096715 - protein, 24 aa, Giardia lamblia
TPEKNDTIIPDPEKKKEYFSKTFK

SEQ ID NO: 3096716 - protein, 4 aa, Giardia lamblia
TPLQ

SEQ ID NO: 3096717 - protein, 8 aa, Giardia lamblia
TPPGTSDE

SEQ ID NO: 3096718 - protein, 4 aa, Giardia lamblia
TPQE

SEQ ID NO: 3096719 - protein, 10 aa, Giardia lamblia
TPSPDASSAP

SEQ ID NO: 3096720 - protein, 6 aa, Giardia lamblia
TQAGKS

SEQ ID NO: 3096721 - protein, 11 aa, Giardia lamblia
TQLQNTNPVSR

SEQ ID NO: 3096722 - protein, 39 aa, Giardia lamblia
TQPLRPQSARAPYTPSGSEYRIPAKDRPLPRSNSAGSFT

SEQ ID NO: 3096723 - protein, 8 aa, Giardia lamblia
TQTKPYDT

SEQ ID NO: 3096724 - protein, 6 aa, Giardia lamblia
TRGHPE

SEQ ID NO: 3096725 - protein, 4 aa, Giardia lamblia
TRHD

SEQ ID NO: 3096726 - protein, 15 aa, Giardia lamblia
TRPAALADSPLDTQT

SEQ ID NO: 3096727 - protein, 5 aa, Giardia lamblia
TRPNE

SEQ ID NO: 3096728 - protein, 4 aa, Giardia lamblia
TRRV

SEQ ID NO: 3096729 - protein, 6 aa, Giardia lamblia
TRTGSI

SEQ ID NO: 3096730 - protein, 4 aa, Giardia lamblia
TSAE

SEQ ID NO: 3096731 - protein, 15 aa, Giardia lamblia
TSATVMDGLAGQIRM

SEQ ID NO: 3096732 - protein, 6 aa, Giardia lamblia
TSDERA

SEQ ID NO: 3096733 - protein, 4 aa, Giardia lamblia
TSDI

SEQ ID NO: 3096734 - protein, 18 aa, Giardia lamblia
TSDKADYEEFDRRRTRHQ

SEQ ID NO: 3096735 - protein, 5 aa, Giardia lamblia
TSDRP

SEQ ID NO: 3096736 - protein, 6 aa, Giardia lamblia
TSGWTG

SEQ ID NO: 3096737 - protein, 4 aa, Giardia lamblia
TSPV

SEQ ID NO: 3096738 - protein, 6 aa, Giardia lamblia
TSQEGG

SEQ ID NO: 3096739 - protein, 7 aa, Giardia lamblia
TSQVSEV

SEQ ID NO: 3096740 - protein, 4 aa, Giardia lamblia
TSTL

SEQ ID NO: 3096741 - protein, 4 aa, Giardia lamblia
TTEK

SEQ ID NO: 3096742 - protein, 16 aa, Giardia lamblia
TTETDLGRDSHKDSSF

SEQ ID NO: 3096743 - protein, 22 aa, Giardia lamblia
TTETDLGRGSHKDSNVVDHGSN

SEQ ID NO: 3096744 - protein, 4 aa, Giardia lamblia
TTGM

SEQ ID NO: 3096745 - protein, 6 aa, Giardia lamblia
TTHPEA

SEQ ID NO: 3096746 - protein, 6 aa, Giardia lamblia
TTSPSA

SEQ ID NO: 3096747 - protein, 8 aa, Giardia lamblia
TTTDGDQH

SEQ ID NO: 3096748 - protein, 4 aa, Giardia lamblia
TTTE

SEQ ID NO: 3096749 - protein, 4 aa, Giardia lamblia
TTVS

SEQ ID NO: 3096750 - protein, 5 aa, Giardia lamblia
TVGDL

SEQ ID NO: 3096751 - protein, 4 aa, Giardia lamblia
TVSS

SEQ ID NO: 3096752 - protein, 5 aa, Giardia lamblia
VDNRE

SEQ ID NO: 3096753 - protein, 4 aa, Giardia lamblia
VDST

SEQ ID NO: 3096754 - protein, 7 aa, Giardia lamblia
VGKTGGN

SEQ ID NO: 3096755 - protein, 7 aa, Giardia lamblia
VGTKTRG

SEQ ID NO: 3096756 - protein, 10 aa, Giardia lamblia
VKENEGLSKR

SEQ ID NO: 3096757 - protein, 16 aa, Giardia lamblia
VKTKSTKIDALEDQSK

SEQ ID NO: 3096758 - protein, 17 aa, Giardia lamblia
VKTKSTKIDALEDQSKE

SEQ ID NO: 3096759 - protein, 9 aa, Giardia lamblia
VNEKYPTNY

SEQ ID NO: 3096760 - protein, 5 aa, Giardia lamblia
VPAGA

SEQ ID NO: 3096761 - protein, 25 aa, Giardia lamblia
VPEGATSSGTPLQKQEPDSGVVRNS

SEQ ID NO: 3096762 - protein, 4 aa, Giardia lamblia
VQEE

SEQ ID NO: 3096763 - protein, 9 aa, Giardia lamblia
VQPSSGAAR

SEQ ID NO: 3096764 - protein, 7 aa, Giardia lamblia
VQSRTNG

SEQ ID NO: 3096765 - protein, 10 aa, Giardia lamblia
VRTGQRDKQK

SEQ ID NO: 3096766 - protein, 11 aa, Giardia lamblia
VTQPREQASAV

SEQ ID NO: 3096767 - protein, 10 aa, Giardia lamblia
VTRGRGSAEL

SEQ ID NO: 3096768 - protein, 4 aa, Giardia lamblia
VTVE

SEQ ID NO: 3096769 - protein, 10 aa, Giardia lamblia
YAERISSDAP

SEQ ID NO: 3096770 - protein, 11 aa, Giardia lamblia
YASGPQPAPLD

SEQ ID NO: 3096771 - protein, 5 aa, Giardia lamblia
YDGAE

SEQ ID NO: 3096772 - protein, 5 aa, Giardia lamblia
YDPAS

SEQ ID NO: 3096773 - protein, 6 aa, Giardia lamblia
YEPTAS

SEQ ID NO: 3096774 - protein, 8 aa, Giardia lamblia
YGQPDNQC

SEQ ID NO: 3096775 - protein, 5 aa, Giardia lamblia
YGRKS

SEQ ID NO: 3096776 - protein, 5 aa, Giardia lamblia
YLDGD

SEQ ID NO: 3096777 - protein, 27 aa, Giardia lamblia
YNAKHKKGKKGKRSKKVVEEDDQAEEQ

SEQ ID NO: 3096778 - protein, 30 aa, Giardia lamblia
YNDETPSSPQDEDETGTSVPENSLSAPPES

SEQ ID NO: 3096779 - protein, 4 aa, Giardia lamblia
YPNT

SEQ ID NO: 3096780 - protein, 9 aa, Giardia lamblia
YRDPSGVRA

SEQ ID NO: 3096781 - protein, 9 aa, Giardia lamblia
YSETVTKDS

SEQ ID NO: 3096782 - protein, 9 aa, Giardia lamblia
YSPISTGTT

SEQ ID NO: 3096783 - protein, 13 aa, Giardia lamblia
AAAAAASRNKNKF

SEQ ID NO: 3096784 - protein, 13 aa, Giardia lamblia
AAAAADDADSKHD

SEQ ID NO: 3096785 - protein, 8 aa, Giardia lamblia
AAAAEDAT

SEQ ID NO: 3096786 - protein, 11 aa, Giardia lamblia
AAAAPGDSPVR

SEQ ID NO: 3096787 - protein, 15 aa, Giardia lamblia
AAAAQEGSAADQHDQ

SEQ ID NO: 3096788 - protein, 9 aa, Giardia lamblia
AAAASSAEF

SEQ ID NO: 3096789 - protein, 11 aa, Giardia lamblia
AAADERGARLR

SEQ ID NO: 3096790 - protein, 8 aa, Giardia lamblia
AAADGSKV

SEQ ID NO: 3096791 - protein, 8 aa, Giardia lamblia
AAADKSVA

SEQ ID NO: 3096792 - protein, 11 aa, Giardia lamblia
AAADTGSDHSI

SEQ ID NO: 3096793 - protein, 8 aa, Giardia lamblia
AAADTPPN

SEQ ID NO: 3096794 - protein, 17 aa, Giardia lamblia
AAAEARTDAERKNAEIS

SEQ ID NO: 3096795 - protein, 12 aa, Giardia lamblia
AAAENAQANGHD

SEQ ID NO: 3096796 - protein, 8 aa, Giardia lamblia
AAAEQTRE

SEQ ID NO: 3096797 - protein, 17 aa, Giardia lamblia
AAAETASRHSRVKHPQD

SEQ ID NO: 3096798 - protein, 7 aa, Giardia lamblia
AAAETVK

SEQ ID NO: 3096799 - protein, 5 aa, Giardia lamblia
AAAGD

SEQ ID NO: 3096800 - protein, 10 aa, Giardia lamblia
AAAGKSQEAI

SEQ ID NO: 3096801 - protein, 5 aa, Giardia lamblia
AAAGL

SEQ ID NO: 3096802 - protein, 9 aa, Giardia lamblia
AAAGPINAQ

SEQ ID NO: 3096803 - protein, 8 aa, Giardia lamblia
AAAHTTTL

SEQ ID NO: 3096804 - protein, 10 aa, Giardia lamblia
AAAKGDRAAM

SEQ ID NO: 3096805 - protein, 8 aa, Giardia lamblia
AAAKKEET

SEQ ID NO: 3096806 - protein, 15 aa, Giardia lamblia
AAAKPLMPKNGAQDL

SEQ ID NO: 3096807 - protein, 6 aa, Giardia lamblia
AAAKRQ

SEQ ID NO: 3096808 - protein, 4 aa, Giardia lamblia
AAAN

SEQ ID NO: 3096809 - protein, 9 aa, Giardia lamblia
AAANEQTHT

SEQ ID NO: 3096810 - protein, 8 aa, Giardia lamblia
AAANNPRK

SEQ ID NO: 3096811 - protein, 6 aa, Giardia lamblia
AAANNT

SEQ ID NO: 3096812 - protein, 23 aa, Giardia lamblia
AAANPPPPVQAPVSAAAPRAGEA

SEQ ID NO: 3096813 - protein, 46 aa, Giardia lamblia
AAANPRIGTTRPSSAYSSKKLKSTPTYETPEKRRRCSSARQESGRV

SEQ ID NO: 3096814 - protein, 23 aa, Giardia lamblia
AAANPSVADMPSPVTLTGTSPTH

SEQ ID NO: 3096815 - protein, 4 aa, Giardia lamblia
AAAP

SEQ ID NO: 3096816 - protein, 14 aa, Giardia lamblia
AAAPGPYAAYPTNT

SEQ ID NO: 3096817 - protein, 8 aa, Giardia lamblia
AAAPGSHA

SEQ ID NO: 3096818 - protein, 7 aa, Giardia lamblia
AAAQDTD

SEQ ID NO: 3096819 - protein, 4 aa, Giardia lamblia
AAAS

SEQ ID NO: 3096820 - protein, 33 aa, Giardia lamblia
AAASATTSTTTTASSPGQKDDQEVEDNNNSSEV

SEQ ID NO: 3096821 - protein, 7 aa, Giardia lamblia
AAASGEN

SEQ ID NO: 3096822 - protein, 8 aa, Giardia lamblia
AAASGGYT

SEQ ID NO: 3096823 - protein, 6 aa, Giardia lamblia
AAASGH

SEQ ID NO: 3096824 - protein, 7 aa, Giardia lamblia
AAASGKL

SEQ ID NO: 3096825 - protein, 15 aa, Giardia lamblia
AAASNTNSSSNQPRL

SEQ ID NO: 3096826 - protein, 8 aa, Giardia lamblia
AAASPLSP

SEQ ID NO: 3096827 - protein, 5 aa, Giardia lamblia
AAASR

SEQ ID NO: 3096828 - protein, 13 aa, Giardia lamblia
AAASRARANAGSE

SEQ ID NO: 3096829 - protein, 17 aa, Giardia lamblia
AAASTATSNAAPLNNSK

SEQ ID NO: 3096830 - protein, 6 aa, Giardia lamblia
AAASTI

SEQ ID NO: 3096831 - protein, 8 aa, Giardia lamblia
AAATGSSK

SEQ ID NO: 3096832 - protein, 14 aa, Giardia lamblia
AAATLKEDNPDAAN

SEQ ID NO: 3096833 - protein, 18 aa, Giardia lamblia
AAATNAAAATTASSLVDS

SEQ ID NO: 3096834 - protein, 17 aa, Giardia lamblia
AAATTASSTDSTFGNCS

SEQ ID NO: 3096835 - protein, 5 aa, Giardia lamblia
AAAVS

SEQ ID NO: 3096836 - protein, 11 aa, Giardia lamblia
AAAYAQKQNQQ

SEQ ID NO: 3096837 - protein, 13 aa, Giardia lamblia
AACADSKSAQGMR

SEQ ID NO: 3096838 - protein, 15 aa, Giardia lamblia
AACEPEDLHKPAVDI

SEQ ID NO: 3096839 - protein, 7 aa, Giardia lamblia
AADAKRI

SEQ ID NO: 3096840 - protein, 6 aa, Giardia lamblia
AADAPV

SEQ ID NO: 3096841 - protein, 7 aa, Giardia lamblia
AADDAES

SEQ ID NO: 3096842 - protein, 5 aa, Giardia lamblia
AADDD

SEQ ID NO: 3096843 - protein, 11 aa, Giardia lamblia
AADEEDGAECQ

SEQ ID NO: 3096844 - protein, 9 aa, Giardia lamblia
AADFTEAEA

SEQ ID NO: 3096845 - protein, 7 aa, Giardia lamblia
AADGDAV

SEQ ID NO: 3096846 - protein, 6 aa, Giardia lamblia
AADGGL

SEQ ID NO: 3096847 - protein, 10 aa, Giardia lamblia
AADGRGKGRQ

SEQ ID NO: 3096848 - protein, 7 aa, Giardia lamblia
AADGSSC

SEQ ID NO: 3096849 - protein, 11 aa, Giardia lamblia
AADGSTDIEQT

SEQ ID NO: 3096850 - protein, 7 aa, Giardia lamblia
AADGTNI

SEQ ID NO: 3096851 - protein, 7 aa, Giardia lamblia
AADGTYI

SEQ ID NO: 3096852 - protein, 14 aa, Giardia lamblia
AADKAEHTTRPVSR

SEQ ID NO: 3096853 - protein, 14 aa, Giardia lamblia
AADKGKEVADKEHS

SEQ ID NO: 3096854 - protein, 21 aa, Giardia lamblia
AADKHSEKIHPKTRKTQRAMS

SEQ ID NO: 3096855 - protein, 11 aa, Giardia lamblia
AADKISTECSG

SEQ ID NO: 3096856 - protein, 33 aa, Giardia lamblia
AADLSKDDSLSSRGTPSRSHSLGRTASNPDTRS

SEQ ID NO: 3096857 - protein, 9 aa, Giardia lamblia
AADMTDDPA

SEQ ID NO: 3096858 - protein, 12 aa, Giardia lamblia
AADNEADDSGAS

SEQ ID NO: 3096859 - protein, 8 aa, Giardia lamblia
AADNGTPI

SEQ ID NO: 3096860 - protein, 8 aa, Giardia lamblia
AADPPRKR

SEQ ID NO: 3096861 - protein, 8 aa, Giardia lamblia
AADPSGAL

SEQ ID NO: 3096862 - protein, 6 aa, Giardia lamblia
AADPVP

SEQ ID NO: 3096863 - protein, 4 aa, Giardia lamblia
AADQ

SEQ ID NO: 3096864 - protein, 5 aa, Giardia lamblia
AADQD

SEQ ID NO: 3096865 - protein, 6 aa, Giardia lamblia
AADQKK

SEQ ID NO: 3096866 - protein, 14 aa, Giardia lamblia
AADQLAAQRATDAY

SEQ ID NO: 3096867 - protein, 11 aa, Giardia lamblia
AADRPKEDEEL

SEQ ID NO: 3096868 - protein, 13 aa, Giardia lamblia
AADSFDANKQATE

SEQ ID NO: 3096869 - protein, 16 aa, Giardia lamblia
AADSIRKNRSKPASAL

SEQ ID NO: 3096870 - protein, 10 aa, Giardia lamblia
AADTKAVKDL

SEQ ID NO: 3096871 - protein, 13 aa, Giardia lamblia
AADYPDEAAGSMG

SEQ ID NO: 3096872 - protein, 14 aa, Giardia lamblia
AAEADALRTENESL

SEQ ID NO: 3096873 - protein, 22 aa, Giardia lamblia
AAEAERDRYKQQITKGDSDRNI

SEQ ID NO: 3096874 - protein, 8 aa, Giardia lamblia
AAEAGATT

SEQ ID NO: 3096875 - protein, 8 aa, Giardia lamblia
AAEAGDSA

SEQ ID NO: 3096876 - protein, 5 aa, Giardia lamblia
AAEAN

SEQ ID NO: 3096877 - protein, 16 aa, Giardia lamblia
AAEARSKSTGKPQTAK

SEQ ID NO: 3096878 - protein, 16 aa, Giardia lamblia
AAEASSKSVRSPLTSS

SEQ ID NO: 3096879 - protein, 4 aa, Giardia lamblia
AAED

SEQ ID NO: 3096880 - protein, 9 aa, Giardia lamblia
AAEDGQKSF

SEQ ID NO: 3096881 - protein, 14 aa, Giardia lamblia
AAEDTTPQGIDRGS

SEQ ID NO: 3096882 - protein, 30 aa, Giardia lamblia
AAEEAAIEERKAKEAEAEKIRRKKEAEFAA

SEQ ID NO: 3096883 - protein, 11 aa, Giardia lamblia
AAEEEHRQCEE

SEQ ID NO: 3096884 - protein, 11 aa, Giardia lamblia
AAEEEVQNSNL

SEQ ID NO: 3096885 - protein, 6 aa, Giardia lamblia
AAEEFA

SEQ ID NO: 3096886 - protein, 9 aa, Giardia lamblia
AAEEGGSWQ

SEQ ID NO: 3096887 - protein, 6 aa, Giardia lamblia
AAEEHT

SEQ ID NO: 3096888 - protein, 11 aa, Giardia lamblia
AAEEKQRQEME

SEQ ID NO: 3096889 - protein, 12 aa, Giardia lamblia
AAEELTKKSQTH

SEQ ID NO: 3096890 - protein, 8 aa, Giardia lamblia
AAEENTDI

SEQ ID NO: 3096891 - protein, 49 aa, Giardia lamblia
AAEEREKDTPNDQATVSEQPFTDVPGKDDNQRKRKTKKKNEESTDGEED

SEQ ID NO: 3096892 - protein, 9 aa, Giardia lamblia
AAEGGHTTF

SEQ ID NO: 3096893 - protein, 10 aa, Giardia lamblia
AAEGKPFSPR

SEQ ID NO: 3096894 - protein, 8 aa, Giardia lamblia
AAEGNAGT

SEQ ID NO: 3096895 - protein, 11 aa, Giardia lamblia
AAEKDQQIDTM

SEQ ID NO: 3096896 - protein, 5 aa, Giardia lamblia
AAEKE

SEQ ID NO: 3096897 - protein, 9 aa, Giardia lamblia
AAEKEEDDY

SEQ ID NO: 3096898 - protein, 8 aa, Giardia lamblia
AAEKGDKV

SEQ ID NO: 3096899 - protein, 6 aa, Giardia lamblia
AAEKRN

SEQ ID NO: 3096900 - protein, 9 aa, Giardia lamblia
AAEKTLSEG

SEQ ID NO: 3096901 - protein, 14 aa, Giardia lamblia
AAEKVAEENQRKAA

SEQ ID NO: 3096902 - protein, 4 aa, Giardia lamblia
AAEL

SEQ ID NO: 3096903 - protein, 19 aa, Giardia lamblia
AAELEGKLSTSATALAGKT

SEQ ID NO: 3096904 - protein, 23 aa, Giardia lamblia
AAENESLKQELKASAKKNTDLTQ

SEQ ID NO: 3096905 - protein, 9 aa, Giardia lamblia
AAENGDTDA

SEQ ID NO: 3096906 - protein, 6 aa, Giardia lamblia
AAENGF

SEQ ID NO: 3096907 - protein, 8 aa, Giardia lamblia
AAENGHAE

SEQ ID NO: 3096908 - protein, 12 aa, Giardia lamblia
AAENKEADKRER

SEQ ID NO: 3096909 - protein, 10 aa, Giardia lamblia
AAEPGQDQYS

SEQ ID NO: 3096910 - protein, 8 aa, Giardia lamblia
AAEPPYSH

SEQ ID NO: 3096911 - protein, 18 aa, Giardia lamblia
AAEPQKRSKSAAREDLER

SEQ ID NO: 3096912 - protein, 9 aa, Giardia lamblia
AAEQNKEEI

SEQ ID NO: 3096913 - protein, 14 aa, Giardia lamblia
AAEREDAPASTVGS

SEQ ID NO: 3096914 - protein, 6 aa, Giardia lamblia
AAERGN

SEQ ID NO: 3096915 - protein, 52 aa, Giardia lamblia
AAERPKTSGTKSRPASRAASKSGTRAKSSDKKEQKPITKKKKVSSKPQQDVM

SEQ ID NO: 3096916 - protein, 16 aa, Giardia lamblia
AAERRAEEQREADSIQ

SEQ ID NO: 3096917 - protein, 8 aa, Giardia lamblia
AAESGNAQ

SEQ ID NO: 3096918 - protein, 24 aa, Giardia lamblia
AAESISGKFTPELPQSPIRMLPLS

SEQ ID NO: 3096919 - protein, 8 aa, Giardia lamblia
AAESKEQS

SEQ ID NO: 3096920 - protein, 25 aa, Giardia lamblia
AAESSNDSSPDEDLSVASTSNNDRH

SEQ ID NO: 3096921 - protein, 18 aa, Giardia lamblia
AAETAATAISSSVSNTLS

SEQ ID NO: 3096922 - protein, 14 aa, Giardia lamblia
AAETDEANAGTLGQ

SEQ ID NO: 3096923 - protein, 9 aa, Giardia lamblia
AAETDEPTA

SEQ ID NO: 3096924 - protein, 5 aa, Giardia lamblia
AAETG

SEQ ID NO: 3096925 - protein, 6 aa, Giardia lamblia
AAETGD

SEQ ID NO: 3096926 - protein, 54 aa, Giardia lamblia
AAETQKQHYPTNNGSNIRYPTPKSGRAGSTSGNALRSSVSGATPRMAGTPGANL

SEQ ID NO: 3096927 - protein, 12 aa, Giardia lamblia
AAETRSSSIRSQ

SEQ ID NO: 3096928 - protein, 5 aa, Giardia lamblia
AAEVD

SEQ ID NO: 3096929 - protein, 4 aa, Giardia lamblia
AAEY

SEQ ID NO: 3096930 - protein, 23 aa, Giardia lamblia
AAGADKSYAISQRNSVERIAVSN

SEQ ID NO: 3096931 - protein, 5 aa, Giardia lamblia
AAGAG

SEQ ID NO: 3096932 - protein, 15 aa, Giardia lamblia
AAGAVSQGGSAHRDA

SEQ ID NO: 3096933 - protein, 7 aa, Giardia lamblia
AAGDAPS

SEQ ID NO: 3096934 - protein, 6 aa, Giardia lamblia
AAGDVQ

SEQ ID NO: 3096935 - protein, 8 aa, Giardia lamblia
AAGEGSAQ

SEQ ID NO: 3096936 - protein, 15 aa, Giardia lamblia
AAGEHGGSGEDVGAK

SEQ ID NO: 3096937 - protein, 9 aa, Giardia lamblia
AAGEQTNSN

SEQ ID NO: 3096938 - protein, 4 aa, Giardia lamblia
AAGG

SEQ ID NO: 3096939 - protein, 8 aa, Giardia lamblia
AAGGQTGS

SEQ ID NO: 3096940 - protein, 9 aa, Giardia lamblia
AAGGSRGTS

SEQ ID NO: 3096941 - protein, 6 aa, Giardia lamblia
AAGGST

SEQ ID NO: 3096942 - protein, 10 aa, Giardia lamblia
AAGGTKRGME

SEQ ID NO: 3096943 - protein, 4 aa, Giardia lamblia
AAGI

SEQ ID NO: 3096944 - protein, 5 aa, Giardia lamblia
AAGIV

SEQ ID NO: 3096945 - protein, 9 aa, Giardia lamblia
AAGKEDDTQ

SEQ ID NO: 3096946 - protein, 14 aa, Giardia lamblia
AAGKELKKQNLKGE

SEQ ID NO: 3096947 - protein, 12 aa, Giardia lamblia
AAGKRTEKKDMG

SEQ ID NO: 3096948 - protein, 9 aa, Giardia lamblia
AAGKSTLAS

SEQ ID NO: 3096949 - protein, 4 aa, Giardia lamblia
AAGL

SEQ ID NO: 3096950 - protein, 15 aa, Giardia lamblia
AAGLPGWTPQMSATN

SEQ ID NO: 3096951 - protein, 10 aa, Giardia lamblia
AAGMGGDTLS

SEQ ID NO: 3096952 - protein, 44 aa, Giardia lamblia
AAGMPPGGFPGGMPPGGFPGGFPGGMPGGAAPGGAPAGPSVDDL

SEQ ID NO: 3096953 - protein, 4 aa, Giardia lamblia
AAGN

SEQ ID NO: 3096954 - protein, 7 aa, Giardia lamblia
AAGNEDA

SEQ ID NO: 3096955 - protein, 7 aa, Giardia lamblia
AAGNSHA

SEQ ID NO: 3096956 - protein, 8 aa, Giardia lamblia
AAGPEPTA

SEQ ID NO: 3096957 - protein, 14 aa, Giardia lamblia
AAGPPRLPRAPDEA

SEQ ID NO: 3096958 - protein, 7 aa, Giardia lamblia
AAGPRGF

SEQ ID NO: 3096959 - protein, 14 aa, Giardia lamblia
AAGPRSNNGQLREG

SEQ ID NO: 3096960 - protein, 6 aa, Giardia lamblia
AAGPSE

SEQ ID NO: 3096961 - protein, 9 aa, Giardia lamblia
AAGPSGLGK

SEQ ID NO: 3096962 - protein, 4 aa, Giardia lamblia
AAGR

SEQ ID NO: 3096963 - protein, 7 aa, Giardia lamblia
AAGRTDT

SEQ ID NO: 3096964 - protein, 4 aa, Giardia lamblia
AAGS

SEQ ID NO: 3096965 - protein, 9 aa, Giardia lamblia
AAGSEYHSG

SEQ ID NO: 3096966 - protein, 19 aa, Giardia lamblia
AAGSGSKAALDAERWLAMQ

SEQ ID NO: 3096967 - protein, 6 aa, Giardia lamblia
AAGSLN

SEQ ID NO: 3096968 - protein, 6 aa, Giardia lamblia
AAGSRA

SEQ ID NO: 3096969 - protein, 26 aa, Giardia lamblia
AAGSRYGLSDQGQTPEIRSATAYQTK

SEQ ID NO: 3096970 - protein, 11 aa, Giardia lamblia
AAGSSASPAAT

SEQ ID NO: 3096971 - protein, 11 aa, Giardia lamblia
AAGSSSEETLA

SEQ ID NO: 3096972 - protein, 30 aa, Giardia lamblia
AAGTAGPAAPRAPPRPREAEPSGAQAVERR

SEQ ID NO: 3096973 - protein, 9 aa, Giardia lamblia
AAGTASEVT

SEQ ID NO: 3096974 - protein, 11 aa, Giardia lamblia
AAGTLSPTRKP

SEQ ID NO: 3096975 - protein, 10 aa, Giardia lamblia
AAGTNQYSGD

SEQ ID NO: 3096976 - protein, 8 aa, Giardia lamblia
AAGTPALG

SEQ ID NO: 3096977 - protein, 16 aa, Giardia lamblia
AAGTPIVEDESDTTRH

SEQ ID NO: 3096978 - protein, 9 aa, Giardia lamblia
AAGTRESSK

SEQ ID NO: 3096979 - protein, 8 aa, Giardia lamblia
AAGTSESD

SEQ ID NO: 3096980 - protein, 9 aa, Giardia lamblia
AAGTSSSVT

SEQ ID NO: 3096981 - protein, 6 aa, Giardia lamblia
AAGTTM

SEQ ID NO: 3096982 - protein, 7 aa, Giardia lamblia
AAGYTDD

SEQ ID NO: 3096983 - protein, 26 aa, Giardia lamblia
AAHAEDYKEYKGECDDAHNPYPTEGS

SEQ ID NO: 3096984 - protein, 4 aa, Giardia lamblia
AAHD

SEQ ID NO: 3096985 - protein, 7 aa, Giardia lamblia
AAHENAQ

SEQ ID NO: 3096986 - protein, 53 aa, Giardia lamblia
AAHKGSTDKRSSVQGETPFVTPSGSRKRSIYDKTTSFTDKSRRNSSQHAPHGR

SEQ ID NO: 3096987 - protein, 6 aa, Giardia lamblia
AAHPDS

SEQ ID NO: 3096988 - protein, 9 aa, Giardia lamblia
AAHPTSRGN

SEQ ID NO: 3096989 - protein, 6 aa, Giardia lamblia
AAHQPR

SEQ ID NO: 3096990 - protein, 5 aa, Giardia lamblia
AAHSM

SEQ ID NO: 3096991 - protein, 7 aa, Giardia lamblia
AAHSQRI

SEQ ID NO: 3096992 - protein, 8 aa, Giardia lamblia
AAHSTSQP

SEQ ID NO: 3096993 - protein, 16 aa, Giardia lamblia
AAHSYAGAVDNAGETG

SEQ ID NO: 3096994 - protein, 9 aa, Giardia lamblia
AAHTSDPNC

SEQ ID NO: 3096995 - protein, 9 aa, Giardia lamblia
AAIDARDAE

SEQ ID NO: 3096996 - protein, 14 aa, Giardia lamblia
AAIDGKIGDQESIP

SEQ ID NO: 3096997 - protein, 7 aa, Giardia lamblia
AAIGPGR

SEQ ID NO: 3096998 - protein, 19 aa, Giardia lamblia
AAIGPYTNHTTADESKPNA

SEQ ID NO: 3096999 - protein, 42 aa, Giardia lamblia
AAIPASDPPLTASAGKSLARMSPRDPRMDDRANGIQASPTNY

SEQ ID NO: 3097000 - protein, 6 aa, Giardia lamblia
AAIPGG

SEQ ID NO: 3097001 - protein, 15 aa, Giardia lamblia
AAIPPAASNEPRAEV

SEQ ID NO: 3097002 - protein, 8 aa, Giardia lamblia
AAIPPSIG

SEQ ID NO: 3097003 - protein, 14 aa, Giardia lamblia
AAIPQGAHGETVTG

SEQ ID NO: 3097004 - protein, 9 aa, Giardia lamblia
AAITGDPQY

SEQ ID NO: 3097005 - protein, 9 aa, Giardia lamblia
AAKAAKKLE

SEQ ID NO: 3097006 - protein, 7 aa, Giardia lamblia
AAKAHRN

SEQ ID NO: 3097007 - protein, 20 aa, Giardia lamblia
AAKANHEAKERSKAQRQEEL

SEQ ID NO: 3097008 - protein, 7 aa, Giardia lamblia
AAKAPAR

SEQ ID NO: 3097009 - protein, 44 aa, Giardia lamblia
AAKAPLGTKARSTKAVSGANSGTAKASAKVALSGTDEHAQPERK

SEQ ID NO: 3097010 - protein, 13 aa, Giardia lamblia
AAKAYQGATSDDI

SEQ ID NO: 3097011 - protein, 6 aa, Giardia lamblia
AAKDAE

SEQ ID NO: 3097012 - protein, 8 aa, Giardia lamblia
AAKDGSRL

SEQ ID NO: 3097013 - protein, 7 aa, Giardia lamblia
AAKDKQI

SEQ ID NO: 3097014 - protein, 10 aa, Giardia lamblia
AAKDPSNRKN

SEQ ID NO: 3097015 - protein, 5 aa, Giardia lamblia
AAKEQ

SEQ ID NO: 3097016 - protein, 6 aa, Giardia lamblia
AAKEQL

SEQ ID NO: 3097017 - protein, 9 aa, Giardia lamblia
AAKESPKPI

SEQ ID NO: 3097018 - protein, 6 aa, Giardia lamblia
AAKETQ

SEQ ID NO: 3097019 - protein, 16 aa, Giardia lamblia
AAKGCKGSEALCTVLG

SEQ ID NO: 3097020 - protein, 8 aa, Giardia lamblia
AAKGDVEA

SEQ ID NO: 3097021 - protein, 7 aa, Giardia lamblia
AAKGEYW

SEQ ID NO: 3097022 - protein, 11 aa, Giardia lamblia
AAKGKDETIEQ

SEQ ID NO: 3097023 - protein, 8 aa, Giardia lamblia
AAKGPQEV

SEQ ID NO: 3097024 - protein, 10 aa, Giardia lamblia
AAKGRKNAFG

SEQ ID NO: 3097025 - protein, 8 aa, Giardia lamblia
AAKGTLPS

SEQ ID NO: 3097026 - protein, 10 aa, Giardia lamblia
AAKKEREQAI

SEQ ID NO: 3097027 - protein, 8 aa, Giardia lamblia
AAKKQGLT

SEQ ID NO: 3097028 - protein, 21 aa, Giardia lamblia
AAKKRGKKGKKDKGKADERPS

SEQ ID NO: 3097029 - protein, 12 aa, Giardia lamblia
AAKLGSGTDGEH

SEQ ID NO: 3097030 - protein, 6 aa, Giardia lamblia
AAKNAF

SEQ ID NO: 3097031 - protein, 9 aa, Giardia lamblia
AAKNGPKGA

SEQ ID NO: 3097032 - protein, 5 aa, Giardia lamblia
AAKNR

SEQ ID NO: 3097033 - protein, 25 aa, Giardia lamblia
AAKNSAAPGRGAGTSSYSRGCRSQK

SEQ ID NO: 3097034 - protein, 24 aa, Giardia lamblia
AAKPIEKSKGKSDSKNEAPKVETK

SEQ ID NO: 3097035 - protein, 5 aa, Giardia lamblia
AAKPL

SEQ ID NO: 3097036 - protein, 12 aa, Giardia lamblia
AAKPSSAQKETA

SEQ ID NO: 3097037 - protein, 9 aa, Giardia lamblia
AAKQGKDAP

SEQ ID NO: 3097038 - protein, 8 aa, Giardia lamblia
AAKQHTVS

SEQ ID NO: 3097039 - protein, 9 aa, Giardia lamblia
AAKQQNARL

SEQ ID NO: 3097040 - protein, 6 aa, Giardia lamblia
AAKRKI

SEQ ID NO: 3097041 - protein, 21 aa, Giardia lamblia
AAKSAEAARAGKSAKPEQSDK

SEQ ID NO: 3097042 - protein, 10 aa, Giardia lamblia
AAKSEIEQRN

SEQ ID NO: 3097043 - protein, 6 aa, Giardia lamblia
AAKSGS

SEQ ID NO: 3097044 - protein, 8 aa, Giardia lamblia
AAKSKDAY

SEQ ID NO: 3097045 - protein, 8 aa, Giardia lamblia
AAKTEQLD

SEQ ID NO: 3097046 - protein, 14 aa, Giardia lamblia
AAKTGNQDAYTSLS

SEQ ID NO: 3097047 - protein, 12 aa, Giardia lamblia
AAKTGQKPEEAE

SEQ ID NO: 3097048 - protein, 13 aa, Giardia lamblia
AAKTVAGASSYDN

SEQ ID NO: 3097049 - protein, 12 aa, Giardia lamblia
AALDPPQEIQPF

SEQ ID NO: 3097050 - protein, 10 aa, Giardia lamblia
AALDTRPSCG

SEQ ID NO: 3097051 - protein, 17 aa, Giardia lamblia
AALEPSTQQALGSNQLD

SEQ ID NO: 3097052 - protein, 15 aa, Giardia lamblia
AALERERNERAERAR

SEQ ID NO: 3097053 - protein, 7 aa, Giardia lamblia
AALPADG

SEQ ID NO: 3097054 - protein, 15 aa, Giardia lamblia
AALPQNNESRSSGDI

SEQ ID NO: 3097055 - protein, 7 aa, Giardia lamblia
AALPTPC

SEQ ID NO: 3097056 - protein, 19 aa, Giardia lamblia
AALPVTGSGRLDGLQRTGN

SEQ ID NO: 3097057 - protein, 8 aa, Giardia lamblia
AALQDQQG

SEQ ID NO: 3097058 - protein, 12 aa, Giardia lamblia
AALQSSTHTEGT

SEQ ID NO: 3097059 - protein, 7 aa, Giardia lamblia
AALSDGE

SEQ ID NO: 3097060 - protein, 7 aa, Giardia lamblia
AALSGGV

SEQ ID NO: 3097061 - protein, 7 aa, Giardia lamblia
AAMGDQA

SEQ ID NO: 3097062 - protein, 9 aa, Giardia lamblia
AANAAAARA

SEQ ID NO: 3097063 - protein, 7 aa, Giardia lamblia
AANAPYR

SEQ ID NO: 3097064 - protein, 8 aa, Giardia lamblia
AANARETH

SEQ ID NO: 3097065 - protein, 6 aa, Giardia lamblia
AANATD

SEQ ID NO: 3097066 - protein, 7 aa, Giardia lamblia
AANATSQ

SEQ ID NO: 3097067 - protein, 4 aa, Giardia lamblia
AANE

SEQ ID NO: 3097068 - protein, 6 aa, Giardia lamblia
AANENA

SEQ ID NO: 3097069 - protein, 9 aa, Giardia lamblia
AANEPETIT

SEQ ID NO: 3097070 - protein, 9 aa, Giardia lamblia
AANERSSRS

SEQ ID NO: 3097071 - protein, 13 aa, Giardia lamblia
AANESEIEQTKDD

SEQ ID NO: 3097072 - protein, 6 aa, Giardia lamblia
AANGGH

SEQ ID NO: 3097073 - protein, 7 aa, Giardia lamblia
AANGNTG

SEQ ID NO: 3097074 - protein, 7 aa, Giardia lamblia
AANGRAN

SEQ ID NO: 3097075 - protein, 10 aa, Giardia lamblia
AANKAADSLE

SEQ ID NO: 3097076 - protein, 10 aa, Giardia lamblia
AANNDPKIGK

SEQ ID NO: 3097077 - protein, 5 aa, Giardia lamblia
AANNI

SEQ ID NO: 3097078 - protein, 7 aa, Giardia lamblia
AANPGKI

SEQ ID NO: 3097079 - protein, 8 aa, Giardia lamblia
AANPITPE

SEQ ID NO: 3097080 - protein, 6 aa, Giardia lamblia
AANPNS

SEQ ID NO: 3097081 - protein, 7 aa, Giardia lamblia
AANPPGA

SEQ ID NO: 3097082 - protein, 21 aa, Giardia lamblia
AANPQPQSEATDLPVTGRKQR

SEQ ID NO: 3097083 - protein, 8 aa, Giardia lamblia
AANPTREY

SEQ ID NO: 3097084 - protein, 5 aa, Giardia lamblia
AANQA

SEQ ID NO: 3097085 - protein, 9 aa, Giardia lamblia
AANREIPSI

SEQ ID NO: 3097086 - protein, 4 aa, Giardia lamblia
AANS

SEQ ID NO: 3097087 - protein, 6 aa, Giardia lamblia
AANTQG

SEQ ID NO: 3097088 - protein, 7 aa, Giardia lamblia
AANTSKQ

SEQ ID NO: 3097089 - protein, 7 aa, Giardia lamblia
AAPAMGP

SEQ ID NO: 3097090 - protein, 8 aa, Giardia lamblia
AAPDLPQR

SEQ ID NO: 3097091 - protein, 31 aa, Giardia lamblia
AAPDPPGHTGRQAEDGQGGAEPSSEPVSRGR

SEQ ID NO: 3097092 - protein, 34 aa, Giardia lamblia
AAPDPPGHTGRQAEDGQGGAEPSSEPVSRGRSCQ

SEQ ID NO: 3097093 - protein, 4 aa, Giardia lamblia
AAPE

SEQ ID NO: 3097094 - protein, 5 aa, Giardia lamblia
AAPET

SEQ ID NO: 3097095 - protein, 9 aa, Giardia lamblia
AAPGGKTTH

SEQ ID NO: 3097096 - protein, 26 aa, Giardia lamblia
AAPGMAPELTSASHLSDGVGSRQGDA

SEQ ID NO: 3097097 - protein, 13 aa, Giardia lamblia
AAPGPIPPSTPSL

SEQ ID NO: 3097098 - protein, 4 aa, Giardia lamblia
AAPH

SEQ ID NO: 3097099 - protein, 6 aa, Giardia lamblia
AAPITK

SEQ ID NO: 3097100 - protein, 29 aa, Giardia lamblia
AAPKDRPTQQQQQQQQQQRNNSKKTNHEY

SEQ ID NO: 3097101 - protein, 6 aa, Giardia lamblia
AAPKTE

SEQ ID NO: 3097102 - protein, 4 aa, Giardia lamblia
AAPN

SEQ ID NO: 3097103 - protein, 6 aa, Giardia lamblia
AAPPEP

SEQ ID NO: 3097104 - protein, 7 aa, Giardia lamblia
AAPPSEG

SEQ ID NO: 3097105 - protein, 17 aa, Giardia lamblia
AAPPSITAPAPPTVNGA

SEQ ID NO: 3097106 - protein, 8 aa, Giardia lamblia
AAPQARKI

SEQ ID NO: 3097107 - protein, 7 aa, Giardia lamblia
AAPQGGA

SEQ ID NO: 3097108 - protein, 8 aa, Giardia lamblia
AAPSASLS

SEQ ID NO: 3097109 - protein, 7 aa, Giardia lamblia
AAPSDEV

SEQ ID NO: 3097110 - protein, 19 aa, Giardia lamblia
AAPSQQARVPPASQAPITA

SEQ ID NO: 3097111 - protein, 8 aa, Giardia lamblia
AAPSQSGK

SEQ ID NO: 3097112 - protein, 9 aa, Giardia lamblia
AAPTAEPIL

SEQ ID NO: 3097113 - protein, 6 aa, Giardia lamblia
AAPTDL

SEQ ID NO: 3097114 - protein, 11 aa, Giardia lamblia
AAPTSTGSNND

SEQ ID NO: 3097115 - protein, 8 aa, Giardia lamblia
AAPTTTSQ

SEQ ID NO: 3097116 - protein, 11 aa, Giardia lamblia
AAPVAQPDTYR

SEQ ID NO: 3097117 - protein, 6 aa, Giardia lamblia
AAPVNH

SEQ ID NO: 3097118 - protein, 9 aa, Giardia lamblia
AAPVSSTPV

SEQ ID NO: 3097119 - protein, 16 aa, Giardia lamblia
AAPYGVGSKKCAGNYA

SEQ ID NO: 3097120 - protein, 6 aa, Giardia lamblia
AAQADT

SEQ ID NO: 3097121 - protein, 7 aa, Giardia lamblia
AAQAELN

SEQ ID NO: 3097122 - protein, 11 aa, Giardia lamblia
AAQAETGSGKT

SEQ ID NO: 3097123 - protein, 25 aa, Giardia lamblia
AAQAKEVVNTKTKPKKHHGTSEGIK

SEQ ID NO: 3097124 - protein, 6 aa, Giardia lamblia
AAQAKR

SEQ ID NO: 3097125 - protein, 7 aa, Giardia lamblia
AAQAKTL

SEQ ID NO: 3097126 - protein, 7 aa, Giardia lamblia
AAQANGR

SEQ ID NO: 3097127 - protein, 18 aa, Giardia lamblia
AAQARAEAAKAQKTLTSL

SEQ ID NO: 3097128 - protein, 18 aa, Giardia lamblia
AAQASQDSIDEAVRNKTS

SEQ ID NO: 3097129 - protein, 9 aa, Giardia lamblia
AAQEAEQRR

SEQ ID NO: 3097130 - protein, 6 aa, Giardia lamblia
AAQEAI

SEQ ID NO: 3097131 - protein, 5 aa, Giardia lamblia
AAQEE

SEQ ID NO: 3097132 - protein, 7 aa, Giardia lamblia
AAQENQQ

SEQ ID NO: 3097133 - protein, 6 aa, Giardia lamblia
AAQEQQ

SEQ ID NO: 3097134 - protein, 5 aa, Giardia lamblia
AAQES

SEQ ID NO: 3097135 - protein, 11 aa, Giardia lamblia
AAQGEVSQRDE

SEQ ID NO: 3097136 - protein, 7 aa, Giardia lamblia
AAQGKKN

SEQ ID NO: 3097137 - protein, 9 aa, Giardia lamblia
AAQGSSDPE

SEQ ID NO: 3097138 - protein, 13 aa, Giardia lamblia
AAQIDQNSGTNYG

SEQ ID NO: 3097139 - protein, 9 aa, Giardia lamblia
AAQKSYDQL

SEQ ID NO: 3097140 - protein, 6 aa, Giardia lamblia
AAQLAE

SEQ ID NO: 3097141 - protein, 10 aa, Giardia lamblia
AAQNAQHAPS

SEQ ID NO: 3097142 - protein, 18 aa, Giardia lamblia
AAQNAQPFTDGEDTRRLR

SEQ ID NO: 3097143 - protein, 6 aa, Giardia lamblia
AAQPAY

SEQ ID NO: 3097144 - protein, 52 aa, Giardia lamblia
AAQPCNTASGNLPPSASKESVQSEKPESAADQPVTQVENTGDEGLEAKPPIV

SEQ ID NO: 3097145 - protein, 7 aa, Giardia lamblia
AAQPGSL

SEQ ID NO: 3097146 - protein, 10 aa, Giardia lamblia
AAQPSQKPKI

SEQ ID NO: 3097147 - protein, 9 aa, Giardia lamblia
AAQPTQNNH

SEQ ID NO: 3097148 - protein, 40 aa, Giardia lamblia
AAQQPQPSRQSQAPSISQSPTRQQQQQQQQQQQQQQRDQA

SEQ ID NO: 3097149 - protein, 12 aa, Giardia lamblia
AAQQRKPRATTR

SEQ ID NO: 3097150 - protein, 20 aa, Giardia lamblia
AAQQSGLATAIEKQSSLERQ

SEQ ID NO: 3097151 - protein, 8 aa, Giardia lamblia
AAQRALTD

SEQ ID NO: 3097152 - protein, 5 aa, Giardia lamblia
AAQRN

SEQ ID NO: 3097153 - protein, 5 aa, Giardia lamblia
AAQRP

SEQ ID NO: 3097154 - protein, 4 aa, Giardia lamblia
AAQY

SEQ ID NO: 3097155 - protein, 6 aa, Giardia lamblia
AARDEF

SEQ ID NO: 3097156 - protein, 15 aa, Giardia lamblia
AARDKDTLAQRQADE

SEQ ID NO: 3097157 - protein, 10 aa, Giardia lamblia
AARDQDVQDL

SEQ ID NO: 3097158 - protein, 6 aa, Giardia lamblia
AARDRL

SEQ ID NO: 3097159 - protein, 4 aa, Giardia lamblia
AARE

SEQ ID NO: 3097160 - protein, 10 aa, Giardia lamblia
AAREEREEAQ

SEQ ID NO: 3097161 - protein, 6 aa, Giardia lamblia
AARETE

SEQ ID NO: 3097162 - protein, 8 aa, Giardia lamblia
AARGDSDD

SEQ ID NO: 3097163 - protein, 12 aa, Giardia lamblia
AARGQRAAQRKA

SEQ ID NO: 3097164 - protein, 6 aa, Giardia lamblia
AARGSA

SEQ ID NO: 3097165 - protein, 22 aa, Giardia lamblia
AARGVSDNSTSQYAEKRSEAFP

SEQ ID NO: 3097166 - protein, 9 aa, Giardia lamblia
AARHANAEI

SEQ ID NO: 3097167 - protein, 8 aa, Giardia lamblia
AARHSKAV

SEQ ID NO: 3097168 - protein, 7 aa, Giardia lamblia
AARIRTS

SEQ ID NO: 3097169 - protein, 4 aa, Giardia lamblia
AARK

SEQ ID NO: 3097170 - protein, 9 aa, Giardia lamblia
AARKEKSKT

SEQ ID NO: 3097171 - protein, 10 aa, Giardia lamblia
AARKGAANSA

SEQ ID NO: 3097172 - protein, 11 aa, Giardia lamblia
AARKSSGNAAG

SEQ ID NO: 3097173 - protein, 7 aa, Giardia lamblia
AARKTSS

SEQ ID NO: 3097174 - protein, 7 aa, Giardia lamblia
AARLGET

SEQ ID NO: 3097175 - protein, 6 aa, Giardia lamblia
AARLGY

SEQ ID NO: 3097176 - protein, 5 aa, Giardia lamblia
AARNT

SEQ ID NO: 3097177 - protein, 6 aa, Giardia lamblia
AARPAS

SEQ ID NO: 3097178 - protein, 20 aa, Giardia lamblia
AARPPSQGVSRSTGSINRGG

SEQ ID NO: 3097179 - protein, 16 aa, Giardia lamblia
AARPSGADVLQEGSRS

SEQ ID NO: 3097180 - protein, 6 aa, Giardia lamblia
AARPSI

SEQ ID NO: 3097181 - protein, 5 aa, Giardia lamblia
AARPV

SEQ ID NO: 3097182 - protein, 7 aa, Giardia lamblia
AARQNAA

SEQ ID NO: 3097183 - protein, 5 aa, Giardia lamblia
AARQS

SEQ ID NO: 3097184 - protein, 8 aa, Giardia lamblia
AARQVSGK

SEQ ID NO: 3097185 - protein, 4 aa, Giardia lamblia
AARR

SEQ ID NO: 3097186 - protein, 27 aa, Giardia lamblia
AARRGNSSLGLSSTGEKGSQAAPAEFS

SEQ ID NO: 3097187 - protein, 8 aa, Giardia lamblia
AARRSGAR

SEQ ID NO: 3097188 - protein, 8 aa, Giardia lamblia
AARRSSVQ

SEQ ID NO: 3097189 - protein, 5 aa, Giardia lamblia
AARSS

SEQ ID NO: 3097190 - protein, 17 aa, Giardia lamblia
AARSSLPNPKNSIPTSR

SEQ ID NO: 3097191 - protein, 6 aa, Giardia lamblia
AARSTA

SEQ ID NO: 3097192 - protein, 15 aa, Giardia lamblia
AARTARFQDRAPHVP

SEQ ID NO: 3097193 - protein, 7 aa, Giardia lamblia
AARTPQY

SEQ ID NO: 3097194 - protein, 5 aa, Giardia lamblia
AARVA

SEQ ID NO: 3097195 - protein, 8 aa, Giardia lamblia
AASAADAQ

SEQ ID NO: 3097196 - protein, 11 aa, Giardia lamblia
AASADGAYVAS

SEQ ID NO: 3097197 - protein, 5 aa, Giardia lamblia
AASAG

SEQ ID NO: 3097198 - protein, 14 aa, Giardia lamblia
AASAGTEEATEGDL

SEQ ID NO: 3097199 - protein, 6 aa, Giardia lamblia
AASAKR

SEQ ID NO: 3097200 - protein, 14 aa, Giardia lamblia
AASAQHPPQGANTQ

SEQ ID NO: 3097201 - protein, 8 aa, Giardia lamblia
AASARQQS

SEQ ID NO: 3097202 - protein, 9 aa, Giardia lamblia
AASARSPET

SEQ ID NO: 3097203 - protein, 53 aa, Giardia lamblia
AASASTPAHSHRSPHPVQSISKPSTATRVSHKTRPTCAAPPDMKTSSSQMNNS

SEQ ID NO: 3097204 - protein, 12 aa, Giardia lamblia
AASATSGTASGQ

SEQ ID NO: 3097205 - protein, 9 aa, Giardia lamblia
AASATVKPD

SEQ ID NO: 3097206 - protein, 6 aa, Giardia lamblia
AASAYV

SEQ ID NO: 3097207 - protein, 8 aa, Giardia lamblia
AASDENAY

SEQ ID NO: 3097208 - protein, 6 aa, Giardia lamblia
AASDEY

SEQ ID NO: 3097209 - protein, 7 aa, Giardia lamblia
AASDKKI

SEQ ID NO: 3097210 - protein, 21 aa, Giardia lamblia
AASDPLTNSPVKSLSRQNEHP

SEQ ID NO: 3097211 - protein, 10 aa, Giardia lamblia
AASDQTQLTR

SEQ ID NO: 3097212 - protein, 10 aa, Giardia lamblia
AASDSRDPTL

SEQ ID NO: 3097213 - protein, 12 aa, Giardia lamblia
AASDVDGSTNTQ

SEQ ID NO: 3097214 - protein, 12 aa, Giardia lamblia
AASEEVNGSGRK

SEQ ID NO: 3097215 - protein, 8 aa, Giardia lamblia
AASELDDD

SEQ ID NO: 3097216 - protein, 6 aa, Giardia lamblia
AASELQ

SEQ ID NO: 3097217 - protein, 27 aa, Giardia lamblia
AASEPVPAAAPVAPTAPPVTEPAPSFN

SEQ ID NO: 3097218 - protein, 10 aa, Giardia lamblia
AASETGDNLS

SEQ ID NO: 3097219 - protein, 7 aa, Giardia lamblia
AASGHKD

SEQ ID NO: 3097220 - protein, 7 aa, Giardia lamblia
AASGIER

SEQ ID NO: 3097221 - protein, 9 aa, Giardia lamblia
AASGSDTES

SEQ ID NO: 3097222 - protein, 5 aa, Giardia lamblia
AASHG

SEQ ID NO: 3097223 - protein, 10 aa, Giardia lamblia
AASIEGPARI

SEQ ID NO: 3097224 - protein, 34 aa, Giardia lamblia
AASKLSDGPYSTPGPDTRISTRLPDSLRRSTSTH

SEQ ID NO: 3097225 - protein, 5 aa, Giardia lamblia
AASKR

SEQ ID NO: 3097226 - protein, 6 aa, Giardia lamblia
AASKSN

SEQ ID NO: 3097227 - protein, 10 aa, Giardia lamblia
AASKSRESRM

SEQ ID NO: 3097228 - protein, 10 aa, Giardia lamblia
AASMKNKNMP

SEQ ID NO: 3097229 - protein, 16 aa, Giardia lamblia
AASNLKDPDLSDPLDN

SEQ ID NO: 3097230 - protein, 8 aa, Giardia lamblia
AASNNDAR

SEQ ID NO: 3097231 - protein, 23 aa, Giardia lamblia
AASNPVTSKRRMDASTVKDSLTS

SEQ ID NO: 3097232 - protein, 6 aa, Giardia lamblia
AASNSL

SEQ ID NO: 3097233 - protein, 24 aa, Giardia lamblia
AASNSSTSAGSKKGSRASSRSRSA

SEQ ID NO: 3097234 - protein, 4 aa, Giardia lamblia
AASP

SEQ ID NO: 3097235 - protein, 5 aa, Giardia lamblia
AASPF

SEQ ID NO: 3097236 - protein, 5 aa, Giardia lamblia
AASPL

SEQ ID NO: 3097237 - protein, 8 aa, Giardia lamblia
AASQDQLD

SEQ ID NO: 3097238 - protein, 10 aa, Giardia lamblia
AASQEAAHTH

SEQ ID NO: 3097239 - protein, 7 aa, Giardia lamblia
AASQNKL

SEQ ID NO: 3097240 - protein, 7 aa, Giardia lamblia
AASQSAV

SEQ ID NO: 3097241 - protein, 7 aa, Giardia lamblia
AASRCPS

SEQ ID NO: 3097242 - protein, 7 aa, Giardia lamblia
AASRDGR

SEQ ID NO: 3097243 - protein, 10 aa, Giardia lamblia
AASRKIVDPP

SEQ ID NO: 3097244 - protein, 14 aa, Giardia lamblia
AASRLGDDKIAAGH

SEQ ID NO: 3097245 - protein, 7 aa, Giardia lamblia
AASRPFD

SEQ ID NO: 3097246 - protein, 17 aa, Giardia lamblia
AASRPQSGSVKAKPVAP

SEQ ID NO: 3097247 - protein, 5 aa, Giardia lamblia
AASRT

SEQ ID NO: 3097248 - protein, 10 aa, Giardia lamblia
AASRTEPSQF

SEQ ID NO: 3097249 - protein, 16 aa, Giardia lamblia
AASSANPRLPPTDPAA

SEQ ID NO: 3097250 - protein, 9 aa, Giardia lamblia
AASSGDYDR

SEQ ID NO: 3097251 - protein, 10 aa, Giardia lamblia
AASSINAPDR

SEQ ID NO: 3097252 - protein, 12 aa, Giardia lamblia
AASSSSTSLNAN

SEQ ID NO: 3097253 - protein, 4 aa, Giardia lamblia
AAST

SEQ ID NO: 3097254 - protein, 5 aa, Giardia lamblia
AASTE

SEQ ID NO: 3097255 - protein, 10 aa, Giardia lamblia
AASTKNTPLG

SEQ ID NO: 3097256 - protein, 7 aa, Giardia lamblia
AASTNPF

SEQ ID NO: 3097257 - protein, 22 aa, Giardia lamblia
AASTRGGDALSDVQPSGPGSTL

SEQ ID NO: 3097258 - protein, 13 aa, Giardia lamblia
AASTSAAQQPQMY

SEQ ID NO: 3097259 - protein, 4 aa, Giardia lamblia
AASV

SEQ ID NO: 3097260 - protein, 12 aa, Giardia lamblia
AASVRAKGVGPN

SEQ ID NO: 3097261 - protein, 5 aa, Giardia lamblia
AASVS

SEQ ID NO: 3097262 - protein, 4 aa, Giardia lamblia
AATA

SEQ ID NO: 3097263 - protein, 6 aa, Giardia lamblia
AATADL

SEQ ID NO: 3097264 - protein, 8 aa, Giardia lamblia
AATAEIDS

SEQ ID NO: 3097265 - protein, 17 aa, Giardia lamblia
AATAETCNPSGKHSRIG

SEQ ID NO: 3097266 - protein, 7 aa, Giardia lamblia
AATAGAL

SEQ ID NO: 3097267 - protein, 15 aa, Giardia lamblia
AATAKTVREGEEYSA

SEQ ID NO: 3097268 - protein, 28 aa, Giardia lamblia
AATAPAASETPNGLGPRASTDDNEEQVK

SEQ ID NO: 3097269 - protein, 9 aa, Giardia lamblia
AATAPTPAP

SEQ ID NO: 3097270 - protein, 14 aa, Giardia lamblia
AATAQDDIVGDGTT

SEQ ID NO: 3097271 - protein, 11 aa, Giardia lamblia
AATAQRGKNFK

SEQ ID NO: 3097272 - protein, 29 aa, Giardia lamblia
AATDNQPPPLGRDELRGDSRNGTRPRSSF

SEQ ID NO: 3097273 - protein, 8 aa, Giardia lamblia
AATDNTTL

SEQ ID NO: 3097274 - protein, 11 aa, Giardia lamblia
AATDSATTSES

SEQ ID NO: 3097275 - protein, 10 aa, Giardia lamblia
AATERSPTHV

SEQ ID NO: 3097276 - protein, 14 aa, Giardia lamblia
AATETASLKEQVDE

SEQ ID NO: 3097277 - protein, 4 aa, Giardia lamblia
AATG

SEQ ID NO: 3097278 - protein, 7 aa, Giardia lamblia
AATGATS

SEQ ID NO: 3097279 - protein, 7 aa, Giardia lamblia
AATGEAT

SEQ ID NO: 3097280 - protein, 12 aa, Giardia lamblia
AATGFPSPESCN

SEQ ID NO: 3097281 - protein, 34 aa, Giardia lamblia
AATGKRDASEEEPSATTGKKAKKGSKGGQAAGPD

SEQ ID NO: 3097282 - protein, 10 aa, Giardia lamblia
AATGKTTSEY

SEQ ID NO: 3097283 - protein, 8 aa, Giardia lamblia
AATGLGKG

SEQ ID NO: 3097284 - protein, 5 aa, Giardia lamblia
AATGP

SEQ ID NO: 3097285 - protein, 6 aa, Giardia lamblia
AATGQL

SEQ ID NO: 3097286 - protein, 12 aa, Giardia lamblia
AATGSSSSSARL

SEQ ID NO: 3097287 - protein, 4 aa, Giardia lamblia
AATH

SEQ ID NO: 3097288 - protein, 12 aa, Giardia lamblia
AATHERKQTKQM

SEQ ID NO: 3097289 - protein, 5 aa, Giardia lamblia
AATIS

SEQ ID NO: 3097290 - protein, 8 aa, Giardia lamblia
AATKTGEA

SEQ ID NO: 3097291 - protein, 7 aa, Giardia lamblia
AATKTGS

SEQ ID NO: 3097292 - protein, 4 aa, Giardia lamblia
AATL

SEQ ID NO: 3097293 - protein, 8 aa, Giardia lamblia
AATLTEEN

SEQ ID NO: 3097294 - protein, 4 aa, Giardia lamblia
AATQ

SEQ ID NO: 3097295 - protein, 14 aa, Giardia lamblia
AATQTDKATNSVST

SEQ ID NO: 3097296 - protein, 8 aa, Giardia lamblia
AATRQREY

SEQ ID NO: 3097297 - protein, 6 aa, Giardia lamblia
AATRQS

SEQ ID NO: 3097298 - protein, 11 aa, Giardia lamblia
AATRRPGIPQE

SEQ ID NO: 3097299 - protein, 6 aa, Giardia lamblia
AATRSV

SEQ ID NO: 3097300 - protein, 5 aa, Giardia lamblia
AATSE

SEQ ID NO: 3097301 - protein, 7 aa, Giardia lamblia
AATSPIE

SEQ ID NO: 3097302 - protein, 7 aa, Giardia lamblia
AATSPKE

SEQ ID NO: 3097303 - protein, 6 aa, Giardia lamblia
AATSRA

SEQ ID NO: 3097304 - protein, 10 aa, Giardia lamblia
AATSSTTETA

SEQ ID NO: 3097305 - protein, 14 aa, Giardia lamblia
AATSTDKGTSSAAS

SEQ ID NO: 3097306 - protein, 5 aa, Giardia lamblia
AATSY

SEQ ID NO: 3097307 - protein, 8 aa, Giardia lamblia
AATTAATT

SEQ ID NO: 3097308 - protein, 8 aa, Giardia lamblia
AATTSNDA

SEQ ID NO: 3097309 - protein, 16 aa, Giardia lamblia
AAVDKRNSSGHGRLLL

SEQ ID NO: 3097310 - protein, 13 aa, Giardia lamblia
AAVEDERRLEKQR

SEQ ID NO: 3097311 - protein, 27 aa, Giardia lamblia
AAVGPGSRAGQDRFEASNNRVSSNTGD

SEQ ID NO: 3097312 - protein, 10 aa, Giardia lamblia
AAVNSDSSKI

SEQ ID NO: 3097313 - protein, 7 aa, Giardia lamblia
AAVNSSD

SEQ ID NO: 3097314 - protein, 5 aa, Giardia lamblia
AAVNT

SEQ ID NO: 3097315 - protein, 17 aa, Giardia lamblia
AAVPASMEKSENNSDLT

SEQ ID NO: 3097316 - protein, 16 aa, Giardia lamblia
AAVPETRGDAEPSDSF

SEQ ID NO: 3097317 - protein, 8 aa, Giardia lamblia
AAVPGKNA

SEQ ID NO: 3097318 - protein, 8 aa, Giardia lamblia
AAVPYKPV

SEQ ID NO: 3097319 - protein, 5 aa, Giardia lamblia
AAVRG

SEQ ID NO: 3097320 - protein, 9 aa, Giardia lamblia
AAYNPGTLP

SEQ ID NO: 3097321 - protein, 17 aa, Giardia lamblia
AAYNTASTSVSRREGVT

SEQ ID NO: 3097322 - protein, 7 aa, Giardia lamblia
AAYSGQK

SEQ ID NO: 3097323 - protein, 19 aa, Giardia lamblia
ACATGSSHAPPGVDPGLSP

SEQ ID NO: 3097324 - protein, 8 aa, Giardia lamblia
ACDEKKRT

SEQ ID NO: 3097325 - protein, 5 aa, Giardia lamblia
ACDPS

SEQ ID NO: 3097326 - protein, 24 aa, Giardia lamblia
ACEAEGDESKNQELGGKSAAQQPR

SEQ ID NO: 3097327 - protein, 6 aa, Giardia lamblia
ACETPD

SEQ ID NO: 3097328 - protein, 11 aa, Giardia lamblia
ACGGDTSRRTY

SEQ ID NO: 3097329 - protein, 8 aa, Giardia lamblia
ACKQERSK

SEQ ID NO: 3097330 - protein, 7 aa, Giardia lamblia
ACKQQSG

SEQ ID NO: 3097331 - protein, 21 aa, Giardia lamblia
ACPPNNGDEEPTISDASNHAV

SEQ ID NO: 3097332 - protein, 7 aa, Giardia lamblia
ACPSGAI

SEQ ID NO: 3097333 - protein, 9 aa, Giardia lamblia
ACREPKRKA

SEQ ID NO: 3097334 - protein, 9 aa, Giardia lamblia
ACSAQSGRL

SEQ ID NO: 3097335 - protein, 6 aa, Giardia lamblia
ACSARK

SEQ ID NO: 3097336 - protein, 8 aa, Giardia lamblia
ACSDKEKQ

SEQ ID NO: 3097337 - protein, 6 aa, Giardia lamblia
ACSDQD

SEQ ID NO: 3097338 - protein, 6 aa, Giardia lamblia
ACSGDE

SEQ ID NO: 3097339 - protein, 5 aa, Giardia lamblia
ACSSE

SEQ ID NO: 3097340 - protein, 8 aa, Giardia lamblia
ACSSTSNL

SEQ ID NO: 3097341 - protein, 23 aa, Giardia lamblia
ACSSYNSRNTTPKPKPESPSSPN

SEQ ID NO: 3097342 - protein, 6 aa, Giardia lamblia
ACSTPQ

SEQ ID NO: 3097343 - protein, 5 aa, Giardia lamblia
ACTDT

SEQ ID NO: 3097344 - protein, 10 aa, Giardia lamblia
ACTKPGFQST

SEQ ID NO: 3097345 - protein, 4 aa, Giardia lamblia
ACTT

SEQ ID NO: 3097346 - protein, 10 aa, Giardia lamblia
ACYETSADAT

SEQ ID NO: 3097347 - protein, 6 aa, Giardia lamblia
ADAASI

SEQ ID NO: 3097348 - protein, 6 aa, Giardia lamblia
ADADAS

SEQ ID NO: 3097349 - protein, 11 aa, Giardia lamblia
ADADASESISP

SEQ ID NO: 3097350 - protein, 14 aa, Giardia lamblia
ADADQDDAEPHDPK

SEQ ID NO: 3097351 - protein, 4 aa, Giardia lamblia
ADAE

SEQ ID NO: 3097352 - protein, 8 aa, Giardia lamblia
ADAEDNVD

SEQ ID NO: 3097353 - protein, 6 aa, Giardia lamblia
ADAETG

SEQ ID NO: 3097354 - protein, 9 aa, Giardia lamblia
ADAGERENI

SEQ ID NO: 3097355 - protein, 8 aa, Giardia lamblia
ADAGGPRI

SEQ ID NO: 3097356 - protein, 10 aa, Giardia lamblia
ADAGPHNNTF

SEQ ID NO: 3097357 - protein, 10 aa, Giardia lamblia
ADAGRKLDEE

SEQ ID NO: 3097358 - protein, 8 aa, Giardia lamblia
ADAGRSRL

SEQ ID NO: 3097359 - protein, 7 aa, Giardia lamblia
ADAGTPI

SEQ ID NO: 3097360 - protein, 11 aa, Giardia lamblia
ADAHNEDKRQE

SEQ ID NO: 3097361 - protein, 10 aa, Giardia lamblia
ADAIAEASNY

SEQ ID NO: 3097362 - protein, 6 aa, Giardia lamblia
ADAINA

SEQ ID NO: 3097363 - protein, 9 aa, Giardia lamblia
ADAKGTSPH

SEQ ID NO: 3097364 - protein, 18 aa, Giardia lamblia
ADAKKDEGTTSDTSEIEG

SEQ ID NO: 3097365 - protein, 37 aa, Giardia lamblia
ADAKKSADDNPDDLDDNAADTERVPDADTHKHREGGP

SEQ ID NO: 3097366 - protein, 13 aa, Giardia lamblia
ADALAPDERVADA

SEQ ID NO: 3097367 - protein, 11 aa, Giardia lamblia
ADANQEAAGVR

SEQ ID NO: 3097368 - protein, 7 aa, Giardia lamblia
ADANRPE

SEQ ID NO: 3097369 - protein, 9 aa, Giardia lamblia
ADAPEETYE

SEQ ID NO: 3097370 - protein, 8 aa, Giardia lamblia
ADAPRSVE

SEQ ID NO: 3097371 - protein, 11 aa, Giardia lamblia
ADAQDPSGESF

SEQ ID NO: 3097372 - protein, 21 aa, Giardia lamblia
ADAQPEGPAVPAEVEASPVNN

SEQ ID NO: 3097373 - protein, 6 aa, Giardia lamblia
ADAQQE

SEQ ID NO: 3097374 - protein, 31 aa, Giardia lamblia
ADARGRRRKQKGPLSQEAEGRYGGANRRDCR

SEQ ID NO: 3097375 - protein, 7 aa, Giardia lamblia
ADARTGV

SEQ ID NO: 3097376 - protein, 24 aa, Giardia lamblia
ADASATVEPSTTGLATEKPEDSPV

SEQ ID NO: 3097377 - protein, 8 aa, Giardia lamblia
ADASERSS

SEQ ID NO: 3097378 - protein, 11 aa, Giardia lamblia
ADASSARKREM

SEQ ID NO: 3097379 - protein, 10 aa, Giardia lamblia
ADATDRQKRD

SEQ ID NO: 3097380 - protein, 8 aa, Giardia lamblia
ADATEKPF

SEQ ID NO: 3097381 - protein, 5 aa, Giardia lamblia
ADATT

SEQ ID NO: 3097382 - protein, 6 aa, Giardia lamblia
ADDASV

SEQ ID NO: 3097383 - protein, 20 aa, Giardia lamblia
ADDDAVGVKGKATAKGLPER

SEQ ID NO: 3097384 - protein, 12 aa, Giardia lamblia
ADDDNESSSKRS

SEQ ID NO: 3097385 - protein, 6 aa, Giardia lamblia
ADDDSS

SEQ ID NO: 3097386 - protein, 13 aa, Giardia lamblia
ADDECKKGTSEKI

SEQ ID NO: 3097387 - protein, 19 aa, Giardia lamblia
ADDEGAMDNSTDEQAPGYV

SEQ ID NO: 3097388 - protein, 4 aa, Giardia lamblia
ADDG

SEQ ID NO: 3097389 - protein, 5 aa, Giardia lamblia
ADDGS

SEQ ID NO: 3097390 - protein, 5 aa, Giardia lamblia
ADDIA

SEQ ID NO: 3097391 - protein, 11 aa, Giardia lamblia
ADDKASTSLTL

SEQ ID NO: 3097392 - protein, 5 aa, Giardia lamblia
ADDKL

SEQ ID NO: 3097393 - protein, 9 aa, Giardia lamblia
ADDKSMQME

SEQ ID NO: 3097394 - protein, 8 aa, Giardia lamblia
ADDLTGAR

SEQ ID NO: 3097395 - protein, 24 aa, Giardia lamblia
ADDNDYKKLQDKINKGGNTGGIGS

SEQ ID NO: 3097396 - protein, 5 aa, Giardia lamblia
ADDPA

SEQ ID NO: 3097397 - protein, 6 aa, Giardia lamblia
ADDPKT

SEQ ID NO: 3097398 - protein, 7 aa, Giardia lamblia
ADDPQYH

SEQ ID NO: 3097399 - protein, 8 aa, Giardia lamblia
ADDPSLEQ

SEQ ID NO: 3097400 - protein, 20 aa, Giardia lamblia
ADDPTDQSISTPVTGPEQKL

SEQ ID NO: 3097401 - protein, 11 aa, Giardia lamblia
ADDQREKAEQA

SEQ ID NO: 3097402 - protein, 8 aa, Giardia lamblia
ADDRPSVD

SEQ ID NO: 3097403 - protein, 33 aa, Giardia lamblia
ADDSASSQALHEPKPKKQGGQSVEPTPDANQAS

SEQ ID NO: 3097404 - protein, 7 aa, Giardia lamblia
ADDSETH

SEQ ID NO: 3097405 - protein, 9 aa, Giardia lamblia
ADDSGPTEC

SEQ ID NO: 3097406 - protein, 7 aa, Giardia lamblia
ADDSHQS

SEQ ID NO: 3097407 - protein, 13 aa, Giardia lamblia
ADDSSTSTSDEAQ

SEQ ID NO: 3097408 - protein, 8 aa, Giardia lamblia
ADDTGETS

SEQ ID NO: 3097409 - protein, 9 aa, Giardia lamblia
ADDTVESSL

SEQ ID NO: 3097410 - protein, 5 aa, Giardia lamblia
ADDYD

SEQ ID NO: 3097411 - protein, 22 aa, Giardia lamblia
ADDYQDEEESEEEDEENEDTKL

SEQ ID NO: 3097412 - protein, 7 aa, Giardia lamblia
ADEAKNT

SEQ ID NO: 3097413 - protein, 9 aa, Giardia lamblia
ADEATGSGR

SEQ ID NO: 3097414 - protein, 11 aa, Giardia lamblia
ADEDEENSLSE

SEQ ID NO: 3097415 - protein, 38 aa, Giardia lamblia
ADEDGDEHDLNPDPEGDEEDEDEDEEDNGSKHLDGSDY

SEQ ID NO: 3097416 - protein, 14 aa, Giardia lamblia
ADEDGEGSEDQEDT

SEQ ID NO: 3097417 - protein, 5 aa, Giardia lamblia
ADEDN

SEQ ID NO: 3097418 - protein, 7 aa, Giardia lamblia
ADEDVRR

SEQ ID NO: 3097419 - protein, 7 aa, Giardia lamblia
ADEEETT

SEQ ID NO: 3097420 - protein, 9 aa, Giardia lamblia
ADEENKKAL

SEQ ID NO: 3097421 - protein, 7 aa, Giardia lamblia
ADEEPVY

SEQ ID NO: 3097422 - protein, 25 aa, Giardia lamblia
ADEEQSQQSHEPQPFKTDHSRGPAL

SEQ ID NO: 3097423 - protein, 11 aa, Giardia lamblia
ADEETETDRET

SEQ ID NO: 3097424 - protein, 4 aa, Giardia lamblia
ADEG

SEQ ID NO: 3097425 - protein, 5 aa, Giardia lamblia
ADEGI

SEQ ID NO: 3097426 - protein, 13 aa, Giardia lamblia
ADEGKIRERDRAQ

SEQ ID NO: 3097427 - protein, 9 aa, Giardia lamblia
ADEKGDEHF

SEQ ID NO: 3097428 - protein, 8 aa, Giardia lamblia
ADEKGDTT

SEQ ID NO: 3097429 - protein, 6 aa, Giardia lamblia
ADEKSR

SEQ ID NO: 3097430 - protein, 6 aa, Giardia lamblia
ADENEL

SEQ ID NO: 3097431 - protein, 10 aa, Giardia lamblia
ADENRNEKNK

SEQ ID NO: 3097432 - protein, 7 aa, Giardia lamblia
ADEPDHE

SEQ ID NO: 3097433 - protein, 9 aa, Giardia lamblia
ADEPGVGKT

SEQ ID NO: 3097434 - protein, 8 aa, Giardia lamblia
ADEPSPLE

SEQ ID NO: 3097435 - protein, 17 aa, Giardia lamblia
ADERSASKLATSSHKKE

SEQ ID NO: 3097436 - protein, 9 aa, Giardia lamblia
ADERYSHNQ

SEQ ID NO: 3097437 - protein, 6 aa, Giardia lamblia
ADESQY

SEQ ID NO: 3097438 - protein, 12 aa, Giardia lamblia
ADESVKKTPEIP

SEQ ID NO: 3097439 - protein, 7 aa, Giardia lamblia
ADETDPI

SEQ ID NO: 3097440 - protein, 6 aa, Giardia lamblia
ADETQQ

SEQ ID NO: 3097441 - protein, 7 aa, Giardia lamblia
ADETTVI

SEQ ID NO: 3097442 - protein, 4 aa, Giardia lamblia
ADEV

SEQ ID NO: 3097443 - protein, 12 aa, Giardia lamblia
ADFDSKDKLGSE

SEQ ID NO: 3097444 - protein, 19 aa, Giardia lamblia
ADFPAEPDETFSEESTFDL

SEQ ID NO: 3097445 - protein, 12 aa, Giardia lamblia
ADFSSDGRTKRA

SEQ ID NO: 3097446 - protein, 4 aa, Giardia lamblia
ADFT

SEQ ID NO: 3097447 - protein, 15 aa, Giardia lamblia
ADGAAEVPDAIEPND

SEQ ID NO: 3097448 - protein, 27 aa, Giardia lamblia
ADGAGKDKKRKKKAHKTPKKIKHEPKK

SEQ ID NO: 3097449 - protein, 11 aa, Giardia lamblia
ADGAKETSVAS

SEQ ID NO: 3097450 - protein, 13 aa, Giardia lamblia
ADGALSTDADSIP

SEQ ID NO: 3097451 - protein, 11 aa, Giardia lamblia
ADGDKDVRDMA

SEQ ID NO: 3097452 - protein, 9 aa, Giardia lamblia
ADGDRERVS

SEQ ID NO: 3097453 - protein, 7 aa, Giardia lamblia
ADGDVTT

SEQ ID NO: 3097454 - protein, 4 aa, Giardia lamblia
ADGE

SEQ ID NO: 3097455 - protein, 5 aa, Giardia lamblia
ADGEI

SEQ ID NO: 3097456 - protein, 11 aa, Giardia lamblia
ADGESTNISQK

SEQ ID NO: 3097457 - protein, 31 aa, Giardia lamblia
ADGETYRTRGRASPKGAQAVSQDCSGEKEGF

SEQ ID NO: 3097458 - protein, 17 aa, Giardia lamblia
ADGGTGKRVYGQGGSAA

SEQ ID NO: 3097459 - protein, 7 aa, Giardia lamblia
ADGKKVE

SEQ ID NO: 3097460 - protein, 12 aa, Giardia lamblia
ADGKPVGAVGDN

SEQ ID NO: 3097461 - protein, 7 aa, Giardia lamblia
ADGKPYL

SEQ ID NO: 3097462 - protein, 5 aa, Giardia lamblia
ADGKR

SEQ ID NO: 3097463 - protein, 20 aa, Giardia lamblia
ADGLSSGKDSVTDGSSSSTM

SEQ ID NO: 3097464 - protein, 6 aa, Giardia lamblia
ADGNVE

SEQ ID NO: 3097465 - protein, 4 aa, Giardia lamblia
ADGQ

SEQ ID NO: 3097466 - protein, 9 aa, Giardia lamblia
ADGQEARGT

SEQ ID NO: 3097467 - protein, 8 aa, Giardia lamblia
ADGQFNSG

SEQ ID NO: 3097468 - protein, 4 aa, Giardia lamblia
ADGR

SEQ ID NO: 3097469 - protein, 15 aa, Giardia lamblia
ADGRANLPATHSNTE

SEQ ID NO: 3097470 - protein, 5 aa, Giardia lamblia
ADGRI

SEQ ID NO: 3097471 - protein, 22 aa, Giardia lamblia
ADGRREAAEAERQQGKGAEPHS

SEQ ID NO: 3097472 - protein, 9 aa, Giardia lamblia
ADGRSPLSI

SEQ ID NO: 3097473 - protein, 11 aa, Giardia lamblia
ADGSGVEHERE

SEQ ID NO: 3097474 - protein, 17 aa, Giardia lamblia
ADGTDIDQAAKENLSGT

SEQ ID NO: 3097475 - protein, 10 aa, Giardia lamblia
ADGTPYPTTY

SEQ ID NO: 3097476 - protein, 5 aa, Giardia lamblia
ADGTQ

SEQ ID NO: 3097477 - protein, 5 aa, Giardia lamblia
ADGTT

SEQ ID NO: 3097478 - protein, 24 aa, Giardia lamblia
ADGTTTTSNDGDAASEAAKAEAYQ

SEQ ID NO: 3097479 - protein, 12 aa, Giardia lamblia
ADGYGKKESKAI

SEQ ID NO: 3097480 - protein, 10 aa, Giardia lamblia
ADHASAGREL

SEQ ID NO: 3097481 - protein, 33 aa, Giardia lamblia
ADHGDNMDDGAIGDLRDSDLDTAQIPEKDVDPG

SEQ ID NO: 3097482 - protein, 6 aa, Giardia lamblia
ADHGSE

SEQ ID NO: 3097483 - protein, 6 aa, Giardia lamblia
ADHHGR

SEQ ID NO: 3097484 - protein, 4 aa, Giardia lamblia
ADHK

SEQ ID NO: 3097485 - protein, 6 aa, Giardia lamblia
ADHPDV

SEQ ID NO: 3097486 - protein, 6 aa, Giardia lamblia
ADHPQY

SEQ ID NO: 3097487 - protein, 19 aa, Giardia lamblia
ADHPRIPEQDSKHRSLSDR

SEQ ID NO: 3097488 - protein, 8 aa, Giardia lamblia
ADHPSQKA

SEQ ID NO: 3097489 - protein, 9 aa, Giardia lamblia
ADHSDGDSI

SEQ ID NO: 3097490 - protein, 20 aa, Giardia lamblia
ADHSSGTGSLEDGSGAAEEE

SEQ ID NO: 3097491 - protein, 12 aa, Giardia lamblia
ADIAQRNGHDDI

SEQ ID NO: 3097492 - protein, 9 aa, Giardia lamblia
ADIPGPGAY

SEQ ID NO: 3097493 - protein, 9 aa, Giardia lamblia
ADIPQTGDD

SEQ ID NO: 3097494 - protein, 5 aa, Giardia lamblia
ADISE

SEQ ID NO: 3097495 - protein, 7 aa, Giardia lamblia
ADISNPE

SEQ ID NO: 3097496 - protein, 24 aa, Giardia lamblia
ADKAAALSTASPSRLDGDSAVTEQ

SEQ ID NO: 3097497 - protein, 14 aa, Giardia lamblia
ADKADLDPEAPDVQ

SEQ ID NO: 3097498 - protein, 7 aa, Giardia lamblia
ADKAEFD

SEQ ID NO: 3097499 - protein, 6 aa, Giardia lamblia
ADKAKL

SEQ ID NO: 3097500 - protein, 6 aa, Giardia lamblia
ADKAQS

SEQ ID NO: 3097501 - protein, 4 aa, Giardia lamblia
ADKD

SEQ ID NO: 3097502 - protein, 8 aa, Giardia lamblia
ADKDAEIE

SEQ ID NO: 3097503 - protein, 9 aa, Giardia lamblia
ADKDANSHK

SEQ ID NO: 3097504 - protein, 8 aa, Giardia lamblia
ADKDDRRA

SEQ ID NO: 3097505 - protein, 6 aa, Giardia lamblia
ADKEDK

SEQ ID NO: 3097506 - protein, 10 aa, Giardia lamblia
ADKEKALEEM

SEQ ID NO: 3097507 - protein, 7 aa, Giardia lamblia
ADKGDAE

SEQ ID NO: 3097508 - protein, 21 aa, Giardia lamblia
ADKHEPLPGAIGAGGHQNASG

SEQ ID NO: 3097509 - protein, 8 aa, Giardia lamblia
ADKKGDIA

SEQ ID NO: 3097510 - protein, 8 aa, Giardia lamblia
ADKPQGPV

SEQ ID NO: 3097511 - protein, 23 aa, Giardia lamblia
ADKQKDIQHSRQSAERIEASTAE

SEQ ID NO: 3097512 - protein, 22 aa, Giardia lamblia
ADKRASSLSETFDRRSRTSDVC

SEQ ID NO: 3097513 - protein, 8 aa, Giardia lamblia
ADKSGSIT

SEQ ID NO: 3097514 - protein, 7 aa, Giardia lamblia
ADKSKLR

SEQ ID NO: 3097515 - protein, 8 aa, Giardia lamblia
ADKTGGDI

SEQ ID NO: 3097516 - protein, 41 aa, Giardia lamblia
ADKTKEVDQGGGPGGQRGMKKGTTGPRQGRGDARPENPSSA

SEQ ID NO: 3097517 - protein, 13 aa, Giardia lamblia
ADLASTDTNIKAT

SEQ ID NO: 3097518 - protein, 7 aa, Giardia lamblia
ADLDGTS

SEQ ID NO: 3097519 - protein, 4 aa, Giardia lamblia
ADLE

SEQ ID NO: 3097520 - protein, 6 aa, Giardia lamblia
ADLEAA

SEQ ID NO: 3097521 - protein, 6 aa, Giardia lamblia
ADLESK

SEQ ID NO: 3097522 - protein, 9 aa, Giardia lamblia
ADLGEKQRT

SEQ ID NO: 3097523 - protein, 5 aa, Giardia lamblia
ADLGS

SEQ ID NO: 3097524 - protein, 26 aa, Giardia lamblia
ADLGSVEVQGAKPRRQSAKKNRMNAH

SEQ ID NO: 3097525 - protein, 8 aa, Giardia lamblia
ADLNTSSI

SEQ ID NO: 3097526 - protein, 4 aa, Giardia lamblia
ADLP

SEQ ID NO: 3097527 - protein, 6 aa, Giardia lamblia
ADLPAA

SEQ ID NO: 3097528 - protein, 17 aa, Giardia lamblia
ADLPQTDSVPHSGATAD

SEQ ID NO: 3097529 - protein, 6 aa, Giardia lamblia
ADLPRL

SEQ ID NO: 3097530 - protein, 13 aa, Giardia lamblia
ADLPSSYTSVSAR

SEQ ID NO: 3097531 - protein, 8 aa, Giardia lamblia
ADLSRSQL

SEQ ID NO: 3097532 - protein, 12 aa, Giardia lamblia
ADLTGAQLDGNP

SEQ ID NO: 3097533 - protein, 15 aa, Giardia lamblia
ADLTSAHKQTGVPVP

SEQ ID NO: 3097534 - protein, 15 aa, Giardia lamblia
ADMDATKDPAPSYGH

SEQ ID NO: 3097535 - protein, 7 aa, Giardia lamblia
ADMPPKS

SEQ ID NO: 3097536 - protein, 8 aa, Giardia lamblia
ADNAPLDV

SEQ ID NO: 3097537 - protein, 11 aa, Giardia lamblia
ADNAQKDKTIQ

SEQ ID NO: 3097538 - protein, 9 aa, Giardia lamblia
ADNDTRKAL

SEQ ID NO: 3097539 - protein, 10 aa, Giardia lamblia
ADNGERDTDL

SEQ ID NO: 3097540 - protein, 9 aa, Giardia lamblia
ADNGTQGLG

SEQ ID NO: 3097541 - protein, 6 aa, Giardia lamblia
ADNHSE

SEQ ID NO: 3097542 - protein, 37 aa, Giardia lamblia
ADNKQTASQRASPSGSRGPSPGVSSQWPGLQSSGHAR

SEQ ID NO: 3097543 - protein, 21 aa, Giardia lamblia
ADNKRKADEEKQERLKQERQE

SEQ ID NO: 3097544 - protein, 4 aa, Giardia lamblia
ADNN

SEQ ID NO: 3097545 - protein, 8 aa, Giardia lamblia
ADNRSKRD

SEQ ID NO: 3097546 - protein, 4 aa, Giardia lamblia
ADNS

SEQ ID NO: 3097547 - protein, 13 aa, Giardia lamblia
ADNSDGKGPSLAS

SEQ ID NO: 3097548 - protein, 8 aa, Giardia lamblia
ADNSGAKS

SEQ ID NO: 3097549 - protein, 4 aa, Giardia lamblia
ADNT

SEQ ID NO: 3097550 - protein, 11 aa, Giardia lamblia
ADNTKRSQANL

SEQ ID NO: 3097551 - protein, 4 aa, Giardia lamblia
ADNV

SEQ ID NO: 3097552 - protein, 5 aa, Giardia lamblia
ADNVD

SEQ ID NO: 3097553 - protein, 8 aa, Giardia lamblia
ADNVPQWN

SEQ ID NO: 3097554 - protein, 8 aa, Giardia lamblia
ADPAAPQP

SEQ ID NO: 3097555 - protein, 8 aa, Giardia lamblia
ADPCGGPP

SEQ ID NO: 3097556 - protein, 9 aa, Giardia lamblia
ADPDLPSLP

SEQ ID NO: 3097557 - protein, 9 aa, Giardia lamblia
ADPDTPTRF

SEQ ID NO: 3097558 - protein, 6 aa, Giardia lamblia
ADPEDG

SEQ ID NO: 3097559 - protein, 12 aa, Giardia lamblia
ADPEMARKENQN

SEQ ID NO: 3097560 - protein, 5 aa, Giardia lamblia
ADPEQ

SEQ ID NO: 3097561 - protein, 4 aa, Giardia lamblia
ADPG

SEQ ID NO: 3097562 - protein, 9 aa, Giardia lamblia
ADPGCENAP

SEQ ID NO: 3097563 - protein, 7 aa, Giardia lamblia
ADPGTDV

SEQ ID NO: 3097564 - protein, 13 aa, Giardia lamblia
ADPGTKEPYDGTS

SEQ ID NO: 3097565 - protein, 8 aa, Giardia lamblia
ADPHNPNY

SEQ ID NO: 3097566 - protein, 6 aa, Giardia lamblia
ADPHQT

SEQ ID NO: 3097567 - protein, 5 aa, Giardia lamblia
ADPIK

SEQ ID NO: 3097568 - protein, 7 aa, Giardia lamblia
ADPKVSP

SEQ ID NO: 3097569 - protein, 5 aa, Giardia lamblia
ADPLG

SEQ ID NO: 3097570 - protein, 9 aa, Giardia lamblia
ADPLHGSGD

SEQ ID NO: 3097571 - protein, 7 aa, Giardia lamblia
ADPLKDT

SEQ ID NO: 3097572 - protein, 7 aa, Giardia lamblia
ADPNDGI

SEQ ID NO: 3097573 - protein, 6 aa, Giardia lamblia
ADPNHP

SEQ ID NO: 3097574 - protein, 7 aa, Giardia lamblia
ADPNTLA

SEQ ID NO: 3097575 - protein, 7 aa, Giardia lamblia
ADPNVRE

SEQ ID NO: 3097576 - protein, 16 aa, Giardia lamblia
ADPPLTGSAPKANADS

SEQ ID NO: 3097577 - protein, 6 aa, Giardia lamblia
ADPQAA

SEQ ID NO: 3097578 - protein, 8 aa, Giardia lamblia
ADPRHPSA

SEQ ID NO: 3097579 - protein, 4 aa, Giardia lamblia
ADPS

SEQ ID NO: 3097580 - protein, 8 aa, Giardia lamblia
ADPSGSIN

SEQ ID NO: 3097581 - protein, 9 aa, Giardia lamblia
ADPSISEDC

SEQ ID NO: 3097582 - protein, 12 aa, Giardia lamblia
ADPSRFEESRRT

SEQ ID NO: 3097583 - protein, 9 aa, Giardia lamblia
ADPSSGSEP

SEQ ID NO: 3097584 - protein, 7 aa, Giardia lamblia
ADPSTNS

SEQ ID NO: 3097585 - protein, 11 aa, Giardia lamblia
ADPSTQPLEDS

SEQ ID NO: 3097586 - protein, 6 aa, Giardia lamblia
ADPSTW

SEQ ID NO: 3097587 - protein, 6 aa, Giardia lamblia
ADPSYT

SEQ ID NO: 3097588 - protein, 4 aa, Giardia lamblia
ADPT

SEQ ID NO: 3097589 - protein, 9 aa, Giardia lamblia
ADQATNDEF

SEQ ID NO: 3097590 - protein, 9 aa, Giardia lamblia
ADQDNNSLG

SEQ ID NO: 3097591 - protein, 12 aa, Giardia lamblia
ADQEAAKEQEIR

SEQ ID NO: 3097592 - protein, 6 aa, Giardia lamblia
ADQGNA

SEQ ID NO: 3097593 - protein, 7 aa, Giardia lamblia
ADQIDDD

SEQ ID NO: 3097594 - protein, 6 aa, Giardia lamblia
ADQINR

SEQ ID NO: 3097595 - protein, 5 aa, Giardia lamblia
ADQPL

SEQ ID NO: 3097596 - protein, 7 aa, Giardia lamblia
ADQPSIS

SEQ ID NO: 3097597 - protein, 5 aa, Giardia lamblia
ADQPV

SEQ ID NO: 3097598 - protein, 10 aa, Giardia lamblia
ADQPVAQNAI

SEQ ID NO: 3097599 - protein, 26 aa, Giardia lamblia
ADQQTAERQHSGTCQKPAKSRQSNEE

SEQ ID NO: 3097600 - protein, 19 aa, Giardia lamblia
ADQRELPPDSYMSSLTGGW

SEQ ID NO: 3097601 - protein, 6 aa, Giardia lamblia
ADQRTS

SEQ ID NO: 3097602 - protein, 18 aa, Giardia lamblia
ADQSATGSDQAENQTQTA

SEQ ID NO: 3097603 - protein, 18 aa, Giardia lamblia
ADQSATGSDQAENRAQTA

SEQ ID NO: 3097604 - protein, 7 aa, Giardia lamblia
ADQSPRV

SEQ ID NO: 3097605 - protein, 8 aa, Giardia lamblia
ADQSQSDC

SEQ ID NO: 3097606 - protein, 8 aa, Giardia lamblia
ADQTRSEL

SEQ ID NO: 3097607 - protein, 13 aa, Giardia lamblia
ADQYSSSSDNLQA

SEQ ID NO: 3097608 - protein, 6 aa, Giardia lamblia
ADRAGH

SEQ ID NO: 3097609 - protein, 11 aa, Giardia lamblia
ADRAGHDVDER

SEQ ID NO: 3097610 - protein, 8 aa, Giardia lamblia
ADRAGNRA

SEQ ID NO: 3097611 - protein, 6 aa, Giardia lamblia
ADRASR

SEQ ID NO: 3097612 - protein, 4 aa, Giardia lamblia
ADRD

SEQ ID NO: 3097613 - protein, 10 aa, Giardia lamblia
ADRDKQEIAE

SEQ ID NO: 3097614 - protein, 9 aa, Giardia lamblia
ADRDSVTSQ

SEQ ID NO: 3097615 - protein, 7 aa, Giardia lamblia
ADREASI

SEQ ID NO: 3097616 - protein, 6 aa, Giardia lamblia
ADREKA

SEQ ID NO: 3097617 - protein, 5 aa, Giardia lamblia
ADREQ

SEQ ID NO: 3097618 - protein, 7 aa, Giardia lamblia
ADRERQN

SEQ ID NO: 3097619 - protein, 7 aa, Giardia lamblia
ADRGDTD

SEQ ID NO: 3097620 - protein, 5 aa, Giardia lamblia
ADRNG

SEQ ID NO: 3097621 - protein, 6 aa, Giardia lamblia
ADRPAE

SEQ ID NO: 3097622 - protein, 5 aa, Giardia lamblia
ADRQS

SEQ ID NO: 3097623 - protein, 18 aa, Giardia lamblia
ADRRDSTPHGDSASTQIG

SEQ ID NO: 3097624 - protein, 8 aa, Giardia lamblia
ADRSTFQQ

SEQ ID NO: 3097625 - protein, 23 aa, Giardia lamblia
ADRSTPQITYSPSRQAATKPQEV

SEQ ID NO: 3097626 - protein, 5 aa, Giardia lamblia
ADRTA

SEQ ID NO: 3097627 - protein, 6 aa, Giardia lamblia
ADRWRS

SEQ ID NO: 3097628 - protein, 5 aa, Giardia lamblia
ADSAM

SEQ ID NO: 3097629 - protein, 9 aa, Giardia lamblia
ADSANKDKA

SEQ ID NO: 3097630 - protein, 8 aa, Giardia lamblia
ADSAYTEE

SEQ ID NO: 3097631 - protein, 5 aa, Giardia lamblia
ADSDP

SEQ ID NO: 3097632 - protein, 9 aa, Giardia lamblia
ADSEREGSF

SEQ ID NO: 3097633 - protein, 12 aa, Giardia lamblia
ADSFSSKSTAIS

SEQ ID NO: 3097634 - protein, 21 aa, Giardia lamblia
ADSGATGGSLYGGKSDISPEV

SEQ ID NO: 3097635 - protein, 14 aa, Giardia lamblia
ADSGHRLPRIDLQT

SEQ ID NO: 3097636 - protein, 6 aa, Giardia lamblia
ADSGNV

SEQ ID NO: 3097637 - protein, 5 aa, Giardia lamblia
ADSIE

SEQ ID NO: 3097638 - protein, 25 aa, Giardia lamblia
ADSITPNRNSSVYSRQSDADSTEMS

SEQ ID NO: 3097639 - protein, 9 aa, Giardia lamblia
ADSKKERRE

SEQ ID NO: 3097640 - protein, 14 aa, Giardia lamblia
ADSLDNSARRRPPC

SEQ ID NO: 3097641 - protein, 8 aa, Giardia lamblia
ADSNEPRK

SEQ ID NO: 3097642 - protein, 5 aa, Giardia lamblia
ADSNQ

SEQ ID NO: 3097643 - protein, 10 aa, Giardia lamblia
ADSNSSNFSR

SEQ ID NO: 3097644 - protein, 18 aa, Giardia lamblia
ADSPFGSAAHQEQRNEQD

SEQ ID NO: 3097645 - protein, 9 aa, Giardia lamblia
ADSPGRLAR

SEQ ID NO: 3097646 - protein, 9 aa, Giardia lamblia
ADSPPNNPY

SEQ ID NO: 3097647 - protein, 5 aa, Giardia lamblia
ADSQI

SEQ ID NO: 3097648 - protein, 6 aa, Giardia lamblia
ADSRAH

SEQ ID NO: 3097649 - protein, 14 aa, Giardia lamblia
ADSSAAPSKENASK

SEQ ID NO: 3097650 - protein, 8 aa, Giardia lamblia
ADSSGQAS

SEQ ID NO: 3097651 - protein, 8 aa, Giardia lamblia
ADSSHDFK

SEQ ID NO: 3097652 - protein, 6 aa, Giardia lamblia
ADSSLP

SEQ ID NO: 3097653 - protein, 18 aa, Giardia lamblia
ADSSMSAEQSDSSHNCGD

SEQ ID NO: 3097654 - protein, 7 aa, Giardia lamblia
ADSSPFD

SEQ ID NO: 3097655 - protein, 7 aa, Giardia lamblia
ADSSPSL

SEQ ID NO: 3097656 - protein, 18 aa, Giardia lamblia
ADSSSIEKDIKTKSNDGD

SEQ ID NO: 3097657 - protein, 9 aa, Giardia lamblia
ADSSTESRI

SEQ ID NO: 3097658 - protein, 6 aa, Giardia lamblia
ADSTSL

SEQ ID NO: 3097659 - protein, 8 aa, Giardia lamblia
ADSVDTGK

SEQ ID NO: 3097660 - protein, 7 aa, Giardia lamblia
ADTARRM

SEQ ID NO: 3097661 - protein, 10 aa, Giardia lamblia
ADTDGPCNNV

SEQ ID NO: 3097662 - protein, 11 aa, Giardia lamblia
ADTDSAPNAAV

SEQ ID NO: 3097663 - protein, 9 aa, Giardia lamblia
ADTEASPIL

SEQ ID NO: 3097664 - protein, 14 aa, Giardia lamblia
ADTEASVCGDEPGV

SEQ ID NO: 3097665 - protein, 9 aa, Giardia lamblia
ADTEKLEDA

SEQ ID NO: 3097666 - protein, 4 aa, Giardia lamblia
ADTG

SEQ ID NO: 3097667 - protein, 10 aa, Giardia lamblia
ADTGKDENSC

SEQ ID NO: 3097668 - protein, 30 aa, Giardia lamblia
ADTIREREAPNALPPPPSNPPSNVPPYPGL

SEQ ID NO: 3097669 - protein, 8 aa, Giardia lamblia
ADTKRLRE

SEQ ID NO: 3097670 - protein, 9 aa, Giardia lamblia
ADTKTIATL

SEQ ID NO: 3097671 - protein, 5 aa, Giardia lamblia
ADTLE

SEQ ID NO: 3097672 - protein, 15 aa, Giardia lamblia
ADTLPSSDLSAKDAY

SEQ ID NO: 3097673 - protein, 4 aa, Giardia lamblia
ADTN

SEQ ID NO: 3097674 - protein, 6 aa, Giardia lamblia
ADTNDV

SEQ ID NO: 3097675 - protein, 8 aa, Giardia lamblia
ADTNPKKV

SEQ ID NO: 3097676 - protein, 6 aa, Giardia lamblia
ADTPEL

SEQ ID NO: 3097677 - protein, 6 aa, Giardia lamblia
ADTPIE

SEQ ID NO: 3097678 - protein, 7 aa, Giardia lamblia
ADTPMGD

SEQ ID NO: 3097679 - protein, 11 aa, Giardia lamblia
ADTPSNANEID

SEQ ID NO: 3097680 - protein, 8 aa, Giardia lamblia
ADTPTTAR

SEQ ID NO: 3097681 - protein, 6 aa, Giardia lamblia
ADTPVD

SEQ ID NO: 3097682 - protein, 5 aa, Giardia lamblia
ADTRK

SEQ ID NO: 3097683 - protein, 4 aa, Giardia lamblia
ADTS

SEQ ID NO: 3097684 - protein, 8 aa, Giardia lamblia
ADTSAPSR

SEQ ID NO: 3097685 - protein, 8 aa, Giardia lamblia
ADTSERNR

SEQ ID NO: 3097686 - protein, 9 aa, Giardia lamblia
ADTSQSQRY

SEQ ID NO: 3097687 - protein, 7 aa, Giardia lamblia
ADTSSIN

SEQ ID NO: 3097688 - protein, 13 aa, Giardia lamblia
ADTSTSGIPPYKE

SEQ ID NO: 3097689 - protein, 7 aa, Giardia lamblia
ADTTASK

SEQ ID NO: 3097690 - protein, 21 aa, Giardia lamblia
ADTTDARSANQSLSEASRLSS

SEQ ID NO: 3097691 - protein, 7 aa, Giardia lamblia
ADTTEEF

SEQ ID NO: 3097692 - protein, 27 aa, Giardia lamblia
ADTTQTASPKATHGNTQIRQDSTNKSC

SEQ ID NO: 3097693 - protein, 4 aa, Giardia lamblia
ADTV

SEQ ID NO: 3097694 - protein, 19 aa, Giardia lamblia
ADTVDGASAVARAKDLESR

SEQ ID NO: 3097695 - protein, 56 aa, Giardia lamblia
ADTVEAEALTSANDMSRPSRPSTTNRPGSAASASGKSTTKDTADGDPHDSESHTSI

SEQ ID NO: 3097696 - protein, 4 aa, Giardia lamblia
ADTY

SEQ ID NO: 3097697 - protein, 7 aa, Giardia lamblia
ADTYGSL

SEQ ID NO: 3097698 - protein, 6 aa, Giardia lamblia
ADVDGR

SEQ ID NO: 3097699 - protein, 7 aa, Giardia lamblia
ADVDSNS

SEQ ID NO: 3097700 - protein, 9 aa, Giardia lamblia
ADVEQRDRE

SEQ ID NO: 3097701 - protein, 4 aa, Giardia lamblia
ADVN

SEQ ID NO: 3097702 - protein, 23 aa, Giardia lamblia
ADVNSKVREAAAAKIAESVSGAT

SEQ ID NO: 3097703 - protein, 13 aa, Giardia lamblia
ADVQSKDSDRLSE

SEQ ID NO: 3097704 - protein, 9 aa, Giardia lamblia
ADVRPREDK

SEQ ID NO: 3097705 - protein, 12 aa, Giardia lamblia
ADVRQDSKEQLE

SEQ ID NO: 3097706 - protein, 9 aa, Giardia lamblia
ADVSDNTDV

SEQ ID NO: 3097707 - protein, 7 aa, Giardia lamblia
ADVSERD

SEQ ID NO: 3097708 - protein, 16 aa, Giardia lamblia
ADVSSGDTAAHAPGSP

SEQ ID NO: 3097709 - protein, 7 aa, Giardia lamblia
ADVTDTS

SEQ ID NO: 3097710 - protein, 6 aa, Giardia lamblia
ADVTSM

SEQ ID NO: 3097711 - protein, 6 aa, Giardia lamblia
ADVYDE

SEQ ID NO: 3097712 - protein, 16 aa, Giardia lamblia
ADYARSNINPLSEKEL

SEQ ID NO: 3097713 - protein, 6 aa, Giardia lamblia
ADYATD

SEQ ID NO: 3097714 - protein, 31 aa, Giardia lamblia
ADYDTQSEVPRLRTPGLTTSVPSQAGTPREA

SEQ ID NO: 3097715 - protein, 6 aa, Giardia lamblia
ADYGTI

SEQ ID NO: 3097716 - protein, 5 aa, Giardia lamblia
ADYKA

SEQ ID NO: 3097717 - protein, 12 aa, Giardia lamblia
ADYRRPSEAVEE

SEQ ID NO: 3097718 - protein, 7 aa, Giardia lamblia
ADYSFGE

SEQ ID NO: 3097719 - protein, 9 aa, Giardia lamblia
ADYSKKKNK

SEQ ID NO: 3097720 - protein, 6 aa, Giardia lamblia
ADYTQY

SEQ ID NO: 3097721 - protein, 27 aa, Giardia lamblia
AEAAAAAAQQAGEQSAAHTAQQAYGHT

SEQ ID NO: 3097722 - protein, 10 aa, Giardia lamblia
AEAAEKDAEL

SEQ ID NO: 3097723 - protein, 75 aa, Giardia lamblia
AEAAEQEAAEQAERLAAEKKARGKKKKVSRPNTAMDDDAKPPSRTSSRSGARPGGSDKGQVSGEKKSSERLREEL

SEQ ID NO: 3097724 - protein, 40 aa, Giardia lamblia
AEAAKQEVAQAAPKKGTKQPPPQAQQSPPGAADDSGYKPP

SEQ ID NO: 3097725 - protein, 19 aa, Giardia lamblia
AEAAPAAAKKEESDDDEIV

SEQ ID NO: 3097726 - protein, 19 aa, Giardia lamblia
AEAARAVGAEQTHKRGEVP

SEQ ID NO: 3097727 - protein, 10 aa, Giardia lamblia
AEAARSKSNK

SEQ ID NO: 3097728 - protein, 12 aa, Giardia lamblia
AEAATTPSAANV

SEQ ID NO: 3097729 - protein, 7 aa, Giardia lamblia
AEAATYK

SEQ ID NO: 3097730 - protein, 9 aa, Giardia lamblia
AEADSHRRS

SEQ ID NO: 3097731 - protein, 10 aa, Giardia lamblia
AEADSSGRTA

SEQ ID NO: 3097732 - protein, 17 aa, Giardia lamblia
AEADTQSMHSGHRPDPI

SEQ ID NO: 3097733 - protein, 4 aa, Giardia lamblia
AEAE

SEQ ID NO: 3097734 - protein, 9 aa, Giardia lamblia
AEAEARNEA

SEQ ID NO: 3097735 - protein, 18 aa, Giardia lamblia
AEAEATGASATHQGHGVS

SEQ ID NO: 3097736 - protein, 10 aa, Giardia lamblia
AEAEEDERVR

SEQ ID NO: 3097737 - protein, 15 aa, Giardia lamblia
AEAEEIKDDAQRDLD

SEQ ID NO: 3097738 - protein, 8 aa, Giardia lamblia
AEAEKSRN

SEQ ID NO: 3097739 - protein, 16 aa, Giardia lamblia
AEAEPQEPVPSTQSVG

SEQ ID NO: 3097740 - protein, 8 aa, Giardia lamblia
AEAERQAL

SEQ ID NO: 3097741 - protein, 5 aa, Giardia lamblia
AEAES

SEQ ID NO: 3097742 - protein, 47 aa, Giardia lamblia
AEAETRPGSPTGSRSASRTSSRSNSRTLGRTSSRNLRRGTGTVPTSF

SEQ ID NO: 3097743 - protein, 6 aa, Giardia lamblia
AEAGDI

SEQ ID NO: 3097744 - protein, 16 aa, Giardia lamblia
AEAGGTAMSGKDEKVF

SEQ ID NO: 3097745 - protein, 5 aa, Giardia lamblia
AEAGH

SEQ ID NO: 3097746 - protein, 12 aa, Giardia lamblia
AEAGMRDARGST

SEQ ID NO: 3097747 - protein, 9 aa, Giardia lamblia
AEAGNLETT

SEQ ID NO: 3097748 - protein, 7 aa, Giardia lamblia
AEAGNTP

SEQ ID NO: 3097749 - protein, 11 aa, Giardia lamblia
AEAGQQNKEGW

SEQ ID NO: 3097750 - protein, 6 aa, Giardia lamblia
AEAGSV

SEQ ID NO: 3097751 - protein, 12 aa, Giardia lamblia
AEAHDRGQDVTQ

SEQ ID NO: 3097752 - protein, 19 aa, Giardia lamblia
AEAHGPVEDFGSANSAGKM

SEQ ID NO: 3097753 - protein, 6 aa, Giardia lamblia
AEAHQR

SEQ ID NO: 3097754 - protein, 11 aa, Giardia lamblia
AEAKKQDINGT

SEQ ID NO: 3097755 - protein, 9 aa, Giardia lamblia
AEAKRQDIK

SEQ ID NO: 3097756 - protein, 8 aa, Giardia lamblia
AEANPTLV

SEQ ID NO: 3097757 - protein, 8 aa, Giardia lamblia
AEAPGKQR

SEQ ID NO: 3097758 - protein, 16 aa, Giardia lamblia
AEAPGLNREKAPEHMP

SEQ ID NO: 3097759 - protein, 5 aa, Giardia lamblia
AEAPL

SEQ ID NO: 3097760 - protein, 20 aa, Giardia lamblia
AEAPPEHSESGNAAQTGDEL

SEQ ID NO: 3097761 - protein, 14 aa, Giardia lamblia
AEAPRPKSSLTDQG

SEQ ID NO: 3097762 - protein, 12 aa, Giardia lamblia
AEAQAKTRRLEE

SEQ ID NO: 3097763 - protein, 10 aa, Giardia lamblia
AEAQANGAKP

SEQ ID NO: 3097764 - protein, 9 aa, Giardia lamblia
AEAQPQDLA

SEQ ID NO: 3097765 - protein, 6 aa, Giardia lamblia
AEAQRR

SEQ ID NO: 3097766 - protein, 7 aa, Giardia lamblia
AEAQTDP

SEQ ID NO: 3097767 - protein, 7 aa, Giardia lamblia
AEAQVSK

SEQ ID NO: 3097768 - protein, 10 aa, Giardia lamblia
AEARAQRHET

SEQ ID NO: 3097769 - protein, 7 aa, Giardia lamblia
AEARKRD

SEQ ID NO: 3097770 - protein, 28 aa, Giardia lamblia
AEARRQRYANRRDSLGGTSSYRPGTSGS

SEQ ID NO: 3097771 - protein, 8 aa, Giardia lamblia
AEARTGLS

SEQ ID NO: 3097772 - protein, 10 aa, Giardia lamblia
AEASPATVSR

SEQ ID NO: 3097773 - protein, 6 aa, Giardia lamblia
AEASQQ

SEQ ID NO: 3097774 - protein, 26 aa, Giardia lamblia
AEASRQSEVSPVSPPRDQSTKETKVP

SEQ ID NO: 3097775 - protein, 11 aa, Giardia lamblia
AEASSAASLYP

SEQ ID NO: 3097776 - protein, 83 aa, Giardia lamblia
AEASSAGQQTKTDTQRSRQPVGAGERTSNRVSEDFSTRKVQDSSKRSYVQQEQESSPSRNHSANTPARTSDPAEGEESREECP

SEQ ID NO: 3097777 - protein, 5 aa, Giardia lamblia
AEAST

SEQ ID NO: 3097778 - protein, 18 aa, Giardia lamblia
AEATEAESAASKTRNEAN

SEQ ID NO: 3097779 - protein, 11 aa, Giardia lamblia
AEATEETNEKI

SEQ ID NO: 3097780 - protein, 7 aa, Giardia lamblia
AEAVQGV

SEQ ID NO: 3097781 - protein, 10 aa, Giardia lamblia
AECSKDSQSL

SEQ ID NO: 3097782 - protein, 5 aa, Giardia lamblia
AEDAE

SEQ ID NO: 3097783 - protein, 7 aa, Giardia lamblia
AEDAQAR

SEQ ID NO: 3097784 - protein, 7 aa, Giardia lamblia
AEDARQA

SEQ ID NO: 3097785 - protein, 7 aa, Giardia lamblia
AEDEDFP

SEQ ID NO: 3097786 - protein, 9 aa, Giardia lamblia
AEDEETYRK

SEQ ID NO: 3097787 - protein, 8 aa, Giardia lamblia
AEDEQSKD

SEQ ID NO: 3097788 - protein, 6 aa, Giardia lamblia
AEDERD

SEQ ID NO: 3097789 - protein, 8 aa, Giardia lamblia
AEDGEDSD

SEQ ID NO: 3097790 - protein, 6 aa, Giardia lamblia
AEDGEI

SEQ ID NO: 3097791 - protein, 7 aa, Giardia lamblia
AEDGNVG

SEQ ID NO: 3097792 - protein, 10 aa, Giardia lamblia
AEDGSVYGAA

SEQ ID NO: 3097793 - protein, 4 aa, Giardia lamblia
AEDH

SEQ ID NO: 3097794 - protein, 12 aa, Giardia lamblia
AEDIKENAQQAI

SEQ ID NO: 3097795 - protein, 9 aa, Giardia lamblia
AEDLPQNQP

SEQ ID NO: 3097796 - protein, 7 aa, Giardia lamblia
AEDNPRR

SEQ ID NO: 3097797 - protein, 7 aa, Giardia lamblia
AEDPTIP

SEQ ID NO: 3097798 - protein, 5 aa, Giardia lamblia
AEDQI

SEQ ID NO: 3097799 - protein, 10 aa, Giardia lamblia
AEDRERAREK

SEQ ID NO: 3097800 - protein, 6 aa, Giardia lamblia
AEDRTR

SEQ ID NO: 3097801 - protein, 6 aa, Giardia lamblia
AEDSNR

SEQ ID NO: 3097802 - protein, 13 aa, Giardia lamblia
AEDTDDDHSDSEP

SEQ ID NO: 3097803 - protein, 9 aa, Giardia lamblia
AEDTPESAL

SEQ ID NO: 3097804 - protein, 12 aa, Giardia lamblia
AEDVMNNGLTRL

SEQ ID NO: 3097805 - protein, 9 aa, Giardia lamblia
AEDYSRASE

SEQ ID NO: 3097806 - protein, 6 aa, Giardia lamblia
AEEAAA

SEQ ID NO: 3097807 - protein, 21 aa, Giardia lamblia
AEEAKSKAIQEAKEANERRLR

SEQ ID NO: 3097808 - protein, 5 aa, Giardia lamblia
AEEAL

SEQ ID NO: 3097809 - protein, 5 aa, Giardia lamblia
AEEAQ

SEQ ID NO: 3097810 - protein, 7 aa, Giardia lamblia
AEEAREF

SEQ ID NO: 3097811 - protein, 7 aa, Giardia lamblia
AEEARKN

SEQ ID NO: 3097812 - protein, 10 aa, Giardia lamblia
AEEARREREE

SEQ ID NO: 3097813 - protein, 6 aa, Giardia lamblia
AEEARV

SEQ ID NO: 3097814 - protein, 10 aa, Giardia lamblia
AEEASDSCDT

SEQ ID NO: 3097815 - protein, 6 aa, Giardia lamblia
AEEASP

SEQ ID NO: 3097816 - protein, 4 aa, Giardia lamblia
AEED

SEQ ID NO: 3097817 - protein, 5 aa, Giardia lamblia
AEEDD

SEQ ID NO: 3097818 - protein, 8 aa, Giardia lamblia
AEEDRATV

SEQ ID NO: 3097819 - protein, 4 aa, Giardia lamblia
AEEE

SEQ ID NO: 3097820 - protein, 8 aa, Giardia lamblia
AEEENNKR

SEQ ID NO: 3097821 - protein, 10 aa, Giardia lamblia
AEEESARPAV

SEQ ID NO: 3097822 - protein, 6 aa, Giardia lamblia
AEEETA

SEQ ID NO: 3097823 - protein, 7 aa, Giardia lamblia
AEEETAL

SEQ ID NO: 3097824 - protein, 6 aa, Giardia lamblia
AEEGAG

SEQ ID NO: 3097825 - protein, 6 aa, Giardia lamblia
AEEGDA

SEQ ID NO: 3097826 - protein, 8 aa, Giardia lamblia
AEEGKYDP

SEQ ID NO: 3097827 - protein, 4 aa, Giardia lamblia
AEEH

SEQ ID NO: 3097828 - protein, 5 aa, Giardia lamblia
AEEHV

SEQ ID NO: 3097829 - protein, 4 aa, Giardia lamblia
AEEI

SEQ ID NO: 3097830 - protein, 18 aa, Giardia lamblia
AEEISTEKNKAKVTTSKV

SEQ ID NO: 3097831 - protein, 17 aa, Giardia lamblia
AEEKWGSDQKPSQTTRD

SEQ ID NO: 3097832 - protein, 4 aa, Giardia lamblia
AEEL

SEQ ID NO: 3097833 - protein, 9 aa, Giardia lamblia
AEELREQRR

SEQ ID NO: 3097834 - protein, 6 aa, Giardia lamblia
AEENSA

SEQ ID NO: 3097835 - protein, 13 aa, Giardia lamblia
AEEQAVRSKSSIN

SEQ ID NO: 3097836 - protein, 6 aa, Giardia lamblia
AEEQEV

SEQ ID NO: 3097837 - protein, 5 aa, Giardia lamblia
AEEQG

SEQ ID NO: 3097838 - protein, 5 aa, Giardia lamblia
AEEQL

SEQ ID NO: 3097839 - protein, 22 aa, Giardia lamblia
AEERERKRRENEERQREAERKL

SEQ ID NO: 3097840 - protein, 19 aa, Giardia lamblia
AEERFNPENRDKELEKRAS

SEQ ID NO: 3097841 - protein, 6 aa, Giardia lamblia
AEERLA

SEQ ID NO: 3097842 - protein, 5 aa, Giardia lamblia
AEERQ

SEQ ID NO: 3097843 - protein, 5 aa, Giardia lamblia
AEESE

SEQ ID NO: 3097844 - protein, 5 aa, Giardia lamblia
AEESF

SEQ ID NO: 3097845 - protein, 8 aa, Giardia lamblia
AEESRIPA

SEQ ID NO: 3097846 - protein, 7 aa, Giardia lamblia
AEESSLG

SEQ ID NO: 3097847 - protein, 6 aa, Giardia lamblia
AEETGI

SEQ ID NO: 3097848 - protein, 7 aa, Giardia lamblia
AEETSTK

SEQ ID NO: 3097849 - protein, 8 aa, Giardia lamblia
AEEVDGQK

SEQ ID NO: 3097850 - protein, 7 aa, Giardia lamblia
AEEVNYE

SEQ ID NO: 3097851 - protein, 18 aa, Giardia lamblia
AEFEEKTKGLQKSTKAEA

SEQ ID NO: 3097852 - protein, 5 aa, Giardia lamblia
AEFPV

SEQ ID NO: 3097853 - protein, 8 aa, Giardia lamblia
AEGAPRQQ

SEQ ID NO: 3097854 - protein, 5 aa, Giardia lamblia
AEGCD

SEQ ID NO: 3097855 - protein, 9 aa, Giardia lamblia
AEGDAAQGA

SEQ ID NO: 3097856 - protein, 21 aa, Giardia lamblia
AEGEEGGNITAKKEAESKSSL

SEQ ID NO: 3097857 - protein, 7 aa, Giardia lamblia
AEGEGDW

SEQ ID NO: 3097858 - protein, 14 aa, Giardia lamblia
AEGEYALVEDLRGL

SEQ ID NO: 3097859 - protein, 6 aa, Giardia lamblia
AEGGGN

SEQ ID NO: 3097860 - protein, 12 aa, Giardia lamblia
AEGGMKNNEGYT

SEQ ID NO: 3097861 - protein, 5 aa, Giardia lamblia
AEGGT

SEQ ID NO: 3097862 - protein, 15 aa, Giardia lamblia
AEGKKSQSFKQPTKV

SEQ ID NO: 3097863 - protein, 5 aa, Giardia lamblia
AEGNH

SEQ ID NO: 3097864 - protein, 6 aa, Giardia lamblia
AEGNNI

SEQ ID NO: 3097865 - protein, 9 aa, Giardia lamblia
AEGPDGKKP

SEQ ID NO: 3097866 - protein, 6 aa, Giardia lamblia
AEGQSL

SEQ ID NO: 3097867 - protein, 8 aa, Giardia lamblia
AEGQTTEV

SEQ ID NO: 3097868 - protein, 8 aa, Giardia lamblia
AEGSDASG

SEQ ID NO: 3097869 - protein, 6 aa, Giardia lamblia
AEGSGK

SEQ ID NO: 3097870 - protein, 6 aa, Giardia lamblia
AEGSVT

SEQ ID NO: 3097871 - protein, 4 aa, Giardia lamblia
AEGT

SEQ ID NO: 3097872 - protein, 7 aa, Giardia lamblia
AEGTDDV

SEQ ID NO: 3097873 - protein, 5 aa, Giardia lamblia
AEGVG

SEQ ID NO: 3097874 - protein, 15 aa, Giardia lamblia
AEHEPTSGGTLGGPV

SEQ ID NO: 3097875 - protein, 5 aa, Giardia lamblia
AEHGT

SEQ ID NO: 3097876 - protein, 4 aa, Giardia lamblia
AEHK

SEQ ID NO: 3097877 - protein, 5 aa, Giardia lamblia
AEHNT

SEQ ID NO: 3097878 - protein, 7 aa, Giardia lamblia
AEHPGTA

SEQ ID NO: 3097879 - protein, 7 aa, Giardia lamblia
AEHPPTH

SEQ ID NO: 3097880 - protein, 6 aa, Giardia lamblia
AEHQKR

SEQ ID NO: 3097881 - protein, 5 aa, Giardia lamblia
AEHRL

SEQ ID NO: 3097882 - protein, 11 aa, Giardia lamblia
AEHSALQNTHK

SEQ ID NO: 3097883 - protein, 4 aa, Giardia lamblia
AEHT

SEQ ID NO: 3097884 - protein, 6 aa, Giardia lamblia
AEIAGL

SEQ ID NO: 3097885 - protein, 5 aa, Giardia lamblia
AEIAR

SEQ ID NO: 3097886 - protein, 4 aa, Giardia lamblia
AEIE

SEQ ID NO: 3097887 - protein, 12 aa, Giardia lamblia
AEIERSKQREEA

SEQ ID NO: 3097888 - protein, 7 aa, Giardia lamblia
AEIESTR

SEQ ID NO: 3097889 - protein, 5 aa, Giardia lamblia
AEIGR

SEQ ID NO: 3097890 - protein, 6 aa, Giardia lamblia
AEINGE

SEQ ID NO: 3097891 - protein, 5 aa, Giardia lamblia
AEIQE

SEQ ID NO: 3097892 - protein, 15 aa, Giardia lamblia
AEIQQRRKERAERMD

SEQ ID NO: 3097893 - protein, 4 aa, Giardia lamblia
AEIS

SEQ ID NO: 3097894 - protein, 5 aa, Giardia lamblia
AEISR

SEQ ID NO: 3097895 - protein, 17 aa, Giardia lamblia
AEKAARQAGKGGKKNGK

SEQ ID NO: 3097896 - protein, 12 aa, Giardia lamblia
AEKAKRSREYEE

SEQ ID NO: 3097897 - protein, 7 aa, Giardia lamblia
AEKASAK

SEQ ID NO: 3097898 - protein, 5 aa, Giardia lamblia
AEKAT

SEQ ID NO: 3097899 - protein, 8 aa, Giardia lamblia
AEKDALEQ

SEQ ID NO: 3097900 - protein, 9 aa, Giardia lamblia
AEKDALRAK

SEQ ID NO: 3097901 - protein, 15 aa, Giardia lamblia
AEKDIDSAKLTSQES

SEQ ID NO: 3097902 - protein, 8 aa, Giardia lamblia
AEKDNAEI

SEQ ID NO: 3097903 - protein, 8 aa, Giardia lamblia
AEKDSNQM

SEQ ID NO: 3097904 - protein, 6 aa, Giardia lamblia
AEKDSV

SEQ ID NO: 3097905 - protein, 10 aa, Giardia lamblia
AEKEADRTAM

SEQ ID NO: 3097906 - protein, 5 aa, Giardia lamblia
AEKEK

SEQ ID NO: 3097907 - protein, 6 aa, Giardia lamblia
AEKGHT

SEQ ID NO: 3097908 - protein, 9 aa, Giardia lamblia
AEKGKITRR

SEQ ID NO: 3097909 - protein, 27 aa, Giardia lamblia
AEKGSAVSPSAFDDYESQSWFDRAFVE

SEQ ID NO: 3097910 - protein, 17 aa, Giardia lamblia
AEKGSGRAAKDKRQYPT

SEQ ID NO: 3097911 - protein, 5 aa, Giardia lamblia
AEKGY

SEQ ID NO: 3097912 - protein, 11 aa, Giardia lamblia
AEKHRTHREEE

SEQ ID NO: 3097913 - protein, 11 aa, Giardia lamblia
AEKKAKSDGAY

SEQ ID NO: 3097914 - protein, 19 aa, Giardia lamblia
AEKKNEIKESSKPNTSIRK

SEQ ID NO: 3097915 - protein, 8 aa, Giardia lamblia
AEKKRELE

SEQ ID NO: 3097916 - protein, 7 aa, Giardia lamblia
AEKLTEA

SEQ ID NO: 3097917 - protein, 9 aa, Giardia lamblia
AEKMTGQHQ

SEQ ID NO: 3097918 - protein, 9 aa, Giardia lamblia
AEKNDSFGA

SEQ ID NO: 3097919 - protein, 6 aa, Giardia lamblia
AEKNSL

SEQ ID NO: 3097920 - protein, 8 aa, Giardia lamblia
AEKNSNIE

SEQ ID NO: 3097921 - protein, 5 aa, Giardia lamblia
AEKNT

SEQ ID NO: 3097922 - protein, 8 aa, Giardia lamblia
AEKPPNAL

SEQ ID NO: 3097923 - protein, 9 aa, Giardia lamblia
AEKQASDEE

SEQ ID NO: 3097924 - protein, 8 aa, Giardia lamblia
AEKQPEGL

SEQ ID NO: 3097925 - protein, 23 aa, Giardia lamblia
AEKSAHTGRRKQRVRPGSEMQTA

SEQ ID NO: 3097926 - protein, 39 aa, Giardia lamblia
AEKSGAHGTRVADSSEMRAVQGSSKQVVGTAPTSTPAAP

SEQ ID NO: 3097927 - protein, 9 aa, Giardia lamblia
AEKSGNANL

SEQ ID NO: 3097928 - protein, 9 aa, Giardia lamblia
AEKSNTRRH

SEQ ID NO: 3097929 - protein, 6 aa, Giardia lamblia
AEKTHH

SEQ ID NO: 3097930 - protein, 10 aa, Giardia lamblia
AEKVSKSDTD

SEQ ID NO: 3097931 - protein, 8 aa, Giardia lamblia
AELAGNQV

SEQ ID NO: 3097932 - protein, 16 aa, Giardia lamblia
AELAKANSTISAHEKT

SEQ ID NO: 3097933 - protein, 8 aa, Giardia lamblia
AELAQKEM

SEQ ID NO: 3097934 - protein, 14 aa, Giardia lamblia
AELARSVSKQELDN

SEQ ID NO: 3097935 - protein, 14 aa, Giardia lamblia
AELDGSQKIHTGTQ

SEQ ID NO: 3097936 - protein, 4 aa, Giardia lamblia
AELE

SEQ ID NO: 3097937 - protein, 5 aa, Giardia lamblia
AELEE

SEQ ID NO: 3097938 - protein, 13 aa, Giardia lamblia
AELESQLKDAQDA

SEQ ID NO: 3097939 - protein, 14 aa, Giardia lamblia
AELGEKTANYSGSD

SEQ ID NO: 3097940 - protein, 16 aa, Giardia lamblia
AELGKKTEQTATLTSE

SEQ ID NO: 3097941 - protein, 11 aa, Giardia lamblia
AELHKQSGQDL

SEQ ID NO: 3097942 - protein, 11 aa, Giardia lamblia
AELKNKDGETP

SEQ ID NO: 3097943 - protein, 13 aa, Giardia lamblia
AELPDGDNKTGKV

SEQ ID NO: 3097944 - protein, 6 aa, Giardia lamblia
AELPDT

SEQ ID NO: 3097945 - protein, 5 aa, Giardia lamblia
AELPR

SEQ ID NO: 3097946 - protein, 11 aa, Giardia lamblia
AELQGSRESNE

SEQ ID NO: 3097947 - protein, 6 aa, Giardia lamblia
AELREA

SEQ ID NO: 3097948 - protein, 11 aa, Giardia lamblia
AELRKEAKQKT

SEQ ID NO: 3097949 - protein, 6 aa, Giardia lamblia
AELRQE

SEQ ID NO: 3097950 - protein, 47 aa, Giardia lamblia
AELSPVTNDTNPQPAGTPPTIPTTPSKIDPKHGAGDKVSERTAEELE

SEQ ID NO: 3097951 - protein, 10 aa, Giardia lamblia
AELSQKETDL

SEQ ID NO: 3097952 - protein, 9 aa, Giardia lamblia
AELSSNSYF

SEQ ID NO: 3097953 - protein, 10 aa, Giardia lamblia
AELSSSDRIE

SEQ ID NO: 3097954 - protein, 5 aa, Giardia lamblia
AELTS

SEQ ID NO: 3097955 - protein, 6 aa, Giardia lamblia
AELTSR

SEQ ID NO: 3097956 - protein, 6 aa, Giardia lamblia
AEMEDT

SEQ ID NO: 3097957 - protein, 5 aa, Giardia lamblia
AEMPG

SEQ ID NO: 3097958 - protein, 6 aa, Giardia lamblia
AENADL

SEQ ID NO: 3097959 - protein, 6 aa, Giardia lamblia
AENAEL

SEQ ID NO: 3097960 - protein, 5 aa, Giardia lamblia
AENDK

SEQ ID NO: 3097961 - protein, 9 aa, Giardia lamblia
AENDSEKVD

SEQ ID NO: 3097962 - protein, 4 aa, Giardia lamblia
AENE

SEQ ID NO: 3097963 - protein, 6 aa, Giardia lamblia
AENERL

SEQ ID NO: 3097964 - protein, 4 aa, Giardia lamblia
AENG

SEQ ID NO: 3097965 - protein, 7 aa, Giardia lamblia
AENGDLP

SEQ ID NO: 3097966 - protein, 5 aa, Giardia lamblia
AENGH

SEQ ID NO: 3097967 - protein, 6 aa, Giardia lamblia
AENGNV

SEQ ID NO: 3097968 - protein, 7 aa, Giardia lamblia
AENKALK

SEQ ID NO: 3097969 - protein, 9 aa, Giardia lamblia
AENKELRTQ

SEQ ID NO: 3097970 - protein, 5 aa, Giardia lamblia
AENND

SEQ ID NO: 3097971 - protein, 6 aa, Giardia lamblia
AENNHP

SEQ ID NO: 3097972 - protein, 4 aa, Giardia lamblia
AENP

SEQ ID NO: 3097973 - protein, 6 aa, Giardia lamblia
AENPAS

SEQ ID NO: 3097974 - protein, 5 aa, Giardia lamblia
AENPL

SEQ ID NO: 3097975 - protein, 5 aa, Giardia lamblia
AENPV

SEQ ID NO: 3097976 - protein, 5 aa, Giardia lamblia
AENQA

SEQ ID NO: 3097977 - protein, 6 aa, Giardia lamblia
AENQQL

SEQ ID NO: 3097978 - protein, 6 aa, Giardia lamblia
AENRAL

SEQ ID NO: 3097979 - protein, 8 aa, Giardia lamblia
AENSALSS

SEQ ID NO: 3097980 - protein, 16 aa, Giardia lamblia
AENSHRKAKGLPPLTN

SEQ ID NO: 3097981 - protein, 8 aa, Giardia lamblia
AENSNQSM

SEQ ID NO: 3097982 - protein, 7 aa, Giardia lamblia
AENTSLH

SEQ ID NO: 3097983 - protein, 11 aa, Giardia lamblia
AENTTLRQQAT

SEQ ID NO: 3097984 - protein, 4 aa, Giardia lamblia
AENV

SEQ ID NO: 3097985 - protein, 9 aa, Giardia lamblia
AEPAPFPSE

SEQ ID NO: 3097986 - protein, 4 aa, Giardia lamblia
AEPD

SEQ ID NO: 3097987 - protein, 5 aa, Giardia lamblia
AEPDH

SEQ ID NO: 3097988 - protein, 8 aa, Giardia lamblia
AEPDKSVE

SEQ ID NO: 3097989 - protein, 7 aa, Giardia lamblia
AEPDRTT

SEQ ID NO: 3097990 - protein, 7 aa, Giardia lamblia
AEPEDSP

SEQ ID NO: 3097991 - protein, 8 aa, Giardia lamblia
AEPEHDDL

SEQ ID NO: 3097992 - protein, 15 aa, Giardia lamblia
AEPEPESKEQPSPQL

SEQ ID NO: 3097993 - protein, 5 aa, Giardia lamblia
AEPFA

SEQ ID NO: 3097994 - protein, 4 aa, Giardia lamblia
AEPG

SEQ ID NO: 3097995 - protein, 14 aa, Giardia lamblia
AEPGFRNQSNETGL

SEQ ID NO: 3097996 - protein, 6 aa, Giardia lamblia
AEPGLI

SEQ ID NO: 3097997 - protein, 15 aa, Giardia lamblia
AEPGPDGGDVEPGLS

SEQ ID NO: 3097998 - protein, 11 aa, Giardia lamblia
AEPKSTSKALS

SEQ ID NO: 3097999 - protein, 32 aa, Giardia lamblia
AEPLPTDSRPDGTTESVTYRTQKDYATSEPSS

SEQ ID NO: 3098000 - protein, 25 aa, Giardia lamblia
AEPNQGLSQPSEAAYSEVRTTPYPT

SEQ ID NO: 3098001 - protein, 6 aa, Giardia lamblia
AEPNQS

SEQ ID NO: 3098002 - protein, 10 aa, Giardia lamblia
AEPNSVSESS

SEQ ID NO: 3098003 - protein, 9 aa, Giardia lamblia
AEPRPPSDI

SEQ ID NO: 3098004 - protein, 23 aa, Giardia lamblia
AEPSAVPSAGPPDGKKGPGRRSK

SEQ ID NO: 3098005 - protein, 13 aa, Giardia lamblia
AEPTRASDNASPC

SEQ ID NO: 3098006 - protein, 13 aa, Giardia lamblia
AEPVATAADTIGS

SEQ ID NO: 3098007 - protein, 5 aa, Giardia lamblia
AEQCK

SEQ ID NO: 3098008 - protein, 7 aa, Giardia lamblia
AEQDGFA

SEQ ID NO: 3098009 - protein, 10 aa, Giardia lamblia
AEQEDSCPQS

SEQ ID NO: 3098010 - protein, 7 aa, Giardia lamblia
AEQEQGY

SEQ ID NO: 3098011 - protein, 6 aa, Giardia lamblia
AEQERR

SEQ ID NO: 3098012 - protein, 5 aa, Giardia lamblia
AEQGD

SEQ ID NO: 3098013 - protein, 7 aa, Giardia lamblia
AEQGDID

SEQ ID NO: 3098014 - protein, 5 aa, Giardia lamblia
AEQGI

SEQ ID NO: 3098015 - protein, 9 aa, Giardia lamblia
AEQGKAEMK

SEQ ID NO: 3098016 - protein, 10 aa, Giardia lamblia
AEQGSIPEEA

SEQ ID NO: 3098017 - protein, 13 aa, Giardia lamblia
AEQHRRGTERSNI

SEQ ID NO: 3098018 - protein, 5 aa, Giardia lamblia
AEQKE

SEQ ID NO: 3098019 - protein, 8 aa, Giardia lamblia
AEQKRENA

SEQ ID NO: 3098020 - protein, 24 aa, Giardia lamblia
AEQKRLKDEQLAKETEEREREKEI

SEQ ID NO: 3098021 - protein, 14 aa, Giardia lamblia
AEQLNAEQLREKAR

SEQ ID NO: 3098022 - protein, 6 aa, Giardia lamblia
AEQMSE

SEQ ID NO: 3098023 - protein, 7 aa, Giardia lamblia
AEQNDPS

SEQ ID NO: 3098024 - protein, 4 aa, Giardia lamblia
AEQP

SEQ ID NO: 3098025 - protein, 6 aa, Giardia lamblia
AEQPHP

SEQ ID NO: 3098026 - protein, 4 aa, Giardia lamblia
AEQQ

SEQ ID NO: 3098027 - protein, 8 aa, Giardia lamblia
AEQQEKNA

SEQ ID NO: 3098028 - protein, 8 aa, Giardia lamblia
AEQQKLEE

SEQ ID NO: 3098029 - protein, 6 aa, Giardia lamblia
AEQQTL

SEQ ID NO: 3098030 - protein, 4 aa, Giardia lamblia
AEQR

SEQ ID NO: 3098031 - protein, 16 aa, Giardia lamblia
AEQRMSAGKQASKRKL

SEQ ID NO: 3098032 - protein, 6 aa, Giardia lamblia
AEQRPK

SEQ ID NO: 3098033 - protein, 7 aa, Giardia lamblia
AEQRTEV

SEQ ID NO: 3098034 - protein, 7 aa, Giardia lamblia
AEQTATV

SEQ ID NO: 3098035 - protein, 7 aa, Giardia lamblia
AEQTEEI

SEQ ID NO: 3098036 - protein, 10 aa, Giardia lamblia
AEQTLESQNL

SEQ ID NO: 3098037 - protein, 7 aa, Giardia lamblia
AEQTLRS

SEQ ID NO: 3098038 - protein, 8 aa, Giardia lamblia
AEQTPEYF

SEQ ID NO: 3098039 - protein, 5 aa, Giardia lamblia
AEQTS

SEQ ID NO: 3098040 - protein, 8 aa, Giardia lamblia
AEQTSGNR

SEQ ID NO: 3098041 - protein, 83 aa, Giardia lamblia
AEQVNDEVEEYEEESNESEEEAQDAEEAQEAARQAGGDTTNPKQDDTSAATTEAPTSPEVTPTSAPEGSSPNKTAVKPAGAKR

SEQ ID NO: 3098042 - protein, 9 aa, Giardia lamblia
AEQYSPAYN

SEQ ID NO: 3098043 - protein, 4 aa, Giardia lamblia
AERA

SEQ ID NO: 3098044 - protein, 4 aa, Giardia lamblia
AERC

SEQ ID NO: 3098045 - protein, 4 aa, Giardia lamblia
AERD

SEQ ID NO: 3098046 - protein, 10 aa, Giardia lamblia
AERDDQDPES

SEQ ID NO: 3098047 - protein, 5 aa, Giardia lamblia
AERDF

SEQ ID NO: 3098048 - protein, 8 aa, Giardia lamblia
AERDSREE

SEQ ID NO: 3098049 - protein, 5 aa, Giardia lamblia
AEREA

SEQ ID NO: 3098050 - protein, 9 aa, Giardia lamblia
AEREAEQYE

SEQ ID NO: 3098051 - protein, 7 aa, Giardia lamblia
AEREAQE

SEQ ID NO: 3098052 - protein, 16 aa, Giardia lamblia
AEREQLAANPRSSQHL

SEQ ID NO: 3098053 - protein, 7 aa, Giardia lamblia
AEREREI

SEQ ID NO: 3098054 - protein, 9 aa, Giardia lamblia
AERERYKKQ

SEQ ID NO: 3098055 - protein, 6 aa, Giardia lamblia
AERGDA

SEQ ID NO: 3098056 - protein, 19 aa, Giardia lamblia
AERGDETGDPSTHLTNKER

SEQ ID NO: 3098057 - protein, 8 aa, Giardia lamblia
AERGDPVP

SEQ ID NO: 3098058 - protein, 7 aa, Giardia lamblia
AERGEIH

SEQ ID NO: 3098059 - protein, 8 aa, Giardia lamblia
AERGRAAR

SEQ ID NO: 3098060 - protein, 6 aa, Giardia lamblia
AERKGV

SEQ ID NO: 3098061 - protein, 15 aa, Giardia lamblia
AERLREEADNREREL

SEQ ID NO: 3098062 - protein, 6 aa, Giardia lamblia
AERNQK

SEQ ID NO: 3098063 - protein, 6 aa, Giardia lamblia
AERNRA

SEQ ID NO: 3098064 - protein, 19 aa, Giardia lamblia
AERPDHARRPSSSSISAMS

SEQ ID NO: 3098065 - protein, 26 aa, Giardia lamblia
AERPENISGWNEPQELKKRKGRPIQS

SEQ ID NO: 3098066 - protein, 8 aa, Giardia lamblia
AERPTAKG

SEQ ID NO: 3098067 - protein, 7 aa, Giardia lamblia
AERPTAR

SEQ ID NO: 3098068 - protein, 34 aa, Giardia lamblia
AERQHNATRAESRSYREQDTAHYSNTDSEVESDD

SEQ ID NO: 3098069 - protein, 10 aa, Giardia lamblia
AERQYGKPRD

SEQ ID NO: 3098070 - protein, 7 aa, Giardia lamblia
AERRKNI

SEQ ID NO: 3098071 - protein, 9 aa, Giardia lamblia
AERRPIPQD

SEQ ID NO: 3098072 - protein, 10 aa, Giardia lamblia
AERSCPSKSL

SEQ ID NO: 3098073 - protein, 9 aa, Giardia lamblia
AERSGPAGK

SEQ ID NO: 3098074 - protein, 5 aa, Giardia lamblia
AERSN

SEQ ID NO: 3098075 - protein, 6 aa, Giardia lamblia
AERSSF

SEQ ID NO: 3098076 - protein, 11 aa, Giardia lamblia
AERSSSTSPVY

SEQ ID NO: 3098077 - protein, 17 aa, Giardia lamblia
AERTAKEKAQTELTAAS

SEQ ID NO: 3098078 - protein, 22 aa, Giardia lamblia
AERTARSIGYTNPNSDGGVPPM

SEQ ID NO: 3098079 - protein, 15 aa, Giardia lamblia
AERTGGHITETRSAR

SEQ ID NO: 3098080 - protein, 18 aa, Giardia lamblia
AERTSYKNNEIPANPPYK

SEQ ID NO: 3098081 - protein, 6 aa, Giardia lamblia
AERTYS

SEQ ID NO: 3098082 - protein, 11 aa, Giardia lamblia
AERYSDNQSAM

SEQ ID NO: 3098083 - protein, 19 aa, Giardia lamblia
AESAAKDHTLNQKTEEIKA

SEQ ID NO: 3098084 - protein, 17 aa, Giardia lamblia
AESAEGTERNTKALQTR

SEQ ID NO: 3098085 - protein, 8 aa, Giardia lamblia
AESAGERQ

SEQ ID NO: 3098086 - protein, 12 aa, Giardia lamblia
AESAVSAKMEQP

SEQ ID NO: 3098087 - protein, 8 aa, Giardia lamblia
AESDGYST

SEQ ID NO: 3098088 - protein, 6 aa, Giardia lamblia
AESEIS

SEQ ID NO: 3098089 - protein, 15 aa, Giardia lamblia
AESEKRNHCICGYHI

SEQ ID NO: 3098090 - protein, 6 aa, Giardia lamblia
AESFSG

SEQ ID NO: 3098091 - protein, 11 aa, Giardia lamblia
AESGAPRDKTI

SEQ ID NO: 3098092 - protein, 9 aa, Giardia lamblia
AESGKNNSV

SEQ ID NO: 3098093 - protein, 22 aa, Giardia lamblia
AESGNASGYSYSSDYSYSTSSD

SEQ ID NO: 3098094 - protein, 19 aa, Giardia lamblia
AESGQMEGQTSQPHVSGPI

SEQ ID NO: 3098095 - protein, 11 aa, Giardia lamblia
AESGSAEDALR

SEQ ID NO: 3098096 - protein, 8 aa, Giardia lamblia
AESGSPLY

SEQ ID NO: 3098097 - protein, 10 aa, Giardia lamblia
AESGSTAEET

SEQ ID NO: 3098098 - protein, 8 aa, Giardia lamblia
AESKVSGL

SEQ ID NO: 3098099 - protein, 5 aa, Giardia lamblia
AESLN

SEQ ID NO: 3098100 - protein, 8 aa, Giardia lamblia
AESLNPDS

SEQ ID NO: 3098101 - protein, 11 aa, Giardia lamblia
AESNAGPPSFN

SEQ ID NO: 3098102 - protein, 13 aa, Giardia lamblia
AESPLESNQHTPI

SEQ ID NO: 3098103 - protein, 7 aa, Giardia lamblia
AESPSTL

SEQ ID NO: 3098104 - protein, 10 aa, Giardia lamblia
AESRKQDWSG

SEQ ID NO: 3098105 - protein, 6 aa, Giardia lamblia
AESRNI

SEQ ID NO: 3098106 - protein, 56 aa, Giardia lamblia
AESRQEEEERKLKQEQIRAEQRAKEQESVQQAAEEVSKAAKRSWEDDADSDSSFEI

SEQ ID NO: 3098107 - protein, 13 aa, Giardia lamblia
AESRQLSSAGDDR

SEQ ID NO: 3098108 - protein, 11 aa, Giardia lamblia
AESRRKRSASI

SEQ ID NO: 3098109 - protein, 4 aa, Giardia lamblia
AESS

SEQ ID NO: 3098110 - protein, 8 aa, Giardia lamblia
AESSEGKI

SEQ ID NO: 3098111 - protein, 6 aa, Giardia lamblia
AESSGG

SEQ ID NO: 3098112 - protein, 10 aa, Giardia lamblia
AESSGSQYSY

SEQ ID NO: 3098113 - protein, 6 aa, Giardia lamblia
AESSTS

SEQ ID NO: 3098114 - protein, 5 aa, Giardia lamblia
AESTG

SEQ ID NO: 3098115 - protein, 28 aa, Giardia lamblia
AESTIGQEGPTRAGSGLAGRSRAPSTHH

SEQ ID NO: 3098116 - protein, 13 aa, Giardia lamblia
AESTKKVEDSLGP

SEQ ID NO: 3098117 - protein, 11 aa, Giardia lamblia
AESTQGPESGM

SEQ ID NO: 3098118 - protein, 13 aa, Giardia lamblia
AESYHSSKQDQSE

SEQ ID NO: 3098119 - protein, 4 aa, Giardia lamblia
AETA

SEQ ID NO: 3098120 - protein, 7 aa, Giardia lamblia
AETADKS

SEQ ID NO: 3098121 - protein, 8 aa, Giardia lamblia
AETAGAGI

SEQ ID NO: 3098122 - protein, 6 aa, Giardia lamblia
AETARF

SEQ ID NO: 3098123 - protein, 6 aa, Giardia lamblia
AETDEG

SEQ ID NO: 3098124 - protein, 6 aa, Giardia lamblia
AETDSK

SEQ ID NO: 3098125 - protein, 6 aa, Giardia lamblia
AETEGH

SEQ ID NO: 3098126 - protein, 14 aa, Giardia lamblia
AETEPKMKDHDERT

SEQ ID NO: 3098127 - protein, 6 aa, Giardia lamblia
AETGDK

SEQ ID NO: 3098128 - protein, 7 aa, Giardia lamblia
AETGDTA

SEQ ID NO: 3098129 - protein, 5 aa, Giardia lamblia
AETGL

SEQ ID NO: 3098130 - protein, 16 aa, Giardia lamblia
AETGPDGNPLPIPKSR

SEQ ID NO: 3098131 - protein, 12 aa, Giardia lamblia
AETGPITSAPPE

SEQ ID NO: 3098132 - protein, 16 aa, Giardia lamblia
AETGRYAHSGRLSSSD

SEQ ID NO: 3098133 - protein, 8 aa, Giardia lamblia
AETGSGKT

SEQ ID NO: 3098134 - protein, 10 aa, Giardia lamblia
AETGSGKTGA

SEQ ID NO: 3098135 - protein, 9 aa, Giardia lamblia
AETGSGKTH

SEQ ID NO: 3098136 - protein, 6 aa, Giardia lamblia
AETKDS

SEQ ID NO: 3098137 - protein, 35 aa, Giardia lamblia
AETKEATPSSPRASHASFKGSPTRLDKNSKHSPRR

SEQ ID NO: 3098138 - protein, 9 aa, Giardia lamblia
AETKERNAE

SEQ ID NO: 3098139 - protein, 7 aa, Giardia lamblia
AETKNGH

SEQ ID NO: 3098140 - protein, 8 aa, Giardia lamblia
AETNAKIE

SEQ ID NO: 3098141 - protein, 12 aa, Giardia lamblia
AETNDKGSVDAL

SEQ ID NO: 3098142 - protein, 5 aa, Giardia lamblia
AETNM

SEQ ID NO: 3098143 - protein, 7 aa, Giardia lamblia
AETNMKD

SEQ ID NO: 3098144 - protein, 5 aa, Giardia lamblia
AETNQ

SEQ ID NO: 3098145 - protein, 7 aa, Giardia lamblia
AETPEEL

SEQ ID NO: 3098146 - protein, 7 aa, Giardia lamblia
AETPQGE

SEQ ID NO: 3098147 - protein, 11 aa, Giardia lamblia
AETQGADGNRY

SEQ ID NO: 3098148 - protein, 8 aa, Giardia lamblia
AETQRSMG

SEQ ID NO: 3098149 - protein, 4 aa, Giardia lamblia
AETR

SEQ ID NO: 3098150 - protein, 6 aa, Giardia lamblia
AETRPT

SEQ ID NO: 3098151 - protein, 8 aa, Giardia lamblia
AETSPENK

SEQ ID NO: 3098152 - protein, 6 aa, Giardia lamblia
AETSVS

SEQ ID NO: 3098153 - protein, 4 aa, Giardia lamblia
AETT

SEQ ID NO: 3098154 - protein, 11 aa, Giardia lamblia
AETTHSTRRTV

SEQ ID NO: 3098155 - protein, 11 aa, Giardia lamblia
AETTNSRGQRY

SEQ ID NO: 3098156 - protein, 7 aa, Giardia lamblia
AETTPLN

SEQ ID NO: 3098157 - protein, 6 aa, Giardia lamblia
AETVPG

SEQ ID NO: 3098158 - protein, 8 aa, Giardia lamblia
AETVSSAT

SEQ ID NO: 3098159 - protein, 11 aa, Giardia lamblia
AETVSSSHLPG

SEQ ID NO: 3098160 - protein, 6 aa, Giardia lamblia
AEVEAS

SEQ ID NO: 3098161 - protein, 6 aa, Giardia lamblia
AEVGDD

SEQ ID NO: 3098162 - protein, 9 aa, Giardia lamblia
AEVGTTTDN

SEQ ID NO: 3098163 - protein, 8 aa, Giardia lamblia
AEVHPKYS

SEQ ID NO: 3098164 - protein, 13 aa, Giardia lamblia
AEVKAEPDAGSMN

SEQ ID NO: 3098165 - protein, 7 aa, Giardia lamblia
AEVKRAA

SEQ ID NO: 3098166 - protein, 4 aa, Giardia lamblia
AEVL

SEQ ID NO: 3098167 - protein, 22 aa, Giardia lamblia
AEVPPATAVAPQHSSEDSFGNT

SEQ ID NO: 3098168 - protein, 11 aa, Giardia lamblia
AEVPQKTPVPP

SEQ ID NO: 3098169 - protein, 4 aa, Giardia lamblia
AEVQ

SEQ ID NO: 3098170 - protein, 5 aa, Giardia lamblia
AEVQA

SEQ ID NO: 3098171 - protein, 5 aa, Giardia lamblia
AEVSN

SEQ ID NO: 3098172 - protein, 6 aa, Giardia lamblia
AEVSNK

SEQ ID NO: 3098173 - protein, 5 aa, Giardia lamblia
AEYAP

SEQ ID NO: 3098174 - protein, 4 aa, Giardia lamblia
AEYD

SEQ ID NO: 3098175 - protein, 11 aa, Giardia lamblia
AEYDASAGSLI

SEQ ID NO: 3098176 - protein, 11 aa, Giardia lamblia
AEYDRSARERD

SEQ ID NO: 3098177 - protein, 4 aa, Giardia lamblia
AEYE

SEQ ID NO: 3098178 - protein, 15 aa, Giardia lamblia
AEYEEYGISILDRRR

SEQ ID NO: 3098179 - protein, 22 aa, Giardia lamblia
AEYEKGGTLGSTLGSPGSSTNS

SEQ ID NO: 3098180 - protein, 8 aa, Giardia lamblia
AEYNAKRK

SEQ ID NO: 3098181 - protein, 4 aa, Giardia lamblia
AEYS

SEQ ID NO: 3098182 - protein, 12 aa, Giardia lamblia
AEYSGRQNNAGF

SEQ ID NO: 3098183 - protein, 25 aa, Giardia lamblia
AFASSGSQSVKSSASSYMTTPEAQI

SEQ ID NO: 3098184 - protein, 6 aa, Giardia lamblia
AFDTDQ

SEQ ID NO: 3098185 - protein, 20 aa, Giardia lamblia
AFEPKRPKKTKRKENKTAEV

SEQ ID NO: 3098186 - protein, 11 aa, Giardia lamblia
AFERQKRAELA

SEQ ID NO: 3098187 - protein, 15 aa, Giardia lamblia
AFESGPTDRSEGAPV

SEQ ID NO: 3098188 - protein, 6 aa, Giardia lamblia
AFETGT

SEQ ID NO: 3098189 - protein, 13 aa, Giardia lamblia
AFGENADSTDAGP

SEQ ID NO: 3098190 - protein, 6 aa, Giardia lamblia
AFGTQN

SEQ ID NO: 3098191 - protein, 14 aa, Giardia lamblia
AFHGSASKGDADRE

SEQ ID NO: 3098192 - protein, 7 aa, Giardia lamblia
AFPSSSA

SEQ ID NO: 3098193 - protein, 7 aa, Giardia lamblia
AFPTPDL

SEQ ID NO: 3098194 - protein, 13 aa, Giardia lamblia
AFQESGSVGGSSY

SEQ ID NO: 3098195 - protein, 15 aa, Giardia lamblia
AFRGQFSENNANGYG

SEQ ID NO: 3098196 - protein, 22 aa, Giardia lamblia
AFRSASTPSAPNHTSAVSPSSM

SEQ ID NO: 3098197 - protein, 12 aa, Giardia lamblia
AFSDGLTGNAPV

SEQ ID NO: 3098198 - protein, 10 aa, Giardia lamblia
AFSGDPMTDP

SEQ ID NO: 3098199 - protein, 9 aa, Giardia lamblia
AFSKKDEQT

SEQ ID NO: 3098200 - protein, 6 aa, Giardia lamblia
AFSNSS

SEQ ID NO: 3098201 - protein, 4 aa, Giardia lamblia
AFSP

SEQ ID NO: 3098202 - protein, 6 aa, Giardia lamblia
AFSPDG

SEQ ID NO: 3098203 - protein, 5 aa, Giardia lamblia
AFSVT

SEQ ID NO: 3098204 - protein, 7 aa, Giardia lamblia
AFTEEGV

SEQ ID NO: 3098205 - protein, 10 aa, Giardia lamblia
AFTKETGLPA

SEQ ID NO: 3098206 - protein, 4 aa, Giardia lamblia
AFTS

SEQ ID NO: 3098207 - protein, 10 aa, Giardia lamblia
AFTSSADKYM

SEQ ID NO: 3098208 - protein, 8 aa, Giardia lamblia
AGAAHRNC

SEQ ID NO: 3098209 - protein, 5 aa, Giardia lamblia
AGADD

SEQ ID NO: 3098210 - protein, 6 aa, Giardia lamblia
AGADHS

SEQ ID NO: 3098211 - protein, 17 aa, Giardia lamblia
AGADKGGDSAENQGTGG

SEQ ID NO: 3098212 - protein, 9 aa, Giardia lamblia
AGADPEPYV

SEQ ID NO: 3098213 - protein, 13 aa, Giardia lamblia
AGAEPQPKKSVNF

SEQ ID NO: 3098214 - protein, 11 aa, Giardia lamblia
AGAGGTSDTPF

SEQ ID NO: 3098215 - protein, 9 aa, Giardia lamblia
AGAGKCGDA

SEQ ID NO: 3098216 - protein, 5 aa, Giardia lamblia
AGAHK

SEQ ID NO: 3098217 - protein, 5 aa, Giardia lamblia
AGAKE

SEQ ID NO: 3098218 - protein, 7 aa, Giardia lamblia
AGANAGV

SEQ ID NO: 3098219 - protein, 14 aa, Giardia lamblia
AGANQVKAETLSSQ

SEQ ID NO: 3098220 - protein, 10 aa, Giardia lamblia
AGAPADPPRV

SEQ ID NO: 3098221 - protein, 9 aa, Giardia lamblia
AGAPEDIPK

SEQ ID NO: 3098222 - protein, 21 aa, Giardia lamblia
AGAPGVTQQITPDVTPPLPQS

SEQ ID NO: 3098223 - protein, 5 aa, Giardia lamblia
AGAPH

SEQ ID NO: 3098224 - protein, 6 aa, Giardia lamblia
AGAPMP

SEQ ID NO: 3098225 - protein, 8 aa, Giardia lamblia
AGAQDSYG

SEQ ID NO: 3098226 - protein, 11 aa, Giardia lamblia
AGAQNKKGETA

SEQ ID NO: 3098227 - protein, 11 aa, Giardia lamblia
AGAQSKDGSTA

SEQ ID NO: 3098228 - protein, 9 aa, Giardia lamblia
AGAQTSKGH

SEQ ID NO: 3098229 - protein, 7 aa, Giardia lamblia
AGAQVNE

SEQ ID NO: 3098230 - protein, 8 aa, Giardia lamblia
AGARASQL

SEQ ID NO: 3098231 - protein, 11 aa, Giardia lamblia
AGARDSSGETA

SEQ ID NO: 3098232 - protein, 9 aa, Giardia lamblia
AGARGPDAK

SEQ ID NO: 3098233 - protein, 8 aa, Giardia lamblia
AGASDSFG

SEQ ID NO: 3098234 - protein, 9 aa, Giardia lamblia
AGASISAGS

SEQ ID NO: 3098235 - protein, 6 aa, Giardia lamblia
AGASPE

SEQ ID NO: 3098236 - protein, 5 aa, Giardia lamblia
AGASV

SEQ ID NO: 3098237 - protein, 10 aa, Giardia lamblia
AGATDPTGRT

SEQ ID NO: 3098238 - protein, 4 aa, Giardia lamblia
AGCA

SEQ ID NO: 3098239 - protein, 6 aa, Giardia lamblia
AGCPPS

SEQ ID NO: 3098240 - protein, 5 aa, Giardia lamblia
AGCSQ

SEQ ID NO: 3098241 - protein, 28 aa, Giardia lamblia
AGCSSRSCGKPFPHESKVPASNDSDNDY

SEQ ID NO: 3098242 - protein, 12 aa, Giardia lamblia
AGCSSTKPTEEK

SEQ ID NO: 3098243 - protein, 9 aa, Giardia lamblia
AGCTPAECT

SEQ ID NO: 3098244 - protein, 5 aa, Giardia lamblia
AGCTQ

SEQ ID NO: 3098245 - protein, 6 aa, Giardia lamblia
AGDAED

SEQ ID NO: 3098246 - protein, 17 aa, Giardia lamblia
AGDARSPSPSPPPDSQI

SEQ ID NO: 3098247 - protein, 4 aa, Giardia lamblia
AGDD

SEQ ID NO: 3098248 - protein, 7 aa, Giardia lamblia
AGDDQGA

SEQ ID NO: 3098249 - protein, 4 aa, Giardia lamblia
AGDE

SEQ ID NO: 3098250 - protein, 5 aa, Giardia lamblia
AGDED

SEQ ID NO: 3098251 - protein, 8 aa, Giardia lamblia
AGDEGQAA

SEQ ID NO: 3098252 - protein, 15 aa, Giardia lamblia
AGDEGRAALNTGDEN

SEQ ID NO: 3098253 - protein, 11 aa, Giardia lamblia
AGDGDTEDSRL

SEQ ID NO: 3098254 - protein, 6 aa, Giardia lamblia
AGDGEL

SEQ ID NO: 3098255 - protein, 17 aa, Giardia lamblia
AGDGLDDANFREETANN

SEQ ID NO: 3098256 - protein, 6 aa, Giardia lamblia
AGDGVS

SEQ ID NO: 3098257 - protein, 4 aa, Giardia lamblia
AGDI

SEQ ID NO: 3098258 - protein, 31 aa, Giardia lamblia
AGDLETPVSRSVSRSDDRRPQAKDKQGNTPL

SEQ ID NO: 3098259 - protein, 6 aa, Giardia lamblia
AGDLNG

SEQ ID NO: 3098260 - protein, 7 aa, Giardia lamblia
AGDLTDA

SEQ ID NO: 3098261 - protein, 6 aa, Giardia lamblia
AGDNKD

SEQ ID NO: 3098262 - protein, 8 aa, Giardia lamblia
AGDPSLPE

SEQ ID NO: 3098263 - protein, 17 aa, Giardia lamblia
AGDQHGTPKDEEGLSEQ

SEQ ID NO: 3098264 - protein, 12 aa, Giardia lamblia
AGDQQQSGLTDS

SEQ ID NO: 3098265 - protein, 6 aa, Giardia lamblia
AGDQQR

SEQ ID NO: 3098266 - protein, 4 aa, Giardia lamblia
AGDS

SEQ ID NO: 3098267 - protein, 6 aa, Giardia lamblia
AGDSRA

SEQ ID NO: 3098268 - protein, 6 aa, Giardia lamblia
AGDSSC

SEQ ID NO: 3098269 - protein, 7 aa, Giardia lamblia
AGDSSSF

SEQ ID NO: 3098270 - protein, 10 aa, Giardia lamblia
AGDTDDVQSD

SEQ ID NO: 3098271 - protein, 27 aa, Giardia lamblia
AGDTIDDTENRSRSVSESGSESDGMDY

SEQ ID NO: 3098272 - protein, 17 aa, Giardia lamblia
AGDTTDERTDETDTDSA

SEQ ID NO: 3098273 - protein, 11 aa, Giardia lamblia
AGDVYTGAGGL

SEQ ID NO: 3098274 - protein, 6 aa, Giardia lamblia
AGDYQN

SEQ ID NO: 3098275 - protein, 21 aa, Giardia lamblia
AGEAAKVSKSRPKTKDQEAEL

SEQ ID NO: 3098276 - protein, 7 aa, Giardia lamblia
AGEAGMV

SEQ ID NO: 3098277 - protein, 9 aa, Giardia lamblia
AGEDDAPSD

SEQ ID NO: 3098278 - protein, 6 aa, Giardia lamblia
AGEDGV

SEQ ID NO: 3098279 - protein, 5 aa, Giardia lamblia
AGEDQ

SEQ ID NO: 3098280 - protein, 14 aa, Giardia lamblia
AGEDQRDTGRPTSA

SEQ ID NO: 3098281 - protein, 11 aa, Giardia lamblia
AGEDTKDVTRT

SEQ ID NO: 3098282 - protein, 6 aa, Giardia lamblia
AGEDTL

SEQ ID NO: 3098283 - protein, 10 aa, Giardia lamblia
AGEERSSFEE

SEQ ID NO: 3098284 - protein, 13 aa, Giardia lamblia
AGEESSALTDESV

SEQ ID NO: 3098285 - protein, 6 aa, Giardia lamblia
AGEFDK

SEQ ID NO: 3098286 - protein, 10 aa, Giardia lamblia
AGEKEKEDFA

SEQ ID NO: 3098287 - protein, 5 aa, Giardia lamblia
AGELA

SEQ ID NO: 3098288 - protein, 7 aa, Giardia lamblia
AGELDQL

SEQ ID NO: 3098289 - protein, 5 aa, Giardia lamblia
AGELE

SEQ ID NO: 3098290 - protein, 10 aa, Giardia lamblia
AGELTAAEED

SEQ ID NO: 3098291 - protein, 15 aa, Giardia lamblia
AGENAESAMEAHNTN

SEQ ID NO: 3098292 - protein, 4 aa, Giardia lamblia
AGEP

SEQ ID NO: 3098293 - protein, 7 aa, Giardia lamblia
AGEPENN

SEQ ID NO: 3098294 - protein, 7 aa, Giardia lamblia
AGEPSMY

SEQ ID NO: 3098295 - protein, 7 aa, Giardia lamblia
AGEQANV

SEQ ID NO: 3098296 - protein, 10 aa, Giardia lamblia
AGERDNQGRT

SEQ ID NO: 3098297 - protein, 7 aa, Giardia lamblia
AGERNGA

SEQ ID NO: 3098298 - protein, 16 aa, Giardia lamblia
AGERPASVASHQEQNP

SEQ ID NO: 3098299 - protein, 5 aa, Giardia lamblia
AGERV

SEQ ID NO: 3098300 - protein, 8 aa, Giardia lamblia
AGESDTLS

SEQ ID NO: 3098301 - protein, 8 aa, Giardia lamblia
AGESEKNL

SEQ ID NO: 3098302 - protein, 20 aa, Giardia lamblia
AGESRTKGDSNSKQRKEKHH

SEQ ID NO: 3098303 - protein, 14 aa, Giardia lamblia
AGESSEDADADVTN

SEQ ID NO: 3098304 - protein, 5 aa, Giardia lamblia
AGEST

SEQ ID NO: 3098305 - protein, 6 aa, Giardia lamblia
AGESVV

SEQ ID NO: 3098306 - protein, 23 aa, Giardia lamblia
AGETGPQVKSIEQRTKKLSDPKQ

SEQ ID NO: 3098307 - protein, 15 aa, Giardia lamblia
AGETSGSESGKSSLT

SEQ ID NO: 3098308 - protein, 9 aa, Giardia lamblia
AGEVNLDGE

SEQ ID NO: 3098309 - protein, 6 aa, Giardia lamblia
AGFKDA

SEQ ID NO: 3098310 - protein, 14 aa, Giardia lamblia
AGFQTTDRAAATGA

SEQ ID NO: 3098311 - protein, 8 aa, Giardia lamblia
AGFSADSG

SEQ ID NO: 3098312 - protein, 6 aa, Giardia lamblia
AGFSAP

SEQ ID NO: 3098313 - protein, 26 aa, Giardia lamblia
AGFSGSGSQSGSRSNSHPSRSDSNSL

SEQ ID NO: 3098314 - protein, 4 aa, Giardia lamblia
AGGD

SEQ ID NO: 3098315 - protein, 6 aa, Giardia lamblia
AGGDNG

SEQ ID NO: 3098316 - protein, 9 aa, Giardia lamblia
AGGDRGLSS

SEQ ID NO: 3098317 - protein, 6 aa, Giardia lamblia
AGGDVS

SEQ ID NO: 3098318 - protein, 4 aa, Giardia lamblia
AGGE

SEQ ID NO: 3098319 - protein, 6 aa, Giardia lamblia
AGGEGP

SEQ ID NO: 3098320 - protein, 7 aa, Giardia lamblia
AGGERPF

SEQ ID NO: 3098321 - protein, 5 aa, Giardia lamblia
AGGFT

SEQ ID NO: 3098322 - protein, 10 aa, Giardia lamblia
AGGGTSSDTL

SEQ ID NO: 3098323 - protein, 4 aa, Giardia lamblia
AGGH

SEQ ID NO: 3098324 - protein, 5 aa, Giardia lamblia
AGGIG

SEQ ID NO: 3098325 - protein, 8 aa, Giardia lamblia
AGGKNGSE

SEQ ID NO: 3098326 - protein, 5 aa, Giardia lamblia
AGGLE

SEQ ID NO: 3098327 - protein, 5 aa, Giardia lamblia
AGGLK

SEQ ID NO: 3098328 - protein, 6 aa, Giardia lamblia
AGGNGT

SEQ ID NO: 3098329 - protein, 7 aa, Giardia lamblia
AGGPGIV

SEQ ID NO: 3098330 - protein, 6 aa, Giardia lamblia
AGGPSF

SEQ ID NO: 3098331 - protein, 4 aa, Giardia lamblia
AGGR

SEQ ID NO: 3098332 - protein, 10 aa, Giardia lamblia
AGGRVSPGET

SEQ ID NO: 3098333 - protein, 12 aa, Giardia lamblia
AGGSKGTSDAAN

SEQ ID NO: 3098334 - protein, 10 aa, Giardia lamblia
AGGTPSYEAN

SEQ ID NO: 3098335 - protein, 4 aa, Giardia lamblia
AGGV

SEQ ID NO: 3098336 - protein, 6 aa, Giardia lamblia
AGGVEE

SEQ ID NO: 3098337 - protein, 9 aa, Giardia lamblia
AGGVPVSKA

SEQ ID NO: 3098338 - protein, 8 aa, Giardia lamblia
AGHGSTST

SEQ ID NO: 3098339 - protein, 4 aa, Giardia lamblia
AGHK

SEQ ID NO: 3098340 - protein, 5 aa, Giardia lamblia
AGHKA

SEQ ID NO: 3098341 - protein, 5 aa, Giardia lamblia
AGHPE

SEQ ID NO: 3098342 - protein, 38 aa, Giardia lamblia
AGHPEEQNTVGGTSLYSGEPRLNEPPCSRPSSEDPRQL

SEQ ID NO: 3098343 - protein, 38 aa, Giardia lamblia
AGHPEEQNTVSGTSLYSGEPRLNEPPCSRPSSEDPRQL

SEQ ID NO: 3098344 - protein, 12 aa, Giardia lamblia
AGHRRQSDGATA

SEQ ID NO: 3098345 - protein, 4 aa, Giardia lamblia
AGHS

SEQ ID NO: 3098346 - protein, 9 aa, Giardia lamblia
AGHSDGDSI

SEQ ID NO: 3098347 - protein, 20 aa, Giardia lamblia
AGHSSTVGSFGSTSKIPSIT

SEQ ID NO: 3098348 - protein, 13 aa, Giardia lamblia
AGIEPTGNNEHSD

SEQ ID NO: 3098349 - protein, 8 aa, Giardia lamblia
AGIETEKG

SEQ ID NO: 3098350 - protein, 9 aa, Giardia lamblia
AGIKDSSGQ

SEQ ID NO: 3098351 - protein, 10 aa, Giardia lamblia
AGIKTKDGRT

SEQ ID NO: 3098352 - protein, 7 aa, Giardia lamblia
AGIPARN

SEQ ID NO: 3098353 - protein, 9 aa, Giardia lamblia
AGIPPKGEL

SEQ ID NO: 3098354 - protein, 23 aa, Giardia lamblia
AGIPQPVQSNKTRESTLRASETT

SEQ ID NO: 3098355 - protein, 10 aa, Giardia lamblia
AGIQDKYGGT

SEQ ID NO: 3098356 - protein, 8 aa, Giardia lamblia
AGIQDRSK

SEQ ID NO: 3098357 - protein, 6 aa, Giardia lamblia
AGIQET

SEQ ID NO: 3098358 - protein, 8 aa, Giardia lamblia
AGIQNQHG

SEQ ID NO: 3098359 - protein, 8 aa, Giardia lamblia
AGIQTRSG

SEQ ID NO: 3098360 - protein, 11 aa, Giardia lamblia
AGIRDEKGDTA

SEQ ID NO: 3098361 - protein, 10 aa, Giardia lamblia
AGIRDHSGST

SEQ ID NO: 3098362 - protein, 6 aa, Giardia lamblia
AGISTK

SEQ ID NO: 3098363 - protein, 8 aa, Giardia lamblia
AGISTNWG

SEQ ID NO: 3098364 - protein, 11 aa, Giardia lamblia
AGITPQSKLGH

SEQ ID NO: 3098365 - protein, 17 aa, Giardia lamblia
AGKASAESSEQRKERGG

SEQ ID NO: 3098366 - protein, 20 aa, Giardia lamblia
AGKDNSEKKSKLDPRFPTSE

SEQ ID NO: 3098367 - protein, 7 aa, Giardia lamblia
AGKEVDN

SEQ ID NO: 3098368 - protein, 5 aa, Giardia lamblia
AGKGG

SEQ ID NO: 3098369 - protein, 6 aa, Giardia lamblia
AGKGHT

SEQ ID NO: 3098370 - protein, 8 aa, Giardia lamblia
AGKGRAGT

SEQ ID NO: 3098371 - protein, 5 aa, Giardia lamblia
AGKHQ

SEQ ID NO: 3098372 - protein, 9 aa, Giardia lamblia
AGKHTGTKP

SEQ ID NO: 3098373 - protein, 12 aa, Giardia lamblia
AGKIANSRNQVA

SEQ ID NO: 3098374 - protein, 6 aa, Giardia lamblia
AGKIGN

SEQ ID NO: 3098375 - protein, 9 aa, Giardia lamblia
AGKKQEEKH

SEQ ID NO: 3098376 - protein, 7 aa, Giardia lamblia
AGKLPGD

SEQ ID NO: 3098377 - protein, 11 aa, Giardia lamblia
AGKNDDSGETA

SEQ ID NO: 3098378 - protein, 8 aa, Giardia lamblia
AGKPQSMK

SEQ ID NO: 3098379 - protein, 17 aa, Giardia lamblia
AGKQARDDNLQLSGLQH

SEQ ID NO: 3098380 - protein, 8 aa, Giardia lamblia
AGKQDSHG

SEQ ID NO: 3098381 - protein, 9 aa, Giardia lamblia
AGKQDVHGQ

SEQ ID NO: 3098382 - protein, 8 aa, Giardia lamblia
AGKQGGRP

SEQ ID NO: 3098383 - protein, 10 aa, Giardia lamblia
AGKQKELNSV

SEQ ID NO: 3098384 - protein, 6 aa, Giardia lamblia
AGKQTH

SEQ ID NO: 3098385 - protein, 9 aa, Giardia lamblia
AGKQTKTGW

SEQ ID NO: 3098386 - protein, 11 aa, Giardia lamblia
AGKRDKSGKSA

SEQ ID NO: 3098387 - protein, 34 aa, Giardia lamblia
AGKRGMTRKEQEQQQKREEASKAASQRERQTGPL

SEQ ID NO: 3098388 - protein, 9 aa, Giardia lamblia
AGKRNTFGE

SEQ ID NO: 3098389 - protein, 6 aa, Giardia lamblia
AGKRTG

SEQ ID NO: 3098390 - protein, 8 aa, Giardia lamblia
AGKSIESA

SEQ ID NO: 3098391 - protein, 5 aa, Giardia lamblia
AGKST

SEQ ID NO: 3098392 - protein, 7 aa, Giardia lamblia
AGKSTIS

SEQ ID NO: 3098393 - protein, 9 aa, Giardia lamblia
AGKTDRDGY

SEQ ID NO: 3098394 - protein, 8 aa, Giardia lamblia
AGKTGASQ

SEQ ID NO: 3098395 - protein, 6 aa, Giardia lamblia
AGKTRH

SEQ ID NO: 3098396 - protein, 11 aa, Giardia lamblia
AGKTRSDGKRA

SEQ ID NO: 3098397 - protein, 8 aa, Giardia lamblia
AGKTTLAE

SEQ ID NO: 3098398 - protein, 5 aa, Giardia lamblia
AGKVA

SEQ ID NO: 3098399 - protein, 8 aa, Giardia lamblia
AGKYCEGT

SEQ ID NO: 3098400 - protein, 8 aa, Giardia lamblia
AGLADTIG

SEQ ID NO: 3098401 - protein, 7 aa, Giardia lamblia
AGLAERG

SEQ ID NO: 3098402 - protein, 9 aa, Giardia lamblia
AGLAGGDIS

SEQ ID NO: 3098403 - protein, 9 aa, Giardia lamblia
AGLASIDRD

SEQ ID NO: 3098404 - protein, 37 aa, Giardia lamblia
AGLDGDKDKLDAKNEQGRTQLSGATGITVTGQGAGAF

SEQ ID NO: 3098405 - protein, 16 aa, Giardia lamblia
AGLDSKATGTEEEGEF

SEQ ID NO: 3098406 - protein, 9 aa, Giardia lamblia
AGLEPGSLT

SEQ ID NO: 3098407 - protein, 24 aa, Giardia lamblia
AGLETTPAVAAEESSAKSDDAPVA

SEQ ID NO: 3098408 - protein, 11 aa, Giardia lamblia
AGLGGEKDEVD

SEQ ID NO: 3098409 - protein, 6 aa, Giardia lamblia
AGLGRE

SEQ ID NO: 3098410 - protein, 13 aa, Giardia lamblia
AGLKNDKGCTART

SEQ ID NO: 3098411 - protein, 9 aa, Giardia lamblia
AGLKTCNGE

SEQ ID NO: 3098412 - protein, 6 aa, Giardia lamblia
AGLPAD

SEQ ID NO: 3098413 - protein, 30 aa, Giardia lamblia
AGLPPSWDKEQSKNHSGEMDGSRVQGTPTP

SEQ ID NO: 3098414 - protein, 11 aa, Giardia lamblia
AGLQANSGTTA

SEQ ID NO: 3098415 - protein, 9 aa, Giardia lamblia
AGLQDKVGK

SEQ ID NO: 3098416 - protein, 10 aa, Giardia lamblia
AGLQDTEGKT

SEQ ID NO: 3098417 - protein, 8 aa, Giardia lamblia
AGLQKANG

SEQ ID NO: 3098418 - protein, 8 aa, Giardia lamblia
AGLQTQTG

SEQ ID NO: 3098419 - protein, 8 aa, Giardia lamblia
AGLQTRNG

SEQ ID NO: 3098420 - protein, 11 aa, Giardia lamblia
AGLRKQDGRTA

SEQ ID NO: 3098421 - protein, 6 aa, Giardia lamblia
AGLRRP

SEQ ID NO: 3098422 - protein, 20 aa, Giardia lamblia
AGLSGHGGTVPNSAGYTGYS

SEQ ID NO: 3098423 - protein, 6 aa, Giardia lamblia
AGLSPI

SEQ ID NO: 3098424 - protein, 10 aa, Giardia lamblia
AGLSPSTADN

SEQ ID NO: 3098425 - protein, 25 aa, Giardia lamblia
AGLSTSSESSRSPSLSTSRRPRPKL

SEQ ID NO: 3098426 - protein, 10 aa, Giardia lamblia
AGLTDKDGTT

SEQ ID NO: 3098427 - protein, 8 aa, Giardia lamblia
AGLTNADG

SEQ ID NO: 3098428 - protein, 12 aa, Giardia lamblia
AGLTNSKGDSAL

SEQ ID NO: 3098429 - protein, 11 aa, Giardia lamblia
AGLTRKDGETA

SEQ ID NO: 3098430 - protein, 11 aa, Giardia lamblia
AGLTSSDGRTA

SEQ ID NO: 3098431 - protein, 17 aa, Giardia lamblia
AGLTTGGFSRGATTLSS

SEQ ID NO: 3098432 - protein, 14 aa, Giardia lamblia
AGMKDAMGRRASDY

SEQ ID NO: 3098433 - protein, 9 aa, Giardia lamblia
AGMKDQDGV

SEQ ID NO: 3098434 - protein, 9 aa, Giardia lamblia
AGMKDSDGW

SEQ ID NO: 3098435 - protein, 11 aa, Giardia lamblia
AGMNDNQGGSA

SEQ ID NO: 3098436 - protein, 7 aa, Giardia lamblia
AGMPTNT

SEQ ID NO: 3098437 - protein, 8 aa, Giardia lamblia
AGMQDNSG

SEQ ID NO: 3098438 - protein, 10 aa, Giardia lamblia
AGMQGKDGAT

SEQ ID NO: 3098439 - protein, 5 aa, Giardia lamblia
AGMQR

SEQ ID NO: 3098440 - protein, 7 aa, Giardia lamblia
AGMQRND

SEQ ID NO: 3098441 - protein, 11 aa, Giardia lamblia
AGMQSNDGKTA

SEQ ID NO: 3098442 - protein, 9 aa, Giardia lamblia
AGMQTPSGL

SEQ ID NO: 3098443 - protein, 10 aa, Giardia lamblia
AGMRDKNGKT

SEQ ID NO: 3098444 - protein, 9 aa, Giardia lamblia
AGMRDSQGN

SEQ ID NO: 3098445 - protein, 10 aa, Giardia lamblia
AGMRNRDGRT

SEQ ID NO: 3098446 - protein, 8 aa, Giardia lamblia
AGMRNTEG

SEQ ID NO: 3098447 - protein, 11 aa, Giardia lamblia
AGMRQNDGTTA

SEQ ID NO: 3098448 - protein, 8 aa, Giardia lamblia
AGMRRSDG

SEQ ID NO: 3098449 - protein, 6 aa, Giardia lamblia
AGMSDV

SEQ ID NO: 3098450 - protein, 10 aa, Giardia lamblia
AGMSDVDKST

SEQ ID NO: 3098451 - protein, 6 aa, Giardia lamblia
AGMSQV

SEQ ID NO: 3098452 - protein, 12 aa, Giardia lamblia
AGMSVNASTSAL

SEQ ID NO: 3098453 - protein, 11 aa, Giardia lamblia
AGMTKPPGYLS

SEQ ID NO: 3098454 - protein, 8 aa, Giardia lamblia
AGMTQSSG

SEQ ID NO: 3098455 - protein, 6 aa, Giardia lamblia
AGNAKA

SEQ ID NO: 3098456 - protein, 7 aa, Giardia lamblia
AGNASGS

SEQ ID NO: 3098457 - protein, 14 aa, Giardia lamblia
AGNATTAASPGSIG

SEQ ID NO: 3098458 - protein, 8 aa, Giardia lamblia
AGNDDGAD

SEQ ID NO: 3098459 - protein, 5 aa, Giardia lamblia
AGNEQ

SEQ ID NO: 3098460 - protein, 5 aa, Giardia lamblia
AGNFN

SEQ ID NO: 3098461 - protein, 5 aa, Giardia lamblia
AGNGD

SEQ ID NO: 3098462 - protein, 6 aa, Giardia lamblia
AGNGHR

SEQ ID NO: 3098463 - protein, 9 aa, Giardia lamblia
AGNGPTDDK

SEQ ID NO: 3098464 - protein, 13 aa, Giardia lamblia
AGNHAQGVSKTSD

SEQ ID NO: 3098465 - protein, 4 aa, Giardia lamblia
AGNI

SEQ ID NO: 3098466 - protein, 9 aa, Giardia lamblia
AGNKNSAIN

SEQ ID NO: 3098467 - protein, 8 aa, Giardia lamblia
AGNLEEDA

SEQ ID NO: 3098468 - protein, 16 aa, Giardia lamblia
AGNPPAAAKRSGTTSY

SEQ ID NO: 3098469 - protein, 9 aa, Giardia lamblia
AGNQGSRQW

SEQ ID NO: 3098470 - protein, 7 aa, Giardia lamblia
AGNQSSN

SEQ ID NO: 3098471 - protein, 7 aa, Giardia lamblia
AGNRDDM

SEQ ID NO: 3098472 - protein, 5 aa, Giardia lamblia
AGNSA

SEQ ID NO: 3098473 - protein, 7 aa, Giardia lamblia
AGNSAAM

SEQ ID NO: 3098474 - protein, 15 aa, Giardia lamblia
AGNSAGKSRDYSYNS

SEQ ID NO: 3098475 - protein, 27 aa, Giardia lamblia
AGNSLKDQYGSATQAKTAPRPGGPTAI

SEQ ID NO: 3098476 - protein, 9 aa, Giardia lamblia
AGNSVDQSA

SEQ ID NO: 3098477 - protein, 10 aa, Giardia lamblia
AGNTAPRATS

SEQ ID NO: 3098478 - protein, 25 aa, Giardia lamblia
AGNTCGNSTEGANTKDADGRQRGLK

SEQ ID NO: 3098479 - protein, 6 aa, Giardia lamblia
AGNTEI

SEQ ID NO: 3098480 - protein, 4 aa, Giardia lamblia
AGNV

SEQ ID NO: 3098481 - protein, 7 aa, Giardia lamblia
AGNVPQE

SEQ ID NO: 3098482 - protein, 5 aa, Giardia lamblia
AGNVS

SEQ ID NO: 3098483 - protein, 6 aa, Giardia lamblia
AGPDNG

SEQ ID NO: 3098484 - protein, 4 aa, Giardia lamblia
AGPE

SEQ ID NO: 3098485 - protein, 6 aa, Giardia lamblia
AGPEDK

SEQ ID NO: 3098486 - protein, 12 aa, Giardia lamblia
AGPEGAEETPGV

SEQ ID NO: 3098487 - protein, 5 aa, Giardia lamblia
AGPFR

SEQ ID NO: 3098488 - protein, 21 aa, Giardia lamblia
AGPGAATEKTQGIIEEVSDIQ

SEQ ID NO: 3098489 - protein, 5 aa, Giardia lamblia
AGPHG

SEQ ID NO: 3098490 - protein, 6 aa, Giardia lamblia
AGPITA

SEQ ID NO: 3098491 - protein, 10 aa, Giardia lamblia
AGPKAWSPRA

SEQ ID NO: 3098492 - protein, 62 aa, Giardia lamblia
AGPKAWSPRATASCHPTSDNRMSPSPGPDDNDREGAQDWTRSRVESQPGENAPLAAADLYGQ

SEQ ID NO: 3098493 - protein, 4 aa, Giardia lamblia
AGPN

SEQ ID NO: 3098494 - protein, 9 aa, Giardia lamblia
AGPNAFSYR

SEQ ID NO: 3098495 - protein, 46 aa, Giardia lamblia
AGPNRTDGTSKPTSKQQTAAAAVAAPPAVQRRATVSGKASSSTTKV

SEQ ID NO: 3098496 - protein, 8 aa, Giardia lamblia
AGPPEYKE

SEQ ID NO: 3098497 - protein, 8 aa, Giardia lamblia
AGPPITPV

SEQ ID NO: 3098498 - protein, 7 aa, Giardia lamblia
AGPQQES

SEQ ID NO: 3098499 - protein, 7 aa, Giardia lamblia
AGPSSHR

SEQ ID NO: 3098500 - protein, 7 aa, Giardia lamblia
AGPTTKA

SEQ ID NO: 3098501 - protein, 19 aa, Giardia lamblia
AGPVAGGGAVTTRNHKTEK

SEQ ID NO: 3098502 - protein, 9 aa, Giardia lamblia
AGPVGSGHG

SEQ ID NO: 3098503 - protein, 5 aa, Giardia lamblia
AGPYP

SEQ ID NO: 3098504 - protein, 17 aa, Giardia lamblia
AGQAAQRSSQREDSASI

SEQ ID NO: 3098505 - protein, 11 aa, Giardia lamblia
AGQASNNYRAI

SEQ ID NO: 3098506 - protein, 5 aa, Giardia lamblia
AGQDK

SEQ ID NO: 3098507 - protein, 11 aa, Giardia lamblia
AGQDTTDSHDL

SEQ ID NO: 3098508 - protein, 7 aa, Giardia lamblia
AGQEDYD

SEQ ID NO: 3098509 - protein, 6 aa, Giardia lamblia
AGQEKF

SEQ ID NO: 3098510 - protein, 6 aa, Giardia lamblia
AGQEQF

SEQ ID NO: 3098511 - protein, 8 aa, Giardia lamblia
AGQERYRS

SEQ ID NO: 3098512 - protein, 6 aa, Giardia lamblia
AGQEST

SEQ ID NO: 3098513 - protein, 18 aa, Giardia lamblia
AGQGPEQNTQLSSTTVPL

SEQ ID NO: 3098514 - protein, 8 aa, Giardia lamblia
AGQGPRAS

SEQ ID NO: 3098515 - protein, 17 aa, Giardia lamblia
AGQIDAEDPASLLTTAD

SEQ ID NO: 3098516 - protein, 6 aa, Giardia lamblia
AGQIDK

SEQ ID NO: 3098517 - protein, 4 aa, Giardia lamblia
AGQK

SEQ ID NO: 3098518 - protein, 10 aa, Giardia lamblia
AGQKSTQVTL

SEQ ID NO: 3098519 - protein, 4 aa, Giardia lamblia
AGQL

SEQ ID NO: 3098520 - protein, 5 aa, Giardia lamblia
AGQNG

SEQ ID NO: 3098521 - protein, 6 aa, Giardia lamblia
AGQNNL

SEQ ID NO: 3098522 - protein, 11 aa, Giardia lamblia
AGQPAAPIQSA

SEQ ID NO: 3098523 - protein, 5 aa, Giardia lamblia
AGQPE

SEQ ID NO: 3098524 - protein, 8 aa, Giardia lamblia
AGQPEDRR

SEQ ID NO: 3098525 - protein, 6 aa, Giardia lamblia
AGQQFS

SEQ ID NO: 3098526 - protein, 10 aa, Giardia lamblia
AGQQTPRGTT

SEQ ID NO: 3098527 - protein, 5 aa, Giardia lamblia
AGQRA

SEQ ID NO: 3098528 - protein, 9 aa, Giardia lamblia
AGQRDANGH

SEQ ID NO: 3098529 - protein, 14 aa, Giardia lamblia
AGQRKVYGATSSMP

SEQ ID NO: 3098530 - protein, 8 aa, Giardia lamblia
AGQSASQT

SEQ ID NO: 3098531 - protein, 58 aa, Giardia lamblia
AGQSGGDKDKESRDHGIQKPTSSGVNRSGVRRETSASNIPGRSGIGGTGGSIPSATDT

SEQ ID NO: 3098532 - protein, 6 aa, Giardia lamblia
AGQSLY

SEQ ID NO: 3098533 - protein, 11 aa, Giardia lamblia
AGQSRGMGHSK

SEQ ID NO: 3098534 - protein, 6 aa, Giardia lamblia
AGQTIG

SEQ ID NO: 3098535 - protein, 9 aa, Giardia lamblia
AGQTNENGL

SEQ ID NO: 3098536 - protein, 5 aa, Giardia lamblia
AGRAA

SEQ ID NO: 3098537 - protein, 7 aa, Giardia lamblia
AGRASES

SEQ ID NO: 3098538 - protein, 5 aa, Giardia lamblia
AGRGI

SEQ ID NO: 3098539 - protein, 6 aa, Giardia lamblia
AGRGLP

SEQ ID NO: 3098540 - protein, 9 aa, Giardia lamblia
AGRHTSQAK

SEQ ID NO: 3098541 - protein, 5 aa, Giardia lamblia
AGRKA

SEQ ID NO: 3098542 - protein, 5 aa, Giardia lamblia
AGRKS

SEQ ID NO: 3098543 - protein, 10 aa, Giardia lamblia
AGRKSGDGST

SEQ ID NO: 3098544 - protein, 8 aa, Giardia lamblia
AGRMGQRG

SEQ ID NO: 3098545 - protein, 10 aa, Giardia lamblia
AGRNRQAARS

SEQ ID NO: 3098546 - protein, 5 aa, Giardia lamblia
AGRPL

SEQ ID NO: 3098547 - protein, 13 aa, Giardia lamblia
AGRPQYTASGEVG

SEQ ID NO: 3098548 - protein, 10 aa, Giardia lamblia
AGRRDHNGQT

SEQ ID NO: 3098549 - protein, 6 aa, Giardia lamblia
AGRRLD

SEQ ID NO: 3098550 - protein, 10 aa, Giardia lamblia
AGRRNDSGET

SEQ ID NO: 3098551 - protein, 9 aa, Giardia lamblia
AGRRRSSTV

SEQ ID NO: 3098552 - protein, 23 aa, Giardia lamblia
AGRRVSGGYAQGGGGGSFASASN

SEQ ID NO: 3098553 - protein, 4 aa, Giardia lamblia
AGRS

SEQ ID NO: 3098554 - protein, 9 aa, Giardia lamblia
AGRSAAPRH

SEQ ID NO: 3098555 - protein, 17 aa, Giardia lamblia
AGRSLKTDNAVDDAVPD

SEQ ID NO: 3098556 - protein, 19 aa, Giardia lamblia
AGRSSSQQKTCKTSSTRSV

SEQ ID NO: 3098557 - protein, 12 aa, Giardia lamblia
AGRTARAGRRGT

SEQ ID NO: 3098558 - protein, 34 aa, Giardia lamblia
AGRTNQARPNTNPGPGAYNAEQYKTTGSDAPAMS

SEQ ID NO: 3098559 - protein, 5 aa, Giardia lamblia
AGRYE

SEQ ID NO: 3098560 - protein, 8 aa, Giardia lamblia
AGRYRESG

SEQ ID NO: 3098561 - protein, 4 aa, Giardia lamblia
AGSA

SEQ ID NO: 3098562 - protein, 8 aa, Giardia lamblia
AGSADSAK

SEQ ID NO: 3098563 - protein, 11 aa, Giardia lamblia
AGSAHEKGSTT

SEQ ID NO: 3098564 - protein, 22 aa, Giardia lamblia
AGSAPLNKRKKQPRKSSRAALR

SEQ ID NO: 3098565 - protein, 8 aa, Giardia lamblia
AGSAQGRG

SEQ ID NO: 3098566 - protein, 9 aa, Giardia lamblia
AGSASEEAV

SEQ ID NO: 3098567 - protein, 7 aa, Giardia lamblia
AGSCNAK

SEQ ID NO: 3098568 - protein, 5 aa, Giardia lamblia
AGSDG

SEQ ID NO: 3098569 - protein, 11 aa, Giardia lamblia
AGSDKSINLNP

SEQ ID NO: 3098570 - protein, 13 aa, Giardia lamblia
AGSDLRAKGPSGM

SEQ ID NO: 3098571 - protein, 23 aa, Giardia lamblia
AGSDSGASDSSESPQSRSLPDSE

SEQ ID NO: 3098572 - protein, 42 aa, Giardia lamblia
AGSEEEKFGETSLPSTEPSNARPKSRPSQSSSMSVSSPPPIP

SEQ ID NO: 3098573 - protein, 14 aa, Giardia lamblia
AGSENVTKSHSNGL

SEQ ID NO: 3098574 - protein, 8 aa, Giardia lamblia
AGSGDNAV

SEQ ID NO: 3098575 - protein, 12 aa, Giardia lamblia
AGSGEASLLSKS

SEQ ID NO: 3098576 - protein, 7 aa, Giardia lamblia
AGSGKST

SEQ ID NO: 3098577 - protein, 7 aa, Giardia lamblia
AGSGQPV

SEQ ID NO: 3098578 - protein, 6 aa, Giardia lamblia
AGSGRI

SEQ ID NO: 3098579 - protein, 11 aa, Giardia lamblia
AGSGSDSNRLN

SEQ ID NO: 3098580 - protein, 6 aa, Giardia lamblia
AGSGST

SEQ ID NO: 3098581 - protein, 8 aa, Giardia lamblia
AGSHGMTG

SEQ ID NO: 3098582 - protein, 4 aa, Giardia lamblia
AGSI

SEQ ID NO: 3098583 - protein, 6 aa, Giardia lamblia
AGSIAS

SEQ ID NO: 3098584 - protein, 7 aa, Giardia lamblia
AGSISEQ

SEQ ID NO: 3098585 - protein, 9 aa, Giardia lamblia
AGSISSAAG

SEQ ID NO: 3098586 - protein, 10 aa, Giardia lamblia
AGSKTQSGRT

SEQ ID NO: 3098587 - protein, 4 aa, Giardia lamblia
AGSL

SEQ ID NO: 3098588 - protein, 5 aa, Giardia lamblia
AGSLE

SEQ ID NO: 3098589 - protein, 20 aa, Giardia lamblia
AGSLGRSDLNNEPEGKPVSG

SEQ ID NO: 3098590 - protein, 9 aa, Giardia lamblia
AGSLTNNPH

SEQ ID NO: 3098591 - protein, 17 aa, Giardia lamblia
AGSNSPRKEPRAQRSPL

SEQ ID NO: 3098592 - protein, 5 aa, Giardia lamblia
AGSPC

SEQ ID NO: 3098593 - protein, 6 aa, Giardia lamblia
AGSQTI

SEQ ID NO: 3098594 - protein, 7 aa, Giardia lamblia
AGSSAGL

SEQ ID NO: 3098595 - protein, 5 aa, Giardia lamblia
AGSSG

SEQ ID NO: 3098596 - protein, 8 aa, Giardia lamblia
AGSSGAEA

SEQ ID NO: 3098597 - protein, 8 aa, Giardia lamblia
AGSSPQTS

SEQ ID NO: 3098598 - protein, 12 aa, Giardia lamblia
AGSSQRSGVSYS

SEQ ID NO: 3098599 - protein, 12 aa, Giardia lamblia
AGSSSCAASINN

SEQ ID NO: 3098600 - protein, 8 aa, Giardia lamblia
AGSSSPMR

SEQ ID NO: 3098601 - protein, 7 aa, Giardia lamblia
AGSSTKR

SEQ ID NO: 3098602 - protein, 10 aa, Giardia lamblia
AGSTENEEGM

SEQ ID NO: 3098603 - protein, 6 aa, Giardia lamblia
AGSTES

SEQ ID NO: 3098604 - protein, 11 aa, Giardia lamblia
AGSTNGAGDTG

SEQ ID NO: 3098605 - protein, 7 aa, Giardia lamblia
AGSTRAY

SEQ ID NO: 3098606 - protein, 10 aa, Giardia lamblia
AGSTSYGPGS

SEQ ID NO: 3098607 - protein, 4 aa, Giardia lamblia
AGSV

SEQ ID NO: 3098608 - protein, 15 aa, Giardia lamblia
AGSVTGGAFLPDVET

SEQ ID NO: 3098609 - protein, 10 aa, Giardia lamblia
AGTAADTAAV

SEQ ID NO: 3098610 - protein, 6 aa, Giardia lamblia
AGTASD

SEQ ID NO: 3098611 - protein, 7 aa, Giardia lamblia
AGTASNF

SEQ ID NO: 3098612 - protein, 6 aa, Giardia lamblia
AGTAWE

SEQ ID NO: 3098613 - protein, 4 aa, Giardia lamblia
AGTD

SEQ ID NO: 3098614 - protein, 14 aa, Giardia lamblia
AGTDTDIDPRGEYN

SEQ ID NO: 3098615 - protein, 12 aa, Giardia lamblia
AGTEKVQKGAHG

SEQ ID NO: 3098616 - protein, 6 aa, Giardia lamblia
AGTGAS

SEQ ID NO: 3098617 - protein, 7 aa, Giardia lamblia
AGTGYGV

SEQ ID NO: 3098618 - protein, 9 aa, Giardia lamblia
AGTKNSRWM

SEQ ID NO: 3098619 - protein, 6 aa, Giardia lamblia
AGTPGN

SEQ ID NO: 3098620 - protein, 8 aa, Giardia lamblia
AGTPSLYS

SEQ ID NO: 3098621 - protein, 8 aa, Giardia lamblia
AGTSALGG

SEQ ID NO: 3098622 - protein, 9 aa, Giardia lamblia
AGTSEGGAA

SEQ ID NO: 3098623 - protein, 14 aa, Giardia lamblia
AGTSGLSGSVTGYP

SEQ ID NO: 3098624 - protein, 9 aa, Giardia lamblia
AGTSLSPYK

SEQ ID NO: 3098625 - protein, 11 aa, Giardia lamblia
AGTSPYDSAPL

SEQ ID NO: 3098626 - protein, 29 aa, Giardia lamblia
AGTTEYYGQEGSPPPRYNARSQHNREMED

SEQ ID NO: 3098627 - protein, 7 aa, Giardia lamblia
AGTTSGF

SEQ ID NO: 3098628 - protein, 8 aa, Giardia lamblia
AGVGGPGH

SEQ ID NO: 3098629 - protein, 19 aa, Giardia lamblia
AGVGKDTQWDSASDSQDRY

SEQ ID NO: 3098630 - protein, 6 aa, Giardia lamblia
AGVKQT

SEQ ID NO: 3098631 - protein, 8 aa, Giardia lamblia
AGVPADAV

SEQ ID NO: 3098632 - protein, 7 aa, Giardia lamblia
AGVPAEY

SEQ ID NO: 3098633 - protein, 7 aa, Giardia lamblia
AGVPGNG

SEQ ID NO: 3098634 - protein, 20 aa, Giardia lamblia
AGVPQQQPQYGSAYGGGYGA

SEQ ID NO: 3098635 - protein, 6 aa, Giardia lamblia
AGVQNA

SEQ ID NO: 3098636 - protein, 4 aa, Giardia lamblia
AGVR

SEQ ID NO: 3098637 - protein, 15 aa, Giardia lamblia
AGVRGNPDGSIPQAD

SEQ ID NO: 3098638 - protein, 4 aa, Giardia lamblia
AGVS

SEQ ID NO: 3098639 - protein, 6 aa, Giardia lamblia
AGVSQA

SEQ ID NO: 3098640 - protein, 6 aa, Giardia lamblia
AGVSTT

SEQ ID NO: 3098641 - protein, 4 aa, Giardia lamblia
AGVT

SEQ ID NO: 3098642 - protein, 6 aa, Giardia lamblia
AGYASI

SEQ ID NO: 3098643 - protein, 18 aa, Giardia lamblia
AGYEASPLDDLSTENERA

SEQ ID NO: 3098644 - protein, 7 aa, Giardia lamblia
AGYRSRA

SEQ ID NO: 3098645 - protein, 10 aa, Giardia lamblia
AGYTPQTGDE

SEQ ID NO: 3098646 - protein, 5 aa, Giardia lamblia
AHAAD

SEQ ID NO: 3098647 - protein, 6 aa, Giardia lamblia
AHAASK

SEQ ID NO: 3098648 - protein, 8 aa, Giardia lamblia
AHAGEGGA

SEQ ID NO: 3098649 - protein, 10 aa, Giardia lamblia
AHAPTDDYQP

SEQ ID NO: 3098650 - protein, 14 aa, Giardia lamblia
AHASDDKDYKPPIL

SEQ ID NO: 3098651 - protein, 8 aa, Giardia lamblia
AHASPATI

SEQ ID NO: 3098652 - protein, 11 aa, Giardia lamblia
AHASTPVSLSP

SEQ ID NO: 3098653 - protein, 7 aa, Giardia lamblia
AHCQESH

SEQ ID NO: 3098654 - protein, 6 aa, Giardia lamblia
AHDGST

SEQ ID NO: 3098655 - protein, 7 aa, Giardia lamblia
AHDNGVT

SEQ ID NO: 3098656 - protein, 5 aa, Giardia lamblia
AHDPT

SEQ ID NO: 3098657 - protein, 19 aa, Giardia lamblia
AHDQQLTYTERKQQKEHEL

SEQ ID NO: 3098658 - protein, 11 aa, Giardia lamblia
AHDQSGKSQSL

SEQ ID NO: 3098659 - protein, 10 aa, Giardia lamblia
AHDSDATSSK

SEQ ID NO: 3098660 - protein, 9 aa, Giardia lamblia
AHDSTQNVN

SEQ ID NO: 3098661 - protein, 5 aa, Giardia lamblia
AHDTE

SEQ ID NO: 3098662 - protein, 11 aa, Giardia lamblia
AHEDTLASRDK

SEQ ID NO: 3098663 - protein, 10 aa, Giardia lamblia
AHEEEETTNT

SEQ ID NO: 3098664 - protein, 8 aa, Giardia lamblia
AHERKETE

SEQ ID NO: 3098665 - protein, 12 aa, Giardia lamblia
AHESGGEAMRSK

SEQ ID NO: 3098666 - protein, 13 aa, Giardia lamblia
AHGAEYYACSLVL

SEQ ID NO: 3098667 - protein, 4 aa, Giardia lamblia
AHGE

SEQ ID NO: 3098668 - protein, 8 aa, Giardia lamblia
AHGENGAE

SEQ ID NO: 3098669 - protein, 6 aa, Giardia lamblia
AHGGDP

SEQ ID NO: 3098670 - protein, 23 aa, Giardia lamblia
AHGKAQKGKATHQGAVTDRTEVS

SEQ ID NO: 3098671 - protein, 12 aa, Giardia lamblia
AHGRRPNTRQGF

SEQ ID NO: 3098672 - protein, 7 aa, Giardia lamblia
AHGTEPL

SEQ ID NO: 3098673 - protein, 5 aa, Giardia lamblia
AHKDD

SEQ ID NO: 3098674 - protein, 10 aa, Giardia lamblia
AHKDREISSL

SEQ ID NO: 3098675 - protein, 8 aa, Giardia lamblia
AHKGTSYD

SEQ ID NO: 3098676 - protein, 9 aa, Giardia lamblia
AHKKENSLQ

SEQ ID NO: 3098677 - protein, 7 aa, Giardia lamblia
AHKPAKR

SEQ ID NO: 3098678 - protein, 11 aa, Giardia lamblia
AHKPRTFQPRY

SEQ ID NO: 3098679 - protein, 7 aa, Giardia lamblia
AHKRDAD

SEQ ID NO: 3098680 - protein, 11 aa, Giardia lamblia
AHKSQSVTRRD

SEQ ID NO: 3098681 - protein, 11 aa, Giardia lamblia
AHKSREPTHST

SEQ ID NO: 3098682 - protein, 5 aa, Giardia lamblia
AHLSR

SEQ ID NO: 3098683 - protein, 4 aa, Giardia lamblia
AHLT

SEQ ID NO: 3098684 - protein, 4 aa, Giardia lamblia
AHNA

SEQ ID NO: 3098685 - protein, 7 aa, Giardia lamblia
AHNGSEE

SEQ ID NO: 3098686 - protein, 13 aa, Giardia lamblia
AHNKEVSRNDGKE

SEQ ID NO: 3098687 - protein, 6 aa, Giardia lamblia
AHPAPN

SEQ ID NO: 3098688 - protein, 6 aa, Giardia lamblia
AHPAST

SEQ ID NO: 3098689 - protein, 12 aa, Giardia lamblia
AHPDAGSETYKY

SEQ ID NO: 3098690 - protein, 8 aa, Giardia lamblia
AHPEKTAA

SEQ ID NO: 3098691 - protein, 5 aa, Giardia lamblia
AHPFT

SEQ ID NO: 3098692 - protein, 7 aa, Giardia lamblia
AHPGVNK

SEQ ID NO: 3098693 - protein, 8 aa, Giardia lamblia
AHPKEDGY

SEQ ID NO: 3098694 - protein, 33 aa, Giardia lamblia
AHPRVRPTSRSHPPIPEPPLPGSLSEGGQISQA

SEQ ID NO: 3098695 - protein, 15 aa, Giardia lamblia
AHPVGGTKAPTNLSN

SEQ ID NO: 3098696 - protein, 7 aa, Giardia lamblia
AHPVSSA

SEQ ID NO: 3098697 - protein, 15 aa, Giardia lamblia
AHPYETPAFQYWKVN

SEQ ID NO: 3098698 - protein, 8 aa, Giardia lamblia
AHQETPEH

SEQ ID NO: 3098699 - protein, 16 aa, Giardia lamblia
AHQGQLQQQQQLPPRQ

SEQ ID NO: 3098700 - protein, 16 aa, Giardia lamblia
AHQPTSDHPSRFRDPE

SEQ ID NO: 3098701 - protein, 17 aa, Giardia lamblia
AHQRKQKPQVELDQEDS

SEQ ID NO: 3098702 - protein, 7 aa, Giardia lamblia
AHQRPTD

SEQ ID NO: 3098703 - protein, 6 aa, Giardia lamblia
AHQSST

SEQ ID NO: 3098704 - protein, 8 aa, Giardia lamblia
AHRDTSSL

SEQ ID NO: 3098705 - protein, 5 aa, Giardia lamblia
AHRET

SEQ ID NO: 3098706 - protein, 10 aa, Giardia lamblia
AHRSTKDTQQ

SEQ ID NO: 3098707 - protein, 6 aa, Giardia lamblia
AHRTRD

SEQ ID NO: 3098708 - protein, 15 aa, Giardia lamblia
AHRTSTESPPSNGLE

SEQ ID NO: 3098709 - protein, 12 aa, Giardia lamblia
AHSAAQESDPVS

SEQ ID NO: 3098710 - protein, 26 aa, Giardia lamblia
AHSASDAAKKLETSGLAINTSPRRRC

SEQ ID NO: 3098711 - protein, 7 aa, Giardia lamblia
AHSATLK

SEQ ID NO: 3098712 - protein, 11 aa, Giardia lamblia
AHSEDSITVNG

SEQ ID NO: 3098713 - protein, 6 aa, Giardia lamblia
AHSGAL

SEQ ID NO: 3098714 - protein, 7 aa, Giardia lamblia
AHSHPSS

SEQ ID NO: 3098715 - protein, 4 aa, Giardia lamblia
AHSL

SEQ ID NO: 3098716 - protein, 12 aa, Giardia lamblia
AHSNSDAVTPTH

SEQ ID NO: 3098717 - protein, 8 aa, Giardia lamblia
AHSPQAPI

SEQ ID NO: 3098718 - protein, 10 aa, Giardia lamblia
AHSQVGPGQD

SEQ ID NO: 3098719 - protein, 4 aa, Giardia lamblia
AHSS

SEQ ID NO: 3098720 - protein, 9 aa, Giardia lamblia
AHSSSSTLT

SEQ ID NO: 3098721 - protein, 8 aa, Giardia lamblia
AHTADDDS

SEQ ID NO: 3098722 - protein, 18 aa, Giardia lamblia
AHTAEAKISTYAQNVNPS

SEQ ID NO: 3098723 - protein, 28 aa, Giardia lamblia
AHTAKNKTLRVPPEPNAKVNHTTSTKEV

SEQ ID NO: 3098724 - protein, 8 aa, Giardia lamblia
AHTDENTH

SEQ ID NO: 3098725 - protein, 5 aa, Giardia lamblia
AHTER

SEQ ID NO: 3098726 - protein, 7 aa, Giardia lamblia
AHTGSHG

SEQ ID NO: 3098727 - protein, 13 aa, Giardia lamblia
AHTKGEVAKTGPT

SEQ ID NO: 3098728 - protein, 5 aa, Giardia lamblia
AHTNV

SEQ ID NO: 3098729 - protein, 4 aa, Giardia lamblia
AHTP

SEQ ID NO: 3098730 - protein, 5 aa, Giardia lamblia
AHTPL

SEQ ID NO: 3098731 - protein, 7 aa, Giardia lamblia
AHTPPGR

SEQ ID NO: 3098732 - protein, 6 aa, Giardia lamblia
AHTPQA

SEQ ID NO: 3098733 - protein, 22 aa, Giardia lamblia
AHTPTAHSELQGPSESTSEVPG

SEQ ID NO: 3098734 - protein, 10 aa, Giardia lamblia
AHTQDELGET

SEQ ID NO: 3098735 - protein, 5 aa, Giardia lamblia
AHTQT

SEQ ID NO: 3098736 - protein, 11 aa, Giardia lamblia
AHTRDANNETG

SEQ ID NO: 3098737 - protein, 8 aa, Giardia lamblia
AHTSTDGP

SEQ ID NO: 3098738 - protein, 23 aa, Giardia lamblia
AHTSTDVQESRKAPLTPSRHDGI

SEQ ID NO: 3098739 - protein, 16 aa, Giardia lamblia
AIAKDDNKATYSTNEQ

SEQ ID NO: 3098740 - protein, 6 aa, Giardia lamblia
AIAQTK

SEQ ID NO: 3098741 - protein, 11 aa, Giardia lamblia
AIAREKAAHDA

SEQ ID NO: 3098742 - protein, 12 aa, Giardia lamblia
AIASTGEKASQL

SEQ ID NO: 3098743 - protein, 6 aa, Giardia lamblia
AIDAKD

SEQ ID NO: 3098744 - protein, 9 aa, Giardia lamblia
AIDDKDKEV

SEQ ID NO: 3098745 - protein, 8 aa, Giardia lamblia
AIDDPEPW

SEQ ID NO: 3098746 - protein, 18 aa, Giardia lamblia
AIDEGDTKTVKSLVWSKQ

SEQ ID NO: 3098747 - protein, 6 aa, Giardia lamblia
AIDPHT

SEQ ID NO: 3098748 - protein, 5 aa, Giardia lamblia
AIDPY

SEQ ID NO: 3098749 - protein, 12 aa, Giardia lamblia
AIDQGNQQHGKT

SEQ ID NO: 3098750 - protein, 8 aa, Giardia lamblia
AIDQGPTY

SEQ ID NO: 3098751 - protein, 4 aa, Giardia lamblia
AIDT

SEQ ID NO: 3098752 - protein, 8 aa, Giardia lamblia
AIDTSGAG

SEQ ID NO: 3098753 - protein, 20 aa, Giardia lamblia
AIEDADNDDHEVEAPANGKG

SEQ ID NO: 3098754 - protein, 13 aa, Giardia lamblia
AIEKAKKSAVSDA

SEQ ID NO: 3098755 - protein, 7 aa, Giardia lamblia
AIEPNDI

SEQ ID NO: 3098756 - protein, 18 aa, Giardia lamblia
AIERAQTVTSRPNPYPDL

SEQ ID NO: 3098757 - protein, 21 aa, Giardia lamblia
AIESSSSSRHTNSLNNPAAER

SEQ ID NO: 3098758 - protein, 29 aa, Giardia lamblia
AIETQRKANKAPSSEEKQMTARRNELNSQ

SEQ ID NO: 3098759 - protein, 5 aa, Giardia lamblia
AIGAN

SEQ ID NO: 3098760 - protein, 6 aa, Giardia lamblia
AIGPTK

SEQ ID NO: 3098761 - protein, 13 aa, Giardia lamblia
AIGSSRPSTGASY

SEQ ID NO: 3098762 - protein, 4 aa, Giardia lamblia
AIHG

SEQ ID NO: 3098763 - protein, 12 aa, Giardia lamblia
AIKNTATKISRG

SEQ ID NO: 3098764 - protein, 7 aa, Giardia lamblia
AIKPAGG

SEQ ID NO: 3098765 - protein, 13 aa, Giardia lamblia
AIKQKRPKVRYPG

SEQ ID NO: 3098766 - protein, 10 aa, Giardia lamblia
AIKQSESTIK

SEQ ID NO: 3098767 - protein, 19 aa, Giardia lamblia
AIKSPLPAISSRPSSGTIS

SEQ ID NO: 3098768 - protein, 15 aa, Giardia lamblia
AINNTGSRYGKATVQ

SEQ ID NO: 3098769 - protein, 12 aa, Giardia lamblia
AINRRKEDANER

SEQ ID NO: 3098770 - protein, 5 aa, Giardia lamblia
AINSS

SEQ ID NO: 3098771 - protein, 22 aa, Giardia lamblia
AIPDPVNVGSSEASRPSRNPIG

SEQ ID NO: 3098772 - protein, 8 aa, Giardia lamblia
AIPKDTPL

SEQ ID NO: 3098773 - protein, 6 aa, Giardia lamblia
AIPKQG

SEQ ID NO: 3098774 - protein, 6 aa, Giardia lamblia
AIPNHA

SEQ ID NO: 3098775 - protein, 12 aa, Giardia lamblia
AIPSDSPSAPRR

SEQ ID NO: 3098776 - protein, 6 aa, Giardia lamblia
AIPSGP

SEQ ID NO: 3098777 - protein, 5 aa, Giardia lamblia
AIPSP

SEQ ID NO: 3098778 - protein, 8 aa, Giardia lamblia
AIPTPDIS

SEQ ID NO: 3098779 - protein, 4 aa, Giardia lamblia
AIPV

SEQ ID NO: 3098780 - protein, 14 aa, Giardia lamblia
AIQDATDSVGSDTN

SEQ ID NO: 3098781 - protein, 22 aa, Giardia lamblia
AIQNTTSLQTSDQERTKKYTSK

SEQ ID NO: 3098782 - protein, 13 aa, Giardia lamblia
AIQTTSNSHENAT

SEQ ID NO: 3098783 - protein, 16 aa, Giardia lamblia
AIRAAERQNGLSPSVL

SEQ ID NO: 3098784 - protein, 9 aa, Giardia lamblia
AIRHRDKDR

SEQ ID NO: 3098785 - protein, 7 aa, Giardia lamblia
AIRPAAG

SEQ ID NO: 3098786 - protein, 10 aa, Giardia lamblia
AIRPTGNSTK

SEQ ID NO: 3098787 - protein, 23 aa, Giardia lamblia
AIRRRKEYERKEKERRAGETTVK

SEQ ID NO: 3098788 - protein, 10 aa, Giardia lamblia
AIRSNTNNRF

SEQ ID NO: 3098789 - protein, 5 aa, Giardia lamblia
AISAG

SEQ ID NO: 3098790 - protein, 17 aa, Giardia lamblia
AISEDRGISESGDKYDE

SEQ ID NO: 3098791 - protein, 6 aa, Giardia lamblia
AISGSG

SEQ ID NO: 3098792 - protein, 14 aa, Giardia lamblia
AISGSKDRTVRVWR

SEQ ID NO: 3098793 - protein, 9 aa, Giardia lamblia
AISHRGKAL

SEQ ID NO: 3098794 - protein, 7 aa, Giardia lamblia
AISKGGV

SEQ ID NO: 3098795 - protein, 5 aa, Giardia lamblia
AISQE

SEQ ID NO: 3098796 - protein, 11 aa, Giardia lamblia
AISSDTPLRER

SEQ ID NO: 3098797 - protein, 11 aa, Giardia lamblia
AISSTKESQYV

SEQ ID NO: 3098798 - protein, 11 aa, Giardia lamblia
AISTETQTVDN

SEQ ID NO: 3098799 - protein, 6 aa, Giardia lamblia
AISTGN

SEQ ID NO: 3098800 - protein, 8 aa, Giardia lamblia
AISTSART

SEQ ID NO: 3098801 - protein, 8 aa, Giardia lamblia
AISTSEPI

SEQ ID NO: 3098802 - protein, 10 aa, Giardia lamblia
AITGPDGESI

SEQ ID NO: 3098803 - protein, 5 aa, Giardia lamblia
AITPE

SEQ ID NO: 3098804 - protein, 6 aa, Giardia lamblia
AITPED

SEQ ID NO: 3098805 - protein, 8 aa, Giardia lamblia
AITPRSGH

SEQ ID NO: 3098806 - protein, 34 aa, Giardia lamblia
AITSGPAPQKSGQTKARTTSGKPAQPGSAPRQPQ

SEQ ID NO: 3098807 - protein, 11 aa, Giardia lamblia
AITSGPKAGRP

SEQ ID NO: 3098808 - protein, 5 aa, Giardia lamblia
AITSP

SEQ ID NO: 3098809 - protein, 6 aa, Giardia lamblia
AITTGS

SEQ ID NO: 3098810 - protein, 12 aa, Giardia lamblia
AKAAKGGSGKAI

SEQ ID NO: 3098811 - protein, 5 aa, Giardia lamblia
AKAAL

SEQ ID NO: 3098812 - protein, 8 aa, Giardia lamblia
AKADASRQ

SEQ ID NO: 3098813 - protein, 9 aa, Giardia lamblia
AKAESPAKR

SEQ ID NO: 3098814 - protein, 9 aa, Giardia lamblia
AKAGTDRDR

SEQ ID NO: 3098815 - protein, 9 aa, Giardia lamblia
AKAHSADMT

SEQ ID NO: 3098816 - protein, 6 aa, Giardia lamblia
AKAIRR

SEQ ID NO: 3098817 - protein, 15 aa, Giardia lamblia
AKAKTQATKKPEVAD

SEQ ID NO: 3098818 - protein, 4 aa, Giardia lamblia
AKAL

SEQ ID NO: 3098819 - protein, 13 aa, Giardia lamblia
AKANGKPLPEKSD

SEQ ID NO: 3098820 - protein, 6 aa, Giardia lamblia
AKANQP

SEQ ID NO: 3098821 - protein, 10 aa, Giardia lamblia
AKANSGSDRE

SEQ ID NO: 3098822 - protein, 13 aa, Giardia lamblia
AKANTAYASGQYQ

SEQ ID NO: 3098823 - protein, 7 aa, Giardia lamblia
AKAPLTA

SEQ ID NO: 3098824 - protein, 25 aa, Giardia lamblia
AKAPSSISDTSSTHSASDIAQSAPL

SEQ ID NO: 3098825 - protein, 8 aa, Giardia lamblia
AKAQAGGL

SEQ ID NO: 3098826 - protein, 36 aa, Giardia lamblia
AKAQAKQALESSPSYALKSPATINPTSKQEEAKTGE

SEQ ID NO: 3098827 - protein, 7 aa, Giardia lamblia
AKAQNSS

SEQ ID NO: 3098828 - protein, 8 aa, Giardia lamblia
AKAQVNSL

SEQ ID NO: 3098829 - protein, 11 aa, Giardia lamblia
AKARGDGSAKP

SEQ ID NO: 3098830 - protein, 13 aa, Giardia lamblia
AKARSTPEREEEL

SEQ ID NO: 3098831 - protein, 11 aa, Giardia lamblia
AKASAASASDI

SEQ ID NO: 3098832 - protein, 15 aa, Giardia lamblia
AKASEGLTDPKGSEK

SEQ ID NO: 3098833 - protein, 11 aa, Giardia lamblia
AKASPGTNPYL

SEQ ID NO: 3098834 - protein, 7 aa, Giardia lamblia
AKASQDR

SEQ ID NO: 3098835 - protein, 11 aa, Giardia lamblia
AKASREASSAI

SEQ ID NO: 3098836 - protein, 10 aa, Giardia lamblia
AKASSEQEYD

SEQ ID NO: 3098837 - protein, 27 aa, Giardia lamblia
AKATAGTTKDAEKGAFSNNTPSSTRHV

SEQ ID NO: 3098838 - protein, 12 aa, Giardia lamblia
AKATAQSTSDHS

SEQ ID NO: 3098839 - protein, 8 aa, Giardia lamblia
AKATCADT

SEQ ID NO: 3098840 - protein, 8 aa, Giardia lamblia
AKATNPEV

SEQ ID NO: 3098841 - protein, 8 aa, Giardia lamblia
AKAVQEDE

SEQ ID NO: 3098842 - protein, 8 aa, Giardia lamblia
AKAYREEH

SEQ ID NO: 3098843 - protein, 6 aa, Giardia lamblia
AKCRPQ

SEQ ID NO: 3098844 - protein, 9 aa, Giardia lamblia
AKDAQDDNQ

SEQ ID NO: 3098845 - protein, 10 aa, Giardia lamblia
AKDAQGKESS

SEQ ID NO: 3098846 - protein, 9 aa, Giardia lamblia
AKDGGPVEA

SEQ ID NO: 3098847 - protein, 10 aa, Giardia lamblia
AKDGKDVQAG

SEQ ID NO: 3098848 - protein, 8 aa, Giardia lamblia
AKDGTEDV

SEQ ID NO: 3098849 - protein, 8 aa, Giardia lamblia
AKDHDGDT

SEQ ID NO: 3098850 - protein, 6 aa, Giardia lamblia
AKDKKI

SEQ ID NO: 3098851 - protein, 7 aa, Giardia lamblia
AKDKKKK

SEQ ID NO: 3098852 - protein, 14 aa, Giardia lamblia
AKDKQDADFTNSAN

SEQ ID NO: 3098853 - protein, 32 aa, Giardia lamblia
AKDKSVKVSKGSSRDKKANILPSKRKSKTTTL

SEQ ID NO: 3098854 - protein, 25 aa, Giardia lamblia
AKDKVDDKMNPAAAKPNLAESPFDR

SEQ ID NO: 3098855 - protein, 19 aa, Giardia lamblia
AKDLPSHQSYQSYQSGHSY

SEQ ID NO: 3098856 - protein, 7 aa, Giardia lamblia
AKDLTPE

SEQ ID NO: 3098857 - protein, 8 aa, Giardia lamblia
AKDMAQAS

SEQ ID NO: 3098858 - protein, 6 aa, Giardia lamblia
AKDPKG

SEQ ID NO: 3098859 - protein, 5 aa, Giardia lamblia
AKDPL

SEQ ID NO: 3098860 - protein, 7 aa, Giardia lamblia
AKDPRTA

SEQ ID NO: 3098861 - protein, 9 aa, Giardia lamblia
AKDPTCPSS

SEQ ID NO: 3098862 - protein, 8 aa, Giardia lamblia
AKDPTSTL

SEQ ID NO: 3098863 - protein, 7 aa, Giardia lamblia
AKDQYGR

SEQ ID NO: 3098864 - protein, 9 aa, Giardia lamblia
AKDSDTGAI

SEQ ID NO: 3098865 - protein, 6 aa, Giardia lamblia
AKDSEI

SEQ ID NO: 3098866 - protein, 4 aa, Giardia lamblia
AKDT

SEQ ID NO: 3098867 - protein, 9 aa, Giardia lamblia
AKDTISRGS

SEQ ID NO: 3098868 - protein, 12 aa, Giardia lamblia
AKDTVPKPVQEQ

SEQ ID NO: 3098869 - protein, 6 aa, Giardia lamblia
AKDVTE

SEQ ID NO: 3098870 - protein, 14 aa, Giardia lamblia
AKDYSNSPAFQHTE

SEQ ID NO: 3098871 - protein, 9 aa, Giardia lamblia
AKEAERVEQ

SEQ ID NO: 3098872 - protein, 7 aa, Giardia lamblia
AKEAQQQ

SEQ ID NO: 3098873 - protein, 15 aa, Giardia lamblia
AKEARLTAKESHCEN

SEQ ID NO: 3098874 - protein, 29 aa, Giardia lamblia
AKEASISSAMSQKSVDLSGSIKPEREQDV

SEQ ID NO: 3098875 - protein, 8 aa, Giardia lamblia
AKEAYPSR

SEQ ID NO: 3098876 - protein, 7 aa, Giardia lamblia
AKECGAE

SEQ ID NO: 3098877 - protein, 4 aa, Giardia lamblia
AKEE

SEQ ID NO: 3098878 - protein, 7 aa, Giardia lamblia
AKEEEKA

SEQ ID NO: 3098879 - protein, 7 aa, Giardia lamblia
AKEEGGA

SEQ ID NO: 3098880 - protein, 11 aa, Giardia lamblia
AKEEKERYEQN

SEQ ID NO: 3098881 - protein, 6 aa, Giardia lamblia
AKEELD

SEQ ID NO: 3098882 - protein, 23 aa, Giardia lamblia
AKEGESGTGSTVTYPDASVRHVK

SEQ ID NO: 3098883 - protein, 6 aa, Giardia lamblia
AKEGPL

SEQ ID NO: 3098884 - protein, 6 aa, Giardia lamblia
AKEKDI

SEQ ID NO: 3098885 - protein, 6 aa, Giardia lamblia
AKEKDL

SEQ ID NO: 3098886 - protein, 14 aa, Giardia lamblia
AKEKDQVSEKHAET

SEQ ID NO: 3098887 - protein, 7 aa, Giardia lamblia
AKEKEIE

SEQ ID NO: 3098888 - protein, 13 aa, Giardia lamblia
AKEKGDYDTQRKN

SEQ ID NO: 3098889 - protein, 10 aa, Giardia lamblia
AKEKKHAAKE

SEQ ID NO: 3098890 - protein, 12 aa, Giardia lamblia
AKEKPASASSNW

SEQ ID NO: 3098891 - protein, 4 aa, Giardia lamblia
AKEL

SEQ ID NO: 3098892 - protein, 12 aa, Giardia lamblia
AKELGENLTDEE

SEQ ID NO: 3098893 - protein, 9 aa, Giardia lamblia
AKENEQAEL

SEQ ID NO: 3098894 - protein, 8 aa, Giardia lamblia
AKENNENE

SEQ ID NO: 3098895 - protein, 6 aa, Giardia lamblia
AKENQL

SEQ ID NO: 3098896 - protein, 13 aa, Giardia lamblia
AKEPEVRKASQEA

SEQ ID NO: 3098897 - protein, 10 aa, Giardia lamblia
AKEPGSLSYN

SEQ ID NO: 3098898 - protein, 12 aa, Giardia lamblia
AKEQHNSRSQQD

SEQ ID NO: 3098899 - protein, 15 aa, Giardia lamblia
AKEQSSPSENSIEKT

SEQ ID NO: 3098900 - protein, 12 aa, Giardia lamblia
AKEQTPSGRRSL

SEQ ID NO: 3098901 - protein, 6 aa, Giardia lamblia
AKERGI

SEQ ID NO: 3098902 - protein, 5 aa, Giardia lamblia
AKERN

SEQ ID NO: 3098903 - protein, 12 aa, Giardia lamblia
AKERTRKEQINR

SEQ ID NO: 3098904 - protein, 4 aa, Giardia lamblia
AKES

SEQ ID NO: 3098905 - protein, 8 aa, Giardia lamblia
AKESENTV

SEQ ID NO: 3098906 - protein, 9 aa, Giardia lamblia
AKESPPPHK

SEQ ID NO: 3098907 - protein, 8 aa, Giardia lamblia
AKETAEAS

SEQ ID NO: 3098908 - protein, 8 aa, Giardia lamblia
AKETNALG

SEQ ID NO: 3098909 - protein, 24 aa, Giardia lamblia
AKETTSGSSKTSRPTLITSISEYF

SEQ ID NO: 3098910 - protein, 13 aa, Giardia lamblia
AKETVAPSINTSD

SEQ ID NO: 3098911 - protein, 6 aa, Giardia lamblia
AKFDNS

SEQ ID NO: 3098912 - protein, 8 aa, Giardia lamblia
AKFSSDKA

SEQ ID NO: 3098913 - protein, 9 aa, Giardia lamblia
AKGAGTLTY

SEQ ID NO: 3098914 - protein, 8 aa, Giardia lamblia
AKGAIDSA

SEQ ID NO: 3098915 - protein, 9 aa, Giardia lamblia
AKGASGESS

SEQ ID NO: 3098916 - protein, 7 aa, Giardia lamblia
AKGDDYT

SEQ ID NO: 3098917 - protein, 14 aa, Giardia lamblia
AKGDRTLDPPNGAE

SEQ ID NO: 3098918 - protein, 5 aa, Giardia lamblia
AKGET

SEQ ID NO: 3098919 - protein, 6 aa, Giardia lamblia
AKGEVK

SEQ ID NO: 3098920 - protein, 6 aa, Giardia lamblia
AKGFGN

SEQ ID NO: 3098921 - protein, 4 aa, Giardia lamblia
AKGG

SEQ ID NO: 3098922 - protein, 8 aa, Giardia lamblia
AKGGDSEC

SEQ ID NO: 3098923 - protein, 7 aa, Giardia lamblia
AKGGKPV

SEQ ID NO: 3098924 - protein, 7 aa, Giardia lamblia
AKGGYPD

SEQ ID NO: 3098925 - protein, 12 aa, Giardia lamblia
AKGHNWGFNGST

SEQ ID NO: 3098926 - protein, 9 aa, Giardia lamblia
AKGKPTARF

SEQ ID NO: 3098927 - protein, 10 aa, Giardia lamblia
AKGNESSAPL

SEQ ID NO: 3098928 - protein, 6 aa, Giardia lamblia
AKGQPV

SEQ ID NO: 3098929 - protein, 7 aa, Giardia lamblia
AKGQVEE

SEQ ID NO: 3098930 - protein, 8 aa, Giardia lamblia
AKGSEDEV

SEQ ID NO: 3098931 - protein, 6 aa, Giardia lamblia
AKGSRA

SEQ ID NO: 3098932 - protein, 28 aa, Giardia lamblia
AKGSRESGSAEGTKSVKSAKDSKACPTN

SEQ ID NO: 3098933 - protein, 8 aa, Giardia lamblia
AKHEKIDT

SEQ ID NO: 3098934 - protein, 4 aa, Giardia lamblia
AKHI

SEQ ID NO: 3098935 - protein, 17 aa, Giardia lamblia
AKHNPDNSTVKGTGDSF

SEQ ID NO: 3098936 - protein, 7 aa, Giardia lamblia
AKHQTAS

SEQ ID NO: 3098937 - protein, 6 aa, Giardia lamblia
AKIASN

SEQ ID NO: 3098938 - protein, 4 aa, Giardia lamblia
AKID

SEQ ID NO: 3098939 - protein, 10 aa, Giardia lamblia
AKIGPGPPMS

SEQ ID NO: 3098940 - protein, 9 aa, Giardia lamblia
AKIKDTDGN

SEQ ID NO: 3098941 - protein, 6 aa, Giardia lamblia
AKINNS

SEQ ID NO: 3098942 - protein, 7 aa, Giardia lamblia
AKIPSSR

SEQ ID NO: 3098943 - protein, 8 aa, Giardia lamblia
AKIPTKQE

SEQ ID NO: 3098944 - protein, 6 aa, Giardia lamblia
AKISQT

SEQ ID NO: 3098945 - protein, 13 aa, Giardia lamblia
AKISSDAQKLGKL

SEQ ID NO: 3098946 - protein, 40 aa, Giardia lamblia
AKKAAEKVAKAGENVEDVKADKKDKKKDEEDAIATAESGG

SEQ ID NO: 3098947 - protein, 16 aa, Giardia lamblia
AKKAEKLRRSNLAEEK

SEQ ID NO: 3098948 - protein, 8 aa, Giardia lamblia
AKKAGKDS

SEQ ID NO: 3098949 - protein, 14 aa, Giardia lamblia
AKKAKLNAKTVSKS

SEQ ID NO: 3098950 - protein, 8 aa, Giardia lamblia
AKKDASEK

SEQ ID NO: 3098951 - protein, 11 aa, Giardia lamblia
AKKDESMRPQL

SEQ ID NO: 3098952 - protein, 9 aa, Giardia lamblia
AKKDSGREF

SEQ ID NO: 3098953 - protein, 9 aa, Giardia lamblia
AKKEDDSST

SEQ ID NO: 3098954 - protein, 12 aa, Giardia lamblia
AKKEECIRILER

SEQ ID NO: 3098955 - protein, 7 aa, Giardia lamblia
AKKGKTL

SEQ ID NO: 3098956 - protein, 10 aa, Giardia lamblia
AKKLNPAEPN

SEQ ID NO: 3098957 - protein, 8 aa, Giardia lamblia
AKKLSPQT

SEQ ID NO: 3098958 - protein, 10 aa, Giardia lamblia
AKKLTDGVNS

SEQ ID NO: 3098959 - protein, 24 aa, Giardia lamblia
AKKPKPKPKETIYSPYSETELSNQ

SEQ ID NO: 3098960 - protein, 20 aa, Giardia lamblia
AKKRAERNLREEGESPGEVR

SEQ ID NO: 3098961 - protein, 24 aa, Giardia lamblia
AKKSMAQQGEHSMGPATPKAISDE

SEQ ID NO: 3098962 - protein, 5 aa, Giardia lamblia
AKKTI

SEQ ID NO: 3098963 - protein, 8 aa, Giardia lamblia
AKKTSRIG

SEQ ID NO: 3098964 - protein, 8 aa, Giardia lamblia
AKKYESRM

SEQ ID NO: 3098965 - protein, 6 aa, Giardia lamblia
AKKYSS

SEQ ID NO: 3098966 - protein, 9 aa, Giardia lamblia
AKLDGAPLE

SEQ ID NO: 3098967 - protein, 28 aa, Giardia lamblia
AKLGYRPTISPDALSSSAEIRHLVQLYS

SEQ ID NO: 3098968 - protein, 10 aa, Giardia lamblia
AKLKEDEEEL

SEQ ID NO: 3098969 - protein, 8 aa, Giardia lamblia
AKLRPKKL

SEQ ID NO: 3098970 - protein, 6 aa, Giardia lamblia
AKLSDV

SEQ ID NO: 3098971 - protein, 6 aa, Giardia lamblia
AKLSKE

SEQ ID NO: 3098972 - protein, 9 aa, Giardia lamblia
AKLTNEDGY

SEQ ID NO: 3098973 - protein, 10 aa, Giardia lamblia
AKLTNNDGDN

SEQ ID NO: 3098974 - protein, 11 aa, Giardia lamblia
AKLTTKDGTTA

SEQ ID NO: 3098975 - protein, 8 aa, Giardia lamblia
AKMGGDSA

SEQ ID NO: 3098976 - protein, 8 aa, Giardia lamblia
AKMQNSSG

SEQ ID NO: 3098977 - protein, 9 aa, Giardia lamblia
AKMQRRRAD

SEQ ID NO: 3098978 - protein, 13 aa, Giardia lamblia
AKMQSIDASGTQI

SEQ ID NO: 3098979 - protein, 9 aa, Giardia lamblia
AKMQSSSGV

SEQ ID NO: 3098980 - protein, 7 aa, Giardia lamblia
AKMSEAE

SEQ ID NO: 3098981 - protein, 16 aa, Giardia lamblia
AKNAKVVGTNRNTDLN

SEQ ID NO: 3098982 - protein, 14 aa, Giardia lamblia
AKNASSAANTGINQ

SEQ ID NO: 3098983 - protein, 4 aa, Giardia lamblia
AKND

SEQ ID NO: 3098984 - protein, 7 aa, Giardia lamblia
AKNDDGL

SEQ ID NO: 3098985 - protein, 7 aa, Giardia lamblia
AKNDELN

SEQ ID NO: 3098986 - protein, 6 aa, Giardia lamblia
AKNEEE

SEQ ID NO: 3098987 - protein, 6 aa, Giardia lamblia
AKNEEV

SEQ ID NO: 3098988 - protein, 16 aa, Giardia lamblia
AKNENKLYTQKPTPFY

SEQ ID NO: 3098989 - protein, 13 aa, Giardia lamblia
AKNGDEHYGSNAL

SEQ ID NO: 3098990 - protein, 8 aa, Giardia lamblia
AKNGDVAG

SEQ ID NO: 3098991 - protein, 7 aa, Giardia lamblia
AKNGEAV

SEQ ID NO: 3098992 - protein, 7 aa, Giardia lamblia
AKNGNLN

SEQ ID NO: 3098993 - protein, 6 aa, Giardia lamblia
AKNGNV

SEQ ID NO: 3098994 - protein, 7 aa, Giardia lamblia
AKNIRDN

SEQ ID NO: 3098995 - protein, 8 aa, Giardia lamblia
AKNKTTAD

SEQ ID NO: 3098996 - protein, 6 aa, Giardia lamblia
AKNLSA

SEQ ID NO: 3098997 - protein, 6 aa, Giardia lamblia
AKNNDV

SEQ ID NO: 3098998 - protein, 8 aa, Giardia lamblia
AKNNELEI

SEQ ID NO: 3098999 - protein, 5 aa, Giardia lamblia
AKNNN

SEQ ID NO: 3099000 - protein, 7 aa, Giardia lamblia
AKNPEIN

SEQ ID NO: 3099001 - protein, 9 aa, Giardia lamblia
AKNPKNSVH

SEQ ID NO: 3099002 - protein, 5 aa, Giardia lamblia
AKNPP

SEQ ID NO: 3099003 - protein, 8 aa, Giardia lamblia
AKNPSISA

SEQ ID NO: 3099004 - protein, 7 aa, Giardia lamblia
AKNPTWA

SEQ ID NO: 3099005 - protein, 7 aa, Giardia lamblia
AKNQNAE

SEQ ID NO: 3099006 - protein, 7 aa, Giardia lamblia
AKNSEPL

SEQ ID NO: 3099007 - protein, 6 aa, Giardia lamblia
AKNTGS

SEQ ID NO: 3099008 - protein, 7 aa, Giardia lamblia
AKNTQRQ

SEQ ID NO: 3099009 - protein, 8 aa, Giardia lamblia
AKNVSASD

SEQ ID NO: 3099010 - protein, 9 aa, Giardia lamblia
AKNYASAAL

SEQ ID NO: 3099011 - protein, 7 aa, Giardia lamblia
AKPACDN

SEQ ID NO: 3099012 - protein, 11 aa, Giardia lamblia
AKPDRASSKSV

SEQ ID NO: 3099013 - protein, 10 aa, Giardia lamblia
AKPEQETTHK

SEQ ID NO: 3099014 - protein, 9 aa, Giardia lamblia
AKPETVSEE

SEQ ID NO: 3099015 - protein, 5 aa, Giardia lamblia
AKPGT

SEQ ID NO: 3099016 - protein, 44 aa, Giardia lamblia
AKPGVDDYTGAEDPFTRARREKKERVAKNKAQQAANIKRARAVK

SEQ ID NO: 3099017 - protein, 15 aa, Giardia lamblia
AKPINTGELQDATAR

SEQ ID NO: 3099018 - protein, 9 aa, Giardia lamblia
AKPKKQVQK

SEQ ID NO: 3099019 - protein, 23 aa, Giardia lamblia
AKPKSATRVPKSSESTGIASSSS

SEQ ID NO: 3099020 - protein, 7 aa, Giardia lamblia
AKPNPTF

SEQ ID NO: 3099021 - protein, 7 aa, Giardia lamblia
AKPNQGH

SEQ ID NO: 3099022 - protein, 4 aa, Giardia lamblia
AKPP

SEQ ID NO: 3099023 - protein, 7 aa, Giardia lamblia
AKPPPDS

SEQ ID NO: 3099024 - protein, 7 aa, Giardia lamblia
AKPPSVT

SEQ ID NO: 3099025 - protein, 8 aa, Giardia lamblia
AKPSPAHK

SEQ ID NO: 3099026 - protein, 5 aa, Giardia lamblia
AKPSY

SEQ ID NO: 3099027 - protein, 48 aa, Giardia lamblia
AKPTPHRPLGPASSTALAQHSSVGGGVSALQDASSRKSGPGETRRPPL

SEQ ID NO: 3099028 - protein, 8 aa, Giardia lamblia
AKPVPTNK

SEQ ID NO: 3099029 - protein, 4 aa, Giardia lamblia
AKPY

SEQ ID NO: 3099030 - protein, 8 aa, Giardia lamblia
AKPYSTTQ

SEQ ID NO: 3099031 - protein, 13 aa, Giardia lamblia
AKQAGTTASTPNC

SEQ ID NO: 3099032 - protein, 12 aa, Giardia lamblia
AKQAQQESSRRC

SEQ ID NO: 3099033 - protein, 8 aa, Giardia lamblia
AKQATGKN

SEQ ID NO: 3099034 - protein, 7 aa, Giardia lamblia
AKQAVDG

SEQ ID NO: 3099035 - protein, 22 aa, Giardia lamblia
AKQDDSSVAAASIGREKSQDFV

SEQ ID NO: 3099036 - protein, 6 aa, Giardia lamblia
AKQDGC

SEQ ID NO: 3099037 - protein, 7 aa, Giardia lamblia
AKQDGIK

SEQ ID NO: 3099038 - protein, 5 aa, Giardia lamblia
AKQDN

SEQ ID NO: 3099039 - protein, 4 aa, Giardia lamblia
AKQE

SEQ ID NO: 3099040 - protein, 7 aa, Giardia lamblia
AKQGYAS

SEQ ID NO: 3099041 - protein, 8 aa, Giardia lamblia
AKQKNATK

SEQ ID NO: 3099042 - protein, 30 aa, Giardia lamblia
AKQKQETLNRKMEEKKLQEAIEKENERPTF

SEQ ID NO: 3099043 - protein, 11 aa, Giardia lamblia
AKQLQAEETRK

SEQ ID NO: 3099044 - protein, 5 aa, Giardia lamblia
AKQMG

SEQ ID NO: 3099045 - protein, 9 aa, Giardia lamblia
AKQNPSLDH

SEQ ID NO: 3099046 - protein, 9 aa, Giardia lamblia
AKQNVSAEK

SEQ ID NO: 3099047 - protein, 7 aa, Giardia lamblia
AKQPIST

SEQ ID NO: 3099048 - protein, 26 aa, Giardia lamblia
AKQPTYQNAYSRNAGAAAGTARQDPC

SEQ ID NO: 3099049 - protein, 16 aa, Giardia lamblia
AKQQAKESEKKRSRLE

SEQ ID NO: 3099050 - protein, 8 aa, Giardia lamblia
AKQQEQRE

SEQ ID NO: 3099051 - protein, 8 aa, Giardia lamblia
AKQQETGF

SEQ ID NO: 3099052 - protein, 10 aa, Giardia lamblia
AKQQQKIREQ

SEQ ID NO: 3099053 - protein, 11 aa, Giardia lamblia
AKQQREEAYRQ

SEQ ID NO: 3099054 - protein, 15 aa, Giardia lamblia
AKQQTAHTSASNAVS

SEQ ID NO: 3099055 - protein, 10 aa, Giardia lamblia
AKQQTANGDT

SEQ ID NO: 3099056 - protein, 7 aa, Giardia lamblia
AKQRELV

SEQ ID NO: 3099057 - protein, 8 aa, Giardia lamblia
AKQRKGQE

SEQ ID NO: 3099058 - protein, 7 aa, Giardia lamblia
AKQRTDL

SEQ ID NO: 3099059 - protein, 6 aa, Giardia lamblia
AKQRTE

SEQ ID NO: 3099060 - protein, 10 aa, Giardia lamblia
AKQRTSAGKT

SEQ ID NO: 3099061 - protein, 7 aa, Giardia lamblia
AKQRYSK

SEQ ID NO: 3099062 - protein, 10 aa, Giardia lamblia
AKQSQSPHVG

SEQ ID NO: 3099063 - protein, 8 aa, Giardia lamblia
AKQSSNAY

SEQ ID NO: 3099064 - protein, 12 aa, Giardia lamblia
AKQTQVDPLPGH

SEQ ID NO: 3099065 - protein, 8 aa, Giardia lamblia
AKQTREDH

SEQ ID NO: 3099066 - protein, 7 aa, Giardia lamblia
AKQVKEL

SEQ ID NO: 3099067 - protein, 9 aa, Giardia lamblia
AKQYAEKTI

SEQ ID NO: 3099068 - protein, 10 aa, Giardia lamblia
AKQYASDSRT

SEQ ID NO: 3099069 - protein, 12 aa, Giardia lamblia
AKRARYDTPDAS

SEQ ID NO: 3099070 - protein, 7 aa, Giardia lamblia
AKRASAA

SEQ ID NO: 3099071 - protein, 6 aa, Giardia lamblia
AKRDKA

SEQ ID NO: 3099072 - protein, 8 aa, Giardia lamblia
AKRDPARF

SEQ ID NO: 3099073 - protein, 13 aa, Giardia lamblia
AKRETSIQKTGRC

SEQ ID NO: 3099074 - protein, 12 aa, Giardia lamblia
AKRHGDDEDSDG

SEQ ID NO: 3099075 - protein, 10 aa, Giardia lamblia
AKRLSSRENL

SEQ ID NO: 3099076 - protein, 8 aa, Giardia lamblia
AKRNNYPY

SEQ ID NO: 3099077 - protein, 7 aa, Giardia lamblia
AKRNPNA

SEQ ID NO: 3099078 - protein, 5 aa, Giardia lamblia
AKRNT

SEQ ID NO: 3099079 - protein, 4 aa, Giardia lamblia
AKRQ

SEQ ID NO: 3099080 - protein, 6 aa, Giardia lamblia
AKRQND

SEQ ID NO: 3099081 - protein, 8 aa, Giardia lamblia
AKRRDHRN

SEQ ID NO: 3099082 - protein, 7 aa, Giardia lamblia
AKRRDTD

SEQ ID NO: 3099083 - protein, 8 aa, Giardia lamblia
AKRRGKRV

SEQ ID NO: 3099084 - protein, 16 aa, Giardia lamblia
AKRRGSGGSSSDVSDK

SEQ ID NO: 3099085 - protein, 6 aa, Giardia lamblia
AKRRTV

SEQ ID NO: 3099086 - protein, 10 aa, Giardia lamblia
AKRSASGKGT

SEQ ID NO: 3099087 - protein, 7 aa, Giardia lamblia
AKRSDKD

SEQ ID NO: 3099088 - protein, 10 aa, Giardia lamblia
AKRSENSVPA

SEQ ID NO: 3099089 - protein, 7 aa, Giardia lamblia
AKRSNEF

SEQ ID NO: 3099090 - protein, 6 aa, Giardia lamblia
AKRTAA

SEQ ID NO: 3099091 - protein, 6 aa, Giardia lamblia
AKRTQI

SEQ ID NO: 3099092 - protein, 7 aa, Giardia lamblia
AKRTSAI

SEQ ID NO: 3099093 - protein, 4 aa, Giardia lamblia
AKRY

SEQ ID NO: 3099094 - protein, 9 aa, Giardia lamblia
AKSAGLDPQ

SEQ ID NO: 3099095 - protein, 14 aa, Giardia lamblia
AKSAKKLTVPATPK

SEQ ID NO: 3099096 - protein, 22 aa, Giardia lamblia
AKSAPSIDQRELNPNESATSPD

SEQ ID NO: 3099097 - protein, 10 aa, Giardia lamblia
AKSARTGTRM

SEQ ID NO: 3099098 - protein, 8 aa, Giardia lamblia
AKSASRPI

SEQ ID NO: 3099099 - protein, 7 aa, Giardia lamblia
AKSATEL

SEQ ID NO: 3099100 - protein, 8 aa, Giardia lamblia
AKSCKQSE

SEQ ID NO: 3099101 - protein, 18 aa, Giardia lamblia
AKSDDLAKAVESSLGPLK

SEQ ID NO: 3099102 - protein, 7 aa, Giardia lamblia
AKSDLAD

SEQ ID NO: 3099103 - protein, 13 aa, Giardia lamblia
AKSDSYASRRERE

SEQ ID NO: 3099104 - protein, 10 aa, Giardia lamblia
AKSDTAAQDW

SEQ ID NO: 3099105 - protein, 16 aa, Giardia lamblia
AKSEAQHTEEQQIPES

SEQ ID NO: 3099106 - protein, 8 aa, Giardia lamblia
AKSEDQRD

SEQ ID NO: 3099107 - protein, 9 aa, Giardia lamblia
AKSEKDGRE

SEQ ID NO: 3099108 - protein, 6 aa, Giardia lamblia
AKSGAV

SEQ ID NO: 3099109 - protein, 8 aa, Giardia lamblia
AKSGKGKT

SEQ ID NO: 3099110 - protein, 16 aa, Giardia lamblia
AKSGPVSPAQLQQSAT

SEQ ID NO: 3099111 - protein, 6 aa, Giardia lamblia
AKSGRE

SEQ ID NO: 3099112 - protein, 13 aa, Giardia lamblia
AKSGTIPPKPPSV

SEQ ID NO: 3099113 - protein, 12 aa, Giardia lamblia
AKSHSANLPGRV

SEQ ID NO: 3099114 - protein, 4 aa, Giardia lamblia
AKSI

SEQ ID NO: 3099115 - protein, 9 aa, Giardia lamblia
AKSKGVHDD

SEQ ID NO: 3099116 - protein, 13 aa, Giardia lamblia
AKSKNIRDMLDMI

SEQ ID NO: 3099117 - protein, 10 aa, Giardia lamblia
AKSKTTVSSP

SEQ ID NO: 3099118 - protein, 4 aa, Giardia lamblia
AKSL

SEQ ID NO: 3099119 - protein, 5 aa, Giardia lamblia
AKSLG

SEQ ID NO: 3099120 - protein, 6 aa, Giardia lamblia
AKSLTE

SEQ ID NO: 3099121 - protein, 10 aa, Giardia lamblia
AKSNLTQKQK

SEQ ID NO: 3099122 - protein, 5 aa, Giardia lamblia
AKSNY

SEQ ID NO: 3099123 - protein, 10 aa, Giardia lamblia
AKSPAGVQDS

SEQ ID NO: 3099124 - protein, 7 aa, Giardia lamblia
AKSPAST

SEQ ID NO: 3099125 - protein, 8 aa, Giardia lamblia
AKSPIQAN

SEQ ID NO: 3099126 - protein, 7 aa, Giardia lamblia
AKSPKGS

SEQ ID NO: 3099127 - protein, 36 aa, Giardia lamblia
AKSPSDGLCRSKSRGTEYSSKARERYDASSTTLPSL

SEQ ID NO: 3099128 - protein, 12 aa, Giardia lamblia
AKSQAYNEQEER

SEQ ID NO: 3099129 - protein, 24 aa, Giardia lamblia
AKSQRSQEQEDSATIRRRSAQDAL

SEQ ID NO: 3099130 - protein, 16 aa, Giardia lamblia
AKSRSSRRSRWDEDDD

SEQ ID NO: 3099131 - protein, 16 aa, Giardia lamblia
AKSRTLPGSTSGEPLL

SEQ ID NO: 3099132 - protein, 9 aa, Giardia lamblia
AKSRTLSTT

SEQ ID NO: 3099133 - protein, 23 aa, Giardia lamblia
AKSSKKASISRNAAYQQLKEENR

SEQ ID NO: 3099134 - protein, 17 aa, Giardia lamblia
AKSSQSNSAEKDQRPKF

SEQ ID NO: 3099135 - protein, 9 aa, Giardia lamblia
AKSSSTGKT

SEQ ID NO: 3099136 - protein, 6 aa, Giardia lamblia
AKSSVE

SEQ ID NO: 3099137 - protein, 10 aa, Giardia lamblia
AKSTGHGADA

SEQ ID NO: 3099138 - protein, 9 aa, Giardia lamblia
AKSTGKADF

SEQ ID NO: 3099139 - protein, 16 aa, Giardia lamblia
AKSTIDESAPATGSDP

SEQ ID NO: 3099140 - protein, 8 aa, Giardia lamblia
AKSTNQDL

SEQ ID NO: 3099141 - protein, 11 aa, Giardia lamblia
AKSTPEKEDRL

SEQ ID NO: 3099142 - protein, 9 aa, Giardia lamblia
AKSTSVRTK

SEQ ID NO: 3099143 - protein, 22 aa, Giardia lamblia
AKSVTSSKPSRLGRRSSSSLAL

SEQ ID NO: 3099144 - protein, 6 aa, Giardia lamblia
AKSYEY

SEQ ID NO: 3099145 - protein, 9 aa, Giardia lamblia
AKTAIQEDK

SEQ ID NO: 3099146 - protein, 5 aa, Giardia lamblia
AKTAK

SEQ ID NO: 3099147 - protein, 14 aa, Giardia lamblia
AKTDEIRNLLDAFQ

SEQ ID NO: 3099148 - protein, 7 aa, Giardia lamblia
AKTDTLR

SEQ ID NO: 3099149 - protein, 19 aa, Giardia lamblia
AKTDTLSSTLPPPLTAETT

SEQ ID NO: 3099150 - protein, 8 aa, Giardia lamblia
AKTEGREV

SEQ ID NO: 3099151 - protein, 6 aa, Giardia lamblia
AKTESA

SEQ ID NO: 3099152 - protein, 8 aa, Giardia lamblia
AKTESERA

SEQ ID NO: 3099153 - protein, 11 aa, Giardia lamblia
AKTGASKSRDT

SEQ ID NO: 3099154 - protein, 8 aa, Giardia lamblia
AKTGSGKT

SEQ ID NO: 3099155 - protein, 10 aa, Giardia lamblia
AKTIKGPKGV

SEQ ID NO: 3099156 - protein, 11 aa, Giardia lamblia
AKTKRKGAGSK

SEQ ID NO: 3099157 - protein, 13 aa, Giardia lamblia
AKTKTLSAMKSAN

SEQ ID NO: 3099158 - protein, 14 aa, Giardia lamblia
AKTKTTGDKKALYE

SEQ ID NO: 3099159 - protein, 11 aa, Giardia lamblia
AKTLSKNMPDV

SEQ ID NO: 3099160 - protein, 8 aa, Giardia lamblia
AKTNEEAQ

SEQ ID NO: 3099161 - protein, 12 aa, Giardia lamblia
AKTPLVNPDPKH

SEQ ID NO: 3099162 - protein, 9 aa, Giardia lamblia
AKTPSTTKS

SEQ ID NO: 3099163 - protein, 5 aa, Giardia lamblia
AKTQF

SEQ ID NO: 3099164 - protein, 8 aa, Giardia lamblia
AKTSADID

SEQ ID NO: 3099165 - protein, 13 aa, Giardia lamblia
AKTSEARELLSLF

SEQ ID NO: 3099166 - protein, 8 aa, Giardia lamblia
AKTSPSQL

SEQ ID NO: 3099167 - protein, 9 aa, Giardia lamblia
AKTSSLADT

SEQ ID NO: 3099168 - protein, 18 aa, Giardia lamblia
AKTSTLSSTSSNIARPDT

SEQ ID NO: 3099169 - protein, 6 aa, Giardia lamblia
AKTSVR

SEQ ID NO: 3099170 - protein, 12 aa, Giardia lamblia
AKTTATNSNNEK

SEQ ID NO: 3099171 - protein, 6 aa, Giardia lamblia
AKTTID

SEQ ID NO: 3099172 - protein, 14 aa, Giardia lamblia
AKTTLNTKKQDAIK

SEQ ID NO: 3099173 - protein, 12 aa, Giardia lamblia
AKTVAPNALDRG

SEQ ID NO: 3099174 - protein, 31 aa, Giardia lamblia
AKVASRQEPSVSKDRPAGSASVGSNSRQWND

SEQ ID NO: 3099175 - protein, 7 aa, Giardia lamblia
AKVGAPS

SEQ ID NO: 3099176 - protein, 14 aa, Giardia lamblia
AKVKQGARPAIPAH

SEQ ID NO: 3099177 - protein, 7 aa, Giardia lamblia
AKVKRGV

SEQ ID NO: 3099178 - protein, 38 aa, Giardia lamblia
AKVPPNKRLASSSKMASAHPGSGSKDVVKGPDQLETTR

SEQ ID NO: 3099179 - protein, 11 aa, Giardia lamblia
AKVPSDISSRD

SEQ ID NO: 3099180 - protein, 15 aa, Giardia lamblia
AKVRTNAGNLSSIPG

SEQ ID NO: 3099181 - protein, 10 aa, Giardia lamblia
AKVSEENKEH

SEQ ID NO: 3099182 - protein, 10 aa, Giardia lamblia
AKVTPSTTRE

SEQ ID NO: 3099183 - protein, 8 aa, Giardia lamblia
AKYDDESF

SEQ ID NO: 3099184 - protein, 23 aa, Giardia lamblia
AKYGGTDPTSSSVVGTSSNVPPH

SEQ ID NO: 3099185 - protein, 8 aa, Giardia lamblia
AKYGNSRI

SEQ ID NO: 3099186 - protein, 7 aa, Giardia lamblia
AKYGSPE

SEQ ID NO: 3099187 - protein, 5 aa, Giardia lamblia
AKYKE

SEQ ID NO: 3099188 - protein, 7 aa, Giardia lamblia
AKYPITG

SEQ ID NO: 3099189 - protein, 6 aa, Giardia lamblia
AKYPRQ

SEQ ID NO: 3099190 - protein, 7 aa, Giardia lamblia
AKYSGRL

SEQ ID NO: 3099191 - protein, 15 aa, Giardia lamblia
AKYTNSNGVGTERPA

SEQ ID NO: 3099192 - protein, 8 aa, Giardia lamblia
AKYTRGKA

SEQ ID NO: 3099193 - protein, 7 aa, Giardia lamblia
ALAAERA

SEQ ID NO: 3099194 - protein, 18 aa, Giardia lamblia
ALAAGGQSKFQDSSITGT

SEQ ID NO: 3099195 - protein, 4 aa, Giardia lamblia
ALAD

SEQ ID NO: 3099196 - protein, 10 aa, Giardia lamblia
ALAENKAGSM

SEQ ID NO: 3099197 - protein, 11 aa, Giardia lamblia
ALAESRSKRTR

SEQ ID NO: 3099198 - protein, 12 aa, Giardia lamblia
ALAETKHEKEHL

SEQ ID NO: 3099199 - protein, 4 aa, Giardia lamblia
ALAK

SEQ ID NO: 3099200 - protein, 7 aa, Giardia lamblia
ALAPSNS

SEQ ID NO: 3099201 - protein, 10 aa, Giardia lamblia
ALASKQSGYE

SEQ ID NO: 3099202 - protein, 12 aa, Giardia lamblia
ALASKRSKVNPV

SEQ ID NO: 3099203 - protein, 5 aa, Giardia lamblia
ALASN

SEQ ID NO: 3099204 - protein, 9 aa, Giardia lamblia
ALASNNATM

SEQ ID NO: 3099205 - protein, 9 aa, Giardia lamblia
ALASSGVDN

SEQ ID NO: 3099206 - protein, 8 aa, Giardia lamblia
ALASSKAE

SEQ ID NO: 3099207 - protein, 8 aa, Giardia lamblia
ALATSSRL

SEQ ID NO: 3099208 - protein, 6 aa, Giardia lamblia
ALDAEK

SEQ ID NO: 3099209 - protein, 13 aa, Giardia lamblia
ALDDTAKKSPVGA

SEQ ID NO: 3099210 - protein, 7 aa, Giardia lamblia
ALDDTRQ

SEQ ID NO: 3099211 - protein, 6 aa, Giardia lamblia
ALDEKA

SEQ ID NO: 3099212 - protein, 6 aa, Giardia lamblia
ALDEKN

SEQ ID NO: 3099213 - protein, 7 aa, Giardia lamblia
ALDEPTW

SEQ ID NO: 3099214 - protein, 32 aa, Giardia lamblia
ALDESSAGMVGKGAGAKQQKAGHPSLDPKNQV

SEQ ID NO: 3099215 - protein, 31 aa, Giardia lamblia
ALDGRAGRIADGEKISTYTADYSKPEIERPL

SEQ ID NO: 3099216 - protein, 6 aa, Giardia lamblia
ALDGTT

SEQ ID NO: 3099217 - protein, 7 aa, Giardia lamblia
ALDHGKK

SEQ ID NO: 3099218 - protein, 10 aa, Giardia lamblia
ALDQGQKYYD

SEQ ID NO: 3099219 - protein, 16 aa, Giardia lamblia
ALDSRSEELTRQLEGL

SEQ ID NO: 3099220 - protein, 10 aa, Giardia lamblia
ALDSTQKSSF

SEQ ID NO: 3099221 - protein, 4 aa, Giardia lamblia
ALDT

SEQ ID NO: 3099222 - protein, 5 aa, Giardia lamblia
ALEDN

SEQ ID NO: 3099223 - protein, 7 aa, Giardia lamblia
ALEDQTK

SEQ ID NO: 3099224 - protein, 7 aa, Giardia lamblia
ALEEEKE

SEQ ID NO: 3099225 - protein, 11 aa, Giardia lamblia
ALEEQKKEFEA

SEQ ID NO: 3099226 - protein, 13 aa, Giardia lamblia
ALEGRTKNTYPQC

SEQ ID NO: 3099227 - protein, 38 aa, Giardia lamblia
ALEKKYSSATGSRDSSYSHAKSERLTSTTDELSIDSEG

SEQ ID NO: 3099228 - protein, 20 aa, Giardia lamblia
ALEKRKINATQAGSSSHGDN

SEQ ID NO: 3099229 - protein, 9 aa, Giardia lamblia
ALENQGKEH

SEQ ID NO: 3099230 - protein, 14 aa, Giardia lamblia
ALEPADDGPDAPAV

SEQ ID NO: 3099231 - protein, 13 aa, Giardia lamblia
ALEPTDFSASDEM

SEQ ID NO: 3099232 - protein, 20 aa, Giardia lamblia
ALERQEDHAAEMRMDKIRIT

SEQ ID NO: 3099233 - protein, 23 aa, Giardia lamblia
ALERRESHKLREPRTAEEGEDIE

SEQ ID NO: 3099234 - protein, 5 aa, Giardia lamblia
ALESD

SEQ ID NO: 3099235 - protein, 11 aa, Giardia lamblia
ALESDKLRQDN

SEQ ID NO: 3099236 - protein, 11 aa, Giardia lamblia
ALESGQAERGD

SEQ ID NO: 3099237 - protein, 7 aa, Giardia lamblia
ALESLDS

SEQ ID NO: 3099238 - protein, 10 aa, Giardia lamblia
ALESNTDADT

SEQ ID NO: 3099239 - protein, 9 aa, Giardia lamblia
ALETEATSL

SEQ ID NO: 3099240 - protein, 7 aa, Giardia lamblia
ALETKAA

SEQ ID NO: 3099241 - protein, 8 aa, Giardia lamblia
ALEYGDGT

SEQ ID NO: 3099242 - protein, 5 aa, Giardia lamblia
ALGEE

SEQ ID NO: 3099243 - protein, 8 aa, Giardia lamblia
ALGGHTND

SEQ ID NO: 3099244 - protein, 7 aa, Giardia lamblia
ALGGKEP

SEQ ID NO: 3099245 - protein, 7 aa, Giardia lamblia
ALGGKTP

SEQ ID NO: 3099246 - protein, 11 aa, Giardia lamblia
ALGGSSDEEAI

SEQ ID NO: 3099247 - protein, 12 aa, Giardia lamblia
ALGNVKGISEAK

SEQ ID NO: 3099248 - protein, 11 aa, Giardia lamblia
ALGPAAATKGV

SEQ ID NO: 3099249 - protein, 6 aa, Giardia lamblia
ALGPYK

SEQ ID NO: 3099250 - protein, 22 aa, Giardia lamblia
ALGRSLSAKDLDGVDSPSKYTA

SEQ ID NO: 3099251 - protein, 5 aa, Giardia lamblia
ALGST

SEQ ID NO: 3099252 - protein, 11 aa, Giardia lamblia
ALGSYKAEATE

SEQ ID NO: 3099253 - protein, 13 aa, Giardia lamblia
ALKDASGSSVQGR

SEQ ID NO: 3099254 - protein, 18 aa, Giardia lamblia
ALKDKRNNFAEGGDFGYR

SEQ ID NO: 3099255 - protein, 23 aa, Giardia lamblia
ALKEKDSTVQELERTRQQVREAE

SEQ ID NO: 3099256 - protein, 7 aa, Giardia lamblia
ALKEKYR

SEQ ID NO: 3099257 - protein, 16 aa, Giardia lamblia
ALKEQQDRARAADEAL

SEQ ID NO: 3099258 - protein, 9 aa, Giardia lamblia
ALKGGSEES

SEQ ID NO: 3099259 - protein, 46 aa, Giardia lamblia
ALKGPGSGLIEEEKKRNATVRQSKKERPRDSQRNKSKTDTEAAQDS

SEQ ID NO: 3099260 - protein, 10 aa, Giardia lamblia
ALKKRQQVKR

SEQ ID NO: 3099261 - protein, 8 aa, Giardia lamblia
ALKSGPAE

SEQ ID NO: 3099262 - protein, 15 aa, Giardia lamblia
ALKTAGAAIGTPNPQ

SEQ ID NO: 3099263 - protein, 5 aa, Giardia lamblia
ALKTE

SEQ ID NO: 3099264 - protein, 14 aa, Giardia lamblia
ALKTERSVAPIRKQ

SEQ ID NO: 3099265 - protein, 8 aa, Giardia lamblia
ALNGQTPL

SEQ ID NO: 3099266 - protein, 10 aa, Giardia lamblia
ALNGSDVSDY

SEQ ID NO: 3099267 - protein, 10 aa, Giardia lamblia
ALNHRRTTSV

SEQ ID NO: 3099268 - protein, 5 aa, Giardia lamblia
ALNNA

SEQ ID NO: 3099269 - protein, 8 aa, Giardia lamblia
ALNPDFDP

SEQ ID NO: 3099270 - protein, 8 aa, Giardia lamblia
ALNRSSTK

SEQ ID NO: 3099271 - protein, 6 aa, Giardia lamblia
ALNSAN

SEQ ID NO: 3099272 - protein, 6 aa, Giardia lamblia
ALNTMD

SEQ ID NO: 3099273 - protein, 10 aa, Giardia lamblia
ALPADTSSEF

SEQ ID NO: 3099274 - protein, 6 aa, Giardia lamblia
ALPDGR

SEQ ID NO: 3099275 - protein, 5 aa, Giardia lamblia
ALPDK

SEQ ID NO: 3099276 - protein, 5 aa, Giardia lamblia
ALPEY

SEQ ID NO: 3099277 - protein, 14 aa, Giardia lamblia
ALPGKEKTSESCRD

SEQ ID NO: 3099278 - protein, 8 aa, Giardia lamblia
ALPGQPAD

SEQ ID NO: 3099279 - protein, 10 aa, Giardia lamblia
ALPKDASSRV

SEQ ID NO: 3099280 - protein, 7 aa, Giardia lamblia
ALPKNPT

SEQ ID NO: 3099281 - protein, 6 aa, Giardia lamblia
ALPNEV

SEQ ID NO: 3099282 - protein, 5 aa, Giardia lamblia
ALPNG

SEQ ID NO: 3099283 - protein, 4 aa, Giardia lamblia
ALPP

SEQ ID NO: 3099284 - protein, 6 aa, Giardia lamblia
ALPPED

SEQ ID NO: 3099285 - protein, 31 aa, Giardia lamblia
ALPPPEPEPVPEPDERTEEGEGTEDSYDNPA

SEQ ID NO: 3099286 - protein, 9 aa, Giardia lamblia
ALPPPPPYL

SEQ ID NO: 3099287 - protein, 12 aa, Giardia lamblia
ALPPPVQPCGSQ

SEQ ID NO: 3099288 - protein, 10 aa, Giardia lamblia
ALPPSRPVGA

SEQ ID NO: 3099289 - protein, 5 aa, Giardia lamblia
ALPPV

SEQ ID NO: 3099290 - protein, 15 aa, Giardia lamblia
ALPQRSSSQGHRPAD

SEQ ID NO: 3099291 - protein, 22 aa, Giardia lamblia
ALPQRTPRKSSETNYKETRSVN

SEQ ID NO: 3099292 - protein, 10 aa, Giardia lamblia
ALPQSGQAAA

SEQ ID NO: 3099293 - protein, 15 aa, Giardia lamblia
ALPQTDMESNRPASL

SEQ ID NO: 3099294 - protein, 16 aa, Giardia lamblia
ALPRGKESSDGVAIEQ

SEQ ID NO: 3099295 - protein, 4 aa, Giardia lamblia
ALPS

SEQ ID NO: 3099296 - protein, 21 aa, Giardia lamblia
ALPSESTAPPRSNTSTAPPRI

SEQ ID NO: 3099297 - protein, 6 aa, Giardia lamblia
ALPSET

SEQ ID NO: 3099298 - protein, 6 aa, Giardia lamblia
ALPSSL

SEQ ID NO: 3099299 - protein, 6 aa, Giardia lamblia
ALPTQT

SEQ ID NO: 3099300 - protein, 6 aa, Giardia lamblia
ALQADQ

SEQ ID NO: 3099301 - protein, 14 aa, Giardia lamblia
ALQAQRDTHEAESA

SEQ ID NO: 3099302 - protein, 10 aa, Giardia lamblia
ALQDTEERCR

SEQ ID NO: 3099303 - protein, 5 aa, Giardia lamblia
ALQHE

SEQ ID NO: 3099304 - protein, 6 aa, Giardia lamblia
ALQKSG

SEQ ID NO: 3099305 - protein, 11 aa, Giardia lamblia
ALQNKQGQTPL

SEQ ID NO: 3099306 - protein, 6 aa, Giardia lamblia
ALQPSF

SEQ ID NO: 3099307 - protein, 20 aa, Giardia lamblia
ALQRSEREVAADERVTDKSA

SEQ ID NO: 3099308 - protein, 6 aa, Giardia lamblia
ALQRTR

SEQ ID NO: 3099309 - protein, 4 aa, Giardia lamblia
ALQS

SEQ ID NO: 3099310 - protein, 6 aa, Giardia lamblia
ALQSHA

SEQ ID NO: 3099311 - protein, 11 aa, Giardia lamblia
ALQTDKDSGIT

SEQ ID NO: 3099312 - protein, 8 aa, Giardia lamblia
ALQTTKRS

SEQ ID NO: 3099313 - protein, 12 aa, Giardia lamblia
ALRAESPDFSPP

SEQ ID NO: 3099314 - protein, 4 aa, Giardia lamblia
ALRD

SEQ ID NO: 3099315 - protein, 11 aa, Giardia lamblia
ALRDKDAELSL

SEQ ID NO: 3099316 - protein, 22 aa, Giardia lamblia
ALRDSSKTQRTNAYEQDSSDQL

SEQ ID NO: 3099317 - protein, 13 aa, Giardia lamblia
ALRGGDPGHPGAV

SEQ ID NO: 3099318 - protein, 6 aa, Giardia lamblia
ALRPGE

SEQ ID NO: 3099319 - protein, 6 aa, Giardia lamblia
ALRSDS

SEQ ID NO: 3099320 - protein, 5 aa, Giardia lamblia
ALRSS

SEQ ID NO: 3099321 - protein, 6 aa, Giardia lamblia
ALRTEQ

SEQ ID NO: 3099322 - protein, 18 aa, Giardia lamblia
ALSAASQEVFSESSQHSQ

SEQ ID NO: 3099323 - protein, 10 aa, Giardia lamblia
ALSADSPLSR

SEQ ID NO: 3099324 - protein, 10 aa, Giardia lamblia
ALSAPHSTNV

SEQ ID NO: 3099325 - protein, 9 aa, Giardia lamblia
ALSAPQFTP

SEQ ID NO: 3099326 - protein, 6 aa, Giardia lamblia
ALSCPS

SEQ ID NO: 3099327 - protein, 4 aa, Giardia lamblia
ALSE

SEQ ID NO: 3099328 - protein, 13 aa, Giardia lamblia
ALSESSNTSFAKG

SEQ ID NO: 3099329 - protein, 6 aa, Giardia lamblia
ALSGGS

SEQ ID NO: 3099330 - protein, 10 aa, Giardia lamblia
ALSGISTPKR

SEQ ID NO: 3099331 - protein, 6 aa, Giardia lamblia
ALSKDD

SEQ ID NO: 3099332 - protein, 10 aa, Giardia lamblia
ALSKRPSSAK

SEQ ID NO: 3099333 - protein, 9 aa, Giardia lamblia
ALSKSGCTS

SEQ ID NO: 3099334 - protein, 11 aa, Giardia lamblia
ALSNGCPDTRD

SEQ ID NO: 3099335 - protein, 23 aa, Giardia lamblia
ALSNQASKHDLPLDNSSTDPEKG

SEQ ID NO: 3099336 - protein, 6 aa, Giardia lamblia
ALSNTT

SEQ ID NO: 3099337 - protein, 8 aa, Giardia lamblia
ALSPDDSY

SEQ ID NO: 3099338 - protein, 10 aa, Giardia lamblia
ALSPEEQETE

SEQ ID NO: 3099339 - protein, 16 aa, Giardia lamblia
ALSPSRDPACNGSSMP

SEQ ID NO: 3099340 - protein, 8 aa, Giardia lamblia
ALSPVSGR

SEQ ID NO: 3099341 - protein, 14 aa, Giardia lamblia
ALSQRSQRRSRRSV

SEQ ID NO: 3099342 - protein, 9 aa, Giardia lamblia
ALSSATETI

SEQ ID NO: 3099343 - protein, 17 aa, Giardia lamblia
ALSSGKNDPEAQLLADE

SEQ ID NO: 3099344 - protein, 5 aa, Giardia lamblia
ALSSK

SEQ ID NO: 3099345 - protein, 11 aa, Giardia lamblia
ALSSQNSSTIR

SEQ ID NO: 3099346 - protein, 17 aa, Giardia lamblia
ALSSSGLQTKAVSSPGQ

SEQ ID NO: 3099347 - protein, 13 aa, Giardia lamblia
ALSSTKQNSNPKA

SEQ ID NO: 3099348 - protein, 16 aa, Giardia lamblia
ALSTQTKLSEKQSDDI

SEQ ID NO: 3099349 - protein, 13 aa, Giardia lamblia
ALTADERQKFDST

SEQ ID NO: 3099350 - protein, 5 aa, Giardia lamblia
ALTAQ

SEQ ID NO: 3099351 - protein, 5 aa, Giardia lamblia
ALTAS

SEQ ID NO: 3099352 - protein, 9 aa, Giardia lamblia
ALTDSGRSN

SEQ ID NO: 3099353 - protein, 23 aa, Giardia lamblia
ALTDTAAEIQQELEGAASSVRST

SEQ ID NO: 3099354 - protein, 4 aa, Giardia lamblia
ALTG

SEQ ID NO: 3099355 - protein, 14 aa, Giardia lamblia
ALTGASKKENRSDW

SEQ ID NO: 3099356 - protein, 16 aa, Giardia lamblia
ALTGQQEGEEPLGPSV

SEQ ID NO: 3099357 - protein, 7 aa, Giardia lamblia
ALTGSRD

SEQ ID NO: 3099358 - protein, 9 aa, Giardia lamblia
ALTNNDTNA

SEQ ID NO: 3099359 - protein, 19 aa, Giardia lamblia
ALTNSTANSVLSTSEAGAH

SEQ ID NO: 3099360 - protein, 8 aa, Giardia lamblia
ALTPGEDA

SEQ ID NO: 3099361 - protein, 14 aa, Giardia lamblia
ALTPPYTSLPEETT

SEQ ID NO: 3099362 - protein, 6 aa, Giardia lamblia
ALTPTD

SEQ ID NO: 3099363 - protein, 12 aa, Giardia lamblia
ALTRENEAHRAE

SEQ ID NO: 3099364 - protein, 8 aa, Giardia lamblia
ALTRESQA

SEQ ID NO: 3099365 - protein, 10 aa, Giardia lamblia
ALTSGLSSSI

SEQ ID NO: 3099366 - protein, 32 aa, Giardia lamblia
ALTSIGKKGSASDKSKISAHYGSKTQDSTRSA

SEQ ID NO: 3099367 - protein, 7 aa, Giardia lamblia
ALTSTSN

SEQ ID NO: 3099368 - protein, 4 aa, Giardia lamblia
ALTT

SEQ ID NO: 3099369 - protein, 10 aa, Giardia lamblia
ALTTEEGRPF

SEQ ID NO: 3099370 - protein, 6 aa, Giardia lamblia
ALTTTL

SEQ ID NO: 3099371 - protein, 15 aa, Giardia lamblia
ALYQGTPSQGASGQV

SEQ ID NO: 3099372 - protein, 33 aa, Giardia lamblia
AMAGSKSQRDQAYKGYETTQYNQRGEGSNSNVQ

SEQ ID NO: 3099373 - protein, 5 aa, Giardia lamblia
AMANR

SEQ ID NO: 3099374 - protein, 9 aa, Giardia lamblia
AMDPSTTSH

SEQ ID NO: 3099375 - protein, 6 aa, Giardia lamblia
AMDPTS

SEQ ID NO: 3099376 - protein, 4 aa, Giardia lamblia
AMEA

SEQ ID NO: 3099377 - protein, 10 aa, Giardia lamblia
AMEANDANYK

SEQ ID NO: 3099378 - protein, 12 aa, Giardia lamblia
AMENDSNETKKR

SEQ ID NO: 3099379 - protein, 10 aa, Giardia lamblia
AMESANSAHQ

SEQ ID NO: 3099380 - protein, 9 aa, Giardia lamblia
AMGDSAENH

SEQ ID NO: 3099381 - protein, 6 aa, Giardia lamblia
AMGTES

SEQ ID NO: 3099382 - protein, 23 aa, Giardia lamblia
AMKEERGGERVSRSYDESNEVEK

SEQ ID NO: 3099383 - protein, 7 aa, Giardia lamblia
AMKETAD

SEQ ID NO: 3099384 - protein, 8 aa, Giardia lamblia
AMKSSGPR

SEQ ID NO: 3099385 - protein, 7 aa, Giardia lamblia
AMKTQGK

SEQ ID NO: 3099386 - protein, 10 aa, Giardia lamblia
AMNPSTTFPK

SEQ ID NO: 3099387 - protein, 7 aa, Giardia lamblia
AMPENDT

SEQ ID NO: 3099388 - protein, 9 aa, Giardia lamblia
AMPGFGGSF

SEQ ID NO: 3099389 - protein, 26 aa, Giardia lamblia
AMPSNARTYPQPVNARKRRHEPPRTS

SEQ ID NO: 3099390 - protein, 15 aa, Giardia lamblia
AMPTAPTDSVQHEDG

SEQ ID NO: 3099391 - protein, 19 aa, Giardia lamblia
AMPTPTTTAAAKTAQADAL

SEQ ID NO: 3099392 - protein, 7 aa, Giardia lamblia
AMQDEDG

SEQ ID NO: 3099393 - protein, 26 aa, Giardia lamblia
AMQSQASQEENKPQFKEASTTPQASG

SEQ ID NO: 3099394 - protein, 8 aa, Giardia lamblia
AMQTQPKR

SEQ ID NO: 3099395 - protein, 14 aa, Giardia lamblia
AMRGRTMARAFAGS

SEQ ID NO: 3099396 - protein, 6 aa, Giardia lamblia
AMRPPS

SEQ ID NO: 3099397 - protein, 6 aa, Giardia lamblia
AMSADS

SEQ ID NO: 3099398 - protein, 8 aa, Giardia lamblia
AMSPDNQG

SEQ ID NO: 3099399 - protein, 26 aa, Giardia lamblia
AMSPSSNKKLNRPEERMKDKEQPTTR

SEQ ID NO: 3099400 - protein, 29 aa, Giardia lamblia
AMSPTADRSGTFTKQSVESQSESSSPYLN

SEQ ID NO: 3099401 - protein, 12 aa, Giardia lamblia
AMSTAGGARYET

SEQ ID NO: 3099402 - protein, 4 aa, Giardia lamblia
AMTD

SEQ ID NO: 3099403 - protein, 14 aa, Giardia lamblia
AMTPGTGAPGSPMN

SEQ ID NO: 3099404 - protein, 12 aa, Giardia lamblia
AMTSEQKAWAEN

SEQ ID NO: 3099405 - protein, 11 aa, Giardia lamblia
AMTSSADPSLA

SEQ ID NO: 3099406 - protein, 32 aa, Giardia lamblia
AMVPPGGSTDTVSSQQSDVPTVQNKSPITTFG

SEQ ID NO: 3099407 - protein, 16 aa, Giardia lamblia
ANAAAAAATDKSAAVA

SEQ ID NO: 3099408 - protein, 7 aa, Giardia lamblia
ANAAASG

SEQ ID NO: 3099409 - protein, 6 aa, Giardia lamblia
ANAADA

SEQ ID NO: 3099410 - protein, 12 aa, Giardia lamblia
ANAANKQKYDAS

SEQ ID NO: 3099411 - protein, 9 aa, Giardia lamblia
ANAAREGDA

SEQ ID NO: 3099412 - protein, 6 aa, Giardia lamblia
ANAARK

SEQ ID NO: 3099413 - protein, 20 aa, Giardia lamblia
ANAAVKGVTAGGSGRGTEAL

SEQ ID NO: 3099414 - protein, 8 aa, Giardia lamblia
ANADDTTL

SEQ ID NO: 3099415 - protein, 13 aa, Giardia lamblia
ANADEAEAAAENA

SEQ ID NO: 3099416 - protein, 10 aa, Giardia lamblia
ANADLATSDA

SEQ ID NO: 3099417 - protein, 16 aa, Giardia lamblia
ANADQRAGRAGRTAPG

SEQ ID NO: 3099418 - protein, 10 aa, Giardia lamblia
ANAEAESSTI

SEQ ID NO: 3099419 - protein, 7 aa, Giardia lamblia
ANAEGRT

SEQ ID NO: 3099420 - protein, 11 aa, Giardia lamblia
ANAEPNPNEWS

SEQ ID NO: 3099421 - protein, 8 aa, Giardia lamblia
ANAETRAK

SEQ ID NO: 3099422 - protein, 7 aa, Giardia lamblia
ANAGGHR

SEQ ID NO: 3099423 - protein, 22 aa, Giardia lamblia
ANAGSGSEVEDKEAYDGEGNMG

SEQ ID NO: 3099424 - protein, 6 aa, Giardia lamblia
ANAPDA

SEQ ID NO: 3099425 - protein, 6 aa, Giardia lamblia
ANAQQT

SEQ ID NO: 3099426 - protein, 12 aa, Giardia lamblia
ANARASGDASDV

SEQ ID NO: 3099427 - protein, 8 aa, Giardia lamblia
ANARDSKG

SEQ ID NO: 3099428 - protein, 10 aa, Giardia lamblia
ANARPTSRPD

SEQ ID NO: 3099429 - protein, 4 aa, Giardia lamblia
ANAS

SEQ ID NO: 3099430 - protein, 19 aa, Giardia lamblia
ANASGDIQEELQNARQEAV

SEQ ID NO: 3099431 - protein, 10 aa, Giardia lamblia
ANASPATVSR

SEQ ID NO: 3099432 - protein, 7 aa, Giardia lamblia
ANASSLS

SEQ ID NO: 3099433 - protein, 19 aa, Giardia lamblia
ANASTDARGVMPSGSVEAQ

SEQ ID NO: 3099434 - protein, 17 aa, Giardia lamblia
ANATNSQDSMNREEETL

SEQ ID NO: 3099435 - protein, 4 aa, Giardia lamblia
ANDA

SEQ ID NO: 3099436 - protein, 16 aa, Giardia lamblia
ANDAARRLAKETGQPV

SEQ ID NO: 3099437 - protein, 5 aa, Giardia lamblia
ANDDL

SEQ ID NO: 3099438 - protein, 9 aa, Giardia lamblia
ANDENTSLR

SEQ ID NO: 3099439 - protein, 7 aa, Giardia lamblia
ANDGTEC

SEQ ID NO: 3099440 - protein, 10 aa, Giardia lamblia
ANDKAKASSL

SEQ ID NO: 3099441 - protein, 10 aa, Giardia lamblia
ANDNSSQISA

SEQ ID NO: 3099442 - protein, 9 aa, Giardia lamblia
ANDPGAEKL

SEQ ID NO: 3099443 - protein, 18 aa, Giardia lamblia
ANDPLVGQGDIGNKHRPF

SEQ ID NO: 3099444 - protein, 14 aa, Giardia lamblia
ANDQPTHEHGASRW

SEQ ID NO: 3099445 - protein, 6 aa, Giardia lamblia
ANDRPE

SEQ ID NO: 3099446 - protein, 9 aa, Giardia lamblia
ANDSDATGI

SEQ ID NO: 3099447 - protein, 9 aa, Giardia lamblia
ANDSEEEQD

SEQ ID NO: 3099448 - protein, 7 aa, Giardia lamblia
ANDSSYN

SEQ ID NO: 3099449 - protein, 5 aa, Giardia lamblia
ANDSV

SEQ ID NO: 3099450 - protein, 9 aa, Giardia lamblia
ANDTAEDHG

SEQ ID NO: 3099451 - protein, 7 aa, Giardia lamblia
ANDVREQ

SEQ ID NO: 3099452 - protein, 9 aa, Giardia lamblia
ANEAAEKER

SEQ ID NO: 3099453 - protein, 11 aa, Giardia lamblia
ANEAGMDPKQF

SEQ ID NO: 3099454 - protein, 8 aa, Giardia lamblia
ANEANAIR

SEQ ID NO: 3099455 - protein, 6 aa, Giardia lamblia
ANEDVQ

SEQ ID NO: 3099456 - protein, 5 aa, Giardia lamblia
ANEEE

SEQ ID NO: 3099457 - protein, 5 aa, Giardia lamblia
ANEGA

SEQ ID NO: 3099458 - protein, 5 aa, Giardia lamblia
ANEIQ

SEQ ID NO: 3099459 - protein, 10 aa, Giardia lamblia
ANEKDKVNGM

SEQ ID NO: 3099460 - protein, 14 aa, Giardia lamblia
ANEKLSSSASEALG

SEQ ID NO: 3099461 - protein, 9 aa, Giardia lamblia
ANEKTACNK

SEQ ID NO: 3099462 - protein, 4 aa, Giardia lamblia
ANER

SEQ ID NO: 3099463 - protein, 8 aa, Giardia lamblia
ANERASSS

SEQ ID NO: 3099464 - protein, 7 aa, Giardia lamblia
ANERGET

SEQ ID NO: 3099465 - protein, 7 aa, Giardia lamblia
ANERRFN

SEQ ID NO: 3099466 - protein, 6 aa, Giardia lamblia
ANESYN

SEQ ID NO: 3099467 - protein, 34 aa, Giardia lamblia
ANETKTVRSIGTDSVPLGASVTSSAEHSNSGYAH

SEQ ID NO: 3099468 - protein, 5 aa, Giardia lamblia
ANETS

SEQ ID NO: 3099469 - protein, 9 aa, Giardia lamblia
ANFQDKQHK

SEQ ID NO: 3099470 - protein, 39 aa, Giardia lamblia
ANFTNGPTGDQESPQSATISASNNPRQTSDLNPVRPPNE

SEQ ID NO: 3099471 - protein, 11 aa, Giardia lamblia
ANGAGPHARQA

SEQ ID NO: 3099472 - protein, 5 aa, Giardia lamblia
ANGAI

SEQ ID NO: 3099473 - protein, 6 aa, Giardia lamblia
ANGDAD

SEQ ID NO: 3099474 - protein, 14 aa, Giardia lamblia
ANGDERLAKNSLGD

SEQ ID NO: 3099475 - protein, 9 aa, Giardia lamblia
ANGGSHKDH

SEQ ID NO: 3099476 - protein, 5 aa, Giardia lamblia
ANGHA

SEQ ID NO: 3099477 - protein, 6 aa, Giardia lamblia
ANGHPD

SEQ ID NO: 3099478 - protein, 5 aa, Giardia lamblia
ANGIS

SEQ ID NO: 3099479 - protein, 6 aa, Giardia lamblia
ANGKEL

SEQ ID NO: 3099480 - protein, 8 aa, Giardia lamblia
ANGKRISE

SEQ ID NO: 3099481 - protein, 7 aa, Giardia lamblia
ANGMGET

SEQ ID NO: 3099482 - protein, 11 aa, Giardia lamblia
ANGNQSSQARD

SEQ ID NO: 3099483 - protein, 9 aa, Giardia lamblia
ANGPMSASS

SEQ ID NO: 3099484 - protein, 4 aa, Giardia lamblia
ANGS

SEQ ID NO: 3099485 - protein, 8 aa, Giardia lamblia
ANGSGKST

SEQ ID NO: 3099486 - protein, 11 aa, Giardia lamblia
ANGVNNEARDR

SEQ ID NO: 3099487 - protein, 5 aa, Giardia lamblia
ANHAD

SEQ ID NO: 3099488 - protein, 6 aa, Giardia lamblia
ANHHSQ

SEQ ID NO: 3099489 - protein, 10 aa, Giardia lamblia
ANHKTDMPTD

SEQ ID NO: 3099490 - protein, 5 aa, Giardia lamblia
ANHPP

SEQ ID NO: 3099491 - protein, 4 aa, Giardia lamblia
ANHY

SEQ ID NO: 3099492 - protein, 6 aa, Giardia lamblia
ANIDKE

SEQ ID NO: 3099493 - protein, 8 aa, Giardia lamblia
ANIEKNSE

SEQ ID NO: 3099494 - protein, 8 aa, Giardia lamblia
ANIENKDN

SEQ ID NO: 3099495 - protein, 17 aa, Giardia lamblia
ANIETSVDTAKPSATPP

SEQ ID NO: 3099496 - protein, 4 aa, Giardia lamblia
ANIH

SEQ ID NO: 3099497 - protein, 12 aa, Giardia lamblia
ANIRRQQMDVDV

SEQ ID NO: 3099498 - protein, 10 aa, Giardia lamblia
ANISEENGKT

SEQ ID NO: 3099499 - protein, 7 aa, Giardia lamblia
ANITESN

SEQ ID NO: 3099500 - protein, 13 aa, Giardia lamblia
ANKEAKRKDLTGT

SEQ ID NO: 3099501 - protein, 6 aa, Giardia lamblia
ANKGDL

SEQ ID NO: 3099502 - protein, 6 aa, Giardia lamblia
ANKGDV

SEQ ID NO: 3099503 - protein, 5 aa, Giardia lamblia
ANKGI

SEQ ID NO: 3099504 - protein, 4 aa, Giardia lamblia
ANKK

SEQ ID NO: 3099505 - protein, 18 aa, Giardia lamblia
ANKKKKPGEGARKPPAQY

SEQ ID NO: 3099506 - protein, 13 aa, Giardia lamblia
ANKLTTKADARFG

SEQ ID NO: 3099507 - protein, 8 aa, Giardia lamblia
ANKQYNGA

SEQ ID NO: 3099508 - protein, 4 aa, Giardia lamblia
ANKR

SEQ ID NO: 3099509 - protein, 16 aa, Giardia lamblia
ANKRGDSTTEGDKETA

SEQ ID NO: 3099510 - protein, 7 aa, Giardia lamblia
ANKRKAK

SEQ ID NO: 3099511 - protein, 6 aa, Giardia lamblia
ANKSSM

SEQ ID NO: 3099512 - protein, 11 aa, Giardia lamblia
ANKTDAKQRFT

SEQ ID NO: 3099513 - protein, 5 aa, Giardia lamblia
ANKVE

SEQ ID NO: 3099514 - protein, 31 aa, Giardia lamblia
ANKVGHGTGSSSGQLSAKGSINYPSQKTSSQ

SEQ ID NO: 3099515 - protein, 8 aa, Giardia lamblia
ANKVQSSR

SEQ ID NO: 3099516 - protein, 5 aa, Giardia lamblia
ANLAA

SEQ ID NO: 3099517 - protein, 7 aa, Giardia lamblia
ANLDDAA

SEQ ID NO: 3099518 - protein, 38 aa, Giardia lamblia
ANLESKESRVTDRAQTESPNAKEGPDDEIERLGETSGN

SEQ ID NO: 3099519 - protein, 4 aa, Giardia lamblia
ANLI

SEQ ID NO: 3099520 - protein, 6 aa, Giardia lamblia
ANLKPP

SEQ ID NO: 3099521 - protein, 4 aa, Giardia lamblia
ANLP

SEQ ID NO: 3099522 - protein, 33 aa, Giardia lamblia
ANLPHDNAQAVARGEEEGTSGHSNKKQQQKAVR

SEQ ID NO: 3099523 - protein, 8 aa, Giardia lamblia
ANLPPGLS

SEQ ID NO: 3099524 - protein, 23 aa, Giardia lamblia
ANLPPTGPVQGNPGSPGHPQSPR

SEQ ID NO: 3099525 - protein, 6 aa, Giardia lamblia
ANLQSE

SEQ ID NO: 3099526 - protein, 7 aa, Giardia lamblia
ANLSREE

SEQ ID NO: 3099527 - protein, 8 aa, Giardia lamblia
ANLTRDDG

SEQ ID NO: 3099528 - protein, 20 aa, Giardia lamblia
ANMEDISDRGEDEHKQGAGI

SEQ ID NO: 3099529 - protein, 7 aa, Giardia lamblia
ANMPSTA

SEQ ID NO: 3099530 - protein, 20 aa, Giardia lamblia
ANMPTDTAAPGSNKMDTSKM

SEQ ID NO: 3099531 - protein, 8 aa, Giardia lamblia
ANMSEQDD

SEQ ID NO: 3099532 - protein, 10 aa, Giardia lamblia
ANNAKQTAAS

SEQ ID NO: 3099533 - protein, 10 aa, Giardia lamblia
ANNATTTASG

SEQ ID NO: 3099534 - protein, 6 aa, Giardia lamblia
ANNDGK

SEQ ID NO: 3099535 - protein, 4 aa, Giardia lamblia
ANNE

SEQ ID NO: 3099536 - protein, 18 aa, Giardia lamblia
ANNEADRLRTGELRKGQN

SEQ ID NO: 3099537 - protein, 13 aa, Giardia lamblia
ANNEANEKEIEKK

SEQ ID NO: 3099538 - protein, 6 aa, Giardia lamblia
ANNEDA

SEQ ID NO: 3099539 - protein, 4 aa, Giardia lamblia
ANNG

SEQ ID NO: 3099540 - protein, 6 aa, Giardia lamblia
ANNKLK

SEQ ID NO: 3099541 - protein, 6 aa, Giardia lamblia
ANNKND

SEQ ID NO: 3099542 - protein, 4 aa, Giardia lamblia
ANNP

SEQ ID NO: 3099543 - protein, 7 aa, Giardia lamblia
ANNPDKY

SEQ ID NO: 3099544 - protein, 5 aa, Giardia lamblia
ANNPE

SEQ ID NO: 3099545 - protein, 6 aa, Giardia lamblia
ANNPEA

SEQ ID NO: 3099546 - protein, 7 aa, Giardia lamblia
ANNPTDE

SEQ ID NO: 3099547 - protein, 7 aa, Giardia lamblia
ANNPTEE

SEQ ID NO: 3099548 - protein, 7 aa, Giardia lamblia
ANNQYNT

SEQ ID NO: 3099549 - protein, 6 aa, Giardia lamblia
ANNRPI

SEQ ID NO: 3099550 - protein, 9 aa, Giardia lamblia
ANNRPNDAG

SEQ ID NO: 3099551 - protein, 6 aa, Giardia lamblia
ANNSLQ

SEQ ID NO: 3099552 - protein, 4 aa, Giardia lamblia
ANNV

SEQ ID NO: 3099553 - protein, 64 aa, Giardia lamblia
ANPCPDADVAASGSISAQKKQGDTPVNVKTNANASPSSLSSKSNKSCRTSDSLSDSSQSKTDLP

SEQ ID NO: 3099554 - protein, 8 aa, Giardia lamblia
ANPDKETD

SEQ ID NO: 3099555 - protein, 9 aa, Giardia lamblia
ANPDTAPAE

SEQ ID NO: 3099556 - protein, 19 aa, Giardia lamblia
ANPDTPSTRRLRQSGRQAE

SEQ ID NO: 3099557 - protein, 12 aa, Giardia lamblia
ANPESDKRTTVG

SEQ ID NO: 3099558 - protein, 6 aa, Giardia lamblia
ANPFPN

SEQ ID NO: 3099559 - protein, 10 aa, Giardia lamblia
ANPGADLSKY

SEQ ID NO: 3099560 - protein, 9 aa, Giardia lamblia
ANPGGTYGD

SEQ ID NO: 3099561 - protein, 6 aa, Giardia lamblia
ANPLTN

SEQ ID NO: 3099562 - protein, 5 aa, Giardia lamblia
ANPQP

SEQ ID NO: 3099563 - protein, 6 aa, Giardia lamblia
ANPTLG

SEQ ID NO: 3099564 - protein, 5 aa, Giardia lamblia
ANPVT

SEQ ID NO: 3099565 - protein, 7 aa, Giardia lamblia
ANPYEVE

SEQ ID NO: 3099566 - protein, 7 aa, Giardia lamblia
ANPYRAS

SEQ ID NO: 3099567 - protein, 16 aa, Giardia lamblia
ANQATKDVQMSGGQRT

SEQ ID NO: 3099568 - protein, 7 aa, Giardia lamblia
ANQATKE

SEQ ID NO: 3099569 - protein, 9 aa, Giardia lamblia
ANQCNTQHG

SEQ ID NO: 3099570 - protein, 14 aa, Giardia lamblia
ANQDSREKRHVPYR

SEQ ID NO: 3099571 - protein, 5 aa, Giardia lamblia
ANQDT

SEQ ID NO: 3099572 - protein, 13 aa, Giardia lamblia
ANQDVRVQWIDYY

SEQ ID NO: 3099573 - protein, 4 aa, Giardia lamblia
ANQE

SEQ ID NO: 3099574 - protein, 13 aa, Giardia lamblia
ANQEETDTVDEEK

SEQ ID NO: 3099575 - protein, 12 aa, Giardia lamblia
ANQGPQEPDDAS

SEQ ID NO: 3099576 - protein, 5 aa, Giardia lamblia
ANQHS

SEQ ID NO: 3099577 - protein, 8 aa, Giardia lamblia
ANQKDKYG

SEQ ID NO: 3099578 - protein, 24 aa, Giardia lamblia
ANQKRATSVNSWSQKKAEKDRETL

SEQ ID NO: 3099579 - protein, 7 aa, Giardia lamblia
ANQPEHI

SEQ ID NO: 3099580 - protein, 10 aa, Giardia lamblia
ANQPPYPGLA

SEQ ID NO: 3099581 - protein, 9 aa, Giardia lamblia
ANQPTVNPK

SEQ ID NO: 3099582 - protein, 20 aa, Giardia lamblia
ANQQKRQCTDPSSLSASTDM

SEQ ID NO: 3099583 - protein, 4 aa, Giardia lamblia
ANQR

SEQ ID NO: 3099584 - protein, 4 aa, Giardia lamblia
ANQY

SEQ ID NO: 3099585 - protein, 10 aa, Giardia lamblia
ANRAQADDDS

SEQ ID NO: 3099586 - protein, 5 aa, Giardia lamblia
ANRDA

SEQ ID NO: 3099587 - protein, 8 aa, Giardia lamblia
ANRGERAE

SEQ ID NO: 3099588 - protein, 19 aa, Giardia lamblia
ANRHGDASAEVTHDDEGGA

SEQ ID NO: 3099589 - protein, 14 aa, Giardia lamblia
ANRKDGSQASQSPE

SEQ ID NO: 3099590 - protein, 4 aa, Giardia lamblia
ANRL

SEQ ID NO: 3099591 - protein, 4 aa, Giardia lamblia
ANRN

SEQ ID NO: 3099592 - protein, 5 aa, Giardia lamblia
ANRPD

SEQ ID NO: 3099593 - protein, 5 aa, Giardia lamblia
ANRSA

SEQ ID NO: 3099594 - protein, 55 aa, Giardia lamblia
ANRSPHSQQPGAAAQRSNTPKHRPPKLSRPGTPDRIPRSSSSGIPRAASARSKMA

SEQ ID NO: 3099595 - protein, 6 aa, Giardia lamblia
ANRTES

SEQ ID NO: 3099596 - protein, 14 aa, Giardia lamblia
ANRTPDGPKKRNRD

SEQ ID NO: 3099597 - protein, 25 aa, Giardia lamblia
ANSAATAQSKINAGKAGVKGQLTDA

SEQ ID NO: 3099598 - protein, 16 aa, Giardia lamblia
ANSANTDKLRSIENRE

SEQ ID NO: 3099599 - protein, 4 aa, Giardia lamblia
ANSC

SEQ ID NO: 3099600 - protein, 23 aa, Giardia lamblia
ANSDSDDCSDVESMDGQAGGNGI

SEQ ID NO: 3099601 - protein, 9 aa, Giardia lamblia
ANSEAERTI

SEQ ID NO: 3099602 - protein, 11 aa, Giardia lamblia
ANSGKKGDSDR

SEQ ID NO: 3099603 - protein, 22 aa, Giardia lamblia
ANSGPREDSCRIGKGGQVRRQS

SEQ ID NO: 3099604 - protein, 4 aa, Giardia lamblia
ANSH

SEQ ID NO: 3099605 - protein, 5 aa, Giardia lamblia
ANSID

SEQ ID NO: 3099606 - protein, 10 aa, Giardia lamblia
ANSIGKGDGV

SEQ ID NO: 3099607 - protein, 7 aa, Giardia lamblia
ANSKSCT

SEQ ID NO: 3099608 - protein, 5 aa, Giardia lamblia
ANSLT

SEQ ID NO: 3099609 - protein, 12 aa, Giardia lamblia
ANSNSSNVTGAR

SEQ ID NO: 3099610 - protein, 6 aa, Giardia lamblia
ANSPAD

SEQ ID NO: 3099611 - protein, 5 aa, Giardia lamblia
ANSPE

SEQ ID NO: 3099612 - protein, 14 aa, Giardia lamblia
ANSQGKELSSEAAS

SEQ ID NO: 3099613 - protein, 9 aa, Giardia lamblia
ANSSDDEFT

SEQ ID NO: 3099614 - protein, 10 aa, Giardia lamblia
ANSSFTPSST

SEQ ID NO: 3099615 - protein, 29 aa, Giardia lamblia
ANSSGRSFTRPPQKKPDPAPRQDPDLSQS

SEQ ID NO: 3099616 - protein, 5 aa, Giardia lamblia
ANSSK

SEQ ID NO: 3099617 - protein, 21 aa, Giardia lamblia
ANSSRPATSNAGESRQRREES

SEQ ID NO: 3099618 - protein, 10 aa, Giardia lamblia
ANSSSTSSLE

SEQ ID NO: 3099619 - protein, 11 aa, Giardia lamblia
ANSTEMDPDTP

SEQ ID NO: 3099620 - protein, 21 aa, Giardia lamblia
ANSTESRISNRPHSSIGKSTI

SEQ ID NO: 3099621 - protein, 7 aa, Giardia lamblia
ANSTGRM

SEQ ID NO: 3099622 - protein, 5 aa, Giardia lamblia
ANSTP

SEQ ID NO: 3099623 - protein, 8 aa, Giardia lamblia
ANSTSDRE

SEQ ID NO: 3099624 - protein, 4 aa, Giardia lamblia
ANSV

SEQ ID NO: 3099625 - protein, 8 aa, Giardia lamblia
ANSVPGTT

SEQ ID NO: 3099626 - protein, 11 aa, Giardia lamblia
ANTAAKNKLAE

SEQ ID NO: 3099627 - protein, 5 aa, Giardia lamblia
ANTAD

SEQ ID NO: 3099628 - protein, 7 aa, Giardia lamblia
ANTADEQ

SEQ ID NO: 3099629 - protein, 8 aa, Giardia lamblia
ANTAKARR

SEQ ID NO: 3099630 - protein, 16 aa, Giardia lamblia
ANTASLPQSSKTELDN

SEQ ID NO: 3099631 - protein, 5 aa, Giardia lamblia
ANTEG

SEQ ID NO: 3099632 - protein, 4 aa, Giardia lamblia
ANTG

SEQ ID NO: 3099633 - protein, 10 aa, Giardia lamblia
ANTGDSGVAT

SEQ ID NO: 3099634 - protein, 7 aa, Giardia lamblia
ANTGVSA

SEQ ID NO: 3099635 - protein, 5 aa, Giardia lamblia
ANTKL

SEQ ID NO: 3099636 - protein, 9 aa, Giardia lamblia
ANTKRQKYE

SEQ ID NO: 3099637 - protein, 15 aa, Giardia lamblia
ANTKTTKKSSTSTVV

SEQ ID NO: 3099638 - protein, 5 aa, Giardia lamblia
ANTKY

SEQ ID NO: 3099639 - protein, 14 aa, Giardia lamblia
ANTLTSAKSSLPTQ

SEQ ID NO: 3099640 - protein, 7 aa, Giardia lamblia
ANTNSIE

SEQ ID NO: 3099641 - protein, 8 aa, Giardia lamblia
ANTNYTAN

SEQ ID NO: 3099642 - protein, 10 aa, Giardia lamblia
ANTPKRDSSV

SEQ ID NO: 3099643 - protein, 5 aa, Giardia lamblia
ANTQG

SEQ ID NO: 3099644 - protein, 9 aa, Giardia lamblia
ANTQTESVS

SEQ ID NO: 3099645 - protein, 9 aa, Giardia lamblia
ANTRDGPVF

SEQ ID NO: 3099646 - protein, 10 aa, Giardia lamblia
ANTRERPSAK

SEQ ID NO: 3099647 - protein, 13 aa, Giardia lamblia
ANTRREKMDSTSL

SEQ ID NO: 3099648 - protein, 8 aa, Giardia lamblia
ANTSPMPA

SEQ ID NO: 3099649 - protein, 9 aa, Giardia lamblia
ANTSSTARS

SEQ ID NO: 3099650 - protein, 5 aa, Giardia lamblia
ANTST

SEQ ID NO: 3099651 - protein, 8 aa, Giardia lamblia
ANTSTGFT

SEQ ID NO: 3099652 - protein, 7 aa, Giardia lamblia
ANTTATG

SEQ ID NO: 3099653 - protein, 8 aa, Giardia lamblia
ANTTITSY

SEQ ID NO: 3099654 - protein, 5 aa, Giardia lamblia
ANTTL

SEQ ID NO: 3099655 - protein, 7 aa, Giardia lamblia
ANTVSPL

SEQ ID NO: 3099656 - protein, 10 aa, Giardia lamblia
ANVDKDLDPR

SEQ ID NO: 3099657 - protein, 17 aa, Giardia lamblia
ANVPDQSPTRRSESGNF

SEQ ID NO: 3099658 - protein, 18 aa, Giardia lamblia
ANVQNNRVGPRTANKPED

SEQ ID NO: 3099659 - protein, 12 aa, Giardia lamblia
ANVSSDDHQHAT

SEQ ID NO: 3099660 - protein, 7 aa, Giardia lamblia
ANVTEAT

SEQ ID NO: 3099661 - protein, 6 aa, Giardia lamblia
ANYAPG

SEQ ID NO: 3099662 - protein, 5 aa, Giardia lamblia
ANYEA

SEQ ID NO: 3099663 - protein, 31 aa, Giardia lamblia
ANYNSLSKSVTQPPPSINQPSLHPSAAPTEQ

SEQ ID NO: 3099664 - protein, 4 aa, Giardia lamblia
ANYT

SEQ ID NO: 3099665 - protein, 8 aa, Giardia lamblia
ANYTEDDV

SEQ ID NO: 3099666 - protein, 11 aa, Giardia lamblia
ANYTPSKRASG

SEQ ID NO: 3099667 - protein, 4 aa, Giardia lamblia
APAA

SEQ ID NO: 3099668 - protein, 26 aa, Giardia lamblia
APAAATAAAAAPEEAKKEESDDDEIV

SEQ ID NO: 3099669 - protein, 5 aa, Giardia lamblia
APAAN

SEQ ID NO: 3099670 - protein, 7 aa, Giardia lamblia
APAASNT

SEQ ID NO: 3099671 - protein, 13 aa, Giardia lamblia
APAATDAYTVKDE

SEQ ID NO: 3099672 - protein, 6 aa, Giardia lamblia
APADLG

SEQ ID NO: 3099673 - protein, 9 aa, Giardia lamblia
APADSESTL

SEQ ID NO: 3099674 - protein, 6 aa, Giardia lamblia
APADST

SEQ ID NO: 3099675 - protein, 13 aa, Giardia lamblia
APAEDTKQENVQE

SEQ ID NO: 3099676 - protein, 4 aa, Giardia lamblia
APAG

SEQ ID NO: 3099677 - protein, 19 aa, Giardia lamblia
APAGPAGTGKTETTKDLGR

SEQ ID NO: 3099678 - protein, 4 aa, Giardia lamblia
APAI

SEQ ID NO: 3099679 - protein, 6 aa, Giardia lamblia
APAKTK

SEQ ID NO: 3099680 - protein, 7 aa, Giardia lamblia
APALPSQ

SEQ ID NO: 3099681 - protein, 6 aa, Giardia lamblia
APANWE

SEQ ID NO: 3099682 - protein, 20 aa, Giardia lamblia
APAPSSVNPNYQAPVESTSQ

SEQ ID NO: 3099683 - protein, 27 aa, Giardia lamblia
APAQQPPPPSTQLTTKQEQPPEQKKDH

SEQ ID NO: 3099684 - protein, 5 aa, Giardia lamblia
APARP

SEQ ID NO: 3099685 - protein, 6 aa, Giardia lamblia
APARRS

SEQ ID NO: 3099686 - protein, 8 aa, Giardia lamblia
APASISSG

SEQ ID NO: 3099687 - protein, 5 aa, Giardia lamblia
APATG

SEQ ID NO: 3099688 - protein, 14 aa, Giardia lamblia
APATLTQPHQHPTL

SEQ ID NO: 3099689 - protein, 17 aa, Giardia lamblia
APATPAIDSKEPDRHTL

SEQ ID NO: 3099690 - protein, 10 aa, Giardia lamblia
APATPNTTQV

SEQ ID NO: 3099691 - protein, 7 aa, Giardia lamblia
APATSSD

SEQ ID NO: 3099692 - protein, 14 aa, Giardia lamblia
APATYSSSFNDEEP

SEQ ID NO: 3099693 - protein, 6 aa, Giardia lamblia
APCEPQ

SEQ ID NO: 3099694 - protein, 4 aa, Giardia lamblia
APDA

SEQ ID NO: 3099695 - protein, 7 aa, Giardia lamblia
APDASEY

SEQ ID NO: 3099696 - protein, 6 aa, Giardia lamblia
APDDDI

SEQ ID NO: 3099697 - protein, 8 aa, Giardia lamblia
APDDDPAL

SEQ ID NO: 3099698 - protein, 14 aa, Giardia lamblia
APDDTSSPVVPSDL

SEQ ID NO: 3099699 - protein, 12 aa, Giardia lamblia
APDEAKKPRPSM

SEQ ID NO: 3099700 - protein, 23 aa, Giardia lamblia
APDEEPEKPVPPPPLKEPHYPAN

SEQ ID NO: 3099701 - protein, 12 aa, Giardia lamblia
APDELNNQPLSK

SEQ ID NO: 3099702 - protein, 4 aa, Giardia lamblia
APDG

SEQ ID NO: 3099703 - protein, 6 aa, Giardia lamblia
APDGII

SEQ ID NO: 3099704 - protein, 39 aa, Giardia lamblia
APDGSFTSNPTEEPAVAPASTEESIEQQRVKPKGHAYAS

SEQ ID NO: 3099705 - protein, 7 aa, Giardia lamblia
APDGVSA

SEQ ID NO: 3099706 - protein, 8 aa, Giardia lamblia
APDIKQQY

SEQ ID NO: 3099707 - protein, 9 aa, Giardia lamblia
APDKQDLVE

SEQ ID NO: 3099708 - protein, 21 aa, Giardia lamblia
APDLPNRLSEQATLPSSEAGA

SEQ ID NO: 3099709 - protein, 12 aa, Giardia lamblia
APDLSTRSNSDL

SEQ ID NO: 3099710 - protein, 9 aa, Giardia lamblia
APDMNSSCS

SEQ ID NO: 3099711 - protein, 5 aa, Giardia lamblia
APDNK

SEQ ID NO: 3099712 - protein, 10 aa, Giardia lamblia
APDNPPYSAT

SEQ ID NO: 3099713 - protein, 13 aa, Giardia lamblia
APDPDSKPYVDAP

SEQ ID NO: 3099714 - protein, 8 aa, Giardia lamblia
APDPIRSY

SEQ ID NO: 3099715 - protein, 6 aa, Giardia lamblia
APDPIS

SEQ ID NO: 3099716 - protein, 8 aa, Giardia lamblia
APDRNDPG

SEQ ID NO: 3099717 - protein, 5 aa, Giardia lamblia
APDRR

SEQ ID NO: 3099718 - protein, 5 aa, Giardia lamblia
APDSN

SEQ ID NO: 3099719 - protein, 7 aa, Giardia lamblia
APDSPAA

SEQ ID NO: 3099720 - protein, 19 aa, Giardia lamblia
APDSRKNIYSNPKHQSALT

SEQ ID NO: 3099721 - protein, 8 aa, Giardia lamblia
APDTGAEA

SEQ ID NO: 3099722 - protein, 19 aa, Giardia lamblia
APDTSSNPTRQRKPKRRDV

SEQ ID NO: 3099723 - protein, 6 aa, Giardia lamblia
APDVTG

SEQ ID NO: 3099724 - protein, 9 aa, Giardia lamblia
APDYTQKKN

SEQ ID NO: 3099725 - protein, 5 aa, Giardia lamblia
APEAD

SEQ ID NO: 3099726 - protein, 8 aa, Giardia lamblia
APEAEEQF

SEQ ID NO: 3099727 - protein, 9 aa, Giardia lamblia
APEANREEL

SEQ ID NO: 3099728 - protein, 5 aa, Giardia lamblia
APEAS

SEQ ID NO: 3099729 - protein, 4 aa, Giardia lamblia
APED

SEQ ID NO: 3099730 - protein, 9 aa, Giardia lamblia
APEDDLRRS

SEQ ID NO: 3099731 - protein, 8 aa, Giardia lamblia
APEDTRKD

SEQ ID NO: 3099732 - protein, 5 aa, Giardia lamblia
APEDV

SEQ ID NO: 3099733 - protein, 5 aa, Giardia lamblia
APEEA

SEQ ID NO: 3099734 - protein, 6 aa, Giardia lamblia
APEEDS

SEQ ID NO: 3099735 - protein, 5 aa, Giardia lamblia
APEEK

SEQ ID NO: 3099736 - protein, 7 aa, Giardia lamblia
APEEKVR

SEQ ID NO: 3099737 - protein, 8 aa, Giardia lamblia
APEEQDYQ

SEQ ID NO: 3099738 - protein, 5 aa, Giardia lamblia
APEGI

SEQ ID NO: 3099739 - protein, 5 aa, Giardia lamblia
APELN

SEQ ID NO: 3099740 - protein, 20 aa, Giardia lamblia
APELQRSSLQTPRQRRISNK

SEQ ID NO: 3099741 - protein, 14 aa, Giardia lamblia
APEMRSGAPGTDRS

SEQ ID NO: 3099742 - protein, 5 aa, Giardia lamblia
APEND

SEQ ID NO: 3099743 - protein, 12 aa, Giardia lamblia
APENPPAPVDPL

SEQ ID NO: 3099744 - protein, 9 aa, Giardia lamblia
APENPVPRA

SEQ ID NO: 3099745 - protein, 7 aa, Giardia lamblia
APEPARI

SEQ ID NO: 3099746 - protein, 5 aa, Giardia lamblia
APEPL

SEQ ID NO: 3099747 - protein, 7 aa, Giardia lamblia
APEPSQR

SEQ ID NO: 3099748 - protein, 8 aa, Giardia lamblia
APERSRQL

SEQ ID NO: 3099749 - protein, 14 aa, Giardia lamblia
APESISAPAMNTEN

SEQ ID NO: 3099750 - protein, 9 aa, Giardia lamblia
APESLKSPL

SEQ ID NO: 3099751 - protein, 6 aa, Giardia lamblia
APESNR

SEQ ID NO: 3099752 - protein, 12 aa, Giardia lamblia
APFAGRDPSNAA

SEQ ID NO: 3099753 - protein, 4 aa, Giardia lamblia
APGA

SEQ ID NO: 3099754 - protein, 5 aa, Giardia lamblia
APGAA

SEQ ID NO: 3099755 - protein, 11 aa, Giardia lamblia
APGAGKGTQAK

SEQ ID NO: 3099756 - protein, 8 aa, Giardia lamblia
APGDTQYA

SEQ ID NO: 3099757 - protein, 6 aa, Giardia lamblia
APGEFM

SEQ ID NO: 3099758 - protein, 8 aa, Giardia lamblia
APGETNNK

SEQ ID NO: 3099759 - protein, 6 aa, Giardia lamblia
APGEVI

SEQ ID NO: 3099760 - protein, 5 aa, Giardia lamblia
APGGW

SEQ ID NO: 3099761 - protein, 6 aa, Giardia lamblia
APGIGS

SEQ ID NO: 3099762 - protein, 9 aa, Giardia lamblia
APGKGFNTE

SEQ ID NO: 3099763 - protein, 11 aa, Giardia lamblia
APGLADTQDAI

SEQ ID NO: 3099764 - protein, 8 aa, Giardia lamblia
APGLQTKE

SEQ ID NO: 3099765 - protein, 11 aa, Giardia lamblia
APGMSSTQTSV

SEQ ID NO: 3099766 - protein, 6 aa, Giardia lamblia
APGNTM

SEQ ID NO: 3099767 - protein, 6 aa, Giardia lamblia
APGNVS

SEQ ID NO: 3099768 - protein, 12 aa, Giardia lamblia
APGPGYYSNEST

SEQ ID NO: 3099769 - protein, 4 aa, Giardia lamblia
APGQ

SEQ ID NO: 3099770 - protein, 8 aa, Giardia lamblia
APGQPPRY

SEQ ID NO: 3099771 - protein, 11 aa, Giardia lamblia
APGQSRNDAFE

SEQ ID NO: 3099772 - protein, 17 aa, Giardia lamblia
APGRPTRGEEVPFPPRT

SEQ ID NO: 3099773 - protein, 11 aa, Giardia lamblia
APGSEGPKKSK

SEQ ID NO: 3099774 - protein, 6 aa, Giardia lamblia
APGSKT

SEQ ID NO: 3099775 - protein, 7 aa, Giardia lamblia
APGSKTF

SEQ ID NO: 3099776 - protein, 11 aa, Giardia lamblia
APGSMQTSGIN

SEQ ID NO: 3099777 - protein, 12 aa, Giardia lamblia
APGSSGVPLGQS

SEQ ID NO: 3099778 - protein, 22 aa, Giardia lamblia
APGSSPSDSRLHRTSTAQATVR

SEQ ID NO: 3099779 - protein, 5 aa, Giardia lamblia
APGSW

SEQ ID NO: 3099780 - protein, 7 aa, Giardia lamblia
APGTGKS

SEQ ID NO: 3099781 - protein, 14 aa, Giardia lamblia
APGTRQEIQQSKDK

SEQ ID NO: 3099782 - protein, 7 aa, Giardia lamblia
APGTSTL

SEQ ID NO: 3099783 - protein, 6 aa, Giardia lamblia
APGVSE

SEQ ID NO: 3099784 - protein, 18 aa, Giardia lamblia
APHESGRKAIKEDGSGLG

SEQ ID NO: 3099785 - protein, 11 aa, Giardia lamblia
APHGQTSIQPT

SEQ ID NO: 3099786 - protein, 14 aa, Giardia lamblia
APHQPAPHVSTSAN

SEQ ID NO: 3099787 - protein, 7 aa, Giardia lamblia
APHRPRQ

SEQ ID NO: 3099788 - protein, 5 aa, Giardia lamblia
APHRR

SEQ ID NO: 3099789 - protein, 8 aa, Giardia lamblia
APHTIPSL

SEQ ID NO: 3099790 - protein, 16 aa, Giardia lamblia
APIASGTYDVPETSPY

SEQ ID NO: 3099791 - protein, 10 aa, Giardia lamblia
APIDDKMTSN

SEQ ID NO: 3099792 - protein, 14 aa, Giardia lamblia
APIDTANELHSGET

SEQ ID NO: 3099793 - protein, 8 aa, Giardia lamblia
APIGTSNG

SEQ ID NO: 3099794 - protein, 9 aa, Giardia lamblia
APIKHSTGR

SEQ ID NO: 3099795 - protein, 4 aa, Giardia lamblia
APIP

SEQ ID NO: 3099796 - protein, 19 aa, Giardia lamblia
APIPRSPEADTRQSYGNGH

SEQ ID NO: 3099797 - protein, 6 aa, Giardia lamblia
APIPST

SEQ ID NO: 3099798 - protein, 6 aa, Giardia lamblia
APIQTE

SEQ ID NO: 3099799 - protein, 14 aa, Giardia lamblia
APISEETQCPEGAR

SEQ ID NO: 3099800 - protein, 4 aa, Giardia lamblia
APIT

SEQ ID NO: 3099801 - protein, 24 aa, Giardia lamblia
APKADKESGKNAAGVSSKESVPQK

SEQ ID NO: 3099802 - protein, 26 aa, Giardia lamblia
APKAQQPVYGQEQRTSPLSNETVTEA

SEQ ID NO: 3099803 - protein, 4 aa, Giardia lamblia
APKD

SEQ ID NO: 3099804 - protein, 9 aa, Giardia lamblia
APKEAGKVK

SEQ ID NO: 3099805 - protein, 5 aa, Giardia lamblia
APKEG

SEQ ID NO: 3099806 - protein, 9 aa, Giardia lamblia
APKESRKLC

SEQ ID NO: 3099807 - protein, 4 aa, Giardia lamblia
APKG

SEQ ID NO: 3099808 - protein, 7 aa, Giardia lamblia
APKGSWN

SEQ ID NO: 3099809 - protein, 17 aa, Giardia lamblia
APKHSKQKKHGKQRGSL

SEQ ID NO: 3099810 - protein, 5 aa, Giardia lamblia
APKLE

SEQ ID NO: 3099811 - protein, 22 aa, Giardia lamblia
APKMTAEQKRVKEEKDIREREE

SEQ ID NO: 3099812 - protein, 9 aa, Giardia lamblia
APKNASYAE

SEQ ID NO: 3099813 - protein, 16 aa, Giardia lamblia
APKNIKPLTAPYTSSL

SEQ ID NO: 3099814 - protein, 5 aa, Giardia lamblia
APKNN

SEQ ID NO: 3099815 - protein, 10 aa, Giardia lamblia
APKNPKANRE

SEQ ID NO: 3099816 - protein, 6 aa, Giardia lamblia
APKPGV

SEQ ID NO: 3099817 - protein, 11 aa, Giardia lamblia
APKPLSSTEAM

SEQ ID NO: 3099818 - protein, 6 aa, Giardia lamblia
APKPRR

SEQ ID NO: 3099819 - protein, 16 aa, Giardia lamblia
APKQPSQLVPFIESDE

SEQ ID NO: 3099820 - protein, 8 aa, Giardia lamblia
APKQRKEV

SEQ ID NO: 3099821 - protein, 4 aa, Giardia lamblia
APKS

SEQ ID NO: 3099822 - protein, 7 aa, Giardia lamblia
APKSCRA

SEQ ID NO: 3099823 - protein, 11 aa, Giardia lamblia
APKSNSAGTAL

SEQ ID NO: 3099824 - protein, 9 aa, Giardia lamblia
APKSSYARI

SEQ ID NO: 3099825 - protein, 6 aa, Giardia lamblia
APKTYT

SEQ ID NO: 3099826 - protein, 6 aa, Giardia lamblia
APKVSQ

SEQ ID NO: 3099827 - protein, 15 aa, Giardia lamblia
APKYNSKDPGASEAY

SEQ ID NO: 3099828 - protein, 9 aa, Giardia lamblia
APLAGPPSS

SEQ ID NO: 3099829 - protein, 10 aa, Giardia lamblia
APLDNTPITV

SEQ ID NO: 3099830 - protein, 8 aa, Giardia lamblia
APLEDNSV

SEQ ID NO: 3099831 - protein, 26 aa, Giardia lamblia
APLGGRRGRPLRRGQQSSQEAPEAVQ

SEQ ID NO: 3099832 - protein, 9 aa, Giardia lamblia
APLGPSGKS

SEQ ID NO: 3099833 - protein, 34 aa, Giardia lamblia
APLGQDYTNESYDNGVTSEANHGTGLRSNAGRGV

SEQ ID NO: 3099834 - protein, 8 aa, Giardia lamblia
APLGTGAA

SEQ ID NO: 3099835 - protein, 8 aa, Giardia lamblia
APLKPESY

SEQ ID NO: 3099836 - protein, 16 aa, Giardia lamblia
APLPAPKESSGHHPRQ

SEQ ID NO: 3099837 - protein, 16 aa, Giardia lamblia
APLPEEKQEKVGTIEN

SEQ ID NO: 3099838 - protein, 7 aa, Giardia lamblia
APLPPAI

SEQ ID NO: 3099839 - protein, 17 aa, Giardia lamblia
APLPSAGPKSASEPSLP

SEQ ID NO: 3099840 - protein, 6 aa, Giardia lamblia
APLPST

SEQ ID NO: 3099841 - protein, 8 aa, Giardia lamblia
APLSDYAG

SEQ ID NO: 3099842 - protein, 4 aa, Giardia lamblia
APLT

SEQ ID NO: 3099843 - protein, 5 aa, Giardia lamblia
APLTA

SEQ ID NO: 3099844 - protein, 5 aa, Giardia lamblia
APLTT

SEQ ID NO: 3099845 - protein, 6 aa, Giardia lamblia
APMGNS

SEQ ID NO: 3099846 - protein, 10 aa, Giardia lamblia
APMPSQPASM

SEQ ID NO: 3099847 - protein, 11 aa, Giardia lamblia
APNAPPQAGRV

SEQ ID NO: 3099848 - protein, 17 aa, Giardia lamblia
APNAPQHTYEPESNVSV

SEQ ID NO: 3099849 - protein, 6 aa, Giardia lamblia
APNEYP

SEQ ID NO: 3099850 - protein, 4 aa, Giardia lamblia
APNI

SEQ ID NO: 3099851 - protein, 6 aa, Giardia lamblia
APNIPQ

SEQ ID NO: 3099852 - protein, 8 aa, Giardia lamblia
APNKQISV

SEQ ID NO: 3099853 - protein, 14 aa, Giardia lamblia
APNLDGDAPGSSLF

SEQ ID NO: 3099854 - protein, 9 aa, Giardia lamblia
APNLPPPLT

SEQ ID NO: 3099855 - protein, 7 aa, Giardia lamblia
APNNPEY

SEQ ID NO: 3099856 - protein, 8 aa, Giardia lamblia
APNPRERI

SEQ ID NO: 3099857 - protein, 20 aa, Giardia lamblia
APNQLSVSADNSLQTENNAL

SEQ ID NO: 3099858 - protein, 9 aa, Giardia lamblia
APNQTKTGV

SEQ ID NO: 3099859 - protein, 5 aa, Giardia lamblia
APNSA

SEQ ID NO: 3099860 - protein, 6 aa, Giardia lamblia
APNSKF

SEQ ID NO: 3099861 - protein, 8 aa, Giardia lamblia
APPAFPPN

SEQ ID NO: 3099862 - protein, 5 aa, Giardia lamblia
APPCP

SEQ ID NO: 3099863 - protein, 15 aa, Giardia lamblia
APPDEECSRRRREDD

SEQ ID NO: 3099864 - protein, 5 aa, Giardia lamblia
APPDV

SEQ ID NO: 3099865 - protein, 4 aa, Giardia lamblia
APPE

SEQ ID NO: 3099866 - protein, 36 aa, Giardia lamblia
APPFRESRGPGLALSSTSSTLTDKIASDDSDSCDKS

SEQ ID NO: 3099867 - protein, 13 aa, Giardia lamblia
APPGASLSSAGTI

SEQ ID NO: 3099868 - protein, 15 aa, Giardia lamblia
APPGQSTESEDESEA

SEQ ID NO: 3099869 - protein, 11 aa, Giardia lamblia
APPGTSKAPAF

SEQ ID NO: 3099870 - protein, 6 aa, Giardia lamblia
APPGYG

SEQ ID NO: 3099871 - protein, 6 aa, Giardia lamblia
APPGYV

SEQ ID NO: 3099872 - protein, 4 aa, Giardia lamblia
APPH

SEQ ID NO: 3099873 - protein, 4 aa, Giardia lamblia
APPI

SEQ ID NO: 3099874 - protein, 14 aa, Giardia lamblia
APPIASGQLQQSSA

SEQ ID NO: 3099875 - protein, 6 aa, Giardia lamblia
APPIEE

SEQ ID NO: 3099876 - protein, 7 aa, Giardia lamblia
APPISEA

SEQ ID NO: 3099877 - protein, 8 aa, Giardia lamblia
APPITEAT

SEQ ID NO: 3099878 - protein, 8 aa, Giardia lamblia
APPKNKDQ

SEQ ID NO: 3099879 - protein, 36 aa, Giardia lamblia
APPLAPEKDMSEEGAVNPTEPSEMDDEGSVDEDGVT

SEQ ID NO: 3099880 - protein, 37 aa, Giardia lamblia
APPLAPEKDTSEEGAGKSSPAESPQTDDEGSVDEDGV

SEQ ID NO: 3099881 - protein, 5 aa, Giardia lamblia
APPLE

SEQ ID NO: 3099882 - protein, 4 aa, Giardia lamblia
APPM

SEQ ID NO: 3099883 - protein, 4 aa, Giardia lamblia
APPN

SEQ ID NO: 3099884 - protein, 10 aa, Giardia lamblia
APPNKQHPTY

SEQ ID NO: 3099885 - protein, 7 aa, Giardia lamblia
APPNLRD

SEQ ID NO: 3099886 - protein, 6 aa, Giardia lamblia
APPPGT

SEQ ID NO: 3099887 - protein, 6 aa, Giardia lamblia
APPPIS

SEQ ID NO: 3099888 - protein, 6 aa, Giardia lamblia
APPPLV

SEQ ID NO: 3099889 - protein, 7 aa, Giardia lamblia
APPPQES

SEQ ID NO: 3099890 - protein, 13 aa, Giardia lamblia
APPPQPPPVSNTS

SEQ ID NO: 3099891 - protein, 6 aa, Giardia lamblia
APPQVP

SEQ ID NO: 3099892 - protein, 4 aa, Giardia lamblia
APPR

SEQ ID NO: 3099893 - protein, 7 aa, Giardia lamblia
APPRKQP

SEQ ID NO: 3099894 - protein, 6 aa, Giardia lamblia
APPSDI

SEQ ID NO: 3099895 - protein, 10 aa, Giardia lamblia
APPSPETKQC

SEQ ID NO: 3099896 - protein, 10 aa, Giardia lamblia
APPSSFAGQR

SEQ ID NO: 3099897 - protein, 10 aa, Giardia lamblia
APPSTADPQI

SEQ ID NO: 3099898 - protein, 8 aa, Giardia lamblia
APPSTDTR

SEQ ID NO: 3099899 - protein, 5 aa, Giardia lamblia
APPSV

SEQ ID NO: 3099900 - protein, 22 aa, Giardia lamblia
APPTQDELAKEEALRSERQAGI

SEQ ID NO: 3099901 - protein, 5 aa, Giardia lamblia
APPTR

SEQ ID NO: 3099902 - protein, 4 aa, Giardia lamblia
APPV

SEQ ID NO: 3099903 - protein, 6 aa, Giardia lamblia
APPVHT

SEQ ID NO: 3099904 - protein, 20 aa, Giardia lamblia
APPVQSRQEDLDDREYSQEH

SEQ ID NO: 3099905 - protein, 6 aa, Giardia lamblia
APQACK

SEQ ID NO: 3099906 - protein, 18 aa, Giardia lamblia
APQASARQATSGTRVSGI

SEQ ID NO: 3099907 - protein, 7 aa, Giardia lamblia
APQDARK

SEQ ID NO: 3099908 - protein, 13 aa, Giardia lamblia
APQEKQEQSRSIP

SEQ ID NO: 3099909 - protein, 7 aa, Giardia lamblia
APQGHGT

SEQ ID NO: 3099910 - protein, 14 aa, Giardia lamblia
APQHSYEDNCTGEP

SEQ ID NO: 3099911 - protein, 7 aa, Giardia lamblia
APQIPGK

SEQ ID NO: 3099912 - protein, 4 aa, Giardia lamblia
APQL

SEQ ID NO: 3099913 - protein, 13 aa, Giardia lamblia
APQPDSVEHTSAP

SEQ ID NO: 3099914 - protein, 8 aa, Giardia lamblia
APQPEPQP

SEQ ID NO: 3099915 - protein, 6 aa, Giardia lamblia
APQPSH

SEQ ID NO: 3099916 - protein, 6 aa, Giardia lamblia
APQQIS

SEQ ID NO: 3099917 - protein, 11 aa, Giardia lamblia
APQQQVPISNE

SEQ ID NO: 3099918 - protein, 7 aa, Giardia lamblia
APQRRRE

SEQ ID NO: 3099919 - protein, 14 aa, Giardia lamblia
APQRSSSPSSPCGP

SEQ ID NO: 3099920 - protein, 6 aa, Giardia lamblia
APQTNI

SEQ ID NO: 3099921 - protein, 10 aa, Giardia lamblia
APQTSVSKDS

SEQ ID NO: 3099922 - protein, 15 aa, Giardia lamblia
APQVGADGASISGFT

SEQ ID NO: 3099923 - protein, 28 aa, Giardia lamblia
APRAAVSSSSAGKGNVTGVGIKSKRIPK

SEQ ID NO: 3099924 - protein, 5 aa, Giardia lamblia
APRAP

SEQ ID NO: 3099925 - protein, 8 aa, Giardia lamblia
APRDNYNR

SEQ ID NO: 3099926 - protein, 20 aa, Giardia lamblia
APRDPTKKAATPSLSEKTEK

SEQ ID NO: 3099927 - protein, 4 aa, Giardia lamblia
APRE

SEQ ID NO: 3099928 - protein, 6 aa, Giardia lamblia
APRETG

SEQ ID NO: 3099929 - protein, 4 aa, Giardia lamblia
APRG

SEQ ID NO: 3099930 - protein, 6 aa, Giardia lamblia
APRGAG

SEQ ID NO: 3099931 - protein, 6 aa, Giardia lamblia
APRGKY

SEQ ID NO: 3099932 - protein, 12 aa, Giardia lamblia
APRGTTSKAVDD

SEQ ID NO: 3099933 - protein, 13 aa, Giardia lamblia
APRINPKSDQESD

SEQ ID NO: 3099934 - protein, 4 aa, Giardia lamblia
APRK

SEQ ID NO: 3099935 - protein, 13 aa, Giardia lamblia
APRMPTGGTANEH

SEQ ID NO: 3099936 - protein, 11 aa, Giardia lamblia
APRNDPAGDAE

SEQ ID NO: 3099937 - protein, 9 aa, Giardia lamblia
APRNNINGD

SEQ ID NO: 3099938 - protein, 9 aa, Giardia lamblia
APRPLPAPT

SEQ ID NO: 3099939 - protein, 8 aa, Giardia lamblia
APRQGTAL

SEQ ID NO: 3099940 - protein, 4 aa, Giardia lamblia
APRR

SEQ ID NO: 3099941 - protein, 14 aa, Giardia lamblia
APRRPSSPSSPCGP

SEQ ID NO: 3099942 - protein, 22 aa, Giardia lamblia
APRSTECVETKDQASAQRSDSI

SEQ ID NO: 3099943 - protein, 5 aa, Giardia lamblia
APRTQ

SEQ ID NO: 3099944 - protein, 11 aa, Giardia lamblia
APRTRSTTGPC

SEQ ID NO: 3099945 - protein, 4 aa, Giardia lamblia
APRV

SEQ ID NO: 3099946 - protein, 9 aa, Giardia lamblia
APRVDAANG

SEQ ID NO: 3099947 - protein, 6 aa, Giardia lamblia
APRYAE

SEQ ID NO: 3099948 - protein, 6 aa, Giardia lamblia
APSADA

SEQ ID NO: 3099949 - protein, 6 aa, Giardia lamblia
APSAGE

SEQ ID NO: 3099950 - protein, 10 aa, Giardia lamblia
APSAKAGELQ

SEQ ID NO: 3099951 - protein, 12 aa, Giardia lamblia
APSAPSAASSER

SEQ ID NO: 3099952 - protein, 7 aa, Giardia lamblia
APSAQKI

SEQ ID NO: 3099953 - protein, 5 aa, Giardia lamblia
APSCA

SEQ ID NO: 3099954 - protein, 13 aa, Giardia lamblia
APSDQQAPATIGG

SEQ ID NO: 3099955 - protein, 8 aa, Giardia lamblia
APSEKGLK

SEQ ID NO: 3099956 - protein, 17 aa, Giardia lamblia
APSETRTFATEPATSDF

SEQ ID NO: 3099957 - protein, 8 aa, Giardia lamblia
APSFEPKN

SEQ ID NO: 3099958 - protein, 4 aa, Giardia lamblia
APSG

SEQ ID NO: 3099959 - protein, 7 aa, Giardia lamblia
APSGSLD

SEQ ID NO: 3099960 - protein, 5 aa, Giardia lamblia
APSIK

SEQ ID NO: 3099961 - protein, 17 aa, Giardia lamblia
APSKDTVGLSNSTGSII

SEQ ID NO: 3099962 - protein, 10 aa, Giardia lamblia
APSKPDELGN

SEQ ID NO: 3099963 - protein, 5 aa, Giardia lamblia
APSNF

SEQ ID NO: 3099964 - protein, 11 aa, Giardia lamblia
APSNPPYNTGY

SEQ ID NO: 3099965 - protein, 5 aa, Giardia lamblia
APSPA

SEQ ID NO: 3099966 - protein, 6 aa, Giardia lamblia
APSPDL

SEQ ID NO: 3099967 - protein, 23 aa, Giardia lamblia
APSPPGPYAAPEVARGGPPTPAA

SEQ ID NO: 3099968 - protein, 21 aa, Giardia lamblia
APSPPPLDDDSPDDAGAPEPV

SEQ ID NO: 3099969 - protein, 15 aa, Giardia lamblia
APSPPSVPSSEPEAP

SEQ ID NO: 3099970 - protein, 22 aa, Giardia lamblia
APSPTGGARGSSSRSPGRTCGS

SEQ ID NO: 3099971 - protein, 19 aa, Giardia lamblia
APSQGVPLSREQRKACSRQ

SEQ ID NO: 3099972 - protein, 15 aa, Giardia lamblia
APSQHGERDADGKTA

SEQ ID NO: 3099973 - protein, 7 aa, Giardia lamblia
APSQKDI

SEQ ID NO: 3099974 - protein, 22 aa, Giardia lamblia
APSQPTESKAKYANTALSEDSR

SEQ ID NO: 3099975 - protein, 7 aa, Giardia lamblia
APSQQSQ

SEQ ID NO: 3099976 - protein, 31 aa, Giardia lamblia
APSREQPTQQGYNRKEVSQQKENYSPPVAQS

SEQ ID NO: 3099977 - protein, 14 aa, Giardia lamblia
APSRPNVSYNPESP

SEQ ID NO: 3099978 - protein, 5 aa, Giardia lamblia
APSRT

SEQ ID NO: 3099979 - protein, 7 aa, Giardia lamblia
APSSAWG

SEQ ID NO: 3099980 - protein, 13 aa, Giardia lamblia
APSSDIVSGPVGT

SEQ ID NO: 3099981 - protein, 10 aa, Giardia lamblia
APSSGDADSF

SEQ ID NO: 3099982 - protein, 8 aa, Giardia lamblia
APSSQETE

SEQ ID NO: 3099983 - protein, 8 aa, Giardia lamblia
APSSTAQH

SEQ ID NO: 3099984 - protein, 10 aa, Giardia lamblia
APSTAVNDEE

SEQ ID NO: 3099985 - protein, 5 aa, Giardia lamblia
APSTE

SEQ ID NO: 3099986 - protein, 6 aa, Giardia lamblia
APSTGV

SEQ ID NO: 3099987 - protein, 8 aa, Giardia lamblia
APSTHDTY

SEQ ID NO: 3099988 - protein, 9 aa, Giardia lamblia
APSTSDGVP

SEQ ID NO: 3099989 - protein, 17 aa, Giardia lamblia
APSTSTSDFKDSRDQEE

SEQ ID NO: 3099990 - protein, 9 aa, Giardia lamblia
APSVQSQSA

SEQ ID NO: 3099991 - protein, 6 aa, Giardia lamblia
APSYVG

SEQ ID NO: 3099992 - protein, 11 aa, Giardia lamblia
APTAAGDSHPT

SEQ ID NO: 3099993 - protein, 6 aa, Giardia lamblia
APTADE

SEQ ID NO: 3099994 - protein, 6 aa, Giardia lamblia
APTAES

SEQ ID NO: 3099995 - protein, 13 aa, Giardia lamblia
APTAHGSRELSES

SEQ ID NO: 3099996 - protein, 8 aa, Giardia lamblia
APTAPDDT

SEQ ID NO: 3099997 - protein, 10 aa, Giardia lamblia
APTASSSTVV

SEQ ID NO: 3099998 - protein, 5 aa, Giardia lamblia
APTDC

SEQ ID NO: 3099999 - protein, 5 aa, Giardia lamblia
APTEA

SEQ ID NO: 3100000 - protein, 5 aa, Giardia lamblia
APTEC

SEQ ID NO: 3100001 - protein, 5 aa, Giardia lamblia
APTGH

SEQ ID NO: 3100002 - protein, 10 aa, Giardia lamblia
APTGNPNSTA

SEQ ID NO: 3100003 - protein, 8 aa, Giardia lamblia
APTGSGKT

SEQ ID NO: 3100004 - protein, 8 aa, Giardia lamblia
APTGTGKT

SEQ ID NO: 3100005 - protein, 13 aa, Giardia lamblia
APTHESPPPQADQ

SEQ ID NO: 3100006 - protein, 22 aa, Giardia lamblia
APTIRPASADISKRGSAHEGQL

SEQ ID NO: 3100007 - protein, 17 aa, Giardia lamblia
APTNDNAKREVQGPCSH

SEQ ID NO: 3100008 - protein, 8 aa, Giardia lamblia
APTNGEGV

SEQ ID NO: 3100009 - protein, 7 aa, Giardia lamblia
APTPQEL

SEQ ID NO: 3100010 - protein, 8 aa, Giardia lamblia
APTPRLGD

SEQ ID NO: 3100011 - protein, 8 aa, Giardia lamblia
APTPSGPS

SEQ ID NO: 3100012 - protein, 4 aa, Giardia lamblia
APTQ

SEQ ID NO: 3100013 - protein, 9 aa, Giardia lamblia
APTQDPDNV

SEQ ID NO: 3100014 - protein, 26 aa, Giardia lamblia
APTRRQEASDSQQGACATSVSETQAG

SEQ ID NO: 3100015 - protein, 8 aa, Giardia lamblia
APTSAGKS

SEQ ID NO: 3100016 - protein, 10 aa, Giardia lamblia
APTSNWGSSM

SEQ ID NO: 3100017 - protein, 14 aa, Giardia lamblia
APTSPQLPSLPPHQ

SEQ ID NO: 3100018 - protein, 8 aa, Giardia lamblia
APTSSQAR

SEQ ID NO: 3100019 - protein, 24 aa, Giardia lamblia
APTTPESGAVRGDTVTPPQTSSAS

SEQ ID NO: 3100020 - protein, 6 aa, Giardia lamblia
APTTRT

SEQ ID NO: 3100021 - protein, 8 aa, Giardia lamblia
APTYSREA

SEQ ID NO: 3100022 - protein, 7 aa, Giardia lamblia
APVARRG

SEQ ID NO: 3100023 - protein, 9 aa, Giardia lamblia
APVATTPFP

SEQ ID NO: 3100024 - protein, 10 aa, Giardia lamblia
APVDAGPAAA

SEQ ID NO: 3100025 - protein, 13 aa, Giardia lamblia
APVDKDPQATDNP

SEQ ID NO: 3100026 - protein, 10 aa, Giardia lamblia
APVEDEDGPA

SEQ ID NO: 3100027 - protein, 8 aa, Giardia lamblia
APVGAPPT

SEQ ID NO: 3100028 - protein, 11 aa, Giardia lamblia
APVGEKDDSNL

SEQ ID NO: 3100029 - protein, 6 aa, Giardia lamblia
APVGHG

SEQ ID NO: 3100030 - protein, 12 aa, Giardia lamblia
APVGPSRTHARQ

SEQ ID NO: 3100031 - protein, 4 aa, Giardia lamblia
APVP

SEQ ID NO: 3100032 - protein, 19 aa, Giardia lamblia
APVPPAVPSGTSKRPGSAS

SEQ ID NO: 3100033 - protein, 5 aa, Giardia lamblia
APVQG

SEQ ID NO: 3100034 - protein, 6 aa, Giardia lamblia
APVRTL

SEQ ID NO: 3100035 - protein, 5 aa, Giardia lamblia
APVRY

SEQ ID NO: 3100036 - protein, 8 aa, Giardia lamblia
APVSNDSP

SEQ ID NO: 3100037 - protein, 7 aa, Giardia lamblia
APVSPVT

SEQ ID NO: 3100038 - protein, 6 aa, Giardia lamblia
APVSQA

SEQ ID NO: 3100039 - protein, 14 aa, Giardia lamblia
APVSSSTSCEPSTN

SEQ ID NO: 3100040 - protein, 9 aa, Giardia lamblia
APVTKAQHP

SEQ ID NO: 3100041 - protein, 21 aa, Giardia lamblia
APVTPEVDGSKTVRSSNLNTP

SEQ ID NO: 3100042 - protein, 8 aa, Giardia lamblia
APVTPPSL

SEQ ID NO: 3100043 - protein, 4 aa, Giardia lamblia
APVV

SEQ ID NO: 3100044 - protein, 5 aa, Giardia lamblia
APVYP

SEQ ID NO: 3100045 - protein, 21 aa, Giardia lamblia
APWPSSYESALSEKIKEAEKH

SEQ ID NO: 3100046 - protein, 6 aa, Giardia lamblia
APYGGM

SEQ ID NO: 3100047 - protein, 4 aa, Giardia lamblia
APYI

SEQ ID NO: 3100048 - protein, 4 aa, Giardia lamblia
APYR

SEQ ID NO: 3100049 - protein, 20 aa, Giardia lamblia
APYSPPVRTTESRIGQPETY

SEQ ID NO: 3100050 - protein, 10 aa, Giardia lamblia
APYSSISTTT

SEQ ID NO: 3100051 - protein, 5 aa, Giardia lamblia
APYYD

SEQ ID NO: 3100052 - protein, 11 aa, Giardia lamblia
AQAAADENSMS

SEQ ID NO: 3100053 - protein, 9 aa, Giardia lamblia
AQAAKFTET

SEQ ID NO: 3100054 - protein, 6 aa, Giardia lamblia
AQAATA

SEQ ID NO: 3100055 - protein, 13 aa, Giardia lamblia
AQAATRRGPSTTR

SEQ ID NO: 3100056 - protein, 5 aa, Giardia lamblia
AQAAV

SEQ ID NO: 3100057 - protein, 7 aa, Giardia lamblia
AQADGQV

SEQ ID NO: 3100058 - protein, 14 aa, Giardia lamblia
AQAEEETDDIVTSS

SEQ ID NO: 3100059 - protein, 5 aa, Giardia lamblia
AQAGD

SEQ ID NO: 3100060 - protein, 32 aa, Giardia lamblia
AQAGGARAPLAAGDRHPAGQGREEAEEASGHR

SEQ ID NO: 3100061 - protein, 12 aa, Giardia lamblia
AQAGLENSEGRT

SEQ ID NO: 3100062 - protein, 5 aa, Giardia lamblia
AQAGS

SEQ ID NO: 3100063 - protein, 7 aa, Giardia lamblia
AQALEER

SEQ ID NO: 3100064 - protein, 4 aa, Giardia lamblia
AQAN

SEQ ID NO: 3100065 - protein, 10 aa, Giardia lamblia
AQANSSTSFT

SEQ ID NO: 3100066 - protein, 6 aa, Giardia lamblia
AQAPNK

SEQ ID NO: 3100067 - protein, 22 aa, Giardia lamblia
AQAQERTKQVEFSQKEANQALE

SEQ ID NO: 3100068 - protein, 8 aa, Giardia lamblia
AQAQPDYG

SEQ ID NO: 3100069 - protein, 13 aa, Giardia lamblia
AQARQKENQASKM

SEQ ID NO: 3100070 - protein, 15 aa, Giardia lamblia
AQASNSAAGGRTQSS

SEQ ID NO: 3100071 - protein, 7 aa, Giardia lamblia
AQASSKN

SEQ ID NO: 3100072 - protein, 7 aa, Giardia lamblia
AQATESV

SEQ ID NO: 3100073 - protein, 12 aa, Giardia lamblia
AQATQGGENERA

SEQ ID NO: 3100074 - protein, 27 aa, Giardia lamblia
AQATQIPSSGPKAPGSSPDALKDIGTQ

SEQ ID NO: 3100075 - protein, 10 aa, Giardia lamblia
AQAYKDGDEL

SEQ ID NO: 3100076 - protein, 24 aa, Giardia lamblia
AQAYNGPDVSSSDLRRALSDNDAL

SEQ ID NO: 3100077 - protein, 11 aa, Giardia lamblia
AQAYSELGGNG

SEQ ID NO: 3100078 - protein, 14 aa, Giardia lamblia
AQCSETDDKSNHTV

SEQ ID NO: 3100079 - protein, 10 aa, Giardia lamblia
AQDAARGYAS

SEQ ID NO: 3100080 - protein, 6 aa, Giardia lamblia
AQDADS

SEQ ID NO: 3100081 - protein, 9 aa, Giardia lamblia
AQDAGGTDY

SEQ ID NO: 3100082 - protein, 18 aa, Giardia lamblia
AQDAPVPDPGDDHRLDGP

SEQ ID NO: 3100083 - protein, 4 aa, Giardia lamblia
AQDG

SEQ ID NO: 3100084 - protein, 6 aa, Giardia lamblia
AQDKEM

SEQ ID NO: 3100085 - protein, 5 aa, Giardia lamblia
AQDLY

SEQ ID NO: 3100086 - protein, 4 aa, Giardia lamblia
AQDM

SEQ ID NO: 3100087 - protein, 9 aa, Giardia lamblia
AQDNEGAAE

SEQ ID NO: 3100088 - protein, 9 aa, Giardia lamblia
AQDNESTCE

SEQ ID NO: 3100089 - protein, 5 aa, Giardia lamblia
AQDNL

SEQ ID NO: 3100090 - protein, 5 aa, Giardia lamblia
AQDNV

SEQ ID NO: 3100091 - protein, 6 aa, Giardia lamblia
AQDPFG

SEQ ID NO: 3100092 - protein, 15 aa, Giardia lamblia
AQDPGVDSAVRKAGG

SEQ ID NO: 3100093 - protein, 7 aa, Giardia lamblia
AQDPQGT

SEQ ID NO: 3100094 - protein, 10 aa, Giardia lamblia
AQDQTSSKQI

SEQ ID NO: 3100095 - protein, 4 aa, Giardia lamblia
AQDS

SEQ ID NO: 3100096 - protein, 9 aa, Giardia lamblia
AQDSAVSDQ

SEQ ID NO: 3100097 - protein, 20 aa, Giardia lamblia
AQDSFAANQSHYDGNADGTW

SEQ ID NO: 3100098 - protein, 6 aa, Giardia lamblia
AQDSGL

SEQ ID NO: 3100099 - protein, 7 aa, Giardia lamblia
AQDSGSI

SEQ ID NO: 3100100 - protein, 16 aa, Giardia lamblia
AQDTHDGVVSDGGSAI

SEQ ID NO: 3100101 - protein, 12 aa, Giardia lamblia
AQDYNRKITPDS

SEQ ID NO: 3100102 - protein, 5 aa, Giardia lamblia
AQEAE

SEQ ID NO: 3100103 - protein, 8 aa, Giardia lamblia
AQEAPGSL

SEQ ID NO: 3100104 - protein, 10 aa, Giardia lamblia
AQEASEYDVD

SEQ ID NO: 3100105 - protein, 18 aa, Giardia lamblia
AQEDDVESDDEDKGYYGD

SEQ ID NO: 3100106 - protein, 27 aa, Giardia lamblia
AQEDNYRKSVTSRTTTLPLPSTSTSVA

SEQ ID NO: 3100107 - protein, 12 aa, Giardia lamblia
AQEDQPSNSTEV

SEQ ID NO: 3100108 - protein, 9 aa, Giardia lamblia
AQEEREAKL

SEQ ID NO: 3100109 - protein, 6 aa, Giardia lamblia
AQEGHK

SEQ ID NO: 3100110 - protein, 8 aa, Giardia lamblia
AQEGNRPN

SEQ ID NO: 3100111 - protein, 7 aa, Giardia lamblia
AQEGTTG

SEQ ID NO: 3100112 - protein, 23 aa, Giardia lamblia
AQEIDNRNEITSLSSSLNKKDEQ

SEQ ID NO: 3100113 - protein, 5 aa, Giardia lamblia
AQELS

SEQ ID NO: 3100114 - protein, 11 aa, Giardia lamblia
AQENRISSGSL

SEQ ID NO: 3100115 - protein, 32 aa, Giardia lamblia
AQEPKPEDSTGFAKEEESLTREPTPDSSEIAT

SEQ ID NO: 3100116 - protein, 9 aa, Giardia lamblia
AQEPQSPQR

SEQ ID NO: 3100117 - protein, 5 aa, Giardia lamblia
AQEQN

SEQ ID NO: 3100118 - protein, 7 aa, Giardia lamblia
AQEQPAV

SEQ ID NO: 3100119 - protein, 9 aa, Giardia lamblia
AQERQESGS

SEQ ID NO: 3100120 - protein, 7 aa, Giardia lamblia
AQERRQQ

SEQ ID NO: 3100121 - protein, 13 aa, Giardia lamblia
AQERSDSAELDTA

SEQ ID NO: 3100122 - protein, 8 aa, Giardia lamblia
AQESRNPI

SEQ ID NO: 3100123 - protein, 11 aa, Giardia lamblia
AQETPDESQGR

SEQ ID NO: 3100124 - protein, 10 aa, Giardia lamblia
AQEVNENGAT

SEQ ID NO: 3100125 - protein, 19 aa, Giardia lamblia
AQEWGTESQKAQGRPLTPN

SEQ ID NO: 3100126 - protein, 14 aa, Giardia lamblia
AQEYDGSDAGATCD

SEQ ID NO: 3100127 - protein, 10 aa, Giardia lamblia
AQEYEQASQI

SEQ ID NO: 3100128 - protein, 7 aa, Giardia lamblia
AQEYKPG

SEQ ID NO: 3100129 - protein, 5 aa, Giardia lamblia
AQGDL

SEQ ID NO: 3100130 - protein, 7 aa, Giardia lamblia
AQGGDRE

SEQ ID NO: 3100131 - protein, 20 aa, Giardia lamblia
AQGGDRGSLTKADSDEGENP

SEQ ID NO: 3100132 - protein, 4 aa, Giardia lamblia
AQGK

SEQ ID NO: 3100133 - protein, 19 aa, Giardia lamblia
AQGKDSGVSTSVSGASSIN

SEQ ID NO: 3100134 - protein, 6 aa, Giardia lamblia
AQGKKK

SEQ ID NO: 3100135 - protein, 12 aa, Giardia lamblia
AQGLSSDKEQLR

SEQ ID NO: 3100136 - protein, 5 aa, Giardia lamblia
AQGQG

SEQ ID NO: 3100137 - protein, 8 aa, Giardia lamblia
AQGRESTI

SEQ ID NO: 3100138 - protein, 20 aa, Giardia lamblia
AQGRPRSFSASTSRKPSNES

SEQ ID NO: 3100139 - protein, 5 aa, Giardia lamblia
AQGRT

SEQ ID NO: 3100140 - protein, 7 aa, Giardia lamblia
AQGSHPP

SEQ ID NO: 3100141 - protein, 14 aa, Giardia lamblia
AQGSHSARLGEDST

SEQ ID NO: 3100142 - protein, 8 aa, Giardia lamblia
AQGSKDLG

SEQ ID NO: 3100143 - protein, 9 aa, Giardia lamblia
AQGSVDEAS

SEQ ID NO: 3100144 - protein, 31 aa, Giardia lamblia
AQGTAQSNQTVTGRKTVTKSSLSRAGTGTLS

SEQ ID NO: 3100145 - protein, 11 aa, Giardia lamblia
AQGTQSTDRPT

SEQ ID NO: 3100146 - protein, 4 aa, Giardia lamblia
AQGV

SEQ ID NO: 3100147 - protein, 6 aa, Giardia lamblia
AQGVNG

SEQ ID NO: 3100148 - protein, 9 aa, Giardia lamblia
AQGVTDPTQ

SEQ ID NO: 3100149 - protein, 13 aa, Giardia lamblia
AQHADSQRDGSSI

SEQ ID NO: 3100150 - protein, 6 aa, Giardia lamblia
AQHAPN

SEQ ID NO: 3100151 - protein, 12 aa, Giardia lamblia
AQHAPQSSSAVR

SEQ ID NO: 3100152 - protein, 8 aa, Giardia lamblia
AQHESGVS

SEQ ID NO: 3100153 - protein, 12 aa, Giardia lamblia
AQHGASQKQANI

SEQ ID NO: 3100154 - protein, 14 aa, Giardia lamblia
AQHIEGNKLPSDVQ

SEQ ID NO: 3100155 - protein, 4 aa, Giardia lamblia
AQHQ

SEQ ID NO: 3100156 - protein, 6 aa, Giardia lamblia
AQHQEQ

SEQ ID NO: 3100157 - protein, 40 aa, Giardia lamblia
AQHTGSEEAATRGLSRGSGAKSSLGDNGRSCTRKKRSRST

SEQ ID NO: 3100158 - protein, 7 aa, Giardia lamblia
AQINNGA

SEQ ID NO: 3100159 - protein, 6 aa, Giardia lamblia
AQIPSK

SEQ ID NO: 3100160 - protein, 40 aa, Giardia lamblia
AQIQNGDSNLLDSTTSGAKKKSSSKARGLKIPGNYKDTHD

SEQ ID NO: 3100161 - protein, 4 aa, Giardia lamblia
AQIR

SEQ ID NO: 3100162 - protein, 6 aa, Giardia lamblia
AQISSL

SEQ ID NO: 3100163 - protein, 7 aa, Giardia lamblia
AQITSSL

SEQ ID NO: 3100164 - protein, 11 aa, Giardia lamblia
AQKADKSGTVA

SEQ ID NO: 3100165 - protein, 8 aa, Giardia lamblia
AQKDAQGG

SEQ ID NO: 3100166 - protein, 6 aa, Giardia lamblia
AQKDRM

SEQ ID NO: 3100167 - protein, 4 aa, Giardia lamblia
AQKE

SEQ ID NO: 3100168 - protein, 14 aa, Giardia lamblia
AQKEDALKDDLNSA

SEQ ID NO: 3100169 - protein, 18 aa, Giardia lamblia
AQKEQRINKSVEKAREFK

SEQ ID NO: 3100170 - protein, 8 aa, Giardia lamblia
AQKERELK

SEQ ID NO: 3100171 - protein, 6 aa, Giardia lamblia
AQKETI

SEQ ID NO: 3100172 - protein, 6 aa, Giardia lamblia
AQKGDV

SEQ ID NO: 3100173 - protein, 15 aa, Giardia lamblia
AQKGKEALESEVSDV

SEQ ID NO: 3100174 - protein, 8 aa, Giardia lamblia
AQKKTGSH

SEQ ID NO: 3100175 - protein, 12 aa, Giardia lamblia
AQKLEEADVKQR

SEQ ID NO: 3100176 - protein, 12 aa, Giardia lamblia
AQKLKEARAHEA

SEQ ID NO: 3100177 - protein, 9 aa, Giardia lamblia
AQKNSEIES

SEQ ID NO: 3100178 - protein, 12 aa, Giardia lamblia
AQKQPNSQHEEL

SEQ ID NO: 3100179 - protein, 7 aa, Giardia lamblia
AQKQTAH

SEQ ID NO: 3100180 - protein, 5 aa, Giardia lamblia
AQKRF

SEQ ID NO: 3100181 - protein, 9 aa, Giardia lamblia
AQKSTFPGQ

SEQ ID NO: 3100182 - protein, 4 aa, Giardia lamblia
AQKT

SEQ ID NO: 3100183 - protein, 27 aa, Giardia lamblia
AQKTKRLSSALQSKDSALKDRRASNFS

SEQ ID NO: 3100184 - protein, 7 aa, Giardia lamblia
AQKTPDL

SEQ ID NO: 3100185 - protein, 7 aa, Giardia lamblia
AQKYNEE

SEQ ID NO: 3100186 - protein, 5 aa, Giardia lamblia
AQLED

SEQ ID NO: 3100187 - protein, 7 aa, Giardia lamblia
AQLEQKG

SEQ ID NO: 3100188 - protein, 23 aa, Giardia lamblia
AQLEREKDTIASQLAEGRETLTQ

SEQ ID NO: 3100189 - protein, 6 aa, Giardia lamblia
AQLGPP

SEQ ID NO: 3100190 - protein, 8 aa, Giardia lamblia
AQLKTKDE

SEQ ID NO: 3100191 - protein, 11 aa, Giardia lamblia
AQLNPTNYPCK

SEQ ID NO: 3100192 - protein, 34 aa, Giardia lamblia
AQLPDAAEQETQPGINSSQSDNVASQSAHQPIDA

SEQ ID NO: 3100193 - protein, 14 aa, Giardia lamblia
AQLPKYDADQGVSV

SEQ ID NO: 3100194 - protein, 14 aa, Giardia lamblia
AQLQKEPPDQTNNP

SEQ ID NO: 3100195 - protein, 12 aa, Giardia lamblia
AQLRAQASQTRL

SEQ ID NO: 3100196 - protein, 4 aa, Giardia lamblia
AQLS

SEQ ID NO: 3100197 - protein, 31 aa, Giardia lamblia
AQLSAPASPALASGCPQARPGTSASGIPTYE

SEQ ID NO: 3100198 - protein, 5 aa, Giardia lamblia
AQLSG

SEQ ID NO: 3100199 - protein, 6 aa, Giardia lamblia
AQLSGE

SEQ ID NO: 3100200 - protein, 7 aa, Giardia lamblia
AQLSTKQ

SEQ ID NO: 3100201 - protein, 8 aa, Giardia lamblia
AQLTEKRT

SEQ ID NO: 3100202 - protein, 47 aa, Giardia lamblia
AQMAKGSSANRRKSSVSQMKSAPQRSGSTVSSARAGSTKRPPTGFAG

SEQ ID NO: 3100203 - protein, 10 aa, Giardia lamblia
AQMQDDKSRT

SEQ ID NO: 3100204 - protein, 14 aa, Giardia lamblia
AQMSTTDGYKYGSG

SEQ ID NO: 3100205 - protein, 16 aa, Giardia lamblia
AQNATNTNNPNNANNE

SEQ ID NO: 3100206 - protein, 7 aa, Giardia lamblia
AQNDREM

SEQ ID NO: 3100207 - protein, 6 aa, Giardia lamblia
AQNDTS

SEQ ID NO: 3100208 - protein, 4 aa, Giardia lamblia
AQNG

SEQ ID NO: 3100209 - protein, 7 aa, Giardia lamblia
AQNGHAV

SEQ ID NO: 3100210 - protein, 7 aa, Giardia lamblia
AQNGKQD

SEQ ID NO: 3100211 - protein, 7 aa, Giardia lamblia
AQNGNVR

SEQ ID NO: 3100212 - protein, 5 aa, Giardia lamblia
AQNKE

SEQ ID NO: 3100213 - protein, 14 aa, Giardia lamblia
AQNKQRKAKRAAEI

SEQ ID NO: 3100214 - protein, 8 aa, Giardia lamblia
AQNPKACA

SEQ ID NO: 3100215 - protein, 6 aa, Giardia lamblia
AQNQRV

SEQ ID NO: 3100216 - protein, 15 aa, Giardia lamblia
AQNRTASVSDKLQQG

SEQ ID NO: 3100217 - protein, 7 aa, Giardia lamblia
AQNSGTD

SEQ ID NO: 3100218 - protein, 5 aa, Giardia lamblia
AQNSV

SEQ ID NO: 3100219 - protein, 11 aa, Giardia lamblia
AQNTKADQMES

SEQ ID NO: 3100220 - protein, 33 aa, Giardia lamblia
AQPDAALAPSPEPQIKKRPTWGQPSSAFTPKTR

SEQ ID NO: 3100221 - protein, 6 aa, Giardia lamblia
AQPDQA

SEQ ID NO: 3100222 - protein, 13 aa, Giardia lamblia
AQPDQDGLPLTDA

SEQ ID NO: 3100223 - protein, 5 aa, Giardia lamblia
AQPHS

SEQ ID NO: 3100224 - protein, 8 aa, Giardia lamblia
AQPLESTS

SEQ ID NO: 3100225 - protein, 6 aa, Giardia lamblia
AQPLSY

SEQ ID NO: 3100226 - protein, 6 aa, Giardia lamblia
AQPNLK

SEQ ID NO: 3100227 - protein, 11 aa, Giardia lamblia
AQPPTSEAVPS

SEQ ID NO: 3100228 - protein, 8 aa, Giardia lamblia
AQPPTYIK

SEQ ID NO: 3100229 - protein, 20 aa, Giardia lamblia
AQPQDTSASHRSHPRSPSVP

SEQ ID NO: 3100230 - protein, 24 aa, Giardia lamblia
AQPRSEMQGSIPAPPADDAPSLTS

SEQ ID NO: 3100231 - protein, 5 aa, Giardia lamblia
AQPSD

SEQ ID NO: 3100232 - protein, 8 aa, Giardia lamblia
AQPSGQAS

SEQ ID NO: 3100233 - protein, 19 aa, Giardia lamblia
AQPSKTNIHEPSDNSYGPI

SEQ ID NO: 3100234 - protein, 32 aa, Giardia lamblia
AQPTASLTSASASPSPRGFSTPGASPQQGHLK

SEQ ID NO: 3100235 - protein, 10 aa, Giardia lamblia
AQPTTTYTAD

SEQ ID NO: 3100236 - protein, 32 aa, Giardia lamblia
AQPVHQPTQQIQPQMQPQAPAQTNNIADLMSF

SEQ ID NO: 3100237 - protein, 15 aa, Giardia lamblia
AQQAAGQMTTSPTAA

SEQ ID NO: 3100238 - protein, 13 aa, Giardia lamblia
AQQAPQKKTKPGL

SEQ ID NO: 3100239 - protein, 8 aa, Giardia lamblia
AQQDADKV

SEQ ID NO: 3100240 - protein, 8 aa, Giardia lamblia
AQQEASSV

SEQ ID NO: 3100241 - protein, 28 aa, Giardia lamblia
AQQEDAKGSAEPEASPVVPAKAPDQHLP

SEQ ID NO: 3100242 - protein, 12 aa, Giardia lamblia
AQQELGEKERAY

SEQ ID NO: 3100243 - protein, 8 aa, Giardia lamblia
AQQENRGY

SEQ ID NO: 3100244 - protein, 10 aa, Giardia lamblia
AQQEPSSIKL

SEQ ID NO: 3100245 - protein, 7 aa, Giardia lamblia
AQQETIE

SEQ ID NO: 3100246 - protein, 6 aa, Giardia lamblia
AQQGAI

SEQ ID NO: 3100247 - protein, 6 aa, Giardia lamblia
AQQGLQ

SEQ ID NO: 3100248 - protein, 6 aa, Giardia lamblia
AQQGNV

SEQ ID NO: 3100249 - protein, 6 aa, Giardia lamblia
AQQKAR

SEQ ID NO: 3100250 - protein, 4 aa, Giardia lamblia
AQQM

SEQ ID NO: 3100251 - protein, 5 aa, Giardia lamblia
AQQNS

SEQ ID NO: 3100252 - protein, 19 aa, Giardia lamblia
AQQRDNMPTETANSRPSAS

SEQ ID NO: 3100253 - protein, 7 aa, Giardia lamblia
AQQRLKQ

SEQ ID NO: 3100254 - protein, 8 aa, Giardia lamblia
AQQSFSAA

SEQ ID NO: 3100255 - protein, 5 aa, Giardia lamblia
AQQSH

SEQ ID NO: 3100256 - protein, 11 aa, Giardia lamblia
AQQTADDITRN

SEQ ID NO: 3100257 - protein, 7 aa, Giardia lamblia
AQQTDPA

SEQ ID NO: 3100258 - protein, 5 aa, Giardia lamblia
AQRAD

SEQ ID NO: 3100259 - protein, 21 aa, Giardia lamblia
AQRATGPTSTSSTATSGPGQH

SEQ ID NO: 3100260 - protein, 4 aa, Giardia lamblia
AQRD

SEQ ID NO: 3100261 - protein, 7 aa, Giardia lamblia
AQRDEDG

SEQ ID NO: 3100262 - protein, 11 aa, Giardia lamblia
AQRDGSKGPYR

SEQ ID NO: 3100263 - protein, 10 aa, Giardia lamblia
AQRDYNSQAI

SEQ ID NO: 3100264 - protein, 10 aa, Giardia lamblia
AQREEKIEAD

SEQ ID NO: 3100265 - protein, 18 aa, Giardia lamblia
AQRGEDSQDDTGDEGSIC

SEQ ID NO: 3100266 - protein, 5 aa, Giardia lamblia
AQRGN

SEQ ID NO: 3100267 - protein, 5 aa, Giardia lamblia
AQRKN

SEQ ID NO: 3100268 - protein, 5 aa, Giardia lamblia
AQRKR

SEQ ID NO: 3100269 - protein, 4 aa, Giardia lamblia
AQRL

SEQ ID NO: 3100270 - protein, 5 aa, Giardia lamblia
AQRMT

SEQ ID NO: 3100271 - protein, 9 aa, Giardia lamblia
AQRNSTIGT

SEQ ID NO: 3100272 - protein, 11 aa, Giardia lamblia
AQRPEENDQLS

SEQ ID NO: 3100273 - protein, 5 aa, Giardia lamblia
AQRPG

SEQ ID NO: 3100274 - protein, 5 aa, Giardia lamblia
AQRPS

SEQ ID NO: 3100275 - protein, 18 aa, Giardia lamblia
AQRPSSLRPLTPSFIFTK

SEQ ID NO: 3100276 - protein, 7 aa, Giardia lamblia
AQRRESH

SEQ ID NO: 3100277 - protein, 12 aa, Giardia lamblia
AQRTCSKPRRRH

SEQ ID NO: 3100278 - protein, 10 aa, Giardia lamblia
AQRTRDSSCQ

SEQ ID NO: 3100279 - protein, 7 aa, Giardia lamblia
AQSATLN

SEQ ID NO: 3100280 - protein, 10 aa, Giardia lamblia
AQSCNTSNPA

SEQ ID NO: 3100281 - protein, 8 aa, Giardia lamblia
AQSDAEQL

SEQ ID NO: 3100282 - protein, 18 aa, Giardia lamblia
AQSDVDRRGVEADSPLRG

SEQ ID NO: 3100283 - protein, 22 aa, Giardia lamblia
AQSDVDRRRVESGGPPSPSGGV

SEQ ID NO: 3100284 - protein, 13 aa, Giardia lamblia
AQSETGKWVRVVV

SEQ ID NO: 3100285 - protein, 9 aa, Giardia lamblia
AQSGEAVDT

SEQ ID NO: 3100286 - protein, 21 aa, Giardia lamblia
AQSGNAPGEAETNPEPEGFSE

SEQ ID NO: 3100287 - protein, 7 aa, Giardia lamblia
AQSGTSA

SEQ ID NO: 3100288 - protein, 23 aa, Giardia lamblia
AQSHRSGSTDLVSSRPRSRSSRS

SEQ ID NO: 3100289 - protein, 4 aa, Giardia lamblia
AQSI

SEQ ID NO: 3100290 - protein, 5 aa, Giardia lamblia
AQSIR

SEQ ID NO: 3100291 - protein, 6 aa, Giardia lamblia
AQSLEE

SEQ ID NO: 3100292 - protein, 6 aa, Giardia lamblia
AQSLSD

SEQ ID NO: 3100293 - protein, 7 aa, Giardia lamblia
AQSNASM

SEQ ID NO: 3100294 - protein, 12 aa, Giardia lamblia
AQSPVSPRPSGF

SEQ ID NO: 3100295 - protein, 4 aa, Giardia lamblia
AQSQ

SEQ ID NO: 3100296 - protein, 40 aa, Giardia lamblia
AQSQTTQEQPYSTISGGPYAPNTFTESQQNEGDVLDQDGT

SEQ ID NO: 3100297 - protein, 4 aa, Giardia lamblia
AQSR

SEQ ID NO: 3100298 - protein, 6 aa, Giardia lamblia
AQSRDK

SEQ ID NO: 3100299 - protein, 5 aa, Giardia lamblia
AQSRE

SEQ ID NO: 3100300 - protein, 30 aa, Giardia lamblia
AQSRGSGPHTQKKSKCTDEGGASQASRDTA

SEQ ID NO: 3100301 - protein, 8 aa, Giardia lamblia
AQSRQTKE

SEQ ID NO: 3100302 - protein, 13 aa, Giardia lamblia
AQSRRSQSSSSAR

SEQ ID NO: 3100303 - protein, 15 aa, Giardia lamblia
AQSSAKGKDLKNQVE

SEQ ID NO: 3100304 - protein, 9 aa, Giardia lamblia
AQSSATGLA

SEQ ID NO: 3100305 - protein, 12 aa, Giardia lamblia
AQSSESNKYNQL

SEQ ID NO: 3100306 - protein, 6 aa, Giardia lamblia
AQSSMT

SEQ ID NO: 3100307 - protein, 7 aa, Giardia lamblia
AQSSRST

SEQ ID NO: 3100308 - protein, 11 aa, Giardia lamblia
AQSSSKPLATS

SEQ ID NO: 3100309 - protein, 6 aa, Giardia lamblia
AQSSSL

SEQ ID NO: 3100310 - protein, 16 aa, Giardia lamblia
AQSSSPSTLRGSMSRR

SEQ ID NO: 3100311 - protein, 4 aa, Giardia lamblia
AQST

SEQ ID NO: 3100312 - protein, 12 aa, Giardia lamblia
AQSTCSEAECSP

SEQ ID NO: 3100313 - protein, 7 aa, Giardia lamblia
AQSTSPL

SEQ ID NO: 3100314 - protein, 12 aa, Giardia lamblia
AQSVASKTYQNT

SEQ ID NO: 3100315 - protein, 4 aa, Giardia lamblia
AQTA

SEQ ID NO: 3100316 - protein, 16 aa, Giardia lamblia
AQTAKTAKQTAGKGHA

SEQ ID NO: 3100317 - protein, 14 aa, Giardia lamblia
AQTASKLDAPRVGT

SEQ ID NO: 3100318 - protein, 16 aa, Giardia lamblia
AQTEISDVDPEEQAKV

SEQ ID NO: 3100319 - protein, 8 aa, Giardia lamblia
AQTGQEHM

SEQ ID NO: 3100320 - protein, 10 aa, Giardia lamblia
AQTGRGHLTD

SEQ ID NO: 3100321 - protein, 8 aa, Giardia lamblia
AQTGSGKT

SEQ ID NO: 3100322 - protein, 52 aa, Giardia lamblia
AQTGSSIHKGPAKTTTTKSIGCGPDTTLSKESSKLTTGASNEYKELSPEEEE

SEQ ID NO: 3100323 - protein, 19 aa, Giardia lamblia
AQTGTGPSSSLTPEGVTKI

SEQ ID NO: 3100324 - protein, 9 aa, Giardia lamblia
AQTKAGSPV

SEQ ID NO: 3100325 - protein, 10 aa, Giardia lamblia
AQTKEKGFQL

SEQ ID NO: 3100326 - protein, 16 aa, Giardia lamblia
AQTPPDPSAPRRAQGR

SEQ ID NO: 3100327 - protein, 16 aa, Giardia lamblia
AQTPPGPSAPRRAQGR

SEQ ID NO: 3100328 - protein, 15 aa, Giardia lamblia
AQTPSEECAQQTPAV

SEQ ID NO: 3100329 - protein, 7 aa, Giardia lamblia
AQTPSMN

SEQ ID NO: 3100330 - protein, 19 aa, Giardia lamblia
AQTQKGQYQREEERREREN

SEQ ID NO: 3100331 - protein, 4 aa, Giardia lamblia
AQTR

SEQ ID NO: 3100332 - protein, 5 aa, Giardia lamblia
AQTRE

SEQ ID NO: 3100333 - protein, 12 aa, Giardia lamblia
AQTRGLSASPGV

SEQ ID NO: 3100334 - protein, 9 aa, Giardia lamblia
AQTSAGPEA

SEQ ID NO: 3100335 - protein, 10 aa, Giardia lamblia
AQTTNTGSYF

SEQ ID NO: 3100336 - protein, 7 aa, Giardia lamblia
AQTYEGK

SEQ ID NO: 3100337 - protein, 4 aa, Giardia lamblia
AQVA

SEQ ID NO: 3100338 - protein, 28 aa, Giardia lamblia
AQVDAQKREKRYNEVQGSFESAQASLEN

SEQ ID NO: 3100339 - protein, 5 aa, Giardia lamblia
AQVDG

SEQ ID NO: 3100340 - protein, 18 aa, Giardia lamblia
AQVDSDGLTKNDLPTEKD

SEQ ID NO: 3100341 - protein, 7 aa, Giardia lamblia
AQVQGKR

SEQ ID NO: 3100342 - protein, 12 aa, Giardia lamblia
AQVSTSDADISR

SEQ ID NO: 3100343 - protein, 4 aa, Giardia lamblia
AQYA

SEQ ID NO: 3100344 - protein, 6 aa, Giardia lamblia
AQYDGN

SEQ ID NO: 3100345 - protein, 7 aa, Giardia lamblia
AQYGDNY

SEQ ID NO: 3100346 - protein, 6 aa, Giardia lamblia
AQYTDA

SEQ ID NO: 3100347 - protein, 18 aa, Giardia lamblia
AQYTDSRSTNLTSATDPY

SEQ ID NO: 3100348 - protein, 5 aa, Giardia lamblia
ARAAL

SEQ ID NO: 3100349 - protein, 14 aa, Giardia lamblia
ARAAQAAGDASAAL

SEQ ID NO: 3100350 - protein, 20 aa, Giardia lamblia
ARAATSGFSQPSYPSHTSQD

SEQ ID NO: 3100351 - protein, 6 aa, Giardia lamblia
ARAAYR

SEQ ID NO: 3100352 - protein, 12 aa, Giardia lamblia
ARADEASAERDR

SEQ ID NO: 3100353 - protein, 10 aa, Giardia lamblia
ARADNSVNQQ

SEQ ID NO: 3100354 - protein, 7 aa, Giardia lamblia
ARADRAG

SEQ ID NO: 3100355 - protein, 17 aa, Giardia lamblia
ARAEASGATASNIAAGD

SEQ ID NO: 3100356 - protein, 12 aa, Giardia lamblia
ARAEQNRQELQD

SEQ ID NO: 3100357 - protein, 8 aa, Giardia lamblia
ARAGDSDV

SEQ ID NO: 3100358 - protein, 6 aa, Giardia lamblia
ARAGHR

SEQ ID NO: 3100359 - protein, 8 aa, Giardia lamblia
ARAGKSNC

SEQ ID NO: 3100360 - protein, 24 aa, Giardia lamblia
ARAIRDKANEEAATASESPHTTQS

SEQ ID NO: 3100361 - protein, 10 aa, Giardia lamblia
ARAKDRQNHD

SEQ ID NO: 3100362 - protein, 4 aa, Giardia lamblia
ARAN

SEQ ID NO: 3100363 - protein, 8 aa, Giardia lamblia
ARANPNEV

SEQ ID NO: 3100364 - protein, 9 aa, Giardia lamblia
ARANTSSTL

SEQ ID NO: 3100365 - protein, 7 aa, Giardia lamblia
ARAPVGG

SEQ ID NO: 3100366 - protein, 8 aa, Giardia lamblia
ARAQGEHI

SEQ ID NO: 3100367 - protein, 4 aa, Giardia lamblia
ARAR

SEQ ID NO: 3100368 - protein, 5 aa, Giardia lamblia
ARARE

SEQ ID NO: 3100369 - protein, 17 aa, Giardia lamblia
ARARRPYKIGPTGTSGT

SEQ ID NO: 3100370 - protein, 7 aa, Giardia lamblia
ARASDLK

SEQ ID NO: 3100371 - protein, 17 aa, Giardia lamblia
ARASELEARNKGLEEAL

SEQ ID NO: 3100372 - protein, 5 aa, Giardia lamblia
ARASN

SEQ ID NO: 3100373 - protein, 14 aa, Giardia lamblia
ARASPSVNDELTSR

SEQ ID NO: 3100374 - protein, 10 aa, Giardia lamblia
ARASTDSSLA

SEQ ID NO: 3100375 - protein, 7 aa, Giardia lamblia
ARASTNK

SEQ ID NO: 3100376 - protein, 7 aa, Giardia lamblia
ARATDNY

SEQ ID NO: 3100377 - protein, 10 aa, Giardia lamblia
ARATRREAER

SEQ ID NO: 3100378 - protein, 6 aa, Giardia lamblia
ARCSSG

SEQ ID NO: 3100379 - protein, 6 aa, Giardia lamblia
ARDAEL

SEQ ID NO: 3100380 - protein, 11 aa, Giardia lamblia
ARDASSELEGF

SEQ ID NO: 3100381 - protein, 8 aa, Giardia lamblia
ARDATGRI

SEQ ID NO: 3100382 - protein, 20 aa, Giardia lamblia
ARDATSIKCSPRNGIATDKH

SEQ ID NO: 3100383 - protein, 11 aa, Giardia lamblia
ARDDATGSEQA

SEQ ID NO: 3100384 - protein, 8 aa, Giardia lamblia
ARDDENDV

SEQ ID NO: 3100385 - protein, 7 aa, Giardia lamblia
ARDDRAR

SEQ ID NO: 3100386 - protein, 6 aa, Giardia lamblia
ARDEED

SEQ ID NO: 3100387 - protein, 20 aa, Giardia lamblia
ARDGGTEVVQTTNSAGEAVP

SEQ ID NO: 3100388 - protein, 16 aa, Giardia lamblia
ARDGTFSSSEAFTKDC

SEQ ID NO: 3100389 - protein, 21 aa, Giardia lamblia
ARDGTKKKGLFSGSKKDKDEL

SEQ ID NO: 3100390 - protein, 16 aa, Giardia lamblia
ARDKGELKEKERQMED

SEQ ID NO: 3100391 - protein, 13 aa, Giardia lamblia
ARDPGVVKSSEDL

SEQ ID NO: 3100392 - protein, 5 aa, Giardia lamblia
ARDPL

SEQ ID NO: 3100393 - protein, 10 aa, Giardia lamblia
ARDPSGTSEL

SEQ ID NO: 3100394 - protein, 17 aa, Giardia lamblia
ARDQEVAASTGTNDGVF

SEQ ID NO: 3100395 - protein, 7 aa, Giardia lamblia
ARDQYGN

SEQ ID NO: 3100396 - protein, 6 aa, Giardia lamblia
ARDRDI

SEQ ID NO: 3100397 - protein, 9 aa, Giardia lamblia
ARDRLHDNP

SEQ ID NO: 3100398 - protein, 8 aa, Giardia lamblia
ARDRSGDT

SEQ ID NO: 3100399 - protein, 28 aa, Giardia lamblia
ARDSNAGREDSNLQEPPVKHSDDPLKQI

SEQ ID NO: 3100400 - protein, 6 aa, Giardia lamblia
ARDSSI

SEQ ID NO: 3100401 - protein, 6 aa, Giardia lamblia
ARDTSG

SEQ ID NO: 3100402 - protein, 8 aa, Giardia lamblia
AREADLSS

SEQ ID NO: 3100403 - protein, 5 aa, Giardia lamblia
AREAG

SEQ ID NO: 3100404 - protein, 4 aa, Giardia lamblia
ARED

SEQ ID NO: 3100405 - protein, 17 aa, Giardia lamblia
AREDQVQEETSTSEQNI

SEQ ID NO: 3100406 - protein, 22 aa, Giardia lamblia
AREEAKARSEETKEDGETRGSG

SEQ ID NO: 3100407 - protein, 6 aa, Giardia lamblia
AREEEL

SEQ ID NO: 3100408 - protein, 13 aa, Giardia lamblia
AREENRRNLVSVL

SEQ ID NO: 3100409 - protein, 6 aa, Giardia lamblia
AREEQI

SEQ ID NO: 3100410 - protein, 11 aa, Giardia lamblia
AREGATAELSG

SEQ ID NO: 3100411 - protein, 41 aa, Giardia lamblia
AREGTVDPEEDASVQRKRQRAEHSGLTAAESVRNDRGLPAS

SEQ ID NO: 3100412 - protein, 75 aa, Giardia lamblia
AREKAEKERQRREQEQQERERKERERQEKEREEREKHELESRERAEAEQWKQKQQQQQQQQQSAISPQKSPPKVR

SEQ ID NO: 3100413 - protein, 15 aa, Giardia lamblia
AREKAPGKFPKPERY

SEQ ID NO: 3100414 - protein, 39 aa, Giardia lamblia
AREKARKAAEANEKTKNSKGTKAPKVKKQSQGPSVTDTM

SEQ ID NO: 3100415 - protein, 8 aa, Giardia lamblia
AREKKEAA

SEQ ID NO: 3100416 - protein, 8 aa, Giardia lamblia
AREKKGLD

SEQ ID NO: 3100417 - protein, 7 aa, Giardia lamblia
AREKREA

SEQ ID NO: 3100418 - protein, 5 aa, Giardia lamblia
AREKY

SEQ ID NO: 3100419 - protein, 7 aa, Giardia lamblia
ARENDEL

SEQ ID NO: 3100420 - protein, 14 aa, Giardia lamblia
ARENGTIKNRLSDQ

SEQ ID NO: 3100421 - protein, 8 aa, Giardia lamblia
ARENKKGT

SEQ ID NO: 3100422 - protein, 5 aa, Giardia lamblia
ARENL

SEQ ID NO: 3100423 - protein, 23 aa, Giardia lamblia
AREPGLLSSDSSKGFCPQPASPA

SEQ ID NO: 3100424 - protein, 14 aa, Giardia lamblia
AREQRKAMKKSKSR

SEQ ID NO: 3100425 - protein, 8 aa, Giardia lamblia
ARERGTHI

SEQ ID NO: 3100426 - protein, 27 aa, Giardia lamblia
ARERRREQEKEKSSQDSMLSSTTSKLL

SEQ ID NO: 3100427 - protein, 7 aa, Giardia lamblia
ARETREN

SEQ ID NO: 3100428 - protein, 14 aa, Giardia lamblia
ARETSGKSRMTTCT

SEQ ID NO: 3100429 - protein, 13 aa, Giardia lamblia
AREVGNTVQNMTL

SEQ ID NO: 3100430 - protein, 4 aa, Giardia lamblia
ARFS

SEQ ID NO: 3100431 - protein, 10 aa, Giardia lamblia
ARGAPDTKSM

SEQ ID NO: 3100432 - protein, 4 aa, Giardia lamblia
ARGD

SEQ ID NO: 3100433 - protein, 6 aa, Giardia lamblia
ARGDAE

SEQ ID NO: 3100434 - protein, 8 aa, Giardia lamblia
ARGDGRKA

SEQ ID NO: 3100435 - protein, 6 aa, Giardia lamblia
ARGDTG

SEQ ID NO: 3100436 - protein, 8 aa, Giardia lamblia
ARGDTKTT

SEQ ID NO: 3100437 - protein, 12 aa, Giardia lamblia
ARGEPSGGPTLD

SEQ ID NO: 3100438 - protein, 9 aa, Giardia lamblia
ARGGAKNVT

SEQ ID NO: 3100439 - protein, 9 aa, Giardia lamblia
ARGGEGEFD

SEQ ID NO: 3100440 - protein, 8 aa, Giardia lamblia
ARGGQTSH

SEQ ID NO: 3100441 - protein, 8 aa, Giardia lamblia
ARGHPPKD

SEQ ID NO: 3100442 - protein, 12 aa, Giardia lamblia
ARGLRDVSAEKA

SEQ ID NO: 3100443 - protein, 6 aa, Giardia lamblia
ARGNIS

SEQ ID NO: 3100444 - protein, 5 aa, Giardia lamblia
ARGPM

SEQ ID NO: 3100445 - protein, 8 aa, Giardia lamblia
ARGPRRRG

SEQ ID NO: 3100446 - protein, 12 aa, Giardia lamblia
ARGPRVEAGGPL

SEQ ID NO: 3100447 - protein, 17 aa, Giardia lamblia
ARGQRLPAGTAAQKADK

SEQ ID NO: 3100448 - protein, 10 aa, Giardia lamblia
ARGRANPPAV

SEQ ID NO: 3100449 - protein, 5 aa, Giardia lamblia
ARGRD

SEQ ID NO: 3100450 - protein, 15 aa, Giardia lamblia
ARGREASDSSSNPIA

SEQ ID NO: 3100451 - protein, 7 aa, Giardia lamblia
ARGRRRR

SEQ ID NO: 3100452 - protein, 13 aa, Giardia lamblia
ARGSGEDNECSRR

SEQ ID NO: 3100453 - protein, 7 aa, Giardia lamblia
ARGSPGY

SEQ ID NO: 3100454 - protein, 4 aa, Giardia lamblia
ARGT

SEQ ID NO: 3100455 - protein, 16 aa, Giardia lamblia
ARGTDNVDINFDELSD

SEQ ID NO: 3100456 - protein, 10 aa, Giardia lamblia
ARHDPEGTHY

SEQ ID NO: 3100457 - protein, 12 aa, Giardia lamblia
ARHGTEDGEGST

SEQ ID NO: 3100458 - protein, 8 aa, Giardia lamblia
ARHHSTSA

SEQ ID NO: 3100459 - protein, 4 aa, Giardia lamblia
ARHP

SEQ ID NO: 3100460 - protein, 9 aa, Giardia lamblia
ARHTDSNGY

SEQ ID NO: 3100461 - protein, 6 aa, Giardia lamblia
ARHTEN

SEQ ID NO: 3100462 - protein, 5 aa, Giardia lamblia
ARIKE

SEQ ID NO: 3100463 - protein, 4 aa, Giardia lamblia
ARIP

SEQ ID NO: 3100464 - protein, 11 aa, Giardia lamblia
ARIPDAKGETG

SEQ ID NO: 3100465 - protein, 5 aa, Giardia lamblia
ARIPG

SEQ ID NO: 3100466 - protein, 10 aa, Giardia lamblia
ARIQTPYGTT

SEQ ID NO: 3100467 - protein, 6 aa, Giardia lamblia
ARIRGR

SEQ ID NO: 3100468 - protein, 6 aa, Giardia lamblia
ARISAS

SEQ ID NO: 3100469 - protein, 6 aa, Giardia lamblia
ARISGA

SEQ ID NO: 3100470 - protein, 11 aa, Giardia lamblia
ARISRADTTDI

SEQ ID NO: 3100471 - protein, 7 aa, Giardia lamblia
ARKADGM

SEQ ID NO: 3100472 - protein, 8 aa, Giardia lamblia
ARKATHPP

SEQ ID NO: 3100473 - protein, 5 aa, Giardia lamblia
ARKAV

SEQ ID NO: 3100474 - protein, 46 aa, Giardia lamblia
ARKEAREKAEAEAAAAAAAATAATEAKTGHTQKKEPVKGKGKRHHE

SEQ ID NO: 3100475 - protein, 13 aa, Giardia lamblia
ARKERRAKSDSKL

SEQ ID NO: 3100476 - protein, 9 aa, Giardia lamblia
ARKETGKLA

SEQ ID NO: 3100477 - protein, 15 aa, Giardia lamblia
ARKGIQSGVRIQDLA

SEQ ID NO: 3100478 - protein, 5 aa, Giardia lamblia
ARKGN

SEQ ID NO: 3100479 - protein, 9 aa, Giardia lamblia
ARKHSQPGF

SEQ ID NO: 3100480 - protein, 30 aa, Giardia lamblia
ARKINTPQSHVRPDVTPSVKNGRRESLSAN

SEQ ID NO: 3100481 - protein, 11 aa, Giardia lamblia
ARKIRRRQTRL

SEQ ID NO: 3100482 - protein, 9 aa, Giardia lamblia
ARKKDVDGY

SEQ ID NO: 3100483 - protein, 9 aa, Giardia lamblia
ARKKPKQCT

SEQ ID NO: 3100484 - protein, 8 aa, Giardia lamblia
ARKLRKEY

SEQ ID NO: 3100485 - protein, 6 aa, Giardia lamblia
ARKNPQ

SEQ ID NO: 3100486 - protein, 16 aa, Giardia lamblia
ARKQQDIYKRLMANMG

SEQ ID NO: 3100487 - protein, 9 aa, Giardia lamblia
ARKQTLNGT

SEQ ID NO: 3100488 - protein, 9 aa, Giardia lamblia
ARKQTQSTA

SEQ ID NO: 3100489 - protein, 4 aa, Giardia lamblia
ARKR

SEQ ID NO: 3100490 - protein, 14 aa, Giardia lamblia
ARKREEQMSKKRQS

SEQ ID NO: 3100491 - protein, 7 aa, Giardia lamblia
ARKRGTS

SEQ ID NO: 3100492 - protein, 12 aa, Giardia lamblia
ARKTDSKITQPS

SEQ ID NO: 3100493 - protein, 5 aa, Giardia lamblia
ARKTG

SEQ ID NO: 3100494 - protein, 13 aa, Giardia lamblia
ARKTTTSAYYRGE

SEQ ID NO: 3100495 - protein, 13 aa, Giardia lamblia
ARKYDDKSDRATT

SEQ ID NO: 3100496 - protein, 20 aa, Giardia lamblia
ARLDAPKAKMTDKTSEQDDV

SEQ ID NO: 3100497 - protein, 9 aa, Giardia lamblia
ARLESSRDN

SEQ ID NO: 3100498 - protein, 10 aa, Giardia lamblia
ARLKESKRAM

SEQ ID NO: 3100499 - protein, 8 aa, Giardia lamblia
ARLNRTDG

SEQ ID NO: 3100500 - protein, 21 aa, Giardia lamblia
ARLPATGGRRKKFSREGGAPV

SEQ ID NO: 3100501 - protein, 12 aa, Giardia lamblia
ARLQNKNGQTAT

SEQ ID NO: 3100502 - protein, 8 aa, Giardia lamblia
ARLQRAAD

SEQ ID NO: 3100503 - protein, 6 aa, Giardia lamblia
ARLRRS

SEQ ID NO: 3100504 - protein, 6 aa, Giardia lamblia
ARLSKA

SEQ ID NO: 3100505 - protein, 7 aa, Giardia lamblia
ARLSNGD

SEQ ID NO: 3100506 - protein, 7 aa, Giardia lamblia
ARLSRPD

SEQ ID NO: 3100507 - protein, 9 aa, Giardia lamblia
ARLTTVDGE

SEQ ID NO: 3100508 - protein, 4 aa, Giardia lamblia
ARMA

SEQ ID NO: 3100509 - protein, 8 aa, Giardia lamblia
ARMQDKDG

SEQ ID NO: 3100510 - protein, 10 aa, Giardia lamblia
ARMQDKRGRT

SEQ ID NO: 3100511 - protein, 8 aa, Giardia lamblia
ARMQDRSG

SEQ ID NO: 3100512 - protein, 7 aa, Giardia lamblia
ARMQNAE

SEQ ID NO: 3100513 - protein, 8 aa, Giardia lamblia
ARMQTKTG

SEQ ID NO: 3100514 - protein, 7 aa, Giardia lamblia
ARMQTNE

SEQ ID NO: 3100515 - protein, 8 aa, Giardia lamblia
ARMRDNDG

SEQ ID NO: 3100516 - protein, 6 aa, Giardia lamblia
ARMRRD

SEQ ID NO: 3100517 - protein, 9 aa, Giardia lamblia
ARMTNTEGA

SEQ ID NO: 3100518 - protein, 10 aa, Giardia lamblia
ARMTTDNGTT

SEQ ID NO: 3100519 - protein, 8 aa, Giardia lamblia
ARMTTNDG

SEQ ID NO: 3100520 - protein, 5 aa, Giardia lamblia
ARNDE

SEQ ID NO: 3100521 - protein, 9 aa, Giardia lamblia
ARNDGPEQI

SEQ ID NO: 3100522 - protein, 15 aa, Giardia lamblia
ARNDTNNANGTNTQG

SEQ ID NO: 3100523 - protein, 6 aa, Giardia lamblia
ARNGHN

SEQ ID NO: 3100524 - protein, 6 aa, Giardia lamblia
ARNGHS

SEQ ID NO: 3100525 - protein, 6 aa, Giardia lamblia
ARNGNI

SEQ ID NO: 3100526 - protein, 18 aa, Giardia lamblia
ARNGSVSTPTVVPDNSTG

SEQ ID NO: 3100527 - protein, 4 aa, Giardia lamblia
ARNN

SEQ ID NO: 3100528 - protein, 7 aa, Giardia lamblia
ARNNLGD

SEQ ID NO: 3100529 - protein, 13 aa, Giardia lamblia
ARNNSGYDSLSKD

SEQ ID NO: 3100530 - protein, 8 aa, Giardia lamblia
ARNPSDAI

SEQ ID NO: 3100531 - protein, 7 aa, Giardia lamblia
ARNPSSS

SEQ ID NO: 3100532 - protein, 9 aa, Giardia lamblia
ARNRKTPKY

SEQ ID NO: 3100533 - protein, 4 aa, Giardia lamblia
ARNS

SEQ ID NO: 3100534 - protein, 10 aa, Giardia lamblia
ARNSCTVSED

SEQ ID NO: 3100535 - protein, 10 aa, Giardia lamblia
ARNSSAETCN

SEQ ID NO: 3100536 - protein, 5 aa, Giardia lamblia
ARNTA

SEQ ID NO: 3100537 - protein, 9 aa, Giardia lamblia
ARNTDTTTE

SEQ ID NO: 3100538 - protein, 15 aa, Giardia lamblia
ARNVEASYARAQEAN

SEQ ID NO: 3100539 - protein, 6 aa, Giardia lamblia
ARPADI

SEQ ID NO: 3100540 - protein, 6 aa, Giardia lamblia
ARPDTM

SEQ ID NO: 3100541 - protein, 16 aa, Giardia lamblia
ARPELDAESDHVQSEQ

SEQ ID NO: 3100542 - protein, 9 aa, Giardia lamblia
ARPEPSSPV

SEQ ID NO: 3100543 - protein, 4 aa, Giardia lamblia
ARPI

SEQ ID NO: 3100544 - protein, 7 aa, Giardia lamblia
ARPKGKY

SEQ ID NO: 3100545 - protein, 11 aa, Giardia lamblia
ARPKQAAQFGS

SEQ ID NO: 3100546 - protein, 7 aa, Giardia lamblia
ARPNNSR

SEQ ID NO: 3100547 - protein, 7 aa, Giardia lamblia
ARPPQIQ

SEQ ID NO: 3100548 - protein, 7 aa, Giardia lamblia
ARPPTKD

SEQ ID NO: 3100549 - protein, 13 aa, Giardia lamblia
ARPRAAKSPPLRS

SEQ ID NO: 3100550 - protein, 5 aa, Giardia lamblia
ARPRL

SEQ ID NO: 3100551 - protein, 4 aa, Giardia lamblia
ARPS

SEQ ID NO: 3100552 - protein, 18 aa, Giardia lamblia
ARPSAPAKRFDRQKAHEE

SEQ ID NO: 3100553 - protein, 16 aa, Giardia lamblia
ARPSESSQTRLGQETD

SEQ ID NO: 3100554 - protein, 5 aa, Giardia lamblia
ARPSI

SEQ ID NO: 3100555 - protein, 4 aa, Giardia lamblia
ARPT

SEQ ID NO: 3100556 - protein, 9 aa, Giardia lamblia
ARPTTPASV

SEQ ID NO: 3100557 - protein, 4 aa, Giardia lamblia
ARPV

SEQ ID NO: 3100558 - protein, 13 aa, Giardia lamblia
ARPVQDGELQLSG

SEQ ID NO: 3100559 - protein, 8 aa, Giardia lamblia
ARPVSQEN

SEQ ID NO: 3100560 - protein, 5 aa, Giardia lamblia
ARQAA

SEQ ID NO: 3100561 - protein, 25 aa, Giardia lamblia
ARQEETETTGRGEINEDEEEGDEPE

SEQ ID NO: 3100562 - protein, 4 aa, Giardia lamblia
ARQG

SEQ ID NO: 3100563 - protein, 6 aa, Giardia lamblia
ARQGRK

SEQ ID NO: 3100564 - protein, 21 aa, Giardia lamblia
ARQHASKGDVHRSHSVGGDAV

SEQ ID NO: 3100565 - protein, 9 aa, Giardia lamblia
ARQKRKEEL

SEQ ID NO: 3100566 - protein, 7 aa, Giardia lamblia
ARQNRAD

SEQ ID NO: 3100567 - protein, 10 aa, Giardia lamblia
ARQPNRRRPG

SEQ ID NO: 3100568 - protein, 5 aa, Giardia lamblia
ARQPT

SEQ ID NO: 3100569 - protein, 13 aa, Giardia lamblia
ARQQANKSGKNYE

SEQ ID NO: 3100570 - protein, 10 aa, Giardia lamblia
ARQRDQEGRT

SEQ ID NO: 3100571 - protein, 17 aa, Giardia lamblia
ARQRELEAQQRQNEEQA

SEQ ID NO: 3100572 - protein, 11 aa, Giardia lamblia
ARQRPQPVNSY

SEQ ID NO: 3100573 - protein, 10 aa, Giardia lamblia
ARQRSPKAGL

SEQ ID NO: 3100574 - protein, 14 aa, Giardia lamblia
ARQSGHNDSVAYNP

SEQ ID NO: 3100575 - protein, 6 aa, Giardia lamblia
ARQSRE

SEQ ID NO: 3100576 - protein, 22 aa, Giardia lamblia
ARQSRSKLSSDPFSSVPRRPAR

SEQ ID NO: 3100577 - protein, 15 aa, Giardia lamblia
ARQTTDAEKAKASSK

SEQ ID NO: 3100578 - protein, 4 aa, Giardia lamblia
ARQV

SEQ ID NO: 3100579 - protein, 24 aa, Giardia lamblia
ARRARTISKRNRNMSKTSNTAEEI

SEQ ID NO: 3100580 - protein, 10 aa, Giardia lamblia
ARRASNRARI

SEQ ID NO: 3100581 - protein, 6 aa, Giardia lamblia
ARRDAS

SEQ ID NO: 3100582 - protein, 7 aa, Giardia lamblia
ARREEEE

SEQ ID NO: 3100583 - protein, 5 aa, Giardia lamblia
ARREG

SEQ ID NO: 3100584 - protein, 7 aa, Giardia lamblia
ARRETAP

SEQ ID NO: 3100585 - protein, 6 aa, Giardia lamblia
ARRGSL

SEQ ID NO: 3100586 - protein, 10 aa, Giardia lamblia
ARRKNKNNET

SEQ ID NO: 3100587 - protein, 4 aa, Giardia lamblia
ARRL

SEQ ID NO: 3100588 - protein, 21 aa, Giardia lamblia
ARRNADAKVMSSSGLDESTLP

SEQ ID NO: 3100589 - protein, 53 aa, Giardia lamblia
ARRPDQPPGQGAMEKQGMQSTPSLPEVSSTSSIQTGPLQPQGLPSQSTLQPQL

SEQ ID NO: 3100590 - protein, 7 aa, Giardia lamblia
ARRPPRW

SEQ ID NO: 3100591 - protein, 6 aa, Giardia lamblia
ARRPSA

SEQ ID NO: 3100592 - protein, 4 aa, Giardia lamblia
ARRQ

SEQ ID NO: 3100593 - protein, 11 aa, Giardia lamblia
ARRQTKDGTTA

SEQ ID NO: 3100594 - protein, 7 aa, Giardia lamblia
ARRQTLE

SEQ ID NO: 3100595 - protein, 7 aa, Giardia lamblia
ARRRQLQ

SEQ ID NO: 3100596 - protein, 6 aa, Giardia lamblia
ARRTRT

SEQ ID NO: 3100597 - protein, 15 aa, Giardia lamblia
ARRVAQAQSAIASDG

SEQ ID NO: 3100598 - protein, 9 aa, Giardia lamblia
ARSAAHTKG

SEQ ID NO: 3100599 - protein, 8 aa, Giardia lamblia
ARSAGYSY

SEQ ID NO: 3100600 - protein, 9 aa, Giardia lamblia
ARSARPDNQ

SEQ ID NO: 3100601 - protein, 17 aa, Giardia lamblia
ARSASASDIPPNPRNLE

SEQ ID NO: 3100602 - protein, 6 aa, Giardia lamblia
ARSCSE

SEQ ID NO: 3100603 - protein, 6 aa, Giardia lamblia
ARSDAF

SEQ ID NO: 3100604 - protein, 19 aa, Giardia lamblia
ARSDAISQTLSKESSIGYD

SEQ ID NO: 3100605 - protein, 6 aa, Giardia lamblia
ARSDGY

SEQ ID NO: 3100606 - protein, 28 aa, Giardia lamblia
ARSDTSDREPSSRAMNSPPRRQGPAAAP

SEQ ID NO: 3100607 - protein, 4 aa, Giardia lamblia
ARSG

SEQ ID NO: 3100608 - protein, 11 aa, Giardia lamblia
ARSGAGERPPL

SEQ ID NO: 3100609 - protein, 7 aa, Giardia lamblia
ARSGDGL

SEQ ID NO: 3100610 - protein, 6 aa, Giardia lamblia
ARSGLG

SEQ ID NO: 3100611 - protein, 16 aa, Giardia lamblia
ARSGQESSTAPRKKAN

SEQ ID NO: 3100612 - protein, 7 aa, Giardia lamblia
ARSGSAG

SEQ ID NO: 3100613 - protein, 6 aa, Giardia lamblia
ARSGSD

SEQ ID NO: 3100614 - protein, 15 aa, Giardia lamblia
ARSGVQKSRLSNANK

SEQ ID NO: 3100615 - protein, 16 aa, Giardia lamblia
ARSHKSLGDDIRDAGV

SEQ ID NO: 3100616 - protein, 4 aa, Giardia lamblia
ARSI

SEQ ID NO: 3100617 - protein, 11 aa, Giardia lamblia
ARSIQSSAEEL

SEQ ID NO: 3100618 - protein, 6 aa, Giardia lamblia
ARSKLD

SEQ ID NO: 3100619 - protein, 8 aa, Giardia lamblia
ARSKLPES

SEQ ID NO: 3100620 - protein, 7 aa, Giardia lamblia
ARSKSVD

SEQ ID NO: 3100621 - protein, 13 aa, Giardia lamblia
ARSLSKPSPEELS

SEQ ID NO: 3100622 - protein, 10 aa, Giardia lamblia
ARSNHSSAPT

SEQ ID NO: 3100623 - protein, 8 aa, Giardia lamblia
ARSPAEGV

SEQ ID NO: 3100624 - protein, 25 aa, Giardia lamblia
ARSPEAQEQTPEKSAELASAPVQPK

SEQ ID NO: 3100625 - protein, 15 aa, Giardia lamblia
ARSPNLTGYHDGPVD

SEQ ID NO: 3100626 - protein, 7 aa, Giardia lamblia
ARSPPFL

SEQ ID NO: 3100627 - protein, 15 aa, Giardia lamblia
ARSPSLTDDGAYREL

SEQ ID NO: 3100628 - protein, 5 aa, Giardia lamblia
ARSQG

SEQ ID NO: 3100629 - protein, 13 aa, Giardia lamblia
ARSQNGKRSGSNL

SEQ ID NO: 3100630 - protein, 7 aa, Giardia lamblia
ARSQQED

SEQ ID NO: 3100631 - protein, 7 aa, Giardia lamblia
ARSQTNK

SEQ ID NO: 3100632 - protein, 12 aa, Giardia lamblia
ARSRKKSDINAQ

SEQ ID NO: 3100633 - protein, 12 aa, Giardia lamblia
ARSRTESPRRRR

SEQ ID NO: 3100634 - protein, 6 aa, Giardia lamblia
ARSRVH

SEQ ID NO: 3100635 - protein, 17 aa, Giardia lamblia
ARSSGREEMLPILSTYA

SEQ ID NO: 3100636 - protein, 19 aa, Giardia lamblia
ARSSMSSNAMADKGATPIT

SEQ ID NO: 3100637 - protein, 5 aa, Giardia lamblia
ARSSS

SEQ ID NO: 3100638 - protein, 12 aa, Giardia lamblia
ARSSSTSKSPLN

SEQ ID NO: 3100639 - protein, 9 aa, Giardia lamblia
ARSSSVTHK

SEQ ID NO: 3100640 - protein, 10 aa, Giardia lamblia
ARSSTPGRDV

SEQ ID NO: 3100641 - protein, 6 aa, Giardia lamblia
ARSTGC

SEQ ID NO: 3100642 - protein, 9 aa, Giardia lamblia
ARSTGKSTL

SEQ ID NO: 3100643 - protein, 8 aa, Giardia lamblia
ARSTHDKG

SEQ ID NO: 3100644 - protein, 12 aa, Giardia lamblia
ARSVSTQDGNEE

SEQ ID NO: 3100645 - protein, 8 aa, Giardia lamblia
ARSYNDLG

SEQ ID NO: 3100646 - protein, 14 aa, Giardia lamblia
ARSYQPTSKPKERR

SEQ ID NO: 3100647 - protein, 31 aa, Giardia lamblia
ARSYQRSDSGNDDEACYESQDSDPEPPGKAE

SEQ ID NO: 3100648 - protein, 5 aa, Giardia lamblia
ARSYS

SEQ ID NO: 3100649 - protein, 16 aa, Giardia lamblia
ARTAGCSAVTEDQDPF

SEQ ID NO: 3100650 - protein, 8 aa, Giardia lamblia
ARTASTYP

SEQ ID NO: 3100651 - protein, 22 aa, Giardia lamblia
ARTDELDDSRPSEQDSQSDGLQ

SEQ ID NO: 3100652 - protein, 6 aa, Giardia lamblia
ARTDNA

SEQ ID NO: 3100653 - protein, 8 aa, Giardia lamblia
ARTDRPAR

SEQ ID NO: 3100654 - protein, 7 aa, Giardia lamblia
ARTEAQS

SEQ ID NO: 3100655 - protein, 12 aa, Giardia lamblia
ARTEGAPRDHAK

SEQ ID NO: 3100656 - protein, 8 aa, Giardia lamblia
ARTERTKK

SEQ ID NO: 3100657 - protein, 5 aa, Giardia lamblia
ARTHG

SEQ ID NO: 3100658 - protein, 5 aa, Giardia lamblia
ARTKL

SEQ ID NO: 3100659 - protein, 8 aa, Giardia lamblia
ARTKTGET

SEQ ID NO: 3100660 - protein, 8 aa, Giardia lamblia
ARTNAAGK

SEQ ID NO: 3100661 - protein, 11 aa, Giardia lamblia
ARTNALTEEDV

SEQ ID NO: 3100662 - protein, 14 aa, Giardia lamblia
ARTNERIEENAQQL

SEQ ID NO: 3100663 - protein, 17 aa, Giardia lamblia
ARTNKSTKGSNSRRAIK

SEQ ID NO: 3100664 - protein, 7 aa, Giardia lamblia
ARTNSYE

SEQ ID NO: 3100665 - protein, 6 aa, Giardia lamblia
ARTQAE

SEQ ID NO: 3100666 - protein, 14 aa, Giardia lamblia
ARTQKATRRDAQKT

SEQ ID NO: 3100667 - protein, 10 aa, Giardia lamblia
ARTQKNKATE

SEQ ID NO: 3100668 - protein, 5 aa, Giardia lamblia
ARTQL

SEQ ID NO: 3100669 - protein, 11 aa, Giardia lamblia
ARTRSEWSPSL

SEQ ID NO: 3100670 - protein, 11 aa, Giardia lamblia
ARTSDKSSVTR

SEQ ID NO: 3100671 - protein, 10 aa, Giardia lamblia
ARTSGRSSKN

SEQ ID NO: 3100672 - protein, 11 aa, Giardia lamblia
ARTSISPTSLR

SEQ ID NO: 3100673 - protein, 5 aa, Giardia lamblia
ARTSS

SEQ ID NO: 3100674 - protein, 22 aa, Giardia lamblia
ARTSSIYSNEGPRQGLGAYSPD

SEQ ID NO: 3100675 - protein, 10 aa, Giardia lamblia
ARTSSLSDED

SEQ ID NO: 3100676 - protein, 11 aa, Giardia lamblia
ARTSSRTRTVY

SEQ ID NO: 3100677 - protein, 18 aa, Giardia lamblia
ARTSSRYADISAKPRSMQ

SEQ ID NO: 3100678 - protein, 7 aa, Giardia lamblia
ARTTAEM

SEQ ID NO: 3100679 - protein, 6 aa, Giardia lamblia
ARTTSA

SEQ ID NO: 3100680 - protein, 20 aa, Giardia lamblia
ARTTSLEGITADEGGTSYTH

SEQ ID NO: 3100681 - protein, 11 aa, Giardia lamblia
ARVESGADQKH

SEQ ID NO: 3100682 - protein, 4 aa, Giardia lamblia
ARVP

SEQ ID NO: 3100683 - protein, 13 aa, Giardia lamblia
ARVRSASITSPIR

SEQ ID NO: 3100684 - protein, 5 aa, Giardia lamblia
ARVSE

SEQ ID NO: 3100685 - protein, 5 aa, Giardia lamblia
ARVSG

SEQ ID NO: 3100686 - protein, 17 aa, Giardia lamblia
ARVSGSPAVDPSAADNE

SEQ ID NO: 3100687 - protein, 16 aa, Giardia lamblia
ARVSTDESNEPSPTIH

SEQ ID NO: 3100688 - protein, 6 aa, Giardia lamblia
ARVTSA

SEQ ID NO: 3100689 - protein, 27 aa, Giardia lamblia
ARYDGATDMEGRPKKMYNNSGTDRNTS

SEQ ID NO: 3100690 - protein, 15 aa, Giardia lamblia
ARYEGQHDSQDAAPQ

SEQ ID NO: 3100691 - protein, 4 aa, Giardia lamblia
ARYG

SEQ ID NO: 3100692 - protein, 6 aa, Giardia lamblia
ARYKQS

SEQ ID NO: 3100693 - protein, 17 aa, Giardia lamblia
ARYKSSDGRTAKQLEDE

SEQ ID NO: 3100694 - protein, 10 aa, Giardia lamblia
ARYQTEDGKT

SEQ ID NO: 3100695 - protein, 4 aa, Giardia lamblia
ASAA

SEQ ID NO: 3100696 - protein, 10 aa, Giardia lamblia
ASAAAGTKRH

SEQ ID NO: 3100697 - protein, 18 aa, Giardia lamblia
ASAAESATATATIDNNPG

SEQ ID NO: 3100698 - protein, 4 aa, Giardia lamblia
ASAD

SEQ ID NO: 3100699 - protein, 9 aa, Giardia lamblia
ASADEKDQI

SEQ ID NO: 3100700 - protein, 8 aa, Giardia lamblia
ASADGQEW

SEQ ID NO: 3100701 - protein, 6 aa, Giardia lamblia
ASADHE

SEQ ID NO: 3100702 - protein, 10 aa, Giardia lamblia
ASADNPAIAE

SEQ ID NO: 3100703 - protein, 9 aa, Giardia lamblia
ASADQTKNF

SEQ ID NO: 3100704 - protein, 4 aa, Giardia lamblia
ASAE

SEQ ID NO: 3100705 - protein, 8 aa, Giardia lamblia
ASAEKASA

SEQ ID NO: 3100706 - protein, 9 aa, Giardia lamblia
ASAENTERL

SEQ ID NO: 3100707 - protein, 8 aa, Giardia lamblia
ASAESSAF

SEQ ID NO: 3100708 - protein, 6 aa, Giardia lamblia
ASAGNV

SEQ ID NO: 3100709 - protein, 5 aa, Giardia lamblia
ASAHG

SEQ ID NO: 3100710 - protein, 4 aa, Giardia lamblia
ASAK

SEQ ID NO: 3100711 - protein, 6 aa, Giardia lamblia
ASAKDY

SEQ ID NO: 3100712 - protein, 16 aa, Giardia lamblia
ASAKSFKGFRNENQET

SEQ ID NO: 3100713 - protein, 5 aa, Giardia lamblia
ASALG

SEQ ID NO: 3100714 - protein, 24 aa, Giardia lamblia
ASALGLSTSNLKQTTASESDPFSG

SEQ ID NO: 3100715 - protein, 23 aa, Giardia lamblia
ASALSQSISSRAVSPLKKPPGSS

SEQ ID NO: 3100716 - protein, 17 aa, Giardia lamblia
ASALSSLPQNQDNAANC

SEQ ID NO: 3100717 - protein, 5 aa, Giardia lamblia
ASALT

SEQ ID NO: 3100718 - protein, 4 aa, Giardia lamblia
ASAM

SEQ ID NO: 3100719 - protein, 7 aa, Giardia lamblia
ASANEHR

SEQ ID NO: 3100720 - protein, 9 aa, Giardia lamblia
ASANGDTNA

SEQ ID NO: 3100721 - protein, 8 aa, Giardia lamblia
ASANGQGV

SEQ ID NO: 3100722 - protein, 7 aa, Giardia lamblia
ASANKAI

SEQ ID NO: 3100723 - protein, 10 aa, Giardia lamblia
ASANQPQPPV

SEQ ID NO: 3100724 - protein, 7 aa, Giardia lamblia
ASANVEA

SEQ ID NO: 3100725 - protein, 8 aa, Giardia lamblia
ASANYTDA

SEQ ID NO: 3100726 - protein, 33 aa, Giardia lamblia
ASAPEPSLKTTIQNNTFDRNKVKARRQAFFADL

SEQ ID NO: 3100727 - protein, 24 aa, Giardia lamblia
ASAPVEDSSTEKATESHPTEPPNL

SEQ ID NO: 3100728 - protein, 4 aa, Giardia lamblia
ASAQ

SEQ ID NO: 3100729 - protein, 8 aa, Giardia lamblia
ASAQLDKL

SEQ ID NO: 3100730 - protein, 19 aa, Giardia lamblia
ASAQNQANTPDANSQETMA

SEQ ID NO: 3100731 - protein, 9 aa, Giardia lamblia
ASAQNQGIY

SEQ ID NO: 3100732 - protein, 10 aa, Giardia lamblia
ASAQNRQQQT

SEQ ID NO: 3100733 - protein, 9 aa, Giardia lamblia
ASAQPNQQP

SEQ ID NO: 3100734 - protein, 14 aa, Giardia lamblia
ASAQSSPSHSPTTN

SEQ ID NO: 3100735 - protein, 7 aa, Giardia lamblia
ASARGEL

SEQ ID NO: 3100736 - protein, 8 aa, Giardia lamblia
ASARPSWA

SEQ ID NO: 3100737 - protein, 7 aa, Giardia lamblia
ASASGEI

SEQ ID NO: 3100738 - protein, 14 aa, Giardia lamblia
ASASGQEGREEAHP

SEQ ID NO: 3100739 - protein, 10 aa, Giardia lamblia
ASASGTKTEL

SEQ ID NO: 3100740 - protein, 46 aa, Giardia lamblia
ASASPLHSSIPQKNLSSKRRAASTSEESHDDIRSPNQGKQAPTTGF

SEQ ID NO: 3100741 - protein, 17 aa, Giardia lamblia
ASASQDDDAKAIKSARN

SEQ ID NO: 3100742 - protein, 12 aa, Giardia lamblia
ASASQPQAPGVD

SEQ ID NO: 3100743 - protein, 9 aa, Giardia lamblia
ASASQTYTR

SEQ ID NO: 3100744 - protein, 27 aa, Giardia lamblia
ASASSTTQATESMTTEDLNASSNTVTY

SEQ ID NO: 3100745 - protein, 8 aa, Giardia lamblia
ASASVTIP

SEQ ID NO: 3100746 - protein, 12 aa, Giardia lamblia
ASATAPKPNPCP

SEQ ID NO: 3100747 - protein, 14 aa, Giardia lamblia
ASATPRDTHSGRED

SEQ ID NO: 3100748 - protein, 6 aa, Giardia lamblia
ASATQG

SEQ ID NO: 3100749 - protein, 18 aa, Giardia lamblia
ASATTGDLATELSNTRAA

SEQ ID NO: 3100750 - protein, 6 aa, Giardia lamblia
ASATTW

SEQ ID NO: 3100751 - protein, 20 aa, Giardia lamblia
ASATYKPTIGGPPSAPSVPR

SEQ ID NO: 3100752 - protein, 5 aa, Giardia lamblia
ASAVD

SEQ ID NO: 3100753 - protein, 14 aa, Giardia lamblia
ASAVETERKINEAR

SEQ ID NO: 3100754 - protein, 40 aa, Giardia lamblia
ASAVKPVKTTVPPRPPREQSGNTHQGATPTSDASDSSSTI

SEQ ID NO: 3100755 - protein, 15 aa, Giardia lamblia
ASDAAKKTYEAEKAT

SEQ ID NO: 3100756 - protein, 18 aa, Giardia lamblia
ASDADIQSIGGTEAQELT

SEQ ID NO: 3100757 - protein, 9 aa, Giardia lamblia
ASDANSQAQ

SEQ ID NO: 3100758 - protein, 5 aa, Giardia lamblia
ASDAS

SEQ ID NO: 3100759 - protein, 14 aa, Giardia lamblia
ASDDASSPAQDASL

SEQ ID NO: 3100760 - protein, 7 aa, Giardia lamblia
ASDDEDL

SEQ ID NO: 3100761 - protein, 8 aa, Giardia lamblia
ASDDGWND

SEQ ID NO: 3100762 - protein, 7 aa, Giardia lamblia
ASDDPDV

SEQ ID NO: 3100763 - protein, 7 aa, Giardia lamblia
ASDDSGV

SEQ ID NO: 3100764 - protein, 10 aa, Giardia lamblia
ASDERNVSDI

SEQ ID NO: 3100765 - protein, 5 aa, Giardia lamblia
ASDGD

SEQ ID NO: 3100766 - protein, 9 aa, Giardia lamblia
ASDGDADRL

SEQ ID NO: 3100767 - protein, 6 aa, Giardia lamblia
ASDGKL

SEQ ID NO: 3100768 - protein, 6 aa, Giardia lamblia
ASDGVR

SEQ ID NO: 3100769 - protein, 20 aa, Giardia lamblia
ASDIEAAKASHSEKLTKISA

SEQ ID NO: 3100770 - protein, 4 aa, Giardia lamblia
ASDK

SEQ ID NO: 3100771 - protein, 9 aa, Giardia lamblia
ASDKAIKTN

SEQ ID NO: 3100772 - protein, 7 aa, Giardia lamblia
ASDKPID

SEQ ID NO: 3100773 - protein, 7 aa, Giardia lamblia
ASDLSSR

SEQ ID NO: 3100774 - protein, 5 aa, Giardia lamblia
ASDNG

SEQ ID NO: 3100775 - protein, 5 aa, Giardia lamblia
ASDNL

SEQ ID NO: 3100776 - protein, 8 aa, Giardia lamblia
ASDNPQYA

SEQ ID NO: 3100777 - protein, 5 aa, Giardia lamblia
ASDNR

SEQ ID NO: 3100778 - protein, 5 aa, Giardia lamblia
ASDNV

SEQ ID NO: 3100779 - protein, 6 aa, Giardia lamblia
ASDPQG

SEQ ID NO: 3100780 - protein, 10 aa, Giardia lamblia
ASDQDESEHV

SEQ ID NO: 3100781 - protein, 7 aa, Giardia lamblia
ASDSAKS

SEQ ID NO: 3100782 - protein, 8 aa, Giardia lamblia
ASDSREMR

SEQ ID NO: 3100783 - protein, 10 aa, Giardia lamblia
ASDSYTAESI

SEQ ID NO: 3100784 - protein, 10 aa, Giardia lamblia
ASDTTNKEAG

SEQ ID NO: 3100785 - protein, 7 aa, Giardia lamblia
ASDTTRD

SEQ ID NO: 3100786 - protein, 5 aa, Giardia lamblia
ASDYT

SEQ ID NO: 3100787 - protein, 33 aa, Giardia lamblia
ASEADTKEESASQAQDEEYETEEEQSSDGEENA

SEQ ID NO: 3100788 - protein, 9 aa, Giardia lamblia
ASEAENKRL

SEQ ID NO: 3100789 - protein, 8 aa, Giardia lamblia
ASEAGYDI

SEQ ID NO: 3100790 - protein, 14 aa, Giardia lamblia
ASEAQETKTAIRSD

SEQ ID NO: 3100791 - protein, 10 aa, Giardia lamblia
ASEASRADKT

SEQ ID NO: 3100792 - protein, 9 aa, Giardia lamblia
ASEDDRSLS

SEQ ID NO: 3100793 - protein, 8 aa, Giardia lamblia
ASEDSRSH

SEQ ID NO: 3100794 - protein, 4 aa, Giardia lamblia
ASEE

SEQ ID NO: 3100795 - protein, 6 aa, Giardia lamblia
ASEEAS

SEQ ID NO: 3100796 - protein, 5 aa, Giardia lamblia
ASEEE

SEQ ID NO: 3100797 - protein, 17 aa, Giardia lamblia
ASEEEFARGSQSDIPPL

SEQ ID NO: 3100798 - protein, 11 aa, Giardia lamblia
ASEEEQPAQLA

SEQ ID NO: 3100799 - protein, 5 aa, Giardia lamblia
ASEEK

SEQ ID NO: 3100800 - protein, 8 aa, Giardia lamblia
ASEEKAMD

SEQ ID NO: 3100801 - protein, 7 aa, Giardia lamblia
ASEGACN

SEQ ID NO: 3100802 - protein, 7 aa, Giardia lamblia
ASEHPHY

SEQ ID NO: 3100803 - protein, 14 aa, Giardia lamblia
ASEKDIAIESSRSL

SEQ ID NO: 3100804 - protein, 6 aa, Giardia lamblia
ASEKEI

SEQ ID NO: 3100805 - protein, 6 aa, Giardia lamblia
ASEKLK

SEQ ID NO: 3100806 - protein, 7 aa, Giardia lamblia
ASELESK

SEQ ID NO: 3100807 - protein, 6 aa, Giardia lamblia
ASELND

SEQ ID NO: 3100808 - protein, 13 aa, Giardia lamblia
ASELTSKAEPLYR

SEQ ID NO: 3100809 - protein, 15 aa, Giardia lamblia
ASELTTGLTPPTRDK

SEQ ID NO: 3100810 - protein, 6 aa, Giardia lamblia
ASENDD

SEQ ID NO: 3100811 - protein, 6 aa, Giardia lamblia
ASENEA

SEQ ID NO: 3100812 - protein, 11 aa, Giardia lamblia
ASENFKDNPNI

SEQ ID NO: 3100813 - protein, 5 aa, Giardia lamblia
ASENL

SEQ ID NO: 3100814 - protein, 14 aa, Giardia lamblia
ASEPSKRQGAVGNK

SEQ ID NO: 3100815 - protein, 8 aa, Giardia lamblia
ASEQAAAE

SEQ ID NO: 3100816 - protein, 11 aa, Giardia lamblia
ASEQEGSVPKL

SEQ ID NO: 3100817 - protein, 18 aa, Giardia lamblia
ASEQKHDIENSADNATKL

SEQ ID NO: 3100818 - protein, 8 aa, Giardia lamblia
ASEQNKDE

SEQ ID NO: 3100819 - protein, 20 aa, Giardia lamblia
ASERADRARARANKEIEDED

SEQ ID NO: 3100820 - protein, 9 aa, Giardia lamblia
ASEREQLQA

SEQ ID NO: 3100821 - protein, 19 aa, Giardia lamblia
ASERFKATSSTETPGPGTY

SEQ ID NO: 3100822 - protein, 9 aa, Giardia lamblia
ASERHKPEY

SEQ ID NO: 3100823 - protein, 15 aa, Giardia lamblia
ASERPVEAEVGDDEE

SEQ ID NO: 3100824 - protein, 6 aa, Giardia lamblia
ASERTN

SEQ ID NO: 3100825 - protein, 11 aa, Giardia lamblia
ASERTRADALE

SEQ ID NO: 3100826 - protein, 9 aa, Giardia lamblia
ASESAVDEA

SEQ ID NO: 3100827 - protein, 7 aa, Giardia lamblia
ASESDPL

SEQ ID NO: 3100828 - protein, 5 aa, Giardia lamblia
ASESE

SEQ ID NO: 3100829 - protein, 8 aa, Giardia lamblia
ASESEPSA

SEQ ID NO: 3100830 - protein, 8 aa, Giardia lamblia
ASETDAMD

SEQ ID NO: 3100831 - protein, 13 aa, Giardia lamblia
ASETDTGGSQQRK

SEQ ID NO: 3100832 - protein, 7 aa, Giardia lamblia
ASETIPY

SEQ ID NO: 3100833 - protein, 6 aa, Giardia lamblia
ASETQL

SEQ ID NO: 3100834 - protein, 8 aa, Giardia lamblia
ASETYDRE

SEQ ID NO: 3100835 - protein, 6 aa, Giardia lamblia
ASETYP

SEQ ID NO: 3100836 - protein, 23 aa, Giardia lamblia
ASFEKESDSERNSVINITSTPTS

SEQ ID NO: 3100837 - protein, 6 aa, Giardia lamblia
ASFEKS

SEQ ID NO: 3100838 - protein, 8 aa, Giardia lamblia
ASFESDES

SEQ ID NO: 3100839 - protein, 4 aa, Giardia lamblia
ASFG

SEQ ID NO: 3100840 - protein, 4 aa, Giardia lamblia
ASFH

SEQ ID NO: 3100841 - protein, 12 aa, Giardia lamblia
ASFQPRRRSALT

SEQ ID NO: 3100842 - protein, 31 aa, Giardia lamblia
ASFSPTSSERFSVSPSSGILEPAQPANLSNQ

SEQ ID NO: 3100843 - protein, 9 aa, Giardia lamblia
ASFSSSVQS

SEQ ID NO: 3100844 - protein, 6 aa, Giardia lamblia
ASGAGT

SEQ ID NO: 3100845 - protein, 6 aa, Giardia lamblia
ASGAPA

SEQ ID NO: 3100846 - protein, 7 aa, Giardia lamblia
ASGASEC

SEQ ID NO: 3100847 - protein, 8 aa, Giardia lamblia
ASGDAHTS

SEQ ID NO: 3100848 - protein, 5 aa, Giardia lamblia
ASGDF

SEQ ID NO: 3100849 - protein, 6 aa, Giardia lamblia
ASGDHS

SEQ ID NO: 3100850 - protein, 8 aa, Giardia lamblia
ASGDIDMD

SEQ ID NO: 3100851 - protein, 6 aa, Giardia lamblia
ASGEMK

SEQ ID NO: 3100852 - protein, 10 aa, Giardia lamblia
ASGESSPKTI

SEQ ID NO: 3100853 - protein, 5 aa, Giardia lamblia
ASGET

SEQ ID NO: 3100854 - protein, 5 aa, Giardia lamblia
ASGEY

SEQ ID NO: 3100855 - protein, 8 aa, Giardia lamblia
ASGGADGG

SEQ ID NO: 3100856 - protein, 8 aa, Giardia lamblia
ASGGPAVY

SEQ ID NO: 3100857 - protein, 14 aa, Giardia lamblia
ASGGSTLGAQQTST

SEQ ID NO: 3100858 - protein, 6 aa, Giardia lamblia
ASGHEL

SEQ ID NO: 3100859 - protein, 6 aa, Giardia lamblia
ASGIGA

SEQ ID NO: 3100860 - protein, 18 aa, Giardia lamblia
ASGISSSGDILTGAEPGV

SEQ ID NO: 3100861 - protein, 4 aa, Giardia lamblia
ASGK

SEQ ID NO: 3100862 - protein, 6 aa, Giardia lamblia
ASGKEV

SEQ ID NO: 3100863 - protein, 27 aa, Giardia lamblia
ASGKLNARHSQISEAPDTKDETPGERA

SEQ ID NO: 3100864 - protein, 17 aa, Giardia lamblia
ASGKPMDEADPRTAQSD

SEQ ID NO: 3100865 - protein, 5 aa, Giardia lamblia
ASGKT

SEQ ID NO: 3100866 - protein, 7 aa, Giardia lamblia
ASGKTYT

SEQ ID NO: 3100867 - protein, 8 aa, Giardia lamblia
ASGLNNST

SEQ ID NO: 3100868 - protein, 8 aa, Giardia lamblia
ASGLPKSV

SEQ ID NO: 3100869 - protein, 5 aa, Giardia lamblia
ASGLS

SEQ ID NO: 3100870 - protein, 9 aa, Giardia lamblia
ASGPAPGKL

SEQ ID NO: 3100871 - protein, 9 aa, Giardia lamblia
ASGPEPGRL

SEQ ID NO: 3100872 - protein, 6 aa, Giardia lamblia
ASGPNI

SEQ ID NO: 3100873 - protein, 6 aa, Giardia lamblia
ASGPQR

SEQ ID NO: 3100874 - protein, 7 aa, Giardia lamblia
ASGPTSM

SEQ ID NO: 3100875 - protein, 11 aa, Giardia lamblia
ASGQDTDGAGQ

SEQ ID NO: 3100876 - protein, 8 aa, Giardia lamblia
ASGRADDA

SEQ ID NO: 3100877 - protein, 4 aa, Giardia lamblia
ASGS

SEQ ID NO: 3100878 - protein, 8 aa, Giardia lamblia
ASGSCEYN

SEQ ID NO: 3100879 - protein, 8 aa, Giardia lamblia
ASGSDDTT

SEQ ID NO: 3100880 - protein, 43 aa, Giardia lamblia
ASGSDGSSLQHTSAADLAQTKKTRGSADTPAKTEQSAKLHGTV

SEQ ID NO: 3100881 - protein, 7 aa, Giardia lamblia
ASGSKEL

SEQ ID NO: 3100882 - protein, 11 aa, Giardia lamblia
ASGSNEKRKSY

SEQ ID NO: 3100883 - protein, 11 aa, Giardia lamblia
ASGSPGYGASY

SEQ ID NO: 3100884 - protein, 6 aa, Giardia lamblia
ASGSYD

SEQ ID NO: 3100885 - protein, 6 aa, Giardia lamblia
ASGTGS

SEQ ID NO: 3100886 - protein, 13 aa, Giardia lamblia
ASGTSGDTSSSKL

SEQ ID NO: 3100887 - protein, 7 aa, Giardia lamblia
ASGTTVS

SEQ ID NO: 3100888 - protein, 20 aa, Giardia lamblia
ASGVTSSNTSIGQCSTGSSD

SEQ ID NO: 3100889 - protein, 4 aa, Giardia lamblia
ASHA

SEQ ID NO: 3100890 - protein, 15 aa, Giardia lamblia
ASHAPASRQNVTNAT

SEQ ID NO: 3100891 - protein, 14 aa, Giardia lamblia
ASHDGLSGDSRSVH

SEQ ID NO: 3100892 - protein, 8 aa, Giardia lamblia
ASHEDTPF

SEQ ID NO: 3100893 - protein, 7 aa, Giardia lamblia
ASHEKHE

SEQ ID NO: 3100894 - protein, 87 aa, Giardia lamblia
ASHEMQDEASNRDSAVKEPHDSPPAKPDGPAPRSRKRRASPSKVRGGRSTLSTPISSTTRPATRKSGTTLSGTTTSRASELEELDGE

SEQ ID NO: 3100895 - protein, 5 aa, Giardia lamblia
ASHER

SEQ ID NO: 3100896 - protein, 4 aa, Giardia lamblia
ASHG

SEQ ID NO: 3100897 - protein, 18 aa, Giardia lamblia
ASHGSSSLKSEHSASRTL

SEQ ID NO: 3100898 - protein, 24 aa, Giardia lamblia
ASHITSEGFTNATQAQTQSIATNA

SEQ ID NO: 3100899 - protein, 6 aa, Giardia lamblia
ASHKEL

SEQ ID NO: 3100900 - protein, 8 aa, Giardia lamblia
ASHNPPKW

SEQ ID NO: 3100901 - protein, 13 aa, Giardia lamblia
ASHNQTATDTEGG

SEQ ID NO: 3100902 - protein, 38 aa, Giardia lamblia
ASHNYDNSIDDTSPIYNQNDGSVRATNDAQGAADTDIT

SEQ ID NO: 3100903 - protein, 7 aa, Giardia lamblia
ASHPDGI

SEQ ID NO: 3100904 - protein, 9 aa, Giardia lamblia
ASHQSDPAL

SEQ ID NO: 3100905 - protein, 6 aa, Giardia lamblia
ASHTSV

SEQ ID NO: 3100906 - protein, 24 aa, Giardia lamblia
ASIDPAEVEQECPPPLPPPLPRPN

SEQ ID NO: 3100907 - protein, 15 aa, Giardia lamblia
ASIDTGYPAPPTSQM

SEQ ID NO: 3100908 - protein, 6 aa, Giardia lamblia
ASIEPY

SEQ ID NO: 3100909 - protein, 6 aa, Giardia lamblia
ASIKMP

SEQ ID NO: 3100910 - protein, 6 aa, Giardia lamblia
ASIKRT

SEQ ID NO: 3100911 - protein, 8 aa, Giardia lamblia
ASINNGTA

SEQ ID NO: 3100912 - protein, 9 aa, Giardia lamblia
ASIPPPPSA

SEQ ID NO: 3100913 - protein, 5 aa, Giardia lamblia
ASIPS

SEQ ID NO: 3100914 - protein, 9 aa, Giardia lamblia
ASIPTEEDK

SEQ ID NO: 3100915 - protein, 6 aa, Giardia lamblia
ASIPTQ

SEQ ID NO: 3100916 - protein, 10 aa, Giardia lamblia
ASIRKTSAPW

SEQ ID NO: 3100917 - protein, 10 aa, Giardia lamblia
ASIRSTSPYA

SEQ ID NO: 3100918 - protein, 18 aa, Giardia lamblia
ASISKHASLNNATNRTRP

SEQ ID NO: 3100919 - protein, 23 aa, Giardia lamblia
ASISPRSKDTVRHRSKKGPSPLK

SEQ ID NO: 3100920 - protein, 6 aa, Giardia lamblia
ASITKR

SEQ ID NO: 3100921 - protein, 35 aa, Giardia lamblia
ASKAAASDAPSTPMTNAKAGPGRPSSARSPYPGID

SEQ ID NO: 3100922 - protein, 12 aa, Giardia lamblia
ASKASGSNPAIG

SEQ ID NO: 3100923 - protein, 14 aa, Giardia lamblia
ASKDAELAGATTGL

SEQ ID NO: 3100924 - protein, 7 aa, Giardia lamblia
ASKDGTV

SEQ ID NO: 3100925 - protein, 6 aa, Giardia lamblia
ASKDNI

SEQ ID NO: 3100926 - protein, 11 aa, Giardia lamblia
ASKEAGFTKDD

SEQ ID NO: 3100927 - protein, 9 aa, Giardia lamblia
ASKENQIST

SEQ ID NO: 3100928 - protein, 8 aa, Giardia lamblia
ASKEPGLQ

SEQ ID NO: 3100929 - protein, 6 aa, Giardia lamblia
ASKFPQ

SEQ ID NO: 3100930 - protein, 7 aa, Giardia lamblia
ASKFTSA

SEQ ID NO: 3100931 - protein, 8 aa, Giardia lamblia
ASKGDVDG

SEQ ID NO: 3100932 - protein, 7 aa, Giardia lamblia
ASKGGLL

SEQ ID NO: 3100933 - protein, 9 aa, Giardia lamblia
ASKKSEETV

SEQ ID NO: 3100934 - protein, 8 aa, Giardia lamblia
ASKKYQGM

SEQ ID NO: 3100935 - protein, 17 aa, Giardia lamblia
ASKNGKDGWPGDHHSET

SEQ ID NO: 3100936 - protein, 13 aa, Giardia lamblia
ASKNKSSPSRADP

SEQ ID NO: 3100937 - protein, 9 aa, Giardia lamblia
ASKNVEDGI

SEQ ID NO: 3100938 - protein, 24 aa, Giardia lamblia
ASKNVSNPNKQKQNLQQYSPVDQT

SEQ ID NO: 3100939 - protein, 8 aa, Giardia lamblia
ASKPDNTG

SEQ ID NO: 3100940 - protein, 7 aa, Giardia lamblia
ASKPEIR

SEQ ID NO: 3100941 - protein, 48 aa, Giardia lamblia
ASKPKPRSKPTQKPETATEDVDVDENPVTDGTEADQDGIYSTNYASEE

SEQ ID NO: 3100942 - protein, 10 aa, Giardia lamblia
ASKPNTQATF

SEQ ID NO: 3100943 - protein, 7 aa, Giardia lamblia
ASKQEVS

SEQ ID NO: 3100944 - protein, 11 aa, Giardia lamblia
ASKQKGQNASF

SEQ ID NO: 3100945 - protein, 8 aa, Giardia lamblia
ASKRQGGQ

SEQ ID NO: 3100946 - protein, 5 aa, Giardia lamblia
ASKST

SEQ ID NO: 3100947 - protein, 9 aa, Giardia lamblia
ASKTDGPDA

SEQ ID NO: 3100948 - protein, 7 aa, Giardia lamblia
ASKTRTL

SEQ ID NO: 3100949 - protein, 72 aa, Giardia lamblia
ASKVTESSSEETSTDSSRDQNWTSATSKTKHPKESAPVAPASVDNESSSDSSSEPPPSTKRPVGRGITLTKR

SEQ ID NO: 3100950 - protein, 8 aa, Giardia lamblia
ASKYSQEL

SEQ ID NO: 3100951 - protein, 4 aa, Giardia lamblia
ASLA

SEQ ID NO: 3100952 - protein, 15 aa, Giardia lamblia
ASLDNGPDSLSSDSC

SEQ ID NO: 3100953 - protein, 6 aa, Giardia lamblia
ASLDTI

SEQ ID NO: 3100954 - protein, 6 aa, Giardia lamblia
ASLEGE

SEQ ID NO: 3100955 - protein, 6 aa, Giardia lamblia
ASLEGG

SEQ ID NO: 3100956 - protein, 16 aa, Giardia lamblia
ASLEQNNIKRGYNESV

SEQ ID NO: 3100957 - protein, 6 aa, Giardia lamblia
ASLERN

SEQ ID NO: 3100958 - protein, 6 aa, Giardia lamblia
ASLGAE

SEQ ID NO: 3100959 - protein, 12 aa, Giardia lamblia
ASLGGSATGSLI

SEQ ID NO: 3100960 - protein, 13 aa, Giardia lamblia
ASLGGSLSQDTSI

SEQ ID NO: 3100961 - protein, 10 aa, Giardia lamblia
ASLGGTTSDI

SEQ ID NO: 3100962 - protein, 7 aa, Giardia lamblia
ASLGSKP

SEQ ID NO: 3100963 - protein, 19 aa, Giardia lamblia
ASLGSNSQLSIDNAQGALN

SEQ ID NO: 3100964 - protein, 4 aa, Giardia lamblia
ASLK

SEQ ID NO: 3100965 - protein, 12 aa, Giardia lamblia
ASLKDKSTCEED

SEQ ID NO: 3100966 - protein, 13 aa, Giardia lamblia
ASLKESVASGERK

SEQ ID NO: 3100967 - protein, 12 aa, Giardia lamblia
ASLKSEKASLET

SEQ ID NO: 3100968 - protein, 5 aa, Giardia lamblia
ASLNE

SEQ ID NO: 3100969 - protein, 6 aa, Giardia lamblia
ASLNSQ

SEQ ID NO: 3100970 - protein, 8 aa, Giardia lamblia
ASLNSSRV

SEQ ID NO: 3100971 - protein, 6 aa, Giardia lamblia
ASLPPG

SEQ ID NO: 3100972 - protein, 13 aa, Giardia lamblia
ASLPPPPQTTSPL

SEQ ID NO: 3100973 - protein, 13 aa, Giardia lamblia
ASLPQDSRSPSTY

SEQ ID NO: 3100974 - protein, 7 aa, Giardia lamblia
ASLPTEA

SEQ ID NO: 3100975 - protein, 8 aa, Giardia lamblia
ASLQGPSL

SEQ ID NO: 3100976 - protein, 13 aa, Giardia lamblia
ASLQSDLKSASEK

SEQ ID NO: 3100977 - protein, 11 aa, Giardia lamblia
ASLQTNQTPEL

SEQ ID NO: 3100978 - protein, 4 aa, Giardia lamblia
ASLS

SEQ ID NO: 3100979 - protein, 18 aa, Giardia lamblia
ASLSERDKIAERNAQLQN

SEQ ID NO: 3100980 - protein, 14 aa, Giardia lamblia
ASLSGGAKNHARKP

SEQ ID NO: 3100981 - protein, 19 aa, Giardia lamblia
ASLSGTAGSGPSGEAPSKF

SEQ ID NO: 3100982 - protein, 12 aa, Giardia lamblia
ASLSKSYESAQA

SEQ ID NO: 3100983 - protein, 10 aa, Giardia lamblia
ASLSPGGGRT

SEQ ID NO: 3100984 - protein, 30 aa, Giardia lamblia
ASLSPPAKLSKQESKRQSCHESNLSEDSYL

SEQ ID NO: 3100985 - protein, 6 aa, Giardia lamblia
ASLSRN

SEQ ID NO: 3100986 - protein, 31 aa, Giardia lamblia
ASLSSKGANAKQLSQSLAEKQAAKDNAETNI

SEQ ID NO: 3100987 - protein, 10 aa, Giardia lamblia
ASLSTPASLP

SEQ ID NO: 3100988 - protein, 25 aa, Giardia lamblia
ASLSVSAAPESSSATTSSATEQDGI

SEQ ID NO: 3100989 - protein, 16 aa, Giardia lamblia
ASLTRTPQQTSPYGEP

SEQ ID NO: 3100990 - protein, 9 aa, Giardia lamblia
ASLTSKYGD

SEQ ID NO: 3100991 - protein, 6 aa, Giardia lamblia
ASLTSQ

SEQ ID NO: 3100992 - protein, 10 aa, Giardia lamblia
ASMDQSTSIA

SEQ ID NO: 3100993 - protein, 19 aa, Giardia lamblia
ASMDRPGKSSDALSNPNYG

SEQ ID NO: 3100994 - protein, 5 aa, Giardia lamblia
ASMES

SEQ ID NO: 3100995 - protein, 18 aa, Giardia lamblia
ASMGSMGNTMTNSKRSLS

SEQ ID NO: 3100996 - protein, 8 aa, Giardia lamblia
ASMKRGTA

SEQ ID NO: 3100997 - protein, 5 aa, Giardia lamblia
ASMNP

SEQ ID NO: 3100998 - protein, 4 aa, Giardia lamblia
ASMR

SEQ ID NO: 3100999 - protein, 4 aa, Giardia lamblia
ASMS

SEQ ID NO: 3101000 - protein, 22 aa, Giardia lamblia
ASMTAGDDRAEITSGSSEARTS

SEQ ID NO: 3101001 - protein, 18 aa, Giardia lamblia
ASNAPTDTQPRGDNVQKY

SEQ ID NO: 3101002 - protein, 13 aa, Giardia lamblia
ASNASSAIPPPLD

SEQ ID NO: 3101003 - protein, 7 aa, Giardia lamblia
ASNASSI

SEQ ID NO: 3101004 - protein, 10 aa, Giardia lamblia
ASNASVDSTA

SEQ ID NO: 3101005 - protein, 8 aa, Giardia lamblia
ASNDSAAA

SEQ ID NO: 3101006 - protein, 5 aa, Giardia lamblia
ASNDT

SEQ ID NO: 3101007 - protein, 9 aa, Giardia lamblia
ASNEEHNQQ

SEQ ID NO: 3101008 - protein, 6 aa, Giardia lamblia
ASNEEN

SEQ ID NO: 3101009 - protein, 7 aa, Giardia lamblia
ASNEMKS

SEQ ID NO: 3101010 - protein, 7 aa, Giardia lamblia
ASNESNL

SEQ ID NO: 3101011 - protein, 11 aa, Giardia lamblia
ASNESSGDTKH

SEQ ID NO: 3101012 - protein, 13 aa, Giardia lamblia
ASNETEDNNEQQV

SEQ ID NO: 3101013 - protein, 23 aa, Giardia lamblia
ASNFAKKPDFPVSAPTVNSAKNE

SEQ ID NO: 3101014 - protein, 7 aa, Giardia lamblia
ASNGDTE

SEQ ID NO: 3101015 - protein, 7 aa, Giardia lamblia
ASNGESI

SEQ ID NO: 3101016 - protein, 5 aa, Giardia lamblia
ASNGH

SEQ ID NO: 3101017 - protein, 6 aa, Giardia lamblia
ASNGHI

SEQ ID NO: 3101018 - protein, 6 aa, Giardia lamblia
ASNGHS

SEQ ID NO: 3101019 - protein, 6 aa, Giardia lamblia
ASNGHT

SEQ ID NO: 3101020 - protein, 7 aa, Giardia lamblia
ASNGHTE

SEQ ID NO: 3101021 - protein, 9 aa, Giardia lamblia
ASNGQEVEK

SEQ ID NO: 3101022 - protein, 6 aa, Giardia lamblia
ASNGSI

SEQ ID NO: 3101023 - protein, 9 aa, Giardia lamblia
ASNGSYKTA

SEQ ID NO: 3101024 - protein, 8 aa, Giardia lamblia
ASNGTSSL

SEQ ID NO: 3101025 - protein, 8 aa, Giardia lamblia
ASNHTDRD

SEQ ID NO: 3101026 - protein, 15 aa, Giardia lamblia
ASNKPAQKNQERDDL

SEQ ID NO: 3101027 - protein, 9 aa, Giardia lamblia
ASNKPSVEG

SEQ ID NO: 3101028 - protein, 8 aa, Giardia lamblia
ASNKRERK

SEQ ID NO: 3101029 - protein, 10 aa, Giardia lamblia
ASNKRSNANI

SEQ ID NO: 3101030 - protein, 11 aa, Giardia lamblia
ASNLTGGINGV

SEQ ID NO: 3101031 - protein, 4 aa, Giardia lamblia
ASNM

SEQ ID NO: 3101032 - protein, 8 aa, Giardia lamblia
ASNMPASQ

SEQ ID NO: 3101033 - protein, 7 aa, Giardia lamblia
ASNNALE

SEQ ID NO: 3101034 - protein, 5 aa, Giardia lamblia
ASNNH

SEQ ID NO: 3101035 - protein, 6 aa, Giardia lamblia
ASNNHR

SEQ ID NO: 3101036 - protein, 6 aa, Giardia lamblia
ASNNNL

SEQ ID NO: 3101037 - protein, 6 aa, Giardia lamblia
ASNNNY

SEQ ID NO: 3101038 - protein, 5 aa, Giardia lamblia
ASNPE

SEQ ID NO: 3101039 - protein, 5 aa, Giardia lamblia
ASNPL

SEQ ID NO: 3101040 - protein, 8 aa, Giardia lamblia
ASNPSYAV

SEQ ID NO: 3101041 - protein, 6 aa, Giardia lamblia
ASNPVV

SEQ ID NO: 3101042 - protein, 9 aa, Giardia lamblia
ASNQNSAFQ

SEQ ID NO: 3101043 - protein, 6 aa, Giardia lamblia
ASNQRI

SEQ ID NO: 3101044 - protein, 8 aa, Giardia lamblia
ASNRGHGG

SEQ ID NO: 3101045 - protein, 8 aa, Giardia lamblia
ASNRSKEI

SEQ ID NO: 3101046 - protein, 11 aa, Giardia lamblia
ASNSATAPVHE

SEQ ID NO: 3101047 - protein, 15 aa, Giardia lamblia
ASNSEEKQIAPPSTF

SEQ ID NO: 3101048 - protein, 5 aa, Giardia lamblia
ASNSL

SEQ ID NO: 3101049 - protein, 8 aa, Giardia lamblia
ASNSPFNE

SEQ ID NO: 3101050 - protein, 11 aa, Giardia lamblia
ASNTEDQDTLR

SEQ ID NO: 3101051 - protein, 7 aa, Giardia lamblia
ASNTEDV

SEQ ID NO: 3101052 - protein, 19 aa, Giardia lamblia
ASNTEIEDGSSDSDRHTMP

SEQ ID NO: 3101053 - protein, 9 aa, Giardia lamblia
ASNTTERKS

SEQ ID NO: 3101054 - protein, 10 aa, Giardia lamblia
ASNTTETKRT

SEQ ID NO: 3101055 - protein, 24 aa, Giardia lamblia
ASNTTNVESKPSEARDTKRTTKLA

SEQ ID NO: 3101056 - protein, 13 aa, Giardia lamblia
ASNYTRQSNPDKP

SEQ ID NO: 3101057 - protein, 7 aa, Giardia lamblia
ASPAEVR

SEQ ID NO: 3101058 - protein, 6 aa, Giardia lamblia
ASPAGP

SEQ ID NO: 3101059 - protein, 11 aa, Giardia lamblia
ASPAGTGLPPR

SEQ ID NO: 3101060 - protein, 7 aa, Giardia lamblia
ASPAQGS

SEQ ID NO: 3101061 - protein, 6 aa, Giardia lamblia
ASPASY

SEQ ID NO: 3101062 - protein, 16 aa, Giardia lamblia
ASPDRVAGKTRSAQDS

SEQ ID NO: 3101063 - protein, 7 aa, Giardia lamblia
ASPDSRQ

SEQ ID NO: 3101064 - protein, 12 aa, Giardia lamblia
ASPDTKLTTKKS

SEQ ID NO: 3101065 - protein, 20 aa, Giardia lamblia
ASPEGQLSPLSTAPSPLPPL

SEQ ID NO: 3101066 - protein, 7 aa, Giardia lamblia
ASPEKEK

SEQ ID NO: 3101067 - protein, 7 aa, Giardia lamblia
ASPENTM

SEQ ID NO: 3101068 - protein, 8 aa, Giardia lamblia
ASPEPAYR

SEQ ID NO: 3101069 - protein, 7 aa, Giardia lamblia
ASPEQVS

SEQ ID NO: 3101070 - protein, 4 aa, Giardia lamblia
ASPF

SEQ ID NO: 3101071 - protein, 7 aa, Giardia lamblia
ASPFPQQ

SEQ ID NO: 3101072 - protein, 7 aa, Giardia lamblia
ASPGSPI

SEQ ID NO: 3101073 - protein, 8 aa, Giardia lamblia
ASPGSSTQ

SEQ ID NO: 3101074 - protein, 6 aa, Giardia lamblia
ASPHPN

SEQ ID NO: 3101075 - protein, 4 aa, Giardia lamblia
ASPI

SEQ ID NO: 3101076 - protein, 5 aa, Giardia lamblia
ASPIN

SEQ ID NO: 3101077 - protein, 26 aa, Giardia lamblia
ASPINRSIGSRGSHVEPYASSTPAIP

SEQ ID NO: 3101078 - protein, 10 aa, Giardia lamblia
ASPIQSSPLR

SEQ ID NO: 3101079 - protein, 12 aa, Giardia lamblia
ASPKKVTEDDPQ

SEQ ID NO: 3101080 - protein, 36 aa, Giardia lamblia
ASPKVGRSFSTEVPRSRQHTKHTDTFAESSSTTNPN

SEQ ID NO: 3101081 - protein, 7 aa, Giardia lamblia
ASPLGIT

SEQ ID NO: 3101082 - protein, 7 aa, Giardia lamblia
ASPLTTS

SEQ ID NO: 3101083 - protein, 10 aa, Giardia lamblia
ASPNAGKVGN

SEQ ID NO: 3101084 - protein, 6 aa, Giardia lamblia
ASPNNN

SEQ ID NO: 3101085 - protein, 13 aa, Giardia lamblia
ASPPGTDTPWDLD

SEQ ID NO: 3101086 - protein, 8 aa, Giardia lamblia
ASPQARTM

SEQ ID NO: 3101087 - protein, 5 aa, Giardia lamblia
ASPQV

SEQ ID NO: 3101088 - protein, 4 aa, Giardia lamblia
ASPR

SEQ ID NO: 3101089 - protein, 8 aa, Giardia lamblia
ASPRGPQI

SEQ ID NO: 3101090 - protein, 8 aa, Giardia lamblia
ASPRQTLT

SEQ ID NO: 3101091 - protein, 8 aa, Giardia lamblia
ASPSAGDH

SEQ ID NO: 3101092 - protein, 6 aa, Giardia lamblia
ASPSAK

SEQ ID NO: 3101093 - protein, 9 aa, Giardia lamblia
ASPSDTEAR

SEQ ID NO: 3101094 - protein, 35 aa, Giardia lamblia
ASPSKITKGSVDIAEKGSGDESSSENDRYKATEDS

SEQ ID NO: 3101095 - protein, 6 aa, Giardia lamblia
ASPSLS

SEQ ID NO: 3101096 - protein, 12 aa, Giardia lamblia
ASPSLTCSTDAD

SEQ ID NO: 3101097 - protein, 7 aa, Giardia lamblia
ASPSSSY

SEQ ID NO: 3101098 - protein, 7 aa, Giardia lamblia
ASPSTDL

SEQ ID NO: 3101099 - protein, 4 aa, Giardia lamblia
ASPT

SEQ ID NO: 3101100 - protein, 9 aa, Giardia lamblia
ASPTHSMTT

SEQ ID NO: 3101101 - protein, 6 aa, Giardia lamblia
ASPTNY

SEQ ID NO: 3101102 - protein, 18 aa, Giardia lamblia
ASPTRDQDLNQRSELQRP

SEQ ID NO: 3101103 - protein, 6 aa, Giardia lamblia
ASPTRN

SEQ ID NO: 3101104 - protein, 26 aa, Giardia lamblia
ASPTRTFTGSGHHGSAPGTPGSPGPM

SEQ ID NO: 3101105 - protein, 14 aa, Giardia lamblia
ASPVSMEQSYLVAL

SEQ ID NO: 3101106 - protein, 31 aa, Giardia lamblia
ASPVTDRLQPTETVSQSSVSDSVSPREGPGT

SEQ ID NO: 3101107 - protein, 14 aa, Giardia lamblia
ASPVYSASSTTHHQ

SEQ ID NO: 3101108 - protein, 6 aa, Giardia lamblia
ASPYNS

SEQ ID NO: 3101109 - protein, 4 aa, Giardia lamblia
ASQA

SEQ ID NO: 3101110 - protein, 9 aa, Giardia lamblia
ASQADEYYG

SEQ ID NO: 3101111 - protein, 7 aa, Giardia lamblia
ASQAKKC

SEQ ID NO: 3101112 - protein, 6 aa, Giardia lamblia
ASQAPN

SEQ ID NO: 3101113 - protein, 11 aa, Giardia lamblia
ASQAPQGDLRS

SEQ ID NO: 3101114 - protein, 9 aa, Giardia lamblia
ASQASQNIQ

SEQ ID NO: 3101115 - protein, 20 aa, Giardia lamblia
ASQCTENVGAGEPAKKADKD

SEQ ID NO: 3101116 - protein, 8 aa, Giardia lamblia
ASQDGEYS

SEQ ID NO: 3101117 - protein, 7 aa, Giardia lamblia
ASQDKCD

SEQ ID NO: 3101118 - protein, 7 aa, Giardia lamblia
ASQEFTS

SEQ ID NO: 3101119 - protein, 5 aa, Giardia lamblia
ASQEG

SEQ ID NO: 3101120 - protein, 14 aa, Giardia lamblia
ASQEHDSPLRQAPT

SEQ ID NO: 3101121 - protein, 31 aa, Giardia lamblia
ASQEKQPSKAASRFSSYAADDEESSTPKAEV

SEQ ID NO: 3101122 - protein, 6 aa, Giardia lamblia
ASQENY

SEQ ID NO: 3101123 - protein, 8 aa, Giardia lamblia
ASQETGMR

SEQ ID NO: 3101124 - protein, 4 aa, Giardia lamblia
ASQG

SEQ ID NO: 3101125 - protein, 26 aa, Giardia lamblia
ASQGGLSGTQGNVPDRAGAGLDGLDP

SEQ ID NO: 3101126 - protein, 23 aa, Giardia lamblia
ASQISKEKKRKHHTSSKCEPRDS

SEQ ID NO: 3101127 - protein, 24 aa, Giardia lamblia
ASQKKDAESNALETEQRSNVRSYE

SEQ ID NO: 3101128 - protein, 6 aa, Giardia lamblia
ASQKYT

SEQ ID NO: 3101129 - protein, 12 aa, Giardia lamblia
ASQLQGSQSVSN

SEQ ID NO: 3101130 - protein, 18 aa, Giardia lamblia
ASQNQRNTDKVKQLNNEN

SEQ ID NO: 3101131 - protein, 7 aa, Giardia lamblia
ASQNTNP

SEQ ID NO: 3101132 - protein, 13 aa, Giardia lamblia
ASQPDEASHGTEY

SEQ ID NO: 3101133 - protein, 7 aa, Giardia lamblia
ASQPGPV

SEQ ID NO: 3101134 - protein, 5 aa, Giardia lamblia
ASQQA

SEQ ID NO: 3101135 - protein, 23 aa, Giardia lamblia
ASQQEPPSPEYSTKQESQRSPKN

SEQ ID NO: 3101136 - protein, 9 aa, Giardia lamblia
ASQQHPSQS

SEQ ID NO: 3101137 - protein, 8 aa, Giardia lamblia
ASQQSRNL

SEQ ID NO: 3101138 - protein, 8 aa, Giardia lamblia
ASQQTADE

SEQ ID NO: 3101139 - protein, 22 aa, Giardia lamblia
ASQQTPDSIASNDASQLFSRGS

SEQ ID NO: 3101140 - protein, 21 aa, Giardia lamblia
ASQRDLGGHPATTLTDDGPDC

SEQ ID NO: 3101141 - protein, 39 aa, Giardia lamblia
ASQSSKKTKTGSSSKADAPHEPEVKKSKSGKDRSNKKQS

SEQ ID NO: 3101142 - protein, 17 aa, Giardia lamblia
ASQTISAPIADDAADPR

SEQ ID NO: 3101143 - protein, 10 aa, Giardia lamblia
ASQTMSTLSQ

SEQ ID NO: 3101144 - protein, 5 aa, Giardia lamblia
ASQTN

SEQ ID NO: 3101145 - protein, 23 aa, Giardia lamblia
ASQTVSTPGRVGGVSPSGLRTIS

SEQ ID NO: 3101146 - protein, 5 aa, Giardia lamblia
ASQTY

SEQ ID NO: 3101147 - protein, 6 aa, Giardia lamblia
ASRAGH

SEQ ID NO: 3101148 - protein, 5 aa, Giardia lamblia
ASRED

SEQ ID NO: 3101149 - protein, 7 aa, Giardia lamblia
ASRENIN

SEQ ID NO: 3101150 - protein, 5 aa, Giardia lamblia
ASRET

SEQ ID NO: 3101151 - protein, 10 aa, Giardia lamblia
ASREYRGRSE

SEQ ID NO: 3101152 - protein, 15 aa, Giardia lamblia
ASRGASEDRKSRTNE

SEQ ID NO: 3101153 - protein, 9 aa, Giardia lamblia
ASRGATNLA

SEQ ID NO: 3101154 - protein, 8 aa, Giardia lamblia
ASRGETPY

SEQ ID NO: 3101155 - protein, 5 aa, Giardia lamblia
ASRGL

SEQ ID NO: 3101156 - protein, 7 aa, Giardia lamblia
ASRGNYG

SEQ ID NO: 3101157 - protein, 12 aa, Giardia lamblia
ASRGPMESSTSS

SEQ ID NO: 3101158 - protein, 6 aa, Giardia lamblia
ASRHDS

SEQ ID NO: 3101159 - protein, 14 aa, Giardia lamblia
ASRHGAGGGPALPR

SEQ ID NO: 3101160 - protein, 17 aa, Giardia lamblia
ASRHRSRPSTALKATTQ

SEQ ID NO: 3101161 - protein, 6 aa, Giardia lamblia
ASRKDS

SEQ ID NO: 3101162 - protein, 6 aa, Giardia lamblia
ASRKNP

SEQ ID NO: 3101163 - protein, 5 aa, Giardia lamblia
ASRKS

SEQ ID NO: 3101164 - protein, 15 aa, Giardia lamblia
ASRLSAARAQERLSR

SEQ ID NO: 3101165 - protein, 5 aa, Giardia lamblia
ASRPN

SEQ ID NO: 3101166 - protein, 8 aa, Giardia lamblia
ASRPNASR

SEQ ID NO: 3101167 - protein, 26 aa, Giardia lamblia
ASRPSSAHTQNEPDYPLDSPQQRTPI

SEQ ID NO: 3101168 - protein, 21 aa, Giardia lamblia
ASRPTQAALSRPHGDANEGMQ

SEQ ID NO: 3101169 - protein, 4 aa, Giardia lamblia
ASRQ

SEQ ID NO: 3101170 - protein, 9 aa, Giardia lamblia
ASRQIRREA

SEQ ID NO: 3101171 - protein, 12 aa, Giardia lamblia
ASRQLASSLTDQ

SEQ ID NO: 3101172 - protein, 10 aa, Giardia lamblia
ASRQNSSGAT

SEQ ID NO: 3101173 - protein, 11 aa, Giardia lamblia
ASRQSRHGSEA

SEQ ID NO: 3101174 - protein, 5 aa, Giardia lamblia
ASRRE

SEQ ID NO: 3101175 - protein, 7 aa, Giardia lamblia
ASRREGK

SEQ ID NO: 3101176 - protein, 19 aa, Giardia lamblia
ASRRSAAKKTVDENGWTIN

SEQ ID NO: 3101177 - protein, 16 aa, Giardia lamblia
ASRSAHNAVRPSEKKM

SEQ ID NO: 3101178 - protein, 6 aa, Giardia lamblia
ASRSEY

SEQ ID NO: 3101179 - protein, 44 aa, Giardia lamblia
ASRSGSASSVRSQSATNIDASAADSGQSGELRDNHEDDNNDYAE

SEQ ID NO: 3101180 - protein, 20 aa, Giardia lamblia
ASRSGSRAAKVREAPSRGNS

SEQ ID NO: 3101181 - protein, 7 aa, Giardia lamblia
ASRSHSS

SEQ ID NO: 3101182 - protein, 5 aa, Giardia lamblia
ASRSQ

SEQ ID NO: 3101183 - protein, 9 aa, Giardia lamblia
ASRSRGVEE

SEQ ID NO: 3101184 - protein, 18 aa, Giardia lamblia
ASRSTMESKLQEKDQEIA

SEQ ID NO: 3101185 - protein, 8 aa, Giardia lamblia
ASRTATFN

SEQ ID NO: 3101186 - protein, 19 aa, Giardia lamblia
ASRTSTETSSSGASPSKDL

SEQ ID NO: 3101187 - protein, 6 aa, Giardia lamblia
ASRVNP

SEQ ID NO: 3101188 - protein, 18 aa, Giardia lamblia
ASRVSPSVQPGYAQPEFN

SEQ ID NO: 3101189 - protein, 9 aa, Giardia lamblia
ASRVSSRQP

SEQ ID NO: 3101190 - protein, 6 aa, Giardia lamblia
ASSADS

SEQ ID NO: 3101191 - protein, 18 aa, Giardia lamblia
ASSAMKKDRYGVEKELED

SEQ ID NO: 3101192 - protein, 13 aa, Giardia lamblia
ASSANDQSNMDTS

SEQ ID NO: 3101193 - protein, 23 aa, Giardia lamblia
ASSAPGPARPASAAQSRPSSVSR

SEQ ID NO: 3101194 - protein, 8 aa, Giardia lamblia
ASSASPAK

SEQ ID NO: 3101195 - protein, 7 aa, Giardia lamblia
ASSATIA

SEQ ID NO: 3101196 - protein, 12 aa, Giardia lamblia
ASSATKPANPYL

SEQ ID NO: 3101197 - protein, 6 aa, Giardia lamblia
ASSCRD

SEQ ID NO: 3101198 - protein, 15 aa, Giardia lamblia
ASSCSSATEIPPRDF

SEQ ID NO: 3101199 - protein, 5 aa, Giardia lamblia
ASSDA

SEQ ID NO: 3101200 - protein, 6 aa, Giardia lamblia
ASSDDF

SEQ ID NO: 3101201 - protein, 6 aa, Giardia lamblia
ASSDEI

SEQ ID NO: 3101202 - protein, 6 aa, Giardia lamblia
ASSDGL

SEQ ID NO: 3101203 - protein, 27 aa, Giardia lamblia
ASSDTFVNPDSGKHCPVKAKKGKLQEK

SEQ ID NO: 3101204 - protein, 15 aa, Giardia lamblia
ASSEAQQEKQGTQGV

SEQ ID NO: 3101205 - protein, 7 aa, Giardia lamblia
ASSEELQ

SEQ ID NO: 3101206 - protein, 10 aa, Giardia lamblia
ASSEGNKTAM

SEQ ID NO: 3101207 - protein, 8 aa, Giardia lamblia
ASSEKDKA

SEQ ID NO: 3101208 - protein, 9 aa, Giardia lamblia
ASSELNPAD

SEQ ID NO: 3101209 - protein, 6 aa, Giardia lamblia
ASSESI

SEQ ID NO: 3101210 - protein, 4 aa, Giardia lamblia
ASSF

SEQ ID NO: 3101211 - protein, 4 aa, Giardia lamblia
ASSG

SEQ ID NO: 3101212 - protein, 8 aa, Giardia lamblia
ASSGASEY

SEQ ID NO: 3101213 - protein, 7 aa, Giardia lamblia
ASSGLGS

SEQ ID NO: 3101214 - protein, 8 aa, Giardia lamblia
ASSGNDSQ

SEQ ID NO: 3101215 - protein, 6 aa, Giardia lamblia
ASSGQT

SEQ ID NO: 3101216 - protein, 4 aa, Giardia lamblia
ASSH

SEQ ID NO: 3101217 - protein, 12 aa, Giardia lamblia
ASSHTCNTPAVS

SEQ ID NO: 3101218 - protein, 5 aa, Giardia lamblia
ASSIS

SEQ ID NO: 3101219 - protein, 12 aa, Giardia lamblia
ASSKKYLSSSAN

SEQ ID NO: 3101220 - protein, 14 aa, Giardia lamblia
ASSKLSDKVGSEYD

SEQ ID NO: 3101221 - protein, 15 aa, Giardia lamblia
ASSKPEEDNSGGENH

SEQ ID NO: 3101222 - protein, 11 aa, Giardia lamblia
ASSKQGKLDAS

SEQ ID NO: 3101223 - protein, 7 aa, Giardia lamblia
ASSKSID

SEQ ID NO: 3101224 - protein, 42 aa, Giardia lamblia
ASSKTPVSQQTTAPSISTTASRGRALGDSSMGDATGVSHNSI

SEQ ID NO: 3101225 - protein, 19 aa, Giardia lamblia
ASSKTTTADNQATPLSPMS

SEQ ID NO: 3101226 - protein, 6 aa, Giardia lamblia
ASSLSA

SEQ ID NO: 3101227 - protein, 10 aa, Giardia lamblia
ASSLTSSTRL

SEQ ID NO: 3101228 - protein, 8 aa, Giardia lamblia
ASSNAPAL

SEQ ID NO: 3101229 - protein, 5 aa, Giardia lamblia
ASSND

SEQ ID NO: 3101230 - protein, 11 aa, Giardia lamblia
ASSNDAQTASL

SEQ ID NO: 3101231 - protein, 8 aa, Giardia lamblia
ASSNNKPE

SEQ ID NO: 3101232 - protein, 25 aa, Giardia lamblia
ASSNSSEAMSQSQGMSARPTQESNS

SEQ ID NO: 3101233 - protein, 6 aa, Giardia lamblia
ASSNTV

SEQ ID NO: 3101234 - protein, 9 aa, Giardia lamblia
ASSPAEKLE

SEQ ID NO: 3101235 - protein, 22 aa, Giardia lamblia
ASSPAYKSTHNQDGNTGAENNH

SEQ ID NO: 3101236 - protein, 9 aa, Giardia lamblia
ASSPIPEYA

SEQ ID NO: 3101237 - protein, 7 aa, Giardia lamblia
ASSPLDQ

SEQ ID NO: 3101238 - protein, 8 aa, Giardia lamblia
ASSPPENI

SEQ ID NO: 3101239 - protein, 7 aa, Giardia lamblia
ASSPRTI

SEQ ID NO: 3101240 - protein, 23 aa, Giardia lamblia
ASSPSALPSHEATGTADKSADIS

SEQ ID NO: 3101241 - protein, 15 aa, Giardia lamblia
ASSPSNSKSGPESSV

SEQ ID NO: 3101242 - protein, 10 aa, Giardia lamblia
ASSPSRSISD

SEQ ID NO: 3101243 - protein, 5 aa, Giardia lamblia
ASSPY

SEQ ID NO: 3101244 - protein, 9 aa, Giardia lamblia
ASSPYRQTQ

SEQ ID NO: 3101245 - protein, 28 aa, Giardia lamblia
ASSQASSSLQIPNATAEVATSTLPTQRS

SEQ ID NO: 3101246 - protein, 6 aa, Giardia lamblia
ASSQGA

SEQ ID NO: 3101247 - protein, 6 aa, Giardia lamblia
ASSQQL

SEQ ID NO: 3101248 - protein, 34 aa, Giardia lamblia
ASSQYAHKDTFKQSENKLGCTQTLGKTEADTTEY

SEQ ID NO: 3101249 - protein, 7 aa, Giardia lamblia
ASSREYS

SEQ ID NO: 3101250 - protein, 7 aa, Giardia lamblia
ASSRFSQ

SEQ ID NO: 3101251 - protein, 9 aa, Giardia lamblia
ASSRGSTLA

SEQ ID NO: 3101252 - protein, 7 aa, Giardia lamblia
ASSRPDG

SEQ ID NO: 3101253 - protein, 16 aa, Giardia lamblia
ASSRPSSAAPSRVTTP

SEQ ID NO: 3101254 - protein, 8 aa, Giardia lamblia
ASSRREAD

SEQ ID NO: 3101255 - protein, 13 aa, Giardia lamblia
ASSRVDADGFEIR

SEQ ID NO: 3101256 - protein, 10 aa, Giardia lamblia
ASSRYTEEDL

SEQ ID NO: 3101257 - protein, 5 aa, Giardia lamblia
ASSSG

SEQ ID NO: 3101258 - protein, 13 aa, Giardia lamblia
ASSSGESSEKQNV

SEQ ID NO: 3101259 - protein, 5 aa, Giardia lamblia
ASSSH

SEQ ID NO: 3101260 - protein, 13 aa, Giardia lamblia
ASSSHGDARPYYG

SEQ ID NO: 3101261 - protein, 15 aa, Giardia lamblia
ASSSHNSSTVLNNTD

SEQ ID NO: 3101262 - protein, 41 aa, Giardia lamblia
ASSSIGDSATSTVKAENFDQPEKKTTGVQGSTASREEHEKH

SEQ ID NO: 3101263 - protein, 9 aa, Giardia lamblia
ASSSIPPDS

SEQ ID NO: 3101264 - protein, 9 aa, Giardia lamblia
ASSSLSQTC

SEQ ID NO: 3101265 - protein, 33 aa, Giardia lamblia
ASSSPERIERDRRSEHSHRSSTPCSRDSTVPQH

SEQ ID NO: 3101266 - protein, 15 aa, Giardia lamblia
ASSSPKTEFRPRTSN

SEQ ID NO: 3101267 - protein, 18 aa, Giardia lamblia
ASSSPPIPESEPPAPTSY

SEQ ID NO: 3101268 - protein, 13 aa, Giardia lamblia
ASSSPTPSRRPSC

SEQ ID NO: 3101269 - protein, 28 aa, Giardia lamblia
ASSSSAHTPGVDPTVSSANIKASASRAS

SEQ ID NO: 3101270 - protein, 7 aa, Giardia lamblia
ASSSTAT

SEQ ID NO: 3101271 - protein, 10 aa, Giardia lamblia
ASSSVSRSAT

SEQ ID NO: 3101272 - protein, 8 aa, Giardia lamblia
ASSSYATS

SEQ ID NO: 3101273 - protein, 5 aa, Giardia lamblia
ASSTA

SEQ ID NO: 3101274 - protein, 8 aa, Giardia lamblia
ASSTDQQT

SEQ ID NO: 3101275 - protein, 11 aa, Giardia lamblia
ASSTLGTRKGA

SEQ ID NO: 3101276 - protein, 14 aa, Giardia lamblia
ASSTPKEPGAAGGK

SEQ ID NO: 3101277 - protein, 8 aa, Giardia lamblia
ASSTPNDY

SEQ ID NO: 3101278 - protein, 13 aa, Giardia lamblia
ASSTRLASSSCNG

SEQ ID NO: 3101279 - protein, 12 aa, Giardia lamblia
ASSTSRTTTDYL

SEQ ID NO: 3101280 - protein, 10 aa, Giardia lamblia
ASSVDRTQAK

SEQ ID NO: 3101281 - protein, 29 aa, Giardia lamblia
ASTAAPVRVGEGAGPIECGREQQAPGLRA

SEQ ID NO: 3101282 - protein, 23 aa, Giardia lamblia
ASTAFRKNTRHGSALPPKSESGL

SEQ ID NO: 3101283 - protein, 9 aa, Giardia lamblia
ASTAHEQEI

SEQ ID NO: 3101284 - protein, 16 aa, Giardia lamblia
ASTAPPPNKEKQLESA

SEQ ID NO: 3101285 - protein, 10 aa, Giardia lamblia
ASTASPSGGG

SEQ ID NO: 3101286 - protein, 4 aa, Giardia lamblia
ASTD

SEQ ID NO: 3101287 - protein, 5 aa, Giardia lamblia
ASTDA

SEQ ID NO: 3101288 - protein, 24 aa, Giardia lamblia
ASTDDKNPTGEKPASVPAPTPASD

SEQ ID NO: 3101289 - protein, 7 aa, Giardia lamblia
ASTDDMR

SEQ ID NO: 3101290 - protein, 5 aa, Giardia lamblia
ASTDI

SEQ ID NO: 3101291 - protein, 7 aa, Giardia lamblia
ASTDSTC

SEQ ID NO: 3101292 - protein, 4 aa, Giardia lamblia
ASTE

SEQ ID NO: 3101293 - protein, 7 aa, Giardia lamblia
ASTEDTP

SEQ ID NO: 3101294 - protein, 12 aa, Giardia lamblia
ASTFATKGSTTL

SEQ ID NO: 3101295 - protein, 24 aa, Giardia lamblia
ASTFATPQTNTIPLSPSESAVQPN

SEQ ID NO: 3101296 - protein, 7 aa, Giardia lamblia
ASTGAVS

SEQ ID NO: 3101297 - protein, 5 aa, Giardia lamblia
ASTGL

SEQ ID NO: 3101298 - protein, 6 aa, Giardia lamblia
ASTGNL

SEQ ID NO: 3101299 - protein, 14 aa, Giardia lamblia
ASTHQGQSIEKETP

SEQ ID NO: 3101300 - protein, 6 aa, Giardia lamblia
ASTIEN

SEQ ID NO: 3101301 - protein, 6 aa, Giardia lamblia
ASTLTS

SEQ ID NO: 3101302 - protein, 21 aa, Giardia lamblia
ASTMNQSPTAADFGYSSGTSL

SEQ ID NO: 3101303 - protein, 37 aa, Giardia lamblia
ASTNAPAPITESGAGGASTQLVPPGSNSSAAGEHKPT

SEQ ID NO: 3101304 - protein, 6 aa, Giardia lamblia
ASTNTE

SEQ ID NO: 3101305 - protein, 4 aa, Giardia lamblia
ASTP

SEQ ID NO: 3101306 - protein, 7 aa, Giardia lamblia
ASTPARL

SEQ ID NO: 3101307 - protein, 5 aa, Giardia lamblia
ASTQA

SEQ ID NO: 3101308 - protein, 19 aa, Giardia lamblia
ASTQIPDYQRSPSPTYERY

SEQ ID NO: 3101309 - protein, 8 aa, Giardia lamblia
ASTQNANS

SEQ ID NO: 3101310 - protein, 6 aa, Giardia lamblia
ASTRSL

SEQ ID NO: 3101311 - protein, 9 aa, Giardia lamblia
ASTSADRYE

SEQ ID NO: 3101312 - protein, 9 aa, Giardia lamblia
ASTSGGAVS

SEQ ID NO: 3101313 - protein, 45 aa, Giardia lamblia
ASTSQPLGTQLPSHSTSLPIPSRSASRTGSVPPQNPRTNSQTPRQ

SEQ ID NO: 3101314 - protein, 11 aa, Giardia lamblia
ASTSSAATECN

SEQ ID NO: 3101315 - protein, 6 aa, Giardia lamblia
ASTSSL

SEQ ID NO: 3101316 - protein, 33 aa, Giardia lamblia
ASTSTDPSLASVSSRQASAKNVAGGQRSAPQSK

SEQ ID NO: 3101317 - protein, 11 aa, Giardia lamblia
ASTTGATTDEV

SEQ ID NO: 3101318 - protein, 6 aa, Giardia lamblia
ASTTLR

SEQ ID NO: 3101319 - protein, 25 aa, Giardia lamblia
ASTVTAEVSARNAQRTKPLPQPNRK

SEQ ID NO: 3101320 - protein, 6 aa, Giardia lamblia
ASTYDE

SEQ ID NO: 3101321 - protein, 5 aa, Giardia lamblia
ASTYS

SEQ ID NO: 3101322 - protein, 7 aa, Giardia lamblia
ASTYTGI

SEQ ID NO: 3101323 - protein, 9 aa, Giardia lamblia
ASVAAGAEH

SEQ ID NO: 3101324 - protein, 18 aa, Giardia lamblia
ASVAGQTATIGAPTTQQA

SEQ ID NO: 3101325 - protein, 6 aa, Giardia lamblia
ASVDGS

SEQ ID NO: 3101326 - protein, 34 aa, Giardia lamblia
ASVDTAPDTAHQEQSLPDAAQPPTTVDSGEKAVD

SEQ ID NO: 3101327 - protein, 6 aa, Giardia lamblia
ASVEGR

SEQ ID NO: 3101328 - protein, 9 aa, Giardia lamblia
ASVGATAGV

SEQ ID NO: 3101329 - protein, 10 aa, Giardia lamblia
ASVGGTSEVE

SEQ ID NO: 3101330 - protein, 5 aa, Giardia lamblia
ASVGN

SEQ ID NO: 3101331 - protein, 11 aa, Giardia lamblia
ASVNQGPTKAA

SEQ ID NO: 3101332 - protein, 9 aa, Giardia lamblia
ASVNRSESI

SEQ ID NO: 3101333 - protein, 20 aa, Giardia lamblia
ASVNTPKQTTRDRYGRQSVT

SEQ ID NO: 3101334 - protein, 4 aa, Giardia lamblia
ASVQ

SEQ ID NO: 3101335 - protein, 6 aa, Giardia lamblia
ASVQSS

SEQ ID NO: 3101336 - protein, 27 aa, Giardia lamblia
ASVQSTSSKIKASAKASAATLRDLRFT

SEQ ID NO: 3101337 - protein, 5 aa, Giardia lamblia
ASVQT

SEQ ID NO: 3101338 - protein, 4 aa, Giardia lamblia
ASVS

SEQ ID NO: 3101339 - protein, 9 aa, Giardia lamblia
ASVSGSAIN

SEQ ID NO: 3101340 - protein, 6 aa, Giardia lamblia
ASVSKF

SEQ ID NO: 3101341 - protein, 9 aa, Giardia lamblia
ASVSRGNYY

SEQ ID NO: 3101342 - protein, 10 aa, Giardia lamblia
ASVSRTRTAN

SEQ ID NO: 3101343 - protein, 18 aa, Giardia lamblia
ASVSTKERGVDAQGEKAI

SEQ ID NO: 3101344 - protein, 7 aa, Giardia lamblia
ASVSYDP

SEQ ID NO: 3101345 - protein, 8 aa, Giardia lamblia
ASVTESQR

SEQ ID NO: 3101346 - protein, 8 aa, Giardia lamblia
ASVTSGTL

SEQ ID NO: 3101347 - protein, 7 aa, Giardia lamblia
ASWRETE

SEQ ID NO: 3101348 - protein, 5 aa, Giardia lamblia
ASYAA

SEQ ID NO: 3101349 - protein, 6 aa, Giardia lamblia
ASYDDL

SEQ ID NO: 3101350 - protein, 11 aa, Giardia lamblia
ASYDGSSTAGH

SEQ ID NO: 3101351 - protein, 16 aa, Giardia lamblia
ASYGGVPGCADASPSK

SEQ ID NO: 3101352 - protein, 6 aa, Giardia lamblia
ASYGKA

SEQ ID NO: 3101353 - protein, 9 aa, Giardia lamblia
ASYGSEQRD

SEQ ID NO: 3101354 - protein, 5 aa, Giardia lamblia
ASYKT

SEQ ID NO: 3101355 - protein, 8 aa, Giardia lamblia
ASYQKVAD

SEQ ID NO: 3101356 - protein, 9 aa, Giardia lamblia
ASYQPEPGF

SEQ ID NO: 3101357 - protein, 10 aa, Giardia lamblia
ASYRNGVEKD

SEQ ID NO: 3101358 - protein, 14 aa, Giardia lamblia
ASYRPESLAKGDIK

SEQ ID NO: 3101359 - protein, 28 aa, Giardia lamblia
ASYSTSSKRSSNDQSTKRSASPQTIDTA

SEQ ID NO: 3101360 - protein, 9 aa, Giardia lamblia
ASYTPRGAT

SEQ ID NO: 3101361 - protein, 14 aa, Giardia lamblia
ASYTPTQNGYSPLQ

SEQ ID NO: 3101362 - protein, 20 aa, Giardia lamblia
ATAASSSATYQDGEKLPPVH

SEQ ID NO: 3101363 - protein, 8 aa, Giardia lamblia
ATACTEKP

SEQ ID NO: 3101364 - protein, 8 aa, Giardia lamblia
ATADPELA

SEQ ID NO: 3101365 - protein, 19 aa, Giardia lamblia
ATADPGFGTQPAETNTALI

SEQ ID NO: 3101366 - protein, 7 aa, Giardia lamblia
ATAEDAL

SEQ ID NO: 3101367 - protein, 11 aa, Giardia lamblia
ATAERAAAEDR

SEQ ID NO: 3101368 - protein, 9 aa, Giardia lamblia
ATAERPQAF

SEQ ID NO: 3101369 - protein, 9 aa, Giardia lamblia
ATAESATPH

SEQ ID NO: 3101370 - protein, 14 aa, Giardia lamblia
ATAGDTHLGGEDFD

SEQ ID NO: 3101371 - protein, 8 aa, Giardia lamblia
ATAGNTEY

SEQ ID NO: 3101372 - protein, 8 aa, Giardia lamblia
ATAGPVPE

SEQ ID NO: 3101373 - protein, 14 aa, Giardia lamblia
ATAGTNVGVPEEQN

SEQ ID NO: 3101374 - protein, 13 aa, Giardia lamblia
ATAKKYVTSGGEF

SEQ ID NO: 3101375 - protein, 4 aa, Giardia lamblia
ATAL

SEQ ID NO: 3101376 - protein, 8 aa, Giardia lamblia
ATAMSPDT

SEQ ID NO: 3101377 - protein, 4 aa, Giardia lamblia
ATAP

SEQ ID NO: 3101378 - protein, 5 aa, Giardia lamblia
ATAPF

SEQ ID NO: 3101379 - protein, 9 aa, Giardia lamblia
ATAPHSDQV

SEQ ID NO: 3101380 - protein, 31 aa, Giardia lamblia
ATAPSKSKETRTPQASEDGADEETSNELNTY

SEQ ID NO: 3101381 - protein, 8 aa, Giardia lamblia
ATAPTPYK

SEQ ID NO: 3101382 - protein, 8 aa, Giardia lamblia
ATAQSSTT

SEQ ID NO: 3101383 - protein, 5 aa, Giardia lamblia
ATARR

SEQ ID NO: 3101384 - protein, 13 aa, Giardia lamblia
ATARSRIEKAGGR

SEQ ID NO: 3101385 - protein, 5 aa, Giardia lamblia
ATASE

SEQ ID NO: 3101386 - protein, 9 aa, Giardia lamblia
ATASRYSQQ

SEQ ID NO: 3101387 - protein, 5 aa, Giardia lamblia
ATATI

SEQ ID NO: 3101388 - protein, 8 aa, Giardia lamblia
ATATLGAS

SEQ ID NO: 3101389 - protein, 20 aa, Giardia lamblia
ATATQSSVTPIEQKSPGSML

SEQ ID NO: 3101390 - protein, 8 aa, Giardia lamblia
ATATQSTE

SEQ ID NO: 3101391 - protein, 6 aa, Giardia lamblia
ATATYP

SEQ ID NO: 3101392 - protein, 11 aa, Giardia lamblia
ATAVASRENRM

SEQ ID NO: 3101393 - protein, 5 aa, Giardia lamblia
ATAVS

SEQ ID NO: 3101394 - protein, 9 aa, Giardia lamblia
ATAVTNQES

SEQ ID NO: 3101395 - protein, 7 aa, Giardia lamblia
ATCSSED

SEQ ID NO: 3101396 - protein, 4 aa, Giardia lamblia
ATCY

SEQ ID NO: 3101397 - protein, 20 aa, Giardia lamblia
ATDADAKNDSRDDFIKPANR

SEQ ID NO: 3101398 - protein, 13 aa, Giardia lamblia
ATDAGKKNRKGKT

SEQ ID NO: 3101399 - protein, 19 aa, Giardia lamblia
ATDALSTENNQQPQSTSYT

SEQ ID NO: 3101400 - protein, 6 aa, Giardia lamblia
ATDATR

SEQ ID NO: 3101401 - protein, 13 aa, Giardia lamblia
ATDCKDNPLIEGP

SEQ ID NO: 3101402 - protein, 14 aa, Giardia lamblia
ATDDAISTRPHPSL

SEQ ID NO: 3101403 - protein, 7 aa, Giardia lamblia
ATDDQRR

SEQ ID NO: 3101404 - protein, 7 aa, Giardia lamblia
ATDDRHR

SEQ ID NO: 3101405 - protein, 5 aa, Giardia lamblia
ATDEM

SEQ ID NO: 3101406 - protein, 6 aa, Giardia lamblia
ATDEPL

SEQ ID NO: 3101407 - protein, 13 aa, Giardia lamblia
ATDESGNQYYSSD

SEQ ID NO: 3101408 - protein, 7 aa, Giardia lamblia
ATDETDV

SEQ ID NO: 3101409 - protein, 6 aa, Giardia lamblia
ATDFRP

SEQ ID NO: 3101410 - protein, 7 aa, Giardia lamblia
ATDGSTA

SEQ ID NO: 3101411 - protein, 27 aa, Giardia lamblia
ATDGTANSADQPATNSFTQQPPFSSSQ

SEQ ID NO: 3101412 - protein, 8 aa, Giardia lamblia
ATDKDLTA

SEQ ID NO: 3101413 - protein, 9 aa, Giardia lamblia
ATDKSGEAL

SEQ ID NO: 3101414 - protein, 4 aa, Giardia lamblia
ATDN

SEQ ID NO: 3101415 - protein, 10 aa, Giardia lamblia
ATDNEQKVRQ

SEQ ID NO: 3101416 - protein, 6 aa, Giardia lamblia
ATDNET

SEQ ID NO: 3101417 - protein, 5 aa, Giardia lamblia
ATDNL

SEQ ID NO: 3101418 - protein, 10 aa, Giardia lamblia
ATDNQKNPLT

SEQ ID NO: 3101419 - protein, 12 aa, Giardia lamblia
ATDNSDSSPQAR

SEQ ID NO: 3101420 - protein, 4 aa, Giardia lamblia
ATDP

SEQ ID NO: 3101421 - protein, 8 aa, Giardia lamblia
ATDPDDVP

SEQ ID NO: 3101422 - protein, 15 aa, Giardia lamblia
ATDPDEEVQKGLTAK

SEQ ID NO: 3101423 - protein, 8 aa, Giardia lamblia
ATDPDTNE

SEQ ID NO: 3101424 - protein, 49 aa, Giardia lamblia
ATDPSALETVDTSKASSSSDQSEEEDETDSESVHQDQEQSSQENNDTTE

SEQ ID NO: 3101425 - protein, 9 aa, Giardia lamblia
ATDQEPLDK

SEQ ID NO: 3101426 - protein, 7 aa, Giardia lamblia
ATDQSHQ

SEQ ID NO: 3101427 - protein, 4 aa, Giardia lamblia
ATDR

SEQ ID NO: 3101428 - protein, 7 aa, Giardia lamblia
ATDRDAE

SEQ ID NO: 3101429 - protein, 10 aa, Giardia lamblia
ATDREGEDYD

SEQ ID NO: 3101430 - protein, 10 aa, Giardia lamblia
ATDRRAQQEL

SEQ ID NO: 3101431 - protein, 9 aa, Giardia lamblia
ATDSRTKEE

SEQ ID NO: 3101432 - protein, 5 aa, Giardia lamblia
ATDTA

SEQ ID NO: 3101433 - protein, 7 aa, Giardia lamblia
ATDTETG

SEQ ID NO: 3101434 - protein, 6 aa, Giardia lamblia
ATDTGI

SEQ ID NO: 3101435 - protein, 32 aa, Giardia lamblia
ATDTLDSDADTDVDESTRQNLDNSTNSRTPGY

SEQ ID NO: 3101436 - protein, 6 aa, Giardia lamblia
ATDTQS

SEQ ID NO: 3101437 - protein, 7 aa, Giardia lamblia
ATDTRGC

SEQ ID NO: 3101438 - protein, 15 aa, Giardia lamblia
ATDTTTDTTNTQPVS

SEQ ID NO: 3101439 - protein, 12 aa, Giardia lamblia
ATDYSQANANTT

SEQ ID NO: 3101440 - protein, 4 aa, Giardia lamblia
ATEA

SEQ ID NO: 3101441 - protein, 11 aa, Giardia lamblia
ATEAENAEGMR

SEQ ID NO: 3101442 - protein, 5 aa, Giardia lamblia
ATEAG

SEQ ID NO: 3101443 - protein, 13 aa, Giardia lamblia
ATEAGLQNNAGET

SEQ ID NO: 3101444 - protein, 7 aa, Giardia lamblia
ATEAKTQ

SEQ ID NO: 3101445 - protein, 12 aa, Giardia lamblia
ATEANKNLSTTM

SEQ ID NO: 3101446 - protein, 15 aa, Giardia lamblia
ATEDPEAAPAAVPKK

SEQ ID NO: 3101447 - protein, 6 aa, Giardia lamblia
ATEDTT

SEQ ID NO: 3101448 - protein, 6 aa, Giardia lamblia
ATEEDH

SEQ ID NO: 3101449 - protein, 6 aa, Giardia lamblia
ATEEDI

SEQ ID NO: 3101450 - protein, 10 aa, Giardia lamblia
ATEEDYDPNF

SEQ ID NO: 3101451 - protein, 12 aa, Giardia lamblia
ATEESSAMEELV

SEQ ID NO: 3101452 - protein, 6 aa, Giardia lamblia
ATEGYQ

SEQ ID NO: 3101453 - protein, 5 aa, Giardia lamblia
ATEHR

SEQ ID NO: 3101454 - protein, 6 aa, Giardia lamblia
ATEIQP

SEQ ID NO: 3101455 - protein, 13 aa, Giardia lamblia
ATEKRTLDDQIAE

SEQ ID NO: 3101456 - protein, 4 aa, Giardia lamblia
ATEL

SEQ ID NO: 3101457 - protein, 15 aa, Giardia lamblia
ATELEEKAVRSKTKR

SEQ ID NO: 3101458 - protein, 7 aa, Giardia lamblia
ATELEGD

SEQ ID NO: 3101459 - protein, 4 aa, Giardia lamblia
ATEN

SEQ ID NO: 3101460 - protein, 8 aa, Giardia lamblia
ATENQTDA

SEQ ID NO: 3101461 - protein, 14 aa, Giardia lamblia
ATEPESKDTSDVTE

SEQ ID NO: 3101462 - protein, 7 aa, Giardia lamblia
ATEPETV

SEQ ID NO: 3101463 - protein, 6 aa, Giardia lamblia
ATEPLT

SEQ ID NO: 3101464 - protein, 7 aa, Giardia lamblia
ATEPPRY

SEQ ID NO: 3101465 - protein, 8 aa, Giardia lamblia
ATEPVSQE

SEQ ID NO: 3101466 - protein, 8 aa, Giardia lamblia
ATEQANAL

SEQ ID NO: 3101467 - protein, 11 aa, Giardia lamblia
ATEQATKDHLR

SEQ ID NO: 3101468 - protein, 6 aa, Giardia lamblia
ATEQGL

SEQ ID NO: 3101469 - protein, 13 aa, Giardia lamblia
ATERPAEATTPTV

SEQ ID NO: 3101470 - protein, 4 aa, Giardia lamblia
ATES

SEQ ID NO: 3101471 - protein, 9 aa, Giardia lamblia
ATESAEGTA

SEQ ID NO: 3101472 - protein, 13 aa, Giardia lamblia
ATESGSKRLSGTL

SEQ ID NO: 3101473 - protein, 11 aa, Giardia lamblia
ATESLPSAEDV

SEQ ID NO: 3101474 - protein, 9 aa, Giardia lamblia
ATESQLSEK

SEQ ID NO: 3101475 - protein, 9 aa, Giardia lamblia
ATETTAPHA

SEQ ID NO: 3101476 - protein, 5 aa, Giardia lamblia
ATETV

SEQ ID NO: 3101477 - protein, 17 aa, Giardia lamblia
ATEVKGGTSPYETREEF

SEQ ID NO: 3101478 - protein, 4 aa, Giardia lamblia
ATEY

SEQ ID NO: 3101479 - protein, 6 aa, Giardia lamblia
ATFDGN

SEQ ID NO: 3101480 - protein, 7 aa, Giardia lamblia
ATFGDRN

SEQ ID NO: 3101481 - protein, 7 aa, Giardia lamblia
ATFSSSQ

SEQ ID NO: 3101482 - protein, 8 aa, Giardia lamblia
ATGADGTV

SEQ ID NO: 3101483 - protein, 21 aa, Giardia lamblia
ATGAGKSHTMSGSDASGPGVI

SEQ ID NO: 3101484 - protein, 5 aa, Giardia lamblia
ATGAK

SEQ ID NO: 3101485 - protein, 14 aa, Giardia lamblia
ATGASRASSSQRPA

SEQ ID NO: 3101486 - protein, 4 aa, Giardia lamblia
ATGC

SEQ ID NO: 3101487 - protein, 6 aa, Giardia lamblia
ATGDHH

SEQ ID NO: 3101488 - protein, 11 aa, Giardia lamblia
ATGDLTSLSEE

SEQ ID NO: 3101489 - protein, 6 aa, Giardia lamblia
ATGDWT

SEQ ID NO: 3101490 - protein, 6 aa, Giardia lamblia
ATGDYP

SEQ ID NO: 3101491 - protein, 5 aa, Giardia lamblia
ATGED

SEQ ID NO: 3101492 - protein, 5 aa, Giardia lamblia
ATGEE

SEQ ID NO: 3101493 - protein, 7 aa, Giardia lamblia
ATGGNTI

SEQ ID NO: 3101494 - protein, 10 aa, Giardia lamblia
ATGGNYAVQD

SEQ ID NO: 3101495 - protein, 9 aa, Giardia lamblia
ATGGQPTDI

SEQ ID NO: 3101496 - protein, 5 aa, Giardia lamblia
ATGHG

SEQ ID NO: 3101497 - protein, 11 aa, Giardia lamblia
ATGHNADDNAE

SEQ ID NO: 3101498 - protein, 5 aa, Giardia lamblia
ATGIT

SEQ ID NO: 3101499 - protein, 7 aa, Giardia lamblia
ATGKKTM

SEQ ID NO: 3101500 - protein, 7 aa, Giardia lamblia
ATGKPEA

SEQ ID NO: 3101501 - protein, 22 aa, Giardia lamblia
ATGKRTASATPAAPAKVQPRQI

SEQ ID NO: 3101502 - protein, 4 aa, Giardia lamblia
ATGN

SEQ ID NO: 3101503 - protein, 10 aa, Giardia lamblia
ATGPAAEAGT

SEQ ID NO: 3101504 - protein, 8 aa, Giardia lamblia
ATGPNGIT

SEQ ID NO: 3101505 - protein, 9 aa, Giardia lamblia
ATGPPEQQG

SEQ ID NO: 3101506 - protein, 7 aa, Giardia lamblia
ATGQASG

SEQ ID NO: 3101507 - protein, 12 aa, Giardia lamblia
ATGRGAGGSEVP

SEQ ID NO: 3101508 - protein, 6 aa, Giardia lamblia
ATGRPD

SEQ ID NO: 3101509 - protein, 11 aa, Giardia lamblia
ATGRYPNGDTE

SEQ ID NO: 3101510 - protein, 6 aa, Giardia lamblia
ATGSAI

SEQ ID NO: 3101511 - protein, 7 aa, Giardia lamblia
ATGSASR

SEQ ID NO: 3101512 - protein, 20 aa, Giardia lamblia
ATGSGKSFTTFGEKNNEGMV

SEQ ID NO: 3101513 - protein, 8 aa, Giardia lamblia
ATGSGKTL

SEQ ID NO: 3101514 - protein, 5 aa, Giardia lamblia
ATGSV

SEQ ID NO: 3101515 - protein, 6 aa, Giardia lamblia
ATGTIQ

SEQ ID NO: 3101516 - protein, 7 aa, Giardia lamblia
ATGTQAS

SEQ ID NO: 3101517 - protein, 10 aa, Giardia lamblia
ATGTTAADAI

SEQ ID NO: 3101518 - protein, 28 aa, Giardia lamblia
ATGYEGKGDMKLSKETAPAAEPKKTRMT

SEQ ID NO: 3101519 - protein, 82 aa, Giardia lamblia
ATGYSTSYTPPITVPEPDGSVGRTSSSVSRGRQSAGSRRSIDATSVATTMASRSRRGSITDQIPRRNMQGEDAAKASDIDSN

SEQ ID NO: 3101520 - protein, 13 aa, Giardia lamblia
ATHGGAHSNPPIL

SEQ ID NO: 3101521 - protein, 4 aa, Giardia lamblia
ATHP

SEQ ID NO: 3101522 - protein, 5 aa, Giardia lamblia
ATHPA

SEQ ID NO: 3101523 - protein, 10 aa, Giardia lamblia
ATHPEPSNSQ

SEQ ID NO: 3101524 - protein, 6 aa, Giardia lamblia
ATHSPF

SEQ ID NO: 3101525 - protein, 6 aa, Giardia lamblia
ATHSQE

SEQ ID NO: 3101526 - protein, 7 aa, Giardia lamblia
ATHSRYE

SEQ ID NO: 3101527 - protein, 17 aa, Giardia lamblia
ATHTKNETDSVKQGVPD

SEQ ID NO: 3101528 - protein, 7 aa, Giardia lamblia
ATIAEKG

SEQ ID NO: 3101529 - protein, 4 aa, Giardia lamblia
ATIN

SEQ ID NO: 3101530 - protein, 17 aa, Giardia lamblia
ATINEEHRARKEEQDYA

SEQ ID NO: 3101531 - protein, 10 aa, Giardia lamblia
ATIPSRKEDL

SEQ ID NO: 3101532 - protein, 21 aa, Giardia lamblia
ATIPTRKTQTFTTSEDNQRSV

SEQ ID NO: 3101533 - protein, 7 aa, Giardia lamblia
ATISQER

SEQ ID NO: 3101534 - protein, 7 aa, Giardia lamblia
ATKAQDF

SEQ ID NO: 3101535 - protein, 17 aa, Giardia lamblia
ATKDAQLGRAYNQNETL

SEQ ID NO: 3101536 - protein, 21 aa, Giardia lamblia
ATKDKGEESGHQSQDSSYSYD

SEQ ID NO: 3101537 - protein, 5 aa, Giardia lamblia
ATKDR

SEQ ID NO: 3101538 - protein, 8 aa, Giardia lamblia
ATKDSSDN

SEQ ID NO: 3101539 - protein, 7 aa, Giardia lamblia
ATKDSTK

SEQ ID NO: 3101540 - protein, 5 aa, Giardia lamblia
ATKER

SEQ ID NO: 3101541 - protein, 10 aa, Giardia lamblia
ATKGAGTDEK

SEQ ID NO: 3101542 - protein, 5 aa, Giardia lamblia
ATKGF

SEQ ID NO: 3101543 - protein, 8 aa, Giardia lamblia
ATKGGKHE

SEQ ID NO: 3101544 - protein, 9 aa, Giardia lamblia
ATKGSAQKL

SEQ ID NO: 3101545 - protein, 7 aa, Giardia lamblia
ATKGVST

SEQ ID NO: 3101546 - protein, 10 aa, Giardia lamblia
ATKKGTKKNF

SEQ ID NO: 3101547 - protein, 4 aa, Giardia lamblia
ATKN

SEQ ID NO: 3101548 - protein, 7 aa, Giardia lamblia
ATKNGHA

SEQ ID NO: 3101549 - protein, 10 aa, Giardia lamblia
ATKNHSSTMK

SEQ ID NO: 3101550 - protein, 8 aa, Giardia lamblia
ATKNMARK

SEQ ID NO: 3101551 - protein, 5 aa, Giardia lamblia
ATKNP

SEQ ID NO: 3101552 - protein, 10 aa, Giardia lamblia
ATKPQQKRNH

SEQ ID NO: 3101553 - protein, 4 aa, Giardia lamblia
ATKQ

SEQ ID NO: 3101554 - protein, 26 aa, Giardia lamblia
ATKQSSPSQARGKQKQRGDDGWEDHP

SEQ ID NO: 3101555 - protein, 8 aa, Giardia lamblia
ATKRREFA

SEQ ID NO: 3101556 - protein, 15 aa, Giardia lamblia
ATKRSDDGTHNDREV

SEQ ID NO: 3101557 - protein, 7 aa, Giardia lamblia
ATKSELD

SEQ ID NO: 3101558 - protein, 8 aa, Giardia lamblia
ATKSGSNI

SEQ ID NO: 3101559 - protein, 9 aa, Giardia lamblia
ATKSIPGTA

SEQ ID NO: 3101560 - protein, 10 aa, Giardia lamblia
ATKTGDPAYM

SEQ ID NO: 3101561 - protein, 9 aa, Giardia lamblia
ATKTGSADL

SEQ ID NO: 3101562 - protein, 7 aa, Giardia lamblia
ATKTYDE

SEQ ID NO: 3101563 - protein, 15 aa, Giardia lamblia
ATKYRGTRNKHNETG

SEQ ID NO: 3101564 - protein, 13 aa, Giardia lamblia
ATLAKGEKQYSDR

SEQ ID NO: 3101565 - protein, 10 aa, Giardia lamblia
ATLAQSESIK

SEQ ID NO: 3101566 - protein, 5 aa, Giardia lamblia
ATLDP

SEQ ID NO: 3101567 - protein, 6 aa, Giardia lamblia
ATLGRG

SEQ ID NO: 3101568 - protein, 14 aa, Giardia lamblia
ATLKNPEDKPYSDE

SEQ ID NO: 3101569 - protein, 7 aa, Giardia lamblia
ATLPRDN

SEQ ID NO: 3101570 - protein, 9 aa, Giardia lamblia
ATLPTPANT

SEQ ID NO: 3101571 - protein, 34 aa, Giardia lamblia
ATLQRGSSNEAAEANGEAVNDDVDSETDYAEYTA

SEQ ID NO: 3101572 - protein, 9 aa, Giardia lamblia
ATLQTNSSC

SEQ ID NO: 3101573 - protein, 15 aa, Giardia lamblia
ATLRPPQETEDKPAY

SEQ ID NO: 3101574 - protein, 6 aa, Giardia lamblia
ATLRTG

SEQ ID NO: 3101575 - protein, 7 aa, Giardia lamblia
ATLSAPV

SEQ ID NO: 3101576 - protein, 10 aa, Giardia lamblia
ATLSNNRNQI

SEQ ID NO: 3101577 - protein, 7 aa, Giardia lamblia
ATLSPNE

SEQ ID NO: 3101578 - protein, 6 aa, Giardia lamblia
ATLSSE

SEQ ID NO: 3101579 - protein, 14 aa, Giardia lamblia
ATLSTTDLSQQGAG

SEQ ID NO: 3101580 - protein, 12 aa, Giardia lamblia
ATLTSKDQQITE

SEQ ID NO: 3101581 - protein, 8 aa, Giardia lamblia
ATLTTAEG

SEQ ID NO: 3101582 - protein, 5 aa, Giardia lamblia
ATMDE

SEQ ID NO: 3101583 - protein, 12 aa, Giardia lamblia
ATMKPENKDLAT

SEQ ID NO: 3101584 - protein, 9 aa, Giardia lamblia
ATMNNDGTT

SEQ ID NO: 3101585 - protein, 5 aa, Giardia lamblia
ATNAE

SEQ ID NO: 3101586 - protein, 42 aa, Giardia lamblia
ATNAEDEQKTNCPTDNDESNTFTQSGQINYDSADAQDSTKGL

SEQ ID NO: 3101587 - protein, 11 aa, Giardia lamblia
ATNASEALGSS

SEQ ID NO: 3101588 - protein, 5 aa, Giardia lamblia
ATNDD

SEQ ID NO: 3101589 - protein, 5 aa, Giardia lamblia
ATNDM

SEQ ID NO: 3101590 - protein, 5 aa, Giardia lamblia
ATNDP

SEQ ID NO: 3101591 - protein, 8 aa, Giardia lamblia
ATNEESNY

SEQ ID NO: 3101592 - protein, 26 aa, Giardia lamblia
ATNEGQPDSEDIEDYDGGVDDLGGQF

SEQ ID NO: 3101593 - protein, 8 aa, Giardia lamblia
ATNEKPRK

SEQ ID NO: 3101594 - protein, 5 aa, Giardia lamblia
ATNER

SEQ ID NO: 3101595 - protein, 9 aa, Giardia lamblia
ATNGSGNRY

SEQ ID NO: 3101596 - protein, 12 aa, Giardia lamblia
ATNKEAEALSKQ

SEQ ID NO: 3101597 - protein, 7 aa, Giardia lamblia
ATNKTLS

SEQ ID NO: 3101598 - protein, 6 aa, Giardia lamblia
ATNNFG

SEQ ID NO: 3101599 - protein, 8 aa, Giardia lamblia
ATNPEEAA

SEQ ID NO: 3101600 - protein, 16 aa, Giardia lamblia
ATNPGTSPTSPPTTNP

SEQ ID NO: 3101601 - protein, 6 aa, Giardia lamblia
ATNPSS

SEQ ID NO: 3101602 - protein, 31 aa, Giardia lamblia
ATNQGSDPACSSAPSVAASTTNRPSKYSDEE

SEQ ID NO: 3101603 - protein, 11 aa, Giardia lamblia
ATNQKKKLSTL

SEQ ID NO: 3101604 - protein, 21 aa, Giardia lamblia
ATNQQRASLAAESADSTTTAV

SEQ ID NO: 3101605 - protein, 9 aa, Giardia lamblia
ATNRDAYSG

SEQ ID NO: 3101606 - protein, 6 aa, Giardia lamblia
ATNRRL

SEQ ID NO: 3101607 - protein, 5 aa, Giardia lamblia
ATNSD

SEQ ID NO: 3101608 - protein, 8 aa, Giardia lamblia
ATNSPGHH

SEQ ID NO: 3101609 - protein, 7 aa, Giardia lamblia
ATNTCSA

SEQ ID NO: 3101610 - protein, 6 aa, Giardia lamblia
ATNTNT

SEQ ID NO: 3101611 - protein, 7 aa, Giardia lamblia
ATNTPQQ

SEQ ID NO: 3101612 - protein, 5 aa, Giardia lamblia
ATNTT

SEQ ID NO: 3101613 - protein, 11 aa, Giardia lamblia
ATNTTSSSGQM

SEQ ID NO: 3101614 - protein, 4 aa, Giardia lamblia
ATNV

SEQ ID NO: 3101615 - protein, 8 aa, Giardia lamblia
ATPAGTAP

SEQ ID NO: 3101616 - protein, 16 aa, Giardia lamblia
ATPASIATATGSTEAA

SEQ ID NO: 3101617 - protein, 16 aa, Giardia lamblia
ATPEPSDSADAFESLP

SEQ ID NO: 3101618 - protein, 8 aa, Giardia lamblia
ATPEQAEE

SEQ ID NO: 3101619 - protein, 5 aa, Giardia lamblia
ATPGK

SEQ ID NO: 3101620 - protein, 6 aa, Giardia lamblia
ATPGTV

SEQ ID NO: 3101621 - protein, 7 aa, Giardia lamblia
ATPGYER

SEQ ID NO: 3101622 - protein, 6 aa, Giardia lamblia
ATPKEI

SEQ ID NO: 3101623 - protein, 6 aa, Giardia lamblia
ATPNQD

SEQ ID NO: 3101624 - protein, 10 aa, Giardia lamblia
ATPNQERSAL

SEQ ID NO: 3101625 - protein, 8 aa, Giardia lamblia
ATPNTHSP

SEQ ID NO: 3101626 - protein, 6 aa, Giardia lamblia
ATPPAS

SEQ ID NO: 3101627 - protein, 55 aa, Giardia lamblia
ATPRRRFDTPKRDEKNDEQSSQSSTTIAQSTRTPQKRTTSARSCTRETPKRDKQH

SEQ ID NO: 3101628 - protein, 4 aa, Giardia lamblia
ATPS

SEQ ID NO: 3101629 - protein, 41 aa, Giardia lamblia
ATPSDGRRGNKKNGKPESDESGQKDGGSSRRRKGSSPSLPI

SEQ ID NO: 3101630 - protein, 41 aa, Giardia lamblia
ATPSDGRRGNKKNRKSESDESGQKDGGSSRRRKGSSPSLPI

SEQ ID NO: 3101631 - protein, 7 aa, Giardia lamblia
ATPSLSS

SEQ ID NO: 3101632 - protein, 20 aa, Giardia lamblia
ATPSQAPRIDSSTNNSLSKP

SEQ ID NO: 3101633 - protein, 19 aa, Giardia lamblia
ATPSTLPGLQPATQQQQSH

SEQ ID NO: 3101634 - protein, 12 aa, Giardia lamblia
ATPTPPGISAYD

SEQ ID NO: 3101635 - protein, 6 aa, Giardia lamblia
ATPTYT

SEQ ID NO: 3101636 - protein, 4 aa, Giardia lamblia
ATQA

SEQ ID NO: 3101637 - protein, 17 aa, Giardia lamblia
ATQAAAGGHATPQVAPD

SEQ ID NO: 3101638 - protein, 4 aa, Giardia lamblia
ATQK

SEQ ID NO: 3101639 - protein, 9 aa, Giardia lamblia
ATQKAKREE

SEQ ID NO: 3101640 - protein, 13 aa, Giardia lamblia
ATQKYTKKTTDME

SEQ ID NO: 3101641 - protein, 9 aa, Giardia lamblia
ATQPKGAVQ

SEQ ID NO: 3101642 - protein, 7 aa, Giardia lamblia
ATQPVTD

SEQ ID NO: 3101643 - protein, 30 aa, Giardia lamblia
ATQQACDTENEVEDSEIDEHGGEASESPAL

SEQ ID NO: 3101644 - protein, 28 aa, Giardia lamblia
ATQRTESENTVQGGAAYTEKKRSHSAAR

SEQ ID NO: 3101645 - protein, 6 aa, Giardia lamblia
ATQSGT

SEQ ID NO: 3101646 - protein, 6 aa, Giardia lamblia
ATQSIS

SEQ ID NO: 3101647 - protein, 9 aa, Giardia lamblia
ATQSSGKQI

SEQ ID NO: 3101648 - protein, 17 aa, Giardia lamblia
ATQSSKSYCKCINRYDI

SEQ ID NO: 3101649 - protein, 5 aa, Giardia lamblia
ATQTD

SEQ ID NO: 3101650 - protein, 18 aa, Giardia lamblia
ATQTEAKEEYNVSRGVQD

SEQ ID NO: 3101651 - protein, 9 aa, Giardia lamblia
ATRANRTLT

SEQ ID NO: 3101652 - protein, 13 aa, Giardia lamblia
ATRATESQSQYNQ

SEQ ID NO: 3101653 - protein, 7 aa, Giardia lamblia
ATRDEQI

SEQ ID NO: 3101654 - protein, 13 aa, Giardia lamblia
ATRELNSDLDNNT

SEQ ID NO: 3101655 - protein, 7 aa, Giardia lamblia
ATREQIN

SEQ ID NO: 3101656 - protein, 7 aa, Giardia lamblia
ATRIDKT

SEQ ID NO: 3101657 - protein, 17 aa, Giardia lamblia
ATRKDELNAKEKEISKL

SEQ ID NO: 3101658 - protein, 14 aa, Giardia lamblia
ATRKTEIPELVSLR

SEQ ID NO: 3101659 - protein, 19 aa, Giardia lamblia
ATRNANGTSVSTPRMSTDK

SEQ ID NO: 3101660 - protein, 7 aa, Giardia lamblia
ATRPADL

SEQ ID NO: 3101661 - protein, 7 aa, Giardia lamblia
ATRPKTT

SEQ ID NO: 3101662 - protein, 21 aa, Giardia lamblia
ATRSSSIRSQSLSSRSRENTV

SEQ ID NO: 3101663 - protein, 11 aa, Giardia lamblia
ATRSTSPRIPS

SEQ ID NO: 3101664 - protein, 9 aa, Giardia lamblia
ATRSTSSID

SEQ ID NO: 3101665 - protein, 11 aa, Giardia lamblia
ATRTAGEGPER

SEQ ID NO: 3101666 - protein, 6 aa, Giardia lamblia
ATRTEI

SEQ ID NO: 3101667 - protein, 22 aa, Giardia lamblia
ATRTPEQSQKQDAHTENAASPE

SEQ ID NO: 3101668 - protein, 31 aa, Giardia lamblia
ATRTTEQSTTNSTVADSQPASHFDILAEFLD

SEQ ID NO: 3101669 - protein, 9 aa, Giardia lamblia
ATRVDTYNR

SEQ ID NO: 3101670 - protein, 6 aa, Giardia lamblia
ATSAGN

SEQ ID NO: 3101671 - protein, 14 aa, Giardia lamblia
ATSAIEGDLRERRS

SEQ ID NO: 3101672 - protein, 9 aa, Giardia lamblia
ATSAKAPYQ

SEQ ID NO: 3101673 - protein, 15 aa, Giardia lamblia
ATSAPSTVGDTPSTL

SEQ ID NO: 3101674 - protein, 26 aa, Giardia lamblia
ATSASGLSEQIESSAQSLQSTGSLHR

SEQ ID NO: 3101675 - protein, 8 aa, Giardia lamblia
ATSASMSA

SEQ ID NO: 3101676 - protein, 8 aa, Giardia lamblia
ATSASSGV

SEQ ID NO: 3101677 - protein, 13 aa, Giardia lamblia
ATSDATDEMSTTS

SEQ ID NO: 3101678 - protein, 6 aa, Giardia lamblia
ATSDDG

SEQ ID NO: 3101679 - protein, 22 aa, Giardia lamblia
ATSDDVDKAKETQQYSSEERVS

SEQ ID NO: 3101680 - protein, 21 aa, Giardia lamblia
ATSDGEESSEESFEEENRQEL

SEQ ID NO: 3101681 - protein, 7 aa, Giardia lamblia
ATSDSKL

SEQ ID NO: 3101682 - protein, 6 aa, Giardia lamblia
ATSDSV

SEQ ID NO: 3101683 - protein, 4 aa, Giardia lamblia
ATSE

SEQ ID NO: 3101684 - protein, 8 aa, Giardia lamblia
ATSEGQEA

SEQ ID NO: 3101685 - protein, 6 aa, Giardia lamblia
ATSEHI

SEQ ID NO: 3101686 - protein, 9 aa, Giardia lamblia
ATSEKKLSN

SEQ ID NO: 3101687 - protein, 12 aa, Giardia lamblia
ATSEPSAPQPSA

SEQ ID NO: 3101688 - protein, 8 aa, Giardia lamblia
ATSESKGI

SEQ ID NO: 3101689 - protein, 4 aa, Giardia lamblia
ATSF

SEQ ID NO: 3101690 - protein, 14 aa, Giardia lamblia
ATSGAAKHRVGESA

SEQ ID NO: 3101691 - protein, 10 aa, Giardia lamblia
ATSGRPAYAV

SEQ ID NO: 3101692 - protein, 11 aa, Giardia lamblia
ATSHPQGQGGL

SEQ ID NO: 3101693 - protein, 4 aa, Giardia lamblia
ATSI

SEQ ID NO: 3101694 - protein, 4 aa, Giardia lamblia
ATSK

SEQ ID NO: 3101695 - protein, 9 aa, Giardia lamblia
ATSKNATSY

SEQ ID NO: 3101696 - protein, 10 aa, Giardia lamblia
ATSLQDSTQD

SEQ ID NO: 3101697 - protein, 7 aa, Giardia lamblia
ATSMTSS

SEQ ID NO: 3101698 - protein, 13 aa, Giardia lamblia
ATSNCNDAKQKYL

SEQ ID NO: 3101699 - protein, 18 aa, Giardia lamblia
ATSNKPPDTAIEADAEAG

SEQ ID NO: 3101700 - protein, 6 aa, Giardia lamblia
ATSNLT

SEQ ID NO: 3101701 - protein, 9 aa, Giardia lamblia
ATSNPESIT

SEQ ID NO: 3101702 - protein, 30 aa, Giardia lamblia
ATSNSPPHPTPAAVAAPTPAPQQPHGQGTH

SEQ ID NO: 3101703 - protein, 41 aa, Giardia lamblia
ATSNTTAPKRDDADESAISASAQGLTTSGSGDVPSLPSGIA

SEQ ID NO: 3101704 - protein, 38 aa, Giardia lamblia
ATSPQQVQATELTGHPVKNYSGKISKRTPCSMPATPTK

SEQ ID NO: 3101705 - protein, 5 aa, Giardia lamblia
ATSQA

SEQ ID NO: 3101706 - protein, 10 aa, Giardia lamblia
ATSQDEQGRT

SEQ ID NO: 3101707 - protein, 11 aa, Giardia lamblia
ATSQPVSAEDL

SEQ ID NO: 3101708 - protein, 7 aa, Giardia lamblia
ATSQSTY

SEQ ID NO: 3101709 - protein, 5 aa, Giardia lamblia
ATSQT

SEQ ID NO: 3101710 - protein, 4 aa, Giardia lamblia
ATSR

SEQ ID NO: 3101711 - protein, 8 aa, Giardia lamblia
ATSRAEEI

SEQ ID NO: 3101712 - protein, 7 aa, Giardia lamblia
ATSREPV

SEQ ID NO: 3101713 - protein, 17 aa, Giardia lamblia
ATSRQSATALGTSAPEV

SEQ ID NO: 3101714 - protein, 18 aa, Giardia lamblia
ATSSEELPPDTSNDYGSI

SEQ ID NO: 3101715 - protein, 6 aa, Giardia lamblia
ATSSIK

SEQ ID NO: 3101716 - protein, 6 aa, Giardia lamblia
ATSSIR

SEQ ID NO: 3101717 - protein, 9 aa, Giardia lamblia
ATSSQEKGT

SEQ ID NO: 3101718 - protein, 7 aa, Giardia lamblia
ATSSRSH

SEQ ID NO: 3101719 - protein, 7 aa, Giardia lamblia
ATSSTAL

SEQ ID NO: 3101720 - protein, 6 aa, Giardia lamblia
ATSSTC

SEQ ID NO: 3101721 - protein, 12 aa, Giardia lamblia
ATSSYNADFDGD

SEQ ID NO: 3101722 - protein, 9 aa, Giardia lamblia
ATSTGASTL

SEQ ID NO: 3101723 - protein, 13 aa, Giardia lamblia
ATSTMSPRSTLST

SEQ ID NO: 3101724 - protein, 16 aa, Giardia lamblia
ATSTRDSGTADYSSGL

SEQ ID NO: 3101725 - protein, 4 aa, Giardia lamblia
ATSV

SEQ ID NO: 3101726 - protein, 42 aa, Giardia lamblia
ATTAGPVANGSESIAAPAPDSFSSRRKEQFSHPYSAATDEIH

SEQ ID NO: 3101727 - protein, 17 aa, Giardia lamblia
ATTASSNSISPSRPYGS

SEQ ID NO: 3101728 - protein, 6 aa, Giardia lamblia
ATTATP

SEQ ID NO: 3101729 - protein, 9 aa, Giardia lamblia
ATTDAAAAR

SEQ ID NO: 3101730 - protein, 7 aa, Giardia lamblia
ATTDEPS

SEQ ID NO: 3101731 - protein, 8 aa, Giardia lamblia
ATTDGAEC

SEQ ID NO: 3101732 - protein, 16 aa, Giardia lamblia
ATTDKGRADDQGVTPQ

SEQ ID NO: 3101733 - protein, 6 aa, Giardia lamblia
ATTDPQ

SEQ ID NO: 3101734 - protein, 18 aa, Giardia lamblia
ATTDSSAGADDQSSELQE

SEQ ID NO: 3101735 - protein, 6 aa, Giardia lamblia
ATTEEL

SEQ ID NO: 3101736 - protein, 8 aa, Giardia lamblia
ATTESSDL

SEQ ID NO: 3101737 - protein, 17 aa, Giardia lamblia
ATTEVRPTAGAEETPVD

SEQ ID NO: 3101738 - protein, 5 aa, Giardia lamblia
ATTEY

SEQ ID NO: 3101739 - protein, 12 aa, Giardia lamblia
ATTEYPRYSNAN

SEQ ID NO: 3101740 - protein, 4 aa, Giardia lamblia
ATTG

SEQ ID NO: 3101741 - protein, 5 aa, Giardia lamblia
ATTGN

SEQ ID NO: 3101742 - protein, 8 aa, Giardia lamblia
ATTGQSHL

SEQ ID NO: 3101743 - protein, 9 aa, Giardia lamblia
ATTGRGDDL

SEQ ID NO: 3101744 - protein, 5 aa, Giardia lamblia
ATTIP

SEQ ID NO: 3101745 - protein, 8 aa, Giardia lamblia
ATTKQALD

SEQ ID NO: 3101746 - protein, 6 aa, Giardia lamblia
ATTLSR

SEQ ID NO: 3101747 - protein, 5 aa, Giardia lamblia
ATTPL

SEQ ID NO: 3101748 - protein, 8 aa, Giardia lamblia
ATTPSPSH

SEQ ID NO: 3101749 - protein, 6 aa, Giardia lamblia
ATTPYY

SEQ ID NO: 3101750 - protein, 9 aa, Giardia lamblia
ATTSADKSV

SEQ ID NO: 3101751 - protein, 8 aa, Giardia lamblia
ATTSNVSR

SEQ ID NO: 3101752 - protein, 8 aa, Giardia lamblia
ATTSPKRS

SEQ ID NO: 3101753 - protein, 9 aa, Giardia lamblia
ATTSQEEQA

SEQ ID NO: 3101754 - protein, 10 aa, Giardia lamblia
ATTSSPWNAA

SEQ ID NO: 3101755 - protein, 10 aa, Giardia lamblia
ATTSVTPEQL

SEQ ID NO: 3101756 - protein, 4 aa, Giardia lamblia
ATTT

SEQ ID NO: 3101757 - protein, 7 aa, Giardia lamblia
ATTTDGM

SEQ ID NO: 3101758 - protein, 5 aa, Giardia lamblia
ATTTE

SEQ ID NO: 3101759 - protein, 12 aa, Giardia lamblia
ATTTGNKHLPGL

SEQ ID NO: 3101760 - protein, 21 aa, Giardia lamblia
ATTTPADQNRSQLKGSAFPRE

SEQ ID NO: 3101761 - protein, 18 aa, Giardia lamblia
ATTVPTSSGKPGSSHSTY

SEQ ID NO: 3101762 - protein, 5 aa, Giardia lamblia
ATVEE

SEQ ID NO: 3101763 - protein, 13 aa, Giardia lamblia
ATVEGGEDAEGNI

SEQ ID NO: 3101764 - protein, 10 aa, Giardia lamblia
ATVGAPSRQS

SEQ ID NO: 3101765 - protein, 7 aa, Giardia lamblia
ATVGTAP

SEQ ID NO: 3101766 - protein, 4 aa, Giardia lamblia
ATVK

SEQ ID NO: 3101767 - protein, 17 aa, Giardia lamblia
ATVPESSLSSVSTADLQ

SEQ ID NO: 3101768 - protein, 8 aa, Giardia lamblia
ATVQPSYT

SEQ ID NO: 3101769 - protein, 9 aa, Giardia lamblia
ATVREKDAE

SEQ ID NO: 3101770 - protein, 10 aa, Giardia lamblia
ATVRQAPSVH

SEQ ID NO: 3101771 - protein, 10 aa, Giardia lamblia
ATVSDRPSLP

SEQ ID NO: 3101772 - protein, 21 aa, Giardia lamblia
ATVSKPQCTACNNNKKVKTAI

SEQ ID NO: 3101773 - protein, 10 aa, Giardia lamblia
ATVSTKKSPL

SEQ ID NO: 3101774 - protein, 9 aa, Giardia lamblia
ATVTKDGIT

SEQ ID NO: 3101775 - protein, 19 aa, Giardia lamblia
ATVTPEVAGSSPNPANPPN

SEQ ID NO: 3101776 - protein, 28 aa, Giardia lamblia
ATWARDQTSPATRTRTRSPTSGSSTDAR

SEQ ID NO: 3101777 - protein, 7 aa, Giardia lamblia
ATYEAKS

SEQ ID NO: 3101778 - protein, 8 aa, Giardia lamblia
ATYGKPPL

SEQ ID NO: 3101779 - protein, 23 aa, Giardia lamblia
ATYGKTSATQSSRQTMSKEIQDA

SEQ ID NO: 3101780 - protein, 5 aa, Giardia lamblia
ATYNK

SEQ ID NO: 3101781 - protein, 10 aa, Giardia lamblia
ATYNSTREGT

SEQ ID NO: 3101782 - protein, 15 aa, Giardia lamblia
ATYPDSHAARHDTLN

SEQ ID NO: 3101783 - protein, 14 aa, Giardia lamblia
ATYPEIYDYLRSLQ

SEQ ID NO: 3101784 - protein, 13 aa, Giardia lamblia
ATYRSKVANDDLD

SEQ ID NO: 3101785 - protein, 12 aa, Giardia lamblia
ATYTDTSDDLPQ

SEQ ID NO: 3101786 - protein, 6 aa, Giardia lamblia
ATYTQL

SEQ ID NO: 3101787 - protein, 6 aa, Giardia lamblia
AVAADS

SEQ ID NO: 3101788 - protein, 9 aa, Giardia lamblia
AVAAQGGAN

SEQ ID NO: 3101789 - protein, 14 aa, Giardia lamblia
AVAATQMNSNSSRS

SEQ ID NO: 3101790 - protein, 33 aa, Giardia lamblia
AVADEREKNESLSKQLNEANGQISTLQSAQDSI

SEQ ID NO: 3101791 - protein, 13 aa, Giardia lamblia
AVAESKQKGLPTQ

SEQ ID NO: 3101792 - protein, 8 aa, Giardia lamblia
AVAGAQRQ

SEQ ID NO: 3101793 - protein, 13 aa, Giardia lamblia
AVAGGSPAQPAVT

SEQ ID NO: 3101794 - protein, 5 aa, Giardia lamblia
AVAPD

SEQ ID NO: 3101795 - protein, 7 aa, Giardia lamblia
AVAPSTA

SEQ ID NO: 3101796 - protein, 8 aa, Giardia lamblia
AVAQTKAN

SEQ ID NO: 3101797 - protein, 11 aa, Giardia lamblia
AVASEDEARKL

SEQ ID NO: 3101798 - protein, 9 aa, Giardia lamblia
AVASRGAPE

SEQ ID NO: 3101799 - protein, 7 aa, Giardia lamblia
AVASSGS

SEQ ID NO: 3101800 - protein, 8 aa, Giardia lamblia
AVATTGVQ

SEQ ID NO: 3101801 - protein, 16 aa, Giardia lamblia
AVDERRKKKDYTDGSW

SEQ ID NO: 3101802 - protein, 18 aa, Giardia lamblia
AVDGAVPGKRFQPPAPIA

SEQ ID NO: 3101803 - protein, 8 aa, Giardia lamblia
AVDGDKKA

SEQ ID NO: 3101804 - protein, 7 aa, Giardia lamblia
AVDMDGS

SEQ ID NO: 3101805 - protein, 9 aa, Giardia lamblia
AVDQREDSL

SEQ ID NO: 3101806 - protein, 21 aa, Giardia lamblia
AVDSSTAQKGGATTQENERLR

SEQ ID NO: 3101807 - protein, 8 aa, Giardia lamblia
AVDTGKTI

SEQ ID NO: 3101808 - protein, 17 aa, Giardia lamblia
AVEESDDVKHAKPPKFG

SEQ ID NO: 3101809 - protein, 17 aa, Giardia lamblia
AVEETPAPGQYNTQAYG

SEQ ID NO: 3101810 - protein, 34 aa, Giardia lamblia
AVEGEKDAAEGEAAADDALDAHDESADDTEKKVD

SEQ ID NO: 3101811 - protein, 7 aa, Giardia lamblia
AVEKQSS

SEQ ID NO: 3101812 - protein, 8 aa, Giardia lamblia
AVEQEEDK

SEQ ID NO: 3101813 - protein, 18 aa, Giardia lamblia
AVEQEQDNPSLRADEEEL

SEQ ID NO: 3101814 - protein, 5 aa, Giardia lamblia
AVEQS

SEQ ID NO: 3101815 - protein, 6 aa, Giardia lamblia
AVEREK

SEQ ID NO: 3101816 - protein, 8 aa, Giardia lamblia
AVERGTSA

SEQ ID NO: 3101817 - protein, 15 aa, Giardia lamblia
AVESAATAEPGTMEG

SEQ ID NO: 3101818 - protein, 18 aa, Giardia lamblia
AVESSISEYGGYSNLTGN

SEQ ID NO: 3101819 - protein, 8 aa, Giardia lamblia
AVESSNEQ

SEQ ID NO: 3101820 - protein, 23 aa, Giardia lamblia
AVFNSSPSLPIQPTSIKAAQSSF

SEQ ID NO: 3101821 - protein, 17 aa, Giardia lamblia
AVGDEGGFAPNVADPEV

SEQ ID NO: 3101822 - protein, 11 aa, Giardia lamblia
AVGDGAGGNKA

SEQ ID NO: 3101823 - protein, 20 aa, Giardia lamblia
AVGEDSVESARQAYHSSVKA

SEQ ID NO: 3101824 - protein, 8 aa, Giardia lamblia
AVGGSTKT

SEQ ID NO: 3101825 - protein, 5 aa, Giardia lamblia
AVGKS

SEQ ID NO: 3101826 - protein, 5 aa, Giardia lamblia
AVGPQ

SEQ ID NO: 3101827 - protein, 9 aa, Giardia lamblia
AVGPSTTAF

SEQ ID NO: 3101828 - protein, 27 aa, Giardia lamblia
AVGRNPQKIKRSTSASQPQYSKPSHPA

SEQ ID NO: 3101829 - protein, 40 aa, Giardia lamblia
AVGRSHQRKDRSTSSGSDFSPDTSMDYSSNEDESTDPDCE

SEQ ID NO: 3101830 - protein, 9 aa, Giardia lamblia
AVGSGQPRV

SEQ ID NO: 3101831 - protein, 5 aa, Giardia lamblia
AVGSS

SEQ ID NO: 3101832 - protein, 8 aa, Giardia lamblia
AVHDPSDL

SEQ ID NO: 3101833 - protein, 42 aa, Giardia lamblia
AVHGDNPDETNSNDFTHSPTATAQDPEVSNAPTEADDQPGRR

SEQ ID NO: 3101834 - protein, 8 aa, Giardia lamblia
AVKGEYDT

SEQ ID NO: 3101835 - protein, 11 aa, Giardia lamblia
AVKKAKSSAVT

SEQ ID NO: 3101836 - protein, 15 aa, Giardia lamblia
AVKQGSYDALDTSDY

SEQ ID NO: 3101837 - protein, 23 aa, Giardia lamblia
AVKSSVSQADKSRIAKFTAEFGS

SEQ ID NO: 3101838 - protein, 16 aa, Giardia lamblia
AVNATGTDVPNSSFDD

SEQ ID NO: 3101839 - protein, 4 aa, Giardia lamblia
AVND

SEQ ID NO: 3101840 - protein, 8 aa, Giardia lamblia
AVNSEGKN

SEQ ID NO: 3101841 - protein, 9 aa, Giardia lamblia
AVPGGPTGF

SEQ ID NO: 3101842 - protein, 18 aa, Giardia lamblia
AVPNGTGHPKAQGSGRFL

SEQ ID NO: 3101843 - protein, 16 aa, Giardia lamblia
AVPNSDAALPPPFPQS

SEQ ID NO: 3101844 - protein, 12 aa, Giardia lamblia
AVPPGSSSPAVT

SEQ ID NO: 3101845 - protein, 8 aa, Giardia lamblia
AVPSKAAD

SEQ ID NO: 3101846 - protein, 9 aa, Giardia lamblia
AVPSPTGDA

SEQ ID NO: 3101847 - protein, 5 aa, Giardia lamblia
AVPTC

SEQ ID NO: 3101848 - protein, 6 aa, Giardia lamblia
AVPTIS

SEQ ID NO: 3101849 - protein, 7 aa, Giardia lamblia
AVPTPAE

SEQ ID NO: 3101850 - protein, 6 aa, Giardia lamblia
AVPTRR

SEQ ID NO: 3101851 - protein, 12 aa, Giardia lamblia
AVQARQTDSIDE

SEQ ID NO: 3101852 - protein, 7 aa, Giardia lamblia
AVQEEAD

SEQ ID NO: 3101853 - protein, 11 aa, Giardia lamblia
AVQKGTPHRDR

SEQ ID NO: 3101854 - protein, 19 aa, Giardia lamblia
AVQKRPKPRRLRSQFAIER

SEQ ID NO: 3101855 - protein, 8 aa, Giardia lamblia
AVQPGETA

SEQ ID NO: 3101856 - protein, 5 aa, Giardia lamblia
AVQPP

SEQ ID NO: 3101857 - protein, 20 aa, Giardia lamblia
AVQQNDPEEVQRSAYTGEGV

SEQ ID NO: 3101858 - protein, 5 aa, Giardia lamblia
AVQSP

SEQ ID NO: 3101859 - protein, 17 aa, Giardia lamblia
AVQSTTSKMASRPTRIR

SEQ ID NO: 3101860 - protein, 13 aa, Giardia lamblia
AVRDSEGKFPTDY

SEQ ID NO: 3101861 - protein, 9 aa, Giardia lamblia
AVRDSGQDI

SEQ ID NO: 3101862 - protein, 6 aa, Giardia lamblia
AVRKQP

SEQ ID NO: 3101863 - protein, 12 aa, Giardia lamblia
AVRNRSVSPVPS

SEQ ID NO: 3101864 - protein, 8 aa, Giardia lamblia
AVRPEEAT

SEQ ID NO: 3101865 - protein, 9 aa, Giardia lamblia
AVRQASKHE

SEQ ID NO: 3101866 - protein, 5 aa, Giardia lamblia
AVRTG

SEQ ID NO: 3101867 - protein, 8 aa, Giardia lamblia
AVRTSNYK

SEQ ID NO: 3101868 - protein, 14 aa, Giardia lamblia
AVSAPGGEQPHGHV

SEQ ID NO: 3101869 - protein, 6 aa, Giardia lamblia
AVSAPQ

SEQ ID NO: 3101870 - protein, 9 aa, Giardia lamblia
AVSASPSPF

SEQ ID NO: 3101871 - protein, 6 aa, Giardia lamblia
AVSATK

SEQ ID NO: 3101872 - protein, 8 aa, Giardia lamblia
AVSATTAY

SEQ ID NO: 3101873 - protein, 8 aa, Giardia lamblia
AVSDTPER

SEQ ID NO: 3101874 - protein, 20 aa, Giardia lamblia
AVSDTTSDRATSSASSVSST

SEQ ID NO: 3101875 - protein, 4 aa, Giardia lamblia
AVSE

SEQ ID NO: 3101876 - protein, 7 aa, Giardia lamblia
AVSGQNI

SEQ ID NO: 3101877 - protein, 4 aa, Giardia lamblia
AVSI

SEQ ID NO: 3101878 - protein, 12 aa, Giardia lamblia
AVSKADKALKTS

SEQ ID NO: 3101879 - protein, 4 aa, Giardia lamblia
AVSP

SEQ ID NO: 3101880 - protein, 7 aa, Giardia lamblia
AVSQGLR

SEQ ID NO: 3101881 - protein, 4 aa, Giardia lamblia
AVSS

SEQ ID NO: 3101882 - protein, 16 aa, Giardia lamblia
AVSSSGVRLPTQTHNP

SEQ ID NO: 3101883 - protein, 8 aa, Giardia lamblia
AVSSTAKV

SEQ ID NO: 3101884 - protein, 6 aa, Giardia lamblia
AVSTET

SEQ ID NO: 3101885 - protein, 14 aa, Giardia lamblia
AVTAGSYAYRNGHE

SEQ ID NO: 3101886 - protein, 11 aa, Giardia lamblia
AVTDDDGAELA

SEQ ID NO: 3101887 - protein, 6 aa, Giardia lamblia
AVTETN

SEQ ID NO: 3101888 - protein, 5 aa, Giardia lamblia
AVTGN

SEQ ID NO: 3101889 - protein, 12 aa, Giardia lamblia
AVTGQDKRNNRL

SEQ ID NO: 3101890 - protein, 7 aa, Giardia lamblia
AVTPASL

SEQ ID NO: 3101891 - protein, 15 aa, Giardia lamblia
AVTPERTRRPLSGTS

SEQ ID NO: 3101892 - protein, 21 aa, Giardia lamblia
AVTPPTQQESLASAPETTLSQ

SEQ ID NO: 3101893 - protein, 6 aa, Giardia lamblia
AVTSGR

SEQ ID NO: 3101894 - protein, 11 aa, Giardia lamblia
AVTSLGQDPAL

SEQ ID NO: 3101895 - protein, 16 aa, Giardia lamblia
AVTSRTLASERRSFAQ

SEQ ID NO: 3101896 - protein, 4 aa, Giardia lamblia
AVTT

SEQ ID NO: 3101897 - protein, 10 aa, Giardia lamblia
AVVQKNKEAA

SEQ ID NO: 3101898 - protein, 12 aa, Giardia lamblia
AWKGKADSNGYS

SEQ ID NO: 3101899 - protein, 4 aa, Giardia lamblia
AWRE

SEQ ID NO: 3101900 - protein, 69 aa, Giardia lamblia
AWTGTGRPPRSRSCGRTWSRRSTSSASRSSRSSRTSWAPTRRGGRSSSSSTTAAPFSGRSSSGSASRRV

SEQ ID NO: 3101901 - protein, 6 aa, Giardia lamblia
AYAESD

SEQ ID NO: 3101902 - protein, 7 aa, Giardia lamblia
AYAPPEL

SEQ ID NO: 3101903 - protein, 6 aa, Giardia lamblia
AYDAST

SEQ ID NO: 3101904 - protein, 11 aa, Giardia lamblia
AYDGTKKTPLR

SEQ ID NO: 3101905 - protein, 5 aa, Giardia lamblia
AYDLP

SEQ ID NO: 3101906 - protein, 11 aa, Giardia lamblia
AYDSEQQSGVT

SEQ ID NO: 3101907 - protein, 8 aa, Giardia lamblia
AYDTNPDA

SEQ ID NO: 3101908 - protein, 4 aa, Giardia lamblia
AYEE

SEQ ID NO: 3101909 - protein, 7 aa, Giardia lamblia
AYEGQWE

SEQ ID NO: 3101910 - protein, 4 aa, Giardia lamblia
AYER

SEQ ID NO: 3101911 - protein, 8 aa, Giardia lamblia
AYERPLPT

SEQ ID NO: 3101912 - protein, 7 aa, Giardia lamblia
AYESTDH

SEQ ID NO: 3101913 - protein, 7 aa, Giardia lamblia
AYGAPTD

SEQ ID NO: 3101914 - protein, 21 aa, Giardia lamblia
AYGEDSRADNNKSALDEPPSE

SEQ ID NO: 3101915 - protein, 6 aa, Giardia lamblia
AYGGID

SEQ ID NO: 3101916 - protein, 19 aa, Giardia lamblia
AYGKANEESIRKASEYVSK

SEQ ID NO: 3101917 - protein, 18 aa, Giardia lamblia
AYGSPDDDLTDEQRQKKR

SEQ ID NO: 3101918 - protein, 7 aa, Giardia lamblia
AYGTSDK

SEQ ID NO: 3101919 - protein, 10 aa, Giardia lamblia
AYHHGEASLN

SEQ ID NO: 3101920 - protein, 4 aa, Giardia lamblia
AYHK

SEQ ID NO: 3101921 - protein, 7 aa, Giardia lamblia
AYHPNTN

SEQ ID NO: 3101922 - protein, 11 aa, Giardia lamblia
AYIEPEEEVPE

SEQ ID NO: 3101923 - protein, 8 aa, Giardia lamblia
AYKEGIPS

SEQ ID NO: 3101924 - protein, 10 aa, Giardia lamblia
AYKEKARETI

SEQ ID NO: 3101925 - protein, 9 aa, Giardia lamblia
AYKEKTGND

SEQ ID NO: 3101926 - protein, 25 aa, Giardia lamblia
AYKGANDESAYYAPDSYYGSAPAES

SEQ ID NO: 3101927 - protein, 10 aa, Giardia lamblia
AYKKEGTQFT

SEQ ID NO: 3101928 - protein, 4 aa, Giardia lamblia
AYNH

SEQ ID NO: 3101929 - protein, 4 aa, Giardia lamblia
AYNN

SEQ ID NO: 3101930 - protein, 12 aa, Giardia lamblia
AYNQRGARQSSH

SEQ ID NO: 3101931 - protein, 4 aa, Giardia lamblia
AYNS

SEQ ID NO: 3101932 - protein, 5 aa, Giardia lamblia
AYPEK

SEQ ID NO: 3101933 - protein, 8 aa, Giardia lamblia
AYPENANV

SEQ ID NO: 3101934 - protein, 18 aa, Giardia lamblia
AYPGPEKAQIASEVKQKR

SEQ ID NO: 3101935 - protein, 6 aa, Giardia lamblia
AYPPKY

SEQ ID NO: 3101936 - protein, 15 aa, Giardia lamblia
AYPPSADVKGTVEDT

SEQ ID NO: 3101937 - protein, 15 aa, Giardia lamblia
AYPTAENPAGDTKGL

SEQ ID NO: 3101938 - protein, 5 aa, Giardia lamblia
AYPTN

SEQ ID NO: 3101939 - protein, 9 aa, Giardia lamblia
AYQGETFGD

SEQ ID NO: 3101940 - protein, 30 aa, Giardia lamblia
AYQKAPPPTMQQRQRASTRQLTRSTTPSIT

SEQ ID NO: 3101941 - protein, 5 aa, Giardia lamblia
AYQPG

SEQ ID NO: 3101942 - protein, 6 aa, Giardia lamblia
AYQQRL

SEQ ID NO: 3101943 - protein, 10 aa, Giardia lamblia
AYQRPASTVY

SEQ ID NO: 3101944 - protein, 11 aa, Giardia lamblia
AYQTNQAQAAE

SEQ ID NO: 3101945 - protein, 17 aa, Giardia lamblia
AYRGSSIDTCNKKQVEE

SEQ ID NO: 3101946 - protein, 4 aa, Giardia lamblia
AYSE

SEQ ID NO: 3101947 - protein, 11 aa, Giardia lamblia
AYSGDSGSLAD

SEQ ID NO: 3101948 - protein, 13 aa, Giardia lamblia
AYSGSDQKNSRKV

SEQ ID NO: 3101949 - protein, 11 aa, Giardia lamblia
AYSNQGSIKAQ

SEQ ID NO: 3101950 - protein, 6 aa, Giardia lamblia
AYSPDG

SEQ ID NO: 3101951 - protein, 7 aa, Giardia lamblia
AYSPDRR

SEQ ID NO: 3101952 - protein, 7 aa, Giardia lamblia
AYSPGSV

SEQ ID NO: 3101953 - protein, 6 aa, Giardia lamblia
AYSQPP

SEQ ID NO: 3101954 - protein, 15 aa, Giardia lamblia
AYSSAGDSEEAENAL

SEQ ID NO: 3101955 - protein, 16 aa, Giardia lamblia
AYSSGNPSIGVGPGNV

SEQ ID NO: 3101956 - protein, 11 aa, Giardia lamblia
AYSSNDPETTQ

SEQ ID NO: 3101957 - protein, 4 aa, Giardia lamblia
AYST

SEQ ID NO: 3101958 - protein, 21 aa, Giardia lamblia
AYSTTSASKEVARTMTNTTPL

SEQ ID NO: 3101959 - protein, 15 aa, Giardia lamblia
AYSTVGQSDADRDTV

SEQ ID NO: 3101960 - protein, 22 aa, Giardia lamblia
AYTDEKDGANDDESETQKEEVD

SEQ ID NO: 3101961 - protein, 8 aa, Giardia lamblia
AYTGSAQG

SEQ ID NO: 3101962 - protein, 6 aa, Giardia lamblia
AYTGSE

SEQ ID NO: 3101963 - protein, 5 aa, Giardia lamblia
AYTKG

SEQ ID NO: 3101964 - protein, 19 aa, Giardia lamblia
AYTPTNKSRSSTPVLQTSK

SEQ ID NO: 3101965 - protein, 7 aa, Giardia lamblia
AYTRPQG

SEQ ID NO: 3101966 - protein, 16 aa, Giardia lamblia
AYTSATEKASKSTLHT

SEQ ID NO: 3101967 - protein, 5 aa, Giardia lamblia
AYVRG

SEQ ID NO: 3101968 - protein, 5 aa, Giardia lamblia
AYYSS

SEQ ID NO: 3101969 - protein, 18 aa, Giardia lamblia
CAAANNSYEQATKSLDAS

SEQ ID NO: 3101970 - protein, 6 aa, Giardia lamblia
CAAPSD

SEQ ID NO: 3101971 - protein, 7 aa, Giardia lamblia
CAASTED

SEQ ID NO: 3101972 - protein, 10 aa, Giardia lamblia
CAATEAATAL

SEQ ID NO: 3101973 - protein, 5 aa, Giardia lamblia
CADAQ

SEQ ID NO: 3101974 - protein, 9 aa, Giardia lamblia
CADNTKATK

SEQ ID NO: 3101975 - protein, 8 aa, Giardia lamblia
CAEGEKLS

SEQ ID NO: 3101976 - protein, 9 aa, Giardia lamblia
CAEGTEDYE

SEQ ID NO: 3101977 - protein, 15 aa, Giardia lamblia
CAGNTKKKSTPGTVD

SEQ ID NO: 3101978 - protein, 4 aa, Giardia lamblia
CAGP

SEQ ID NO: 3101979 - protein, 16 aa, Giardia lamblia
CAGSDGASDGNDATSR

SEQ ID NO: 3101980 - protein, 9 aa, Giardia lamblia
CAKDPEKSL

SEQ ID NO: 3101981 - protein, 4 aa, Giardia lamblia
CAND

SEQ ID NO: 3101982 - protein, 7 aa, Giardia lamblia
CANPAPG

SEQ ID NO: 3101983 - protein, 10 aa, Giardia lamblia
CANPGKDDGI

SEQ ID NO: 3101984 - protein, 6 aa, Giardia lamblia
CAPDPM

SEQ ID NO: 3101985 - protein, 7 aa, Giardia lamblia
CAPDTDT

SEQ ID NO: 3101986 - protein, 4 aa, Giardia lamblia
CAPG

SEQ ID NO: 3101987 - protein, 16 aa, Giardia lamblia
CAPGHVDGKDGGSGKL

SEQ ID NO: 3101988 - protein, 7 aa, Giardia lamblia
CAPGNIA

SEQ ID NO: 3101989 - protein, 12 aa, Giardia lamblia
CAPSVPAEDIRE

SEQ ID NO: 3101990 - protein, 5 aa, Giardia lamblia
CAQGN

SEQ ID NO: 3101991 - protein, 7 aa, Giardia lamblia
CAQQDSN

SEQ ID NO: 3101992 - protein, 7 aa, Giardia lamblia
CASADAA

SEQ ID NO: 3101993 - protein, 43 aa, Giardia lamblia
CASCPSAGSCGATSGYGGFGSDNGVTFTTQTTSGTNTGITAGT

SEQ ID NO: 3101994 - protein, 10 aa, Giardia lamblia
CASGAAPRSL

SEQ ID NO: 3101995 - protein, 6 aa, Giardia lamblia
CASTTQ

SEQ ID NO: 3101996 - protein, 7 aa, Giardia lamblia
CATCGKD

SEQ ID NO: 3101997 - protein, 26 aa, Giardia lamblia
CATSGRSQSSTTLKNTDSSLQQHAEG

SEQ ID NO: 3101998 - protein, 5 aa, Giardia lamblia
CATTT

SEQ ID NO: 3101999 - protein, 5 aa, Giardia lamblia
CCTRT

SEQ ID NO: 3102000 - protein, 4 aa, Giardia lamblia
CDAE

SEQ ID NO: 3102001 - protein, 10 aa, Giardia lamblia
CDAGPEAPLT

SEQ ID NO: 3102002 - protein, 4 aa, Giardia lamblia
CDAP

SEQ ID NO: 3102003 - protein, 9 aa, Giardia lamblia
CDATGKTAL

SEQ ID NO: 3102004 - protein, 9 aa, Giardia lamblia
CDDAEARLR

SEQ ID NO: 3102005 - protein, 9 aa, Giardia lamblia
CDDAGRTPL

SEQ ID NO: 3102006 - protein, 10 aa, Giardia lamblia
CDDAKRNAQR

SEQ ID NO: 3102007 - protein, 32 aa, Giardia lamblia
CDDTPSSGRQAKLPGTPSSVVSTDSNSDIQEY

SEQ ID NO: 3102008 - protein, 7 aa, Giardia lamblia
CDEDEPR

SEQ ID NO: 3102009 - protein, 20 aa, Giardia lamblia
CDEDGAGSFQGPPFLTETAI

SEQ ID NO: 3102010 - protein, 5 aa, Giardia lamblia
CDEEH

SEQ ID NO: 3102011 - protein, 6 aa, Giardia lamblia
CDEPSA

SEQ ID NO: 3102012 - protein, 26 aa, Giardia lamblia
CDEQNALEEEQSDQDDYVPPAPDADF

SEQ ID NO: 3102013 - protein, 5 aa, Giardia lamblia
CDESG

SEQ ID NO: 3102014 - protein, 7 aa, Giardia lamblia
CDETASI

SEQ ID NO: 3102015 - protein, 7 aa, Giardia lamblia
CDGNGRT

SEQ ID NO: 3102016 - protein, 4 aa, Giardia lamblia
CDGS

SEQ ID NO: 3102017 - protein, 8 aa, Giardia lamblia
CDGSPEIP

SEQ ID NO: 3102018 - protein, 6 aa, Giardia lamblia
CDNAGR

SEQ ID NO: 3102019 - protein, 7 aa, Giardia lamblia
CDNKGRQ

SEQ ID NO: 3102020 - protein, 9 aa, Giardia lamblia
CDNTKEHED

SEQ ID NO: 3102021 - protein, 9 aa, Giardia lamblia
CDPKGDRSV

SEQ ID NO: 3102022 - protein, 17 aa, Giardia lamblia
CDPPPVSSKEGLHTNST

SEQ ID NO: 3102023 - protein, 7 aa, Giardia lamblia
CDPQQSA

SEQ ID NO: 3102024 - protein, 8 aa, Giardia lamblia
CDRASTGT

SEQ ID NO: 3102025 - protein, 5 aa, Giardia lamblia
CDSES

SEQ ID NO: 3102026 - protein, 15 aa, Giardia lamblia
CDSKEAQRASSPSAL

SEQ ID NO: 3102027 - protein, 6 aa, Giardia lamblia
CDSKPI

SEQ ID NO: 3102028 - protein, 6 aa, Giardia lamblia
CDSKTC

SEQ ID NO: 3102029 - protein, 8 aa, Giardia lamblia
CDSPDKAK

SEQ ID NO: 3102030 - protein, 6 aa, Giardia lamblia
CDSRGR

SEQ ID NO: 3102031 - protein, 10 aa, Giardia lamblia
CDSYSPRDSC

SEQ ID NO: 3102032 - protein, 9 aa, Giardia lamblia
CDTASGSHG

SEQ ID NO: 3102033 - protein, 8 aa, Giardia lamblia
CDTDNSGM

SEQ ID NO: 3102034 - protein, 8 aa, Giardia lamblia
CDTETPEA

SEQ ID NO: 3102035 - protein, 10 aa, Giardia lamblia
CDTPGAYPSL

SEQ ID NO: 3102036 - protein, 4 aa, Giardia lamblia
CDTS

SEQ ID NO: 3102037 - protein, 6 aa, Giardia lamblia
CEEKQY

SEQ ID NO: 3102038 - protein, 6 aa, Giardia lamblia
CEEQQQ

SEQ ID NO: 3102039 - protein, 11 aa, Giardia lamblia
CEESTAPDLEP

SEQ ID NO: 3102040 - protein, 6 aa, Giardia lamblia
CEGEEM

SEQ ID NO: 3102041 - protein, 14 aa, Giardia lamblia
CEGPQSPHASRSGA

SEQ ID NO: 3102042 - protein, 13 aa, Giardia lamblia
CEGTPKDKLTPKS

SEQ ID NO: 3102043 - protein, 14 aa, Giardia lamblia
CEKNQQGAYTSRPD

SEQ ID NO: 3102044 - protein, 4 aa, Giardia lamblia
CENI

SEQ ID NO: 3102045 - protein, 5 aa, Giardia lamblia
CENNT

SEQ ID NO: 3102046 - protein, 5 aa, Giardia lamblia
CEPGT

SEQ ID NO: 3102047 - protein, 12 aa, Giardia lamblia
CEPKSNGPTAYK

SEQ ID NO: 3102048 - protein, 4 aa, Giardia lamblia
CEPN

SEQ ID NO: 3102049 - protein, 25 aa, Giardia lamblia
CEPSTRRDSPSCKSRVNASATAVKG

SEQ ID NO: 3102050 - protein, 4 aa, Giardia lamblia
CEQE

SEQ ID NO: 3102051 - protein, 7 aa, Giardia lamblia
CEQEGDG

SEQ ID NO: 3102052 - protein, 8 aa, Giardia lamblia
CERQGNGA

SEQ ID NO: 3102053 - protein, 14 aa, Giardia lamblia
CERRGSAKSELQNA

SEQ ID NO: 3102054 - protein, 21 aa, Giardia lamblia
CESDGRRDKPDEDVLTSDRGA

SEQ ID NO: 3102055 - protein, 20 aa, Giardia lamblia
CESRTAPGDLLSDTSDNVPE

SEQ ID NO: 3102056 - protein, 6 aa, Giardia lamblia
CETEGD

SEQ ID NO: 3102057 - protein, 6 aa, Giardia lamblia
CETQND

SEQ ID NO: 3102058 - protein, 10 aa, Giardia lamblia
CETSDKKTIG

SEQ ID NO: 3102059 - protein, 10 aa, Giardia lamblia
CETSERGAAS

SEQ ID NO: 3102060 - protein, 6 aa, Giardia lamblia
CETSGS

SEQ ID NO: 3102061 - protein, 4 aa, Giardia lamblia
CGAL

SEQ ID NO: 3102062 - protein, 12 aa, Giardia lamblia
CGASSKKKQMKG

SEQ ID NO: 3102063 - protein, 5 aa, Giardia lamblia
CGDKV

SEQ ID NO: 3102064 - protein, 15 aa, Giardia lamblia
CGDPNCTNNHCRSSK

SEQ ID NO: 3102065 - protein, 7 aa, Giardia lamblia
CGDPSLQ

SEQ ID NO: 3102066 - protein, 7 aa, Giardia lamblia
CGDSGRF

SEQ ID NO: 3102067 - protein, 5 aa, Giardia lamblia
CGEQT

SEQ ID NO: 3102068 - protein, 4 aa, Giardia lamblia
CGGD

SEQ ID NO: 3102069 - protein, 12 aa, Giardia lamblia
CGGGSTLKTEIQ

SEQ ID NO: 3102070 - protein, 8 aa, Giardia lamblia
CGGPGAGF

SEQ ID NO: 3102071 - protein, 7 aa, Giardia lamblia
CGGSKKV

SEQ ID NO: 3102072 - protein, 5 aa, Giardia lamblia
CGGTG

SEQ ID NO: 3102073 - protein, 8 aa, Giardia lamblia
CGKGERGF

SEQ ID NO: 3102074 - protein, 7 aa, Giardia lamblia
CGKKTMP

SEQ ID NO: 3102075 - protein, 6 aa, Giardia lamblia
CGKTAQ

SEQ ID NO: 3102076 - protein, 4 aa, Giardia lamblia
CGNT

SEQ ID NO: 3102077 - protein, 11 aa, Giardia lamblia
CGPASQSNTEL

SEQ ID NO: 3102078 - protein, 6 aa, Giardia lamblia
CGPNEK

SEQ ID NO: 3102079 - protein, 5 aa, Giardia lamblia
CGPQL

SEQ ID NO: 3102080 - protein, 15 aa, Giardia lamblia
CGPTSEFNGTGTGVS

SEQ ID NO: 3102081 - protein, 6 aa, Giardia lamblia
CGQKTK

SEQ ID NO: 3102082 - protein, 19 aa, Giardia lamblia
CGQTPKEADTKDKEEDKEH

SEQ ID NO: 3102083 - protein, 6 aa, Giardia lamblia
CGRADK

SEQ ID NO: 3102084 - protein, 10 aa, Giardia lamblia
CGRDGQPAKA

SEQ ID NO: 3102085 - protein, 10 aa, Giardia lamblia
CGRPDKEPDT

SEQ ID NO: 3102086 - protein, 4 aa, Giardia lamblia
CGRQ

SEQ ID NO: 3102087 - protein, 14 aa, Giardia lamblia
CGRRPRSAKNATVS

SEQ ID NO: 3102088 - protein, 8 aa, Giardia lamblia
CGSAAQSS

SEQ ID NO: 3102089 - protein, 8 aa, Giardia lamblia
CGSGANEA

SEQ ID NO: 3102090 - protein, 19 aa, Giardia lamblia
CGSGRDGRSRSRSKSVRGS

SEQ ID NO: 3102091 - protein, 6 aa, Giardia lamblia
CGSNET

SEQ ID NO: 3102092 - protein, 14 aa, Giardia lamblia
CGSPHSAYDAELSR

SEQ ID NO: 3102093 - protein, 7 aa, Giardia lamblia
CGSPRND

SEQ ID NO: 3102094 - protein, 14 aa, Giardia lamblia
CGSSGDAQGDDAEI

SEQ ID NO: 3102095 - protein, 9 aa, Giardia lamblia
CGTGTGRTI

SEQ ID NO: 3102096 - protein, 6 aa, Giardia lamblia
CGTQTT

SEQ ID NO: 3102097 - protein, 4 aa, Giardia lamblia
CGTT

SEQ ID NO: 3102098 - protein, 6 aa, Giardia lamblia
CGVPSA

SEQ ID NO: 3102099 - protein, 16 aa, Giardia lamblia
CGVPSADTSSEDGRLS

SEQ ID NO: 3102100 - protein, 6 aa, Giardia lamblia
CGYPSA

SEQ ID NO: 3102101 - protein, 6 aa, Giardia lamblia
CHDQQS

SEQ ID NO: 3102102 - protein, 6 aa, Giardia lamblia
CHESGH

SEQ ID NO: 3102103 - protein, 9 aa, Giardia lamblia
CHGPGSNPA

SEQ ID NO: 3102104 - protein, 5 aa, Giardia lamblia
CHKSR

SEQ ID NO: 3102105 - protein, 49 aa, Giardia lamblia
CHPTSDNRMSPSPGPDDNDREGAQDWTRSRVESQPGENAPLAAADLYGQ

SEQ ID NO: 3102106 - protein, 20 aa, Giardia lamblia
CHTPPQGNSAAQSQTQASTK

SEQ ID NO: 3102107 - protein, 6 aa, Giardia lamblia
CHTPTG

SEQ ID NO: 3102108 - protein, 9 aa, Giardia lamblia
CIGQRDEQK

SEQ ID NO: 3102109 - protein, 7 aa, Giardia lamblia
CITGDSD

SEQ ID NO: 3102110 - protein, 14 aa, Giardia lamblia
CKAASPTHSSTANV

SEQ ID NO: 3102111 - protein, 9 aa, Giardia lamblia
CKADTTRLT

SEQ ID NO: 3102112 - protein, 9 aa, Giardia lamblia
CKASSQADL

SEQ ID NO: 3102113 - protein, 11 aa, Giardia lamblia
CKDDLSPISST

SEQ ID NO: 3102114 - protein, 7 aa, Giardia lamblia
CKDTDTE

SEQ ID NO: 3102115 - protein, 6 aa, Giardia lamblia
CKEAPV

SEQ ID NO: 3102116 - protein, 11 aa, Giardia lamblia
CKEEAKNKLRA

SEQ ID NO: 3102117 - protein, 21 aa, Giardia lamblia
CKEGKKAFDETQDKSANKQEN

SEQ ID NO: 3102118 - protein, 7 aa, Giardia lamblia
CKGASTM

SEQ ID NO: 3102119 - protein, 14 aa, Giardia lamblia
CKHSRDALKQRLAK

SEQ ID NO: 3102120 - protein, 6 aa, Giardia lamblia
CKKGDD

SEQ ID NO: 3102121 - protein, 6 aa, Giardia lamblia
CKKNEE

SEQ ID NO: 3102122 - protein, 7 aa, Giardia lamblia
CKKSRRI

SEQ ID NO: 3102123 - protein, 8 aa, Giardia lamblia
CKNDKSKM

SEQ ID NO: 3102124 - protein, 6 aa, Giardia lamblia
CKNKGT

SEQ ID NO: 3102125 - protein, 7 aa, Giardia lamblia
CKNPKCN

SEQ ID NO: 3102126 - protein, 10 aa, Giardia lamblia
CKPGNPSADC

SEQ ID NO: 3102127 - protein, 17 aa, Giardia lamblia
CKPSLPSLSSSAHQTHQ

SEQ ID NO: 3102128 - protein, 6 aa, Giardia lamblia
CKSDPA

SEQ ID NO: 3102129 - protein, 7 aa, Giardia lamblia
CKSETIQ

SEQ ID NO: 3102130 - protein, 8 aa, Giardia lamblia
CKSNGAKK

SEQ ID NO: 3102131 - protein, 7 aa, Giardia lamblia
CKSRENS

SEQ ID NO: 3102132 - protein, 28 aa, Giardia lamblia
CKSTQRGQEVSFPGAPVSKEKQSIAPRA

SEQ ID NO: 3102133 - protein, 8 aa, Giardia lamblia
CKTADTGY

SEQ ID NO: 3102134 - protein, 14 aa, Giardia lamblia
CKTASETRKVHGDR

SEQ ID NO: 3102135 - protein, 7 aa, Giardia lamblia
CKTPSAA

SEQ ID NO: 3102136 - protein, 24 aa, Giardia lamblia
CKTQEAEYDSDTTDNGEPPRPKYS

SEQ ID NO: 3102137 - protein, 6 aa, Giardia lamblia
CKTSNY

SEQ ID NO: 3102138 - protein, 12 aa, Giardia lamblia
CKVGGISPTQSA

SEQ ID NO: 3102139 - protein, 8 aa, Giardia lamblia
CKYSSSSP

SEQ ID NO: 3102140 - protein, 8 aa, Giardia lamblia
CLDQNSTG

SEQ ID NO: 3102141 - protein, 7 aa, Giardia lamblia
CLQPQSI

SEQ ID NO: 3102142 - protein, 8 aa, Giardia lamblia
CLTPQGKT

SEQ ID NO: 3102143 - protein, 6 aa, Giardia lamblia
CMQRGD

SEQ ID NO: 3102144 - protein, 10 aa, Giardia lamblia
CNCSGNNSAD

SEQ ID NO: 3102145 - protein, 7 aa, Giardia lamblia
CNDDGDT

SEQ ID NO: 3102146 - protein, 8 aa, Giardia lamblia
CNDPSSDM

SEQ ID NO: 3102147 - protein, 6 aa, Giardia lamblia
CNDSGV

SEQ ID NO: 3102148 - protein, 7 aa, Giardia lamblia
CNGNTAL

SEQ ID NO: 3102149 - protein, 7 aa, Giardia lamblia
CNNEKAK

SEQ ID NO: 3102150 - protein, 10 aa, Giardia lamblia
CNNPAYHEDQ

SEQ ID NO: 3102151 - protein, 7 aa, Giardia lamblia
CNNSRPY

SEQ ID NO: 3102152 - protein, 8 aa, Giardia lamblia
CNPDSSVG

SEQ ID NO: 3102153 - protein, 6 aa, Giardia lamblia
CNPEGE

SEQ ID NO: 3102154 - protein, 4 aa, Giardia lamblia
CNPK

SEQ ID NO: 3102155 - protein, 8 aa, Giardia lamblia
CNPRARDT

SEQ ID NO: 3102156 - protein, 10 aa, Giardia lamblia
CNPRIDEKAP

SEQ ID NO: 3102157 - protein, 4 aa, Giardia lamblia
CNQQ

SEQ ID NO: 3102158 - protein, 11 aa, Giardia lamblia
CNRSRQAENAS

SEQ ID NO: 3102159 - protein, 4 aa, Giardia lamblia
CNSN

SEQ ID NO: 3102160 - protein, 7 aa, Giardia lamblia
CNSSPLE

SEQ ID NO: 3102161 - protein, 32 aa, Giardia lamblia
CNSSSHDGLCNPNADQCTDSLKPVSAPSPIEY

SEQ ID NO: 3102162 - protein, 8 aa, Giardia lamblia
CNSTPDSF

SEQ ID NO: 3102163 - protein, 9 aa, Giardia lamblia
CNTAGTARY

SEQ ID NO: 3102164 - protein, 6 aa, Giardia lamblia
CNTKTD

SEQ ID NO: 3102165 - protein, 14 aa, Giardia lamblia
CNTPLPRPAESDSL

SEQ ID NO: 3102166 - protein, 19 aa, Giardia lamblia
CPARKDQESSQSQTNPLTY

SEQ ID NO: 3102167 - protein, 7 aa, Giardia lamblia
CPDDPGG

SEQ ID NO: 3102168 - protein, 5 aa, Giardia lamblia
CPDPE

SEQ ID NO: 3102169 - protein, 8 aa, Giardia lamblia
CPEEPPGR

SEQ ID NO: 3102170 - protein, 4 aa, Giardia lamblia
CPEG

SEQ ID NO: 3102171 - protein, 20 aa, Giardia lamblia
CPEGYSGTRCENRECPEGET

SEQ ID NO: 3102172 - protein, 4 aa, Giardia lamblia
CPEP

SEQ ID NO: 3102173 - protein, 9 aa, Giardia lamblia
CPEQSRKNI

SEQ ID NO: 3102174 - protein, 13 aa, Giardia lamblia
CPESRASQQDHSL

SEQ ID NO: 3102175 - protein, 9 aa, Giardia lamblia
CPGCGESNT

SEQ ID NO: 3102176 - protein, 5 aa, Giardia lamblia
CPGNW

SEQ ID NO: 3102177 - protein, 7 aa, Giardia lamblia
CPGPKRR

SEQ ID NO: 3102178 - protein, 5 aa, Giardia lamblia
CPGTL

SEQ ID NO: 3102179 - protein, 6 aa, Giardia lamblia
CPHGEA

SEQ ID NO: 3102180 - protein, 7 aa, Giardia lamblia
CPHPSNS

SEQ ID NO: 3102181 - protein, 7 aa, Giardia lamblia
CPKTGEK

SEQ ID NO: 3102182 - protein, 8 aa, Giardia lamblia
CPKVPSSQ

SEQ ID NO: 3102183 - protein, 9 aa, Giardia lamblia
CPMPSGRPA

SEQ ID NO: 3102184 - protein, 5 aa, Giardia lamblia
CPPDM

SEQ ID NO: 3102185 - protein, 5 aa, Giardia lamblia
CPPGW

SEQ ID NO: 3102186 - protein, 9 aa, Giardia lamblia
CPQDPSDTI

SEQ ID NO: 3102187 - protein, 5 aa, Giardia lamblia
CPQDY

SEQ ID NO: 3102188 - protein, 15 aa, Giardia lamblia
CPQNQRSHSEDSTLY

SEQ ID NO: 3102189 - protein, 5 aa, Giardia lamblia
CPRHD

SEQ ID NO: 3102190 - protein, 13 aa, Giardia lamblia
CPRPPPKNDDIAI

SEQ ID NO: 3102191 - protein, 11 aa, Giardia lamblia
CPRPPRGIPPP

SEQ ID NO: 3102192 - protein, 33 aa, Giardia lamblia
CPRTPRLSKKEQAKTPKKDRAKTPKSCGTKTLR

SEQ ID NO: 3102193 - protein, 8 aa, Giardia lamblia
CPRTTTDG

SEQ ID NO: 3102194 - protein, 6 aa, Giardia lamblia
CPSAPD

SEQ ID NO: 3102195 - protein, 9 aa, Giardia lamblia
CPSGASTGM

SEQ ID NO: 3102196 - protein, 11 aa, Giardia lamblia
CPSPASVKGYS

SEQ ID NO: 3102197 - protein, 4 aa, Giardia lamblia
CPSS

SEQ ID NO: 3102198 - protein, 4 aa, Giardia lamblia
CPSV

SEQ ID NO: 3102199 - protein, 11 aa, Giardia lamblia
CPTAPHDSPEL

SEQ ID NO: 3102200 - protein, 8 aa, Giardia lamblia
CPTARGNV

SEQ ID NO: 3102201 - protein, 14 aa, Giardia lamblia
CPTEGPAKGGIGDE

SEQ ID NO: 3102202 - protein, 6 aa, Giardia lamblia
CPTPDQ

SEQ ID NO: 3102203 - protein, 41 aa, Giardia lamblia
CPTPGKESKPTLPDMGPRTGSRALSRKGTPKSTAMKEDPAS

SEQ ID NO: 3102204 - protein, 5 aa, Giardia lamblia
CPYDE

SEQ ID NO: 3102205 - protein, 7 aa, Giardia lamblia
CQAPGKA

SEQ ID NO: 3102206 - protein, 11 aa, Giardia lamblia
CQASGDDSEPV

SEQ ID NO: 3102207 - protein, 7 aa, Giardia lamblia
CQCTGDS

SEQ ID NO: 3102208 - protein, 7 aa, Giardia lamblia
CQDESKR

SEQ ID NO: 3102209 - protein, 6 aa, Giardia lamblia
CQDNGP

SEQ ID NO: 3102210 - protein, 11 aa, Giardia lamblia
CQDPGGPYYDA

SEQ ID NO: 3102211 - protein, 6 aa, Giardia lamblia
CQDSDG

SEQ ID NO: 3102212 - protein, 4 aa, Giardia lamblia
CQET

SEQ ID NO: 3102213 - protein, 11 aa, Giardia lamblia
CQGTDSISPPA

SEQ ID NO: 3102214 - protein, 13 aa, Giardia lamblia
CQKEESDRSSQFS

SEQ ID NO: 3102215 - protein, 6 aa, Giardia lamblia
CQKSQK

SEQ ID NO: 3102216 - protein, 5 aa, Giardia lamblia
CQNER

SEQ ID NO: 3102217 - protein, 16 aa, Giardia lamblia
CQSANISDCSSETEDS

SEQ ID NO: 3102218 - protein, 15 aa, Giardia lamblia
CQSPARDLDSDPQVQ

SEQ ID NO: 3102219 - protein, 5 aa, Giardia lamblia
CQSPQ

SEQ ID NO: 3102220 - protein, 9 aa, Giardia lamblia
CQSTGANDN

SEQ ID NO: 3102221 - protein, 6 aa, Giardia lamblia
CQTPKG

SEQ ID NO: 3102222 - protein, 39 aa, Giardia lamblia
CQTPQLGSSRARTPLSGRSERPYRRQGTRQVSFRDPPPR

SEQ ID NO: 3102223 - protein, 9 aa, Giardia lamblia
CQTTDRHKK

SEQ ID NO: 3102224 - protein, 6 aa, Giardia lamblia
CQTTGQ

SEQ ID NO: 3102225 - protein, 6 aa, Giardia lamblia
CRAETA

SEQ ID NO: 3102226 - protein, 7 aa, Giardia lamblia
CRAGRDG

SEQ ID NO: 3102227 - protein, 5 aa, Giardia lamblia
CRAQG

SEQ ID NO: 3102228 - protein, 8 aa, Giardia lamblia
CRDNEGDT

SEQ ID NO: 3102229 - protein, 12 aa, Giardia lamblia
CRDSAKAKPSWL

SEQ ID NO: 3102230 - protein, 6 aa, Giardia lamblia
CREGGP

SEQ ID NO: 3102231 - protein, 7 aa, Giardia lamblia
CREQPGG

SEQ ID NO: 3102232 - protein, 18 aa, Giardia lamblia
CRGERAPDEADQTGRAES

SEQ ID NO: 3102233 - protein, 30 aa, Giardia lamblia
CRGERAPDEADQTGRAESLATQSDRLLSSY

SEQ ID NO: 3102234 - protein, 6 aa, Giardia lamblia
CRNSRN

SEQ ID NO: 3102235 - protein, 11 aa, Giardia lamblia
CRPEGTIPSEY

SEQ ID NO: 3102236 - protein, 10 aa, Giardia lamblia
CRPKNGNERS

SEQ ID NO: 3102237 - protein, 7 aa, Giardia lamblia
CRQGPGP

SEQ ID NO: 3102238 - protein, 12 aa, Giardia lamblia
CRQSVNESSTMT

SEQ ID NO: 3102239 - protein, 9 aa, Giardia lamblia
CRRPEEKRQ

SEQ ID NO: 3102240 - protein, 13 aa, Giardia lamblia
CRRREKAEAMRRG

SEQ ID NO: 3102241 - protein, 35 aa, Giardia lamblia
CRRSRSASRAGSRRSSVSGPPSVNGFRDDPQGAND

SEQ ID NO: 3102242 - protein, 10 aa, Giardia lamblia
CRSDNGKTAL

SEQ ID NO: 3102243 - protein, 7 aa, Giardia lamblia
CRSPPGD

SEQ ID NO: 3102244 - protein, 4 aa, Giardia lamblia
CRST

SEQ ID NO: 3102245 - protein, 6 aa, Giardia lamblia
CSAEST

SEQ ID NO: 3102246 - protein, 8 aa, Giardia lamblia
CSAETAED

SEQ ID NO: 3102247 - protein, 14 aa, Giardia lamblia
CSAGDVGPDTCGRR

SEQ ID NO: 3102248 - protein, 13 aa, Giardia lamblia
CSAPSVRNRQGGN

SEQ ID NO: 3102249 - protein, 10 aa, Giardia lamblia
CSARSSIDTD

SEQ ID NO: 3102250 - protein, 7 aa, Giardia lamblia
CSARTGL

SEQ ID NO: 3102251 - protein, 4 aa, Giardia lamblia
CSCA

SEQ ID NO: 3102252 - protein, 8 aa, Giardia lamblia
CSCDKSDG

SEQ ID NO: 3102253 - protein, 7 aa, Giardia lamblia
CSCTSSG

SEQ ID NO: 3102254 - protein, 11 aa, Giardia lamblia
CSDNKNTSQGH

SEQ ID NO: 3102255 - protein, 7 aa, Giardia lamblia
CSDRKIP

SEQ ID NO: 3102256 - protein, 12 aa, Giardia lamblia
CSDSRRNDFDGL

SEQ ID NO: 3102257 - protein, 8 aa, Giardia lamblia
CSDSSATN

SEQ ID NO: 3102258 - protein, 10 aa, Giardia lamblia
CSDTNNGGID

SEQ ID NO: 3102259 - protein, 6 aa, Giardia lamblia
CSDTSK

SEQ ID NO: 3102260 - protein, 16 aa, Giardia lamblia
CSEASNRLTSQKPYRL

SEQ ID NO: 3102261 - protein, 6 aa, Giardia lamblia
CSEDST

SEQ ID NO: 3102262 - protein, 26 aa, Giardia lamblia
CSEEGFADEAKAPIEDDLEQTTGNAL

SEQ ID NO: 3102263 - protein, 9 aa, Giardia lamblia
CSEPGSFSR

SEQ ID NO: 3102264 - protein, 9 aa, Giardia lamblia
CSEPPPSPI

SEQ ID NO: 3102265 - protein, 5 aa, Giardia lamblia
CSEST

SEQ ID NO: 3102266 - protein, 13 aa, Giardia lamblia
CSGETRGATPKEI

SEQ ID NO: 3102267 - protein, 13 aa, Giardia lamblia
CSGGISNLVVITD

SEQ ID NO: 3102268 - protein, 7 aa, Giardia lamblia
CSGGNAA

SEQ ID NO: 3102269 - protein, 15 aa, Giardia lamblia
CSGKSSGSYQATAGI

SEQ ID NO: 3102270 - protein, 11 aa, Giardia lamblia
CSGLRNEDGET

SEQ ID NO: 3102271 - protein, 6 aa, Giardia lamblia
CSGQTA

SEQ ID NO: 3102272 - protein, 7 aa, Giardia lamblia
CSGQTED

SEQ ID NO: 3102273 - protein, 12 aa, Giardia lamblia
CSHGDTGPSLNN

SEQ ID NO: 3102274 - protein, 4 aa, Giardia lamblia
CSHR

SEQ ID NO: 3102275 - protein, 11 aa, Giardia lamblia
CSHSNSCGSVE

SEQ ID NO: 3102276 - protein, 4 aa, Giardia lamblia
CSIS

SEQ ID NO: 3102277 - protein, 6 aa, Giardia lamblia
CSKDST

SEQ ID NO: 3102278 - protein, 8 aa, Giardia lamblia
CSKGPAMS

SEQ ID NO: 3102279 - protein, 9 aa, Giardia lamblia
CSKKMADGI

SEQ ID NO: 3102280 - protein, 7 aa, Giardia lamblia
CSKPPQV

SEQ ID NO: 3102281 - protein, 8 aa, Giardia lamblia
CSKSSSRI

SEQ ID NO: 3102282 - protein, 27 aa, Giardia lamblia
CSLDKGNNKTDHQEGPSPESHASTKSI

SEQ ID NO: 3102283 - protein, 10 aa, Giardia lamblia
CSLGTDGKPC

SEQ ID NO: 3102284 - protein, 12 aa, Giardia lamblia
CSLSEDTIKATS

SEQ ID NO: 3102285 - protein, 12 aa, Giardia lamblia
CSNASKSASVDP

SEQ ID NO: 3102286 - protein, 10 aa, Giardia lamblia
CSNEPEDSTP

SEQ ID NO: 3102287 - protein, 6 aa, Giardia lamblia
CSNGDS

SEQ ID NO: 3102288 - protein, 19 aa, Giardia lamblia
CSNGEEPRDSFTDAQEPEL

SEQ ID NO: 3102289 - protein, 5 aa, Giardia lamblia
CSNHS

SEQ ID NO: 3102290 - protein, 9 aa, Giardia lamblia
CSNPNNPLP

SEQ ID NO: 3102291 - protein, 13 aa, Giardia lamblia
CSPAETQNPKSEV

SEQ ID NO: 3102292 - protein, 6 aa, Giardia lamblia
CSPDGQ

SEQ ID NO: 3102293 - protein, 20 aa, Giardia lamblia
CSPDNPLPTAPAVKAPQLEN

SEQ ID NO: 3102294 - protein, 20 aa, Giardia lamblia
CSPEQSIDRPHSLEEGGDAV

SEQ ID NO: 3102295 - protein, 11 aa, Giardia lamblia
CSPGRNSDAPK

SEQ ID NO: 3102296 - protein, 4 aa, Giardia lamblia
CSPI

SEQ ID NO: 3102297 - protein, 24 aa, Giardia lamblia
CSPKVPPSERLRDNKESNEGTHND

SEQ ID NO: 3102298 - protein, 13 aa, Giardia lamblia
CSPNPLSLSEKTS

SEQ ID NO: 3102299 - protein, 7 aa, Giardia lamblia
CSPPQSP

SEQ ID NO: 3102300 - protein, 13 aa, Giardia lamblia
CSPPSPPSPVHQP

SEQ ID NO: 3102301 - protein, 11 aa, Giardia lamblia
CSPRPGPRAFG

SEQ ID NO: 3102302 - protein, 12 aa, Giardia lamblia
CSPRPGSRAFGE

SEQ ID NO: 3102303 - protein, 13 aa, Giardia lamblia
CSRKERGSRAADL

SEQ ID NO: 3102304 - protein, 8 aa, Giardia lamblia
CSRNSLAG

SEQ ID NO: 3102305 - protein, 10 aa, Giardia lamblia
CSRNSQTRGA

SEQ ID NO: 3102306 - protein, 25 aa, Giardia lamblia
CSRPHSRPMTGPAPKARSGSAYTTT

SEQ ID NO: 3102307 - protein, 15 aa, Giardia lamblia
CSRTHTRQGSQISSE

SEQ ID NO: 3102308 - protein, 6 aa, Giardia lamblia
CSSAQD

SEQ ID NO: 3102309 - protein, 6 aa, Giardia lamblia
CSSDGS

SEQ ID NO: 3102310 - protein, 14 aa, Giardia lamblia
CSSEYTPSKAVPDT

SEQ ID NO: 3102311 - protein, 4 aa, Giardia lamblia
CSSN

SEQ ID NO: 3102312 - protein, 6 aa, Giardia lamblia
CSSNDE

SEQ ID NO: 3102313 - protein, 35 aa, Giardia lamblia
CSSPGKSVTKSRTTSRQSKQNPHGSPAGSLGGTNR

SEQ ID NO: 3102314 - protein, 9 aa, Giardia lamblia
CSSPPIAPT

SEQ ID NO: 3102315 - protein, 10 aa, Giardia lamblia
CSSQGSNPTV

SEQ ID NO: 3102316 - protein, 4 aa, Giardia lamblia
CSSR

SEQ ID NO: 3102317 - protein, 12 aa, Giardia lamblia
CSSRVSRETKDA

SEQ ID NO: 3102318 - protein, 27 aa, Giardia lamblia
CSSSDASDHDDITSDTAQQLSSFADGN

SEQ ID NO: 3102319 - protein, 13 aa, Giardia lamblia
CSSSGASTIARSN

SEQ ID NO: 3102320 - protein, 15 aa, Giardia lamblia
CSSSGQHADGRSSGL

SEQ ID NO: 3102321 - protein, 8 aa, Giardia lamblia
CSSSPRSS

SEQ ID NO: 3102322 - protein, 6 aa, Giardia lamblia
CSSSQS

SEQ ID NO: 3102323 - protein, 13 aa, Giardia lamblia
CSSSSRSACQLLS

SEQ ID NO: 3102324 - protein, 7 aa, Giardia lamblia
CSSTQAG

SEQ ID NO: 3102325 - protein, 7 aa, Giardia lamblia
CSTAEGR

SEQ ID NO: 3102326 - protein, 37 aa, Giardia lamblia
CSTNNTIGIGSGRQTDDEEDDDDDRVGRAVGEGPEGD

SEQ ID NO: 3102327 - protein, 5 aa, Giardia lamblia
CSTPF

SEQ ID NO: 3102328 - protein, 15 aa, Giardia lamblia
CSTPGGGDSRALEDT

SEQ ID NO: 3102329 - protein, 15 aa, Giardia lamblia
CSTRGIRKEDKDDYR

SEQ ID NO: 3102330 - protein, 7 aa, Giardia lamblia
CSTTRSK

SEQ ID NO: 3102331 - protein, 25 aa, Giardia lamblia
CSVAQPEEGLDAAPRDYLVERIMIV

SEQ ID NO: 3102332 - protein, 6 aa, Giardia lamblia
CSYDNH

SEQ ID NO: 3102333 - protein, 4 aa, Giardia lamblia
CTAM

SEQ ID NO: 3102334 - protein, 20 aa, Giardia lamblia
CTAQRADRLEQELSDARKQL

SEQ ID NO: 3102335 - protein, 18 aa, Giardia lamblia
CTATPVSSVTSGVSPPHN

SEQ ID NO: 3102336 - protein, 9 aa, Giardia lamblia
CTDDEEALK

SEQ ID NO: 3102337 - protein, 6 aa, Giardia lamblia
CTDPSS

SEQ ID NO: 3102338 - protein, 7 aa, Giardia lamblia
CTDYQSR

SEQ ID NO: 3102339 - protein, 6 aa, Giardia lamblia
CTEAQR

SEQ ID NO: 3102340 - protein, 11 aa, Giardia lamblia
CTEDHKASDKL

SEQ ID NO: 3102341 - protein, 5 aa, Giardia lamblia
CTELK

SEQ ID NO: 3102342 - protein, 4 aa, Giardia lamblia
CTEP

SEQ ID NO: 3102343 - protein, 12 aa, Giardia lamblia
CTEQEAGDAGQR

SEQ ID NO: 3102344 - protein, 44 aa, Giardia lamblia
CTESYPADKPTTSGPRAASSSKKAKRSSSLKRRAQQIKKHNKQY

SEQ ID NO: 3102345 - protein, 9 aa, Giardia lamblia
CTGDGVAPA

SEQ ID NO: 3102346 - protein, 13 aa, Giardia lamblia
CTGPASQDPAVSE

SEQ ID NO: 3102347 - protein, 16 aa, Giardia lamblia
CTGPGLGDVRWWREDA

SEQ ID NO: 3102348 - protein, 27 aa, Giardia lamblia
CTGPTSQDVLPGTDEHATSASLASEAE

SEQ ID NO: 3102349 - protein, 5 aa, Giardia lamblia
CTGQD

SEQ ID NO: 3102350 - protein, 8 aa, Giardia lamblia
CTKAQQDR

SEQ ID NO: 3102351 - protein, 8 aa, Giardia lamblia
CTNDRGRR

SEQ ID NO: 3102352 - protein, 18 aa, Giardia lamblia
CTNEDGTVEAKNTAVDVA

SEQ ID NO: 3102353 - protein, 8 aa, Giardia lamblia
CTNKSQTA

SEQ ID NO: 3102354 - protein, 12 aa, Giardia lamblia
CTPAPSTATTSL

SEQ ID NO: 3102355 - protein, 6 aa, Giardia lamblia
CTPDGR

SEQ ID NO: 3102356 - protein, 9 aa, Giardia lamblia
CTPKLDQSS

SEQ ID NO: 3102357 - protein, 16 aa, Giardia lamblia
CTPKTHSTALQQGSMR

SEQ ID NO: 3102358 - protein, 4 aa, Giardia lamblia
CTPN

SEQ ID NO: 3102359 - protein, 5 aa, Giardia lamblia
CTPTY

SEQ ID NO: 3102360 - protein, 6 aa, Giardia lamblia
CTQDTN

SEQ ID NO: 3102361 - protein, 46 aa, Giardia lamblia
CTQQPNAAKTTTQYEHDPFSSTKRSLAAKSKPKVCRSTNADFSASS

SEQ ID NO: 3102362 - protein, 9 aa, Giardia lamblia
CTQSEDHQS

SEQ ID NO: 3102363 - protein, 17 aa, Giardia lamblia
CTRQPLKPTLSSGMPEI

SEQ ID NO: 3102364 - protein, 6 aa, Giardia lamblia
CTRTTS

SEQ ID NO: 3102365 - protein, 12 aa, Giardia lamblia
CTSARAKKAFQA

SEQ ID NO: 3102366 - protein, 6 aa, Giardia lamblia
CTSLTG

SEQ ID NO: 3102367 - protein, 14 aa, Giardia lamblia
CTSPNTKTPNRHHP

SEQ ID NO: 3102368 - protein, 10 aa, Giardia lamblia
CTSSSKASFS

SEQ ID NO: 3102369 - protein, 26 aa, Giardia lamblia
CTSTRSSLSSAQLERAENSKKSDVDK

SEQ ID NO: 3102370 - protein, 5 aa, Giardia lamblia
CTSVE

SEQ ID NO: 3102371 - protein, 10 aa, Giardia lamblia
CTTESYDSER

SEQ ID NO: 3102372 - protein, 12 aa, Giardia lamblia
CTTHSHSKKDEA

SEQ ID NO: 3102373 - protein, 7 aa, Giardia lamblia
CTTQKEL

SEQ ID NO: 3102374 - protein, 9 aa, Giardia lamblia
CTTVPRRKT

SEQ ID NO: 3102375 - protein, 6 aa, Giardia lamblia
CTTVSG

SEQ ID NO: 3102376 - protein, 10 aa, Giardia lamblia
CTYTPRDTRD

SEQ ID NO: 3102377 - protein, 9 aa, Giardia lamblia
CVDKDGRTA

SEQ ID NO: 3102378 - protein, 81 aa, Giardia lamblia
CVKKETEKQKALKDVEDANGRDTGNQDVANKGNPDEEESTPSSEEKEEKKLVDSEHSTEDSDEEASKKGKTPSPKKGCCRC

SEQ ID NO: 3102379 - protein, 10 aa, Giardia lamblia
CVQSPTEQFS

SEQ ID NO: 3102380 - protein, 4 aa, Giardia lamblia
CVSP

SEQ ID NO: 3102381 - protein, 7 aa, Giardia lamblia
CYDEPKK

SEQ ID NO: 3102382 - protein, 11 aa, Giardia lamblia
CYGGTSGSFAT

SEQ ID NO: 3102383 - protein, 10 aa, Giardia lamblia
CYKKQREKDL

SEQ ID NO: 3102384 - protein, 8 aa, Giardia lamblia
CYNPGSSI

SEQ ID NO: 3102385 - protein, 11 aa, Giardia lamblia
CYPREQQDRRM

SEQ ID NO: 3102386 - protein, 5 aa, Giardia lamblia
CYRSG

SEQ ID NO: 3102387 - protein, 17 aa, Giardia lamblia
CYTDDQDHTPKGRSGEL

SEQ ID NO: 3102388 - protein, 11 aa, Giardia lamblia
DAADQDAESGL

SEQ ID NO: 3102389 - protein, 4 aa, Giardia lamblia
DAAE

SEQ ID NO: 3102390 - protein, 11 aa, Giardia lamblia
DAAEDESQKKA

SEQ ID NO: 3102391 - protein, 4 aa, Giardia lamblia
DAAG

SEQ ID NO: 3102392 - protein, 10 aa, Giardia lamblia
DAAHNSDQLQ

SEQ ID NO: 3102393 - protein, 6 aa, Giardia lamblia
DAAKRT

SEQ ID NO: 3102394 - protein, 25 aa, Giardia lamblia
DAAKSNEVTKEDKPVPKQKGSVERT

SEQ ID NO: 3102395 - protein, 10 aa, Giardia lamblia
DAAKTSLKQI

SEQ ID NO: 3102396 - protein, 9 aa, Giardia lamblia
DAAKYSSEH

SEQ ID NO: 3102397 - protein, 7 aa, Giardia lamblia
DAALGNN

SEQ ID NO: 3102398 - protein, 6 aa, Giardia lamblia
DAANEI

SEQ ID NO: 3102399 - protein, 11 aa, Giardia lamblia
DAAPATTTNTT

SEQ ID NO: 3102400 - protein, 23 aa, Giardia lamblia
DAAPDGIPRPSSNSRRPSNDLTQ

SEQ ID NO: 3102401 - protein, 6 aa, Giardia lamblia
DAAPHR

SEQ ID NO: 3102402 - protein, 7 aa, Giardia lamblia
DAAQKRS

SEQ ID NO: 3102403 - protein, 13 aa, Giardia lamblia
DAASAANEKERHQ

SEQ ID NO: 3102404 - protein, 9 aa, Giardia lamblia
DAASEPPSI

SEQ ID NO: 3102405 - protein, 15 aa, Giardia lamblia
DAASKSRKDGSESVA

SEQ ID NO: 3102406 - protein, 10 aa, Giardia lamblia
DAASNADTDI

SEQ ID NO: 3102407 - protein, 9 aa, Giardia lamblia
DAASNAENY

SEQ ID NO: 3102408 - protein, 5 aa, Giardia lamblia
DAATA

SEQ ID NO: 3102409 - protein, 25 aa, Giardia lamblia
DAATSLDNVETSSVAGSFTSDGQSL

SEQ ID NO: 3102410 - protein, 7 aa, Giardia lamblia
DAAVRSK

SEQ ID NO: 3102411 - protein, 10 aa, Giardia lamblia
DACGTSNQEV

SEQ ID NO: 3102412 - protein, 17 aa, Giardia lamblia
DACPPDASREDQDTKKI

SEQ ID NO: 3102413 - protein, 5 aa, Giardia lamblia
DACSA

SEQ ID NO: 3102414 - protein, 11 aa, Giardia lamblia
DADANGQTSID

SEQ ID NO: 3102415 - protein, 12 aa, Giardia lamblia
DADARKREELTR

SEQ ID NO: 3102416 - protein, 6 aa, Giardia lamblia
DADASV

SEQ ID NO: 3102417 - protein, 30 aa, Giardia lamblia
DADDEARHERGQRAMEEKEQQDRDREEARA

SEQ ID NO: 3102418 - protein, 14 aa, Giardia lamblia
DADDNVQNSSRPMS

SEQ ID NO: 3102419 - protein, 10 aa, Giardia lamblia
DADEQEDDPV

SEQ ID NO: 3102420 - protein, 11 aa, Giardia lamblia
DADESETKLSN

SEQ ID NO: 3102421 - protein, 4 aa, Giardia lamblia
DADG

SEQ ID NO: 3102422 - protein, 28 aa, Giardia lamblia
DADGAEPSELTGVGRAAEEVQRQNSLTD

SEQ ID NO: 3102423 - protein, 7 aa, Giardia lamblia
DADGHAL

SEQ ID NO: 3102424 - protein, 7 aa, Giardia lamblia
DADGNEM

SEQ ID NO: 3102425 - protein, 9 aa, Giardia lamblia
DADGSDPYT

SEQ ID NO: 3102426 - protein, 10 aa, Giardia lamblia
DADGSEKLSP

SEQ ID NO: 3102427 - protein, 8 aa, Giardia lamblia
DADKESYI

SEQ ID NO: 3102428 - protein, 11 aa, Giardia lamblia
DADLKSKTMTR

SEQ ID NO: 3102429 - protein, 9 aa, Giardia lamblia
DADNSDAIA

SEQ ID NO: 3102430 - protein, 9 aa, Giardia lamblia
DADPPTAMP

SEQ ID NO: 3102431 - protein, 6 aa, Giardia lamblia
DADQPT

SEQ ID NO: 3102432 - protein, 5 aa, Giardia lamblia
DADQV

SEQ ID NO: 3102433 - protein, 39 aa, Giardia lamblia
DADSNDANRISRRGPRTTKRDFKDQSGQPFANDDDDPFD

SEQ ID NO: 3102434 - protein, 7 aa, Giardia lamblia
DADSRER

SEQ ID NO: 3102435 - protein, 17 aa, Giardia lamblia
DADSRRSFSTESEAQMD

SEQ ID NO: 3102436 - protein, 9 aa, Giardia lamblia
DADTDRTSC

SEQ ID NO: 3102437 - protein, 6 aa, Giardia lamblia
DADTID

SEQ ID NO: 3102438 - protein, 8 aa, Giardia lamblia
DADTQTDD

SEQ ID NO: 3102439 - protein, 32 aa, Giardia lamblia
DAEAEEDEDEPEKPRTKKEPLKLSPGQNATPS

SEQ ID NO: 3102440 - protein, 88 aa, Giardia lamblia
DAEDTNDTKDAKEKHKEKSKEKHRDKDKEKEKHKEKEKDKEKHRDKDKDKERDKEKHKDKDKHRDKDREKDKEKHKSKDDDKKNKTHS

SEQ ID NO: 3102441 - protein, 8 aa, Giardia lamblia
DAEEEIDT

SEQ ID NO: 3102442 - protein, 9 aa, Giardia lamblia
DAEERAAEE

SEQ ID NO: 3102443 - protein, 4 aa, Giardia lamblia
DAEG

SEQ ID NO: 3102444 - protein, 7 aa, Giardia lamblia
DAEGNYP

SEQ ID NO: 3102445 - protein, 9 aa, Giardia lamblia
DAEGSDAEQ

SEQ ID NO: 3102446 - protein, 15 aa, Giardia lamblia
DAEGTVPDKAKSYGY

SEQ ID NO: 3102447 - protein, 6 aa, Giardia lamblia
DAEHSP

SEQ ID NO: 3102448 - protein, 6 aa, Giardia lamblia
DAEIGE

SEQ ID NO: 3102449 - protein, 7 aa, Giardia lamblia
DAEITSY

SEQ ID NO: 3102450 - protein, 11 aa, Giardia lamblia
DAEKEAYEDSL

SEQ ID NO: 3102451 - protein, 14 aa, Giardia lamblia
DAEKQRSGASRDRI

SEQ ID NO: 3102452 - protein, 5 aa, Giardia lamblia
DAEKT

SEQ ID NO: 3102453 - protein, 8 aa, Giardia lamblia
DAENKPPV

SEQ ID NO: 3102454 - protein, 13 aa, Giardia lamblia
DAENRALQHSPTT

SEQ ID NO: 3102455 - protein, 8 aa, Giardia lamblia
DAENSRLR

SEQ ID NO: 3102456 - protein, 6 aa, Giardia lamblia
DAENTP

SEQ ID NO: 3102457 - protein, 6 aa, Giardia lamblia
DAEPSL

SEQ ID NO: 3102458 - protein, 10 aa, Giardia lamblia
DAEPSPITTK

SEQ ID NO: 3102459 - protein, 8 aa, Giardia lamblia
DAEQADEL

SEQ ID NO: 3102460 - protein, 6 aa, Giardia lamblia
DAEQAL

SEQ ID NO: 3102461 - protein, 6 aa, Giardia lamblia
DAESES

SEQ ID NO: 3102462 - protein, 8 aa, Giardia lamblia
DAESPASN

SEQ ID NO: 3102463 - protein, 5 aa, Giardia lamblia
DAESS

SEQ ID NO: 3102464 - protein, 8 aa, Giardia lamblia
DAESVSNA

SEQ ID NO: 3102465 - protein, 14 aa, Giardia lamblia
DAETSDSSSTDTEH

SEQ ID NO: 3102466 - protein, 11 aa, Giardia lamblia
DAFGPGKSLPI

SEQ ID NO: 3102467 - protein, 6 aa, Giardia lamblia
DAFNED

SEQ ID NO: 3102468 - protein, 13 aa, Giardia lamblia
DAFSQSNPTQSET

SEQ ID NO: 3102469 - protein, 4 aa, Giardia lamblia
DAFT

SEQ ID NO: 3102470 - protein, 4 aa, Giardia lamblia
DAGA

SEQ ID NO: 3102471 - protein, 12 aa, Giardia lamblia
DAGADVESVAPA

SEQ ID NO: 3102472 - protein, 14 aa, Giardia lamblia
DAGAKQAQTKPEKL

SEQ ID NO: 3102473 - protein, 10 aa, Giardia lamblia
DAGANYSDSL

SEQ ID NO: 3102474 - protein, 10 aa, Giardia lamblia
DAGAQSGRTY

SEQ ID NO: 3102475 - protein, 8 aa, Giardia lamblia
DAGEQLAA

SEQ ID NO: 3102476 - protein, 7 aa, Giardia lamblia
DAGGQTA

SEQ ID NO: 3102477 - protein, 11 aa, Giardia lamblia
DAGKRNDAGET

SEQ ID NO: 3102478 - protein, 8 aa, Giardia lamblia
DAGKSMGA

SEQ ID NO: 3102479 - protein, 13 aa, Giardia lamblia
DAGLGEKEEQPIE

SEQ ID NO: 3102480 - protein, 11 aa, Giardia lamblia
DAGLQDRTGRS

SEQ ID NO: 3102481 - protein, 8 aa, Giardia lamblia
DAGMGGAI

SEQ ID NO: 3102482 - protein, 5 aa, Giardia lamblia
DAGNE

SEQ ID NO: 3102483 - protein, 13 aa, Giardia lamblia
DAGNEYYGSVTPQ

SEQ ID NO: 3102484 - protein, 19 aa, Giardia lamblia
DAGPKLKSRSVEANPAFDK

SEQ ID NO: 3102485 - protein, 10 aa, Giardia lamblia
DAGQDERPAD

SEQ ID NO: 3102486 - protein, 10 aa, Giardia lamblia
DAGRGKQTKL

SEQ ID NO: 3102487 - protein, 9 aa, Giardia lamblia
DAGRPKGKR

SEQ ID NO: 3102488 - protein, 11 aa, Giardia lamblia
DAGSNSDSETM

SEQ ID NO: 3102489 - protein, 8 aa, Giardia lamblia
DAGSQYTD

SEQ ID NO: 3102490 - protein, 7 aa, Giardia lamblia
DAGTDPY

SEQ ID NO: 3102491 - protein, 8 aa, Giardia lamblia
DAGTTMSR

SEQ ID NO: 3102492 - protein, 4 aa, Giardia lamblia
DAGV

SEQ ID NO: 3102493 - protein, 4 aa, Giardia lamblia
DAGY

SEQ ID NO: 3102494 - protein, 25 aa, Giardia lamblia
DAHAQSEHTPTERPKKAPESGCITE

SEQ ID NO: 3102495 - protein, 5 aa, Giardia lamblia
DAHDP

SEQ ID NO: 3102496 - protein, 7 aa, Giardia lamblia
DAHEEEI

SEQ ID NO: 3102497 - protein, 5 aa, Giardia lamblia
DAHGK

SEQ ID NO: 3102498 - protein, 22 aa, Giardia lamblia
DAHGNSYTGDWAKGKKHGNGTL

SEQ ID NO: 3102499 - protein, 14 aa, Giardia lamblia
DAHKEKHENQMGKN

SEQ ID NO: 3102500 - protein, 17 aa, Giardia lamblia
DAHQGKQAHSHSQPEFS

SEQ ID NO: 3102501 - protein, 5 aa, Giardia lamblia
DAHRN

SEQ ID NO: 3102502 - protein, 10 aa, Giardia lamblia
DAIAKSDAIG

SEQ ID NO: 3102503 - protein, 14 aa, Giardia lamblia
DAIATTAKKTAEYK

SEQ ID NO: 3102504 - protein, 5 aa, Giardia lamblia
DAIDQ

SEQ ID NO: 3102505 - protein, 15 aa, Giardia lamblia
DAIPQNSLEAQTDTS

SEQ ID NO: 3102506 - protein, 5 aa, Giardia lamblia
DAIVP

SEQ ID NO: 3102507 - protein, 7 aa, Giardia lamblia
DAKAGVE

SEQ ID NO: 3102508 - protein, 5 aa, Giardia lamblia
DAKAK

SEQ ID NO: 3102509 - protein, 5 aa, Giardia lamblia
DAKAM

SEQ ID NO: 3102510 - protein, 5 aa, Giardia lamblia
DAKAQ

SEQ ID NO: 3102511 - protein, 4 aa, Giardia lamblia
DAKD

SEQ ID NO: 3102512 - protein, 10 aa, Giardia lamblia
DAKDKEIGQL

SEQ ID NO: 3102513 - protein, 8 aa, Giardia lamblia
DAKEREQL

SEQ ID NO: 3102514 - protein, 6 aa, Giardia lamblia
DAKERL

SEQ ID NO: 3102515 - protein, 6 aa, Giardia lamblia
DAKGDV

SEQ ID NO: 3102516 - protein, 8 aa, Giardia lamblia
DAKGMSDE

SEQ ID NO: 3102517 - protein, 6 aa, Giardia lamblia
DAKHEA

SEQ ID NO: 3102518 - protein, 11 aa, Giardia lamblia
DAKIADTHTPY

SEQ ID NO: 3102519 - protein, 7 aa, Giardia lamblia
DAKIAEI

SEQ ID NO: 3102520 - protein, 13 aa, Giardia lamblia
DAKKTLSKKKRYR

SEQ ID NO: 3102521 - protein, 10 aa, Giardia lamblia
DAKLPKKSEH

SEQ ID NO: 3102522 - protein, 8 aa, Giardia lamblia
DAKLPKTL

SEQ ID NO: 3102523 - protein, 10 aa, Giardia lamblia
DAKLSGNSRK

SEQ ID NO: 3102524 - protein, 9 aa, Giardia lamblia
DAKPDNVPE

SEQ ID NO: 3102525 - protein, 5 aa, Giardia lamblia
DAKPT

SEQ ID NO: 3102526 - protein, 23 aa, Giardia lamblia
DAKQGERATDAAIKEAGATEAEA

SEQ ID NO: 3102527 - protein, 4 aa, Giardia lamblia
DAKR

SEQ ID NO: 3102528 - protein, 7 aa, Giardia lamblia
DAKSDLR

SEQ ID NO: 3102529 - protein, 6 aa, Giardia lamblia
DAKSYR

SEQ ID NO: 3102530 - protein, 8 aa, Giardia lamblia
DAKVPERT

SEQ ID NO: 3102531 - protein, 19 aa, Giardia lamblia
DALGKTASLVSENNEMKET

SEQ ID NO: 3102532 - protein, 14 aa, Giardia lamblia
DALKNGQGDGRDAA

SEQ ID NO: 3102533 - protein, 7 aa, Giardia lamblia
DALKPGT

SEQ ID NO: 3102534 - protein, 4 aa, Giardia lamblia
DALN

SEQ ID NO: 3102535 - protein, 11 aa, Giardia lamblia
DALNGSDTGLD

SEQ ID NO: 3102536 - protein, 11 aa, Giardia lamblia
DALNNKKSSES

SEQ ID NO: 3102537 - protein, 6 aa, Giardia lamblia
DALPDD

SEQ ID NO: 3102538 - protein, 9 aa, Giardia lamblia
DALREENAS

SEQ ID NO: 3102539 - protein, 13 aa, Giardia lamblia
DALSDSSQNPTIH

SEQ ID NO: 3102540 - protein, 12 aa, Giardia lamblia
DALSEDNSKTLE

SEQ ID NO: 3102541 - protein, 12 aa, Giardia lamblia
DALSRNPNAQQA

SEQ ID NO: 3102542 - protein, 11 aa, Giardia lamblia
DALSRSSNDVS

SEQ ID NO: 3102543 - protein, 9 aa, Giardia lamblia
DALSTTDEL

SEQ ID NO: 3102544 - protein, 7 aa, Giardia lamblia
DALTPSE

SEQ ID NO: 3102545 - protein, 6 aa, Giardia lamblia
DAMEAE

SEQ ID NO: 3102546 - protein, 21 aa, Giardia lamblia
DAMNQTPSKKDTSTREKRAPE

SEQ ID NO: 3102547 - protein, 5 aa, Giardia lamblia
DAMSG

SEQ ID NO: 3102548 - protein, 25 aa, Giardia lamblia
DANASLSVSKSEKSYKEDDGVRLDS

SEQ ID NO: 3102549 - protein, 14 aa, Giardia lamblia
DANEGDLDSCLQEG

SEQ ID NO: 3102550 - protein, 6 aa, Giardia lamblia
DANGQT

SEQ ID NO: 3102551 - protein, 10 aa, Giardia lamblia
DANGRPVGSQ

SEQ ID NO: 3102552 - protein, 7 aa, Giardia lamblia
DANGSGV

SEQ ID NO: 3102553 - protein, 7 aa, Giardia lamblia
DANGWTP

SEQ ID NO: 3102554 - protein, 13 aa, Giardia lamblia
DANGYRSKNIRRS

SEQ ID NO: 3102555 - protein, 9 aa, Giardia lamblia
DANKSKEIE

SEQ ID NO: 3102556 - protein, 9 aa, Giardia lamblia
DANNAFSPA

SEQ ID NO: 3102557 - protein, 7 aa, Giardia lamblia
DANNHRS

SEQ ID NO: 3102558 - protein, 11 aa, Giardia lamblia
DANNSNLKEAA

SEQ ID NO: 3102559 - protein, 4 aa, Giardia lamblia
DANP

SEQ ID NO: 3102560 - protein, 6 aa, Giardia lamblia
DANPDT

SEQ ID NO: 3102561 - protein, 8 aa, Giardia lamblia
DANPNQEP

SEQ ID NO: 3102562 - protein, 7 aa, Giardia lamblia
DANPTVQ

SEQ ID NO: 3102563 - protein, 11 aa, Giardia lamblia
DANQDSKLDGA

SEQ ID NO: 3102564 - protein, 24 aa, Giardia lamblia
DANQPRDKGLADNCGTAPETQAAS

SEQ ID NO: 3102565 - protein, 6 aa, Giardia lamblia
DANQSD

SEQ ID NO: 3102566 - protein, 4 aa, Giardia lamblia
DANR

SEQ ID NO: 3102567 - protein, 6 aa, Giardia lamblia
DANSFG

SEQ ID NO: 3102568 - protein, 7 aa, Giardia lamblia
DANTNTY

SEQ ID NO: 3102569 - protein, 13 aa, Giardia lamblia
DAPALASAANVNE

SEQ ID NO: 3102570 - protein, 9 aa, Giardia lamblia
DAPASQAHA

SEQ ID NO: 3102571 - protein, 8 aa, Giardia lamblia
DAPEYQGQ

SEQ ID NO: 3102572 - protein, 7 aa, Giardia lamblia
DAPPINE

SEQ ID NO: 3102573 - protein, 8 aa, Giardia lamblia
DAPPKRYE

SEQ ID NO: 3102574 - protein, 7 aa, Giardia lamblia
DAPPSAD

SEQ ID NO: 3102575 - protein, 20 aa, Giardia lamblia
DAPPSPQAPRLSPGKSEPAH

SEQ ID NO: 3102576 - protein, 7 aa, Giardia lamblia
DAPQSLP

SEQ ID NO: 3102577 - protein, 7 aa, Giardia lamblia
DAPRGQD

SEQ ID NO: 3102578 - protein, 7 aa, Giardia lamblia
DAPRQKV

SEQ ID NO: 3102579 - protein, 32 aa, Giardia lamblia
DAPSAPGTPNRTTMQPPRTSTSRSGSRQNNRM

SEQ ID NO: 3102580 - protein, 21 aa, Giardia lamblia
DAPSHDVTESGHKEDAHERGL

SEQ ID NO: 3102581 - protein, 16 aa, Giardia lamblia
DAPSNKPSIDAQSLTS

SEQ ID NO: 3102582 - protein, 17 aa, Giardia lamblia
DAPSSAISGSRSSVAST

SEQ ID NO: 3102583 - protein, 8 aa, Giardia lamblia
DAPSSMKE

SEQ ID NO: 3102584 - protein, 6 aa, Giardia lamblia
DAPSTL

SEQ ID NO: 3102585 - protein, 17 aa, Giardia lamblia
DAPSTPAAISEAPAPDL

SEQ ID NO: 3102586 - protein, 7 aa, Giardia lamblia
DAPTLGY

SEQ ID NO: 3102587 - protein, 7 aa, Giardia lamblia
DAPTTIR

SEQ ID NO: 3102588 - protein, 4 aa, Giardia lamblia
DAPV

SEQ ID NO: 3102589 - protein, 7 aa, Giardia lamblia
DAPVQRQ

SEQ ID NO: 3102590 - protein, 9 aa, Giardia lamblia
DAPVSLPAR

SEQ ID NO: 3102591 - protein, 6 aa, Giardia lamblia
DAPYTR

SEQ ID NO: 3102592 - protein, 4 aa, Giardia lamblia
DAQE

SEQ ID NO: 3102593 - protein, 6 aa, Giardia lamblia
DAQETL

SEQ ID NO: 3102594 - protein, 12 aa, Giardia lamblia
DAQGGDDERVKE

SEQ ID NO: 3102595 - protein, 6 aa, Giardia lamblia
DAQGKT

SEQ ID NO: 3102596 - protein, 7 aa, Giardia lamblia
DAQKDFN

SEQ ID NO: 3102597 - protein, 14 aa, Giardia lamblia
DAQKQLSSHASENA

SEQ ID NO: 3102598 - protein, 5 aa, Giardia lamblia
DAQKR

SEQ ID NO: 3102599 - protein, 28 aa, Giardia lamblia
DAQPDHATAQPEATFSEGGEKASHTKTT

SEQ ID NO: 3102600 - protein, 6 aa, Giardia lamblia
DAQPGF

SEQ ID NO: 3102601 - protein, 11 aa, Giardia lamblia
DAQQQSSDTDN

SEQ ID NO: 3102602 - protein, 5 aa, Giardia lamblia
DAQQR

SEQ ID NO: 3102603 - protein, 13 aa, Giardia lamblia
DAQRKATQNAGTI

SEQ ID NO: 3102604 - protein, 6 aa, Giardia lamblia
DAQRSP

SEQ ID NO: 3102605 - protein, 8 aa, Giardia lamblia
DAQSESSM

SEQ ID NO: 3102606 - protein, 9 aa, Giardia lamblia
DAQSKLSSC

SEQ ID NO: 3102607 - protein, 19 aa, Giardia lamblia
DAQSYNPIGASADTALNGT

SEQ ID NO: 3102608 - protein, 5 aa, Giardia lamblia
DAQTA

SEQ ID NO: 3102609 - protein, 8 aa, Giardia lamblia
DAQTQDTP

SEQ ID NO: 3102610 - protein, 24 aa, Giardia lamblia
DARAAKKYIDNNRNKMNKDGDTAL

SEQ ID NO: 3102611 - protein, 9 aa, Giardia lamblia
DARAGTSGI

SEQ ID NO: 3102612 - protein, 9 aa, Giardia lamblia
DARAQPPVV

SEQ ID NO: 3102613 - protein, 18 aa, Giardia lamblia
DARDAVREKHVGDTDSDD

SEQ ID NO: 3102614 - protein, 9 aa, Giardia lamblia
DARDTQLHR

SEQ ID NO: 3102615 - protein, 6 aa, Giardia lamblia
DARETS

SEQ ID NO: 3102616 - protein, 10 aa, Giardia lamblia
DARGGETPYS

SEQ ID NO: 3102617 - protein, 17 aa, Giardia lamblia
DARHQKKKKKASSASLS

SEQ ID NO: 3102618 - protein, 11 aa, Giardia lamblia
DARIENERSIE

SEQ ID NO: 3102619 - protein, 13 aa, Giardia lamblia
DARKKELVTKVKG

SEQ ID NO: 3102620 - protein, 7 aa, Giardia lamblia
DARKRDI

SEQ ID NO: 3102621 - protein, 6 aa, Giardia lamblia
DARNGI

SEQ ID NO: 3102622 - protein, 10 aa, Giardia lamblia
DARNQSVESL

SEQ ID NO: 3102623 - protein, 8 aa, Giardia lamblia
DARPGSNA

SEQ ID NO: 3102624 - protein, 6 aa, Giardia lamblia
DARQQS

SEQ ID NO: 3102625 - protein, 8 aa, Giardia lamblia
DARRHAAD

SEQ ID NO: 3102626 - protein, 8 aa, Giardia lamblia
DARRSPAS

SEQ ID NO: 3102627 - protein, 4 aa, Giardia lamblia
DARS

SEQ ID NO: 3102628 - protein, 9 aa, Giardia lamblia
DARSAETAS

SEQ ID NO: 3102629 - protein, 12 aa, Giardia lamblia
DARSKYDIKDRG

SEQ ID NO: 3102630 - protein, 10 aa, Giardia lamblia
DARSRSPEDI

SEQ ID NO: 3102631 - protein, 5 aa, Giardia lamblia
DARSW

SEQ ID NO: 3102632 - protein, 10 aa, Giardia lamblia
DARTDHVSPK

SEQ ID NO: 3102633 - protein, 8 aa, Giardia lamblia
DASADGFQ

SEQ ID NO: 3102634 - protein, 6 aa, Giardia lamblia
DASARI

SEQ ID NO: 3102635 - protein, 17 aa, Giardia lamblia
DASDLGAKSNVATTQEV

SEQ ID NO: 3102636 - protein, 7 aa, Giardia lamblia
DASDNVA

SEQ ID NO: 3102637 - protein, 15 aa, Giardia lamblia
DASDTSEKECSETTD

SEQ ID NO: 3102638 - protein, 8 aa, Giardia lamblia
DASEETPS

SEQ ID NO: 3102639 - protein, 7 aa, Giardia lamblia
DASETPV

SEQ ID NO: 3102640 - protein, 7 aa, Giardia lamblia
DASGHTA

SEQ ID NO: 3102641 - protein, 6 aa, Giardia lamblia
DASGKT

SEQ ID NO: 3102642 - protein, 9 aa, Giardia lamblia
DASGRGTTP

SEQ ID NO: 3102643 - protein, 11 aa, Giardia lamblia
DASGSSTPRHK

SEQ ID NO: 3102644 - protein, 14 aa, Giardia lamblia
DASGTVTHIIKKYA

SEQ ID NO: 3102645 - protein, 9 aa, Giardia lamblia
DASIDRPSY

SEQ ID NO: 3102646 - protein, 4 aa, Giardia lamblia
DASK

SEQ ID NO: 3102647 - protein, 11 aa, Giardia lamblia
DASLEKEQKLR

SEQ ID NO: 3102648 - protein, 11 aa, Giardia lamblia
DASNLKQDTYT

SEQ ID NO: 3102649 - protein, 8 aa, Giardia lamblia
DASNPNDN

SEQ ID NO: 3102650 - protein, 8 aa, Giardia lamblia
DASNTRTY

SEQ ID NO: 3102651 - protein, 5 aa, Giardia lamblia
DASNW

SEQ ID NO: 3102652 - protein, 8 aa, Giardia lamblia
DASPDSLE

SEQ ID NO: 3102653 - protein, 8 aa, Giardia lamblia
DASPEGKV

SEQ ID NO: 3102654 - protein, 8 aa, Giardia lamblia
DASPESCE

SEQ ID NO: 3102655 - protein, 14 aa, Giardia lamblia
DASPLPSSNPTTTI

SEQ ID NO: 3102656 - protein, 7 aa, Giardia lamblia
DASPSDI

SEQ ID NO: 3102657 - protein, 22 aa, Giardia lamblia
DASPSSELNSLQRDPKYSHSSR

SEQ ID NO: 3102658 - protein, 12 aa, Giardia lamblia
DASPTSSSQILN

SEQ ID NO: 3102659 - protein, 7 aa, Giardia lamblia
DASQKLS

SEQ ID NO: 3102660 - protein, 7 aa, Giardia lamblia
DASQPSV

SEQ ID NO: 3102661 - protein, 7 aa, Giardia lamblia
DASQRYY

SEQ ID NO: 3102662 - protein, 5 aa, Giardia lamblia
DASRT

SEQ ID NO: 3102663 - protein, 18 aa, Giardia lamblia
DASRTRDSVGESAPASRL

SEQ ID NO: 3102664 - protein, 8 aa, Giardia lamblia
DASSGIKR

SEQ ID NO: 3102665 - protein, 8 aa, Giardia lamblia
DASSRKGV

SEQ ID NO: 3102666 - protein, 9 aa, Giardia lamblia
DASTKPTVK

SEQ ID NO: 3102667 - protein, 12 aa, Giardia lamblia
DASTNSDSPTYY

SEQ ID NO: 3102668 - protein, 18 aa, Giardia lamblia
DASTPSKRARSKKSRTVE

SEQ ID NO: 3102669 - protein, 4 aa, Giardia lamblia
DASY

SEQ ID NO: 3102670 - protein, 24 aa, Giardia lamblia
DATAHKQRSNESSQLSPLRPESCA

SEQ ID NO: 3102671 - protein, 8 aa, Giardia lamblia
DATAPSGE

SEQ ID NO: 3102672 - protein, 8 aa, Giardia lamblia
DATASTQA

SEQ ID NO: 3102673 - protein, 7 aa, Giardia lamblia
DATAYSV

SEQ ID NO: 3102674 - protein, 4 aa, Giardia lamblia
DATD

SEQ ID NO: 3102675 - protein, 12 aa, Giardia lamblia
DATDKSSSDGLE

SEQ ID NO: 3102676 - protein, 6 aa, Giardia lamblia
DATDRY

SEQ ID NO: 3102677 - protein, 8 aa, Giardia lamblia
DATENPKE

SEQ ID NO: 3102678 - protein, 17 aa, Giardia lamblia
DATGNDELIDMFSHLQS

SEQ ID NO: 3102679 - protein, 9 aa, Giardia lamblia
DATGQEIAS

SEQ ID NO: 3102680 - protein, 6 aa, Giardia lamblia
DATGRI

SEQ ID NO: 3102681 - protein, 7 aa, Giardia lamblia
DATGRVN

SEQ ID NO: 3102682 - protein, 5 aa, Giardia lamblia
DATGY

SEQ ID NO: 3102683 - protein, 6 aa, Giardia lamblia
DATHTS

SEQ ID NO: 3102684 - protein, 4 aa, Giardia lamblia
DATI

SEQ ID NO: 3102685 - protein, 6 aa, Giardia lamblia
DATITS

SEQ ID NO: 3102686 - protein, 6 aa, Giardia lamblia
DATKID

SEQ ID NO: 3102687 - protein, 21 aa, Giardia lamblia
DATPPDDFQHPESDPNQLSSS

SEQ ID NO: 3102688 - protein, 5 aa, Giardia lamblia
DATPQ

SEQ ID NO: 3102689 - protein, 9 aa, Giardia lamblia
DATQSGNFP

SEQ ID NO: 3102690 - protein, 13 aa, Giardia lamblia
DATQTPRKASSVK

SEQ ID NO: 3102691 - protein, 17 aa, Giardia lamblia
DATRDATDLSEKSIRRG

SEQ ID NO: 3102692 - protein, 7 aa, Giardia lamblia
DATRRRL

SEQ ID NO: 3102693 - protein, 19 aa, Giardia lamblia
DATRTAQYDHYPSRPSSQN

SEQ ID NO: 3102694 - protein, 13 aa, Giardia lamblia
DATRTKPTLKVSE

SEQ ID NO: 3102695 - protein, 4 aa, Giardia lamblia
DATS

SEQ ID NO: 3102696 - protein, 9 aa, Giardia lamblia
DATSKPRQA

SEQ ID NO: 3102697 - protein, 7 aa, Giardia lamblia
DATSNAD

SEQ ID NO: 3102698 - protein, 27 aa, Giardia lamblia
DATSSSGGLQLSPPGEKIKPHEKPAKG

SEQ ID NO: 3102699 - protein, 14 aa, Giardia lamblia
DATSTEFDPETTNP

SEQ ID NO: 3102700 - protein, 6 aa, Giardia lamblia
DATTNM

SEQ ID NO: 3102701 - protein, 15 aa, Giardia lamblia
DATTNTYTRTQLPPE

SEQ ID NO: 3102702 - protein, 14 aa, Giardia lamblia
DATWSTPVARPQRP

SEQ ID NO: 3102703 - protein, 4 aa, Giardia lamblia
DAVD

SEQ ID NO: 3102704 - protein, 8 aa, Giardia lamblia
DAVDASQH

SEQ ID NO: 3102705 - protein, 9 aa, Giardia lamblia
DAVDKEGNT

SEQ ID NO: 3102706 - protein, 35 aa, Giardia lamblia
DAVEDSDRSEQSSRASSRSASVSASSGAVNPSYGN

SEQ ID NO: 3102707 - protein, 9 aa, Giardia lamblia
DAVEPRPAA

SEQ ID NO: 3102708 - protein, 11 aa, Giardia lamblia
DAVPSTAYPSN

SEQ ID NO: 3102709 - protein, 5 aa, Giardia lamblia
DAVSE

SEQ ID NO: 3102710 - protein, 34 aa, Giardia lamblia
DAVSTSDDTQSVNPATYAQQQANNPFTKPKLQPQ

SEQ ID NO: 3102711 - protein, 18 aa, Giardia lamblia
DAWQSNDAIRDPVANETI

SEQ ID NO: 3102712 - protein, 9 aa, Giardia lamblia
DAYEQTKRI

SEQ ID NO: 3102713 - protein, 6 aa, Giardia lamblia
DAYGNT

SEQ ID NO: 3102714 - protein, 36 aa, Giardia lamblia
DAYKSEGSGMANPYGTPSFSQNPYGNPYGASTGLYG

SEQ ID NO: 3102715 - protein, 27 aa, Giardia lamblia
DAYPNAVSEPRPGSASTKNEPVVTATD

SEQ ID NO: 3102716 - protein, 4 aa, Giardia lamblia
DAYQ

SEQ ID NO: 3102717 - protein, 16 aa, Giardia lamblia
DAYSPLPSDAPKPLQT

SEQ ID NO: 3102718 - protein, 23 aa, Giardia lamblia
DAYTETGSYRSVTEVSDARSSLD

SEQ ID NO: 3102719 - protein, 8 aa, Giardia lamblia
DCASGTND

SEQ ID NO: 3102720 - protein, 6 aa, Giardia lamblia
DCATPA

SEQ ID NO: 3102721 - protein, 5 aa, Giardia lamblia
DCDNK

SEQ ID NO: 3102722 - protein, 8 aa, Giardia lamblia
DCDQPEPC

SEQ ID NO: 3102723 - protein, 14 aa, Giardia lamblia
DCDSTDSLPVSGPN

SEQ ID NO: 3102724 - protein, 6 aa, Giardia lamblia
DCDSVS

SEQ ID NO: 3102725 - protein, 4 aa, Giardia lamblia
DCGE

SEQ ID NO: 3102726 - protein, 9 aa, Giardia lamblia
DCITSNDKA

SEQ ID NO: 3102727 - protein, 4 aa, Giardia lamblia
DCKP

SEQ ID NO: 3102728 - protein, 5 aa, Giardia lamblia
DCPQR

SEQ ID NO: 3102729 - protein, 4 aa, Giardia lamblia
DCPR

SEQ ID NO: 3102730 - protein, 5 aa, Giardia lamblia
DCPTS

SEQ ID NO: 3102731 - protein, 10 aa, Giardia lamblia
DCQSANTARY

SEQ ID NO: 3102732 - protein, 4 aa, Giardia lamblia
DCRG

SEQ ID NO: 3102733 - protein, 18 aa, Giardia lamblia
DCRPGFKKEKPREPDTNE

SEQ ID NO: 3102734 - protein, 26 aa, Giardia lamblia
DCRPKSKKDIGQSHQKLGNRDTKLAE

SEQ ID NO: 3102735 - protein, 6 aa, Giardia lamblia
DCRTVR

SEQ ID NO: 3102736 - protein, 6 aa, Giardia lamblia
DCSARA

SEQ ID NO: 3102737 - protein, 7 aa, Giardia lamblia
DCSGLAP

SEQ ID NO: 3102738 - protein, 10 aa, Giardia lamblia
DCSHKPAEYT

SEQ ID NO: 3102739 - protein, 11 aa, Giardia lamblia
DCSPSSYDPKN

SEQ ID NO: 3102740 - protein, 5 aa, Giardia lamblia
DCSSD

SEQ ID NO: 3102741 - protein, 8 aa, Giardia lamblia
DCTDNSTQ

SEQ ID NO: 3102742 - protein, 6 aa, Giardia lamblia
DCTGDN

SEQ ID NO: 3102743 - protein, 6 aa, Giardia lamblia
DCTGTG

SEQ ID NO: 3102744 - protein, 8 aa, Giardia lamblia
DCTPPRDD

SEQ ID NO: 3102745 - protein, 4 aa, Giardia lamblia
DCTQ

SEQ ID NO: 3102746 - protein, 22 aa, Giardia lamblia
DCTRSSPRIQRGSTDKRSTTQS

SEQ ID NO: 3102747 - protein, 8 aa, Giardia lamblia
DCVTPEGR

SEQ ID NO: 3102748 - protein, 8 aa, Giardia lamblia
DCYPPRKR

SEQ ID NO: 3102749 - protein, 5 aa, Giardia lamblia
DDAAD

SEQ ID NO: 3102750 - protein, 8 aa, Giardia lamblia
DDAAPSRE

SEQ ID NO: 3102751 - protein, 7 aa, Giardia lamblia
DDACNQN

SEQ ID NO: 3102752 - protein, 5 aa, Giardia lamblia
DDADN

SEQ ID NO: 3102753 - protein, 6 aa, Giardia lamblia
DDAESE

SEQ ID NO: 3102754 - protein, 8 aa, Giardia lamblia
DDAGRMSG

SEQ ID NO: 3102755 - protein, 17 aa, Giardia lamblia
DDAKAETAATRTSNAAL

SEQ ID NO: 3102756 - protein, 21 aa, Giardia lamblia
DDAKQSEQSKENETRTASGVR

SEQ ID NO: 3102757 - protein, 4 aa, Giardia lamblia
DDAP

SEQ ID NO: 3102758 - protein, 8 aa, Giardia lamblia
DDAPEQKS

SEQ ID NO: 3102759 - protein, 6 aa, Giardia lamblia
DDAPGS

SEQ ID NO: 3102760 - protein, 9 aa, Giardia lamblia
DDARSVGDI

SEQ ID NO: 3102761 - protein, 4 aa, Giardia lamblia
DDAT

SEQ ID NO: 3102762 - protein, 7 aa, Giardia lamblia
DDATRMA

SEQ ID NO: 3102763 - protein, 5 aa, Giardia lamblia
DDAVE

SEQ ID NO: 3102764 - protein, 13 aa, Giardia lamblia
DDAYNEEGYMDGQ

SEQ ID NO: 3102765 - protein, 4 aa, Giardia lamblia
DDDA

SEQ ID NO: 3102766 - protein, 14 aa, Giardia lamblia
DDDDADQITDESLM

SEQ ID NO: 3102767 - protein, 33 aa, Giardia lamblia
DDDDDDKPSKSTGREKRNPTTAGSGKLGSAESE

SEQ ID NO: 3102768 - protein, 10 aa, Giardia lamblia
DDDDEEQRDQ

SEQ ID NO: 3102769 - protein, 10 aa, Giardia lamblia
DDDDKRSVSE

SEQ ID NO: 3102770 - protein, 7 aa, Giardia lamblia
DDDDTSI

SEQ ID NO: 3102771 - protein, 7 aa, Giardia lamblia
DDDEDDI

SEQ ID NO: 3102772 - protein, 23 aa, Giardia lamblia
DDDETSEEGGLKEPRKTVSSVRA

SEQ ID NO: 3102773 - protein, 71 aa, Giardia lamblia
DDDGKDDGNADVIPDDDGDDNEKDDTAQKTGDASKQSAEKASDRPTTEKGSRKSRRATTRPGSSVKAGVQD

SEQ ID NO: 3102774 - protein, 6 aa, Giardia lamblia
DDDGRT

SEQ ID NO: 3102775 - protein, 6 aa, Giardia lamblia
DDDGYV

SEQ ID NO: 3102776 - protein, 33 aa, Giardia lamblia
DDDHNQSQGSEKQEEDDKQEENTESDSSETEGP

SEQ ID NO: 3102777 - protein, 9 aa, Giardia lamblia
DDDINSSGC

SEQ ID NO: 3102778 - protein, 6 aa, Giardia lamblia
DDDKRT

SEQ ID NO: 3102779 - protein, 10 aa, Giardia lamblia
DDDKTRVEEH

SEQ ID NO: 3102780 - protein, 6 aa, Giardia lamblia
DDDLAI

SEQ ID NO: 3102781 - protein, 13 aa, Giardia lamblia
DDDNVDDEPHGEH

SEQ ID NO: 3102782 - protein, 8 aa, Giardia lamblia
DDDPDTRL

SEQ ID NO: 3102783 - protein, 9 aa, Giardia lamblia
DDDPHTCSS

SEQ ID NO: 3102784 - protein, 8 aa, Giardia lamblia
DDDPHTCT

SEQ ID NO: 3102785 - protein, 11 aa, Giardia lamblia
DDDQPSIRKAR

SEQ ID NO: 3102786 - protein, 7 aa, Giardia lamblia
DDDREEI

SEQ ID NO: 3102787 - protein, 4 aa, Giardia lamblia
DDDS

SEQ ID NO: 3102788 - protein, 5 aa, Giardia lamblia
DDDSF

SEQ ID NO: 3102789 - protein, 17 aa, Giardia lamblia
DDDSISSKAVQKCSGDV

SEQ ID NO: 3102790 - protein, 7 aa, Giardia lamblia
DDDSITA

SEQ ID NO: 3102791 - protein, 12 aa, Giardia lamblia
DDDYDTGGHYKG

SEQ ID NO: 3102792 - protein, 7 aa, Giardia lamblia
DDEADEL

SEQ ID NO: 3102793 - protein, 8 aa, Giardia lamblia
DDEADKWE

SEQ ID NO: 3102794 - protein, 7 aa, Giardia lamblia
DDEAGSS

SEQ ID NO: 3102795 - protein, 11 aa, Giardia lamblia
DDEANAETKTA

SEQ ID NO: 3102796 - protein, 5 aa, Giardia lamblia
DDEAQ

SEQ ID NO: 3102797 - protein, 7 aa, Giardia lamblia
DDEASQL

SEQ ID NO: 3102798 - protein, 17 aa, Giardia lamblia
DDEDEEDGDEEGLDGDD

SEQ ID NO: 3102799 - protein, 8 aa, Giardia lamblia
DDEDEYSL

SEQ ID NO: 3102800 - protein, 11 aa, Giardia lamblia
DDEDNPKQAHG

SEQ ID NO: 3102801 - protein, 8 aa, Giardia lamblia
DDEDTDPN

SEQ ID NO: 3102802 - protein, 22 aa, Giardia lamblia
DDEDTTSSPNKHLQDRDPSIRA

SEQ ID NO: 3102803 - protein, 20 aa, Giardia lamblia
DDEDVDKTEEQNIRNQKARG

SEQ ID NO: 3102804 - protein, 9 aa, Giardia lamblia
DDEGARRTA

SEQ ID NO: 3102805 - protein, 15 aa, Giardia lamblia
DDEGGMDEDLDDDET

SEQ ID NO: 3102806 - protein, 7 aa, Giardia lamblia
DDEGQTA

SEQ ID NO: 3102807 - protein, 6 aa, Giardia lamblia
DDEHME

SEQ ID NO: 3102808 - protein, 11 aa, Giardia lamblia
DDEHNRAKGDL

SEQ ID NO: 3102809 - protein, 57 aa, Giardia lamblia
DDEHPDPSAPGDDQQGDRQPQDPKPEEGDQAQSDPAPANALPGALPGGPEPQKEQIE

SEQ ID NO: 3102810 - protein, 6 aa, Giardia lamblia
DDEIAG

SEQ ID NO: 3102811 - protein, 12 aa, Giardia lamblia
DDEIDKSDANIE

SEQ ID NO: 3102812 - protein, 7 aa, Giardia lamblia
DDEKHRS

SEQ ID NO: 3102813 - protein, 6 aa, Giardia lamblia
DDELNE

SEQ ID NO: 3102814 - protein, 15 aa, Giardia lamblia
DDELPKDESSTTDSE

SEQ ID NO: 3102815 - protein, 20 aa, Giardia lamblia
DDEMKNDINTDLADDDFFDD

SEQ ID NO: 3102816 - protein, 4 aa, Giardia lamblia
DDEP

SEQ ID NO: 3102817 - protein, 17 aa, Giardia lamblia
DDEPGQLPINTANPKYV

SEQ ID NO: 3102818 - protein, 8 aa, Giardia lamblia
DDEPTAFR

SEQ ID NO: 3102819 - protein, 4 aa, Giardia lamblia
DDEQ

SEQ ID NO: 3102820 - protein, 17 aa, Giardia lamblia
DDEQSQRNQMAESNIGV

SEQ ID NO: 3102821 - protein, 4 aa, Giardia lamblia
DDER

SEQ ID NO: 3102822 - protein, 5 aa, Giardia lamblia
DDERD

SEQ ID NO: 3102823 - protein, 7 aa, Giardia lamblia
DDERREA

SEQ ID NO: 3102824 - protein, 10 aa, Giardia lamblia
DDESAGYDES

SEQ ID NO: 3102825 - protein, 11 aa, Giardia lamblia
DDESKDWDTQI

SEQ ID NO: 3102826 - protein, 11 aa, Giardia lamblia
DDESSSDYLDE

SEQ ID NO: 3102827 - protein, 17 aa, Giardia lamblia
DDETDPQRNQTSEQQPS

SEQ ID NO: 3102828 - protein, 6 aa, Giardia lamblia
DDETLT

SEQ ID NO: 3102829 - protein, 8 aa, Giardia lamblia
DDETRDRE

SEQ ID NO: 3102830 - protein, 34 aa, Giardia lamblia
DDFDLGESATLNPNAEGDAGQDVDDFAGDFDDFD

SEQ ID NO: 3102831 - protein, 7 aa, Giardia lamblia
DDFGDDF

SEQ ID NO: 3102832 - protein, 5 aa, Giardia lamblia
DDFGP

SEQ ID NO: 3102833 - protein, 43 aa, Giardia lamblia
DDFSDSAPAQRRRNESSAGSPFYNASASKGASRSEGSEPPRKH

SEQ ID NO: 3102834 - protein, 8 aa, Giardia lamblia
DDGAETDL

SEQ ID NO: 3102835 - protein, 12 aa, Giardia lamblia
DDGASSHGDSDI

SEQ ID NO: 3102836 - protein, 12 aa, Giardia lamblia
DDGASSHGDSGI

SEQ ID NO: 3102837 - protein, 8 aa, Giardia lamblia
DDGDTSGL

SEQ ID NO: 3102838 - protein, 7 aa, Giardia lamblia
DDGDYDR

SEQ ID NO: 3102839 - protein, 4 aa, Giardia lamblia
DDGE

SEQ ID NO: 3102840 - protein, 12 aa, Giardia lamblia
DDGEEAEVDENE

SEQ ID NO: 3102841 - protein, 5 aa, Giardia lamblia
DDGGL

SEQ ID NO: 3102842 - protein, 7 aa, Giardia lamblia
DDGIASQ

SEQ ID NO: 3102843 - protein, 14 aa, Giardia lamblia
DDGIDPHKSESREF

SEQ ID NO: 3102844 - protein, 11 aa, Giardia lamblia
DDGKKSKGQAV

SEQ ID NO: 3102845 - protein, 15 aa, Giardia lamblia
DDGKKVRDIKSAEAA

SEQ ID NO: 3102846 - protein, 4 aa, Giardia lamblia
DDGN

SEQ ID NO: 3102847 - protein, 12 aa, Giardia lamblia
DDGNGPIQRPGS

SEQ ID NO: 3102848 - protein, 8 aa, Giardia lamblia
DDGNPRTI

SEQ ID NO: 3102849 - protein, 14 aa, Giardia lamblia
DDGQGSNELSRTAS

SEQ ID NO: 3102850 - protein, 5 aa, Giardia lamblia
DDGSN

SEQ ID NO: 3102851 - protein, 11 aa, Giardia lamblia
DDGTDNQGKGL

SEQ ID NO: 3102852 - protein, 7 aa, Giardia lamblia
DDGTGTR

SEQ ID NO: 3102853 - protein, 4 aa, Giardia lamblia
DDGV

SEQ ID NO: 3102854 - protein, 8 aa, Giardia lamblia
DDGYTAVG

SEQ ID NO: 3102855 - protein, 8 aa, Giardia lamblia
DDHQNKTK

SEQ ID NO: 3102856 - protein, 5 aa, Giardia lamblia
DDIDG

SEQ ID NO: 3102857 - protein, 5 aa, Giardia lamblia
DDIES

SEQ ID NO: 3102858 - protein, 29 aa, Giardia lamblia
DDIGESESSDTRTDKASEDLDSNVSDRDN

SEQ ID NO: 3102859 - protein, 6 aa, Giardia lamblia
DDIGTQ

SEQ ID NO: 3102860 - protein, 6 aa, Giardia lamblia
DDIPAH

SEQ ID NO: 3102861 - protein, 28 aa, Giardia lamblia
DDIPSSKRLTTTREGHRGISSTSNHGSH

SEQ ID NO: 3102862 - protein, 11 aa, Giardia lamblia
DDKASPNGWYS

SEQ ID NO: 3102863 - protein, 16 aa, Giardia lamblia
DDKEAAEARIQRKDES

SEQ ID NO: 3102864 - protein, 6 aa, Giardia lamblia
DDKGNT

SEQ ID NO: 3102865 - protein, 10 aa, Giardia lamblia
DDKKKRRAEL

SEQ ID NO: 3102866 - protein, 10 aa, Giardia lamblia
DDKNMDTRKP

SEQ ID NO: 3102867 - protein, 77 aa, Giardia lamblia
DDKPAEQAKDAEDVADSADANAEAEEEGQKPLSDVDEERLRTPESRNSTEDDQHRSAEKNEDGSALDHPDVEGHGDA

SEQ ID NO: 3102868 - protein, 10 aa, Giardia lamblia
DDKPAETERI

SEQ ID NO: 3102869 - protein, 8 aa, Giardia lamblia
DDKQDDLA

SEQ ID NO: 3102870 - protein, 9 aa, Giardia lamblia
DDKSAETDR

SEQ ID NO: 3102871 - protein, 5 aa, Giardia lamblia
DDKSF

SEQ ID NO: 3102872 - protein, 16 aa, Giardia lamblia
DDKSGNTEDDQGTVDS

SEQ ID NO: 3102873 - protein, 8 aa, Giardia lamblia
DDKSRAKV

SEQ ID NO: 3102874 - protein, 7 aa, Giardia lamblia
DDKTAKM

SEQ ID NO: 3102875 - protein, 7 aa, Giardia lamblia
DDKTISQ

SEQ ID NO: 3102876 - protein, 9 aa, Giardia lamblia
DDLADSQEA

SEQ ID NO: 3102877 - protein, 5 aa, Giardia lamblia
DDLAK

SEQ ID NO: 3102878 - protein, 7 aa, Giardia lamblia
DDLARGG

SEQ ID NO: 3102879 - protein, 10 aa, Giardia lamblia
DDLASRDEEI

SEQ ID NO: 3102880 - protein, 10 aa, Giardia lamblia
DDLDPEETAT

SEQ ID NO: 3102881 - protein, 13 aa, Giardia lamblia
DDLESDRATADNR

SEQ ID NO: 3102882 - protein, 7 aa, Giardia lamblia
DDLPGAM

SEQ ID NO: 3102883 - protein, 6 aa, Giardia lamblia
DDLSQR

SEQ ID NO: 3102884 - protein, 5 aa, Giardia lamblia
DDLYN

SEQ ID NO: 3102885 - protein, 7 aa, Giardia lamblia
DDMSENT

SEQ ID NO: 3102886 - protein, 33 aa, Giardia lamblia
DDNDEDTEEDAGDLELREQKEKIRAQEQMQQEC

SEQ ID NO: 3102887 - protein, 7 aa, Giardia lamblia
DDNEEPA

SEQ ID NO: 3102888 - protein, 16 aa, Giardia lamblia
DDNEERYETASNECRQ

SEQ ID NO: 3102889 - protein, 5 aa, Giardia lamblia
DDNGM

SEQ ID NO: 3102890 - protein, 7 aa, Giardia lamblia
DDNGNSQ

SEQ ID NO: 3102891 - protein, 8 aa, Giardia lamblia
DDNHALSS

SEQ ID NO: 3102892 - protein, 8 aa, Giardia lamblia
DDNPGTPR

SEQ ID NO: 3102893 - protein, 7 aa, Giardia lamblia
DDNPNSY

SEQ ID NO: 3102894 - protein, 5 aa, Giardia lamblia
DDNSR

SEQ ID NO: 3102895 - protein, 22 aa, Giardia lamblia
DDPAQTVEASSPTEQPYTQKPE

SEQ ID NO: 3102896 - protein, 4 aa, Giardia lamblia
DDPC

SEQ ID NO: 3102897 - protein, 6 aa, Giardia lamblia
DDPDAK

SEQ ID NO: 3102898 - protein, 6 aa, Giardia lamblia
DDPDLR

SEQ ID NO: 3102899 - protein, 9 aa, Giardia lamblia
DDPDSEGHG

SEQ ID NO: 3102900 - protein, 5 aa, Giardia lamblia
DDPDV

SEQ ID NO: 3102901 - protein, 6 aa, Giardia lamblia
DDPDYT

SEQ ID NO: 3102902 - protein, 4 aa, Giardia lamblia
DDPE

SEQ ID NO: 3102903 - protein, 6 aa, Giardia lamblia
DDPEID

SEQ ID NO: 3102904 - protein, 8 aa, Giardia lamblia
DDPERARE

SEQ ID NO: 3102905 - protein, 6 aa, Giardia lamblia
DDPESA

SEQ ID NO: 3102906 - protein, 4 aa, Giardia lamblia
DDPF

SEQ ID NO: 3102907 - protein, 16 aa, Giardia lamblia
DDPFNKRPPDTALPTL

SEQ ID NO: 3102908 - protein, 27 aa, Giardia lamblia
DDPGRNVRAPADPQAGCNQSIRGHYHV

SEQ ID NO: 3102909 - protein, 9 aa, Giardia lamblia
DDPGVTKIR

SEQ ID NO: 3102910 - protein, 5 aa, Giardia lamblia
DDPHP

SEQ ID NO: 3102911 - protein, 7 aa, Giardia lamblia
DDPKQKR

SEQ ID NO: 3102912 - protein, 8 aa, Giardia lamblia
DDPNENYA

SEQ ID NO: 3102913 - protein, 12 aa, Giardia lamblia
DDPNPDDPLNSA

SEQ ID NO: 3102914 - protein, 6 aa, Giardia lamblia
DDPPAV

SEQ ID NO: 3102915 - protein, 7 aa, Giardia lamblia
DDPPNIA

SEQ ID NO: 3102916 - protein, 7 aa, Giardia lamblia
DDPQPWK

SEQ ID NO: 3102917 - protein, 4 aa, Giardia lamblia
DDPT

SEQ ID NO: 3102918 - protein, 9 aa, Giardia lamblia
DDPTDKDDI

SEQ ID NO: 3102919 - protein, 5 aa, Giardia lamblia
DDPTE

SEQ ID NO: 3102920 - protein, 6 aa, Giardia lamblia
DDPTPL

SEQ ID NO: 3102921 - protein, 10 aa, Giardia lamblia
DDPVADPASA

SEQ ID NO: 3102922 - protein, 12 aa, Giardia lamblia
DDPYDPNRSYPE

SEQ ID NO: 3102923 - protein, 7 aa, Giardia lamblia
DDQAAEV

SEQ ID NO: 3102924 - protein, 5 aa, Giardia lamblia
DDQAP

SEQ ID NO: 3102925 - protein, 19 aa, Giardia lamblia
DDQAYPSESTASDIARRKG

SEQ ID NO: 3102926 - protein, 6 aa, Giardia lamblia
DDQDEG

SEQ ID NO: 3102927 - protein, 12 aa, Giardia lamblia
DDQEGKNAEVSA

SEQ ID NO: 3102928 - protein, 9 aa, Giardia lamblia
DDQEQGLDE

SEQ ID NO: 3102929 - protein, 22 aa, Giardia lamblia
DDQKAAKPKKKQGKKVQSQKER

SEQ ID NO: 3102930 - protein, 6 aa, Giardia lamblia
DDQPVG

SEQ ID NO: 3102931 - protein, 8 aa, Giardia lamblia
DDQSGRTI

SEQ ID NO: 3102932 - protein, 4 aa, Giardia lamblia
DDQT

SEQ ID NO: 3102933 - protein, 10 aa, Giardia lamblia
DDQTGSPLQT

SEQ ID NO: 3102934 - protein, 6 aa, Giardia lamblia
DDQVGE

SEQ ID NO: 3102935 - protein, 34 aa, Giardia lamblia
DDRAEEEQLSRSDPPTMEPAPPAGSGSRTGTPVD

SEQ ID NO: 3102936 - protein, 5 aa, Giardia lamblia
DDRAI

SEQ ID NO: 3102937 - protein, 9 aa, Giardia lamblia
DDRATSLSD

SEQ ID NO: 3102938 - protein, 5 aa, Giardia lamblia
DDREG

SEQ ID NO: 3102939 - protein, 6 aa, Giardia lamblia
DDRELS

SEQ ID NO: 3102940 - protein, 9 aa, Giardia lamblia
DDRGRLEES

SEQ ID NO: 3102941 - protein, 5 aa, Giardia lamblia
DDRPL

SEQ ID NO: 3102942 - protein, 10 aa, Giardia lamblia
DDRQELPSLS

SEQ ID NO: 3102943 - protein, 9 aa, Giardia lamblia
DDRRPNRYA

SEQ ID NO: 3102944 - protein, 17 aa, Giardia lamblia
DDRTDNENYDAPHPDRT

SEQ ID NO: 3102945 - protein, 15 aa, Giardia lamblia
DDRTRGDGVGDGQGL

SEQ ID NO: 3102946 - protein, 23 aa, Giardia lamblia
DDRVGDSDNEIEYSTTRDDQGLK

SEQ ID NO: 3102947 - protein, 7 aa, Giardia lamblia
DDRYEKT

SEQ ID NO: 3102948 - protein, 6 aa, Giardia lamblia
DDSAAM

SEQ ID NO: 3102949 - protein, 12 aa, Giardia lamblia
DDSADADGYVPD

SEQ ID NO: 3102950 - protein, 20 aa, Giardia lamblia
DDSAQAKKQHRASQKSARKL

SEQ ID NO: 3102951 - protein, 8 aa, Giardia lamblia
DDSARDAR

SEQ ID NO: 3102952 - protein, 32 aa, Giardia lamblia
DDSDEENDHSDSSPQQKEVAEEFGSEESTFTD

SEQ ID NO: 3102953 - protein, 11 aa, Giardia lamblia
DDSEPESDADG

SEQ ID NO: 3102954 - protein, 16 aa, Giardia lamblia
DDSESDDYGTKKGGAV

SEQ ID NO: 3102955 - protein, 8 aa, Giardia lamblia
DDSETAVA

SEQ ID NO: 3102956 - protein, 5 aa, Giardia lamblia
DDSGG

SEQ ID NO: 3102957 - protein, 4 aa, Giardia lamblia
DDSI

SEQ ID NO: 3102958 - protein, 5 aa, Giardia lamblia
DDSIK

SEQ ID NO: 3102959 - protein, 10 aa, Giardia lamblia
DDSKSKKRMV

SEQ ID NO: 3102960 - protein, 8 aa, Giardia lamblia
DDSKSSLS

SEQ ID NO: 3102961 - protein, 7 aa, Giardia lamblia
DDSNQPI

SEQ ID NO: 3102962 - protein, 8 aa, Giardia lamblia
DDSQDSVR

SEQ ID NO: 3102963 - protein, 5 aa, Giardia lamblia
DDSQL

SEQ ID NO: 3102964 - protein, 12 aa, Giardia lamblia
DDSQTRAGTIPA

SEQ ID NO: 3102965 - protein, 4 aa, Giardia lamblia
DDSR

SEQ ID NO: 3102966 - protein, 6 aa, Giardia lamblia
DDSRGR

SEQ ID NO: 3102967 - protein, 5 aa, Giardia lamblia
DDSSC

SEQ ID NO: 3102968 - protein, 26 aa, Giardia lamblia
DDSSDLEIDDKASSRAASRKHVGPAM

SEQ ID NO: 3102969 - protein, 6 aa, Giardia lamblia
DDSSDV

SEQ ID NO: 3102970 - protein, 8 aa, Giardia lamblia
DDSSKGAL

SEQ ID NO: 3102971 - protein, 15 aa, Giardia lamblia
DDSSKQTSEAGDPSD

SEQ ID NO: 3102972 - protein, 7 aa, Giardia lamblia
DDSSKTM

SEQ ID NO: 3102973 - protein, 5 aa, Giardia lamblia
DDSSR

SEQ ID NO: 3102974 - protein, 12 aa, Giardia lamblia
DDSSRDARDSGA

SEQ ID NO: 3102975 - protein, 7 aa, Giardia lamblia
DDSSSLA

SEQ ID NO: 3102976 - protein, 10 aa, Giardia lamblia
DDSSSPDNHG

SEQ ID NO: 3102977 - protein, 11 aa, Giardia lamblia
DDSSSRPQQQV

SEQ ID NO: 3102978 - protein, 9 aa, Giardia lamblia
DDSSSTEEF

SEQ ID NO: 3102979 - protein, 6 aa, Giardia lamblia
DDSTPL

SEQ ID NO: 3102980 - protein, 15 aa, Giardia lamblia
DDSTSSTVAQQPDGL

SEQ ID NO: 3102981 - protein, 14 aa, Giardia lamblia
DDTATDSVHTNEQV

SEQ ID NO: 3102982 - protein, 16 aa, Giardia lamblia
DDTDRVSNRNLPAETY

SEQ ID NO: 3102983 - protein, 7 aa, Giardia lamblia
DDTESDM

SEQ ID NO: 3102984 - protein, 5 aa, Giardia lamblia
DDTGH

SEQ ID NO: 3102985 - protein, 8 aa, Giardia lamblia
DDTGTPYN

SEQ ID NO: 3102986 - protein, 15 aa, Giardia lamblia
DDTLSPSQKEFTNGR

SEQ ID NO: 3102987 - protein, 16 aa, Giardia lamblia
DDTPLPSSISTRSGTN

SEQ ID NO: 3102988 - protein, 13 aa, Giardia lamblia
DDTPRKRHRAYRN

SEQ ID NO: 3102989 - protein, 24 aa, Giardia lamblia
DDTPSGWTDDSSTPGTNDETEHVQ

SEQ ID NO: 3102990 - protein, 8 aa, Giardia lamblia
DDTQRPPM

SEQ ID NO: 3102991 - protein, 13 aa, Giardia lamblia
DDTRARVSYNGTN

SEQ ID NO: 3102992 - protein, 13 aa, Giardia lamblia
DDTRMDLSTDSRN

SEQ ID NO: 3102993 - protein, 14 aa, Giardia lamblia
DDTSCPKPEDDSVR

SEQ ID NO: 3102994 - protein, 7 aa, Giardia lamblia
DDTTTLS

SEQ ID NO: 3102995 - protein, 7 aa, Giardia lamblia
DDTTWPG

SEQ ID NO: 3102996 - protein, 4 aa, Giardia lamblia
DDTV

SEQ ID NO: 3102997 - protein, 5 aa, Giardia lamblia
DDVDD

SEQ ID NO: 3102998 - protein, 11 aa, Giardia lamblia
DDVEKSSKQWA

SEQ ID NO: 3102999 - protein, 9 aa, Giardia lamblia
DDVGREKAH

SEQ ID NO: 3103000 - protein, 13 aa, Giardia lamblia
DDVITSQATKKQL

SEQ ID NO: 3103001 - protein, 44 aa, Giardia lamblia
DDVNDNAPDKVESEGPEQHEKTEEEAEESEEEGEEEEDAARDNG

SEQ ID NO: 3103002 - protein, 6 aa, Giardia lamblia
DDVNRG

SEQ ID NO: 3103003 - protein, 6 aa, Giardia lamblia
DDVPNL

SEQ ID NO: 3103004 - protein, 10 aa, Giardia lamblia
DDVPNSSARA

SEQ ID NO: 3103005 - protein, 7 aa, Giardia lamblia
DDVRKLP

SEQ ID NO: 3103006 - protein, 8 aa, Giardia lamblia
DDVRQAAE

SEQ ID NO: 3103007 - protein, 7 aa, Giardia lamblia
DDVRRKD

SEQ ID NO: 3103008 - protein, 12 aa, Giardia lamblia
DDYDALDDYDFS

SEQ ID NO: 3103009 - protein, 5 aa, Giardia lamblia
DDYEH

SEQ ID NO: 3103010 - protein, 6 aa, Giardia lamblia
DDYEKA

SEQ ID NO: 3103011 - protein, 9 aa, Giardia lamblia
DDYNGYKEA

SEQ ID NO: 3103012 - protein, 6 aa, Giardia lamblia
DDYTRR

SEQ ID NO: 3103013 - protein, 4 aa, Giardia lamblia
DEAA

SEQ ID NO: 3103014 - protein, 20 aa, Giardia lamblia
DEAAARAEQAEESAAKTARL

SEQ ID NO: 3103015 - protein, 29 aa, Giardia lamblia
DEAAKREKEDRQEGNDPDWFPTGKQAKGT

SEQ ID NO: 3103016 - protein, 20 aa, Giardia lamblia
DEAAMDEKRKYVSNNTSATL

SEQ ID NO: 3103017 - protein, 10 aa, Giardia lamblia
DEAASKPENL

SEQ ID NO: 3103018 - protein, 7 aa, Giardia lamblia
DEAEGGI

SEQ ID NO: 3103019 - protein, 7 aa, Giardia lamblia
DEAERSL

SEQ ID NO: 3103020 - protein, 11 aa, Giardia lamblia
DEAGASTDTGH

SEQ ID NO: 3103021 - protein, 11 aa, Giardia lamblia
DEAGDGSTVRE

SEQ ID NO: 3103022 - protein, 10 aa, Giardia lamblia
DEAGMQDDQG

SEQ ID NO: 3103023 - protein, 5 aa, Giardia lamblia
DEAGR

SEQ ID NO: 3103024 - protein, 9 aa, Giardia lamblia
DEAGRRAGF

SEQ ID NO: 3103025 - protein, 11 aa, Giardia lamblia
DEAKNKQVPSP

SEQ ID NO: 3103026 - protein, 8 aa, Giardia lamblia
DEAKSTME

SEQ ID NO: 3103027 - protein, 7 aa, Giardia lamblia
DEALETA

SEQ ID NO: 3103028 - protein, 6 aa, Giardia lamblia
DEALRK

SEQ ID NO: 3103029 - protein, 8 aa, Giardia lamblia
DEAPDALS

SEQ ID NO: 3103030 - protein, 27 aa, Giardia lamblia
DEAPSSVRKTKDSDKRGKPQSASSNLA

SEQ ID NO: 3103031 - protein, 7 aa, Giardia lamblia
DEAQRAN

SEQ ID NO: 3103032 - protein, 15 aa, Giardia lamblia
DEAQRREDELNRSNL

SEQ ID NO: 3103033 - protein, 9 aa, Giardia lamblia
DEARGAQED

SEQ ID NO: 3103034 - protein, 4 aa, Giardia lamblia
DEAT

SEQ ID NO: 3103035 - protein, 7 aa, Giardia lamblia
DEATATQ

SEQ ID NO: 3103036 - protein, 6 aa, Giardia lamblia
DEATGA

SEQ ID NO: 3103037 - protein, 6 aa, Giardia lamblia
DEATLT

SEQ ID NO: 3103038 - protein, 8 aa, Giardia lamblia
DEATSRLT

SEQ ID NO: 3103039 - protein, 14 aa, Giardia lamblia
DEATTMESSSETVQ

SEQ ID NO: 3103040 - protein, 12 aa, Giardia lamblia
DEATTPRQGTPS

SEQ ID NO: 3103041 - protein, 8 aa, Giardia lamblia
DEATTYAS

SEQ ID NO: 3103042 - protein, 18 aa, Giardia lamblia
DECRPHQPSTLHSDAPEI

SEQ ID NO: 3103043 - protein, 11 aa, Giardia lamblia
DECTDYPNTQE

SEQ ID NO: 3103044 - protein, 7 aa, Giardia lamblia
DEDADEP

SEQ ID NO: 3103045 - protein, 10 aa, Giardia lamblia
DEDASLAPSR

SEQ ID NO: 3103046 - protein, 8 aa, Giardia lamblia
DEDEATVR

SEQ ID NO: 3103047 - protein, 8 aa, Giardia lamblia
DEDEGGYN

SEQ ID NO: 3103048 - protein, 27 aa, Giardia lamblia
DEDEQRTETHSTAHTNNEASSPQHGYR

SEQ ID NO: 3103049 - protein, 10 aa, Giardia lamblia
DEDESDGAGR

SEQ ID NO: 3103050 - protein, 8 aa, Giardia lamblia
DEDGMSPI

SEQ ID NO: 3103051 - protein, 9 aa, Giardia lamblia
DEDGNSTMF

SEQ ID NO: 3103052 - protein, 8 aa, Giardia lamblia
DEDGNTGL

SEQ ID NO: 3103053 - protein, 5 aa, Giardia lamblia
DEDGW

SEQ ID NO: 3103054 - protein, 5 aa, Giardia lamblia
DEDGY

SEQ ID NO: 3103055 - protein, 9 aa, Giardia lamblia
DEDLTSPSI

SEQ ID NO: 3103056 - protein, 11 aa, Giardia lamblia
DEDPDEADKGG

SEQ ID NO: 3103057 - protein, 6 aa, Giardia lamblia
DEDPPI

SEQ ID NO: 3103058 - protein, 7 aa, Giardia lamblia
DEDPRTL

SEQ ID NO: 3103059 - protein, 9 aa, Giardia lamblia
DEDQRERLK

SEQ ID NO: 3103060 - protein, 15 aa, Giardia lamblia
DEDSDNSDYEDRDAN

SEQ ID NO: 3103061 - protein, 8 aa, Giardia lamblia
DEDSSAAA

SEQ ID NO: 3103062 - protein, 7 aa, Giardia lamblia
DEDTSLT

SEQ ID NO: 3103063 - protein, 4 aa, Giardia lamblia
DEDV

SEQ ID NO: 3103064 - protein, 18 aa, Giardia lamblia
DEEDDRPPESPAALPEEQ

SEQ ID NO: 3103065 - protein, 6 aa, Giardia lamblia
DEEDEK

SEQ ID NO: 3103066 - protein, 30 aa, Giardia lamblia
DEEDELPPISKPVQSRQPHEATVSSRPSVS

SEQ ID NO: 3103067 - protein, 8 aa, Giardia lamblia
DEEDLKDD

SEQ ID NO: 3103068 - protein, 6 aa, Giardia lamblia
DEEEDA

SEQ ID NO: 3103069 - protein, 8 aa, Giardia lamblia
DEEEKYNS

SEQ ID NO: 3103070 - protein, 14 aa, Giardia lamblia
DEEGADDEAQENRV

SEQ ID NO: 3103071 - protein, 11 aa, Giardia lamblia
DEEGGTRDATG

SEQ ID NO: 3103072 - protein, 11 aa, Giardia lamblia
DEEGSITPNSL

SEQ ID NO: 3103073 - protein, 9 aa, Giardia lamblia
DEEGTTAAA

SEQ ID NO: 3103074 - protein, 4 aa, Giardia lamblia
DEEK

SEQ ID NO: 3103075 - protein, 18 aa, Giardia lamblia
DEEKTRRERALPAPGTSV

SEQ ID NO: 3103076 - protein, 4 aa, Giardia lamblia
DEEL

SEQ ID NO: 3103077 - protein, 8 aa, Giardia lamblia
DEELDEDL

SEQ ID NO: 3103078 - protein, 9 aa, Giardia lamblia
DEEPNTSEF

SEQ ID NO: 3103079 - protein, 13 aa, Giardia lamblia
DEEQEVEGPPGAL

SEQ ID NO: 3103080 - protein, 12 aa, Giardia lamblia
DEEQGRRARAED

SEQ ID NO: 3103081 - protein, 7 aa, Giardia lamblia
DEEQRSG

SEQ ID NO: 3103082 - protein, 9 aa, Giardia lamblia
DEEQYNEKI

SEQ ID NO: 3103083 - protein, 11 aa, Giardia lamblia
DEESDSEPVDL

SEQ ID NO: 3103084 - protein, 10 aa, Giardia lamblia
DEESKQAIDT

SEQ ID NO: 3103085 - protein, 5 aa, Giardia lamblia
DEESL

SEQ ID NO: 3103086 - protein, 9 aa, Giardia lamblia
DEESRIAGE

SEQ ID NO: 3103087 - protein, 19 aa, Giardia lamblia
DEETPGSIGSITASPEVRE

SEQ ID NO: 3103088 - protein, 5 aa, Giardia lamblia
DEEWD

SEQ ID NO: 3103089 - protein, 4 aa, Giardia lamblia
DEEY

SEQ ID NO: 3103090 - protein, 13 aa, Giardia lamblia
DEEYEDSPMREDA

SEQ ID NO: 3103091 - protein, 4 aa, Giardia lamblia
DEFA

SEQ ID NO: 3103092 - protein, 9 aa, Giardia lamblia
DEFKSDDSA

SEQ ID NO: 3103093 - protein, 25 aa, Giardia lamblia
DEFTDRKETPMNGGSPNKSHHYPGS

SEQ ID NO: 3103094 - protein, 21 aa, Giardia lamblia
DEGAETPLKTSPLRKTPSQQH

SEQ ID NO: 3103095 - protein, 11 aa, Giardia lamblia
DEGDARKTSPI

SEQ ID NO: 3103096 - protein, 5 aa, Giardia lamblia
DEGDE

SEQ ID NO: 3103097 - protein, 8 aa, Giardia lamblia
DEGDYVQQ

SEQ ID NO: 3103098 - protein, 17 aa, Giardia lamblia
DEGEDENTAGALPNPND

SEQ ID NO: 3103099 - protein, 5 aa, Giardia lamblia
DEGEQ

SEQ ID NO: 3103100 - protein, 6 aa, Giardia lamblia
DEGFGT

SEQ ID NO: 3103101 - protein, 5 aa, Giardia lamblia
DEGGY

SEQ ID NO: 3103102 - protein, 8 aa, Giardia lamblia
DEGKNTNI

SEQ ID NO: 3103103 - protein, 16 aa, Giardia lamblia
DEGLDEDEEDTGTEKQ

SEQ ID NO: 3103104 - protein, 6 aa, Giardia lamblia
DEGPKQ

SEQ ID NO: 3103105 - protein, 7 aa, Giardia lamblia
DEGRNRI

SEQ ID NO: 3103106 - protein, 7 aa, Giardia lamblia
DEGRQAH

SEQ ID NO: 3103107 - protein, 4 aa, Giardia lamblia
DEGS

SEQ ID NO: 3103108 - protein, 23 aa, Giardia lamblia
DEGVRITGTSYQGMEGENRPPEI

SEQ ID NO: 3103109 - protein, 8 aa, Giardia lamblia
DEGYAEKN

SEQ ID NO: 3103110 - protein, 4 aa, Giardia lamblia
DEHE

SEQ ID NO: 3103111 - protein, 28 aa, Giardia lamblia
DEHGEHAGDVSDSPFAVRGQDNVESFSD

SEQ ID NO: 3103112 - protein, 9 aa, Giardia lamblia
DEHHRTGTK

SEQ ID NO: 3103113 - protein, 29 aa, Giardia lamblia
DEHKQRIQAEKDAEAKYQQRKKDEAAADM

SEQ ID NO: 3103114 - protein, 4 aa, Giardia lamblia
DEHR

SEQ ID NO: 3103115 - protein, 5 aa, Giardia lamblia
DEHSD

SEQ ID NO: 3103116 - protein, 9 aa, Giardia lamblia
DEHSERTHG

SEQ ID NO: 3103117 - protein, 8 aa, Giardia lamblia
DEHSNPRR

SEQ ID NO: 3103118 - protein, 14 aa, Giardia lamblia
DEIAKQKAEAEEGL

SEQ ID NO: 3103119 - protein, 4 aa, Giardia lamblia
DEIK

SEQ ID NO: 3103120 - protein, 10 aa, Giardia lamblia
DEIKGDGKCV

SEQ ID NO: 3103121 - protein, 27 aa, Giardia lamblia
DEIKNQKEQAERQRREEIERERANAAR

SEQ ID NO: 3103122 - protein, 5 aa, Giardia lamblia
DEIPC

SEQ ID NO: 3103123 - protein, 39 aa, Giardia lamblia
DEISEDEGEGEGEGELEEELDDEEYTDEDEDEDSSQSSK

SEQ ID NO: 3103124 - protein, 33 aa, Giardia lamblia
DEISREIDEQNKKTEKRNEDGRAERRDDVEGLE

SEQ ID NO: 3103125 - protein, 12 aa, Giardia lamblia
DEKDVSSNAKQQ

SEQ ID NO: 3103126 - protein, 10 aa, Giardia lamblia
DEKHQSSRSF

SEQ ID NO: 3103127 - protein, 4 aa, Giardia lamblia
DEKI

SEQ ID NO: 3103128 - protein, 5 aa, Giardia lamblia
DEKIT

SEQ ID NO: 3103129 - protein, 5 aa, Giardia lamblia
DEKLT

SEQ ID NO: 3103130 - protein, 7 aa, Giardia lamblia
DEKNRPV

SEQ ID NO: 3103131 - protein, 5 aa, Giardia lamblia
DEKQD

SEQ ID NO: 3103132 - protein, 5 aa, Giardia lamblia
DEKRG

SEQ ID NO: 3103133 - protein, 4 aa, Giardia lamblia
DEKT

SEQ ID NO: 3103134 - protein, 11 aa, Giardia lamblia
DEKTGEYRPRY

SEQ ID NO: 3103135 - protein, 16 aa, Giardia lamblia
DEKTGKTIEYQPKQTT

SEQ ID NO: 3103136 - protein, 10 aa, Giardia lamblia
DEKTGSVKQE

SEQ ID NO: 3103137 - protein, 6 aa, Giardia lamblia
DEKTHN

SEQ ID NO: 3103138 - protein, 8 aa, Giardia lamblia
DEKYARKQ

SEQ ID NO: 3103139 - protein, 5 aa, Giardia lamblia
DELAE

SEQ ID NO: 3103140 - protein, 6 aa, Giardia lamblia
DELAEQ

SEQ ID NO: 3103141 - protein, 8 aa, Giardia lamblia
DELDEDAS

SEQ ID NO: 3103142 - protein, 8 aa, Giardia lamblia
DELDKSKG

SEQ ID NO: 3103143 - protein, 8 aa, Giardia lamblia
DELDKSRN

SEQ ID NO: 3103144 - protein, 9 aa, Giardia lamblia
DELDPPKDR

SEQ ID NO: 3103145 - protein, 29 aa, Giardia lamblia
DELDVDSQSMTRPARSRPDSGGKSRLPRP

SEQ ID NO: 3103146 - protein, 6 aa, Giardia lamblia
DELEDM

SEQ ID NO: 3103147 - protein, 4 aa, Giardia lamblia
DELG

SEQ ID NO: 3103148 - protein, 10 aa, Giardia lamblia
DELGPPMSTD

SEQ ID NO: 3103149 - protein, 4 aa, Giardia lamblia
DELH

SEQ ID NO: 3103150 - protein, 9 aa, Giardia lamblia
DELKKENTK

SEQ ID NO: 3103151 - protein, 10 aa, Giardia lamblia
DELKQTKKAP

SEQ ID NO: 3103152 - protein, 14 aa, Giardia lamblia
DELQGKGSSAVELP

SEQ ID NO: 3103153 - protein, 4 aa, Giardia lamblia
DELR

SEQ ID NO: 3103154 - protein, 5 aa, Giardia lamblia
DELRE

SEQ ID NO: 3103155 - protein, 13 aa, Giardia lamblia
DELSAGGTETLPS

SEQ ID NO: 3103156 - protein, 6 aa, Giardia lamblia
DELSDT

SEQ ID NO: 3103157 - protein, 9 aa, Giardia lamblia
DELSSGEKS

SEQ ID NO: 3103158 - protein, 25 aa, Giardia lamblia
DELSSSSDNGDQGQPLTEPNNIPID

SEQ ID NO: 3103159 - protein, 14 aa, Giardia lamblia
DELTQRYSSMEKEN

SEQ ID NO: 3103160 - protein, 16 aa, Giardia lamblia
DEMGDPDLDEKTAHTA

SEQ ID NO: 3103161 - protein, 4 aa, Giardia lamblia
DEMH

SEQ ID NO: 3103162 - protein, 9 aa, Giardia lamblia
DEMNEAARV

SEQ ID NO: 3103163 - protein, 5 aa, Giardia lamblia
DENAK

SEQ ID NO: 3103164 - protein, 9 aa, Giardia lamblia
DENEESEQF

SEQ ID NO: 3103165 - protein, 9 aa, Giardia lamblia
DENEKVGTT

SEQ ID NO: 3103166 - protein, 8 aa, Giardia lamblia
DENEPEKV

SEQ ID NO: 3103167 - protein, 18 aa, Giardia lamblia
DENFDDESASSLTDEKPY

SEQ ID NO: 3103168 - protein, 5 aa, Giardia lamblia
DENGD

SEQ ID NO: 3103169 - protein, 9 aa, Giardia lamblia
DENGELEET

SEQ ID NO: 3103170 - protein, 7 aa, Giardia lamblia
DENGEYG

SEQ ID NO: 3103171 - protein, 8 aa, Giardia lamblia
DENGKKKK

SEQ ID NO: 3103172 - protein, 15 aa, Giardia lamblia
DENGNLVRNGDKQYI

SEQ ID NO: 3103173 - protein, 6 aa, Giardia lamblia
DENGNT

SEQ ID NO: 3103174 - protein, 9 aa, Giardia lamblia
DENIAPADL

SEQ ID NO: 3103175 - protein, 15 aa, Giardia lamblia
DENLTKSAMEDKGEN

SEQ ID NO: 3103176 - protein, 20 aa, Giardia lamblia
DENNEEKELTYAGSRHPYDN

SEQ ID NO: 3103177 - protein, 10 aa, Giardia lamblia
DENPNTGEVS

SEQ ID NO: 3103178 - protein, 6 aa, Giardia lamblia
DENQNI

SEQ ID NO: 3103179 - protein, 5 aa, Giardia lamblia
DENQP

SEQ ID NO: 3103180 - protein, 5 aa, Giardia lamblia
DENRQ

SEQ ID NO: 3103181 - protein, 5 aa, Giardia lamblia
DENST

SEQ ID NO: 3103182 - protein, 20 aa, Giardia lamblia
DENVTEGSTIIPDSTNSGEL

SEQ ID NO: 3103183 - protein, 14 aa, Giardia lamblia
DEPAEPSRKKPKKI

SEQ ID NO: 3103184 - protein, 13 aa, Giardia lamblia
DEPAKPAPPGPTA

SEQ ID NO: 3103185 - protein, 13 aa, Giardia lamblia
DEPAPTAEHSPLT

SEQ ID NO: 3103186 - protein, 5 aa, Giardia lamblia
DEPDL

SEQ ID NO: 3103187 - protein, 38 aa, Giardia lamblia
DEPDTPDSTTQDSSENIDSDSSVNVNGDSNISEPRGLT

SEQ ID NO: 3103188 - protein, 5 aa, Giardia lamblia
DEPDY

SEQ ID NO: 3103189 - protein, 5 aa, Giardia lamblia
DEPEL

SEQ ID NO: 3103190 - protein, 10 aa, Giardia lamblia
DEPENTSPLP

SEQ ID NO: 3103191 - protein, 7 aa, Giardia lamblia
DEPINSM

SEQ ID NO: 3103192 - protein, 7 aa, Giardia lamblia
DEPLGTG

SEQ ID NO: 3103193 - protein, 7 aa, Giardia lamblia
DEPLSKR

SEQ ID NO: 3103194 - protein, 15 aa, Giardia lamblia
DEPNPNITFHISFTK

SEQ ID NO: 3103195 - protein, 19 aa, Giardia lamblia
DEPPASKSHPLQNSGDYSS

SEQ ID NO: 3103196 - protein, 9 aa, Giardia lamblia
DEPPDCDES

SEQ ID NO: 3103197 - protein, 33 aa, Giardia lamblia
DEPPGSPVQPPAELNPQDENNPSGPSAAATATT

SEQ ID NO: 3103198 - protein, 11 aa, Giardia lamblia
DEPPKPRPRAG

SEQ ID NO: 3103199 - protein, 11 aa, Giardia lamblia
DEPPKQRPRAG

SEQ ID NO: 3103200 - protein, 15 aa, Giardia lamblia
DEPPSSVTTKNGPHV

SEQ ID NO: 3103201 - protein, 7 aa, Giardia lamblia
DEPQSAV

SEQ ID NO: 3103202 - protein, 36 aa, Giardia lamblia
DEPRIEDTPTVRAKTPSEGNQEREQEDTKQPQHIPY

SEQ ID NO: 3103203 - protein, 7 aa, Giardia lamblia
DEPSGQV

SEQ ID NO: 3103204 - protein, 7 aa, Giardia lamblia
DEPTAQG

SEQ ID NO: 3103205 - protein, 5 aa, Giardia lamblia
DEPTD

SEQ ID NO: 3103206 - protein, 13 aa, Giardia lamblia
DEPVSEDYAQAQL

SEQ ID NO: 3103207 - protein, 5 aa, Giardia lamblia
DEQAI

SEQ ID NO: 3103208 - protein, 13 aa, Giardia lamblia
DEQAPADTQASQE

SEQ ID NO: 3103209 - protein, 7 aa, Giardia lamblia
DEQAPTV

SEQ ID NO: 3103210 - protein, 6 aa, Giardia lamblia
DEQARR

SEQ ID NO: 3103211 - protein, 6 aa, Giardia lamblia
DEQAVN

SEQ ID NO: 3103212 - protein, 4 aa, Giardia lamblia
DEQD

SEQ ID NO: 3103213 - protein, 4 aa, Giardia lamblia
DEQE

SEQ ID NO: 3103214 - protein, 17 aa, Giardia lamblia
DEQEASESESSEINPDD

SEQ ID NO: 3103215 - protein, 11 aa, Giardia lamblia
DEQEKDHEVDS

SEQ ID NO: 3103216 - protein, 11 aa, Giardia lamblia
DEQGKDVDPEV

SEQ ID NO: 3103217 - protein, 10 aa, Giardia lamblia
DEQKAQDTRL

SEQ ID NO: 3103218 - protein, 10 aa, Giardia lamblia
DEQKPEEQDV

SEQ ID NO: 3103219 - protein, 4 aa, Giardia lamblia
DEQL

SEQ ID NO: 3103220 - protein, 9 aa, Giardia lamblia
DEQMPAASS

SEQ ID NO: 3103221 - protein, 5 aa, Giardia lamblia
DEQNQ

SEQ ID NO: 3103222 - protein, 7 aa, Giardia lamblia
DEQPEPI

SEQ ID NO: 3103223 - protein, 8 aa, Giardia lamblia
DEQSNAVK

SEQ ID NO: 3103224 - protein, 8 aa, Giardia lamblia
DEQTLNDT

SEQ ID NO: 3103225 - protein, 7 aa, Giardia lamblia
DEREQEI

SEQ ID NO: 3103226 - protein, 7 aa, Giardia lamblia
DERERRN

SEQ ID NO: 3103227 - protein, 4 aa, Giardia lamblia
DERL

SEQ ID NO: 3103228 - protein, 6 aa, Giardia lamblia
DERLGQ

SEQ ID NO: 3103229 - protein, 6 aa, Giardia lamblia
DERPKA

SEQ ID NO: 3103230 - protein, 13 aa, Giardia lamblia
DERPTTRDRLSTD

SEQ ID NO: 3103231 - protein, 32 aa, Giardia lamblia
DERSRQAESLARTAQAKWGDADSQKRMEIFLG

SEQ ID NO: 3103232 - protein, 6 aa, Giardia lamblia
DERTKC

SEQ ID NO: 3103233 - protein, 6 aa, Giardia lamblia
DERTKR

SEQ ID NO: 3103234 - protein, 5 aa, Giardia lamblia
DERVQ

SEQ ID NO: 3103235 - protein, 16 aa, Giardia lamblia
DESAALTDKLEAREKA

SEQ ID NO: 3103236 - protein, 22 aa, Giardia lamblia
DESAEESTDESSTEEYTEKSDD

SEQ ID NO: 3103237 - protein, 5 aa, Giardia lamblia
DESAI

SEQ ID NO: 3103238 - protein, 6 aa, Giardia lamblia
DESASD

SEQ ID NO: 3103239 - protein, 4 aa, Giardia lamblia
DESC

SEQ ID NO: 3103240 - protein, 30 aa, Giardia lamblia
DESDASSHSEISESSTKPIESAALPPEAPV

SEQ ID NO: 3103241 - protein, 10 aa, Giardia lamblia
DESDEPVYTG

SEQ ID NO: 3103242 - protein, 9 aa, Giardia lamblia
DESDRYKGC

SEQ ID NO: 3103243 - protein, 18 aa, Giardia lamblia
DESDSENIKSKLAQEQDS

SEQ ID NO: 3103244 - protein, 6 aa, Giardia lamblia
DESDTE

SEQ ID NO: 3103245 - protein, 5 aa, Giardia lamblia
DESEA

SEQ ID NO: 3103246 - protein, 33 aa, Giardia lamblia
DESEDSEDQTNGSSETVDDSSSQGSRPDAEPEM

SEQ ID NO: 3103247 - protein, 4 aa, Giardia lamblia
DESF

SEQ ID NO: 3103248 - protein, 5 aa, Giardia lamblia
DESGA

SEQ ID NO: 3103249 - protein, 6 aa, Giardia lamblia
DESGRT

SEQ ID NO: 3103250 - protein, 71 aa, Giardia lamblia
DESKEASDDDVDDTENRKEQRQQRQREKKRGALQGNDEESDNSDPLDGDGVSASSRQTTRPTYEGYPSRQR

SEQ ID NO: 3103251 - protein, 17 aa, Giardia lamblia
DESKRSASSPPHPKREH

SEQ ID NO: 3103252 - protein, 9 aa, Giardia lamblia
DESKTDKQT

SEQ ID NO: 3103253 - protein, 12 aa, Giardia lamblia
DESLNESDPRSG

SEQ ID NO: 3103254 - protein, 15 aa, Giardia lamblia
DESPASGRLRSGASK

SEQ ID NO: 3103255 - protein, 6 aa, Giardia lamblia
DESPHV

SEQ ID NO: 3103256 - protein, 5 aa, Giardia lamblia
DESPK

SEQ ID NO: 3103257 - protein, 9 aa, Giardia lamblia
DESPPFTHR

SEQ ID NO: 3103258 - protein, 5 aa, Giardia lamblia
DESPT

SEQ ID NO: 3103259 - protein, 5 aa, Giardia lamblia
DESRG

SEQ ID NO: 3103260 - protein, 7 aa, Giardia lamblia
DESRKQI

SEQ ID NO: 3103261 - protein, 6 aa, Giardia lamblia
DESSSS

SEQ ID NO: 3103262 - protein, 8 aa, Giardia lamblia
DESTLTNA

SEQ ID NO: 3103263 - protein, 4 aa, Giardia lamblia
DESV

SEQ ID NO: 3103264 - protein, 5 aa, Giardia lamblia
DESVK

SEQ ID NO: 3103265 - protein, 4 aa, Giardia lamblia
DESY

SEQ ID NO: 3103266 - protein, 26 aa, Giardia lamblia
DETAPTIHKPKRGRSASKQSRKFSSP

SEQ ID NO: 3103267 - protein, 6 aa, Giardia lamblia
DETEAV

SEQ ID NO: 3103268 - protein, 14 aa, Giardia lamblia
DETEDPSMRIPKGR

SEQ ID NO: 3103269 - protein, 9 aa, Giardia lamblia
DETEKEKQE

SEQ ID NO: 3103270 - protein, 14 aa, Giardia lamblia
DETEQRREKEAYKA

SEQ ID NO: 3103271 - protein, 10 aa, Giardia lamblia
DETFGSDDSW

SEQ ID NO: 3103272 - protein, 6 aa, Giardia lamblia
DETGGQ

SEQ ID NO: 3103273 - protein, 6 aa, Giardia lamblia
DETGIR

SEQ ID NO: 3103274 - protein, 6 aa, Giardia lamblia
DETGIS

SEQ ID NO: 3103275 - protein, 6 aa, Giardia lamblia
DETGST

SEQ ID NO: 3103276 - protein, 4 aa, Giardia lamblia
DETM

SEQ ID NO: 3103277 - protein, 7 aa, Giardia lamblia
DETNFER

SEQ ID NO: 3103278 - protein, 9 aa, Giardia lamblia
DETNHTDSA

SEQ ID NO: 3103279 - protein, 8 aa, Giardia lamblia
DETNQKAV

SEQ ID NO: 3103280 - protein, 7 aa, Giardia lamblia
DETQGAE

SEQ ID NO: 3103281 - protein, 11 aa, Giardia lamblia
DETQTAESSDA

SEQ ID NO: 3103282 - protein, 8 aa, Giardia lamblia
DETQTGNL

SEQ ID NO: 3103283 - protein, 14 aa, Giardia lamblia
DETSAPKAKNRNPC

SEQ ID NO: 3103284 - protein, 15 aa, Giardia lamblia
DETSAPKAKNRNPCT

SEQ ID NO: 3103285 - protein, 6 aa, Giardia lamblia
DETSPI

SEQ ID NO: 3103286 - protein, 6 aa, Giardia lamblia
DETTEM

SEQ ID NO: 3103287 - protein, 6 aa, Giardia lamblia
DETTNT

SEQ ID NO: 3103288 - protein, 6 aa, Giardia lamblia
DETTVN

SEQ ID NO: 3103289 - protein, 7 aa, Giardia lamblia
DETVSQS

SEQ ID NO: 3103290 - protein, 4 aa, Giardia lamblia
DEVA

SEQ ID NO: 3103291 - protein, 35 aa, Giardia lamblia
DEVAHSKKGAFTSTKPVEYSPEDERIPYNAKGASY

SEQ ID NO: 3103292 - protein, 17 aa, Giardia lamblia
DEVAKRAKALGIPESVW

SEQ ID NO: 3103293 - protein, 15 aa, Giardia lamblia
DEVEDDGKEKGTKLT

SEQ ID NO: 3103294 - protein, 9 aa, Giardia lamblia
DEVKSDNDD

SEQ ID NO: 3103295 - protein, 10 aa, Giardia lamblia
DEVPDGEGTC

SEQ ID NO: 3103296 - protein, 14 aa, Giardia lamblia
DEVQERTKHIEEAR

SEQ ID NO: 3103297 - protein, 13 aa, Giardia lamblia
DEVRQAKQKYDSL

SEQ ID NO: 3103298 - protein, 16 aa, Giardia lamblia
DEVSTPDADEQTPEEC

SEQ ID NO: 3103299 - protein, 5 aa, Giardia lamblia
DEVTG

SEQ ID NO: 3103300 - protein, 5 aa, Giardia lamblia
DEYDE

SEQ ID NO: 3103301 - protein, 6 aa, Giardia lamblia
DEYDNA

SEQ ID NO: 3103302 - protein, 7 aa, Giardia lamblia
DEYENAS

SEQ ID NO: 3103303 - protein, 5 aa, Giardia lamblia
DEYET

SEQ ID NO: 3103304 - protein, 4 aa, Giardia lamblia
DEYG

SEQ ID NO: 3103305 - protein, 6 aa, Giardia lamblia
DEYPDL

SEQ ID NO: 3103306 - protein, 5 aa, Giardia lamblia
DEYPG

SEQ ID NO: 3103307 - protein, 10 aa, Giardia lamblia
DFAERTGSVR

SEQ ID NO: 3103308 - protein, 9 aa, Giardia lamblia
DFAPGSGMD

SEQ ID NO: 3103309 - protein, 7 aa, Giardia lamblia
DFDGNDL

SEQ ID NO: 3103310 - protein, 6 aa, Giardia lamblia
DFDPRN

SEQ ID NO: 3103311 - protein, 18 aa, Giardia lamblia
DFDQPSNKKKKKEEKRED

SEQ ID NO: 3103312 - protein, 4 aa, Giardia lamblia
DFDR

SEQ ID NO: 3103313 - protein, 5 aa, Giardia lamblia
DFDTA

SEQ ID NO: 3103314 - protein, 28 aa, Giardia lamblia
DFEGGYSRTQSARTPKRSSSSSRSPLES

SEQ ID NO: 3103315 - protein, 10 aa, Giardia lamblia
DFEGSSSLAP

SEQ ID NO: 3103316 - protein, 8 aa, Giardia lamblia
DFENAETP

SEQ ID NO: 3103317 - protein, 4 aa, Giardia lamblia
DFEQ

SEQ ID NO: 3103318 - protein, 5 aa, Giardia lamblia
DFERS

SEQ ID NO: 3103319 - protein, 4 aa, Giardia lamblia
DFET

SEQ ID NO: 3103320 - protein, 11 aa, Giardia lamblia
DFGEGSKTLDA

SEQ ID NO: 3103321 - protein, 11 aa, Giardia lamblia
DFHKSKHRRAY

SEQ ID NO: 3103322 - protein, 8 aa, Giardia lamblia
DFKTGQTK

SEQ ID NO: 3103323 - protein, 7 aa, Giardia lamblia
DFLPSKD

SEQ ID NO: 3103324 - protein, 13 aa, Giardia lamblia
DFPHGKGEVQLPN

SEQ ID NO: 3103325 - protein, 7 aa, Giardia lamblia
DFPQNPG

SEQ ID NO: 3103326 - protein, 12 aa, Giardia lamblia
DFPSLGSPCPPT

SEQ ID NO: 3103327 - protein, 4 aa, Giardia lamblia
DFPT

SEQ ID NO: 3103328 - protein, 10 aa, Giardia lamblia
DFQRGDRTQE

SEQ ID NO: 3103329 - protein, 7 aa, Giardia lamblia
DFSAPKG

SEQ ID NO: 3103330 - protein, 24 aa, Giardia lamblia
DFSDEDDDTIESMSGAPDVSEAKR

SEQ ID NO: 3103331 - protein, 9 aa, Giardia lamblia
DFSNPTLSQ

SEQ ID NO: 3103332 - protein, 7 aa, Giardia lamblia
DFSPASK

SEQ ID NO: 3103333 - protein, 10 aa, Giardia lamblia
DFSTDEPSRF

SEQ ID NO: 3103334 - protein, 7 aa, Giardia lamblia
DFSTERS

SEQ ID NO: 3103335 - protein, 10 aa, Giardia lamblia
DFVDSSSERV

SEQ ID NO: 3103336 - protein, 8 aa, Giardia lamblia
DGAARNSI

SEQ ID NO: 3103337 - protein, 10 aa, Giardia lamblia
DGADESGEWT

SEQ ID NO: 3103338 - protein, 9 aa, Giardia lamblia
DGADPDYLS

SEQ ID NO: 3103339 - protein, 10 aa, Giardia lamblia
DGADPSVPRR

SEQ ID NO: 3103340 - protein, 4 aa, Giardia lamblia
DGAE

SEQ ID NO: 3103341 - protein, 13 aa, Giardia lamblia
DGAGPGGARPPAV

SEQ ID NO: 3103342 - protein, 6 aa, Giardia lamblia
DGAHSK

SEQ ID NO: 3103343 - protein, 27 aa, Giardia lamblia
DGAIASSTLAASQRGAIPESDDAPITT

SEQ ID NO: 3103344 - protein, 7 aa, Giardia lamblia
DGAIPTS

SEQ ID NO: 3103345 - protein, 15 aa, Giardia lamblia
DGAPAQPVETDPAQL

SEQ ID NO: 3103346 - protein, 7 aa, Giardia lamblia
DGAPGPC

SEQ ID NO: 3103347 - protein, 6 aa, Giardia lamblia
DGAPSR

SEQ ID NO: 3103348 - protein, 5 aa, Giardia lamblia
DGAQI

SEQ ID NO: 3103349 - protein, 17 aa, Giardia lamblia
DGASFSSSDALSQDTQS

SEQ ID NO: 3103350 - protein, 16 aa, Giardia lamblia
DGASKSTSDARGNEHK

SEQ ID NO: 3103351 - protein, 9 aa, Giardia lamblia
DGASSIPPM

SEQ ID NO: 3103352 - protein, 13 aa, Giardia lamblia
DGASVDNASTSAP

SEQ ID NO: 3103353 - protein, 8 aa, Giardia lamblia
DGATGKTT

SEQ ID NO: 3103354 - protein, 9 aa, Giardia lamblia
DGATPAMDR

SEQ ID NO: 3103355 - protein, 9 aa, Giardia lamblia
DGATQGTRA

SEQ ID NO: 3103356 - protein, 13 aa, Giardia lamblia
DGAVRSHAPQSGK

SEQ ID NO: 3103357 - protein, 10 aa, Giardia lamblia
DGCHSDTELS

SEQ ID NO: 3103358 - protein, 11 aa, Giardia lamblia
DGCKSTEKTAT

SEQ ID NO: 3103359 - protein, 16 aa, Giardia lamblia
DGCSAGNYRANASGYD

SEQ ID NO: 3103360 - protein, 7 aa, Giardia lamblia
DGDAPIE

SEQ ID NO: 3103361 - protein, 16 aa, Giardia lamblia
DGDAPLEAKLTEPPLK

SEQ ID NO: 3103362 - protein, 7 aa, Giardia lamblia
DGDDAHQ

SEQ ID NO: 3103363 - protein, 5 aa, Giardia lamblia
DGDDL

SEQ ID NO: 3103364 - protein, 5 aa, Giardia lamblia
DGDDR

SEQ ID NO: 3103365 - protein, 11 aa, Giardia lamblia
DGDEEDEDAEK

SEQ ID NO: 3103366 - protein, 10 aa, Giardia lamblia
DGDEEEPAFT

SEQ ID NO: 3103367 - protein, 7 aa, Giardia lamblia
DGDFEAA

SEQ ID NO: 3103368 - protein, 4 aa, Giardia lamblia
DGDG

SEQ ID NO: 3103369 - protein, 10 aa, Giardia lamblia
DGDGSQQKLQ

SEQ ID NO: 3103370 - protein, 5 aa, Giardia lamblia
DGDIE

SEQ ID NO: 3103371 - protein, 9 aa, Giardia lamblia
DGDKDKVEK

SEQ ID NO: 3103372 - protein, 8 aa, Giardia lamblia
DGDKIHER

SEQ ID NO: 3103373 - protein, 11 aa, Giardia lamblia
DGDKVNDEPHG

SEQ ID NO: 3103374 - protein, 7 aa, Giardia lamblia
DGDLSGV

SEQ ID NO: 3103375 - protein, 6 aa, Giardia lamblia
DGDMPQ

SEQ ID NO: 3103376 - protein, 7 aa, Giardia lamblia
DGDNRIS

SEQ ID NO: 3103377 - protein, 20 aa, Giardia lamblia
DGDNTRSNITSAGHPPSSLP

SEQ ID NO: 3103378 - protein, 6 aa, Giardia lamblia
DGDPKI

SEQ ID NO: 3103379 - protein, 4 aa, Giardia lamblia
DGDQ

SEQ ID NO: 3103380 - protein, 8 aa, Giardia lamblia
DGDRRTPH

SEQ ID NO: 3103381 - protein, 5 aa, Giardia lamblia
DGDRT

SEQ ID NO: 3103382 - protein, 11 aa, Giardia lamblia
DGDSGVNSRSI

SEQ ID NO: 3103383 - protein, 9 aa, Giardia lamblia
DGDSTDETL

SEQ ID NO: 3103384 - protein, 9 aa, Giardia lamblia
DGDSTVTLT

SEQ ID NO: 3103385 - protein, 7 aa, Giardia lamblia
DGDTEGV

SEQ ID NO: 3103386 - protein, 7 aa, Giardia lamblia
DGDTSAL

SEQ ID NO: 3103387 - protein, 8 aa, Giardia lamblia
DGECSKER

SEQ ID NO: 3103388 - protein, 7 aa, Giardia lamblia
DGEDEER

SEQ ID NO: 3103389 - protein, 9 aa, Giardia lamblia
DGEDKPVKR

SEQ ID NO: 3103390 - protein, 19 aa, Giardia lamblia
DGEEDALAESADDNSDTLT

SEQ ID NO: 3103391 - protein, 7 aa, Giardia lamblia
DGEESTS

SEQ ID NO: 3103392 - protein, 8 aa, Giardia lamblia
DGEETLPP

SEQ ID NO: 3103393 - protein, 8 aa, Giardia lamblia
DGEETSDV

SEQ ID NO: 3103394 - protein, 5 aa, Giardia lamblia
DGEIE

SEQ ID NO: 3103395 - protein, 12 aa, Giardia lamblia
DGEITSEQDSKV

SEQ ID NO: 3103396 - protein, 9 aa, Giardia lamblia
DGEKLKETM

SEQ ID NO: 3103397 - protein, 14 aa, Giardia lamblia
DGELDNGPAAMEKE

SEQ ID NO: 3103398 - protein, 5 aa, Giardia lamblia
DGELR

SEQ ID NO: 3103399 - protein, 7 aa, Giardia lamblia
DGEPDGI

SEQ ID NO: 3103400 - protein, 10 aa, Giardia lamblia
DGEPQRDLNQ

SEQ ID NO: 3103401 - protein, 6 aa, Giardia lamblia
DGEPTM

SEQ ID NO: 3103402 - protein, 9 aa, Giardia lamblia
DGEQGVDAG

SEQ ID NO: 3103403 - protein, 13 aa, Giardia lamblia
DGERSSDRPDKAE

SEQ ID NO: 3103404 - protein, 6 aa, Giardia lamblia
DGERTV

SEQ ID NO: 3103405 - protein, 6 aa, Giardia lamblia
DGESPC

SEQ ID NO: 3103406 - protein, 17 aa, Giardia lamblia
DGESPRDRTSPKPLSSS

SEQ ID NO: 3103407 - protein, 12 aa, Giardia lamblia
DGETATNPHNED

SEQ ID NO: 3103408 - protein, 13 aa, Giardia lamblia
DGETGNKHAEDRL

SEQ ID NO: 3103409 - protein, 5 aa, Giardia lamblia
DGETM

SEQ ID NO: 3103410 - protein, 7 aa, Giardia lamblia
DGETRSL

SEQ ID NO: 3103411 - protein, 12 aa, Giardia lamblia
DGETSPDKPGHA

SEQ ID NO: 3103412 - protein, 8 aa, Giardia lamblia
DGEYTSTG

SEQ ID NO: 3103413 - protein, 9 aa, Giardia lamblia
DGFDDSPRG

SEQ ID NO: 3103414 - protein, 7 aa, Giardia lamblia
DGFGGSK

SEQ ID NO: 3103415 - protein, 6 aa, Giardia lamblia
DGFNEE

SEQ ID NO: 3103416 - protein, 9 aa, Giardia lamblia
DGFPSDPSN

SEQ ID NO: 3103417 - protein, 13 aa, Giardia lamblia
DGFPTTKSTDTYR

SEQ ID NO: 3103418 - protein, 25 aa, Giardia lamblia
DGFSGEKSKSRPDTKNSTGRSAGEA

SEQ ID NO: 3103419 - protein, 12 aa, Giardia lamblia
DGFTDSLQGGGC

SEQ ID NO: 3103420 - protein, 6 aa, Giardia lamblia
DGGAQD

SEQ ID NO: 3103421 - protein, 5 aa, Giardia lamblia
DGGDL

SEQ ID NO: 3103422 - protein, 4 aa, Giardia lamblia
DGGF

SEQ ID NO: 3103423 - protein, 16 aa, Giardia lamblia
DGGFGTTPGDESHGGQ

SEQ ID NO: 3103424 - protein, 8 aa, Giardia lamblia
DGGFTYDT

SEQ ID NO: 3103425 - protein, 5 aa, Giardia lamblia
DGGGH

SEQ ID NO: 3103426 - protein, 5 aa, Giardia lamblia
DGGIE

SEQ ID NO: 3103427 - protein, 14 aa, Giardia lamblia
DGGNQGRYGDKPSI

SEQ ID NO: 3103428 - protein, 17 aa, Giardia lamblia
DGGNQKSVTGPDSVRDY

SEQ ID NO: 3103429 - protein, 7 aa, Giardia lamblia
DGGPENR

SEQ ID NO: 3103430 - protein, 4 aa, Giardia lamblia
DGGR

SEQ ID NO: 3103431 - protein, 7 aa, Giardia lamblia
DGGREEK

SEQ ID NO: 3103432 - protein, 9 aa, Giardia lamblia
DGGRTKQLS

SEQ ID NO: 3103433 - protein, 13 aa, Giardia lamblia
DGGSTPSAGGPGG

SEQ ID NO: 3103434 - protein, 7 aa, Giardia lamblia
DGGTHHP

SEQ ID NO: 3103435 - protein, 9 aa, Giardia lamblia
DGGTSPVAK

SEQ ID NO: 3103436 - protein, 8 aa, Giardia lamblia
DGHAPVSR

SEQ ID NO: 3103437 - protein, 4 aa, Giardia lamblia
DGHL

SEQ ID NO: 3103438 - protein, 4 aa, Giardia lamblia
DGHM

SEQ ID NO: 3103439 - protein, 61 aa, Giardia lamblia
DGHRQREHSVNTNDMVSSSGGGLSPVQPDIKKTKRRSKKSAVERATTPSVDALEDAQKSLE

SEQ ID NO: 3103440 - protein, 13 aa, Giardia lamblia
DGHSGSSQVQDTV

SEQ ID NO: 3103441 - protein, 6 aa, Giardia lamblia
DGIGPD

SEQ ID NO: 3103442 - protein, 9 aa, Giardia lamblia
DGIPGGTDT

SEQ ID NO: 3103443 - protein, 6 aa, Giardia lamblia
DGIRNE

SEQ ID NO: 3103444 - protein, 7 aa, Giardia lamblia
DGISGEQ

SEQ ID NO: 3103445 - protein, 4 aa, Giardia lamblia
DGIT

SEQ ID NO: 3103446 - protein, 6 aa, Giardia lamblia
DGITDE

SEQ ID NO: 3103447 - protein, 10 aa, Giardia lamblia
DGKASISSQL

SEQ ID NO: 3103448 - protein, 6 aa, Giardia lamblia
DGKERE

SEQ ID NO: 3103449 - protein, 11 aa, Giardia lamblia
DGKGGPVRERG

SEQ ID NO: 3103450 - protein, 7 aa, Giardia lamblia
DGKGGTA

SEQ ID NO: 3103451 - protein, 10 aa, Giardia lamblia
DGKKSGGTTV

SEQ ID NO: 3103452 - protein, 4 aa, Giardia lamblia
DGKN

SEQ ID NO: 3103453 - protein, 6 aa, Giardia lamblia
DGKNIS

SEQ ID NO: 3103454 - protein, 11 aa, Giardia lamblia
DGKSKGPEKEK

SEQ ID NO: 3103455 - protein, 5 aa, Giardia lamblia
DGKSP

SEQ ID NO: 3103456 - protein, 8 aa, Giardia lamblia
DGKSPRYY

SEQ ID NO: 3103457 - protein, 15 aa, Giardia lamblia
DGKSYENKSPSNGVT

SEQ ID NO: 3103458 - protein, 6 aa, Giardia lamblia
DGKTVN

SEQ ID NO: 3103459 - protein, 20 aa, Giardia lamblia
DGKVKKGPIDERVRNGMRGQ

SEQ ID NO: 3103460 - protein, 5 aa, Giardia lamblia
DGKYA

SEQ ID NO: 3103461 - protein, 5 aa, Giardia lamblia
DGKYK

SEQ ID NO: 3103462 - protein, 4 aa, Giardia lamblia
DGLA

SEQ ID NO: 3103463 - protein, 5 aa, Giardia lamblia
DGLEE

SEQ ID NO: 3103464 - protein, 4 aa, Giardia lamblia
DGLG

SEQ ID NO: 3103465 - protein, 25 aa, Giardia lamblia
DGLGGSAGNGGDEKNGDKAPDSIDE

SEQ ID NO: 3103466 - protein, 10 aa, Giardia lamblia
DGLPASASSD

SEQ ID NO: 3103467 - protein, 8 aa, Giardia lamblia
DGLQEQDV

SEQ ID NO: 3103468 - protein, 19 aa, Giardia lamblia
DGLRTRGNSYSRDRVSGAP

SEQ ID NO: 3103469 - protein, 4 aa, Giardia lamblia
DGLS

SEQ ID NO: 3103470 - protein, 6 aa, Giardia lamblia
DGLSES

SEQ ID NO: 3103471 - protein, 6 aa, Giardia lamblia
DGLSGK

SEQ ID NO: 3103472 - protein, 21 aa, Giardia lamblia
DGLSRAANIASSTAASQRQQT

SEQ ID NO: 3103473 - protein, 7 aa, Giardia lamblia
DGLTESQ

SEQ ID NO: 3103474 - protein, 17 aa, Giardia lamblia
DGMDSKNRVSEKRSASD

SEQ ID NO: 3103475 - protein, 7 aa, Giardia lamblia
DGMGYSK

SEQ ID NO: 3103476 - protein, 7 aa, Giardia lamblia
DGMNPDN

SEQ ID NO: 3103477 - protein, 7 aa, Giardia lamblia
DGMQDTM

SEQ ID NO: 3103478 - protein, 4 aa, Giardia lamblia
DGMS

SEQ ID NO: 3103479 - protein, 9 aa, Giardia lamblia
DGNDAAKQL

SEQ ID NO: 3103480 - protein, 29 aa, Giardia lamblia
DGNEAENAENAEGNETESKQPYLCPSVIT

SEQ ID NO: 3103481 - protein, 8 aa, Giardia lamblia
DGNETQGN

SEQ ID NO: 3103482 - protein, 8 aa, Giardia lamblia
DGNIKATS

SEQ ID NO: 3103483 - protein, 10 aa, Giardia lamblia
DGNKEPTNPL

SEQ ID NO: 3103484 - protein, 7 aa, Giardia lamblia
DGNPGEI

SEQ ID NO: 3103485 - protein, 10 aa, Giardia lamblia
DGNPLECDGR

SEQ ID NO: 3103486 - protein, 8 aa, Giardia lamblia
DGNSPHAE

SEQ ID NO: 3103487 - protein, 9 aa, Giardia lamblia
DGNSRYQGE

SEQ ID NO: 3103488 - protein, 7 aa, Giardia lamblia
DGNSSST

SEQ ID NO: 3103489 - protein, 5 aa, Giardia lamblia
DGNTH

SEQ ID NO: 3103490 - protein, 4 aa, Giardia lamblia
DGPA

SEQ ID NO: 3103491 - protein, 14 aa, Giardia lamblia
DGPAETLTTEVEPE

SEQ ID NO: 3103492 - protein, 7 aa, Giardia lamblia
DGPAPTG

SEQ ID NO: 3103493 - protein, 7 aa, Giardia lamblia
DGPDARQ

SEQ ID NO: 3103494 - protein, 13 aa, Giardia lamblia
DGPDIYGSSAATI

SEQ ID NO: 3103495 - protein, 7 aa, Giardia lamblia
DGPDKGK

SEQ ID NO: 3103496 - protein, 9 aa, Giardia lamblia
DGPDNMPNE

SEQ ID NO: 3103497 - protein, 10 aa, Giardia lamblia
DGPDSLDPEQ

SEQ ID NO: 3103498 - protein, 9 aa, Giardia lamblia
DGPDTATIR

SEQ ID NO: 3103499 - protein, 4 aa, Giardia lamblia
DGPF

SEQ ID NO: 3103500 - protein, 12 aa, Giardia lamblia
DGPISSKALPAV

SEQ ID NO: 3103501 - protein, 6 aa, Giardia lamblia
DGPITA

SEQ ID NO: 3103502 - protein, 4 aa, Giardia lamblia
DGPL

SEQ ID NO: 3103503 - protein, 6 aa, Giardia lamblia
DGPMGE

SEQ ID NO: 3103504 - protein, 7 aa, Giardia lamblia
DGPRGKT

SEQ ID NO: 3103505 - protein, 5 aa, Giardia lamblia
DGPRL

SEQ ID NO: 3103506 - protein, 6 aa, Giardia lamblia
DGPRPY

SEQ ID NO: 3103507 - protein, 4 aa, Giardia lamblia
DGPS

SEQ ID NO: 3103508 - protein, 4 aa, Giardia lamblia
DGPT

SEQ ID NO: 3103509 - protein, 7 aa, Giardia lamblia
DGPVGSK

SEQ ID NO: 3103510 - protein, 7 aa, Giardia lamblia
DGPYKVS

SEQ ID NO: 3103511 - protein, 5 aa, Giardia lamblia
DGQAA

SEQ ID NO: 3103512 - protein, 10 aa, Giardia lamblia
DGQDDNAPAS

SEQ ID NO: 3103513 - protein, 8 aa, Giardia lamblia
DGQEKDFG

SEQ ID NO: 3103514 - protein, 13 aa, Giardia lamblia
DGQGALEDAPNTQ

SEQ ID NO: 3103515 - protein, 6 aa, Giardia lamblia
DGQGGM

SEQ ID NO: 3103516 - protein, 16 aa, Giardia lamblia
DGQHSANPKQKKNQPT

SEQ ID NO: 3103517 - protein, 12 aa, Giardia lamblia
DGQLQPASADDD

SEQ ID NO: 3103518 - protein, 5 aa, Giardia lamblia
DGQPM

SEQ ID NO: 3103519 - protein, 8 aa, Giardia lamblia
DGQQMTKA

SEQ ID NO: 3103520 - protein, 5 aa, Giardia lamblia
DGQTG

SEQ ID NO: 3103521 - protein, 26 aa, Giardia lamblia
DGQTGARQQPQGAVRSKAGAGNEADM

SEQ ID NO: 3103522 - protein, 5 aa, Giardia lamblia
DGQTL

SEQ ID NO: 3103523 - protein, 4 aa, Giardia lamblia
DGRA

SEQ ID NO: 3103524 - protein, 4 aa, Giardia lamblia
DGRD

SEQ ID NO: 3103525 - protein, 7 aa, Giardia lamblia
DGRDSRI

SEQ ID NO: 3103526 - protein, 7 aa, Giardia lamblia
DGREYTG

SEQ ID NO: 3103527 - protein, 34 aa, Giardia lamblia
DGRGADAEDGTGARKATRERHGDTVEGTPTPGDL

SEQ ID NO: 3103528 - protein, 5 aa, Giardia lamblia
DGRGK

SEQ ID NO: 3103529 - protein, 7 aa, Giardia lamblia
DGRIEPS

SEQ ID NO: 3103530 - protein, 5 aa, Giardia lamblia
DGRKG

SEQ ID NO: 3103531 - protein, 7 aa, Giardia lamblia
DGRKGKT

SEQ ID NO: 3103532 - protein, 6 aa, Giardia lamblia
DGRKQG

SEQ ID NO: 3103533 - protein, 7 aa, Giardia lamblia
DGRPEHV

SEQ ID NO: 3103534 - protein, 8 aa, Giardia lamblia
DGRQTESI

SEQ ID NO: 3103535 - protein, 12 aa, Giardia lamblia
DGRQTTAKLDSH

SEQ ID NO: 3103536 - protein, 7 aa, Giardia lamblia
DGRRKQF

SEQ ID NO: 3103537 - protein, 7 aa, Giardia lamblia
DGRSPLK

SEQ ID NO: 3103538 - protein, 4 aa, Giardia lamblia
DGRT

SEQ ID NO: 3103539 - protein, 22 aa, Giardia lamblia
DGRTPGDIARSVNNEEVSLIIG

SEQ ID NO: 3103540 - protein, 7 aa, Giardia lamblia
DGRTQDR

SEQ ID NO: 3103541 - protein, 4 aa, Giardia lamblia
DGSA

SEQ ID NO: 3103542 - protein, 9 aa, Giardia lamblia
DGSAFSSHD

SEQ ID NO: 3103543 - protein, 17 aa, Giardia lamblia
DGSAPRSTRASIDSAGI

SEQ ID NO: 3103544 - protein, 10 aa, Giardia lamblia
DGSASGPRQV

SEQ ID NO: 3103545 - protein, 16 aa, Giardia lamblia
DGSASGTTKVTKDGVS

SEQ ID NO: 3103546 - protein, 36 aa, Giardia lamblia
DGSDATSSSVDSGIGSRTHSEAPIGGGDKDEGAHSS

SEQ ID NO: 3103547 - protein, 4 aa, Giardia lamblia
DGSE

SEQ ID NO: 3103548 - protein, 5 aa, Giardia lamblia
DGSEE

SEQ ID NO: 3103549 - protein, 7 aa, Giardia lamblia
DGSESSM

SEQ ID NO: 3103550 - protein, 11 aa, Giardia lamblia
DGSGAQQPTVS

SEQ ID NO: 3103551 - protein, 6 aa, Giardia lamblia
DGSGAY

SEQ ID NO: 3103552 - protein, 5 aa, Giardia lamblia
DGSGE

SEQ ID NO: 3103553 - protein, 45 aa, Giardia lamblia
DGSGQNQCTSCPEGKYLKGDKTCVTSDQCTSTVYPDPESGTCKEC

SEQ ID NO: 3103554 - protein, 5 aa, Giardia lamblia
DGSGY

SEQ ID NO: 3103555 - protein, 4 aa, Giardia lamblia
DGSH

SEQ ID NO: 3103556 - protein, 8 aa, Giardia lamblia
DGSISISD

SEQ ID NO: 3103557 - protein, 9 aa, Giardia lamblia
DGSLRPSEL

SEQ ID NO: 3103558 - protein, 22 aa, Giardia lamblia
DGSMTGGSTASLTRKQPGPSIL

SEQ ID NO: 3103559 - protein, 6 aa, Giardia lamblia
DGSPGD

SEQ ID NO: 3103560 - protein, 5 aa, Giardia lamblia
DGSPL

SEQ ID NO: 3103561 - protein, 5 aa, Giardia lamblia
DGSPY

SEQ ID NO: 3103562 - protein, 11 aa, Giardia lamblia
DGSRASSGSSY

SEQ ID NO: 3103563 - protein, 7 aa, Giardia lamblia
DGSRYEG

SEQ ID NO: 3103564 - protein, 7 aa, Giardia lamblia
DGSRYTG

SEQ ID NO: 3103565 - protein, 14 aa, Giardia lamblia
DGSSAGASKNELYG

SEQ ID NO: 3103566 - protein, 9 aa, Giardia lamblia
DGSSEEPAF

SEQ ID NO: 3103567 - protein, 8 aa, Giardia lamblia
DGSSESKV

SEQ ID NO: 3103568 - protein, 9 aa, Giardia lamblia
DGSSIANGD

SEQ ID NO: 3103569 - protein, 5 aa, Giardia lamblia
DGSSL

SEQ ID NO: 3103570 - protein, 8 aa, Giardia lamblia
DGSSPRSV

SEQ ID NO: 3103571 - protein, 9 aa, Giardia lamblia
DGSSSAARI

SEQ ID NO: 3103572 - protein, 5 aa, Giardia lamblia
DGSST

SEQ ID NO: 3103573 - protein, 5 aa, Giardia lamblia
DGSTI

SEQ ID NO: 3103574 - protein, 11 aa, Giardia lamblia
DGSTQPGDRKA

SEQ ID NO: 3103575 - protein, 6 aa, Giardia lamblia
DGSTRA

SEQ ID NO: 3103576 - protein, 12 aa, Giardia lamblia
DGSTRSGRALSA

SEQ ID NO: 3103577 - protein, 17 aa, Giardia lamblia
DGSVAVDTNRKQPHNDS

SEQ ID NO: 3103578 - protein, 8 aa, Giardia lamblia
DGSVGKSS

SEQ ID NO: 3103579 - protein, 9 aa, Giardia lamblia
DGSVNEAIP

SEQ ID NO: 3103580 - protein, 6 aa, Giardia lamblia
DGSVSV

SEQ ID NO: 3103581 - protein, 6 aa, Giardia lamblia
DGSVYE

SEQ ID NO: 3103582 - protein, 9 aa, Giardia lamblia
DGTAAEKEY

SEQ ID NO: 3103583 - protein, 5 aa, Giardia lamblia
DGTAK

SEQ ID NO: 3103584 - protein, 10 aa, Giardia lamblia
DGTATEGGIN

SEQ ID NO: 3103585 - protein, 8 aa, Giardia lamblia
DGTATFST

SEQ ID NO: 3103586 - protein, 15 aa, Giardia lamblia
DGTEGRLSNTVYLGD

SEQ ID NO: 3103587 - protein, 6 aa, Giardia lamblia
DGTGKL

SEQ ID NO: 3103588 - protein, 7 aa, Giardia lamblia
DGTGPQA

SEQ ID NO: 3103589 - protein, 10 aa, Giardia lamblia
DGTGRPDFVG

SEQ ID NO: 3103590 - protein, 7 aa, Giardia lamblia
DGTHENA

SEQ ID NO: 3103591 - protein, 17 aa, Giardia lamblia
DGTIETSIVQGQEMLLQ

SEQ ID NO: 3103592 - protein, 5 aa, Giardia lamblia
DGTQA

SEQ ID NO: 3103593 - protein, 13 aa, Giardia lamblia
DGTRTPRSKTPVD

SEQ ID NO: 3103594 - protein, 7 aa, Giardia lamblia
DGTSGYL

SEQ ID NO: 3103595 - protein, 12 aa, Giardia lamblia
DGTSLTVSPTGT

SEQ ID NO: 3103596 - protein, 8 aa, Giardia lamblia
DGTSNTRQ

SEQ ID NO: 3103597 - protein, 32 aa, Giardia lamblia
DGTSRRPRPSDDAKGTRPSATKYSSALPQEAA

SEQ ID NO: 3103598 - protein, 4 aa, Giardia lamblia
DGTT

SEQ ID NO: 3103599 - protein, 5 aa, Giardia lamblia
DGTTA

SEQ ID NO: 3103600 - protein, 12 aa, Giardia lamblia
DGTTGERRLDPG

SEQ ID NO: 3103601 - protein, 5 aa, Giardia lamblia
DGTTP

SEQ ID NO: 3103602 - protein, 13 aa, Giardia lamblia
DGTTSDIPISTRM

SEQ ID NO: 3103603 - protein, 8 aa, Giardia lamblia
DGTTVSID

SEQ ID NO: 3103604 - protein, 7 aa, Giardia lamblia
DGTVKKR

SEQ ID NO: 3103605 - protein, 25 aa, Giardia lamblia
DGVDGSTSMQSLPAKHGTNSGTSEY

SEQ ID NO: 3103606 - protein, 6 aa, Giardia lamblia
DGVEAT

SEQ ID NO: 3103607 - protein, 7 aa, Giardia lamblia
DGVEEES

SEQ ID NO: 3103608 - protein, 4 aa, Giardia lamblia
DGVI

SEQ ID NO: 3103609 - protein, 18 aa, Giardia lamblia
DGVNGGLSGEQKQPVTTS

SEQ ID NO: 3103610 - protein, 5 aa, Giardia lamblia
DGVQR

SEQ ID NO: 3103611 - protein, 8 aa, Giardia lamblia
DGVSTESL

SEQ ID NO: 3103612 - protein, 6 aa, Giardia lamblia
DGVTDK

SEQ ID NO: 3103613 - protein, 16 aa, Giardia lamblia
DGVTRHTRKHRNEFGD

SEQ ID NO: 3103614 - protein, 6 aa, Giardia lamblia
DGVTSI

SEQ ID NO: 3103615 - protein, 8 aa, Giardia lamblia
DGYAASAL

SEQ ID NO: 3103616 - protein, 4 aa, Giardia lamblia
DGYT

SEQ ID NO: 3103617 - protein, 5 aa, Giardia lamblia
DGYTK

SEQ ID NO: 3103618 - protein, 10 aa, Giardia lamblia
DHADPNVPDN

SEQ ID NO: 3103619 - protein, 6 aa, Giardia lamblia
DHAEQG

SEQ ID NO: 3103620 - protein, 12 aa, Giardia lamblia
DHAEQVQKNDQS

SEQ ID NO: 3103621 - protein, 4 aa, Giardia lamblia
DHAT

SEQ ID NO: 3103622 - protein, 4 aa, Giardia lamblia
DHDG

SEQ ID NO: 3103623 - protein, 6 aa, Giardia lamblia
DHDPHR

SEQ ID NO: 3103624 - protein, 6 aa, Giardia lamblia
DHEDYE

SEQ ID NO: 3103625 - protein, 12 aa, Giardia lamblia
DHEGEVANQDKN

SEQ ID NO: 3103626 - protein, 5 aa, Giardia lamblia
DHEIE

SEQ ID NO: 3103627 - protein, 8 aa, Giardia lamblia
DHERATLE

SEQ ID NO: 3103628 - protein, 12 aa, Giardia lamblia
DHETALRRQKQD

SEQ ID NO: 3103629 - protein, 4 aa, Giardia lamblia
DHEY

SEQ ID NO: 3103630 - protein, 6 aa, Giardia lamblia
DHFPDQ

SEQ ID NO: 3103631 - protein, 16 aa, Giardia lamblia
DHGERTGSIAGGGRYD

SEQ ID NO: 3103632 - protein, 6 aa, Giardia lamblia
DHGETG

SEQ ID NO: 3103633 - protein, 8 aa, Giardia lamblia
DHGQRTEA

SEQ ID NO: 3103634 - protein, 10 aa, Giardia lamblia
DHGVQTNSYD

SEQ ID NO: 3103635 - protein, 10 aa, Giardia lamblia
DHKAKAPKKQ

SEQ ID NO: 3103636 - protein, 9 aa, Giardia lamblia
DHKDGKDMH

SEQ ID NO: 3103637 - protein, 6 aa, Giardia lamblia
DHKKCD

SEQ ID NO: 3103638 - protein, 23 aa, Giardia lamblia
DHKSNAPAESPGSAREPAQEEKT

SEQ ID NO: 3103639 - protein, 7 aa, Giardia lamblia
DHLEKKE

SEQ ID NO: 3103640 - protein, 12 aa, Giardia lamblia
DHLGSDASSVSA

SEQ ID NO: 3103641 - protein, 8 aa, Giardia lamblia
DHLNPKST

SEQ ID NO: 3103642 - protein, 7 aa, Giardia lamblia
DHLPRGT

SEQ ID NO: 3103643 - protein, 5 aa, Giardia lamblia
DHNGG

SEQ ID NO: 3103644 - protein, 9 aa, Giardia lamblia
DHNQSPRNL

SEQ ID NO: 3103645 - protein, 15 aa, Giardia lamblia
DHPAAAEAAVKEYSN

SEQ ID NO: 3103646 - protein, 8 aa, Giardia lamblia
DHPEDAAA

SEQ ID NO: 3103647 - protein, 6 aa, Giardia lamblia
DHPSPV

SEQ ID NO: 3103648 - protein, 6 aa, Giardia lamblia
DHPTAR

SEQ ID NO: 3103649 - protein, 4 aa, Giardia lamblia
DHQE

SEQ ID NO: 3103650 - protein, 5 aa, Giardia lamblia
DHQFE

SEQ ID NO: 3103651 - protein, 5 aa, Giardia lamblia
DHQPS

SEQ ID NO: 3103652 - protein, 15 aa, Giardia lamblia
DHQQSTNITSNDPEC

SEQ ID NO: 3103653 - protein, 7 aa, Giardia lamblia
DHQRPDF

SEQ ID NO: 3103654 - protein, 17 aa, Giardia lamblia
DHQTTTERDSNQLTSSE

SEQ ID NO: 3103655 - protein, 4 aa, Giardia lamblia
DHRR

SEQ ID NO: 3103656 - protein, 12 aa, Giardia lamblia
DHRRAGTSFTEG

SEQ ID NO: 3103657 - protein, 6 aa, Giardia lamblia
DHSGGT

SEQ ID NO: 3103658 - protein, 7 aa, Giardia lamblia
DHSGTTP

SEQ ID NO: 3103659 - protein, 12 aa, Giardia lamblia
DHSKARMEEART

SEQ ID NO: 3103660 - protein, 7 aa, Giardia lamblia
DHSPGTT

SEQ ID NO: 3103661 - protein, 13 aa, Giardia lamblia
DHSRNAAGEGHAP

SEQ ID NO: 3103662 - protein, 6 aa, Giardia lamblia
DHSRPE

SEQ ID NO: 3103663 - protein, 7 aa, Giardia lamblia
DHSRQDK

SEQ ID NO: 3103664 - protein, 10 aa, Giardia lamblia
DHSSDSPIQS

SEQ ID NO: 3103665 - protein, 6 aa, Giardia lamblia
DHSSGA

SEQ ID NO: 3103666 - protein, 5 aa, Giardia lamblia
DHSSY

SEQ ID NO: 3103667 - protein, 29 aa, Giardia lamblia
DHTDRVEKTKIQKPKQKRLTVEESKYQRR

SEQ ID NO: 3103668 - protein, 15 aa, Giardia lamblia
DHTSGSYNPAEYDSS

SEQ ID NO: 3103669 - protein, 16 aa, Giardia lamblia
DHTSPVSSVDTHQPTL

SEQ ID NO: 3103670 - protein, 7 aa, Giardia lamblia
DHTTIEP

SEQ ID NO: 3103671 - protein, 6 aa, Giardia lamblia
DHVEES

SEQ ID NO: 3103672 - protein, 9 aa, Giardia lamblia
DHVPDGRAL

SEQ ID NO: 3103673 - protein, 10 aa, Giardia lamblia
DHVSPNRNYE

SEQ ID NO: 3103674 - protein, 4 aa, Giardia lamblia
DHYS

SEQ ID NO: 3103675 - protein, 7 aa, Giardia lamblia
DIAKEKS

SEQ ID NO: 3103676 - protein, 12 aa, Giardia lamblia
DIASTSPQGRTK

SEQ ID NO: 3103677 - protein, 74 aa, Giardia lamblia
DIATKKKRDSSFPAGDSNSSNLDNDASDDEISNQPGSGSESNEDNQTATPRSHASKAERKSSRQLQTRARTESS

SEQ ID NO: 3103678 - protein, 7 aa, Giardia lamblia
DIATPGK

SEQ ID NO: 3103679 - protein, 10 aa, Giardia lamblia
DICNQEDDAT

SEQ ID NO: 3103680 - protein, 16 aa, Giardia lamblia
DIDDKRRNAADTRQRY

SEQ ID NO: 3103681 - protein, 7 aa, Giardia lamblia
DIDEGVA

SEQ ID NO: 3103682 - protein, 5 aa, Giardia lamblia
DIDET

SEQ ID NO: 3103683 - protein, 8 aa, Giardia lamblia
DIDGEGQI

SEQ ID NO: 3103684 - protein, 6 aa, Giardia lamblia
DIDGKT

SEQ ID NO: 3103685 - protein, 4 aa, Giardia lamblia
DIDP

SEQ ID NO: 3103686 - protein, 10 aa, Giardia lamblia
DIDPREKAMS

SEQ ID NO: 3103687 - protein, 7 aa, Giardia lamblia
DIDPTNE

SEQ ID NO: 3103688 - protein, 4 aa, Giardia lamblia
DIDQ

SEQ ID NO: 3103689 - protein, 12 aa, Giardia lamblia
DIEAAKRAVPAE

SEQ ID NO: 3103690 - protein, 6 aa, Giardia lamblia
DIEDAP

SEQ ID NO: 3103691 - protein, 4 aa, Giardia lamblia
DIEE

SEQ ID NO: 3103692 - protein, 12 aa, Giardia lamblia
DIEGAKSKPLYT

SEQ ID NO: 3103693 - protein, 8 aa, Giardia lamblia
DIEGHEEE

SEQ ID NO: 3103694 - protein, 15 aa, Giardia lamblia
DIEGSSLNPVSREYP

SEQ ID NO: 3103695 - protein, 10 aa, Giardia lamblia
DIERRDKDEL

SEQ ID NO: 3103696 - protein, 4 aa, Giardia lamblia
DIES

SEQ ID NO: 3103697 - protein, 20 aa, Giardia lamblia
DIETLEDSGSNDLNLKGTAR

SEQ ID NO: 3103698 - protein, 11 aa, Giardia lamblia
DIETTEDGRST

SEQ ID NO: 3103699 - protein, 7 aa, Giardia lamblia
DIGAGNY

SEQ ID NO: 3103700 - protein, 5 aa, Giardia lamblia
DIGDE

SEQ ID NO: 3103701 - protein, 13 aa, Giardia lamblia
DIGDSVQGIKSSG

SEQ ID NO: 3103702 - protein, 12 aa, Giardia lamblia
DIGGPTSEATEP

SEQ ID NO: 3103703 - protein, 6 aa, Giardia lamblia
DIGGYD

SEQ ID NO: 3103704 - protein, 10 aa, Giardia lamblia
DIGKKNKYGY

SEQ ID NO: 3103705 - protein, 5 aa, Giardia lamblia
DIGLA

SEQ ID NO: 3103706 - protein, 35 aa, Giardia lamblia
DIGSPSLSHNRPSESVSDDTLSSTSTPTFATPATD

SEQ ID NO: 3103707 - protein, 6 aa, Giardia lamblia
DIKITK

SEQ ID NO: 3103708 - protein, 8 aa, Giardia lamblia
DIKKGAEN

SEQ ID NO: 3103709 - protein, 14 aa, Giardia lamblia
DIKKQAGHENNDGY

SEQ ID NO: 3103710 - protein, 12 aa, Giardia lamblia
DIKPSNALVSGD

SEQ ID NO: 3103711 - protein, 10 aa, Giardia lamblia
DIKPSTIKSV

SEQ ID NO: 3103712 - protein, 10 aa, Giardia lamblia
DIKQTSAKFT

SEQ ID NO: 3103713 - protein, 34 aa, Giardia lamblia
DIKRTKSPKSPKRSGASEKNDNSRKERKGTSEAR

SEQ ID NO: 3103714 - protein, 9 aa, Giardia lamblia
DILTSSGNG

SEQ ID NO: 3103715 - protein, 18 aa, Giardia lamblia
DINDQTAKELAKEHGHED

SEQ ID NO: 3103716 - protein, 4 aa, Giardia lamblia
DINK

SEQ ID NO: 3103717 - protein, 26 aa, Giardia lamblia
DINSKDFRSSRIQEAAAATQSGHVSP

SEQ ID NO: 3103718 - protein, 5 aa, Giardia lamblia
DIPAS

SEQ ID NO: 3103719 - protein, 4 aa, Giardia lamblia
DIPD

SEQ ID NO: 3103720 - protein, 5 aa, Giardia lamblia
DIPDA

SEQ ID NO: 3103721 - protein, 7 aa, Giardia lamblia
DIPEAQE

SEQ ID NO: 3103722 - protein, 6 aa, Giardia lamblia
DIPENA

SEQ ID NO: 3103723 - protein, 11 aa, Giardia lamblia
DIPGEKGEEGI

SEQ ID NO: 3103724 - protein, 4 aa, Giardia lamblia
DIPH

SEQ ID NO: 3103725 - protein, 16 aa, Giardia lamblia
DIPKTGSRARYSIGNE

SEQ ID NO: 3103726 - protein, 12 aa, Giardia lamblia
DIPPEAERGTST

SEQ ID NO: 3103727 - protein, 5 aa, Giardia lamblia
DIPQA

SEQ ID NO: 3103728 - protein, 5 aa, Giardia lamblia
DIPSA

SEQ ID NO: 3103729 - protein, 6 aa, Giardia lamblia
DIPSST

SEQ ID NO: 3103730 - protein, 11 aa, Giardia lamblia
DIPTEDNGQID

SEQ ID NO: 3103731 - protein, 34 aa, Giardia lamblia
DIQASKAAEQAAKDQRLSTELSNSVKKYNQEKQE

SEQ ID NO: 3103732 - protein, 7 aa, Giardia lamblia
DIQSPEL

SEQ ID NO: 3103733 - protein, 6 aa, Giardia lamblia
DIQTAR

SEQ ID NO: 3103734 - protein, 17 aa, Giardia lamblia
DIRDGDEEDSQATPIPE

SEQ ID NO: 3103735 - protein, 6 aa, Giardia lamblia
DIREPA

SEQ ID NO: 3103736 - protein, 10 aa, Giardia lamblia
DISDNEPEPW

SEQ ID NO: 3103737 - protein, 13 aa, Giardia lamblia
DISDPSDTEPFDG

SEQ ID NO: 3103738 - protein, 18 aa, Giardia lamblia
DISDYESANLGSASAPQL

SEQ ID NO: 3103739 - protein, 4 aa, Giardia lamblia
DISH

SEQ ID NO: 3103740 - protein, 5 aa, Giardia lamblia
DISHD

SEQ ID NO: 3103741 - protein, 5 aa, Giardia lamblia
DISHT

SEQ ID NO: 3103742 - protein, 11 aa, Giardia lamblia
DISKTEAEINE

SEQ ID NO: 3103743 - protein, 5 aa, Giardia lamblia
DISNR

SEQ ID NO: 3103744 - protein, 4 aa, Giardia lamblia
DISP

SEQ ID NO: 3103745 - protein, 6 aa, Giardia lamblia
DISPTV

SEQ ID NO: 3103746 - protein, 35 aa, Giardia lamblia
DISRQTISSPVPRAISATPAALQNEGDVDHGKESA

SEQ ID NO: 3103747 - protein, 36 aa, Giardia lamblia
DISRRETKVNTKSRLHGNARVDPDDLSSASTDNLNQ

SEQ ID NO: 3103748 - protein, 9 aa, Giardia lamblia
DISSDSSHI

SEQ ID NO: 3103749 - protein, 13 aa, Giardia lamblia
DITEEGSSPHSMG

SEQ ID NO: 3103750 - protein, 4 aa, Giardia lamblia
DITG

SEQ ID NO: 3103751 - protein, 8 aa, Giardia lamblia
DITKVSSD

SEQ ID NO: 3103752 - protein, 4 aa, Giardia lamblia
DITQ

SEQ ID NO: 3103753 - protein, 7 aa, Giardia lamblia
DITRKEV

SEQ ID NO: 3103754 - protein, 5 aa, Giardia lamblia
DITTR

SEQ ID NO: 3103755 - protein, 5 aa, Giardia lamblia
DITYG

SEQ ID NO: 3103756 - protein, 10 aa, Giardia lamblia
DIVDSRGKTP

SEQ ID NO: 3103757 - protein, 23 aa, Giardia lamblia
DIVSGSKNASKAPTKGKDPAHEN

SEQ ID NO: 3103758 - protein, 11 aa, Giardia lamblia
DIYDNKGNTPL

SEQ ID NO: 3103759 - protein, 25 aa, Giardia lamblia
DIYPGRVPSAQGKKTKESEEDIPAK

SEQ ID NO: 3103760 - protein, 8 aa, Giardia lamblia
DKAAGDMD

SEQ ID NO: 3103761 - protein, 10 aa, Giardia lamblia
DKAASEDTNY

SEQ ID NO: 3103762 - protein, 7 aa, Giardia lamblia
DKADNSA

SEQ ID NO: 3103763 - protein, 8 aa, Giardia lamblia
DKAGTKAL

SEQ ID NO: 3103764 - protein, 28 aa, Giardia lamblia
DKAIDEASTLTSKLASSEEDNAKTEAKF

SEQ ID NO: 3103765 - protein, 8 aa, Giardia lamblia
DKAISESK

SEQ ID NO: 3103766 - protein, 8 aa, Giardia lamblia
DKAKAIED

SEQ ID NO: 3103767 - protein, 8 aa, Giardia lamblia
DKAKRYGK

SEQ ID NO: 3103768 - protein, 8 aa, Giardia lamblia
DKAKTGQL

SEQ ID NO: 3103769 - protein, 6 aa, Giardia lamblia
DKANAR

SEQ ID NO: 3103770 - protein, 10 aa, Giardia lamblia
DKAPTPDANL

SEQ ID NO: 3103771 - protein, 7 aa, Giardia lamblia
DKAQPIR

SEQ ID NO: 3103772 - protein, 7 aa, Giardia lamblia
DKASDHN

SEQ ID NO: 3103773 - protein, 11 aa, Giardia lamblia
DKASEEAKKRL

SEQ ID NO: 3103774 - protein, 7 aa, Giardia lamblia
DKASINE

SEQ ID NO: 3103775 - protein, 26 aa, Giardia lamblia
DKASISKKKKTDRAAKSASSIDSRGT

SEQ ID NO: 3103776 - protein, 4 aa, Giardia lamblia
DKAT

SEQ ID NO: 3103777 - protein, 80 aa, Giardia lamblia
DKATEGGKPMKKSSDTASTASIQQPKPAEKRQKPPQSTSVVPAPNPNGRNRPHEKDDKRPAEPKRTSASATPESDTIAQP

SEQ ID NO: 3103778 - protein, 18 aa, Giardia lamblia
DKATGEEYHPDENENEEV

SEQ ID NO: 3103779 - protein, 9 aa, Giardia lamblia
DKATQTSAA

SEQ ID NO: 3103780 - protein, 7 aa, Giardia lamblia
DKATTDY

SEQ ID NO: 3103781 - protein, 55 aa, Giardia lamblia
DKAVSSVGVNTSSVDSVSVSTSMPPAPAEAASRPSTNERTSSKGKAKSVSVSTTT

SEQ ID NO: 3103782 - protein, 8 aa, Giardia lamblia
DKCGNSYK

SEQ ID NO: 3103783 - protein, 7 aa, Giardia lamblia
DKDAELE

SEQ ID NO: 3103784 - protein, 8 aa, Giardia lamblia
DKDAQISK

SEQ ID NO: 3103785 - protein, 6 aa, Giardia lamblia
DKDDEI

SEQ ID NO: 3103786 - protein, 9 aa, Giardia lamblia
DKDEAIESI

SEQ ID NO: 3103787 - protein, 4 aa, Giardia lamblia
DKDG

SEQ ID NO: 3103788 - protein, 5 aa, Giardia lamblia
DKDGH

SEQ ID NO: 3103789 - protein, 6 aa, Giardia lamblia
DKDGLT

SEQ ID NO: 3103790 - protein, 5 aa, Giardia lamblia
DKDGW

SEQ ID NO: 3103791 - protein, 35 aa, Giardia lamblia
DKDIHKQSSTSRSDTTDTDPVSQNSSPSNNALDGN

SEQ ID NO: 3103792 - protein, 9 aa, Giardia lamblia
DKDKQSMQA

SEQ ID NO: 3103793 - protein, 4 aa, Giardia lamblia
DKDP

SEQ ID NO: 3103794 - protein, 7 aa, Giardia lamblia
DKDPTLT

SEQ ID NO: 3103795 - protein, 9 aa, Giardia lamblia
DKDRELDDL

SEQ ID NO: 3103796 - protein, 6 aa, Giardia lamblia
DKDRET

SEQ ID NO: 3103797 - protein, 11 aa, Giardia lamblia
DKDSPYSGQTH

SEQ ID NO: 3103798 - protein, 10 aa, Giardia lamblia
DKDSVDAAKA

SEQ ID NO: 3103799 - protein, 9 aa, Giardia lamblia
DKDTGEQLT

SEQ ID NO: 3103800 - protein, 6 aa, Giardia lamblia
DKDTKY

SEQ ID NO: 3103801 - protein, 4 aa, Giardia lamblia
DKDY

SEQ ID NO: 3103802 - protein, 9 aa, Giardia lamblia
DKEAEVESM

SEQ ID NO: 3103803 - protein, 6 aa, Giardia lamblia
DKEAKT

SEQ ID NO: 3103804 - protein, 4 aa, Giardia lamblia
DKED

SEQ ID NO: 3103805 - protein, 10 aa, Giardia lamblia
DKEEESIGTS

SEQ ID NO: 3103806 - protein, 7 aa, Giardia lamblia
DKEELRI

SEQ ID NO: 3103807 - protein, 8 aa, Giardia lamblia
DKEETRLG

SEQ ID NO: 3103808 - protein, 8 aa, Giardia lamblia
DKEETSRT

SEQ ID NO: 3103809 - protein, 6 aa, Giardia lamblia
DKEIDS

SEQ ID NO: 3103810 - protein, 7 aa, Giardia lamblia
DKEIPED

SEQ ID NO: 3103811 - protein, 7 aa, Giardia lamblia
DKEKINA

SEQ ID NO: 3103812 - protein, 6 aa, Giardia lamblia
DKELDD

SEQ ID NO: 3103813 - protein, 7 aa, Giardia lamblia
DKENNQF

SEQ ID NO: 3103814 - protein, 4 aa, Giardia lamblia
DKEQ

SEQ ID NO: 3103815 - protein, 9 aa, Giardia lamblia
DKEQAYRRQ

SEQ ID NO: 3103816 - protein, 17 aa, Giardia lamblia
DKEQHKIQSCSSADDHT

SEQ ID NO: 3103817 - protein, 4 aa, Giardia lamblia
DKER

SEQ ID NO: 3103818 - protein, 8 aa, Giardia lamblia
DKEREHRE

SEQ ID NO: 3103819 - protein, 40 aa, Giardia lamblia
DKEREVANGLEEEEVTAAEGDDAPDDAAEQGDAEQRALEA

SEQ ID NO: 3103820 - protein, 6 aa, Giardia lamblia
DKERQG

SEQ ID NO: 3103821 - protein, 6 aa, Giardia lamblia
DKERWR

SEQ ID NO: 3103822 - protein, 6 aa, Giardia lamblia
DKESGQ

SEQ ID NO: 3103823 - protein, 10 aa, Giardia lamblia
DKESSDNDTW

SEQ ID NO: 3103824 - protein, 12 aa, Giardia lamblia
DKESYAKHVSGK

SEQ ID NO: 3103825 - protein, 4 aa, Giardia lamblia
DKET

SEQ ID NO: 3103826 - protein, 7 aa, Giardia lamblia
DKETGGV

SEQ ID NO: 3103827 - protein, 21 aa, Giardia lamblia
DKETKQDTPSELDTDKQDDEL

SEQ ID NO: 3103828 - protein, 7 aa, Giardia lamblia
DKETTYR

SEQ ID NO: 3103829 - protein, 6 aa, Giardia lamblia
DKETYT

SEQ ID NO: 3103830 - protein, 4 aa, Giardia lamblia
DKEW

SEQ ID NO: 3103831 - protein, 21 aa, Giardia lamblia
DKGDDQGNRYATEGTSKPFTV

SEQ ID NO: 3103832 - protein, 10 aa, Giardia lamblia
DKGDYKNNPE

SEQ ID NO: 3103833 - protein, 12 aa, Giardia lamblia
DKGETGIPSSSV

SEQ ID NO: 3103834 - protein, 6 aa, Giardia lamblia
DKGGHL

SEQ ID NO: 3103835 - protein, 16 aa, Giardia lamblia
DKGKERNNRAEDDGEL

SEQ ID NO: 3103836 - protein, 7 aa, Giardia lamblia
DKGKYSI

SEQ ID NO: 3103837 - protein, 14 aa, Giardia lamblia
DKGLPQDGESRTRF

SEQ ID NO: 3103838 - protein, 6 aa, Giardia lamblia
DKGLQT

SEQ ID NO: 3103839 - protein, 11 aa, Giardia lamblia
DKGNGEQNVTS

SEQ ID NO: 3103840 - protein, 5 aa, Giardia lamblia
DKGNM

SEQ ID NO: 3103841 - protein, 9 aa, Giardia lamblia
DKGTDGDAL

SEQ ID NO: 3103842 - protein, 7 aa, Giardia lamblia
DKGTEAT

SEQ ID NO: 3103843 - protein, 10 aa, Giardia lamblia
DKGVSQETKE

SEQ ID NO: 3103844 - protein, 15 aa, Giardia lamblia
DKGYYTARDVPRTDF

SEQ ID NO: 3103845 - protein, 8 aa, Giardia lamblia
DKHKNQRY

SEQ ID NO: 3103846 - protein, 12 aa, Giardia lamblia
DKIANGENSFPA

SEQ ID NO: 3103847 - protein, 38 aa, Giardia lamblia
DKIATSEEGNPKDEPHANDQQCSADSFSEKDAHSSKQL

SEQ ID NO: 3103848 - protein, 13 aa, Giardia lamblia
DKIEEAGACTQTD

SEQ ID NO: 3103849 - protein, 11 aa, Giardia lamblia
DKIKDAASRLN

SEQ ID NO: 3103850 - protein, 7 aa, Giardia lamblia
DKINESM

SEQ ID NO: 3103851 - protein, 7 aa, Giardia lamblia
DKIQENL

SEQ ID NO: 3103852 - protein, 14 aa, Giardia lamblia
DKISTGKLTKDEVI

SEQ ID NO: 3103853 - protein, 8 aa, Giardia lamblia
DKITAKNS

SEQ ID NO: 3103854 - protein, 14 aa, Giardia lamblia
DKKASRKAAEAGMQ

SEQ ID NO: 3103855 - protein, 10 aa, Giardia lamblia
DKKDSDASAI

SEQ ID NO: 3103856 - protein, 4 aa, Giardia lamblia
DKKE

SEQ ID NO: 3103857 - protein, 9 aa, Giardia lamblia
DKKEKDTAL

SEQ ID NO: 3103858 - protein, 7 aa, Giardia lamblia
DKKGQTA

SEQ ID NO: 3103859 - protein, 6 aa, Giardia lamblia
DKKGRT

SEQ ID NO: 3103860 - protein, 7 aa, Giardia lamblia
DKKGRTA

SEQ ID NO: 3103861 - protein, 47 aa, Giardia lamblia
DKKGSAANASRNSVRSSSKSRSRSSASSSKHVSSSHKSSQKTSKVSA

SEQ ID NO: 3103862 - protein, 29 aa, Giardia lamblia
DKKKEAKEKKLAAKENREAPKALSEGPLK

SEQ ID NO: 3103863 - protein, 11 aa, Giardia lamblia
DKKPDSCSKSA

SEQ ID NO: 3103864 - protein, 7 aa, Giardia lamblia
DKKRNVA

SEQ ID NO: 3103865 - protein, 7 aa, Giardia lamblia
DKKSIRH

SEQ ID NO: 3103866 - protein, 26 aa, Giardia lamblia
DKKSSKGSIPSPTTSTQSLTGQPSLD

SEQ ID NO: 3103867 - protein, 4 aa, Giardia lamblia
DKKT

SEQ ID NO: 3103868 - protein, 5 aa, Giardia lamblia
DKKTG

SEQ ID NO: 3103869 - protein, 10 aa, Giardia lamblia
DKKTKEALDT

SEQ ID NO: 3103870 - protein, 6 aa, Giardia lamblia
DKKVRG

SEQ ID NO: 3103871 - protein, 19 aa, Giardia lamblia
DKLAPPPKLSRKARRRRSL

SEQ ID NO: 3103872 - protein, 4 aa, Giardia lamblia
DKLG

SEQ ID NO: 3103873 - protein, 9 aa, Giardia lamblia
DKLGNTYQS

SEQ ID NO: 3103874 - protein, 40 aa, Giardia lamblia
DKLKDTGPPVRQQSSRSARAKALPKEAYQGVKRSAPRLDP

SEQ ID NO: 3103875 - protein, 7 aa, Giardia lamblia
DKLKEKD

SEQ ID NO: 3103876 - protein, 9 aa, Giardia lamblia
DKLNQEKET

SEQ ID NO: 3103877 - protein, 7 aa, Giardia lamblia
DKLQGNS

SEQ ID NO: 3103878 - protein, 8 aa, Giardia lamblia
DKLRENRR

SEQ ID NO: 3103879 - protein, 14 aa, Giardia lamblia
DKLTAETNQVKQKS

SEQ ID NO: 3103880 - protein, 12 aa, Giardia lamblia
DKLTESKVQAEA

SEQ ID NO: 3103881 - protein, 13 aa, Giardia lamblia
DKLTGTIEATDEY

SEQ ID NO: 3103882 - protein, 8 aa, Giardia lamblia
DKLTNRQT

SEQ ID NO: 3103883 - protein, 9 aa, Giardia lamblia
DKMTETVGG

SEQ ID NO: 3103884 - protein, 13 aa, Giardia lamblia
DKNAQGSLPGFDS

SEQ ID NO: 3103885 - protein, 24 aa, Giardia lamblia
DKNAQVSPTTNPTSTDVICTDLSK

SEQ ID NO: 3103886 - protein, 6 aa, Giardia lamblia
DKNEEI

SEQ ID NO: 3103887 - protein, 9 aa, Giardia lamblia
DKNGKTAYQ

SEQ ID NO: 3103888 - protein, 7 aa, Giardia lamblia
DKNNKKN

SEQ ID NO: 3103889 - protein, 12 aa, Giardia lamblia
DKNNPETDPSEI

SEQ ID NO: 3103890 - protein, 7 aa, Giardia lamblia
DKNPDVS

SEQ ID NO: 3103891 - protein, 9 aa, Giardia lamblia
DKNPSLRTG

SEQ ID NO: 3103892 - protein, 23 aa, Giardia lamblia
DKNQKRSKSKQGGLEAEKEDDME

SEQ ID NO: 3103893 - protein, 7 aa, Giardia lamblia
DKNRALE

SEQ ID NO: 3103894 - protein, 9 aa, Giardia lamblia
DKNRTQTKM

SEQ ID NO: 3103895 - protein, 19 aa, Giardia lamblia
DKNRTVASTNMNATSSRSH

SEQ ID NO: 3103896 - protein, 14 aa, Giardia lamblia
DKNTSNEVSQSTRV

SEQ ID NO: 3103897 - protein, 9 aa, Giardia lamblia
DKPAVSGRE

SEQ ID NO: 3103898 - protein, 8 aa, Giardia lamblia
DKPDGRGM

SEQ ID NO: 3103899 - protein, 15 aa, Giardia lamblia
DKPDQNLSDAVEARQ

SEQ ID NO: 3103900 - protein, 6 aa, Giardia lamblia
DKPGAS

SEQ ID NO: 3103901 - protein, 7 aa, Giardia lamblia
DKPPDME

SEQ ID NO: 3103902 - protein, 16 aa, Giardia lamblia
DKPPVQSSTMGSFGST

SEQ ID NO: 3103903 - protein, 12 aa, Giardia lamblia
DKPRAPTTARGK

SEQ ID NO: 3103904 - protein, 8 aa, Giardia lamblia
DKPYNNKS

SEQ ID NO: 3103905 - protein, 4 aa, Giardia lamblia
DKQA

SEQ ID NO: 3103906 - protein, 20 aa, Giardia lamblia
DKQAGGKCEKTKKEYGISDD

SEQ ID NO: 3103907 - protein, 15 aa, Giardia lamblia
DKQAHEKKKASMKAA

SEQ ID NO: 3103908 - protein, 4 aa, Giardia lamblia
DKQE

SEQ ID NO: 3103909 - protein, 7 aa, Giardia lamblia
DKQEREQ

SEQ ID NO: 3103910 - protein, 6 aa, Giardia lamblia
DKQGRV

SEQ ID NO: 3103911 - protein, 12 aa, Giardia lamblia
DKQISQTENAIT

SEQ ID NO: 3103912 - protein, 7 aa, Giardia lamblia
DKQKARD

SEQ ID NO: 3103913 - protein, 9 aa, Giardia lamblia
DKQKSQTID

SEQ ID NO: 3103914 - protein, 16 aa, Giardia lamblia
DKQMSQGENSINSSGL

SEQ ID NO: 3103915 - protein, 13 aa, Giardia lamblia
DKQQKLQDYDGKT

SEQ ID NO: 3103916 - protein, 15 aa, Giardia lamblia
DKQRAKGQQAGAEQV

SEQ ID NO: 3103917 - protein, 7 aa, Giardia lamblia
DKQSRRA

SEQ ID NO: 3103918 - protein, 6 aa, Giardia lamblia
DKRDYI

SEQ ID NO: 3103919 - protein, 8 aa, Giardia lamblia
DKREPTWD

SEQ ID NO: 3103920 - protein, 41 aa, Giardia lamblia
DKREQTDRTDAGPPFNTADGTPPTSDAHAAANNRETKTPFY

SEQ ID NO: 3103921 - protein, 13 aa, Giardia lamblia
DKRFEGDNMSKSQ

SEQ ID NO: 3103922 - protein, 7 aa, Giardia lamblia
DKRITNT

SEQ ID NO: 3103923 - protein, 14 aa, Giardia lamblia
DKRLQEAQRHAKEQ

SEQ ID NO: 3103924 - protein, 45 aa, Giardia lamblia
DKRNAKSARRGGGGRGGGGGRGDRGYGGDRGYGGGRGGYGGDRGR

SEQ ID NO: 3103925 - protein, 8 aa, Giardia lamblia
DKRNGRGT

SEQ ID NO: 3103926 - protein, 6 aa, Giardia lamblia
DKRPPV

SEQ ID NO: 3103927 - protein, 17 aa, Giardia lamblia
DKRPRPDGRRAIKRSIK

SEQ ID NO: 3103928 - protein, 7 aa, Giardia lamblia
DKRQDEI

SEQ ID NO: 3103929 - protein, 14 aa, Giardia lamblia
DKRQEGKALGIGSS

SEQ ID NO: 3103930 - protein, 14 aa, Giardia lamblia
DKRQIRQKREKDGI

SEQ ID NO: 3103931 - protein, 8 aa, Giardia lamblia
DKRQKTDG

SEQ ID NO: 3103932 - protein, 48 aa, Giardia lamblia
DKRRPSTEDAQPSAEYRTASSIEAESTSVNSHQEDRSRSVERQQQSIE

SEQ ID NO: 3103933 - protein, 7 aa, Giardia lamblia
DKRRTPD

SEQ ID NO: 3103934 - protein, 18 aa, Giardia lamblia
DKRSSRQENCQNDDPSIN

SEQ ID NO: 3103935 - protein, 6 aa, Giardia lamblia
DKRTDS

SEQ ID NO: 3103936 - protein, 18 aa, Giardia lamblia
DKSAENSDDIDDKSPDDF

SEQ ID NO: 3103937 - protein, 5 aa, Giardia lamblia
DKSAK

SEQ ID NO: 3103938 - protein, 5 aa, Giardia lamblia
DKSAT

SEQ ID NO: 3103939 - protein, 4 aa, Giardia lamblia
DKSD

SEQ ID NO: 3103940 - protein, 9 aa, Giardia lamblia
DKSDKNAYA

SEQ ID NO: 3103941 - protein, 5 aa, Giardia lamblia
DKSDT

SEQ ID NO: 3103942 - protein, 6 aa, Giardia lamblia
DKSEAD

SEQ ID NO: 3103943 - protein, 4 aa, Giardia lamblia
DKSF

SEQ ID NO: 3103944 - protein, 21 aa, Giardia lamblia
DKSFKERAKLDSDKHKTNTAM

SEQ ID NO: 3103945 - protein, 6 aa, Giardia lamblia
DKSGDT

SEQ ID NO: 3103946 - protein, 5 aa, Giardia lamblia
DKSGE

SEQ ID NO: 3103947 - protein, 6 aa, Giardia lamblia
DKSGRT

SEQ ID NO: 3103948 - protein, 7 aa, Giardia lamblia
DKSGTLD

SEQ ID NO: 3103949 - protein, 7 aa, Giardia lamblia
DKSGTTA

SEQ ID NO: 3103950 - protein, 4 aa, Giardia lamblia
DKSI

SEQ ID NO: 3103951 - protein, 18 aa, Giardia lamblia
DKSIGEKKHKRQHQGPNH

SEQ ID NO: 3103952 - protein, 12 aa, Giardia lamblia
DKSNDSKSGAHI

SEQ ID NO: 3103953 - protein, 5 aa, Giardia lamblia
DKSNI

SEQ ID NO: 3103954 - protein, 4 aa, Giardia lamblia
DKSR

SEQ ID NO: 3103955 - protein, 25 aa, Giardia lamblia
DKSRPRTPPMCGPKRSTADPSENVF

SEQ ID NO: 3103956 - protein, 7 aa, Giardia lamblia
DKSRYES

SEQ ID NO: 3103957 - protein, 9 aa, Giardia lamblia
DKSSEDVRS

SEQ ID NO: 3103958 - protein, 5 aa, Giardia lamblia
DKSTL

SEQ ID NO: 3103959 - protein, 9 aa, Giardia lamblia
DKSTSKKER

SEQ ID NO: 3103960 - protein, 11 aa, Giardia lamblia
DKSTSSDVSPV

SEQ ID NO: 3103961 - protein, 4 aa, Giardia lamblia
DKSY

SEQ ID NO: 3103962 - protein, 4 aa, Giardia lamblia
DKTA

SEQ ID NO: 3103963 - protein, 10 aa, Giardia lamblia
DKTCGNERTK

SEQ ID NO: 3103964 - protein, 7 aa, Giardia lamblia
DKTDPNY

SEQ ID NO: 3103965 - protein, 6 aa, Giardia lamblia
DKTGGV

SEQ ID NO: 3103966 - protein, 8 aa, Giardia lamblia
DKTIAETS

SEQ ID NO: 3103967 - protein, 7 aa, Giardia lamblia
DKTKAGF

SEQ ID NO: 3103968 - protein, 17 aa, Giardia lamblia
DKTKGAQKSQKKEPFSK

SEQ ID NO: 3103969 - protein, 9 aa, Giardia lamblia
DKTMTESER

SEQ ID NO: 3103970 - protein, 8 aa, Giardia lamblia
DKTNANEF

SEQ ID NO: 3103971 - protein, 8 aa, Giardia lamblia
DKTNRWPA

SEQ ID NO: 3103972 - protein, 12 aa, Giardia lamblia
DKTNTANLPVPR

SEQ ID NO: 3103973 - protein, 9 aa, Giardia lamblia
DKTPSEEMQ

SEQ ID NO: 3103974 - protein, 9 aa, Giardia lamblia
DKTQNPDDP

SEQ ID NO: 3103975 - protein, 5 aa, Giardia lamblia
DKTRA

SEQ ID NO: 3103976 - protein, 9 aa, Giardia lamblia
DKTSKARKV

SEQ ID NO: 3103977 - protein, 9 aa, Giardia lamblia
DKTSTEPTV

SEQ ID NO: 3103978 - protein, 7 aa, Giardia lamblia
DKTTGQS

SEQ ID NO: 3103979 - protein, 7 aa, Giardia lamblia
DKTTVTK

SEQ ID NO: 3103980 - protein, 4 aa, Giardia lamblia
DKTV

SEQ ID NO: 3103981 - protein, 7 aa, Giardia lamblia
DKTYATK

SEQ ID NO: 3103982 - protein, 7 aa, Giardia lamblia
DKTYRTP

SEQ ID NO: 3103983 - protein, 4 aa, Giardia lamblia
DKVA

SEQ ID NO: 3103984 - protein, 9 aa, Giardia lamblia
DKVQDNGSL

SEQ ID NO: 3103985 - protein, 7 aa, Giardia lamblia
DKVQPYP

SEQ ID NO: 3103986 - protein, 4 aa, Giardia lamblia
DKVR

SEQ ID NO: 3103987 - protein, 6 aa, Giardia lamblia
DKYGNT

SEQ ID NO: 3103988 - protein, 6 aa, Giardia lamblia
DKYGQT

SEQ ID NO: 3103989 - protein, 15 aa, Giardia lamblia
DKYPKSRSSSRQHKS

SEQ ID NO: 3103990 - protein, 7 aa, Giardia lamblia
DKYPSGF

SEQ ID NO: 3103991 - protein, 6 aa, Giardia lamblia
DKYPSV

SEQ ID NO: 3103992 - protein, 12 aa, Giardia lamblia
DKYRPSGSCQAS

SEQ ID NO: 3103993 - protein, 12 aa, Giardia lamblia
DLAAAKKKSEQL

SEQ ID NO: 3103994 - protein, 11 aa, Giardia lamblia
DLADKHRKSEE

SEQ ID NO: 3103995 - protein, 6 aa, Giardia lamblia
DLAEAK

SEQ ID NO: 3103996 - protein, 12 aa, Giardia lamblia
DLAEKEDTITSL

SEQ ID NO: 3103997 - protein, 12 aa, Giardia lamblia
DLAGPSVRTPKP

SEQ ID NO: 3103998 - protein, 7 aa, Giardia lamblia
DLAGQTH

SEQ ID NO: 3103999 - protein, 8 aa, Giardia lamblia
DLAGSPRL

SEQ ID NO: 3104000 - protein, 7 aa, Giardia lamblia
DLAPSPV

SEQ ID NO: 3104001 - protein, 40 aa, Giardia lamblia
DLARSSSNTATHQPPPTSESHLDTTKATRDTFGTLTTDES

SEQ ID NO: 3104002 - protein, 8 aa, Giardia lamblia
DLASAKDE

SEQ ID NO: 3104003 - protein, 10 aa, Giardia lamblia
DLASPEQRQL

SEQ ID NO: 3104004 - protein, 22 aa, Giardia lamblia
DLASTERLQSDGSNRPGSDDDL

SEQ ID NO: 3104005 - protein, 10 aa, Giardia lamblia
DLATALKPSD

SEQ ID NO: 3104006 - protein, 5 aa, Giardia lamblia
DLATH

SEQ ID NO: 3104007 - protein, 6 aa, Giardia lamblia
DLATTY

SEQ ID NO: 3104008 - protein, 5 aa, Giardia lamblia
DLDAP

SEQ ID NO: 3104009 - protein, 5 aa, Giardia lamblia
DLDAQ

SEQ ID NO: 3104010 - protein, 8 aa, Giardia lamblia
DLDDKSTE

SEQ ID NO: 3104011 - protein, 14 aa, Giardia lamblia
DLDEAAKAKERLSD

SEQ ID NO: 3104012 - protein, 7 aa, Giardia lamblia
DLDEATK

SEQ ID NO: 3104013 - protein, 4 aa, Giardia lamblia
DLDG

SEQ ID NO: 3104014 - protein, 11 aa, Giardia lamblia
DLDKSTRDVDD

SEQ ID NO: 3104015 - protein, 5 aa, Giardia lamblia
DLDPD

SEQ ID NO: 3104016 - protein, 16 aa, Giardia lamblia
DLDPGNLDHSQTSPKQ

SEQ ID NO: 3104017 - protein, 10 aa, Giardia lamblia
DLDQRGTSST

SEQ ID NO: 3104018 - protein, 14 aa, Giardia lamblia
DLDQSNSAESTDST

SEQ ID NO: 3104019 - protein, 11 aa, Giardia lamblia
DLDQSSPPLKR

SEQ ID NO: 3104020 - protein, 7 aa, Giardia lamblia
DLDTDGA

SEQ ID NO: 3104021 - protein, 10 aa, Giardia lamblia
DLDTNNASIQ

SEQ ID NO: 3104022 - protein, 14 aa, Giardia lamblia
DLEEEQDESKEEAV

SEQ ID NO: 3104023 - protein, 12 aa, Giardia lamblia
DLEEQRSKAELK

SEQ ID NO: 3104024 - protein, 4 aa, Giardia lamblia
DLEG

SEQ ID NO: 3104025 - protein, 5 aa, Giardia lamblia
DLEGR

SEQ ID NO: 3104026 - protein, 12 aa, Giardia lamblia
DLEPKRIEDARN

SEQ ID NO: 3104027 - protein, 8 aa, Giardia lamblia
DLEPNTTI

SEQ ID NO: 3104028 - protein, 8 aa, Giardia lamblia
DLERAERE

SEQ ID NO: 3104029 - protein, 11 aa, Giardia lamblia
DLERAKPNPLL

SEQ ID NO: 3104030 - protein, 7 aa, Giardia lamblia
DLERRRA

SEQ ID NO: 3104031 - protein, 22 aa, Giardia lamblia
DLESSDDGAAAPGATARFADKE

SEQ ID NO: 3104032 - protein, 8 aa, Giardia lamblia
DLESSQNA

SEQ ID NO: 3104033 - protein, 11 aa, Giardia lamblia
DLGAPQDQGEV

SEQ ID NO: 3104034 - protein, 24 aa, Giardia lamblia
DLGGTGNSKQLSINQNANRLSQEE

SEQ ID NO: 3104035 - protein, 12 aa, Giardia lamblia
DLGQAGVPEKLP

SEQ ID NO: 3104036 - protein, 9 aa, Giardia lamblia
DLGQQDNRG

SEQ ID NO: 3104037 - protein, 16 aa, Giardia lamblia
DLGSDSDSDSDSVSPE

SEQ ID NO: 3104038 - protein, 6 aa, Giardia lamblia
DLGSEE

SEQ ID NO: 3104039 - protein, 15 aa, Giardia lamblia
DLGSPEALDFVMKYA

SEQ ID NO: 3104040 - protein, 12 aa, Giardia lamblia
DLGTKDDDMKPD

SEQ ID NO: 3104041 - protein, 6 aa, Giardia lamblia
DLHPNP

SEQ ID NO: 3104042 - protein, 4 aa, Giardia lamblia
DLHS

SEQ ID NO: 3104043 - protein, 5 aa, Giardia lamblia
DLHTS

SEQ ID NO: 3104044 - protein, 4 aa, Giardia lamblia
DLKG

SEQ ID NO: 3104045 - protein, 12 aa, Giardia lamblia
DLKKEAKEKRSR

SEQ ID NO: 3104046 - protein, 8 aa, Giardia lamblia
DLKPQNTL

SEQ ID NO: 3104047 - protein, 5 aa, Giardia lamblia
DLKSE

SEQ ID NO: 3104048 - protein, 7 aa, Giardia lamblia
DLKSEHT

SEQ ID NO: 3104049 - protein, 12 aa, Giardia lamblia
DLKSKTPSPSGL

SEQ ID NO: 3104050 - protein, 7 aa, Giardia lamblia
DLKTKEQ

SEQ ID NO: 3104051 - protein, 12 aa, Giardia lamblia
DLKTNEGKTAYQ

SEQ ID NO: 3104052 - protein, 4 aa, Giardia lamblia
DLND

SEQ ID NO: 3104053 - protein, 4 aa, Giardia lamblia
DLNE

SEQ ID NO: 3104054 - protein, 6 aa, Giardia lamblia
DLNEDE

SEQ ID NO: 3104055 - protein, 4 aa, Giardia lamblia
DLNG

SEQ ID NO: 3104056 - protein, 8 aa, Giardia lamblia
DLPADTQL

SEQ ID NO: 3104057 - protein, 6 aa, Giardia lamblia
DLPAEL

SEQ ID NO: 3104058 - protein, 6 aa, Giardia lamblia
DLPANA

SEQ ID NO: 3104059 - protein, 8 aa, Giardia lamblia
DLPDGPLA

SEQ ID NO: 3104060 - protein, 5 aa, Giardia lamblia
DLPFP

SEQ ID NO: 3104061 - protein, 4 aa, Giardia lamblia
DLPN

SEQ ID NO: 3104062 - protein, 10 aa, Giardia lamblia
DLPPELKPAS

SEQ ID NO: 3104063 - protein, 8 aa, Giardia lamblia
DLPPPVSA

SEQ ID NO: 3104064 - protein, 9 aa, Giardia lamblia
DLPPQPEST

SEQ ID NO: 3104065 - protein, 6 aa, Giardia lamblia
DLPQGI

SEQ ID NO: 3104066 - protein, 13 aa, Giardia lamblia
DLPQKTRLSAEDR

SEQ ID NO: 3104067 - protein, 6 aa, Giardia lamblia
DLPQSQ

SEQ ID NO: 3104068 - protein, 4 aa, Giardia lamblia
DLPR

SEQ ID NO: 3104069 - protein, 9 aa, Giardia lamblia
DLPRAPPDV

SEQ ID NO: 3104070 - protein, 5 aa, Giardia lamblia
DLPRG

SEQ ID NO: 3104071 - protein, 4 aa, Giardia lamblia
DLPS

SEQ ID NO: 3104072 - protein, 12 aa, Giardia lamblia
DLPSYTEPQAVG

SEQ ID NO: 3104073 - protein, 4 aa, Giardia lamblia
DLPT

SEQ ID NO: 3104074 - protein, 13 aa, Giardia lamblia
DLPTDPERTPESM

SEQ ID NO: 3104075 - protein, 6 aa, Giardia lamblia
DLPTEN

SEQ ID NO: 3104076 - protein, 16 aa, Giardia lamblia
DLQARADVSERTAEKL

SEQ ID NO: 3104077 - protein, 9 aa, Giardia lamblia
DLQASDGKT

SEQ ID NO: 3104078 - protein, 8 aa, Giardia lamblia
DLQEDTGH

SEQ ID NO: 3104079 - protein, 7 aa, Giardia lamblia
DLQESDL

SEQ ID NO: 3104080 - protein, 5 aa, Giardia lamblia
DLQNS

SEQ ID NO: 3104081 - protein, 5 aa, Giardia lamblia
DLQPI

SEQ ID NO: 3104082 - protein, 6 aa, Giardia lamblia
DLQPNT

SEQ ID NO: 3104083 - protein, 7 aa, Giardia lamblia
DLQPPGF

SEQ ID NO: 3104084 - protein, 15 aa, Giardia lamblia
DLQQANEANSQLRAE

SEQ ID NO: 3104085 - protein, 25 aa, Giardia lamblia
DLQQGTSRAASSSRPRSYSASRAGC

SEQ ID NO: 3104086 - protein, 8 aa, Giardia lamblia
DLQRKAEE

SEQ ID NO: 3104087 - protein, 12 aa, Giardia lamblia
DLQRRLSEARDE

SEQ ID NO: 3104088 - protein, 10 aa, Giardia lamblia
DLQSDAVTPA

SEQ ID NO: 3104089 - protein, 15 aa, Giardia lamblia
DLQSKSTASSESERK

SEQ ID NO: 3104090 - protein, 8 aa, Giardia lamblia
DLQTQEKA

SEQ ID NO: 3104091 - protein, 12 aa, Giardia lamblia
DLRDTLSAGSVS

SEQ ID NO: 3104092 - protein, 5 aa, Giardia lamblia
DLRER

SEQ ID NO: 3104093 - protein, 9 aa, Giardia lamblia
DLRGENENL

SEQ ID NO: 3104094 - protein, 10 aa, Giardia lamblia
DLRKTTDKGM

SEQ ID NO: 3104095 - protein, 4 aa, Giardia lamblia
DLRN

SEQ ID NO: 3104096 - protein, 5 aa, Giardia lamblia
DLRPG

SEQ ID NO: 3104097 - protein, 8 aa, Giardia lamblia
DLRQERDE

SEQ ID NO: 3104098 - protein, 9 aa, Giardia lamblia
DLSAKSARI

SEQ ID NO: 3104099 - protein, 12 aa, Giardia lamblia
DLSAKSPGAPAA

SEQ ID NO: 3104100 - protein, 23 aa, Giardia lamblia
DLSEANRQSTNLQSSNAEKETQI

SEQ ID NO: 3104101 - protein, 30 aa, Giardia lamblia
DLSETKQALAAAQAAAHSKDQVASSVTEEL

SEQ ID NO: 3104102 - protein, 21 aa, Giardia lamblia
DLSETNTDEETDDSDSDSQSL

SEQ ID NO: 3104103 - protein, 6 aa, Giardia lamblia
DLSGAD

SEQ ID NO: 3104104 - protein, 10 aa, Giardia lamblia
DLSGPKNVSP

SEQ ID NO: 3104105 - protein, 8 aa, Giardia lamblia
DLSGTAMS

SEQ ID NO: 3104106 - protein, 28 aa, Giardia lamblia
DLSKPEENVATEKGVSGHHQTVKEDAPT

SEQ ID NO: 3104107 - protein, 5 aa, Giardia lamblia
DLSNE

SEQ ID NO: 3104108 - protein, 8 aa, Giardia lamblia
DLSNSYHT

SEQ ID NO: 3104109 - protein, 8 aa, Giardia lamblia
DLSPKPSL

SEQ ID NO: 3104110 - protein, 19 aa, Giardia lamblia
DLSPPPRTMASPSQNPRDK

SEQ ID NO: 3104111 - protein, 9 aa, Giardia lamblia
DLSPTPEAE

SEQ ID NO: 3104112 - protein, 4 aa, Giardia lamblia
DLSS

SEQ ID NO: 3104113 - protein, 7 aa, Giardia lamblia
DLSSNDR

SEQ ID NO: 3104114 - protein, 8 aa, Giardia lamblia
DLSSPQLR

SEQ ID NO: 3104115 - protein, 13 aa, Giardia lamblia
DLSSQMGQPVTAP

SEQ ID NO: 3104116 - protein, 12 aa, Giardia lamblia
DLSTPSRRGYIS

SEQ ID NO: 3104117 - protein, 5 aa, Giardia lamblia
DLTAA

SEQ ID NO: 3104118 - protein, 6 aa, Giardia lamblia
DLTAAD

SEQ ID NO: 3104119 - protein, 39 aa, Giardia lamblia
DLTAEAKRAMEEAERAKIEANTALTSANLREAKARDLEE

SEQ ID NO: 3104120 - protein, 8 aa, Giardia lamblia
DLTDPSNV

SEQ ID NO: 3104121 - protein, 24 aa, Giardia lamblia
DLTDQNQGSDPSEKVRQDQENHSP

SEQ ID NO: 3104122 - protein, 7 aa, Giardia lamblia
DLTDSTH

SEQ ID NO: 3104123 - protein, 11 aa, Giardia lamblia
DLTEDDLKKSG

SEQ ID NO: 3104124 - protein, 14 aa, Giardia lamblia
DLTEPTYKAPDGVL

SEQ ID NO: 3104125 - protein, 18 aa, Giardia lamblia
DLTEQSSPLSFQASNDAL

SEQ ID NO: 3104126 - protein, 8 aa, Giardia lamblia
DLTGGSDD

SEQ ID NO: 3104127 - protein, 10 aa, Giardia lamblia
DLTKPSPAFA

SEQ ID NO: 3104128 - protein, 5 aa, Giardia lamblia
DLTNG

SEQ ID NO: 3104129 - protein, 7 aa, Giardia lamblia
DLTPEQK

SEQ ID NO: 3104130 - protein, 20 aa, Giardia lamblia
DLTPNKSVRSGSKPESQRTS

SEQ ID NO: 3104131 - protein, 5 aa, Giardia lamblia
DLTPQ

SEQ ID NO: 3104132 - protein, 18 aa, Giardia lamblia
DLTPSGQRTYTVRAQLMQ

SEQ ID NO: 3104133 - protein, 5 aa, Giardia lamblia
DLTQT

SEQ ID NO: 3104134 - protein, 5 aa, Giardia lamblia
DLTTA

SEQ ID NO: 3104135 - protein, 21 aa, Giardia lamblia
DLTTGTDQPDKVQMKQDKKEE

SEQ ID NO: 3104136 - protein, 8 aa, Giardia lamblia
DLTTNTEH

SEQ ID NO: 3104137 - protein, 8 aa, Giardia lamblia
DLYPPTAL

SEQ ID NO: 3104138 - protein, 8 aa, Giardia lamblia
DMAAPQPL

SEQ ID NO: 3104139 - protein, 4 aa, Giardia lamblia
DMAG

SEQ ID NO: 3104140 - protein, 7 aa, Giardia lamblia
DMATAEA

SEQ ID NO: 3104141 - protein, 6 aa, Giardia lamblia
DMCSQT

SEQ ID NO: 3104142 - protein, 23 aa, Giardia lamblia
DMEDTDSIDADRESSNSEEDDCH

SEQ ID NO: 3104143 - protein, 10 aa, Giardia lamblia
DMEPSGSSSE

SEQ ID NO: 3104144 - protein, 7 aa, Giardia lamblia
DMERDRQ

SEQ ID NO: 3104145 - protein, 8 aa, Giardia lamblia
DMESIEDD

SEQ ID NO: 3104146 - protein, 6 aa, Giardia lamblia
DMGITP

SEQ ID NO: 3104147 - protein, 10 aa, Giardia lamblia
DMKASNATQK

SEQ ID NO: 3104148 - protein, 15 aa, Giardia lamblia
DMKNSVSDDTPAQEV

SEQ ID NO: 3104149 - protein, 11 aa, Giardia lamblia
DMKQASLNTTI

SEQ ID NO: 3104150 - protein, 17 aa, Giardia lamblia
DMKQPNGKTALSYAQSD

SEQ ID NO: 3104151 - protein, 4 aa, Giardia lamblia
DMNK

SEQ ID NO: 3104152 - protein, 7 aa, Giardia lamblia
DMPEDMQ

SEQ ID NO: 3104153 - protein, 7 aa, Giardia lamblia
DMPPSEA

SEQ ID NO: 3104154 - protein, 20 aa, Giardia lamblia
DMPRKTATPTLKAPIDRPAF

SEQ ID NO: 3104155 - protein, 7 aa, Giardia lamblia
DMPTGQT

SEQ ID NO: 3104156 - protein, 6 aa, Giardia lamblia
DMPTSA

SEQ ID NO: 3104157 - protein, 29 aa, Giardia lamblia
DMQNQARALGTKASVNPELNGTSSPQQLG

SEQ ID NO: 3104158 - protein, 5 aa, Giardia lamblia
DMRDH

SEQ ID NO: 3104159 - protein, 9 aa, Giardia lamblia
DMRDNRGCT

SEQ ID NO: 3104160 - protein, 6 aa, Giardia lamblia
DMRGHQ

SEQ ID NO: 3104161 - protein, 5 aa, Giardia lamblia
DMSAS

SEQ ID NO: 3104162 - protein, 12 aa, Giardia lamblia
DMSKDDLKSTSL

SEQ ID NO: 3104163 - protein, 5 aa, Giardia lamblia
DMSPW

SEQ ID NO: 3104164 - protein, 5 aa, Giardia lamblia
DMSSP

SEQ ID NO: 3104165 - protein, 7 aa, Giardia lamblia
DMSSTLS

SEQ ID NO: 3104166 - protein, 11 aa, Giardia lamblia
DMSTNALTSSY

SEQ ID NO: 3104167 - protein, 18 aa, Giardia lamblia
DMSTTQGGMGRGSYLGEA

SEQ ID NO: 3104168 - protein, 10 aa, Giardia lamblia
DMTDSATTSI

SEQ ID NO: 3104169 - protein, 6 aa, Giardia lamblia
DMTKQD

SEQ ID NO: 3104170 - protein, 5 aa, Giardia lamblia
DNAEI

SEQ ID NO: 3104171 - protein, 7 aa, Giardia lamblia
DNAEKYN

SEQ ID NO: 3104172 - protein, 4 aa, Giardia lamblia
DNAG

SEQ ID NO: 3104173 - protein, 6 aa, Giardia lamblia
DNAGLG

SEQ ID NO: 3104174 - protein, 9 aa, Giardia lamblia
DNAGNEVPQ

SEQ ID NO: 3104175 - protein, 7 aa, Giardia lamblia
DNAGSTA

SEQ ID NO: 3104176 - protein, 6 aa, Giardia lamblia
DNAHRR

SEQ ID NO: 3104177 - protein, 7 aa, Giardia lamblia
DNAKETA

SEQ ID NO: 3104178 - protein, 8 aa, Giardia lamblia
DNAKSNRA

SEQ ID NO: 3104179 - protein, 6 aa, Giardia lamblia
DNALTE

SEQ ID NO: 3104180 - protein, 5 aa, Giardia lamblia
DNANS

SEQ ID NO: 3104181 - protein, 9 aa, Giardia lamblia
DNAPKTSIQ

SEQ ID NO: 3104182 - protein, 6 aa, Giardia lamblia
DNAQTT

SEQ ID NO: 3104183 - protein, 4 aa, Giardia lamblia
DNAR

SEQ ID NO: 3104184 - protein, 19 aa, Giardia lamblia
DNARAQQYQHQSGGNQQEL

SEQ ID NO: 3104185 - protein, 7 aa, Giardia lamblia
DNARIQT

SEQ ID NO: 3104186 - protein, 20 aa, Giardia lamblia
DNARKPNDKPADSNAILTFA

SEQ ID NO: 3104187 - protein, 12 aa, Giardia lamblia
DNARSEDSNKLT

SEQ ID NO: 3104188 - protein, 12 aa, Giardia lamblia
DNATSKSPARAV

SEQ ID NO: 3104189 - protein, 6 aa, Giardia lamblia
DNCSDE

SEQ ID NO: 3104190 - protein, 9 aa, Giardia lamblia
DNDDSRNMC

SEQ ID NO: 3104191 - protein, 10 aa, Giardia lamblia
DNDEDEPAID

SEQ ID NO: 3104192 - protein, 15 aa, Giardia lamblia
DNDENNGDSYHTDEP

SEQ ID NO: 3104193 - protein, 7 aa, Giardia lamblia
DNDETTL

SEQ ID NO: 3104194 - protein, 20 aa, Giardia lamblia
DNDGENNEMVESSSTRPETA

SEQ ID NO: 3104195 - protein, 7 aa, Giardia lamblia
DNDGLTP

SEQ ID NO: 3104196 - protein, 4 aa, Giardia lamblia
DNDI

SEQ ID NO: 3104197 - protein, 8 aa, Giardia lamblia
DNDIRKRN

SEQ ID NO: 3104198 - protein, 7 aa, Giardia lamblia
DNDNTSA

SEQ ID NO: 3104199 - protein, 6 aa, Giardia lamblia
DNDPLV

SEQ ID NO: 3104200 - protein, 8 aa, Giardia lamblia
DNDPNGDQ

SEQ ID NO: 3104201 - protein, 14 aa, Giardia lamblia
DNDQRGSLNQTSVS

SEQ ID NO: 3104202 - protein, 7 aa, Giardia lamblia
DNDSTKQ

SEQ ID NO: 3104203 - protein, 11 aa, Giardia lamblia
DNDTKQSQGVR

SEQ ID NO: 3104204 - protein, 4 aa, Giardia lamblia
DNDV

SEQ ID NO: 3104205 - protein, 16 aa, Giardia lamblia
DNEANTESKSPSAGTS

SEQ ID NO: 3104206 - protein, 35 aa, Giardia lamblia
DNEARPSDDLSRIGNNSLSVSKSGSPRKKARGLSA

SEQ ID NO: 3104207 - protein, 8 aa, Giardia lamblia
DNEDAKAV

SEQ ID NO: 3104208 - protein, 8 aa, Giardia lamblia
DNEDGDAR

SEQ ID NO: 3104209 - protein, 20 aa, Giardia lamblia
DNEDQSSNKASKPALPPRSS

SEQ ID NO: 3104210 - protein, 5 aa, Giardia lamblia
DNEEF

SEQ ID NO: 3104211 - protein, 12 aa, Giardia lamblia
DNEESNQTPEQR

SEQ ID NO: 3104212 - protein, 11 aa, Giardia lamblia
DNEEVYDKEDG

SEQ ID NO: 3104213 - protein, 4 aa, Giardia lamblia
DNEG

SEQ ID NO: 3104214 - protein, 6 aa, Giardia lamblia
DNEGNT

SEQ ID NO: 3104215 - protein, 6 aa, Giardia lamblia
DNEGRS

SEQ ID NO: 3104216 - protein, 22 aa, Giardia lamblia
DNEGSLYDEDEDTEDDTADYGG

SEQ ID NO: 3104217 - protein, 6 aa, Giardia lamblia
DNEGSV

SEQ ID NO: 3104218 - protein, 8 aa, Giardia lamblia
DNEGTPHQ

SEQ ID NO: 3104219 - protein, 11 aa, Giardia lamblia
DNEHRNETERL

SEQ ID NO: 3104220 - protein, 13 aa, Giardia lamblia
DNEKKQHERQRKR

SEQ ID NO: 3104221 - protein, 12 aa, Giardia lamblia
DNELKKEKRRIA

SEQ ID NO: 3104222 - protein, 8 aa, Giardia lamblia
DNENTEEL

SEQ ID NO: 3104223 - protein, 7 aa, Giardia lamblia
DNEPAEY

SEQ ID NO: 3104224 - protein, 10 aa, Giardia lamblia
DNESLEDDDR

SEQ ID NO: 3104225 - protein, 6 aa, Giardia lamblia
DNESNN

SEQ ID NO: 3104226 - protein, 10 aa, Giardia lamblia
DNESSQASKE

SEQ ID NO: 3104227 - protein, 10 aa, Giardia lamblia
DNESSSDSQL

SEQ ID NO: 3104228 - protein, 12 aa, Giardia lamblia
DNETAGKTYEPV

SEQ ID NO: 3104229 - protein, 7 aa, Giardia lamblia
DNETGNY

SEQ ID NO: 3104230 - protein, 30 aa, Giardia lamblia
DNFGAEEATSSEETGLSSKECAKDERGNTP

SEQ ID NO: 3104231 - protein, 8 aa, Giardia lamblia
DNFPKRRN

SEQ ID NO: 3104232 - protein, 6 aa, Giardia lamblia
DNFSAE

SEQ ID NO: 3104233 - protein, 10 aa, Giardia lamblia
DNGADQGKGY

SEQ ID NO: 3104234 - protein, 7 aa, Giardia lamblia
DNGDEEM

SEQ ID NO: 3104235 - protein, 6 aa, Giardia lamblia
DNGDSI

SEQ ID NO: 3104236 - protein, 9 aa, Giardia lamblia
DNGGNANEH

SEQ ID NO: 3104237 - protein, 6 aa, Giardia lamblia
DNGGQT

SEQ ID NO: 3104238 - protein, 7 aa, Giardia lamblia
DNGKRIA

SEQ ID NO: 3104239 - protein, 18 aa, Giardia lamblia
DNGLDGRTLDEPMGPKPE

SEQ ID NO: 3104240 - protein, 11 aa, Giardia lamblia
DNGRSKSNTQI

SEQ ID NO: 3104241 - protein, 6 aa, Giardia lamblia
DNGSVS

SEQ ID NO: 3104242 - protein, 10 aa, Giardia lamblia
DNGTNKHDER

SEQ ID NO: 3104243 - protein, 4 aa, Giardia lamblia
DNGV

SEQ ID NO: 3104244 - protein, 5 aa, Giardia lamblia
DNGVD

SEQ ID NO: 3104245 - protein, 15 aa, Giardia lamblia
DNGVESHYNTDGSEP

SEQ ID NO: 3104246 - protein, 21 aa, Giardia lamblia
DNGYRSASAYSSTSHRQTLGP

SEQ ID NO: 3104247 - protein, 5 aa, Giardia lamblia
DNHGA

SEQ ID NO: 3104248 - protein, 6 aa, Giardia lamblia
DNHGNT

SEQ ID NO: 3104249 - protein, 6 aa, Giardia lamblia
DNHGQT

SEQ ID NO: 3104250 - protein, 6 aa, Giardia lamblia
DNHGRT

SEQ ID NO: 3104251 - protein, 5 aa, Giardia lamblia
DNHLD

SEQ ID NO: 3104252 - protein, 7 aa, Giardia lamblia
DNHLKGR

SEQ ID NO: 3104253 - protein, 13 aa, Giardia lamblia
DNIAASPTEPVTS

SEQ ID NO: 3104254 - protein, 6 aa, Giardia lamblia
DNIDSP

SEQ ID NO: 3104255 - protein, 6 aa, Giardia lamblia
DNIDTN

SEQ ID NO: 3104256 - protein, 4 aa, Giardia lamblia
DNIN

SEQ ID NO: 3104257 - protein, 14 aa, Giardia lamblia
DNIQRGRYEEGVTG

SEQ ID NO: 3104258 - protein, 9 aa, Giardia lamblia
DNISTKSAN

SEQ ID NO: 3104259 - protein, 8 aa, Giardia lamblia
DNKDSSAQ

SEQ ID NO: 3104260 - protein, 10 aa, Giardia lamblia
DNKDTRGKQK

SEQ ID NO: 3104261 - protein, 6 aa, Giardia lamblia
DNKENL

SEQ ID NO: 3104262 - protein, 8 aa, Giardia lamblia
DNKGNKAL

SEQ ID NO: 3104263 - protein, 6 aa, Giardia lamblia
DNKGRS

SEQ ID NO: 3104264 - protein, 8 aa, Giardia lamblia
DNKGSTAL

SEQ ID NO: 3104265 - protein, 6 aa, Giardia lamblia
DNKKRG

SEQ ID NO: 3104266 - protein, 8 aa, Giardia lamblia
DNKKSQVR

SEQ ID NO: 3104267 - protein, 8 aa, Giardia lamblia
DNKLSEEL

SEQ ID NO: 3104268 - protein, 9 aa, Giardia lamblia
DNKNQEKLA

SEQ ID NO: 3104269 - protein, 32 aa, Giardia lamblia
DNKPNRKNRYHKKETEAVRPSVPAPPQQSSLV

SEQ ID NO: 3104270 - protein, 9 aa, Giardia lamblia
DNKPNTLDT

SEQ ID NO: 3104271 - protein, 10 aa, Giardia lamblia
DNKQARPPTY

SEQ ID NO: 3104272 - protein, 8 aa, Giardia lamblia
DNKQQTPL

SEQ ID NO: 3104273 - protein, 6 aa, Giardia lamblia
DNKRAM

SEQ ID NO: 3104274 - protein, 7 aa, Giardia lamblia
DNKRSVQ

SEQ ID NO: 3104275 - protein, 9 aa, Giardia lamblia
DNKTESVQT

SEQ ID NO: 3104276 - protein, 4 aa, Giardia lamblia
DNKY

SEQ ID NO: 3104277 - protein, 15 aa, Giardia lamblia
DNLASQKNDRDKYKT

SEQ ID NO: 3104278 - protein, 24 aa, Giardia lamblia
DNLDGKQQSTDDQATDKTQPPSTS

SEQ ID NO: 3104279 - protein, 7 aa, Giardia lamblia
DNLEKER

SEQ ID NO: 3104280 - protein, 4 aa, Giardia lamblia
DNLG

SEQ ID NO: 3104281 - protein, 4 aa, Giardia lamblia
DNLN

SEQ ID NO: 3104282 - protein, 4 aa, Giardia lamblia
DNLS

SEQ ID NO: 3104283 - protein, 7 aa, Giardia lamblia
DNMDPTA

SEQ ID NO: 3104284 - protein, 5 aa, Giardia lamblia
DNMSR

SEQ ID NO: 3104285 - protein, 4 aa, Giardia lamblia
DNMT

SEQ ID NO: 3104286 - protein, 31 aa, Giardia lamblia
DNMTDADVTQPISSGKDAGLSAQATTQVTTT

SEQ ID NO: 3104287 - protein, 7 aa, Giardia lamblia
DNNAGFA

SEQ ID NO: 3104288 - protein, 7 aa, Giardia lamblia
DNNARTA

SEQ ID NO: 3104289 - protein, 8 aa, Giardia lamblia
DNNARVTN

SEQ ID NO: 3104290 - protein, 6 aa, Giardia lamblia
DNNDHT

SEQ ID NO: 3104291 - protein, 9 aa, Giardia lamblia
DNNEDNNKV

SEQ ID NO: 3104292 - protein, 7 aa, Giardia lamblia
DNNEKLT

SEQ ID NO: 3104293 - protein, 4 aa, Giardia lamblia
DNNG

SEQ ID NO: 3104294 - protein, 6 aa, Giardia lamblia
DNNGHT

SEQ ID NO: 3104295 - protein, 6 aa, Giardia lamblia
DNNGIE

SEQ ID NO: 3104296 - protein, 8 aa, Giardia lamblia
DNNGNSAL

SEQ ID NO: 3104297 - protein, 6 aa, Giardia lamblia
DNNGRT

SEQ ID NO: 3104298 - protein, 7 aa, Giardia lamblia
DNNGRTA

SEQ ID NO: 3104299 - protein, 7 aa, Giardia lamblia
DNNGSSV

SEQ ID NO: 3104300 - protein, 7 aa, Giardia lamblia
DNNGTTA

SEQ ID NO: 3104301 - protein, 5 aa, Giardia lamblia
DNNID

SEQ ID NO: 3104302 - protein, 6 aa, Giardia lamblia
DNNNET

SEQ ID NO: 3104303 - protein, 5 aa, Giardia lamblia
DNNPE

SEQ ID NO: 3104304 - protein, 9 aa, Giardia lamblia
DNNPPGAEV

SEQ ID NO: 3104305 - protein, 10 aa, Giardia lamblia
DNNQQPSPKM

SEQ ID NO: 3104306 - protein, 4 aa, Giardia lamblia
DNNT

SEQ ID NO: 3104307 - protein, 5 aa, Giardia lamblia
DNPEA

SEQ ID NO: 3104308 - protein, 8 aa, Giardia lamblia
DNPEEPLE

SEQ ID NO: 3104309 - protein, 34 aa, Giardia lamblia
DNPERTEECDNTNSQQIASNTSSDDAIDSPITGM

SEQ ID NO: 3104310 - protein, 16 aa, Giardia lamblia
DNPESFEASEQDNQES

SEQ ID NO: 3104311 - protein, 9 aa, Giardia lamblia
DNPGGDDSQ

SEQ ID NO: 3104312 - protein, 5 aa, Giardia lamblia
DNPGV

SEQ ID NO: 3104313 - protein, 22 aa, Giardia lamblia
DNPKQSQQQAQGKQSVDEQSTI

SEQ ID NO: 3104314 - protein, 4 aa, Giardia lamblia
DNPQ

SEQ ID NO: 3104315 - protein, 7 aa, Giardia lamblia
DNPQLNA

SEQ ID NO: 3104316 - protein, 12 aa, Giardia lamblia
DNPQSSGSCSCG

SEQ ID NO: 3104317 - protein, 24 aa, Giardia lamblia
DNPRTNNNSSPSNPKPPRQDASQK

SEQ ID NO: 3104318 - protein, 25 aa, Giardia lamblia
DNPRTNNNSSPSNPKPPRQDASQKH

SEQ ID NO: 3104319 - protein, 7 aa, Giardia lamblia
DNPSASA

SEQ ID NO: 3104320 - protein, 5 aa, Giardia lamblia
DNPST

SEQ ID NO: 3104321 - protein, 6 aa, Giardia lamblia
DNPTWA

SEQ ID NO: 3104322 - protein, 5 aa, Giardia lamblia
DNPVS

SEQ ID NO: 3104323 - protein, 10 aa, Giardia lamblia
DNQDNSNGTA

SEQ ID NO: 3104324 - protein, 8 aa, Giardia lamblia
DNQGLSAR

SEQ ID NO: 3104325 - protein, 6 aa, Giardia lamblia
DNQKRN

SEQ ID NO: 3104326 - protein, 15 aa, Giardia lamblia
DNQLRGSIATQNDRL

SEQ ID NO: 3104327 - protein, 5 aa, Giardia lamblia
DNQRN

SEQ ID NO: 3104328 - protein, 6 aa, Giardia lamblia
DNQSGE

SEQ ID NO: 3104329 - protein, 5 aa, Giardia lamblia
DNQVR

SEQ ID NO: 3104330 - protein, 12 aa, Giardia lamblia
DNRAPNIDGNGV

SEQ ID NO: 3104331 - protein, 5 aa, Giardia lamblia
DNREA

SEQ ID NO: 3104332 - protein, 6 aa, Giardia lamblia
DNREDD

SEQ ID NO: 3104333 - protein, 5 aa, Giardia lamblia
DNRFN

SEQ ID NO: 3104334 - protein, 5 aa, Giardia lamblia
DNRPD

SEQ ID NO: 3104335 - protein, 5 aa, Giardia lamblia
DNRPI

SEQ ID NO: 3104336 - protein, 29 aa, Giardia lamblia
DNRPNTNPGPGAYTPASKATKTSAPSFSL

SEQ ID NO: 3104337 - protein, 5 aa, Giardia lamblia
DNRRI

SEQ ID NO: 3104338 - protein, 7 aa, Giardia lamblia
DNRSNAV

SEQ ID NO: 3104339 - protein, 8 aa, Giardia lamblia
DNSAELRE

SEQ ID NO: 3104340 - protein, 9 aa, Giardia lamblia
DNSCEPDSQ

SEQ ID NO: 3104341 - protein, 9 aa, Giardia lamblia
DNSDERRQA

SEQ ID NO: 3104342 - protein, 4 aa, Giardia lamblia
DNSE

SEQ ID NO: 3104343 - protein, 14 aa, Giardia lamblia
DNSGAKAFKVNSEN

SEQ ID NO: 3104344 - protein, 9 aa, Giardia lamblia
DNSIAKTNE

SEQ ID NO: 3104345 - protein, 5 aa, Giardia lamblia
DNSKS

SEQ ID NO: 3104346 - protein, 7 aa, Giardia lamblia
DNSNKSC

SEQ ID NO: 3104347 - protein, 4 aa, Giardia lamblia
DNSP

SEQ ID NO: 3104348 - protein, 5 aa, Giardia lamblia
DNSPC

SEQ ID NO: 3104349 - protein, 14 aa, Giardia lamblia
DNSPHDEDASGQLE

SEQ ID NO: 3104350 - protein, 6 aa, Giardia lamblia
DNSPKL

SEQ ID NO: 3104351 - protein, 6 aa, Giardia lamblia
DNSQAM

SEQ ID NO: 3104352 - protein, 19 aa, Giardia lamblia
DNSQAYDSAKRTSSDTQPL

SEQ ID NO: 3104353 - protein, 7 aa, Giardia lamblia
DNSRKLD

SEQ ID NO: 3104354 - protein, 8 aa, Giardia lamblia
DNSSPEEF

SEQ ID NO: 3104355 - protein, 8 aa, Giardia lamblia
DNSSRAET

SEQ ID NO: 3104356 - protein, 5 aa, Giardia lamblia
DNSSS

SEQ ID NO: 3104357 - protein, 9 aa, Giardia lamblia
DNSTSCSTV

SEQ ID NO: 3104358 - protein, 21 aa, Giardia lamblia
DNSVTGSSLANSTTVPPLGTT

SEQ ID NO: 3104359 - protein, 7 aa, Giardia lamblia
DNSYPDL

SEQ ID NO: 3104360 - protein, 8 aa, Giardia lamblia
DNTAEGDA

SEQ ID NO: 3104361 - protein, 7 aa, Giardia lamblia
DNTASIP

SEQ ID NO: 3104362 - protein, 4 aa, Giardia lamblia
DNTD

SEQ ID NO: 3104363 - protein, 10 aa, Giardia lamblia
DNTEPNRIAT

SEQ ID NO: 3104364 - protein, 8 aa, Giardia lamblia
DNTGDYPL

SEQ ID NO: 3104365 - protein, 5 aa, Giardia lamblia
DNTGK

SEQ ID NO: 3104366 - protein, 7 aa, Giardia lamblia
DNTGRSA

SEQ ID NO: 3104367 - protein, 6 aa, Giardia lamblia
DNTGRT

SEQ ID NO: 3104368 - protein, 6 aa, Giardia lamblia
DNTGSA

SEQ ID NO: 3104369 - protein, 7 aa, Giardia lamblia
DNTGTSM

SEQ ID NO: 3104370 - protein, 5 aa, Giardia lamblia
DNTNL

SEQ ID NO: 3104371 - protein, 7 aa, Giardia lamblia
DNTPKTK

SEQ ID NO: 3104372 - protein, 7 aa, Giardia lamblia
DNTPTDQ

SEQ ID NO: 3104373 - protein, 8 aa, Giardia lamblia
DNTQTRER

SEQ ID NO: 3104374 - protein, 7 aa, Giardia lamblia
DNTQTST

SEQ ID NO: 3104375 - protein, 10 aa, Giardia lamblia
DNTSDPSTEL

SEQ ID NO: 3104376 - protein, 12 aa, Giardia lamblia
DNTSHLENCTLG

SEQ ID NO: 3104377 - protein, 18 aa, Giardia lamblia
DNTSRDYSGLGPKAANIR

SEQ ID NO: 3104378 - protein, 12 aa, Giardia lamblia
DNTTSSLSQSAI

SEQ ID NO: 3104379 - protein, 8 aa, Giardia lamblia
DNTTTYEA

SEQ ID NO: 3104380 - protein, 10 aa, Giardia lamblia
DNVARHKNEA

SEQ ID NO: 3104381 - protein, 11 aa, Giardia lamblia
DNVEDNGNVDY

SEQ ID NO: 3104382 - protein, 5 aa, Giardia lamblia
DNVGA

SEQ ID NO: 3104383 - protein, 25 aa, Giardia lamblia
DNVRRNSPYHSGTSQYVPPSKNKDA

SEQ ID NO: 3104384 - protein, 7 aa, Giardia lamblia
DNVSNES

SEQ ID NO: 3104385 - protein, 6 aa, Giardia lamblia
DNVSTG

SEQ ID NO: 3104386 - protein, 9 aa, Giardia lamblia
DNVTADGRS

SEQ ID NO: 3104387 - protein, 8 aa, Giardia lamblia
DNVTKTKD

SEQ ID NO: 3104388 - protein, 5 aa, Giardia lamblia
DNVTP

SEQ ID NO: 3104389 - protein, 4 aa, Giardia lamblia
DNWG

SEQ ID NO: 3104390 - protein, 5 aa, Giardia lamblia
DNYGK

SEQ ID NO: 3104391 - protein, 17 aa, Giardia lamblia
DNYGPPPVTVDSPPSSI

SEQ ID NO: 3104392 - protein, 6 aa, Giardia lamblia
DNYNNT

SEQ ID NO: 3104393 - protein, 4 aa, Giardia lamblia
DNYP

SEQ ID NO: 3104394 - protein, 8 aa, Giardia lamblia
DNYPDQPP

SEQ ID NO: 3104395 - protein, 6 aa, Giardia lamblia
DNYRGD

SEQ ID NO: 3104396 - protein, 4 aa, Giardia lamblia
DNYY

SEQ ID NO: 3104397 - protein, 7 aa, Giardia lamblia
DPAADAH

SEQ ID NO: 3104398 - protein, 5 aa, Giardia lamblia
DPAAP

SEQ ID NO: 3104399 - protein, 18 aa, Giardia lamblia
DPAASQGQIPEDTSKHTP

SEQ ID NO: 3104400 - protein, 7 aa, Giardia lamblia
DPACPEP

SEQ ID NO: 3104401 - protein, 4 aa, Giardia lamblia
DPAE

SEQ ID NO: 3104402 - protein, 6 aa, Giardia lamblia
DPAGYV

SEQ ID NO: 3104403 - protein, 6 aa, Giardia lamblia
DPAHNI

SEQ ID NO: 3104404 - protein, 9 aa, Giardia lamblia
DPAKQPAAD

SEQ ID NO: 3104405 - protein, 9 aa, Giardia lamblia
DPAKRQTKA

SEQ ID NO: 3104406 - protein, 9 aa, Giardia lamblia
DPAKYAPDL

SEQ ID NO: 3104407 - protein, 14 aa, Giardia lamblia
DPALDKEDAPKVIS

SEQ ID NO: 3104408 - protein, 12 aa, Giardia lamblia
DPANAAINTTNN

SEQ ID NO: 3104409 - protein, 8 aa, Giardia lamblia
DPANARIG

SEQ ID NO: 3104410 - protein, 5 aa, Giardia lamblia
DPANF

SEQ ID NO: 3104411 - protein, 19 aa, Giardia lamblia
DPAPHRFKSPSTLYEPSQR

SEQ ID NO: 3104412 - protein, 5 aa, Giardia lamblia
DPARN

SEQ ID NO: 3104413 - protein, 9 aa, Giardia lamblia
DPARRAKSY

SEQ ID NO: 3104414 - protein, 6 aa, Giardia lamblia
DPARSA

SEQ ID NO: 3104415 - protein, 8 aa, Giardia lamblia
DPASRADC

SEQ ID NO: 3104416 - protein, 5 aa, Giardia lamblia
DPASV

SEQ ID NO: 3104417 - protein, 12 aa, Giardia lamblia
DPATEPSAPGPI

SEQ ID NO: 3104418 - protein, 6 aa, Giardia lamblia
DPATLT

SEQ ID NO: 3104419 - protein, 13 aa, Giardia lamblia
DPATPEKPTNSVA

SEQ ID NO: 3104420 - protein, 6 aa, Giardia lamblia
DPATSN

SEQ ID NO: 3104421 - protein, 7 aa, Giardia lamblia
DPCESQE

SEQ ID NO: 3104422 - protein, 5 aa, Giardia lamblia
DPDDF

SEQ ID NO: 3104423 - protein, 4 aa, Giardia lamblia
DPDE

SEQ ID NO: 3104424 - protein, 4 aa, Giardia lamblia
DPDG

SEQ ID NO: 3104425 - protein, 6 aa, Giardia lamblia
DPDGNT

SEQ ID NO: 3104426 - protein, 7 aa, Giardia lamblia
DPDGRTL

SEQ ID NO: 3104427 - protein, 5 aa, Giardia lamblia
DPDIA

SEQ ID NO: 3104428 - protein, 7 aa, Giardia lamblia
DPDKLRN

SEQ ID NO: 3104429 - protein, 10 aa, Giardia lamblia
DPDKTDPTGA

SEQ ID NO: 3104430 - protein, 4 aa, Giardia lamblia
DPDL

SEQ ID NO: 3104431 - protein, 4 aa, Giardia lamblia
DPDN

SEQ ID NO: 3104432 - protein, 7 aa, Giardia lamblia
DPDPDLS

SEQ ID NO: 3104433 - protein, 6 aa, Giardia lamblia
DPDPID

SEQ ID NO: 3104434 - protein, 10 aa, Giardia lamblia
DPDPSKRPTA

SEQ ID NO: 3104435 - protein, 14 aa, Giardia lamblia
DPDQPQAQRAFDTE

SEQ ID NO: 3104436 - protein, 6 aa, Giardia lamblia
DPDRTD

SEQ ID NO: 3104437 - protein, 8 aa, Giardia lamblia
DPDTARDF

SEQ ID NO: 3104438 - protein, 9 aa, Giardia lamblia
DPDTQKISA

SEQ ID NO: 3104439 - protein, 7 aa, Giardia lamblia
DPDTSME

SEQ ID NO: 3104440 - protein, 16 aa, Giardia lamblia
DPDTYDEIEVPKLCLV

SEQ ID NO: 3104441 - protein, 10 aa, Giardia lamblia
DPEASPINSS

SEQ ID NO: 3104442 - protein, 23 aa, Giardia lamblia
DPEDQGTDSLDPNTAKAGSVSTV

SEQ ID NO: 3104443 - protein, 4 aa, Giardia lamblia
DPEE

SEQ ID NO: 3104444 - protein, 5 aa, Giardia lamblia
DPEEE

SEQ ID NO: 3104445 - protein, 6 aa, Giardia lamblia
DPEEFE

SEQ ID NO: 3104446 - protein, 4 aa, Giardia lamblia
DPEF

SEQ ID NO: 3104447 - protein, 6 aa, Giardia lamblia
DPEGNT

SEQ ID NO: 3104448 - protein, 8 aa, Giardia lamblia
DPEGSSEA

SEQ ID NO: 3104449 - protein, 5 aa, Giardia lamblia
DPEHI

SEQ ID NO: 3104450 - protein, 4 aa, Giardia lamblia
DPEK

SEQ ID NO: 3104451 - protein, 6 aa, Giardia lamblia
DPEKRA

SEQ ID NO: 3104452 - protein, 6 aa, Giardia lamblia
DPEKYS

SEQ ID NO: 3104453 - protein, 16 aa, Giardia lamblia
DPELERKRREAAEQSM

SEQ ID NO: 3104454 - protein, 6 aa, Giardia lamblia
DPENSH

SEQ ID NO: 3104455 - protein, 7 aa, Giardia lamblia
DPEPGIT

SEQ ID NO: 3104456 - protein, 6 aa, Giardia lamblia
DPEQDR

SEQ ID NO: 3104457 - protein, 11 aa, Giardia lamblia
DPEQEETPLGN

SEQ ID NO: 3104458 - protein, 4 aa, Giardia lamblia
DPER

SEQ ID NO: 3104459 - protein, 4 aa, Giardia lamblia
DPES

SEQ ID NO: 3104460 - protein, 6 aa, Giardia lamblia
DPESET

SEQ ID NO: 3104461 - protein, 28 aa, Giardia lamblia
DPESLASSGSKGTHPVRPASYRKESPKI

SEQ ID NO: 3104462 - protein, 8 aa, Giardia lamblia
DPETGSTT

SEQ ID NO: 3104463 - protein, 21 aa, Giardia lamblia
DPETRKEVREPTELTSKERDI

SEQ ID NO: 3104464 - protein, 14 aa, Giardia lamblia
DPETSGSTNVTNPS

SEQ ID NO: 3104465 - protein, 5 aa, Giardia lamblia
DPETV

SEQ ID NO: 3104466 - protein, 5 aa, Giardia lamblia
DPEVQ

SEQ ID NO: 3104467 - protein, 4 aa, Giardia lamblia
DPFD

SEQ ID NO: 3104468 - protein, 13 aa, Giardia lamblia
DPFSDSESSTLEG

SEQ ID NO: 3104469 - protein, 5 aa, Giardia lamblia
DPFSG

SEQ ID NO: 3104470 - protein, 7 aa, Giardia lamblia
DPFSSKE

SEQ ID NO: 3104471 - protein, 21 aa, Giardia lamblia
DPGATSFTASYTTAARQTVQK

SEQ ID NO: 3104472 - protein, 6 aa, Giardia lamblia
DPGEAM

SEQ ID NO: 3104473 - protein, 4 aa, Giardia lamblia
DPGF

SEQ ID NO: 3104474 - protein, 5 aa, Giardia lamblia
DPGIR

SEQ ID NO: 3104475 - protein, 8 aa, Giardia lamblia
DPGLESQG

SEQ ID NO: 3104476 - protein, 8 aa, Giardia lamblia
DPGLSSTL

SEQ ID NO: 3104477 - protein, 33 aa, Giardia lamblia
DPGMALSGSGSVHSSKSPKHLSPQQSPRLTPEQ

SEQ ID NO: 3104478 - protein, 8 aa, Giardia lamblia
DPGSAKSQ

SEQ ID NO: 3104479 - protein, 7 aa, Giardia lamblia
DPGSRYE

SEQ ID NO: 3104480 - protein, 6 aa, Giardia lamblia
DPGTDI

SEQ ID NO: 3104481 - protein, 13 aa, Giardia lamblia
DPGTVKSRLPYPK

SEQ ID NO: 3104482 - protein, 5 aa, Giardia lamblia
DPGTY

SEQ ID NO: 3104483 - protein, 17 aa, Giardia lamblia
DPGVDRKVEDTDRTHAS

SEQ ID NO: 3104484 - protein, 7 aa, Giardia lamblia
DPGWSQN

SEQ ID NO: 3104485 - protein, 11 aa, Giardia lamblia
DPHASKKKYTL

SEQ ID NO: 3104486 - protein, 9 aa, Giardia lamblia
DPHDGRYSN

SEQ ID NO: 3104487 - protein, 5 aa, Giardia lamblia
DPHER

SEQ ID NO: 3104488 - protein, 5 aa, Giardia lamblia
DPHGN

SEQ ID NO: 3104489 - protein, 5 aa, Giardia lamblia
DPHNQ

SEQ ID NO: 3104490 - protein, 53 aa, Giardia lamblia
DPHPPTAPATTAATPVSTTARTRSPGVTPGIRRTPSRPGSSELADRKSPQIQV

SEQ ID NO: 3104491 - protein, 5 aa, Giardia lamblia
DPHPQ

SEQ ID NO: 3104492 - protein, 6 aa, Giardia lamblia
DPHRGI

SEQ ID NO: 3104493 - protein, 4 aa, Giardia lamblia
DPIE

SEQ ID NO: 3104494 - protein, 9 aa, Giardia lamblia
DPIPAAPPF

SEQ ID NO: 3104495 - protein, 5 aa, Giardia lamblia
DPIPC

SEQ ID NO: 3104496 - protein, 4 aa, Giardia lamblia
DPIS

SEQ ID NO: 3104497 - protein, 6 aa, Giardia lamblia
DPISGN

SEQ ID NO: 3104498 - protein, 5 aa, Giardia lamblia
DPITG

SEQ ID NO: 3104499 - protein, 14 aa, Giardia lamblia
DPKDQAFTNPTKPV

SEQ ID NO: 3104500 - protein, 5 aa, Giardia lamblia
DPKEI

SEQ ID NO: 3104501 - protein, 6 aa, Giardia lamblia
DPKHPD

SEQ ID NO: 3104502 - protein, 8 aa, Giardia lamblia
DPKNEGGT

SEQ ID NO: 3104503 - protein, 8 aa, Giardia lamblia
DPKPGEPV

SEQ ID NO: 3104504 - protein, 35 aa, Giardia lamblia
DPKPVEPPKQDTSVADAKPAVPDQPKNEPSKPTGT

SEQ ID NO: 3104505 - protein, 10 aa, Giardia lamblia
DPKPVRPASA

SEQ ID NO: 3104506 - protein, 9 aa, Giardia lamblia
DPKRGTPQL

SEQ ID NO: 3104507 - protein, 14 aa, Giardia lamblia
DPKSVQSSRRKGDY

SEQ ID NO: 3104508 - protein, 7 aa, Giardia lamblia
DPKTTEY

SEQ ID NO: 3104509 - protein, 5 aa, Giardia lamblia
DPLAN

SEQ ID NO: 3104510 - protein, 8 aa, Giardia lamblia
DPLDQQPI

SEQ ID NO: 3104511 - protein, 32 aa, Giardia lamblia
DPLDTRYSDTTISRSIDSDLSQHGMPTKAQRA

SEQ ID NO: 3104512 - protein, 5 aa, Giardia lamblia
DPLDV

SEQ ID NO: 3104513 - protein, 22 aa, Giardia lamblia
DPLEEPQANGSKKYKISRSMPT

SEQ ID NO: 3104514 - protein, 5 aa, Giardia lamblia
DPLEK

SEQ ID NO: 3104515 - protein, 4 aa, Giardia lamblia
DPLH

SEQ ID NO: 3104516 - protein, 20 aa, Giardia lamblia
DPLKQKDAAPATASTTNVDS

SEQ ID NO: 3104517 - protein, 11 aa, Giardia lamblia
DPLKSYDDDAF

SEQ ID NO: 3104518 - protein, 47 aa, Giardia lamblia
DPLKTTTKHRGISSENHIGSKPLQSTKSTTYSSKHNKQTIGRKGTSI

SEQ ID NO: 3104519 - protein, 4 aa, Giardia lamblia
DPLL

SEQ ID NO: 3104520 - protein, 5 aa, Giardia lamblia
DPLNG

SEQ ID NO: 3104521 - protein, 10 aa, Giardia lamblia
DPLPAEEDTQ

SEQ ID NO: 3104522 - protein, 7 aa, Giardia lamblia
DPLPDKD

SEQ ID NO: 3104523 - protein, 5 aa, Giardia lamblia
DPLPH

SEQ ID NO: 3104524 - protein, 6 aa, Giardia lamblia
DPLPQD

SEQ ID NO: 3104525 - protein, 4 aa, Giardia lamblia
DPLS

SEQ ID NO: 3104526 - protein, 28 aa, Giardia lamblia
DPLSPDKLEEPSIDEPVEDHAEHDNDQQ

SEQ ID NO: 3104527 - protein, 30 aa, Giardia lamblia
DPLTDKPTGVVQGQGSQAGAPEATANQPTK

SEQ ID NO: 3104528 - protein, 13 aa, Giardia lamblia
DPLTDSGLTQQTD

SEQ ID NO: 3104529 - protein, 12 aa, Giardia lamblia
DPLTPISSSRLN

SEQ ID NO: 3104530 - protein, 7 aa, Giardia lamblia
DPMAPQR

SEQ ID NO: 3104531 - protein, 4 aa, Giardia lamblia
DPME

SEQ ID NO: 3104532 - protein, 4 aa, Giardia lamblia
DPMK

SEQ ID NO: 3104533 - protein, 14 aa, Giardia lamblia
DPMKRPSDGLGRVP

SEQ ID NO: 3104534 - protein, 6 aa, Giardia lamblia
DPMPEV

SEQ ID NO: 3104535 - protein, 4 aa, Giardia lamblia
DPMQ

SEQ ID NO: 3104536 - protein, 13 aa, Giardia lamblia
DPNAERNETYTTI

SEQ ID NO: 3104537 - protein, 10 aa, Giardia lamblia
DPNAEYSSST

SEQ ID NO: 3104538 - protein, 19 aa, Giardia lamblia
DPNATISAYTSQQSMSQAS

SEQ ID NO: 3104539 - protein, 11 aa, Giardia lamblia
DPNCKSPANVD

SEQ ID NO: 3104540 - protein, 15 aa, Giardia lamblia
DPNEARIPSAQSPPL

SEQ ID NO: 3104541 - protein, 5 aa, Giardia lamblia
DPNGV

SEQ ID NO: 3104542 - protein, 17 aa, Giardia lamblia
DPNIPSGHKYPTSDKRM

SEQ ID NO: 3104543 - protein, 37 aa, Giardia lamblia
DPNIRTKAQATSSRNAYDTGRGDDDEVQGSGGAQCQA

SEQ ID NO: 3104544 - protein, 10 aa, Giardia lamblia
DPNKQGKNWE

SEQ ID NO: 3104545 - protein, 11 aa, Giardia lamblia
DPNLPTTEGAP

SEQ ID NO: 3104546 - protein, 6 aa, Giardia lamblia
DPNLQS

SEQ ID NO: 3104547 - protein, 4 aa, Giardia lamblia
DPNN

SEQ ID NO: 3104548 - protein, 13 aa, Giardia lamblia
DPNNPNPKSVGQE

SEQ ID NO: 3104549 - protein, 11 aa, Giardia lamblia
DPNPKDPANCD

SEQ ID NO: 3104550 - protein, 12 aa, Giardia lamblia
DPNPMSPANNEA

SEQ ID NO: 3104551 - protein, 11 aa, Giardia lamblia
DPNPTRRPSAS

SEQ ID NO: 3104552 - protein, 18 aa, Giardia lamblia
DPNQSSANAKADPRPAKK

SEQ ID NO: 3104553 - protein, 5 aa, Giardia lamblia
DPNRQ

SEQ ID NO: 3104554 - protein, 5 aa, Giardia lamblia
DPNRT

SEQ ID NO: 3104555 - protein, 5 aa, Giardia lamblia
DPNSS

SEQ ID NO: 3104556 - protein, 5 aa, Giardia lamblia
DPNTA

SEQ ID NO: 3104557 - protein, 8 aa, Giardia lamblia
DPPARAAA

SEQ ID NO: 3104558 - protein, 24 aa, Giardia lamblia
DPPDPEKKKKKGSKGKKGSKGKKG

SEQ ID NO: 3104559 - protein, 18 aa, Giardia lamblia
DPPEDVPEGADDDAYEAP

SEQ ID NO: 3104560 - protein, 18 aa, Giardia lamblia
DPPEQEKSATQAKKVPRT

SEQ ID NO: 3104561 - protein, 10 aa, Giardia lamblia
DPPMQAHTSP

SEQ ID NO: 3104562 - protein, 7 aa, Giardia lamblia
DPPPATP

SEQ ID NO: 3104563 - protein, 6 aa, Giardia lamblia
DPPPDK

SEQ ID NO: 3104564 - protein, 6 aa, Giardia lamblia
DPPPIY

SEQ ID NO: 3104565 - protein, 11 aa, Giardia lamblia
DPPPLERLPAS

SEQ ID NO: 3104566 - protein, 7 aa, Giardia lamblia
DPPQDDG

SEQ ID NO: 3104567 - protein, 9 aa, Giardia lamblia
DPPRQAKKA

SEQ ID NO: 3104568 - protein, 6 aa, Giardia lamblia
DPPRTG

SEQ ID NO: 3104569 - protein, 7 aa, Giardia lamblia
DPPRTVA

SEQ ID NO: 3104570 - protein, 4 aa, Giardia lamblia
DPPS

SEQ ID NO: 3104571 - protein, 5 aa, Giardia lamblia
DPPSF

SEQ ID NO: 3104572 - protein, 6 aa, Giardia lamblia
DPPSVD

SEQ ID NO: 3104573 - protein, 5 aa, Giardia lamblia
DPPTI

SEQ ID NO: 3104574 - protein, 7 aa, Giardia lamblia
DPPTIPN

SEQ ID NO: 3104575 - protein, 6 aa, Giardia lamblia
DPPYDP

SEQ ID NO: 3104576 - protein, 6 aa, Giardia lamblia
DPPYET

SEQ ID NO: 3104577 - protein, 6 aa, Giardia lamblia
DPQAAP

SEQ ID NO: 3104578 - protein, 8 aa, Giardia lamblia
DPQDTWNQ

SEQ ID NO: 3104579 - protein, 6 aa, Giardia lamblia
DPQGEQ

SEQ ID NO: 3104580 - protein, 6 aa, Giardia lamblia
DPQLEP

SEQ ID NO: 3104581 - protein, 14 aa, Giardia lamblia
DPQLTKASESGQAW

SEQ ID NO: 3104582 - protein, 14 aa, Giardia lamblia
DPQNAKANLASATA

SEQ ID NO: 3104583 - protein, 5 aa, Giardia lamblia
DPQNK

SEQ ID NO: 3104584 - protein, 5 aa, Giardia lamblia
DPQNP

SEQ ID NO: 3104585 - protein, 7 aa, Giardia lamblia
DPQNTSR

SEQ ID NO: 3104586 - protein, 9 aa, Giardia lamblia
DPQQQTTQD

SEQ ID NO: 3104587 - protein, 7 aa, Giardia lamblia
DPQQTVA

SEQ ID NO: 3104588 - protein, 13 aa, Giardia lamblia
DPQRAVKPADPDE

SEQ ID NO: 3104589 - protein, 9 aa, Giardia lamblia
DPQSRPSAA

SEQ ID NO: 3104590 - protein, 9 aa, Giardia lamblia
DPQSTQEEV

SEQ ID NO: 3104591 - protein, 5 aa, Giardia lamblia
DPQTS

SEQ ID NO: 3104592 - protein, 6 aa, Giardia lamblia
DPQTYR

SEQ ID NO: 3104593 - protein, 11 aa, Giardia lamblia
DPQVEGTDGKK

SEQ ID NO: 3104594 - protein, 7 aa, Giardia lamblia
DPRAQGS

SEQ ID NO: 3104595 - protein, 5 aa, Giardia lamblia
DPRDA

SEQ ID NO: 3104596 - protein, 5 aa, Giardia lamblia
DPREE

SEQ ID NO: 3104597 - protein, 6 aa, Giardia lamblia
DPRGCL

SEQ ID NO: 3104598 - protein, 23 aa, Giardia lamblia
DPRGSRPLTSRPISSGGAGSKSM

SEQ ID NO: 3104599 - protein, 13 aa, Giardia lamblia
DPRHTNSAQASAS

SEQ ID NO: 3104600 - protein, 4 aa, Giardia lamblia
DPRI

SEQ ID NO: 3104601 - protein, 5 aa, Giardia lamblia
DPRKA

SEQ ID NO: 3104602 - protein, 30 aa, Giardia lamblia
DPRKMSASGALNNPRDTSLSSGLQQTPKSA

SEQ ID NO: 3104603 - protein, 7 aa, Giardia lamblia
DPRNNTL

SEQ ID NO: 3104604 - protein, 9 aa, Giardia lamblia
DPRPEHRSG

SEQ ID NO: 3104605 - protein, 5 aa, Giardia lamblia
DPRPR

SEQ ID NO: 3104606 - protein, 49 aa, Giardia lamblia
DPRQRRGTGTKEVRSHQSDRVIETSKSQQYEEDKPRSLSPLSQNNLDTP

SEQ ID NO: 3104607 - protein, 4 aa, Giardia lamblia
DPRR

SEQ ID NO: 3104608 - protein, 6 aa, Giardia lamblia
DPRRCE

SEQ ID NO: 3104609 - protein, 14 aa, Giardia lamblia
DPRRKNKSEESVAR

SEQ ID NO: 3104610 - protein, 9 aa, Giardia lamblia
DPRRRPAPR

SEQ ID NO: 3104611 - protein, 5 aa, Giardia lamblia
DPRTG

SEQ ID NO: 3104612 - protein, 4 aa, Giardia lamblia
DPRV

SEQ ID NO: 3104613 - protein, 4 aa, Giardia lamblia
DPSA

SEQ ID NO: 3104614 - protein, 19 aa, Giardia lamblia
DPSAKNKERPSSKATAGLY

SEQ ID NO: 3104615 - protein, 12 aa, Giardia lamblia
DPSARETSRMDS

SEQ ID NO: 3104616 - protein, 10 aa, Giardia lamblia
DPSARPSARE

SEQ ID NO: 3104617 - protein, 7 aa, Giardia lamblia
DPSAYPR

SEQ ID NO: 3104618 - protein, 32 aa, Giardia lamblia
DPSDESSNSYDSDEEYSNEDSNEGSNKDAPDF

SEQ ID NO: 3104619 - protein, 8 aa, Giardia lamblia
DPSDKNYE

SEQ ID NO: 3104620 - protein, 7 aa, Giardia lamblia
DPSDRMS

SEQ ID NO: 3104621 - protein, 5 aa, Giardia lamblia
DPSEN

SEQ ID NO: 3104622 - protein, 16 aa, Giardia lamblia
DPSFPADPATILPPPT

SEQ ID NO: 3104623 - protein, 15 aa, Giardia lamblia
DPSGASNAGQLSQLQ

SEQ ID NO: 3104624 - protein, 7 aa, Giardia lamblia
DPSGNSY

SEQ ID NO: 3104625 - protein, 17 aa, Giardia lamblia
DPSHTDSHSSQRPGSQL

SEQ ID NO: 3104626 - protein, 11 aa, Giardia lamblia
DPSIGSPSPAI

SEQ ID NO: 3104627 - protein, 13 aa, Giardia lamblia
DPSISASDSINTQ

SEQ ID NO: 3104628 - protein, 6 aa, Giardia lamblia
DPSITE

SEQ ID NO: 3104629 - protein, 18 aa, Giardia lamblia
DPSKRPSARDCLKHPYFA

SEQ ID NO: 3104630 - protein, 6 aa, Giardia lamblia
DPSLNT

SEQ ID NO: 3104631 - protein, 6 aa, Giardia lamblia
DPSNTR

SEQ ID NO: 3104632 - protein, 4 aa, Giardia lamblia
DPSP

SEQ ID NO: 3104633 - protein, 7 aa, Giardia lamblia
DPSPAPK

SEQ ID NO: 3104634 - protein, 8 aa, Giardia lamblia
DPSQTGRV

SEQ ID NO: 3104635 - protein, 6 aa, Giardia lamblia
DPSREY

SEQ ID NO: 3104636 - protein, 7 aa, Giardia lamblia
DPSRGNV

SEQ ID NO: 3104637 - protein, 8 aa, Giardia lamblia
DPSRLHSN

SEQ ID NO: 3104638 - protein, 9 aa, Giardia lamblia
DPSSCRTED

SEQ ID NO: 3104639 - protein, 15 aa, Giardia lamblia
DPSSEEWKRPARRGK

SEQ ID NO: 3104640 - protein, 6 aa, Giardia lamblia
DPSSGV

SEQ ID NO: 3104641 - protein, 8 aa, Giardia lamblia
DPSTAKSQ

SEQ ID NO: 3104642 - protein, 8 aa, Giardia lamblia
DPSTEDPE

SEQ ID NO: 3104643 - protein, 6 aa, Giardia lamblia
DPSTQT

SEQ ID NO: 3104644 - protein, 5 aa, Giardia lamblia
DPSTR

SEQ ID NO: 3104645 - protein, 5 aa, Giardia lamblia
DPSTT

SEQ ID NO: 3104646 - protein, 9 aa, Giardia lamblia
DPSTYHGTH

SEQ ID NO: 3104647 - protein, 43 aa, Giardia lamblia
DPSVGLANKREKKPKTPKLTKEEKRAASLSARTAKSKKHKDGV

SEQ ID NO: 3104648 - protein, 5 aa, Giardia lamblia
DPSVN

SEQ ID NO: 3104649 - protein, 6 aa, Giardia lamblia
DPSVTT

SEQ ID NO: 3104650 - protein, 4 aa, Giardia lamblia
DPSW

SEQ ID NO: 3104651 - protein, 13 aa, Giardia lamblia
DPTATVSSLAPSD

SEQ ID NO: 3104652 - protein, 4 aa, Giardia lamblia
DPTD

SEQ ID NO: 3104653 - protein, 20 aa, Giardia lamblia
DPTDASAESDSVASVSSAVD

SEQ ID NO: 3104654 - protein, 8 aa, Giardia lamblia
DPTDDKGV

SEQ ID NO: 3104655 - protein, 7 aa, Giardia lamblia
DPTDEIG

SEQ ID NO: 3104656 - protein, 6 aa, Giardia lamblia
DPTDHL

SEQ ID NO: 3104657 - protein, 7 aa, Giardia lamblia
DPTEIGP

SEQ ID NO: 3104658 - protein, 6 aa, Giardia lamblia
DPTGAK

SEQ ID NO: 3104659 - protein, 6 aa, Giardia lamblia
DPTGGA

SEQ ID NO: 3104660 - protein, 5 aa, Giardia lamblia
DPTGV

SEQ ID NO: 3104661 - protein, 14 aa, Giardia lamblia
DPTIETEDSPSANF

SEQ ID NO: 3104662 - protein, 7 aa, Giardia lamblia
DPTKQEE

SEQ ID NO: 3104663 - protein, 5 aa, Giardia lamblia
DPTNA

SEQ ID NO: 3104664 - protein, 6 aa, Giardia lamblia
DPTNPL

SEQ ID NO: 3104665 - protein, 5 aa, Giardia lamblia
DPTNV

SEQ ID NO: 3104666 - protein, 24 aa, Giardia lamblia
DPTPEISDDISSNDEIDPATLTAE

SEQ ID NO: 3104667 - protein, 5 aa, Giardia lamblia
DPTPL

SEQ ID NO: 3104668 - protein, 9 aa, Giardia lamblia
DPTPNGSYH

SEQ ID NO: 3104669 - protein, 4 aa, Giardia lamblia
DPTQ

SEQ ID NO: 3104670 - protein, 8 aa, Giardia lamblia
DPTQEQYR

SEQ ID NO: 3104671 - protein, 6 aa, Giardia lamblia
DPTQSM

SEQ ID NO: 3104672 - protein, 6 aa, Giardia lamblia
DPTSGI

SEQ ID NO: 3104673 - protein, 8 aa, Giardia lamblia
DPTTGEYL

SEQ ID NO: 3104674 - protein, 4 aa, Giardia lamblia
DPTV

SEQ ID NO: 3104675 - protein, 5 aa, Giardia lamblia
DPVAA

SEQ ID NO: 3104676 - protein, 9 aa, Giardia lamblia
DPVEEQRKH

SEQ ID NO: 3104677 - protein, 10 aa, Giardia lamblia
DPVEGSRNKE

SEQ ID NO: 3104678 - protein, 15 aa, Giardia lamblia
DPVENQRLKNDSPPV

SEQ ID NO: 3104679 - protein, 4 aa, Giardia lamblia
DPVP

SEQ ID NO: 3104680 - protein, 7 aa, Giardia lamblia
DPVPQAR

SEQ ID NO: 3104681 - protein, 7 aa, Giardia lamblia
DPVSKAT

SEQ ID NO: 3104682 - protein, 4 aa, Giardia lamblia
DPVY

SEQ ID NO: 3104683 - protein, 12 aa, Giardia lamblia
DPWGGSPGPMDS

SEQ ID NO: 3104684 - protein, 25 aa, Giardia lamblia
DPWSTSPDSKSGTHSPRKGLQSYQS

SEQ ID NO: 3104685 - protein, 7 aa, Giardia lamblia
DPWTAPL

SEQ ID NO: 3104686 - protein, 7 aa, Giardia lamblia
DPWTPEN

SEQ ID NO: 3104687 - protein, 10 aa, Giardia lamblia
DPYGPSITSA

SEQ ID NO: 3104688 - protein, 19 aa, Giardia lamblia
DPYPGQEMDDKGNAKPLPD

SEQ ID NO: 3104689 - protein, 8 aa, Giardia lamblia
DPYPRAES

SEQ ID NO: 3104690 - protein, 4 aa, Giardia lamblia
DPYT

SEQ ID NO: 3104691 - protein, 5 aa, Giardia lamblia
DPYTI

SEQ ID NO: 3104692 - protein, 5 aa, Giardia lamblia
DPYTL

SEQ ID NO: 3104693 - protein, 16 aa, Giardia lamblia
DQAAPNCTTVKGPAGA

SEQ ID NO: 3104694 - protein, 6 aa, Giardia lamblia
DQADTV

SEQ ID NO: 3104695 - protein, 6 aa, Giardia lamblia
DQAERN

SEQ ID NO: 3104696 - protein, 7 aa, Giardia lamblia
DQAGQFD

SEQ ID NO: 3104697 - protein, 5 aa, Giardia lamblia
DQAKD

SEQ ID NO: 3104698 - protein, 12 aa, Giardia lamblia
DQARTGESEARK

SEQ ID NO: 3104699 - protein, 10 aa, Giardia lamblia
DQASAKATKE

SEQ ID NO: 3104700 - protein, 7 aa, Giardia lamblia
DQASGTT

SEQ ID NO: 3104701 - protein, 11 aa, Giardia lamblia
DQDANAGGLGR

SEQ ID NO: 3104702 - protein, 9 aa, Giardia lamblia
DQDDRSTAA

SEQ ID NO: 3104703 - protein, 9 aa, Giardia lamblia
DQDEARKNC

SEQ ID NO: 3104704 - protein, 21 aa, Giardia lamblia
DQDESGDPCSTSTSGEGSLHE

SEQ ID NO: 3104705 - protein, 31 aa, Giardia lamblia
DQDISPHGEPEYSDSVNKESTEESVHSSLQD

SEQ ID NO: 3104706 - protein, 7 aa, Giardia lamblia
DQDLPTL

SEQ ID NO: 3104707 - protein, 15 aa, Giardia lamblia
DQDPLRGYTSNQNSY

SEQ ID NO: 3104708 - protein, 4 aa, Giardia lamblia
DQDR

SEQ ID NO: 3104709 - protein, 5 aa, Giardia lamblia
DQDRF

SEQ ID NO: 3104710 - protein, 11 aa, Giardia lamblia
DQDRQAASAPA

SEQ ID NO: 3104711 - protein, 13 aa, Giardia lamblia
DQDSQAMATAPLE

SEQ ID NO: 3104712 - protein, 16 aa, Giardia lamblia
DQDSTCLTSDAPRPTC

SEQ ID NO: 3104713 - protein, 7 aa, Giardia lamblia
DQDTATS

SEQ ID NO: 3104714 - protein, 8 aa, Giardia lamblia
DQDTGVQQ

SEQ ID NO: 3104715 - protein, 16 aa, Giardia lamblia
DQDTVATSNGLADRTR

SEQ ID NO: 3104716 - protein, 7 aa, Giardia lamblia
DQEATRL

SEQ ID NO: 3104717 - protein, 8 aa, Giardia lamblia
DQEDQSVG

SEQ ID NO: 3104718 - protein, 6 aa, Giardia lamblia
DQEGPI

SEQ ID NO: 3104719 - protein, 20 aa, Giardia lamblia
DQEGSSVIQTGGTFASSSND

SEQ ID NO: 3104720 - protein, 7 aa, Giardia lamblia
DQEHDSS

SEQ ID NO: 3104721 - protein, 6 aa, Giardia lamblia
DQEKNT

SEQ ID NO: 3104722 - protein, 8 aa, Giardia lamblia
DQELEGPA

SEQ ID NO: 3104723 - protein, 7 aa, Giardia lamblia
DQELSGS

SEQ ID NO: 3104724 - protein, 7 aa, Giardia lamblia
DQEPESV

SEQ ID NO: 3104725 - protein, 10 aa, Giardia lamblia
DQEPPRKSLR

SEQ ID NO: 3104726 - protein, 11 aa, Giardia lamblia
DQESSLYSRPS

SEQ ID NO: 3104727 - protein, 11 aa, Giardia lamblia
DQETQQQTKKR

SEQ ID NO: 3104728 - protein, 7 aa, Giardia lamblia
DQEVPQL

SEQ ID NO: 3104729 - protein, 8 aa, Giardia lamblia
DQEVRGDW

SEQ ID NO: 3104730 - protein, 4 aa, Giardia lamblia
DQFR

SEQ ID NO: 3104731 - protein, 24 aa, Giardia lamblia
DQGAEPAEGGLYKTEEKGAESAEE

SEQ ID NO: 3104732 - protein, 7 aa, Giardia lamblia
DQGDLEV

SEQ ID NO: 3104733 - protein, 11 aa, Giardia lamblia
DQGERDKEKRS

SEQ ID NO: 3104734 - protein, 4 aa, Giardia lamblia
DQGF

SEQ ID NO: 3104735 - protein, 5 aa, Giardia lamblia
DQGFN

SEQ ID NO: 3104736 - protein, 20 aa, Giardia lamblia
DQGIDDHDGGMELEPEEEVH

SEQ ID NO: 3104737 - protein, 8 aa, Giardia lamblia
DQGKLAEK

SEQ ID NO: 3104738 - protein, 4 aa, Giardia lamblia
DQGL

SEQ ID NO: 3104739 - protein, 10 aa, Giardia lamblia
DQGQDQSSVE

SEQ ID NO: 3104740 - protein, 8 aa, Giardia lamblia
DQGRGRGL

SEQ ID NO: 3104741 - protein, 6 aa, Giardia lamblia
DQGSIS

SEQ ID NO: 3104742 - protein, 11 aa, Giardia lamblia
DQGSVGRGRES

SEQ ID NO: 3104743 - protein, 7 aa, Giardia lamblia
DQGTYGM

SEQ ID NO: 3104744 - protein, 16 aa, Giardia lamblia
DQGYDPSGPRSSETRD

SEQ ID NO: 3104745 - protein, 13 aa, Giardia lamblia
DQHATLGSSTEEF

SEQ ID NO: 3104746 - protein, 10 aa, Giardia lamblia
DQHDSANFRG

SEQ ID NO: 3104747 - protein, 13 aa, Giardia lamblia
DQHKSKSTTRPVD

SEQ ID NO: 3104748 - protein, 4 aa, Giardia lamblia
DQHY

SEQ ID NO: 3104749 - protein, 18 aa, Giardia lamblia
DQIDPKPSRNQETAKPKK

SEQ ID NO: 3104750 - protein, 10 aa, Giardia lamblia
DQIEKQRKDI

SEQ ID NO: 3104751 - protein, 5 aa, Giardia lamblia
DQISD

SEQ ID NO: 3104752 - protein, 5 aa, Giardia lamblia
DQKDA

SEQ ID NO: 3104753 - protein, 10 aa, Giardia lamblia
DQKDDQPARL

SEQ ID NO: 3104754 - protein, 40 aa, Giardia lamblia
DQKESSKHEKHKQGVDADNEDEQAKQESEADDICVDEGVS

SEQ ID NO: 3104755 - protein, 22 aa, Giardia lamblia
DQKETSTRLIPNESSGKLSKDT

SEQ ID NO: 3104756 - protein, 7 aa, Giardia lamblia
DQKHTLE

SEQ ID NO: 3104757 - protein, 8 aa, Giardia lamblia
DQKPPSVY

SEQ ID NO: 3104758 - protein, 9 aa, Giardia lamblia
DQKQRELEE

SEQ ID NO: 3104759 - protein, 6 aa, Giardia lamblia
DQKQRR

SEQ ID NO: 3104760 - protein, 6 aa, Giardia lamblia
DQKQRT

SEQ ID NO: 3104761 - protein, 9 aa, Giardia lamblia
DQKRTLNEA

SEQ ID NO: 3104762 - protein, 12 aa, Giardia lamblia
DQLADDKARLQE

SEQ ID NO: 3104763 - protein, 4 aa, Giardia lamblia
DQLD

SEQ ID NO: 3104764 - protein, 11 aa, Giardia lamblia
DQLDDKEKNMA

SEQ ID NO: 3104765 - protein, 10 aa, Giardia lamblia
DQLDEKNRDL

SEQ ID NO: 3104766 - protein, 6 aa, Giardia lamblia
DQLRES

SEQ ID NO: 3104767 - protein, 7 aa, Giardia lamblia
DQLRTTK

SEQ ID NO: 3104768 - protein, 4 aa, Giardia lamblia
DQMH

SEQ ID NO: 3104769 - protein, 11 aa, Giardia lamblia
DQMTATGRDTL

SEQ ID NO: 3104770 - protein, 7 aa, Giardia lamblia
DQNGVST

SEQ ID NO: 3104771 - protein, 12 aa, Giardia lamblia
DQNKQVKQKEIA

SEQ ID NO: 3104772 - protein, 18 aa, Giardia lamblia
DQPAAPTATEEPVATAGD

SEQ ID NO: 3104773 - protein, 37 aa, Giardia lamblia
DQPAFGNKTPITGDSSQRSSADDPTRVDTSGSQAQAE

SEQ ID NO: 3104774 - protein, 8 aa, Giardia lamblia
DQPAKDPL

SEQ ID NO: 3104775 - protein, 8 aa, Giardia lamblia
DQPAPPLA

SEQ ID NO: 3104776 - protein, 6 aa, Giardia lamblia
DQPEGS

SEQ ID NO: 3104777 - protein, 5 aa, Giardia lamblia
DQPEK

SEQ ID NO: 3104778 - protein, 5 aa, Giardia lamblia
DQPGG

SEQ ID NO: 3104779 - protein, 12 aa, Giardia lamblia
DQPGVSQKADYY

SEQ ID NO: 3104780 - protein, 29 aa, Giardia lamblia
DQPGYQRNPSSTSSSFSSAATSTSSFKGY

SEQ ID NO: 3104781 - protein, 5 aa, Giardia lamblia
DQPIA

SEQ ID NO: 3104782 - protein, 7 aa, Giardia lamblia
DQPIPSS

SEQ ID NO: 3104783 - protein, 9 aa, Giardia lamblia
DQPPGSIES

SEQ ID NO: 3104784 - protein, 12 aa, Giardia lamblia
DQPQCRDNDGNL

SEQ ID NO: 3104785 - protein, 23 aa, Giardia lamblia
DQPQNVEESRTIGPRQPWHGRPR

SEQ ID NO: 3104786 - protein, 10 aa, Giardia lamblia
DQPTKSPEEY

SEQ ID NO: 3104787 - protein, 7 aa, Giardia lamblia
DQPTNAC

SEQ ID NO: 3104788 - protein, 14 aa, Giardia lamblia
DQPTQLGPNKGSVK

SEQ ID NO: 3104789 - protein, 5 aa, Giardia lamblia
DQPVN

SEQ ID NO: 3104790 - protein, 11 aa, Giardia lamblia
DQQDCDSKKSA

SEQ ID NO: 3104791 - protein, 14 aa, Giardia lamblia
DQQEDHPHNRDNNP

SEQ ID NO: 3104792 - protein, 5 aa, Giardia lamblia
DQQKV

SEQ ID NO: 3104793 - protein, 6 aa, Giardia lamblia
DQQNQT

SEQ ID NO: 3104794 - protein, 24 aa, Giardia lamblia
DQQPPGDKDVGRPHEKSAKLQSSV

SEQ ID NO: 3104795 - protein, 16 aa, Giardia lamblia
DQQSSDFRLPPNAGTF

SEQ ID NO: 3104796 - protein, 8 aa, Giardia lamblia
DQQSSPDW

SEQ ID NO: 3104797 - protein, 12 aa, Giardia lamblia
DQQTRAGEYGED

SEQ ID NO: 3104798 - protein, 11 aa, Giardia lamblia
DQQTTKASVDQ

SEQ ID NO: 3104799 - protein, 4 aa, Giardia lamblia
DQQV

SEQ ID NO: 3104800 - protein, 8 aa, Giardia lamblia
DQRAPIPN

SEQ ID NO: 3104801 - protein, 7 aa, Giardia lamblia
DQREARE

SEQ ID NO: 3104802 - protein, 14 aa, Giardia lamblia
DQREREGLQTSPAE

SEQ ID NO: 3104803 - protein, 5 aa, Giardia lamblia
DQRGC

SEQ ID NO: 3104804 - protein, 10 aa, Giardia lamblia
DQRGQTTEEG

SEQ ID NO: 3104805 - protein, 5 aa, Giardia lamblia
DQRIY

SEQ ID NO: 3104806 - protein, 4 aa, Giardia lamblia
DQRT

SEQ ID NO: 3104807 - protein, 11 aa, Giardia lamblia
DQRTPLPSQYS

SEQ ID NO: 3104808 - protein, 24 aa, Giardia lamblia
DQSAASETPTSAPHSREGKPRTDK

SEQ ID NO: 3104809 - protein, 6 aa, Giardia lamblia
DQSAHR

SEQ ID NO: 3104810 - protein, 7 aa, Giardia lamblia
DQSDNNT

SEQ ID NO: 3104811 - protein, 16 aa, Giardia lamblia
DQSGDLTLPTNSGRQI

SEQ ID NO: 3104812 - protein, 6 aa, Giardia lamblia
DQSGFS

SEQ ID NO: 3104813 - protein, 7 aa, Giardia lamblia
DQSGLRE

SEQ ID NO: 3104814 - protein, 8 aa, Giardia lamblia
DQSGPDVV

SEQ ID NO: 3104815 - protein, 7 aa, Giardia lamblia
DQSGRCT

SEQ ID NO: 3104816 - protein, 11 aa, Giardia lamblia
DQSGSNQNEDI

SEQ ID NO: 3104817 - protein, 18 aa, Giardia lamblia
DQSHVNESRTVPNVERNE

SEQ ID NO: 3104818 - protein, 10 aa, Giardia lamblia
DQSKESATRK

SEQ ID NO: 3104819 - protein, 13 aa, Giardia lamblia
DQSQYSSLGNRKT

SEQ ID NO: 3104820 - protein, 7 aa, Giardia lamblia
DQSREET

SEQ ID NO: 3104821 - protein, 8 aa, Giardia lamblia
DQSRTATA

SEQ ID NO: 3104822 - protein, 9 aa, Giardia lamblia
DQSSNLKSS

SEQ ID NO: 3104823 - protein, 9 aa, Giardia lamblia
DQSTDSAKA

SEQ ID NO: 3104824 - protein, 21 aa, Giardia lamblia
DQSTEVEESSSEGNDENNSEL

SEQ ID NO: 3104825 - protein, 6 aa, Giardia lamblia
DQSTRE

SEQ ID NO: 3104826 - protein, 17 aa, Giardia lamblia
DQSTTSTPSISGSRPVS

SEQ ID NO: 3104827 - protein, 13 aa, Giardia lamblia
DQSVRSKTRSVPR

SEQ ID NO: 3104828 - protein, 5 aa, Giardia lamblia
DQTAP

SEQ ID NO: 3104829 - protein, 7 aa, Giardia lamblia
DQTDATV

SEQ ID NO: 3104830 - protein, 8 aa, Giardia lamblia
DQTDPDRL

SEQ ID NO: 3104831 - protein, 16 aa, Giardia lamblia
DQTEQCVDEANKSLET

SEQ ID NO: 3104832 - protein, 6 aa, Giardia lamblia
DQTETA

SEQ ID NO: 3104833 - protein, 16 aa, Giardia lamblia
DQTKESASSLVDPTPA

SEQ ID NO: 3104834 - protein, 8 aa, Giardia lamblia
DQTMQRGT

SEQ ID NO: 3104835 - protein, 6 aa, Giardia lamblia
DQTNAN

SEQ ID NO: 3104836 - protein, 4 aa, Giardia lamblia
DQTP

SEQ ID NO: 3104837 - protein, 8 aa, Giardia lamblia
DQTRAKNA

SEQ ID NO: 3104838 - protein, 7 aa, Giardia lamblia
DQTTDNR

SEQ ID NO: 3104839 - protein, 5 aa, Giardia lamblia
DQTTS

SEQ ID NO: 3104840 - protein, 8 aa, Giardia lamblia
DQVPPHTI

SEQ ID NO: 3104841 - protein, 8 aa, Giardia lamblia
DQVRDQGE

SEQ ID NO: 3104842 - protein, 24 aa, Giardia lamblia
DQVRERKREHVAARNKAAATRADK

SEQ ID NO: 3104843 - protein, 10 aa, Giardia lamblia
DQVSQQKGEI

SEQ ID NO: 3104844 - protein, 10 aa, Giardia lamblia
DQVTRDQANL

SEQ ID NO: 3104845 - protein, 4 aa, Giardia lamblia
DQYD

SEQ ID NO: 3104846 - protein, 26 aa, Giardia lamblia
DQYDSQSVADCKENPYASHGSQVSRS

SEQ ID NO: 3104847 - protein, 5 aa, Giardia lamblia
DRAEQ

SEQ ID NO: 3104848 - protein, 5 aa, Giardia lamblia
DRAER

SEQ ID NO: 3104849 - protein, 8 aa, Giardia lamblia
DRAERARS

SEQ ID NO: 3104850 - protein, 17 aa, Giardia lamblia
DRAESLATQSDRLLSSY

SEQ ID NO: 3104851 - protein, 8 aa, Giardia lamblia
DRAGKDTM

SEQ ID NO: 3104852 - protein, 9 aa, Giardia lamblia
DRAKQLNTT

SEQ ID NO: 3104853 - protein, 11 aa, Giardia lamblia
DRAKSAAVDAN

SEQ ID NO: 3104854 - protein, 7 aa, Giardia lamblia
DRANDEI

SEQ ID NO: 3104855 - protein, 8 aa, Giardia lamblia
DRANDETI

SEQ ID NO: 3104856 - protein, 24 aa, Giardia lamblia
DRAQNASTSASSSIKKASGARKKV

SEQ ID NO: 3104857 - protein, 11 aa, Giardia lamblia
DRARSPESTRS

SEQ ID NO: 3104858 - protein, 7 aa, Giardia lamblia
DRASESV

SEQ ID NO: 3104859 - protein, 8 aa, Giardia lamblia
DRASNDNS

SEQ ID NO: 3104860 - protein, 5 aa, Giardia lamblia
DRASS

SEQ ID NO: 3104861 - protein, 19 aa, Giardia lamblia
DRASSNEKDEKEASSSEHC

SEQ ID NO: 3104862 - protein, 6 aa, Giardia lamblia
DRASVT

SEQ ID NO: 3104863 - protein, 6 aa, Giardia lamblia
DRATPV

SEQ ID NO: 3104864 - protein, 10 aa, Giardia lamblia
DRCKPKKCNQ

SEQ ID NO: 3104865 - protein, 7 aa, Giardia lamblia
DRDETSN

SEQ ID NO: 3104866 - protein, 9 aa, Giardia lamblia
DRDGALETD

SEQ ID NO: 3104867 - protein, 10 aa, Giardia lamblia
DRDGDGEIDE

SEQ ID NO: 3104868 - protein, 8 aa, Giardia lamblia
DRDGRIEG

SEQ ID NO: 3104869 - protein, 9 aa, Giardia lamblia
DRDGSAADC

SEQ ID NO: 3104870 - protein, 6 aa, Giardia lamblia
DRDHGT

SEQ ID NO: 3104871 - protein, 6 aa, Giardia lamblia
DRDKDR

SEQ ID NO: 3104872 - protein, 6 aa, Giardia lamblia
DRDPDV

SEQ ID NO: 3104873 - protein, 9 aa, Giardia lamblia
DRDQKLGDF

SEQ ID NO: 3104874 - protein, 15 aa, Giardia lamblia
DRDSESTAKNTDSSL

SEQ ID NO: 3104875 - protein, 9 aa, Giardia lamblia
DRDSKEYYG

SEQ ID NO: 3104876 - protein, 8 aa, Giardia lamblia
DRDSLDTL

SEQ ID NO: 3104877 - protein, 9 aa, Giardia lamblia
DRDSMTQKR

SEQ ID NO: 3104878 - protein, 11 aa, Giardia lamblia
DRDTVTSNQHQ

SEQ ID NO: 3104879 - protein, 7 aa, Giardia lamblia
DREANPF

SEQ ID NO: 3104880 - protein, 11 aa, Giardia lamblia
DREARSQPNIK

SEQ ID NO: 3104881 - protein, 10 aa, Giardia lamblia
DREDAEAQLK

SEQ ID NO: 3104882 - protein, 13 aa, Giardia lamblia
DREDPSNSTSQFS

SEQ ID NO: 3104883 - protein, 7 aa, Giardia lamblia
DREEREL

SEQ ID NO: 3104884 - protein, 6 aa, Giardia lamblia
DREFKS

SEQ ID NO: 3104885 - protein, 6 aa, Giardia lamblia
DREGEN

SEQ ID NO: 3104886 - protein, 7 aa, Giardia lamblia
DREGENI

SEQ ID NO: 3104887 - protein, 7 aa, Giardia lamblia
DREGTIE

SEQ ID NO: 3104888 - protein, 5 aa, Giardia lamblia
DREGY

SEQ ID NO: 3104889 - protein, 18 aa, Giardia lamblia
DREHLGPGSYNDTQSFSA

SEQ ID NO: 3104890 - protein, 21 aa, Giardia lamblia
DRELGTPYHSSAGSNVTAAQK

SEQ ID NO: 3104891 - protein, 12 aa, Giardia lamblia
DRELNKQMADGT

SEQ ID NO: 3104892 - protein, 9 aa, Giardia lamblia
DRENAGREE

SEQ ID NO: 3104893 - protein, 6 aa, Giardia lamblia
DREPED

SEQ ID NO: 3104894 - protein, 20 aa, Giardia lamblia
DREPTRDDSASASRNQKGRR

SEQ ID NO: 3104895 - protein, 15 aa, Giardia lamblia
DREQRASSLKEGAIP

SEQ ID NO: 3104896 - protein, 6 aa, Giardia lamblia
DREQRK

SEQ ID NO: 3104897 - protein, 10 aa, Giardia lamblia
DRERGKRRVR

SEQ ID NO: 3104898 - protein, 12 aa, Giardia lamblia
DRESAANTSLGQ

SEQ ID NO: 3104899 - protein, 4 aa, Giardia lamblia
DRET

SEQ ID NO: 3104900 - protein, 6 aa, Giardia lamblia
DRETEE

SEQ ID NO: 3104901 - protein, 7 aa, Giardia lamblia
DRETGGF

SEQ ID NO: 3104902 - protein, 9 aa, Giardia lamblia
DRETTEKKL

SEQ ID NO: 3104903 - protein, 12 aa, Giardia lamblia
DRFAATDSSACS

SEQ ID NO: 3104904 - protein, 13 aa, Giardia lamblia
DRFKNPSNFSTQK

SEQ ID NO: 3104905 - protein, 5 aa, Giardia lamblia
DRGAS

SEQ ID NO: 3104906 - protein, 4 aa, Giardia lamblia
DRGD

SEQ ID NO: 3104907 - protein, 5 aa, Giardia lamblia
DRGDV

SEQ ID NO: 3104908 - protein, 9 aa, Giardia lamblia
DRGEGQVQL

SEQ ID NO: 3104909 - protein, 11 aa, Giardia lamblia
DRGEKDKNGRT

SEQ ID NO: 3104910 - protein, 6 aa, Giardia lamblia
DRGGSG

SEQ ID NO: 3104911 - protein, 6 aa, Giardia lamblia
DRGKQS

SEQ ID NO: 3104912 - protein, 6 aa, Giardia lamblia
DRGNTE

SEQ ID NO: 3104913 - protein, 8 aa, Giardia lamblia
DRGNTLDS

SEQ ID NO: 3104914 - protein, 5 aa, Giardia lamblia
DRGNY

SEQ ID NO: 3104915 - protein, 8 aa, Giardia lamblia
DRGPKGHT

SEQ ID NO: 3104916 - protein, 5 aa, Giardia lamblia
DRGQY

SEQ ID NO: 3104917 - protein, 11 aa, Giardia lamblia
DRGRLQNELRE

SEQ ID NO: 3104918 - protein, 5 aa, Giardia lamblia
DRGSK

SEQ ID NO: 3104919 - protein, 7 aa, Giardia lamblia
DRGSRAL

SEQ ID NO: 3104920 - protein, 6 aa, Giardia lamblia
DRGSRG

SEQ ID NO: 3104921 - protein, 5 aa, Giardia lamblia
DRGTH

SEQ ID NO: 3104922 - protein, 17 aa, Giardia lamblia
DRHNSSTPQYVAPGSSN

SEQ ID NO: 3104923 - protein, 8 aa, Giardia lamblia
DRHQESAP

SEQ ID NO: 3104924 - protein, 4 aa, Giardia lamblia
DRHS

SEQ ID NO: 3104925 - protein, 12 aa, Giardia lamblia
DRHYTGKGRFDY

SEQ ID NO: 3104926 - protein, 5 aa, Giardia lamblia
DRIEN

SEQ ID NO: 3104927 - protein, 15 aa, Giardia lamblia
DRIGASASVAICGGQ

SEQ ID NO: 3104928 - protein, 7 aa, Giardia lamblia
DRIGRPQ

SEQ ID NO: 3104929 - protein, 8 aa, Giardia lamblia
DRINKKTD

SEQ ID NO: 3104930 - protein, 5 aa, Giardia lamblia
DRIPM

SEQ ID NO: 3104931 - protein, 11 aa, Giardia lamblia
DRIPPPSPDGL

SEQ ID NO: 3104932 - protein, 5 aa, Giardia lamblia
DRITA

SEQ ID NO: 3104933 - protein, 7 aa, Giardia lamblia
DRITRAK

SEQ ID NO: 3104934 - protein, 20 aa, Giardia lamblia
DRKEQQSRGMGSSSGTSTDD

SEQ ID NO: 3104935 - protein, 6 aa, Giardia lamblia
DRKGKT

SEQ ID NO: 3104936 - protein, 5 aa, Giardia lamblia
DRKPM

SEQ ID NO: 3104937 - protein, 6 aa, Giardia lamblia
DRKRVS

SEQ ID NO: 3104938 - protein, 7 aa, Giardia lamblia
DRKSTEI

SEQ ID NO: 3104939 - protein, 10 aa, Giardia lamblia
DRKTSAYKST

SEQ ID NO: 3104940 - protein, 8 aa, Giardia lamblia
DRLAGDGD

SEQ ID NO: 3104941 - protein, 9 aa, Giardia lamblia
DRLGGVPPS

SEQ ID NO: 3104942 - protein, 17 aa, Giardia lamblia
DRLGPTQDENSINSDDL

SEQ ID NO: 3104943 - protein, 11 aa, Giardia lamblia
DRLKEAEAELA

SEQ ID NO: 3104944 - protein, 7 aa, Giardia lamblia
DRLNEPA

SEQ ID NO: 3104945 - protein, 8 aa, Giardia lamblia
DRLQDNKG

SEQ ID NO: 3104946 - protein, 6 aa, Giardia lamblia
DRLQET

SEQ ID NO: 3104947 - protein, 5 aa, Giardia lamblia
DRLQS

SEQ ID NO: 3104948 - protein, 6 aa, Giardia lamblia
DRLQTG

SEQ ID NO: 3104949 - protein, 8 aa, Giardia lamblia
DRLSATGE

SEQ ID NO: 3104950 - protein, 10 aa, Giardia lamblia
DRLSGAKRRS

SEQ ID NO: 3104951 - protein, 19 aa, Giardia lamblia
DRMQASAESAAKDISSLTQ

SEQ ID NO: 3104952 - protein, 5 aa, Giardia lamblia
DRNDG

SEQ ID NO: 3104953 - protein, 7 aa, Giardia lamblia
DRNDNNM

SEQ ID NO: 3104954 - protein, 8 aa, Giardia lamblia
DRNDPAAV

SEQ ID NO: 3104955 - protein, 6 aa, Giardia lamblia
DRNDPV

SEQ ID NO: 3104956 - protein, 4 aa, Giardia lamblia
DRNG

SEQ ID NO: 3104957 - protein, 7 aa, Giardia lamblia
DRNGYTS

SEQ ID NO: 3104958 - protein, 9 aa, Giardia lamblia
DRNKDYQDT

SEQ ID NO: 3104959 - protein, 7 aa, Giardia lamblia
DRNPEFT

SEQ ID NO: 3104960 - protein, 5 aa, Giardia lamblia
DRNQI

SEQ ID NO: 3104961 - protein, 9 aa, Giardia lamblia
DRNTESKHI

SEQ ID NO: 3104962 - protein, 4 aa, Giardia lamblia
DRNY

SEQ ID NO: 3104963 - protein, 8 aa, Giardia lamblia
DRPALSES

SEQ ID NO: 3104964 - protein, 5 aa, Giardia lamblia
DRPAM

SEQ ID NO: 3104965 - protein, 23 aa, Giardia lamblia
DRPASKAPIPSRTSAKISARNER

SEQ ID NO: 3104966 - protein, 40 aa, Giardia lamblia
DRPASSTTRQVPSKTAATMGPGSLAASTSARSLDKSARKL

SEQ ID NO: 3104967 - protein, 7 aa, Giardia lamblia
DRPDTAK

SEQ ID NO: 3104968 - protein, 5 aa, Giardia lamblia
DRPDY

SEQ ID NO: 3104969 - protein, 13 aa, Giardia lamblia
DRPGSTIKTHEQA

SEQ ID NO: 3104970 - protein, 5 aa, Giardia lamblia
DRPKV

SEQ ID NO: 3104971 - protein, 6 aa, Giardia lamblia
DRPNLT

SEQ ID NO: 3104972 - protein, 12 aa, Giardia lamblia
DRPSDGGTDARS

SEQ ID NO: 3104973 - protein, 5 aa, Giardia lamblia
DRPSN

SEQ ID NO: 3104974 - protein, 5 aa, Giardia lamblia
DRPSP

SEQ ID NO: 3104975 - protein, 7 aa, Giardia lamblia
DRPSTET

SEQ ID NO: 3104976 - protein, 15 aa, Giardia lamblia
DRPSTRVSNKKQRPS

SEQ ID NO: 3104977 - protein, 5 aa, Giardia lamblia
DRPSV

SEQ ID NO: 3104978 - protein, 7 aa, Giardia lamblia
DRPTHKL

SEQ ID NO: 3104979 - protein, 8 aa, Giardia lamblia
DRPVGGST

SEQ ID NO: 3104980 - protein, 5 aa, Giardia lamblia
DRQGQ

SEQ ID NO: 3104981 - protein, 10 aa, Giardia lamblia
DRQGQVDPSI

SEQ ID NO: 3104982 - protein, 21 aa, Giardia lamblia
DRQHREDRYESHGNRKNRRSF

SEQ ID NO: 3104983 - protein, 4 aa, Giardia lamblia
DRQL

SEQ ID NO: 3104984 - protein, 5 aa, Giardia lamblia
DRQQR

SEQ ID NO: 3104985 - protein, 7 aa, Giardia lamblia
DRQRPYT

SEQ ID NO: 3104986 - protein, 6 aa, Giardia lamblia
DRQTGT

SEQ ID NO: 3104987 - protein, 15 aa, Giardia lamblia
DRRCGTGSSVTVSGV

SEQ ID NO: 3104988 - protein, 6 aa, Giardia lamblia
DRRGRS

SEQ ID NO: 3104989 - protein, 9 aa, Giardia lamblia
DRRGTEEDT

SEQ ID NO: 3104990 - protein, 14 aa, Giardia lamblia
DRRHQGTGERAFPK

SEQ ID NO: 3104991 - protein, 9 aa, Giardia lamblia
DRRPTTEPF

SEQ ID NO: 3104992 - protein, 20 aa, Giardia lamblia
DRRRREYELEKEEDEEYARR

SEQ ID NO: 3104993 - protein, 7 aa, Giardia lamblia
DRRRSIN

SEQ ID NO: 3104994 - protein, 7 aa, Giardia lamblia
DRRTERD

SEQ ID NO: 3104995 - protein, 14 aa, Giardia lamblia
DRRTSGTGGLPRNA

SEQ ID NO: 3104996 - protein, 10 aa, Giardia lamblia
DRRTYPQKGS

SEQ ID NO: 3104997 - protein, 12 aa, Giardia lamblia
DRSDTSVTPSVT

SEQ ID NO: 3104998 - protein, 17 aa, Giardia lamblia
DRSDYNTCERTARYDGM

SEQ ID NO: 3104999 - protein, 12 aa, Giardia lamblia
DRSEYSTSSAQD

SEQ ID NO: 3105000 - protein, 8 aa, Giardia lamblia
DRSGGWKS

SEQ ID NO: 3105001 - protein, 13 aa, Giardia lamblia
DRSGHLAALNAIA

SEQ ID NO: 3105002 - protein, 6 aa, Giardia lamblia
DRSGQM

SEQ ID NO: 3105003 - protein, 5 aa, Giardia lamblia
DRSGR

SEQ ID NO: 3105004 - protein, 9 aa, Giardia lamblia
DRSGSIGTN

SEQ ID NO: 3105005 - protein, 21 aa, Giardia lamblia
DRSHEDASTRRNIDEEKAELL

SEQ ID NO: 3105006 - protein, 8 aa, Giardia lamblia
DRSHNAVS

SEQ ID NO: 3105007 - protein, 5 aa, Giardia lamblia
DRSIR

SEQ ID NO: 3105008 - protein, 4 aa, Giardia lamblia
DRSN

SEQ ID NO: 3105009 - protein, 6 aa, Giardia lamblia
DRSNDP

SEQ ID NO: 3105010 - protein, 6 aa, Giardia lamblia
DRSNLP

SEQ ID NO: 3105011 - protein, 34 aa, Giardia lamblia
DRSPEEQPRRKPPSVLSRQSEERAVSRSKSTTPM

SEQ ID NO: 3105012 - protein, 7 aa, Giardia lamblia
DRSPSMT

SEQ ID NO: 3105013 - protein, 30 aa, Giardia lamblia
DRSSKPKPERARLSKGSSVGRRADASPPNV

SEQ ID NO: 3105014 - protein, 15 aa, Giardia lamblia
DRSSLTGTSPYKGSL

SEQ ID NO: 3105015 - protein, 13 aa, Giardia lamblia
DRSTIPDDNTMNK

SEQ ID NO: 3105016 - protein, 20 aa, Giardia lamblia
DRSTQNGALPGESNDDSWNS

SEQ ID NO: 3105017 - protein, 7 aa, Giardia lamblia
DRSTQTP

SEQ ID NO: 3105018 - protein, 15 aa, Giardia lamblia
DRSTRSLKNVQSTTA

SEQ ID NO: 3105019 - protein, 5 aa, Giardia lamblia
DRSVP

SEQ ID NO: 3105020 - protein, 6 aa, Giardia lamblia
DRSVPA

SEQ ID NO: 3105021 - protein, 29 aa, Giardia lamblia
DRSYNPRGAEQSRSDPTVKSDKKQKTPAF

SEQ ID NO: 3105022 - protein, 14 aa, Giardia lamblia
DRTDNVEEAQVPDD

SEQ ID NO: 3105023 - protein, 8 aa, Giardia lamblia
DRTEDYGK

SEQ ID NO: 3105024 - protein, 8 aa, Giardia lamblia
DRTETKGT

SEQ ID NO: 3105025 - protein, 8 aa, Giardia lamblia
DRTGAQSP

SEQ ID NO: 3105026 - protein, 5 aa, Giardia lamblia
DRTGM

SEQ ID NO: 3105027 - protein, 12 aa, Giardia lamblia
DRTLKSASSTTL

SEQ ID NO: 3105028 - protein, 6 aa, Giardia lamblia
DRTPAY

SEQ ID NO: 3105029 - protein, 7 aa, Giardia lamblia
DRTPKQR

SEQ ID NO: 3105030 - protein, 5 aa, Giardia lamblia
DRTPL

SEQ ID NO: 3105031 - protein, 8 aa, Giardia lamblia
DRTSDRDV

SEQ ID NO: 3105032 - protein, 16 aa, Giardia lamblia
DRTTSASSTSSGASGT

SEQ ID NO: 3105033 - protein, 8 aa, Giardia lamblia
DRTTSPVK

SEQ ID NO: 3105034 - protein, 4 aa, Giardia lamblia
DRTV

SEQ ID NO: 3105035 - protein, 8 aa, Giardia lamblia
DRVDDPGY

SEQ ID NO: 3105036 - protein, 9 aa, Giardia lamblia
DRVNGTTRS

SEQ ID NO: 3105037 - protein, 6 aa, Giardia lamblia
DRVPVT

SEQ ID NO: 3105038 - protein, 4 aa, Giardia lamblia
DRVS

SEQ ID NO: 3105039 - protein, 21 aa, Giardia lamblia
DRVSEKDKERPKYSARKGTKD

SEQ ID NO: 3105040 - protein, 6 aa, Giardia lamblia
DRVSKA

SEQ ID NO: 3105041 - protein, 5 aa, Giardia lamblia
DRYEG

SEQ ID NO: 3105042 - protein, 4 aa, Giardia lamblia
DRYG

SEQ ID NO: 3105043 - protein, 22 aa, Giardia lamblia
DRYKPDNIDKAADDGQQQGLGG

SEQ ID NO: 3105044 - protein, 13 aa, Giardia lamblia
DRYNTKDTTGREG

SEQ ID NO: 3105045 - protein, 4 aa, Giardia lamblia
DRYP

SEQ ID NO: 3105046 - protein, 6 aa, Giardia lamblia
DRYQQT

SEQ ID NO: 3105047 - protein, 16 aa, Giardia lamblia
DRYRSGSVVTPSFSRI

SEQ ID NO: 3105048 - protein, 5 aa, Giardia lamblia
DRYSE

SEQ ID NO: 3105049 - protein, 13 aa, Giardia lamblia
DRYSRKRNMSRQT

SEQ ID NO: 3105050 - protein, 5 aa, Giardia lamblia
DRYSV

SEQ ID NO: 3105051 - protein, 10 aa, Giardia lamblia
DSAAETNDGA

SEQ ID NO: 3105052 - protein, 5 aa, Giardia lamblia
DSAAM

SEQ ID NO: 3105053 - protein, 7 aa, Giardia lamblia
DSAAPNL

SEQ ID NO: 3105054 - protein, 19 aa, Giardia lamblia
DSAASRSALGDKDVNIPPE

SEQ ID NO: 3105055 - protein, 6 aa, Giardia lamblia
DSADLS

SEQ ID NO: 3105056 - protein, 7 aa, Giardia lamblia
DSAEARA

SEQ ID NO: 3105057 - protein, 5 aa, Giardia lamblia
DSAEM

SEQ ID NO: 3105058 - protein, 6 aa, Giardia lamblia
DSAGHT

SEQ ID NO: 3105059 - protein, 50 aa, Giardia lamblia
DSAGSSRKGGRTQKKGYGKSVKTTGSQDLTDADLEPPADQRTHDGYRNAY

SEQ ID NO: 3105060 - protein, 14 aa, Giardia lamblia
DSAKGDKSDKNDEF

SEQ ID NO: 3105061 - protein, 12 aa, Giardia lamblia
DSALSTAAFHIA

SEQ ID NO: 3105062 - protein, 14 aa, Giardia lamblia
DSANGNEDPGEKPV

SEQ ID NO: 3105063 - protein, 4 aa, Giardia lamblia
DSAP

SEQ ID NO: 3105064 - protein, 35 aa, Giardia lamblia
DSAPAFSLSGRSDINSRNSNPGPGTYDQNESPIRR

SEQ ID NO: 3105065 - protein, 10 aa, Giardia lamblia
DSAPSRTGEI

SEQ ID NO: 3105066 - protein, 6 aa, Giardia lamblia
DSAPTN

SEQ ID NO: 3105067 - protein, 10 aa, Giardia lamblia
DSAPYQSPSL

SEQ ID NO: 3105068 - protein, 17 aa, Giardia lamblia
DSAQARSGGVSTIPPYS

SEQ ID NO: 3105069 - protein, 5 aa, Giardia lamblia
DSAQE

SEQ ID NO: 3105070 - protein, 11 aa, Giardia lamblia
DSARNPASTKD

SEQ ID NO: 3105071 - protein, 9 aa, Giardia lamblia
DSASGVTDV

SEQ ID NO: 3105072 - protein, 8 aa, Giardia lamblia
DSASISKS

SEQ ID NO: 3105073 - protein, 32 aa, Giardia lamblia
DSASRNVSVNPTLQSTNPSNIQTAQENTISPN

SEQ ID NO: 3105074 - protein, 6 aa, Giardia lamblia
DSASRR

SEQ ID NO: 3105075 - protein, 9 aa, Giardia lamblia
DSASTYERN

SEQ ID NO: 3105076 - protein, 20 aa, Giardia lamblia
DSASYSEDRSRDSATPGAQA

SEQ ID NO: 3105077 - protein, 7 aa, Giardia lamblia
DSATDID

SEQ ID NO: 3105078 - protein, 7 aa, Giardia lamblia
DSATIAP

SEQ ID NO: 3105079 - protein, 9 aa, Giardia lamblia
DSATKLEHQ

SEQ ID NO: 3105080 - protein, 22 aa, Giardia lamblia
DSATPTDCLPPEGYKSASAGAN

SEQ ID NO: 3105081 - protein, 17 aa, Giardia lamblia
DSATTCQREESASEKFE

SEQ ID NO: 3105082 - protein, 14 aa, Giardia lamblia
DSAYADDGQSSTAR

SEQ ID NO: 3105083 - protein, 7 aa, Giardia lamblia
DSAYSNE

SEQ ID NO: 3105084 - protein, 6 aa, Giardia lamblia
DSCASK

SEQ ID NO: 3105085 - protein, 13 aa, Giardia lamblia
DSCETAKETDDKL

SEQ ID NO: 3105086 - protein, 5 aa, Giardia lamblia
DSCGR

SEQ ID NO: 3105087 - protein, 15 aa, Giardia lamblia
DSCPSGSSGSCDKSN

SEQ ID NO: 3105088 - protein, 6 aa, Giardia lamblia
DSCRDD

SEQ ID NO: 3105089 - protein, 4 aa, Giardia lamblia
DSCT

SEQ ID NO: 3105090 - protein, 8 aa, Giardia lamblia
DSDAAARI

SEQ ID NO: 3105091 - protein, 9 aa, Giardia lamblia
DSDAEAARL

SEQ ID NO: 3105092 - protein, 14 aa, Giardia lamblia
DSDALPAPGTTEYY

SEQ ID NO: 3105093 - protein, 5 aa, Giardia lamblia
DSDAV

SEQ ID NO: 3105094 - protein, 16 aa, Giardia lamblia
DSDCSSRFDDDLSRSR

SEQ ID NO: 3105095 - protein, 10 aa, Giardia lamblia
DSDDDSIDRA

SEQ ID NO: 3105096 - protein, 14 aa, Giardia lamblia
DSDDEDEKNDSVIP

SEQ ID NO: 3105097 - protein, 53 aa, Giardia lamblia
DSDHSDPLDRGCTGGQVSPLTSSRHRRESQKSSCSKSSASPEASASSHSNTNP

SEQ ID NO: 3105098 - protein, 6 aa, Giardia lamblia
DSDKYT

SEQ ID NO: 3105099 - protein, 26 aa, Giardia lamblia
DSDNDGSSKCAAPGSSATESATPTPV

SEQ ID NO: 3105100 - protein, 9 aa, Giardia lamblia
DSDNDSRIN

SEQ ID NO: 3105101 - protein, 9 aa, Giardia lamblia
DSDNGPSGK

SEQ ID NO: 3105102 - protein, 7 aa, Giardia lamblia
DSDPGKI

SEQ ID NO: 3105103 - protein, 11 aa, Giardia lamblia
DSDPPKITRKE

SEQ ID NO: 3105104 - protein, 19 aa, Giardia lamblia
DSDPSDPDAPAQEDKIEAP

SEQ ID NO: 3105105 - protein, 8 aa, Giardia lamblia
DSDPSTQT

SEQ ID NO: 3105106 - protein, 14 aa, Giardia lamblia
DSDQELDSQQHTED

SEQ ID NO: 3105107 - protein, 5 aa, Giardia lamblia
DSDRL

SEQ ID NO: 3105108 - protein, 4 aa, Giardia lamblia
DSDS

SEQ ID NO: 3105109 - protein, 17 aa, Giardia lamblia
DSDSDGSLLTESVPDEP

SEQ ID NO: 3105110 - protein, 10 aa, Giardia lamblia
DSDSPQQSNL

SEQ ID NO: 3105111 - protein, 6 aa, Giardia lamblia
DSDSRM

SEQ ID NO: 3105112 - protein, 5 aa, Giardia lamblia
DSDSY

SEQ ID NO: 3105113 - protein, 19 aa, Giardia lamblia
DSDTDNSSISAQGKSDRRA

SEQ ID NO: 3105114 - protein, 6 aa, Giardia lamblia
DSEAAN

SEQ ID NO: 3105115 - protein, 4 aa, Giardia lamblia
DSED

SEQ ID NO: 3105116 - protein, 14 aa, Giardia lamblia
DSEDITPANRSVTD

SEQ ID NO: 3105117 - protein, 11 aa, Giardia lamblia
DSEDKSLGNSY

SEQ ID NO: 3105118 - protein, 17 aa, Giardia lamblia
DSEDPTQTEFSEGTTSR

SEQ ID NO: 3105119 - protein, 11 aa, Giardia lamblia
DSEDSRASEAN

SEQ ID NO: 3105120 - protein, 6 aa, Giardia lamblia
DSEDSV

SEQ ID NO: 3105121 - protein, 4 aa, Giardia lamblia
DSEE

SEQ ID NO: 3105122 - protein, 16 aa, Giardia lamblia
DSEESGIDRKNRGKEL

SEQ ID NO: 3105123 - protein, 8 aa, Giardia lamblia
DSEGLKVT

SEQ ID NO: 3105124 - protein, 6 aa, Giardia lamblia
DSEGNT

SEQ ID NO: 3105125 - protein, 12 aa, Giardia lamblia
DSEGPQPSRELD

SEQ ID NO: 3105126 - protein, 8 aa, Giardia lamblia
DSEGQSDL

SEQ ID NO: 3105127 - protein, 8 aa, Giardia lamblia
DSEGTFDD

SEQ ID NO: 3105128 - protein, 10 aa, Giardia lamblia
DSELRTETES

SEQ ID NO: 3105129 - protein, 14 aa, Giardia lamblia
DSELSDSTQPRIDT

SEQ ID NO: 3105130 - protein, 24 aa, Giardia lamblia
DSEMEETTAESKVANDSDYPSFTE

SEQ ID NO: 3105131 - protein, 14 aa, Giardia lamblia
DSEMKSRLAALFAG

SEQ ID NO: 3105132 - protein, 23 aa, Giardia lamblia
DSENALKQDEEDYDAKSQSTLPE

SEQ ID NO: 3105133 - protein, 8 aa, Giardia lamblia
DSENAREA

SEQ ID NO: 3105134 - protein, 15 aa, Giardia lamblia
DSENDMDDVDSQSHE

SEQ ID NO: 3105135 - protein, 7 aa, Giardia lamblia
DSEPDRS

SEQ ID NO: 3105136 - protein, 7 aa, Giardia lamblia
DSEQAEH

SEQ ID NO: 3105137 - protein, 4 aa, Giardia lamblia
DSER

SEQ ID NO: 3105138 - protein, 25 aa, Giardia lamblia
DSESDTSTIADKSHLSSQKKYFGSK

SEQ ID NO: 3105139 - protein, 20 aa, Giardia lamblia
DSESIEQGYDDAAYRLMFLM

SEQ ID NO: 3105140 - protein, 52 aa, Giardia lamblia
DSESTECVSTSTEGDKSSRDDISEDDISESGKQEEHETEPPLKQQERGDANN

SEQ ID NO: 3105141 - protein, 8 aa, Giardia lamblia
DSETIEES

SEQ ID NO: 3105142 - protein, 7 aa, Giardia lamblia
DSETPMV

SEQ ID NO: 3105143 - protein, 12 aa, Giardia lamblia
DSFDGFSQTKNN

SEQ ID NO: 3105144 - protein, 47 aa, Giardia lamblia
DSFDREAHKRKNRRKSKRRAASEQESSYDDSSFDESEEEMQSKRKQK

SEQ ID NO: 3105145 - protein, 6 aa, Giardia lamblia
DSFGRT

SEQ ID NO: 3105146 - protein, 14 aa, Giardia lamblia
DSFQATSSVKATSL

SEQ ID NO: 3105147 - protein, 6 aa, Giardia lamblia
DSFQGS

SEQ ID NO: 3105148 - protein, 4 aa, Giardia lamblia
DSFR

SEQ ID NO: 3105149 - protein, 4 aa, Giardia lamblia
DSFT

SEQ ID NO: 3105150 - protein, 5 aa, Giardia lamblia
DSGAA

SEQ ID NO: 3105151 - protein, 8 aa, Giardia lamblia
DSGAASTS

SEQ ID NO: 3105152 - protein, 9 aa, Giardia lamblia
DSGADGYAQ

SEQ ID NO: 3105153 - protein, 12 aa, Giardia lamblia
DSGANQSKTRDM

SEQ ID NO: 3105154 - protein, 6 aa, Giardia lamblia
DSGATN

SEQ ID NO: 3105155 - protein, 12 aa, Giardia lamblia
DSGDGQKPTIAN

SEQ ID NO: 3105156 - protein, 13 aa, Giardia lamblia
DSGDIRPPISAPH

SEQ ID NO: 3105157 - protein, 5 aa, Giardia lamblia
DSGEK

SEQ ID NO: 3105158 - protein, 5 aa, Giardia lamblia
DSGFN

SEQ ID NO: 3105159 - protein, 12 aa, Giardia lamblia
DSGGPGNSPGSI

SEQ ID NO: 3105160 - protein, 6 aa, Giardia lamblia
DSGIGT

SEQ ID NO: 3105161 - protein, 8 aa, Giardia lamblia
DSGKASLP

SEQ ID NO: 3105162 - protein, 8 aa, Giardia lamblia
DSGKRAAI

SEQ ID NO: 3105163 - protein, 4 aa, Giardia lamblia
DSGL

SEQ ID NO: 3105164 - protein, 5 aa, Giardia lamblia
DSGNA

SEQ ID NO: 3105165 - protein, 17 aa, Giardia lamblia
DSGNDNSDGSDEDEGDV

SEQ ID NO: 3105166 - protein, 5 aa, Giardia lamblia
DSGNR

SEQ ID NO: 3105167 - protein, 8 aa, Giardia lamblia
DSGNRGAL

SEQ ID NO: 3105168 - protein, 10 aa, Giardia lamblia
DSGNRTKTWS

SEQ ID NO: 3105169 - protein, 7 aa, Giardia lamblia
DSGQRSV

SEQ ID NO: 3105170 - protein, 5 aa, Giardia lamblia
DSGRG

SEQ ID NO: 3105171 - protein, 8 aa, Giardia lamblia
DSGRIRRR

SEQ ID NO: 3105172 - protein, 8 aa, Giardia lamblia
DSGSDDPF

SEQ ID NO: 3105173 - protein, 16 aa, Giardia lamblia
DSGSQLVNERETAGLG

SEQ ID NO: 3105174 - protein, 4 aa, Giardia lamblia
DSGT

SEQ ID NO: 3105175 - protein, 7 aa, Giardia lamblia
DSGTDSS

SEQ ID NO: 3105176 - protein, 4 aa, Giardia lamblia
DSGV

SEQ ID NO: 3105177 - protein, 7 aa, Giardia lamblia
DSGVGKS

SEQ ID NO: 3105178 - protein, 7 aa, Giardia lamblia
DSGVQPT

SEQ ID NO: 3105179 - protein, 7 aa, Giardia lamblia
DSGYETS

SEQ ID NO: 3105180 - protein, 6 aa, Giardia lamblia
DSHAAT

SEQ ID NO: 3105181 - protein, 6 aa, Giardia lamblia
DSHGET

SEQ ID NO: 3105182 - protein, 7 aa, Giardia lamblia
DSHGNTP

SEQ ID NO: 3105183 - protein, 6 aa, Giardia lamblia
DSHHYS

SEQ ID NO: 3105184 - protein, 17 aa, Giardia lamblia
DSHKTLGSSSLNSKITK

SEQ ID NO: 3105185 - protein, 6 aa, Giardia lamblia
DSHLNE

SEQ ID NO: 3105186 - protein, 14 aa, Giardia lamblia
DSHPLSAGSPEPTL

SEQ ID NO: 3105187 - protein, 6 aa, Giardia lamblia
DSHPQG

SEQ ID NO: 3105188 - protein, 19 aa, Giardia lamblia
DSHSTKPACIGGDADGTEW

SEQ ID NO: 3105189 - protein, 21 aa, Giardia lamblia
DSIAKAERDLEEAESKRAINA

SEQ ID NO: 3105190 - protein, 14 aa, Giardia lamblia
DSIDDSGGPPGPSH

SEQ ID NO: 3105191 - protein, 6 aa, Giardia lamblia
DSIDEP

SEQ ID NO: 3105192 - protein, 4 aa, Giardia lamblia
DSIE

SEQ ID NO: 3105193 - protein, 5 aa, Giardia lamblia
DSIEG

SEQ ID NO: 3105194 - protein, 5 aa, Giardia lamblia
DSIER

SEQ ID NO: 3105195 - protein, 7 aa, Giardia lamblia
DSIGHGK

SEQ ID NO: 3105196 - protein, 9 aa, Giardia lamblia
DSIKANRER

SEQ ID NO: 3105197 - protein, 16 aa, Giardia lamblia
DSIKQAEKEEESRKAH

SEQ ID NO: 3105198 - protein, 13 aa, Giardia lamblia
DSIQNKKTYTHNK

SEQ ID NO: 3105199 - protein, 7 aa, Giardia lamblia
DSIQRTI

SEQ ID NO: 3105200 - protein, 12 aa, Giardia lamblia
DSIQTARTATEL

SEQ ID NO: 3105201 - protein, 10 aa, Giardia lamblia
DSIREPGNDD

SEQ ID NO: 3105202 - protein, 32 aa, Giardia lamblia
DSISDSASEPSAHEGEPKRKHLGYNDAEQLTS

SEQ ID NO: 3105203 - protein, 13 aa, Giardia lamblia
DSISPNTTPTDCQ

SEQ ID NO: 3105204 - protein, 8 aa, Giardia lamblia
DSITSRNA

SEQ ID NO: 3105205 - protein, 10 aa, Giardia lamblia
DSKAAQEGRI

SEQ ID NO: 3105206 - protein, 16 aa, Giardia lamblia
DSKADGVSPIGSAGSN

SEQ ID NO: 3105207 - protein, 9 aa, Giardia lamblia
DSKAQAREV

SEQ ID NO: 3105208 - protein, 8 aa, Giardia lamblia
DSKAYEQL

SEQ ID NO: 3105209 - protein, 9 aa, Giardia lamblia
DSKDASGTE

SEQ ID NO: 3105210 - protein, 7 aa, Giardia lamblia
DSKDNRD

SEQ ID NO: 3105211 - protein, 9 aa, Giardia lamblia
DSKDPDSIV

SEQ ID NO: 3105212 - protein, 13 aa, Giardia lamblia
DSKDSPSCPGGPI

SEQ ID NO: 3105213 - protein, 4 aa, Giardia lamblia
DSKE

SEQ ID NO: 3105214 - protein, 8 aa, Giardia lamblia
DSKEANDG

SEQ ID NO: 3105215 - protein, 14 aa, Giardia lamblia
DSKESTHEKTYEED

SEQ ID NO: 3105216 - protein, 6 aa, Giardia lamblia
DSKGLV

SEQ ID NO: 3105217 - protein, 10 aa, Giardia lamblia
DSKKGGDPHE

SEQ ID NO: 3105218 - protein, 7 aa, Giardia lamblia
DSKKTTE

SEQ ID NO: 3105219 - protein, 7 aa, Giardia lamblia
DSKLNES

SEQ ID NO: 3105220 - protein, 33 aa, Giardia lamblia
DSKLSTRKQGGSPVATSMDGTSSKGEVSSLSDQ

SEQ ID NO: 3105221 - protein, 7 aa, Giardia lamblia
DSKNESA

SEQ ID NO: 3105222 - protein, 7 aa, Giardia lamblia
DSKPDID

SEQ ID NO: 3105223 - protein, 7 aa, Giardia lamblia
DSKPGVE

SEQ ID NO: 3105224 - protein, 8 aa, Giardia lamblia
DSKRCSAK

SEQ ID NO: 3105225 - protein, 11 aa, Giardia lamblia
DSKRDEDATMT

SEQ ID NO: 3105226 - protein, 5 aa, Giardia lamblia
DSKRI

SEQ ID NO: 3105227 - protein, 5 aa, Giardia lamblia
DSKRY

SEQ ID NO: 3105228 - protein, 7 aa, Giardia lamblia
DSKSGAI

SEQ ID NO: 3105229 - protein, 13 aa, Giardia lamblia
DSKSGRTTQGLTK

SEQ ID NO: 3105230 - protein, 6 aa, Giardia lamblia
DSKTQV

SEQ ID NO: 3105231 - protein, 9 aa, Giardia lamblia
DSKTSTQQY

SEQ ID NO: 3105232 - protein, 6 aa, Giardia lamblia
DSLAGD

SEQ ID NO: 3105233 - protein, 14 aa, Giardia lamblia
DSLDDGKSTISRRT

SEQ ID NO: 3105234 - protein, 6 aa, Giardia lamblia
DSLDPK

SEQ ID NO: 3105235 - protein, 4 aa, Giardia lamblia
DSLE

SEQ ID NO: 3105236 - protein, 5 aa, Giardia lamblia
DSLEP

SEQ ID NO: 3105237 - protein, 5 aa, Giardia lamblia
DSLGA

SEQ ID NO: 3105238 - protein, 6 aa, Giardia lamblia
DSLGKE

SEQ ID NO: 3105239 - protein, 18 aa, Giardia lamblia
DSLGSGKLSGDEKYQPEI

SEQ ID NO: 3105240 - protein, 13 aa, Giardia lamblia
DSLGTTSEPSQQL

SEQ ID NO: 3105241 - protein, 10 aa, Giardia lamblia
DSLNAPKKYG

SEQ ID NO: 3105242 - protein, 6 aa, Giardia lamblia
DSLNGA

SEQ ID NO: 3105243 - protein, 7 aa, Giardia lamblia
DSLNPQS

SEQ ID NO: 3105244 - protein, 17 aa, Giardia lamblia
DSLPQDNAVEGGGLSSL

SEQ ID NO: 3105245 - protein, 25 aa, Giardia lamblia
DSLPRQQSCSKSDAFETSTKNIPID

SEQ ID NO: 3105246 - protein, 6 aa, Giardia lamblia
DSLPTK

SEQ ID NO: 3105247 - protein, 7 aa, Giardia lamblia
DSLPTSS

SEQ ID NO: 3105248 - protein, 11 aa, Giardia lamblia
DSLSKSVPHSA

SEQ ID NO: 3105249 - protein, 6 aa, Giardia lamblia
DSLSRD

SEQ ID NO: 3105250 - protein, 9 aa, Giardia lamblia
DSLSSSDLE

SEQ ID NO: 3105251 - protein, 8 aa, Giardia lamblia
DSLSSTED

SEQ ID NO: 3105252 - protein, 5 aa, Giardia lamblia
DSLTS

SEQ ID NO: 3105253 - protein, 24 aa, Giardia lamblia
DSMASSNAKFNDVSQEHQTPSLPP

SEQ ID NO: 3105254 - protein, 4 aa, Giardia lamblia
DSMQ

SEQ ID NO: 3105255 - protein, 22 aa, Giardia lamblia
DSMRTGAELPGNTSINNGLSPS

SEQ ID NO: 3105256 - protein, 8 aa, Giardia lamblia
DSNCTNGA

SEQ ID NO: 3105257 - protein, 11 aa, Giardia lamblia
DSNDRKAGGDA

SEQ ID NO: 3105258 - protein, 4 aa, Giardia lamblia
DSNG

SEQ ID NO: 3105259 - protein, 5 aa, Giardia lamblia
DSNGN

SEQ ID NO: 3105260 - protein, 6 aa, Giardia lamblia
DSNGQT

SEQ ID NO: 3105261 - protein, 7 aa, Giardia lamblia
DSNGTIV

SEQ ID NO: 3105262 - protein, 38 aa, Giardia lamblia
DSNHTTNQNRNQEQSPILSSPSNRSSDCKHKNASISHS

SEQ ID NO: 3105263 - protein, 19 aa, Giardia lamblia
DSNLAETTEAPASSRSPNI

SEQ ID NO: 3105264 - protein, 7 aa, Giardia lamblia
DSNMGEN

SEQ ID NO: 3105265 - protein, 4 aa, Giardia lamblia
DSNN

SEQ ID NO: 3105266 - protein, 5 aa, Giardia lamblia
DSNNV

SEQ ID NO: 3105267 - protein, 8 aa, Giardia lamblia
DSNPSLAR

SEQ ID NO: 3105268 - protein, 15 aa, Giardia lamblia
DSNQVRNLAEGQSIQ

SEQ ID NO: 3105269 - protein, 5 aa, Giardia lamblia
DSNRA

SEQ ID NO: 3105270 - protein, 10 aa, Giardia lamblia
DSNSDQSDIS

SEQ ID NO: 3105271 - protein, 14 aa, Giardia lamblia
DSNTIPSGDNREQR

SEQ ID NO: 3105272 - protein, 17 aa, Giardia lamblia
DSPATNAPCAPPSQFNR

SEQ ID NO: 3105273 - protein, 15 aa, Giardia lamblia
DSPAVAIPTTKGIRP

SEQ ID NO: 3105274 - protein, 12 aa, Giardia lamblia
DSPDDQGRDKKN

SEQ ID NO: 3105275 - protein, 7 aa, Giardia lamblia
DSPDPVP

SEQ ID NO: 3105276 - protein, 15 aa, Giardia lamblia
DSPDRLPTPPAGPYD

SEQ ID NO: 3105277 - protein, 6 aa, Giardia lamblia
DSPDRT

SEQ ID NO: 3105278 - protein, 6 aa, Giardia lamblia
DSPDTG

SEQ ID NO: 3105279 - protein, 8 aa, Giardia lamblia
DSPGNPYT

SEQ ID NO: 3105280 - protein, 13 aa, Giardia lamblia
DSPGQGDAPGTYS

SEQ ID NO: 3105281 - protein, 12 aa, Giardia lamblia
DSPGTGGSGPIF

SEQ ID NO: 3105282 - protein, 9 aa, Giardia lamblia
DSPKDAPTF

SEQ ID NO: 3105283 - protein, 14 aa, Giardia lamblia
DSPLDREKRRAREG

SEQ ID NO: 3105284 - protein, 11 aa, Giardia lamblia
DSPPIQKGTSD

SEQ ID NO: 3105285 - protein, 22 aa, Giardia lamblia
DSPPTRDQSGTGPEKQPEPEEQ

SEQ ID NO: 3105286 - protein, 5 aa, Giardia lamblia
DSPQA

SEQ ID NO: 3105287 - protein, 6 aa, Giardia lamblia
DSPQIP

SEQ ID NO: 3105288 - protein, 4 aa, Giardia lamblia
DSPR

SEQ ID NO: 3105289 - protein, 19 aa, Giardia lamblia
DSPRTSTLAEPLSNKATET

SEQ ID NO: 3105290 - protein, 23 aa, Giardia lamblia
DSPSLAEGEASYSIAAEGIIDAA

SEQ ID NO: 3105291 - protein, 10 aa, Giardia lamblia
DSPSLPEAEA

SEQ ID NO: 3105292 - protein, 9 aa, Giardia lamblia
DSPSSSAHC

SEQ ID NO: 3105293 - protein, 19 aa, Giardia lamblia
DSPTEDYSKPESRKQSTSV

SEQ ID NO: 3105294 - protein, 6 aa, Giardia lamblia
DSPTHS

SEQ ID NO: 3105295 - protein, 14 aa, Giardia lamblia
DSPYRRTLGRIVRL

SEQ ID NO: 3105296 - protein, 4 aa, Giardia lamblia
DSQA

SEQ ID NO: 3105297 - protein, 4 aa, Giardia lamblia
DSQD

SEQ ID NO: 3105298 - protein, 8 aa, Giardia lamblia
DSQDNKPL

SEQ ID NO: 3105299 - protein, 14 aa, Giardia lamblia
DSQDRDKNKLNTAL

SEQ ID NO: 3105300 - protein, 8 aa, Giardia lamblia
DSQDREQA

SEQ ID NO: 3105301 - protein, 7 aa, Giardia lamblia
DSQGKTA

SEQ ID NO: 3105302 - protein, 6 aa, Giardia lamblia
DSQINA

SEQ ID NO: 3105303 - protein, 6 aa, Giardia lamblia
DSQIPD

SEQ ID NO: 3105304 - protein, 13 aa, Giardia lamblia
DSQLEEGKKIGNN

SEQ ID NO: 3105305 - protein, 8 aa, Giardia lamblia
DSQLENDG

SEQ ID NO: 3105306 - protein, 12 aa, Giardia lamblia
DSQLTKSPALTG

SEQ ID NO: 3105307 - protein, 8 aa, Giardia lamblia
DSQPAQLD

SEQ ID NO: 3105308 - protein, 9 aa, Giardia lamblia
DSQQTIGAG

SEQ ID NO: 3105309 - protein, 6 aa, Giardia lamblia
DSQRKC

SEQ ID NO: 3105310 - protein, 8 aa, Giardia lamblia
DSQRRTKI

SEQ ID NO: 3105311 - protein, 7 aa, Giardia lamblia
DSQSSLK

SEQ ID NO: 3105312 - protein, 6 aa, Giardia lamblia
DSQSTV

SEQ ID NO: 3105313 - protein, 5 aa, Giardia lamblia
DSRAC

SEQ ID NO: 3105314 - protein, 25 aa, Giardia lamblia
DSRAGTSGFSRENMGAADHGSSTLD

SEQ ID NO: 3105315 - protein, 9 aa, Giardia lamblia
DSRAVSPAT

SEQ ID NO: 3105316 - protein, 12 aa, Giardia lamblia
DSRDDRRTSSAY

SEQ ID NO: 3105317 - protein, 13 aa, Giardia lamblia
DSRDISKAESDIG

SEQ ID NO: 3105318 - protein, 5 aa, Giardia lamblia
DSREI

SEQ ID NO: 3105319 - protein, 5 aa, Giardia lamblia
DSREL

SEQ ID NO: 3105320 - protein, 4 aa, Giardia lamblia
DSRG

SEQ ID NO: 3105321 - protein, 5 aa, Giardia lamblia
DSRGF

SEQ ID NO: 3105322 - protein, 7 aa, Giardia lamblia
DSRGLDP

SEQ ID NO: 3105323 - protein, 6 aa, Giardia lamblia
DSRHDL

SEQ ID NO: 3105324 - protein, 16 aa, Giardia lamblia
DSRHTDWSTGKLSGGQ

SEQ ID NO: 3105325 - protein, 5 aa, Giardia lamblia
DSRIS

SEQ ID NO: 3105326 - protein, 4 aa, Giardia lamblia
DSRK

SEQ ID NO: 3105327 - protein, 13 aa, Giardia lamblia
DSRKTHEDEANSI

SEQ ID NO: 3105328 - protein, 5 aa, Giardia lamblia
DSRND

SEQ ID NO: 3105329 - protein, 8 aa, Giardia lamblia
DSRPAAGD

SEQ ID NO: 3105330 - protein, 9 aa, Giardia lamblia
DSRPEPFRT

SEQ ID NO: 3105331 - protein, 8 aa, Giardia lamblia
DSRSGLSI

SEQ ID NO: 3105332 - protein, 16 aa, Giardia lamblia
DSRSKKKQSHKKVGHR

SEQ ID NO: 3105333 - protein, 21 aa, Giardia lamblia
DSRSTRSSKKSVSRATTPSSM

SEQ ID NO: 3105334 - protein, 9 aa, Giardia lamblia
DSRSTSRVG

SEQ ID NO: 3105335 - protein, 7 aa, Giardia lamblia
DSRTDQL

SEQ ID NO: 3105336 - protein, 8 aa, Giardia lamblia
DSRTGTTV

SEQ ID NO: 3105337 - protein, 6 aa, Giardia lamblia
DSRTNE

SEQ ID NO: 3105338 - protein, 10 aa, Giardia lamblia
DSRTTDETSV

SEQ ID NO: 3105339 - protein, 5 aa, Giardia lamblia
DSSAI

SEQ ID NO: 3105340 - protein, 10 aa, Giardia lamblia
DSSAKILPPS

SEQ ID NO: 3105341 - protein, 15 aa, Giardia lamblia
DSSAPPCLRSDGSNC

SEQ ID NO: 3105342 - protein, 28 aa, Giardia lamblia
DSSASDNNDSFVSDSNTDSSTYSNREDG

SEQ ID NO: 3105343 - protein, 4 aa, Giardia lamblia
DSSD

SEQ ID NO: 3105344 - protein, 7 aa, Giardia lamblia
DSSDERE

SEQ ID NO: 3105345 - protein, 10 aa, Giardia lamblia
DSSDESEQIH

SEQ ID NO: 3105346 - protein, 4 aa, Giardia lamblia
DSSE

SEQ ID NO: 3105347 - protein, 32 aa, Giardia lamblia
DSSEESEEHKTNVEASAIETDADGTLPRNKGA

SEQ ID NO: 3105348 - protein, 18 aa, Giardia lamblia
DSSEMTGRSRSKSKGNRL

SEQ ID NO: 3105349 - protein, 8 aa, Giardia lamblia
DSSESYEE

SEQ ID NO: 3105350 - protein, 4 aa, Giardia lamblia
DSSG

SEQ ID NO: 3105351 - protein, 15 aa, Giardia lamblia
DSSGGSSSSSQGERG

SEQ ID NO: 3105352 - protein, 21 aa, Giardia lamblia
DSSGLDHDQGVAGDQEKDEYP

SEQ ID NO: 3105353 - protein, 11 aa, Giardia lamblia
DSSGRGSFEVS

SEQ ID NO: 3105354 - protein, 5 aa, Giardia lamblia
DSSIS

SEQ ID NO: 3105355 - protein, 8 aa, Giardia lamblia
DSSKLSLS

SEQ ID NO: 3105356 - protein, 8 aa, Giardia lamblia
DSSLPSNT

SEQ ID NO: 3105357 - protein, 7 aa, Giardia lamblia
DSSMGRA

SEQ ID NO: 3105358 - protein, 13 aa, Giardia lamblia
DSSNDQRKAADNE

SEQ ID NO: 3105359 - protein, 6 aa, Giardia lamblia
DSSNRT

SEQ ID NO: 3105360 - protein, 4 aa, Giardia lamblia
DSSP

SEQ ID NO: 3105361 - protein, 7 aa, Giardia lamblia
DSSPGLW

SEQ ID NO: 3105362 - protein, 8 aa, Giardia lamblia
DSSPIASE

SEQ ID NO: 3105363 - protein, 7 aa, Giardia lamblia
DSSPNDL

SEQ ID NO: 3105364 - protein, 8 aa, Giardia lamblia
DSSQAGSL

SEQ ID NO: 3105365 - protein, 7 aa, Giardia lamblia
DSSQLRD

SEQ ID NO: 3105366 - protein, 21 aa, Giardia lamblia
DSSRDEGPQPASAKDESMTHK

SEQ ID NO: 3105367 - protein, 25 aa, Giardia lamblia
DSSRGLAEKSTKASRPKNKGVRKEL

SEQ ID NO: 3105368 - protein, 6 aa, Giardia lamblia
DSSRRD

SEQ ID NO: 3105369 - protein, 13 aa, Giardia lamblia
DSSRTSSTDGYSY

SEQ ID NO: 3105370 - protein, 6 aa, Giardia lamblia
DSSSIN

SEQ ID NO: 3105371 - protein, 15 aa, Giardia lamblia
DSSSITTQRTGGVDK

SEQ ID NO: 3105372 - protein, 8 aa, Giardia lamblia
DSSSNTAL

SEQ ID NO: 3105373 - protein, 5 aa, Giardia lamblia
DSSSR

SEQ ID NO: 3105374 - protein, 7 aa, Giardia lamblia
DSSSSLV

SEQ ID NO: 3105375 - protein, 10 aa, Giardia lamblia
DSSSSSTPLL

SEQ ID NO: 3105376 - protein, 25 aa, Giardia lamblia
DSSTARANNLSGSRSAAYDSAEPEV

SEQ ID NO: 3105377 - protein, 7 aa, Giardia lamblia
DSSTEQI

SEQ ID NO: 3105378 - protein, 9 aa, Giardia lamblia
DSSTGKHTE

SEQ ID NO: 3105379 - protein, 5 aa, Giardia lamblia
DSSTK

SEQ ID NO: 3105380 - protein, 6 aa, Giardia lamblia
DSSTSI

SEQ ID NO: 3105381 - protein, 9 aa, Giardia lamblia
DSSVNKSSS

SEQ ID NO: 3105382 - protein, 33 aa, Giardia lamblia
DSTAESKPRREDQKSRDAPMEQSNISNTTATTL

SEQ ID NO: 3105383 - protein, 6 aa, Giardia lamblia
DSTDQN

SEQ ID NO: 3105384 - protein, 10 aa, Giardia lamblia
DSTDQPPVKT

SEQ ID NO: 3105385 - protein, 5 aa, Giardia lamblia
DSTDS

SEQ ID NO: 3105386 - protein, 23 aa, Giardia lamblia
DSTEDYPQTSGTAGNVRASTHDN

SEQ ID NO: 3105387 - protein, 8 aa, Giardia lamblia
DSTGAWDT

SEQ ID NO: 3105388 - protein, 9 aa, Giardia lamblia
DSTGGGAGN

SEQ ID NO: 3105389 - protein, 5 aa, Giardia lamblia
DSTGI

SEQ ID NO: 3105390 - protein, 8 aa, Giardia lamblia
DSTGKSPL

SEQ ID NO: 3105391 - protein, 6 aa, Giardia lamblia
DSTGLH

SEQ ID NO: 3105392 - protein, 7 aa, Giardia lamblia
DSTGNLN

SEQ ID NO: 3105393 - protein, 5 aa, Giardia lamblia
DSTIE

SEQ ID NO: 3105394 - protein, 25 aa, Giardia lamblia
DSTIKEKVARQKEETRHSAESFRDT

SEQ ID NO: 3105395 - protein, 10 aa, Giardia lamblia
DSTINPDGTF

SEQ ID NO: 3105396 - protein, 13 aa, Giardia lamblia
DSTLPSNETEPSS

SEQ ID NO: 3105397 - protein, 8 aa, Giardia lamblia
DSTLTTTC

SEQ ID NO: 3105398 - protein, 4 aa, Giardia lamblia
DSTN

SEQ ID NO: 3105399 - protein, 15 aa, Giardia lamblia
DSTNLQTKSDDEELS

SEQ ID NO: 3105400 - protein, 5 aa, Giardia lamblia
DSTNP

SEQ ID NO: 3105401 - protein, 24 aa, Giardia lamblia
DSTPETTGGSLPPPESASSVSNPI

SEQ ID NO: 3105402 - protein, 18 aa, Giardia lamblia
DSTQLESVKSTISAMLSK

SEQ ID NO: 3105403 - protein, 4 aa, Giardia lamblia
DSTR

SEQ ID NO: 3105404 - protein, 15 aa, Giardia lamblia
DSTRTPTTTRQFQPR

SEQ ID NO: 3105405 - protein, 14 aa, Giardia lamblia
DSTSEESDTETSAV

SEQ ID NO: 3105406 - protein, 13 aa, Giardia lamblia
DSTSKTPKSYPVR

SEQ ID NO: 3105407 - protein, 9 aa, Giardia lamblia
DSTSQDKSY

SEQ ID NO: 3105408 - protein, 8 aa, Giardia lamblia
DSTSRPGL

SEQ ID NO: 3105409 - protein, 11 aa, Giardia lamblia
DSTSSTSESAT

SEQ ID NO: 3105410 - protein, 16 aa, Giardia lamblia
DSTSTAAKAAQNLQNT

SEQ ID NO: 3105411 - protein, 5 aa, Giardia lamblia
DSTTI

SEQ ID NO: 3105412 - protein, 7 aa, Giardia lamblia
DSTTKES

SEQ ID NO: 3105413 - protein, 16 aa, Giardia lamblia
DSTTRKADRDSKRKRK

SEQ ID NO: 3105414 - protein, 26 aa, Giardia lamblia
DSTTTHIKGSEGRALNPHNKDTGTVL

SEQ ID NO: 3105415 - protein, 15 aa, Giardia lamblia
DSTVDKKSDVDTEEL

SEQ ID NO: 3105416 - protein, 6 aa, Giardia lamblia
DSTYRQ

SEQ ID NO: 3105417 - protein, 12 aa, Giardia lamblia
DSVADAGRGLTR

SEQ ID NO: 3105418 - protein, 5 aa, Giardia lamblia
DSVAT

SEQ ID NO: 3105419 - protein, 11 aa, Giardia lamblia
DSVDGAKDWKR

SEQ ID NO: 3105420 - protein, 4 aa, Giardia lamblia
DSVE

SEQ ID NO: 3105421 - protein, 8 aa, Giardia lamblia
DSVEQRGA

SEQ ID NO: 3105422 - protein, 8 aa, Giardia lamblia
DSVHSDSL

SEQ ID NO: 3105423 - protein, 7 aa, Giardia lamblia
DSVKEQS

SEQ ID NO: 3105424 - protein, 5 aa, Giardia lamblia
DSVNG

SEQ ID NO: 3105425 - protein, 4 aa, Giardia lamblia
DSVP

SEQ ID NO: 3105426 - protein, 7 aa, Giardia lamblia
DSVPEAP

SEQ ID NO: 3105427 - protein, 16 aa, Giardia lamblia
DSVPEVSQKPLSRSAT

SEQ ID NO: 3105428 - protein, 11 aa, Giardia lamblia
DSVSADDVAKA

SEQ ID NO: 3105429 - protein, 13 aa, Giardia lamblia
DSVSASHGHGAKP

SEQ ID NO: 3105430 - protein, 5 aa, Giardia lamblia
DSVTA

SEQ ID NO: 3105431 - protein, 19 aa, Giardia lamblia
DSVTRTNNYNSEVNAKAEN

SEQ ID NO: 3105432 - protein, 17 aa, Giardia lamblia
DSVTSESIARGKELNNA

SEQ ID NO: 3105433 - protein, 7 aa, Giardia lamblia
DSWSSSH

SEQ ID NO: 3105434 - protein, 7 aa, Giardia lamblia
DSYAGEP

SEQ ID NO: 3105435 - protein, 6 aa, Giardia lamblia
DSYASF

SEQ ID NO: 3105436 - protein, 6 aa, Giardia lamblia
DSYGVK

SEQ ID NO: 3105437 - protein, 10 aa, Giardia lamblia
DSYNSSEDSM

SEQ ID NO: 3105438 - protein, 5 aa, Giardia lamblia
DSYQS

SEQ ID NO: 3105439 - protein, 8 aa, Giardia lamblia
DSYVGTKR

SEQ ID NO: 3105440 - protein, 7 aa, Giardia lamblia
DTADASA

SEQ ID NO: 3105441 - protein, 8 aa, Giardia lamblia
DTAEPETL

SEQ ID NO: 3105442 - protein, 8 aa, Giardia lamblia
DTAETRRK

SEQ ID NO: 3105443 - protein, 10 aa, Giardia lamblia
DTAGQEKFGG

SEQ ID NO: 3105444 - protein, 9 aa, Giardia lamblia
DTAKRGPRL

SEQ ID NO: 3105445 - protein, 6 aa, Giardia lamblia
DTALQN

SEQ ID NO: 3105446 - protein, 7 aa, Giardia lamblia
DTAPAVS

SEQ ID NO: 3105447 - protein, 15 aa, Giardia lamblia
DTAPKKEASAEDDPY

SEQ ID NO: 3105448 - protein, 19 aa, Giardia lamblia
DTAPSATEHLGDEDDDSVL

SEQ ID NO: 3105449 - protein, 15 aa, Giardia lamblia
DTAPSVGTRPPQKDT

SEQ ID NO: 3105450 - protein, 6 aa, Giardia lamblia
DTAPVR

SEQ ID NO: 3105451 - protein, 6 aa, Giardia lamblia
DTARGI

SEQ ID NO: 3105452 - protein, 4 aa, Giardia lamblia
DTAS

SEQ ID NO: 3105453 - protein, 7 aa, Giardia lamblia
DTASNKD

SEQ ID NO: 3105454 - protein, 9 aa, Giardia lamblia
DTASRGDLK

SEQ ID NO: 3105455 - protein, 9 aa, Giardia lamblia
DTASSKRKR

SEQ ID NO: 3105456 - protein, 13 aa, Giardia lamblia
DTASTSQGSNPRG

SEQ ID NO: 3105457 - protein, 7 aa, Giardia lamblia
DTATSDL

SEQ ID NO: 3105458 - protein, 6 aa, Giardia lamblia
DTCGSY

SEQ ID NO: 3105459 - protein, 6 aa, Giardia lamblia
DTCKNK

SEQ ID NO: 3105460 - protein, 10 aa, Giardia lamblia
DTDDDTGQGI

SEQ ID NO: 3105461 - protein, 17 aa, Giardia lamblia
DTDDISKEDVKDKIRSQ

SEQ ID NO: 3105462 - protein, 5 aa, Giardia lamblia
DTDDN

SEQ ID NO: 3105463 - protein, 8 aa, Giardia lamblia
DTDDNRTN

SEQ ID NO: 3105464 - protein, 9 aa, Giardia lamblia
DTDGQGTPV

SEQ ID NO: 3105465 - protein, 9 aa, Giardia lamblia
DTDNDEESV

SEQ ID NO: 3105466 - protein, 6 aa, Giardia lamblia
DTDNTT

SEQ ID NO: 3105467 - protein, 8 aa, Giardia lamblia
DTDPESID

SEQ ID NO: 3105468 - protein, 6 aa, Giardia lamblia
DTDPLT

SEQ ID NO: 3105469 - protein, 8 aa, Giardia lamblia
DTDPNWQK

SEQ ID NO: 3105470 - protein, 6 aa, Giardia lamblia
DTDPRL

SEQ ID NO: 3105471 - protein, 7 aa, Giardia lamblia
DTDQQTV

SEQ ID NO: 3105472 - protein, 17 aa, Giardia lamblia
DTDRRKDDDVTKKGGVE

SEQ ID NO: 3105473 - protein, 10 aa, Giardia lamblia
DTDSAAGEQS

SEQ ID NO: 3105474 - protein, 10 aa, Giardia lamblia
DTDSAYSEKY

SEQ ID NO: 3105475 - protein, 7 aa, Giardia lamblia
DTDSQGW

SEQ ID NO: 3105476 - protein, 38 aa, Giardia lamblia
DTDSQQGSTSDAPEEAGAGDNSQVKTEDGQAATEDYGQ

SEQ ID NO: 3105477 - protein, 12 aa, Giardia lamblia
DTDSSKEPAPRA

SEQ ID NO: 3105478 - protein, 8 aa, Giardia lamblia
DTDSTEHT

SEQ ID NO: 3105479 - protein, 10 aa, Giardia lamblia
DTDTVEPSQI

SEQ ID NO: 3105480 - protein, 6 aa, Giardia lamblia
DTDYKS

SEQ ID NO: 3105481 - protein, 8 aa, Giardia lamblia
DTDYTEEQ

SEQ ID NO: 3105482 - protein, 5 aa, Giardia lamblia
DTEAA

SEQ ID NO: 3105483 - protein, 8 aa, Giardia lamblia
DTEAGIDT

SEQ ID NO: 3105484 - protein, 7 aa, Giardia lamblia
DTEDQGN

SEQ ID NO: 3105485 - protein, 7 aa, Giardia lamblia
DTEEDEA

SEQ ID NO: 3105486 - protein, 7 aa, Giardia lamblia
DTEEFKQ

SEQ ID NO: 3105487 - protein, 5 aa, Giardia lamblia
DTEEV

SEQ ID NO: 3105488 - protein, 4 aa, Giardia lamblia
DTEF

SEQ ID NO: 3105489 - protein, 6 aa, Giardia lamblia
DTEGTE

SEQ ID NO: 3105490 - protein, 4 aa, Giardia lamblia
DTEI

SEQ ID NO: 3105491 - protein, 6 aa, Giardia lamblia
DTEKDI

SEQ ID NO: 3105492 - protein, 15 aa, Giardia lamblia
DTENIEVDDPSEPPI

SEQ ID NO: 3105493 - protein, 8 aa, Giardia lamblia
DTEPSVET

SEQ ID NO: 3105494 - protein, 6 aa, Giardia lamblia
DTERRN

SEQ ID NO: 3105495 - protein, 5 aa, Giardia lamblia
DTESA

SEQ ID NO: 3105496 - protein, 7 aa, Giardia lamblia
DTESEEC

SEQ ID NO: 3105497 - protein, 9 aa, Giardia lamblia
DTESKQTIS

SEQ ID NO: 3105498 - protein, 12 aa, Giardia lamblia
DTESKSSHYPTY

SEQ ID NO: 3105499 - protein, 7 aa, Giardia lamblia
DTETGAS

SEQ ID NO: 3105500 - protein, 8 aa, Giardia lamblia
DTETQGTL

SEQ ID NO: 3105501 - protein, 4 aa, Giardia lamblia
DTEY

SEQ ID NO: 3105502 - protein, 10 aa, Giardia lamblia
DTFSPTRTRA

SEQ ID NO: 3105503 - protein, 7 aa, Giardia lamblia
DTFTTDA

SEQ ID NO: 3105504 - protein, 25 aa, Giardia lamblia
DTGANTPDLSASAPQLHRNTRSTPL

SEQ ID NO: 3105505 - protein, 5 aa, Giardia lamblia
DTGAP

SEQ ID NO: 3105506 - protein, 12 aa, Giardia lamblia
DTGAPAPSSTHG

SEQ ID NO: 3105507 - protein, 7 aa, Giardia lamblia
DTGATNA

SEQ ID NO: 3105508 - protein, 9 aa, Giardia lamblia
DTGDSEAKM

SEQ ID NO: 3105509 - protein, 5 aa, Giardia lamblia
DTGEI

SEQ ID NO: 3105510 - protein, 4 aa, Giardia lamblia
DTGF

SEQ ID NO: 3105511 - protein, 6 aa, Giardia lamblia
DTGKEE

SEQ ID NO: 3105512 - protein, 7 aa, Giardia lamblia
DTGKTSL

SEQ ID NO: 3105513 - protein, 9 aa, Giardia lamblia
DTGNKRTVE

SEQ ID NO: 3105514 - protein, 7 aa, Giardia lamblia
DTGNWRT

SEQ ID NO: 3105515 - protein, 10 aa, Giardia lamblia
DTGQTDDQRS

SEQ ID NO: 3105516 - protein, 10 aa, Giardia lamblia
DTGSGSEAGR

SEQ ID NO: 3105517 - protein, 7 aa, Giardia lamblia
DTGSNDA

SEQ ID NO: 3105518 - protein, 17 aa, Giardia lamblia
DTGTDLSQGRATAARSA

SEQ ID NO: 3105519 - protein, 12 aa, Giardia lamblia
DTGTNSKTSVQA

SEQ ID NO: 3105520 - protein, 6 aa, Giardia lamblia
DTHAES

SEQ ID NO: 3105521 - protein, 12 aa, Giardia lamblia
DTHASGQSSFQE

SEQ ID NO: 3105522 - protein, 14 aa, Giardia lamblia
DTHPHSSTNALSNH

SEQ ID NO: 3105523 - protein, 7 aa, Giardia lamblia
DTHPTGT

SEQ ID NO: 3105524 - protein, 5 aa, Giardia lamblia
DTIAG

SEQ ID NO: 3105525 - protein, 15 aa, Giardia lamblia
DTIAQAQSGTGKTAA

SEQ ID NO: 3105526 - protein, 13 aa, Giardia lamblia
DTIKDPAHISDGV

SEQ ID NO: 3105527 - protein, 12 aa, Giardia lamblia
DTIQPQAYADPI

SEQ ID NO: 3105528 - protein, 10 aa, Giardia lamblia
DTISDQNKEL

SEQ ID NO: 3105529 - protein, 6 aa, Giardia lamblia
DTKDDP

SEQ ID NO: 3105530 - protein, 10 aa, Giardia lamblia
DTKEAENPSV

SEQ ID NO: 3105531 - protein, 10 aa, Giardia lamblia
DTKEATENAG

SEQ ID NO: 3105532 - protein, 28 aa, Giardia lamblia
DTKEDEAYADYRRRTAREARERDQQSID

SEQ ID NO: 3105533 - protein, 34 aa, Giardia lamblia
DTKEKKGKKGSKGNKGSKGKGKLKLPGDDVETPG

SEQ ID NO: 3105534 - protein, 8 aa, Giardia lamblia
DTKGASNT

SEQ ID NO: 3105535 - protein, 6 aa, Giardia lamblia
DTKGRT

SEQ ID NO: 3105536 - protein, 5 aa, Giardia lamblia
DTKHT

SEQ ID NO: 3105537 - protein, 5 aa, Giardia lamblia
DTKIQ

SEQ ID NO: 3105538 - protein, 7 aa, Giardia lamblia
DTKKHAH

SEQ ID NO: 3105539 - protein, 7 aa, Giardia lamblia
DTKNGEC

SEQ ID NO: 3105540 - protein, 10 aa, Giardia lamblia
DTKNHTSQLK

SEQ ID NO: 3105541 - protein, 14 aa, Giardia lamblia
DTKPGNIAYDPTSH

SEQ ID NO: 3105542 - protein, 12 aa, Giardia lamblia
DTKQTDDGKQAQ

SEQ ID NO: 3105543 - protein, 5 aa, Giardia lamblia
DTKRV

SEQ ID NO: 3105544 - protein, 9 aa, Giardia lamblia
DTKSQSANS

SEQ ID NO: 3105545 - protein, 5 aa, Giardia lamblia
DTKTD

SEQ ID NO: 3105546 - protein, 9 aa, Giardia lamblia
DTKTMTSDE

SEQ ID NO: 3105547 - protein, 13 aa, Giardia lamblia
DTKTTYAKPDYDE

SEQ ID NO: 3105548 - protein, 4 aa, Giardia lamblia
DTLE

SEQ ID NO: 3105549 - protein, 8 aa, Giardia lamblia
DTLGPSDR

SEQ ID NO: 3105550 - protein, 17 aa, Giardia lamblia
DTLGQSDRGTNEITSSI

SEQ ID NO: 3105551 - protein, 28 aa, Giardia lamblia
DTLKQAQEALSQAKKADQKRLQQAVDEA

SEQ ID NO: 3105552 - protein, 7 aa, Giardia lamblia
DTLPDGR

SEQ ID NO: 3105553 - protein, 8 aa, Giardia lamblia
DTLPPNAS

SEQ ID NO: 3105554 - protein, 7 aa, Giardia lamblia
DTLPTRQ

SEQ ID NO: 3105555 - protein, 4 aa, Giardia lamblia
DTLS

SEQ ID NO: 3105556 - protein, 5 aa, Giardia lamblia
DTLSE

SEQ ID NO: 3105557 - protein, 9 aa, Giardia lamblia
DTLSGNNIH

SEQ ID NO: 3105558 - protein, 17 aa, Giardia lamblia
DTLSPPSASSMNKGERG

SEQ ID NO: 3105559 - protein, 12 aa, Giardia lamblia
DTLSSPSSSDDL

SEQ ID NO: 3105560 - protein, 4 aa, Giardia lamblia
DTLT

SEQ ID NO: 3105561 - protein, 10 aa, Giardia lamblia
DTLTEENNNL

SEQ ID NO: 3105562 - protein, 14 aa, Giardia lamblia
DTMARTVSSQDKPP

SEQ ID NO: 3105563 - protein, 7 aa, Giardia lamblia
DTMPDGK

SEQ ID NO: 3105564 - protein, 11 aa, Giardia lamblia
DTMSQVPSHDE

SEQ ID NO: 3105565 - protein, 13 aa, Giardia lamblia
DTMTSTPRDLSKS

SEQ ID NO: 3105566 - protein, 4 aa, Giardia lamblia
DTNA

SEQ ID NO: 3105567 - protein, 6 aa, Giardia lamblia
DTNDRE

SEQ ID NO: 3105568 - protein, 11 aa, Giardia lamblia
DTNDSEQHRAA

SEQ ID NO: 3105569 - protein, 4 aa, Giardia lamblia
DTNE

SEQ ID NO: 3105570 - protein, 9 aa, Giardia lamblia
DTNEPLQNT

SEQ ID NO: 3105571 - protein, 5 aa, Giardia lamblia
DTNEQ

SEQ ID NO: 3105572 - protein, 12 aa, Giardia lamblia
DTNEQHTAAERR

SEQ ID NO: 3105573 - protein, 12 aa, Giardia lamblia
DTNGAKHAYENN

SEQ ID NO: 3105574 - protein, 6 aa, Giardia lamblia
DTNGGG

SEQ ID NO: 3105575 - protein, 8 aa, Giardia lamblia
DTNGGSTV

SEQ ID NO: 3105576 - protein, 4 aa, Giardia lamblia
DTNK

SEQ ID NO: 3105577 - protein, 6 aa, Giardia lamblia
DTNKEV

SEQ ID NO: 3105578 - protein, 10 aa, Giardia lamblia
DTNKNTSHQV

SEQ ID NO: 3105579 - protein, 5 aa, Giardia lamblia
DTNKS

SEQ ID NO: 3105580 - protein, 11 aa, Giardia lamblia
DTNLSDDTRDE

SEQ ID NO: 3105581 - protein, 11 aa, Giardia lamblia
DTNPEAESKEY

SEQ ID NO: 3105582 - protein, 10 aa, Giardia lamblia
DTNPGRENPE

SEQ ID NO: 3105583 - protein, 8 aa, Giardia lamblia
DTNPSYSS

SEQ ID NO: 3105584 - protein, 17 aa, Giardia lamblia
DTNSPVPEFSTKTQYTS

SEQ ID NO: 3105585 - protein, 8 aa, Giardia lamblia
DTNSTGNT

SEQ ID NO: 3105586 - protein, 5 aa, Giardia lamblia
DTNTQ

SEQ ID NO: 3105587 - protein, 7 aa, Giardia lamblia
DTPAEIA

SEQ ID NO: 3105588 - protein, 15 aa, Giardia lamblia
DTPALSEDRASLKEE

SEQ ID NO: 3105589 - protein, 7 aa, Giardia lamblia
DTPAQIK

SEQ ID NO: 3105590 - protein, 6 aa, Giardia lamblia
DTPASL

SEQ ID NO: 3105591 - protein, 6 aa, Giardia lamblia
DTPDKI

SEQ ID NO: 3105592 - protein, 5 aa, Giardia lamblia
DTPEE

SEQ ID NO: 3105593 - protein, 8 aa, Giardia lamblia
DTPEKAPL

SEQ ID NO: 3105594 - protein, 15 aa, Giardia lamblia
DTPEKNEQGGITNAE

SEQ ID NO: 3105595 - protein, 22 aa, Giardia lamblia
DTPFGSVPKEKEQVKRSSTTIT

SEQ ID NO: 3105596 - protein, 7 aa, Giardia lamblia
DTPFKSS

SEQ ID NO: 3105597 - protein, 5 aa, Giardia lamblia
DTPGA

SEQ ID NO: 3105598 - protein, 22 aa, Giardia lamblia
DTPGSVPAKEEAQKKSQPVIKA

SEQ ID NO: 3105599 - protein, 18 aa, Giardia lamblia
DTPIDKDTPSTHVSKTSK

SEQ ID NO: 3105600 - protein, 10 aa, Giardia lamblia
DTPISTNPTV

SEQ ID NO: 3105601 - protein, 13 aa, Giardia lamblia
DTPKKGKSQGLSS

SEQ ID NO: 3105602 - protein, 16 aa, Giardia lamblia
DTPNILGPASGGEPIA

SEQ ID NO: 3105603 - protein, 4 aa, Giardia lamblia
DTPP

SEQ ID NO: 3105604 - protein, 9 aa, Giardia lamblia
DTPPELPSD

SEQ ID NO: 3105605 - protein, 8 aa, Giardia lamblia
DTPPVSRD

SEQ ID NO: 3105606 - protein, 4 aa, Giardia lamblia
DTPR

SEQ ID NO: 3105607 - protein, 5 aa, Giardia lamblia
DTPSF

SEQ ID NO: 3105608 - protein, 16 aa, Giardia lamblia
DTPSIGSAKGYPNEPT

SEQ ID NO: 3105609 - protein, 7 aa, Giardia lamblia
DTPSSKT

SEQ ID NO: 3105610 - protein, 8 aa, Giardia lamblia
DTPSTIPS

SEQ ID NO: 3105611 - protein, 5 aa, Giardia lamblia
DTPTA

SEQ ID NO: 3105612 - protein, 4 aa, Giardia lamblia
DTQA

SEQ ID NO: 3105613 - protein, 12 aa, Giardia lamblia
DTQAMGSYPPNY

SEQ ID NO: 3105614 - protein, 4 aa, Giardia lamblia
DTQL

SEQ ID NO: 3105615 - protein, 5 aa, Giardia lamblia
DTQNL

SEQ ID NO: 3105616 - protein, 5 aa, Giardia lamblia
DTQPL

SEQ ID NO: 3105617 - protein, 12 aa, Giardia lamblia
DTQQSDDQVDSA

SEQ ID NO: 3105618 - protein, 5 aa, Giardia lamblia
DTQRK

SEQ ID NO: 3105619 - protein, 5 aa, Giardia lamblia
DTQRS

SEQ ID NO: 3105620 - protein, 6 aa, Giardia lamblia
DTQSQW

SEQ ID NO: 3105621 - protein, 12 aa, Giardia lamblia
DTQSTRRPISAN

SEQ ID NO: 3105622 - protein, 14 aa, Giardia lamblia
DTQSVSPGPRKSSL

SEQ ID NO: 3105623 - protein, 6 aa, Giardia lamblia
DTRAQL

SEQ ID NO: 3105624 - protein, 6 aa, Giardia lamblia
DTRATM

SEQ ID NO: 3105625 - protein, 6 aa, Giardia lamblia
DTRGRT

SEQ ID NO: 3105626 - protein, 8 aa, Giardia lamblia
DTRKPLQL

SEQ ID NO: 3105627 - protein, 5 aa, Giardia lamblia
DTRNN

SEQ ID NO: 3105628 - protein, 10 aa, Giardia lamblia
DTRNNKQTPR

SEQ ID NO: 3105629 - protein, 7 aa, Giardia lamblia
DTRRAAD

SEQ ID NO: 3105630 - protein, 9 aa, Giardia lamblia
DTRSTGGPV

SEQ ID NO: 3105631 - protein, 33 aa, Giardia lamblia
DTRSTSAISGLNKSATHRSLADPGRTSQRYPQT

SEQ ID NO: 3105632 - protein, 5 aa, Giardia lamblia
DTRTK

SEQ ID NO: 3105633 - protein, 10 aa, Giardia lamblia
DTRTKELSEL

SEQ ID NO: 3105634 - protein, 9 aa, Giardia lamblia
DTRTPQQND

SEQ ID NO: 3105635 - protein, 18 aa, Giardia lamblia
DTRYDDNSLTTHDNTRIA

SEQ ID NO: 3105636 - protein, 13 aa, Giardia lamblia
DTSAEKEKAVNEA

SEQ ID NO: 3105637 - protein, 9 aa, Giardia lamblia
DTSASLTPD

SEQ ID NO: 3105638 - protein, 27 aa, Giardia lamblia
DTSASMEDGNSLQNTSMTESSRPKMTT

SEQ ID NO: 3105639 - protein, 6 aa, Giardia lamblia
DTSCED

SEQ ID NO: 3105640 - protein, 17 aa, Giardia lamblia
DTSDEAVPVKNPENPFT

SEQ ID NO: 3105641 - protein, 7 aa, Giardia lamblia
DTSDSSD

SEQ ID NO: 3105642 - protein, 11 aa, Giardia lamblia
DTSEKNEQGGI

SEQ ID NO: 3105643 - protein, 4 aa, Giardia lamblia
DTSF

SEQ ID NO: 3105644 - protein, 4 aa, Giardia lamblia
DTSG

SEQ ID NO: 3105645 - protein, 7 aa, Giardia lamblia
DTSGAGI

SEQ ID NO: 3105646 - protein, 13 aa, Giardia lamblia
DTSGASSMDDKST

SEQ ID NO: 3105647 - protein, 6 aa, Giardia lamblia
DTSGLE

SEQ ID NO: 3105648 - protein, 13 aa, Giardia lamblia
DTSGSDPKNKGIA

SEQ ID NO: 3105649 - protein, 7 aa, Giardia lamblia
DTSGSGM

SEQ ID NO: 3105650 - protein, 8 aa, Giardia lamblia
DTSGSVAD

SEQ ID NO: 3105651 - protein, 8 aa, Giardia lamblia
DTSHNMER

SEQ ID NO: 3105652 - protein, 4 aa, Giardia lamblia
DTSI

SEQ ID NO: 3105653 - protein, 8 aa, Giardia lamblia
DTSNNTEV

SEQ ID NO: 3105654 - protein, 7 aa, Giardia lamblia
DTSNTGT

SEQ ID NO: 3105655 - protein, 5 aa, Giardia lamblia
DTSPA

SEQ ID NO: 3105656 - protein, 5 aa, Giardia lamblia
DTSPC

SEQ ID NO: 3105657 - protein, 7 aa, Giardia lamblia
DTSPEQV

SEQ ID NO: 3105658 - protein, 15 aa, Giardia lamblia
DTSPHSSTAFEEAQR

SEQ ID NO: 3105659 - protein, 6 aa, Giardia lamblia
DTSPVT

SEQ ID NO: 3105660 - protein, 4 aa, Giardia lamblia
DTSQ

SEQ ID NO: 3105661 - protein, 10 aa, Giardia lamblia
DTSRPTSEGT

SEQ ID NO: 3105662 - protein, 4 aa, Giardia lamblia
DTSS

SEQ ID NO: 3105663 - protein, 27 aa, Giardia lamblia
DTSSLAPNGKPGRTKRAAARRQSSGDN

SEQ ID NO: 3105664 - protein, 12 aa, Giardia lamblia
DTSSREAHAAGE

SEQ ID NO: 3105665 - protein, 6 aa, Giardia lamblia
DTSSSS

SEQ ID NO: 3105666 - protein, 36 aa, Giardia lamblia
DTSSSSSLSHAQSMEQSLADDDDAQLGERSSTSGPL

SEQ ID NO: 3105667 - protein, 10 aa, Giardia lamblia
DTSTRKQDIR

SEQ ID NO: 3105668 - protein, 10 aa, Giardia lamblia
DTSTSDPDFR

SEQ ID NO: 3105669 - protein, 7 aa, Giardia lamblia
DTSTTTD

SEQ ID NO: 3105670 - protein, 23 aa, Giardia lamblia
DTSYDSPSSSSAECDGGPEKGDC

SEQ ID NO: 3105671 - protein, 9 aa, Giardia lamblia
DTSYNPPEN

SEQ ID NO: 3105672 - protein, 10 aa, Giardia lamblia
DTSYPTPNVS

SEQ ID NO: 3105673 - protein, 6 aa, Giardia lamblia
DTTDPR

SEQ ID NO: 3105674 - protein, 11 aa, Giardia lamblia
DTTENDDDDRL

SEQ ID NO: 3105675 - protein, 9 aa, Giardia lamblia
DTTETPDGR

SEQ ID NO: 3105676 - protein, 6 aa, Giardia lamblia
DTTIES

SEQ ID NO: 3105677 - protein, 6 aa, Giardia lamblia
DTTKAV

SEQ ID NO: 3105678 - protein, 14 aa, Giardia lamblia
DTTLPSQGVNPEEV

SEQ ID NO: 3105679 - protein, 7 aa, Giardia lamblia
DTTNTKA

SEQ ID NO: 3105680 - protein, 5 aa, Giardia lamblia
DTTPF

SEQ ID NO: 3105681 - protein, 10 aa, Giardia lamblia
DTTRQTPTSL

SEQ ID NO: 3105682 - protein, 6 aa, Giardia lamblia
DTTSDQ

SEQ ID NO: 3105683 - protein, 30 aa, Giardia lamblia
DTTSSPHSEQAQARASSAANVTTRHTGQSK

SEQ ID NO: 3105684 - protein, 6 aa, Giardia lamblia
DTTTDE

SEQ ID NO: 3105685 - protein, 23 aa, Giardia lamblia
DTTTFPARTTNPTRIRAEQGLEE

SEQ ID NO: 3105686 - protein, 7 aa, Giardia lamblia
DTTTQNP

SEQ ID NO: 3105687 - protein, 20 aa, Giardia lamblia
DTTTVTLDPKRPESKPISVD

SEQ ID NO: 3105688 - protein, 4 aa, Giardia lamblia
DTTV

SEQ ID NO: 3105689 - protein, 20 aa, Giardia lamblia
DTVEERLPTPAASESSTPRG

SEQ ID NO: 3105690 - protein, 6 aa, Giardia lamblia
DTVGAA

SEQ ID NO: 3105691 - protein, 7 aa, Giardia lamblia
DTVGSEY

SEQ ID NO: 3105692 - protein, 9 aa, Giardia lamblia
DTVGVESKN

SEQ ID NO: 3105693 - protein, 6 aa, Giardia lamblia
DTVHSE

SEQ ID NO: 3105694 - protein, 7 aa, Giardia lamblia
DTVKNKD

SEQ ID NO: 3105695 - protein, 8 aa, Giardia lamblia
DTVKSEEQ

SEQ ID NO: 3105696 - protein, 8 aa, Giardia lamblia
DTVPEPSV

SEQ ID NO: 3105697 - protein, 10 aa, Giardia lamblia
DTVPQSENTV

SEQ ID NO: 3105698 - protein, 4 aa, Giardia lamblia
DTVR

SEQ ID NO: 3105699 - protein, 5 aa, Giardia lamblia
DTVRS

SEQ ID NO: 3105700 - protein, 4 aa, Giardia lamblia
DTVS

SEQ ID NO: 3105701 - protein, 10 aa, Giardia lamblia
DTVSYANKAG

SEQ ID NO: 3105702 - protein, 9 aa, Giardia lamblia
DTVTDSVSR

SEQ ID NO: 3105703 - protein, 9 aa, Giardia lamblia
DTVTTTSSL

SEQ ID NO: 3105704 - protein, 23 aa, Giardia lamblia
DTVVPEKGQDPTNTYNNQVEDGA

SEQ ID NO: 3105705 - protein, 23 aa, Giardia lamblia
DTWTNSDRVDGGTGGQNISAEYS

SEQ ID NO: 3105706 - protein, 11 aa, Giardia lamblia
DTWTPDQLSAD

SEQ ID NO: 3105707 - protein, 12 aa, Giardia lamblia
DTYAGARSWNGD

SEQ ID NO: 3105708 - protein, 12 aa, Giardia lamblia
DTYEDSADLPTS

SEQ ID NO: 3105709 - protein, 18 aa, Giardia lamblia
DTYKDLQPQSPDVNDSCS

SEQ ID NO: 3105710 - protein, 6 aa, Giardia lamblia
DTYQQA

SEQ ID NO: 3105711 - protein, 18 aa, Giardia lamblia
DTYREYERSYNDGPGSTR

SEQ ID NO: 3105712 - protein, 8 aa, Giardia lamblia
DTYRRNGG

SEQ ID NO: 3105713 - protein, 5 aa, Giardia lamblia
DTYSR

SEQ ID NO: 3105714 - protein, 10 aa, Giardia lamblia
DTYTREGQVE

SEQ ID NO: 3105715 - protein, 11 aa, Giardia lamblia
DVADAAEERID

SEQ ID NO: 3105716 - protein, 13 aa, Giardia lamblia
DVADTASKPFTTR

SEQ ID NO: 3105717 - protein, 14 aa, Giardia lamblia
DVASGEAKGAEQEA

SEQ ID NO: 3105718 - protein, 7 aa, Giardia lamblia
DVASGRE

SEQ ID NO: 3105719 - protein, 7 aa, Giardia lamblia
DVASPQL

SEQ ID NO: 3105720 - protein, 7 aa, Giardia lamblia
DVASYDD

SEQ ID NO: 3105721 - protein, 4 aa, Giardia lamblia
DVAT

SEQ ID NO: 3105722 - protein, 16 aa, Giardia lamblia
DVATESTATNSKTYTS

SEQ ID NO: 3105723 - protein, 7 aa, Giardia lamblia
DVDAEDD

SEQ ID NO: 3105724 - protein, 7 aa, Giardia lamblia
DVDESTQ

SEQ ID NO: 3105725 - protein, 15 aa, Giardia lamblia
DVDGSDDAYANMSDA

SEQ ID NO: 3105726 - protein, 6 aa, Giardia lamblia
DVDNSG

SEQ ID NO: 3105727 - protein, 10 aa, Giardia lamblia
DVDSKGETPL

SEQ ID NO: 3105728 - protein, 5 aa, Giardia lamblia
DVDSV

SEQ ID NO: 3105729 - protein, 7 aa, Giardia lamblia
DVDTEGL

SEQ ID NO: 3105730 - protein, 4 aa, Giardia lamblia
DVEA

SEQ ID NO: 3105731 - protein, 7 aa, Giardia lamblia
DVEDTGD

SEQ ID NO: 3105732 - protein, 5 aa, Giardia lamblia
DVEGG

SEQ ID NO: 3105733 - protein, 16 aa, Giardia lamblia
DVENTDPDSQDTEAHG

SEQ ID NO: 3105734 - protein, 11 aa, Giardia lamblia
DVEPKKKRVAK

SEQ ID NO: 3105735 - protein, 9 aa, Giardia lamblia
DVEPNGADY

SEQ ID NO: 3105736 - protein, 6 aa, Giardia lamblia
DVEPYR

SEQ ID NO: 3105737 - protein, 5 aa, Giardia lamblia
DVERA

SEQ ID NO: 3105738 - protein, 17 aa, Giardia lamblia
DVERFSPNTAPPKQQPL

SEQ ID NO: 3105739 - protein, 9 aa, Giardia lamblia
DVERSLPPK

SEQ ID NO: 3105740 - protein, 4 aa, Giardia lamblia
DVES

SEQ ID NO: 3105741 - protein, 6 aa, Giardia lamblia
DVESDQ

SEQ ID NO: 3105742 - protein, 20 aa, Giardia lamblia
DVESDVEQQVEQSAKKSPVQ

SEQ ID NO: 3105743 - protein, 6 aa, Giardia lamblia
DVETAE

SEQ ID NO: 3105744 - protein, 13 aa, Giardia lamblia
DVETEKPVAAQKG

SEQ ID NO: 3105745 - protein, 8 aa, Giardia lamblia
DVGDAAAA

SEQ ID NO: 3105746 - protein, 8 aa, Giardia lamblia
DVGETSGM

SEQ ID NO: 3105747 - protein, 5 aa, Giardia lamblia
DVGRG

SEQ ID NO: 3105748 - protein, 14 aa, Giardia lamblia
DVGSDSASKSTKKF

SEQ ID NO: 3105749 - protein, 14 aa, Giardia lamblia
DVGSNCPDTSHSSS

SEQ ID NO: 3105750 - protein, 28 aa, Giardia lamblia
DVGSSMGKPDTSGGSSKSAKATKMPKQT

SEQ ID NO: 3105751 - protein, 8 aa, Giardia lamblia
DVGSTSRS

SEQ ID NO: 3105752 - protein, 8 aa, Giardia lamblia
DVHSTQSS

SEQ ID NO: 3105753 - protein, 8 aa, Giardia lamblia
DVKEEPYT

SEQ ID NO: 3105754 - protein, 8 aa, Giardia lamblia
DVKEQNNA

SEQ ID NO: 3105755 - protein, 7 aa, Giardia lamblia
DVKGNPK

SEQ ID NO: 3105756 - protein, 5 aa, Giardia lamblia
DVKGT

SEQ ID NO: 3105757 - protein, 8 aa, Giardia lamblia
DVKKAKQI

SEQ ID NO: 3105758 - protein, 9 aa, Giardia lamblia
DVKNSDDET

SEQ ID NO: 3105759 - protein, 16 aa, Giardia lamblia
DVKNTTKVSHPPRHDS

SEQ ID NO: 3105760 - protein, 5 aa, Giardia lamblia
DVKTP

SEQ ID NO: 3105761 - protein, 16 aa, Giardia lamblia
DVLDEKPEKLPTEPFS

SEQ ID NO: 3105762 - protein, 5 aa, Giardia lamblia
DVLSE

SEQ ID NO: 3105763 - protein, 30 aa, Giardia lamblia
DVLSGSGRRTTGTAMSTVSASGKTSSDDQM

SEQ ID NO: 3105764 - protein, 8 aa, Giardia lamblia
DVNGDDAL

SEQ ID NO: 3105765 - protein, 5 aa, Giardia lamblia
DVNGH

SEQ ID NO: 3105766 - protein, 6 aa, Giardia lamblia
DVNSDG

SEQ ID NO: 3105767 - protein, 6 aa, Giardia lamblia
DVPAEQ

SEQ ID NO: 3105768 - protein, 48 aa, Giardia lamblia
DVPAQKPQSKRSSGYGEPGARPKPPADIRDKSGRLRKADGSLRFILPE

SEQ ID NO: 3105769 - protein, 7 aa, Giardia lamblia
DVPARTL

SEQ ID NO: 3105770 - protein, 7 aa, Giardia lamblia
DVPDPEG

SEQ ID NO: 3105771 - protein, 7 aa, Giardia lamblia
DVPDTPL

SEQ ID NO: 3105772 - protein, 21 aa, Giardia lamblia
DVPEQNEEDGYSSNPVPDNPV

SEQ ID NO: 3105773 - protein, 15 aa, Giardia lamblia
DVPEYGEAPIDRNAK

SEQ ID NO: 3105774 - protein, 10 aa, Giardia lamblia
DVPNAPKSSF

SEQ ID NO: 3105775 - protein, 7 aa, Giardia lamblia
DVPPGKP

SEQ ID NO: 3105776 - protein, 7 aa, Giardia lamblia
DVPPHLG

SEQ ID NO: 3105777 - protein, 12 aa, Giardia lamblia
DVPPPSSAPSMV

SEQ ID NO: 3105778 - protein, 16 aa, Giardia lamblia
DVPPSDDGDEPPISSV

SEQ ID NO: 3105779 - protein, 7 aa, Giardia lamblia
DVPPTEH

SEQ ID NO: 3105780 - protein, 6 aa, Giardia lamblia
DVPPTN

SEQ ID NO: 3105781 - protein, 29 aa, Giardia lamblia
DVQQPSKDQQPTATGKRYGSAATTSSGTY

SEQ ID NO: 3105782 - protein, 15 aa, Giardia lamblia
DVQRQADRLAEKDAR

SEQ ID NO: 3105783 - protein, 35 aa, Giardia lamblia
DVRKQSEVPDGPADFNAARDQSAPTSVQSQQRQQQ

SEQ ID NO: 3105784 - protein, 17 aa, Giardia lamblia
DVRLNPSSTESTETPLV

SEQ ID NO: 3105785 - protein, 8 aa, Giardia lamblia
DVRPSTRS

SEQ ID NO: 3105786 - protein, 9 aa, Giardia lamblia
DVRQPTKIQ

SEQ ID NO: 3105787 - protein, 8 aa, Giardia lamblia
DVSAAHSA

SEQ ID NO: 3105788 - protein, 10 aa, Giardia lamblia
DVSDASEKTH

SEQ ID NO: 3105789 - protein, 14 aa, Giardia lamblia
DVSDDDGEEGYESN

SEQ ID NO: 3105790 - protein, 7 aa, Giardia lamblia
DVSDRRP

SEQ ID NO: 3105791 - protein, 20 aa, Giardia lamblia
DVSDSDIEGSIPSDLPELEG

SEQ ID NO: 3105792 - protein, 7 aa, Giardia lamblia
DVSENGE

SEQ ID NO: 3105793 - protein, 22 aa, Giardia lamblia
DVSERKTSDRPAARAGAPGVKQ

SEQ ID NO: 3105794 - protein, 5 aa, Giardia lamblia
DVSGA

SEQ ID NO: 3105795 - protein, 11 aa, Giardia lamblia
DVSKPASKVST

SEQ ID NO: 3105796 - protein, 9 aa, Giardia lamblia
DVSKQRDLY

SEQ ID NO: 3105797 - protein, 8 aa, Giardia lamblia
DVSNSEIK

SEQ ID NO: 3105798 - protein, 7 aa, Giardia lamblia
DVSPPVN

SEQ ID NO: 3105799 - protein, 8 aa, Giardia lamblia
DVSQNHPY

SEQ ID NO: 3105800 - protein, 9 aa, Giardia lamblia
DVSSDEVPK

SEQ ID NO: 3105801 - protein, 4 aa, Giardia lamblia
DVST

SEQ ID NO: 3105802 - protein, 7 aa, Giardia lamblia
DVSTENR

SEQ ID NO: 3105803 - protein, 12 aa, Giardia lamblia
DVSTGGTRMPSS

SEQ ID NO: 3105804 - protein, 8 aa, Giardia lamblia
DVSTITEE

SEQ ID NO: 3105805 - protein, 25 aa, Giardia lamblia
DVTASNSSQPSTQTSQALYSKDGQI

SEQ ID NO: 3105806 - protein, 4 aa, Giardia lamblia
DVTD

SEQ ID NO: 3105807 - protein, 9 aa, Giardia lamblia
DVTEEHGRT

SEQ ID NO: 3105808 - protein, 4 aa, Giardia lamblia
DVTK

SEQ ID NO: 3105809 - protein, 9 aa, Giardia lamblia
DVTKERDAL

SEQ ID NO: 3105810 - protein, 8 aa, Giardia lamblia
DVTKIGPA

SEQ ID NO: 3105811 - protein, 6 aa, Giardia lamblia
DVTKRQ

SEQ ID NO: 3105812 - protein, 6 aa, Giardia lamblia
DVTPAS

SEQ ID NO: 3105813 - protein, 7 aa, Giardia lamblia
DVTRAEV

SEQ ID NO: 3105814 - protein, 5 aa, Giardia lamblia
DVTRS

SEQ ID NO: 3105815 - protein, 13 aa, Giardia lamblia
DVTSGSVTPATAT

SEQ ID NO: 3105816 - protein, 15 aa, Giardia lamblia
DVTSPRQDVNCTGKR

SEQ ID NO: 3105817 - protein, 14 aa, Giardia lamblia
DVVKGGPKVDENGN

SEQ ID NO: 3105818 - protein, 11 aa, Giardia lamblia
DVWRGSRDNFS

SEQ ID NO: 3105819 - protein, 7 aa, Giardia lamblia
DVYTSTG

SEQ ID NO: 3105820 - protein, 13 aa, Giardia lamblia
DWNDEQEDRELSS

SEQ ID NO: 3105821 - protein, 5 aa, Giardia lamblia
DWPEE

SEQ ID NO: 3105822 - protein, 5 aa, Giardia lamblia
DWSGK

SEQ ID NO: 3105823 - protein, 4 aa, Giardia lamblia
DWSP

SEQ ID NO: 3105824 - protein, 7 aa, Giardia lamblia
DYAGSIS

SEQ ID NO: 3105825 - protein, 4 aa, Giardia lamblia
DYAP

SEQ ID NO: 3105826 - protein, 4 aa, Giardia lamblia
DYAR

SEQ ID NO: 3105827 - protein, 11 aa, Giardia lamblia
DYARTKTYDGK

SEQ ID NO: 3105828 - protein, 18 aa, Giardia lamblia
DYATDTASLPDTDYECTP

SEQ ID NO: 3105829 - protein, 4 aa, Giardia lamblia
DYDD

SEQ ID NO: 3105830 - protein, 6 aa, Giardia lamblia
DYDNRE

SEQ ID NO: 3105831 - protein, 6 aa, Giardia lamblia
DYDPAK

SEQ ID NO: 3105832 - protein, 11 aa, Giardia lamblia
DYEANLKTNKG

SEQ ID NO: 3105833 - protein, 7 aa, Giardia lamblia
DYEASAR

SEQ ID NO: 3105834 - protein, 6 aa, Giardia lamblia
DYEASD

SEQ ID NO: 3105835 - protein, 11 aa, Giardia lamblia
DYEASQLSKEL

SEQ ID NO: 3105836 - protein, 13 aa, Giardia lamblia
DYEDTDLNVQNNT

SEQ ID NO: 3105837 - protein, 6 aa, Giardia lamblia
DYEKIK

SEQ ID NO: 3105838 - protein, 6 aa, Giardia lamblia
DYEKNQ

SEQ ID NO: 3105839 - protein, 6 aa, Giardia lamblia
DYEPSY

SEQ ID NO: 3105840 - protein, 6 aa, Giardia lamblia
DYERAR

SEQ ID NO: 3105841 - protein, 8 aa, Giardia lamblia
DYGDTTPL

SEQ ID NO: 3105842 - protein, 11 aa, Giardia lamblia
DYGEAASVSGR

SEQ ID NO: 3105843 - protein, 5 aa, Giardia lamblia
DYGNT

SEQ ID NO: 3105844 - protein, 17 aa, Giardia lamblia
DYGTSQDETTGDHQNPY

SEQ ID NO: 3105845 - protein, 5 aa, Giardia lamblia
DYKCP

SEQ ID NO: 3105846 - protein, 15 aa, Giardia lamblia
DYKPASRESLEDAPN

SEQ ID NO: 3105847 - protein, 15 aa, Giardia lamblia
DYKRKRGSKIQVSKS

SEQ ID NO: 3105848 - protein, 10 aa, Giardia lamblia
DYKSNSTATI

SEQ ID NO: 3105849 - protein, 9 aa, Giardia lamblia
DYLPPTAEP

SEQ ID NO: 3105850 - protein, 4 aa, Giardia lamblia
DYND

SEQ ID NO: 3105851 - protein, 5 aa, Giardia lamblia
DYNEQ

SEQ ID NO: 3105852 - protein, 6 aa, Giardia lamblia
DYNEQK

SEQ ID NO: 3105853 - protein, 6 aa, Giardia lamblia
DYNGSI

SEQ ID NO: 3105854 - protein, 39 aa, Giardia lamblia
DYNNTNNYDSYNSGYDNYNSGYDNYSSGGYNSYGGGYSS

SEQ ID NO: 3105855 - protein, 50 aa, Giardia lamblia
DYNPYGTDYGYDAGGYDYGAGYGGYGNQETGYGDQTYGYGEPAEQPQDSL

SEQ ID NO: 3105856 - protein, 8 aa, Giardia lamblia
DYNRDGGI

SEQ ID NO: 3105857 - protein, 16 aa, Giardia lamblia
DYNTNGGTPGTLPGTD

SEQ ID NO: 3105858 - protein, 14 aa, Giardia lamblia
DYNTTARTTLPGAT

SEQ ID NO: 3105859 - protein, 7 aa, Giardia lamblia
DYPATDI

SEQ ID NO: 3105860 - protein, 20 aa, Giardia lamblia
DYPDRRPFSSREQGDPYRPM

SEQ ID NO: 3105861 - protein, 6 aa, Giardia lamblia
DYPFDT

SEQ ID NO: 3105862 - protein, 10 aa, Giardia lamblia
DYPGPSPYAD

SEQ ID NO: 3105863 - protein, 9 aa, Giardia lamblia
DYPLSPPEC

SEQ ID NO: 3105864 - protein, 7 aa, Giardia lamblia
DYPNYSE

SEQ ID NO: 3105865 - protein, 11 aa, Giardia lamblia
DYPPKRPSKTL

SEQ ID NO: 3105866 - protein, 7 aa, Giardia lamblia
DYPPPGL

SEQ ID NO: 3105867 - protein, 19 aa, Giardia lamblia
DYPQECQDTNREERAKTAT

SEQ ID NO: 3105868 - protein, 5 aa, Giardia lamblia
DYPQT

SEQ ID NO: 3105869 - protein, 7 aa, Giardia lamblia
DYPSAVA

SEQ ID NO: 3105870 - protein, 5 aa, Giardia lamblia
DYPSD

SEQ ID NO: 3105871 - protein, 6 aa, Giardia lamblia
DYQASY

SEQ ID NO: 3105872 - protein, 7 aa, Giardia lamblia
DYQGRTA

SEQ ID NO: 3105873 - protein, 9 aa, Giardia lamblia
DYQRTSPLA

SEQ ID NO: 3105874 - protein, 4 aa, Giardia lamblia
DYQS

SEQ ID NO: 3105875 - protein, 10 aa, Giardia lamblia
DYRDGPFTAE

SEQ ID NO: 3105876 - protein, 12 aa, Giardia lamblia
DYRDSERSLDQL

SEQ ID NO: 3105877 - protein, 4 aa, Giardia lamblia
DYRE

SEQ ID NO: 3105878 - protein, 6 aa, Giardia lamblia
DYRPPS

SEQ ID NO: 3105879 - protein, 10 aa, Giardia lamblia
DYRTPETSLT

SEQ ID NO: 3105880 - protein, 4 aa, Giardia lamblia
DYSA

SEQ ID NO: 3105881 - protein, 19 aa, Giardia lamblia
DYSATKEPPSTESQGLTPQ

SEQ ID NO: 3105882 - protein, 7 aa, Giardia lamblia
DYSDDKD

SEQ ID NO: 3105883 - protein, 8 aa, Giardia lamblia
DYSPPTQP

SEQ ID NO: 3105884 - protein, 8 aa, Giardia lamblia
DYSPSDTI

SEQ ID NO: 3105885 - protein, 5 aa, Giardia lamblia
DYSSR

SEQ ID NO: 3105886 - protein, 16 aa, Giardia lamblia
DYSTHRTSAPTEAESK

SEQ ID NO: 3105887 - protein, 16 aa, Giardia lamblia
DYTEENRKKAELLFEG

SEQ ID NO: 3105888 - protein, 15 aa, Giardia lamblia
DYTNTDYYSDQNAPF

SEQ ID NO: 3105889 - protein, 6 aa, Giardia lamblia
DYTNVT

SEQ ID NO: 3105890 - protein, 4 aa, Giardia lamblia
DYTP

SEQ ID NO: 3105891 - protein, 9 aa, Giardia lamblia
DYTPPGSVN

SEQ ID NO: 3105892 - protein, 6 aa, Giardia lamblia
DYTPSR

SEQ ID NO: 3105893 - protein, 6 aa, Giardia lamblia
DYTSQT

SEQ ID NO: 3105894 - protein, 11 aa, Giardia lamblia
DYTSQYSITGN

SEQ ID NO: 3105895 - protein, 6 aa, Giardia lamblia
DYTSSI

SEQ ID NO: 3105896 - protein, 9 aa, Giardia lamblia
DYTTRKSHR

SEQ ID NO: 3105897 - protein, 9 aa, Giardia lamblia
DYVHKEKDP

SEQ ID NO: 3105898 - protein, 5 aa, Giardia lamblia
DYYTP

SEQ ID NO: 3105899 - protein, 6 aa, Giardia lamblia
EAAAAH

SEQ ID NO: 3105900 - protein, 6 aa, Giardia lamblia
EAAAAL

SEQ ID NO: 3105901 - protein, 8 aa, Giardia lamblia
EAAADTYP

SEQ ID NO: 3105902 - protein, 14 aa, Giardia lamblia
EAAAERQKASQHLQ

SEQ ID NO: 3105903 - protein, 9 aa, Giardia lamblia
EAAAQASNL

SEQ ID NO: 3105904 - protein, 12 aa, Giardia lamblia
EAAASSFKTVFP

SEQ ID NO: 3105905 - protein, 9 aa, Giardia lamblia
EAADSNEQL

SEQ ID NO: 3105906 - protein, 9 aa, Giardia lamblia
EAADTDTIE

SEQ ID NO: 3105907 - protein, 10 aa, Giardia lamblia
EAAERRDPRF

SEQ ID NO: 3105908 - protein, 9 aa, Giardia lamblia
EAAGGAKRF

SEQ ID NO: 3105909 - protein, 5 aa, Giardia lamblia
EAAGK

SEQ ID NO: 3105910 - protein, 7 aa, Giardia lamblia
EAAGQTD

SEQ ID NO: 3105911 - protein, 18 aa, Giardia lamblia
EAAGRKLEEATALNTSLT

SEQ ID NO: 3105912 - protein, 4 aa, Giardia lamblia
EAAK

SEQ ID NO: 3105913 - protein, 11 aa, Giardia lamblia
EAAKQSDRGFT

SEQ ID NO: 3105914 - protein, 5 aa, Giardia lamblia
EAAKV

SEQ ID NO: 3105915 - protein, 11 aa, Giardia lamblia
EAAMQNRTGET

SEQ ID NO: 3105916 - protein, 8 aa, Giardia lamblia
EAAPANDD

SEQ ID NO: 3105917 - protein, 7 aa, Giardia lamblia
EAAPETL

SEQ ID NO: 3105918 - protein, 12 aa, Giardia lamblia
EAAPNEANKSAA

SEQ ID NO: 3105919 - protein, 18 aa, Giardia lamblia
EAAQDEALRYKSEAKELR

SEQ ID NO: 3105920 - protein, 22 aa, Giardia lamblia
EAAQDPTQDPPPGSQKVRESFQ

SEQ ID NO: 3105921 - protein, 14 aa, Giardia lamblia
EAAQSVKGNSCAET

SEQ ID NO: 3105922 - protein, 7 aa, Giardia lamblia
EAAREAA

SEQ ID NO: 3105923 - protein, 22 aa, Giardia lamblia
EAARHDKEKNELKQDLKQKQTE

SEQ ID NO: 3105924 - protein, 7 aa, Giardia lamblia
EAARNRQ

SEQ ID NO: 3105925 - protein, 7 aa, Giardia lamblia
EAARRLE

SEQ ID NO: 3105926 - protein, 8 aa, Giardia lamblia
EAARRNPD

SEQ ID NO: 3105927 - protein, 25 aa, Giardia lamblia
EAASIAASQSMNSSSVTNSQGLPTS

SEQ ID NO: 3105928 - protein, 9 aa, Giardia lamblia
EAASMSPAL

SEQ ID NO: 3105929 - protein, 6 aa, Giardia lamblia
EAATDT

SEQ ID NO: 3105930 - protein, 17 aa, Giardia lamblia
EAATEAQDLAGTGLQSK

SEQ ID NO: 3105931 - protein, 8 aa, Giardia lamblia
EAATGSSI

SEQ ID NO: 3105932 - protein, 5 aa, Giardia lamblia
EAATI

SEQ ID NO: 3105933 - protein, 10 aa, Giardia lamblia
EAATRAADPE

SEQ ID NO: 3105934 - protein, 11 aa, Giardia lamblia
EACKGKLNEAG

SEQ ID NO: 3105935 - protein, 10 aa, Giardia lamblia
EACTQRKDGY

SEQ ID NO: 3105936 - protein, 17 aa, Giardia lamblia
EADAIRDTRDPAKEARR

SEQ ID NO: 3105937 - protein, 8 aa, Giardia lamblia
EADAQGVG

SEQ ID NO: 3105938 - protein, 6 aa, Giardia lamblia
EADARA

SEQ ID NO: 3105939 - protein, 6 aa, Giardia lamblia
EADATI

SEQ ID NO: 3105940 - protein, 11 aa, Giardia lamblia
EADATRGADAA

SEQ ID NO: 3105941 - protein, 16 aa, Giardia lamblia
EADDEDNETDADERTV

SEQ ID NO: 3105942 - protein, 9 aa, Giardia lamblia
EADDSKEHI

SEQ ID NO: 3105943 - protein, 9 aa, Giardia lamblia
EADGADSLA

SEQ ID NO: 3105944 - protein, 6 aa, Giardia lamblia
EADGEV

SEQ ID NO: 3105945 - protein, 5 aa, Giardia lamblia
EADGT

SEQ ID NO: 3105946 - protein, 7 aa, Giardia lamblia
EADGTTP

SEQ ID NO: 3105947 - protein, 4 aa, Giardia lamblia
EADI

SEQ ID NO: 3105948 - protein, 9 aa, Giardia lamblia
EADKPLNEN

SEQ ID NO: 3105949 - protein, 5 aa, Giardia lamblia
EADLE

SEQ ID NO: 3105950 - protein, 7 aa, Giardia lamblia
EADLSSK

SEQ ID NO: 3105951 - protein, 6 aa, Giardia lamblia
EADNAN

SEQ ID NO: 3105952 - protein, 5 aa, Giardia lamblia
EADNP

SEQ ID NO: 3105953 - protein, 5 aa, Giardia lamblia
EADNR

SEQ ID NO: 3105954 - protein, 4 aa, Giardia lamblia
EADP

SEQ ID NO: 3105955 - protein, 4 aa, Giardia lamblia
EADQ

SEQ ID NO: 3105956 - protein, 9 aa, Giardia lamblia
EADQAKERE

SEQ ID NO: 3105957 - protein, 5 aa, Giardia lamblia
EADQL

SEQ ID NO: 3105958 - protein, 8 aa, Giardia lamblia
EADRDEKD

SEQ ID NO: 3105959 - protein, 12 aa, Giardia lamblia
EADRDGDGEINE

SEQ ID NO: 3105960 - protein, 7 aa, Giardia lamblia
EADSGAR

SEQ ID NO: 3105961 - protein, 10 aa, Giardia lamblia
EADSHGFQSM

SEQ ID NO: 3105962 - protein, 13 aa, Giardia lamblia
EADTESENQRART

SEQ ID NO: 3105963 - protein, 10 aa, Giardia lamblia
EADTRSSELT

SEQ ID NO: 3105964 - protein, 4 aa, Giardia lamblia
EAEA

SEQ ID NO: 3105965 - protein, 8 aa, Giardia lamblia
EAEAGKMA

SEQ ID NO: 3105966 - protein, 4 aa, Giardia lamblia
EAED

SEQ ID NO: 3105967 - protein, 10 aa, Giardia lamblia
EAEEKPPESV

SEQ ID NO: 3105968 - protein, 6 aa, Giardia lamblia
EAEEPC

SEQ ID NO: 3105969 - protein, 6 aa, Giardia lamblia
EAEESK

SEQ ID NO: 3105970 - protein, 9 aa, Giardia lamblia
EAEFQTSGP

SEQ ID NO: 3105971 - protein, 4 aa, Giardia lamblia
EAEG

SEQ ID NO: 3105972 - protein, 16 aa, Giardia lamblia
EAEGQAGTPSEKTDDK

SEQ ID NO: 3105973 - protein, 25 aa, Giardia lamblia
EAEGSRPNTASKKGPKLDKTAFPTM

SEQ ID NO: 3105974 - protein, 6 aa, Giardia lamblia
EAEHDG

SEQ ID NO: 3105975 - protein, 6 aa, Giardia lamblia
EAEIED

SEQ ID NO: 3105976 - protein, 7 aa, Giardia lamblia
EAEKAAR

SEQ ID NO: 3105977 - protein, 6 aa, Giardia lamblia
EAEKAN

SEQ ID NO: 3105978 - protein, 16 aa, Giardia lamblia
EAEKGDTTSPKQSTEI

SEQ ID NO: 3105979 - protein, 10 aa, Giardia lamblia
EAEKSAAGAQ

SEQ ID NO: 3105980 - protein, 11 aa, Giardia lamblia
EAEMQNKNGRS

SEQ ID NO: 3105981 - protein, 5 aa, Giardia lamblia
EAENA

SEQ ID NO: 3105982 - protein, 21 aa, Giardia lamblia
EAENAKLRDENAKLKAGMNAS

SEQ ID NO: 3105983 - protein, 8 aa, Giardia lamblia
EAENAQLR

SEQ ID NO: 3105984 - protein, 8 aa, Giardia lamblia
EAENASLN

SEQ ID NO: 3105985 - protein, 5 aa, Giardia lamblia
EAENI

SEQ ID NO: 3105986 - protein, 11 aa, Giardia lamblia
EAENSELRSQN

SEQ ID NO: 3105987 - protein, 8 aa, Giardia lamblia
EAENTSIQ

SEQ ID NO: 3105988 - protein, 4 aa, Giardia lamblia
EAEP

SEQ ID NO: 3105989 - protein, 10 aa, Giardia lamblia
EAEPKAPKSI

SEQ ID NO: 3105990 - protein, 33 aa, Giardia lamblia
EAEQEAEKQFSQETKTESKPQKGKTILSPEQAA

SEQ ID NO: 3105991 - protein, 29 aa, Giardia lamblia
EAEQEKKRLKREREEAERLAAEEGEENEE

SEQ ID NO: 3105992 - protein, 7 aa, Giardia lamblia
EAEQPNI

SEQ ID NO: 3105993 - protein, 13 aa, Giardia lamblia
EAEQQRKQLEEQC

SEQ ID NO: 3105994 - protein, 8 aa, Giardia lamblia
EAERANLP

SEQ ID NO: 3105995 - protein, 7 aa, Giardia lamblia
EAERDSL

SEQ ID NO: 3105996 - protein, 11 aa, Giardia lamblia
EAERKSSEKLA

SEQ ID NO: 3105997 - protein, 24 aa, Giardia lamblia
EAERLASPRLRSNEHTSMSADLTD

SEQ ID NO: 3105998 - protein, 7 aa, Giardia lamblia
EAERLQR

SEQ ID NO: 3105999 - protein, 9 aa, Giardia lamblia
EAERQAKSL

SEQ ID NO: 3106000 - protein, 14 aa, Giardia lamblia
EAERYESSRSSLQK

SEQ ID NO: 3106001 - protein, 7 aa, Giardia lamblia
EAESLED

SEQ ID NO: 3106002 - protein, 6 aa, Giardia lamblia
EAESMK

SEQ ID NO: 3106003 - protein, 11 aa, Giardia lamblia
EAETAKLKTRT

SEQ ID NO: 3106004 - protein, 10 aa, Giardia lamblia
EAETDETFPL

SEQ ID NO: 3106005 - protein, 7 aa, Giardia lamblia
EAETERL

SEQ ID NO: 3106006 - protein, 7 aa, Giardia lamblia
EAETHVD

SEQ ID NO: 3106007 - protein, 42 aa, Giardia lamblia
EAETPRQNIEPRPSLSEYPYRDSSHVSSELEGSRVPDNSFTA

SEQ ID NO: 3106008 - protein, 7 aa, Giardia lamblia
EAETSED

SEQ ID NO: 3106009 - protein, 8 aa, Giardia lamblia
EAEYPQID

SEQ ID NO: 3106010 - protein, 6 aa, Giardia lamblia
EAFGSS

SEQ ID NO: 3106011 - protein, 6 aa, Giardia lamblia
EAFPPE

SEQ ID NO: 3106012 - protein, 7 aa, Giardia lamblia
EAFSSRA

SEQ ID NO: 3106013 - protein, 6 aa, Giardia lamblia
EAFSTS

SEQ ID NO: 3106014 - protein, 10 aa, Giardia lamblia
EAFTQPQRST

SEQ ID NO: 3106015 - protein, 5 aa, Giardia lamblia
EAGAN

SEQ ID NO: 3106016 - protein, 10 aa, Giardia lamblia
EAGAQANDGW

SEQ ID NO: 3106017 - protein, 10 aa, Giardia lamblia
EAGAQTKEGY

SEQ ID NO: 3106018 - protein, 6 aa, Giardia lamblia
EAGARK

SEQ ID NO: 3106019 - protein, 10 aa, Giardia lamblia
EAGATNNNGY

SEQ ID NO: 3106020 - protein, 13 aa, Giardia lamblia
EAGAVNADGKNAS

SEQ ID NO: 3106021 - protein, 4 aa, Giardia lamblia
EAGD

SEQ ID NO: 3106022 - protein, 10 aa, Giardia lamblia
EAGEQTPSGW

SEQ ID NO: 3106023 - protein, 11 aa, Giardia lamblia
EAGERDHNGHT

SEQ ID NO: 3106024 - protein, 14 aa, Giardia lamblia
EAGETRRVTTAGKS

SEQ ID NO: 3106025 - protein, 12 aa, Giardia lamblia
EAGGKRATGGTA

SEQ ID NO: 3106026 - protein, 7 aa, Giardia lamblia
EAGHKTK

SEQ ID NO: 3106027 - protein, 9 aa, Giardia lamblia
EAGIQDKNG

SEQ ID NO: 3106028 - protein, 8 aa, Giardia lamblia
EAGIQTDP

SEQ ID NO: 3106029 - protein, 11 aa, Giardia lamblia
EAGIQTTTGES

SEQ ID NO: 3106030 - protein, 11 aa, Giardia lamblia
EAGIRNQDGET

SEQ ID NO: 3106031 - protein, 8 aa, Giardia lamblia
EAGKATNA

SEQ ID NO: 3106032 - protein, 6 aa, Giardia lamblia
EAGKLA

SEQ ID NO: 3106033 - protein, 9 aa, Giardia lamblia
EAGKRTHDS

SEQ ID NO: 3106034 - protein, 10 aa, Giardia lamblia
EAGKTTDVGD

SEQ ID NO: 3106035 - protein, 8 aa, Giardia lamblia
EAGLADAR

SEQ ID NO: 3106036 - protein, 11 aa, Giardia lamblia
EAGLKDNSGCT

SEQ ID NO: 3106037 - protein, 5 aa, Giardia lamblia
EAGLP

SEQ ID NO: 3106038 - protein, 12 aa, Giardia lamblia
EAGLQKNDGQTS

SEQ ID NO: 3106039 - protein, 12 aa, Giardia lamblia
EAGLQQKNGNTA

SEQ ID NO: 3106040 - protein, 9 aa, Giardia lamblia
EAGLQSNGL

SEQ ID NO: 3106041 - protein, 9 aa, Giardia lamblia
EAGLSKADG

SEQ ID NO: 3106042 - protein, 11 aa, Giardia lamblia
EAGLTGRDGRT

SEQ ID NO: 3106043 - protein, 10 aa, Giardia lamblia
EAGLTSDFGN

SEQ ID NO: 3106044 - protein, 9 aa, Giardia lamblia
EAGMKEKTG

SEQ ID NO: 3106045 - protein, 5 aa, Giardia lamblia
EAGMQ

SEQ ID NO: 3106046 - protein, 8 aa, Giardia lamblia
EAGMQTRK

SEQ ID NO: 3106047 - protein, 10 aa, Giardia lamblia
EAGMSNRLGE

SEQ ID NO: 3106048 - protein, 9 aa, Giardia lamblia
EAGMTTNKT

SEQ ID NO: 3106049 - protein, 19 aa, Giardia lamblia
EAGNSALKTGRYKEAAEHY

SEQ ID NO: 3106050 - protein, 7 aa, Giardia lamblia
EAGNSDC

SEQ ID NO: 3106051 - protein, 8 aa, Giardia lamblia
EAGPDGSF

SEQ ID NO: 3106052 - protein, 19 aa, Giardia lamblia
EAGQLPAHGDTSSPTLSQA

SEQ ID NO: 3106053 - protein, 7 aa, Giardia lamblia
EAGQQGV

SEQ ID NO: 3106054 - protein, 8 aa, Giardia lamblia
EAGRADIN

SEQ ID NO: 3106055 - protein, 9 aa, Giardia lamblia
EAGRKNACG

SEQ ID NO: 3106056 - protein, 5 aa, Giardia lamblia
EAGRQ

SEQ ID NO: 3106057 - protein, 11 aa, Giardia lamblia
EAGRQDEDGET

SEQ ID NO: 3106058 - protein, 21 aa, Giardia lamblia
EAGRQGETTTAGSSKKGGIWS

SEQ ID NO: 3106059 - protein, 9 aa, Giardia lamblia
EAGRQTNTG

SEQ ID NO: 3106060 - protein, 10 aa, Giardia lamblia
EAGRRSAELD

SEQ ID NO: 3106061 - protein, 10 aa, Giardia lamblia
EAGRSTASGM

SEQ ID NO: 3106062 - protein, 6 aa, Giardia lamblia
EAGSFN

SEQ ID NO: 3106063 - protein, 12 aa, Giardia lamblia
EAGSRDGSGKPA

SEQ ID NO: 3106064 - protein, 11 aa, Giardia lamblia
EAGSVRKDGKT

SEQ ID NO: 3106065 - protein, 7 aa, Giardia lamblia
EAGSVTT

SEQ ID NO: 3106066 - protein, 9 aa, Giardia lamblia
EAGTEECPA

SEQ ID NO: 3106067 - protein, 7 aa, Giardia lamblia
EAGTNLK

SEQ ID NO: 3106068 - protein, 6 aa, Giardia lamblia
EAGTYR

SEQ ID NO: 3106069 - protein, 5 aa, Giardia lamblia
EAGVE

SEQ ID NO: 3106070 - protein, 7 aa, Giardia lamblia
EAGVQDV

SEQ ID NO: 3106071 - protein, 9 aa, Giardia lamblia
EAGVQSADG

SEQ ID NO: 3106072 - protein, 11 aa, Giardia lamblia
EAGYAGPFGSQ

SEQ ID NO: 3106073 - protein, 11 aa, Giardia lamblia
EAGYANEAGRT

SEQ ID NO: 3106074 - protein, 7 aa, Giardia lamblia
EAGYQDS

SEQ ID NO: 3106075 - protein, 10 aa, Giardia lamblia
EAGYQNKSGW

SEQ ID NO: 3106076 - protein, 23 aa, Giardia lamblia
EAHEKAKDEYDKATEGIKASLER

SEQ ID NO: 3106077 - protein, 5 aa, Giardia lamblia
EAHGN

SEQ ID NO: 3106078 - protein, 4 aa, Giardia lamblia
EAHR

SEQ ID NO: 3106079 - protein, 6 aa, Giardia lamblia
EAHSDE

SEQ ID NO: 3106080 - protein, 11 aa, Giardia lamblia
EAHSSSEKLGD

SEQ ID NO: 3106081 - protein, 10 aa, Giardia lamblia
EAIAEEANRR

SEQ ID NO: 3106082 - protein, 11 aa, Giardia lamblia
EAIPGSTVQET

SEQ ID NO: 3106083 - protein, 11 aa, Giardia lamblia
EAIQDQQDKGV

SEQ ID NO: 3106084 - protein, 9 aa, Giardia lamblia
EAKAEEPKD

SEQ ID NO: 3106085 - protein, 9 aa, Giardia lamblia
EAKAGELQQ

SEQ ID NO: 3106086 - protein, 10 aa, Giardia lamblia
EAKASTDESL

SEQ ID NO: 3106087 - protein, 7 aa, Giardia lamblia
EAKATLD

SEQ ID NO: 3106088 - protein, 5 aa, Giardia lamblia
EAKDA

SEQ ID NO: 3106089 - protein, 28 aa, Giardia lamblia
EAKDKSKKSKERARGGVDPNSSSSQLKS

SEQ ID NO: 3106090 - protein, 6 aa, Giardia lamblia
EAKDLE

SEQ ID NO: 3106091 - protein, 8 aa, Giardia lamblia
EAKDRAHR

SEQ ID NO: 3106092 - protein, 12 aa, Giardia lamblia
EAKDSKRKIPSD

SEQ ID NO: 3106093 - protein, 8 aa, Giardia lamblia
EAKEACAN

SEQ ID NO: 3106094 - protein, 7 aa, Giardia lamblia
EAKEHKY

SEQ ID NO: 3106095 - protein, 15 aa, Giardia lamblia
EAKEKGRQKPNAKRI

SEQ ID NO: 3106096 - protein, 40 aa, Giardia lamblia
EAKEQNVSDSNSETGAEDAATQTITSSQDALQAETCGTNT

SEQ ID NO: 3106097 - protein, 8 aa, Giardia lamblia
EAKERAEF

SEQ ID NO: 3106098 - protein, 8 aa, Giardia lamblia
EAKGREKA

SEQ ID NO: 3106099 - protein, 6 aa, Giardia lamblia
EAKIET

SEQ ID NO: 3106100 - protein, 11 aa, Giardia lamblia
EAKKAARPLPY

SEQ ID NO: 3106101 - protein, 21 aa, Giardia lamblia
EAKKDLAREKQRLADERRQEH

SEQ ID NO: 3106102 - protein, 48 aa, Giardia lamblia
EAKKGGKGKKGKKGSKGKKGKKGSRGSKSLPALEPPPPVGPVGDASVE

SEQ ID NO: 3106103 - protein, 7 aa, Giardia lamblia
EAKKGLT

SEQ ID NO: 3106104 - protein, 10 aa, Giardia lamblia
EAKKKERIEK

SEQ ID NO: 3106105 - protein, 14 aa, Giardia lamblia
EAKKPKDKKQNQQP

SEQ ID NO: 3106106 - protein, 9 aa, Giardia lamblia
EAKKREQEE

SEQ ID NO: 3106107 - protein, 11 aa, Giardia lamblia
EAKKTTTNGKT

SEQ ID NO: 3106108 - protein, 16 aa, Giardia lamblia
EAKMAEAKAKNATDIA

SEQ ID NO: 3106109 - protein, 6 aa, Giardia lamblia
EAKQGK

SEQ ID NO: 3106110 - protein, 9 aa, Giardia lamblia
EAKRRQRAN

SEQ ID NO: 3106111 - protein, 7 aa, Giardia lamblia
EAKRRSS

SEQ ID NO: 3106112 - protein, 9 aa, Giardia lamblia
EAKRTQAAL

SEQ ID NO: 3106113 - protein, 19 aa, Giardia lamblia
EAKSSPHKSKIEELLRSYI

SEQ ID NO: 3106114 - protein, 29 aa, Giardia lamblia
EAKTRKDTAQRRREEAERQRQIAQRNAKQ

SEQ ID NO: 3106115 - protein, 7 aa, Giardia lamblia
EAKWPRG

SEQ ID NO: 3106116 - protein, 4 aa, Giardia lamblia
EALA

SEQ ID NO: 3106117 - protein, 4 aa, Giardia lamblia
EALE

SEQ ID NO: 3106118 - protein, 10 aa, Giardia lamblia
EALEDAEKAG

SEQ ID NO: 3106119 - protein, 8 aa, Giardia lamblia
EALETSNQ

SEQ ID NO: 3106120 - protein, 7 aa, Giardia lamblia
EALGNDL

SEQ ID NO: 3106121 - protein, 4 aa, Giardia lamblia
EALP

SEQ ID NO: 3106122 - protein, 15 aa, Giardia lamblia
EALPTPPEKELEAAK

SEQ ID NO: 3106123 - protein, 6 aa, Giardia lamblia
EALPTT

SEQ ID NO: 3106124 - protein, 4 aa, Giardia lamblia
EALQ

SEQ ID NO: 3106125 - protein, 11 aa, Giardia lamblia
EALQSKANKRT

SEQ ID NO: 3106126 - protein, 10 aa, Giardia lamblia
EALRGTSTEV

SEQ ID NO: 3106127 - protein, 9 aa, Giardia lamblia
EALRQGEKK

SEQ ID NO: 3106128 - protein, 4 aa, Giardia lamblia
EALS

SEQ ID NO: 3106129 - protein, 18 aa, Giardia lamblia
EALSERKAEYNALNDQYK

SEQ ID NO: 3106130 - protein, 14 aa, Giardia lamblia
EALSKGTDKVQDEL

SEQ ID NO: 3106131 - protein, 15 aa, Giardia lamblia
EAMEEEQASKLQPQM

SEQ ID NO: 3106132 - protein, 5 aa, Giardia lamblia
EAMEN

SEQ ID NO: 3106133 - protein, 9 aa, Giardia lamblia
EANAAAEST

SEQ ID NO: 3106134 - protein, 13 aa, Giardia lamblia
EANAAKDKEIEEL

SEQ ID NO: 3106135 - protein, 8 aa, Giardia lamblia
EANAASSL

SEQ ID NO: 3106136 - protein, 6 aa, Giardia lamblia
EANAGS

SEQ ID NO: 3106137 - protein, 8 aa, Giardia lamblia
EANANASN

SEQ ID NO: 3106138 - protein, 9 aa, Giardia lamblia
EANARGSIH

SEQ ID NO: 3106139 - protein, 7 aa, Giardia lamblia
EANEHPT

SEQ ID NO: 3106140 - protein, 4 aa, Giardia lamblia
EANG

SEQ ID NO: 3106141 - protein, 8 aa, Giardia lamblia
EANGRRGV

SEQ ID NO: 3106142 - protein, 6 aa, Giardia lamblia
EANGSL

SEQ ID NO: 3106143 - protein, 7 aa, Giardia lamblia
EANIGEL

SEQ ID NO: 3106144 - protein, 4 aa, Giardia lamblia
EANK

SEQ ID NO: 3106145 - protein, 14 aa, Giardia lamblia
EANKESHAGADVSD

SEQ ID NO: 3106146 - protein, 6 aa, Giardia lamblia
EANNGL

SEQ ID NO: 3106147 - protein, 5 aa, Giardia lamblia
EANNI

SEQ ID NO: 3106148 - protein, 7 aa, Giardia lamblia
EANPAYS

SEQ ID NO: 3106149 - protein, 7 aa, Giardia lamblia
EANPNIQ

SEQ ID NO: 3106150 - protein, 19 aa, Giardia lamblia
EANRAAREQAEVERRAEEQ

SEQ ID NO: 3106151 - protein, 10 aa, Giardia lamblia
EANRRNTDAS

SEQ ID NO: 3106152 - protein, 5 aa, Giardia lamblia
EANSD

SEQ ID NO: 3106153 - protein, 5 aa, Giardia lamblia
EANSK

SEQ ID NO: 3106154 - protein, 11 aa, Giardia lamblia
EANVEKENNRL

SEQ ID NO: 3106155 - protein, 11 aa, Giardia lamblia
EANYTRSNGAT

SEQ ID NO: 3106156 - protein, 23 aa, Giardia lamblia
EAPADVPSQASVQDEAQYPEDDE

SEQ ID NO: 3106157 - protein, 22 aa, Giardia lamblia
EAPATQPIDDIPQGAANPVAGL

SEQ ID NO: 3106158 - protein, 8 aa, Giardia lamblia
EAPDAYKP

SEQ ID NO: 3106159 - protein, 9 aa, Giardia lamblia
EAPDGRSST

SEQ ID NO: 3106160 - protein, 13 aa, Giardia lamblia
EAPDQLTSGTPPI

SEQ ID NO: 3106161 - protein, 16 aa, Giardia lamblia
EAPDVSSYRRTNNQQT

SEQ ID NO: 3106162 - protein, 7 aa, Giardia lamblia
EAPEEAL

SEQ ID NO: 3106163 - protein, 10 aa, Giardia lamblia
EAPEEGSESL

SEQ ID NO: 3106164 - protein, 22 aa, Giardia lamblia
EAPEPHAGYHTNTDSRQAPIDT

SEQ ID NO: 3106165 - protein, 16 aa, Giardia lamblia
EAPEQESKSSSPNITY

SEQ ID NO: 3106166 - protein, 15 aa, Giardia lamblia
EAPLPSVMYKGLFAK

SEQ ID NO: 3106167 - protein, 14 aa, Giardia lamblia
EAPMKPPGSPTSSV

SEQ ID NO: 3106168 - protein, 24 aa, Giardia lamblia
EAPNLPERIPSHSSASISGSGGVT

SEQ ID NO: 3106169 - protein, 9 aa, Giardia lamblia
EAPPITEPL

SEQ ID NO: 3106170 - protein, 9 aa, Giardia lamblia
EAPPPKPTA

SEQ ID NO: 3106171 - protein, 16 aa, Giardia lamblia
EAPPSTDGKDAEHSND

SEQ ID NO: 3106172 - protein, 8 aa, Giardia lamblia
EAPSEDEA

SEQ ID NO: 3106173 - protein, 9 aa, Giardia lamblia
EAPSEQGLN

SEQ ID NO: 3106174 - protein, 15 aa, Giardia lamblia
EAPSLQDSPSSTDQF

SEQ ID NO: 3106175 - protein, 13 aa, Giardia lamblia
EAPSNGPGAPKTI

SEQ ID NO: 3106176 - protein, 9 aa, Giardia lamblia
EAPSSENTA

SEQ ID NO: 3106177 - protein, 9 aa, Giardia lamblia
EAPTGTGKT

SEQ ID NO: 3106178 - protein, 7 aa, Giardia lamblia
EAPTKTS

SEQ ID NO: 3106179 - protein, 5 aa, Giardia lamblia
EAPTL

SEQ ID NO: 3106180 - protein, 4 aa, Giardia lamblia
EAQA

SEQ ID NO: 3106181 - protein, 14 aa, Giardia lamblia
EAQCQSSQAPQDIA

SEQ ID NO: 3106182 - protein, 8 aa, Giardia lamblia
EAQDESSL

SEQ ID NO: 3106183 - protein, 8 aa, Giardia lamblia
EAQDEVSE

SEQ ID NO: 3106184 - protein, 16 aa, Giardia lamblia
EAQEAEREKAAEAQYA

SEQ ID NO: 3106185 - protein, 7 aa, Giardia lamblia
EAQEENM

SEQ ID NO: 3106186 - protein, 10 aa, Giardia lamblia
EAQEKPLERL

SEQ ID NO: 3106187 - protein, 7 aa, Giardia lamblia
EAQENTF

SEQ ID NO: 3106188 - protein, 9 aa, Giardia lamblia
EAQEQAKKQ

SEQ ID NO: 3106189 - protein, 6 aa, Giardia lamblia
EAQGAK

SEQ ID NO: 3106190 - protein, 8 aa, Giardia lamblia
EAQHEGPH

SEQ ID NO: 3106191 - protein, 16 aa, Giardia lamblia
EAQKDLDEATPALEAA

SEQ ID NO: 3106192 - protein, 13 aa, Giardia lamblia
EAQKHKEQRERNY

SEQ ID NO: 3106193 - protein, 8 aa, Giardia lamblia
EAQKIADE

SEQ ID NO: 3106194 - protein, 8 aa, Giardia lamblia
EAQKTTSM

SEQ ID NO: 3106195 - protein, 9 aa, Giardia lamblia
EAQLQRKDG

SEQ ID NO: 3106196 - protein, 4 aa, Giardia lamblia
EAQN

SEQ ID NO: 3106197 - protein, 18 aa, Giardia lamblia
EAQNNPPSLSAGPAAYEG

SEQ ID NO: 3106198 - protein, 4 aa, Giardia lamblia
EAQP

SEQ ID NO: 3106199 - protein, 5 aa, Giardia lamblia
EAQPN

SEQ ID NO: 3106200 - protein, 19 aa, Giardia lamblia
EAQPSQQPQPAQQAARSLQ

SEQ ID NO: 3106201 - protein, 10 aa, Giardia lamblia
EAQQAAEQSV

SEQ ID NO: 3106202 - protein, 10 aa, Giardia lamblia
EAQQEKSRAM

SEQ ID NO: 3106203 - protein, 7 aa, Giardia lamblia
EAQQTDV

SEQ ID NO: 3106204 - protein, 18 aa, Giardia lamblia
EAQRETALEKARAEAGQR

SEQ ID NO: 3106205 - protein, 6 aa, Giardia lamblia
EAQRHT

SEQ ID NO: 3106206 - protein, 7 aa, Giardia lamblia
EAQRKDK

SEQ ID NO: 3106207 - protein, 6 aa, Giardia lamblia
EAQRTH

SEQ ID NO: 3106208 - protein, 6 aa, Giardia lamblia
EAQSKR

SEQ ID NO: 3106209 - protein, 10 aa, Giardia lamblia
EAQSQTELQD

SEQ ID NO: 3106210 - protein, 6 aa, Giardia lamblia
EAQSRF

SEQ ID NO: 3106211 - protein, 7 aa, Giardia lamblia
EAQTYGE

SEQ ID NO: 3106212 - protein, 7 aa, Giardia lamblia
EARADNE

SEQ ID NO: 3106213 - protein, 11 aa, Giardia lamblia
EARAQSKQGET

SEQ ID NO: 3106214 - protein, 9 aa, Giardia lamblia
EARASTANH

SEQ ID NO: 3106215 - protein, 7 aa, Giardia lamblia
EAREGTA

SEQ ID NO: 3106216 - protein, 7 aa, Giardia lamblia
EARESSL

SEQ ID NO: 3106217 - protein, 12 aa, Giardia lamblia
EARGQAPETGAL

SEQ ID NO: 3106218 - protein, 7 aa, Giardia lamblia
EARGQDG

SEQ ID NO: 3106219 - protein, 10 aa, Giardia lamblia
EARGRDPSAA

SEQ ID NO: 3106220 - protein, 4 aa, Giardia lamblia
EARH

SEQ ID NO: 3106221 - protein, 6 aa, Giardia lamblia
EARHSA

SEQ ID NO: 3106222 - protein, 11 aa, Giardia lamblia
EARISTNDGKT

SEQ ID NO: 3106223 - protein, 12 aa, Giardia lamblia
EARKEYTRQIDE

SEQ ID NO: 3106224 - protein, 8 aa, Giardia lamblia
EARKGLQS

SEQ ID NO: 3106225 - protein, 10 aa, Giardia lamblia
EARKQDNLGT

SEQ ID NO: 3106226 - protein, 5 aa, Giardia lamblia
EARLS

SEQ ID NO: 3106227 - protein, 9 aa, Giardia lamblia
EARMQDNAG

SEQ ID NO: 3106228 - protein, 8 aa, Giardia lamblia
EARMRNQE

SEQ ID NO: 3106229 - protein, 4 aa, Giardia lamblia
EARN

SEQ ID NO: 3106230 - protein, 9 aa, Giardia lamblia
EARNREAHK

SEQ ID NO: 3106231 - protein, 8 aa, Giardia lamblia
EARPEKKW

SEQ ID NO: 3106232 - protein, 6 aa, Giardia lamblia
EARRSP

SEQ ID NO: 3106233 - protein, 4 aa, Giardia lamblia
EARS

SEQ ID NO: 3106234 - protein, 6 aa, Giardia lamblia
EARSNM

SEQ ID NO: 3106235 - protein, 14 aa, Giardia lamblia
EARSPRRSDAMSDG

SEQ ID NO: 3106236 - protein, 10 aa, Giardia lamblia
EARSSDSFGK

SEQ ID NO: 3106237 - protein, 7 aa, Giardia lamblia
EARTAEI

SEQ ID NO: 3106238 - protein, 9 aa, Giardia lamblia
EARTTTRTG

SEQ ID NO: 3106239 - protein, 8 aa, Giardia lamblia
EASAATEI

SEQ ID NO: 3106240 - protein, 14 aa, Giardia lamblia
EASASKPSHKGTQR

SEQ ID NO: 3106241 - protein, 5 aa, Giardia lamblia
EASAT

SEQ ID NO: 3106242 - protein, 9 aa, Giardia lamblia
EASDTSRAR

SEQ ID NO: 3106243 - protein, 20 aa, Giardia lamblia
EASEAKAKRLPDKNSSVGSS

SEQ ID NO: 3106244 - protein, 12 aa, Giardia lamblia
EASEATQAENRK

SEQ ID NO: 3106245 - protein, 11 aa, Giardia lamblia
EASENDSQSII

SEQ ID NO: 3106246 - protein, 6 aa, Giardia lamblia
EASENY

SEQ ID NO: 3106247 - protein, 5 aa, Giardia lamblia
EASES

SEQ ID NO: 3106248 - protein, 16 aa, Giardia lamblia
EASGETTQGFRHGEET

SEQ ID NO: 3106249 - protein, 11 aa, Giardia lamblia
EASGGQHTNHE

SEQ ID NO: 3106250 - protein, 26 aa, Giardia lamblia
EASGTGEEEEPEPEPEPEDPAEYPDI

SEQ ID NO: 3106251 - protein, 10 aa, Giardia lamblia
EASGTTAPEK

SEQ ID NO: 3106252 - protein, 6 aa, Giardia lamblia
EASHAQ

SEQ ID NO: 3106253 - protein, 5 aa, Giardia lamblia
EASHT

SEQ ID NO: 3106254 - protein, 4 aa, Giardia lamblia
EASI

SEQ ID NO: 3106255 - protein, 9 aa, Giardia lamblia
EASKRDALG

SEQ ID NO: 3106256 - protein, 6 aa, Giardia lamblia
EASKTL

SEQ ID NO: 3106257 - protein, 7 aa, Giardia lamblia
EASLRNN

SEQ ID NO: 3106258 - protein, 9 aa, Giardia lamblia
EASMRGSNG

SEQ ID NO: 3106259 - protein, 10 aa, Giardia lamblia
EASMSDARSY

SEQ ID NO: 3106260 - protein, 48 aa, Giardia lamblia
EASNINKKHDPVAPTVNRKPAGTEAAHTEHPTSSRDKPKAASQVKGGS

SEQ ID NO: 3106261 - protein, 7 aa, Giardia lamblia
EASNTSG

SEQ ID NO: 3106262 - protein, 7 aa, Giardia lamblia
EASPAER

SEQ ID NO: 3106263 - protein, 7 aa, Giardia lamblia
EASPAGL

SEQ ID NO: 3106264 - protein, 7 aa, Giardia lamblia
EASPDQR

SEQ ID NO: 3106265 - protein, 8 aa, Giardia lamblia
EASPDQTI

SEQ ID NO: 3106266 - protein, 7 aa, Giardia lamblia
EASPDRG

SEQ ID NO: 3106267 - protein, 5 aa, Giardia lamblia
EASPE

SEQ ID NO: 3106268 - protein, 8 aa, Giardia lamblia
EASPNGVS

SEQ ID NO: 3106269 - protein, 8 aa, Giardia lamblia
EASQDGTL

SEQ ID NO: 3106270 - protein, 6 aa, Giardia lamblia
EASQDV

SEQ ID NO: 3106271 - protein, 7 aa, Giardia lamblia
EASRDND

SEQ ID NO: 3106272 - protein, 8 aa, Giardia lamblia
EASRGNEL

SEQ ID NO: 3106273 - protein, 7 aa, Giardia lamblia
EASRGQI

SEQ ID NO: 3106274 - protein, 13 aa, Giardia lamblia
EASRKAADELEAK

SEQ ID NO: 3106275 - protein, 5 aa, Giardia lamblia
EASSA

SEQ ID NO: 3106276 - protein, 8 aa, Giardia lamblia
EASSDAPL

SEQ ID NO: 3106277 - protein, 9 aa, Giardia lamblia
EASSKHKHT

SEQ ID NO: 3106278 - protein, 9 aa, Giardia lamblia
EASSRSEIP

SEQ ID NO: 3106279 - protein, 14 aa, Giardia lamblia
EASSRTATAISDTG

SEQ ID NO: 3106280 - protein, 8 aa, Giardia lamblia
EASSTDAK

SEQ ID NO: 3106281 - protein, 7 aa, Giardia lamblia
EASSTEK

SEQ ID NO: 3106282 - protein, 17 aa, Giardia lamblia
EASSTREKSPSRNPSLC

SEQ ID NO: 3106283 - protein, 8 aa, Giardia lamblia
EASTAPGL

SEQ ID NO: 3106284 - protein, 5 aa, Giardia lamblia
EASTM

SEQ ID NO: 3106285 - protein, 10 aa, Giardia lamblia
EASYAKEAGD

SEQ ID NO: 3106286 - protein, 4 aa, Giardia lamblia
EATD

SEQ ID NO: 3106287 - protein, 12 aa, Giardia lamblia
EATDRASQSTAS

SEQ ID NO: 3106288 - protein, 10 aa, Giardia lamblia
EATERDDKGM

SEQ ID NO: 3106289 - protein, 7 aa, Giardia lamblia
EATGEGL

SEQ ID NO: 3106290 - protein, 9 aa, Giardia lamblia
EATGGRTSV

SEQ ID NO: 3106291 - protein, 7 aa, Giardia lamblia
EATGKHQ

SEQ ID NO: 3106292 - protein, 15 aa, Giardia lamblia
EATHKAGGNASRFSE

SEQ ID NO: 3106293 - protein, 13 aa, Giardia lamblia
EATHSPDEDFPKM

SEQ ID NO: 3106294 - protein, 8 aa, Giardia lamblia
EATKDDNK

SEQ ID NO: 3106295 - protein, 7 aa, Giardia lamblia
EATKPIL

SEQ ID NO: 3106296 - protein, 25 aa, Giardia lamblia
EATKRQKTIKAKSISSVNRSAETIT

SEQ ID NO: 3106297 - protein, 4 aa, Giardia lamblia
EATL

SEQ ID NO: 3106298 - protein, 23 aa, Giardia lamblia
EATLTASEANTPTLSGVSQRRGS

SEQ ID NO: 3106299 - protein, 9 aa, Giardia lamblia
EATLTNPDN

SEQ ID NO: 3106300 - protein, 11 aa, Giardia lamblia
EATLTNSDGRT

SEQ ID NO: 3106301 - protein, 10 aa, Giardia lamblia
EATMTNNSGL

SEQ ID NO: 3106302 - protein, 4 aa, Giardia lamblia
EATN

SEQ ID NO: 3106303 - protein, 4 aa, Giardia lamblia
EATQ

SEQ ID NO: 3106304 - protein, 17 aa, Giardia lamblia
EATQNNLRSSRTLEGKV

SEQ ID NO: 3106305 - protein, 4 aa, Giardia lamblia
EATR

SEQ ID NO: 3106306 - protein, 11 aa, Giardia lamblia
EATRDKAGKIT

SEQ ID NO: 3106307 - protein, 10 aa, Giardia lamblia
EATRDPDTGV

SEQ ID NO: 3106308 - protein, 9 aa, Giardia lamblia
EATRVEENY

SEQ ID NO: 3106309 - protein, 4 aa, Giardia lamblia
EATS

SEQ ID NO: 3106310 - protein, 17 aa, Giardia lamblia
EATTAEISRKYKEKEMT

SEQ ID NO: 3106311 - protein, 7 aa, Giardia lamblia
EATTGGV

SEQ ID NO: 3106312 - protein, 4 aa, Giardia lamblia
EATY

SEQ ID NO: 3106313 - protein, 22 aa, Giardia lamblia
EATYVQREQAKKNLQAHASAAP

SEQ ID NO: 3106314 - protein, 34 aa, Giardia lamblia
EAVAPSATKPSSRSVSASSQGKGSATGVQEQNSS

SEQ ID NO: 3106315 - protein, 4 aa, Giardia lamblia
EAVD

SEQ ID NO: 3106316 - protein, 7 aa, Giardia lamblia
EAVDPKL

SEQ ID NO: 3106317 - protein, 6 aa, Giardia lamblia
EAVEAR

SEQ ID NO: 3106318 - protein, 11 aa, Giardia lamblia
EAVETANASIA

SEQ ID NO: 3106319 - protein, 9 aa, Giardia lamblia
EAVKGPGLD

SEQ ID NO: 3106320 - protein, 9 aa, Giardia lamblia
EAVTQPNGA

SEQ ID NO: 3106321 - protein, 11 aa, Giardia lamblia
EAYGAGAAGTR

SEQ ID NO: 3106322 - protein, 6 aa, Giardia lamblia
EAYIPN

SEQ ID NO: 3106323 - protein, 15 aa, Giardia lamblia
EAYSSDDEGGQTEDS

SEQ ID NO: 3106324 - protein, 15 aa, Giardia lamblia
EAYTEAKQKQRKPEE

SEQ ID NO: 3106325 - protein, 5 aa, Giardia lamblia
EAYTG

SEQ ID NO: 3106326 - protein, 21 aa, Giardia lamblia
EAYTSRPRSTAFHGGSKPSDF

SEQ ID NO: 3106327 - protein, 9 aa, Giardia lamblia
ECAADSGQI

SEQ ID NO: 3106328 - protein, 8 aa, Giardia lamblia
ECANGQER

SEQ ID NO: 3106329 - protein, 28 aa, Giardia lamblia
ECAPEKCSGCPARGACSSRGADNSTSVA

SEQ ID NO: 3106330 - protein, 6 aa, Giardia lamblia
ECAQKK

SEQ ID NO: 3106331 - protein, 8 aa, Giardia lamblia
ECDADDRV

SEQ ID NO: 3106332 - protein, 19 aa, Giardia lamblia
ECDRRNTQAEQASARASEF

SEQ ID NO: 3106333 - protein, 17 aa, Giardia lamblia
ECDRSYKTVGQKISPEA

SEQ ID NO: 3106334 - protein, 5 aa, Giardia lamblia
ECEDE

SEQ ID NO: 3106335 - protein, 7 aa, Giardia lamblia
ECEGGSS

SEQ ID NO: 3106336 - protein, 7 aa, Giardia lamblia
ECGATGT

SEQ ID NO: 3106337 - protein, 7 aa, Giardia lamblia
ECGNSSL

SEQ ID NO: 3106338 - protein, 6 aa, Giardia lamblia
ECNPGY

SEQ ID NO: 3106339 - protein, 4 aa, Giardia lamblia
ECPG

SEQ ID NO: 3106340 - protein, 10 aa, Giardia lamblia
ECRASREREI

SEQ ID NO: 3106341 - protein, 7 aa, Giardia lamblia
ECSEPDS

SEQ ID NO: 3106342 - protein, 11 aa, Giardia lamblia
ECSNDKIYTQE

SEQ ID NO: 3106343 - protein, 9 aa, Giardia lamblia
ECSPMTTAT

SEQ ID NO: 3106344 - protein, 11 aa, Giardia lamblia
ECSPREPCTSG

SEQ ID NO: 3106345 - protein, 12 aa, Giardia lamblia
ECTDRKSNPVRT

SEQ ID NO: 3106346 - protein, 4 aa, Giardia lamblia
ECTG

SEQ ID NO: 3106347 - protein, 19 aa, Giardia lamblia
ECTQSRPSSEKGRPEDDEL

SEQ ID NO: 3106348 - protein, 28 aa, Giardia lamblia
ECVEGNKESSQSPMDTSSGVANESTQTM

SEQ ID NO: 3106349 - protein, 4 aa, Giardia lamblia
EDAA

SEQ ID NO: 3106350 - protein, 10 aa, Giardia lamblia
EDAANERRCR

SEQ ID NO: 3106351 - protein, 8 aa, Giardia lamblia
EDAAQRGS

SEQ ID NO: 3106352 - protein, 26 aa, Giardia lamblia
EDADGAKKKGRPDQPTVTPTLPLDGD

SEQ ID NO: 3106353 - protein, 13 aa, Giardia lamblia
EDADRDKGRTIES

SEQ ID NO: 3106354 - protein, 4 aa, Giardia lamblia
EDAE

SEQ ID NO: 3106355 - protein, 10 aa, Giardia lamblia
EDAGQTVDES

SEQ ID NO: 3106356 - protein, 6 aa, Giardia lamblia
EDAGRG

SEQ ID NO: 3106357 - protein, 5 aa, Giardia lamblia
EDAKS

SEQ ID NO: 3106358 - protein, 4 aa, Giardia lamblia
EDAL

SEQ ID NO: 3106359 - protein, 6 aa, Giardia lamblia
EDANSI

SEQ ID NO: 3106360 - protein, 5 aa, Giardia lamblia
EDAPR

SEQ ID NO: 3106361 - protein, 10 aa, Giardia lamblia
EDAQKRDDRS

SEQ ID NO: 3106362 - protein, 7 aa, Giardia lamblia
EDARSGL

SEQ ID NO: 3106363 - protein, 7 aa, Giardia lamblia
EDASEPL

SEQ ID NO: 3106364 - protein, 34 aa, Giardia lamblia
EDASKKPPESGGKNVPKKKTEEAAPATDPMKEPD

SEQ ID NO: 3106365 - protein, 6 aa, Giardia lamblia
EDASRR

SEQ ID NO: 3106366 - protein, 5 aa, Giardia lamblia
EDATA

SEQ ID NO: 3106367 - protein, 12 aa, Giardia lamblia
EDATRVASTVND

SEQ ID NO: 3106368 - protein, 12 aa, Giardia lamblia
EDATTRQNATQE

SEQ ID NO: 3106369 - protein, 44 aa, Giardia lamblia
EDAVESSEPLSKPIRPNARSPEPSPALSQGGSSLRTSTSTVASS

SEQ ID NO: 3106370 - protein, 6 aa, Giardia lamblia
EDAVSQ

SEQ ID NO: 3106371 - protein, 11 aa, Giardia lamblia
EDAYKENTKEL

SEQ ID NO: 3106372 - protein, 5 aa, Giardia lamblia
EDAYN

SEQ ID NO: 3106373 - protein, 8 aa, Giardia lamblia
EDAYQPDN

SEQ ID NO: 3106374 - protein, 6 aa, Giardia lamblia
EDDALD

SEQ ID NO: 3106375 - protein, 13 aa, Giardia lamblia
EDDDESDDLDSEV

SEQ ID NO: 3106376 - protein, 7 aa, Giardia lamblia
EDDFEST

SEQ ID NO: 3106377 - protein, 5 aa, Giardia lamblia
EDDIQ

SEQ ID NO: 3106378 - protein, 5 aa, Giardia lamblia
EDDIR

SEQ ID NO: 3106379 - protein, 8 aa, Giardia lamblia
EDDKDKYE

SEQ ID NO: 3106380 - protein, 10 aa, Giardia lamblia
EDDKSRAETA

SEQ ID NO: 3106381 - protein, 9 aa, Giardia lamblia
EDDLSNNKE

SEQ ID NO: 3106382 - protein, 9 aa, Giardia lamblia
EDDNSKAVH

SEQ ID NO: 3106383 - protein, 7 aa, Giardia lamblia
EDDPDRT

SEQ ID NO: 3106384 - protein, 21 aa, Giardia lamblia
EDDQYQSQEYSTAASTTQTLR

SEQ ID NO: 3106385 - protein, 22 aa, Giardia lamblia
EDDRHDSPSSRMSSSDEEGDLY

SEQ ID NO: 3106386 - protein, 7 aa, Giardia lamblia
EDDSKED

SEQ ID NO: 3106387 - protein, 8 aa, Giardia lamblia
EDDTGKIS

SEQ ID NO: 3106388 - protein, 16 aa, Giardia lamblia
EDDTLTEEELDSQRNS

SEQ ID NO: 3106389 - protein, 12 aa, Giardia lamblia
EDDTRTQLPSFN

SEQ ID NO: 3106390 - protein, 23 aa, Giardia lamblia
EDDVRDSKPALQETGFKKRKNSV

SEQ ID NO: 3106391 - protein, 12 aa, Giardia lamblia
EDDYEPTEEEIQ

SEQ ID NO: 3106392 - protein, 4 aa, Giardia lamblia
EDEA

SEQ ID NO: 3106393 - protein, 23 aa, Giardia lamblia
EDEAADGERKKGERVRKAVSGTS

SEQ ID NO: 3106394 - protein, 23 aa, Giardia lamblia
EDEAGSHADDTLPLDSDAEREAF

SEQ ID NO: 3106395 - protein, 7 aa, Giardia lamblia
EDEASIY

SEQ ID NO: 3106396 - protein, 9 aa, Giardia lamblia
EDEDGADRA

SEQ ID NO: 3106397 - protein, 7 aa, Giardia lamblia
EDEDGHT

SEQ ID NO: 3106398 - protein, 13 aa, Giardia lamblia
EDEDRRGSTYRTQ

SEQ ID NO: 3106399 - protein, 4 aa, Giardia lamblia
EDEE

SEQ ID NO: 3106400 - protein, 77 aa, Giardia lamblia
EDEEEPEEEAEEEEPEEEEKEEPEDEPPVEEKVEEEEDANGEEKGEDGEDKDEGEEEPEEEEPEEPLPPPKKPVQER

SEQ ID NO: 3106401 - protein, 21 aa, Giardia lamblia
EDEEHSVARPKEVSKEALQTS

SEQ ID NO: 3106402 - protein, 9 aa, Giardia lamblia
EDEEKYEQL

SEQ ID NO: 3106403 - protein, 16 aa, Giardia lamblia
EDEELGSMQSGTSTAN

SEQ ID NO: 3106404 - protein, 4 aa, Giardia lamblia
EDEF

SEQ ID NO: 3106405 - protein, 6 aa, Giardia lamblia
EDEKNE

SEQ ID NO: 3106406 - protein, 7 aa, Giardia lamblia
EDEKQRV

SEQ ID NO: 3106407 - protein, 46 aa, Giardia lamblia
EDEKRAKSIKERNTQLTARAQTSGEAIRQGSSNVPLPRPQTSASVH

SEQ ID NO: 3106408 - protein, 20 aa, Giardia lamblia
EDELRKSKDAIATLTKQNNE

SEQ ID NO: 3106409 - protein, 14 aa, Giardia lamblia
EDELRKSKEQITEL

SEQ ID NO: 3106410 - protein, 7 aa, Giardia lamblia
EDENSRL

SEQ ID NO: 3106411 - protein, 4 aa, Giardia lamblia
EDEP

SEQ ID NO: 3106412 - protein, 6 aa, Giardia lamblia
EDEPLS

SEQ ID NO: 3106413 - protein, 26 aa, Giardia lamblia
EDEPLSSEAASLSDYTQSKKSRGERY

SEQ ID NO: 3106414 - protein, 8 aa, Giardia lamblia
EDERDAGG

SEQ ID NO: 3106415 - protein, 7 aa, Giardia lamblia
EDEREQV

SEQ ID NO: 3106416 - protein, 14 aa, Giardia lamblia
EDERKQMANTTAQT

SEQ ID NO: 3106417 - protein, 5 aa, Giardia lamblia
EDERN

SEQ ID NO: 3106418 - protein, 14 aa, Giardia lamblia
EDERRAYEKSLEQP

SEQ ID NO: 3106419 - protein, 4 aa, Giardia lamblia
EDFK

SEQ ID NO: 3106420 - protein, 16 aa, Giardia lamblia
EDGARRGGYRTATTGH

SEQ ID NO: 3106421 - protein, 10 aa, Giardia lamblia
EDGDSGDLSR

SEQ ID NO: 3106422 - protein, 19 aa, Giardia lamblia
EDGDSGTLRTTGDDSIRPS

SEQ ID NO: 3106423 - protein, 5 aa, Giardia lamblia
EDGEI

SEQ ID NO: 3106424 - protein, 5 aa, Giardia lamblia
EDGFG

SEQ ID NO: 3106425 - protein, 7 aa, Giardia lamblia
EDGGDLQ

SEQ ID NO: 3106426 - protein, 8 aa, Giardia lamblia
EDGGEIPE

SEQ ID NO: 3106427 - protein, 6 aa, Giardia lamblia
EDGGFY

SEQ ID NO: 3106428 - protein, 12 aa, Giardia lamblia
EDGGSLPSPEIT

SEQ ID NO: 3106429 - protein, 25 aa, Giardia lamblia
EDGGSLSKPVRTRSNRRYANEHRQD

SEQ ID NO: 3106430 - protein, 7 aa, Giardia lamblia
EDGGTRI

SEQ ID NO: 3106431 - protein, 12 aa, Giardia lamblia
EDGNDASADPFS

SEQ ID NO: 3106432 - protein, 5 aa, Giardia lamblia
EDGRA

SEQ ID NO: 3106433 - protein, 6 aa, Giardia lamblia
EDGRPY

SEQ ID NO: 3106434 - protein, 7 aa, Giardia lamblia
EDGSAFG

SEQ ID NO: 3106435 - protein, 10 aa, Giardia lamblia
EDGSDGQRAY

SEQ ID NO: 3106436 - protein, 9 aa, Giardia lamblia
EDGSQSPDV

SEQ ID NO: 3106437 - protein, 5 aa, Giardia lamblia
EDGSY

SEQ ID NO: 3106438 - protein, 7 aa, Giardia lamblia
EDGTISG

SEQ ID NO: 3106439 - protein, 6 aa, Giardia lamblia
EDGTPA

SEQ ID NO: 3106440 - protein, 7 aa, Giardia lamblia
EDGTSRR

SEQ ID NO: 3106441 - protein, 24 aa, Giardia lamblia
EDGYDDTSDEDPPTSLTSSTAEIP

SEQ ID NO: 3106442 - protein, 6 aa, Giardia lamblia
EDGYTD

SEQ ID NO: 3106443 - protein, 6 aa, Giardia lamblia
EDHPTC

SEQ ID NO: 3106444 - protein, 15 aa, Giardia lamblia
EDHQAELKEPQKDVQ

SEQ ID NO: 3106445 - protein, 4 aa, Giardia lamblia
EDIE

SEQ ID NO: 3106446 - protein, 20 aa, Giardia lamblia
EDIEEVEKEAEQSAGQPLDT

SEQ ID NO: 3106447 - protein, 13 aa, Giardia lamblia
EDIESQADGVGST

SEQ ID NO: 3106448 - protein, 4 aa, Giardia lamblia
EDIG

SEQ ID NO: 3106449 - protein, 9 aa, Giardia lamblia
EDIGGGDAG

SEQ ID NO: 3106450 - protein, 4 aa, Giardia lamblia
EDIN

SEQ ID NO: 3106451 - protein, 16 aa, Giardia lamblia
EDIPQLQDAADEPAVS

SEQ ID NO: 3106452 - protein, 4 aa, Giardia lamblia
EDIQ

SEQ ID NO: 3106453 - protein, 6 aa, Giardia lamblia
EDIQQA

SEQ ID NO: 3106454 - protein, 5 aa, Giardia lamblia
EDIRR

SEQ ID NO: 3106455 - protein, 9 aa, Giardia lamblia
EDISEAPKQ

SEQ ID NO: 3106456 - protein, 7 aa, Giardia lamblia
EDISSEE

SEQ ID NO: 3106457 - protein, 13 aa, Giardia lamblia
EDKERGKKITTRE

SEQ ID NO: 3106458 - protein, 4 aa, Giardia lamblia
EDKG

SEQ ID NO: 3106459 - protein, 27 aa, Giardia lamblia
EDKHTPVISSPDTRRIGNSKKSSPFEG

SEQ ID NO: 3106460 - protein, 27 aa, Giardia lamblia
EDKIADEEKAMNAKHKNKTKQSIAKEK

SEQ ID NO: 3106461 - protein, 9 aa, Giardia lamblia
EDKLQEKEN

SEQ ID NO: 3106462 - protein, 11 aa, Giardia lamblia
EDKRKSQPTNA

SEQ ID NO: 3106463 - protein, 18 aa, Giardia lamblia
EDKRTKVQTDVDSLGTSE

SEQ ID NO: 3106464 - protein, 8 aa, Giardia lamblia
EDKSKGRN

SEQ ID NO: 3106465 - protein, 4 aa, Giardia lamblia
EDKT

SEQ ID NO: 3106466 - protein, 7 aa, Giardia lamblia
EDKTTRE

SEQ ID NO: 3106467 - protein, 11 aa, Giardia lamblia
EDKVKETTQEN

SEQ ID NO: 3106468 - protein, 4 aa, Giardia lamblia
EDLA

SEQ ID NO: 3106469 - protein, 7 aa, Giardia lamblia
EDLADPE

SEQ ID NO: 3106470 - protein, 10 aa, Giardia lamblia
EDLAEQSSAV

SEQ ID NO: 3106471 - protein, 4 aa, Giardia lamblia
EDLD

SEQ ID NO: 3106472 - protein, 8 aa, Giardia lamblia
EDLDKTAT

SEQ ID NO: 3106473 - protein, 7 aa, Giardia lamblia
EDLDSPE

SEQ ID NO: 3106474 - protein, 6 aa, Giardia lamblia
EDLERS

SEQ ID NO: 3106475 - protein, 6 aa, Giardia lamblia
EDLESN

SEQ ID NO: 3106476 - protein, 4 aa, Giardia lamblia
EDLG

SEQ ID NO: 3106477 - protein, 16 aa, Giardia lamblia
EDLNESDSESQSSLSV

SEQ ID NO: 3106478 - protein, 6 aa, Giardia lamblia
EDLNKL

SEQ ID NO: 3106479 - protein, 11 aa, Giardia lamblia
EDLNTSTTPFL

SEQ ID NO: 3106480 - protein, 4 aa, Giardia lamblia
EDLP

SEQ ID NO: 3106481 - protein, 12 aa, Giardia lamblia
EDLPDEKELEPD

SEQ ID NO: 3106482 - protein, 4 aa, Giardia lamblia
EDLQ

SEQ ID NO: 3106483 - protein, 8 aa, Giardia lamblia
EDLQSRDR

SEQ ID NO: 3106484 - protein, 19 aa, Giardia lamblia
EDLRNGRLRSDSLEGDKER

SEQ ID NO: 3106485 - protein, 6 aa, Giardia lamblia
EDLRQD

SEQ ID NO: 3106486 - protein, 5 aa, Giardia lamblia
EDLSR

SEQ ID NO: 3106487 - protein, 9 aa, Giardia lamblia
EDLTKRQSD

SEQ ID NO: 3106488 - protein, 18 aa, Giardia lamblia
EDLTSSTKFDGDISTGLT

SEQ ID NO: 3106489 - protein, 9 aa, Giardia lamblia
EDLTTQQES

SEQ ID NO: 3106490 - protein, 4 aa, Giardia lamblia
EDMN

SEQ ID NO: 3106491 - protein, 9 aa, Giardia lamblia
EDMPAGQTH

SEQ ID NO: 3106492 - protein, 13 aa, Giardia lamblia
EDMQTDYRQQEEE

SEQ ID NO: 3106493 - protein, 6 aa, Giardia lamblia
EDNASL

SEQ ID NO: 3106494 - protein, 6 aa, Giardia lamblia
EDNDQY

SEQ ID NO: 3106495 - protein, 5 aa, Giardia lamblia
EDNDY

SEQ ID NO: 3106496 - protein, 7 aa, Giardia lamblia
EDNEPEI

SEQ ID NO: 3106497 - protein, 12 aa, Giardia lamblia
EDNKRSREQSRC

SEQ ID NO: 3106498 - protein, 4 aa, Giardia lamblia
EDNL

SEQ ID NO: 3106499 - protein, 5 aa, Giardia lamblia
EDNNE

SEQ ID NO: 3106500 - protein, 21 aa, Giardia lamblia
EDNQPLESESTSDPHMPSSSQ

SEQ ID NO: 3106501 - protein, 37 aa, Giardia lamblia
EDNQTDLSHESQNESQVASEESDQLRETNETLEGEEM

SEQ ID NO: 3106502 - protein, 17 aa, Giardia lamblia
EDNSNIKPNILKKSPST

SEQ ID NO: 3106503 - protein, 13 aa, Giardia lamblia
EDPALSQATKDAI

SEQ ID NO: 3106504 - protein, 6 aa, Giardia lamblia
EDPASD

SEQ ID NO: 3106505 - protein, 39 aa, Giardia lamblia
EDPAVIGPEAPVSGISTDDPERTGDTKSTSRRSHRTGGI

SEQ ID NO: 3106506 - protein, 7 aa, Giardia lamblia
EDPDAGF

SEQ ID NO: 3106507 - protein, 14 aa, Giardia lamblia
EDPEPQPDTSTAEN

SEQ ID NO: 3106508 - protein, 6 aa, Giardia lamblia
EDPERY

SEQ ID NO: 3106509 - protein, 7 aa, Giardia lamblia
EDPHHFD

SEQ ID NO: 3106510 - protein, 7 aa, Giardia lamblia
EDPKEKK

SEQ ID NO: 3106511 - protein, 6 aa, Giardia lamblia
EDPKKA

SEQ ID NO: 3106512 - protein, 5 aa, Giardia lamblia
EDPNT

SEQ ID NO: 3106513 - protein, 8 aa, Giardia lamblia
EDPPGSKR

SEQ ID NO: 3106514 - protein, 10 aa, Giardia lamblia
EDPPSTSTQS

SEQ ID NO: 3106515 - protein, 8 aa, Giardia lamblia
EDPPTSFE

SEQ ID NO: 3106516 - protein, 4 aa, Giardia lamblia
EDPQ

SEQ ID NO: 3106517 - protein, 9 aa, Giardia lamblia
EDPQSRPNF

SEQ ID NO: 3106518 - protein, 14 aa, Giardia lamblia
EDPRDNVAVPDPRV

SEQ ID NO: 3106519 - protein, 9 aa, Giardia lamblia
EDPRDRNGV

SEQ ID NO: 3106520 - protein, 7 aa, Giardia lamblia
EDPRHSD

SEQ ID NO: 3106521 - protein, 15 aa, Giardia lamblia
EDPSGDVTGPLKPPI

SEQ ID NO: 3106522 - protein, 6 aa, Giardia lamblia
EDPSNF

SEQ ID NO: 3106523 - protein, 10 aa, Giardia lamblia
EDPSRPESQE

SEQ ID NO: 3106524 - protein, 8 aa, Giardia lamblia
EDPSTHKA

SEQ ID NO: 3106525 - protein, 9 aa, Giardia lamblia
EDPTDDDGM

SEQ ID NO: 3106526 - protein, 9 aa, Giardia lamblia
EDPTDEKGV

SEQ ID NO: 3106527 - protein, 9 aa, Giardia lamblia
EDPTDGNGV

SEQ ID NO: 3106528 - protein, 9 aa, Giardia lamblia
EDPTDRNGV

SEQ ID NO: 3106529 - protein, 4 aa, Giardia lamblia
EDPV

SEQ ID NO: 3106530 - protein, 4 aa, Giardia lamblia
EDQA

SEQ ID NO: 3106531 - protein, 12 aa, Giardia lamblia
EDQADATAKDCP

SEQ ID NO: 3106532 - protein, 7 aa, Giardia lamblia
EDQDGFQ

SEQ ID NO: 3106533 - protein, 13 aa, Giardia lamblia
EDQDLSKQRKGKE

SEQ ID NO: 3106534 - protein, 8 aa, Giardia lamblia
EDQDTPAW

SEQ ID NO: 3106535 - protein, 12 aa, Giardia lamblia
EDQENVSVSSKR

SEQ ID NO: 3106536 - protein, 23 aa, Giardia lamblia
EDQHADASSKDVQDHNTNDTPDA

SEQ ID NO: 3106537 - protein, 4 aa, Giardia lamblia
EDQI

SEQ ID NO: 3106538 - protein, 11 aa, Giardia lamblia
EDQKTYHTKAS

SEQ ID NO: 3106539 - protein, 15 aa, Giardia lamblia
EDQLKATKAMTSTGM

SEQ ID NO: 3106540 - protein, 6 aa, Giardia lamblia
EDQRDV

SEQ ID NO: 3106541 - protein, 6 aa, Giardia lamblia
EDQSAI

SEQ ID NO: 3106542 - protein, 8 aa, Giardia lamblia
EDQSAKDA

SEQ ID NO: 3106543 - protein, 7 aa, Giardia lamblia
EDQSDCV

SEQ ID NO: 3106544 - protein, 10 aa, Giardia lamblia
EDQSDTDPKK

SEQ ID NO: 3106545 - protein, 6 aa, Giardia lamblia
EDQSRP

SEQ ID NO: 3106546 - protein, 5 aa, Giardia lamblia
EDQYR

SEQ ID NO: 3106547 - protein, 9 aa, Giardia lamblia
EDRAGLSEE

SEQ ID NO: 3106548 - protein, 5 aa, Giardia lamblia
EDRAR

SEQ ID NO: 3106549 - protein, 8 aa, Giardia lamblia
EDRDKEIS

SEQ ID NO: 3106550 - protein, 5 aa, Giardia lamblia
EDRDV

SEQ ID NO: 3106551 - protein, 12 aa, Giardia lamblia
EDRERSKQSTKS

SEQ ID NO: 3106552 - protein, 7 aa, Giardia lamblia
EDRETFT

SEQ ID NO: 3106553 - protein, 91 aa, Giardia lamblia
EDRFGPPAKPRGSVAAQQRSQLPRRQSNMGVQNTPAVRKGRNQPGSQAQVNRTPAPRGAPTYSQAQNLAPTSSAPNNASNVPVPRDITPSA

SEQ ID NO: 3106554 - protein, 7 aa, Giardia lamblia
EDRGQHQ

SEQ ID NO: 3106555 - protein, 5 aa, Giardia lamblia
EDRIT

SEQ ID NO: 3106556 - protein, 8 aa, Giardia lamblia
EDRNSPAY

SEQ ID NO: 3106557 - protein, 9 aa, Giardia lamblia
EDRSSPDYD

SEQ ID NO: 3106558 - protein, 22 aa, Giardia lamblia
EDRSSSRGASMNAARPPPHVSQ

SEQ ID NO: 3106559 - protein, 10 aa, Giardia lamblia
EDRTQSQTQF

SEQ ID NO: 3106560 - protein, 15 aa, Giardia lamblia
EDSASSEANAASTSI

SEQ ID NO: 3106561 - protein, 9 aa, Giardia lamblia
EDSENRGKL

SEQ ID NO: 3106562 - protein, 7 aa, Giardia lamblia
EDSESNE

SEQ ID NO: 3106563 - protein, 7 aa, Giardia lamblia
EDSGHAR

SEQ ID NO: 3106564 - protein, 4 aa, Giardia lamblia
EDSI

SEQ ID NO: 3106565 - protein, 7 aa, Giardia lamblia
EDSIGRT

SEQ ID NO: 3106566 - protein, 16 aa, Giardia lamblia
EDSKAKTSADYPEGDR

SEQ ID NO: 3106567 - protein, 7 aa, Giardia lamblia
EDSKQIE

SEQ ID NO: 3106568 - protein, 12 aa, Giardia lamblia
EDSMPDASQERI

SEQ ID NO: 3106569 - protein, 9 aa, Giardia lamblia
EDSNFQGRT

SEQ ID NO: 3106570 - protein, 9 aa, Giardia lamblia
EDSPARTRI

SEQ ID NO: 3106571 - protein, 33 aa, Giardia lamblia
EDSPCDASTLSTTSRGKAGAKGVITRGGTHATV

SEQ ID NO: 3106572 - protein, 15 aa, Giardia lamblia
EDSPKAPKAFTEQDD

SEQ ID NO: 3106573 - protein, 32 aa, Giardia lamblia
EDSPRKSPGITQVEPRKDSPVKNGTGKVTVSN

SEQ ID NO: 3106574 - protein, 14 aa, Giardia lamblia
EDSPSIRNPSSAKY

SEQ ID NO: 3106575 - protein, 7 aa, Giardia lamblia
EDSQCDT

SEQ ID NO: 3106576 - protein, 21 aa, Giardia lamblia
EDSQSTNSLLSPNGGLSGASM

SEQ ID NO: 3106577 - protein, 17 aa, Giardia lamblia
EDSSSEDFMPGETLPSD

SEQ ID NO: 3106578 - protein, 9 aa, Giardia lamblia
EDSSSWYTS

SEQ ID NO: 3106579 - protein, 10 aa, Giardia lamblia
EDSSTTDPEL

SEQ ID NO: 3106580 - protein, 5 aa, Giardia lamblia
EDSTD

SEQ ID NO: 3106581 - protein, 9 aa, Giardia lamblia
EDSTGNASF

SEQ ID NO: 3106582 - protein, 7 aa, Giardia lamblia
EDSTHVD

SEQ ID NO: 3106583 - protein, 21 aa, Giardia lamblia
EDSTPIPTDRTRHKGGRRGRR

SEQ ID NO: 3106584 - protein, 6 aa, Giardia lamblia
EDSTPV

SEQ ID NO: 3106585 - protein, 5 aa, Giardia lamblia
EDSTQ

SEQ ID NO: 3106586 - protein, 19 aa, Giardia lamblia
EDSTQDELEARYSESSRRH

SEQ ID NO: 3106587 - protein, 8 aa, Giardia lamblia
EDSTSRDS

SEQ ID NO: 3106588 - protein, 8 aa, Giardia lamblia
EDSTSTLQ

SEQ ID NO: 3106589 - protein, 5 aa, Giardia lamblia
EDSVP

SEQ ID NO: 3106590 - protein, 148 aa, Giardia lamblia
EDSYQRAATPECEESAEEPLAAPAPLDPAKDESYQRAATPECEESAEEPLAAPAPLDPAKDESYQRAATPECEESAEEPLAAPAPLDPAKDESYQRAATPECEESAEEPLAAPAPLDPAKDESYQRAATPECEESAEEPLAAPAPLDN

SEQ ID NO: 3106591 - protein, 4 aa, Giardia lamblia
EDTA

SEQ ID NO: 3106592 - protein, 11 aa, Giardia lamblia
EDTADPSEALS

SEQ ID NO: 3106593 - protein, 18 aa, Giardia lamblia
EDTADYQVGESAGQASTV

SEQ ID NO: 3106594 - protein, 9 aa, Giardia lamblia
EDTAGSSVD

SEQ ID NO: 3106595 - protein, 4 aa, Giardia lamblia
EDTC

SEQ ID NO: 3106596 - protein, 4 aa, Giardia lamblia
EDTD

SEQ ID NO: 3106597 - protein, 15 aa, Giardia lamblia
EDTDDTLGAGNMTSM

SEQ ID NO: 3106598 - protein, 22 aa, Giardia lamblia
EDTDRTNGYEEQDPSPISPSSV

SEQ ID NO: 3106599 - protein, 14 aa, Giardia lamblia
EDTDTDEVRSIKEQ

SEQ ID NO: 3106600 - protein, 48 aa, Giardia lamblia
EDTDTEDSRASSRKKRSRANSRSTSRATSKGSTKAASRSARSRSNTAV

SEQ ID NO: 3106601 - protein, 5 aa, Giardia lamblia
EDTDY

SEQ ID NO: 3106602 - protein, 5 aa, Giardia lamblia
EDTEL

SEQ ID NO: 3106603 - protein, 8 aa, Giardia lamblia
EDTERFAN

SEQ ID NO: 3106604 - protein, 17 aa, Giardia lamblia
EDTFAQTTAKHGRDGDA

SEQ ID NO: 3106605 - protein, 48 aa, Giardia lamblia
EDTGFTQTKASQDKGSRNKENAQERQDDAMPAPLEPLSSAAKKDEPVA

SEQ ID NO: 3106606 - protein, 9 aa, Giardia lamblia
EDTHLPPSR

SEQ ID NO: 3106607 - protein, 6 aa, Giardia lamblia
EDTNEL

SEQ ID NO: 3106608 - protein, 16 aa, Giardia lamblia
EDTNERSEHCLQSETH

SEQ ID NO: 3106609 - protein, 5 aa, Giardia lamblia
EDTPI

SEQ ID NO: 3106610 - protein, 14 aa, Giardia lamblia
EDTPIQYAPSDDSG

SEQ ID NO: 3106611 - protein, 12 aa, Giardia lamblia
EDTPPPALPDDP

SEQ ID NO: 3106612 - protein, 15 aa, Giardia lamblia
EDTQAPYAVLFYLRF

SEQ ID NO: 3106613 - protein, 6 aa, Giardia lamblia
EDTQGG

SEQ ID NO: 3106614 - protein, 5 aa, Giardia lamblia
EDTRI

SEQ ID NO: 3106615 - protein, 17 aa, Giardia lamblia
EDTRRASAVAKKAEEAY

SEQ ID NO: 3106616 - protein, 5 aa, Giardia lamblia
EDTSI

SEQ ID NO: 3106617 - protein, 8 aa, Giardia lamblia
EDTTAAPA

SEQ ID NO: 3106618 - protein, 11 aa, Giardia lamblia
EDTTKRLEKSR

SEQ ID NO: 3106619 - protein, 7 aa, Giardia lamblia
EDTTRSV

SEQ ID NO: 3106620 - protein, 6 aa, Giardia lamblia
EDVEPG

SEQ ID NO: 3106621 - protein, 6 aa, Giardia lamblia
EDVERL

SEQ ID NO: 3106622 - protein, 14 aa, Giardia lamblia
EDVKTDPTLSTTKV

SEQ ID NO: 3106623 - protein, 4 aa, Giardia lamblia
EDVN

SEQ ID NO: 3106624 - protein, 18 aa, Giardia lamblia
EDVNDTGRPQPTAKTATA

SEQ ID NO: 3106625 - protein, 13 aa, Giardia lamblia
EDVNKQDQENAQL

SEQ ID NO: 3106626 - protein, 10 aa, Giardia lamblia
EDVNTSAPTR

SEQ ID NO: 3106627 - protein, 4 aa, Giardia lamblia
EDVQ

SEQ ID NO: 3106628 - protein, 6 aa, Giardia lamblia
EDVREG

SEQ ID NO: 3106629 - protein, 34 aa, Giardia lamblia
EDVSEQDYEDNSEHSDTSGSGHSHKKEKHEAELE

SEQ ID NO: 3106630 - protein, 26 aa, Giardia lamblia
EDVSNQSQIESANEQPADSALPVDQE

SEQ ID NO: 3106631 - protein, 18 aa, Giardia lamblia
EDVSSDARASHTPSPSSS

SEQ ID NO: 3106632 - protein, 6 aa, Giardia lamblia
EDYAPT

SEQ ID NO: 3106633 - protein, 6 aa, Giardia lamblia
EDYARR

SEQ ID NO: 3106634 - protein, 6 aa, Giardia lamblia
EEAAAK

SEQ ID NO: 3106635 - protein, 5 aa, Giardia lamblia
EEAAG

SEQ ID NO: 3106636 - protein, 11 aa, Giardia lamblia
EEAAGSTNLRG

SEQ ID NO: 3106637 - protein, 5 aa, Giardia lamblia
EEAAR

SEQ ID NO: 3106638 - protein, 11 aa, Giardia lamblia
EEADAGSEGRL

SEQ ID NO: 3106639 - protein, 10 aa, Giardia lamblia
EEADPAHTTE

SEQ ID NO: 3106640 - protein, 12 aa, Giardia lamblia
EEADRAVRETNG

SEQ ID NO: 3106641 - protein, 8 aa, Giardia lamblia
EEAEINGK

SEQ ID NO: 3106642 - protein, 13 aa, Giardia lamblia
EEAENQGDEPNVG

SEQ ID NO: 3106643 - protein, 10 aa, Giardia lamblia
EEAEPNEAGV

SEQ ID NO: 3106644 - protein, 5 aa, Giardia lamblia
EEAER

SEQ ID NO: 3106645 - protein, 9 aa, Giardia lamblia
EEAERRRRA

SEQ ID NO: 3106646 - protein, 12 aa, Giardia lamblia
EEAGAENNRGQT

SEQ ID NO: 3106647 - protein, 21 aa, Giardia lamblia
EEAGHLSSSASSPASIESSSS

SEQ ID NO: 3106648 - protein, 10 aa, Giardia lamblia
EEAGKRANMG

SEQ ID NO: 3106649 - protein, 5 aa, Giardia lamblia
EEAHS

SEQ ID NO: 3106650 - protein, 11 aa, Giardia lamblia
EEAIATSYTKE

SEQ ID NO: 3106651 - protein, 9 aa, Giardia lamblia
EEAKAEVQS

SEQ ID NO: 3106652 - protein, 17 aa, Giardia lamblia
EEAKDGMERASSRTTEL

SEQ ID NO: 3106653 - protein, 5 aa, Giardia lamblia
EEAKT

SEQ ID NO: 3106654 - protein, 4 aa, Giardia lamblia
EEAL

SEQ ID NO: 3106655 - protein, 7 aa, Giardia lamblia
EEALKEE

SEQ ID NO: 3106656 - protein, 7 aa, Giardia lamblia
EEANDNK

SEQ ID NO: 3106657 - protein, 18 aa, Giardia lamblia
EEANISVQKKKKGKKGEK

SEQ ID NO: 3106658 - protein, 20 aa, Giardia lamblia
EEAPPTDTRVSDSISNTDTD

SEQ ID NO: 3106659 - protein, 18 aa, Giardia lamblia
EEAQYNELTNEKDSGFKS

SEQ ID NO: 3106660 - protein, 22 aa, Giardia lamblia
EEARDESESDTEYEEDTSGVEE

SEQ ID NO: 3106661 - protein, 8 aa, Giardia lamblia
EEARDPPQ

SEQ ID NO: 3106662 - protein, 8 aa, Giardia lamblia
EEARGGNF

SEQ ID NO: 3106663 - protein, 13 aa, Giardia lamblia
EEARRDLGKQQRY

SEQ ID NO: 3106664 - protein, 6 aa, Giardia lamblia
EEASLQ

SEQ ID NO: 3106665 - protein, 6 aa, Giardia lamblia
EEATDL

SEQ ID NO: 3106666 - protein, 7 aa, Giardia lamblia
EEATEHR

SEQ ID NO: 3106667 - protein, 7 aa, Giardia lamblia
EEATQQR

SEQ ID NO: 3106668 - protein, 12 aa, Giardia lamblia
EEAVQKNGGSIE

SEQ ID NO: 3106669 - protein, 5 aa, Giardia lamblia
EEAVT

SEQ ID NO: 3106670 - protein, 14 aa, Giardia lamblia
EEAYNNSKCPSKGA

SEQ ID NO: 3106671 - protein, 5 aa, Giardia lamblia
EEAYS

SEQ ID NO: 3106672 - protein, 12 aa, Giardia lamblia
EEAYTRPAGAAF

SEQ ID NO: 3106673 - protein, 19 aa, Giardia lamblia
EECEENPNYEVTSHGGSQH

SEQ ID NO: 3106674 - protein, 5 aa, Giardia lamblia
EECER

SEQ ID NO: 3106675 - protein, 7 aa, Giardia lamblia
EECGMSA

SEQ ID NO: 3106676 - protein, 4 aa, Giardia lamblia
EEDA

SEQ ID NO: 3106677 - protein, 6 aa, Giardia lamblia
EEDAAL

SEQ ID NO: 3106678 - protein, 26 aa, Giardia lamblia
EEDAEQLNREAKTDTHVTGAAPDTSD

SEQ ID NO: 3106679 - protein, 24 aa, Giardia lamblia
EEDAITTKTSEAAQSKDSPPTGSI

SEQ ID NO: 3106680 - protein, 8 aa, Giardia lamblia
EEDAVRSA

SEQ ID NO: 3106681 - protein, 14 aa, Giardia lamblia
EEDDQLEGYQEQDN

SEQ ID NO: 3106682 - protein, 5 aa, Giardia lamblia
EEDDR

SEQ ID NO: 3106683 - protein, 11 aa, Giardia lamblia
EEDDRASTSPH

SEQ ID NO: 3106684 - protein, 8 aa, Giardia lamblia
EEDDSTDL

SEQ ID NO: 3106685 - protein, 14 aa, Giardia lamblia
EEDDTGDQDRSASL

SEQ ID NO: 3106686 - protein, 10 aa, Giardia lamblia
EEDEDNVGSK

SEQ ID NO: 3106687 - protein, 5 aa, Giardia lamblia
EEDEG

SEQ ID NO: 3106688 - protein, 11 aa, Giardia lamblia
EEDEGSESDQD

SEQ ID NO: 3106689 - protein, 7 aa, Giardia lamblia
EEDEIPP

SEQ ID NO: 3106690 - protein, 18 aa, Giardia lamblia
EEDEKSEEEYRSTQIKQS

SEQ ID NO: 3106691 - protein, 9 aa, Giardia lamblia
EEDENEAKE

SEQ ID NO: 3106692 - protein, 4 aa, Giardia lamblia
EEDG

SEQ ID NO: 3106693 - protein, 20 aa, Giardia lamblia
EEDGEGEGVEENGDDDNNFD

SEQ ID NO: 3106694 - protein, 4 aa, Giardia lamblia
EEDI

SEQ ID NO: 3106695 - protein, 6 aa, Giardia lamblia
EEDISQ

SEQ ID NO: 3106696 - protein, 10 aa, Giardia lamblia
EEDKAGNTIT

SEQ ID NO: 3106697 - protein, 5 aa, Giardia lamblia
EEDKI

SEQ ID NO: 3106698 - protein, 9 aa, Giardia lamblia
EEDKLPSDY

SEQ ID NO: 3106699 - protein, 4 aa, Giardia lamblia
EEDL

SEQ ID NO: 3106700 - protein, 8 aa, Giardia lamblia
EEDNGADV

SEQ ID NO: 3106701 - protein, 8 aa, Giardia lamblia
EEDNLDPG

SEQ ID NO: 3106702 - protein, 7 aa, Giardia lamblia
EEDPLTK

SEQ ID NO: 3106703 - protein, 6 aa, Giardia lamblia
EEDPQT

SEQ ID NO: 3106704 - protein, 10 aa, Giardia lamblia
EEDQQELAKD

SEQ ID NO: 3106705 - protein, 20 aa, Giardia lamblia
EEDRALKNTHDNEESDHTKG

SEQ ID NO: 3106706 - protein, 8 aa, Giardia lamblia
EEDRKSYY

SEQ ID NO: 3106707 - protein, 16 aa, Giardia lamblia
EEDRNEVKNHLSVFEA

SEQ ID NO: 3106708 - protein, 8 aa, Giardia lamblia
EEDRTGGD

SEQ ID NO: 3106709 - protein, 15 aa, Giardia lamblia
EEDRVASAKLAVFGV

SEQ ID NO: 3106710 - protein, 10 aa, Giardia lamblia
EEDSKRLRDQ

SEQ ID NO: 3106711 - protein, 5 aa, Giardia lamblia
EEDTD

SEQ ID NO: 3106712 - protein, 4 aa, Giardia lamblia
EEDV

SEQ ID NO: 3106713 - protein, 5 aa, Giardia lamblia
EEDVA

SEQ ID NO: 3106714 - protein, 5 aa, Giardia lamblia
EEDVD

SEQ ID NO: 3106715 - protein, 8 aa, Giardia lamblia
EEDYNEKA

SEQ ID NO: 3106716 - protein, 8 aa, Giardia lamblia
EEEADEEY

SEQ ID NO: 3106717 - protein, 14 aa, Giardia lamblia
EEEAEMRDSNGQHT

SEQ ID NO: 3106718 - protein, 6 aa, Giardia lamblia
EEEAKE

SEQ ID NO: 3106719 - protein, 5 aa, Giardia lamblia
EEEAR

SEQ ID NO: 3106720 - protein, 9 aa, Giardia lamblia
EEEDQQQRG

SEQ ID NO: 3106721 - protein, 7 aa, Giardia lamblia
EEEEKRR

SEQ ID NO: 3106722 - protein, 5 aa, Giardia lamblia
EEEEL

SEQ ID NO: 3106723 - protein, 17 aa, Giardia lamblia
EEEERKKLKAAREEELA

SEQ ID NO: 3106724 - protein, 6 aa, Giardia lamblia
EEEERS

SEQ ID NO: 3106725 - protein, 22 aa, Giardia lamblia
EEEEVKAVQSQKEKDLKEAQRR

SEQ ID NO: 3106726 - protein, 14 aa, Giardia lamblia
EEEGKKAAADDDAC

SEQ ID NO: 3106727 - protein, 6 aa, Giardia lamblia
EEEGKR

SEQ ID NO: 3106728 - protein, 9 aa, Giardia lamblia
EEEGVPGTA

SEQ ID NO: 3106729 - protein, 7 aa, Giardia lamblia
EEEHARL

SEQ ID NO: 3106730 - protein, 13 aa, Giardia lamblia
EEEHPANTAYQPG

SEQ ID NO: 3106731 - protein, 4 aa, Giardia lamblia
EEEK

SEQ ID NO: 3106732 - protein, 8 aa, Giardia lamblia
EEEKAREI

SEQ ID NO: 3106733 - protein, 29 aa, Giardia lamblia
EEEKERKRKEEAAAKKKAEREKELKERQK

SEQ ID NO: 3106734 - protein, 11 aa, Giardia lamblia
EEEKERSLKEE

SEQ ID NO: 3106735 - protein, 5 aa, Giardia lamblia
EEEKK

SEQ ID NO: 3106736 - protein, 6 aa, Giardia lamblia
EEEKKM

SEQ ID NO: 3106737 - protein, 5 aa, Giardia lamblia
EEELG

SEQ ID NO: 3106738 - protein, 8 aa, Giardia lamblia
EEENGRLK

SEQ ID NO: 3106739 - protein, 14 aa, Giardia lamblia
EEENSSGKRGQGSP

SEQ ID NO: 3106740 - protein, 14 aa, Giardia lamblia
EEEPAVEANTYEAE

SEQ ID NO: 3106741 - protein, 67 aa, Giardia lamblia
EEEPLDDDNPNEAEEELNEDAPDDENPDLGEEFPDEDQDHDDPNDPMDVPEQEEPVAEEDNDAAIPD

SEQ ID NO: 3106742 - protein, 15 aa, Giardia lamblia
EEEPQGLEDETGHAA

SEQ ID NO: 3106743 - protein, 4 aa, Giardia lamblia
EEEQ

SEQ ID NO: 3106744 - protein, 8 aa, Giardia lamblia
EEEQDKVE

SEQ ID NO: 3106745 - protein, 10 aa, Giardia lamblia
EEEQDRQKEL

SEQ ID NO: 3106746 - protein, 6 aa, Giardia lamblia
EEEQRK

SEQ ID NO: 3106747 - protein, 13 aa, Giardia lamblia
EEERALKQRDGSI

SEQ ID NO: 3106748 - protein, 18 aa, Giardia lamblia
EEERERRDNYAPKKSEFD

SEQ ID NO: 3106749 - protein, 9 aa, Giardia lamblia
EEERQLSNK

SEQ ID NO: 3106750 - protein, 14 aa, Giardia lamblia
EEERRELKEVDKRS

SEQ ID NO: 3106751 - protein, 10 aa, Giardia lamblia
EEERRTASLQ

SEQ ID NO: 3106752 - protein, 4 aa, Giardia lamblia
EEES

SEQ ID NO: 3106753 - protein, 14 aa, Giardia lamblia
EEESESDHRDYRRR

SEQ ID NO: 3106754 - protein, 8 aa, Giardia lamblia
EEESNAFT

SEQ ID NO: 3106755 - protein, 6 aa, Giardia lamblia
EEETLG

SEQ ID NO: 3106756 - protein, 20 aa, Giardia lamblia
EEEWSESEEPVEENSEEREE

SEQ ID NO: 3106757 - protein, 5 aa, Giardia lamblia
EEEYK

SEQ ID NO: 3106758 - protein, 13 aa, Giardia lamblia
EEGADDNDGDTRV

SEQ ID NO: 3106759 - protein, 10 aa, Giardia lamblia
EEGDENSNLS

SEQ ID NO: 3106760 - protein, 13 aa, Giardia lamblia
EEGDLRNEKGETP

SEQ ID NO: 3106761 - protein, 10 aa, Giardia lamblia
EEGGDQNEWG

SEQ ID NO: 3106762 - protein, 14 aa, Giardia lamblia
EEGGIALPDGSTPL

SEQ ID NO: 3106763 - protein, 13 aa, Giardia lamblia
EEGGLQAENGATA

SEQ ID NO: 3106764 - protein, 6 aa, Giardia lamblia
EEGHGD

SEQ ID NO: 3106765 - protein, 14 aa, Giardia lamblia
EEGHPSEKKRADIT

SEQ ID NO: 3106766 - protein, 11 aa, Giardia lamblia
EEGISNSPSKL

SEQ ID NO: 3106767 - protein, 9 aa, Giardia lamblia
EEGLRDSSG

SEQ ID NO: 3106768 - protein, 11 aa, Giardia lamblia
EEGMKDSNDKT

SEQ ID NO: 3106769 - protein, 9 aa, Giardia lamblia
EEGMQRPDG

SEQ ID NO: 3106770 - protein, 5 aa, Giardia lamblia
EEGNE

SEQ ID NO: 3106771 - protein, 6 aa, Giardia lamblia
EEGPEI

SEQ ID NO: 3106772 - protein, 13 aa, Giardia lamblia
EEGPIRKRHGKGR

SEQ ID NO: 3106773 - protein, 11 aa, Giardia lamblia
EEGPKRDLKQR

SEQ ID NO: 3106774 - protein, 4 aa, Giardia lamblia
EEGQ

SEQ ID NO: 3106775 - protein, 15 aa, Giardia lamblia
EEGQAYLTGGPEGYK

SEQ ID NO: 3106776 - protein, 22 aa, Giardia lamblia
EEGQSPDEQLTSGSQQKPGSNK

SEQ ID NO: 3106777 - protein, 8 aa, Giardia lamblia
EEGRRAYK

SEQ ID NO: 3106778 - protein, 8 aa, Giardia lamblia
EEGSESTW

SEQ ID NO: 3106779 - protein, 9 aa, Giardia lamblia
EEGVSTKSD

SEQ ID NO: 3106780 - protein, 6 aa, Giardia lamblia
EEGYDN

SEQ ID NO: 3106781 - protein, 6 aa, Giardia lamblia
EEHDPS

SEQ ID NO: 3106782 - protein, 5 aa, Giardia lamblia
EEHDT

SEQ ID NO: 3106783 - protein, 15 aa, Giardia lamblia
EEHKEKVKSSQKEYI

SEQ ID NO: 3106784 - protein, 6 aa, Giardia lamblia
EEHNHA

SEQ ID NO: 3106785 - protein, 6 aa, Giardia lamblia
EEHNPN

SEQ ID NO: 3106786 - protein, 15 aa, Giardia lamblia
EEHQRNNPESDNGPL

SEQ ID NO: 3106787 - protein, 4 aa, Giardia lamblia
EEHR

SEQ ID NO: 3106788 - protein, 17 aa, Giardia lamblia
EEHRRQTGRSHRENPQL

SEQ ID NO: 3106789 - protein, 7 aa, Giardia lamblia
EEHSEGI

SEQ ID NO: 3106790 - protein, 21 aa, Giardia lamblia
EEHSSQAVSQPLDNDAGERDA

SEQ ID NO: 3106791 - protein, 6 aa, Giardia lamblia
EEHSTE

SEQ ID NO: 3106792 - protein, 15 aa, Giardia lamblia
EEHTESDEAMNEQSK

SEQ ID NO: 3106793 - protein, 8 aa, Giardia lamblia
EEHTNKSL

SEQ ID NO: 3106794 - protein, 27 aa, Giardia lamblia
EEIDAENVRRSRVRSKKRNETSDTTSQ

SEQ ID NO: 3106795 - protein, 8 aa, Giardia lamblia
EEINKKAE

SEQ ID NO: 3106796 - protein, 5 aa, Giardia lamblia
EEIPE

SEQ ID NO: 3106797 - protein, 10 aa, Giardia lamblia
EEIPSDKDIE

SEQ ID NO: 3106798 - protein, 4 aa, Giardia lamblia
EEKA

SEQ ID NO: 3106799 - protein, 10 aa, Giardia lamblia
EEKDDATEAA

SEQ ID NO: 3106800 - protein, 8 aa, Giardia lamblia
EEKDQEIS

SEQ ID NO: 3106801 - protein, 13 aa, Giardia lamblia
EEKEEKKHRRRKV

SEQ ID NO: 3106802 - protein, 6 aa, Giardia lamblia
EEKEEL

SEQ ID NO: 3106803 - protein, 5 aa, Giardia lamblia
EEKEL

SEQ ID NO: 3106804 - protein, 7 aa, Giardia lamblia
EEKERDG

SEQ ID NO: 3106805 - protein, 11 aa, Giardia lamblia
EEKGLSAADTL

SEQ ID NO: 3106806 - protein, 9 aa, Giardia lamblia
EEKIRGSQD

SEQ ID NO: 3106807 - protein, 4 aa, Giardia lamblia
EEKK

SEQ ID NO: 3106808 - protein, 7 aa, Giardia lamblia
EEKKRSR

SEQ ID NO: 3106809 - protein, 10 aa, Giardia lamblia
EEKNRSNAKA

SEQ ID NO: 3106810 - protein, 8 aa, Giardia lamblia
EEKPDTEL

SEQ ID NO: 3106811 - protein, 8 aa, Giardia lamblia
EEKPSENQ

SEQ ID NO: 3106812 - protein, 13 aa, Giardia lamblia
EEKPYTVPRPHPV

SEQ ID NO: 3106813 - protein, 9 aa, Giardia lamblia
EEKQASLQL

SEQ ID NO: 3106814 - protein, 36 aa, Giardia lamblia
EEKQEEESTESEEEYDEDGNKIEGKKKKKLNPNDPL

SEQ ID NO: 3106815 - protein, 17 aa, Giardia lamblia
EEKQNTSTVTTIPPSQI

SEQ ID NO: 3106816 - protein, 13 aa, Giardia lamblia
EEKRAEAKRMATE

SEQ ID NO: 3106817 - protein, 10 aa, Giardia lamblia
EEKRRSDAAE

SEQ ID NO: 3106818 - protein, 7 aa, Giardia lamblia
EEKRTAL

SEQ ID NO: 3106819 - protein, 4 aa, Giardia lamblia
EEKS

SEQ ID NO: 3106820 - protein, 9 aa, Giardia lamblia
EEKSGLYTA

SEQ ID NO: 3106821 - protein, 49 aa, Giardia lamblia
EEKSSSHKREHRKEHKKDDKKEHRKDDKKDDKKEDKRSRSKDRKEVRDA

SEQ ID NO: 3106822 - protein, 9 aa, Giardia lamblia
EEKTEAQVQ

SEQ ID NO: 3106823 - protein, 6 aa, Giardia lamblia
EEKTHA

SEQ ID NO: 3106824 - protein, 10 aa, Giardia lamblia
EEKTHPVADE

SEQ ID NO: 3106825 - protein, 17 aa, Giardia lamblia
EEKTIESASSNPDLSSI

SEQ ID NO: 3106826 - protein, 8 aa, Giardia lamblia
EEKTSTDL

SEQ ID NO: 3106827 - protein, 4 aa, Giardia lamblia
EEKV

SEQ ID NO: 3106828 - protein, 4 aa, Giardia lamblia
EELA

SEQ ID NO: 3106829 - protein, 6 aa, Giardia lamblia
EELAAT

SEQ ID NO: 3106830 - protein, 11 aa, Giardia lamblia
EELAQEKRQEF

SEQ ID NO: 3106831 - protein, 10 aa, Giardia lamblia
EELAQRETRM

SEQ ID NO: 3106832 - protein, 7 aa, Giardia lamblia
EELATGS

SEQ ID NO: 3106833 - protein, 11 aa, Giardia lamblia
EELDDRENTIT

SEQ ID NO: 3106834 - protein, 5 aa, Giardia lamblia
EELEE

SEQ ID NO: 3106835 - protein, 10 aa, Giardia lamblia
EELESENERL

SEQ ID NO: 3106836 - protein, 6 aa, Giardia lamblia
EELGDR

SEQ ID NO: 3106837 - protein, 8 aa, Giardia lamblia
EELGDSKR

SEQ ID NO: 3106838 - protein, 13 aa, Giardia lamblia
EELGKYSELSRPK

SEQ ID NO: 3106839 - protein, 8 aa, Giardia lamblia
EELGRENA

SEQ ID NO: 3106840 - protein, 8 aa, Giardia lamblia
EELKGDAE

SEQ ID NO: 3106841 - protein, 5 aa, Giardia lamblia
EELNN

SEQ ID NO: 3106842 - protein, 4 aa, Giardia lamblia
EELQ

SEQ ID NO: 3106843 - protein, 8 aa, Giardia lamblia
EELQQTAG

SEQ ID NO: 3106844 - protein, 8 aa, Giardia lamblia
EELQSREQ

SEQ ID NO: 3106845 - protein, 11 aa, Giardia lamblia
EELRDKKREVA

SEQ ID NO: 3106846 - protein, 7 aa, Giardia lamblia
EELRKQR

SEQ ID NO: 3106847 - protein, 13 aa, Giardia lamblia
EELRSTEHARALS

SEQ ID NO: 3106848 - protein, 6 aa, Giardia lamblia
EELSGS

SEQ ID NO: 3106849 - protein, 5 aa, Giardia lamblia
EELSP

SEQ ID NO: 3106850 - protein, 10 aa, Giardia lamblia
EELSSSEEDS

SEQ ID NO: 3106851 - protein, 6 aa, Giardia lamblia
EELTGA

SEQ ID NO: 3106852 - protein, 6 aa, Giardia lamblia
EELTGQ

SEQ ID NO: 3106853 - protein, 10 aa, Giardia lamblia
EELTNPNSKL

SEQ ID NO: 3106854 - protein, 4 aa, Giardia lamblia
EEMK

SEQ ID NO: 3106855 - protein, 11 aa, Giardia lamblia
EEMKNSAALQE

SEQ ID NO: 3106856 - protein, 4 aa, Giardia lamblia
EEMN

SEQ ID NO: 3106857 - protein, 5 aa, Giardia lamblia
EEMQE

SEQ ID NO: 3106858 - protein, 4 aa, Giardia lamblia
EEMR

SEQ ID NO: 3106859 - protein, 5 aa, Giardia lamblia
EEMRN

SEQ ID NO: 3106860 - protein, 4 aa, Giardia lamblia
EENA

SEQ ID NO: 3106861 - protein, 9 aa, Giardia lamblia
EENAQLRTK

SEQ ID NO: 3106862 - protein, 5 aa, Giardia lamblia
EENAR

SEQ ID NO: 3106863 - protein, 8 aa, Giardia lamblia
EENASLSD

SEQ ID NO: 3106864 - protein, 12 aa, Giardia lamblia
EENDEARGEQPL

SEQ ID NO: 3106865 - protein, 16 aa, Giardia lamblia
EENEDSSNNQANSSEY

SEQ ID NO: 3106866 - protein, 13 aa, Giardia lamblia
EENENARTEADAE

SEQ ID NO: 3106867 - protein, 9 aa, Giardia lamblia
EENERTKYT

SEQ ID NO: 3106868 - protein, 6 aa, Giardia lamblia
EENGKL

SEQ ID NO: 3106869 - protein, 12 aa, Giardia lamblia
EENGLQDKNGWT

SEQ ID NO: 3106870 - protein, 8 aa, Giardia lamblia
EENGNLRK

SEQ ID NO: 3106871 - protein, 5 aa, Giardia lamblia
EENKA

SEQ ID NO: 3106872 - protein, 6 aa, Giardia lamblia
EENKKI

SEQ ID NO: 3106873 - protein, 7 aa, Giardia lamblia
EENKNKV

SEQ ID NO: 3106874 - protein, 6 aa, Giardia lamblia
EENKPI

SEQ ID NO: 3106875 - protein, 7 aa, Giardia lamblia
EENMQRH

SEQ ID NO: 3106876 - protein, 4 aa, Giardia lamblia
EENP

SEQ ID NO: 3106877 - protein, 21 aa, Giardia lamblia
EENPSATSNLSSQGKTPATAT

SEQ ID NO: 3106878 - protein, 10 aa, Giardia lamblia
EENPSSEFER

SEQ ID NO: 3106879 - protein, 5 aa, Giardia lamblia
EENQA

SEQ ID NO: 3106880 - protein, 8 aa, Giardia lamblia
EENQERER

SEQ ID NO: 3106881 - protein, 6 aa, Giardia lamblia
EENQRL

SEQ ID NO: 3106882 - protein, 10 aa, Giardia lamblia
EENRRMSASN

SEQ ID NO: 3106883 - protein, 4 aa, Giardia lamblia
EENS

SEQ ID NO: 3106884 - protein, 6 aa, Giardia lamblia
EENSKY

SEQ ID NO: 3106885 - protein, 12 aa, Giardia lamblia
EENTPVPGYGSP

SEQ ID NO: 3106886 - protein, 6 aa, Giardia lamblia
EENVQD

SEQ ID NO: 3106887 - protein, 9 aa, Giardia lamblia
EENYGEALG

SEQ ID NO: 3106888 - protein, 10 aa, Giardia lamblia
EEPAPEPKDL

SEQ ID NO: 3106889 - protein, 9 aa, Giardia lamblia
EEPDASTDC

SEQ ID NO: 3106890 - protein, 5 aa, Giardia lamblia
EEPDL

SEQ ID NO: 3106891 - protein, 8 aa, Giardia lamblia
EEPDQRIS

SEQ ID NO: 3106892 - protein, 7 aa, Giardia lamblia
EEPEDSD

SEQ ID NO: 3106893 - protein, 6 aa, Giardia lamblia
EEPEIK

SEQ ID NO: 3106894 - protein, 8 aa, Giardia lamblia
EEPEPEET

SEQ ID NO: 3106895 - protein, 4 aa, Giardia lamblia
EEPG

SEQ ID NO: 3106896 - protein, 15 aa, Giardia lamblia
EEPGPPPSNVAPGQC

SEQ ID NO: 3106897 - protein, 14 aa, Giardia lamblia
EEPGPQSPATPFTQ

SEQ ID NO: 3106898 - protein, 4 aa, Giardia lamblia
EEPP

SEQ ID NO: 3106899 - protein, 7 aa, Giardia lamblia
EEPPATA

SEQ ID NO: 3106900 - protein, 13 aa, Giardia lamblia
EEPPPELRNASSE

SEQ ID NO: 3106901 - protein, 7 aa, Giardia lamblia
EEPQCSQ

SEQ ID NO: 3106902 - protein, 4 aa, Giardia lamblia
EEPR

SEQ ID NO: 3106903 - protein, 10 aa, Giardia lamblia
EEPREGQPLT

SEQ ID NO: 3106904 - protein, 22 aa, Giardia lamblia
EEPRESKQTQTSGRNLANDQNM

SEQ ID NO: 3106905 - protein, 5 aa, Giardia lamblia
EEPSN

SEQ ID NO: 3106906 - protein, 7 aa, Giardia lamblia
EEPSQLD

SEQ ID NO: 3106907 - protein, 4 aa, Giardia lamblia
EEPT

SEQ ID NO: 3106908 - protein, 5 aa, Giardia lamblia
EEPTS

SEQ ID NO: 3106909 - protein, 12 aa, Giardia lamblia
EEPVTTRESSLP

SEQ ID NO: 3106910 - protein, 5 aa, Giardia lamblia
EEPYT

SEQ ID NO: 3106911 - protein, 10 aa, Giardia lamblia
EEQETKSCEQ

SEQ ID NO: 3106912 - protein, 6 aa, Giardia lamblia
EEQGPV

SEQ ID NO: 3106913 - protein, 9 aa, Giardia lamblia
EEQGSAGSC

SEQ ID NO: 3106914 - protein, 5 aa, Giardia lamblia
EEQID

SEQ ID NO: 3106915 - protein, 4 aa, Giardia lamblia
EEQL

SEQ ID NO: 3106916 - protein, 6 aa, Giardia lamblia
EEQLND

SEQ ID NO: 3106917 - protein, 10 aa, Giardia lamblia
EEQMPTPSIK

SEQ ID NO: 3106918 - protein, 16 aa, Giardia lamblia
EEQNRESTTMQSPTFG

SEQ ID NO: 3106919 - protein, 10 aa, Giardia lamblia
EEQPDGQYNG

SEQ ID NO: 3106920 - protein, 14 aa, Giardia lamblia
EEQPNMKRESYRVS

SEQ ID NO: 3106921 - protein, 9 aa, Giardia lamblia
EEQQEHAKK

SEQ ID NO: 3106922 - protein, 7 aa, Giardia lamblia
EEQQKEC

SEQ ID NO: 3106923 - protein, 20 aa, Giardia lamblia
EEQQNKASAKAQEKKEQSFA

SEQ ID NO: 3106924 - protein, 6 aa, Giardia lamblia
EEQQSK

SEQ ID NO: 3106925 - protein, 4 aa, Giardia lamblia
EEQR

SEQ ID NO: 3106926 - protein, 6 aa, Giardia lamblia
EEQRDG

SEQ ID NO: 3106927 - protein, 10 aa, Giardia lamblia
EEQRRHQQEV

SEQ ID NO: 3106928 - protein, 8 aa, Giardia lamblia
EEQSPKQH

SEQ ID NO: 3106929 - protein, 8 aa, Giardia lamblia
EEQSPLPK

SEQ ID NO: 3106930 - protein, 5 aa, Giardia lamblia
EEQTL

SEQ ID NO: 3106931 - protein, 5 aa, Giardia lamblia
EEQTN

SEQ ID NO: 3106932 - protein, 4 aa, Giardia lamblia
EEQV

SEQ ID NO: 3106933 - protein, 13 aa, Giardia lamblia
EEQYNRERSSIDK

SEQ ID NO: 3106934 - protein, 15 aa, Giardia lamblia
EERAKRAEDRYNESI

SEQ ID NO: 3106935 - protein, 6 aa, Giardia lamblia
EERATK

SEQ ID NO: 3106936 - protein, 12 aa, Giardia lamblia
EERCGAAEDSPL

SEQ ID NO: 3106937 - protein, 9 aa, Giardia lamblia
EERDEKSQL

SEQ ID NO: 3106938 - protein, 9 aa, Giardia lamblia
EERDKKYKL

SEQ ID NO: 3106939 - protein, 10 aa, Giardia lamblia
EERDKPSTVW

SEQ ID NO: 3106940 - protein, 8 aa, Giardia lamblia
EERDKYAA

SEQ ID NO: 3106941 - protein, 10 aa, Giardia lamblia
EERDNPSLRG

SEQ ID NO: 3106942 - protein, 8 aa, Giardia lamblia
EERDVNGR

SEQ ID NO: 3106943 - protein, 18 aa, Giardia lamblia
EEREEGDGEEDLNEDGTV

SEQ ID NO: 3106944 - protein, 5 aa, Giardia lamblia
EEREI

SEQ ID NO: 3106945 - protein, 5 aa, Giardia lamblia
EEREN

SEQ ID NO: 3106946 - protein, 47 aa, Giardia lamblia
EERIKDKEEAERQRQKNREKKEKEKEKRPGQQSAKVAQKRSKAADAD

SEQ ID NO: 3106947 - protein, 9 aa, Giardia lamblia
EERKAAGPE

SEQ ID NO: 3106948 - protein, 8 aa, Giardia lamblia
EERKGDDA

SEQ ID NO: 3106949 - protein, 14 aa, Giardia lamblia
EERLDPPGRKRSIQ

SEQ ID NO: 3106950 - protein, 9 aa, Giardia lamblia
EERNCKPEV

SEQ ID NO: 3106951 - protein, 17 aa, Giardia lamblia
EERPPSEQAALQPQKSR

SEQ ID NO: 3106952 - protein, 8 aa, Giardia lamblia
EERRDGTS

SEQ ID NO: 3106953 - protein, 10 aa, Giardia lamblia
EERRRKAESR

SEQ ID NO: 3106954 - protein, 8 aa, Giardia lamblia
EERSEPSL

SEQ ID NO: 3106955 - protein, 5 aa, Giardia lamblia
EERSN

SEQ ID NO: 3106956 - protein, 9 aa, Giardia lamblia
EERTAQDSF

SEQ ID NO: 3106957 - protein, 6 aa, Giardia lamblia
EERTPK

SEQ ID NO: 3106958 - protein, 5 aa, Giardia lamblia
EERVS

SEQ ID NO: 3106959 - protein, 4 aa, Giardia lamblia
EERW

SEQ ID NO: 3106960 - protein, 7 aa, Giardia lamblia
EERWTQP

SEQ ID NO: 3106961 - protein, 14 aa, Giardia lamblia
EESAASSSTYTTEI

SEQ ID NO: 3106962 - protein, 5 aa, Giardia lamblia
EESCD

SEQ ID NO: 3106963 - protein, 6 aa, Giardia lamblia
EESDDI

SEQ ID NO: 3106964 - protein, 7 aa, Giardia lamblia
EESENKR

SEQ ID NO: 3106965 - protein, 35 aa, Giardia lamblia
EESESQPPSMQPEEPAAPAAPIQEQPEEQPQRDPM

SEQ ID NO: 3106966 - protein, 5 aa, Giardia lamblia
EESFK

SEQ ID NO: 3106967 - protein, 4 aa, Giardia lamblia
EESG

SEQ ID NO: 3106968 - protein, 7 aa, Giardia lamblia
EESGNYI

SEQ ID NO: 3106969 - protein, 12 aa, Giardia lamblia
EESGVTNRDNKT

SEQ ID NO: 3106970 - protein, 8 aa, Giardia lamblia
EESHGNQI

SEQ ID NO: 3106971 - protein, 7 aa, Giardia lamblia
EESHNSD

SEQ ID NO: 3106972 - protein, 6 aa, Giardia lamblia
EESIPA

SEQ ID NO: 3106973 - protein, 7 aa, Giardia lamblia
EESIRDE

SEQ ID NO: 3106974 - protein, 10 aa, Giardia lamblia
EESIRTQQAI

SEQ ID NO: 3106975 - protein, 5 aa, Giardia lamblia
EESKN

SEQ ID NO: 3106976 - protein, 6 aa, Giardia lamblia
EESKQQ

SEQ ID NO: 3106977 - protein, 10 aa, Giardia lamblia
EESNSSKEQL

SEQ ID NO: 3106978 - protein, 7 aa, Giardia lamblia
EESPEDR

SEQ ID NO: 3106979 - protein, 11 aa, Giardia lamblia
EESQELNEAAS

SEQ ID NO: 3106980 - protein, 13 aa, Giardia lamblia
EESQPHTLSPRNE

SEQ ID NO: 3106981 - protein, 9 aa, Giardia lamblia
EESQVCPPR

SEQ ID NO: 3106982 - protein, 21 aa, Giardia lamblia
EESSDESNQDLNQNAGQDGGF

SEQ ID NO: 3106983 - protein, 8 aa, Giardia lamblia
EESSDNIA

SEQ ID NO: 3106984 - protein, 5 aa, Giardia lamblia
EESSF

SEQ ID NO: 3106985 - protein, 10 aa, Giardia lamblia
EESSGSTPYL

SEQ ID NO: 3106986 - protein, 8 aa, Giardia lamblia
EESSHPYH

SEQ ID NO: 3106987 - protein, 13 aa, Giardia lamblia
EESTATGKQCKSD

SEQ ID NO: 3106988 - protein, 13 aa, Giardia lamblia
EESTEREAFYASQ

SEQ ID NO: 3106989 - protein, 10 aa, Giardia lamblia
EESTRGPSAL

SEQ ID NO: 3106990 - protein, 8 aa, Giardia lamblia
EESVPPDN

SEQ ID NO: 3106991 - protein, 12 aa, Giardia lamblia
EESVRGASAETE

SEQ ID NO: 3106992 - protein, 11 aa, Giardia lamblia
EESYSKQKHPV

SEQ ID NO: 3106993 - protein, 11 aa, Giardia lamblia
EETAKTLESEV

SEQ ID NO: 3106994 - protein, 9 aa, Giardia lamblia
EETASNATV

SEQ ID NO: 3106995 - protein, 9 aa, Giardia lamblia
EETEEKVNQ

SEQ ID NO: 3106996 - protein, 7 aa, Giardia lamblia
EETEGVT

SEQ ID NO: 3106997 - protein, 5 aa, Giardia lamblia
EETEQ

SEQ ID NO: 3106998 - protein, 6 aa, Giardia lamblia
EETGHS

SEQ ID NO: 3106999 - protein, 12 aa, Giardia lamblia
EETGPNPQQKGK

SEQ ID NO: 3107000 - protein, 6 aa, Giardia lamblia
EETGRV

SEQ ID NO: 3107001 - protein, 9 aa, Giardia lamblia
EETIKEKSV

SEQ ID NO: 3107002 - protein, 14 aa, Giardia lamblia
EETKAEVLHNKGKF

SEQ ID NO: 3107003 - protein, 7 aa, Giardia lamblia
EETKEEL

SEQ ID NO: 3107004 - protein, 9 aa, Giardia lamblia
EETKKPADL

SEQ ID NO: 3107005 - protein, 7 aa, Giardia lamblia
EETKRQL

SEQ ID NO: 3107006 - protein, 11 aa, Giardia lamblia
EETKSKATELQ

SEQ ID NO: 3107007 - protein, 6 aa, Giardia lamblia
EETNNR

SEQ ID NO: 3107008 - protein, 6 aa, Giardia lamblia
EETPAD

SEQ ID NO: 3107009 - protein, 5 aa, Giardia lamblia
EETPD

SEQ ID NO: 3107010 - protein, 9 aa, Giardia lamblia
EETPNRRDN

SEQ ID NO: 3107011 - protein, 4 aa, Giardia lamblia
EETR

SEQ ID NO: 3107012 - protein, 5 aa, Giardia lamblia
EETRR

SEQ ID NO: 3107013 - protein, 6 aa, Giardia lamblia
EETRSP

SEQ ID NO: 3107014 - protein, 15 aa, Giardia lamblia
EETRSSKKGAEYKGD

SEQ ID NO: 3107015 - protein, 6 aa, Giardia lamblia
EETSHD

SEQ ID NO: 3107016 - protein, 7 aa, Giardia lamblia
EETSKAV

SEQ ID NO: 3107017 - protein, 7 aa, Giardia lamblia
EETSKTL

SEQ ID NO: 3107018 - protein, 13 aa, Giardia lamblia
EETSRVPKNSDKY

SEQ ID NO: 3107019 - protein, 13 aa, Giardia lamblia
EETTDKRKATHGT

SEQ ID NO: 3107020 - protein, 6 aa, Giardia lamblia
EETTKK

SEQ ID NO: 3107021 - protein, 11 aa, Giardia lamblia
EETVSPSTGSI

SEQ ID NO: 3107022 - protein, 7 aa, Giardia lamblia
EETYQDD

SEQ ID NO: 3107023 - protein, 4 aa, Giardia lamblia
EEVA

SEQ ID NO: 3107024 - protein, 8 aa, Giardia lamblia
EEVDNDKT

SEQ ID NO: 3107025 - protein, 10 aa, Giardia lamblia
EEVDSAGDIT

SEQ ID NO: 3107026 - protein, 7 aa, Giardia lamblia
EEVEKNT

SEQ ID NO: 3107027 - protein, 10 aa, Giardia lamblia
EEVESGEKCP

SEQ ID NO: 3107028 - protein, 9 aa, Giardia lamblia
EEVETQDRA

SEQ ID NO: 3107029 - protein, 7 aa, Giardia lamblia
EEVGRAK

SEQ ID NO: 3107030 - protein, 6 aa, Giardia lamblia
EEVPDG

SEQ ID NO: 3107031 - protein, 9 aa, Giardia lamblia
EEVPDSQVQ

SEQ ID NO: 3107032 - protein, 9 aa, Giardia lamblia
EEVRASKQI

SEQ ID NO: 3107033 - protein, 11 aa, Giardia lamblia
EEVRSYGDKVT

SEQ ID NO: 3107034 - protein, 8 aa, Giardia lamblia
EEVSPSGA

SEQ ID NO: 3107035 - protein, 26 aa, Giardia lamblia
EEVTTNKREKAKLEEQITQKKQSITH

SEQ ID NO: 3107036 - protein, 5 aa, Giardia lamblia
EEWGE

SEQ ID NO: 3107037 - protein, 4 aa, Giardia lamblia
EEYK

SEQ ID NO: 3107038 - protein, 12 aa, Giardia lamblia
EEYNGASAKFAT

SEQ ID NO: 3107039 - protein, 11 aa, Giardia lamblia
EEYPDKRTDNF

SEQ ID NO: 3107040 - protein, 7 aa, Giardia lamblia
EEYPQSV

SEQ ID NO: 3107041 - protein, 4 aa, Giardia lamblia
EEYQ

SEQ ID NO: 3107042 - protein, 8 aa, Giardia lamblia
EEYQAENK

SEQ ID NO: 3107043 - protein, 6 aa, Giardia lamblia
EEYRIP

SEQ ID NO: 3107044 - protein, 12 aa, Giardia lamblia
EFADSDRATLGL

SEQ ID NO: 3107045 - protein, 13 aa, Giardia lamblia
EFAQTKDKAKSVD

SEQ ID NO: 3107046 - protein, 10 aa, Giardia lamblia
EFDDNAKTKV

SEQ ID NO: 3107047 - protein, 4 aa, Giardia lamblia
EFDE

SEQ ID NO: 3107048 - protein, 18 aa, Giardia lamblia
EFEAAKKEISTTKLKGTS

SEQ ID NO: 3107049 - protein, 32 aa, Giardia lamblia
EFEERNLPSTDGDSDDSSYDWDDKSCTASFLT

SEQ ID NO: 3107050 - protein, 4 aa, Giardia lamblia
EFEG

SEQ ID NO: 3107051 - protein, 4 aa, Giardia lamblia
EFEK

SEQ ID NO: 3107052 - protein, 12 aa, Giardia lamblia
EFERPGDLFLAL

SEQ ID NO: 3107053 - protein, 6 aa, Giardia lamblia
EFGGRD

SEQ ID NO: 3107054 - protein, 11 aa, Giardia lamblia
EFKDDKRHGEG

SEQ ID NO: 3107055 - protein, 14 aa, Giardia lamblia
EFNEGASSSGEPIR

SEQ ID NO: 3107056 - protein, 12 aa, Giardia lamblia
EFNSMGRKTARA

SEQ ID NO: 3107057 - protein, 6 aa, Giardia lamblia
EFPKNA

SEQ ID NO: 3107058 - protein, 10 aa, Giardia lamblia
EFPRGEQAKE

SEQ ID NO: 3107059 - protein, 6 aa, Giardia lamblia
EFPSDG

SEQ ID NO: 3107060 - protein, 5 aa, Giardia lamblia
EFPTR

SEQ ID NO: 3107061 - protein, 11 aa, Giardia lamblia
EFRPEDNKSGA

SEQ ID NO: 3107062 - protein, 5 aa, Giardia lamblia
EFSDS

SEQ ID NO: 3107063 - protein, 5 aa, Giardia lamblia
EFSKD

SEQ ID NO: 3107064 - protein, 7 aa, Giardia lamblia
EFSPEDL

SEQ ID NO: 3107065 - protein, 5 aa, Giardia lamblia
EFTEK

SEQ ID NO: 3107066 - protein, 11 aa, Giardia lamblia
EFTKNTAEYTR

SEQ ID NO: 3107067 - protein, 5 aa, Giardia lamblia
EGAAE

SEQ ID NO: 3107068 - protein, 8 aa, Giardia lamblia
EGAAQSLV

SEQ ID NO: 3107069 - protein, 11 aa, Giardia lamblia
EGADKNPDGLT

SEQ ID NO: 3107070 - protein, 7 aa, Giardia lamblia
EGAGLKP

SEQ ID NO: 3107071 - protein, 11 aa, Giardia lamblia
EGAGRKTGMDV

SEQ ID NO: 3107072 - protein, 9 aa, Giardia lamblia
EGAHRDPDG

SEQ ID NO: 3107073 - protein, 15 aa, Giardia lamblia
EGAPAGFGSSTYSAP

SEQ ID NO: 3107074 - protein, 7 aa, Giardia lamblia
EGAPSQT

SEQ ID NO: 3107075 - protein, 4 aa, Giardia lamblia
EGAQ

SEQ ID NO: 3107076 - protein, 10 aa, Giardia lamblia
EGAQNSEDRT

SEQ ID NO: 3107077 - protein, 8 aa, Giardia lamblia
EGAVQDRS

SEQ ID NO: 3107078 - protein, 11 aa, Giardia lamblia
EGCKGDNQGRT

SEQ ID NO: 3107079 - protein, 9 aa, Giardia lamblia
EGCSPESSS

SEQ ID NO: 3107080 - protein, 5 aa, Giardia lamblia
EGCSQ

SEQ ID NO: 3107081 - protein, 13 aa, Giardia lamblia
EGDAKDKKKDEEG

SEQ ID NO: 3107082 - protein, 7 aa, Giardia lamblia
EGDALTK

SEQ ID NO: 3107083 - protein, 39 aa, Giardia lamblia
EGDASRPHSQRSSPRKPSKKMTSQAPEASSSYSPSPITE

SEQ ID NO: 3107084 - protein, 6 aa, Giardia lamblia
EGDDEH

SEQ ID NO: 3107085 - protein, 7 aa, Giardia lamblia
EGDDPEA

SEQ ID NO: 3107086 - protein, 7 aa, Giardia lamblia
EGDDTAD

SEQ ID NO: 3107087 - protein, 6 aa, Giardia lamblia
EGDESL

SEQ ID NO: 3107088 - protein, 8 aa, Giardia lamblia
EGDHASSL

SEQ ID NO: 3107089 - protein, 4 aa, Giardia lamblia
EGDI

SEQ ID NO: 3107090 - protein, 12 aa, Giardia lamblia
EGDIADNEGHGP

SEQ ID NO: 3107091 - protein, 7 aa, Giardia lamblia
EGDIADS

SEQ ID NO: 3107092 - protein, 5 aa, Giardia lamblia
EGDIK

SEQ ID NO: 3107093 - protein, 7 aa, Giardia lamblia
EGDKSGN

SEQ ID NO: 3107094 - protein, 12 aa, Giardia lamblia
EGDMRDNGKRTA

SEQ ID NO: 3107095 - protein, 6 aa, Giardia lamblia
EGDNTE

SEQ ID NO: 3107096 - protein, 5 aa, Giardia lamblia
EGDPG

SEQ ID NO: 3107097 - protein, 8 aa, Giardia lamblia
EGDPLPQE

SEQ ID NO: 3107098 - protein, 10 aa, Giardia lamblia
EGDPSVPDSP

SEQ ID NO: 3107099 - protein, 8 aa, Giardia lamblia
EGDSAKAL

SEQ ID NO: 3107100 - protein, 6 aa, Giardia lamblia
EGDSIG

SEQ ID NO: 3107101 - protein, 6 aa, Giardia lamblia
EGDTTP

SEQ ID NO: 3107102 - protein, 4 aa, Giardia lamblia
EGDV

SEQ ID NO: 3107103 - protein, 9 aa, Giardia lamblia
EGDVHKPGG

SEQ ID NO: 3107104 - protein, 24 aa, Giardia lamblia
EGDYREGKFSAREQSSLDRSPMDR

SEQ ID NO: 3107105 - protein, 4 aa, Giardia lamblia
EGEA

SEQ ID NO: 3107106 - protein, 16 aa, Giardia lamblia
EGEASSDEIQPDPTEF

SEQ ID NO: 3107107 - protein, 5 aa, Giardia lamblia
EGECQ

SEQ ID NO: 3107108 - protein, 24 aa, Giardia lamblia
EGEDDEQGQEEEEEGELHEFQRSV

SEQ ID NO: 3107109 - protein, 9 aa, Giardia lamblia
EGEEGYEEN

SEQ ID NO: 3107110 - protein, 8 aa, Giardia lamblia
EGEHKQEV

SEQ ID NO: 3107111 - protein, 4 aa, Giardia lamblia
EGEI

SEQ ID NO: 3107112 - protein, 7 aa, Giardia lamblia
EGEIPPT

SEQ ID NO: 3107113 - protein, 5 aa, Giardia lamblia
EGEIQ

SEQ ID NO: 3107114 - protein, 4 aa, Giardia lamblia
EGEK

SEQ ID NO: 3107115 - protein, 7 aa, Giardia lamblia
EGEKFAK

SEQ ID NO: 3107116 - protein, 10 aa, Giardia lamblia
EGEKKTEELR

SEQ ID NO: 3107117 - protein, 6 aa, Giardia lamblia
EGENGV

SEQ ID NO: 3107118 - protein, 5 aa, Giardia lamblia
EGETY

SEQ ID NO: 3107119 - protein, 6 aa, Giardia lamblia
EGFPTD

SEQ ID NO: 3107120 - protein, 4 aa, Giardia lamblia
EGFT

SEQ ID NO: 3107121 - protein, 7 aa, Giardia lamblia
EGFTAGQ

SEQ ID NO: 3107122 - protein, 7 aa, Giardia lamblia
EGGASGW

SEQ ID NO: 3107123 - protein, 10 aa, Giardia lamblia
EGGCSDASRN

SEQ ID NO: 3107124 - protein, 18 aa, Giardia lamblia
EGGEMERCNSSNVVPTIC

SEQ ID NO: 3107125 - protein, 7 aa, Giardia lamblia
EGGEQTG

SEQ ID NO: 3107126 - protein, 7 aa, Giardia lamblia
EGGGKTY

SEQ ID NO: 3107127 - protein, 9 aa, Giardia lamblia
EGGIKDKFG

SEQ ID NO: 3107128 - protein, 10 aa, Giardia lamblia
EGGIKDKNGW

SEQ ID NO: 3107129 - protein, 10 aa, Giardia lamblia
EGGIQDIEGR

SEQ ID NO: 3107130 - protein, 9 aa, Giardia lamblia
EGGIQDNSK

SEQ ID NO: 3107131 - protein, 11 aa, Giardia lamblia
EGGIQDSRGET

SEQ ID NO: 3107132 - protein, 5 aa, Giardia lamblia
EGGIR

SEQ ID NO: 3107133 - protein, 9 aa, Giardia lamblia
EGGIRDNSG

SEQ ID NO: 3107134 - protein, 9 aa, Giardia lamblia
EGGIRRDDG

SEQ ID NO: 3107135 - protein, 7 aa, Giardia lamblia
EGGISRD

SEQ ID NO: 3107136 - protein, 10 aa, Giardia lamblia
EGGKQQSQEH

SEQ ID NO: 3107137 - protein, 11 aa, Giardia lamblia
EGGKQTSEGRS

SEQ ID NO: 3107138 - protein, 11 aa, Giardia lamblia
EGGKRRNNGTT

SEQ ID NO: 3107139 - protein, 13 aa, Giardia lamblia
EGGLATPDGSTAL

SEQ ID NO: 3107140 - protein, 34 aa, Giardia lamblia
EGGLESPRSPENSCPVTTSHPPQVDADKPQIPRE

SEQ ID NO: 3107141 - protein, 5 aa, Giardia lamblia
EGGLQ

SEQ ID NO: 3107142 - protein, 11 aa, Giardia lamblia
EGGLQDTDGNT

SEQ ID NO: 3107143 - protein, 12 aa, Giardia lamblia
EGGLRDEDNQSA

SEQ ID NO: 3107144 - protein, 9 aa, Giardia lamblia
EGGLRDNGG

SEQ ID NO: 3107145 - protein, 9 aa, Giardia lamblia
EGGLRDNNG

SEQ ID NO: 3107146 - protein, 7 aa, Giardia lamblia
EGGLSTN

SEQ ID NO: 3107147 - protein, 9 aa, Giardia lamblia
EGGLTGQNG

SEQ ID NO: 3107148 - protein, 5 aa, Giardia lamblia
EGGMA

SEQ ID NO: 3107149 - protein, 10 aa, Giardia lamblia
EGGMANKSGY

SEQ ID NO: 3107150 - protein, 10 aa, Giardia lamblia
EGGMKDNYDK

SEQ ID NO: 3107151 - protein, 11 aa, Giardia lamblia
EGGMKGSNGGT

SEQ ID NO: 3107152 - protein, 6 aa, Giardia lamblia
EGGMKK

SEQ ID NO: 3107153 - protein, 12 aa, Giardia lamblia
EGGMKRPDGSTA

SEQ ID NO: 3107154 - protein, 12 aa, Giardia lamblia
EGGMKSSDGRTA

SEQ ID NO: 3107155 - protein, 9 aa, Giardia lamblia
EGGMNNGSG

SEQ ID NO: 3107156 - protein, 7 aa, Giardia lamblia
EGGMQDK

SEQ ID NO: 3107157 - protein, 11 aa, Giardia lamblia
EGGMQDNAGRT

SEQ ID NO: 3107158 - protein, 12 aa, Giardia lamblia
EGGMQDNKGTTA

SEQ ID NO: 3107159 - protein, 8 aa, Giardia lamblia
EGGMQDSW

SEQ ID NO: 3107160 - protein, 7 aa, Giardia lamblia
EGGMQEG

SEQ ID NO: 3107161 - protein, 9 aa, Giardia lamblia
EGGMQGSGG

SEQ ID NO: 3107162 - protein, 11 aa, Giardia lamblia
EGGMQNEDGET

SEQ ID NO: 3107163 - protein, 7 aa, Giardia lamblia
EGGMQNN

SEQ ID NO: 3107164 - protein, 11 aa, Giardia lamblia
EGGMQNNGGST

SEQ ID NO: 3107165 - protein, 12 aa, Giardia lamblia
EGGMQNSNGRTA

SEQ ID NO: 3107166 - protein, 6 aa, Giardia lamblia
EGGMQR

SEQ ID NO: 3107167 - protein, 10 aa, Giardia lamblia
EGGMQRHDGK

SEQ ID NO: 3107168 - protein, 12 aa, Giardia lamblia
EGGMQRSDGQTA

SEQ ID NO: 3107169 - protein, 10 aa, Giardia lamblia
EGGMQSPSGA

SEQ ID NO: 3107170 - protein, 11 aa, Giardia lamblia
EGGMQTSGGET

SEQ ID NO: 3107171 - protein, 10 aa, Giardia lamblia
EGGMQTSYGS

SEQ ID NO: 3107172 - protein, 12 aa, Giardia lamblia
EGGMQTSYGSTA

SEQ ID NO: 3107173 - protein, 8 aa, Giardia lamblia
EGGMQTTK

SEQ ID NO: 3107174 - protein, 9 aa, Giardia lamblia
EGGMQTTKG

SEQ ID NO: 3107175 - protein, 16 aa, Giardia lamblia
EGGMQTTKGDRPYECG

SEQ ID NO: 3107176 - protein, 12 aa, Giardia lamblia
EGGMRDNNGGTA

SEQ ID NO: 3107177 - protein, 9 aa, Giardia lamblia
EGGMRDSGG

SEQ ID NO: 3107178 - protein, 9 aa, Giardia lamblia
EGGMRDSNG

SEQ ID NO: 3107179 - protein, 7 aa, Giardia lamblia
EGGMRGS

SEQ ID NO: 3107180 - protein, 9 aa, Giardia lamblia
EGGMRNNKG

SEQ ID NO: 3107181 - protein, 12 aa, Giardia lamblia
EGGMRQKDGTTA

SEQ ID NO: 3107182 - protein, 11 aa, Giardia lamblia
EGGMRQNDNGT

SEQ ID NO: 3107183 - protein, 7 aa, Giardia lamblia
EGGMRSD

SEQ ID NO: 3107184 - protein, 7 aa, Giardia lamblia
EGGMRSG

SEQ ID NO: 3107185 - protein, 11 aa, Giardia lamblia
EGGMTDKDGYS

SEQ ID NO: 3107186 - protein, 7 aa, Giardia lamblia
EGGNFQE

SEQ ID NO: 3107187 - protein, 6 aa, Giardia lamblia
EGGNGA

SEQ ID NO: 3107188 - protein, 8 aa, Giardia lamblia
EGGQGIES

SEQ ID NO: 3107189 - protein, 5 aa, Giardia lamblia
EGGRD

SEQ ID NO: 3107190 - protein, 11 aa, Giardia lamblia
EGGRQTNDGTT

SEQ ID NO: 3107191 - protein, 25 aa, Giardia lamblia
EGGRRSASRRHRKKMSAPSDASRTL

SEQ ID NO: 3107192 - protein, 9 aa, Giardia lamblia
EGGRSTRTD

SEQ ID NO: 3107193 - protein, 6 aa, Giardia lamblia
EGGSAE

SEQ ID NO: 3107194 - protein, 20 aa, Giardia lamblia
EGGSPPEDEDRGRRKHANES

SEQ ID NO: 3107195 - protein, 7 aa, Giardia lamblia
EGGTFSD

SEQ ID NO: 3107196 - protein, 14 aa, Giardia lamblia
EGGTPVRPTNATTL

SEQ ID NO: 3107197 - protein, 8 aa, Giardia lamblia
EGGVQDSY

SEQ ID NO: 3107198 - protein, 7 aa, Giardia lamblia
EGGVQNK

SEQ ID NO: 3107199 - protein, 11 aa, Giardia lamblia
EGGYQTRRGQT

SEQ ID NO: 3107200 - protein, 6 aa, Giardia lamblia
EGHADG

SEQ ID NO: 3107201 - protein, 6 aa, Giardia lamblia
EGHAEA

SEQ ID NO: 3107202 - protein, 5 aa, Giardia lamblia
EGHEG

SEQ ID NO: 3107203 - protein, 13 aa, Giardia lamblia
EGHEVAEGGSVSN

SEQ ID NO: 3107204 - protein, 4 aa, Giardia lamblia
EGHK

SEQ ID NO: 3107205 - protein, 6 aa, Giardia lamblia
EGHKRH

SEQ ID NO: 3107206 - protein, 5 aa, Giardia lamblia
EGHPR

SEQ ID NO: 3107207 - protein, 4 aa, Giardia lamblia
EGHS

SEQ ID NO: 3107208 - protein, 13 aa, Giardia lamblia
EGHTEKYNRDGSG

SEQ ID NO: 3107209 - protein, 5 aa, Giardia lamblia
EGHTG

SEQ ID NO: 3107210 - protein, 7 aa, Giardia lamblia
EGHTKSM

SEQ ID NO: 3107211 - protein, 7 aa, Giardia lamblia
EGHTKSV

SEQ ID NO: 3107212 - protein, 9 aa, Giardia lamblia
EGHTSADYE

SEQ ID NO: 3107213 - protein, 4 aa, Giardia lamblia
EGID

SEQ ID NO: 3107214 - protein, 11 aa, Giardia lamblia
EGIDDNNGCRD

SEQ ID NO: 3107215 - protein, 4 aa, Giardia lamblia
EGIE

SEQ ID NO: 3107216 - protein, 6 aa, Giardia lamblia
EGIPDN

SEQ ID NO: 3107217 - protein, 9 aa, Giardia lamblia
EGIPSLGQT

SEQ ID NO: 3107218 - protein, 8 aa, Giardia lamblia
EGIPYSKD

SEQ ID NO: 3107219 - protein, 21 aa, Giardia lamblia
EGIQKDGGSNAHESSMCSPNK

SEQ ID NO: 3107220 - protein, 8 aa, Giardia lamblia
EGIRSTYQ

SEQ ID NO: 3107221 - protein, 19 aa, Giardia lamblia
EGISPAPTDKTDKTKHNSL

SEQ ID NO: 3107222 - protein, 7 aa, Giardia lamblia
EGITDPD

SEQ ID NO: 3107223 - protein, 7 aa, Giardia lamblia
EGKDPKD

SEQ ID NO: 3107224 - protein, 9 aa, Giardia lamblia
EGKDTGLYG

SEQ ID NO: 3107225 - protein, 10 aa, Giardia lamblia
EGKDTVQQLQ

SEQ ID NO: 3107226 - protein, 9 aa, Giardia lamblia
EGKEKGLSV

SEQ ID NO: 3107227 - protein, 8 aa, Giardia lamblia
EGKHSPRL

SEQ ID NO: 3107228 - protein, 6 aa, Giardia lamblia
EGKHTV

SEQ ID NO: 3107229 - protein, 4 aa, Giardia lamblia
EGKI

SEQ ID NO: 3107230 - protein, 4 aa, Giardia lamblia
EGKK

SEQ ID NO: 3107231 - protein, 13 aa, Giardia lamblia
EGKKLDSPNKTIQ

SEQ ID NO: 3107232 - protein, 6 aa, Giardia lamblia
EGKKPV

SEQ ID NO: 3107233 - protein, 10 aa, Giardia lamblia
EGKLKSQEKY

SEQ ID NO: 3107234 - protein, 9 aa, Giardia lamblia
EGKMKDTEG

SEQ ID NO: 3107235 - protein, 10 aa, Giardia lamblia
EGKMQNVNGS

SEQ ID NO: 3107236 - protein, 10 aa, Giardia lamblia
EGKPAAQQDH

SEQ ID NO: 3107237 - protein, 16 aa, Giardia lamblia
EGKQAEPNALATPYDS

SEQ ID NO: 3107238 - protein, 6 aa, Giardia lamblia
EGKQDV

SEQ ID NO: 3107239 - protein, 9 aa, Giardia lamblia
EGKQSLLST

SEQ ID NO: 3107240 - protein, 6 aa, Giardia lamblia
EGKRGD

SEQ ID NO: 3107241 - protein, 27 aa, Giardia lamblia
EGKSPHGALQPNNEQHYSTRNNPTHTL

SEQ ID NO: 3107242 - protein, 9 aa, Giardia lamblia
EGKTLNANG

SEQ ID NO: 3107243 - protein, 8 aa, Giardia lamblia
EGKVADPV

SEQ ID NO: 3107244 - protein, 9 aa, Giardia lamblia
EGKYQDKAT

SEQ ID NO: 3107245 - protein, 4 aa, Giardia lamblia
EGLE

SEQ ID NO: 3107246 - protein, 25 aa, Giardia lamblia
EGLEQKQESVSTNPETQQNQSHNDT

SEQ ID NO: 3107247 - protein, 8 aa, Giardia lamblia
EGLETGTR

SEQ ID NO: 3107248 - protein, 4 aa, Giardia lamblia
EGLG

SEQ ID NO: 3107249 - protein, 7 aa, Giardia lamblia
EGLGPNG

SEQ ID NO: 3107250 - protein, 30 aa, Giardia lamblia
EGLLTTDNDDLKDLSPEDLNTGGPEPTKPY

SEQ ID NO: 3107251 - protein, 6 aa, Giardia lamblia
EGLNSD

SEQ ID NO: 3107252 - protein, 9 aa, Giardia lamblia
EGLPAGQED

SEQ ID NO: 3107253 - protein, 6 aa, Giardia lamblia
EGLPTG

SEQ ID NO: 3107254 - protein, 6 aa, Giardia lamblia
EGLPTQ

SEQ ID NO: 3107255 - protein, 12 aa, Giardia lamblia
EGLRKQKDEEQK

SEQ ID NO: 3107256 - protein, 5 aa, Giardia lamblia
EGLSL

SEQ ID NO: 3107257 - protein, 6 aa, Giardia lamblia
EGLSSR

SEQ ID NO: 3107258 - protein, 4 aa, Giardia lamblia
EGLT

SEQ ID NO: 3107259 - protein, 7 aa, Giardia lamblia
EGLTEED

SEQ ID NO: 3107260 - protein, 10 aa, Giardia lamblia
EGLTKQKNRY

SEQ ID NO: 3107261 - protein, 7 aa, Giardia lamblia
EGLTTTD

SEQ ID NO: 3107262 - protein, 9 aa, Giardia lamblia
EGMKKKEAA

SEQ ID NO: 3107263 - protein, 9 aa, Giardia lamblia
EGMRDASAR

SEQ ID NO: 3107264 - protein, 4 aa, Giardia lamblia
EGNE

SEQ ID NO: 3107265 - protein, 9 aa, Giardia lamblia
EGNERNPKA

SEQ ID NO: 3107266 - protein, 9 aa, Giardia lamblia
EGNIPPNGL

SEQ ID NO: 3107267 - protein, 9 aa, Giardia lamblia
EGNKDEAFT

SEQ ID NO: 3107268 - protein, 7 aa, Giardia lamblia
EGNKNHA

SEQ ID NO: 3107269 - protein, 7 aa, Giardia lamblia
EGNKSQT

SEQ ID NO: 3107270 - protein, 4 aa, Giardia lamblia
EGNL

SEQ ID NO: 3107271 - protein, 5 aa, Giardia lamblia
EGNLS

SEQ ID NO: 3107272 - protein, 9 aa, Giardia lamblia
EGNNAEEAA

SEQ ID NO: 3107273 - protein, 5 aa, Giardia lamblia
EGNNS

SEQ ID NO: 3107274 - protein, 4 aa, Giardia lamblia
EGNP

SEQ ID NO: 3107275 - protein, 9 aa, Giardia lamblia
EGNQSLEEK

SEQ ID NO: 3107276 - protein, 7 aa, Giardia lamblia
EGNRAKI

SEQ ID NO: 3107277 - protein, 8 aa, Giardia lamblia
EGNRSGPC

SEQ ID NO: 3107278 - protein, 8 aa, Giardia lamblia
EGNSPQTR

SEQ ID NO: 3107279 - protein, 5 aa, Giardia lamblia
EGNTE

SEQ ID NO: 3107280 - protein, 12 aa, Giardia lamblia
EGPAQPGSDPRY

SEQ ID NO: 3107281 - protein, 6 aa, Giardia lamblia
EGPDNP

SEQ ID NO: 3107282 - protein, 4 aa, Giardia lamblia
EGPF

SEQ ID NO: 3107283 - protein, 8 aa, Giardia lamblia
EGPGLAEA

SEQ ID NO: 3107284 - protein, 13 aa, Giardia lamblia
EGPGNIYSSSSYP

SEQ ID NO: 3107285 - protein, 9 aa, Giardia lamblia
EGPHQTAEI

SEQ ID NO: 3107286 - protein, 4 aa, Giardia lamblia
EGPL

SEQ ID NO: 3107287 - protein, 28 aa, Giardia lamblia
EGPLEPKVNDKYTKNERAIAPDGQSVPI

SEQ ID NO: 3107288 - protein, 8 aa, Giardia lamblia
EGPNVADE

SEQ ID NO: 3107289 - protein, 32 aa, Giardia lamblia
EGPPDSSIAGEPMHGGARASSGLHPQRQSQVK

SEQ ID NO: 3107290 - protein, 15 aa, Giardia lamblia
EGPRATNEIDQERRT

SEQ ID NO: 3107291 - protein, 25 aa, Giardia lamblia
EGPTAPSDAVSVSSSSLGNDLGPLE

SEQ ID NO: 3107292 - protein, 7 aa, Giardia lamblia
EGPTKLV

SEQ ID NO: 3107293 - protein, 14 aa, Giardia lamblia
EGPTRSSRINEISS

SEQ ID NO: 3107294 - protein, 20 aa, Giardia lamblia
EGQDAKDIKSIPDSSYEDNE

SEQ ID NO: 3107295 - protein, 5 aa, Giardia lamblia
EGQEE

SEQ ID NO: 3107296 - protein, 14 aa, Giardia lamblia
EGQEVQGRDAPDHL

SEQ ID NO: 3107297 - protein, 20 aa, Giardia lamblia
EGQEVQGRDRRIPPPQSKRR

SEQ ID NO: 3107298 - protein, 28 aa, Giardia lamblia
EGQEVQGRDRRIPPPQVQEAPRGALRGR

SEQ ID NO: 3107299 - protein, 48 aa, Giardia lamblia
EGQEVQGRDRRIPPPQVQGAPRGAPRGPLSGLPSPSPTWLQRRTSTRR

SEQ ID NO: 3107300 - protein, 4 aa, Giardia lamblia
EGQG

SEQ ID NO: 3107301 - protein, 6 aa, Giardia lamblia
EGQGCD

SEQ ID NO: 3107302 - protein, 10 aa, Giardia lamblia
EGQGNSDTKQ

SEQ ID NO: 3107303 - protein, 6 aa, Giardia lamblia
EGQPEK

SEQ ID NO: 3107304 - protein, 18 aa, Giardia lamblia
EGQRKAIEDAKLEKERAR

SEQ ID NO: 3107305 - protein, 6 aa, Giardia lamblia
EGQSLH

SEQ ID NO: 3107306 - protein, 11 aa, Giardia lamblia
EGQTDEEEIGA

SEQ ID NO: 3107307 - protein, 4 aa, Giardia lamblia
EGQY

SEQ ID NO: 3107308 - protein, 12 aa, Giardia lamblia
EGRAAYETGSSA

SEQ ID NO: 3107309 - protein, 4 aa, Giardia lamblia
EGRE

SEQ ID NO: 3107310 - protein, 13 aa, Giardia lamblia
EGRERKASKKQSL

SEQ ID NO: 3107311 - protein, 16 aa, Giardia lamblia
EGRGADRKKEKEFNRE

SEQ ID NO: 3107312 - protein, 6 aa, Giardia lamblia
EGRGEL

SEQ ID NO: 3107313 - protein, 24 aa, Giardia lamblia
EGRKDSSEPLPETVDEKDNGNERL

SEQ ID NO: 3107314 - protein, 5 aa, Giardia lamblia
EGRKE

SEQ ID NO: 3107315 - protein, 11 aa, Giardia lamblia
EGRMKDSNDKT

SEQ ID NO: 3107316 - protein, 11 aa, Giardia lamblia
EGRMKRTDGTT

SEQ ID NO: 3107317 - protein, 9 aa, Giardia lamblia
EGRMQDKDG

SEQ ID NO: 3107318 - protein, 14 aa, Giardia lamblia
EGRMQDSYGQTALM

SEQ ID NO: 3107319 - protein, 9 aa, Giardia lamblia
EGRMQGSGG

SEQ ID NO: 3107320 - protein, 11 aa, Giardia lamblia
EGRMQTNSGET

SEQ ID NO: 3107321 - protein, 5 aa, Giardia lamblia
EGRNS

SEQ ID NO: 3107322 - protein, 10 aa, Giardia lamblia
EGRPQPETEA

SEQ ID NO: 3107323 - protein, 7 aa, Giardia lamblia
EGRPSDA

SEQ ID NO: 3107324 - protein, 17 aa, Giardia lamblia
EGRPSEERAGHGRTTID

SEQ ID NO: 3107325 - protein, 17 aa, Giardia lamblia
EGRQEAKRLRFTLQYVE

SEQ ID NO: 3107326 - protein, 12 aa, Giardia lamblia
EGRQGGSQGAAM

SEQ ID NO: 3107327 - protein, 13 aa, Giardia lamblia
EGRRHPLSESAEA

SEQ ID NO: 3107328 - protein, 8 aa, Giardia lamblia
EGRSGSYF

SEQ ID NO: 3107329 - protein, 5 aa, Giardia lamblia
EGRSI

SEQ ID NO: 3107330 - protein, 9 aa, Giardia lamblia
EGRSSQVDQ

SEQ ID NO: 3107331 - protein, 12 aa, Giardia lamblia
EGRSTLRTGETG

SEQ ID NO: 3107332 - protein, 4 aa, Giardia lamblia
EGRT

SEQ ID NO: 3107333 - protein, 4 aa, Giardia lamblia
EGRV

SEQ ID NO: 3107334 - protein, 31 aa, Giardia lamblia
EGSCEKPDNKSKEEVETPAPSAVKRGPSKKK

SEQ ID NO: 3107335 - protein, 7 aa, Giardia lamblia
EGSDAES

SEQ ID NO: 3107336 - protein, 15 aa, Giardia lamblia
EGSDAIPGSTEAKSL

SEQ ID NO: 3107337 - protein, 8 aa, Giardia lamblia
EGSDPAAY

SEQ ID NO: 3107338 - protein, 4 aa, Giardia lamblia
EGSF

SEQ ID NO: 3107339 - protein, 7 aa, Giardia lamblia
EGSFTDQ

SEQ ID NO: 3107340 - protein, 11 aa, Giardia lamblia
EGSGRLPPAQS

SEQ ID NO: 3107341 - protein, 8 aa, Giardia lamblia
EGSGRPEK

SEQ ID NO: 3107342 - protein, 7 aa, Giardia lamblia
EGSGYRN

SEQ ID NO: 3107343 - protein, 4 aa, Giardia lamblia
EGSK

SEQ ID NO: 3107344 - protein, 7 aa, Giardia lamblia
EGSKNHA

SEQ ID NO: 3107345 - protein, 4 aa, Giardia lamblia
EGSL

SEQ ID NO: 3107346 - protein, 30 aa, Giardia lamblia
EGSLSDSQLRSTKAQPAAEQDTKVNEEPYE

SEQ ID NO: 3107347 - protein, 12 aa, Giardia lamblia
EGSMRDNNGQTA

SEQ ID NO: 3107348 - protein, 10 aa, Giardia lamblia
EGSQLDGNGQ

SEQ ID NO: 3107349 - protein, 4 aa, Giardia lamblia
EGSR

SEQ ID NO: 3107350 - protein, 24 aa, Giardia lamblia
EGSRGTTDSRPYSRNQRSDSRVSR

SEQ ID NO: 3107351 - protein, 13 aa, Giardia lamblia
EGSRVKRNAASDL

SEQ ID NO: 3107352 - protein, 10 aa, Giardia lamblia
EGSSGPKARM

SEQ ID NO: 3107353 - protein, 21 aa, Giardia lamblia
EGSTASESRINSNEDKDRDEL

SEQ ID NO: 3107354 - protein, 7 aa, Giardia lamblia
EGSTTQS

SEQ ID NO: 3107355 - protein, 8 aa, Giardia lamblia
EGSVDKQS

SEQ ID NO: 3107356 - protein, 6 aa, Giardia lamblia
EGTASS

SEQ ID NO: 3107357 - protein, 6 aa, Giardia lamblia
EGTEKT

SEQ ID NO: 3107358 - protein, 29 aa, Giardia lamblia
EGTEPSAFKAYSQSTTAMEPSAPRQANPF

SEQ ID NO: 3107359 - protein, 8 aa, Giardia lamblia
EGTFRPEK

SEQ ID NO: 3107360 - protein, 8 aa, Giardia lamblia
EGTGCGTS

SEQ ID NO: 3107361 - protein, 13 aa, Giardia lamblia
EGTGLMNCNVHLE

SEQ ID NO: 3107362 - protein, 14 aa, Giardia lamblia
EGTIKDASGKTALD

SEQ ID NO: 3107363 - protein, 9 aa, Giardia lamblia
EGTITRPTG

SEQ ID NO: 3107364 - protein, 11 aa, Giardia lamblia
EGTLRDKSGAT

SEQ ID NO: 3107365 - protein, 9 aa, Giardia lamblia
EGTMTDNNG

SEQ ID NO: 3107366 - protein, 7 aa, Giardia lamblia
EGTNSSL

SEQ ID NO: 3107367 - protein, 6 aa, Giardia lamblia
EGTQAQ

SEQ ID NO: 3107368 - protein, 5 aa, Giardia lamblia
EGTRI

SEQ ID NO: 3107369 - protein, 7 aa, Giardia lamblia
EGTSERR

SEQ ID NO: 3107370 - protein, 18 aa, Giardia lamblia
EGTTSPPVDNAGATQKTS

SEQ ID NO: 3107371 - protein, 10 aa, Giardia lamblia
EGTTYSSANS

SEQ ID NO: 3107372 - protein, 7 aa, Giardia lamblia
EGTVPTF

SEQ ID NO: 3107373 - protein, 6 aa, Giardia lamblia
EGTYGT

SEQ ID NO: 3107374 - protein, 15 aa, Giardia lamblia
EGVGPTPAKADETEI

SEQ ID NO: 3107375 - protein, 9 aa, Giardia lamblia
EGVHDGTEH

SEQ ID NO: 3107376 - protein, 6 aa, Giardia lamblia
EGVHPE

SEQ ID NO: 3107377 - protein, 10 aa, Giardia lamblia
EGVPEGSLAP

SEQ ID NO: 3107378 - protein, 54 aa, Giardia lamblia
EGVQESPALSAPASVKSKASKSEHGKKDRKKGTESSDTSIAETPAEEQKPVPAV

SEQ ID NO: 3107379 - protein, 12 aa, Giardia lamblia
EGVSAEASSLAG

SEQ ID NO: 3107380 - protein, 10 aa, Giardia lamblia
EGVSSGPQSI

SEQ ID NO: 3107381 - protein, 4 aa, Giardia lamblia
EGVT

SEQ ID NO: 3107382 - protein, 9 aa, Giardia lamblia
EGVVPKGSS

SEQ ID NO: 3107383 - protein, 6 aa, Giardia lamblia
EGWRAR

SEQ ID NO: 3107384 - protein, 5 aa, Giardia lamblia
EGYAK

SEQ ID NO: 3107385 - protein, 5 aa, Giardia lamblia
EGYET

SEQ ID NO: 3107386 - protein, 8 aa, Giardia lamblia
EGYGGHST

SEQ ID NO: 3107387 - protein, 31 aa, Giardia lamblia
EGYKGPSVREQPSCTKTRSQLRSSSTGQSSQ

SEQ ID NO: 3107388 - protein, 6 aa, Giardia lamblia
EGYNDL

SEQ ID NO: 3107389 - protein, 6 aa, Giardia lamblia
EGYRPT

SEQ ID NO: 3107390 - protein, 12 aa, Giardia lamblia
EGYTSVSPTCAP

SEQ ID NO: 3107391 - protein, 9 aa, Giardia lamblia
EHAEARNET

SEQ ID NO: 3107392 - protein, 11 aa, Giardia lamblia
EHAEKTQAQED

SEQ ID NO: 3107393 - protein, 8 aa, Giardia lamblia
EHAEPGLK

SEQ ID NO: 3107394 - protein, 10 aa, Giardia lamblia
EHASRQTPHL

SEQ ID NO: 3107395 - protein, 18 aa, Giardia lamblia
EHDEQLAKEQEKIKKLSD

SEQ ID NO: 3107396 - protein, 6 aa, Giardia lamblia
EHDGGP

SEQ ID NO: 3107397 - protein, 5 aa, Giardia lamblia
EHDNK

SEQ ID NO: 3107398 - protein, 4 aa, Giardia lamblia
EHDS

SEQ ID NO: 3107399 - protein, 39 aa, Giardia lamblia
EHDSASLSLKAKTAYSGPVSTEGGDKSIQTSPLTPVPAD

SEQ ID NO: 3107400 - protein, 14 aa, Giardia lamblia
EHDSSADGEGIPPF

SEQ ID NO: 3107401 - protein, 33 aa, Giardia lamblia
EHDTAETQITGPRSDALTSDPASHVSTVPGTEL

SEQ ID NO: 3107402 - protein, 11 aa, Giardia lamblia
EHEEKERTSHK

SEQ ID NO: 3107403 - protein, 18 aa, Giardia lamblia
EHEGRGNNAANPLESSVT

SEQ ID NO: 3107404 - protein, 5 aa, Giardia lamblia
EHEKA

SEQ ID NO: 3107405 - protein, 51 aa, Giardia lamblia
EHEKAERKRERAEKKRLEQEAKKPGSTVPPPKKVEQKIEKGMPEPLGPGTY

SEQ ID NO: 3107406 - protein, 21 aa, Giardia lamblia
EHELPAEGKRYQGWGSDDDDV

SEQ ID NO: 3107407 - protein, 6 aa, Giardia lamblia
EHENEK

SEQ ID NO: 3107408 - protein, 14 aa, Giardia lamblia
EHEQESRSLWAIFN

SEQ ID NO: 3107409 - protein, 4 aa, Giardia lamblia
EHER

SEQ ID NO: 3107410 - protein, 11 aa, Giardia lamblia
EHESDSSALQQ

SEQ ID NO: 3107411 - protein, 23 aa, Giardia lamblia
EHGGTEESDHLQRQEGTHSKGGL

SEQ ID NO: 3107412 - protein, 7 aa, Giardia lamblia
EHGRQDL

SEQ ID NO: 3107413 - protein, 4 aa, Giardia lamblia
EHGS

SEQ ID NO: 3107414 - protein, 16 aa, Giardia lamblia
EHIGDTDKDTDKKSGI

SEQ ID NO: 3107415 - protein, 11 aa, Giardia lamblia
EHIPNDKTHTR

SEQ ID NO: 3107416 - protein, 9 aa, Giardia lamblia
EHISKDAKT

SEQ ID NO: 3107417 - protein, 9 aa, Giardia lamblia
EHKDTADDK

SEQ ID NO: 3107418 - protein, 11 aa, Giardia lamblia
EHKKTKQSYRT

SEQ ID NO: 3107419 - protein, 7 aa, Giardia lamblia
EHKPDFG

SEQ ID NO: 3107420 - protein, 17 aa, Giardia lamblia
EHKTEKAREQTSDSPPV

SEQ ID NO: 3107421 - protein, 9 aa, Giardia lamblia
EHLGRSSSV

SEQ ID NO: 3107422 - protein, 42 aa, Giardia lamblia
EHLGTGSINPLASPTLSPGLSGTASSLRSEATGSITAPSMTV

SEQ ID NO: 3107423 - protein, 6 aa, Giardia lamblia
EHLRRG

SEQ ID NO: 3107424 - protein, 6 aa, Giardia lamblia
EHNAQT

SEQ ID NO: 3107425 - protein, 4 aa, Giardia lamblia
EHNE

SEQ ID NO: 3107426 - protein, 7 aa, Giardia lamblia
EHNPSDA

SEQ ID NO: 3107427 - protein, 5 aa, Giardia lamblia
EHPDV

SEQ ID NO: 3107428 - protein, 54 aa, Giardia lamblia
EHPEDRPGAAKEKPAKRDVDTRERRKKPTAAVDNEDASPSQDQGPNLGADAPNN

SEQ ID NO: 3107429 - protein, 7 aa, Giardia lamblia
EHPPASK

SEQ ID NO: 3107430 - protein, 5 aa, Giardia lamblia
EHPPV

SEQ ID NO: 3107431 - protein, 8 aa, Giardia lamblia
EHPVSDER

SEQ ID NO: 3107432 - protein, 8 aa, Giardia lamblia
EHQPDSSD

SEQ ID NO: 3107433 - protein, 6 aa, Giardia lamblia
EHRPEE

SEQ ID NO: 3107434 - protein, 21 aa, Giardia lamblia
EHRPRDSASSVSFSQSPQEPA

SEQ ID NO: 3107435 - protein, 9 aa, Giardia lamblia
EHRSATRQP

SEQ ID NO: 3107436 - protein, 5 aa, Giardia lamblia
EHRSE

SEQ ID NO: 3107437 - protein, 6 aa, Giardia lamblia
EHSADN

SEQ ID NO: 3107438 - protein, 14 aa, Giardia lamblia
EHSDPGGSNSDPGV

SEQ ID NO: 3107439 - protein, 20 aa, Giardia lamblia
EHSDTSTGSTCDGQTLEQER

SEQ ID NO: 3107440 - protein, 4 aa, Giardia lamblia
EHSE

SEQ ID NO: 3107441 - protein, 17 aa, Giardia lamblia
EHSGVNTEGLETHKSAD

SEQ ID NO: 3107442 - protein, 8 aa, Giardia lamblia
EHSPNSSV

SEQ ID NO: 3107443 - protein, 15 aa, Giardia lamblia
EHSPPNDPPVPKPER

SEQ ID NO: 3107444 - protein, 6 aa, Giardia lamblia
EHSPSR

SEQ ID NO: 3107445 - protein, 10 aa, Giardia lamblia
EHSSARGKQL

SEQ ID NO: 3107446 - protein, 12 aa, Giardia lamblia
EHSTRDAAADGV

SEQ ID NO: 3107447 - protein, 5 aa, Giardia lamblia
EHSYK

SEQ ID NO: 3107448 - protein, 8 aa, Giardia lamblia
EHTEDTTK

SEQ ID NO: 3107449 - protein, 5 aa, Giardia lamblia
EHTKD

SEQ ID NO: 3107450 - protein, 4 aa, Giardia lamblia
EHTQ

SEQ ID NO: 3107451 - protein, 7 aa, Giardia lamblia
EHTQNGE

SEQ ID NO: 3107452 - protein, 7 aa, Giardia lamblia
EHTSSDR

SEQ ID NO: 3107453 - protein, 6 aa, Giardia lamblia
EHTTGY

SEQ ID NO: 3107454 - protein, 7 aa, Giardia lamblia
EHYATEE

SEQ ID NO: 3107455 - protein, 4 aa, Giardia lamblia
EHYQ

SEQ ID NO: 3107456 - protein, 4 aa, Giardia lamblia
EHYR

SEQ ID NO: 3107457 - protein, 15 aa, Giardia lamblia
EIAKSMQANSSELDR

SEQ ID NO: 3107458 - protein, 10 aa, Giardia lamblia
EIANGKRKVE

SEQ ID NO: 3107459 - protein, 12 aa, Giardia lamblia
EIAPKDGASSLD

SEQ ID NO: 3107460 - protein, 5 aa, Giardia lamblia
EIAPN

SEQ ID NO: 3107461 - protein, 10 aa, Giardia lamblia
EIAPSDSRKY

SEQ ID NO: 3107462 - protein, 11 aa, Giardia lamblia
EIDDERRKTEL

SEQ ID NO: 3107463 - protein, 10 aa, Giardia lamblia
EIDEEENKEN

SEQ ID NO: 3107464 - protein, 7 aa, Giardia lamblia
EIDEQAA

SEQ ID NO: 3107465 - protein, 9 aa, Giardia lamblia
EIDGKQEQM

SEQ ID NO: 3107466 - protein, 18 aa, Giardia lamblia
EIDKTRSEHQKTLTEQQE

SEQ ID NO: 3107467 - protein, 6 aa, Giardia lamblia
EIDNKG

SEQ ID NO: 3107468 - protein, 5 aa, Giardia lamblia
EIDSQ

SEQ ID NO: 3107469 - protein, 7 aa, Giardia lamblia
EIEAENQ

SEQ ID NO: 3107470 - protein, 7 aa, Giardia lamblia
EIEASPA

SEQ ID NO: 3107471 - protein, 7 aa, Giardia lamblia
EIEASTY

SEQ ID NO: 3107472 - protein, 6 aa, Giardia lamblia
EIEATI

SEQ ID NO: 3107473 - protein, 5 aa, Giardia lamblia
EIEDA

SEQ ID NO: 3107474 - protein, 10 aa, Giardia lamblia
EIEDEKRNLP

SEQ ID NO: 3107475 - protein, 13 aa, Giardia lamblia
EIEDSRSKAELSS

SEQ ID NO: 3107476 - protein, 19 aa, Giardia lamblia
EIEDTRKTLAAAEAKLSNY

SEQ ID NO: 3107477 - protein, 12 aa, Giardia lamblia
EIEERKKEEERI

SEQ ID NO: 3107478 - protein, 11 aa, Giardia lamblia
EIEKSKEKALH

SEQ ID NO: 3107479 - protein, 4 aa, Giardia lamblia
EIEN

SEQ ID NO: 3107480 - protein, 15 aa, Giardia lamblia
EIEQDEALNDARDET

SEQ ID NO: 3107481 - protein, 5 aa, Giardia lamblia
EIEQG

SEQ ID NO: 3107482 - protein, 19 aa, Giardia lamblia
EIEREHEELRRKRQDIQER

SEQ ID NO: 3107483 - protein, 16 aa, Giardia lamblia
EIETEQRDDALNQSFS

SEQ ID NO: 3107484 - protein, 8 aa, Giardia lamblia
EIGGEGVQ

SEQ ID NO: 3107485 - protein, 11 aa, Giardia lamblia
EIGHGTSLRND

SEQ ID NO: 3107486 - protein, 5 aa, Giardia lamblia
EIGNT

SEQ ID NO: 3107487 - protein, 4 aa, Giardia lamblia
EIGT

SEQ ID NO: 3107488 - protein, 6 aa, Giardia lamblia
EIGTTD

SEQ ID NO: 3107489 - protein, 6 aa, Giardia lamblia
EIHESE

SEQ ID NO: 3107490 - protein, 8 aa, Giardia lamblia
EIKAPSEQ

SEQ ID NO: 3107491 - protein, 11 aa, Giardia lamblia
EIKDGNNNTAA

SEQ ID NO: 3107492 - protein, 11 aa, Giardia lamblia
EIKDNTGKSPM

SEQ ID NO: 3107493 - protein, 8 aa, Giardia lamblia
EIKGLNKN

SEQ ID NO: 3107494 - protein, 7 aa, Giardia lamblia
EIKGSDD

SEQ ID NO: 3107495 - protein, 9 aa, Giardia lamblia
EIKRETKKL

SEQ ID NO: 3107496 - protein, 5 aa, Giardia lamblia
EIKTG

SEQ ID NO: 3107497 - protein, 9 aa, Giardia lamblia
EIKTGQTHN

SEQ ID NO: 3107498 - protein, 9 aa, Giardia lamblia
EINDENAKI

SEQ ID NO: 3107499 - protein, 7 aa, Giardia lamblia
EINGARN

SEQ ID NO: 3107500 - protein, 10 aa, Giardia lamblia
EINKTQASEV

SEQ ID NO: 3107501 - protein, 11 aa, Giardia lamblia
EINPENNLSQP

SEQ ID NO: 3107502 - protein, 5 aa, Giardia lamblia
EINPT

SEQ ID NO: 3107503 - protein, 5 aa, Giardia lamblia
EINQT

SEQ ID NO: 3107504 - protein, 15 aa, Giardia lamblia
EINSDESEVGENHDH

SEQ ID NO: 3107505 - protein, 32 aa, Giardia lamblia
EIPDEEESEDFYDDDEEEDEEFSAGNGNLFDE

SEQ ID NO: 3107506 - protein, 9 aa, Giardia lamblia
EIPEASRSK

SEQ ID NO: 3107507 - protein, 10 aa, Giardia lamblia
EIPGSDPTSL

SEQ ID NO: 3107508 - protein, 7 aa, Giardia lamblia
EIPKQSS

SEQ ID NO: 3107509 - protein, 11 aa, Giardia lamblia
EIPNSKGDTNM

SEQ ID NO: 3107510 - protein, 6 aa, Giardia lamblia
EIPNTS

SEQ ID NO: 3107511 - protein, 11 aa, Giardia lamblia
EIPPEKKEKGL

SEQ ID NO: 3107512 - protein, 16 aa, Giardia lamblia
EIPRSITTDSSTIANT

SEQ ID NO: 3107513 - protein, 6 aa, Giardia lamblia
EIPRSS

SEQ ID NO: 3107514 - protein, 23 aa, Giardia lamblia
EIPSHTPQVTGTVETAQPTETIE

SEQ ID NO: 3107515 - protein, 4 aa, Giardia lamblia
EIPV

SEQ ID NO: 3107516 - protein, 4 aa, Giardia lamblia
EIQA

SEQ ID NO: 3107517 - protein, 12 aa, Giardia lamblia
EIQASKQKIAQA

SEQ ID NO: 3107518 - protein, 9 aa, Giardia lamblia
EIQESSAQH

SEQ ID NO: 3107519 - protein, 10 aa, Giardia lamblia
EIQGEGERAT

SEQ ID NO: 3107520 - protein, 5 aa, Giardia lamblia
EIQKQ

SEQ ID NO: 3107521 - protein, 12 aa, Giardia lamblia
EIQQSAAQCTAA

SEQ ID NO: 3107522 - protein, 9 aa, Giardia lamblia
EIQRDTNNI

SEQ ID NO: 3107523 - protein, 13 aa, Giardia lamblia
EIRPDDPDQYSVD

SEQ ID NO: 3107524 - protein, 10 aa, Giardia lamblia
EIRPHDSSVA

SEQ ID NO: 3107525 - protein, 8 aa, Giardia lamblia
EIRRNENR

SEQ ID NO: 3107526 - protein, 10 aa, Giardia lamblia
EIRSGQRTSI

SEQ ID NO: 3107527 - protein, 6 aa, Giardia lamblia
EIRSTD

SEQ ID NO: 3107528 - protein, 9 aa, Giardia lamblia
EISDGENSL

SEQ ID NO: 3107529 - protein, 12 aa, Giardia lamblia
EISEKSAENASL

SEQ ID NO: 3107530 - protein, 8 aa, Giardia lamblia
EISHNKED

SEQ ID NO: 3107531 - protein, 5 aa, Giardia lamblia
EISKL

SEQ ID NO: 3107532 - protein, 7 aa, Giardia lamblia
EISPRRG

SEQ ID NO: 3107533 - protein, 7 aa, Giardia lamblia
EISPTAA

SEQ ID NO: 3107534 - protein, 8 aa, Giardia lamblia
EISPTRKS

SEQ ID NO: 3107535 - protein, 16 aa, Giardia lamblia
EISRSSHSRTPTSLST

SEQ ID NO: 3107536 - protein, 11 aa, Giardia lamblia
EISSQIEPTMN

SEQ ID NO: 3107537 - protein, 5 aa, Giardia lamblia
EITER

SEQ ID NO: 3107538 - protein, 31 aa, Giardia lamblia
EITETTEYSGSEAKGSSITDALKNNDPSIST

SEQ ID NO: 3107539 - protein, 10 aa, Giardia lamblia
EITGPAPDEL

SEQ ID NO: 3107540 - protein, 9 aa, Giardia lamblia
EITGPYSEA

SEQ ID NO: 3107541 - protein, 5 aa, Giardia lamblia
EITGR

SEQ ID NO: 3107542 - protein, 11 aa, Giardia lamblia
EITGSEEEASL

SEQ ID NO: 3107543 - protein, 4 aa, Giardia lamblia
EITP

SEQ ID NO: 3107544 - protein, 13 aa, Giardia lamblia
EITPKKKTQSPKD

SEQ ID NO: 3107545 - protein, 8 aa, Giardia lamblia
EITRTQPD

SEQ ID NO: 3107546 - protein, 5 aa, Giardia lamblia
EITSD

SEQ ID NO: 3107547 - protein, 10 aa, Giardia lamblia
EITSENNACK

SEQ ID NO: 3107548 - protein, 15 aa, Giardia lamblia
EITSPQDATIEADRN

SEQ ID NO: 3107549 - protein, 15 aa, Giardia lamblia
EITSTPLRKEDDGTV

SEQ ID NO: 3107550 - protein, 7 aa, Giardia lamblia
EKAADLS

SEQ ID NO: 3107551 - protein, 5 aa, Giardia lamblia
EKAAE

SEQ ID NO: 3107552 - protein, 22 aa, Giardia lamblia
EKAAEAEKSLAAQELESAKQRT

SEQ ID NO: 3107553 - protein, 15 aa, Giardia lamblia
EKAAVSATDAANREL

SEQ ID NO: 3107554 - protein, 9 aa, Giardia lamblia
EKADAESVS

SEQ ID NO: 3107555 - protein, 6 aa, Giardia lamblia
EKADRS

SEQ ID NO: 3107556 - protein, 8 aa, Giardia lamblia
EKADSQIT

SEQ ID NO: 3107557 - protein, 14 aa, Giardia lamblia
EKADVPKKKRFFGL

SEQ ID NO: 3107558 - protein, 7 aa, Giardia lamblia
EKAEANT

SEQ ID NO: 3107559 - protein, 21 aa, Giardia lamblia
EKAENAAKESRDSKEEAEKAR

SEQ ID NO: 3107560 - protein, 25 aa, Giardia lamblia
EKAHAQRRADARRVRDTDGPPAACP

SEQ ID NO: 3107561 - protein, 9 aa, Giardia lamblia
EKAIQGDEP

SEQ ID NO: 3107562 - protein, 9 aa, Giardia lamblia
EKAISPAEK

SEQ ID NO: 3107563 - protein, 21 aa, Giardia lamblia
EKAKDRPRQRKSEPRTPPRER

SEQ ID NO: 3107564 - protein, 7 aa, Giardia lamblia
EKAKEYI

SEQ ID NO: 3107565 - protein, 17 aa, Giardia lamblia
EKALQTQSSMQRQRATE

SEQ ID NO: 3107566 - protein, 17 aa, Giardia lamblia
EKANELDGYNRERQARE

SEQ ID NO: 3107567 - protein, 6 aa, Giardia lamblia
EKANQD

SEQ ID NO: 3107568 - protein, 4 aa, Giardia lamblia
EKAP

SEQ ID NO: 3107569 - protein, 7 aa, Giardia lamblia
EKAQEQR

SEQ ID NO: 3107570 - protein, 14 aa, Giardia lamblia
EKAQGDSSKCGKSP

SEQ ID NO: 3107571 - protein, 31 aa, Giardia lamblia
EKAQPPATTARGGSSQNSSRDESDTTDPTRM

SEQ ID NO: 3107572 - protein, 18 aa, Giardia lamblia
EKARSANQVVSTSSSAVQ

SEQ ID NO: 3107573 - protein, 20 aa, Giardia lamblia
EKASKKKLITPPQGTHPRSL

SEQ ID NO: 3107574 - protein, 13 aa, Giardia lamblia
EKASLAASEVKRS

SEQ ID NO: 3107575 - protein, 7 aa, Giardia lamblia
EKASSLS

SEQ ID NO: 3107576 - protein, 9 aa, Giardia lamblia
EKATPSATI

SEQ ID NO: 3107577 - protein, 8 aa, Giardia lamblia
EKCNSLES

SEQ ID NO: 3107578 - protein, 6 aa, Giardia lamblia
EKCSSE

SEQ ID NO: 3107579 - protein, 9 aa, Giardia lamblia
EKDANDNYV

SEQ ID NO: 3107580 - protein, 14 aa, Giardia lamblia
EKDARAKDKTIQEL

SEQ ID NO: 3107581 - protein, 23 aa, Giardia lamblia
EKDDSARASNTNNNSESRPASSS

SEQ ID NO: 3107582 - protein, 9 aa, Giardia lamblia
EKDEENDRL

SEQ ID NO: 3107583 - protein, 8 aa, Giardia lamblia
EKDEKLAK

SEQ ID NO: 3107584 - protein, 10 aa, Giardia lamblia
EKDGDNSDYE

SEQ ID NO: 3107585 - protein, 7 aa, Giardia lamblia
EKDGEIS

SEQ ID NO: 3107586 - protein, 5 aa, Giardia lamblia
EKDGL

SEQ ID NO: 3107587 - protein, 9 aa, Giardia lamblia
EKDGPLPTG

SEQ ID NO: 3107588 - protein, 9 aa, Giardia lamblia
EKDGTGETA

SEQ ID NO: 3107589 - protein, 14 aa, Giardia lamblia
EKDHDKTLNENRTL

SEQ ID NO: 3107590 - protein, 5 aa, Giardia lamblia
EKDHP

SEQ ID NO: 3107591 - protein, 8 aa, Giardia lamblia
EKDIGGES

SEQ ID NO: 3107592 - protein, 10 aa, Giardia lamblia
EKDIHDNSGY

SEQ ID NO: 3107593 - protein, 8 aa, Giardia lamblia
EKDISGRS

SEQ ID NO: 3107594 - protein, 15 aa, Giardia lamblia
EKDKALASSCTRQRA

SEQ ID NO: 3107595 - protein, 7 aa, Giardia lamblia
EKDKASA

SEQ ID NO: 3107596 - protein, 9 aa, Giardia lamblia
EKDKKNSVR

SEQ ID NO: 3107597 - protein, 5 aa, Giardia lamblia
EKDLT

SEQ ID NO: 3107598 - protein, 9 aa, Giardia lamblia
EKDLTTEIT

SEQ ID NO: 3107599 - protein, 12 aa, Giardia lamblia
EKDMKNNRGDTA

SEQ ID NO: 3107600 - protein, 11 aa, Giardia lamblia
EKDMKSKWGNT

SEQ ID NO: 3107601 - protein, 8 aa, Giardia lamblia
EKDPETMD

SEQ ID NO: 3107602 - protein, 8 aa, Giardia lamblia
EKDPHKDQ

SEQ ID NO: 3107603 - protein, 11 aa, Giardia lamblia
EKDPTNSAAKL

SEQ ID NO: 3107604 - protein, 4 aa, Giardia lamblia
EKDQ

SEQ ID NO: 3107605 - protein, 6 aa, Giardia lamblia
EKDQAC

SEQ ID NO: 3107606 - protein, 8 aa, Giardia lamblia
EKDRPTYR

SEQ ID NO: 3107607 - protein, 10 aa, Giardia lamblia
EKDSDSDFED

SEQ ID NO: 3107608 - protein, 7 aa, Giardia lamblia
EKDSSDY

SEQ ID NO: 3107609 - protein, 8 aa, Giardia lamblia
EKDTELSR

SEQ ID NO: 3107610 - protein, 20 aa, Giardia lamblia
EKDTKPLEQQQSTRKSHSGG

SEQ ID NO: 3107611 - protein, 17 aa, Giardia lamblia
EKDTVETQARTKALQKA

SEQ ID NO: 3107612 - protein, 43 aa, Giardia lamblia
EKDTYGDDSMTTGSPSGQTRSRSSSKSHKKNSLEQENKSLKQM

SEQ ID NO: 3107613 - protein, 8 aa, Giardia lamblia
EKDVPREE

SEQ ID NO: 3107614 - protein, 12 aa, Giardia lamblia
EKEAGISDSVGG

SEQ ID NO: 3107615 - protein, 8 aa, Giardia lamblia
EKEAGLVT

SEQ ID NO: 3107616 - protein, 9 aa, Giardia lamblia
EKEAGSVSY

SEQ ID NO: 3107617 - protein, 10 aa, Giardia lamblia
EKEASPPAVS

SEQ ID NO: 3107618 - protein, 5 aa, Giardia lamblia
EKEDL

SEQ ID NO: 3107619 - protein, 16 aa, Giardia lamblia
EKEDSELSSGSSSGID

SEQ ID NO: 3107620 - protein, 19 aa, Giardia lamblia
EKEDSVRGTVSNTDIAGDE

SEQ ID NO: 3107621 - protein, 8 aa, Giardia lamblia
EKEEARQD

SEQ ID NO: 3107622 - protein, 5 aa, Giardia lamblia
EKEEE

SEQ ID NO: 3107623 - protein, 23 aa, Giardia lamblia
EKEEEMEAGDEETDNIGGSDLET

SEQ ID NO: 3107624 - protein, 8 aa, Giardia lamblia
EKEEESRY

SEQ ID NO: 3107625 - protein, 9 aa, Giardia lamblia
EKEELNSQI

SEQ ID NO: 3107626 - protein, 10 aa, Giardia lamblia
EKEERASKNV

SEQ ID NO: 3107627 - protein, 7 aa, Giardia lamblia
EKEEREL

SEQ ID NO: 3107628 - protein, 9 aa, Giardia lamblia
EKEETYRKA

SEQ ID NO: 3107629 - protein, 15 aa, Giardia lamblia
EKEGAYNSTNAASTL

SEQ ID NO: 3107630 - protein, 14 aa, Giardia lamblia
EKEGGIQRHDGSTA

SEQ ID NO: 3107631 - protein, 9 aa, Giardia lamblia
EKEGGQPDA

SEQ ID NO: 3107632 - protein, 7 aa, Giardia lamblia
EKEGTEL

SEQ ID NO: 3107633 - protein, 9 aa, Giardia lamblia
EKEGVQTEQ

SEQ ID NO: 3107634 - protein, 8 aa, Giardia lamblia
EKEGVSSD

SEQ ID NO: 3107635 - protein, 8 aa, Giardia lamblia
EKEHQAPG

SEQ ID NO: 3107636 - protein, 11 aa, Giardia lamblia
EKEIPNPDETA

SEQ ID NO: 3107637 - protein, 7 aa, Giardia lamblia
EKEISSA

SEQ ID NO: 3107638 - protein, 8 aa, Giardia lamblia
EKEKAITD

SEQ ID NO: 3107639 - protein, 9 aa, Giardia lamblia
EKEKDSTIQ

SEQ ID NO: 3107640 - protein, 13 aa, Giardia lamblia
EKEKESARNRNAN

SEQ ID NO: 3107641 - protein, 9 aa, Giardia lamblia
EKEKEVETL

SEQ ID NO: 3107642 - protein, 7 aa, Giardia lamblia
EKEKGSK

SEQ ID NO: 3107643 - protein, 14 aa, Giardia lamblia
EKELKVGSGLSTTF

SEQ ID NO: 3107644 - protein, 5 aa, Giardia lamblia
EKELQ

SEQ ID NO: 3107645 - protein, 4 aa, Giardia lamblia
EKEM

SEQ ID NO: 3107646 - protein, 8 aa, Giardia lamblia
EKENEDLK

SEQ ID NO: 3107647 - protein, 14 aa, Giardia lamblia
EKENNEQALTSPIS

SEQ ID NO: 3107648 - protein, 6 aa, Giardia lamblia
EKEPAI

SEQ ID NO: 3107649 - protein, 12 aa, Giardia lamblia
EKEQEAASYAHH

SEQ ID NO: 3107650 - protein, 7 aa, Giardia lamblia
EKEQEIQ

SEQ ID NO: 3107651 - protein, 9 aa, Giardia lamblia
EKEQVSSEA

SEQ ID NO: 3107652 - protein, 12 aa, Giardia lamblia
EKERDNAYKAQA

SEQ ID NO: 3107653 - protein, 31 aa, Giardia lamblia
EKERDRGERGSVGSSSTFEAEASQSNPDPKL

SEQ ID NO: 3107654 - protein, 46 aa, Giardia lamblia
EKERKEALTRSSEPAQEPQSQESQATTAADNKSDKPEPEPEPENEQ

SEQ ID NO: 3107655 - protein, 7 aa, Giardia lamblia
EKERSAE

SEQ ID NO: 3107656 - protein, 5 aa, Giardia lamblia
EKERV

SEQ ID NO: 3107657 - protein, 8 aa, Giardia lamblia
EKESDASR

SEQ ID NO: 3107658 - protein, 6 aa, Giardia lamblia
EKESTC

SEQ ID NO: 3107659 - protein, 13 aa, Giardia lamblia
EKETDTAENRQQH

SEQ ID NO: 3107660 - protein, 5 aa, Giardia lamblia
EKETE

SEQ ID NO: 3107661 - protein, 12 aa, Giardia lamblia
EKETKLATSDNR

SEQ ID NO: 3107662 - protein, 6 aa, Giardia lamblia
EKEVAK

SEQ ID NO: 3107663 - protein, 12 aa, Giardia lamblia
EKEVGRQNSLGR

SEQ ID NO: 3107664 - protein, 12 aa, Giardia lamblia
EKEWRSDNARDI

SEQ ID NO: 3107665 - protein, 5 aa, Giardia lamblia
EKEYS

SEQ ID NO: 3107666 - protein, 9 aa, Giardia lamblia
EKFEGESGK

SEQ ID NO: 3107667 - protein, 16 aa, Giardia lamblia
EKFKGEDSSLKSSTLS

SEQ ID NO: 3107668 - protein, 6 aa, Giardia lamblia
EKFSVP

SEQ ID NO: 3107669 - protein, 7 aa, Giardia lamblia
EKFTYTP

SEQ ID NO: 3107670 - protein, 9 aa, Giardia lamblia
EKGAKDSFG

SEQ ID NO: 3107671 - protein, 27 aa, Giardia lamblia
EKGAPLSSTTHTKQGRRSRASTIPQVT

SEQ ID NO: 3107672 - protein, 7 aa, Giardia lamblia
EKGATTE

SEQ ID NO: 3107673 - protein, 8 aa, Giardia lamblia
EKGCTASS

SEQ ID NO: 3107674 - protein, 10 aa, Giardia lamblia
EKGDAGTTTV

SEQ ID NO: 3107675 - protein, 6 aa, Giardia lamblia
EKGDIE

SEQ ID NO: 3107676 - protein, 6 aa, Giardia lamblia
EKGDTK

SEQ ID NO: 3107677 - protein, 8 aa, Giardia lamblia
EKGDVERC

SEQ ID NO: 3107678 - protein, 9 aa, Giardia lamblia
EKGEQTAEL

SEQ ID NO: 3107679 - protein, 4 aa, Giardia lamblia
EKGG

SEQ ID NO: 3107680 - protein, 7 aa, Giardia lamblia
EKGGVPG

SEQ ID NO: 3107681 - protein, 11 aa, Giardia lamblia
EKGHQDKSGHT

SEQ ID NO: 3107682 - protein, 4 aa, Giardia lamblia
EKGI

SEQ ID NO: 3107683 - protein, 6 aa, Giardia lamblia
EKGIEE

SEQ ID NO: 3107684 - protein, 5 aa, Giardia lamblia
EKGIN

SEQ ID NO: 3107685 - protein, 8 aa, Giardia lamblia
EKGIQDKY

SEQ ID NO: 3107686 - protein, 10 aa, Giardia lamblia
EKGIQDNNGL

SEQ ID NO: 3107687 - protein, 7 aa, Giardia lamblia
EKGIRDE

SEQ ID NO: 3107688 - protein, 9 aa, Giardia lamblia
EKGIRDNQG

SEQ ID NO: 3107689 - protein, 5 aa, Giardia lamblia
EKGIT

SEQ ID NO: 3107690 - protein, 9 aa, Giardia lamblia
EKGKENNSV

SEQ ID NO: 3107691 - protein, 29 aa, Giardia lamblia
EKGKGKSKPKKLAQSKQGPKQEQPPAAPC

SEQ ID NO: 3107692 - protein, 11 aa, Giardia lamblia
EKGLADNEGKT

SEQ ID NO: 3107693 - protein, 10 aa, Giardia lamblia
EKGLKDNNGW

SEQ ID NO: 3107694 - protein, 9 aa, Giardia lamblia
EKGLRDKNG

SEQ ID NO: 3107695 - protein, 9 aa, Giardia lamblia
EKGLRDKTG

SEQ ID NO: 3107696 - protein, 11 aa, Giardia lamblia
EKGLRDSKGRT

SEQ ID NO: 3107697 - protein, 9 aa, Giardia lamblia
EKGMQDDDG

SEQ ID NO: 3107698 - protein, 5 aa, Giardia lamblia
EKGNH

SEQ ID NO: 3107699 - protein, 6 aa, Giardia lamblia
EKGNVD

SEQ ID NO: 3107700 - protein, 5 aa, Giardia lamblia
EKGNY

SEQ ID NO: 3107701 - protein, 11 aa, Giardia lamblia
EKGQRDKRGQT

SEQ ID NO: 3107702 - protein, 9 aa, Giardia lamblia
EKGRQEVQQ

SEQ ID NO: 3107703 - protein, 10 aa, Giardia lamblia
EKGRQMADGT

SEQ ID NO: 3107704 - protein, 13 aa, Giardia lamblia
EKGSDYAYKGELS

SEQ ID NO: 3107705 - protein, 8 aa, Giardia lamblia
EKGSPSLS

SEQ ID NO: 3107706 - protein, 10 aa, Giardia lamblia
EKGSSGREAM

SEQ ID NO: 3107707 - protein, 10 aa, Giardia lamblia
EKGTANSVCA

SEQ ID NO: 3107708 - protein, 6 aa, Giardia lamblia
EKGTGS

SEQ ID NO: 3107709 - protein, 9 aa, Giardia lamblia
EKGTWSTKS

SEQ ID NO: 3107710 - protein, 5 aa, Giardia lamblia
EKGVD

SEQ ID NO: 3107711 - protein, 4 aa, Giardia lamblia
EKGY

SEQ ID NO: 3107712 - protein, 5 aa, Giardia lamblia
EKGYP

SEQ ID NO: 3107713 - protein, 11 aa, Giardia lamblia
EKGYPDSEPTT

SEQ ID NO: 3107714 - protein, 16 aa, Giardia lamblia
EKHNKESNHAPSNPSR

SEQ ID NO: 3107715 - protein, 18 aa, Giardia lamblia
EKHPEAAELAQEARDSER

SEQ ID NO: 3107716 - protein, 10 aa, Giardia lamblia
EKHPEQAEEH

SEQ ID NO: 3107717 - protein, 15 aa, Giardia lamblia
EKHRSEKTDTEDPRN

SEQ ID NO: 3107718 - protein, 9 aa, Giardia lamblia
EKHSNAELV

SEQ ID NO: 3107719 - protein, 6 aa, Giardia lamblia
EKHTGN

SEQ ID NO: 3107720 - protein, 6 aa, Giardia lamblia
EKIDTL

SEQ ID NO: 3107721 - protein, 5 aa, Giardia lamblia
EKIEP

SEQ ID NO: 3107722 - protein, 27 aa, Giardia lamblia
EKIRSGQYPAGSVPLRAEDGSLEPQEY

SEQ ID NO: 3107723 - protein, 4 aa, Giardia lamblia
EKIS

SEQ ID NO: 3107724 - protein, 6 aa, Giardia lamblia
EKITSL

SEQ ID NO: 3107725 - protein, 16 aa, Giardia lamblia
EKKAQKRKEKSIRSEK

SEQ ID NO: 3107726 - protein, 8 aa, Giardia lamblia
EKKCSGGL

SEQ ID NO: 3107727 - protein, 16 aa, Giardia lamblia
EKKEEASKRLKAEKKQ

SEQ ID NO: 3107728 - protein, 18 aa, Giardia lamblia
EKKERAREARLREEQEKQ

SEQ ID NO: 3107729 - protein, 6 aa, Giardia lamblia
EKKHNL

SEQ ID NO: 3107730 - protein, 12 aa, Giardia lamblia
EKKKADAVQEQY

SEQ ID NO: 3107731 - protein, 12 aa, Giardia lamblia
EKKKEKESLENQ

SEQ ID NO: 3107732 - protein, 13 aa, Giardia lamblia
EKKLEDPAATLPE

SEQ ID NO: 3107733 - protein, 9 aa, Giardia lamblia
EKKNTESRV

SEQ ID NO: 3107734 - protein, 15 aa, Giardia lamblia
EKKPAGRVEGGMADS

SEQ ID NO: 3107735 - protein, 58 aa, Giardia lamblia
EKKPGASEPLATNKAGIPQPYQHPPQPIPQQYPTDGPLPGTYSDQVQSRAVSERLTPR

SEQ ID NO: 3107736 - protein, 9 aa, Giardia lamblia
EKKQAKQLE

SEQ ID NO: 3107737 - protein, 15 aa, Giardia lamblia
EKKQDPTEDASLAET

SEQ ID NO: 3107738 - protein, 9 aa, Giardia lamblia
EKKQSDLEK

SEQ ID NO: 3107739 - protein, 13 aa, Giardia lamblia
EKKRHTNNAQESL

SEQ ID NO: 3107740 - protein, 10 aa, Giardia lamblia
EKKSAKCENP

SEQ ID NO: 3107741 - protein, 9 aa, Giardia lamblia
EKKTDVAKH

SEQ ID NO: 3107742 - protein, 9 aa, Giardia lamblia
EKKTREAKQ

SEQ ID NO: 3107743 - protein, 11 aa, Giardia lamblia
EKKYGKALGEE

SEQ ID NO: 3107744 - protein, 11 aa, Giardia lamblia
EKLAAAKASIP

SEQ ID NO: 3107745 - protein, 9 aa, Giardia lamblia
EKLAQKEKD

SEQ ID NO: 3107746 - protein, 11 aa, Giardia lamblia
EKLDKAPDKMT

SEQ ID NO: 3107747 - protein, 5 aa, Giardia lamblia
EKLEE

SEQ ID NO: 3107748 - protein, 7 aa, Giardia lamblia
EKLEENE

SEQ ID NO: 3107749 - protein, 7 aa, Giardia lamblia
EKLEQKK

SEQ ID NO: 3107750 - protein, 13 aa, Giardia lamblia
EKLEQQAKALNRE

SEQ ID NO: 3107751 - protein, 4 aa, Giardia lamblia
EKLM

SEQ ID NO: 3107752 - protein, 15 aa, Giardia lamblia
EKLNKETRNVPQSPQ

SEQ ID NO: 3107753 - protein, 11 aa, Giardia lamblia
EKLNSKSTEIS

SEQ ID NO: 3107754 - protein, 5 aa, Giardia lamblia
EKLPR

SEQ ID NO: 3107755 - protein, 13 aa, Giardia lamblia
EKLPSAAPQKTAT

SEQ ID NO: 3107756 - protein, 11 aa, Giardia lamblia
EKLQASNGELK

SEQ ID NO: 3107757 - protein, 10 aa, Giardia lamblia
EKLQNTNGET

SEQ ID NO: 3107758 - protein, 10 aa, Giardia lamblia
EKLRNKEREY

SEQ ID NO: 3107759 - protein, 12 aa, Giardia lamblia
EKLSASNETIQN

SEQ ID NO: 3107760 - protein, 12 aa, Giardia lamblia
EKLSEADSERAA

SEQ ID NO: 3107761 - protein, 5 aa, Giardia lamblia
EKLSK

SEQ ID NO: 3107762 - protein, 8 aa, Giardia lamblia
EKLTTEQT

SEQ ID NO: 3107763 - protein, 10 aa, Giardia lamblia
EKMQAKNKSL

SEQ ID NO: 3107764 - protein, 10 aa, Giardia lamblia
EKNADGDTVS

SEQ ID NO: 3107765 - protein, 5 aa, Giardia lamblia
EKNAE

SEQ ID NO: 3107766 - protein, 4 aa, Giardia lamblia
EKND

SEQ ID NO: 3107767 - protein, 9 aa, Giardia lamblia
EKNGDHNNA

SEQ ID NO: 3107768 - protein, 12 aa, Giardia lamblia
EKNGLQLTSGTA

SEQ ID NO: 3107769 - protein, 7 aa, Giardia lamblia
EKNGTID

SEQ ID NO: 3107770 - protein, 6 aa, Giardia lamblia
EKNIDR

SEQ ID NO: 3107771 - protein, 6 aa, Giardia lamblia
EKNINR

SEQ ID NO: 3107772 - protein, 6 aa, Giardia lamblia
EKNISA

SEQ ID NO: 3107773 - protein, 5 aa, Giardia lamblia
EKNKD

SEQ ID NO: 3107774 - protein, 4 aa, Giardia lamblia
EKNL

SEQ ID NO: 3107775 - protein, 10 aa, Giardia lamblia
EKNMQDKDGY

SEQ ID NO: 3107776 - protein, 5 aa, Giardia lamblia
EKNNT

SEQ ID NO: 3107777 - protein, 13 aa, Giardia lamblia
EKNPEMYEFLSRY

SEQ ID NO: 3107778 - protein, 5 aa, Giardia lamblia
EKNPI

SEQ ID NO: 3107779 - protein, 15 aa, Giardia lamblia
EKNPRRVPTSRAKEA

SEQ ID NO: 3107780 - protein, 6 aa, Giardia lamblia
EKNQSA

SEQ ID NO: 3107781 - protein, 7 aa, Giardia lamblia
EKNQTRT

SEQ ID NO: 3107782 - protein, 7 aa, Giardia lamblia
EKNQVPV

SEQ ID NO: 3107783 - protein, 29 aa, Giardia lamblia
EKNSALADASAAITRNRASSSGMQYGGLG

SEQ ID NO: 3107784 - protein, 10 aa, Giardia lamblia
EKNTDAYGQT

SEQ ID NO: 3107785 - protein, 31 aa, Giardia lamblia
EKNTDDEYTSEDSPTESSEMDGEDGVDEDGV

SEQ ID NO: 3107786 - protein, 10 aa, Giardia lamblia
EKNYGEERAS

SEQ ID NO: 3107787 - protein, 16 aa, Giardia lamblia
EKPDPSKISPEDEKAY

SEQ ID NO: 3107788 - protein, 6 aa, Giardia lamblia
EKPDTL

SEQ ID NO: 3107789 - protein, 7 aa, Giardia lamblia
EKPEGEA

SEQ ID NO: 3107790 - protein, 9 aa, Giardia lamblia
EKPELENQR

SEQ ID NO: 3107791 - protein, 9 aa, Giardia lamblia
EKPFDTPAN

SEQ ID NO: 3107792 - protein, 6 aa, Giardia lamblia
EKPGYA

SEQ ID NO: 3107793 - protein, 9 aa, Giardia lamblia
EKPHHDTSS

SEQ ID NO: 3107794 - protein, 16 aa, Giardia lamblia
EKPIARGFSTQSNRLT

SEQ ID NO: 3107795 - protein, 12 aa, Giardia lamblia
EKPKAASQIKGG

SEQ ID NO: 3107796 - protein, 9 aa, Giardia lamblia
EKPKKTTIK

SEQ ID NO: 3107797 - protein, 11 aa, Giardia lamblia
EKPLPEEKPLT

SEQ ID NO: 3107798 - protein, 5 aa, Giardia lamblia
EKPMD

SEQ ID NO: 3107799 - protein, 8 aa, Giardia lamblia
EKPQEHDV

SEQ ID NO: 3107800 - protein, 6 aa, Giardia lamblia
EKPRIS

SEQ ID NO: 3107801 - protein, 4 aa, Giardia lamblia
EKPS

SEQ ID NO: 3107802 - protein, 8 aa, Giardia lamblia
EKPSEIPT

SEQ ID NO: 3107803 - protein, 6 aa, Giardia lamblia
EKPTGD

SEQ ID NO: 3107804 - protein, 6 aa, Giardia lamblia
EKPTNK

SEQ ID NO: 3107805 - protein, 13 aa, Giardia lamblia
EKPTVGRKEASNI

SEQ ID NO: 3107806 - protein, 9 aa, Giardia lamblia
EKPYKTTAS

SEQ ID NO: 3107807 - protein, 17 aa, Giardia lamblia
EKQAETDEQTRKDLEQL

SEQ ID NO: 3107808 - protein, 18 aa, Giardia lamblia
EKQAKQRKPRSSSGNSEL

SEQ ID NO: 3107809 - protein, 16 aa, Giardia lamblia
EKQALQEKNDEMERRE

SEQ ID NO: 3107810 - protein, 8 aa, Giardia lamblia
EKQANDRA

SEQ ID NO: 3107811 - protein, 8 aa, Giardia lamblia
EKQAQKDY

SEQ ID NO: 3107812 - protein, 27 aa, Giardia lamblia
EKQAVSCGNTKTNAPTTRRTGGGYVAP

SEQ ID NO: 3107813 - protein, 14 aa, Giardia lamblia
EKQDPTLVGSPEGE

SEQ ID NO: 3107814 - protein, 9 aa, Giardia lamblia
EKQEVRGSR

SEQ ID NO: 3107815 - protein, 12 aa, Giardia lamblia
EKQGIREDENNK

SEQ ID NO: 3107816 - protein, 9 aa, Giardia lamblia
EKQGQSRRI

SEQ ID NO: 3107817 - protein, 4 aa, Giardia lamblia
EKQI

SEQ ID NO: 3107818 - protein, 6 aa, Giardia lamblia
EKQISS

SEQ ID NO: 3107819 - protein, 11 aa, Giardia lamblia
EKQKEKTRKKS

SEQ ID NO: 3107820 - protein, 5 aa, Giardia lamblia
EKQPI

SEQ ID NO: 3107821 - protein, 8 aa, Giardia lamblia
EKQPSIPS

SEQ ID NO: 3107822 - protein, 7 aa, Giardia lamblia
EKQQENS

SEQ ID NO: 3107823 - protein, 8 aa, Giardia lamblia
EKQQEQIG

SEQ ID NO: 3107824 - protein, 6 aa, Giardia lamblia
EKQQIS

SEQ ID NO: 3107825 - protein, 4 aa, Giardia lamblia
EKQR

SEQ ID NO: 3107826 - protein, 9 aa, Giardia lamblia
EKQRESEVT

SEQ ID NO: 3107827 - protein, 24 aa, Giardia lamblia
EKQRIEEQRRRYQEDQARAQEKVR

SEQ ID NO: 3107828 - protein, 15 aa, Giardia lamblia
EKQRIQSESSDSTEM

SEQ ID NO: 3107829 - protein, 5 aa, Giardia lamblia
EKQRQ

SEQ ID NO: 3107830 - protein, 16 aa, Giardia lamblia
EKQSGFSGPFPASQDS

SEQ ID NO: 3107831 - protein, 7 aa, Giardia lamblia
EKQSLEY

SEQ ID NO: 3107832 - protein, 5 aa, Giardia lamblia
EKQYV

SEQ ID NO: 3107833 - protein, 9 aa, Giardia lamblia
EKRADAQSS

SEQ ID NO: 3107834 - protein, 5 aa, Giardia lamblia
EKRAR

SEQ ID NO: 3107835 - protein, 8 aa, Giardia lamblia
EKRDSEAK

SEQ ID NO: 3107836 - protein, 6 aa, Giardia lamblia
EKREED

SEQ ID NO: 3107837 - protein, 8 aa, Giardia lamblia
EKREELDT

SEQ ID NO: 3107838 - protein, 13 aa, Giardia lamblia
EKREKPSFSSSTE

SEQ ID NO: 3107839 - protein, 14 aa, Giardia lamblia
EKRELEQERKENYM

SEQ ID NO: 3107840 - protein, 8 aa, Giardia lamblia
EKRGRVSE

SEQ ID NO: 3107841 - protein, 6 aa, Giardia lamblia
EKRHTD

SEQ ID NO: 3107842 - protein, 6 aa, Giardia lamblia
EKRKDI

SEQ ID NO: 3107843 - protein, 5 aa, Giardia lamblia
EKRKN

SEQ ID NO: 3107844 - protein, 8 aa, Giardia lamblia
EKRNAAHQ

SEQ ID NO: 3107845 - protein, 4 aa, Giardia lamblia
EKRP

SEQ ID NO: 3107846 - protein, 5 aa, Giardia lamblia
EKRPG

SEQ ID NO: 3107847 - protein, 25 aa, Giardia lamblia
EKRPKTPTIKSATAKVSKARTPTTA

SEQ ID NO: 3107848 - protein, 7 aa, Giardia lamblia
EKRPNVQ

SEQ ID NO: 3107849 - protein, 9 aa, Giardia lamblia
EKRQREREA

SEQ ID NO: 3107850 - protein, 4 aa, Giardia lamblia
EKRR

SEQ ID NO: 3107851 - protein, 6 aa, Giardia lamblia
EKRRKH

SEQ ID NO: 3107852 - protein, 17 aa, Giardia lamblia
EKRRPTSSDITSRTDTD

SEQ ID NO: 3107853 - protein, 10 aa, Giardia lamblia
EKRSANIRTI

SEQ ID NO: 3107854 - protein, 8 aa, Giardia lamblia
EKRSGGSI

SEQ ID NO: 3107855 - protein, 9 aa, Giardia lamblia
EKRTNASGT

SEQ ID NO: 3107856 - protein, 9 aa, Giardia lamblia
EKRYQNSEG

SEQ ID NO: 3107857 - protein, 25 aa, Giardia lamblia
EKSATGFAEREPEAKQTGIRSGASS

SEQ ID NO: 3107858 - protein, 6 aa, Giardia lamblia
EKSDAA

SEQ ID NO: 3107859 - protein, 7 aa, Giardia lamblia
EKSEEIE

SEQ ID NO: 3107860 - protein, 12 aa, Giardia lamblia
EKSGEASRAKLT

SEQ ID NO: 3107861 - protein, 6 aa, Giardia lamblia
EKSGGF

SEQ ID NO: 3107862 - protein, 15 aa, Giardia lamblia
EKSIGDEKPTEPDKL

SEQ ID NO: 3107863 - protein, 14 aa, Giardia lamblia
EKSIGDSRPSTKDV

SEQ ID NO: 3107864 - protein, 16 aa, Giardia lamblia
EKSKSTWRSHNNAQSK

SEQ ID NO: 3107865 - protein, 6 aa, Giardia lamblia
EKSLDG

SEQ ID NO: 3107866 - protein, 13 aa, Giardia lamblia
EKSLTNSKVKKQR

SEQ ID NO: 3107867 - protein, 7 aa, Giardia lamblia
EKSMTGT

SEQ ID NO: 3107868 - protein, 16 aa, Giardia lamblia
EKSPPDEPKGLPTPSF

SEQ ID NO: 3107869 - protein, 12 aa, Giardia lamblia
EKSPSEQSSRAI

SEQ ID NO: 3107870 - protein, 9 aa, Giardia lamblia
EKSREGKCA

SEQ ID NO: 3107871 - protein, 28 aa, Giardia lamblia
EKSRQNALKRRQEELENRSAKAQREQGW

SEQ ID NO: 3107872 - protein, 10 aa, Giardia lamblia
EKSRQSNKGW

SEQ ID NO: 3107873 - protein, 12 aa, Giardia lamblia
EKSRRSKPHPDG

SEQ ID NO: 3107874 - protein, 27 aa, Giardia lamblia
EKSSACIDSTPSSTPYSTRGRLPPRTV

SEQ ID NO: 3107875 - protein, 15 aa, Giardia lamblia
EKSSDMYTSTHDDKT

SEQ ID NO: 3107876 - protein, 5 aa, Giardia lamblia
EKSTA

SEQ ID NO: 3107877 - protein, 23 aa, Giardia lamblia
EKSTDGSKQEVSTITPQPKSSRF

SEQ ID NO: 3107878 - protein, 8 aa, Giardia lamblia
EKSTKSNV

SEQ ID NO: 3107879 - protein, 4 aa, Giardia lamblia
EKSV

SEQ ID NO: 3107880 - protein, 5 aa, Giardia lamblia
EKSYL

SEQ ID NO: 3107881 - protein, 14 aa, Giardia lamblia
EKTDPSTVSDTASR

SEQ ID NO: 3107882 - protein, 8 aa, Giardia lamblia
EKTEGRTA

SEQ ID NO: 3107883 - protein, 8 aa, Giardia lamblia
EKTESMDS

SEQ ID NO: 3107884 - protein, 12 aa, Giardia lamblia
EKTGEGFKNSKD

SEQ ID NO: 3107885 - protein, 6 aa, Giardia lamblia
EKTGKC

SEQ ID NO: 3107886 - protein, 7 aa, Giardia lamblia
EKTGLKT

SEQ ID NO: 3107887 - protein, 11 aa, Giardia lamblia
EKTHPQQPSRV

SEQ ID NO: 3107888 - protein, 14 aa, Giardia lamblia
EKTITNNDGKTAGT

SEQ ID NO: 3107889 - protein, 12 aa, Giardia lamblia
EKTKGRGRTSSV

SEQ ID NO: 3107890 - protein, 10 aa, Giardia lamblia
EKTLTNGRPY

SEQ ID NO: 3107891 - protein, 7 aa, Giardia lamblia
EKTNSCA

SEQ ID NO: 3107892 - protein, 4 aa, Giardia lamblia
EKTQ

SEQ ID NO: 3107893 - protein, 14 aa, Giardia lamblia
EKTQDVRAAGGLEQ

SEQ ID NO: 3107894 - protein, 11 aa, Giardia lamblia
EKTQLAEEQHA

SEQ ID NO: 3107895 - protein, 9 aa, Giardia lamblia
EKTQSEAMS

SEQ ID NO: 3107896 - protein, 9 aa, Giardia lamblia
EKTREDNQA

SEQ ID NO: 3107897 - protein, 5 aa, Giardia lamblia
EKTRV

SEQ ID NO: 3107898 - protein, 9 aa, Giardia lamblia
EKTSGEKYS

SEQ ID NO: 3107899 - protein, 19 aa, Giardia lamblia
EKTVSNNTRKMAQQAKDNS

SEQ ID NO: 3107900 - protein, 14 aa, Giardia lamblia
EKVAGENRVGAHPE

SEQ ID NO: 3107901 - protein, 4 aa, Giardia lamblia
EKVD

SEQ ID NO: 3107902 - protein, 7 aa, Giardia lamblia
EKVEKNS

SEQ ID NO: 3107903 - protein, 9 aa, Giardia lamblia
EKVEPGKME

SEQ ID NO: 3107904 - protein, 4 aa, Giardia lamblia
EKVG

SEQ ID NO: 3107905 - protein, 9 aa, Giardia lamblia
EKVNKDHNS

SEQ ID NO: 3107906 - protein, 21 aa, Giardia lamblia
EKVNRADRSSTSTSPAKRNIK

SEQ ID NO: 3107907 - protein, 12 aa, Giardia lamblia
EKVPNSTSTVTI

SEQ ID NO: 3107908 - protein, 6 aa, Giardia lamblia
EKVSAT

SEQ ID NO: 3107909 - protein, 7 aa, Giardia lamblia
EKVSKAA

SEQ ID NO: 3107910 - protein, 5 aa, Giardia lamblia
EKYAD

SEQ ID NO: 3107911 - protein, 18 aa, Giardia lamblia
EKYERQRLSDEEAEDNSA

SEQ ID NO: 3107912 - protein, 8 aa, Giardia lamblia
EKYNDLTN

SEQ ID NO: 3107913 - protein, 19 aa, Giardia lamblia
EKYNNQEALEGYRKTTEKI

SEQ ID NO: 3107914 - protein, 7 aa, Giardia lamblia
EKYSAEC

SEQ ID NO: 3107915 - protein, 10 aa, Giardia lamblia
EKYSSWDNKK

SEQ ID NO: 3107916 - protein, 7 aa, Giardia lamblia
EKYTDKA

SEQ ID NO: 3107917 - protein, 6 aa, Giardia lamblia
EKYTTV

SEQ ID NO: 3107918 - protein, 7 aa, Giardia lamblia
EKYVTSQ

SEQ ID NO: 3107919 - protein, 7 aa, Giardia lamblia
ELAEDTK

SEQ ID NO: 3107920 - protein, 9 aa, Giardia lamblia
ELAEKERDI

SEQ ID NO: 3107921 - protein, 4 aa, Giardia lamblia
ELAG

SEQ ID NO: 3107922 - protein, 5 aa, Giardia lamblia
ELAPQ

SEQ ID NO: 3107923 - protein, 8 aa, Giardia lamblia
ELAPRAPQ

SEQ ID NO: 3107924 - protein, 9 aa, Giardia lamblia
ELAQADTRD

SEQ ID NO: 3107925 - protein, 5 aa, Giardia lamblia
ELAQE

SEQ ID NO: 3107926 - protein, 9 aa, Giardia lamblia
ELARKSADF

SEQ ID NO: 3107927 - protein, 15 aa, Giardia lamblia
ELASAKKEKEEASSK

SEQ ID NO: 3107928 - protein, 7 aa, Giardia lamblia
ELASRND

SEQ ID NO: 3107929 - protein, 11 aa, Giardia lamblia
ELATGDEATAR

SEQ ID NO: 3107930 - protein, 22 aa, Giardia lamblia
ELATKESLSRKKYDELNNESTD

SEQ ID NO: 3107931 - protein, 8 aa, Giardia lamblia
ELDAGEDT

SEQ ID NO: 3107932 - protein, 7 aa, Giardia lamblia
ELDAQQD

SEQ ID NO: 3107933 - protein, 48 aa, Giardia lamblia
ELDDDDEEAKEQKRLAEEEAKKAAAAAEEEARKKAEEAEEKKQKRLSE

SEQ ID NO: 3107934 - protein, 10 aa, Giardia lamblia
ELDENASKIE

SEQ ID NO: 3107935 - protein, 5 aa, Giardia lamblia
ELDEP

SEQ ID NO: 3107936 - protein, 5 aa, Giardia lamblia
ELDGN

SEQ ID NO: 3107937 - protein, 9 aa, Giardia lamblia
ELDGTAGKT

SEQ ID NO: 3107938 - protein, 11 aa, Giardia lamblia
ELDNAQTSQGW

SEQ ID NO: 3107939 - protein, 16 aa, Giardia lamblia
ELDPDNDENLRQGKAA

SEQ ID NO: 3107940 - protein, 8 aa, Giardia lamblia
ELDPKDES

SEQ ID NO: 3107941 - protein, 7 aa, Giardia lamblia
ELDPREA

SEQ ID NO: 3107942 - protein, 7 aa, Giardia lamblia
ELDPRPR

SEQ ID NO: 3107943 - protein, 15 aa, Giardia lamblia
ELDPSVSKDVDLSSS

SEQ ID NO: 3107944 - protein, 16 aa, Giardia lamblia
ELDRSPSVSARPSSKT

SEQ ID NO: 3107945 - protein, 25 aa, Giardia lamblia
ELDSQKSKRPSSRSATNQRQHHDEP

SEQ ID NO: 3107946 - protein, 13 aa, Giardia lamblia
ELDTSNLKSQSPF

SEQ ID NO: 3107947 - protein, 4 aa, Giardia lamblia
ELEA

SEQ ID NO: 3107948 - protein, 17 aa, Giardia lamblia
ELEASSASIGKYSPQGY

SEQ ID NO: 3107949 - protein, 4 aa, Giardia lamblia
ELEE

SEQ ID NO: 3107950 - protein, 11 aa, Giardia lamblia
ELEEAGKQFSH

SEQ ID NO: 3107951 - protein, 7 aa, Giardia lamblia
ELEEDNE

SEQ ID NO: 3107952 - protein, 12 aa, Giardia lamblia
ELEEEEEERSSS

SEQ ID NO: 3107953 - protein, 6 aa, Giardia lamblia
ELEEET

SEQ ID NO: 3107954 - protein, 8 aa, Giardia lamblia
ELEEKENV

SEQ ID NO: 3107955 - protein, 7 aa, Giardia lamblia
ELEENTT

SEQ ID NO: 3107956 - protein, 8 aa, Giardia lamblia
ELEEQEQN

SEQ ID NO: 3107957 - protein, 8 aa, Giardia lamblia
ELEERSAK

SEQ ID NO: 3107958 - protein, 4 aa, Giardia lamblia
ELEG

SEQ ID NO: 3107959 - protein, 6 aa, Giardia lamblia
ELEGYK

SEQ ID NO: 3107960 - protein, 6 aa, Giardia lamblia
ELENDR

SEQ ID NO: 3107961 - protein, 12 aa, Giardia lamblia
ELEQKQGELDEK

SEQ ID NO: 3107962 - protein, 12 aa, Giardia lamblia
ELEQRADTAYEP

SEQ ID NO: 3107963 - protein, 12 aa, Giardia lamblia
ELEQTKRALRDK

SEQ ID NO: 3107964 - protein, 10 aa, Giardia lamblia
ELESTDLRSE

SEQ ID NO: 3107965 - protein, 4 aa, Giardia lamblia
ELET

SEQ ID NO: 3107966 - protein, 20 aa, Giardia lamblia
ELETAADSLEVEQDHPESSI

SEQ ID NO: 3107967 - protein, 5 aa, Giardia lamblia
ELETE

SEQ ID NO: 3107968 - protein, 9 aa, Giardia lamblia
ELETKEEEL

SEQ ID NO: 3107969 - protein, 5 aa, Giardia lamblia
ELETR

SEQ ID NO: 3107970 - protein, 9 aa, Giardia lamblia
ELGETTERL

SEQ ID NO: 3107971 - protein, 7 aa, Giardia lamblia
ELGGKEP

SEQ ID NO: 3107972 - protein, 7 aa, Giardia lamblia
ELGHTSS

SEQ ID NO: 3107973 - protein, 6 aa, Giardia lamblia
ELGPED

SEQ ID NO: 3107974 - protein, 5 aa, Giardia lamblia
ELGQT

SEQ ID NO: 3107975 - protein, 6 aa, Giardia lamblia
ELGSEH

SEQ ID NO: 3107976 - protein, 8 aa, Giardia lamblia
ELGSTKAD

SEQ ID NO: 3107977 - protein, 21 aa, Giardia lamblia
ELGTDKTDKPESYTDGKEEEE

SEQ ID NO: 3107978 - protein, 7 aa, Giardia lamblia
ELGTGAG

SEQ ID NO: 3107979 - protein, 6 aa, Giardia lamblia
ELHGSN

SEQ ID NO: 3107980 - protein, 4 aa, Giardia lamblia
ELKA

SEQ ID NO: 3107981 - protein, 9 aa, Giardia lamblia
ELKAEKDSI

SEQ ID NO: 3107982 - protein, 5 aa, Giardia lamblia
ELKDI

SEQ ID NO: 3107983 - protein, 19 aa, Giardia lamblia
ELKDYESGAESEGKGSGIS

SEQ ID NO: 3107984 - protein, 8 aa, Giardia lamblia
ELKEENQQ

SEQ ID NO: 3107985 - protein, 15 aa, Giardia lamblia
ELKNQQRQVEKQEAL

SEQ ID NO: 3107986 - protein, 10 aa, Giardia lamblia
ELKNTSSEVG

SEQ ID NO: 3107987 - protein, 8 aa, Giardia lamblia
ELKPGLSK

SEQ ID NO: 3107988 - protein, 5 aa, Giardia lamblia
ELKQP

SEQ ID NO: 3107989 - protein, 17 aa, Giardia lamblia
ELKQQYTTGISSTSTSI

SEQ ID NO: 3107990 - protein, 9 aa, Giardia lamblia
ELKRETAEL

SEQ ID NO: 3107991 - protein, 5 aa, Giardia lamblia
ELKRK

SEQ ID NO: 3107992 - protein, 22 aa, Giardia lamblia
ELKSKSSGSPLKTASTSATLPS

SEQ ID NO: 3107993 - protein, 23 aa, Giardia lamblia
ELKSSRDSLQSAIPPKVTPASAI

SEQ ID NO: 3107994 - protein, 4 aa, Giardia lamblia
ELLE

SEQ ID NO: 3107995 - protein, 9 aa, Giardia lamblia
ELNEGELNP

SEQ ID NO: 3107996 - protein, 8 aa, Giardia lamblia
ELNPDKAN

SEQ ID NO: 3107997 - protein, 8 aa, Giardia lamblia
ELNPGEVS

SEQ ID NO: 3107998 - protein, 12 aa, Giardia lamblia
ELNQKKPDSPGE

SEQ ID NO: 3107999 - protein, 23 aa, Giardia lamblia
ELNRQTSSAVSSAQDAKEAIDRN

SEQ ID NO: 3108000 - protein, 6 aa, Giardia lamblia
ELNRRS

SEQ ID NO: 3108001 - protein, 13 aa, Giardia lamblia
ELNSIGSKSVDGI

SEQ ID NO: 3108002 - protein, 13 aa, Giardia lamblia
ELNSSNSKVQELT

SEQ ID NO: 3108003 - protein, 5 aa, Giardia lamblia
ELPCP

SEQ ID NO: 3108004 - protein, 7 aa, Giardia lamblia
ELPDDRD

SEQ ID NO: 3108005 - protein, 21 aa, Giardia lamblia
ELPDGSAMEPSLRGEQIGEES

SEQ ID NO: 3108006 - protein, 10 aa, Giardia lamblia
ELPEEDPSDE

SEQ ID NO: 3108007 - protein, 13 aa, Giardia lamblia
ELPENQELRPEGH

SEQ ID NO: 3108008 - protein, 7 aa, Giardia lamblia
ELPGGKN

SEQ ID NO: 3108009 - protein, 5 aa, Giardia lamblia
ELPGS

SEQ ID NO: 3108010 - protein, 10 aa, Giardia lamblia
ELPKGQQQAE

SEQ ID NO: 3108011 - protein, 6 aa, Giardia lamblia
ELPKPA

SEQ ID NO: 3108012 - protein, 5 aa, Giardia lamblia
ELPNG

SEQ ID NO: 3108013 - protein, 8 aa, Giardia lamblia
ELPPPPDA

SEQ ID NO: 3108014 - protein, 10 aa, Giardia lamblia
ELPPQQAPAD

SEQ ID NO: 3108015 - protein, 12 aa, Giardia lamblia
ELPPSGPTTVST

SEQ ID NO: 3108016 - protein, 7 aa, Giardia lamblia
ELPQKPI

SEQ ID NO: 3108017 - protein, 22 aa, Giardia lamblia
ELPQRPDDAEHRAPSDVSSTTL

SEQ ID NO: 3108018 - protein, 11 aa, Giardia lamblia
ELPQSKQTVSE

SEQ ID NO: 3108019 - protein, 6 aa, Giardia lamblia
ELPRHT

SEQ ID NO: 3108020 - protein, 5 aa, Giardia lamblia
ELPSP

SEQ ID NO: 3108021 - protein, 8 aa, Giardia lamblia
ELPTDDRK

SEQ ID NO: 3108022 - protein, 9 aa, Giardia lamblia
ELPTEAKAD

SEQ ID NO: 3108023 - protein, 15 aa, Giardia lamblia
ELPTENSTDSEGSGE

SEQ ID NO: 3108024 - protein, 4 aa, Giardia lamblia
ELPV

SEQ ID NO: 3108025 - protein, 7 aa, Giardia lamblia
ELPYDET

SEQ ID NO: 3108026 - protein, 6 aa, Giardia lamblia
ELQARD

SEQ ID NO: 3108027 - protein, 13 aa, Giardia lamblia
ELQDSKNEADAAL

SEQ ID NO: 3108028 - protein, 17 aa, Giardia lamblia
ELQDTENKFKDHRSDMT

SEQ ID NO: 3108029 - protein, 8 aa, Giardia lamblia
ELQETQGL

SEQ ID NO: 3108030 - protein, 4 aa, Giardia lamblia
ELQG

SEQ ID NO: 3108031 - protein, 5 aa, Giardia lamblia
ELQGA

SEQ ID NO: 3108032 - protein, 10 aa, Giardia lamblia
ELQGDSEQPH

SEQ ID NO: 3108033 - protein, 17 aa, Giardia lamblia
ELQNESMQARNPPAEDR

SEQ ID NO: 3108034 - protein, 19 aa, Giardia lamblia
ELQPESREGMVGQERARRA

SEQ ID NO: 3108035 - protein, 5 aa, Giardia lamblia
ELQPI

SEQ ID NO: 3108036 - protein, 6 aa, Giardia lamblia
ELQQAE

SEQ ID NO: 3108037 - protein, 7 aa, Giardia lamblia
ELQQARG

SEQ ID NO: 3108038 - protein, 13 aa, Giardia lamblia
ELQRSTELYSSKD

SEQ ID NO: 3108039 - protein, 5 aa, Giardia lamblia
ELQSA

SEQ ID NO: 3108040 - protein, 5 aa, Giardia lamblia
ELQST

SEQ ID NO: 3108041 - protein, 9 aa, Giardia lamblia
ELQSTNQSQ

SEQ ID NO: 3108042 - protein, 6 aa, Giardia lamblia
ELQTAT

SEQ ID NO: 3108043 - protein, 5 aa, Giardia lamblia
ELQTS

SEQ ID NO: 3108044 - protein, 4 aa, Giardia lamblia
ELRA

SEQ ID NO: 3108045 - protein, 11 aa, Giardia lamblia
ELREERSKTHI

SEQ ID NO: 3108046 - protein, 5 aa, Giardia lamblia
ELREK

SEQ ID NO: 3108047 - protein, 10 aa, Giardia lamblia
ELREPGTSTA

SEQ ID NO: 3108048 - protein, 4 aa, Giardia lamblia
ELRG

SEQ ID NO: 3108049 - protein, 11 aa, Giardia lamblia
ELRGNKPAFKQ

SEQ ID NO: 3108050 - protein, 8 aa, Giardia lamblia
ELRGQNEA

SEQ ID NO: 3108051 - protein, 12 aa, Giardia lamblia
ELRGQTDARGRT

SEQ ID NO: 3108052 - protein, 9 aa, Giardia lamblia
ELRKRTSKG

SEQ ID NO: 3108053 - protein, 12 aa, Giardia lamblia
ELRNKRDEADKL

SEQ ID NO: 3108054 - protein, 31 aa, Giardia lamblia
ELRPPSARFRGTDSLSGLESQSSENSLPELV

SEQ ID NO: 3108055 - protein, 8 aa, Giardia lamblia
ELRPSYEK

SEQ ID NO: 3108056 - protein, 12 aa, Giardia lamblia
ELRSSGSFSAKT

SEQ ID NO: 3108057 - protein, 7 aa, Giardia lamblia
ELSAARQ

SEQ ID NO: 3108058 - protein, 5 aa, Giardia lamblia
ELSAE

SEQ ID NO: 3108059 - protein, 11 aa, Giardia lamblia
ELSAGSDRPAE

SEQ ID NO: 3108060 - protein, 7 aa, Giardia lamblia
ELSARTE

SEQ ID NO: 3108061 - protein, 6 aa, Giardia lamblia
ELSAST

SEQ ID NO: 3108062 - protein, 13 aa, Giardia lamblia
ELSDAGRKIQSEK

SEQ ID NO: 3108063 - protein, 13 aa, Giardia lamblia
ELSDAQRKQAKAA

SEQ ID NO: 3108064 - protein, 9 aa, Giardia lamblia
ELSDKEKQH

SEQ ID NO: 3108065 - protein, 8 aa, Giardia lamblia
ELSDSKDV

SEQ ID NO: 3108066 - protein, 9 aa, Giardia lamblia
ELSDSTKVT

SEQ ID NO: 3108067 - protein, 17 aa, Giardia lamblia
ELSDSTTRSESPSVGWP

SEQ ID NO: 3108068 - protein, 10 aa, Giardia lamblia
ELSEEELKKK

SEQ ID NO: 3108069 - protein, 16 aa, Giardia lamblia
ELSEERNEHGNKAKCV

SEQ ID NO: 3108070 - protein, 5 aa, Giardia lamblia
ELSEP

SEQ ID NO: 3108071 - protein, 9 aa, Giardia lamblia
ELSEREQGI

SEQ ID NO: 3108072 - protein, 15 aa, Giardia lamblia
ELSGRSRDAPADETA

SEQ ID NO: 3108073 - protein, 6 aa, Giardia lamblia
ELSKNN

SEQ ID NO: 3108074 - protein, 8 aa, Giardia lamblia
ELSKSPKV

SEQ ID NO: 3108075 - protein, 8 aa, Giardia lamblia
ELSKTAPS

SEQ ID NO: 3108076 - protein, 4 aa, Giardia lamblia
ELSN

SEQ ID NO: 3108077 - protein, 8 aa, Giardia lamblia
ELSPEQVK

SEQ ID NO: 3108078 - protein, 5 aa, Giardia lamblia
ELSPY

SEQ ID NO: 3108079 - protein, 4 aa, Giardia lamblia
ELSR

SEQ ID NO: 3108080 - protein, 11 aa, Giardia lamblia
ELSRPPSSKEM

SEQ ID NO: 3108081 - protein, 7 aa, Giardia lamblia
ELSRQKD

SEQ ID NO: 3108082 - protein, 14 aa, Giardia lamblia
ELSRTTASVEAART

SEQ ID NO: 3108083 - protein, 8 aa, Giardia lamblia
ELSSDHNG

SEQ ID NO: 3108084 - protein, 28 aa, Giardia lamblia
ELSSDSEDNHSSALSSSGMDSGQGWTQR

SEQ ID NO: 3108085 - protein, 8 aa, Giardia lamblia
ELSSEEDA

SEQ ID NO: 3108086 - protein, 6 aa, Giardia lamblia
ELSSGA

SEQ ID NO: 3108087 - protein, 14 aa, Giardia lamblia
ELSSPTQSEPHPRL

SEQ ID NO: 3108088 - protein, 8 aa, Giardia lamblia
ELSSTSQD

SEQ ID NO: 3108089 - protein, 7 aa, Giardia lamblia
ELSTARD

SEQ ID NO: 3108090 - protein, 7 aa, Giardia lamblia
ELSTEDA

SEQ ID NO: 3108091 - protein, 6 aa, Giardia lamblia
ELSTST

SEQ ID NO: 3108092 - protein, 9 aa, Giardia lamblia
ELTAKSARI

SEQ ID NO: 3108093 - protein, 12 aa, Giardia lamblia
ELTDQHNKKALE

SEQ ID NO: 3108094 - protein, 19 aa, Giardia lamblia
ELTEETSDLSDDASKNYLK

SEQ ID NO: 3108095 - protein, 7 aa, Giardia lamblia
ELTEGEI

SEQ ID NO: 3108096 - protein, 24 aa, Giardia lamblia
ELTESQEKTPAKIPFSSRDTLSDD

SEQ ID NO: 3108097 - protein, 4 aa, Giardia lamblia
ELTK

SEQ ID NO: 3108098 - protein, 7 aa, Giardia lamblia
ELTKPAD

SEQ ID NO: 3108099 - protein, 9 aa, Giardia lamblia
ELTKTQSEI

SEQ ID NO: 3108100 - protein, 6 aa, Giardia lamblia
ELTNAD

SEQ ID NO: 3108101 - protein, 6 aa, Giardia lamblia
ELTPAD

SEQ ID NO: 3108102 - protein, 7 aa, Giardia lamblia
ELTPSSV

SEQ ID NO: 3108103 - protein, 11 aa, Giardia lamblia
ELTQKTKKLTR

SEQ ID NO: 3108104 - protein, 4 aa, Giardia lamblia
ELTR

SEQ ID NO: 3108105 - protein, 11 aa, Giardia lamblia
ELTSDQQRQQR

SEQ ID NO: 3108106 - protein, 11 aa, Giardia lamblia
ELTSQREEASL

SEQ ID NO: 3108107 - protein, 21 aa, Giardia lamblia
ELTTDPPGQRLGTPVRAPMSS

SEQ ID NO: 3108108 - protein, 7 aa, Giardia lamblia
ELTTRKR

SEQ ID NO: 3108109 - protein, 6 aa, Giardia lamblia
ELTTSL

SEQ ID NO: 3108110 - protein, 6 aa, Giardia lamblia
ELYNGG

SEQ ID NO: 3108111 - protein, 5 aa, Giardia lamblia
EMAAA

SEQ ID NO: 3108112 - protein, 14 aa, Giardia lamblia
EMARTQKNKATEHH

SEQ ID NO: 3108113 - protein, 5 aa, Giardia lamblia
EMDGY

SEQ ID NO: 3108114 - protein, 26 aa, Giardia lamblia
EMEEPADANDPAKLRTTYDHDANRGF

SEQ ID NO: 3108115 - protein, 4 aa, Giardia lamblia
EMES

SEQ ID NO: 3108116 - protein, 4 aa, Giardia lamblia
EMGD

SEQ ID NO: 3108117 - protein, 9 aa, Giardia lamblia
EMGNKGLTE

SEQ ID NO: 3108118 - protein, 26 aa, Giardia lamblia
EMGSDDSDDADFEAAPDSSSGEYTED

SEQ ID NO: 3108119 - protein, 10 aa, Giardia lamblia
EMKDKDGNTA

SEQ ID NO: 3108120 - protein, 14 aa, Giardia lamblia
EMKSDNSALPADTY

SEQ ID NO: 3108121 - protein, 54 aa, Giardia lamblia
EMNTASDKLKSQLDSAKSRLQDEQAAKAALQDEVDKAERAVRAGRTAAGSKDKD

SEQ ID NO: 3108122 - protein, 6 aa, Giardia lamblia
EMPSPE

SEQ ID NO: 3108123 - protein, 12 aa, Giardia lamblia
EMQDNNKMTATE

SEQ ID NO: 3108124 - protein, 4 aa, Giardia lamblia
EMQE

SEQ ID NO: 3108125 - protein, 18 aa, Giardia lamblia
EMQNRSRSTGHDADSTEI

SEQ ID NO: 3108126 - protein, 9 aa, Giardia lamblia
EMQSSTGKT

SEQ ID NO: 3108127 - protein, 10 aa, Giardia lamblia
EMRDPLSGTR

SEQ ID NO: 3108128 - protein, 6 aa, Giardia lamblia
EMSPTF

SEQ ID NO: 3108129 - protein, 9 aa, Giardia lamblia
EMSSKNQKQ

SEQ ID NO: 3108130 - protein, 13 aa, Giardia lamblia
EMTAERDDLASNL

SEQ ID NO: 3108131 - protein, 12 aa, Giardia lamblia
ENAAERSRKAAE

SEQ ID NO: 3108132 - protein, 22 aa, Giardia lamblia
ENAARNREDIQNKNREEAASYR

SEQ ID NO: 3108133 - protein, 5 aa, Giardia lamblia
ENAAY

SEQ ID NO: 3108134 - protein, 6 aa, Giardia lamblia
ENAERY

SEQ ID NO: 3108135 - protein, 9 aa, Giardia lamblia
ENAIDTSTR

SEQ ID NO: 3108136 - protein, 9 aa, Giardia lamblia
ENAKGQDRG

SEQ ID NO: 3108137 - protein, 8 aa, Giardia lamblia
ENAQLSDS

SEQ ID NO: 3108138 - protein, 7 aa, Giardia lamblia
ENAQSRL

SEQ ID NO: 3108139 - protein, 10 aa, Giardia lamblia
ENARAREDKV

SEQ ID NO: 3108140 - protein, 17 aa, Giardia lamblia
ENARKFNPAATGAVAGG

SEQ ID NO: 3108141 - protein, 8 aa, Giardia lamblia
ENARLKDE

SEQ ID NO: 3108142 - protein, 7 aa, Giardia lamblia
ENARLKS

SEQ ID NO: 3108143 - protein, 13 aa, Giardia lamblia
ENARQVDKENKRV

SEQ ID NO: 3108144 - protein, 9 aa, Giardia lamblia
ENASFNSDK

SEQ ID NO: 3108145 - protein, 6 aa, Giardia lamblia
ENASKT

SEQ ID NO: 3108146 - protein, 8 aa, Giardia lamblia
ENASLKAT

SEQ ID NO: 3108147 - protein, 6 aa, Giardia lamblia
ENASLR

SEQ ID NO: 3108148 - protein, 14 aa, Giardia lamblia
ENASLRKNTEKSNI

SEQ ID NO: 3108149 - protein, 4 aa, Giardia lamblia
ENAT

SEQ ID NO: 3108150 - protein, 10 aa, Giardia lamblia
ENATDADAPT

SEQ ID NO: 3108151 - protein, 14 aa, Giardia lamblia
ENATELKSANKALS

SEQ ID NO: 3108152 - protein, 7 aa, Giardia lamblia
ENATKEA

SEQ ID NO: 3108153 - protein, 19 aa, Giardia lamblia
ENATTPHHHTDPSSQNVSQ

SEQ ID NO: 3108154 - protein, 6 aa, Giardia lamblia
ENAYSK

SEQ ID NO: 3108155 - protein, 5 aa, Giardia lamblia
ENDAD

SEQ ID NO: 3108156 - protein, 9 aa, Giardia lamblia
ENDAIEPTS

SEQ ID NO: 3108157 - protein, 5 aa, Giardia lamblia
ENDAL

SEQ ID NO: 3108158 - protein, 10 aa, Giardia lamblia
ENDDTESSPI

SEQ ID NO: 3108159 - protein, 8 aa, Giardia lamblia
ENDELGTK

SEQ ID NO: 3108160 - protein, 5 aa, Giardia lamblia
ENDET

SEQ ID NO: 3108161 - protein, 9 aa, Giardia lamblia
ENDGPTTLT

SEQ ID NO: 3108162 - protein, 4 aa, Giardia lamblia
ENDN

SEQ ID NO: 3108163 - protein, 7 aa, Giardia lamblia
ENDNVAL

SEQ ID NO: 3108164 - protein, 9 aa, Giardia lamblia
ENDRSRKTV

SEQ ID NO: 3108165 - protein, 7 aa, Giardia lamblia
ENDRVDG

SEQ ID NO: 3108166 - protein, 13 aa, Giardia lamblia
ENDSGDMPIDEGF

SEQ ID NO: 3108167 - protein, 5 aa, Giardia lamblia
ENDSL

SEQ ID NO: 3108168 - protein, 17 aa, Giardia lamblia
ENDSLKKGAAELDTSSY

SEQ ID NO: 3108169 - protein, 6 aa, Giardia lamblia
ENDSLR

SEQ ID NO: 3108170 - protein, 15 aa, Giardia lamblia
ENDTSRGATGKKNPV

SEQ ID NO: 3108171 - protein, 7 aa, Giardia lamblia
ENEAGEI

SEQ ID NO: 3108172 - protein, 27 aa, Giardia lamblia
ENEECRGASDNQAPSQVDSHSSDEQYR

SEQ ID NO: 3108173 - protein, 5 aa, Giardia lamblia
ENEEL

SEQ ID NO: 3108174 - protein, 6 aa, Giardia lamblia
ENEERL

SEQ ID NO: 3108175 - protein, 16 aa, Giardia lamblia
ENEETSLTSSSDTDVE

SEQ ID NO: 3108176 - protein, 7 aa, Giardia lamblia
ENEGTAV

SEQ ID NO: 3108177 - protein, 7 aa, Giardia lamblia
ENEISTT

SEQ ID NO: 3108178 - protein, 8 aa, Giardia lamblia
ENEKELKT

SEQ ID NO: 3108179 - protein, 6 aa, Giardia lamblia
ENEKLN

SEQ ID NO: 3108180 - protein, 5 aa, Giardia lamblia
ENENL

SEQ ID NO: 3108181 - protein, 6 aa, Giardia lamblia
ENENTD

SEQ ID NO: 3108182 - protein, 8 aa, Giardia lamblia
ENEPLSSV

SEQ ID NO: 3108183 - protein, 31 aa, Giardia lamblia
ENEQRERELRKQTTNYQESVSHTSDTYDDSD

SEQ ID NO: 3108184 - protein, 4 aa, Giardia lamblia
ENER

SEQ ID NO: 3108185 - protein, 8 aa, Giardia lamblia
ENERLDEE

SEQ ID NO: 3108186 - protein, 7 aa, Giardia lamblia
ENERLRK

SEQ ID NO: 3108187 - protein, 13 aa, Giardia lamblia
ENETGLKDACHST

SEQ ID NO: 3108188 - protein, 18 aa, Giardia lamblia
ENETLKKELSERPQHDDS

SEQ ID NO: 3108189 - protein, 7 aa, Giardia lamblia
ENETSIR

SEQ ID NO: 3108190 - protein, 6 aa, Giardia lamblia
ENETTL

SEQ ID NO: 3108191 - protein, 4 aa, Giardia lamblia
ENEY

SEQ ID NO: 3108192 - protein, 5 aa, Giardia lamblia
ENFGA

SEQ ID NO: 3108193 - protein, 15 aa, Giardia lamblia
ENFQSSTEKGNDQSL

SEQ ID NO: 3108194 - protein, 12 aa, Giardia lamblia
ENFSSDSRSPAL

SEQ ID NO: 3108195 - protein, 6 aa, Giardia lamblia
ENFTPE

SEQ ID NO: 3108196 - protein, 9 aa, Giardia lamblia
ENGASFTTS

SEQ ID NO: 3108197 - protein, 13 aa, Giardia lamblia
ENGDAPTMAPPKM

SEQ ID NO: 3108198 - protein, 21 aa, Giardia lamblia
ENGDEIPPPVQKEPTPPPVAA

SEQ ID NO: 3108199 - protein, 32 aa, Giardia lamblia
ENGDNNGKSGPAAKADKSSSRGPSKKQARGSL

SEQ ID NO: 3108200 - protein, 14 aa, Giardia lamblia
ENGGARVYKPDERK

SEQ ID NO: 3108201 - protein, 8 aa, Giardia lamblia
ENGGSENL

SEQ ID NO: 3108202 - protein, 26 aa, Giardia lamblia
ENGHEEDTDQNTKGDSTTGGSTETTF

SEQ ID NO: 3108203 - protein, 5 aa, Giardia lamblia
ENGHS

SEQ ID NO: 3108204 - protein, 6 aa, Giardia lamblia
ENGHTE

SEQ ID NO: 3108205 - protein, 5 aa, Giardia lamblia
ENGIE

SEQ ID NO: 3108206 - protein, 5 aa, Giardia lamblia
ENGKT

SEQ ID NO: 3108207 - protein, 9 aa, Giardia lamblia
ENGLQDKNG

SEQ ID NO: 3108208 - protein, 9 aa, Giardia lamblia
ENGNFEEDE

SEQ ID NO: 3108209 - protein, 5 aa, Giardia lamblia
ENGNI

SEQ ID NO: 3108210 - protein, 7 aa, Giardia lamblia
ENGNITP

SEQ ID NO: 3108211 - protein, 4 aa, Giardia lamblia
ENGP

SEQ ID NO: 3108212 - protein, 5 aa, Giardia lamblia
ENGQN

SEQ ID NO: 3108213 - protein, 4 aa, Giardia lamblia
ENGS

SEQ ID NO: 3108214 - protein, 8 aa, Giardia lamblia
ENGSAEAA

SEQ ID NO: 3108215 - protein, 8 aa, Giardia lamblia
ENGSDDCV

SEQ ID NO: 3108216 - protein, 16 aa, Giardia lamblia
ENGSTDTDADPPCPEK

SEQ ID NO: 3108217 - protein, 8 aa, Giardia lamblia
ENGTGKST

SEQ ID NO: 3108218 - protein, 13 aa, Giardia lamblia
ENGTPANREKTEN

SEQ ID NO: 3108219 - protein, 5 aa, Giardia lamblia
ENGTT

SEQ ID NO: 3108220 - protein, 10 aa, Giardia lamblia
ENGVRDSNRK

SEQ ID NO: 3108221 - protein, 9 aa, Giardia lamblia
ENHEGDTVE

SEQ ID NO: 3108222 - protein, 6 aa, Giardia lamblia
ENHGNS

SEQ ID NO: 3108223 - protein, 23 aa, Giardia lamblia
ENHGTHGNPTHVNQAHTDKKHSV

SEQ ID NO: 3108224 - protein, 8 aa, Giardia lamblia
ENHNHGGE

SEQ ID NO: 3108225 - protein, 6 aa, Giardia lamblia
ENHSRH

SEQ ID NO: 3108226 - protein, 8 aa, Giardia lamblia
ENIPSSQK

SEQ ID NO: 3108227 - protein, 9 aa, Giardia lamblia
ENIPTADGS

SEQ ID NO: 3108228 - protein, 9 aa, Giardia lamblia
ENISQTAIA

SEQ ID NO: 3108229 - protein, 14 aa, Giardia lamblia
ENITPDDTLQKCPQ

SEQ ID NO: 3108230 - protein, 15 aa, Giardia lamblia
ENKAASSNARYAAPE

SEQ ID NO: 3108231 - protein, 10 aa, Giardia lamblia
ENKASINEDI

SEQ ID NO: 3108232 - protein, 6 aa, Giardia lamblia
ENKDIR

SEQ ID NO: 3108233 - protein, 7 aa, Giardia lamblia
ENKEEHK

SEQ ID NO: 3108234 - protein, 5 aa, Giardia lamblia
ENKGL

SEQ ID NO: 3108235 - protein, 9 aa, Giardia lamblia
ENKGTRDSI

SEQ ID NO: 3108236 - protein, 4 aa, Giardia lamblia
ENKI

SEQ ID NO: 3108237 - protein, 100 aa, Giardia lamblia
ENKLRGKELNPNADGKKKGSDSGAENGDDDADDKDDKDDKGEKKKKDKDKDDDDSEDGAKRSERRSRRGSMRGEDHSTKDEKRKKTDSHRNSKRFGGDFH

SEQ ID NO: 3108238 - protein, 35 aa, Giardia lamblia
ENKNKNNDEDAETVETDKRKAKSRPYKQKYETSEH

SEQ ID NO: 3108239 - protein, 11 aa, Giardia lamblia
ENKNTGPSRSA

SEQ ID NO: 3108240 - protein, 5 aa, Giardia lamblia
ENKRL

SEQ ID NO: 3108241 - protein, 8 aa, Giardia lamblia
ENKRNGTM

SEQ ID NO: 3108242 - protein, 8 aa, Giardia lamblia
ENKSTETN

SEQ ID NO: 3108243 - protein, 8 aa, Giardia lamblia
ENKSTSLD

SEQ ID NO: 3108244 - protein, 9 aa, Giardia lamblia
ENLDKDEHA

SEQ ID NO: 3108245 - protein, 13 aa, Giardia lamblia
ENLDPSRLARGDP

SEQ ID NO: 3108246 - protein, 7 aa, Giardia lamblia
ENLEDAT

SEQ ID NO: 3108247 - protein, 5 aa, Giardia lamblia
ENLEK

SEQ ID NO: 3108248 - protein, 9 aa, Giardia lamblia
ENLGSDAAE

SEQ ID NO: 3108249 - protein, 5 aa, Giardia lamblia
ENLPG

SEQ ID NO: 3108250 - protein, 7 aa, Giardia lamblia
ENLPQGC

SEQ ID NO: 3108251 - protein, 4 aa, Giardia lamblia
ENLQ

SEQ ID NO: 3108252 - protein, 13 aa, Giardia lamblia
ENLREDSSLSGTL

SEQ ID NO: 3108253 - protein, 12 aa, Giardia lamblia
ENLRKDGTMETG

SEQ ID NO: 3108254 - protein, 8 aa, Giardia lamblia
ENLSAKGR

SEQ ID NO: 3108255 - protein, 19 aa, Giardia lamblia
ENLSSPSSKVEDRDPSNEL

SEQ ID NO: 3108256 - protein, 7 aa, Giardia lamblia
ENMNNSY

SEQ ID NO: 3108257 - protein, 10 aa, Giardia lamblia
ENNANDKPAV

SEQ ID NO: 3108258 - protein, 9 aa, Giardia lamblia
ENNAQGPEN

SEQ ID NO: 3108259 - protein, 5 aa, Giardia lamblia
ENNCA

SEQ ID NO: 3108260 - protein, 4 aa, Giardia lamblia
ENND

SEQ ID NO: 3108261 - protein, 9 aa, Giardia lamblia
ENNEKKETA

SEQ ID NO: 3108262 - protein, 8 aa, Giardia lamblia
ENNESKIQ

SEQ ID NO: 3108263 - protein, 10 aa, Giardia lamblia
ENNESLANQY

SEQ ID NO: 3108264 - protein, 10 aa, Giardia lamblia
ENNEYQQHSA

SEQ ID NO: 3108265 - protein, 12 aa, Giardia lamblia
ENNHQPKLKPLP

SEQ ID NO: 3108266 - protein, 7 aa, Giardia lamblia
ENNNADA

SEQ ID NO: 3108267 - protein, 10 aa, Giardia lamblia
ENNPQNSKIT

SEQ ID NO: 3108268 - protein, 4 aa, Giardia lamblia
ENNS

SEQ ID NO: 3108269 - protein, 5 aa, Giardia lamblia
ENNSI

SEQ ID NO: 3108270 - protein, 35 aa, Giardia lamblia
ENNSKNNTPGSRVSSHSPRRQSPKPSANGSPKGPI

SEQ ID NO: 3108271 - protein, 8 aa, Giardia lamblia
ENNSYKAK

SEQ ID NO: 3108272 - protein, 15 aa, Giardia lamblia
ENNYKPEKASNRREK

SEQ ID NO: 3108273 - protein, 6 aa, Giardia lamblia
ENPAST

SEQ ID NO: 3108274 - protein, 12 aa, Giardia lamblia
ENPAVRGAYGQQ

SEQ ID NO: 3108275 - protein, 8 aa, Giardia lamblia
ENPGPGAY

SEQ ID NO: 3108276 - protein, 5 aa, Giardia lamblia
ENPIP

SEQ ID NO: 3108277 - protein, 20 aa, Giardia lamblia
ENPKYKQRAVSSSQPLTEED

SEQ ID NO: 3108278 - protein, 11 aa, Giardia lamblia
ENPMPSIPSEV

SEQ ID NO: 3108279 - protein, 6 aa, Giardia lamblia
ENPNIS

SEQ ID NO: 3108280 - protein, 5 aa, Giardia lamblia
ENPPL

SEQ ID NO: 3108281 - protein, 5 aa, Giardia lamblia
ENPQC

SEQ ID NO: 3108282 - protein, 5 aa, Giardia lamblia
ENPRC

SEQ ID NO: 3108283 - protein, 6 aa, Giardia lamblia
ENPRGI

SEQ ID NO: 3108284 - protein, 9 aa, Giardia lamblia
ENPSDASVY

SEQ ID NO: 3108285 - protein, 23 aa, Giardia lamblia
ENPSEDTAQQGSVQHTPQQTHQT

SEQ ID NO: 3108286 - protein, 9 aa, Giardia lamblia
ENPSGPAKK

SEQ ID NO: 3108287 - protein, 4 aa, Giardia lamblia
ENPT

SEQ ID NO: 3108288 - protein, 9 aa, Giardia lamblia
ENPTDENGI

SEQ ID NO: 3108289 - protein, 5 aa, Giardia lamblia
ENPVT

SEQ ID NO: 3108290 - protein, 9 aa, Giardia lamblia
ENQEPTAAN

SEQ ID NO: 3108291 - protein, 5 aa, Giardia lamblia
ENQET

SEQ ID NO: 3108292 - protein, 7 aa, Giardia lamblia
ENQGQEH

SEQ ID NO: 3108293 - protein, 5 aa, Giardia lamblia
ENQIE

SEQ ID NO: 3108294 - protein, 5 aa, Giardia lamblia
ENQLQ

SEQ ID NO: 3108295 - protein, 4 aa, Giardia lamblia
ENQM

SEQ ID NO: 3108296 - protein, 26 aa, Giardia lamblia
ENQQRQSQQSTDELTAAREKIKEARN

SEQ ID NO: 3108297 - protein, 9 aa, Giardia lamblia
ENQSNESSL

SEQ ID NO: 3108298 - protein, 13 aa, Giardia lamblia
ENQSSYVVTIFSM

SEQ ID NO: 3108299 - protein, 11 aa, Giardia lamblia
ENQSVHRQNKE

SEQ ID NO: 3108300 - protein, 6 aa, Giardia lamblia
ENQTLR

SEQ ID NO: 3108301 - protein, 10 aa, Giardia lamblia
ENRDYAASNQ

SEQ ID NO: 3108302 - protein, 15 aa, Giardia lamblia
ENRGASASVSSCTND

SEQ ID NO: 3108303 - protein, 11 aa, Giardia lamblia
ENRIPNAQGTT

SEQ ID NO: 3108304 - protein, 15 aa, Giardia lamblia
ENRKSDLRRRCPSGK

SEQ ID NO: 3108305 - protein, 7 aa, Giardia lamblia
ENRPAIK

SEQ ID NO: 3108306 - protein, 8 aa, Giardia lamblia
ENRRKEKI

SEQ ID NO: 3108307 - protein, 10 aa, Giardia lamblia
ENRRPPATKC

SEQ ID NO: 3108308 - protein, 11 aa, Giardia lamblia
ENRSVNRDGRT

SEQ ID NO: 3108309 - protein, 4 aa, Giardia lamblia
ENRT

SEQ ID NO: 3108310 - protein, 14 aa, Giardia lamblia
ENRTFKSSAKSLAQ

SEQ ID NO: 3108311 - protein, 13 aa, Giardia lamblia
ENRTPRGSVASDA

SEQ ID NO: 3108312 - protein, 7 aa, Giardia lamblia
ENRVSAK

SEQ ID NO: 3108313 - protein, 7 aa, Giardia lamblia
ENSDEDE

SEQ ID NO: 3108314 - protein, 8 aa, Giardia lamblia
ENSDFESI

SEQ ID NO: 3108315 - protein, 6 aa, Giardia lamblia
ENSEVP

SEQ ID NO: 3108316 - protein, 9 aa, Giardia lamblia
ENSFRNDEG

SEQ ID NO: 3108317 - protein, 4 aa, Giardia lamblia
ENSI

SEQ ID NO: 3108318 - protein, 7 aa, Giardia lamblia
ENSIFDP

SEQ ID NO: 3108319 - protein, 10 aa, Giardia lamblia
ENSKQYMKNP

SEQ ID NO: 3108320 - protein, 10 aa, Giardia lamblia
ENSKSSKSLL

SEQ ID NO: 3108321 - protein, 4 aa, Giardia lamblia
ENSL

SEQ ID NO: 3108322 - protein, 8 aa, Giardia lamblia
ENSNKEAA

SEQ ID NO: 3108323 - protein, 10 aa, Giardia lamblia
ENSQKKADKA

SEQ ID NO: 3108324 - protein, 8 aa, Giardia lamblia
ENSQNPRR

SEQ ID NO: 3108325 - protein, 16 aa, Giardia lamblia
ENSRAARTMRSEEIEQ

SEQ ID NO: 3108326 - protein, 6 aa, Giardia lamblia
ENSRKR

SEQ ID NO: 3108327 - protein, 5 aa, Giardia lamblia
ENSRV

SEQ ID NO: 3108328 - protein, 7 aa, Giardia lamblia
ENSSAEA

SEQ ID NO: 3108329 - protein, 16 aa, Giardia lamblia
ENSSKHESAVNDKYKR

SEQ ID NO: 3108330 - protein, 9 aa, Giardia lamblia
ENSSNETIK

SEQ ID NO: 3108331 - protein, 11 aa, Giardia lamblia
ENSTRTEQDPL

SEQ ID NO: 3108332 - protein, 6 aa, Giardia lamblia
ENSTTD

SEQ ID NO: 3108333 - protein, 9 aa, Giardia lamblia
ENSYQSFGA

SEQ ID NO: 3108334 - protein, 13 aa, Giardia lamblia
ENTAQVGDRPLSN

SEQ ID NO: 3108335 - protein, 11 aa, Giardia lamblia
ENTASANDFTS

SEQ ID NO: 3108336 - protein, 15 aa, Giardia lamblia
ENTDAPNSTNHDNIP

SEQ ID NO: 3108337 - protein, 13 aa, Giardia lamblia
ENTETGMTNKAGY

SEQ ID NO: 3108338 - protein, 13 aa, Giardia lamblia
ENTGKFTHEESTS

SEQ ID NO: 3108339 - protein, 5 aa, Giardia lamblia
ENTNL

SEQ ID NO: 3108340 - protein, 7 aa, Giardia lamblia
ENTPGYV

SEQ ID NO: 3108341 - protein, 8 aa, Giardia lamblia
ENTPTSYS

SEQ ID NO: 3108342 - protein, 6 aa, Giardia lamblia
ENTQGA

SEQ ID NO: 3108343 - protein, 12 aa, Giardia lamblia
ENTSAPSASATF

SEQ ID NO: 3108344 - protein, 7 aa, Giardia lamblia
ENTSLSS

SEQ ID NO: 3108345 - protein, 8 aa, Giardia lamblia
ENTSSGVS

SEQ ID NO: 3108346 - protein, 15 aa, Giardia lamblia
ENTSSQSNNSIPLQA

SEQ ID NO: 3108347 - protein, 15 aa, Giardia lamblia
ENTVATQREKQSRRS

SEQ ID NO: 3108348 - protein, 6 aa, Giardia lamblia
ENVADS

SEQ ID NO: 3108349 - protein, 4 aa, Giardia lamblia
ENVD

SEQ ID NO: 3108350 - protein, 11 aa, Giardia lamblia
ENVDPATQEIT

SEQ ID NO: 3108351 - protein, 8 aa, Giardia lamblia
ENVETSAA

SEQ ID NO: 3108352 - protein, 5 aa, Giardia lamblia
ENVGL

SEQ ID NO: 3108353 - protein, 18 aa, Giardia lamblia
ENVPPETVSVPDNTLDPA

SEQ ID NO: 3108354 - protein, 8 aa, Giardia lamblia
ENVQGGQR

SEQ ID NO: 3108355 - protein, 8 aa, Giardia lamblia
ENVSKTHD

SEQ ID NO: 3108356 - protein, 9 aa, Giardia lamblia
ENVSLQSGH

SEQ ID NO: 3108357 - protein, 5 aa, Giardia lamblia
ENVTG

SEQ ID NO: 3108358 - protein, 49 aa, Giardia lamblia
ENYNKRSANKSAKRQSQQDRRGPRSNMQSDSEQHEDDYASNNDKNPVKS

SEQ ID NO: 3108359 - protein, 11 aa, Giardia lamblia
ENYPENGIPDI

SEQ ID NO: 3108360 - protein, 12 aa, Giardia lamblia
ENYQHNAQSSFR

SEQ ID NO: 3108361 - protein, 17 aa, Giardia lamblia
ENYRGQTVTRSSLTPAP

SEQ ID NO: 3108362 - protein, 10 aa, Giardia lamblia
ENYSPKEDNA

SEQ ID NO: 3108363 - protein, 5 aa, Giardia lamblia
EPADE

SEQ ID NO: 3108364 - protein, 7 aa, Giardia lamblia
EPADSKT

SEQ ID NO: 3108365 - protein, 4 aa, Giardia lamblia
EPAG

SEQ ID NO: 3108366 - protein, 12 aa, Giardia lamblia
EPAGDGVHPEGA

SEQ ID NO: 3108367 - protein, 15 aa, Giardia lamblia
EPAGEKPTGSGRAVS

SEQ ID NO: 3108368 - protein, 8 aa, Giardia lamblia
EPANPKDL

SEQ ID NO: 3108369 - protein, 9 aa, Giardia lamblia
EPAPPSEFS

SEQ ID NO: 3108370 - protein, 8 aa, Giardia lamblia
EPASKVNK

SEQ ID NO: 3108371 - protein, 10 aa, Giardia lamblia
EPDASDFPSR

SEQ ID NO: 3108372 - protein, 5 aa, Giardia lamblia
EPDAV

SEQ ID NO: 3108373 - protein, 7 aa, Giardia lamblia
EPDDETS

SEQ ID NO: 3108374 - protein, 7 aa, Giardia lamblia
EPDDPDY

SEQ ID NO: 3108375 - protein, 14 aa, Giardia lamblia
EPDDVAADEEGTLR

SEQ ID NO: 3108376 - protein, 12 aa, Giardia lamblia
EPDEPLNISKLM

SEQ ID NO: 3108377 - protein, 6 aa, Giardia lamblia
EPDKSS

SEQ ID NO: 3108378 - protein, 10 aa, Giardia lamblia
EPDNKQEAAN

SEQ ID NO: 3108379 - protein, 5 aa, Giardia lamblia
EPDNL

SEQ ID NO: 3108380 - protein, 10 aa, Giardia lamblia
EPDQESNMRP

SEQ ID NO: 3108381 - protein, 13 aa, Giardia lamblia
EPDQLRKKATPYY

SEQ ID NO: 3108382 - protein, 8 aa, Giardia lamblia
EPDSHQPN

SEQ ID NO: 3108383 - protein, 11 aa, Giardia lamblia
EPDTPPTHYEP

SEQ ID NO: 3108384 - protein, 14 aa, Giardia lamblia
EPDTQDYGEMTQET

SEQ ID NO: 3108385 - protein, 6 aa, Giardia lamblia
EPEDTN

SEQ ID NO: 3108386 - protein, 11 aa, Giardia lamblia
EPEESIPKTFG

SEQ ID NO: 3108387 - protein, 13 aa, Giardia lamblia
EPEGADDNRPNCI

SEQ ID NO: 3108388 - protein, 14 aa, Giardia lamblia
EPENLKKDHPNSDK

SEQ ID NO: 3108389 - protein, 12 aa, Giardia lamblia
EPENRSRPPEPM

SEQ ID NO: 3108390 - protein, 18 aa, Giardia lamblia
EPENSKEGVPFPGPSFTG

SEQ ID NO: 3108391 - protein, 12 aa, Giardia lamblia
EPENSSDPLAKS

SEQ ID NO: 3108392 - protein, 9 aa, Giardia lamblia
EPEPAKDAF

SEQ ID NO: 3108393 - protein, 12 aa, Giardia lamblia
EPEPATSATGAE

SEQ ID NO: 3108394 - protein, 5 aa, Giardia lamblia
EPERE

SEQ ID NO: 3108395 - protein, 6 aa, Giardia lamblia
EPERSE

SEQ ID NO: 3108396 - protein, 4 aa, Giardia lamblia
EPES

SEQ ID NO: 3108397 - protein, 7 aa, Giardia lamblia
EPESEVI

SEQ ID NO: 3108398 - protein, 15 aa, Giardia lamblia
EPESNDFKQAKYGAS

SEQ ID NO: 3108399 - protein, 25 aa, Giardia lamblia
EPEYGDNDYDSNYCNKRKKSRVAEE

SEQ ID NO: 3108400 - protein, 9 aa, Giardia lamblia
EPGKEADLT

SEQ ID NO: 3108401 - protein, 5 aa, Giardia lamblia
EPGLK

SEQ ID NO: 3108402 - protein, 34 aa, Giardia lamblia
EPGPDSCSPDSFDARAASEKMRTDKDRQGRRTEL

SEQ ID NO: 3108403 - protein, 32 aa, Giardia lamblia
EPGPQTRLNRQGAPKDFKISEKRNTAFPSSTN

SEQ ID NO: 3108404 - protein, 9 aa, Giardia lamblia
EPGSAPYST

SEQ ID NO: 3108405 - protein, 7 aa, Giardia lamblia
EPGSPCG

SEQ ID NO: 3108406 - protein, 7 aa, Giardia lamblia
EPGTDSV

SEQ ID NO: 3108407 - protein, 9 aa, Giardia lamblia
EPGYDTATG

SEQ ID NO: 3108408 - protein, 4 aa, Giardia lamblia
EPHE

SEQ ID NO: 3108409 - protein, 6 aa, Giardia lamblia
EPHIEP

SEQ ID NO: 3108410 - protein, 6 aa, Giardia lamblia
EPHRPR

SEQ ID NO: 3108411 - protein, 11 aa, Giardia lamblia
EPHTPLDQNSL

SEQ ID NO: 3108412 - protein, 14 aa, Giardia lamblia
EPIAPQPDLPTNDY

SEQ ID NO: 3108413 - protein, 5 aa, Giardia lamblia
EPIES

SEQ ID NO: 3108414 - protein, 8 aa, Giardia lamblia
EPIGGDSC

SEQ ID NO: 3108415 - protein, 9 aa, Giardia lamblia
EPIGSDSAI

SEQ ID NO: 3108416 - protein, 23 aa, Giardia lamblia
EPIKQPKRKDYEKKLSKDSSNIA

SEQ ID NO: 3108417 - protein, 4 aa, Giardia lamblia
EPIP

SEQ ID NO: 3108418 - protein, 5 aa, Giardia lamblia
EPIPG

SEQ ID NO: 3108419 - protein, 14 aa, Giardia lamblia
EPIPISSSKPDFRG

SEQ ID NO: 3108420 - protein, 7 aa, Giardia lamblia
EPISPSR

SEQ ID NO: 3108421 - protein, 8 aa, Giardia lamblia
EPKEEAQR

SEQ ID NO: 3108422 - protein, 8 aa, Giardia lamblia
EPKFTETG

SEQ ID NO: 3108423 - protein, 10 aa, Giardia lamblia
EPKGTETITS

SEQ ID NO: 3108424 - protein, 5 aa, Giardia lamblia
EPKKP

SEQ ID NO: 3108425 - protein, 8 aa, Giardia lamblia
EPKNAAKV

SEQ ID NO: 3108426 - protein, 13 aa, Giardia lamblia
EPKPFTEQDDGRS

SEQ ID NO: 3108427 - protein, 8 aa, Giardia lamblia
EPKPGVES

SEQ ID NO: 3108428 - protein, 6 aa, Giardia lamblia
EPKREE

SEQ ID NO: 3108429 - protein, 20 aa, Giardia lamblia
EPKRERLAQAEQTLKTQQEA

SEQ ID NO: 3108430 - protein, 14 aa, Giardia lamblia
EPKRNQNSASFPPV

SEQ ID NO: 3108431 - protein, 5 aa, Giardia lamblia
EPKSV

SEQ ID NO: 3108432 - protein, 8 aa, Giardia lamblia
EPKTTEEA

SEQ ID NO: 3108433 - protein, 14 aa, Giardia lamblia
EPKYQPDDRSGQIE

SEQ ID NO: 3108434 - protein, 56 aa, Giardia lamblia
EPLETTPANSSDIKERVPPNESETTRSSQPSGHRKRSSRKHSSASKARMTESDSEI

SEQ ID NO: 3108435 - protein, 4 aa, Giardia lamblia
EPLG

SEQ ID NO: 3108436 - protein, 14 aa, Giardia lamblia
EPLKTQSKHAIDTS

SEQ ID NO: 3108437 - protein, 13 aa, Giardia lamblia
EPLPEEATLSTPN

SEQ ID NO: 3108438 - protein, 13 aa, Giardia lamblia
EPLPTPKASEDMP

SEQ ID NO: 3108439 - protein, 5 aa, Giardia lamblia
EPLRD

SEQ ID NO: 3108440 - protein, 13 aa, Giardia lamblia
EPLRNANPNPDAS

SEQ ID NO: 3108441 - protein, 11 aa, Giardia lamblia
EPLTEAEEKTA

SEQ ID NO: 3108442 - protein, 53 aa, Giardia lamblia
EPMGENADENEDDLTTNDIGGAPPDAASKQARANSRPRSRMKASGVSDTEDLS

SEQ ID NO: 3108443 - protein, 11 aa, Giardia lamblia
EPNDHRGYRSR

SEQ ID NO: 3108444 - protein, 5 aa, Giardia lamblia
EPNED

SEQ ID NO: 3108445 - protein, 9 aa, Giardia lamblia
EPNGTEAPR

SEQ ID NO: 3108446 - protein, 7 aa, Giardia lamblia
EPNISAS

SEQ ID NO: 3108447 - protein, 6 aa, Giardia lamblia
EPNKEV

SEQ ID NO: 3108448 - protein, 8 aa, Giardia lamblia
EPNPSTVT

SEQ ID NO: 3108449 - protein, 5 aa, Giardia lamblia
EPPAE

SEQ ID NO: 3108450 - protein, 16 aa, Giardia lamblia
EPPAERTRKLEDGSEV

SEQ ID NO: 3108451 - protein, 7 aa, Giardia lamblia
EPPAGSR

SEQ ID NO: 3108452 - protein, 7 aa, Giardia lamblia
EPPAPER

SEQ ID NO: 3108453 - protein, 8 aa, Giardia lamblia
EPPDQQGL

SEQ ID NO: 3108454 - protein, 7 aa, Giardia lamblia
EPPETVA

SEQ ID NO: 3108455 - protein, 4 aa, Giardia lamblia
EPPH

SEQ ID NO: 3108456 - protein, 9 aa, Giardia lamblia
EPPKPKTTY

SEQ ID NO: 3108457 - protein, 21 aa, Giardia lamblia
EPPLGSSDYDKKEQTALESGP

SEQ ID NO: 3108458 - protein, 6 aa, Giardia lamblia
EPPLTT

SEQ ID NO: 3108459 - protein, 4 aa, Giardia lamblia
EPPP

SEQ ID NO: 3108460 - protein, 8 aa, Giardia lamblia
EPPPDRSL

SEQ ID NO: 3108461 - protein, 7 aa, Giardia lamblia
EPPPHKT

SEQ ID NO: 3108462 - protein, 7 aa, Giardia lamblia
EPPQKKL

SEQ ID NO: 3108463 - protein, 6 aa, Giardia lamblia
EPPSDY

SEQ ID NO: 3108464 - protein, 14 aa, Giardia lamblia
EPPVGSDRDKRDSK

SEQ ID NO: 3108465 - protein, 4 aa, Giardia lamblia
EPQA

SEQ ID NO: 3108466 - protein, 5 aa, Giardia lamblia
EPQLQ

SEQ ID NO: 3108467 - protein, 7 aa, Giardia lamblia
EPQPFKE

SEQ ID NO: 3108468 - protein, 14 aa, Giardia lamblia
EPQSAFSDSLQRAS

SEQ ID NO: 3108469 - protein, 6 aa, Giardia lamblia
EPQTCA

SEQ ID NO: 3108470 - protein, 6 aa, Giardia lamblia
EPQTTT

SEQ ID NO: 3108471 - protein, 19 aa, Giardia lamblia
EPQYSSNTLSGDISSTQLQ

SEQ ID NO: 3108472 - protein, 4 aa, Giardia lamblia
EPRA

SEQ ID NO: 3108473 - protein, 8 aa, Giardia lamblia
EPRASYSH

SEQ ID NO: 3108474 - protein, 12 aa, Giardia lamblia
EPRDNPAPSFPP

SEQ ID NO: 3108475 - protein, 4 aa, Giardia lamblia
EPRE

SEQ ID NO: 3108476 - protein, 6 aa, Giardia lamblia
EPREPS

SEQ ID NO: 3108477 - protein, 5 aa, Giardia lamblia
EPREV

SEQ ID NO: 3108478 - protein, 10 aa, Giardia lamblia
EPRLKGAPHI

SEQ ID NO: 3108479 - protein, 5 aa, Giardia lamblia
EPRMP

SEQ ID NO: 3108480 - protein, 14 aa, Giardia lamblia
EPRMSRRERERAGL

SEQ ID NO: 3108481 - protein, 9 aa, Giardia lamblia
EPRPKRKRI

SEQ ID NO: 3108482 - protein, 13 aa, Giardia lamblia
EPRSDMSFSDSDY

SEQ ID NO: 3108483 - protein, 10 aa, Giardia lamblia
EPRTRPLGAR

SEQ ID NO: 3108484 - protein, 13 aa, Giardia lamblia
EPRTYTRSRSQGL

SEQ ID NO: 3108485 - protein, 10 aa, Giardia lamblia
EPRVRETAEE

SEQ ID NO: 3108486 - protein, 5 aa, Giardia lamblia
EPRVS

SEQ ID NO: 3108487 - protein, 9 aa, Giardia lamblia
EPSAAEKER

SEQ ID NO: 3108488 - protein, 17 aa, Giardia lamblia
EPSAHSDAFSSATPSTS

SEQ ID NO: 3108489 - protein, 7 aa, Giardia lamblia
EPSEKTA

SEQ ID NO: 3108490 - protein, 10 aa, Giardia lamblia
EPSIQDKGFS

SEQ ID NO: 3108491 - protein, 7 aa, Giardia lamblia
EPSKEER

SEQ ID NO: 3108492 - protein, 14 aa, Giardia lamblia
EPSLKHSSVPRSVD

SEQ ID NO: 3108493 - protein, 4 aa, Giardia lamblia
EPSM

SEQ ID NO: 3108494 - protein, 9 aa, Giardia lamblia
EPSNQCNGE

SEQ ID NO: 3108495 - protein, 11 aa, Giardia lamblia
EPSNVSTTGMN

SEQ ID NO: 3108496 - protein, 4 aa, Giardia lamblia
EPSP

SEQ ID NO: 3108497 - protein, 10 aa, Giardia lamblia
EPSPDDRPTV

SEQ ID NO: 3108498 - protein, 7 aa, Giardia lamblia
EPSPDER

SEQ ID NO: 3108499 - protein, 8 aa, Giardia lamblia
EPSPGIHS

SEQ ID NO: 3108500 - protein, 8 aa, Giardia lamblia
EPSPKEER

SEQ ID NO: 3108501 - protein, 5 aa, Giardia lamblia
EPSTE

SEQ ID NO: 3108502 - protein, 4 aa, Giardia lamblia
EPSV

SEQ ID NO: 3108503 - protein, 13 aa, Giardia lamblia
EPSVGTDNPKPKK

SEQ ID NO: 3108504 - protein, 4 aa, Giardia lamblia
EPTA

SEQ ID NO: 3108505 - protein, 5 aa, Giardia lamblia
EPTDA

SEQ ID NO: 3108506 - protein, 7 aa, Giardia lamblia
EPTEEGF

SEQ ID NO: 3108507 - protein, 13 aa, Giardia lamblia
EPTEKIGSSILNI

SEQ ID NO: 3108508 - protein, 4 aa, Giardia lamblia
EPTG

SEQ ID NO: 3108509 - protein, 14 aa, Giardia lamblia
EPTHSDGISLTTGE

SEQ ID NO: 3108510 - protein, 6 aa, Giardia lamblia
EPTIPS

SEQ ID NO: 3108511 - protein, 4 aa, Giardia lamblia
EPTK

SEQ ID NO: 3108512 - protein, 31 aa, Giardia lamblia
EPTPAALQEPEEPAPPQPPTPGRSDSVSADI

SEQ ID NO: 3108513 - protein, 11 aa, Giardia lamblia
EPTPRSTQVQR

SEQ ID NO: 3108514 - protein, 8 aa, Giardia lamblia
EPTQFGTI

SEQ ID NO: 3108515 - protein, 4 aa, Giardia lamblia
EPTS

SEQ ID NO: 3108516 - protein, 6 aa, Giardia lamblia
EPTTDF

SEQ ID NO: 3108517 - protein, 9 aa, Giardia lamblia
EPTTGLDPV

SEQ ID NO: 3108518 - protein, 5 aa, Giardia lamblia
EPTVK

SEQ ID NO: 3108519 - protein, 5 aa, Giardia lamblia
EPVAQ

SEQ ID NO: 3108520 - protein, 14 aa, Giardia lamblia
EPVASTSTVPGTAQ

SEQ ID NO: 3108521 - protein, 16 aa, Giardia lamblia
EPVERDGKGPREPSRK

SEQ ID NO: 3108522 - protein, 14 aa, Giardia lamblia
EPVGDSDGTHGGTK

SEQ ID NO: 3108523 - protein, 6 aa, Giardia lamblia
EPVGQV

SEQ ID NO: 3108524 - protein, 6 aa, Giardia lamblia
EPVKGS

SEQ ID NO: 3108525 - protein, 11 aa, Giardia lamblia
EPVNPQPEAGL

SEQ ID NO: 3108526 - protein, 5 aa, Giardia lamblia
EPVQT

SEQ ID NO: 3108527 - protein, 11 aa, Giardia lamblia
EPVSGTPRGFQ

SEQ ID NO: 3108528 - protein, 5 aa, Giardia lamblia
EPVTR

SEQ ID NO: 3108529 - protein, 8 aa, Giardia lamblia
EPYAEPTV

SEQ ID NO: 3108530 - protein, 5 aa, Giardia lamblia
EPYNN

SEQ ID NO: 3108531 - protein, 8 aa, Giardia lamblia
EPYPDTCT

SEQ ID NO: 3108532 - protein, 4 aa, Giardia lamblia
EPYR

SEQ ID NO: 3108533 - protein, 8 aa, Giardia lamblia
EPYRTEDE

SEQ ID NO: 3108534 - protein, 24 aa, Giardia lamblia
EPYSRSPSDDSDNSGTNQELDREQ

SEQ ID NO: 3108535 - protein, 11 aa, Giardia lamblia
EPYSSQQALGS

SEQ ID NO: 3108536 - protein, 16 aa, Giardia lamblia
EPYTRTLPSGQEESGI

SEQ ID NO: 3108537 - protein, 6 aa, Giardia lamblia
EQADEQ

SEQ ID NO: 3108538 - protein, 17 aa, Giardia lamblia
EQADQRKGRAGREGPGQ

SEQ ID NO: 3108539 - protein, 4 aa, Giardia lamblia
EQAE

SEQ ID NO: 3108540 - protein, 7 aa, Giardia lamblia
EQAEKRE

SEQ ID NO: 3108541 - protein, 15 aa, Giardia lamblia
EQAEQAADGSSPSAP

SEQ ID NO: 3108542 - protein, 9 aa, Giardia lamblia
EQAGETNKR

SEQ ID NO: 3108543 - protein, 6 aa, Giardia lamblia
EQAHNP

SEQ ID NO: 3108544 - protein, 10 aa, Giardia lamblia
EQAKTSPLRK

SEQ ID NO: 3108545 - protein, 4 aa, Giardia lamblia
EQAL

SEQ ID NO: 3108546 - protein, 16 aa, Giardia lamblia
EQAPPRPKSVIPQESP

SEQ ID NO: 3108547 - protein, 11 aa, Giardia lamblia
EQAQRRSTDSL

SEQ ID NO: 3108548 - protein, 7 aa, Giardia lamblia
EQARADL

SEQ ID NO: 3108549 - protein, 5 aa, Giardia lamblia
EQARE

SEQ ID NO: 3108550 - protein, 10 aa, Giardia lamblia
EQAREMKTEA

SEQ ID NO: 3108551 - protein, 16 aa, Giardia lamblia
EQARKRSESDKRNKQL

SEQ ID NO: 3108552 - protein, 6 aa, Giardia lamblia
EQASNN

SEQ ID NO: 3108553 - protein, 8 aa, Giardia lamblia
EQASSREA

SEQ ID NO: 3108554 - protein, 20 aa, Giardia lamblia
EQCESEAPLATDLPGHKGPA

SEQ ID NO: 3108555 - protein, 23 aa, Giardia lamblia
EQCGKSATSANGVTTDRATTPVT

SEQ ID NO: 3108556 - protein, 8 aa, Giardia lamblia
EQDATISN

SEQ ID NO: 3108557 - protein, 12 aa, Giardia lamblia
EQDDARAQDLSG

SEQ ID NO: 3108558 - protein, 7 aa, Giardia lamblia
EQDDPHF

SEQ ID NO: 3108559 - protein, 9 aa, Giardia lamblia
EQDDTIVEQ

SEQ ID NO: 3108560 - protein, 8 aa, Giardia lamblia
EQDGCTDD

SEQ ID NO: 3108561 - protein, 17 aa, Giardia lamblia
EQDGSKSASRSEAVNDS

SEQ ID NO: 3108562 - protein, 5 aa, Giardia lamblia
EQDLA

SEQ ID NO: 3108563 - protein, 7 aa, Giardia lamblia
EQDPKRI

SEQ ID NO: 3108564 - protein, 11 aa, Giardia lamblia
EQDPNSEPSPV

SEQ ID NO: 3108565 - protein, 7 aa, Giardia lamblia
EQDQEDP

SEQ ID NO: 3108566 - protein, 7 aa, Giardia lamblia
EQDQGRV

SEQ ID NO: 3108567 - protein, 14 aa, Giardia lamblia
EQDSCSRLKRETED

SEQ ID NO: 3108568 - protein, 19 aa, Giardia lamblia
EQDVKTPEYATSSPSIGTV

SEQ ID NO: 3108569 - protein, 4 aa, Giardia lamblia
EQEA

SEQ ID NO: 3108570 - protein, 39 aa, Giardia lamblia
EQEAFSPRGVGKGSTSRSGRRQEEPSPWKPLGGRGGKTF

SEQ ID NO: 3108571 - protein, 8 aa, Giardia lamblia
EQEAKSHH

SEQ ID NO: 3108572 - protein, 21 aa, Giardia lamblia
EQEDKLKSTIADEYARQQTTD

SEQ ID NO: 3108573 - protein, 24 aa, Giardia lamblia
EQEEKKSKKGLGKGKKGGAPATSE

SEQ ID NO: 3108574 - protein, 7 aa, Giardia lamblia
EQEEREF

SEQ ID NO: 3108575 - protein, 6 aa, Giardia lamblia
EQEETI

SEQ ID NO: 3108576 - protein, 13 aa, Giardia lamblia
EQEGQMRNTEGNT

SEQ ID NO: 3108577 - protein, 7 aa, Giardia lamblia
EQEGVEF

SEQ ID NO: 3108578 - protein, 16 aa, Giardia lamblia
EQEHQRRQEEEQERLR

SEQ ID NO: 3108579 - protein, 8 aa, Giardia lamblia
EQEKKRQA

SEQ ID NO: 3108580 - protein, 6 aa, Giardia lamblia
EQEKKY

SEQ ID NO: 3108581 - protein, 5 aa, Giardia lamblia
EQEKL

SEQ ID NO: 3108582 - protein, 18 aa, Giardia lamblia
EQEKQDAEKYSNAARDME

SEQ ID NO: 3108583 - protein, 4 aa, Giardia lamblia
EQEL

SEQ ID NO: 3108584 - protein, 12 aa, Giardia lamblia
EQELDDKEREYW

SEQ ID NO: 3108585 - protein, 13 aa, Giardia lamblia
EQELKRKDDEIRR

SEQ ID NO: 3108586 - protein, 6 aa, Giardia lamblia
EQELPR

SEQ ID NO: 3108587 - protein, 5 aa, Giardia lamblia
EQENR

SEQ ID NO: 3108588 - protein, 11 aa, Giardia lamblia
EQEPADTSGRV

SEQ ID NO: 3108589 - protein, 6 aa, Giardia lamblia
EQEPIP

SEQ ID NO: 3108590 - protein, 7 aa, Giardia lamblia
EQEPRPM

SEQ ID NO: 3108591 - protein, 12 aa, Giardia lamblia
EQEPSSQEEMPV

SEQ ID NO: 3108592 - protein, 9 aa, Giardia lamblia
EQEQGTMQD

SEQ ID NO: 3108593 - protein, 15 aa, Giardia lamblia
EQEQPISSQSTRSTG

SEQ ID NO: 3108594 - protein, 8 aa, Giardia lamblia
EQERAARY

SEQ ID NO: 3108595 - protein, 6 aa, Giardia lamblia
EQERAK

SEQ ID NO: 3108596 - protein, 6 aa, Giardia lamblia
EQESDE

SEQ ID NO: 3108597 - protein, 7 aa, Giardia lamblia
EQESRPA

SEQ ID NO: 3108598 - protein, 17 aa, Giardia lamblia
EQESSSNIGSSFTSSSN

SEQ ID NO: 3108599 - protein, 4 aa, Giardia lamblia
EQET

SEQ ID NO: 3108600 - protein, 5 aa, Giardia lamblia
EQFEA

SEQ ID NO: 3108601 - protein, 21 aa, Giardia lamblia
EQFGNATTASLQQELDAATKT

SEQ ID NO: 3108602 - protein, 6 aa, Giardia lamblia
EQFPGA

SEQ ID NO: 3108603 - protein, 20 aa, Giardia lamblia
EQGAEEARRAAEAQDKHNSM

SEQ ID NO: 3108604 - protein, 6 aa, Giardia lamblia
EQGAEI

SEQ ID NO: 3108605 - protein, 5 aa, Giardia lamblia
EQGAG

SEQ ID NO: 3108606 - protein, 6 aa, Giardia lamblia
EQGEEI

SEQ ID NO: 3108607 - protein, 5 aa, Giardia lamblia
EQGEI

SEQ ID NO: 3108608 - protein, 9 aa, Giardia lamblia
EQGEKELPS

SEQ ID NO: 3108609 - protein, 6 aa, Giardia lamblia
EQGFTK

SEQ ID NO: 3108610 - protein, 11 aa, Giardia lamblia
EQGIQDNEGTT

SEQ ID NO: 3108611 - protein, 5 aa, Giardia lamblia
EQGKN

SEQ ID NO: 3108612 - protein, 12 aa, Giardia lamblia
EQGLQDTAGHTA

SEQ ID NO: 3108613 - protein, 6 aa, Giardia lamblia
EQGLTQ

SEQ ID NO: 3108614 - protein, 5 aa, Giardia lamblia
EQGNK

SEQ ID NO: 3108615 - protein, 8 aa, Giardia lamblia
EQGNPNSV

SEQ ID NO: 3108616 - protein, 24 aa, Giardia lamblia
EQGPVTGPNTIDSLPESQGISEHG

SEQ ID NO: 3108617 - protein, 5 aa, Giardia lamblia
EQGRR

SEQ ID NO: 3108618 - protein, 8 aa, Giardia lamblia
EQGSAEEE

SEQ ID NO: 3108619 - protein, 10 aa, Giardia lamblia
EQGSISKDEH

SEQ ID NO: 3108620 - protein, 6 aa, Giardia lamblia
EQGTEI

SEQ ID NO: 3108621 - protein, 5 aa, Giardia lamblia
EQGTR

SEQ ID NO: 3108622 - protein, 7 aa, Giardia lamblia
EQGWDQS

SEQ ID NO: 3108623 - protein, 6 aa, Giardia lamblia
EQGYED

SEQ ID NO: 3108624 - protein, 26 aa, Giardia lamblia
EQHKEAETALSDPETEMTPEERARKE

SEQ ID NO: 3108625 - protein, 8 aa, Giardia lamblia
EQHLPNPN

SEQ ID NO: 3108626 - protein, 5 aa, Giardia lamblia
EQIAG

SEQ ID NO: 3108627 - protein, 10 aa, Giardia lamblia
EQIDDKQREI

SEQ ID NO: 3108628 - protein, 5 aa, Giardia lamblia
EQIDP

SEQ ID NO: 3108629 - protein, 7 aa, Giardia lamblia
EQIERTG

SEQ ID NO: 3108630 - protein, 11 aa, Giardia lamblia
EQIGRSPAQDR

SEQ ID NO: 3108631 - protein, 6 aa, Giardia lamblia
EQIPPV

SEQ ID NO: 3108632 - protein, 4 aa, Giardia lamblia
EQIQ

SEQ ID NO: 3108633 - protein, 20 aa, Giardia lamblia
EQITGTQKETKEDEVASTQQ

SEQ ID NO: 3108634 - protein, 9 aa, Giardia lamblia
EQKAPDSAR

SEQ ID NO: 3108635 - protein, 7 aa, Giardia lamblia
EQKATDE

SEQ ID NO: 3108636 - protein, 6 aa, Giardia lamblia
EQKDQI

SEQ ID NO: 3108637 - protein, 8 aa, Giardia lamblia
EQKDRDIS

SEQ ID NO: 3108638 - protein, 6 aa, Giardia lamblia
EQKERY

SEQ ID NO: 3108639 - protein, 7 aa, Giardia lamblia
EQKGLKR

SEQ ID NO: 3108640 - protein, 11 aa, Giardia lamblia
EQKIAQKQAPF

SEQ ID NO: 3108641 - protein, 8 aa, Giardia lamblia
EQKKKYTK

SEQ ID NO: 3108642 - protein, 8 aa, Giardia lamblia
EQKKQDID

SEQ ID NO: 3108643 - protein, 23 aa, Giardia lamblia
EQKPVGSTVYTDEPGASSEDLDR

SEQ ID NO: 3108644 - protein, 10 aa, Giardia lamblia
EQKRKEDTRA

SEQ ID NO: 3108645 - protein, 22 aa, Giardia lamblia
EQKRMQAEGDAVGGDGKKGKSA

SEQ ID NO: 3108646 - protein, 10 aa, Giardia lamblia
EQLADSTASM

SEQ ID NO: 3108647 - protein, 8 aa, Giardia lamblia
EQLAERRE

SEQ ID NO: 3108648 - protein, 8 aa, Giardia lamblia
EQLAGTEK

SEQ ID NO: 3108649 - protein, 11 aa, Giardia lamblia
EQLATQGTVPA

SEQ ID NO: 3108650 - protein, 11 aa, Giardia lamblia
EQLDEKERDTV

SEQ ID NO: 3108651 - protein, 4 aa, Giardia lamblia
EQLE

SEQ ID NO: 3108652 - protein, 13 aa, Giardia lamblia
EQLEQSSKDLAQL

SEQ ID NO: 3108653 - protein, 6 aa, Giardia lamblia
EQLERE

SEQ ID NO: 3108654 - protein, 10 aa, Giardia lamblia
EQLKTQEKQL

SEQ ID NO: 3108655 - protein, 5 aa, Giardia lamblia
EQLNA

SEQ ID NO: 3108656 - protein, 20 aa, Giardia lamblia
EQLQSKDAAFTEEQSARDAL

SEQ ID NO: 3108657 - protein, 4 aa, Giardia lamblia
EQLS

SEQ ID NO: 3108658 - protein, 10 aa, Giardia lamblia
EQLSAASAKK

SEQ ID NO: 3108659 - protein, 6 aa, Giardia lamblia
EQLSET

SEQ ID NO: 3108660 - protein, 5 aa, Giardia lamblia
EQLSK

SEQ ID NO: 3108661 - protein, 9 aa, Giardia lamblia
EQMGSKNTE

SEQ ID NO: 3108662 - protein, 24 aa, Giardia lamblia
EQMSASRRKEHNALRRRGKDADEM

SEQ ID NO: 3108663 - protein, 6 aa, Giardia lamblia
EQMSTD

SEQ ID NO: 3108664 - protein, 4 aa, Giardia lamblia
EQNE

SEQ ID NO: 3108665 - protein, 6 aa, Giardia lamblia
EQNEQL

SEQ ID NO: 3108666 - protein, 8 aa, Giardia lamblia
EQNESQVT

SEQ ID NO: 3108667 - protein, 7 aa, Giardia lamblia
EQNGGAR

SEQ ID NO: 3108668 - protein, 11 aa, Giardia lamblia
EQNGRPGRRQA

SEQ ID NO: 3108669 - protein, 44 aa, Giardia lamblia
EQNLPQHKSPHVKSKGSKQVSQSRDSSSSDSKKSTSAPTRSASV

SEQ ID NO: 3108670 - protein, 6 aa, Giardia lamblia
EQNQSL

SEQ ID NO: 3108671 - protein, 28 aa, Giardia lamblia
EQNRRAIAERRDAQERARHEEVAEEKMQ

SEQ ID NO: 3108672 - protein, 10 aa, Giardia lamblia
EQNRSKIDSS

SEQ ID NO: 3108673 - protein, 4 aa, Giardia lamblia
EQNS

SEQ ID NO: 3108674 - protein, 23 aa, Giardia lamblia
EQNTADPTNEESAPKKKRKLTKQ

SEQ ID NO: 3108675 - protein, 8 aa, Giardia lamblia
EQNVSPKE

SEQ ID NO: 3108676 - protein, 6 aa, Giardia lamblia
EQPANL

SEQ ID NO: 3108677 - protein, 6 aa, Giardia lamblia
EQPARS

SEQ ID NO: 3108678 - protein, 4 aa, Giardia lamblia
EQPE

SEQ ID NO: 3108679 - protein, 7 aa, Giardia lamblia
EQPEDGT

SEQ ID NO: 3108680 - protein, 16 aa, Giardia lamblia
EQPEETYEETHSPSDS

SEQ ID NO: 3108681 - protein, 35 aa, Giardia lamblia
EQPEKKRSKSSKSSRKEKKRHEDEGMKDRRVSKIK

SEQ ID NO: 3108682 - protein, 5 aa, Giardia lamblia
EQPFS

SEQ ID NO: 3108683 - protein, 7 aa, Giardia lamblia
EQPGKSH

SEQ ID NO: 3108684 - protein, 7 aa, Giardia lamblia
EQPGTGV

SEQ ID NO: 3108685 - protein, 7 aa, Giardia lamblia
EQPKMPS

SEQ ID NO: 3108686 - protein, 8 aa, Giardia lamblia
EQPPLKEL

SEQ ID NO: 3108687 - protein, 10 aa, Giardia lamblia
EQPPSEDPQL

SEQ ID NO: 3108688 - protein, 6 aa, Giardia lamblia
EQPQAF

SEQ ID NO: 3108689 - protein, 18 aa, Giardia lamblia
EQPQPPYSPTSEDYGALG

SEQ ID NO: 3108690 - protein, 9 aa, Giardia lamblia
EQPQQEVPQ

SEQ ID NO: 3108691 - protein, 10 aa, Giardia lamblia
EQPRSQLSTS

SEQ ID NO: 3108692 - protein, 4 aa, Giardia lamblia
EQPS

SEQ ID NO: 3108693 - protein, 7 aa, Giardia lamblia
EQPSFTT

SEQ ID NO: 3108694 - protein, 5 aa, Giardia lamblia
EQPSI

SEQ ID NO: 3108695 - protein, 7 aa, Giardia lamblia
EQPSIEG

SEQ ID NO: 3108696 - protein, 6 aa, Giardia lamblia
EQPTAI

SEQ ID NO: 3108697 - protein, 8 aa, Giardia lamblia
EQPTSAPS

SEQ ID NO: 3108698 - protein, 7 aa, Giardia lamblia
EQPTWPS

SEQ ID NO: 3108699 - protein, 5 aa, Giardia lamblia
EQPVA

SEQ ID NO: 3108700 - protein, 5 aa, Giardia lamblia
EQPYQ

SEQ ID NO: 3108701 - protein, 10 aa, Giardia lamblia
EQQAHKEDQK

SEQ ID NO: 3108702 - protein, 10 aa, Giardia lamblia
EQQAKGETIS

SEQ ID NO: 3108703 - protein, 12 aa, Giardia lamblia
EQQASDSKERTQ

SEQ ID NO: 3108704 - protein, 6 aa, Giardia lamblia
EQQEEL

SEQ ID NO: 3108705 - protein, 7 aa, Giardia lamblia
EQQEPQY

SEQ ID NO: 3108706 - protein, 5 aa, Giardia lamblia
EQQHS

SEQ ID NO: 3108707 - protein, 11 aa, Giardia lamblia
EQQIKDSQGRT

SEQ ID NO: 3108708 - protein, 22 aa, Giardia lamblia
EQQKSIDKRAKQEGPASTSGSK

SEQ ID NO: 3108709 - protein, 17 aa, Giardia lamblia
EQQNEIREQQNAAQVSQ

SEQ ID NO: 3108710 - protein, 6 aa, Giardia lamblia
EQQNTI

SEQ ID NO: 3108711 - protein, 21 aa, Giardia lamblia
EQQPSAPNTGATPQSVPSSHV

SEQ ID NO: 3108712 - protein, 4 aa, Giardia lamblia
EQQQ

SEQ ID NO: 3108713 - protein, 7 aa, Giardia lamblia
EQQQRAV

SEQ ID NO: 3108714 - protein, 18 aa, Giardia lamblia
EQQQSHTKAEVNQEENRA

SEQ ID NO: 3108715 - protein, 5 aa, Giardia lamblia
EQQRK

SEQ ID NO: 3108716 - protein, 7 aa, Giardia lamblia
EQQRSAE

SEQ ID NO: 3108717 - protein, 11 aa, Giardia lamblia
EQQSGSREALK

SEQ ID NO: 3108718 - protein, 8 aa, Giardia lamblia
EQQSSKHQ

SEQ ID NO: 3108719 - protein, 14 aa, Giardia lamblia
EQRAAQNMDPDGYH

SEQ ID NO: 3108720 - protein, 8 aa, Giardia lamblia
EQRDQDAV

SEQ ID NO: 3108721 - protein, 10 aa, Giardia lamblia
EQRDTLTGQE

SEQ ID NO: 3108722 - protein, 4 aa, Giardia lamblia
EQRE

SEQ ID NO: 3108723 - protein, 29 aa, Giardia lamblia
EQREGQRPQDPALRRPQQREVPPQGRSPS

SEQ ID NO: 3108724 - protein, 20 aa, Giardia lamblia
EQREQQQEGEEEGDGMDDSL

SEQ ID NO: 3108725 - protein, 18 aa, Giardia lamblia
EQRERQNNLKSFKDGKTP

SEQ ID NO: 3108726 - protein, 5 aa, Giardia lamblia
EQRGT

SEQ ID NO: 3108727 - protein, 7 aa, Giardia lamblia
EQRKAKK

SEQ ID NO: 3108728 - protein, 13 aa, Giardia lamblia
EQRKENEEAVSAE

SEQ ID NO: 3108729 - protein, 7 aa, Giardia lamblia
EQRLKQS

SEQ ID NO: 3108730 - protein, 8 aa, Giardia lamblia
EQRPPREA

SEQ ID NO: 3108731 - protein, 29 aa, Giardia lamblia
EQRPTAASSGSQSKPAAIGSSGNSNNGQA

SEQ ID NO: 3108732 - protein, 5 aa, Giardia lamblia
EQRQR

SEQ ID NO: 3108733 - protein, 5 aa, Giardia lamblia
EQRRD

SEQ ID NO: 3108734 - protein, 4 aa, Giardia lamblia
EQRS

SEQ ID NO: 3108735 - protein, 6 aa, Giardia lamblia
EQRSKL

SEQ ID NO: 3108736 - protein, 16 aa, Giardia lamblia
EQRSQRAQEKKRQEVE

SEQ ID NO: 3108737 - protein, 5 aa, Giardia lamblia
EQRYK

SEQ ID NO: 3108738 - protein, 7 aa, Giardia lamblia
EQSATPT

SEQ ID NO: 3108739 - protein, 7 aa, Giardia lamblia
EQSCKDS

SEQ ID NO: 3108740 - protein, 10 aa, Giardia lamblia
EQSDNGSVAT

SEQ ID NO: 3108741 - protein, 8 aa, Giardia lamblia
EQSDNQEI

SEQ ID NO: 3108742 - protein, 5 aa, Giardia lamblia
EQSES

SEQ ID NO: 3108743 - protein, 5 aa, Giardia lamblia
EQSFR

SEQ ID NO: 3108744 - protein, 4 aa, Giardia lamblia
EQSG

SEQ ID NO: 3108745 - protein, 5 aa, Giardia lamblia
EQSGD

SEQ ID NO: 3108746 - protein, 18 aa, Giardia lamblia
EQSGMELDETKRKEKKTL

SEQ ID NO: 3108747 - protein, 7 aa, Giardia lamblia
EQSGSSR

SEQ ID NO: 3108748 - protein, 11 aa, Giardia lamblia
EQSGTKRSRLS

SEQ ID NO: 3108749 - protein, 32 aa, Giardia lamblia
EQSGYAPTVPHSPSNSALPGGSGADVPRPLST

SEQ ID NO: 3108750 - protein, 11 aa, Giardia lamblia
EQSIEEYSQTS

SEQ ID NO: 3108751 - protein, 11 aa, Giardia lamblia
EQSINGSDDLR

SEQ ID NO: 3108752 - protein, 12 aa, Giardia lamblia
EQSKERSANKAC

SEQ ID NO: 3108753 - protein, 9 aa, Giardia lamblia
EQSNSSDVS

SEQ ID NO: 3108754 - protein, 11 aa, Giardia lamblia
EQSQKEASAFQ

SEQ ID NO: 3108755 - protein, 11 aa, Giardia lamblia
EQSQRQRTQGT

SEQ ID NO: 3108756 - protein, 9 aa, Giardia lamblia
EQSQSRKYQ

SEQ ID NO: 3108757 - protein, 8 aa, Giardia lamblia
EQSRRDDL

SEQ ID NO: 3108758 - protein, 5 aa, Giardia lamblia
EQSSI

SEQ ID NO: 3108759 - protein, 5 aa, Giardia lamblia
EQSSK

SEQ ID NO: 3108760 - protein, 5 aa, Giardia lamblia
EQSSQ

SEQ ID NO: 3108761 - protein, 11 aa, Giardia lamblia
EQSTKNQGDKA

SEQ ID NO: 3108762 - protein, 4 aa, Giardia lamblia
EQSY

SEQ ID NO: 3108763 - protein, 6 aa, Giardia lamblia
EQSYMP

SEQ ID NO: 3108764 - protein, 6 aa, Giardia lamblia
EQTAAT

SEQ ID NO: 3108765 - protein, 10 aa, Giardia lamblia
EQTAKTIRDV

SEQ ID NO: 3108766 - protein, 13 aa, Giardia lamblia
EQTAWDPEALTES

SEQ ID NO: 3108767 - protein, 6 aa, Giardia lamblia
EQTCSS

SEQ ID NO: 3108768 - protein, 6 aa, Giardia lamblia
EQTDPA

SEQ ID NO: 3108769 - protein, 4 aa, Giardia lamblia
EQTE

SEQ ID NO: 3108770 - protein, 6 aa, Giardia lamblia
EQTGAL

SEQ ID NO: 3108771 - protein, 10 aa, Giardia lamblia
EQTGNPAIDA

SEQ ID NO: 3108772 - protein, 10 aa, Giardia lamblia
EQTKSAETRR

SEQ ID NO: 3108773 - protein, 14 aa, Giardia lamblia
EQTLDKKKKTKKRK

SEQ ID NO: 3108774 - protein, 7 aa, Giardia lamblia
EQTQKQL

SEQ ID NO: 3108775 - protein, 5 aa, Giardia lamblia
EQTRL

SEQ ID NO: 3108776 - protein, 7 aa, Giardia lamblia
EQTRPGW

SEQ ID NO: 3108777 - protein, 10 aa, Giardia lamblia
EQTSATMDSQ

SEQ ID NO: 3108778 - protein, 8 aa, Giardia lamblia
EQTSENEA

SEQ ID NO: 3108779 - protein, 10 aa, Giardia lamblia
EQTSKNNASL

SEQ ID NO: 3108780 - protein, 8 aa, Giardia lamblia
EQTTANLE

SEQ ID NO: 3108781 - protein, 6 aa, Giardia lamblia
EQTTDK

SEQ ID NO: 3108782 - protein, 10 aa, Giardia lamblia
EQVNEKTREI

SEQ ID NO: 3108783 - protein, 31 aa, Giardia lamblia
EQVNSQQQQQHTEQRQADESSTKLAERTEKL

SEQ ID NO: 3108784 - protein, 15 aa, Giardia lamblia
EQVPASKKRERTREM

SEQ ID NO: 3108785 - protein, 17 aa, Giardia lamblia
EQYAEKAVQSGEDFSEH

SEQ ID NO: 3108786 - protein, 6 aa, Giardia lamblia
EQYEGM

SEQ ID NO: 3108787 - protein, 7 aa, Giardia lamblia
EQYSQGR

SEQ ID NO: 3108788 - protein, 20 aa, Giardia lamblia
ERAADSEKELKKKADYQREV

SEQ ID NO: 3108789 - protein, 28 aa, Giardia lamblia
ERAAKDNPAPPEVDSHGHKKAAPNPSAT

SEQ ID NO: 3108790 - protein, 7 aa, Giardia lamblia
ERAATNG

SEQ ID NO: 3108791 - protein, 8 aa, Giardia lamblia
ERAEAAGL

SEQ ID NO: 3108792 - protein, 24 aa, Giardia lamblia
ERAGNKQAEKDVHSYATGKEATQV

SEQ ID NO: 3108793 - protein, 15 aa, Giardia lamblia
ERAKESAALADKEEK

SEQ ID NO: 3108794 - protein, 10 aa, Giardia lamblia
ERAKKLTTQQ

SEQ ID NO: 3108795 - protein, 8 aa, Giardia lamblia
ERAKNVKN

SEQ ID NO: 3108796 - protein, 9 aa, Giardia lamblia
ERAKTRALS

SEQ ID NO: 3108797 - protein, 4 aa, Giardia lamblia
ERAL

SEQ ID NO: 3108798 - protein, 9 aa, Giardia lamblia
ERANDGSTH

SEQ ID NO: 3108799 - protein, 15 aa, Giardia lamblia
ERANSATGEKDVQSP

SEQ ID NO: 3108800 - protein, 20 aa, Giardia lamblia
ERAQTGTLSTRDTELGESYT

SEQ ID NO: 3108801 - protein, 4 aa, Giardia lamblia
ERAR

SEQ ID NO: 3108802 - protein, 13 aa, Giardia lamblia
ERARAAKGMNRKQ

SEQ ID NO: 3108803 - protein, 21 aa, Giardia lamblia
ERARELKKEYQSLGKANKEDA

SEQ ID NO: 3108804 - protein, 20 aa, Giardia lamblia
ERARKRKERNEGGRSRAHTG

SEQ ID NO: 3108805 - protein, 10 aa, Giardia lamblia
ERASESAKQY

SEQ ID NO: 3108806 - protein, 9 aa, Giardia lamblia
ERASNYTDR

SEQ ID NO: 3108807 - protein, 9 aa, Giardia lamblia
ERATHEHAT

SEQ ID NO: 3108808 - protein, 6 aa, Giardia lamblia
ERATRS

SEQ ID NO: 3108809 - protein, 4 aa, Giardia lamblia
ERCG

SEQ ID NO: 3108810 - protein, 11 aa, Giardia lamblia
ERCNSDDYTAD

SEQ ID NO: 3108811 - protein, 7 aa, Giardia lamblia
ERDANGM

SEQ ID NO: 3108812 - protein, 5 aa, Giardia lamblia
ERDDL

SEQ ID NO: 3108813 - protein, 6 aa, Giardia lamblia
ERDELQ

SEQ ID NO: 3108814 - protein, 7 aa, Giardia lamblia
ERDERSK

SEQ ID NO: 3108815 - protein, 17 aa, Giardia lamblia
ERDGLAGSTGATTGHRT

SEQ ID NO: 3108816 - protein, 7 aa, Giardia lamblia
ERDGRSD

SEQ ID NO: 3108817 - protein, 5 aa, Giardia lamblia
ERDHA

SEQ ID NO: 3108818 - protein, 7 aa, Giardia lamblia
ERDLGSQ

SEQ ID NO: 3108819 - protein, 8 aa, Giardia lamblia
ERDNDGLS

SEQ ID NO: 3108820 - protein, 11 aa, Giardia lamblia
ERDPESQESRK

SEQ ID NO: 3108821 - protein, 8 aa, Giardia lamblia
ERDPSGYT

SEQ ID NO: 3108822 - protein, 6 aa, Giardia lamblia
ERDRTQ

SEQ ID NO: 3108823 - protein, 9 aa, Giardia lamblia
ERDSLRQEK

SEQ ID NO: 3108824 - protein, 7 aa, Giardia lamblia
ERDTARL

SEQ ID NO: 3108825 - protein, 7 aa, Giardia lamblia
EREADVD

SEQ ID NO: 3108826 - protein, 10 aa, Giardia lamblia
EREAREKTHE

SEQ ID NO: 3108827 - protein, 10 aa, Giardia lamblia
EREATSVRNT

SEQ ID NO: 3108828 - protein, 6 aa, Giardia lamblia
EREDKA

SEQ ID NO: 3108829 - protein, 11 aa, Giardia lamblia
EREDTCARNNG

SEQ ID NO: 3108830 - protein, 11 aa, Giardia lamblia
EREDYTAAASD

SEQ ID NO: 3108831 - protein, 30 aa, Giardia lamblia
EREEALERTDRPKSSIRYPPPPSSSSKDAH

SEQ ID NO: 3108832 - protein, 11 aa, Giardia lamblia
EREEHGCTDEQ

SEQ ID NO: 3108833 - protein, 9 aa, Giardia lamblia
EREEQHDRD

SEQ ID NO: 3108834 - protein, 4 aa, Giardia lamblia
EREG

SEQ ID NO: 3108835 - protein, 8 aa, Giardia lamblia
EREGHPRP

SEQ ID NO: 3108836 - protein, 7 aa, Giardia lamblia
EREIASQ

SEQ ID NO: 3108837 - protein, 4 aa, Giardia lamblia
EREK

SEQ ID NO: 3108838 - protein, 5 aa, Giardia lamblia
EREKK

SEQ ID NO: 3108839 - protein, 41 aa, Giardia lamblia
EREKKEHARITKEHEKTADNLASYAAEKAGELSEPFMEPSG

SEQ ID NO: 3108840 - protein, 8 aa, Giardia lamblia
ERENSGLR

SEQ ID NO: 3108841 - protein, 10 aa, Giardia lamblia
EREPKIVENN

SEQ ID NO: 3108842 - protein, 24 aa, Giardia lamblia
EREQEERVARRESLRKRQADERDS

SEQ ID NO: 3108843 - protein, 9 aa, Giardia lamblia
EREQHDEVE

SEQ ID NO: 3108844 - protein, 5 aa, Giardia lamblia
EREQK

SEQ ID NO: 3108845 - protein, 9 aa, Giardia lamblia
EREQQRQKG

SEQ ID NO: 3108846 - protein, 5 aa, Giardia lamblia
EREQS

SEQ ID NO: 3108847 - protein, 18 aa, Giardia lamblia
EREQSDFNGTRVNGREMQ

SEQ ID NO: 3108848 - protein, 4 aa, Giardia lamblia
ERER

SEQ ID NO: 3108849 - protein, 11 aa, Giardia lamblia
EREREEDRATI

SEQ ID NO: 3108850 - protein, 14 aa, Giardia lamblia
ERERERTQRGLAPP

SEQ ID NO: 3108851 - protein, 6 aa, Giardia lamblia
ERERES

SEQ ID NO: 3108852 - protein, 15 aa, Giardia lamblia
ERERGRSAPRPASSL

SEQ ID NO: 3108853 - protein, 5 aa, Giardia lamblia
ERERK

SEQ ID NO: 3108854 - protein, 6 aa, Giardia lamblia
ERERYK

SEQ ID NO: 3108855 - protein, 9 aa, Giardia lamblia
ERESSSIRQ

SEQ ID NO: 3108856 - protein, 8 aa, Giardia lamblia
ERESVPKS

SEQ ID NO: 3108857 - protein, 5 aa, Giardia lamblia
ERETG

SEQ ID NO: 3108858 - protein, 10 aa, Giardia lamblia
EREVSSAKDA

SEQ ID NO: 3108859 - protein, 6 aa, Giardia lamblia
ERFADQ

SEQ ID NO: 3108860 - protein, 20 aa, Giardia lamblia
ERFAKEDEKIREGQKARNEL

SEQ ID NO: 3108861 - protein, 11 aa, Giardia lamblia
ERFASAGENKT

SEQ ID NO: 3108862 - protein, 12 aa, Giardia lamblia
ERFEESASRELA

SEQ ID NO: 3108863 - protein, 5 aa, Giardia lamblia
ERGDA

SEQ ID NO: 3108864 - protein, 6 aa, Giardia lamblia
ERGDVD

SEQ ID NO: 3108865 - protein, 7 aa, Giardia lamblia
ERGEPRP

SEQ ID NO: 3108866 - protein, 13 aa, Giardia lamblia
ERGFPVSSYSKED

SEQ ID NO: 3108867 - protein, 5 aa, Giardia lamblia
ERGHT

SEQ ID NO: 3108868 - protein, 10 aa, Giardia lamblia
ERGIQDKSGM

SEQ ID NO: 3108869 - protein, 7 aa, Giardia lamblia
ERGIRDH

SEQ ID NO: 3108870 - protein, 13 aa, Giardia lamblia
ERGKDVKGDQDHS

SEQ ID NO: 3108871 - protein, 10 aa, Giardia lamblia
ERGLKDKSGW

SEQ ID NO: 3108872 - protein, 9 aa, Giardia lamblia
ERGLQDKNG

SEQ ID NO: 3108873 - protein, 9 aa, Giardia lamblia
ERGMQESDG

SEQ ID NO: 3108874 - protein, 5 aa, Giardia lamblia
ERGNA

SEQ ID NO: 3108875 - protein, 5 aa, Giardia lamblia
ERGNE

SEQ ID NO: 3108876 - protein, 4 aa, Giardia lamblia
ERGP

SEQ ID NO: 3108877 - protein, 7 aa, Giardia lamblia
ERGPGGE

SEQ ID NO: 3108878 - protein, 12 aa, Giardia lamblia
ERGREHDKAAKK

SEQ ID NO: 3108879 - protein, 11 aa, Giardia lamblia
ERGRRNKNSRT

SEQ ID NO: 3108880 - protein, 5 aa, Giardia lamblia
ERGRS

SEQ ID NO: 3108881 - protein, 21 aa, Giardia lamblia
ERGRTASEAQRTLSNCLFRFP

SEQ ID NO: 3108882 - protein, 8 aa, Giardia lamblia
ERGSKTKF

SEQ ID NO: 3108883 - protein, 7 aa, Giardia lamblia
ERGTSIS

SEQ ID NO: 3108884 - protein, 10 aa, Giardia lamblia
ERGVTTAGEA

SEQ ID NO: 3108885 - protein, 4 aa, Giardia lamblia
ERGY

SEQ ID NO: 3108886 - protein, 6 aa, Giardia lamblia
ERHASS

SEQ ID NO: 3108887 - protein, 7 aa, Giardia lamblia
ERHATKR

SEQ ID NO: 3108888 - protein, 6 aa, Giardia lamblia
ERHEKP

SEQ ID NO: 3108889 - protein, 4 aa, Giardia lamblia
ERHG

SEQ ID NO: 3108890 - protein, 8 aa, Giardia lamblia
ERHGSIED

SEQ ID NO: 3108891 - protein, 5 aa, Giardia lamblia
ERHGV

SEQ ID NO: 3108892 - protein, 13 aa, Giardia lamblia
ERHNGRPIPNDKR

SEQ ID NO: 3108893 - protein, 9 aa, Giardia lamblia
ERHRETANR

SEQ ID NO: 3108894 - protein, 6 aa, Giardia lamblia
ERHRTT

SEQ ID NO: 3108895 - protein, 5 aa, Giardia lamblia
ERHTT

SEQ ID NO: 3108896 - protein, 7 aa, Giardia lamblia
ERINSAK

SEQ ID NO: 3108897 - protein, 12 aa, Giardia lamblia
ERIRDPNQLNRE

SEQ ID NO: 3108898 - protein, 6 aa, Giardia lamblia
ERISNT

SEQ ID NO: 3108899 - protein, 10 aa, Giardia lamblia
ERKAEDRARE

SEQ ID NO: 3108900 - protein, 15 aa, Giardia lamblia
ERKAQESLEAQENRR

SEQ ID NO: 3108901 - protein, 8 aa, Giardia lamblia
ERKATGTI

SEQ ID NO: 3108902 - protein, 11 aa, Giardia lamblia
ERKDEANKLEQ

SEQ ID NO: 3108903 - protein, 18 aa, Giardia lamblia
ERKDGTLCDEQDSQYKQT

SEQ ID NO: 3108904 - protein, 18 aa, Giardia lamblia
ERKERIDAKKLEALKQLT

SEQ ID NO: 3108905 - protein, 7 aa, Giardia lamblia
ERKGCPE

SEQ ID NO: 3108906 - protein, 7 aa, Giardia lamblia
ERKGIPK

SEQ ID NO: 3108907 - protein, 6 aa, Giardia lamblia
ERKGNY

SEQ ID NO: 3108908 - protein, 6 aa, Giardia lamblia
ERKISP

SEQ ID NO: 3108909 - protein, 10 aa, Giardia lamblia
ERKKAEGGVK

SEQ ID NO: 3108910 - protein, 10 aa, Giardia lamblia
ERKNNQLSKQ

SEQ ID NO: 3108911 - protein, 9 aa, Giardia lamblia
ERKPTMSRD

SEQ ID NO: 3108912 - protein, 8 aa, Giardia lamblia
ERKRQEDE

SEQ ID NO: 3108913 - protein, 4 aa, Giardia lamblia
ERKT

SEQ ID NO: 3108914 - protein, 8 aa, Giardia lamblia
ERKYKNNL

SEQ ID NO: 3108915 - protein, 4 aa, Giardia lamblia
ERLA

SEQ ID NO: 3108916 - protein, 14 aa, Giardia lamblia
ERLDEAEAYREDEM

SEQ ID NO: 3108917 - protein, 12 aa, Giardia lamblia
ERLNGDISEKTK

SEQ ID NO: 3108918 - protein, 16 aa, Giardia lamblia
ERLNTELERSNKLQDR

SEQ ID NO: 3108919 - protein, 14 aa, Giardia lamblia
ERLRTTKPKPLTKQ

SEQ ID NO: 3108920 - protein, 8 aa, Giardia lamblia
ERLSDGAT

SEQ ID NO: 3108921 - protein, 5 aa, Giardia lamblia
ERLTA

SEQ ID NO: 3108922 - protein, 5 aa, Giardia lamblia
ERLTT

SEQ ID NO: 3108923 - protein, 6 aa, Giardia lamblia
ERMPKD

SEQ ID NO: 3108924 - protein, 5 aa, Giardia lamblia
ERMRR

SEQ ID NO: 3108925 - protein, 7 aa, Giardia lamblia
ERNANRK

SEQ ID NO: 3108926 - protein, 14 aa, Giardia lamblia
ERNARAAEREHYEA

SEQ ID NO: 3108927 - protein, 12 aa, Giardia lamblia
ERNGGGSSVRSA

SEQ ID NO: 3108928 - protein, 23 aa, Giardia lamblia
ERNGKMAANEPTMTDGSDCDGDI

SEQ ID NO: 3108929 - protein, 7 aa, Giardia lamblia
ERNGNAK

SEQ ID NO: 3108930 - protein, 5 aa, Giardia lamblia
ERNGT

SEQ ID NO: 3108931 - protein, 4 aa, Giardia lamblia
ERNH

SEQ ID NO: 3108932 - protein, 9 aa, Giardia lamblia
ERNISTESG

SEQ ID NO: 3108933 - protein, 5 aa, Giardia lamblia
ERNKT

SEQ ID NO: 3108934 - protein, 6 aa, Giardia lamblia
ERNNKP

SEQ ID NO: 3108935 - protein, 8 aa, Giardia lamblia
ERNPQRHT

SEQ ID NO: 3108936 - protein, 15 aa, Giardia lamblia
ERNSLRSELKEQAAE

SEQ ID NO: 3108937 - protein, 5 aa, Giardia lamblia
ERNTA

SEQ ID NO: 3108938 - protein, 13 aa, Giardia lamblia
ERNTLTRENASLR

SEQ ID NO: 3108939 - protein, 5 aa, Giardia lamblia
ERNTQ

SEQ ID NO: 3108940 - protein, 6 aa, Giardia lamblia
ERPAEA

SEQ ID NO: 3108941 - protein, 5 aa, Giardia lamblia
ERPAF

SEQ ID NO: 3108942 - protein, 17 aa, Giardia lamblia
ERPAHPAITPAPSPPRH

SEQ ID NO: 3108943 - protein, 12 aa, Giardia lamblia
ERPAPLTSYDEN

SEQ ID NO: 3108944 - protein, 18 aa, Giardia lamblia
ERPAQSLSVTDDTTKEIR

SEQ ID NO: 3108945 - protein, 4 aa, Giardia lamblia
ERPD

SEQ ID NO: 3108946 - protein, 8 aa, Giardia lamblia
ERPDLGGG

SEQ ID NO: 3108947 - protein, 9 aa, Giardia lamblia
ERPDSLQNV

SEQ ID NO: 3108948 - protein, 13 aa, Giardia lamblia
ERPEDLNKDEPIY

SEQ ID NO: 3108949 - protein, 8 aa, Giardia lamblia
ERPLTKDN

SEQ ID NO: 3108950 - protein, 7 aa, Giardia lamblia
ERPNLDT

SEQ ID NO: 3108951 - protein, 26 aa, Giardia lamblia
ERPQEQVDAETSMSPKEHGPTKPSIA

SEQ ID NO: 3108952 - protein, 14 aa, Giardia lamblia
ERPQVGESQSYDFE

SEQ ID NO: 3108953 - protein, 5 aa, Giardia lamblia
ERPRS

SEQ ID NO: 3108954 - protein, 9 aa, Giardia lamblia
ERPRSARHG

SEQ ID NO: 3108955 - protein, 5 aa, Giardia lamblia
ERPSI

SEQ ID NO: 3108956 - protein, 9 aa, Giardia lamblia
ERPSLPSIP

SEQ ID NO: 3108957 - protein, 8 aa, Giardia lamblia
ERPSPSIR

SEQ ID NO: 3108958 - protein, 16 aa, Giardia lamblia
ERPSSEMRLNDLPEGE

SEQ ID NO: 3108959 - protein, 6 aa, Giardia lamblia
ERPVIS

SEQ ID NO: 3108960 - protein, 13 aa, Giardia lamblia
ERPVKNSGIPQGD

SEQ ID NO: 3108961 - protein, 4 aa, Giardia lamblia
ERQA

SEQ ID NO: 3108962 - protein, 9 aa, Giardia lamblia
ERQARKAKI

SEQ ID NO: 3108963 - protein, 19 aa, Giardia lamblia
ERQDKTCPIESEPHSHTTM

SEQ ID NO: 3108964 - protein, 5 aa, Giardia lamblia
ERQEA

SEQ ID NO: 3108965 - protein, 5 aa, Giardia lamblia
ERQHT

SEQ ID NO: 3108966 - protein, 4 aa, Giardia lamblia
ERQK

SEQ ID NO: 3108967 - protein, 9 aa, Giardia lamblia
ERQKEAELD

SEQ ID NO: 3108968 - protein, 10 aa, Giardia lamblia
ERQNAELDQK

SEQ ID NO: 3108969 - protein, 8 aa, Giardia lamblia
ERQPTPHR

SEQ ID NO: 3108970 - protein, 11 aa, Giardia lamblia
ERQQDAKANLE

SEQ ID NO: 3108971 - protein, 12 aa, Giardia lamblia
ERQQKRYGRQER

SEQ ID NO: 3108972 - protein, 7 aa, Giardia lamblia
ERQQTNI

SEQ ID NO: 3108973 - protein, 5 aa, Giardia lamblia
ERQRR

SEQ ID NO: 3108974 - protein, 9 aa, Giardia lamblia
ERQRRRRGE

SEQ ID NO: 3108975 - protein, 9 aa, Giardia lamblia
ERQRSNVGD

SEQ ID NO: 3108976 - protein, 9 aa, Giardia lamblia
ERQSDNYAA

SEQ ID NO: 3108977 - protein, 11 aa, Giardia lamblia
ERQTEAEKRCS

SEQ ID NO: 3108978 - protein, 17 aa, Giardia lamblia
ERQTNELKERLKEKETQ

SEQ ID NO: 3108979 - protein, 10 aa, Giardia lamblia
ERRASKQLQE

SEQ ID NO: 3108980 - protein, 7 aa, Giardia lamblia
ERRDKEL

SEQ ID NO: 3108981 - protein, 6 aa, Giardia lamblia
ERREPK

SEQ ID NO: 3108982 - protein, 18 aa, Giardia lamblia
ERRFEDTEGLPDVPNSDT

SEQ ID NO: 3108983 - protein, 7 aa, Giardia lamblia
ERRGDKA

SEQ ID NO: 3108984 - protein, 20 aa, Giardia lamblia
ERRGQEDVERNDIVQTRVGI

SEQ ID NO: 3108985 - protein, 8 aa, Giardia lamblia
ERRGVSTS

SEQ ID NO: 3108986 - protein, 5 aa, Giardia lamblia
ERRKF

SEQ ID NO: 3108987 - protein, 12 aa, Giardia lamblia
ERRLTDKNGDTA

SEQ ID NO: 3108988 - protein, 7 aa, Giardia lamblia
ERRPTAR

SEQ ID NO: 3108989 - protein, 14 aa, Giardia lamblia
ERRPTARELCEMLR

SEQ ID NO: 3108990 - protein, 11 aa, Giardia lamblia
ERRQASPTIVP

SEQ ID NO: 3108991 - protein, 26 aa, Giardia lamblia
ERRQQKRMSEKTGSSSASITKKTPTN

SEQ ID NO: 3108992 - protein, 10 aa, Giardia lamblia
ERRRKEAEDP

SEQ ID NO: 3108993 - protein, 11 aa, Giardia lamblia
ERRRQSTSRRA

SEQ ID NO: 3108994 - protein, 7 aa, Giardia lamblia
ERRSTDG

SEQ ID NO: 3108995 - protein, 12 aa, Giardia lamblia
ERRSTDQSQTTK

SEQ ID NO: 3108996 - protein, 5 aa, Giardia lamblia
ERRTN

SEQ ID NO: 3108997 - protein, 5 aa, Giardia lamblia
ERRTP

SEQ ID NO: 3108998 - protein, 6 aa, Giardia lamblia
ERSDGR

SEQ ID NO: 3108999 - protein, 4 aa, Giardia lamblia
ERSE

SEQ ID NO: 3109000 - protein, 9 aa, Giardia lamblia
ERSEDPAYA

SEQ ID NO: 3109001 - protein, 10 aa, Giardia lamblia
ERSEKAAHER

SEQ ID NO: 3109002 - protein, 9 aa, Giardia lamblia
ERSFEDKEL

SEQ ID NO: 3109003 - protein, 10 aa, Giardia lamblia
ERSGSKRGQG

SEQ ID NO: 3109004 - protein, 13 aa, Giardia lamblia
ERSISKGGEPTSI

SEQ ID NO: 3109005 - protein, 12 aa, Giardia lamblia
ERSKVDEQAEKI

SEQ ID NO: 3109006 - protein, 4 aa, Giardia lamblia
ERSL

SEQ ID NO: 3109007 - protein, 9 aa, Giardia lamblia
ERSNRPEME

SEQ ID NO: 3109008 - protein, 9 aa, Giardia lamblia
ERSPGPADY

SEQ ID NO: 3109009 - protein, 7 aa, Giardia lamblia
ERSPSGL

SEQ ID NO: 3109010 - protein, 14 aa, Giardia lamblia
ERSQSSASVQTRTP

SEQ ID NO: 3109011 - protein, 4 aa, Giardia lamblia
ERSR

SEQ ID NO: 3109012 - protein, 9 aa, Giardia lamblia
ERSRNDTLT

SEQ ID NO: 3109013 - protein, 10 aa, Giardia lamblia
ERSRRDKDSK

SEQ ID NO: 3109014 - protein, 10 aa, Giardia lamblia
ERSRRQEAQR

SEQ ID NO: 3109015 - protein, 19 aa, Giardia lamblia
ERSRSRGSSRGAERDKGRI

SEQ ID NO: 3109016 - protein, 4 aa, Giardia lamblia
ERSS

SEQ ID NO: 3109017 - protein, 5 aa, Giardia lamblia
ERSSN

SEQ ID NO: 3109018 - protein, 7 aa, Giardia lamblia
ERSSPAY

SEQ ID NO: 3109019 - protein, 22 aa, Giardia lamblia
ERSSTSSNRSTPLSTTYEDDSE

SEQ ID NO: 3109020 - protein, 5 aa, Giardia lamblia
ERSSV

SEQ ID NO: 3109021 - protein, 10 aa, Giardia lamblia
ERSTSHSDYR

SEQ ID NO: 3109022 - protein, 11 aa, Giardia lamblia
ERTEKEEAERL

SEQ ID NO: 3109023 - protein, 14 aa, Giardia lamblia
ERTESGLKNAQDET

SEQ ID NO: 3109024 - protein, 11 aa, Giardia lamblia
ERTGEGFRNSK

SEQ ID NO: 3109025 - protein, 7 aa, Giardia lamblia
ERTGSAT

SEQ ID NO: 3109026 - protein, 4 aa, Giardia lamblia
ERTI

SEQ ID NO: 3109027 - protein, 4 aa, Giardia lamblia
ERTK

SEQ ID NO: 3109028 - protein, 5 aa, Giardia lamblia
ERTKA

SEQ ID NO: 3109029 - protein, 6 aa, Giardia lamblia
ERTKEF

SEQ ID NO: 3109030 - protein, 7 aa, Giardia lamblia
ERTKELN

SEQ ID NO: 3109031 - protein, 6 aa, Giardia lamblia
ERTKSN

SEQ ID NO: 3109032 - protein, 7 aa, Giardia lamblia
ERTNESM

SEQ ID NO: 3109033 - protein, 6 aa, Giardia lamblia
ERTNPE

SEQ ID NO: 3109034 - protein, 9 aa, Giardia lamblia
ERTPEGINS

SEQ ID NO: 3109035 - protein, 14 aa, Giardia lamblia
ERTQKQCKRSMDDA

SEQ ID NO: 3109036 - protein, 4 aa, Giardia lamblia
ERTR

SEQ ID NO: 3109037 - protein, 12 aa, Giardia lamblia
ERTRKLKEEVEQ

SEQ ID NO: 3109038 - protein, 10 aa, Giardia lamblia
ERTRSPANEH

SEQ ID NO: 3109039 - protein, 12 aa, Giardia lamblia
ERTSQAQRAAGN

SEQ ID NO: 3109040 - protein, 16 aa, Giardia lamblia
ERTSREGSPDEEAEKL

SEQ ID NO: 3109041 - protein, 7 aa, Giardia lamblia
ERTWNPA

SEQ ID NO: 3109042 - protein, 11 aa, Giardia lamblia
ERVAEQEHLPN

SEQ ID NO: 3109043 - protein, 13 aa, Giardia lamblia
ERVEESAEARGPI

SEQ ID NO: 3109044 - protein, 17 aa, Giardia lamblia
ERVGSPTAAASKSGTSL

SEQ ID NO: 3109045 - protein, 6 aa, Giardia lamblia
ERVKTA

SEQ ID NO: 3109046 - protein, 15 aa, Giardia lamblia
ERVPTSESDGSPVSF

SEQ ID NO: 3109047 - protein, 13 aa, Giardia lamblia
ERVRSDGMQPEGW

SEQ ID NO: 3109048 - protein, 8 aa, Giardia lamblia
ERVSGNSA

SEQ ID NO: 3109049 - protein, 4 aa, Giardia lamblia
ERVT

SEQ ID NO: 3109050 - protein, 6 aa, Giardia lamblia
ERVTPA

SEQ ID NO: 3109051 - protein, 4 aa, Giardia lamblia
ERYE

SEQ ID NO: 3109052 - protein, 7 aa, Giardia lamblia
ERYKGGV

SEQ ID NO: 3109053 - protein, 8 aa, Giardia lamblia
ERYNRTPE

SEQ ID NO: 3109054 - protein, 13 aa, Giardia lamblia
ERYRREKEESIRR

SEQ ID NO: 3109055 - protein, 4 aa, Giardia lamblia
ERYS

SEQ ID NO: 3109056 - protein, 5 aa, Giardia lamblia
ESAAA

SEQ ID NO: 3109057 - protein, 12 aa, Giardia lamblia
ESAAAYAANSGD

SEQ ID NO: 3109058 - protein, 15 aa, Giardia lamblia
ESAALTDKLEAREKA

SEQ ID NO: 3109059 - protein, 13 aa, Giardia lamblia
ESAAQLSNTASAG

SEQ ID NO: 3109060 - protein, 5 aa, Giardia lamblia
ESADE

SEQ ID NO: 3109061 - protein, 22 aa, Giardia lamblia
ESADRSEADSSAGENDSNVPLQ

SEQ ID NO: 3109062 - protein, 8 aa, Giardia lamblia
ESADSSIK

SEQ ID NO: 3109063 - protein, 6 aa, Giardia lamblia
ESAEAE

SEQ ID NO: 3109064 - protein, 7 aa, Giardia lamblia
ESAEALQ

SEQ ID NO: 3109065 - protein, 12 aa, Giardia lamblia
ESAEGTLPLSTE

SEQ ID NO: 3109066 - protein, 7 aa, Giardia lamblia
ESAEKDA

SEQ ID NO: 3109067 - protein, 10 aa, Giardia lamblia
ESAERSLERP

SEQ ID NO: 3109068 - protein, 11 aa, Giardia lamblia
ESAGAETFRGG

SEQ ID NO: 3109069 - protein, 8 aa, Giardia lamblia
ESAGASGH

SEQ ID NO: 3109070 - protein, 9 aa, Giardia lamblia
ESAGREQGL

SEQ ID NO: 3109071 - protein, 7 aa, Giardia lamblia
ESAHASQ

SEQ ID NO: 3109072 - protein, 9 aa, Giardia lamblia
ESAHSDLAA

SEQ ID NO: 3109073 - protein, 4 aa, Giardia lamblia
ESAI

SEQ ID NO: 3109074 - protein, 12 aa, Giardia lamblia
ESAISNKSISAP

SEQ ID NO: 3109075 - protein, 12 aa, Giardia lamblia
ESAKAPSSEGAR

SEQ ID NO: 3109076 - protein, 6 aa, Giardia lamblia
ESAKPS

SEQ ID NO: 3109077 - protein, 14 aa, Giardia lamblia
ESAKQSARAATTPV

SEQ ID NO: 3109078 - protein, 4 aa, Giardia lamblia
ESAL

SEQ ID NO: 3109079 - protein, 10 aa, Giardia lamblia
ESALPGYDSA

SEQ ID NO: 3109080 - protein, 4 aa, Giardia lamblia
ESAM

SEQ ID NO: 3109081 - protein, 12 aa, Giardia lamblia
ESANARKQEKYY

SEQ ID NO: 3109082 - protein, 9 aa, Giardia lamblia
ESANRSLDS

SEQ ID NO: 3109083 - protein, 13 aa, Giardia lamblia
ESANTDAEYDKPA

SEQ ID NO: 3109084 - protein, 11 aa, Giardia lamblia
ESANYTKTYEL

SEQ ID NO: 3109085 - protein, 6 aa, Giardia lamblia
ESAPDC

SEQ ID NO: 3109086 - protein, 17 aa, Giardia lamblia
ESAPPSRNIGDGSTKDY

SEQ ID NO: 3109087 - protein, 14 aa, Giardia lamblia
ESAPVVPSNDMPYS

SEQ ID NO: 3109088 - protein, 6 aa, Giardia lamblia
ESAQGG

SEQ ID NO: 3109089 - protein, 7 aa, Giardia lamblia
ESAQGHT

SEQ ID NO: 3109090 - protein, 14 aa, Giardia lamblia
ESAQPQTQADANAA

SEQ ID NO: 3109091 - protein, 5 aa, Giardia lamblia
ESAQR

SEQ ID NO: 3109092 - protein, 14 aa, Giardia lamblia
ESAQRSSAEGDKRV

SEQ ID NO: 3109093 - protein, 10 aa, Giardia lamblia
ESAQSKKACP

SEQ ID NO: 3109094 - protein, 5 aa, Giardia lamblia
ESARI

SEQ ID NO: 3109095 - protein, 5 aa, Giardia lamblia
ESARS

SEQ ID NO: 3109096 - protein, 5 aa, Giardia lamblia
ESARV

SEQ ID NO: 3109097 - protein, 8 aa, Giardia lamblia
ESASAQEQ

SEQ ID NO: 3109098 - protein, 9 aa, Giardia lamblia
ESASASAYG

SEQ ID NO: 3109099 - protein, 5 aa, Giardia lamblia
ESASY

SEQ ID NO: 3109100 - protein, 8 aa, Giardia lamblia
ESATEDPL

SEQ ID NO: 3109101 - protein, 10 aa, Giardia lamblia
ESATQAEIQE

SEQ ID NO: 3109102 - protein, 8 aa, Giardia lamblia
ESATYSSV

SEQ ID NO: 3109103 - protein, 12 aa, Giardia lamblia
ESAYQPGSAHSP

SEQ ID NO: 3109104 - protein, 9 aa, Giardia lamblia
ESCGNTEPL

SEQ ID NO: 3109105 - protein, 7 aa, Giardia lamblia
ESDASGW

SEQ ID NO: 3109106 - protein, 27 aa, Giardia lamblia
ESDDSDSEQSESDQNSSEANEEIEERE

SEQ ID NO: 3109107 - protein, 7 aa, Giardia lamblia
ESDEENM

SEQ ID NO: 3109108 - protein, 12 aa, Giardia lamblia
ESDEESSSAHSQ

SEQ ID NO: 3109109 - protein, 5 aa, Giardia lamblia
ESDER

SEQ ID NO: 3109110 - protein, 13 aa, Giardia lamblia
ESDESNSEDTSDV

SEQ ID NO: 3109111 - protein, 20 aa, Giardia lamblia
ESDEYQAMGPPDATSKTANV

SEQ ID NO: 3109112 - protein, 6 aa, Giardia lamblia
ESDHIK

SEQ ID NO: 3109113 - protein, 11 aa, Giardia lamblia
ESDLADKTGQT

SEQ ID NO: 3109114 - protein, 9 aa, Giardia lamblia
ESDLGTGDY

SEQ ID NO: 3109115 - protein, 11 aa, Giardia lamblia
ESDLTPQPRSN

SEQ ID NO: 3109116 - protein, 7 aa, Giardia lamblia
ESDNAQL

SEQ ID NO: 3109117 - protein, 30 aa, Giardia lamblia
ESDNLTAPSTSSDVSINRPSVSTANLPAQR

SEQ ID NO: 3109118 - protein, 6 aa, Giardia lamblia
ESDNMG

SEQ ID NO: 3109119 - protein, 12 aa, Giardia lamblia
ESDNVSDSGESY

SEQ ID NO: 3109120 - protein, 10 aa, Giardia lamblia
ESDPAGSDPL

SEQ ID NO: 3109121 - protein, 31 aa, Giardia lamblia
ESDQASGALPAIPQGSVSANVEAASMNEYEA

SEQ ID NO: 3109122 - protein, 14 aa, Giardia lamblia
ESDSESSNDITKET

SEQ ID NO: 3109123 - protein, 5 aa, Giardia lamblia
ESDSR

SEQ ID NO: 3109124 - protein, 11 aa, Giardia lamblia
ESDSSHRTDHA

SEQ ID NO: 3109125 - protein, 8 aa, Giardia lamblia
ESDVPSDY

SEQ ID NO: 3109126 - protein, 5 aa, Giardia lamblia
ESEDD

SEQ ID NO: 3109127 - protein, 30 aa, Giardia lamblia
ESEHEDRIEQGPDEELQEPDDAEPEEEYEY

SEQ ID NO: 3109128 - protein, 11 aa, Giardia lamblia
ESEHQNKYTTL

SEQ ID NO: 3109129 - protein, 22 aa, Giardia lamblia
ESEHTSMTPEEEKKTQASIKKL

SEQ ID NO: 3109130 - protein, 6 aa, Giardia lamblia
ESEIGD

SEQ ID NO: 3109131 - protein, 5 aa, Giardia lamblia
ESEKA

SEQ ID NO: 3109132 - protein, 5 aa, Giardia lamblia
ESEKR

SEQ ID NO: 3109133 - protein, 7 aa, Giardia lamblia
ESEKTSI

SEQ ID NO: 3109134 - protein, 8 aa, Giardia lamblia
ESELEAKK

SEQ ID NO: 3109135 - protein, 4 aa, Giardia lamblia
ESEN

SEQ ID NO: 3109136 - protein, 11 aa, Giardia lamblia
ESENPAIPEGM

SEQ ID NO: 3109137 - protein, 8 aa, Giardia lamblia
ESENSLDE

SEQ ID NO: 3109138 - protein, 13 aa, Giardia lamblia
ESENSRLQAQAQM

SEQ ID NO: 3109139 - protein, 5 aa, Giardia lamblia
ESERA

SEQ ID NO: 3109140 - protein, 17 aa, Giardia lamblia
ESERQTNSEKDKEIQGM

SEQ ID NO: 3109141 - protein, 12 aa, Giardia lamblia
ESERRASERSQR

SEQ ID NO: 3109142 - protein, 6 aa, Giardia lamblia
ESERSL

SEQ ID NO: 3109143 - protein, 13 aa, Giardia lamblia
ESESPPSSPPLPL

SEQ ID NO: 3109144 - protein, 18 aa, Giardia lamblia
ESESQSEKHQESGAHTTR

SEQ ID NO: 3109145 - protein, 4 aa, Giardia lamblia
ESET

SEQ ID NO: 3109146 - protein, 10 aa, Giardia lamblia
ESETAHSKTD

SEQ ID NO: 3109147 - protein, 39 aa, Giardia lamblia
ESETMRSQNAGTKPDQIPSRSRSAEESLASQKTRRMSAS

SEQ ID NO: 3109148 - protein, 6 aa, Giardia lamblia
ESEVPG

SEQ ID NO: 3109149 - protein, 5 aa, Giardia lamblia
ESEVR

SEQ ID NO: 3109150 - protein, 5 aa, Giardia lamblia
ESEVT

SEQ ID NO: 3109151 - protein, 4 aa, Giardia lamblia
ESEY

SEQ ID NO: 3109152 - protein, 10 aa, Giardia lamblia
ESFDASERNI

SEQ ID NO: 3109153 - protein, 14 aa, Giardia lamblia
ESFKGSSGSETTFA

SEQ ID NO: 3109154 - protein, 6 aa, Giardia lamblia
ESFKRK

SEQ ID NO: 3109155 - protein, 7 aa, Giardia lamblia
ESFNETA

SEQ ID NO: 3109156 - protein, 10 aa, Giardia lamblia
ESFSRNTRAP

SEQ ID NO: 3109157 - protein, 5 aa, Giardia lamblia
ESFTN

SEQ ID NO: 3109158 - protein, 12 aa, Giardia lamblia
ESFTSDGNADHS

SEQ ID NO: 3109159 - protein, 16 aa, Giardia lamblia
ESGAHRLSGTELTEPE

SEQ ID NO: 3109160 - protein, 5 aa, Giardia lamblia
ESGAV

SEQ ID NO: 3109161 - protein, 7 aa, Giardia lamblia
ESGAYQP

SEQ ID NO: 3109162 - protein, 7 aa, Giardia lamblia
ESGDSQF

SEQ ID NO: 3109163 - protein, 5 aa, Giardia lamblia
ESGEL

SEQ ID NO: 3109164 - protein, 12 aa, Giardia lamblia
ESGELRKVCGLP

SEQ ID NO: 3109165 - protein, 9 aa, Giardia lamblia
ESGESLRLS

SEQ ID NO: 3109166 - protein, 15 aa, Giardia lamblia
ESGFRTNASHPNGAG

SEQ ID NO: 3109167 - protein, 5 aa, Giardia lamblia
ESGGS

SEQ ID NO: 3109168 - protein, 14 aa, Giardia lamblia
ESGGVSSVNEDNSI

SEQ ID NO: 3109169 - protein, 8 aa, Giardia lamblia
ESGHQDKI

SEQ ID NO: 3109170 - protein, 9 aa, Giardia lamblia
ESGHRDAAG

SEQ ID NO: 3109171 - protein, 9 aa, Giardia lamblia
ESGHRDSKG

SEQ ID NO: 3109172 - protein, 5 aa, Giardia lamblia
ESGHT

SEQ ID NO: 3109173 - protein, 8 aa, Giardia lamblia
ESGITTKR

SEQ ID NO: 3109174 - protein, 6 aa, Giardia lamblia
ESGKRD

SEQ ID NO: 3109175 - protein, 10 aa, Giardia lamblia
ESGLKSKEGW

SEQ ID NO: 3109176 - protein, 10 aa, Giardia lamblia
ESGLKSSSGM

SEQ ID NO: 3109177 - protein, 5 aa, Giardia lamblia
ESGLS

SEQ ID NO: 3109178 - protein, 11 aa, Giardia lamblia
ESGMENNTGQT

SEQ ID NO: 3109179 - protein, 8 aa, Giardia lamblia
ESGMGEES

SEQ ID NO: 3109180 - protein, 10 aa, Giardia lamblia
ESGMKNDKGW

SEQ ID NO: 3109181 - protein, 12 aa, Giardia lamblia
ESGMKSDKGRTA

SEQ ID NO: 3109182 - protein, 5 aa, Giardia lamblia
ESGMQ

SEQ ID NO: 3109183 - protein, 11 aa, Giardia lamblia
ESGMQNNDGET

SEQ ID NO: 3109184 - protein, 12 aa, Giardia lamblia
ESGMQRSDGRTA

SEQ ID NO: 3109185 - protein, 11 aa, Giardia lamblia
ESGMQTNNGET

SEQ ID NO: 3109186 - protein, 9 aa, Giardia lamblia
ESGMQTPEG

SEQ ID NO: 3109187 - protein, 10 aa, Giardia lamblia
ESGMRTNKGY

SEQ ID NO: 3109188 - protein, 14 aa, Giardia lamblia
ESGNLSTTERIDDT

SEQ ID NO: 3109189 - protein, 9 aa, Giardia lamblia
ESGNMTSAA

SEQ ID NO: 3109190 - protein, 10 aa, Giardia lamblia
ESGNYNEVRE

SEQ ID NO: 3109191 - protein, 7 aa, Giardia lamblia
ESGQTNL

SEQ ID NO: 3109192 - protein, 9 aa, Giardia lamblia
ESGQVPPQD

SEQ ID NO: 3109193 - protein, 11 aa, Giardia lamblia
ESGRAAYEELS

SEQ ID NO: 3109194 - protein, 11 aa, Giardia lamblia
ESGRERQNGES

SEQ ID NO: 3109195 - protein, 11 aa, Giardia lamblia
ESGRRPDNGEP

SEQ ID NO: 3109196 - protein, 8 aa, Giardia lamblia
ESGSGKTV

SEQ ID NO: 3109197 - protein, 5 aa, Giardia lamblia
ESGSH

SEQ ID NO: 3109198 - protein, 15 aa, Giardia lamblia
ESGSPFTGDAYSPLT

SEQ ID NO: 3109199 - protein, 11 aa, Giardia lamblia
ESGSPSSSKVN

SEQ ID NO: 3109200 - protein, 19 aa, Giardia lamblia
ESGSSKADGPGNDNKDTYN

SEQ ID NO: 3109201 - protein, 14 aa, Giardia lamblia
ESGSYSGSAPTGVY

SEQ ID NO: 3109202 - protein, 10 aa, Giardia lamblia
ESGTDGPRSI

SEQ ID NO: 3109203 - protein, 11 aa, Giardia lamblia
ESGTDGPRSVS

SEQ ID NO: 3109204 - protein, 16 aa, Giardia lamblia
ESGTGPASSSKSDQNL

SEQ ID NO: 3109205 - protein, 6 aa, Giardia lamblia
ESGTIE

SEQ ID NO: 3109206 - protein, 39 aa, Giardia lamblia
ESGTNDLNKSLKRSSSCSKINPMSGTGRIPVPNPPNPPL

SEQ ID NO: 3109207 - protein, 5 aa, Giardia lamblia
ESGTR

SEQ ID NO: 3109208 - protein, 12 aa, Giardia lamblia
ESGVERADGATA

SEQ ID NO: 3109209 - protein, 6 aa, Giardia lamblia
ESGVHD

SEQ ID NO: 3109210 - protein, 7 aa, Giardia lamblia
ESGVQQR

SEQ ID NO: 3109211 - protein, 9 aa, Giardia lamblia
ESGYQKSDG

SEQ ID NO: 3109212 - protein, 7 aa, Giardia lamblia
ESHAPHK

SEQ ID NO: 3109213 - protein, 12 aa, Giardia lamblia
ESHDPDEDECGL

SEQ ID NO: 3109214 - protein, 6 aa, Giardia lamblia
ESHDTS

SEQ ID NO: 3109215 - protein, 5 aa, Giardia lamblia
ESHGY

SEQ ID NO: 3109216 - protein, 6 aa, Giardia lamblia
ESHIGS

SEQ ID NO: 3109217 - protein, 10 aa, Giardia lamblia
ESHITDRRGH

SEQ ID NO: 3109218 - protein, 9 aa, Giardia lamblia
ESHKDISSR

SEQ ID NO: 3109219 - protein, 6 aa, Giardia lamblia
ESHSEN

SEQ ID NO: 3109220 - protein, 7 aa, Giardia lamblia
ESHTGRI

SEQ ID NO: 3109221 - protein, 4 aa, Giardia lamblia
ESIA

SEQ ID NO: 3109222 - protein, 18 aa, Giardia lamblia
ESIAARDKLSKSRDGGFR

SEQ ID NO: 3109223 - protein, 13 aa, Giardia lamblia
ESIDKVSNNAEIT

SEQ ID NO: 3109224 - protein, 8 aa, Giardia lamblia
ESIERPSD

SEQ ID NO: 3109225 - protein, 6 aa, Giardia lamblia
ESIGDS

SEQ ID NO: 3109226 - protein, 18 aa, Giardia lamblia
ESIKSTDGNNSEQQEPDR

SEQ ID NO: 3109227 - protein, 4 aa, Giardia lamblia
ESIQ

SEQ ID NO: 3109228 - protein, 9 aa, Giardia lamblia
ESIQPQGKI

SEQ ID NO: 3109229 - protein, 8 aa, Giardia lamblia
ESIRDSAG

SEQ ID NO: 3109230 - protein, 9 aa, Giardia lamblia
ESITREEEL

SEQ ID NO: 3109231 - protein, 8 aa, Giardia lamblia
ESITSASE

SEQ ID NO: 3109232 - protein, 12 aa, Giardia lamblia
ESITSVGPQPLP

SEQ ID NO: 3109233 - protein, 16 aa, Giardia lamblia
ESKAQISQLTEKSTYE

SEQ ID NO: 3109234 - protein, 7 aa, Giardia lamblia
ESKDDKI

SEQ ID NO: 3109235 - protein, 7 aa, Giardia lamblia
ESKDEQL

SEQ ID NO: 3109236 - protein, 13 aa, Giardia lamblia
ESKDVYAVPISAF

SEQ ID NO: 3109237 - protein, 10 aa, Giardia lamblia
ESKENQEDDT

SEQ ID NO: 3109238 - protein, 9 aa, Giardia lamblia
ESKGPNPDL

SEQ ID NO: 3109239 - protein, 14 aa, Giardia lamblia
ESKKKTKRDPTTGK

SEQ ID NO: 3109240 - protein, 16 aa, Giardia lamblia
ESKLETEKASKTSNLQ

SEQ ID NO: 3109241 - protein, 13 aa, Giardia lamblia
ESKMQNKDGKTAL

SEQ ID NO: 3109242 - protein, 6 aa, Giardia lamblia
ESKPAL

SEQ ID NO: 3109243 - protein, 6 aa, Giardia lamblia
ESKQHT

SEQ ID NO: 3109244 - protein, 16 aa, Giardia lamblia
ESKQTSERERSPRPSL

SEQ ID NO: 3109245 - protein, 17 aa, Giardia lamblia
ESKRTGALETPASSSLA

SEQ ID NO: 3109246 - protein, 9 aa, Giardia lamblia
ESKSATPSF

SEQ ID NO: 3109247 - protein, 6 aa, Giardia lamblia
ESKSKL

SEQ ID NO: 3109248 - protein, 6 aa, Giardia lamblia
ESKSLR

SEQ ID NO: 3109249 - protein, 7 aa, Giardia lamblia
ESKSPEF

SEQ ID NO: 3109250 - protein, 26 aa, Giardia lamblia
ESKSTTHNTTQPASSALSAVTGSPVI

SEQ ID NO: 3109251 - protein, 6 aa, Giardia lamblia
ESKTDQ

SEQ ID NO: 3109252 - protein, 8 aa, Giardia lamblia
ESKTKQFS

SEQ ID NO: 3109253 - protein, 4 aa, Giardia lamblia
ESLA

SEQ ID NO: 3109254 - protein, 6 aa, Giardia lamblia
ESLAGS

SEQ ID NO: 3109255 - protein, 16 aa, Giardia lamblia
ESLDGSEEFDSSLKPC

SEQ ID NO: 3109256 - protein, 4 aa, Giardia lamblia
ESLE

SEQ ID NO: 3109257 - protein, 8 aa, Giardia lamblia
ESLESRST

SEQ ID NO: 3109258 - protein, 6 aa, Giardia lamblia
ESLESS

SEQ ID NO: 3109259 - protein, 92 aa, Giardia lamblia
ESLGRSMGGTVGGGLGATGGATKKLKASLGPDEGRATQKPKLKPKPQPQPTSGPGIDNKFGGPPVSRQGPDMGARAGGADMKIGGSGKGTYN

SEQ ID NO: 3109260 - protein, 4 aa, Giardia lamblia
ESLK

SEQ ID NO: 3109261 - protein, 14 aa, Giardia lamblia
ESLKAAPATGVSSQ

SEQ ID NO: 3109262 - protein, 8 aa, Giardia lamblia
ESLNQQTE

SEQ ID NO: 3109263 - protein, 8 aa, Giardia lamblia
ESLPAASA

SEQ ID NO: 3109264 - protein, 7 aa, Giardia lamblia
ESLPMSK

SEQ ID NO: 3109265 - protein, 8 aa, Giardia lamblia
ESLQQDEQ

SEQ ID NO: 3109266 - protein, 9 aa, Giardia lamblia
ESLQSSSAT

SEQ ID NO: 3109267 - protein, 7 aa, Giardia lamblia
ESLQTNR

SEQ ID NO: 3109268 - protein, 31 aa, Giardia lamblia
ESLRASKRLSGLPDKKSNETTPQAKRNDRQV

SEQ ID NO: 3109269 - protein, 14 aa, Giardia lamblia
ESLRKEKQDLTSSI

SEQ ID NO: 3109270 - protein, 9 aa, Giardia lamblia
ESLRTQDAK

SEQ ID NO: 3109271 - protein, 6 aa, Giardia lamblia
ESLSAE

SEQ ID NO: 3109272 - protein, 10 aa, Giardia lamblia
ESLTSREREC

SEQ ID NO: 3109273 - protein, 23 aa, Giardia lamblia
ESMGSKDSLVKSPSQNPQLSPAA

SEQ ID NO: 3109274 - protein, 4 aa, Giardia lamblia
ESMP

SEQ ID NO: 3109275 - protein, 7 aa, Giardia lamblia
ESMRSGG

SEQ ID NO: 3109276 - protein, 6 aa, Giardia lamblia
ESNAAY

SEQ ID NO: 3109277 - protein, 8 aa, Giardia lamblia
ESNARKKR

SEQ ID NO: 3109278 - protein, 40 aa, Giardia lamblia
ESNASRTNLANNEDVAPVGGEEGSSASEDSEASQISEDPV

SEQ ID NO: 3109279 - protein, 12 aa, Giardia lamblia
ESNEGDAETYTK

SEQ ID NO: 3109280 - protein, 7 aa, Giardia lamblia
ESNEITE

SEQ ID NO: 3109281 - protein, 19 aa, Giardia lamblia
ESNEQLAGTVASQEQSLNT

SEQ ID NO: 3109282 - protein, 5 aa, Giardia lamblia
ESNGT

SEQ ID NO: 3109283 - protein, 5 aa, Giardia lamblia
ESNID

SEQ ID NO: 3109284 - protein, 9 aa, Giardia lamblia
ESNIENRAR

SEQ ID NO: 3109285 - protein, 7 aa, Giardia lamblia
ESNNAPA

SEQ ID NO: 3109286 - protein, 6 aa, Giardia lamblia
ESNNQT

SEQ ID NO: 3109287 - protein, 6 aa, Giardia lamblia
ESNNSD

SEQ ID NO: 3109288 - protein, 7 aa, Giardia lamblia
ESNQNHG

SEQ ID NO: 3109289 - protein, 16 aa, Giardia lamblia
ESNRQALGAKAAEAAV

SEQ ID NO: 3109290 - protein, 11 aa, Giardia lamblia
ESNRSSSATDL

SEQ ID NO: 3109291 - protein, 6 aa, Giardia lamblia
ESNSDY

SEQ ID NO: 3109292 - protein, 4 aa, Giardia lamblia
ESPA

SEQ ID NO: 3109293 - protein, 23 aa, Giardia lamblia
ESPAGRQATALSDNMGGSDSCIY

SEQ ID NO: 3109294 - protein, 14 aa, Giardia lamblia
ESPASENNEDFERA

SEQ ID NO: 3109295 - protein, 110 aa, Giardia lamblia
ESPDEQSHASASSSSDDYTSGTTTESNEEESEEDNEEEESEDEDEEDESEEDEDEEEEEEYEEEEEEEEEEEEEESEEEETSEESEEETGESEEDEEETSEDEEQSAQSA

SEQ ID NO: 3109296 - protein, 8 aa, Giardia lamblia
ESPDKLSQ

SEQ ID NO: 3109297 - protein, 4 aa, Giardia lamblia
ESPE

SEQ ID NO: 3109298 - protein, 12 aa, Giardia lamblia
ESPEAMSQEHTS

SEQ ID NO: 3109299 - protein, 5 aa, Giardia lamblia
ESPER

SEQ ID NO: 3109300 - protein, 5 aa, Giardia lamblia
ESPFY

SEQ ID NO: 3109301 - protein, 4 aa, Giardia lamblia
ESPG

SEQ ID NO: 3109302 - protein, 9 aa, Giardia lamblia
ESPGNGFST

SEQ ID NO: 3109303 - protein, 5 aa, Giardia lamblia
ESPIE

SEQ ID NO: 3109304 - protein, 4 aa, Giardia lamblia
ESPP

SEQ ID NO: 3109305 - protein, 10 aa, Giardia lamblia
ESPPKADAFN

SEQ ID NO: 3109306 - protein, 5 aa, Giardia lamblia
ESPPS

SEQ ID NO: 3109307 - protein, 10 aa, Giardia lamblia
ESPPSVSAEP

SEQ ID NO: 3109308 - protein, 35 aa, Giardia lamblia
ESPPTVDLPGSKHSASTRTHSRHQTRSTTPPSTMP

SEQ ID NO: 3109309 - protein, 6 aa, Giardia lamblia
ESPQTP

SEQ ID NO: 3109310 - protein, 7 aa, Giardia lamblia
ESPRNPQ

SEQ ID NO: 3109311 - protein, 5 aa, Giardia lamblia
ESPRQ

SEQ ID NO: 3109312 - protein, 10 aa, Giardia lamblia
ESPSKENLSQ

SEQ ID NO: 3109313 - protein, 7 aa, Giardia lamblia
ESPSPYL

SEQ ID NO: 3109314 - protein, 17 aa, Giardia lamblia
ESPSSTSYSCSTESQDD

SEQ ID NO: 3109315 - protein, 7 aa, Giardia lamblia
ESPSTVQ

SEQ ID NO: 3109316 - protein, 4 aa, Giardia lamblia
ESPT

SEQ ID NO: 3109317 - protein, 9 aa, Giardia lamblia
ESPTARPVY

SEQ ID NO: 3109318 - protein, 23 aa, Giardia lamblia
ESPVRQTNRHAKQNKSAFNEQKQ

SEQ ID NO: 3109319 - protein, 6 aa, Giardia lamblia
ESQAPV

SEQ ID NO: 3109320 - protein, 9 aa, Giardia lamblia
ESQDAFPQD

SEQ ID NO: 3109321 - protein, 5 aa, Giardia lamblia
ESQGK

SEQ ID NO: 3109322 - protein, 7 aa, Giardia lamblia
ESQGSDI

SEQ ID NO: 3109323 - protein, 6 aa, Giardia lamblia
ESQGYA

SEQ ID NO: 3109324 - protein, 5 aa, Giardia lamblia
ESQHN

SEQ ID NO: 3109325 - protein, 9 aa, Giardia lamblia
ESQLRGNDA

SEQ ID NO: 3109326 - protein, 10 aa, Giardia lamblia
ESQNSEEGQT

SEQ ID NO: 3109327 - protein, 12 aa, Giardia lamblia
ESQNTRKEAEEK

SEQ ID NO: 3109328 - protein, 4 aa, Giardia lamblia
ESQP

SEQ ID NO: 3109329 - protein, 6 aa, Giardia lamblia
ESQPFT

SEQ ID NO: 3109330 - protein, 9 aa, Giardia lamblia
ESQPVAPEK

SEQ ID NO: 3109331 - protein, 10 aa, Giardia lamblia
ESQPYSESLR

SEQ ID NO: 3109332 - protein, 9 aa, Giardia lamblia
ESQRESVTG

SEQ ID NO: 3109333 - protein, 8 aa, Giardia lamblia
ESQSDQNL

SEQ ID NO: 3109334 - protein, 8 aa, Giardia lamblia
ESQSEKRR

SEQ ID NO: 3109335 - protein, 17 aa, Giardia lamblia
ESQSLNKTQAADTDQIH

SEQ ID NO: 3109336 - protein, 6 aa, Giardia lamblia
ESQSTI

SEQ ID NO: 3109337 - protein, 5 aa, Giardia lamblia
ESQSV

SEQ ID NO: 3109338 - protein, 7 aa, Giardia lamblia
ESQTGTE

SEQ ID NO: 3109339 - protein, 5 aa, Giardia lamblia
ESQVG

SEQ ID NO: 3109340 - protein, 7 aa, Giardia lamblia
ESQYRRS

SEQ ID NO: 3109341 - protein, 6 aa, Giardia lamblia
ESRDAS

SEQ ID NO: 3109342 - protein, 6 aa, Giardia lamblia
ESRDKV

SEQ ID NO: 3109343 - protein, 7 aa, Giardia lamblia
ESRDLDD

SEQ ID NO: 3109344 - protein, 7 aa, Giardia lamblia
ESRDPST

SEQ ID NO: 3109345 - protein, 23 aa, Giardia lamblia
ESREEADGEATRPSDSSSHSDLN

SEQ ID NO: 3109346 - protein, 4 aa, Giardia lamblia
ESRH

SEQ ID NO: 3109347 - protein, 4 aa, Giardia lamblia
ESRI

SEQ ID NO: 3109348 - protein, 8 aa, Giardia lamblia
ESRKQNEQ

SEQ ID NO: 3109349 - protein, 10 aa, Giardia lamblia
ESRKSISEEE

SEQ ID NO: 3109350 - protein, 6 aa, Giardia lamblia
ESRLTT

SEQ ID NO: 3109351 - protein, 9 aa, Giardia lamblia
ESRMQDGNG

SEQ ID NO: 3109352 - protein, 11 aa, Giardia lamblia
ESRMRKNDGTT

SEQ ID NO: 3109353 - protein, 13 aa, Giardia lamblia
ESRMRSDKAEPAI

SEQ ID NO: 3109354 - protein, 17 aa, Giardia lamblia
ESRNQKRSKSNRHNATT

SEQ ID NO: 3109355 - protein, 5 aa, Giardia lamblia
ESRPN

SEQ ID NO: 3109356 - protein, 9 aa, Giardia lamblia
ESRQDEPSS

SEQ ID NO: 3109357 - protein, 5 aa, Giardia lamblia
ESRQG

SEQ ID NO: 3109358 - protein, 17 aa, Giardia lamblia
ESRQQDGRPNADTSRKL

SEQ ID NO: 3109359 - protein, 8 aa, Giardia lamblia
ESRQTDVD

SEQ ID NO: 3109360 - protein, 6 aa, Giardia lamblia
ESRREE

SEQ ID NO: 3109361 - protein, 9 aa, Giardia lamblia
ESRRQDEWG

SEQ ID NO: 3109362 - protein, 9 aa, Giardia lamblia
ESRRQKENG

SEQ ID NO: 3109363 - protein, 11 aa, Giardia lamblia
ESRSKTPRPLQ

SEQ ID NO: 3109364 - protein, 7 aa, Giardia lamblia
ESRSMAD

SEQ ID NO: 3109365 - protein, 5 aa, Giardia lamblia
ESRSN

SEQ ID NO: 3109366 - protein, 19 aa, Giardia lamblia
ESRSNDNDYAYNPSAEQMQ

SEQ ID NO: 3109367 - protein, 5 aa, Giardia lamblia
ESRTK

SEQ ID NO: 3109368 - protein, 8 aa, Giardia lamblia
ESRTNDTL

SEQ ID NO: 3109369 - protein, 5 aa, Giardia lamblia
ESSAE

SEQ ID NO: 3109370 - protein, 10 aa, Giardia lamblia
ESSANPDALQ

SEQ ID NO: 3109371 - protein, 11 aa, Giardia lamblia
ESSDKKMQSDS

SEQ ID NO: 3109372 - protein, 13 aa, Giardia lamblia
ESSDPKKNRLNRT

SEQ ID NO: 3109373 - protein, 7 aa, Giardia lamblia
ESSDYLE

SEQ ID NO: 3109374 - protein, 14 aa, Giardia lamblia
ESSEAIAPAEQNVR

SEQ ID NO: 3109375 - protein, 9 aa, Giardia lamblia
ESSEAKHET

SEQ ID NO: 3109376 - protein, 7 aa, Giardia lamblia
ESSEANR

SEQ ID NO: 3109377 - protein, 11 aa, Giardia lamblia
ESSEEANKEKA

SEQ ID NO: 3109378 - protein, 9 aa, Giardia lamblia
ESSEISGIS

SEQ ID NO: 3109379 - protein, 7 aa, Giardia lamblia
ESSGETL

SEQ ID NO: 3109380 - protein, 49 aa, Giardia lamblia
ESSGILGASTTSAFSSMTEREQTVRQRASIRDRSRTHSPTSVSRTRDSS

SEQ ID NO: 3109381 - protein, 16 aa, Giardia lamblia
ESSGLETQSQESYSKR

SEQ ID NO: 3109382 - protein, 8 aa, Giardia lamblia
ESSHTETI

SEQ ID NO: 3109383 - protein, 4 aa, Giardia lamblia
ESSI

SEQ ID NO: 3109384 - protein, 18 aa, Giardia lamblia
ESSIDASDSLTGLEPAGT

SEQ ID NO: 3109385 - protein, 15 aa, Giardia lamblia
ESSITNKGNTKPGCT

SEQ ID NO: 3109386 - protein, 16 aa, Giardia lamblia
ESSKEIKRVDKDGRTA

SEQ ID NO: 3109387 - protein, 6 aa, Giardia lamblia
ESSKRA

SEQ ID NO: 3109388 - protein, 4 aa, Giardia lamblia
ESSL

SEQ ID NO: 3109389 - protein, 10 aa, Giardia lamblia
ESSLEQSKKD

SEQ ID NO: 3109390 - protein, 6 aa, Giardia lamblia
ESSLKE

SEQ ID NO: 3109391 - protein, 10 aa, Giardia lamblia
ESSLKTAEAE

SEQ ID NO: 3109392 - protein, 6 aa, Giardia lamblia
ESSLPS

SEQ ID NO: 3109393 - protein, 15 aa, Giardia lamblia
ESSLQEARAENDDLR

SEQ ID NO: 3109394 - protein, 13 aa, Giardia lamblia
ESSLTTKQGATAL

SEQ ID NO: 3109395 - protein, 4 aa, Giardia lamblia
ESSM

SEQ ID NO: 3109396 - protein, 7 aa, Giardia lamblia
ESSMTNS

SEQ ID NO: 3109397 - protein, 9 aa, Giardia lamblia
ESSNAINSE

SEQ ID NO: 3109398 - protein, 9 aa, Giardia lamblia
ESSPGYVPE

SEQ ID NO: 3109399 - protein, 11 aa, Giardia lamblia
ESSPLGLDSAE

SEQ ID NO: 3109400 - protein, 31 aa, Giardia lamblia
ESSPLRTQHGAARSPNAKALGDDSINSPRAL

SEQ ID NO: 3109401 - protein, 9 aa, Giardia lamblia
ESSPSADVR

SEQ ID NO: 3109402 - protein, 20 aa, Giardia lamblia
ESSQGPFPGSKMTKEELATS

SEQ ID NO: 3109403 - protein, 8 aa, Giardia lamblia
ESSQRDYK

SEQ ID NO: 3109404 - protein, 10 aa, Giardia lamblia
ESSRDVSRPV

SEQ ID NO: 3109405 - protein, 7 aa, Giardia lamblia
ESSRGGV

SEQ ID NO: 3109406 - protein, 9 aa, Giardia lamblia
ESSRRPTEE

SEQ ID NO: 3109407 - protein, 6 aa, Giardia lamblia
ESSRSH

SEQ ID NO: 3109408 - protein, 17 aa, Giardia lamblia
ESSSAHPTSPRDPLRES

SEQ ID NO: 3109409 - protein, 14 aa, Giardia lamblia
ESSSDDLRQKAKRS

SEQ ID NO: 3109410 - protein, 13 aa, Giardia lamblia
ESSSDDSSTVPSA

SEQ ID NO: 3109411 - protein, 22 aa, Giardia lamblia
ESSSKDLQLGHSQDGTVSTDTS

SEQ ID NO: 3109412 - protein, 8 aa, Giardia lamblia
ESSSQIPT

SEQ ID NO: 3109413 - protein, 10 aa, Giardia lamblia
ESSSSKEATY

SEQ ID NO: 3109414 - protein, 7 aa, Giardia lamblia
ESSSSPI

SEQ ID NO: 3109415 - protein, 8 aa, Giardia lamblia
ESSSTRIS

SEQ ID NO: 3109416 - protein, 16 aa, Giardia lamblia
ESSSTTEKRSREVSTV

SEQ ID NO: 3109417 - protein, 11 aa, Giardia lamblia
ESSTGGIAESS

SEQ ID NO: 3109418 - protein, 6 aa, Giardia lamblia
ESSTSL

SEQ ID NO: 3109419 - protein, 9 aa, Giardia lamblia
ESSTSNTIT

SEQ ID NO: 3109420 - protein, 8 aa, Giardia lamblia
ESSTTADI

SEQ ID NO: 3109421 - protein, 8 aa, Giardia lamblia
ESSTTDSF

SEQ ID NO: 3109422 - protein, 12 aa, Giardia lamblia
ESSTTSGSSSIP

SEQ ID NO: 3109423 - protein, 7 aa, Giardia lamblia
ESSTVST

SEQ ID NO: 3109424 - protein, 13 aa, Giardia lamblia
ESSVGRPATEHTG

SEQ ID NO: 3109425 - protein, 6 aa, Giardia lamblia
ESSVHA

SEQ ID NO: 3109426 - protein, 4 aa, Giardia lamblia
ESTA

SEQ ID NO: 3109427 - protein, 8 aa, Giardia lamblia
ESTAGETE

SEQ ID NO: 3109428 - protein, 5 aa, Giardia lamblia
ESTAL

SEQ ID NO: 3109429 - protein, 8 aa, Giardia lamblia
ESTDTNTS

SEQ ID NO: 3109430 - protein, 9 aa, Giardia lamblia
ESTEAQTER

SEQ ID NO: 3109431 - protein, 9 aa, Giardia lamblia
ESTEHRAKI

SEQ ID NO: 3109432 - protein, 7 aa, Giardia lamblia
ESTENMK

SEQ ID NO: 3109433 - protein, 9 aa, Giardia lamblia
ESTEPQDTY

SEQ ID NO: 3109434 - protein, 4 aa, Giardia lamblia
ESTF

SEQ ID NO: 3109435 - protein, 7 aa, Giardia lamblia
ESTGDIL

SEQ ID NO: 3109436 - protein, 10 aa, Giardia lamblia
ESTLTDSNGL

SEQ ID NO: 3109437 - protein, 4 aa, Giardia lamblia
ESTN

SEQ ID NO: 3109438 - protein, 9 aa, Giardia lamblia
ESTNGSPRD

SEQ ID NO: 3109439 - protein, 5 aa, Giardia lamblia
ESTNN

SEQ ID NO: 3109440 - protein, 5 aa, Giardia lamblia
ESTNT

SEQ ID NO: 3109441 - protein, 8 aa, Giardia lamblia
ESTPNIPA

SEQ ID NO: 3109442 - protein, 9 aa, Giardia lamblia
ESTPNSANA

SEQ ID NO: 3109443 - protein, 7 aa, Giardia lamblia
ESTQKGL

SEQ ID NO: 3109444 - protein, 13 aa, Giardia lamblia
ESTQPANEAKGTA

SEQ ID NO: 3109445 - protein, 6 aa, Giardia lamblia
ESTQRQ

SEQ ID NO: 3109446 - protein, 7 aa, Giardia lamblia
ESTRAPL

SEQ ID NO: 3109447 - protein, 6 aa, Giardia lamblia
ESTRRP

SEQ ID NO: 3109448 - protein, 15 aa, Giardia lamblia
ESTSERPSEDAASND

SEQ ID NO: 3109449 - protein, 23 aa, Giardia lamblia
ESTSKEAPHMQERPATDSASPAI

SEQ ID NO: 3109450 - protein, 5 aa, Giardia lamblia
ESTTP

SEQ ID NO: 3109451 - protein, 12 aa, Giardia lamblia
ESTTTTQELPRE

SEQ ID NO: 3109452 - protein, 8 aa, Giardia lamblia
ESTVGTSN

SEQ ID NO: 3109453 - protein, 7 aa, Giardia lamblia
ESTVPYT

SEQ ID NO: 3109454 - protein, 5 aa, Giardia lamblia
ESTVR

SEQ ID NO: 3109455 - protein, 5 aa, Giardia lamblia
ESTVS

SEQ ID NO: 3109456 - protein, 6 aa, Giardia lamblia
ESTVSV

SEQ ID NO: 3109457 - protein, 14 aa, Giardia lamblia
ESTYGKPPSVASKE

SEQ ID NO: 3109458 - protein, 17 aa, Giardia lamblia
ESTYPSEDVKELPPDTA

SEQ ID NO: 3109459 - protein, 5 aa, Giardia lamblia
ESVAD

SEQ ID NO: 3109460 - protein, 20 aa, Giardia lamblia
ESVDAPLSHATDQDAASGIK

SEQ ID NO: 3109461 - protein, 7 aa, Giardia lamblia
ESVEPDS

SEQ ID NO: 3109462 - protein, 12 aa, Giardia lamblia
ESVGGYAYGGTA

SEQ ID NO: 3109463 - protein, 8 aa, Giardia lamblia
ESVGTVEG

SEQ ID NO: 3109464 - protein, 9 aa, Giardia lamblia
ESVLSPSNT

SEQ ID NO: 3109465 - protein, 35 aa, Giardia lamblia
ESVNTMTPSRHESRQGLPHSLSSKDHVAKRTPTGV

SEQ ID NO: 3109466 - protein, 8 aa, Giardia lamblia
ESVQTSQL

SEQ ID NO: 3109467 - protein, 23 aa, Giardia lamblia
ESVRQDAKQPATHASGQGKRTAH

SEQ ID NO: 3109468 - protein, 9 aa, Giardia lamblia
ESVSKESLK

SEQ ID NO: 3109469 - protein, 11 aa, Giardia lamblia
ESVSSKNRALE

SEQ ID NO: 3109470 - protein, 44 aa, Giardia lamblia
ESVSSRSTSLNSASSRRASISGPSGTRVPSCKGRSASTSSHALN

SEQ ID NO: 3109471 - protein, 10 aa, Giardia lamblia
ESVSTGASTQ

SEQ ID NO: 3109472 - protein, 7 aa, Giardia lamblia
ESVTNPQ

SEQ ID NO: 3109473 - protein, 16 aa, Giardia lamblia
ESWSPEGQEQSSTGYL

SEQ ID NO: 3109474 - protein, 6 aa, Giardia lamblia
ESYANL

SEQ ID NO: 3109475 - protein, 6 aa, Giardia lamblia
ESYDLS

SEQ ID NO: 3109476 - protein, 6 aa, Giardia lamblia
ESYIEQ

SEQ ID NO: 3109477 - protein, 5 aa, Giardia lamblia
ESYPE

SEQ ID NO: 3109478 - protein, 4 aa, Giardia lamblia
ESYQ

SEQ ID NO: 3109479 - protein, 11 aa, Giardia lamblia
ESYQETSRVPS

SEQ ID NO: 3109480 - protein, 11 aa, Giardia lamblia
ESYRYKPSALT

SEQ ID NO: 3109481 - protein, 9 aa, Giardia lamblia
ESYSTPGTQ

SEQ ID NO: 3109482 - protein, 4 aa, Giardia lamblia
ESYT

SEQ ID NO: 3109483 - protein, 9 aa, Giardia lamblia
ESYTGSGTS

SEQ ID NO: 3109484 - protein, 5 aa, Giardia lamblia
ESYTR

SEQ ID NO: 3109485 - protein, 7 aa, Giardia lamblia
ESYYGDS

SEQ ID NO: 3109486 - protein, 7 aa, Giardia lamblia
ETAAADV

SEQ ID NO: 3109487 - protein, 8 aa, Giardia lamblia
ETAAGHDP

SEQ ID NO: 3109488 - protein, 6 aa, Giardia lamblia
ETAAQR

SEQ ID NO: 3109489 - protein, 16 aa, Giardia lamblia
ETAASFETDDSSGSHD

SEQ ID NO: 3109490 - protein, 18 aa, Giardia lamblia
ETAEHNDNSTQSDKINEN

SEQ ID NO: 3109491 - protein, 4 aa, Giardia lamblia
ETAF

SEQ ID NO: 3109492 - protein, 14 aa, Giardia lamblia
ETAGVSTEVTRDVA

SEQ ID NO: 3109493 - protein, 4 aa, Giardia lamblia
ETAH

SEQ ID NO: 3109494 - protein, 6 aa, Giardia lamblia
ETAKHT

SEQ ID NO: 3109495 - protein, 11 aa, Giardia lamblia
ETAKKNEYPPL

SEQ ID NO: 3109496 - protein, 12 aa, Giardia lamblia
ETAKSKGGPLPE

SEQ ID NO: 3109497 - protein, 9 aa, Giardia lamblia
ETANGTMEA

SEQ ID NO: 3109498 - protein, 6 aa, Giardia lamblia
ETANSF

SEQ ID NO: 3109499 - protein, 9 aa, Giardia lamblia
ETAPESKTV

SEQ ID NO: 3109500 - protein, 9 aa, Giardia lamblia
ETAPQESNN

SEQ ID NO: 3109501 - protein, 4 aa, Giardia lamblia
ETAQ

SEQ ID NO: 3109502 - protein, 6 aa, Giardia lamblia
ETARDK

SEQ ID NO: 3109503 - protein, 13 aa, Giardia lamblia
ETARRHEEDVARR

SEQ ID NO: 3109504 - protein, 4 aa, Giardia lamblia
ETAS

SEQ ID NO: 3109505 - protein, 25 aa, Giardia lamblia
ETASCTSTALAPTSDTGNLQEESRD

SEQ ID NO: 3109506 - protein, 11 aa, Giardia lamblia
ETASGESYQGE

SEQ ID NO: 3109507 - protein, 6 aa, Giardia lamblia
ETASSV

SEQ ID NO: 3109508 - protein, 10 aa, Giardia lamblia
ETASTSSIGD

SEQ ID NO: 3109509 - protein, 5 aa, Giardia lamblia
ETATG

SEQ ID NO: 3109510 - protein, 4 aa, Giardia lamblia
ETCR

SEQ ID NO: 3109511 - protein, 9 aa, Giardia lamblia
ETDAEKRHL

SEQ ID NO: 3109512 - protein, 8 aa, Giardia lamblia
ETDGTKSI

SEQ ID NO: 3109513 - protein, 6 aa, Giardia lamblia
ETDISG

SEQ ID NO: 3109514 - protein, 13 aa, Giardia lamblia
ETDLKNAESLPSA

SEQ ID NO: 3109515 - protein, 5 aa, Giardia lamblia
ETDLT

SEQ ID NO: 3109516 - protein, 4 aa, Giardia lamblia
ETDR

SEQ ID NO: 3109517 - protein, 10 aa, Giardia lamblia
ETDRSRRQNM

SEQ ID NO: 3109518 - protein, 9 aa, Giardia lamblia
ETDSGSDKR

SEQ ID NO: 3109519 - protein, 10 aa, Giardia lamblia
ETDSVSSSDC

SEQ ID NO: 3109520 - protein, 15 aa, Giardia lamblia
ETDSVSTEIFGSTLF

SEQ ID NO: 3109521 - protein, 9 aa, Giardia lamblia
ETDTPENKA

SEQ ID NO: 3109522 - protein, 13 aa, Giardia lamblia
ETDYTEATANKGL

SEQ ID NO: 3109523 - protein, 4 aa, Giardia lamblia
ETEA

SEQ ID NO: 3109524 - protein, 4 aa, Giardia lamblia
ETED

SEQ ID NO: 3109525 - protein, 9 aa, Giardia lamblia
ETEEPQKAM

SEQ ID NO: 3109526 - protein, 9 aa, Giardia lamblia
ETEERQREI

SEQ ID NO: 3109527 - protein, 8 aa, Giardia lamblia
ETEEYGGL

SEQ ID NO: 3109528 - protein, 14 aa, Giardia lamblia
ETEKASSNSIGSIN

SEQ ID NO: 3109529 - protein, 9 aa, Giardia lamblia
ETEKDLKTT

SEQ ID NO: 3109530 - protein, 6 aa, Giardia lamblia
ETEKSK

SEQ ID NO: 3109531 - protein, 7 aa, Giardia lamblia
ETEKTER

SEQ ID NO: 3109532 - protein, 17 aa, Giardia lamblia
ETELREDDETKDTAAPM

SEQ ID NO: 3109533 - protein, 7 aa, Giardia lamblia
ETENPTH

SEQ ID NO: 3109534 - protein, 6 aa, Giardia lamblia
ETENQR

SEQ ID NO: 3109535 - protein, 5 aa, Giardia lamblia
ETENS

SEQ ID NO: 3109536 - protein, 10 aa, Giardia lamblia
ETENSGLKAE

SEQ ID NO: 3109537 - protein, 5 aa, Giardia lamblia
ETEPA

SEQ ID NO: 3109538 - protein, 8 aa, Giardia lamblia
ETEQHTKE

SEQ ID NO: 3109539 - protein, 5 aa, Giardia lamblia
ETERS

SEQ ID NO: 3109540 - protein, 6 aa, Giardia lamblia
ETESGF

SEQ ID NO: 3109541 - protein, 7 aa, Giardia lamblia
ETETASS

SEQ ID NO: 3109542 - protein, 6 aa, Giardia lamblia
ETETDH

SEQ ID NO: 3109543 - protein, 17 aa, Giardia lamblia
ETETPLGSVRRSPEAAH

SEQ ID NO: 3109544 - protein, 19 aa, Giardia lamblia
ETETQGKRRIAQAREENAQ

SEQ ID NO: 3109545 - protein, 11 aa, Giardia lamblia
ETETTSKYKAL

SEQ ID NO: 3109546 - protein, 6 aa, Giardia lamblia
ETFENG

SEQ ID NO: 3109547 - protein, 6 aa, Giardia lamblia
ETFSSS

SEQ ID NO: 3109548 - protein, 12 aa, Giardia lamblia
ETFTTYADNQTT

SEQ ID NO: 3109549 - protein, 5 aa, Giardia lamblia
ETGCR

SEQ ID NO: 3109550 - protein, 4 aa, Giardia lamblia
ETGE

SEQ ID NO: 3109551 - protein, 22 aa, Giardia lamblia
ETGEVDQYGGRNHAEEVTAADP

SEQ ID NO: 3109552 - protein, 5 aa, Giardia lamblia
ETGEW

SEQ ID NO: 3109553 - protein, 10 aa, Giardia lamblia
ETGGRSTARL

SEQ ID NO: 3109554 - protein, 10 aa, Giardia lamblia
ETGGTSEAAS

SEQ ID NO: 3109555 - protein, 16 aa, Giardia lamblia
ETGGVTPEPPRPSPYV

SEQ ID NO: 3109556 - protein, 10 aa, Giardia lamblia
ETGIKNNGHQ

SEQ ID NO: 3109557 - protein, 6 aa, Giardia lamblia
ETGIQN

SEQ ID NO: 3109558 - protein, 11 aa, Giardia lamblia
ETGIQNNSGDT

SEQ ID NO: 3109559 - protein, 9 aa, Giardia lamblia
ETGIRNNEH

SEQ ID NO: 3109560 - protein, 10 aa, Giardia lamblia
ETGIRNNEHQ

SEQ ID NO: 3109561 - protein, 4 aa, Giardia lamblia
ETGM

SEQ ID NO: 3109562 - protein, 7 aa, Giardia lamblia
ETGNTEK

SEQ ID NO: 3109563 - protein, 11 aa, Giardia lamblia
ETGQLDKTGYS

SEQ ID NO: 3109564 - protein, 7 aa, Giardia lamblia
ETGRETE

SEQ ID NO: 3109565 - protein, 7 aa, Giardia lamblia
ETGSATL

SEQ ID NO: 3109566 - protein, 11 aa, Giardia lamblia
ETGSGKSTRIP

SEQ ID NO: 3109567 - protein, 5 aa, Giardia lamblia
ETGSQ

SEQ ID NO: 3109568 - protein, 6 aa, Giardia lamblia
ETGTGM

SEQ ID NO: 3109569 - protein, 4 aa, Giardia lamblia
ETGV

SEQ ID NO: 3109570 - protein, 4 aa, Giardia lamblia
ETGY

SEQ ID NO: 3109571 - protein, 6 aa, Giardia lamblia
ETHESV

SEQ ID NO: 3109572 - protein, 5 aa, Giardia lamblia
ETHGN

SEQ ID NO: 3109573 - protein, 10 aa, Giardia lamblia
ETHKATGKHK

SEQ ID NO: 3109574 - protein, 7 aa, Giardia lamblia
ETHKPIP

SEQ ID NO: 3109575 - protein, 4 aa, Giardia lamblia
ETIA

SEQ ID NO: 3109576 - protein, 4 aa, Giardia lamblia
ETIE

SEQ ID NO: 3109577 - protein, 9 aa, Giardia lamblia
ETIKAAGGK

SEQ ID NO: 3109578 - protein, 4 aa, Giardia lamblia
ETIQ

SEQ ID NO: 3109579 - protein, 6 aa, Giardia lamblia
ETKAPI

SEQ ID NO: 3109580 - protein, 11 aa, Giardia lamblia
ETKATQGNTPM

SEQ ID NO: 3109581 - protein, 6 aa, Giardia lamblia
ETKERS

SEQ ID NO: 3109582 - protein, 10 aa, Giardia lamblia
ETKGVKKDEV

SEQ ID NO: 3109583 - protein, 4 aa, Giardia lamblia
ETKI

SEQ ID NO: 3109584 - protein, 7 aa, Giardia lamblia
ETKPNNR

SEQ ID NO: 3109585 - protein, 7 aa, Giardia lamblia
ETKQREM

SEQ ID NO: 3109586 - protein, 14 aa, Giardia lamblia
ETKQSGSKEAPQIS

SEQ ID NO: 3109587 - protein, 10 aa, Giardia lamblia
ETKQTNARGE

SEQ ID NO: 3109588 - protein, 24 aa, Giardia lamblia
ETKRIKEERRQAELQEGLQEKETA

SEQ ID NO: 3109589 - protein, 9 aa, Giardia lamblia
ETKRTRPTF

SEQ ID NO: 3109590 - protein, 5 aa, Giardia lamblia
ETKSE

SEQ ID NO: 3109591 - protein, 27 aa, Giardia lamblia
ETKSSKTHSTEEMQSDHSSDEHAEPIE

SEQ ID NO: 3109592 - protein, 51 aa, Giardia lamblia
ETKTASISKSSLAPRESSEGDTDDIHDADEGIESISKRSEDQTAKQSYNPV

SEQ ID NO: 3109593 - protein, 9 aa, Giardia lamblia
ETKTFTPEE

SEQ ID NO: 3109594 - protein, 7 aa, Giardia lamblia
ETKTQED

SEQ ID NO: 3109595 - protein, 8 aa, Giardia lamblia
ETKTQELD

SEQ ID NO: 3109596 - protein, 4 aa, Giardia lamblia
ETLA

SEQ ID NO: 3109597 - protein, 12 aa, Giardia lamblia
ETLADEYSTMSP

SEQ ID NO: 3109598 - protein, 8 aa, Giardia lamblia
ETLAGNSD

SEQ ID NO: 3109599 - protein, 19 aa, Giardia lamblia
ETLANKQKAELDEYTASLE

SEQ ID NO: 3109600 - protein, 7 aa, Giardia lamblia
ETLASHR

SEQ ID NO: 3109601 - protein, 6 aa, Giardia lamblia
ETLGDD

SEQ ID NO: 3109602 - protein, 8 aa, Giardia lamblia
ETLGNERD

SEQ ID NO: 3109603 - protein, 9 aa, Giardia lamblia
ETLKNEAQT

SEQ ID NO: 3109604 - protein, 35 aa, Giardia lamblia
ETMDTTSEYTQDTTNSLPTGGDYSSALAATTAPGV

SEQ ID NO: 3109605 - protein, 4 aa, Giardia lamblia
ETMT

SEQ ID NO: 3109606 - protein, 6 aa, Giardia lamblia
ETNDEQ

SEQ ID NO: 3109607 - protein, 9 aa, Giardia lamblia
ETNDPAPVT

SEQ ID NO: 3109608 - protein, 7 aa, Giardia lamblia
ETNEERL

SEQ ID NO: 3109609 - protein, 6 aa, Giardia lamblia
ETNGYV

SEQ ID NO: 3109610 - protein, 5 aa, Giardia lamblia
ETNKE

SEQ ID NO: 3109611 - protein, 8 aa, Giardia lamblia
ETNKKRKV

SEQ ID NO: 3109612 - protein, 8 aa, Giardia lamblia
ETNKNNQT

SEQ ID NO: 3109613 - protein, 8 aa, Giardia lamblia
ETNKNSQI

SEQ ID NO: 3109614 - protein, 5 aa, Giardia lamblia
ETNKT

SEQ ID NO: 3109615 - protein, 8 aa, Giardia lamblia
ETNKVGQA

SEQ ID NO: 3109616 - protein, 15 aa, Giardia lamblia
ETNNTQFVGNAQPAH

SEQ ID NO: 3109617 - protein, 10 aa, Giardia lamblia
ETNPDQGYPR

SEQ ID NO: 3109618 - protein, 6 aa, Giardia lamblia
ETNPHM

SEQ ID NO: 3109619 - protein, 10 aa, Giardia lamblia
ETNPSRHKRI

SEQ ID NO: 3109620 - protein, 11 aa, Giardia lamblia
ETNRQDKRGRT

SEQ ID NO: 3109621 - protein, 4 aa, Giardia lamblia
ETNS

SEQ ID NO: 3109622 - protein, 5 aa, Giardia lamblia
ETNSN

SEQ ID NO: 3109623 - protein, 6 aa, Giardia lamblia
ETNSSV

SEQ ID NO: 3109624 - protein, 11 aa, Giardia lamblia
ETNYSAPNGIT

SEQ ID NO: 3109625 - protein, 26 aa, Giardia lamblia
ETPAAANHNGSHNNSADKEPASTAPT

SEQ ID NO: 3109626 - protein, 9 aa, Giardia lamblia
ETPAEEKEK

SEQ ID NO: 3109627 - protein, 10 aa, Giardia lamblia
ETPAEPPADE

SEQ ID NO: 3109628 - protein, 11 aa, Giardia lamblia
ETPAPIEGVDD

SEQ ID NO: 3109629 - protein, 21 aa, Giardia lamblia
ETPAVSSTTQLSRPNSAQSTM

SEQ ID NO: 3109630 - protein, 13 aa, Giardia lamblia
ETPDAVSAEAAAA

SEQ ID NO: 3109631 - protein, 5 aa, Giardia lamblia
ETPDP

SEQ ID NO: 3109632 - protein, 4 aa, Giardia lamblia
ETPE

SEQ ID NO: 3109633 - protein, 16 aa, Giardia lamblia
ETPEARMKDSGKGRTA

SEQ ID NO: 3109634 - protein, 5 aa, Giardia lamblia
ETPEE

SEQ ID NO: 3109635 - protein, 7 aa, Giardia lamblia
ETPEGAK

SEQ ID NO: 3109636 - protein, 7 aa, Giardia lamblia
ETPEGIM

SEQ ID NO: 3109637 - protein, 5 aa, Giardia lamblia
ETPEI

SEQ ID NO: 3109638 - protein, 10 aa, Giardia lamblia
ETPEKRPSNA

SEQ ID NO: 3109639 - protein, 7 aa, Giardia lamblia
ETPGASS

SEQ ID NO: 3109640 - protein, 6 aa, Giardia lamblia
ETPGGM

SEQ ID NO: 3109641 - protein, 18 aa, Giardia lamblia
ETPGHSVTPAVAPSGHAS

SEQ ID NO: 3109642 - protein, 6 aa, Giardia lamblia
ETPIPE

SEQ ID NO: 3109643 - protein, 17 aa, Giardia lamblia
ETPNHQESELSSHTEKT

SEQ ID NO: 3109644 - protein, 28 aa, Giardia lamblia
ETPPPEPDAYADAGAQGNDYKVDDEAAA

SEQ ID NO: 3109645 - protein, 10 aa, Giardia lamblia
ETPQSETYTG

SEQ ID NO: 3109646 - protein, 7 aa, Giardia lamblia
ETPTGHV

SEQ ID NO: 3109647 - protein, 14 aa, Giardia lamblia
ETPVGEKKNISGAW

SEQ ID NO: 3109648 - protein, 6 aa, Giardia lamblia
ETPVSP

SEQ ID NO: 3109649 - protein, 13 aa, Giardia lamblia
ETQAQAPTTALGP

SEQ ID NO: 3109650 - protein, 10 aa, Giardia lamblia
ETQDSDRTGA

SEQ ID NO: 3109651 - protein, 6 aa, Giardia lamblia
ETQEEL

SEQ ID NO: 3109652 - protein, 6 aa, Giardia lamblia
ETQETQ

SEQ ID NO: 3109653 - protein, 18 aa, Giardia lamblia
ETQHSKDLGESRRMPPRS

SEQ ID NO: 3109654 - protein, 5 aa, Giardia lamblia
ETQKY

SEQ ID NO: 3109655 - protein, 5 aa, Giardia lamblia
ETQNA

SEQ ID NO: 3109656 - protein, 12 aa, Giardia lamblia
ETQSHANNIQNE

SEQ ID NO: 3109657 - protein, 17 aa, Giardia lamblia
ETQTQTGENPYSSETEG

SEQ ID NO: 3109658 - protein, 4 aa, Giardia lamblia
ETRA

SEQ ID NO: 3109659 - protein, 13 aa, Giardia lamblia
ETRAKQADTLEKT

SEQ ID NO: 3109660 - protein, 5 aa, Giardia lamblia
ETRDP

SEQ ID NO: 3109661 - protein, 9 aa, Giardia lamblia
ETRENTKAY

SEQ ID NO: 3109662 - protein, 8 aa, Giardia lamblia
ETRESEYL

SEQ ID NO: 3109663 - protein, 5 aa, Giardia lamblia
ETRGP

SEQ ID NO: 3109664 - protein, 8 aa, Giardia lamblia
ETRIQDRN

SEQ ID NO: 3109665 - protein, 10 aa, Giardia lamblia
ETRKDNQSIY

SEQ ID NO: 3109666 - protein, 13 aa, Giardia lamblia
ETRLKKTGTRAGG

SEQ ID NO: 3109667 - protein, 10 aa, Giardia lamblia
ETRMKNNDHQ

SEQ ID NO: 3109668 - protein, 8 aa, Giardia lamblia
ETRQERSS

SEQ ID NO: 3109669 - protein, 6 aa, Giardia lamblia
ETRREQ

SEQ ID NO: 3109670 - protein, 8 aa, Giardia lamblia
ETRRNNDY

SEQ ID NO: 3109671 - protein, 19 aa, Giardia lamblia
ETRSKRAEARQRKKERVAN

SEQ ID NO: 3109672 - protein, 29 aa, Giardia lamblia
ETRSKSAKLDGVAKNPGVSHTDAASTYKR

SEQ ID NO: 3109673 - protein, 4 aa, Giardia lamblia
ETRT

SEQ ID NO: 3109674 - protein, 6 aa, Giardia lamblia
ETRVPP

SEQ ID NO: 3109675 - protein, 9 aa, Giardia lamblia
ETSAAPGKQ

SEQ ID NO: 3109676 - protein, 7 aa, Giardia lamblia
ETSAITE

SEQ ID NO: 3109677 - protein, 10 aa, Giardia lamblia
ETSASGDSVC

SEQ ID NO: 3109678 - protein, 11 aa, Giardia lamblia
ETSASSGHGID

SEQ ID NO: 3109679 - protein, 20 aa, Giardia lamblia
ETSDGDKETNATSKQTIKPG

SEQ ID NO: 3109680 - protein, 8 aa, Giardia lamblia
ETSDIENE

SEQ ID NO: 3109681 - protein, 27 aa, Giardia lamblia
ETSDKSVETSTTDPVVTRNQQQPDSES

SEQ ID NO: 3109682 - protein, 8 aa, Giardia lamblia
ETSDNLSV

SEQ ID NO: 3109683 - protein, 27 aa, Giardia lamblia
ETSEPGQRATSRPPSSRLTKSTLSASF

SEQ ID NO: 3109684 - protein, 7 aa, Giardia lamblia
ETSGTNM

SEQ ID NO: 3109685 - protein, 7 aa, Giardia lamblia
ETSKKDK

SEQ ID NO: 3109686 - protein, 6 aa, Giardia lamblia
ETSKLP

SEQ ID NO: 3109687 - protein, 15 aa, Giardia lamblia
ETSKLRQDSLEAENA

SEQ ID NO: 3109688 - protein, 5 aa, Giardia lamblia
ETSKN

SEQ ID NO: 3109689 - protein, 6 aa, Giardia lamblia
ETSLPV

SEQ ID NO: 3109690 - protein, 7 aa, Giardia lamblia
ETSLTSQ

SEQ ID NO: 3109691 - protein, 9 aa, Giardia lamblia
ETSNMHGPD

SEQ ID NO: 3109692 - protein, 8 aa, Giardia lamblia
ETSNREAE

SEQ ID NO: 3109693 - protein, 9 aa, Giardia lamblia
ETSNSELQE

SEQ ID NO: 3109694 - protein, 7 aa, Giardia lamblia
ETSNYGK

SEQ ID NO: 3109695 - protein, 6 aa, Giardia lamblia
ETSPED

SEQ ID NO: 3109696 - protein, 17 aa, Giardia lamblia
ETSPGYDAFANICGKII

SEQ ID NO: 3109697 - protein, 7 aa, Giardia lamblia
ETSPQNL

SEQ ID NO: 3109698 - protein, 8 aa, Giardia lamblia
ETSQKAKY

SEQ ID NO: 3109699 - protein, 7 aa, Giardia lamblia
ETSQQED

SEQ ID NO: 3109700 - protein, 7 aa, Giardia lamblia
ETSRAQP

SEQ ID NO: 3109701 - protein, 12 aa, Giardia lamblia
ETSRPRSSHGSY

SEQ ID NO: 3109702 - protein, 11 aa, Giardia lamblia
ETSRQNHDGET

SEQ ID NO: 3109703 - protein, 4 aa, Giardia lamblia
ETSS

SEQ ID NO: 3109704 - protein, 5 aa, Giardia lamblia
ETSSA

SEQ ID NO: 3109705 - protein, 10 aa, Giardia lamblia
ETSTKPAQLS

SEQ ID NO: 3109706 - protein, 5 aa, Giardia lamblia
ETSVT

SEQ ID NO: 3109707 - protein, 10 aa, Giardia lamblia
ETTAASENNI

SEQ ID NO: 3109708 - protein, 7 aa, Giardia lamblia
ETTARNS

SEQ ID NO: 3109709 - protein, 14 aa, Giardia lamblia
ETTDEMKTEEDEED

SEQ ID NO: 3109710 - protein, 5 aa, Giardia lamblia
ETTEA

SEQ ID NO: 3109711 - protein, 10 aa, Giardia lamblia
ETTEESISQR

SEQ ID NO: 3109712 - protein, 5 aa, Giardia lamblia
ETTEQ

SEQ ID NO: 3109713 - protein, 10 aa, Giardia lamblia
ETTGKAAPKL

SEQ ID NO: 3109714 - protein, 9 aa, Giardia lamblia
ETTIESQRQ

SEQ ID NO: 3109715 - protein, 16 aa, Giardia lamblia
ETTKKPLRFPNAEAGD

SEQ ID NO: 3109716 - protein, 8 aa, Giardia lamblia
ETTKKYAH

SEQ ID NO: 3109717 - protein, 6 aa, Giardia lamblia
ETTKSG

SEQ ID NO: 3109718 - protein, 12 aa, Giardia lamblia
ETTKTGANDKPV

SEQ ID NO: 3109719 - protein, 9 aa, Giardia lamblia
ETTLASTEQ

SEQ ID NO: 3109720 - protein, 4 aa, Giardia lamblia
ETTM

SEQ ID NO: 3109721 - protein, 10 aa, Giardia lamblia
ETTPPIKSQE

SEQ ID NO: 3109722 - protein, 12 aa, Giardia lamblia
ETTQAQKSLPSV

SEQ ID NO: 3109723 - protein, 12 aa, Giardia lamblia
ETTQKLQQSTGL

SEQ ID NO: 3109724 - protein, 12 aa, Giardia lamblia
ETTRKKLGEKRK

SEQ ID NO: 3109725 - protein, 4 aa, Giardia lamblia
ETTS

SEQ ID NO: 3109726 - protein, 4 aa, Giardia lamblia
ETTT

SEQ ID NO: 3109727 - protein, 5 aa, Giardia lamblia
ETTTC

SEQ ID NO: 3109728 - protein, 6 aa, Giardia lamblia
ETTTGA

SEQ ID NO: 3109729 - protein, 5 aa, Giardia lamblia
ETTTN

SEQ ID NO: 3109730 - protein, 7 aa, Giardia lamblia
ETTTPKE

SEQ ID NO: 3109731 - protein, 19 aa, Giardia lamblia
ETTTVRSTSCSKEDGSQPI

SEQ ID NO: 3109732 - protein, 4 aa, Giardia lamblia
ETVA

SEQ ID NO: 3109733 - protein, 8 aa, Giardia lamblia
ETVAQDNK

SEQ ID NO: 3109734 - protein, 4 aa, Giardia lamblia
ETVD

SEQ ID NO: 3109735 - protein, 21 aa, Giardia lamblia
ETVEHTDKSAQSSVDASTHAT

SEQ ID NO: 3109736 - protein, 26 aa, Giardia lamblia
ETVETAQNDASKLTSYGETEEDFPPD

SEQ ID NO: 3109737 - protein, 17 aa, Giardia lamblia
ETVPKHAEVPPSSAPSE

SEQ ID NO: 3109738 - protein, 10 aa, Giardia lamblia
ETVQSKSLSE

SEQ ID NO: 3109739 - protein, 32 aa, Giardia lamblia
ETVSEGDTQGGGCSAGKRGQSEACKMGYLDQW

SEQ ID NO: 3109740 - protein, 6 aa, Giardia lamblia
ETVSPE

SEQ ID NO: 3109741 - protein, 6 aa, Giardia lamblia
ETVSQK

SEQ ID NO: 3109742 - protein, 10 aa, Giardia lamblia
ETVSTDQSGS

SEQ ID NO: 3109743 - protein, 5 aa, Giardia lamblia
ETVTA

SEQ ID NO: 3109744 - protein, 9 aa, Giardia lamblia
ETVTEDKDY

SEQ ID NO: 3109745 - protein, 6 aa, Giardia lamblia
ETVTER

SEQ ID NO: 3109746 - protein, 5 aa, Giardia lamblia
ETVTQ

SEQ ID NO: 3109747 - protein, 6 aa, Giardia lamblia
ETYEEE

SEQ ID NO: 3109748 - protein, 8 aa, Giardia lamblia
ETYEKERQ

SEQ ID NO: 3109749 - protein, 10 aa, Giardia lamblia
ETYKDKTVDE

SEQ ID NO: 3109750 - protein, 4 aa, Giardia lamblia
ETYL

SEQ ID NO: 3109751 - protein, 7 aa, Giardia lamblia
ETYRQQL

SEQ ID NO: 3109752 - protein, 17 aa, Giardia lamblia
ETYSDDEGEEVAPSKHQ

SEQ ID NO: 3109753 - protein, 5 aa, Giardia lamblia
ETYSG

SEQ ID NO: 3109754 - protein, 27 aa, Giardia lamblia
ETYTREDIAESSVDQDVDASLEEQNAG

SEQ ID NO: 3109755 - protein, 4 aa, Giardia lamblia
EVAG

SEQ ID NO: 3109756 - protein, 6 aa, Giardia lamblia
EVAGPQ

SEQ ID NO: 3109757 - protein, 4 aa, Giardia lamblia
EVAP

SEQ ID NO: 3109758 - protein, 7 aa, Giardia lamblia
EVAPREA

SEQ ID NO: 3109759 - protein, 15 aa, Giardia lamblia
EVARPGSLSSPRPSS

SEQ ID NO: 3109760 - protein, 4 aa, Giardia lamblia
EVAS

SEQ ID NO: 3109761 - protein, 6 aa, Giardia lamblia
EVASIG

SEQ ID NO: 3109762 - protein, 6 aa, Giardia lamblia
EVCPST

SEQ ID NO: 3109763 - protein, 10 aa, Giardia lamblia
EVDDSTSTAL

SEQ ID NO: 3109764 - protein, 9 aa, Giardia lamblia
EVDERGNTS

SEQ ID NO: 3109765 - protein, 5 aa, Giardia lamblia
EVDEY

SEQ ID NO: 3109766 - protein, 15 aa, Giardia lamblia
EVDGDDGEKGSGLPD

SEQ ID NO: 3109767 - protein, 6 aa, Giardia lamblia
EVDSDG

SEQ ID NO: 3109768 - protein, 5 aa, Giardia lamblia
EVDVG

SEQ ID NO: 3109769 - protein, 5 aa, Giardia lamblia
EVEAS

SEQ ID NO: 3109770 - protein, 6 aa, Giardia lamblia
EVEDEA

SEQ ID NO: 3109771 - protein, 5 aa, Giardia lamblia
EVEET

SEQ ID NO: 3109772 - protein, 11 aa, Giardia lamblia
EVEGSSPSSSS

SEQ ID NO: 3109773 - protein, 4 aa, Giardia lamblia
EVEK

SEQ ID NO: 3109774 - protein, 8 aa, Giardia lamblia
EVEKERRS

SEQ ID NO: 3109775 - protein, 10 aa, Giardia lamblia
EVEPRRKAEA

SEQ ID NO: 3109776 - protein, 6 aa, Giardia lamblia
EVEQEA

SEQ ID NO: 3109777 - protein, 14 aa, Giardia lamblia
EVEQEKEQAIAGRD

SEQ ID NO: 3109778 - protein, 8 aa, Giardia lamblia
EVETQAAK

SEQ ID NO: 3109779 - protein, 6 aa, Giardia lamblia
EVGADR

SEQ ID NO: 3109780 - protein, 4 aa, Giardia lamblia
EVGE

SEQ ID NO: 3109781 - protein, 15 aa, Giardia lamblia
EVGEEAERAQAAAEA

SEQ ID NO: 3109782 - protein, 6 aa, Giardia lamblia
EVGNTT

SEQ ID NO: 3109783 - protein, 15 aa, Giardia lamblia
EVGPATGEPSPETAP

SEQ ID NO: 3109784 - protein, 6 aa, Giardia lamblia
EVGQSS

SEQ ID NO: 3109785 - protein, 4 aa, Giardia lamblia
EVGR

SEQ ID NO: 3109786 - protein, 33 aa, Giardia lamblia
EVGTPESTVTPHSEQQSPPGLLPPPPPPQPRHS

SEQ ID NO: 3109787 - protein, 13 aa, Giardia lamblia
EVGYSSKISQRSF

SEQ ID NO: 3109788 - protein, 4 aa, Giardia lamblia
EVHA

SEQ ID NO: 3109789 - protein, 8 aa, Giardia lamblia
EVKKSADN

SEQ ID NO: 3109790 - protein, 8 aa, Giardia lamblia
EVKPSSGA

SEQ ID NO: 3109791 - protein, 8 aa, Giardia lamblia
EVKQEERS

SEQ ID NO: 3109792 - protein, 15 aa, Giardia lamblia
EVKRGRSGLSTSTTS

SEQ ID NO: 3109793 - protein, 8 aa, Giardia lamblia
EVKTYKKR

SEQ ID NO: 3109794 - protein, 13 aa, Giardia lamblia
EVLPSSKTFAGAP

SEQ ID NO: 3109795 - protein, 12 aa, Giardia lamblia
EVNATGGKGPDA

SEQ ID NO: 3109796 - protein, 10 aa, Giardia lamblia
EVNEASKSLL

SEQ ID NO: 3109797 - protein, 5 aa, Giardia lamblia
EVNGD

SEQ ID NO: 3109798 - protein, 11 aa, Giardia lamblia
EVNGEVSTDPD

SEQ ID NO: 3109799 - protein, 16 aa, Giardia lamblia
EVNGTIDDLDGDGALK

SEQ ID NO: 3109800 - protein, 5 aa, Giardia lamblia
EVNKK

SEQ ID NO: 3109801 - protein, 8 aa, Giardia lamblia
EVNTNGDT

SEQ ID NO: 3109802 - protein, 9 aa, Giardia lamblia
EVPDTATNL

SEQ ID NO: 3109803 - protein, 18 aa, Giardia lamblia
EVPGTRGRTTLDVTPKKD

SEQ ID NO: 3109804 - protein, 5 aa, Giardia lamblia
EVPKS

SEQ ID NO: 3109805 - protein, 6 aa, Giardia lamblia
EVPLPD

SEQ ID NO: 3109806 - protein, 21 aa, Giardia lamblia
EVPNPGTSKSSYDRALTSTTS

SEQ ID NO: 3109807 - protein, 6 aa, Giardia lamblia
EVPPNQ

SEQ ID NO: 3109808 - protein, 29 aa, Giardia lamblia
EVPQRQATAPQPSTEQKKQEEPQPQSDVN

SEQ ID NO: 3109809 - protein, 6 aa, Giardia lamblia
EVQANS

SEQ ID NO: 3109810 - protein, 5 aa, Giardia lamblia
EVQDA

SEQ ID NO: 3109811 - protein, 16 aa, Giardia lamblia
EVQDENAALKDELEAK

SEQ ID NO: 3109812 - protein, 16 aa, Giardia lamblia
EVQEDPPPSAGAKSQV

SEQ ID NO: 3109813 - protein, 8 aa, Giardia lamblia
EVQEHTAR

SEQ ID NO: 3109814 - protein, 10 aa, Giardia lamblia
EVQEKYPSNT

SEQ ID NO: 3109815 - protein, 6 aa, Giardia lamblia
EVQERE

SEQ ID NO: 3109816 - protein, 9 aa, Giardia lamblia
EVQKASVRE

SEQ ID NO: 3109817 - protein, 9 aa, Giardia lamblia
EVQPPTEPE

SEQ ID NO: 3109818 - protein, 12 aa, Giardia lamblia
EVQRARDASDSI

SEQ ID NO: 3109819 - protein, 8 aa, Giardia lamblia
EVQRQNDT

SEQ ID NO: 3109820 - protein, 22 aa, Giardia lamblia
EVQSGNDKGTRSISPNPDQDDL

SEQ ID NO: 3109821 - protein, 5 aa, Giardia lamblia
EVQTE

SEQ ID NO: 3109822 - protein, 12 aa, Giardia lamblia
EVQTKEEAKYEE

SEQ ID NO: 3109823 - protein, 5 aa, Giardia lamblia
EVRGS

SEQ ID NO: 3109824 - protein, 6 aa, Giardia lamblia
EVRSEM

SEQ ID NO: 3109825 - protein, 13 aa, Giardia lamblia
EVRSGGAPTSASD

SEQ ID NO: 3109826 - protein, 11 aa, Giardia lamblia
EVRTPNAPPGL

SEQ ID NO: 3109827 - protein, 18 aa, Giardia lamblia
EVRTPVDQLTPNKSIEPE

SEQ ID NO: 3109828 - protein, 7 aa, Giardia lamblia
EVSADDG

SEQ ID NO: 3109829 - protein, 14 aa, Giardia lamblia
EVSAGELKKNKQYT

SEQ ID NO: 3109830 - protein, 8 aa, Giardia lamblia
EVSATEPV

SEQ ID NO: 3109831 - protein, 10 aa, Giardia lamblia
EVSERTKTYS

SEQ ID NO: 3109832 - protein, 18 aa, Giardia lamblia
EVSESEEEEVHGTSRPVR

SEQ ID NO: 3109833 - protein, 9 aa, Giardia lamblia
EVSESKKDY

SEQ ID NO: 3109834 - protein, 6 aa, Giardia lamblia
EVSGDA

SEQ ID NO: 3109835 - protein, 10 aa, Giardia lamblia
EVSKAREALE

SEQ ID NO: 3109836 - protein, 11 aa, Giardia lamblia
EVSLTNTEKYP

SEQ ID NO: 3109837 - protein, 11 aa, Giardia lamblia
EVSPSSSQHNS

SEQ ID NO: 3109838 - protein, 13 aa, Giardia lamblia
EVSSGSRYDGRKS

SEQ ID NO: 3109839 - protein, 17 aa, Giardia lamblia
EVSSQAQKQISASNQAF

SEQ ID NO: 3109840 - protein, 5 aa, Giardia lamblia
EVSTE

SEQ ID NO: 3109841 - protein, 8 aa, Giardia lamblia
EVTAEAEA

SEQ ID NO: 3109842 - protein, 10 aa, Giardia lamblia
EVTAKDNQGL

SEQ ID NO: 3109843 - protein, 27 aa, Giardia lamblia
EVTAPGASNEEKMGDHSSISPINPRSI

SEQ ID NO: 3109844 - protein, 5 aa, Giardia lamblia
EVTED

SEQ ID NO: 3109845 - protein, 6 aa, Giardia lamblia
EVTGKR

SEQ ID NO: 3109846 - protein, 5 aa, Giardia lamblia
EVTPL

SEQ ID NO: 3109847 - protein, 71 aa, Giardia lamblia
EVTQSSLAPAEEQSHSEAAGETCEPQSTDPQSEHEQSAEPQPDDEAQGPETVAESGEPPEAASGSGSISGA

SEQ ID NO: 3109848 - protein, 11 aa, Giardia lamblia
EVTRKAPREGV

SEQ ID NO: 3109849 - protein, 5 aa, Giardia lamblia
EVTSD

SEQ ID NO: 3109850 - protein, 29 aa, Giardia lamblia
EVTSEHSGTKIGCSQGTANEASSNTTTQN

SEQ ID NO: 3109851 - protein, 9 aa, Giardia lamblia
EVTSQNTLQ

SEQ ID NO: 3109852 - protein, 18 aa, Giardia lamblia
EVTSTSAAASSEDQAPFA

SEQ ID NO: 3109853 - protein, 5 aa, Giardia lamblia
EVTTG

SEQ ID NO: 3109854 - protein, 19 aa, Giardia lamblia
EVTTPGPESVPRPRVPPNI

SEQ ID NO: 3109855 - protein, 11 aa, Giardia lamblia
EVTTPVNPTDL

SEQ ID NO: 3109856 - protein, 12 aa, Giardia lamblia
EVVGNTKSGVSQ

SEQ ID NO: 3109857 - protein, 4 aa, Giardia lamblia
EVVS

SEQ ID NO: 3109858 - protein, 15 aa, Giardia lamblia
EVYPNGNAPPRGTKL

SEQ ID NO: 3109859 - protein, 11 aa, Giardia lamblia
EWAESNNTEIS

SEQ ID NO: 3109860 - protein, 7 aa, Giardia lamblia
EWHPSTK

SEQ ID NO: 3109861 - protein, 11 aa, Giardia lamblia
EWNESCDRPDR

SEQ ID NO: 3109862 - protein, 16 aa, Giardia lamblia
EWPRRDKQRGERSRNS

SEQ ID NO: 3109863 - protein, 7 aa, Giardia lamblia
EWPSGGS

SEQ ID NO: 3109864 - protein, 11 aa, Giardia lamblia
EYAEYSNQNMK

SEQ ID NO: 3109865 - protein, 9 aa, Giardia lamblia
EYANRRDEA

SEQ ID NO: 3109866 - protein, 4 aa, Giardia lamblia
EYAP

SEQ ID NO: 3109867 - protein, 12 aa, Giardia lamblia
EYASGKSGSKCA

SEQ ID NO: 3109868 - protein, 8 aa, Giardia lamblia
EYASRNRN

SEQ ID NO: 3109869 - protein, 26 aa, Giardia lamblia
EYCSSQTDTHKRRNKESTSQSPTDDH

SEQ ID NO: 3109870 - protein, 7 aa, Giardia lamblia
EYDADPS

SEQ ID NO: 3109871 - protein, 8 aa, Giardia lamblia
EYDENGTA

SEQ ID NO: 3109872 - protein, 6 aa, Giardia lamblia
EYDNVS

SEQ ID NO: 3109873 - protein, 8 aa, Giardia lamblia
EYDPRTSQ

SEQ ID NO: 3109874 - protein, 4 aa, Giardia lamblia
EYDQ

SEQ ID NO: 3109875 - protein, 8 aa, Giardia lamblia
EYDRGSRV

SEQ ID NO: 3109876 - protein, 6 aa, Giardia lamblia
EYEDAK

SEQ ID NO: 3109877 - protein, 13 aa, Giardia lamblia
EYEEAGGNIPSTI

SEQ ID NO: 3109878 - protein, 5 aa, Giardia lamblia
EYEED

SEQ ID NO: 3109879 - protein, 5 aa, Giardia lamblia
EYEEE

SEQ ID NO: 3109880 - protein, 10 aa, Giardia lamblia
EYEESPNTYA

SEQ ID NO: 3109881 - protein, 5 aa, Giardia lamblia
EYENL

SEQ ID NO: 3109882 - protein, 23 aa, Giardia lamblia
EYEPNSSIDQGSASDSQSIQGSA

SEQ ID NO: 3109883 - protein, 9 aa, Giardia lamblia
EYEQEKETI

SEQ ID NO: 3109884 - protein, 10 aa, Giardia lamblia
EYEQQADEID

SEQ ID NO: 3109885 - protein, 17 aa, Giardia lamblia
EYERSSSAYRNKLQNAP

SEQ ID NO: 3109886 - protein, 19 aa, Giardia lamblia
EYESESSRGGSITARTPRA

SEQ ID NO: 3109887 - protein, 9 aa, Giardia lamblia
EYESPSSSM

SEQ ID NO: 3109888 - protein, 5 aa, Giardia lamblia
EYGAK

SEQ ID NO: 3109889 - protein, 31 aa, Giardia lamblia
EYGASSPNRARPVSAAQSNKTGRGAGYGRGT

SEQ ID NO: 3109890 - protein, 10 aa, Giardia lamblia
EYGERRNAFS

SEQ ID NO: 3109891 - protein, 8 aa, Giardia lamblia
EYGGGEGI

SEQ ID NO: 3109892 - protein, 9 aa, Giardia lamblia
EYGGRQDNC

SEQ ID NO: 3109893 - protein, 4 aa, Giardia lamblia
EYGK

SEQ ID NO: 3109894 - protein, 10 aa, Giardia lamblia
EYGKQHDQKL

SEQ ID NO: 3109895 - protein, 5 aa, Giardia lamblia
EYGKR

SEQ ID NO: 3109896 - protein, 10 aa, Giardia lamblia
EYGKRDARGY

SEQ ID NO: 3109897 - protein, 34 aa, Giardia lamblia
EYGNPKEQDSEEEEDEGQNIDGDAIEPESGEPGK

SEQ ID NO: 3109898 - protein, 9 aa, Giardia lamblia
EYGPYDSPE

SEQ ID NO: 3109899 - protein, 4 aa, Giardia lamblia
EYGQ

SEQ ID NO: 3109900 - protein, 4 aa, Giardia lamblia
EYGR

SEQ ID NO: 3109901 - protein, 5 aa, Giardia lamblia
EYGSS

SEQ ID NO: 3109902 - protein, 14 aa, Giardia lamblia
EYGTASNIKSRVNK

SEQ ID NO: 3109903 - protein, 6 aa, Giardia lamblia
EYHARK

SEQ ID NO: 3109904 - protein, 5 aa, Giardia lamblia
EYKAA

SEQ ID NO: 3109905 - protein, 26 aa, Giardia lamblia
EYKDGSGRHPRRAAQPKRHGPRGRKH

SEQ ID NO: 3109906 - protein, 17 aa, Giardia lamblia
EYKESYEQLSKEHDGAL

SEQ ID NO: 3109907 - protein, 10 aa, Giardia lamblia
EYKKENEERM

SEQ ID NO: 3109908 - protein, 4 aa, Giardia lamblia
EYKQ

SEQ ID NO: 3109909 - protein, 5 aa, Giardia lamblia
EYKQL

SEQ ID NO: 3109910 - protein, 9 aa, Giardia lamblia
EYKQQRDYR

SEQ ID NO: 3109911 - protein, 4 aa, Giardia lamblia
EYKT

SEQ ID NO: 3109912 - protein, 11 aa, Giardia lamblia
EYNAPKNEEKW

SEQ ID NO: 3109913 - protein, 8 aa, Giardia lamblia
EYNKSEKH

SEQ ID NO: 3109914 - protein, 9 aa, Giardia lamblia
EYNNSGAAS

SEQ ID NO: 3109915 - protein, 17 aa, Giardia lamblia
EYNPEEGHEVNEDAQSL

SEQ ID NO: 3109916 - protein, 6 aa, Giardia lamblia
EYNPST

SEQ ID NO: 3109917 - protein, 8 aa, Giardia lamblia
EYNRREEE

SEQ ID NO: 3109918 - protein, 9 aa, Giardia lamblia
EYNTRKIPR

SEQ ID NO: 3109919 - protein, 7 aa, Giardia lamblia
EYPGDYQ

SEQ ID NO: 3109920 - protein, 9 aa, Giardia lamblia
EYPKDMQAT

SEQ ID NO: 3109921 - protein, 10 aa, Giardia lamblia
EYPLNSDDLE

SEQ ID NO: 3109922 - protein, 11 aa, Giardia lamblia
EYPPANHENGM

SEQ ID NO: 3109923 - protein, 26 aa, Giardia lamblia
EYPPASAGMSSYNYDRSSRNSSLPSV

SEQ ID NO: 3109924 - protein, 9 aa, Giardia lamblia
EYPPDTIPS

SEQ ID NO: 3109925 - protein, 9 aa, Giardia lamblia
EYPPKTETP

SEQ ID NO: 3109926 - protein, 7 aa, Giardia lamblia
EYPPNVP

SEQ ID NO: 3109927 - protein, 6 aa, Giardia lamblia
EYQDKA

SEQ ID NO: 3109928 - protein, 5 aa, Giardia lamblia
EYQLK

SEQ ID NO: 3109929 - protein, 4 aa, Giardia lamblia
EYQP

SEQ ID NO: 3109930 - protein, 4 aa, Giardia lamblia
EYQY

SEQ ID NO: 3109931 - protein, 8 aa, Giardia lamblia
EYREGGDL

SEQ ID NO: 3109932 - protein, 9 aa, Giardia lamblia
EYREKTKRS

SEQ ID NO: 3109933 - protein, 19 aa, Giardia lamblia
EYRPATPAKQETPKSPTRL

SEQ ID NO: 3109934 - protein, 5 aa, Giardia lamblia
EYRPG

SEQ ID NO: 3109935 - protein, 49 aa, Giardia lamblia
EYRTGKSSNSPTTTTSGAKKSKAPEKTRQSRTLTKSTIEESPTRADTSI

SEQ ID NO: 3109936 - protein, 6 aa, Giardia lamblia
EYRTKK

SEQ ID NO: 3109937 - protein, 7 aa, Giardia lamblia
EYSDANA

SEQ ID NO: 3109938 - protein, 8 aa, Giardia lamblia
EYSDEQRI

SEQ ID NO: 3109939 - protein, 4 aa, Giardia lamblia
EYSE

SEQ ID NO: 3109940 - protein, 15 aa, Giardia lamblia
EYSETRDACKDTSNR

SEQ ID NO: 3109941 - protein, 10 aa, Giardia lamblia
EYSGKKEDME

SEQ ID NO: 3109942 - protein, 21 aa, Giardia lamblia
EYSKTDVGNVQQSEESEGGTL

SEQ ID NO: 3109943 - protein, 7 aa, Giardia lamblia
EYSNPSV

SEQ ID NO: 3109944 - protein, 36 aa, Giardia lamblia
EYSSDTVDPEDSNCEGARGNDYPSTPTDQESDIEEW

SEQ ID NO: 3109945 - protein, 5 aa, Giardia lamblia
EYSSI

SEQ ID NO: 3109946 - protein, 8 aa, Giardia lamblia
EYSSPSRL

SEQ ID NO: 3109947 - protein, 6 aa, Giardia lamblia
EYSSRS

SEQ ID NO: 3109948 - protein, 12 aa, Giardia lamblia
EYTIKSGEKNYT

SEQ ID NO: 3109949 - protein, 5 aa, Giardia lamblia
EYTND

SEQ ID NO: 3109950 - protein, 16 aa, Giardia lamblia
EYTPPAKKGVQQPNPY

SEQ ID NO: 3109951 - protein, 6 aa, Giardia lamblia
EYTQEL

SEQ ID NO: 3109952 - protein, 5 aa, Giardia lamblia
EYTSK

SEQ ID NO: 3109953 - protein, 17 aa, Giardia lamblia
EYTSPARNTASPRRHDD

SEQ ID NO: 3109954 - protein, 4 aa, Giardia lamblia
EYTT

SEQ ID NO: 3109955 - protein, 5 aa, Giardia lamblia
EYTTD

SEQ ID NO: 3109956 - protein, 5 aa, Giardia lamblia
EYVGS

SEQ ID NO: 3109957 - protein, 11 aa, Giardia lamblia
EYVPPNRDTTA

SEQ ID NO: 3109958 - protein, 21 aa, Giardia lamblia
EYVSNEKGLAEELTKKEAEIA

SEQ ID NO: 3109959 - protein, 14 aa, Giardia lamblia
EYYDEEHGEDDPPI

SEQ ID NO: 3109960 - protein, 13 aa, Giardia lamblia
EYYTDANSCAPNT

SEQ ID NO: 3109961 - protein, 41 aa, Giardia lamblia
FAANDKAKSDTANKEPEAEAATENQAAADTAPKPEQEEKVE

SEQ ID NO: 3109962 - protein, 10 aa, Giardia lamblia
FAANDPDAVR

SEQ ID NO: 3109963 - protein, 9 aa, Giardia lamblia
FADANGETA

SEQ ID NO: 3109964 - protein, 30 aa, Giardia lamblia
FADQQKRDHEADIRRRKEEADRRREEEKAA

SEQ ID NO: 3109965 - protein, 13 aa, Giardia lamblia
FADRQKPSTPQCQ

SEQ ID NO: 3109966 - protein, 7 aa, Giardia lamblia
FAEHEPL

SEQ ID NO: 3109967 - protein, 31 aa, Giardia lamblia
FAEQPAASHSDNSNVTNERANTGRAEPTLEQ

SEQ ID NO: 3109968 - protein, 7 aa, Giardia lamblia
FAESQDE

SEQ ID NO: 3109969 - protein, 12 aa, Giardia lamblia
FAESTTNAYETN

SEQ ID NO: 3109970 - protein, 13 aa, Giardia lamblia
FAETANGKEIEER

SEQ ID NO: 3109971 - protein, 9 aa, Giardia lamblia
FAGDDAPRA

SEQ ID NO: 3109972 - protein, 19 aa, Giardia lamblia
FAGNQTKTHKTLAKAQKSL

SEQ ID NO: 3109973 - protein, 24 aa, Giardia lamblia
FAGSAGAVPSYSRSVSNPSVPKTY

SEQ ID NO: 3109974 - protein, 16 aa, Giardia lamblia
FAGSGQKIRAPPPHTI

SEQ ID NO: 3109975 - protein, 11 aa, Giardia lamblia
FAGSKNEKGET

SEQ ID NO: 3109976 - protein, 11 aa, Giardia lamblia
FAGSRDSRGRT

SEQ ID NO: 3109977 - protein, 6 aa, Giardia lamblia
FAKEQG

SEQ ID NO: 3109978 - protein, 16 aa, Giardia lamblia
FALPDPSDQFGGGPYP

SEQ ID NO: 3109979 - protein, 7 aa, Giardia lamblia
FANKENQ

SEQ ID NO: 3109980 - protein, 17 aa, Giardia lamblia
FANTSLNTPAPQSAPEV

SEQ ID NO: 3109981 - protein, 4 aa, Giardia lamblia
FAPE

SEQ ID NO: 3109982 - protein, 12 aa, Giardia lamblia
FAPEDAGPTGAR

SEQ ID NO: 3109983 - protein, 21 aa, Giardia lamblia
FAPEEGNKVGGGGNAPENPNE

SEQ ID NO: 3109984 - protein, 8 aa, Giardia lamblia
FAPHSNAQ

SEQ ID NO: 3109985 - protein, 8 aa, Giardia lamblia
FAPPGPGA

SEQ ID NO: 3109986 - protein, 14 aa, Giardia lamblia
FAPPPESGSNITVH

SEQ ID NO: 3109987 - protein, 18 aa, Giardia lamblia
FAQKEGKSKQTSIKQRKE

SEQ ID NO: 3109988 - protein, 11 aa, Giardia lamblia
FAQQQDKQGRT

SEQ ID NO: 3109989 - protein, 6 aa, Giardia lamblia
FAREQK

SEQ ID NO: 3109990 - protein, 6 aa, Giardia lamblia
FARERS

SEQ ID NO: 3109991 - protein, 5 aa, Giardia lamblia
FARGN

SEQ ID NO: 3109992 - protein, 5 aa, Giardia lamblia
FASAT

SEQ ID NO: 3109993 - protein, 8 aa, Giardia lamblia
FASDRDAD

SEQ ID NO: 3109994 - protein, 6 aa, Giardia lamblia
FASNPA

SEQ ID NO: 3109995 - protein, 8 aa, Giardia lamblia
FASPPTNV

SEQ ID NO: 3109996 - protein, 8 aa, Giardia lamblia
FATENDSS

SEQ ID NO: 3109997 - protein, 6 aa, Giardia lamblia
FATGAP

SEQ ID NO: 3109998 - protein, 16 aa, Giardia lamblia
FATGGDDGRVMLFELG

SEQ ID NO: 3109999 - protein, 4 aa, Giardia lamblia
FATP

SEQ ID NO: 3110000 - protein, 11 aa, Giardia lamblia
FATPEPRQTNA

SEQ ID NO: 3110001 - protein, 12 aa, Giardia lamblia
FATTDKEDTGFS

SEQ ID NO: 3110002 - protein, 11 aa, Giardia lamblia
FATTISPKTRH

SEQ ID NO: 3110003 - protein, 6 aa, Giardia lamblia
FATTKE

SEQ ID NO: 3110004 - protein, 5 aa, Giardia lamblia
FCPPQ

SEQ ID NO: 3110005 - protein, 12 aa, Giardia lamblia
FDANASAAEVDI

SEQ ID NO: 3110006 - protein, 12 aa, Giardia lamblia
FDANEQSSSNNL

SEQ ID NO: 3110007 - protein, 20 aa, Giardia lamblia
FDASERDNRPVFKEQYSLPN

SEQ ID NO: 3110008 - protein, 6 aa, Giardia lamblia
FDEDDG

SEQ ID NO: 3110009 - protein, 12 aa, Giardia lamblia
FDEENESPDHPT

SEQ ID NO: 3110010 - protein, 32 aa, Giardia lamblia
FDEGDRKYGCHNPRRRTPEEQNAVEGTKSRYS

SEQ ID NO: 3110011 - protein, 6 aa, Giardia lamblia
FDEPSK

SEQ ID NO: 3110012 - protein, 6 aa, Giardia lamblia
FDESTT

SEQ ID NO: 3110013 - protein, 4 aa, Giardia lamblia
FDGD

SEQ ID NO: 3110014 - protein, 18 aa, Giardia lamblia
FDGPVSSPDLAMSPGESA

SEQ ID NO: 3110015 - protein, 6 aa, Giardia lamblia
FDGSTA

SEQ ID NO: 3110016 - protein, 11 aa, Giardia lamblia
FDKATSSLTSL

SEQ ID NO: 3110017 - protein, 5 aa, Giardia lamblia
FDNDG

SEQ ID NO: 3110018 - protein, 51 aa, Giardia lamblia
FDPANDSDSDSHPRKKERTAKAKQGKSGKGIKGPKLGGNGKSASGGKGEVA

SEQ ID NO: 3110019 - protein, 8 aa, Giardia lamblia
FDPEAEEV

SEQ ID NO: 3110020 - protein, 6 aa, Giardia lamblia
FDPEKM

SEQ ID NO: 3110021 - protein, 22 aa, Giardia lamblia
FDPKNASKEDQLGITQCLRPAM

SEQ ID NO: 3110022 - protein, 16 aa, Giardia lamblia
FDPPHTQALASSRRAT

SEQ ID NO: 3110023 - protein, 6 aa, Giardia lamblia
FDPQAD

SEQ ID NO: 3110024 - protein, 4 aa, Giardia lamblia
FDPS

SEQ ID NO: 3110025 - protein, 32 aa, Giardia lamblia
FDQGSNSSTRLGSEAHKSMSKNGLRGNVTGDD

SEQ ID NO: 3110026 - protein, 6 aa, Giardia lamblia
FDQKNT

SEQ ID NO: 3110027 - protein, 5 aa, Giardia lamblia
FDRNP

SEQ ID NO: 3110028 - protein, 5 aa, Giardia lamblia
FDRTE

SEQ ID NO: 3110029 - protein, 5 aa, Giardia lamblia
FDSDE

SEQ ID NO: 3110030 - protein, 9 aa, Giardia lamblia
FDSDEDDYN

SEQ ID NO: 3110031 - protein, 5 aa, Giardia lamblia
FDSKS

SEQ ID NO: 3110032 - protein, 38 aa, Giardia lamblia
FDSNEKARSLGDCKKTAKHSQHGSAPGPTSSAATAEPS

SEQ ID NO: 3110033 - protein, 14 aa, Giardia lamblia
FDSNRTSEAMDAPD

SEQ ID NO: 3110034 - protein, 10 aa, Giardia lamblia
FDSSGDPENN

SEQ ID NO: 3110035 - protein, 5 aa, Giardia lamblia
FDSSH

SEQ ID NO: 3110036 - protein, 23 aa, Giardia lamblia
FDSSVRDTRQGATSDPLSRSALT

SEQ ID NO: 3110037 - protein, 7 aa, Giardia lamblia
FDSTEEA

SEQ ID NO: 3110038 - protein, 5 aa, Giardia lamblia
FDSTN

SEQ ID NO: 3110039 - protein, 17 aa, Giardia lamblia
FDSTSTNNIISSFLTQV

SEQ ID NO: 3110040 - protein, 6 aa, Giardia lamblia
FDTEQR

SEQ ID NO: 3110041 - protein, 12 aa, Giardia lamblia
FDTGNVGTQTYR

SEQ ID NO: 3110042 - protein, 6 aa, Giardia lamblia
FDTPNS

SEQ ID NO: 3110043 - protein, 4 aa, Giardia lamblia
FEDG

SEQ ID NO: 3110044 - protein, 12 aa, Giardia lamblia
FEDNRKEITEQG

SEQ ID NO: 3110045 - protein, 9 aa, Giardia lamblia
FEDPPDTPL

SEQ ID NO: 3110046 - protein, 4 aa, Giardia lamblia
FEDS

SEQ ID NO: 3110047 - protein, 12 aa, Giardia lamblia
FEDTSYTPTREL

SEQ ID NO: 3110048 - protein, 14 aa, Giardia lamblia
FEDVSSKNLLANKI

SEQ ID NO: 3110049 - protein, 4 aa, Giardia lamblia
FEEE

SEQ ID NO: 3110050 - protein, 12 aa, Giardia lamblia
FEEEKARRAKKT

SEQ ID NO: 3110051 - protein, 14 aa, Giardia lamblia
FEEGNAMDTSTENV

SEQ ID NO: 3110052 - protein, 8 aa, Giardia lamblia
FEEPAAEY

SEQ ID NO: 3110053 - protein, 16 aa, Giardia lamblia
FEERKGLRRPRSPSEL

SEQ ID NO: 3110054 - protein, 15 aa, Giardia lamblia
FEERSPSSDFDEPEP

SEQ ID NO: 3110055 - protein, 15 aa, Giardia lamblia
FEETSSRDKTGTTQL

SEQ ID NO: 3110056 - protein, 16 aa, Giardia lamblia
FEGAQPPGRRCRGARR

SEQ ID NO: 3110057 - protein, 6 aa, Giardia lamblia
FEGGRH

SEQ ID NO: 3110058 - protein, 14 aa, Giardia lamblia
FEGGVGKKAMKKQG

SEQ ID NO: 3110059 - protein, 20 aa, Giardia lamblia
FEGNQSVKADNAPAALSGHA

SEQ ID NO: 3110060 - protein, 10 aa, Giardia lamblia
FEGNSPYPHS

SEQ ID NO: 3110061 - protein, 7 aa, Giardia lamblia
FEKNDAV

SEQ ID NO: 3110062 - protein, 7 aa, Giardia lamblia
FENRNEP

SEQ ID NO: 3110063 - protein, 11 aa, Giardia lamblia
FEPGRTRQPAE

SEQ ID NO: 3110064 - protein, 4 aa, Giardia lamblia
FEPK

SEQ ID NO: 3110065 - protein, 8 aa, Giardia lamblia
FEPQNNKS

SEQ ID NO: 3110066 - protein, 5 aa, Giardia lamblia
FEPSG

SEQ ID NO: 3110067 - protein, 13 aa, Giardia lamblia
FEPSPQDQNVQRY

SEQ ID NO: 3110068 - protein, 9 aa, Giardia lamblia
FEQKSGEEA

SEQ ID NO: 3110069 - protein, 6 aa, Giardia lamblia
FERPGA

SEQ ID NO: 3110070 - protein, 5 aa, Giardia lamblia
FESAA

SEQ ID NO: 3110071 - protein, 5 aa, Giardia lamblia
FESER

SEQ ID NO: 3110072 - protein, 14 aa, Giardia lamblia
FESESGSTKSNTDN

SEQ ID NO: 3110073 - protein, 22 aa, Giardia lamblia
FESHTEYDHPAPITKDVPREAS

SEQ ID NO: 3110074 - protein, 6 aa, Giardia lamblia
FESKEQ

SEQ ID NO: 3110075 - protein, 5 aa, Giardia lamblia
FESNY

SEQ ID NO: 3110076 - protein, 5 aa, Giardia lamblia
FESQC

SEQ ID NO: 3110077 - protein, 4 aa, Giardia lamblia
FESR

SEQ ID NO: 3110078 - protein, 7 aa, Giardia lamblia
FESRNEP

SEQ ID NO: 3110079 - protein, 8 aa, Giardia lamblia
FESTDEQP

SEQ ID NO: 3110080 - protein, 11 aa, Giardia lamblia
FESTDVDDAVP

SEQ ID NO: 3110081 - protein, 8 aa, Giardia lamblia
FETDAKGY

SEQ ID NO: 3110082 - protein, 7 aa, Giardia lamblia
FETDPDT

SEQ ID NO: 3110083 - protein, 4 aa, Giardia lamblia
FETS

SEQ ID NO: 3110084 - protein, 6 aa, Giardia lamblia
FETTDS

SEQ ID NO: 3110085 - protein, 11 aa, Giardia lamblia
FFSDDEDAYRR

SEQ ID NO: 3110086 - protein, 9 aa, Giardia lamblia
FGAAETPSI

SEQ ID NO: 3110087 - protein, 10 aa, Giardia lamblia
FGADSSAEVS

SEQ ID NO: 3110088 - protein, 7 aa, Giardia lamblia
FGADSTA

SEQ ID NO: 3110089 - protein, 10 aa, Giardia lamblia
FGAKDARKQA

SEQ ID NO: 3110090 - protein, 16 aa, Giardia lamblia
FGAKPTSAGKEAKDVR

SEQ ID NO: 3110091 - protein, 11 aa, Giardia lamblia
FGANGELTTDE

SEQ ID NO: 3110092 - protein, 9 aa, Giardia lamblia
FGDAPRSSR

SEQ ID NO: 3110093 - protein, 8 aa, Giardia lamblia
FGDGSRSC

SEQ ID NO: 3110094 - protein, 8 aa, Giardia lamblia
FGDNGPAM

SEQ ID NO: 3110095 - protein, 25 aa, Giardia lamblia
FGDPVKAPASAGRAYGSRAPMRART

SEQ ID NO: 3110096 - protein, 5 aa, Giardia lamblia
FGEEE

SEQ ID NO: 3110097 - protein, 13 aa, Giardia lamblia
FGEKAENSPKHDL

SEQ ID NO: 3110098 - protein, 8 aa, Giardia lamblia
FGENGTAT

SEQ ID NO: 3110099 - protein, 29 aa, Giardia lamblia
FGEQRNDPLSTSTELCPSNNSSFISTPNQ

SEQ ID NO: 3110100 - protein, 61 aa, Giardia lamblia
FGESGAYNPDVEAEPEQNPSHDQPKADSSASAGNAGKKNTSPAKKSHSRASTGGSKSGKTS

SEQ ID NO: 3110101 - protein, 9 aa, Giardia lamblia
FGESGNRTE

SEQ ID NO: 3110102 - protein, 5 aa, Giardia lamblia
FGESS

SEQ ID NO: 3110103 - protein, 6 aa, Giardia lamblia
FGGCPH

SEQ ID NO: 3110104 - protein, 13 aa, Giardia lamblia
FGGDSSSSEEESS

SEQ ID NO: 3110105 - protein, 5 aa, Giardia lamblia
FGGKD

SEQ ID NO: 3110106 - protein, 9 aa, Giardia lamblia
FGGKDPKTL

SEQ ID NO: 3110107 - protein, 4 aa, Giardia lamblia
FGGP

SEQ ID NO: 3110108 - protein, 6 aa, Giardia lamblia
FGGSQG

SEQ ID NO: 3110109 - protein, 5 aa, Giardia lamblia
FGGTN

SEQ ID NO: 3110110 - protein, 17 aa, Giardia lamblia
FGHTEGGHGDADERDAR

SEQ ID NO: 3110111 - protein, 10 aa, Giardia lamblia
FGKAPTQVSG

SEQ ID NO: 3110112 - protein, 4 aa, Giardia lamblia
FGKT

SEQ ID NO: 3110113 - protein, 9 aa, Giardia lamblia
FGKTTDKKL

SEQ ID NO: 3110114 - protein, 6 aa, Giardia lamblia
FGNDTE

SEQ ID NO: 3110115 - protein, 9 aa, Giardia lamblia
FGNSKEKRL

SEQ ID NO: 3110116 - protein, 6 aa, Giardia lamblia
FGPAGT

SEQ ID NO: 3110117 - protein, 7 aa, Giardia lamblia
FGPAPHE

SEQ ID NO: 3110118 - protein, 10 aa, Giardia lamblia
FGPASSAESA

SEQ ID NO: 3110119 - protein, 6 aa, Giardia lamblia
FGPATE

SEQ ID NO: 3110120 - protein, 5 aa, Giardia lamblia
FGPDS

SEQ ID NO: 3110121 - protein, 5 aa, Giardia lamblia
FGPEA

SEQ ID NO: 3110122 - protein, 7 aa, Giardia lamblia
FGPGNNA

SEQ ID NO: 3110123 - protein, 10 aa, Giardia lamblia
FGPHSSEQLY

SEQ ID NO: 3110124 - protein, 9 aa, Giardia lamblia
FGPKGTFTG

SEQ ID NO: 3110125 - protein, 11 aa, Giardia lamblia
FGPSSSHTMGP

SEQ ID NO: 3110126 - protein, 9 aa, Giardia lamblia
FGPTTAGAD

SEQ ID NO: 3110127 - protein, 7 aa, Giardia lamblia
FGQDGGV

SEQ ID NO: 3110128 - protein, 7 aa, Giardia lamblia
FGQKANV

SEQ ID NO: 3110129 - protein, 10 aa, Giardia lamblia
FGQSGSGNNW

SEQ ID NO: 3110130 - protein, 8 aa, Giardia lamblia
FGQSTRKS

SEQ ID NO: 3110131 - protein, 8 aa, Giardia lamblia
FGRAGPKG

SEQ ID NO: 3110132 - protein, 7 aa, Giardia lamblia
FGRPGTF

SEQ ID NO: 3110133 - protein, 4 aa, Giardia lamblia
FGRT

SEQ ID NO: 3110134 - protein, 8 aa, Giardia lamblia
FGRTRPSL

SEQ ID NO: 3110135 - protein, 10 aa, Giardia lamblia
FGSAGTKNFY

SEQ ID NO: 3110136 - protein, 7 aa, Giardia lamblia
FGSDKTT

SEQ ID NO: 3110137 - protein, 11 aa, Giardia lamblia
FGSEDKAAEFA

SEQ ID NO: 3110138 - protein, 4 aa, Giardia lamblia
FGSG

SEQ ID NO: 3110139 - protein, 8 aa, Giardia lamblia
FGSGGKHV

SEQ ID NO: 3110140 - protein, 10 aa, Giardia lamblia
FGSGNGASAL

SEQ ID NO: 3110141 - protein, 9 aa, Giardia lamblia
FGSHGGTDS

SEQ ID NO: 3110142 - protein, 28 aa, Giardia lamblia
FGSPGRPNSHVKPKGEHKGRRGARGRHS

SEQ ID NO: 3110143 - protein, 7 aa, Giardia lamblia
FGSSEGT

SEQ ID NO: 3110144 - protein, 7 aa, Giardia lamblia
FGSSGSC

SEQ ID NO: 3110145 - protein, 19 aa, Giardia lamblia
FGTATTQERVKEIARAYAN

SEQ ID NO: 3110146 - protein, 9 aa, Giardia lamblia
FGTGRVPSA

SEQ ID NO: 3110147 - protein, 10 aa, Giardia lamblia
FGTGTSLKES

SEQ ID NO: 3110148 - protein, 5 aa, Giardia lamblia
FGTPR

SEQ ID NO: 3110149 - protein, 7 aa, Giardia lamblia
FGTRSIS

SEQ ID NO: 3110150 - protein, 6 aa, Giardia lamblia
FGTSPV

SEQ ID NO: 3110151 - protein, 11 aa, Giardia lamblia
FGTSSNHSYYD

SEQ ID NO: 3110152 - protein, 10 aa, Giardia lamblia
FGTSTGKCPG

SEQ ID NO: 3110153 - protein, 16 aa, Giardia lamblia
FGTTKQTAAIKAATDA

SEQ ID NO: 3110154 - protein, 4 aa, Giardia lamblia
FGYP

SEQ ID NO: 3110155 - protein, 7 aa, Giardia lamblia
FHGPEAG

SEQ ID NO: 3110156 - protein, 5 aa, Giardia lamblia
FHPDE

SEQ ID NO: 3110157 - protein, 9 aa, Giardia lamblia
FHPPPEQLP

SEQ ID NO: 3110158 - protein, 7 aa, Giardia lamblia
FHPSKKE

SEQ ID NO: 3110159 - protein, 9 aa, Giardia lamblia
FHSKEAGAG

SEQ ID NO: 3110160 - protein, 20 aa, Giardia lamblia
FHSSTRSGKPLETPKKRAFS

SEQ ID NO: 3110161 - protein, 11 aa, Giardia lamblia
FHTSDSTRECS

SEQ ID NO: 3110162 - protein, 19 aa, Giardia lamblia
FIPSSGAPDPTTNGDRRPL

SEQ ID NO: 3110163 - protein, 6 aa, Giardia lamblia
FKADGD

SEQ ID NO: 3110164 - protein, 10 aa, Giardia lamblia
FKAGQTDSDT

SEQ ID NO: 3110165 - protein, 6 aa, Giardia lamblia
FKAPEY

SEQ ID NO: 3110166 - protein, 4 aa, Giardia lamblia
FKAR

SEQ ID NO: 3110167 - protein, 12 aa, Giardia lamblia
FKESSGSEPSIG

SEQ ID NO: 3110168 - protein, 10 aa, Giardia lamblia
FKGDQNRESM

SEQ ID NO: 3110169 - protein, 9 aa, Giardia lamblia
FKGGNDERC

SEQ ID NO: 3110170 - protein, 11 aa, Giardia lamblia
FKGNSGPGVGF

SEQ ID NO: 3110171 - protein, 11 aa, Giardia lamblia
FKGRTTDAGST

SEQ ID NO: 3110172 - protein, 12 aa, Giardia lamblia
FKGSKDENGETG

SEQ ID NO: 3110173 - protein, 4 aa, Giardia lamblia
FKGY

SEQ ID NO: 3110174 - protein, 7 aa, Giardia lamblia
FKNDEGS

SEQ ID NO: 3110175 - protein, 8 aa, Giardia lamblia
FKNGDGIT

SEQ ID NO: 3110176 - protein, 6 aa, Giardia lamblia
FKNGDY

SEQ ID NO: 3110177 - protein, 8 aa, Giardia lamblia
FKNRPSRL

SEQ ID NO: 3110178 - protein, 4 aa, Giardia lamblia
FKPA

SEQ ID NO: 3110179 - protein, 10 aa, Giardia lamblia
FKPDKIDSKG

SEQ ID NO: 3110180 - protein, 15 aa, Giardia lamblia
FKPDSMTKVDRAGET

SEQ ID NO: 3110181 - protein, 6 aa, Giardia lamblia
FKPEPG

SEQ ID NO: 3110182 - protein, 17 aa, Giardia lamblia
FKPGREPINGTATGPRR

SEQ ID NO: 3110183 - protein, 29 aa, Giardia lamblia
FKPPTNPAAQTQAAAQQPQVQQNQMQQPM

SEQ ID NO: 3110184 - protein, 9 aa, Giardia lamblia
FKPSPRDCV

SEQ ID NO: 3110185 - protein, 7 aa, Giardia lamblia
FKPSTAA

SEQ ID NO: 3110186 - protein, 9 aa, Giardia lamblia
FKPSTGRAR

SEQ ID NO: 3110187 - protein, 8 aa, Giardia lamblia
FKRPDNDG

SEQ ID NO: 3110188 - protein, 11 aa, Giardia lamblia
FKRPGSNVNTN

SEQ ID NO: 3110189 - protein, 6 aa, Giardia lamblia
FKSESD

SEQ ID NO: 3110190 - protein, 6 aa, Giardia lamblia
FKSPPE

SEQ ID NO: 3110191 - protein, 19 aa, Giardia lamblia
FKSPQNSCAQVPAPPTSTH

SEQ ID NO: 3110192 - protein, 8 aa, Giardia lamblia
FKSRPGTM

SEQ ID NO: 3110193 - protein, 13 aa, Giardia lamblia
FKSSADKQGGCFI

SEQ ID NO: 3110194 - protein, 4 aa, Giardia lamblia
FKST

SEQ ID NO: 3110195 - protein, 15 aa, Giardia lamblia
FKSTQPRSRAVPPTI

SEQ ID NO: 3110196 - protein, 12 aa, Giardia lamblia
FKTNEGDSMNSL

SEQ ID NO: 3110197 - protein, 8 aa, Giardia lamblia
FKTPEPKM

SEQ ID NO: 3110198 - protein, 14 aa, Giardia lamblia
FKTRESSVTSLHGR

SEQ ID NO: 3110199 - protein, 7 aa, Giardia lamblia
FLPPGNK

SEQ ID NO: 3110200 - protein, 12 aa, Giardia lamblia
FNAAPQNAQVES

SEQ ID NO: 3110201 - protein, 7 aa, Giardia lamblia
FNAKTEQ

SEQ ID NO: 3110202 - protein, 26 aa, Giardia lamblia
FNAPASPQQMASSQGVPTRNSLGDQS

SEQ ID NO: 3110203 - protein, 8 aa, Giardia lamblia
FNASTDRG

SEQ ID NO: 3110204 - protein, 12 aa, Giardia lamblia
FNDHTPDTVNNL

SEQ ID NO: 3110205 - protein, 8 aa, Giardia lamblia
FNDKQRAE

SEQ ID NO: 3110206 - protein, 18 aa, Giardia lamblia
FNDNYSMGSGIKQNAGEV

SEQ ID NO: 3110207 - protein, 8 aa, Giardia lamblia
FNDRPDVK

SEQ ID NO: 3110208 - protein, 9 aa, Giardia lamblia
FNEEPSQDS

SEQ ID NO: 3110209 - protein, 4 aa, Giardia lamblia
FNEK

SEQ ID NO: 3110210 - protein, 7 aa, Giardia lamblia
FNEKNSK

SEQ ID NO: 3110211 - protein, 16 aa, Giardia lamblia
FNETPIKPKRPGSNRL

SEQ ID NO: 3110212 - protein, 5 aa, Giardia lamblia
FNGDG

SEQ ID NO: 3110213 - protein, 12 aa, Giardia lamblia
FNIESSSSSNIV

SEQ ID NO: 3110214 - protein, 10 aa, Giardia lamblia
FNNDTDEVKN

SEQ ID NO: 3110215 - protein, 18 aa, Giardia lamblia
FNNSGQSRYHESRGSIEN

SEQ ID NO: 3110216 - protein, 12 aa, Giardia lamblia
FNPDQSFGRRTG

SEQ ID NO: 3110217 - protein, 6 aa, Giardia lamblia
FNPGAK

SEQ ID NO: 3110218 - protein, 9 aa, Giardia lamblia
FNPLPSEHS

SEQ ID NO: 3110219 - protein, 4 aa, Giardia lamblia
FNPN

SEQ ID NO: 3110220 - protein, 6 aa, Giardia lamblia
FNPNNP

SEQ ID NO: 3110221 - protein, 6 aa, Giardia lamblia
FNPQAD

SEQ ID NO: 3110222 - protein, 14 aa, Giardia lamblia
FNPQTRVSQVSGGK

SEQ ID NO: 3110223 - protein, 9 aa, Giardia lamblia
FNPSQSSYD

SEQ ID NO: 3110224 - protein, 9 aa, Giardia lamblia
FNPSSGGVK

SEQ ID NO: 3110225 - protein, 6 aa, Giardia lamblia
FNQDGH

SEQ ID NO: 3110226 - protein, 4 aa, Giardia lamblia
FNQG

SEQ ID NO: 3110227 - protein, 6 aa, Giardia lamblia
FNQGQS

SEQ ID NO: 3110228 - protein, 50 aa, Giardia lamblia
FNQNRQTAAQRGAGGLANYPSGSIGGQRPGVRQHTPRNTDGTPREKPTRI

SEQ ID NO: 3110229 - protein, 5 aa, Giardia lamblia
FNRSD

SEQ ID NO: 3110230 - protein, 7 aa, Giardia lamblia
FNSGSNG

SEQ ID NO: 3110231 - protein, 11 aa, Giardia lamblia
FNSGTSKYTLK

SEQ ID NO: 3110232 - protein, 8 aa, Giardia lamblia
FNSQASAH

SEQ ID NO: 3110233 - protein, 8 aa, Giardia lamblia
FNSRPSAA

SEQ ID NO: 3110234 - protein, 4 aa, Giardia lamblia
FNTE

SEQ ID NO: 3110235 - protein, 5 aa, Giardia lamblia
FPADN

SEQ ID NO: 3110236 - protein, 37 aa, Giardia lamblia
FPAEAPNNQLSAPAPEKIVTPGRQKTRPNPGAKANIL

SEQ ID NO: 3110237 - protein, 9 aa, Giardia lamblia
FPAKTEKDE

SEQ ID NO: 3110238 - protein, 11 aa, Giardia lamblia
FPASNSDPTQL

SEQ ID NO: 3110239 - protein, 9 aa, Giardia lamblia
FPDNTRPDE

SEQ ID NO: 3110240 - protein, 4 aa, Giardia lamblia
FPDP

SEQ ID NO: 3110241 - protein, 6 aa, Giardia lamblia
FPDPGD

SEQ ID NO: 3110242 - protein, 6 aa, Giardia lamblia
FPDPHR

SEQ ID NO: 3110243 - protein, 4 aa, Giardia lamblia
FPDS

SEQ ID NO: 3110244 - protein, 19 aa, Giardia lamblia
FPDVSSKEYTKPLAKESSH

SEQ ID NO: 3110245 - protein, 4 aa, Giardia lamblia
FPEA

SEQ ID NO: 3110246 - protein, 25 aa, Giardia lamblia
FPEDSDGADAVRQISPSVAAPESQN

SEQ ID NO: 3110247 - protein, 13 aa, Giardia lamblia
FPEHQDPDEENRT

SEQ ID NO: 3110248 - protein, 13 aa, Giardia lamblia
FPEHTDSTAACSG

SEQ ID NO: 3110249 - protein, 10 aa, Giardia lamblia
FPEPNEDPAP

SEQ ID NO: 3110250 - protein, 6 aa, Giardia lamblia
FPETGD

SEQ ID NO: 3110251 - protein, 20 aa, Giardia lamblia
FPGAAAPSTAMPYGDPTAGL

SEQ ID NO: 3110252 - protein, 8 aa, Giardia lamblia
FPGDQGGD

SEQ ID NO: 3110253 - protein, 6 aa, Giardia lamblia
FPGDSE

SEQ ID NO: 3110254 - protein, 6 aa, Giardia lamblia
FPGDSS

SEQ ID NO: 3110255 - protein, 18 aa, Giardia lamblia
FPGGQADSLTQTKTQLEH

SEQ ID NO: 3110256 - protein, 5 aa, Giardia lamblia
FPGRN

SEQ ID NO: 3110257 - protein, 15 aa, Giardia lamblia
FPGTRGRRGASASQQ

SEQ ID NO: 3110258 - protein, 13 aa, Giardia lamblia
FPGYSKDGFDSSA

SEQ ID NO: 3110259 - protein, 4 aa, Giardia lamblia
FPIG

SEQ ID NO: 3110260 - protein, 23 aa, Giardia lamblia
FPKQSSKKQGTAPAQGKAKNGKK

SEQ ID NO: 3110261 - protein, 7 aa, Giardia lamblia
FPKTETI

SEQ ID NO: 3110262 - protein, 29 aa, Giardia lamblia
FPMPDDAPNNKQKLRAKSIEAGAKQGKKL

SEQ ID NO: 3110263 - protein, 4 aa, Giardia lamblia
FPNG

SEQ ID NO: 3110264 - protein, 18 aa, Giardia lamblia
FPNKDTNDDEHSNQSEYS

SEQ ID NO: 3110265 - protein, 8 aa, Giardia lamblia
FPNKPIKS

SEQ ID NO: 3110266 - protein, 9 aa, Giardia lamblia
FPNQQNTQC

SEQ ID NO: 3110267 - protein, 9 aa, Giardia lamblia
FPNTSLQPP

SEQ ID NO: 3110268 - protein, 4 aa, Giardia lamblia
FPPA

SEQ ID NO: 3110269 - protein, 9 aa, Giardia lamblia
FPPDLKATS

SEQ ID NO: 3110270 - protein, 6 aa, Giardia lamblia
FPPEPN

SEQ ID NO: 3110271 - protein, 7 aa, Giardia lamblia
FPPEPSG

SEQ ID NO: 3110272 - protein, 12 aa, Giardia lamblia
FPPGTSDLSGGE

SEQ ID NO: 3110273 - protein, 5 aa, Giardia lamblia
FPPHH

SEQ ID NO: 3110274 - protein, 12 aa, Giardia lamblia
FPPNYTRQGPEI

SEQ ID NO: 3110275 - protein, 6 aa, Giardia lamblia
FPPPDM

SEQ ID NO: 3110276 - protein, 16 aa, Giardia lamblia
FPPPEGSSNNAKRTVN

SEQ ID NO: 3110277 - protein, 5 aa, Giardia lamblia
FPPPY

SEQ ID NO: 3110278 - protein, 23 aa, Giardia lamblia
FPPRSQSPAVSDSIDKSAPLAPK

SEQ ID NO: 3110279 - protein, 7 aa, Giardia lamblia
FPPSTEW

SEQ ID NO: 3110280 - protein, 11 aa, Giardia lamblia
FPPSTKSTPQF

SEQ ID NO: 3110281 - protein, 7 aa, Giardia lamblia
FPQAQTE

SEQ ID NO: 3110282 - protein, 11 aa, Giardia lamblia
FPQEKQKALEN

SEQ ID NO: 3110283 - protein, 12 aa, Giardia lamblia
FPQGAGSISSYG

SEQ ID NO: 3110284 - protein, 5 aa, Giardia lamblia
FPQSS

SEQ ID NO: 3110285 - protein, 5 aa, Giardia lamblia
FPQTC

SEQ ID NO: 3110286 - protein, 12 aa, Giardia lamblia
FPQTQTPTQHYP

SEQ ID NO: 3110287 - protein, 4 aa, Giardia lamblia
FPRN

SEQ ID NO: 3110288 - protein, 12 aa, Giardia lamblia
FPRTSQAGQRFR

SEQ ID NO: 3110289 - protein, 5 aa, Giardia lamblia
FPSDN

SEQ ID NO: 3110290 - protein, 9 aa, Giardia lamblia
FPSDPEQAA

SEQ ID NO: 3110291 - protein, 12 aa, Giardia lamblia
FPSEEKPPAGIR

SEQ ID NO: 3110292 - protein, 10 aa, Giardia lamblia
FPSEETRANL

SEQ ID NO: 3110293 - protein, 5 aa, Giardia lamblia
FPSET

SEQ ID NO: 3110294 - protein, 5 aa, Giardia lamblia
FPSKV

SEQ ID NO: 3110295 - protein, 4 aa, Giardia lamblia
FPSN

SEQ ID NO: 3110296 - protein, 12 aa, Giardia lamblia
FPSNSSSRLGTP

SEQ ID NO: 3110297 - protein, 14 aa, Giardia lamblia
FPSPDQQGTIADST

SEQ ID NO: 3110298 - protein, 7 aa, Giardia lamblia
FPSPPAE

SEQ ID NO: 3110299 - protein, 16 aa, Giardia lamblia
FPSPRYDNADQGTSQA

SEQ ID NO: 3110300 - protein, 6 aa, Giardia lamblia
FPSRNI

SEQ ID NO: 3110301 - protein, 6 aa, Giardia lamblia
FPTEPY

SEQ ID NO: 3110302 - protein, 6 aa, Giardia lamblia
FPTPKI

SEQ ID NO: 3110303 - protein, 20 aa, Giardia lamblia
FPTTQEPPENQAMRQSSSTL

SEQ ID NO: 3110304 - protein, 4 aa, Giardia lamblia
FPWT

SEQ ID NO: 3110305 - protein, 5 aa, Giardia lamblia
FPYTT

SEQ ID NO: 3110306 - protein, 9 aa, Giardia lamblia
FQAPKTSDT

SEQ ID NO: 3110307 - protein, 6 aa, Giardia lamblia
FQASSS

SEQ ID NO: 3110308 - protein, 9 aa, Giardia lamblia
FQDKAGQTA

SEQ ID NO: 3110309 - protein, 8 aa, Giardia lamblia
FQDKEDSQ

SEQ ID NO: 3110310 - protein, 10 aa, Giardia lamblia
FQDKSGRTAL

SEQ ID NO: 3110311 - protein, 47 aa, Giardia lamblia
FQDREASDSYDDDAKYSTDEEELSEEEAESDSGIITSDDDSNSDNLA

SEQ ID NO: 3110312 - protein, 5 aa, Giardia lamblia
FQDTT

SEQ ID NO: 3110313 - protein, 4 aa, Giardia lamblia
FQGH

SEQ ID NO: 3110314 - protein, 17 aa, Giardia lamblia
FQKDPPMNCSGGPVGDD

SEQ ID NO: 3110315 - protein, 4 aa, Giardia lamblia
FQKT

SEQ ID NO: 3110316 - protein, 5 aa, Giardia lamblia
FQNNE

SEQ ID NO: 3110317 - protein, 8 aa, Giardia lamblia
FQNRDSAQ

SEQ ID NO: 3110318 - protein, 4 aa, Giardia lamblia
FQNT

SEQ ID NO: 3110319 - protein, 4 aa, Giardia lamblia
FQPE

SEQ ID NO: 3110320 - protein, 7 aa, Giardia lamblia
FQPGSPS

SEQ ID NO: 3110321 - protein, 11 aa, Giardia lamblia
FQPKTRGGRRA

SEQ ID NO: 3110322 - protein, 7 aa, Giardia lamblia
FQPPQQK

SEQ ID NO: 3110323 - protein, 10 aa, Giardia lamblia
FQPQTSEKRV

SEQ ID NO: 3110324 - protein, 5 aa, Giardia lamblia
FQQAQ

SEQ ID NO: 3110325 - protein, 17 aa, Giardia lamblia
FQQQTRRNTKADDEFET

SEQ ID NO: 3110326 - protein, 10 aa, Giardia lamblia
FQRSGEDWSR

SEQ ID NO: 3110327 - protein, 43 aa, Giardia lamblia
FQSDDAPKASQSTLPATPGGTLYPGGVKGAQTMGSVSGVTSHS

SEQ ID NO: 3110328 - protein, 8 aa, Giardia lamblia
FQSPPPAV

SEQ ID NO: 3110329 - protein, 9 aa, Giardia lamblia
FQSQSEPKK

SEQ ID NO: 3110330 - protein, 18 aa, Giardia lamblia
FQSSDAAFAEPQSRINSE

SEQ ID NO: 3110331 - protein, 5 aa, Giardia lamblia
FQSTH

SEQ ID NO: 3110332 - protein, 13 aa, Giardia lamblia
FQTSGASSRFRGE

SEQ ID NO: 3110333 - protein, 23 aa, Giardia lamblia
FRASETEARQQEAAASKAHTAAQ

SEQ ID NO: 3110334 - protein, 4 aa, Giardia lamblia
FRDA

SEQ ID NO: 3110335 - protein, 11 aa, Giardia lamblia
FRDNADANTSI

SEQ ID NO: 3110336 - protein, 27 aa, Giardia lamblia
FRDNHGKSALNYASEGGHADVVAILRK

SEQ ID NO: 3110337 - protein, 5 aa, Giardia lamblia
FRDPT

SEQ ID NO: 3110338 - protein, 7 aa, Giardia lamblia
FRDTAVG

SEQ ID NO: 3110339 - protein, 7 aa, Giardia lamblia
FREEDQK

SEQ ID NO: 3110340 - protein, 12 aa, Giardia lamblia
FRERSNVQGRRI

SEQ ID NO: 3110341 - protein, 12 aa, Giardia lamblia
FRGSDDGDGETG

SEQ ID NO: 3110342 - protein, 6 aa, Giardia lamblia
FRKNPD

SEQ ID NO: 3110343 - protein, 4 aa, Giardia lamblia
FRKP

SEQ ID NO: 3110344 - protein, 13 aa, Giardia lamblia
FRNESSDQTHSPE

SEQ ID NO: 3110345 - protein, 6 aa, Giardia lamblia
FRNTGG

SEQ ID NO: 3110346 - protein, 14 aa, Giardia lamblia
FRPANSGSGPASRM

SEQ ID NO: 3110347 - protein, 11 aa, Giardia lamblia
FRPASARTQSL

SEQ ID NO: 3110348 - protein, 65 aa, Giardia lamblia
FRPASGALTPMNSSTLTTSALKETQPVQKRARSASSQQKGNTITAAPSISQAQHSLSDAGLSSTF

SEQ ID NO: 3110349 - protein, 9 aa, Giardia lamblia
FRPGESHRE

SEQ ID NO: 3110350 - protein, 24 aa, Giardia lamblia
FRPKDTPFSSGNVSPYADKGVADQ

SEQ ID NO: 3110351 - protein, 6 aa, Giardia lamblia
FRPKES

SEQ ID NO: 3110352 - protein, 6 aa, Giardia lamblia
FRPPSS

SEQ ID NO: 3110353 - protein, 5 aa, Giardia lamblia
FRPSG

SEQ ID NO: 3110354 - protein, 11 aa, Giardia lamblia
FRPSKKQIKEA

SEQ ID NO: 3110355 - protein, 4 aa, Giardia lamblia
FRQE

SEQ ID NO: 3110356 - protein, 25 aa, Giardia lamblia
FRQTNKDTTNYQEQPESHTRASRAR

SEQ ID NO: 3110357 - protein, 7 aa, Giardia lamblia
FRRTTDP

SEQ ID NO: 3110358 - protein, 4 aa, Giardia lamblia
FRSA

SEQ ID NO: 3110359 - protein, 4 aa, Giardia lamblia
FRSE

SEQ ID NO: 3110360 - protein, 9 aa, Giardia lamblia
FRSSTSSDF

SEQ ID NO: 3110361 - protein, 22 aa, Giardia lamblia
FRSTRRSSATRRGLSGEKGKSL

SEQ ID NO: 3110362 - protein, 8 aa, Giardia lamblia
FRTAEGKT

SEQ ID NO: 3110363 - protein, 9 aa, Giardia lamblia
FSADNKEPL

SEQ ID NO: 3110364 - protein, 7 aa, Giardia lamblia
FSADPDK

SEQ ID NO: 3110365 - protein, 5 aa, Giardia lamblia
FSAER

SEQ ID NO: 3110366 - protein, 11 aa, Giardia lamblia
FSARHKAENTD

SEQ ID NO: 3110367 - protein, 5 aa, Giardia lamblia
FSARS

SEQ ID NO: 3110368 - protein, 5 aa, Giardia lamblia
FSAST

SEQ ID NO: 3110369 - protein, 10 aa, Giardia lamblia
FSATVQPTTL

SEQ ID NO: 3110370 - protein, 7 aa, Giardia lamblia
FSDDEVA

SEQ ID NO: 3110371 - protein, 9 aa, Giardia lamblia
FSDDKDQGL

SEQ ID NO: 3110372 - protein, 6 aa, Giardia lamblia
FSDEAP

SEQ ID NO: 3110373 - protein, 5 aa, Giardia lamblia
FSDEE

SEQ ID NO: 3110374 - protein, 9 aa, Giardia lamblia
FSDGQSGSV

SEQ ID NO: 3110375 - protein, 9 aa, Giardia lamblia
FSDNEKKQT

SEQ ID NO: 3110376 - protein, 10 aa, Giardia lamblia
FSDNRAKFNA

SEQ ID NO: 3110377 - protein, 7 aa, Giardia lamblia
FSDQTYT

SEQ ID NO: 3110378 - protein, 21 aa, Giardia lamblia
FSDSSDVSSSRGVDGSGKKRC

SEQ ID NO: 3110379 - protein, 7 aa, Giardia lamblia
FSEETSK

SEQ ID NO: 3110380 - protein, 9 aa, Giardia lamblia
FSEGGGAYQ

SEQ ID NO: 3110381 - protein, 11 aa, Giardia lamblia
FSEHKSSASVP

SEQ ID NO: 3110382 - protein, 5 aa, Giardia lamblia
FSEHS

SEQ ID NO: 3110383 - protein, 8 aa, Giardia lamblia
FSEKKQRL

SEQ ID NO: 3110384 - protein, 8 aa, Giardia lamblia
FSENPAAA

SEQ ID NO: 3110385 - protein, 18 aa, Giardia lamblia
FSEPDEETGQPSNQGRTW

SEQ ID NO: 3110386 - protein, 7 aa, Giardia lamblia
FSEQPGI

SEQ ID NO: 3110387 - protein, 11 aa, Giardia lamblia
FSESNTGSDVT

SEQ ID NO: 3110388 - protein, 11 aa, Giardia lamblia
FSESPDPVTQG

SEQ ID NO: 3110389 - protein, 11 aa, Giardia lamblia
FSESREDQTNA

SEQ ID NO: 3110390 - protein, 25 aa, Giardia lamblia
FSESSDIGRNTSEDQSALSLDDAAE

SEQ ID NO: 3110391 - protein, 10 aa, Giardia lamblia
FSESTGTQHP

SEQ ID NO: 3110392 - protein, 9 aa, Giardia lamblia
FSESTKRDI

SEQ ID NO: 3110393 - protein, 15 aa, Giardia lamblia
FSETEAGKESEDGLK

SEQ ID NO: 3110394 - protein, 5 aa, Giardia lamblia
FSETV

SEQ ID NO: 3110395 - protein, 9 aa, Giardia lamblia
FSGADKSQH

SEQ ID NO: 3110396 - protein, 30 aa, Giardia lamblia
FSGASRPNISAKDLQTSVSLSSQTRSATKS

SEQ ID NO: 3110397 - protein, 4 aa, Giardia lamblia
FSGD

SEQ ID NO: 3110398 - protein, 10 aa, Giardia lamblia
FSGEDTVSND

SEQ ID NO: 3110399 - protein, 8 aa, Giardia lamblia
FSGEKGQI

SEQ ID NO: 3110400 - protein, 7 aa, Giardia lamblia
FSGGHSG

SEQ ID NO: 3110401 - protein, 12 aa, Giardia lamblia
FSGGQQNTATAP

SEQ ID NO: 3110402 - protein, 11 aa, Giardia lamblia
FSGHAASKPTL

SEQ ID NO: 3110403 - protein, 8 aa, Giardia lamblia
FSGHGTAR

SEQ ID NO: 3110404 - protein, 20 aa, Giardia lamblia
FSGKTYTVSGPHYSSSERGL

SEQ ID NO: 3110405 - protein, 5 aa, Giardia lamblia
FSGNK

SEQ ID NO: 3110406 - protein, 9 aa, Giardia lamblia
FSGSPRTTL

SEQ ID NO: 3110407 - protein, 12 aa, Giardia lamblia
FSGSRTPSGDTG

SEQ ID NO: 3110408 - protein, 17 aa, Giardia lamblia
FSGSSDVDDERCQDTTG

SEQ ID NO: 3110409 - protein, 7 aa, Giardia lamblia
FSHADSS

SEQ ID NO: 3110410 - protein, 12 aa, Giardia lamblia
FSKKDKEQHEPQ

SEQ ID NO: 3110411 - protein, 15 aa, Giardia lamblia
FSKPADTGNDPSEGE

SEQ ID NO: 3110412 - protein, 9 aa, Giardia lamblia
FSKPGKPGF

SEQ ID NO: 3110413 - protein, 5 aa, Giardia lamblia
FSKSM

SEQ ID NO: 3110414 - protein, 6 aa, Giardia lamblia
FSKSPI

SEQ ID NO: 3110415 - protein, 17 aa, Giardia lamblia
FSKSQYGRINSTPQRLS

SEQ ID NO: 3110416 - protein, 11 aa, Giardia lamblia
FSKSTDVDGET

SEQ ID NO: 3110417 - protein, 12 aa, Giardia lamblia
FSKTQSSTTDVC

SEQ ID NO: 3110418 - protein, 6 aa, Giardia lamblia
FSNEQK

SEQ ID NO: 3110419 - protein, 5 aa, Giardia lamblia
FSNGG

SEQ ID NO: 3110420 - protein, 6 aa, Giardia lamblia
FSNKHD

SEQ ID NO: 3110421 - protein, 64 aa, Giardia lamblia
FSNPSKGAQSRSNNSSRSSSVEEDLAGRQRKPQRHRGKGLGAKLSNQVSGDAKEHSTSDGSEHG

SEQ ID NO: 3110422 - protein, 15 aa, Giardia lamblia
FSNPSSDQQATHDPH

SEQ ID NO: 3110423 - protein, 6 aa, Giardia lamblia
FSNSVS

SEQ ID NO: 3110424 - protein, 5 aa, Giardia lamblia
FSPDS

SEQ ID NO: 3110425 - protein, 11 aa, Giardia lamblia
FSPDSTGASNI

SEQ ID NO: 3110426 - protein, 5 aa, Giardia lamblia
FSPGQ

SEQ ID NO: 3110427 - protein, 8 aa, Giardia lamblia
FSPKAENI

SEQ ID NO: 3110428 - protein, 7 aa, Giardia lamblia
FSPNDPS

SEQ ID NO: 3110429 - protein, 5 aa, Giardia lamblia
FSPNP

SEQ ID NO: 3110430 - protein, 10 aa, Giardia lamblia
FSPPSTPQLH

SEQ ID NO: 3110431 - protein, 28 aa, Giardia lamblia
FSPPTTAATATAAAAASTSPAPSQGPVV

SEQ ID NO: 3110432 - protein, 6 aa, Giardia lamblia
FSPQRR

SEQ ID NO: 3110433 - protein, 20 aa, Giardia lamblia
FSPQSGGDLSKIAARIRECM

SEQ ID NO: 3110434 - protein, 12 aa, Giardia lamblia
FSPRPNSDSAAA

SEQ ID NO: 3110435 - protein, 6 aa, Giardia lamblia
FSPSGH

SEQ ID NO: 3110436 - protein, 29 aa, Giardia lamblia
FSQNTSPRSSVATDKAGAATLDQADDADN

SEQ ID NO: 3110437 - protein, 7 aa, Giardia lamblia
FSQSSHS

SEQ ID NO: 3110438 - protein, 47 aa, Giardia lamblia
FSQTGPLTGRVSKGSASPKAKRPLSNNGLGPKGAIGPISMPKHLPAP

SEQ ID NO: 3110439 - protein, 5 aa, Giardia lamblia
FSRNS

SEQ ID NO: 3110440 - protein, 9 aa, Giardia lamblia
FSRSRKSDI

SEQ ID NO: 3110441 - protein, 4 aa, Giardia lamblia
FSSA

SEQ ID NO: 3110442 - protein, 5 aa, Giardia lamblia
FSSAD

SEQ ID NO: 3110443 - protein, 11 aa, Giardia lamblia
FSSAPASKRAS

SEQ ID NO: 3110444 - protein, 45 aa, Giardia lamblia
FSSASKPNPDNVQAPVERDKADTIDDSVTEEDSSDYVDTDPSHVK

SEQ ID NO: 3110445 - protein, 19 aa, Giardia lamblia
FSSDGEAGSGPKGRPRPGT

SEQ ID NO: 3110446 - protein, 7 aa, Giardia lamblia
FSSDPGL

SEQ ID NO: 3110447 - protein, 8 aa, Giardia lamblia
FSSDSQTL

SEQ ID NO: 3110448 - protein, 7 aa, Giardia lamblia
FSSEDGQ

SEQ ID NO: 3110449 - protein, 28 aa, Giardia lamblia
FSSEPIDAAEVEDDEGDDPLSTNLSGGN

SEQ ID NO: 3110450 - protein, 20 aa, Giardia lamblia
FSSEPVSRSMSADVKQPQFR

SEQ ID NO: 3110451 - protein, 13 aa, Giardia lamblia
FSSESEESSKPVE

SEQ ID NO: 3110452 - protein, 10 aa, Giardia lamblia
FSSGKGAHLS

SEQ ID NO: 3110453 - protein, 6 aa, Giardia lamblia
FSSGTT

SEQ ID NO: 3110454 - protein, 8 aa, Giardia lamblia
FSSKPHQN

SEQ ID NO: 3110455 - protein, 19 aa, Giardia lamblia
FSSKRAGGDVQTANKADPY

SEQ ID NO: 3110456 - protein, 8 aa, Giardia lamblia
FSSKTQPE

SEQ ID NO: 3110457 - protein, 11 aa, Giardia lamblia
FSSNQGHLNET

SEQ ID NO: 3110458 - protein, 5 aa, Giardia lamblia
FSSNY

SEQ ID NO: 3110459 - protein, 17 aa, Giardia lamblia
FSSPGIAPGQSVSEDSP

SEQ ID NO: 3110460 - protein, 12 aa, Giardia lamblia
FSSPGNAGSGSW

SEQ ID NO: 3110461 - protein, 7 aa, Giardia lamblia
FSSQPHQ

SEQ ID NO: 3110462 - protein, 10 aa, Giardia lamblia
FSSQSGISAT

SEQ ID NO: 3110463 - protein, 52 aa, Giardia lamblia
FSSQSRKHKRHHSSRSSSRKNELARREARTRSSQAGRHRRRASSTSSTSVYS

SEQ ID NO: 3110464 - protein, 19 aa, Giardia lamblia
FSSRGDSDTRTDPSDHDFD

SEQ ID NO: 3110465 - protein, 10 aa, Giardia lamblia
FSSRHGQKGT

SEQ ID NO: 3110466 - protein, 28 aa, Giardia lamblia
FSSRSSNASTRSHSPSVNSMKSASRDSL

SEQ ID NO: 3110467 - protein, 8 aa, Giardia lamblia
FSSSGSEH

SEQ ID NO: 3110468 - protein, 8 aa, Giardia lamblia
FSSSQSSP

SEQ ID NO: 3110469 - protein, 14 aa, Giardia lamblia
FSSSSDDGVTTPSL

SEQ ID NO: 3110470 - protein, 10 aa, Giardia lamblia
FSSSSDTELD

SEQ ID NO: 3110471 - protein, 30 aa, Giardia lamblia
FSSSSSSGPSSTDSCAPKSSELPASESKAH

SEQ ID NO: 3110472 - protein, 9 aa, Giardia lamblia
FSSSSTGNL

SEQ ID NO: 3110473 - protein, 13 aa, Giardia lamblia
FSSTGSLTYTPNG

SEQ ID NO: 3110474 - protein, 7 aa, Giardia lamblia
FSSTNGL

SEQ ID NO: 3110475 - protein, 7 aa, Giardia lamblia
FSSTSTR

SEQ ID NO: 3110476 - protein, 10 aa, Giardia lamblia
FSTDPCNASM

SEQ ID NO: 3110477 - protein, 7 aa, Giardia lamblia
FSTETDA

SEQ ID NO: 3110478 - protein, 7 aa, Giardia lamblia
FSTGASE

SEQ ID NO: 3110479 - protein, 26 aa, Giardia lamblia
FSTHGSSSAARASRDSNGKSSGQSEG

SEQ ID NO: 3110480 - protein, 13 aa, Giardia lamblia
FSTPSYLSQGAKD

SEQ ID NO: 3110481 - protein, 14 aa, Giardia lamblia
FSTQQSQAPPQLQA

SEQ ID NO: 3110482 - protein, 5 aa, Giardia lamblia
FSTRQ

SEQ ID NO: 3110483 - protein, 10 aa, Giardia lamblia
FSTSDVRSYH

SEQ ID NO: 3110484 - protein, 8 aa, Giardia lamblia
FSTSTTNQ

SEQ ID NO: 3110485 - protein, 7 aa, Giardia lamblia
FSTTPDR

SEQ ID NO: 3110486 - protein, 17 aa, Giardia lamblia
FSTTPTGTTAAESSSLT

SEQ ID NO: 3110487 - protein, 13 aa, Giardia lamblia
FSTTSDGKQARSR

SEQ ID NO: 3110488 - protein, 7 aa, Giardia lamblia
FSTTTND

SEQ ID NO: 3110489 - protein, 9 aa, Giardia lamblia
FSVSPTSVS

SEQ ID NO: 3110490 - protein, 13 aa, Giardia lamblia
FSWSSESGETTDY

SEQ ID NO: 3110491 - protein, 6 aa, Giardia lamblia
FTAGAG

SEQ ID NO: 3110492 - protein, 9 aa, Giardia lamblia
FTAPGAPTP

SEQ ID NO: 3110493 - protein, 8 aa, Giardia lamblia
FTAPSPDV

SEQ ID NO: 3110494 - protein, 6 aa, Giardia lamblia
FTASSD

SEQ ID NO: 3110495 - protein, 18 aa, Giardia lamblia
FTDEREHGENIEEERENK

SEQ ID NO: 3110496 - protein, 4 aa, Giardia lamblia
FTDP

SEQ ID NO: 3110497 - protein, 7 aa, Giardia lamblia
FTDSDLP

SEQ ID NO: 3110498 - protein, 7 aa, Giardia lamblia
FTEASDH

SEQ ID NO: 3110499 - protein, 10 aa, Giardia lamblia
FTEPASCPRC

SEQ ID NO: 3110500 - protein, 10 aa, Giardia lamblia
FTERTPAVPV

SEQ ID NO: 3110501 - protein, 7 aa, Giardia lamblia
FTGAYSP

SEQ ID NO: 3110502 - protein, 7 aa, Giardia lamblia
FTGDASH

SEQ ID NO: 3110503 - protein, 4 aa, Giardia lamblia
FTGE

SEQ ID NO: 3110504 - protein, 6 aa, Giardia lamblia
FTGNTG

SEQ ID NO: 3110505 - protein, 10 aa, Giardia lamblia
FTGPQSNLAP

SEQ ID NO: 3110506 - protein, 6 aa, Giardia lamblia
FTGRDY

SEQ ID NO: 3110507 - protein, 5 aa, Giardia lamblia
FTGSN

SEQ ID NO: 3110508 - protein, 5 aa, Giardia lamblia
FTGTN

SEQ ID NO: 3110509 - protein, 6 aa, Giardia lamblia
FTKDQA

SEQ ID NO: 3110510 - protein, 9 aa, Giardia lamblia
FTKNPLATA

SEQ ID NO: 3110511 - protein, 7 aa, Giardia lamblia
FTKSDGT

SEQ ID NO: 3110512 - protein, 10 aa, Giardia lamblia
FTNPEQGKRY

SEQ ID NO: 3110513 - protein, 6 aa, Giardia lamblia
FTNSSG

SEQ ID NO: 3110514 - protein, 4 aa, Giardia lamblia
FTPD

SEQ ID NO: 3110515 - protein, 12 aa, Giardia lamblia
FTPDEISKTTTS

SEQ ID NO: 3110516 - protein, 17 aa, Giardia lamblia
FTPGEQSPVHAKASEAR

SEQ ID NO: 3110517 - protein, 19 aa, Giardia lamblia
FTPGGTVTNLGQSESVSTN

SEQ ID NO: 3110518 - protein, 4 aa, Giardia lamblia
FTPN

SEQ ID NO: 3110519 - protein, 6 aa, Giardia lamblia
FTPPEC

SEQ ID NO: 3110520 - protein, 13 aa, Giardia lamblia
FTPQLAQSTSEAG

SEQ ID NO: 3110521 - protein, 8 aa, Giardia lamblia
FTPRGAAD

SEQ ID NO: 3110522 - protein, 6 aa, Giardia lamblia
FTPRPA

SEQ ID NO: 3110523 - protein, 5 aa, Giardia lamblia
FTPRQ

SEQ ID NO: 3110524 - protein, 10 aa, Giardia lamblia
FTPRSNSVGN

SEQ ID NO: 3110525 - protein, 4 aa, Giardia lamblia
FTPS

SEQ ID NO: 3110526 - protein, 5 aa, Giardia lamblia
FTPTI

SEQ ID NO: 3110527 - protein, 5 aa, Giardia lamblia
FTPTK

SEQ ID NO: 3110528 - protein, 5 aa, Giardia lamblia
FTQES

SEQ ID NO: 3110529 - protein, 8 aa, Giardia lamblia
FTQPNSDI

SEQ ID NO: 3110530 - protein, 5 aa, Giardia lamblia
FTQQG

SEQ ID NO: 3110531 - protein, 15 aa, Giardia lamblia
FTQSTRKKNEEATKL

SEQ ID NO: 3110532 - protein, 7 aa, Giardia lamblia
FTQTTPA

SEQ ID NO: 3110533 - protein, 7 aa, Giardia lamblia
FTRETAP

SEQ ID NO: 3110534 - protein, 10 aa, Giardia lamblia
FTRPNNKESY

SEQ ID NO: 3110535 - protein, 8 aa, Giardia lamblia
FTRPSTSV

SEQ ID NO: 3110536 - protein, 10 aa, Giardia lamblia
FTRRRSESIP

SEQ ID NO: 3110537 - protein, 12 aa, Giardia lamblia
FTRSKSSSEQKP

SEQ ID NO: 3110538 - protein, 6 aa, Giardia lamblia
FTRTRS

SEQ ID NO: 3110539 - protein, 8 aa, Giardia lamblia
FTSGEKIN

SEQ ID NO: 3110540 - protein, 9 aa, Giardia lamblia
FTSKDPANI

SEQ ID NO: 3110541 - protein, 15 aa, Giardia lamblia
FTSKETNKTPNPDSG

SEQ ID NO: 3110542 - protein, 7 aa, Giardia lamblia
FTSKSDA

SEQ ID NO: 3110543 - protein, 31 aa, Giardia lamblia
FTSNPWGQSRPPARPETCTGEVNGSNETASM

SEQ ID NO: 3110544 - protein, 8 aa, Giardia lamblia
FTSQTAEY

SEQ ID NO: 3110545 - protein, 8 aa, Giardia lamblia
FTTEEDKR

SEQ ID NO: 3110546 - protein, 4 aa, Giardia lamblia
FTTG

SEQ ID NO: 3110547 - protein, 6 aa, Giardia lamblia
FTTKKD

SEQ ID NO: 3110548 - protein, 8 aa, Giardia lamblia
FTTPGNIT

SEQ ID NO: 3110549 - protein, 10 aa, Giardia lamblia
FTTRHEDQGG

SEQ ID NO: 3110550 - protein, 37 aa, Giardia lamblia
FTTSESVQENVQQPTYPRKATLSRKKSIPALAPGQGI

SEQ ID NO: 3110551 - protein, 5 aa, Giardia lamblia
FTTTT

SEQ ID NO: 3110552 - protein, 18 aa, Giardia lamblia
FTVGPGAVSSEDEGPLDN

SEQ ID NO: 3110553 - protein, 8 aa, Giardia lamblia
FVGTRKPA

SEQ ID NO: 3110554 - protein, 8 aa, Giardia lamblia
FYRDAKPD

SEQ ID NO: 3110555 - protein, 8 aa, Giardia lamblia
GAAAARRT

SEQ ID NO: 3110556 - protein, 19 aa, Giardia lamblia
GAAASRKKNRDNITQVDVQ

SEQ ID NO: 3110557 - protein, 14 aa, Giardia lamblia
GAACKSDSSNSRHP

SEQ ID NO: 3110558 - protein, 15 aa, Giardia lamblia
GAADTSRANSIRPTI

SEQ ID NO: 3110559 - protein, 6 aa, Giardia lamblia
GAAEEV

SEQ ID NO: 3110560 - protein, 26 aa, Giardia lamblia
GAAEIKPPQPQGSASAKHQDLERGST

SEQ ID NO: 3110561 - protein, 19 aa, Giardia lamblia
GAAERNADDPNYAALCSLF

SEQ ID NO: 3110562 - protein, 7 aa, Giardia lamblia
GAAGPTI

SEQ ID NO: 3110563 - protein, 5 aa, Giardia lamblia
GAAGS

SEQ ID NO: 3110564 - protein, 7 aa, Giardia lamblia
GAAGTAQ

SEQ ID NO: 3110565 - protein, 8 aa, Giardia lamblia
GAAKAGSL

SEQ ID NO: 3110566 - protein, 9 aa, Giardia lamblia
GAAKDNLNE

SEQ ID NO: 3110567 - protein, 22 aa, Giardia lamblia
GAAKSQSRHSTTSEKYSTRQDC

SEQ ID NO: 3110568 - protein, 7 aa, Giardia lamblia
GAANYSR

SEQ ID NO: 3110569 - protein, 13 aa, Giardia lamblia
GAAPAAASTAAAV

SEQ ID NO: 3110570 - protein, 6 aa, Giardia lamblia
GAAPLS

SEQ ID NO: 3110571 - protein, 11 aa, Giardia lamblia
GAAQQKQAHPL

SEQ ID NO: 3110572 - protein, 7 aa, Giardia lamblia
GAARPSS

SEQ ID NO: 3110573 - protein, 21 aa, Giardia lamblia
GAASAPAAAPTPSTPAPVAPI

SEQ ID NO: 3110574 - protein, 7 aa, Giardia lamblia
GAASGVA

SEQ ID NO: 3110575 - protein, 18 aa, Giardia lamblia
GAASHSVEDTPSNDLTKH

SEQ ID NO: 3110576 - protein, 9 aa, Giardia lamblia
GAATQDEVD

SEQ ID NO: 3110577 - protein, 7 aa, Giardia lamblia
GACGGEK

SEQ ID NO: 3110578 - protein, 7 aa, Giardia lamblia
GACPQKC

SEQ ID NO: 3110579 - protein, 11 aa, Giardia lamblia
GADADSPGCGS

SEQ ID NO: 3110580 - protein, 10 aa, Giardia lamblia
GADASSTSTA

SEQ ID NO: 3110581 - protein, 10 aa, Giardia lamblia
GADDPDEETG

SEQ ID NO: 3110582 - protein, 14 aa, Giardia lamblia
GADDPDIMNTEASE

SEQ ID NO: 3110583 - protein, 7 aa, Giardia lamblia
GADGGAS

SEQ ID NO: 3110584 - protein, 6 aa, Giardia lamblia
GADHGN

SEQ ID NO: 3110585 - protein, 24 aa, Giardia lamblia
GADIESDDDDVEVTPPTLAGNTNY

SEQ ID NO: 3110586 - protein, 7 aa, Giardia lamblia
GADPTSQ

SEQ ID NO: 3110587 - protein, 5 aa, Giardia lamblia
GADRA

SEQ ID NO: 3110588 - protein, 39 aa, Giardia lamblia
GADSNLQRSDAVAGSTAFPQQSPARPSPPRSERPPKKEK

SEQ ID NO: 3110589 - protein, 13 aa, Giardia lamblia
GADSNTSLYGTSS

SEQ ID NO: 3110590 - protein, 7 aa, Giardia lamblia
GADSPID

SEQ ID NO: 3110591 - protein, 7 aa, Giardia lamblia
GADSPLS

SEQ ID NO: 3110592 - protein, 13 aa, Giardia lamblia
GADSPSTSATATM

SEQ ID NO: 3110593 - protein, 16 aa, Giardia lamblia
GADSTDSLEDAIDNES

SEQ ID NO: 3110594 - protein, 6 aa, Giardia lamblia
GADTDL

SEQ ID NO: 3110595 - protein, 11 aa, Giardia lamblia
GADTDVPAGDI

SEQ ID NO: 3110596 - protein, 16 aa, Giardia lamblia
GADVSSFSTAGGRRTE

SEQ ID NO: 3110597 - protein, 6 aa, Giardia lamblia
GADYSE

SEQ ID NO: 3110598 - protein, 10 aa, Giardia lamblia
GAEAGSLRRG

SEQ ID NO: 3110599 - protein, 5 aa, Giardia lamblia
GAEAS

SEQ ID NO: 3110600 - protein, 5 aa, Giardia lamblia
GAEDR

SEQ ID NO: 3110601 - protein, 4 aa, Giardia lamblia
GAEE

SEQ ID NO: 3110602 - protein, 8 aa, Giardia lamblia
GAEEHHKK

SEQ ID NO: 3110603 - protein, 10 aa, Giardia lamblia
GAEEIESTEL

SEQ ID NO: 3110604 - protein, 6 aa, Giardia lamblia
GAEEQI

SEQ ID NO: 3110605 - protein, 5 aa, Giardia lamblia
GAEES

SEQ ID NO: 3110606 - protein, 4 aa, Giardia lamblia
GAEG

SEQ ID NO: 3110607 - protein, 6 aa, Giardia lamblia
GAEITG

SEQ ID NO: 3110608 - protein, 5 aa, Giardia lamblia
GAELE

SEQ ID NO: 3110609 - protein, 6 aa, Giardia lamblia
GAEMTR

SEQ ID NO: 3110610 - protein, 13 aa, Giardia lamblia
GAENISMNPTTNG

SEQ ID NO: 3110611 - protein, 19 aa, Giardia lamblia
GAENPHSNRHSRSSSPNTV

SEQ ID NO: 3110612 - protein, 6 aa, Giardia lamblia
GAEPGV

SEQ ID NO: 3110613 - protein, 6 aa, Giardia lamblia
GAEPTL

SEQ ID NO: 3110614 - protein, 25 aa, Giardia lamblia
GAEQDGSDTLDRDNALGSVPTEKRA

SEQ ID NO: 3110615 - protein, 12 aa, Giardia lamblia
GAEQPQAATYTS

SEQ ID NO: 3110616 - protein, 4 aa, Giardia lamblia
GAER

SEQ ID NO: 3110617 - protein, 9 aa, Giardia lamblia
GAERTKTWK

SEQ ID NO: 3110618 - protein, 5 aa, Giardia lamblia
GAESG

SEQ ID NO: 3110619 - protein, 13 aa, Giardia lamblia
GAESIVGDTGPLG

SEQ ID NO: 3110620 - protein, 5 aa, Giardia lamblia
GAESL

SEQ ID NO: 3110621 - protein, 14 aa, Giardia lamblia
GAEVPEEKQARSTT

SEQ ID NO: 3110622 - protein, 8 aa, Giardia lamblia
GAFNEPNL

SEQ ID NO: 3110623 - protein, 4 aa, Giardia lamblia
GAGA

SEQ ID NO: 3110624 - protein, 12 aa, Giardia lamblia
GAGANGPRTEVA

SEQ ID NO: 3110625 - protein, 8 aa, Giardia lamblia
GAGASTDM

SEQ ID NO: 3110626 - protein, 7 aa, Giardia lamblia
GAGATDA

SEQ ID NO: 3110627 - protein, 6 aa, Giardia lamblia
GAGATV

SEQ ID NO: 3110628 - protein, 4 aa, Giardia lamblia
GAGD

SEQ ID NO: 3110629 - protein, 6 aa, Giardia lamblia
GAGGAT

SEQ ID NO: 3110630 - protein, 6 aa, Giardia lamblia
GAGGLS

SEQ ID NO: 3110631 - protein, 6 aa, Giardia lamblia
GAGGQA

SEQ ID NO: 3110632 - protein, 24 aa, Giardia lamblia
GAGHEDEEHEQESSEESGAPEATS

SEQ ID NO: 3110633 - protein, 5 aa, Giardia lamblia
GAGIK

SEQ ID NO: 3110634 - protein, 9 aa, Giardia lamblia
GAGISSPAD

SEQ ID NO: 3110635 - protein, 8 aa, Giardia lamblia
GAGKDSTL

SEQ ID NO: 3110636 - protein, 5 aa, Giardia lamblia
GAGKI

SEQ ID NO: 3110637 - protein, 7 aa, Giardia lamblia
GAGKSNF

SEQ ID NO: 3110638 - protein, 7 aa, Giardia lamblia
GAGKTTT

SEQ ID NO: 3110639 - protein, 8 aa, Giardia lamblia
GAGKVDES

SEQ ID NO: 3110640 - protein, 5 aa, Giardia lamblia
GAGLG

SEQ ID NO: 3110641 - protein, 14 aa, Giardia lamblia
GAGLSSEKSSQRDA

SEQ ID NO: 3110642 - protein, 13 aa, Giardia lamblia
GAGRVARDPTLPA

SEQ ID NO: 3110643 - protein, 8 aa, Giardia lamblia
GAGSLDGS

SEQ ID NO: 3110644 - protein, 20 aa, Giardia lamblia
GAGSPAEAPAQSTEAVASPV

SEQ ID NO: 3110645 - protein, 9 aa, Giardia lamblia
GAGSTTSMD

SEQ ID NO: 3110646 - protein, 5 aa, Giardia lamblia
GAGSY

SEQ ID NO: 3110647 - protein, 10 aa, Giardia lamblia
GAGTDPLPGR

SEQ ID NO: 3110648 - protein, 6 aa, Giardia lamblia
GAGTGF

SEQ ID NO: 3110649 - protein, 10 aa, Giardia lamblia
GAHEPTSTNN

SEQ ID NO: 3110650 - protein, 4 aa, Giardia lamblia
GAHG

SEQ ID NO: 3110651 - protein, 6 aa, Giardia lamblia
GAHPSE

SEQ ID NO: 3110652 - protein, 8 aa, Giardia lamblia
GAHSGLPS

SEQ ID NO: 3110653 - protein, 28 aa, Giardia lamblia
GAHTAAKTVRSDPDATVSPKDSDPVPER

SEQ ID NO: 3110654 - protein, 7 aa, Giardia lamblia
GAHYQES

SEQ ID NO: 3110655 - protein, 7 aa, Giardia lamblia
GAIDKKD

SEQ ID NO: 3110656 - protein, 4 aa, Giardia lamblia
GAIH

SEQ ID NO: 3110657 - protein, 4 aa, Giardia lamblia
GAIP

SEQ ID NO: 3110658 - protein, 7 aa, Giardia lamblia
GAIPAEA

SEQ ID NO: 3110659 - protein, 5 aa, Giardia lamblia
GAISD

SEQ ID NO: 3110660 - protein, 9 aa, Giardia lamblia
GAKAADPED

SEQ ID NO: 3110661 - protein, 6 aa, Giardia lamblia
GAKEYT

SEQ ID NO: 3110662 - protein, 10 aa, Giardia lamblia
GAKGLERKPL

SEQ ID NO: 3110663 - protein, 6 aa, Giardia lamblia
GAKGSC

SEQ ID NO: 3110664 - protein, 8 aa, Giardia lamblia
GAKKQYDK

SEQ ID NO: 3110665 - protein, 9 aa, Giardia lamblia
GAKKTTEVA

SEQ ID NO: 3110666 - protein, 9 aa, Giardia lamblia
GAKPSLHQQ

SEQ ID NO: 3110667 - protein, 9 aa, Giardia lamblia
GAKRNMEGE

SEQ ID NO: 3110668 - protein, 8 aa, Giardia lamblia
GAKSPPTL

SEQ ID NO: 3110669 - protein, 13 aa, Giardia lamblia
GAKSQRKTGERIG

SEQ ID NO: 3110670 - protein, 11 aa, Giardia lamblia
GAKTASSLPEL

SEQ ID NO: 3110671 - protein, 5 aa, Giardia lamblia
GAKTE

SEQ ID NO: 3110672 - protein, 8 aa, Giardia lamblia
GAKTKEGM

SEQ ID NO: 3110673 - protein, 9 aa, Giardia lamblia
GAKTQIDKN

SEQ ID NO: 3110674 - protein, 10 aa, Giardia lamblia
GAKVESSLRQ

SEQ ID NO: 3110675 - protein, 5 aa, Giardia lamblia
GAKYS

SEQ ID NO: 3110676 - protein, 4 aa, Giardia lamblia
GALK

SEQ ID NO: 3110677 - protein, 12 aa, Giardia lamblia
GALKYSGHPSQC

SEQ ID NO: 3110678 - protein, 7 aa, Giardia lamblia
GALNQQS

SEQ ID NO: 3110679 - protein, 4 aa, Giardia lamblia
GALP

SEQ ID NO: 3110680 - protein, 13 aa, Giardia lamblia
GALPSNVGGGNNL

SEQ ID NO: 3110681 - protein, 15 aa, Giardia lamblia
GALPSPEAEEQCQSR

SEQ ID NO: 3110682 - protein, 4 aa, Giardia lamblia
GALS

SEQ ID NO: 3110683 - protein, 5 aa, Giardia lamblia
GALSH

SEQ ID NO: 3110684 - protein, 13 aa, Giardia lamblia
GAMNSSDDEYRGI

SEQ ID NO: 3110685 - protein, 11 aa, Giardia lamblia
GAMSDDSTNVD

SEQ ID NO: 3110686 - protein, 8 aa, Giardia lamblia
GAMSNTGT

SEQ ID NO: 3110687 - protein, 12 aa, Giardia lamblia
GANDTNEKRASL

SEQ ID NO: 3110688 - protein, 8 aa, Giardia lamblia
GANEASRH

SEQ ID NO: 3110689 - protein, 9 aa, Giardia lamblia
GANEGSSTS

SEQ ID NO: 3110690 - protein, 10 aa, Giardia lamblia
GANKAPPPTK

SEQ ID NO: 3110691 - protein, 19 aa, Giardia lamblia
GANMEPNSPRRDDRGAGGW

SEQ ID NO: 3110692 - protein, 7 aa, Giardia lamblia
GANNERV

SEQ ID NO: 3110693 - protein, 9 aa, Giardia lamblia
GANPSERSD

SEQ ID NO: 3110694 - protein, 9 aa, Giardia lamblia
GANTAQAKD

SEQ ID NO: 3110695 - protein, 12 aa, Giardia lamblia
GANTPKRRPLPL

SEQ ID NO: 3110696 - protein, 10 aa, Giardia lamblia
GANYAGKNQP

SEQ ID NO: 3110697 - protein, 23 aa, Giardia lamblia
GAPAAADTTQEKFGNATSRSTSH

SEQ ID NO: 3110698 - protein, 6 aa, Giardia lamblia
GAPAAS

SEQ ID NO: 3110699 - protein, 9 aa, Giardia lamblia
GAPAASDFS

SEQ ID NO: 3110700 - protein, 17 aa, Giardia lamblia
GAPAGPAGTGKTESVKD

SEQ ID NO: 3110701 - protein, 6 aa, Giardia lamblia
GAPAMT

SEQ ID NO: 3110702 - protein, 5 aa, Giardia lamblia
GAPAP

SEQ ID NO: 3110703 - protein, 28 aa, Giardia lamblia
GAPASERKQPVVKKTDSKKDKNVPEPAS

SEQ ID NO: 3110704 - protein, 8 aa, Giardia lamblia
GAPEAPPL

SEQ ID NO: 3110705 - protein, 13 aa, Giardia lamblia
GAPEDNAAAEDSH

SEQ ID NO: 3110706 - protein, 11 aa, Giardia lamblia
GAPFPSGARSN

SEQ ID NO: 3110707 - protein, 16 aa, Giardia lamblia
GAPIEKQAKTKQKRSN

SEQ ID NO: 3110708 - protein, 6 aa, Giardia lamblia
GAPKEL

SEQ ID NO: 3110709 - protein, 4 aa, Giardia lamblia
GAPL

SEQ ID NO: 3110710 - protein, 10 aa, Giardia lamblia
GAPLGESTRQ

SEQ ID NO: 3110711 - protein, 25 aa, Giardia lamblia
GAPLSARSKVKAGSNRALPPKNEVR

SEQ ID NO: 3110712 - protein, 5 aa, Giardia lamblia
GAPNL

SEQ ID NO: 3110713 - protein, 7 aa, Giardia lamblia
GAPNMGT

SEQ ID NO: 3110714 - protein, 6 aa, Giardia lamblia
GAPNVT

SEQ ID NO: 3110715 - protein, 18 aa, Giardia lamblia
GAPQGPAGTGKTESTKDL

SEQ ID NO: 3110716 - protein, 7 aa, Giardia lamblia
GAPQNTL

SEQ ID NO: 3110717 - protein, 14 aa, Giardia lamblia
GAPQPHHSGPVSGA

SEQ ID NO: 3110718 - protein, 9 aa, Giardia lamblia
GAPRHASSA

SEQ ID NO: 3110719 - protein, 10 aa, Giardia lamblia
GAPSDKTELS

SEQ ID NO: 3110720 - protein, 10 aa, Giardia lamblia
GAPSKDQLVG

SEQ ID NO: 3110721 - protein, 9 aa, Giardia lamblia
GAPSSRSTF

SEQ ID NO: 3110722 - protein, 6 aa, Giardia lamblia
GAPSTW

SEQ ID NO: 3110723 - protein, 14 aa, Giardia lamblia
GAPTGAGVTTKEQA

SEQ ID NO: 3110724 - protein, 7 aa, Giardia lamblia
GAPTPRH

SEQ ID NO: 3110725 - protein, 8 aa, Giardia lamblia
GAPTPTKK

SEQ ID NO: 3110726 - protein, 7 aa, Giardia lamblia
GAPTREE

SEQ ID NO: 3110727 - protein, 10 aa, Giardia lamblia
GAPVPRKEHK

SEQ ID NO: 3110728 - protein, 4 aa, Giardia lamblia
GAPY

SEQ ID NO: 3110729 - protein, 11 aa, Giardia lamblia
GAQADASASNL

SEQ ID NO: 3110730 - protein, 9 aa, Giardia lamblia
GAQAKQALK

SEQ ID NO: 3110731 - protein, 10 aa, Giardia lamblia
GAQARTAEME

SEQ ID NO: 3110732 - protein, 9 aa, Giardia lamblia
GAQDEDGMT

SEQ ID NO: 3110733 - protein, 8 aa, Giardia lamblia
GAQDWEGN

SEQ ID NO: 3110734 - protein, 10 aa, Giardia lamblia
GAQFGKSKKT

SEQ ID NO: 3110735 - protein, 12 aa, Giardia lamblia
GAQKGRKLPPGV

SEQ ID NO: 3110736 - protein, 12 aa, Giardia lamblia
GAQKLDKNSGLG

SEQ ID NO: 3110737 - protein, 12 aa, Giardia lamblia
GAQKNRKVPPGV

SEQ ID NO: 3110738 - protein, 8 aa, Giardia lamblia
GAQKPLAQ

SEQ ID NO: 3110739 - protein, 9 aa, Giardia lamblia
GAQLQDGTS

SEQ ID NO: 3110740 - protein, 20 aa, Giardia lamblia
GAQLRTERTTGYLCPDEWLL

SEQ ID NO: 3110741 - protein, 9 aa, Giardia lamblia
GAQQESFDD

SEQ ID NO: 3110742 - protein, 9 aa, Giardia lamblia
GAQSGVERI

SEQ ID NO: 3110743 - protein, 7 aa, Giardia lamblia
GAQTSSD

SEQ ID NO: 3110744 - protein, 4 aa, Giardia lamblia
GAQY

SEQ ID NO: 3110745 - protein, 10 aa, Giardia lamblia
GAQYTNPPPF

SEQ ID NO: 3110746 - protein, 7 aa, Giardia lamblia
GARADGR

SEQ ID NO: 3110747 - protein, 7 aa, Giardia lamblia
GARDSQG

SEQ ID NO: 3110748 - protein, 5 aa, Giardia lamblia
GAREI

SEQ ID NO: 3110749 - protein, 7 aa, Giardia lamblia
GARESKY

SEQ ID NO: 3110750 - protein, 8 aa, Giardia lamblia
GARGTPAG

SEQ ID NO: 3110751 - protein, 7 aa, Giardia lamblia
GARHPSR

SEQ ID NO: 3110752 - protein, 5 aa, Giardia lamblia
GARIT

SEQ ID NO: 3110753 - protein, 8 aa, Giardia lamblia
GARLGSKG

SEQ ID NO: 3110754 - protein, 4 aa, Giardia lamblia
GARQ

SEQ ID NO: 3110755 - protein, 36 aa, Giardia lamblia
GARQQNQSLHETPNTSEGQRRRNNKQSRPVASTDTQ

SEQ ID NO: 3110756 - protein, 8 aa, Giardia lamblia
GARTAEGK

SEQ ID NO: 3110757 - protein, 7 aa, Giardia lamblia
GARVSEG

SEQ ID NO: 3110758 - protein, 17 aa, Giardia lamblia
GASASLASSLSVPSPKR

SEQ ID NO: 3110759 - protein, 11 aa, Giardia lamblia
GASASSGSSAL

SEQ ID NO: 3110760 - protein, 4 aa, Giardia lamblia
GASC

SEQ ID NO: 3110761 - protein, 15 aa, Giardia lamblia
GASDQEGHGAGLSSK

SEQ ID NO: 3110762 - protein, 5 aa, Giardia lamblia
GASEA

SEQ ID NO: 3110763 - protein, 9 aa, Giardia lamblia
GASEGNGLG

SEQ ID NO: 3110764 - protein, 7 aa, Giardia lamblia
GASETND

SEQ ID NO: 3110765 - protein, 14 aa, Giardia lamblia
GASFTSQSFADEPA

SEQ ID NO: 3110766 - protein, 4 aa, Giardia lamblia
GASG

SEQ ID NO: 3110767 - protein, 11 aa, Giardia lamblia
GASGGDTNNDL

SEQ ID NO: 3110768 - protein, 11 aa, Giardia lamblia
GASISEDLRGD

SEQ ID NO: 3110769 - protein, 6 aa, Giardia lamblia
GASLPP

SEQ ID NO: 3110770 - protein, 15 aa, Giardia lamblia
GASLQGKKDSSSRIP

SEQ ID NO: 3110771 - protein, 10 aa, Giardia lamblia
GASLSNETAH

SEQ ID NO: 3110772 - protein, 12 aa, Giardia lamblia
GASLTKTGLSNS

SEQ ID NO: 3110773 - protein, 10 aa, Giardia lamblia
GASNAVGETG

SEQ ID NO: 3110774 - protein, 5 aa, Giardia lamblia
GASNS

SEQ ID NO: 3110775 - protein, 7 aa, Giardia lamblia
GASPGAA

SEQ ID NO: 3110776 - protein, 25 aa, Giardia lamblia
GASPKSEPTKVSTQLRRKNTSRAAE

SEQ ID NO: 3110777 - protein, 6 aa, Giardia lamblia
GASPSE

SEQ ID NO: 3110778 - protein, 14 aa, Giardia lamblia
GASQSEEYGSMDDA

SEQ ID NO: 3110779 - protein, 7 aa, Giardia lamblia
GASQYGP

SEQ ID NO: 3110780 - protein, 13 aa, Giardia lamblia
GASRALDADAAST

SEQ ID NO: 3110781 - protein, 11 aa, Giardia lamblia
GASRDRTDAVD

SEQ ID NO: 3110782 - protein, 49 aa, Giardia lamblia
GASSTDKPESDDCKGEEDNPHKESTTQDSASEADKNAKKPRKERLRSEY

SEQ ID NO: 3110783 - protein, 5 aa, Giardia lamblia
GASVS

SEQ ID NO: 3110784 - protein, 5 aa, Giardia lamblia
GASVT

SEQ ID NO: 3110785 - protein, 35 aa, Giardia lamblia
GATASSHSRLSTKTIDSPAVSRPTSSLSQSGYTKG

SEQ ID NO: 3110786 - protein, 4 aa, Giardia lamblia
GATD

SEQ ID NO: 3110787 - protein, 11 aa, Giardia lamblia
GATDEQKRTIS

SEQ ID NO: 3110788 - protein, 5 aa, Giardia lamblia
GATDN

SEQ ID NO: 3110789 - protein, 10 aa, Giardia lamblia
GATDNNGNTA

SEQ ID NO: 3110790 - protein, 15 aa, Giardia lamblia
GATDRPASTVSKGVH

SEQ ID NO: 3110791 - protein, 7 aa, Giardia lamblia
GATDTPL

SEQ ID NO: 3110792 - protein, 8 aa, Giardia lamblia
GATEAAGS

SEQ ID NO: 3110793 - protein, 8 aa, Giardia lamblia
GATESNNI

SEQ ID NO: 3110794 - protein, 5 aa, Giardia lamblia
GATET

SEQ ID NO: 3110795 - protein, 8 aa, Giardia lamblia
GATGAAGS

SEQ ID NO: 3110796 - protein, 13 aa, Giardia lamblia
GATGANADSSRSH

SEQ ID NO: 3110797 - protein, 10 aa, Giardia lamblia
GATGSGKSTC

SEQ ID NO: 3110798 - protein, 16 aa, Giardia lamblia
GATGSNAASSTQPGFS

SEQ ID NO: 3110799 - protein, 13 aa, Giardia lamblia
GATITEQGDESGE

SEQ ID NO: 3110800 - protein, 7 aa, Giardia lamblia
GATKDTM

SEQ ID NO: 3110801 - protein, 10 aa, Giardia lamblia
GATKKEIESA

SEQ ID NO: 3110802 - protein, 7 aa, Giardia lamblia
GATKQRL

SEQ ID NO: 3110803 - protein, 6 aa, Giardia lamblia
GATLES

SEQ ID NO: 3110804 - protein, 4 aa, Giardia lamblia
GATN

SEQ ID NO: 3110805 - protein, 13 aa, Giardia lamblia
GATPFKPADSVLF

SEQ ID NO: 3110806 - protein, 13 aa, Giardia lamblia
GATPKMRKPPLKA

SEQ ID NO: 3110807 - protein, 8 aa, Giardia lamblia
GATPNAAK

SEQ ID NO: 3110808 - protein, 14 aa, Giardia lamblia
GATPREYASKSEAL

SEQ ID NO: 3110809 - protein, 8 aa, Giardia lamblia
GATQDLTQ

SEQ ID NO: 3110810 - protein, 7 aa, Giardia lamblia
GATRETR

SEQ ID NO: 3110811 - protein, 36 aa, Giardia lamblia
GATSLESNPVEDYDDREDSKDQDSPTAGRHGNPGPM

SEQ ID NO: 3110812 - protein, 9 aa, Giardia lamblia
GATSQRSVG

SEQ ID NO: 3110813 - protein, 8 aa, Giardia lamblia
GATSQSAI

SEQ ID NO: 3110814 - protein, 7 aa, Giardia lamblia
GATTGGS

SEQ ID NO: 3110815 - protein, 4 aa, Giardia lamblia
GAVD

SEQ ID NO: 3110816 - protein, 5 aa, Giardia lamblia
GAVDS

SEQ ID NO: 3110817 - protein, 12 aa, Giardia lamblia
GAVEDAEKEFKN

SEQ ID NO: 3110818 - protein, 21 aa, Giardia lamblia
GAVEQVEEANPGKKNKSKGKK

SEQ ID NO: 3110819 - protein, 6 aa, Giardia lamblia
GAVGSE

SEQ ID NO: 3110820 - protein, 10 aa, Giardia lamblia
GAVNRTQDSS

SEQ ID NO: 3110821 - protein, 10 aa, Giardia lamblia
GAVPNSAVTP

SEQ ID NO: 3110822 - protein, 8 aa, Giardia lamblia
GAVPSSSV

SEQ ID NO: 3110823 - protein, 5 aa, Giardia lamblia
GAVSG

SEQ ID NO: 3110824 - protein, 7 aa, Giardia lamblia
GAVSGRA

SEQ ID NO: 3110825 - protein, 9 aa, Giardia lamblia
GAVSPQAIP

SEQ ID NO: 3110826 - protein, 8 aa, Giardia lamblia
GAVSSQGY

SEQ ID NO: 3110827 - protein, 13 aa, Giardia lamblia
GAVTNQQGGYATA

SEQ ID NO: 3110828 - protein, 25 aa, Giardia lamblia
GAYIKGASSQTASTVQTTKSTKKGK

SEQ ID NO: 3110829 - protein, 5 aa, Giardia lamblia
GAYKE

SEQ ID NO: 3110830 - protein, 4 aa, Giardia lamblia
GAYL

SEQ ID NO: 3110831 - protein, 6 aa, Giardia lamblia
GAYQSL

SEQ ID NO: 3110832 - protein, 12 aa, Giardia lamblia
GCAPSNGKCTAC

SEQ ID NO: 3110833 - protein, 12 aa, Giardia lamblia
GCARGSPRVSSH

SEQ ID NO: 3110834 - protein, 8 aa, Giardia lamblia
GCASSSKL

SEQ ID NO: 3110835 - protein, 12 aa, Giardia lamblia
GCDGASKDRSVF

SEQ ID NO: 3110836 - protein, 14 aa, Giardia lamblia
GCDKGTDPETSTVD

SEQ ID NO: 3110837 - protein, 16 aa, Giardia lamblia
GCETGPATDGNPSEAA

SEQ ID NO: 3110838 - protein, 12 aa, Giardia lamblia
GCFRGEQTDGTC

SEQ ID NO: 3110839 - protein, 5 aa, Giardia lamblia
GCGDP

SEQ ID NO: 3110840 - protein, 19 aa, Giardia lamblia
GCGGRRGRQPSALGEGTSA

SEQ ID NO: 3110841 - protein, 5 aa, Giardia lamblia
GCGKT

SEQ ID NO: 3110842 - protein, 8 aa, Giardia lamblia
GCGKTSIA

SEQ ID NO: 3110843 - protein, 5 aa, Giardia lamblia
GCGKW

SEQ ID NO: 3110844 - protein, 6 aa, Giardia lamblia
GCGNGY

SEQ ID NO: 3110845 - protein, 4 aa, Giardia lamblia
GCGS

SEQ ID NO: 3110846 - protein, 5 aa, Giardia lamblia
GCGSQ

SEQ ID NO: 3110847 - protein, 5 aa, Giardia lamblia
GCGSV

SEQ ID NO: 3110848 - protein, 6 aa, Giardia lamblia
GCIPPG

SEQ ID NO: 3110849 - protein, 24 aa, Giardia lamblia
GCIPSSNKFQQRQQLNSEQTDNPL

SEQ ID NO: 3110850 - protein, 23 aa, Giardia lamblia
GCKNRSDDSMSARTAFSTDTVEN

SEQ ID NO: 3110851 - protein, 6 aa, Giardia lamblia
GCKPEY

SEQ ID NO: 3110852 - protein, 7 aa, Giardia lamblia
GCKYEGA

SEQ ID NO: 3110853 - protein, 12 aa, Giardia lamblia
GCPASRTPSYDR

SEQ ID NO: 3110854 - protein, 5 aa, Giardia lamblia
GCPPS

SEQ ID NO: 3110855 - protein, 5 aa, Giardia lamblia
GCPST

SEQ ID NO: 3110856 - protein, 6 aa, Giardia lamblia
GCPTPG

SEQ ID NO: 3110857 - protein, 5 aa, Giardia lamblia
GCQEE

SEQ ID NO: 3110858 - protein, 8 aa, Giardia lamblia
GCQTNTGY

SEQ ID NO: 3110859 - protein, 11 aa, Giardia lamblia
GCRAKRPRGEQ

SEQ ID NO: 3110860 - protein, 4 aa, Giardia lamblia
GCSA

SEQ ID NO: 3110861 - protein, 16 aa, Giardia lamblia
GCSDPLNSQDDSVTAR

SEQ ID NO: 3110862 - protein, 7 aa, Giardia lamblia
GCSDRTN

SEQ ID NO: 3110863 - protein, 26 aa, Giardia lamblia
GCSSSKRGQTGPLYNPNSPGGKVGPN

SEQ ID NO: 3110864 - protein, 42 aa, Giardia lamblia
GCSSSSESGKSSTRSSSDSSYSSSSSSLSSSSSSSSPTSSSS

SEQ ID NO: 3110865 - protein, 7 aa, Giardia lamblia
GCSVSGQ

SEQ ID NO: 3110866 - protein, 4 aa, Giardia lamblia
GCTG

SEQ ID NO: 3110867 - protein, 12 aa, Giardia lamblia
GCTGRSAPPLPE

SEQ ID NO: 3110868 - protein, 9 aa, Giardia lamblia
GCTNSNGDT

SEQ ID NO: 3110869 - protein, 5 aa, Giardia lamblia
GCTPE

SEQ ID NO: 3110870 - protein, 5 aa, Giardia lamblia
GCTSP

SEQ ID NO: 3110871 - protein, 6 aa, Giardia lamblia
GDAAEH

SEQ ID NO: 3110872 - protein, 7 aa, Giardia lamblia
GDAAELA

SEQ ID NO: 3110873 - protein, 8 aa, Giardia lamblia
GDAANSPI

SEQ ID NO: 3110874 - protein, 9 aa, Giardia lamblia
GDAAPRPFE

SEQ ID NO: 3110875 - protein, 21 aa, Giardia lamblia
GDADAVRSNLQETGKKDGNSW

SEQ ID NO: 3110876 - protein, 5 aa, Giardia lamblia
GDADP

SEQ ID NO: 3110877 - protein, 17 aa, Giardia lamblia
GDADPKSATADQKPEQV

SEQ ID NO: 3110878 - protein, 23 aa, Giardia lamblia
GDAEGGDGSAATVGTPSANSAGI

SEQ ID NO: 3110879 - protein, 6 aa, Giardia lamblia
GDAGDY

SEQ ID NO: 3110880 - protein, 4 aa, Giardia lamblia
GDAH

SEQ ID NO: 3110881 - protein, 6 aa, Giardia lamblia
GDAKKG

SEQ ID NO: 3110882 - protein, 6 aa, Giardia lamblia
GDAPPV

SEQ ID NO: 3110883 - protein, 18 aa, Giardia lamblia
GDAPSREPYSDAEASALP

SEQ ID NO: 3110884 - protein, 9 aa, Giardia lamblia
GDAQDARDD

SEQ ID NO: 3110885 - protein, 4 aa, Giardia lamblia
GDAR

SEQ ID NO: 3110886 - protein, 8 aa, Giardia lamblia
GDASDRTK

SEQ ID NO: 3110887 - protein, 7 aa, Giardia lamblia
GDASFPG

SEQ ID NO: 3110888 - protein, 9 aa, Giardia lamblia
GDASRYSGA

SEQ ID NO: 3110889 - protein, 36 aa, Giardia lamblia
GDASSNDGFQHRSSGIDTGIRGDKSHRRKPEQTDPN

SEQ ID NO: 3110890 - protein, 27 aa, Giardia lamblia
GDASTEQQQQQHTCQATDREPSTGQRY

SEQ ID NO: 3110891 - protein, 6 aa, Giardia lamblia
GDATPW

SEQ ID NO: 3110892 - protein, 7 aa, Giardia lamblia
GDAYKGA

SEQ ID NO: 3110893 - protein, 5 aa, Giardia lamblia
GDCDG

SEQ ID NO: 3110894 - protein, 7 aa, Giardia lamblia
GDCSNKI

SEQ ID NO: 3110895 - protein, 5 aa, Giardia lamblia
GDDAG

SEQ ID NO: 3110896 - protein, 13 aa, Giardia lamblia
GDDAPSDFTPSKE

SEQ ID NO: 3110897 - protein, 12 aa, Giardia lamblia
GDDAQGETDYDE

SEQ ID NO: 3110898 - protein, 13 aa, Giardia lamblia
GDDDNVLKESSES

SEQ ID NO: 3110899 - protein, 5 aa, Giardia lamblia
GDDEG

SEQ ID NO: 3110900 - protein, 8 aa, Giardia lamblia
GDDGGAAV

SEQ ID NO: 3110901 - protein, 9 aa, Giardia lamblia
GDDGKISEA

SEQ ID NO: 3110902 - protein, 11 aa, Giardia lamblia
GDDGKLASIKG

SEQ ID NO: 3110903 - protein, 14 aa, Giardia lamblia
GDDITQPKTRGRRP

SEQ ID NO: 3110904 - protein, 21 aa, Giardia lamblia
GDDNAQNTNNSINGREGSVDG

SEQ ID NO: 3110905 - protein, 5 aa, Giardia lamblia
GDDPD

SEQ ID NO: 3110906 - protein, 15 aa, Giardia lamblia
GDDQSDKRKVSELEE

SEQ ID NO: 3110907 - protein, 5 aa, Giardia lamblia
GDDRE

SEQ ID NO: 3110908 - protein, 8 aa, Giardia lamblia
GDDRGSQF

SEQ ID NO: 3110909 - protein, 21 aa, Giardia lamblia
GDDRHPVSSVASASHAATMSA

SEQ ID NO: 3110910 - protein, 8 aa, Giardia lamblia
GDDSNTNA

SEQ ID NO: 3110911 - protein, 9 aa, Giardia lamblia
GDDSSFNGV

SEQ ID NO: 3110912 - protein, 13 aa, Giardia lamblia
GDDTAAAPASDLP

SEQ ID NO: 3110913 - protein, 10 aa, Giardia lamblia
GDDTDSEGHT

SEQ ID NO: 3110914 - protein, 6 aa, Giardia lamblia
GDDTPL

SEQ ID NO: 3110915 - protein, 4 aa, Giardia lamblia
GDDV

SEQ ID NO: 3110916 - protein, 13 aa, Giardia lamblia
GDEAADSFSANAQ

SEQ ID NO: 3110917 - protein, 9 aa, Giardia lamblia
GDEAPNITP

SEQ ID NO: 3110918 - protein, 9 aa, Giardia lamblia
GDEAPPQAK

SEQ ID NO: 3110919 - protein, 11 aa, Giardia lamblia
GDEAPTNKPLD

SEQ ID NO: 3110920 - protein, 6 aa, Giardia lamblia
GDEEPF

SEQ ID NO: 3110921 - protein, 8 aa, Giardia lamblia
GDEESARK

SEQ ID NO: 3110922 - protein, 12 aa, Giardia lamblia
GDEESLASAAKL

SEQ ID NO: 3110923 - protein, 6 aa, Giardia lamblia
GDEHDD

SEQ ID NO: 3110924 - protein, 11 aa, Giardia lamblia
GDENVLSQQNE

SEQ ID NO: 3110925 - protein, 10 aa, Giardia lamblia
GDEQTEADKE

SEQ ID NO: 3110926 - protein, 6 aa, Giardia lamblia
GDEQYK

SEQ ID NO: 3110927 - protein, 4 aa, Giardia lamblia
GDER

SEQ ID NO: 3110928 - protein, 11 aa, Giardia lamblia
GDERSKDHSDK

SEQ ID NO: 3110929 - protein, 4 aa, Giardia lamblia
GDES

SEQ ID NO: 3110930 - protein, 29 aa, Giardia lamblia
GDETKQQDAQTEVPGTKSDGTKDKQEEIE

SEQ ID NO: 3110931 - protein, 16 aa, Giardia lamblia
GDETTTPSAPYVETDD

SEQ ID NO: 3110932 - protein, 14 aa, Giardia lamblia
GDEVREEAQMDNPA

SEQ ID NO: 3110933 - protein, 4 aa, Giardia lamblia
GDGA

SEQ ID NO: 3110934 - protein, 23 aa, Giardia lamblia
GDGAAGSGATKKKADVATLSDPG

SEQ ID NO: 3110935 - protein, 12 aa, Giardia lamblia
GDGDPELGKDSR

SEQ ID NO: 3110936 - protein, 20 aa, Giardia lamblia
GDGEASTHSEAAPASSEQKT

SEQ ID NO: 3110937 - protein, 8 aa, Giardia lamblia
GDGEHQPS

SEQ ID NO: 3110938 - protein, 7 aa, Giardia lamblia
GDGFLGG

SEQ ID NO: 3110939 - protein, 6 aa, Giardia lamblia
GDGFQE

SEQ ID NO: 3110940 - protein, 6 aa, Giardia lamblia
GDGKEE

SEQ ID NO: 3110941 - protein, 14 aa, Giardia lamblia
GDGKSELINPFINS

SEQ ID NO: 3110942 - protein, 5 aa, Giardia lamblia
GDGNG

SEQ ID NO: 3110943 - protein, 6 aa, Giardia lamblia
GDGPVT

SEQ ID NO: 3110944 - protein, 5 aa, Giardia lamblia
GDGQG

SEQ ID NO: 3110945 - protein, 4 aa, Giardia lamblia
GDGS

SEQ ID NO: 3110946 - protein, 25 aa, Giardia lamblia
GDGSKKPTGLSTQRDKKPIDSYSQP

SEQ ID NO: 3110947 - protein, 15 aa, Giardia lamblia
GDGSNPPSGETLRGS

SEQ ID NO: 3110948 - protein, 8 aa, Giardia lamblia
GDGSTGDL

SEQ ID NO: 3110949 - protein, 6 aa, Giardia lamblia
GDGSVG

SEQ ID NO: 3110950 - protein, 4 aa, Giardia lamblia
GDGV

SEQ ID NO: 3110951 - protein, 5 aa, Giardia lamblia
GDGVT

SEQ ID NO: 3110952 - protein, 5 aa, Giardia lamblia
GDHDG

SEQ ID NO: 3110953 - protein, 9 aa, Giardia lamblia
GDHKQARKC

SEQ ID NO: 3110954 - protein, 8 aa, Giardia lamblia
GDHNDRSS

SEQ ID NO: 3110955 - protein, 7 aa, Giardia lamblia
GDHNSYD

SEQ ID NO: 3110956 - protein, 12 aa, Giardia lamblia
GDHTSSAASRGI

SEQ ID NO: 3110957 - protein, 6 aa, Giardia lamblia
GDIEAE

SEQ ID NO: 3110958 - protein, 5 aa, Giardia lamblia
GDIGS

SEQ ID NO: 3110959 - protein, 10 aa, Giardia lamblia
GDIPKAPDTL

SEQ ID NO: 3110960 - protein, 4 aa, Giardia lamblia
GDIR

SEQ ID NO: 3110961 - protein, 9 aa, Giardia lamblia
GDIRDDSIN

SEQ ID NO: 3110962 - protein, 5 aa, Giardia lamblia
GDISE

SEQ ID NO: 3110963 - protein, 21 aa, Giardia lamblia
GDISPARSPTGSADSRHKKPR

SEQ ID NO: 3110964 - protein, 4 aa, Giardia lamblia
GDIT

SEQ ID NO: 3110965 - protein, 6 aa, Giardia lamblia
GDITGN

SEQ ID NO: 3110966 - protein, 8 aa, Giardia lamblia
GDKDGRAI

SEQ ID NO: 3110967 - protein, 4 aa, Giardia lamblia
GDKE

SEQ ID NO: 3110968 - protein, 5 aa, Giardia lamblia
GDKEA

SEQ ID NO: 3110969 - protein, 9 aa, Giardia lamblia
GDKESYKEE

SEQ ID NO: 3110970 - protein, 10 aa, Giardia lamblia
GDKFDSGTGW

SEQ ID NO: 3110971 - protein, 8 aa, Giardia lamblia
GDKKETMS

SEQ ID NO: 3110972 - protein, 17 aa, Giardia lamblia
GDKKTKSGKRALQRQSK

SEQ ID NO: 3110973 - protein, 16 aa, Giardia lamblia
GDKQARSNRKSIASQK

SEQ ID NO: 3110974 - protein, 12 aa, Giardia lamblia
GDKQKQNDIQQA

SEQ ID NO: 3110975 - protein, 5 aa, Giardia lamblia
GDKRM

SEQ ID NO: 3110976 - protein, 8 aa, Giardia lamblia
GDKTLPGL

SEQ ID NO: 3110977 - protein, 12 aa, Giardia lamblia
GDLDDPDHNPLD

SEQ ID NO: 3110978 - protein, 30 aa, Giardia lamblia
GDLDNTEREARKKHRTRTGKVDKEQSRRQD

SEQ ID NO: 3110979 - protein, 6 aa, Giardia lamblia
GDLDTE

SEQ ID NO: 3110980 - protein, 6 aa, Giardia lamblia
GDLDTV

SEQ ID NO: 3110981 - protein, 11 aa, Giardia lamblia
GDLGTDSRQVD

SEQ ID NO: 3110982 - protein, 6 aa, Giardia lamblia
GDLKTP

SEQ ID NO: 3110983 - protein, 7 aa, Giardia lamblia
GDLNKKD

SEQ ID NO: 3110984 - protein, 6 aa, Giardia lamblia
GDLNTN

SEQ ID NO: 3110985 - protein, 4 aa, Giardia lamblia
GDLP

SEQ ID NO: 3110986 - protein, 21 aa, Giardia lamblia
GDLSSTKGSGSVSDVASNAAT

SEQ ID NO: 3110987 - protein, 4 aa, Giardia lamblia
GDLT

SEQ ID NO: 3110988 - protein, 6 aa, Giardia lamblia
GDMGRP

SEQ ID NO: 3110989 - protein, 13 aa, Giardia lamblia
GDMRDSSGKTALD

SEQ ID NO: 3110990 - protein, 9 aa, Giardia lamblia
GDMSNEAAT

SEQ ID NO: 3110991 - protein, 7 aa, Giardia lamblia
GDNAEGK

SEQ ID NO: 3110992 - protein, 8 aa, Giardia lamblia
GDNDGAGI

SEQ ID NO: 3110993 - protein, 6 aa, Giardia lamblia
GDNEKR

SEQ ID NO: 3110994 - protein, 10 aa, Giardia lamblia
GDNEPKTQKD

SEQ ID NO: 3110995 - protein, 5 aa, Giardia lamblia
GDNIK

SEQ ID NO: 3110996 - protein, 24 aa, Giardia lamblia
GDNKATRGDAENMATSASQLAGEL

SEQ ID NO: 3110997 - protein, 6 aa, Giardia lamblia
GDNPHY

SEQ ID NO: 3110998 - protein, 6 aa, Giardia lamblia
GDNSKV

SEQ ID NO: 3110999 - protein, 9 aa, Giardia lamblia
GDNTAPLQS

SEQ ID NO: 3111000 - protein, 30 aa, Giardia lamblia
GDNYDNYDNEDDNEDKRPDREFSPPKPRQR

SEQ ID NO: 3111001 - protein, 7 aa, Giardia lamblia
GDPADAR

SEQ ID NO: 3111002 - protein, 6 aa, Giardia lamblia
GDPARF

SEQ ID NO: 3111003 - protein, 4 aa, Giardia lamblia
GDPD

SEQ ID NO: 3111004 - protein, 4 aa, Giardia lamblia
GDPE

SEQ ID NO: 3111005 - protein, 5 aa, Giardia lamblia
GDPEA

SEQ ID NO: 3111006 - protein, 7 aa, Giardia lamblia
GDPEFDP

SEQ ID NO: 3111007 - protein, 12 aa, Giardia lamblia
GDPFSGRSGGSC

SEQ ID NO: 3111008 - protein, 9 aa, Giardia lamblia
GDPGSKIPY

SEQ ID NO: 3111009 - protein, 39 aa, Giardia lamblia
GDPHETDETRSTPIDDRNTVSAQADVPSSVDGTKDHAVG

SEQ ID NO: 3111010 - protein, 7 aa, Giardia lamblia
GDPHPLP

SEQ ID NO: 3111011 - protein, 15 aa, Giardia lamblia
GDPHTVSSKLSGKCG

SEQ ID NO: 3111012 - protein, 4 aa, Giardia lamblia
GDPI

SEQ ID NO: 3111013 - protein, 5 aa, Giardia lamblia
GDPMP

SEQ ID NO: 3111014 - protein, 9 aa, Giardia lamblia
GDPNQLPPT

SEQ ID NO: 3111015 - protein, 11 aa, Giardia lamblia
GDPPADRGYRP

SEQ ID NO: 3111016 - protein, 7 aa, Giardia lamblia
GDPPLSQ

SEQ ID NO: 3111017 - protein, 8 aa, Giardia lamblia
GDPPSKRY

SEQ ID NO: 3111018 - protein, 9 aa, Giardia lamblia
GDPQTGKSA

SEQ ID NO: 3111019 - protein, 6 aa, Giardia lamblia
GDPTDK

SEQ ID NO: 3111020 - protein, 13 aa, Giardia lamblia
GDPTQEKLTPDQI

SEQ ID NO: 3111021 - protein, 15 aa, Giardia lamblia
GDPTTRPLSSAVGGQ

SEQ ID NO: 3111022 - protein, 5 aa, Giardia lamblia
GDPVG

SEQ ID NO: 3111023 - protein, 9 aa, Giardia lamblia
GDPVSSVAD

SEQ ID NO: 3111024 - protein, 6 aa, Giardia lamblia
GDQAKL

SEQ ID NO: 3111025 - protein, 6 aa, Giardia lamblia
GDQEGR

SEQ ID NO: 3111026 - protein, 8 aa, Giardia lamblia
GDQEHDSY

SEQ ID NO: 3111027 - protein, 8 aa, Giardia lamblia
GDQEQRAK

SEQ ID NO: 3111028 - protein, 20 aa, Giardia lamblia
GDQGKGGRQEDDDTQTLDTG

SEQ ID NO: 3111029 - protein, 7 aa, Giardia lamblia
GDQNATT

SEQ ID NO: 3111030 - protein, 10 aa, Giardia lamblia
GDQPEQARDH

SEQ ID NO: 3111031 - protein, 10 aa, Giardia lamblia
GDQPHEKETL

SEQ ID NO: 3111032 - protein, 10 aa, Giardia lamblia
GDQPQAEPED

SEQ ID NO: 3111033 - protein, 18 aa, Giardia lamblia
GDQPQPSPRSIMGLYQMM

SEQ ID NO: 3111034 - protein, 16 aa, Giardia lamblia
GDQPRPQVTASNGPMY

SEQ ID NO: 3111035 - protein, 8 aa, Giardia lamblia
GDQPTNEL

SEQ ID NO: 3111036 - protein, 4 aa, Giardia lamblia
GDQQ

SEQ ID NO: 3111037 - protein, 11 aa, Giardia lamblia
GDRAQTFEGTA

SEQ ID NO: 3111038 - protein, 9 aa, Giardia lamblia
GDRATPKYE

SEQ ID NO: 3111039 - protein, 6 aa, Giardia lamblia
GDRDPA

SEQ ID NO: 3111040 - protein, 4 aa, Giardia lamblia
GDRE

SEQ ID NO: 3111041 - protein, 17 aa, Giardia lamblia
GDREGNGGPGASDGTNH

SEQ ID NO: 3111042 - protein, 10 aa, Giardia lamblia
GDREQSGSVD

SEQ ID NO: 3111043 - protein, 10 aa, Giardia lamblia
GDRGASSAKL

SEQ ID NO: 3111044 - protein, 9 aa, Giardia lamblia
GDRGRVEPQ

SEQ ID NO: 3111045 - protein, 11 aa, Giardia lamblia
GDRKVSKETCP

SEQ ID NO: 3111046 - protein, 14 aa, Giardia lamblia
GDRPPSYHAESDPH

SEQ ID NO: 3111047 - protein, 7 aa, Giardia lamblia
GDRPSAT

SEQ ID NO: 3111048 - protein, 4 aa, Giardia lamblia
GDRR

SEQ ID NO: 3111049 - protein, 6 aa, Giardia lamblia
GDRSGG

SEQ ID NO: 3111050 - protein, 7 aa, Giardia lamblia
GDRSGRS

SEQ ID NO: 3111051 - protein, 5 aa, Giardia lamblia
GDRSP

SEQ ID NO: 3111052 - protein, 5 aa, Giardia lamblia
GDRVP

SEQ ID NO: 3111053 - protein, 13 aa, Giardia lamblia
GDRVQVDKKGRTA

SEQ ID NO: 3111054 - protein, 7 aa, Giardia lamblia
GDRYKSY

SEQ ID NO: 3111055 - protein, 23 aa, Giardia lamblia
GDSATDNSVSTGAITSHTGSSTF

SEQ ID NO: 3111056 - protein, 5 aa, Giardia lamblia
GDSDP

SEQ ID NO: 3111057 - protein, 7 aa, Giardia lamblia
GDSEDTV

SEQ ID NO: 3111058 - protein, 18 aa, Giardia lamblia
GDSFGEYNSRTLGAPSTD

SEQ ID NO: 3111059 - protein, 5 aa, Giardia lamblia
GDSGA

SEQ ID NO: 3111060 - protein, 5 aa, Giardia lamblia
GDSGL

SEQ ID NO: 3111061 - protein, 10 aa, Giardia lamblia
GDSGNGRREG

SEQ ID NO: 3111062 - protein, 8 aa, Giardia lamblia
GDSGSLQD

SEQ ID NO: 3111063 - protein, 8 aa, Giardia lamblia
GDSKDFVG

SEQ ID NO: 3111064 - protein, 11 aa, Giardia lamblia
GDSKIGSISHS

SEQ ID NO: 3111065 - protein, 8 aa, Giardia lamblia
GDSKRALD

SEQ ID NO: 3111066 - protein, 7 aa, Giardia lamblia
GDSPTKA

SEQ ID NO: 3111067 - protein, 21 aa, Giardia lamblia
GDSRRETEMSPSTQRSELEDT

SEQ ID NO: 3111068 - protein, 7 aa, Giardia lamblia
GDSSAKP

SEQ ID NO: 3111069 - protein, 11 aa, Giardia lamblia
GDSSQKERATE

SEQ ID NO: 3111070 - protein, 14 aa, Giardia lamblia
GDSSSSLSDYNARD

SEQ ID NO: 3111071 - protein, 10 aa, Giardia lamblia
GDSTETWEPP

SEQ ID NO: 3111072 - protein, 7 aa, Giardia lamblia
GDSTGER

SEQ ID NO: 3111073 - protein, 20 aa, Giardia lamblia
GDSTPASESPEEPTKPPPLC

SEQ ID NO: 3111074 - protein, 9 aa, Giardia lamblia
GDSTPTEKE

SEQ ID NO: 3111075 - protein, 8 aa, Giardia lamblia
GDSTSGES

SEQ ID NO: 3111076 - protein, 9 aa, Giardia lamblia
GDTAEPTRE

SEQ ID NO: 3111077 - protein, 11 aa, Giardia lamblia
GDTAEQDHHED

SEQ ID NO: 3111078 - protein, 5 aa, Giardia lamblia
GDTAR

SEQ ID NO: 3111079 - protein, 11 aa, Giardia lamblia
GDTASPAPDAL

SEQ ID NO: 3111080 - protein, 17 aa, Giardia lamblia
GDTDEVKENIHEKGRTD

SEQ ID NO: 3111081 - protein, 10 aa, Giardia lamblia
GDTDGVRENV

SEQ ID NO: 3111082 - protein, 7 aa, Giardia lamblia
GDTDKLP

SEQ ID NO: 3111083 - protein, 22 aa, Giardia lamblia
GDTEAYDGKDSSFRANNRDNSL

SEQ ID NO: 3111084 - protein, 12 aa, Giardia lamblia
GDTENASSSVGN

SEQ ID NO: 3111085 - protein, 5 aa, Giardia lamblia
GDTGP

SEQ ID NO: 3111086 - protein, 8 aa, Giardia lamblia
GDTKRRQQ

SEQ ID NO: 3111087 - protein, 6 aa, Giardia lamblia
GDTLTT

SEQ ID NO: 3111088 - protein, 5 aa, Giardia lamblia
GDTNL

SEQ ID NO: 3111089 - protein, 4 aa, Giardia lamblia
GDTP

SEQ ID NO: 3111090 - protein, 8 aa, Giardia lamblia
GDTPTECA

SEQ ID NO: 3111091 - protein, 5 aa, Giardia lamblia
GDTSA

SEQ ID NO: 3111092 - protein, 8 aa, Giardia lamblia
GDTSGLQA

SEQ ID NO: 3111093 - protein, 7 aa, Giardia lamblia
GDTSLDL

SEQ ID NO: 3111094 - protein, 14 aa, Giardia lamblia
GDTSSSSSPTENTV

SEQ ID NO: 3111095 - protein, 6 aa, Giardia lamblia
GDTSYD

SEQ ID NO: 3111096 - protein, 4 aa, Giardia lamblia
GDTT

SEQ ID NO: 3111097 - protein, 84 aa, Giardia lamblia
GDTVSGTATGAVGGTKGRACAQEGPSHLQGRPANGFAKAGKEGRKKGAGDFQSHGNRAKGVAASSGKAPSHLQKPQSFSGLGRV

SEQ ID NO: 3111098 - protein, 7 aa, Giardia lamblia
GDTVTQP

SEQ ID NO: 3111099 - protein, 7 aa, Giardia lamblia
GDTYKGA

SEQ ID NO: 3111100 - protein, 6 aa, Giardia lamblia
GDTYSG

SEQ ID NO: 3111101 - protein, 4 aa, Giardia lamblia
GDVD

SEQ ID NO: 3111102 - protein, 16 aa, Giardia lamblia
GDVDARVDATADTTLQ

SEQ ID NO: 3111103 - protein, 20 aa, Giardia lamblia
GDVDPQACGTGKDTDGPALT

SEQ ID NO: 3111104 - protein, 4 aa, Giardia lamblia
GDVE

SEQ ID NO: 3111105 - protein, 9 aa, Giardia lamblia
GDVQTTDPE

SEQ ID NO: 3111106 - protein, 4 aa, Giardia lamblia
GDVR

SEQ ID NO: 3111107 - protein, 16 aa, Giardia lamblia
GDVSAADRANEESIAS

SEQ ID NO: 3111108 - protein, 6 aa, Giardia lamblia
GDVSDV

SEQ ID NO: 3111109 - protein, 7 aa, Giardia lamblia
GDVTAAT

SEQ ID NO: 3111110 - protein, 8 aa, Giardia lamblia
GDWAPDCT

SEQ ID NO: 3111111 - protein, 11 aa, Giardia lamblia
GDYDTASQLTN

SEQ ID NO: 3111112 - protein, 4 aa, Giardia lamblia
GDYE

SEQ ID NO: 3111113 - protein, 15 aa, Giardia lamblia
GDYGASNREDGGRAA

SEQ ID NO: 3111114 - protein, 4 aa, Giardia lamblia
GDYH

SEQ ID NO: 3111115 - protein, 5 aa, Giardia lamblia
GDYPD

SEQ ID NO: 3111116 - protein, 7 aa, Giardia lamblia
GDYPPPD

SEQ ID NO: 3111117 - protein, 6 aa, Giardia lamblia
GDYRQA

SEQ ID NO: 3111118 - protein, 4 aa, Giardia lamblia
GDYT

SEQ ID NO: 3111119 - protein, 4 aa, Giardia lamblia
GEAA

SEQ ID NO: 3111120 - protein, 5 aa, Giardia lamblia
GEAAN

SEQ ID NO: 3111121 - protein, 25 aa, Giardia lamblia
GEAASDRSQKDEDGWKTLRPDSKYY

SEQ ID NO: 3111122 - protein, 7 aa, Giardia lamblia
GEAASST

SEQ ID NO: 3111123 - protein, 10 aa, Giardia lamblia
GEADKHQEAA

SEQ ID NO: 3111124 - protein, 8 aa, Giardia lamblia
GEADNKHY

SEQ ID NO: 3111125 - protein, 5 aa, Giardia lamblia
GEAEA

SEQ ID NO: 3111126 - protein, 14 aa, Giardia lamblia
GEAEEIEERPPPYR

SEQ ID NO: 3111127 - protein, 8 aa, Giardia lamblia
GEAESNQL

SEQ ID NO: 3111128 - protein, 11 aa, Giardia lamblia
GEAGRKTNEGW

SEQ ID NO: 3111129 - protein, 15 aa, Giardia lamblia
GEAGTKTEGLPGRVS

SEQ ID NO: 3111130 - protein, 4 aa, Giardia lamblia
GEAL

SEQ ID NO: 3111131 - protein, 5 aa, Giardia lamblia
GEAPA

SEQ ID NO: 3111132 - protein, 9 aa, Giardia lamblia
GEAPGEGSK

SEQ ID NO: 3111133 - protein, 41 aa, Giardia lamblia
GEAPKTPTQLTNGDSSANSGRYGCTTSTSEEPPMKKTSLAN

SEQ ID NO: 3111134 - protein, 24 aa, Giardia lamblia
GEARSATPDKVNTQPLSGQTPTNL

SEQ ID NO: 3111135 - protein, 32 aa, Giardia lamblia
GEASAPVTKKKGEGKKKGAAPSEPPAAELPPS

SEQ ID NO: 3111136 - protein, 8 aa, Giardia lamblia
GEATPERC

SEQ ID NO: 3111137 - protein, 7 aa, Giardia lamblia
GEAVHPD

SEQ ID NO: 3111138 - protein, 4 aa, Giardia lamblia
GEAY

SEQ ID NO: 3111139 - protein, 6 aa, Giardia lamblia
GECSKK

SEQ ID NO: 3111140 - protein, 13 aa, Giardia lamblia
GEDDGAVSTPLSR

SEQ ID NO: 3111141 - protein, 4 aa, Giardia lamblia
GEDG

SEQ ID NO: 3111142 - protein, 8 aa, Giardia lamblia
GEDKTTAL

SEQ ID NO: 3111143 - protein, 11 aa, Giardia lamblia
GEDNANPDGYA

SEQ ID NO: 3111144 - protein, 5 aa, Giardia lamblia
GEDPL

SEQ ID NO: 3111145 - protein, 5 aa, Giardia lamblia
GEDRD

SEQ ID NO: 3111146 - protein, 5 aa, Giardia lamblia
GEDRT

SEQ ID NO: 3111147 - protein, 7 aa, Giardia lamblia
GEDSDKM

SEQ ID NO: 3111148 - protein, 9 aa, Giardia lamblia
GEDSPCQSA

SEQ ID NO: 3111149 - protein, 10 aa, Giardia lamblia
GEDSSQKSII

SEQ ID NO: 3111150 - protein, 11 aa, Giardia lamblia
GEDSVAQTNVG

SEQ ID NO: 3111151 - protein, 5 aa, Giardia lamblia
GEDVT

SEQ ID NO: 3111152 - protein, 24 aa, Giardia lamblia
GEDYDNGSPANLAPPSAQQGPHPA

SEQ ID NO: 3111153 - protein, 4 aa, Giardia lamblia
GEEA

SEQ ID NO: 3111154 - protein, 6 aa, Giardia lamblia
GEEAYS

SEQ ID NO: 3111155 - protein, 5 aa, Giardia lamblia
GEEDE

SEQ ID NO: 3111156 - protein, 18 aa, Giardia lamblia
GEEGHASTWTDKDPVTQR

SEQ ID NO: 3111157 - protein, 4 aa, Giardia lamblia
GEEI

SEQ ID NO: 3111158 - protein, 7 aa, Giardia lamblia
GEEISSS

SEQ ID NO: 3111159 - protein, 7 aa, Giardia lamblia
GEEKINT

SEQ ID NO: 3111160 - protein, 8 aa, Giardia lamblia
GEELTPKM

SEQ ID NO: 3111161 - protein, 5 aa, Giardia lamblia
GEEMA

SEQ ID NO: 3111162 - protein, 6 aa, Giardia lamblia
GEENLA

SEQ ID NO: 3111163 - protein, 28 aa, Giardia lamblia
GEEPATSGVTVATGDAQAQKQYPPTSIA

SEQ ID NO: 3111164 - protein, 14 aa, Giardia lamblia
GEESIQVGSTTITS

SEQ ID NO: 3111165 - protein, 5 aa, Giardia lamblia
GEESK

SEQ ID NO: 3111166 - protein, 15 aa, Giardia lamblia
GEESPNGGQELASQP

SEQ ID NO: 3111167 - protein, 7 aa, Giardia lamblia
GEETEDV

SEQ ID NO: 3111168 - protein, 4 aa, Giardia lamblia
GEEV

SEQ ID NO: 3111169 - protein, 10 aa, Giardia lamblia
GEFPDSRGEN

SEQ ID NO: 3111170 - protein, 7 aa, Giardia lamblia
GEGAEVT

SEQ ID NO: 3111171 - protein, 9 aa, Giardia lamblia
GEGAPKPKA

SEQ ID NO: 3111172 - protein, 9 aa, Giardia lamblia
GEGAREQRG

SEQ ID NO: 3111173 - protein, 8 aa, Giardia lamblia
GEGDSPYD

SEQ ID NO: 3111174 - protein, 16 aa, Giardia lamblia
GEGGAAQEASIKSHGK

SEQ ID NO: 3111175 - protein, 9 aa, Giardia lamblia
GEGGSGGAL

SEQ ID NO: 3111176 - protein, 7 aa, Giardia lamblia
GEGKSGI

SEQ ID NO: 3111177 - protein, 10 aa, Giardia lamblia
GEGKSQEEIK

SEQ ID NO: 3111178 - protein, 5 aa, Giardia lamblia
GEGLP

SEQ ID NO: 3111179 - protein, 7 aa, Giardia lamblia
GEGLTTD

SEQ ID NO: 3111180 - protein, 6 aa, Giardia lamblia
GEGNLS

SEQ ID NO: 3111181 - protein, 6 aa, Giardia lamblia
GEGNTE

SEQ ID NO: 3111182 - protein, 15 aa, Giardia lamblia
GEGPALSKRSPPTPI

SEQ ID NO: 3111183 - protein, 7 aa, Giardia lamblia
GEGPRTI

SEQ ID NO: 3111184 - protein, 11 aa, Giardia lamblia
GEGPRTIPKGQ

SEQ ID NO: 3111185 - protein, 6 aa, Giardia lamblia
GEGRAT

SEQ ID NO: 3111186 - protein, 4 aa, Giardia lamblia
GEGS

SEQ ID NO: 3111187 - protein, 14 aa, Giardia lamblia
GEGSERNKNQTNIE

SEQ ID NO: 3111188 - protein, 5 aa, Giardia lamblia
GEGSY

SEQ ID NO: 3111189 - protein, 6 aa, Giardia lamblia
GEGSYG

SEQ ID NO: 3111190 - protein, 17 aa, Giardia lamblia
GEGTGASGSSKSNQLQM

SEQ ID NO: 3111191 - protein, 14 aa, Giardia lamblia
GEGVDKGSFNARSS

SEQ ID NO: 3111192 - protein, 5 aa, Giardia lamblia
GEGYS

SEQ ID NO: 3111193 - protein, 15 aa, Giardia lamblia
GEGYYADSATNTCSS

SEQ ID NO: 3111194 - protein, 6 aa, Giardia lamblia
GEHSQA

SEQ ID NO: 3111195 - protein, 7 aa, Giardia lamblia
GEIDPTR

SEQ ID NO: 3111196 - protein, 13 aa, Giardia lamblia
GEIEGKDKRTREY

SEQ ID NO: 3111197 - protein, 5 aa, Giardia lamblia
GEIKA

SEQ ID NO: 3111198 - protein, 8 aa, Giardia lamblia
GEIKSRNS

SEQ ID NO: 3111199 - protein, 14 aa, Giardia lamblia
GEIPAGNLGTQTDI

SEQ ID NO: 3111200 - protein, 7 aa, Giardia lamblia
GEIPRPR

SEQ ID NO: 3111201 - protein, 5 aa, Giardia lamblia
GEIRT

SEQ ID NO: 3111202 - protein, 4 aa, Giardia lamblia
GEIS

SEQ ID NO: 3111203 - protein, 8 aa, Giardia lamblia
GEKADRHT

SEQ ID NO: 3111204 - protein, 8 aa, Giardia lamblia
GEKAIPAT

SEQ ID NO: 3111205 - protein, 7 aa, Giardia lamblia
GEKDFTD

SEQ ID NO: 3111206 - protein, 9 aa, Giardia lamblia
GEKDNQRAR

SEQ ID NO: 3111207 - protein, 6 aa, Giardia lamblia
GEKGDA

SEQ ID NO: 3111208 - protein, 13 aa, Giardia lamblia
GEKGDRKAIQRSE

SEQ ID NO: 3111209 - protein, 10 aa, Giardia lamblia
GEKGEKSNSL

SEQ ID NO: 3111210 - protein, 12 aa, Giardia lamblia
GEKGQLSEGSAF

SEQ ID NO: 3111211 - protein, 7 aa, Giardia lamblia
GEKQPEV

SEQ ID NO: 3111212 - protein, 9 aa, Giardia lamblia
GEKRPPHKL

SEQ ID NO: 3111213 - protein, 12 aa, Giardia lamblia
GEKRYKVVGYSQ

SEQ ID NO: 3111214 - protein, 5 aa, Giardia lamblia
GEKSI

SEQ ID NO: 3111215 - protein, 6 aa, Giardia lamblia
GEKTKE

SEQ ID NO: 3111216 - protein, 4 aa, Giardia lamblia
GEKV

SEQ ID NO: 3111217 - protein, 7 aa, Giardia lamblia
GEKYEAG

SEQ ID NO: 3111218 - protein, 36 aa, Giardia lamblia
GEKYGPPIHGSKGALAGGPSPSTRPHRRPSCAVRLA

SEQ ID NO: 3111219 - protein, 10 aa, Giardia lamblia
GELAGNPDEC

SEQ ID NO: 3111220 - protein, 12 aa, Giardia lamblia
GELGLQDKQGRS

SEQ ID NO: 3111221 - protein, 4 aa, Giardia lamblia
GELH

SEQ ID NO: 3111222 - protein, 10 aa, Giardia lamblia
GELQAPEAVR

SEQ ID NO: 3111223 - protein, 9 aa, Giardia lamblia
GELSRASSN

SEQ ID NO: 3111224 - protein, 14 aa, Giardia lamblia
GELTAEEAGIDPDA

SEQ ID NO: 3111225 - protein, 10 aa, Giardia lamblia
GELTKSGCTV

SEQ ID NO: 3111226 - protein, 6 aa, Giardia lamblia
GEMTKS

SEQ ID NO: 3111227 - protein, 4 aa, Giardia lamblia
GEMV

SEQ ID NO: 3111228 - protein, 4 aa, Giardia lamblia
GENE

SEQ ID NO: 3111229 - protein, 8 aa, Giardia lamblia
GENELAEN

SEQ ID NO: 3111230 - protein, 8 aa, Giardia lamblia
GENGRQCS

SEQ ID NO: 3111231 - protein, 14 aa, Giardia lamblia
GENKERNKSASKSF

SEQ ID NO: 3111232 - protein, 9 aa, Giardia lamblia
GENLPPNKS

SEQ ID NO: 3111233 - protein, 4 aa, Giardia lamblia
GENP

SEQ ID NO: 3111234 - protein, 6 aa, Giardia lamblia
GENQEL

SEQ ID NO: 3111235 - protein, 5 aa, Giardia lamblia
GENQQ

SEQ ID NO: 3111236 - protein, 21 aa, Giardia lamblia
GENSNTPHCGRHESNKQENGV

SEQ ID NO: 3111237 - protein, 18 aa, Giardia lamblia
GENTMGGKENIDGNTEFY

SEQ ID NO: 3111238 - protein, 26 aa, Giardia lamblia
GEPEPPSPKVAPPTSLNKGSKPKHQV

SEQ ID NO: 3111239 - protein, 13 aa, Giardia lamblia
GEPESNPAGANRS

SEQ ID NO: 3111240 - protein, 20 aa, Giardia lamblia
GEPEYRAGKKCSAQGETIGN

SEQ ID NO: 3111241 - protein, 4 aa, Giardia lamblia
GEPL

SEQ ID NO: 3111242 - protein, 11 aa, Giardia lamblia
GEPPNPPPAFG

SEQ ID NO: 3111243 - protein, 7 aa, Giardia lamblia
GEPRSGD

SEQ ID NO: 3111244 - protein, 15 aa, Giardia lamblia
GEPTRRGDRFRESSF

SEQ ID NO: 3111245 - protein, 5 aa, Giardia lamblia
GEPTV

SEQ ID NO: 3111246 - protein, 4 aa, Giardia lamblia
GEPW

SEQ ID NO: 3111247 - protein, 4 aa, Giardia lamblia
GEPY

SEQ ID NO: 3111248 - protein, 4 aa, Giardia lamblia
GEQA

SEQ ID NO: 3111249 - protein, 9 aa, Giardia lamblia
GEQEEGSKL

SEQ ID NO: 3111250 - protein, 5 aa, Giardia lamblia
GEQER

SEQ ID NO: 3111251 - protein, 14 aa, Giardia lamblia
GEQGAGRILSIKCF

SEQ ID NO: 3111252 - protein, 8 aa, Giardia lamblia
GEQGDNAN

SEQ ID NO: 3111253 - protein, 7 aa, Giardia lamblia
GEQHEPK

SEQ ID NO: 3111254 - protein, 5 aa, Giardia lamblia
GEQKV

SEQ ID NO: 3111255 - protein, 4 aa, Giardia lamblia
GEQL

SEQ ID NO: 3111256 - protein, 13 aa, Giardia lamblia
GEQLDGSDTFQEL

SEQ ID NO: 3111257 - protein, 5 aa, Giardia lamblia
GEQMG

SEQ ID NO: 3111258 - protein, 4 aa, Giardia lamblia
GEQN

SEQ ID NO: 3111259 - protein, 40 aa, Giardia lamblia
GEQPLTTTTSASAKRRKRMATTEDADEDEPSLPASGPQKK

SEQ ID NO: 3111260 - protein, 8 aa, Giardia lamblia
GEQQSHAE

SEQ ID NO: 3111261 - protein, 6 aa, Giardia lamblia
GEQQSS

SEQ ID NO: 3111262 - protein, 13 aa, Giardia lamblia
GERALDSKDTQIA

SEQ ID NO: 3111263 - protein, 4 aa, Giardia lamblia
GERD

SEQ ID NO: 3111264 - protein, 15 aa, Giardia lamblia
GERDRQAAEKEREDH

SEQ ID NO: 3111265 - protein, 11 aa, Giardia lamblia
GERGYPPVIPP

SEQ ID NO: 3111266 - protein, 18 aa, Giardia lamblia
GERKEGGKFQTRDPKQTL

SEQ ID NO: 3111267 - protein, 10 aa, Giardia lamblia
GERLSNAEKM

SEQ ID NO: 3111268 - protein, 6 aa, Giardia lamblia
GERNHS

SEQ ID NO: 3111269 - protein, 8 aa, Giardia lamblia
GERPGVDY

SEQ ID NO: 3111270 - protein, 5 aa, Giardia lamblia
GERPI

SEQ ID NO: 3111271 - protein, 5 aa, Giardia lamblia
GERQT

SEQ ID NO: 3111272 - protein, 11 aa, Giardia lamblia
GERRANRDRKV

SEQ ID NO: 3111273 - protein, 13 aa, Giardia lamblia
GERRNEGPEETYQ

SEQ ID NO: 3111274 - protein, 12 aa, Giardia lamblia
GERRTFKEDPDQ

SEQ ID NO: 3111275 - protein, 9 aa, Giardia lamblia
GERRTPTIK

SEQ ID NO: 3111276 - protein, 9 aa, Giardia lamblia
GERSGPAYE

SEQ ID NO: 3111277 - protein, 5 aa, Giardia lamblia
GERYN

SEQ ID NO: 3111278 - protein, 4 aa, Giardia lamblia
GESE

SEQ ID NO: 3111279 - protein, 6 aa, Giardia lamblia
GESEQN

SEQ ID NO: 3111280 - protein, 6 aa, Giardia lamblia
GESERK

SEQ ID NO: 3111281 - protein, 5 aa, Giardia lamblia
GESGD

SEQ ID NO: 3111282 - protein, 41 aa, Giardia lamblia
GESGIASAADNTQIAASSTNINNYGANDEDSDVGFEQYLAD

SEQ ID NO: 3111283 - protein, 7 aa, Giardia lamblia
GESGTTA

SEQ ID NO: 3111284 - protein, 9 aa, Giardia lamblia
GESITSGYS

SEQ ID NO: 3111285 - protein, 7 aa, Giardia lamblia
GESKCEA

SEQ ID NO: 3111286 - protein, 8 aa, Giardia lamblia
GESKDLDS

SEQ ID NO: 3111287 - protein, 19 aa, Giardia lamblia
GESKREAVTKSVKGKCETH

SEQ ID NO: 3111288 - protein, 9 aa, Giardia lamblia
GESLSDGST

SEQ ID NO: 3111289 - protein, 7 aa, Giardia lamblia
GESNHMG

SEQ ID NO: 3111290 - protein, 7 aa, Giardia lamblia
GESNNIS

SEQ ID NO: 3111291 - protein, 6 aa, Giardia lamblia
GESPID

SEQ ID NO: 3111292 - protein, 5 aa, Giardia lamblia
GESRV

SEQ ID NO: 3111293 - protein, 8 aa, Giardia lamblia
GESSTASD

SEQ ID NO: 3111294 - protein, 6 aa, Giardia lamblia
GESTLN

SEQ ID NO: 3111295 - protein, 4 aa, Giardia lamblia
GESV

SEQ ID NO: 3111296 - protein, 4 aa, Giardia lamblia
GESY

SEQ ID NO: 3111297 - protein, 13 aa, Giardia lamblia
GETADGETDDSDT

SEQ ID NO: 3111298 - protein, 9 aa, Giardia lamblia
GETDDDENT

SEQ ID NO: 3111299 - protein, 17 aa, Giardia lamblia
GETDEQSAKKAKRALEK

SEQ ID NO: 3111300 - protein, 6 aa, Giardia lamblia
GETEKA

SEQ ID NO: 3111301 - protein, 4 aa, Giardia lamblia
GETG

SEQ ID NO: 3111302 - protein, 5 aa, Giardia lamblia
GETGF

SEQ ID NO: 3111303 - protein, 10 aa, Giardia lamblia
GETGKQANRN

SEQ ID NO: 3111304 - protein, 6 aa, Giardia lamblia
GETPKA

SEQ ID NO: 3111305 - protein, 5 aa, Giardia lamblia
GETPL

SEQ ID NO: 3111306 - protein, 4 aa, Giardia lamblia
GETR

SEQ ID NO: 3111307 - protein, 6 aa, Giardia lamblia
GETSAP

SEQ ID NO: 3111308 - protein, 9 aa, Giardia lamblia
GETSHNAAS

SEQ ID NO: 3111309 - protein, 8 aa, Giardia lamblia
GETSNREH

SEQ ID NO: 3111310 - protein, 7 aa, Giardia lamblia
GETTITE

SEQ ID NO: 3111311 - protein, 9 aa, Giardia lamblia
GETTKTQDE

SEQ ID NO: 3111312 - protein, 9 aa, Giardia lamblia
GETTVKPVD

SEQ ID NO: 3111313 - protein, 8 aa, Giardia lamblia
GETVAPDN

SEQ ID NO: 3111314 - protein, 5 aa, Giardia lamblia
GETYS

SEQ ID NO: 3111315 - protein, 28 aa, Giardia lamblia
GEVDDDASSPVRDGQKKPRNKKRQTNTR

SEQ ID NO: 3111316 - protein, 18 aa, Giardia lamblia
GEVDPDQPAISSMDESNS

SEQ ID NO: 3111317 - protein, 22 aa, Giardia lamblia
GEVDPPKVAAGQSIPTTSSADL

SEQ ID NO: 3111318 - protein, 10 aa, Giardia lamblia
GEVGSKTKYG

SEQ ID NO: 3111319 - protein, 5 aa, Giardia lamblia
GEVHR

SEQ ID NO: 3111320 - protein, 10 aa, Giardia lamblia
GEVHRNRAPK

SEQ ID NO: 3111321 - protein, 4 aa, Giardia lamblia
GEVK

SEQ ID NO: 3111322 - protein, 7 aa, Giardia lamblia
GEVNAAN

SEQ ID NO: 3111323 - protein, 10 aa, Giardia lamblia
GEVNTEGVSA

SEQ ID NO: 3111324 - protein, 6 aa, Giardia lamblia
GEVPGG

SEQ ID NO: 3111325 - protein, 4 aa, Giardia lamblia
GEVR

SEQ ID NO: 3111326 - protein, 24 aa, Giardia lamblia
GEVRRRGDLSSNMTSDSTSFPEEL

SEQ ID NO: 3111327 - protein, 9 aa, Giardia lamblia
GEVVSPEEI

SEQ ID NO: 3111328 - protein, 8 aa, Giardia lamblia
GEYESSRQ

SEQ ID NO: 3111329 - protein, 7 aa, Giardia lamblia
GEYNANG

SEQ ID NO: 3111330 - protein, 4 aa, Giardia lamblia
GEYQ

SEQ ID NO: 3111331 - protein, 10 aa, Giardia lamblia
GEYSKRSRRA

SEQ ID NO: 3111332 - protein, 10 aa, Giardia lamblia
GEYTAGNASR

SEQ ID NO: 3111333 - protein, 6 aa, Giardia lamblia
GEYTET

SEQ ID NO: 3111334 - protein, 4 aa, Giardia lamblia
GEYV

SEQ ID NO: 3111335 - protein, 5 aa, Giardia lamblia
GEYVT

SEQ ID NO: 3111336 - protein, 6 aa, Giardia lamblia
GFAEGS

SEQ ID NO: 3111337 - protein, 8 aa, Giardia lamblia
GFDDDGRT

SEQ ID NO: 3111338 - protein, 15 aa, Giardia lamblia
GFDESDRATLRRRTG

SEQ ID NO: 3111339 - protein, 11 aa, Giardia lamblia
GFDNDSNLNNG

SEQ ID NO: 3111340 - protein, 9 aa, Giardia lamblia
GFDPKKRAA

SEQ ID NO: 3111341 - protein, 6 aa, Giardia lamblia
GFEANT

SEQ ID NO: 3111342 - protein, 6 aa, Giardia lamblia
GFEENN

SEQ ID NO: 3111343 - protein, 8 aa, Giardia lamblia
GFESPSDV

SEQ ID NO: 3111344 - protein, 5 aa, Giardia lamblia
GFETQ

SEQ ID NO: 3111345 - protein, 6 aa, Giardia lamblia
GFGAPR

SEQ ID NO: 3111346 - protein, 12 aa, Giardia lamblia
GFGGGSSSQSVF

SEQ ID NO: 3111347 - protein, 26 aa, Giardia lamblia
GFGGPTTGSGDESAATSLAGTTELSG

SEQ ID NO: 3111348 - protein, 12 aa, Giardia lamblia
GFGGTTNQQPRL

SEQ ID NO: 3111349 - protein, 5 aa, Giardia lamblia
GFGSG

SEQ ID NO: 3111350 - protein, 9 aa, Giardia lamblia
GFKDAEGRA

SEQ ID NO: 3111351 - protein, 10 aa, Giardia lamblia
GFKKPSQKDV

SEQ ID NO: 3111352 - protein, 20 aa, Giardia lamblia
GFKPTSNSPPEVEKNPREIA

SEQ ID NO: 3111353 - protein, 9 aa, Giardia lamblia
GFMPGGGGE

SEQ ID NO: 3111354 - protein, 8 aa, Giardia lamblia
GFNPQEIT

SEQ ID NO: 3111355 - protein, 14 aa, Giardia lamblia
GFNSENDQNVEDFR

SEQ ID NO: 3111356 - protein, 23 aa, Giardia lamblia
GFPGAQKALPEGTPVSGELSPGI

SEQ ID NO: 3111357 - protein, 7 aa, Giardia lamblia
GFPSTSV

SEQ ID NO: 3111358 - protein, 6 aa, Giardia lamblia
GFQGRE

SEQ ID NO: 3111359 - protein, 14 aa, Giardia lamblia
GFQPPSEEAEEDMK

SEQ ID NO: 3111360 - protein, 7 aa, Giardia lamblia
GFQPVGT

SEQ ID NO: 3111361 - protein, 7 aa, Giardia lamblia
GFSDESG

SEQ ID NO: 3111362 - protein, 5 aa, Giardia lamblia
GFSGK

SEQ ID NO: 3111363 - protein, 5 aa, Giardia lamblia
GFSGN

SEQ ID NO: 3111364 - protein, 13 aa, Giardia lamblia
GFSGQTPSNADSQ

SEQ ID NO: 3111365 - protein, 7 aa, Giardia lamblia
GFSPYTR

SEQ ID NO: 3111366 - protein, 23 aa, Giardia lamblia
GFSTTSNAANDSMSKELDTNSSH

SEQ ID NO: 3111367 - protein, 14 aa, Giardia lamblia
GFTDAPKALKPSSK

SEQ ID NO: 3111368 - protein, 8 aa, Giardia lamblia
GFTKGSNY

SEQ ID NO: 3111369 - protein, 5 aa, Giardia lamblia
GFTPE

SEQ ID NO: 3111370 - protein, 7 aa, Giardia lamblia
GFTSADR

SEQ ID NO: 3111371 - protein, 9 aa, Giardia lamblia
GFTTPDKTS

SEQ ID NO: 3111372 - protein, 5 aa, Giardia lamblia
GFTTT

SEQ ID NO: 3111373 - protein, 6 aa, Giardia lamblia
GGAAAQ

SEQ ID NO: 3111374 - protein, 16 aa, Giardia lamblia
GGAAGRSTATASVAGD

SEQ ID NO: 3111375 - protein, 5 aa, Giardia lamblia
GGAEE

SEQ ID NO: 3111376 - protein, 8 aa, Giardia lamblia
GGAEGHRS

SEQ ID NO: 3111377 - protein, 9 aa, Giardia lamblia
GGAKDRDTA

SEQ ID NO: 3111378 - protein, 19 aa, Giardia lamblia
GGAKEEASKDATASMPPNN

SEQ ID NO: 3111379 - protein, 10 aa, Giardia lamblia
GGALQDGDLK

SEQ ID NO: 3111380 - protein, 16 aa, Giardia lamblia
GGALSDKGPSNEISGL

SEQ ID NO: 3111381 - protein, 8 aa, Giardia lamblia
GGANPEAL

SEQ ID NO: 3111382 - protein, 8 aa, Giardia lamblia
GGANVAEK

SEQ ID NO: 3111383 - protein, 21 aa, Giardia lamblia
GGAPAGDAGAGNDASSTNVSQ

SEQ ID NO: 3111384 - protein, 19 aa, Giardia lamblia
GGAPAGDAGAVEPGLSDAE

SEQ ID NO: 3111385 - protein, 19 aa, Giardia lamblia
GGAPAGPAGTGKTESTKDL

SEQ ID NO: 3111386 - protein, 29 aa, Giardia lamblia
GGAPGPAAPAVPPASRPARKAAIALGEDE

SEQ ID NO: 3111387 - protein, 8 aa, Giardia lamblia
GGAPQAND

SEQ ID NO: 3111388 - protein, 9 aa, Giardia lamblia
GGAPRSAVT

SEQ ID NO: 3111389 - protein, 6 aa, Giardia lamblia
GGAPVV

SEQ ID NO: 3111390 - protein, 4 aa, Giardia lamblia
GGAQ

SEQ ID NO: 3111391 - protein, 10 aa, Giardia lamblia
GGAQKSDGTT

SEQ ID NO: 3111392 - protein, 13 aa, Giardia lamblia
GGARESRDSRDVR

SEQ ID NO: 3111393 - protein, 7 aa, Giardia lamblia
GGARGRY

SEQ ID NO: 3111394 - protein, 4 aa, Giardia lamblia
GGAS

SEQ ID NO: 3111395 - protein, 8 aa, Giardia lamblia
GGASSPTH

SEQ ID NO: 3111396 - protein, 11 aa, Giardia lamblia
GGASSSIAKPG

SEQ ID NO: 3111397 - protein, 5 aa, Giardia lamblia
GGATI

SEQ ID NO: 3111398 - protein, 11 aa, Giardia lamblia
GGAYDKSGKIP

SEQ ID NO: 3111399 - protein, 6 aa, Giardia lamblia
GGCETP

SEQ ID NO: 3111400 - protein, 19 aa, Giardia lamblia
GGCQNGGGMPKIKGKKEAV

SEQ ID NO: 3111401 - protein, 11 aa, Giardia lamblia
GGCSLSGPAKE

SEQ ID NO: 3111402 - protein, 6 aa, Giardia lamblia
GGDAAT

SEQ ID NO: 3111403 - protein, 4 aa, Giardia lamblia
GGDD

SEQ ID NO: 3111404 - protein, 6 aa, Giardia lamblia
GGDDAT

SEQ ID NO: 3111405 - protein, 5 aa, Giardia lamblia
GGDDG

SEQ ID NO: 3111406 - protein, 6 aa, Giardia lamblia
GGDEGY

SEQ ID NO: 3111407 - protein, 5 aa, Giardia lamblia
GGDGH

SEQ ID NO: 3111408 - protein, 7 aa, Giardia lamblia
GGDIPKD

SEQ ID NO: 3111409 - protein, 8 aa, Giardia lamblia
GGDKPSAE

SEQ ID NO: 3111410 - protein, 4 aa, Giardia lamblia
GGDL

SEQ ID NO: 3111411 - protein, 4 aa, Giardia lamblia
GGDP

SEQ ID NO: 3111412 - protein, 7 aa, Giardia lamblia
GGDPNAM

SEQ ID NO: 3111413 - protein, 11 aa, Giardia lamblia
GGDQGAQLSSQ

SEQ ID NO: 3111414 - protein, 17 aa, Giardia lamblia
GGDSATAAKKAKATNKI

SEQ ID NO: 3111415 - protein, 6 aa, Giardia lamblia
GGDVAT

SEQ ID NO: 3111416 - protein, 5 aa, Giardia lamblia
GGDVN

SEQ ID NO: 3111417 - protein, 8 aa, Giardia lamblia
GGEGNGGV

SEQ ID NO: 3111418 - protein, 7 aa, Giardia lamblia
GGEIPQE

SEQ ID NO: 3111419 - protein, 4 aa, Giardia lamblia
GGEL

SEQ ID NO: 3111420 - protein, 12 aa, Giardia lamblia
GGELKTPPGQGY

SEQ ID NO: 3111421 - protein, 6 aa, Giardia lamblia
GGEMTT

SEQ ID NO: 3111422 - protein, 5 aa, Giardia lamblia
GGENR

SEQ ID NO: 3111423 - protein, 7 aa, Giardia lamblia
GGEPQVP

SEQ ID NO: 3111424 - protein, 11 aa, Giardia lamblia
GGEPRSNEMAS

SEQ ID NO: 3111425 - protein, 11 aa, Giardia lamblia
GGEQTARYNTD

SEQ ID NO: 3111426 - protein, 5 aa, Giardia lamblia
GGERQ

SEQ ID NO: 3111427 - protein, 11 aa, Giardia lamblia
GGESKPNPEER

SEQ ID NO: 3111428 - protein, 10 aa, Giardia lamblia
GGESRPEDDQ

SEQ ID NO: 3111429 - protein, 6 aa, Giardia lamblia
GGESYS

SEQ ID NO: 3111430 - protein, 4 aa, Giardia lamblia
GGET

SEQ ID NO: 3111431 - protein, 8 aa, Giardia lamblia
GGETTTKG

SEQ ID NO: 3111432 - protein, 10 aa, Giardia lamblia
GGEVDPDEEL

SEQ ID NO: 3111433 - protein, 8 aa, Giardia lamblia
GGEVSGTN

SEQ ID NO: 3111434 - protein, 20 aa, Giardia lamblia
GGFDRRRSKPKNTPEVEEQP

SEQ ID NO: 3111435 - protein, 39 aa, Giardia lamblia
GGFGSSGDAPAKVDESSRKDTPELPTDPGLLSTTEEAQK

SEQ ID NO: 3111436 - protein, 7 aa, Giardia lamblia
GGFPDAA

SEQ ID NO: 3111437 - protein, 7 aa, Giardia lamblia
GGFPTTT

SEQ ID NO: 3111438 - protein, 5 aa, Giardia lamblia
GGFSS

SEQ ID NO: 3111439 - protein, 12 aa, Giardia lamblia
GGFSSSSAGVGR

SEQ ID NO: 3111440 - protein, 8 aa, Giardia lamblia
GGGETREF

SEQ ID NO: 3111441 - protein, 13 aa, Giardia lamblia
GGGGANSPPSGMY

SEQ ID NO: 3111442 - protein, 4 aa, Giardia lamblia
GGGH

SEQ ID NO: 3111443 - protein, 6 aa, Giardia lamblia
GGGHSS

SEQ ID NO: 3111444 - protein, 14 aa, Giardia lamblia
GGGLTDTNQCGEEE

SEQ ID NO: 3111445 - protein, 6 aa, Giardia lamblia
GGGMPG

SEQ ID NO: 3111446 - protein, 6 aa, Giardia lamblia
GGGNLG

SEQ ID NO: 3111447 - protein, 9 aa, Giardia lamblia
GGGPGSGSL

SEQ ID NO: 3111448 - protein, 14 aa, Giardia lamblia
GGGQRSQKRYNSQV

SEQ ID NO: 3111449 - protein, 12 aa, Giardia lamblia
GGGQYEDTTRSL

SEQ ID NO: 3111450 - protein, 16 aa, Giardia lamblia
GGGRSSNRGPKQCQPI

SEQ ID NO: 3111451 - protein, 9 aa, Giardia lamblia
GGGRTDKPL

SEQ ID NO: 3111452 - protein, 7 aa, Giardia lamblia
GGGSAEI

SEQ ID NO: 3111453 - protein, 11 aa, Giardia lamblia
GGGSEGGSPIN

SEQ ID NO: 3111454 - protein, 22 aa, Giardia lamblia
GGGSNGPCACRSGTRDVEGDSA

SEQ ID NO: 3111455 - protein, 11 aa, Giardia lamblia
GGGSPGDSAKS

SEQ ID NO: 3111456 - protein, 5 aa, Giardia lamblia
GGGSR

SEQ ID NO: 3111457 - protein, 10 aa, Giardia lamblia
GGGSRSTLSM

SEQ ID NO: 3111458 - protein, 13 aa, Giardia lamblia
GGGTGNADKNSQS

SEQ ID NO: 3111459 - protein, 10 aa, Giardia lamblia
GGGTGSGLGS

SEQ ID NO: 3111460 - protein, 5 aa, Giardia lamblia
GGGTY

SEQ ID NO: 3111461 - protein, 10 aa, Giardia lamblia
GGGVSVQARG

SEQ ID NO: 3111462 - protein, 21 aa, Giardia lamblia
GGGYRASESAAADTPAGTGYV

SEQ ID NO: 3111463 - protein, 9 aa, Giardia lamblia
GGGYTARSA

SEQ ID NO: 3111464 - protein, 4 aa, Giardia lamblia
GGHA

SEQ ID NO: 3111465 - protein, 5 aa, Giardia lamblia
GGHAD

SEQ ID NO: 3111466 - protein, 5 aa, Giardia lamblia
GGHAE

SEQ ID NO: 3111467 - protein, 4 aa, Giardia lamblia
GGHE

SEQ ID NO: 3111468 - protein, 7 aa, Giardia lamblia
GGHGPLA

SEQ ID NO: 3111469 - protein, 4 aa, Giardia lamblia
GGHK

SEQ ID NO: 3111470 - protein, 4 aa, Giardia lamblia
GGHR

SEQ ID NO: 3111471 - protein, 23 aa, Giardia lamblia
GGHRKHPSGRGKAGGLQHKRTSF

SEQ ID NO: 3111472 - protein, 10 aa, Giardia lamblia
GGHSGGSSDA

SEQ ID NO: 3111473 - protein, 12 aa, Giardia lamblia
GGHSPGRAGSIS

SEQ ID NO: 3111474 - protein, 4 aa, Giardia lamblia
GGHT

SEQ ID NO: 3111475 - protein, 9 aa, Giardia lamblia
GGHVPEGES

SEQ ID NO: 3111476 - protein, 6 aa, Giardia lamblia
GGHYSE

SEQ ID NO: 3111477 - protein, 6 aa, Giardia lamblia
GGIPCK

SEQ ID NO: 3111478 - protein, 14 aa, Giardia lamblia
GGIPGEGGYPADLT

SEQ ID NO: 3111479 - protein, 7 aa, Giardia lamblia
GGIPPGM

SEQ ID NO: 3111480 - protein, 5 aa, Giardia lamblia
GGIQD

SEQ ID NO: 3111481 - protein, 8 aa, Giardia lamblia
GGITTTNG

SEQ ID NO: 3111482 - protein, 10 aa, Giardia lamblia
GGKAVTRSAL

SEQ ID NO: 3111483 - protein, 4 aa, Giardia lamblia
GGKD

SEQ ID NO: 3111484 - protein, 7 aa, Giardia lamblia
GGKKGSN

SEQ ID NO: 3111485 - protein, 6 aa, Giardia lamblia
GGKMPD

SEQ ID NO: 3111486 - protein, 9 aa, Giardia lamblia
GGKNEPAVA

SEQ ID NO: 3111487 - protein, 11 aa, Giardia lamblia
GGKNPAAYGAP

SEQ ID NO: 3111488 - protein, 7 aa, Giardia lamblia
GGKNPKA

SEQ ID NO: 3111489 - protein, 10 aa, Giardia lamblia
GGKNRKIGPT

SEQ ID NO: 3111490 - protein, 5 aa, Giardia lamblia
GGKPY

SEQ ID NO: 3111491 - protein, 5 aa, Giardia lamblia
GGKVT

SEQ ID NO: 3111492 - protein, 9 aa, Giardia lamblia
GGLADDEGH

SEQ ID NO: 3111493 - protein, 8 aa, Giardia lamblia
GGLEPGAA

SEQ ID NO: 3111494 - protein, 5 aa, Giardia lamblia
GGLGT

SEQ ID NO: 3111495 - protein, 7 aa, Giardia lamblia
GGLPSGF

SEQ ID NO: 3111496 - protein, 4 aa, Giardia lamblia
GGLQ

SEQ ID NO: 3111497 - protein, 8 aa, Giardia lamblia
GGLQDDHG

SEQ ID NO: 3111498 - protein, 9 aa, Giardia lamblia
GGLQDKDGI

SEQ ID NO: 3111499 - protein, 6 aa, Giardia lamblia
GGLQDN

SEQ ID NO: 3111500 - protein, 7 aa, Giardia lamblia
GGLQDYS

SEQ ID NO: 3111501 - protein, 8 aa, Giardia lamblia
GGLQNHQG

SEQ ID NO: 3111502 - protein, 8 aa, Giardia lamblia
GGLRDEEG

SEQ ID NO: 3111503 - protein, 8 aa, Giardia lamblia
GGLRRKDG

SEQ ID NO: 3111504 - protein, 7 aa, Giardia lamblia
GGLSDQN

SEQ ID NO: 3111505 - protein, 9 aa, Giardia lamblia
GGLTDLSGR

SEQ ID NO: 3111506 - protein, 4 aa, Giardia lamblia
GGMA

SEQ ID NO: 3111507 - protein, 12 aa, Giardia lamblia
GGMANNSKSTAL

SEQ ID NO: 3111508 - protein, 15 aa, Giardia lamblia
GGMATKGDENGESAG

SEQ ID NO: 3111509 - protein, 4 aa, Giardia lamblia
GGMC

SEQ ID NO: 3111510 - protein, 14 aa, Giardia lamblia
GGMCSNDKDTHGAG

SEQ ID NO: 3111511 - protein, 8 aa, Giardia lamblia
GGMEKDRG

SEQ ID NO: 3111512 - protein, 8 aa, Giardia lamblia
GGMKDNTG

SEQ ID NO: 3111513 - protein, 9 aa, Giardia lamblia
GGMKEKDGL

SEQ ID NO: 3111514 - protein, 10 aa, Giardia lamblia
GGMKTDDGKT

SEQ ID NO: 3111515 - protein, 13 aa, Giardia lamblia
GGMPGAQKSTCDK

SEQ ID NO: 3111516 - protein, 9 aa, Giardia lamblia
GGMQDKDGW

SEQ ID NO: 3111517 - protein, 9 aa, Giardia lamblia
GGMQDNDGY

SEQ ID NO: 3111518 - protein, 11 aa, Giardia lamblia
GGMQDNPGGTA

SEQ ID NO: 3111519 - protein, 8 aa, Giardia lamblia
GGMQKNRG

SEQ ID NO: 3111520 - protein, 10 aa, Giardia lamblia
GGMQRKDGYT

SEQ ID NO: 3111521 - protein, 11 aa, Giardia lamblia
GGMQRTTGETA

SEQ ID NO: 3111522 - protein, 11 aa, Giardia lamblia
GGMRSGSGRTA

SEQ ID NO: 3111523 - protein, 8 aa, Giardia lamblia
GGMSSADG

SEQ ID NO: 3111524 - protein, 11 aa, Giardia lamblia
GGMTKDKDFTA

SEQ ID NO: 3111525 - protein, 14 aa, Giardia lamblia
GGMTQPQEAGTHSN

SEQ ID NO: 3111526 - protein, 8 aa, Giardia lamblia
GGMTTSNG

SEQ ID NO: 3111527 - protein, 10 aa, Giardia lamblia
GGMYDTSGRT

SEQ ID NO: 3111528 - protein, 8 aa, Giardia lamblia
GGNDPPVY

SEQ ID NO: 3111529 - protein, 6 aa, Giardia lamblia
GGNDTI

SEQ ID NO: 3111530 - protein, 8 aa, Giardia lamblia
GGNEEDSA

SEQ ID NO: 3111531 - protein, 6 aa, Giardia lamblia
GGNGAC

SEQ ID NO: 3111532 - protein, 24 aa, Giardia lamblia
GGNGPNGLRSAESATGSSVTTGTM

SEQ ID NO: 3111533 - protein, 8 aa, Giardia lamblia
GGNGQGSL

SEQ ID NO: 3111534 - protein, 6 aa, Giardia lamblia
GGNITE

SEQ ID NO: 3111535 - protein, 11 aa, Giardia lamblia
GGNKQVLDGSG

SEQ ID NO: 3111536 - protein, 4 aa, Giardia lamblia
GGNL

SEQ ID NO: 3111537 - protein, 32 aa, Giardia lamblia
GGNLRAPSRGMAPPPSAGYKPVNGRYSDGDLD

SEQ ID NO: 3111538 - protein, 7 aa, Giardia lamblia
GGNPYAH

SEQ ID NO: 3111539 - protein, 18 aa, Giardia lamblia
GGNPYTGQIPGDPNGDHR

SEQ ID NO: 3111540 - protein, 4 aa, Giardia lamblia
GGNS

SEQ ID NO: 3111541 - protein, 5 aa, Giardia lamblia
GGNSR

SEQ ID NO: 3111542 - protein, 7 aa, Giardia lamblia
GGPAGLT

SEQ ID NO: 3111543 - protein, 8 aa, Giardia lamblia
GGPEAEIA

SEQ ID NO: 3111544 - protein, 9 aa, Giardia lamblia
GGPEGSKNQ

SEQ ID NO: 3111545 - protein, 6 aa, Giardia lamblia
GGPELS

SEQ ID NO: 3111546 - protein, 5 aa, Giardia lamblia
GGPHS

SEQ ID NO: 3111547 - protein, 29 aa, Giardia lamblia
GGPKRERRRPTDQRRTESSNKRRATLKTS

SEQ ID NO: 3111548 - protein, 21 aa, Giardia lamblia
GGPPASSHSRTGLRAPAKSSI

SEQ ID NO: 3111549 - protein, 20 aa, Giardia lamblia
GGPPYSAGRRPPPTARPGSA

SEQ ID NO: 3111550 - protein, 7 aa, Giardia lamblia
GGPQTLE

SEQ ID NO: 3111551 - protein, 30 aa, Giardia lamblia
GGPSAQSTLEQASRVTRTANVSAASRHHSA

SEQ ID NO: 3111552 - protein, 10 aa, Giardia lamblia
GGPSGLPPMH

SEQ ID NO: 3111553 - protein, 5 aa, Giardia lamblia
GGPSI

SEQ ID NO: 3111554 - protein, 10 aa, Giardia lamblia
GGPSSETIDT

SEQ ID NO: 3111555 - protein, 4 aa, Giardia lamblia
GGPV

SEQ ID NO: 3111556 - protein, 5 aa, Giardia lamblia
GGPVE

SEQ ID NO: 3111557 - protein, 8 aa, Giardia lamblia
GGQAPGGH

SEQ ID NO: 3111558 - protein, 7 aa, Giardia lamblia
GGQCAHS

SEQ ID NO: 3111559 - protein, 22 aa, Giardia lamblia
GGQDNHTRTIEQDNNSAQASPI

SEQ ID NO: 3111560 - protein, 4 aa, Giardia lamblia
GGQE

SEQ ID NO: 3111561 - protein, 4 aa, Giardia lamblia
GGQH

SEQ ID NO: 3111562 - protein, 4 aa, Giardia lamblia
GGQR

SEQ ID NO: 3111563 - protein, 17 aa, Giardia lamblia
GGQSLTSTGDKAATMTT

SEQ ID NO: 3111564 - protein, 6 aa, Giardia lamblia
GGQSPL

SEQ ID NO: 3111565 - protein, 7 aa, Giardia lamblia
GGQTAQT

SEQ ID NO: 3111566 - protein, 15 aa, Giardia lamblia
GGQTQVGATPQPHQQ

SEQ ID NO: 3111567 - protein, 4 aa, Giardia lamblia
GGQY

SEQ ID NO: 3111568 - protein, 17 aa, Giardia lamblia
GGRDAKYQKVDDDYEDF

SEQ ID NO: 3111569 - protein, 5 aa, Giardia lamblia
GGRDR

SEQ ID NO: 3111570 - protein, 7 aa, Giardia lamblia
GGREPED

SEQ ID NO: 3111571 - protein, 8 aa, Giardia lamblia
GGRFPNKE

SEQ ID NO: 3111572 - protein, 7 aa, Giardia lamblia
GGRITEQ

SEQ ID NO: 3111573 - protein, 4 aa, Giardia lamblia
GGRL

SEQ ID NO: 3111574 - protein, 4 aa, Giardia lamblia
GGRR

SEQ ID NO: 3111575 - protein, 10 aa, Giardia lamblia
GGRSSRMEGV

SEQ ID NO: 3111576 - protein, 17 aa, Giardia lamblia
GGRSTRSSGSFGSESSI

SEQ ID NO: 3111577 - protein, 10 aa, Giardia lamblia
GGRTTGPEVA

SEQ ID NO: 3111578 - protein, 9 aa, Giardia lamblia
GGRVSDGKD

SEQ ID NO: 3111579 - protein, 10 aa, Giardia lamblia
GGRVTRDGTT

SEQ ID NO: 3111580 - protein, 16 aa, Giardia lamblia
GGRYESWKSEQSIDTM

SEQ ID NO: 3111581 - protein, 17 aa, Giardia lamblia
GGSADISKELSAGSGAR

SEQ ID NO: 3111582 - protein, 5 aa, Giardia lamblia
GGSAM

SEQ ID NO: 3111583 - protein, 7 aa, Giardia lamblia
GGSAMDA

SEQ ID NO: 3111584 - protein, 8 aa, Giardia lamblia
GGSATVPV

SEQ ID NO: 3111585 - protein, 6 aa, Giardia lamblia
GGSEKI

SEQ ID NO: 3111586 - protein, 10 aa, Giardia lamblia
GGSETAQENP

SEQ ID NO: 3111587 - protein, 17 aa, Giardia lamblia
GGSGAYTTGLQLYGVPA

SEQ ID NO: 3111588 - protein, 10 aa, Giardia lamblia
GGSGKQSCTK

SEQ ID NO: 3111589 - protein, 8 aa, Giardia lamblia
GGSGRRSL

SEQ ID NO: 3111590 - protein, 9 aa, Giardia lamblia
GGSGRSSLA

SEQ ID NO: 3111591 - protein, 4 aa, Giardia lamblia
GGSI

SEQ ID NO: 3111592 - protein, 8 aa, Giardia lamblia
GGSISGTV

SEQ ID NO: 3111593 - protein, 9 aa, Giardia lamblia
GGSLDGSTS

SEQ ID NO: 3111594 - protein, 5 aa, Giardia lamblia
GGSNG

SEQ ID NO: 3111595 - protein, 8 aa, Giardia lamblia
GGSNGSTL

SEQ ID NO: 3111596 - protein, 14 aa, Giardia lamblia
GGSNHAASPPAVAP

SEQ ID NO: 3111597 - protein, 9 aa, Giardia lamblia
GGSNREGQI

SEQ ID NO: 3111598 - protein, 8 aa, Giardia lamblia
GGSNTKHS

SEQ ID NO: 3111599 - protein, 21 aa, Giardia lamblia
GGSNTRASPEQDEDAKRKLQA

SEQ ID NO: 3111600 - protein, 9 aa, Giardia lamblia
GGSPCDSAK

SEQ ID NO: 3111601 - protein, 5 aa, Giardia lamblia
GGSPK

SEQ ID NO: 3111602 - protein, 6 aa, Giardia lamblia
GGSPNA

SEQ ID NO: 3111603 - protein, 7 aa, Giardia lamblia
GGSPPKS

SEQ ID NO: 3111604 - protein, 12 aa, Giardia lamblia
GGSQERGDDARL

SEQ ID NO: 3111605 - protein, 7 aa, Giardia lamblia
GGSRGTS

SEQ ID NO: 3111606 - protein, 5 aa, Giardia lamblia
GGSRS

SEQ ID NO: 3111607 - protein, 5 aa, Giardia lamblia
GGSSA

SEQ ID NO: 3111608 - protein, 7 aa, Giardia lamblia
GGSSCSQ

SEQ ID NO: 3111609 - protein, 9 aa, Giardia lamblia
GGSSEDGLD

SEQ ID NO: 3111610 - protein, 6 aa, Giardia lamblia
GGSSGL

SEQ ID NO: 3111611 - protein, 8 aa, Giardia lamblia
GGSSPQTL

SEQ ID NO: 3111612 - protein, 5 aa, Giardia lamblia
GGSTL

SEQ ID NO: 3111613 - protein, 7 aa, Giardia lamblia
GGSTNNH

SEQ ID NO: 3111614 - protein, 10 aa, Giardia lamblia
GGSTTETGCS

SEQ ID NO: 3111615 - protein, 4 aa, Giardia lamblia
GGSV

SEQ ID NO: 3111616 - protein, 6 aa, Giardia lamblia
GGSVTA

SEQ ID NO: 3111617 - protein, 5 aa, Giardia lamblia
GGTAV

SEQ ID NO: 3111618 - protein, 7 aa, Giardia lamblia
GGTEHYS

SEQ ID NO: 3111619 - protein, 14 aa, Giardia lamblia
GGTEPKGDCVAEGG

SEQ ID NO: 3111620 - protein, 11 aa, Giardia lamblia
GGTESDPENPH

SEQ ID NO: 3111621 - protein, 7 aa, Giardia lamblia
GGTETVD

SEQ ID NO: 3111622 - protein, 5 aa, Giardia lamblia
GGTEV

SEQ ID NO: 3111623 - protein, 5 aa, Giardia lamblia
GGTGL

SEQ ID NO: 3111624 - protein, 8 aa, Giardia lamblia
GGTGSGKS

SEQ ID NO: 3111625 - protein, 8 aa, Giardia lamblia
GGTGSGLG

SEQ ID NO: 3111626 - protein, 8 aa, Giardia lamblia
GGTGTGEQ

SEQ ID NO: 3111627 - protein, 9 aa, Giardia lamblia
GGTKYSVNP

SEQ ID NO: 3111628 - protein, 9 aa, Giardia lamblia
GGTLDNDGH

SEQ ID NO: 3111629 - protein, 22 aa, Giardia lamblia
GGTLGTSSAGAGLGKRSNAETM

SEQ ID NO: 3111630 - protein, 5 aa, Giardia lamblia
GGTNA

SEQ ID NO: 3111631 - protein, 10 aa, Giardia lamblia
GGTPRPDPYA

SEQ ID NO: 3111632 - protein, 6 aa, Giardia lamblia
GGTSDL

SEQ ID NO: 3111633 - protein, 15 aa, Giardia lamblia
GGTSETSPYLKKFED

SEQ ID NO: 3111634 - protein, 9 aa, Giardia lamblia
GGTSGIEDR

SEQ ID NO: 3111635 - protein, 7 aa, Giardia lamblia
GGTSLEK

SEQ ID NO: 3111636 - protein, 7 aa, Giardia lamblia
GGTSQSK

SEQ ID NO: 3111637 - protein, 8 aa, Giardia lamblia
GGTTDADL

SEQ ID NO: 3111638 - protein, 7 aa, Giardia lamblia
GGTTNSN

SEQ ID NO: 3111639 - protein, 10 aa, Giardia lamblia
GGTVDESRLT

SEQ ID NO: 3111640 - protein, 4 aa, Giardia lamblia
GGVA

SEQ ID NO: 3111641 - protein, 8 aa, Giardia lamblia
GGVANSMG

SEQ ID NO: 3111642 - protein, 35 aa, Giardia lamblia
GGVDAERKQAAPASPDPLHPGPASRAGLPEPAGGH

SEQ ID NO: 3111643 - protein, 7 aa, Giardia lamblia
GGVDPAQ

SEQ ID NO: 3111644 - protein, 5 aa, Giardia lamblia
GGVGI

SEQ ID NO: 3111645 - protein, 13 aa, Giardia lamblia
GGVPGCADTCPSK

SEQ ID NO: 3111646 - protein, 11 aa, Giardia lamblia
GGVQNANGETP

SEQ ID NO: 3111647 - protein, 20 aa, Giardia lamblia
GGVQPVKNKTDSGTKEGTGI

SEQ ID NO: 3111648 - protein, 4 aa, Giardia lamblia
GGVR

SEQ ID NO: 3111649 - protein, 4 aa, Giardia lamblia
GGVS

SEQ ID NO: 3111650 - protein, 14 aa, Giardia lamblia
GGVTNDKHEWGKGH

SEQ ID NO: 3111651 - protein, 8 aa, Giardia lamblia
GGYATPEL

SEQ ID NO: 3111652 - protein, 5 aa, Giardia lamblia
GGYDQ

SEQ ID NO: 3111653 - protein, 4 aa, Giardia lamblia
GGYE

SEQ ID NO: 3111654 - protein, 6 aa, Giardia lamblia
GGYHNT

SEQ ID NO: 3111655 - protein, 10 aa, Giardia lamblia
GGYQDRSGNS

SEQ ID NO: 3111656 - protein, 7 aa, Giardia lamblia
GGYQNTH

SEQ ID NO: 3111657 - protein, 14 aa, Giardia lamblia
GGYRDDIPRSTDPR

SEQ ID NO: 3111658 - protein, 6 aa, Giardia lamblia
GGYTKE

SEQ ID NO: 3111659 - protein, 14 aa, Giardia lamblia
GGYVEKPEHNLPKT

SEQ ID NO: 3111660 - protein, 5 aa, Giardia lamblia
GHAEA

SEQ ID NO: 3111661 - protein, 7 aa, Giardia lamblia
GHAPERA

SEQ ID NO: 3111662 - protein, 4 aa, Giardia lamblia
GHAR

SEQ ID NO: 3111663 - protein, 4 aa, Giardia lamblia
GHAS

SEQ ID NO: 3111664 - protein, 33 aa, Giardia lamblia
GHASADAPRRLSGGGPTSRMSSAKSTASAKTPF

SEQ ID NO: 3111665 - protein, 8 aa, Giardia lamblia
GHATASKK

SEQ ID NO: 3111666 - protein, 4 aa, Giardia lamblia
GHDE

SEQ ID NO: 3111667 - protein, 7 aa, Giardia lamblia
GHDEGHG

SEQ ID NO: 3111668 - protein, 23 aa, Giardia lamblia
GHDGAMATQKNSKRNKQQSVNTL

SEQ ID NO: 3111669 - protein, 11 aa, Giardia lamblia
GHDGATDPGYD

SEQ ID NO: 3111670 - protein, 4 aa, Giardia lamblia
GHDK

SEQ ID NO: 3111671 - protein, 4 aa, Giardia lamblia
GHDQ

SEQ ID NO: 3111672 - protein, 34 aa, Giardia lamblia
GHDRGARRNEPDDGPSIRGVSSGPLSMLGIGPKV

SEQ ID NO: 3111673 - protein, 5 aa, Giardia lamblia
GHEGG

SEQ ID NO: 3111674 - protein, 4 aa, Giardia lamblia
GHEK

SEQ ID NO: 3111675 - protein, 11 aa, Giardia lamblia
GHESGEPAADV

SEQ ID NO: 3111676 - protein, 20 aa, Giardia lamblia
GHEVDGTAFNAPPGSTDKQI

SEQ ID NO: 3111677 - protein, 4 aa, Giardia lamblia
GHGG

SEQ ID NO: 3111678 - protein, 9 aa, Giardia lamblia
GHGGDRASK

SEQ ID NO: 3111679 - protein, 12 aa, Giardia lamblia
GHGGQEAARIAG

SEQ ID NO: 3111680 - protein, 5 aa, Giardia lamblia
GHGKY

SEQ ID NO: 3111681 - protein, 4 aa, Giardia lamblia
GHGN

SEQ ID NO: 3111682 - protein, 13 aa, Giardia lamblia
GHGNRVQQSTPGF

SEQ ID NO: 3111683 - protein, 22 aa, Giardia lamblia
GHGPADHSPIKPTSTTSSNTSL

SEQ ID NO: 3111684 - protein, 4 aa, Giardia lamblia
GHGT

SEQ ID NO: 3111685 - protein, 5 aa, Giardia lamblia
GHGVT

SEQ ID NO: 3111686 - protein, 6 aa, Giardia lamblia
GHHGNR

SEQ ID NO: 3111687 - protein, 7 aa, Giardia lamblia
GHHGPHC

SEQ ID NO: 3111688 - protein, 8 aa, Giardia lamblia
GHHSASDS

SEQ ID NO: 3111689 - protein, 11 aa, Giardia lamblia
GHHTPRSGTPW

SEQ ID NO: 3111690 - protein, 11 aa, Giardia lamblia
GHINPGPNEVL

SEQ ID NO: 3111691 - protein, 7 aa, Giardia lamblia
GHIRNKQ

SEQ ID NO: 3111692 - protein, 13 aa, Giardia lamblia
GHKASPPPQPEGE

SEQ ID NO: 3111693 - protein, 4 aa, Giardia lamblia
GHKD

SEQ ID NO: 3111694 - protein, 10 aa, Giardia lamblia
GHKDESAELK

SEQ ID NO: 3111695 - protein, 8 aa, Giardia lamblia
GHKGTGKV

SEQ ID NO: 3111696 - protein, 14 aa, Giardia lamblia
GHKPQTDTRLDSKS

SEQ ID NO: 3111697 - protein, 18 aa, Giardia lamblia
GHKPSEYAKTLHIRNLLP

SEQ ID NO: 3111698 - protein, 9 aa, Giardia lamblia
GHLSPEGYS

SEQ ID NO: 3111699 - protein, 10 aa, Giardia lamblia
GHMTDGQGRT

SEQ ID NO: 3111700 - protein, 6 aa, Giardia lamblia
GHNDDR

SEQ ID NO: 3111701 - protein, 15 aa, Giardia lamblia
GHNEDDPKDDGPGLD

SEQ ID NO: 3111702 - protein, 5 aa, Giardia lamblia
GHNGP

SEQ ID NO: 3111703 - protein, 5 aa, Giardia lamblia
GHNPI

SEQ ID NO: 3111704 - protein, 5 aa, Giardia lamblia
GHNSV

SEQ ID NO: 3111705 - protein, 5 aa, Giardia lamblia
GHPDA

SEQ ID NO: 3111706 - protein, 5 aa, Giardia lamblia
GHPEN

SEQ ID NO: 3111707 - protein, 12 aa, Giardia lamblia
GHPGVNTTLGGN

SEQ ID NO: 3111708 - protein, 16 aa, Giardia lamblia
GHPPPSYPVHPQETNL

SEQ ID NO: 3111709 - protein, 16 aa, Giardia lamblia
GHPQPQAESSSTPQVG

SEQ ID NO: 3111710 - protein, 6 aa, Giardia lamblia
GHPRTA

SEQ ID NO: 3111711 - protein, 8 aa, Giardia lamblia
GHPTPVAD

SEQ ID NO: 3111712 - protein, 5 aa, Giardia lamblia
GHQGP

SEQ ID NO: 3111713 - protein, 21 aa, Giardia lamblia
GHQKQTSLKERESSTETGNPE

SEQ ID NO: 3111714 - protein, 4 aa, Giardia lamblia
GHQP

SEQ ID NO: 3111715 - protein, 7 aa, Giardia lamblia
GHQRDNG

SEQ ID NO: 3111716 - protein, 4 aa, Giardia lamblia
GHRN

SEQ ID NO: 3111717 - protein, 9 aa, Giardia lamblia
GHSAVNSEM

SEQ ID NO: 3111718 - protein, 4 aa, Giardia lamblia
GHSD

SEQ ID NO: 3111719 - protein, 8 aa, Giardia lamblia
GHSGIAQS

SEQ ID NO: 3111720 - protein, 7 aa, Giardia lamblia
GHSGNSL

SEQ ID NO: 3111721 - protein, 5 aa, Giardia lamblia
GHSPQ

SEQ ID NO: 3111722 - protein, 9 aa, Giardia lamblia
GHSRGGGAL

SEQ ID NO: 3111723 - protein, 6 aa, Giardia lamblia
GHSRKT

SEQ ID NO: 3111724 - protein, 8 aa, Giardia lamblia
GHSSATPV

SEQ ID NO: 3111725 - protein, 5 aa, Giardia lamblia
GHSSS

SEQ ID NO: 3111726 - protein, 4 aa, Giardia lamblia
GHTD

SEQ ID NO: 3111727 - protein, 4 aa, Giardia lamblia
GHTE

SEQ ID NO: 3111728 - protein, 5 aa, Giardia lamblia
GHTEA

SEQ ID NO: 3111729 - protein, 8 aa, Giardia lamblia
GHTHDEAH

SEQ ID NO: 3111730 - protein, 8 aa, Giardia lamblia
GHTKREPC

SEQ ID NO: 3111731 - protein, 5 aa, Giardia lamblia
GHTNE

SEQ ID NO: 3111732 - protein, 4 aa, Giardia lamblia
GHTS

SEQ ID NO: 3111733 - protein, 7 aa, Giardia lamblia
GHTSAAS

SEQ ID NO: 3111734 - protein, 5 aa, Giardia lamblia
GHTSE

SEQ ID NO: 3111735 - protein, 5 aa, Giardia lamblia
GHVKS

SEQ ID NO: 3111736 - protein, 11 aa, Giardia lamblia
GHVPTSDTSAR

SEQ ID NO: 3111737 - protein, 16 aa, Giardia lamblia
GIAAKQDATGAPIGRR

SEQ ID NO: 3111738 - protein, 9 aa, Giardia lamblia
GIAKSTAQA

SEQ ID NO: 3111739 - protein, 7 aa, Giardia lamblia
GIANPDS

SEQ ID NO: 3111740 - protein, 5 aa, Giardia lamblia
GIAPG

SEQ ID NO: 3111741 - protein, 4 aa, Giardia lamblia
GIDG

SEQ ID NO: 3111742 - protein, 9 aa, Giardia lamblia
GIDKSGTLH

SEQ ID NO: 3111743 - protein, 5 aa, Giardia lamblia
GIDPP

SEQ ID NO: 3111744 - protein, 7 aa, Giardia lamblia
GIDPSDE

SEQ ID NO: 3111745 - protein, 8 aa, Giardia lamblia
GIDPTGEK

SEQ ID NO: 3111746 - protein, 57 aa, Giardia lamblia
GIDQDNSNELSEGSEASTSAESSQGWEKKQLKRDDSIDDEEDRDEKKPNAVSPESRL

SEQ ID NO: 3111747 - protein, 9 aa, Giardia lamblia
GIDQGGPRT

SEQ ID NO: 3111748 - protein, 12 aa, Giardia lamblia
GIDSSKQSMPAS

SEQ ID NO: 3111749 - protein, 42 aa, Giardia lamblia
GIDTAKAGVSDLQATSPPQLEDPSSKASIQNAQDVSLGDETN

SEQ ID NO: 3111750 - protein, 4 aa, Giardia lamblia
GIEG

SEQ ID NO: 3111751 - protein, 8 aa, Giardia lamblia
GIEKPSDA

SEQ ID NO: 3111752 - protein, 4 aa, Giardia lamblia
GIEP

SEQ ID NO: 3111753 - protein, 4 aa, Giardia lamblia
GIER

SEQ ID NO: 3111754 - protein, 13 aa, Giardia lamblia
GIFGDGGPSIMSK

SEQ ID NO: 3111755 - protein, 4 aa, Giardia lamblia
GIGA

SEQ ID NO: 3111756 - protein, 9 aa, Giardia lamblia
GIGARERQY

SEQ ID NO: 3111757 - protein, 13 aa, Giardia lamblia
GIGATRSSKFVPL

SEQ ID NO: 3111758 - protein, 5 aa, Giardia lamblia
GIGDG

SEQ ID NO: 3111759 - protein, 12 aa, Giardia lamblia
GIGENKDSTHSE

SEQ ID NO: 3111760 - protein, 5 aa, Giardia lamblia
GIGGK

SEQ ID NO: 3111761 - protein, 4 aa, Giardia lamblia
GIGK

SEQ ID NO: 3111762 - protein, 10 aa, Giardia lamblia
GIGKESGKLT

SEQ ID NO: 3111763 - protein, 10 aa, Giardia lamblia
GIGQRDEQGM

SEQ ID NO: 3111764 - protein, 4 aa, Giardia lamblia
GIGR

SEQ ID NO: 3111765 - protein, 6 aa, Giardia lamblia
GIGSGS

SEQ ID NO: 3111766 - protein, 9 aa, Giardia lamblia
GIGSTPNVL

SEQ ID NO: 3111767 - protein, 7 aa, Giardia lamblia
GIGTDAS

SEQ ID NO: 3111768 - protein, 8 aa, Giardia lamblia
GIGTDATM

SEQ ID NO: 3111769 - protein, 10 aa, Giardia lamblia
GIHQQPSGLQ

SEQ ID NO: 3111770 - protein, 8 aa, Giardia lamblia
GIKDHEGH

SEQ ID NO: 3111771 - protein, 9 aa, Giardia lamblia
GIKDKNGHN

SEQ ID NO: 3111772 - protein, 8 aa, Giardia lamblia
GIKDPGCA

SEQ ID NO: 3111773 - protein, 9 aa, Giardia lamblia
GIKDSNGDT

SEQ ID NO: 3111774 - protein, 6 aa, Giardia lamblia
GIKGRS

SEQ ID NO: 3111775 - protein, 10 aa, Giardia lamblia
GIKPKTGQTA

SEQ ID NO: 3111776 - protein, 6 aa, Giardia lamblia
GILPGG

SEQ ID NO: 3111777 - protein, 6 aa, Giardia lamblia
GILSND

SEQ ID NO: 3111778 - protein, 7 aa, Giardia lamblia
GILTPDG

SEQ ID NO: 3111779 - protein, 5 aa, Giardia lamblia
GINGL

SEQ ID NO: 3111780 - protein, 11 aa, Giardia lamblia
GINPDGTLRPE

SEQ ID NO: 3111781 - protein, 7 aa, Giardia lamblia
GINSPHP

SEQ ID NO: 3111782 - protein, 7 aa, Giardia lamblia
GINSSTV

SEQ ID NO: 3111783 - protein, 60 aa, Giardia lamblia
GIPAPAPSVNQRSHVSRGREYKEQYATSSNNHRDRQEDTRQKRKTNPSLKKVESNSAAAK

SEQ ID NO: 3111784 - protein, 4 aa, Giardia lamblia
GIPD

SEQ ID NO: 3111785 - protein, 7 aa, Giardia lamblia
GIPDKNG

SEQ ID NO: 3111786 - protein, 6 aa, Giardia lamblia
GIPDQP

SEQ ID NO: 3111787 - protein, 4 aa, Giardia lamblia
GIPE

SEQ ID NO: 3111788 - protein, 8 aa, Giardia lamblia
GIPEDPIT

SEQ ID NO: 3111789 - protein, 10 aa, Giardia lamblia
GIPGDKRPKP

SEQ ID NO: 3111790 - protein, 16 aa, Giardia lamblia
GIPKEAPTKNRGHADT

SEQ ID NO: 3111791 - protein, 9 aa, Giardia lamblia
GIPPPGQYR

SEQ ID NO: 3111792 - protein, 7 aa, Giardia lamblia
GIPPSEA

SEQ ID NO: 3111793 - protein, 6 aa, Giardia lamblia
GIPPSG

SEQ ID NO: 3111794 - protein, 6 aa, Giardia lamblia
GIPRTA

SEQ ID NO: 3111795 - protein, 5 aa, Giardia lamblia
GIPSN

SEQ ID NO: 3111796 - protein, 4 aa, Giardia lamblia
GIPV

SEQ ID NO: 3111797 - protein, 8 aa, Giardia lamblia
GIQDKDGM

SEQ ID NO: 3111798 - protein, 8 aa, Giardia lamblia
GIQGPGGS

SEQ ID NO: 3111799 - protein, 6 aa, Giardia lamblia
GIQGRA

SEQ ID NO: 3111800 - protein, 6 aa, Giardia lamblia
GIQGSG

SEQ ID NO: 3111801 - protein, 6 aa, Giardia lamblia
GIQPPL

SEQ ID NO: 3111802 - protein, 12 aa, Giardia lamblia
GIQQQSDKESMY

SEQ ID NO: 3111803 - protein, 7 aa, Giardia lamblia
GIQTEEG

SEQ ID NO: 3111804 - protein, 8 aa, Giardia lamblia
GIRDKDGM

SEQ ID NO: 3111805 - protein, 8 aa, Giardia lamblia
GIRDSHGR

SEQ ID NO: 3111806 - protein, 9 aa, Giardia lamblia
GIRDSSGQT

SEQ ID NO: 3111807 - protein, 9 aa, Giardia lamblia
GIRGSGRQT

SEQ ID NO: 3111808 - protein, 5 aa, Giardia lamblia
GIRPG

SEQ ID NO: 3111809 - protein, 6 aa, Giardia lamblia
GIRPGD

SEQ ID NO: 3111810 - protein, 6 aa, Giardia lamblia
GIRQTD

SEQ ID NO: 3111811 - protein, 4 aa, Giardia lamblia
GIRR

SEQ ID NO: 3111812 - protein, 14 aa, Giardia lamblia
GIRRNSSSSTLSSS

SEQ ID NO: 3111813 - protein, 9 aa, Giardia lamblia
GIRSAPRGL

SEQ ID NO: 3111814 - protein, 7 aa, Giardia lamblia
GIRSGEG

SEQ ID NO: 3111815 - protein, 5 aa, Giardia lamblia
GISAN

SEQ ID NO: 3111816 - protein, 6 aa, Giardia lamblia
GISDAT

SEQ ID NO: 3111817 - protein, 7 aa, Giardia lamblia
GISDERG

SEQ ID NO: 3111818 - protein, 9 aa, Giardia lamblia
GISDRATRL

SEQ ID NO: 3111819 - protein, 53 aa, Giardia lamblia
GISDSQTARNRSNSMEYEEKPKRARSYGTARKATKKTAVSNSDDHALTNEEAE

SEQ ID NO: 3111820 - protein, 14 aa, Giardia lamblia
GISESDHERRRPHP

SEQ ID NO: 3111821 - protein, 7 aa, Giardia lamblia
GISGEES

SEQ ID NO: 3111822 - protein, 9 aa, Giardia lamblia
GISGPDGKT

SEQ ID NO: 3111823 - protein, 6 aa, Giardia lamblia
GISPDV

SEQ ID NO: 3111824 - protein, 4 aa, Giardia lamblia
GISQ

SEQ ID NO: 3111825 - protein, 19 aa, Giardia lamblia
GISSNSKDETPADNLLDLS

SEQ ID NO: 3111826 - protein, 6 aa, Giardia lamblia
GISSPR

SEQ ID NO: 3111827 - protein, 5 aa, Giardia lamblia
GITAT

SEQ ID NO: 3111828 - protein, 5 aa, Giardia lamblia
GITDA

SEQ ID NO: 3111829 - protein, 29 aa, Giardia lamblia
GITEPPAQEDPDTPNDLVPPNNQDPVLDP

SEQ ID NO: 3111830 - protein, 5 aa, Giardia lamblia
GITGR

SEQ ID NO: 3111831 - protein, 4 aa, Giardia lamblia
GITP

SEQ ID NO: 3111832 - protein, 4 aa, Giardia lamblia
GITT

SEQ ID NO: 3111833 - protein, 12 aa, Giardia lamblia
GIVRDNQENAIS

SEQ ID NO: 3111834 - protein, 5 aa, Giardia lamblia
GIVSG

SEQ ID NO: 3111835 - protein, 10 aa, Giardia lamblia
GKAANESGLP

SEQ ID NO: 3111836 - protein, 5 aa, Giardia lamblia
GKADE

SEQ ID NO: 3111837 - protein, 15 aa, Giardia lamblia
GKAGIQQKQEQDRAL

SEQ ID NO: 3111838 - protein, 10 aa, Giardia lamblia
GKAGLTPADC

SEQ ID NO: 3111839 - protein, 14 aa, Giardia lamblia
GKAGRFRSNLSGKR

SEQ ID NO: 3111840 - protein, 11 aa, Giardia lamblia
GKAKEKQEYNA

SEQ ID NO: 3111841 - protein, 14 aa, Giardia lamblia
GKAKPATSSKKKRS

SEQ ID NO: 3111842 - protein, 4 aa, Giardia lamblia
GKAL

SEQ ID NO: 3111843 - protein, 23 aa, Giardia lamblia
GKANAATSGSSSSPGHDSESGYV

SEQ ID NO: 3111844 - protein, 5 aa, Giardia lamblia
GKAPA

SEQ ID NO: 3111845 - protein, 7 aa, Giardia lamblia
GKAPCPN

SEQ ID NO: 3111846 - protein, 22 aa, Giardia lamblia
GKAPGGKKSKLIQKAQKSKALT

SEQ ID NO: 3111847 - protein, 9 aa, Giardia lamblia
GKAPPPPRT

SEQ ID NO: 3111848 - protein, 16 aa, Giardia lamblia
GKAQQKLTTRQEKHNA

SEQ ID NO: 3111849 - protein, 7 aa, Giardia lamblia
GKAQSLD

SEQ ID NO: 3111850 - protein, 8 aa, Giardia lamblia
GKAQTRQT

SEQ ID NO: 3111851 - protein, 8 aa, Giardia lamblia
GKAQYSDD

SEQ ID NO: 3111852 - protein, 4 aa, Giardia lamblia
GKAR

SEQ ID NO: 3111853 - protein, 9 aa, Giardia lamblia
GKASRYVKS

SEQ ID NO: 3111854 - protein, 9 aa, Giardia lamblia
GKASSQPDV

SEQ ID NO: 3111855 - protein, 9 aa, Giardia lamblia
GKATDPEMA

SEQ ID NO: 3111856 - protein, 8 aa, Giardia lamblia
GKATSTEV

SEQ ID NO: 3111857 - protein, 9 aa, Giardia lamblia
GKAVGAATS

SEQ ID NO: 3111858 - protein, 18 aa, Giardia lamblia
GKAVQYDGAVTKSGGSAL

SEQ ID NO: 3111859 - protein, 15 aa, Giardia lamblia
GKAVREEQISIILDF

SEQ ID NO: 3111860 - protein, 7 aa, Giardia lamblia
GKCATNG

SEQ ID NO: 3111861 - protein, 4 aa, Giardia lamblia
GKCF

SEQ ID NO: 3111862 - protein, 7 aa, Giardia lamblia
GKCPKCD

SEQ ID NO: 3111863 - protein, 18 aa, Giardia lamblia
GKDAKLHTRPPKPKKMQP

SEQ ID NO: 3111864 - protein, 22 aa, Giardia lamblia
GKDARNNRTRNTITQQHSDRKQ

SEQ ID NO: 3111865 - protein, 8 aa, Giardia lamblia
GKDCGVPG

SEQ ID NO: 3111866 - protein, 10 aa, Giardia lamblia
GKDDGDHKEE

SEQ ID NO: 3111867 - protein, 4 aa, Giardia lamblia
GKDE

SEQ ID NO: 3111868 - protein, 9 aa, Giardia lamblia
GKDEAGEHD

SEQ ID NO: 3111869 - protein, 9 aa, Giardia lamblia
GKDETESEK

SEQ ID NO: 3111870 - protein, 18 aa, Giardia lamblia
GKDIGSATAHHDPVPKVP

SEQ ID NO: 3111871 - protein, 10 aa, Giardia lamblia
GKDISRDVSK

SEQ ID NO: 3111872 - protein, 5 aa, Giardia lamblia
GKDNM

SEQ ID NO: 3111873 - protein, 11 aa, Giardia lamblia
GKDPHDPSIRD

SEQ ID NO: 3111874 - protein, 7 aa, Giardia lamblia
GKDPSRD

SEQ ID NO: 3111875 - protein, 17 aa, Giardia lamblia
GKDQNRQRQQLNARRTV

SEQ ID NO: 3111876 - protein, 13 aa, Giardia lamblia
GKDRAEGQRSEVQ

SEQ ID NO: 3111877 - protein, 28 aa, Giardia lamblia
GKDSKQAAFNDAPDLKQASVSSSGDIAR

SEQ ID NO: 3111878 - protein, 6 aa, Giardia lamblia
GKDSTP

SEQ ID NO: 3111879 - protein, 7 aa, Giardia lamblia
GKDTGGA

SEQ ID NO: 3111880 - protein, 6 aa, Giardia lamblia
GKDTRA

SEQ ID NO: 3111881 - protein, 18 aa, Giardia lamblia
GKDTSTYSDLSGSQLSSS

SEQ ID NO: 3111882 - protein, 6 aa, Giardia lamblia
GKDVPK

SEQ ID NO: 3111883 - protein, 7 aa, Giardia lamblia
GKDYNET

SEQ ID NO: 3111884 - protein, 13 aa, Giardia lamblia
GKEARKQDSEGRT

SEQ ID NO: 3111885 - protein, 12 aa, Giardia lamblia
GKEARMQDKEGY

SEQ ID NO: 3111886 - protein, 8 aa, Giardia lamblia
GKEDDHGL

SEQ ID NO: 3111887 - protein, 12 aa, Giardia lamblia
GKEEKGKTNVDQ

SEQ ID NO: 3111888 - protein, 6 aa, Giardia lamblia
GKEISR

SEQ ID NO: 3111889 - protein, 6 aa, Giardia lamblia
GKEKMG

SEQ ID NO: 3111890 - protein, 9 aa, Giardia lamblia
GKEKPTQDY

SEQ ID NO: 3111891 - protein, 8 aa, Giardia lamblia
GKELDDEV

SEQ ID NO: 3111892 - protein, 12 aa, Giardia lamblia
GKELKTKPTQHS

SEQ ID NO: 3111893 - protein, 8 aa, Giardia lamblia
GKELPDDI

SEQ ID NO: 3111894 - protein, 7 aa, Giardia lamblia
GKELSSA

SEQ ID NO: 3111895 - protein, 6 aa, Giardia lamblia
GKELTE

SEQ ID NO: 3111896 - protein, 7 aa, Giardia lamblia
GKEPVGI

SEQ ID NO: 3111897 - protein, 8 aa, Giardia lamblia
GKEQGQWK

SEQ ID NO: 3111898 - protein, 7 aa, Giardia lamblia
GKERKFK

SEQ ID NO: 3111899 - protein, 5 aa, Giardia lamblia
GKERR

SEQ ID NO: 3111900 - protein, 9 aa, Giardia lamblia
GKERYETQD

SEQ ID NO: 3111901 - protein, 9 aa, Giardia lamblia
GKESTYANV

SEQ ID NO: 3111902 - protein, 8 aa, Giardia lamblia
GKETKDGL

SEQ ID NO: 3111903 - protein, 11 aa, Giardia lamblia
GKFDKERPKWS

SEQ ID NO: 3111904 - protein, 8 aa, Giardia lamblia
GKGDGHLQ

SEQ ID NO: 3111905 - protein, 19 aa, Giardia lamblia
GKGEATSKPILGSKQPDMH

SEQ ID NO: 3111906 - protein, 7 aa, Giardia lamblia
GKGFGSG

SEQ ID NO: 3111907 - protein, 13 aa, Giardia lamblia
GKGGSKLRSDQRP

SEQ ID NO: 3111908 - protein, 11 aa, Giardia lamblia
GKGGVGKSTLA

SEQ ID NO: 3111909 - protein, 12 aa, Giardia lamblia
GKGGVGKSTVST

SEQ ID NO: 3111910 - protein, 103 aa, Giardia lamblia
GKGKGKDKHKESAHEASTSGSVSKPDTTPSTQVEDQTSASLKPASEAASAPAAASSATSPPQLKTTSPPPPPPPAVVSPSKPPAPATPTTAADASKPTSDIKP

SEQ ID NO: 3111911 - protein, 5 aa, Giardia lamblia
GKGNV

SEQ ID NO: 3111912 - protein, 9 aa, Giardia lamblia
GKGPYSSEL

SEQ ID NO: 3111913 - protein, 7 aa, Giardia lamblia
GKGRATG

SEQ ID NO: 3111914 - protein, 10 aa, Giardia lamblia
GKGRNMGSVT

SEQ ID NO: 3111915 - protein, 8 aa, Giardia lamblia
GKGSLSDA

SEQ ID NO: 3111916 - protein, 7 aa, Giardia lamblia
GKGSTKL

SEQ ID NO: 3111917 - protein, 5 aa, Giardia lamblia
GKGSY

SEQ ID NO: 3111918 - protein, 9 aa, Giardia lamblia
GKGTDDPAV

SEQ ID NO: 3111919 - protein, 19 aa, Giardia lamblia
GKGVKLSGSQSNEAHRAEK

SEQ ID NO: 3111920 - protein, 7 aa, Giardia lamblia
GKGYTAK

SEQ ID NO: 3111921 - protein, 5 aa, Giardia lamblia
GKGYV

SEQ ID NO: 3111922 - protein, 11 aa, Giardia lamblia
GKHAGNKLGPQ

SEQ ID NO: 3111923 - protein, 5 aa, Giardia lamblia
GKHAV

SEQ ID NO: 3111924 - protein, 12 aa, Giardia lamblia
GKHGAEASYPKS

SEQ ID NO: 3111925 - protein, 8 aa, Giardia lamblia
GKHNEKNY

SEQ ID NO: 3111926 - protein, 33 aa, Giardia lamblia
GKHSADAGDRPFAGRKPRGSMPGGVDDGASYEH

SEQ ID NO: 3111927 - protein, 7 aa, Giardia lamblia
GKIDTAA

SEQ ID NO: 3111928 - protein, 7 aa, Giardia lamblia
GKITEDE

SEQ ID NO: 3111929 - protein, 8 aa, Giardia lamblia
GKKAAERG

SEQ ID NO: 3111930 - protein, 8 aa, Giardia lamblia
GKKAANPN

SEQ ID NO: 3111931 - protein, 14 aa, Giardia lamblia
GKKADSDLDCDQET

SEQ ID NO: 3111932 - protein, 8 aa, Giardia lamblia
GKKATTGL

SEQ ID NO: 3111933 - protein, 10 aa, Giardia lamblia
GKKEKDYGHY

SEQ ID NO: 3111934 - protein, 6 aa, Giardia lamblia
GKKESD

SEQ ID NO: 3111935 - protein, 6 aa, Giardia lamblia
GKKFPD

SEQ ID NO: 3111936 - protein, 8 aa, Giardia lamblia
GKKKLGRP

SEQ ID NO: 3111937 - protein, 7 aa, Giardia lamblia
GKKSNMI

SEQ ID NO: 3111938 - protein, 21 aa, Giardia lamblia
GKKTGGTPSVPPGGFNFGAPP

SEQ ID NO: 3111939 - protein, 8 aa, Giardia lamblia
GKKTHTLT

SEQ ID NO: 3111940 - protein, 7 aa, Giardia lamblia
GKKYDEK

SEQ ID NO: 3111941 - protein, 7 aa, Giardia lamblia
GKKYTTQ

SEQ ID NO: 3111942 - protein, 5 aa, Giardia lamblia
GKLDT

SEQ ID NO: 3111943 - protein, 8 aa, Giardia lamblia
GKLETRQA

SEQ ID NO: 3111944 - protein, 8 aa, Giardia lamblia
GKLGPDGL

SEQ ID NO: 3111945 - protein, 7 aa, Giardia lamblia
GKLGPTP

SEQ ID NO: 3111946 - protein, 10 aa, Giardia lamblia
GKLGQQSETL

SEQ ID NO: 3111947 - protein, 5 aa, Giardia lamblia
GKLGS

SEQ ID NO: 3111948 - protein, 10 aa, Giardia lamblia
GKLGSGGDFN

SEQ ID NO: 3111949 - protein, 5 aa, Giardia lamblia
GKLHP

SEQ ID NO: 3111950 - protein, 8 aa, Giardia lamblia
GKLLPGGI

SEQ ID NO: 3111951 - protein, 9 aa, Giardia lamblia
GKLNNADES

SEQ ID NO: 3111952 - protein, 6 aa, Giardia lamblia
GKLPDE

SEQ ID NO: 3111953 - protein, 8 aa, Giardia lamblia
GKLPEDRL

SEQ ID NO: 3111954 - protein, 7 aa, Giardia lamblia
GKLTKAM

SEQ ID NO: 3111955 - protein, 5 aa, Giardia lamblia
GKLTL

SEQ ID NO: 3111956 - protein, 8 aa, Giardia lamblia
GKLTNPQQ

SEQ ID NO: 3111957 - protein, 6 aa, Giardia lamblia
GKMQES

SEQ ID NO: 3111958 - protein, 14 aa, Giardia lamblia
GKMRDGDIDTNSKL

SEQ ID NO: 3111959 - protein, 4 aa, Giardia lamblia
GKMS

SEQ ID NO: 3111960 - protein, 7 aa, Giardia lamblia
GKMSEDQ

SEQ ID NO: 3111961 - protein, 10 aa, Giardia lamblia
GKMSKSVPDS

SEQ ID NO: 3111962 - protein, 5 aa, Giardia lamblia
GKMTT

SEQ ID NO: 3111963 - protein, 9 aa, Giardia lamblia
GKMTTTTGE

SEQ ID NO: 3111964 - protein, 8 aa, Giardia lamblia
GKNGSTAL

SEQ ID NO: 3111965 - protein, 4 aa, Giardia lamblia
GKNP

SEQ ID NO: 3111966 - protein, 8 aa, Giardia lamblia
GKNPGSSY

SEQ ID NO: 3111967 - protein, 11 aa, Giardia lamblia
GKNRTADSEYA

SEQ ID NO: 3111968 - protein, 7 aa, Giardia lamblia
GKNTCKE

SEQ ID NO: 3111969 - protein, 19 aa, Giardia lamblia
GKNVASSTRPNYSITPNEG

SEQ ID NO: 3111970 - protein, 15 aa, Giardia lamblia
GKNVTASSEARRERD

SEQ ID NO: 3111971 - protein, 32 aa, Giardia lamblia
GKPAASAATTTPAATPATGASTFASANAPTFG

SEQ ID NO: 3111972 - protein, 9 aa, Giardia lamblia
GKPAGGAGF

SEQ ID NO: 3111973 - protein, 22 aa, Giardia lamblia
GKPAQYISGTDGTRVSSPSASF

SEQ ID NO: 3111974 - protein, 10 aa, Giardia lamblia
GKPATGKTAL

SEQ ID NO: 3111975 - protein, 12 aa, Giardia lamblia
GKPAVGNALDGY

SEQ ID NO: 3111976 - protein, 6 aa, Giardia lamblia
GKPCDA

SEQ ID NO: 3111977 - protein, 6 aa, Giardia lamblia
GKPDLS

SEQ ID NO: 3111978 - protein, 14 aa, Giardia lamblia
GKPFSTEAHGPDVR

SEQ ID NO: 3111979 - protein, 14 aa, Giardia lamblia
GKPFYQTKTANTGY

SEQ ID NO: 3111980 - protein, 15 aa, Giardia lamblia
GKPGIPDSGIAASSN

SEQ ID NO: 3111981 - protein, 5 aa, Giardia lamblia
GKPLG

SEQ ID NO: 3111982 - protein, 7 aa, Giardia lamblia
GKPMPAQ

SEQ ID NO: 3111983 - protein, 5 aa, Giardia lamblia
GKPNE

SEQ ID NO: 3111984 - protein, 5 aa, Giardia lamblia
GKPPA

SEQ ID NO: 3111985 - protein, 37 aa, Giardia lamblia
GKPPEDKQGELEKRRQAREAAELEQQKAEEEGNLERA

SEQ ID NO: 3111986 - protein, 9 aa, Giardia lamblia
GKPPYDNLN

SEQ ID NO: 3111987 - protein, 5 aa, Giardia lamblia
GKPRN

SEQ ID NO: 3111988 - protein, 9 aa, Giardia lamblia
GKPRTDPTF

SEQ ID NO: 3111989 - protein, 10 aa, Giardia lamblia
GKPSSRGQAL

SEQ ID NO: 3111990 - protein, 4 aa, Giardia lamblia
GKPT

SEQ ID NO: 3111991 - protein, 9 aa, Giardia lamblia
GKPTANGGT

SEQ ID NO: 3111992 - protein, 9 aa, Giardia lamblia
GKPTSDGRY

SEQ ID NO: 3111993 - protein, 5 aa, Giardia lamblia
GKPYG

SEQ ID NO: 3111994 - protein, 6 aa, Giardia lamblia
GKPYRD

SEQ ID NO: 3111995 - protein, 7 aa, Giardia lamblia
GKQAALT

SEQ ID NO: 3111996 - protein, 14 aa, Giardia lamblia
GKQAPQHSQQPEGH

SEQ ID NO: 3111997 - protein, 6 aa, Giardia lamblia
GKQAPT

SEQ ID NO: 3111998 - protein, 7 aa, Giardia lamblia
GKQASGA

SEQ ID NO: 3111999 - protein, 9 aa, Giardia lamblia
GKQDKNGYT

SEQ ID NO: 3112000 - protein, 8 aa, Giardia lamblia
GKQLPDPL

SEQ ID NO: 3112001 - protein, 41 aa, Giardia lamblia
GKQPGISTQHPASEQQMASATGIRQPEGEHTDADDEEERDD

SEQ ID NO: 3112002 - protein, 9 aa, Giardia lamblia
GKQRDTLGE

SEQ ID NO: 3112003 - protein, 9 aa, Giardia lamblia
GKQRENGQT

SEQ ID NO: 3112004 - protein, 8 aa, Giardia lamblia
GKQTSSGW

SEQ ID NO: 3112005 - protein, 11 aa, Giardia lamblia
GKRAPTNPAYS

SEQ ID NO: 3112006 - protein, 6 aa, Giardia lamblia
GKREEA

SEQ ID NO: 3112007 - protein, 8 aa, Giardia lamblia
GKRERSGP

SEQ ID NO: 3112008 - protein, 6 aa, Giardia lamblia
GKRGEV

SEQ ID NO: 3112009 - protein, 7 aa, Giardia lamblia
GKRGKKR

SEQ ID NO: 3112010 - protein, 8 aa, Giardia lamblia
GKRGREHP

SEQ ID NO: 3112011 - protein, 20 aa, Giardia lamblia
GKRHGQGRYTNADGSYYEGS

SEQ ID NO: 3112012 - protein, 5 aa, Giardia lamblia
GKRLP

SEQ ID NO: 3112013 - protein, 7 aa, Giardia lamblia
GKRNAPN

SEQ ID NO: 3112014 - protein, 7 aa, Giardia lamblia
GKRPGPL

SEQ ID NO: 3112015 - protein, 12 aa, Giardia lamblia
GKRQKAASVKRI

SEQ ID NO: 3112016 - protein, 30 aa, Giardia lamblia
GKRSPSTNKLGQAATKQIDLPESKTTMSVK

SEQ ID NO: 3112017 - protein, 38 aa, Giardia lamblia
GKRSSYLEQENDVSTHDTDADSESSGELGDRALGQLGK

SEQ ID NO: 3112018 - protein, 4 aa, Giardia lamblia
GKRT

SEQ ID NO: 3112019 - protein, 6 aa, Giardia lamblia
GKRTTI

SEQ ID NO: 3112020 - protein, 4 aa, Giardia lamblia
GKSA

SEQ ID NO: 3112021 - protein, 5 aa, Giardia lamblia
GKSAI

SEQ ID NO: 3112022 - protein, 14 aa, Giardia lamblia
GKSASQYAQEAGHT

SEQ ID NO: 3112023 - protein, 9 aa, Giardia lamblia
GKSDSLGST

SEQ ID NO: 3112024 - protein, 4 aa, Giardia lamblia
GKSE

SEQ ID NO: 3112025 - protein, 12 aa, Giardia lamblia
GKSEGSAEKVDE

SEQ ID NO: 3112026 - protein, 5 aa, Giardia lamblia
GKSER

SEQ ID NO: 3112027 - protein, 6 aa, Giardia lamblia
GKSGAS

SEQ ID NO: 3112028 - protein, 7 aa, Giardia lamblia
GKSGMGK

SEQ ID NO: 3112029 - protein, 45 aa, Giardia lamblia
GKSGPIEPLGSASGRRFESPALRSASSFSALPDRNSSKASNTTLG

SEQ ID NO: 3112030 - protein, 23 aa, Giardia lamblia
GKSINGCTQSTNRSSPPTTPHMP

SEQ ID NO: 3112031 - protein, 14 aa, Giardia lamblia
GKSIPAATKRDETL

SEQ ID NO: 3112032 - protein, 7 aa, Giardia lamblia
GKSLGNA

SEQ ID NO: 3112033 - protein, 5 aa, Giardia lamblia
GKSNV

SEQ ID NO: 3112034 - protein, 6 aa, Giardia lamblia
GKSPAY

SEQ ID NO: 3112035 - protein, 20 aa, Giardia lamblia
GKSPSTTGAGVEGALTKGPF

SEQ ID NO: 3112036 - protein, 8 aa, Giardia lamblia
GKSQSISQ

SEQ ID NO: 3112037 - protein, 8 aa, Giardia lamblia
GKSQTALT

SEQ ID NO: 3112038 - protein, 19 aa, Giardia lamblia
GKSRTTGQSAVSLPTPSSF

SEQ ID NO: 3112039 - protein, 4 aa, Giardia lamblia
GKSS

SEQ ID NO: 3112040 - protein, 7 aa, Giardia lamblia
GKSSDID

SEQ ID NO: 3112041 - protein, 10 aa, Giardia lamblia
GKSSTPNDHM

SEQ ID NO: 3112042 - protein, 9 aa, Giardia lamblia
GKSTDENFS

SEQ ID NO: 3112043 - protein, 7 aa, Giardia lamblia
GKSTDPV

SEQ ID NO: 3112044 - protein, 9 aa, Giardia lamblia
GKSTEDEYD

SEQ ID NO: 3112045 - protein, 9 aa, Giardia lamblia
GKSTLSATA

SEQ ID NO: 3112046 - protein, 7 aa, Giardia lamblia
GKSTLTD

SEQ ID NO: 3112047 - protein, 13 aa, Giardia lamblia
GKSTQIDKRMTRS

SEQ ID NO: 3112048 - protein, 5 aa, Giardia lamblia
GKSVG

SEQ ID NO: 3112049 - protein, 7 aa, Giardia lamblia
GKSYFSK

SEQ ID NO: 3112050 - protein, 4 aa, Giardia lamblia
GKTA

SEQ ID NO: 3112051 - protein, 6 aa, Giardia lamblia
GKTAID

SEQ ID NO: 3112052 - protein, 8 aa, Giardia lamblia
GKTANETV

SEQ ID NO: 3112053 - protein, 11 aa, Giardia lamblia
GKTAPIPTGGY

SEQ ID NO: 3112054 - protein, 12 aa, Giardia lamblia
GKTATKTLAGAS

SEQ ID NO: 3112055 - protein, 11 aa, Giardia lamblia
GKTDSENGNLP

SEQ ID NO: 3112056 - protein, 6 aa, Giardia lamblia
GKTESV

SEQ ID NO: 3112057 - protein, 6 aa, Giardia lamblia
GKTFPQ

SEQ ID NO: 3112058 - protein, 6 aa, Giardia lamblia
GKTGEI

SEQ ID NO: 3112059 - protein, 9 aa, Giardia lamblia
GKTGSGGRT

SEQ ID NO: 3112060 - protein, 5 aa, Giardia lamblia
GKTGY

SEQ ID NO: 3112061 - protein, 12 aa, Giardia lamblia
GKTHKTKRVPLA

SEQ ID NO: 3112062 - protein, 8 aa, Giardia lamblia
GKTHLTGH

SEQ ID NO: 3112063 - protein, 13 aa, Giardia lamblia
GKTISFGREKGKT

SEQ ID NO: 3112064 - protein, 16 aa, Giardia lamblia
GKTKESPENREETDFD

SEQ ID NO: 3112065 - protein, 10 aa, Giardia lamblia
GKTKQYKSTF

SEQ ID NO: 3112066 - protein, 9 aa, Giardia lamblia
GKTKTALSR

SEQ ID NO: 3112067 - protein, 4 aa, Giardia lamblia
GKTL

SEQ ID NO: 3112068 - protein, 15 aa, Giardia lamblia
GKTLTGRIAGSSTTY

SEQ ID NO: 3112069 - protein, 7 aa, Giardia lamblia
GKTNTSV

SEQ ID NO: 3112070 - protein, 4 aa, Giardia lamblia
GKTP

SEQ ID NO: 3112071 - protein, 7 aa, Giardia lamblia
GKTPETN

SEQ ID NO: 3112072 - protein, 9 aa, Giardia lamblia
GKTRRTGTV

SEQ ID NO: 3112073 - protein, 4 aa, Giardia lamblia
GKTS

SEQ ID NO: 3112074 - protein, 6 aa, Giardia lamblia
GKTYDE

SEQ ID NO: 3112075 - protein, 14 aa, Giardia lamblia
GKTYDSAIDPTTNL

SEQ ID NO: 3112076 - protein, 7 aa, Giardia lamblia
GKVDPSS

SEQ ID NO: 3112077 - protein, 4 aa, Giardia lamblia
GKVP

SEQ ID NO: 3112078 - protein, 15 aa, Giardia lamblia
GKWGTGKIERAVETL

SEQ ID NO: 3112079 - protein, 6 aa, Giardia lamblia
GKWREA

SEQ ID NO: 3112080 - protein, 8 aa, Giardia lamblia
GKYATVDG

SEQ ID NO: 3112081 - protein, 19 aa, Giardia lamblia
GKYENTTGEIREVGRSADQ

SEQ ID NO: 3112082 - protein, 9 aa, Giardia lamblia
GKYGQPETV

SEQ ID NO: 3112083 - protein, 12 aa, Giardia lamblia
GKYGTRYGRAAR

SEQ ID NO: 3112084 - protein, 6 aa, Giardia lamblia
GKYPTA

SEQ ID NO: 3112085 - protein, 10 aa, Giardia lamblia
GLADPRAAYP

SEQ ID NO: 3112086 - protein, 9 aa, Giardia lamblia
GLADSRGRT

SEQ ID NO: 3112087 - protein, 46 aa, Giardia lamblia
GLAEDDQNEPLDDGPLDEGDSNDELLPDEEQLEDEPLEEDDDMNAS

SEQ ID NO: 3112088 - protein, 7 aa, Giardia lamblia
GLAGGDW

SEQ ID NO: 3112089 - protein, 26 aa, Giardia lamblia
GLAGSSKFQEGVKEGEEEATSDVDDS

SEQ ID NO: 3112090 - protein, 10 aa, Giardia lamblia
GLAGTPDNEC

SEQ ID NO: 3112091 - protein, 6 aa, Giardia lamblia
GLAKMS

SEQ ID NO: 3112092 - protein, 10 aa, Giardia lamblia
GLANNEGQRA

SEQ ID NO: 3112093 - protein, 13 aa, Giardia lamblia
GLAQGKHYYNKII

SEQ ID NO: 3112094 - protein, 8 aa, Giardia lamblia
GLASPGPA

SEQ ID NO: 3112095 - protein, 5 aa, Giardia lamblia
GLASS

SEQ ID NO: 3112096 - protein, 12 aa, Giardia lamblia
GLATGSLTTDSG

SEQ ID NO: 3112097 - protein, 7 aa, Giardia lamblia
GLATPEG

SEQ ID NO: 3112098 - protein, 4 aa, Giardia lamblia
GLAV

SEQ ID NO: 3112099 - protein, 4 aa, Giardia lamblia
GLDA

SEQ ID NO: 3112100 - protein, 16 aa, Giardia lamblia
GLDASDAKNSAKDKYK

SEQ ID NO: 3112101 - protein, 4 aa, Giardia lamblia
GLDD

SEQ ID NO: 3112102 - protein, 6 aa, Giardia lamblia
GLDDPY

SEQ ID NO: 3112103 - protein, 7 aa, Giardia lamblia
GLDGPTY

SEQ ID NO: 3112104 - protein, 11 aa, Giardia lamblia
GLDKATEKQPL

SEQ ID NO: 3112105 - protein, 6 aa, Giardia lamblia
GLDPEK

SEQ ID NO: 3112106 - protein, 6 aa, Giardia lamblia
GLDPPI

SEQ ID NO: 3112107 - protein, 4 aa, Giardia lamblia
GLDR

SEQ ID NO: 3112108 - protein, 7 aa, Giardia lamblia
GLDRPDD

SEQ ID NO: 3112109 - protein, 10 aa, Giardia lamblia
GLDSGETNDQ

SEQ ID NO: 3112110 - protein, 9 aa, Giardia lamblia
GLEASRPNI

SEQ ID NO: 3112111 - protein, 5 aa, Giardia lamblia
GLEDG

SEQ ID NO: 3112112 - protein, 10 aa, Giardia lamblia
GLEESEHGTI

SEQ ID NO: 3112113 - protein, 4 aa, Giardia lamblia
GLEG

SEQ ID NO: 3112114 - protein, 5 aa, Giardia lamblia
GLERG

SEQ ID NO: 3112115 - protein, 8 aa, Giardia lamblia
GLESNQLK

SEQ ID NO: 3112116 - protein, 6 aa, Giardia lamblia
GLFDDE

SEQ ID NO: 3112117 - protein, 8 aa, Giardia lamblia
GLFGKSAT

SEQ ID NO: 3112118 - protein, 4 aa, Giardia lamblia
GLGA

SEQ ID NO: 3112119 - protein, 13 aa, Giardia lamblia
GLGDPSSAPTSLN

SEQ ID NO: 3112120 - protein, 9 aa, Giardia lamblia
GLGGEKDRW

SEQ ID NO: 3112121 - protein, 9 aa, Giardia lamblia
GLGGEKERW

SEQ ID NO: 3112122 - protein, 7 aa, Giardia lamblia
GLGNGSD

SEQ ID NO: 3112123 - protein, 5 aa, Giardia lamblia
GLGPH

SEQ ID NO: 3112124 - protein, 11 aa, Giardia lamblia
GLGPTVSREQE

SEQ ID NO: 3112125 - protein, 9 aa, Giardia lamblia
GLGQHPQSA

SEQ ID NO: 3112126 - protein, 5 aa, Giardia lamblia
GLGQR

SEQ ID NO: 3112127 - protein, 13 aa, Giardia lamblia
GLGRNSYNSSQAL

SEQ ID NO: 3112128 - protein, 6 aa, Giardia lamblia
GLGRTG

SEQ ID NO: 3112129 - protein, 11 aa, Giardia lamblia
GLGSERDSEDV

SEQ ID NO: 3112130 - protein, 10 aa, Giardia lamblia
GLGSTSNSIS

SEQ ID NO: 3112131 - protein, 4 aa, Giardia lamblia
GLGT

SEQ ID NO: 3112132 - protein, 6 aa, Giardia lamblia
GLGTTP

SEQ ID NO: 3112133 - protein, 8 aa, Giardia lamblia
GLHDDTQR

SEQ ID NO: 3112134 - protein, 4 aa, Giardia lamblia
GLHS

SEQ ID NO: 3112135 - protein, 12 aa, Giardia lamblia
GLIDSSGKAIDL

SEQ ID NO: 3112136 - protein, 5 aa, Giardia lamblia
GLING

SEQ ID NO: 3112137 - protein, 10 aa, Giardia lamblia
GLIPDNGNHT

SEQ ID NO: 3112138 - protein, 10 aa, Giardia lamblia
GLKDKDAEIA

SEQ ID NO: 3112139 - protein, 5 aa, Giardia lamblia
GLKDQ

SEQ ID NO: 3112140 - protein, 9 aa, Giardia lamblia
GLKDRAGKT

SEQ ID NO: 3112141 - protein, 8 aa, Giardia lamblia
GLKDSNGK

SEQ ID NO: 3112142 - protein, 4 aa, Giardia lamblia
GLKK

SEQ ID NO: 3112143 - protein, 20 aa, Giardia lamblia
GLKKTPSVTPVPDTPSPAGG

SEQ ID NO: 3112144 - protein, 23 aa, Giardia lamblia
GLKRGQGHLTPELGGDANEPLYS

SEQ ID NO: 3112145 - protein, 9 aa, Giardia lamblia
GLKRNTDGV

SEQ ID NO: 3112146 - protein, 11 aa, Giardia lamblia
GLLGGPDKSGI

SEQ ID NO: 3112147 - protein, 5 aa, Giardia lamblia
GLLTT

SEQ ID NO: 3112148 - protein, 12 aa, Giardia lamblia
GLNADGGSVPTK

SEQ ID NO: 3112149 - protein, 10 aa, Giardia lamblia
GLNEAVSSKD

SEQ ID NO: 3112150 - protein, 9 aa, Giardia lamblia
GLNGTGKSN

SEQ ID NO: 3112151 - protein, 10 aa, Giardia lamblia
GLNKESPTIT

SEQ ID NO: 3112152 - protein, 9 aa, Giardia lamblia
GLNNNKPFG

SEQ ID NO: 3112153 - protein, 10 aa, Giardia lamblia
GLNQGKETNL

SEQ ID NO: 3112154 - protein, 9 aa, Giardia lamblia
GLNQPYTGG

SEQ ID NO: 3112155 - protein, 18 aa, Giardia lamblia
GLNSAGHSPVQDDAKRAE

SEQ ID NO: 3112156 - protein, 9 aa, Giardia lamblia
GLNTEQAPK

SEQ ID NO: 3112157 - protein, 7 aa, Giardia lamblia
GLPAATY

SEQ ID NO: 3112158 - protein, 5 aa, Giardia lamblia
GLPDA

SEQ ID NO: 3112159 - protein, 5 aa, Giardia lamblia
GLPDG

SEQ ID NO: 3112160 - protein, 8 aa, Giardia lamblia
GLPDNGRK

SEQ ID NO: 3112161 - protein, 6 aa, Giardia lamblia
GLPDTM

SEQ ID NO: 3112162 - protein, 4 aa, Giardia lamblia
GLPE

SEQ ID NO: 3112163 - protein, 5 aa, Giardia lamblia
GLPKK

SEQ ID NO: 3112164 - protein, 9 aa, Giardia lamblia
GLPMGETRD

SEQ ID NO: 3112165 - protein, 4 aa, Giardia lamblia
GLPP

SEQ ID NO: 3112166 - protein, 5 aa, Giardia lamblia
GLPPI

SEQ ID NO: 3112167 - protein, 10 aa, Giardia lamblia
GLPPSDPVEP

SEQ ID NO: 3112168 - protein, 7 aa, Giardia lamblia
GLPPTGA

SEQ ID NO: 3112169 - protein, 9 aa, Giardia lamblia
GLPRVGNAV

SEQ ID NO: 3112170 - protein, 14 aa, Giardia lamblia
GLPSRPQYSEERLE

SEQ ID NO: 3112171 - protein, 4 aa, Giardia lamblia
GLPY

SEQ ID NO: 3112172 - protein, 18 aa, Giardia lamblia
GLQAPLPADPKEKAWEGS

SEQ ID NO: 3112173 - protein, 10 aa, Giardia lamblia
GLQDAQGRTA

SEQ ID NO: 3112174 - protein, 9 aa, Giardia lamblia
GLQDEEGKT

SEQ ID NO: 3112175 - protein, 10 aa, Giardia lamblia
GLQDKDGKTA

SEQ ID NO: 3112176 - protein, 10 aa, Giardia lamblia
GLQDKTGISI

SEQ ID NO: 3112177 - protein, 7 aa, Giardia lamblia
GLQDSRD

SEQ ID NO: 3112178 - protein, 23 aa, Giardia lamblia
GLQPDKDSAHKSSAHGADTSQKT

SEQ ID NO: 3112179 - protein, 5 aa, Giardia lamblia
GLQPL

SEQ ID NO: 3112180 - protein, 6 aa, Giardia lamblia
GLQPRA

SEQ ID NO: 3112181 - protein, 19 aa, Giardia lamblia
GLQQQGYRYDNGQWTRETV

SEQ ID NO: 3112182 - protein, 4 aa, Giardia lamblia
GLQS

SEQ ID NO: 3112183 - protein, 5 aa, Giardia lamblia
GLQST

SEQ ID NO: 3112184 - protein, 5 aa, Giardia lamblia
GLQTI

SEQ ID NO: 3112185 - protein, 13 aa, Giardia lamblia
GLQTKRPNATNEV

SEQ ID NO: 3112186 - protein, 9 aa, Giardia lamblia
GLRDPKGQT

SEQ ID NO: 3112187 - protein, 10 aa, Giardia lamblia
GLRDTDGATA

SEQ ID NO: 3112188 - protein, 11 aa, Giardia lamblia
GLRGSRGLSSS

SEQ ID NO: 3112189 - protein, 15 aa, Giardia lamblia
GLRGSSASISKPAAN

SEQ ID NO: 3112190 - protein, 25 aa, Giardia lamblia
GLRPSQGAAHTNSYSLGGKKRRRID

SEQ ID NO: 3112191 - protein, 9 aa, Giardia lamblia
GLRSDRDGM

SEQ ID NO: 3112192 - protein, 13 aa, Giardia lamblia
GLRTSEGHPNKEG

SEQ ID NO: 3112193 - protein, 6 aa, Giardia lamblia
GLSAEL

SEQ ID NO: 3112194 - protein, 9 aa, Giardia lamblia
GLSANGKGF

SEQ ID NO: 3112195 - protein, 6 aa, Giardia lamblia
GLSARN

SEQ ID NO: 3112196 - protein, 5 aa, Giardia lamblia
GLSDE

SEQ ID NO: 3112197 - protein, 10 aa, Giardia lamblia
GLSDGTEATA

SEQ ID NO: 3112198 - protein, 10 aa, Giardia lamblia
GLSGDTSGLG

SEQ ID NO: 3112199 - protein, 10 aa, Giardia lamblia
GLSGGEAKED

SEQ ID NO: 3112200 - protein, 19 aa, Giardia lamblia
GLSGPTTRQGTEDNKETNV

SEQ ID NO: 3112201 - protein, 15 aa, Giardia lamblia
GLSKPDENDDTGRRK

SEQ ID NO: 3112202 - protein, 14 aa, Giardia lamblia
GLSNPRDDPRHPYT

SEQ ID NO: 3112203 - protein, 8 aa, Giardia lamblia
GLSPATGG

SEQ ID NO: 3112204 - protein, 7 aa, Giardia lamblia
GLSPDEV

SEQ ID NO: 3112205 - protein, 7 aa, Giardia lamblia
GLSPEER

SEQ ID NO: 3112206 - protein, 9 aa, Giardia lamblia
GLSPKDLGD

SEQ ID NO: 3112207 - protein, 23 aa, Giardia lamblia
GLSQQLDDTYRPSSTSQSTRSMN

SEQ ID NO: 3112208 - protein, 4 aa, Giardia lamblia
GLSR

SEQ ID NO: 3112209 - protein, 9 aa, Giardia lamblia
GLSRPTQPL

SEQ ID NO: 3112210 - protein, 13 aa, Giardia lamblia
GLSSSATLKDATV

SEQ ID NO: 3112211 - protein, 5 aa, Giardia lamblia
GLSTA

SEQ ID NO: 3112212 - protein, 5 aa, Giardia lamblia
GLTDH

SEQ ID NO: 3112213 - protein, 9 aa, Giardia lamblia
GLTDSKGNT

SEQ ID NO: 3112214 - protein, 9 aa, Giardia lamblia
GLTDSKGRT

SEQ ID NO: 3112215 - protein, 6 aa, Giardia lamblia
GLTEKY

SEQ ID NO: 3112216 - protein, 10 aa, Giardia lamblia
GLTENGESNA

SEQ ID NO: 3112217 - protein, 21 aa, Giardia lamblia
GLTEQSGQSARLAGSLGTSSR

SEQ ID NO: 3112218 - protein, 56 aa, Giardia lamblia
GLTESRSKGSASSSGHSSTATSNISGRGSKAQTGKGTTSLPPIAKTRNQRVAREEE

SEQ ID NO: 3112219 - protein, 4 aa, Giardia lamblia
GLTF

SEQ ID NO: 3112220 - protein, 4 aa, Giardia lamblia
GLTG

SEQ ID NO: 3112221 - protein, 6 aa, Giardia lamblia
GLTGDD

SEQ ID NO: 3112222 - protein, 6 aa, Giardia lamblia
GLTGSY

SEQ ID NO: 3112223 - protein, 9 aa, Giardia lamblia
GLTGVSKDD

SEQ ID NO: 3112224 - protein, 6 aa, Giardia lamblia
GLTKSE

SEQ ID NO: 3112225 - protein, 4 aa, Giardia lamblia
GLTP

SEQ ID NO: 3112226 - protein, 14 aa, Giardia lamblia
GLTPPGTDSANQHV

SEQ ID NO: 3112227 - protein, 4 aa, Giardia lamblia
GLTQ

SEQ ID NO: 3112228 - protein, 5 aa, Giardia lamblia
GLTQP

SEQ ID NO: 3112229 - protein, 9 aa, Giardia lamblia
GLTRTDGKT

SEQ ID NO: 3112230 - protein, 13 aa, Giardia lamblia
GLTSAGRKARGLH

SEQ ID NO: 3112231 - protein, 10 aa, Giardia lamblia
GLTSSDGPAQ

SEQ ID NO: 3112232 - protein, 6 aa, Giardia lamblia
GLTSTT

SEQ ID NO: 3112233 - protein, 4 aa, Giardia lamblia
GLTT

SEQ ID NO: 3112234 - protein, 9 aa, Giardia lamblia
GLTTADGST

SEQ ID NO: 3112235 - protein, 8 aa, Giardia lamblia
GLVDESSS

SEQ ID NO: 3112236 - protein, 4 aa, Giardia lamblia
GLYE

SEQ ID NO: 3112237 - protein, 10 aa, Giardia lamblia
GMADDTKNTA

SEQ ID NO: 3112238 - protein, 6 aa, Giardia lamblia
GMANPR

SEQ ID NO: 3112239 - protein, 9 aa, Giardia lamblia
GMAREDGKT

SEQ ID NO: 3112240 - protein, 9 aa, Giardia lamblia
GMASKQGET

SEQ ID NO: 3112241 - protein, 8 aa, Giardia lamblia
GMATEKAN

SEQ ID NO: 3112242 - protein, 5 aa, Giardia lamblia
GMDAA

SEQ ID NO: 3112243 - protein, 11 aa, Giardia lamblia
GMEEDETKGYR

SEQ ID NO: 3112244 - protein, 11 aa, Giardia lamblia
GMEGELSDKER

SEQ ID NO: 3112245 - protein, 10 aa, Giardia lamblia
GMEKSQRQTV

SEQ ID NO: 3112246 - protein, 12 aa, Giardia lamblia
GMENFGSEATKV

SEQ ID NO: 3112247 - protein, 5 aa, Giardia lamblia
GMEST

SEQ ID NO: 3112248 - protein, 9 aa, Giardia lamblia
GMGGRSGNV

SEQ ID NO: 3112249 - protein, 10 aa, Giardia lamblia
GMGSTKAQTF

SEQ ID NO: 3112250 - protein, 10 aa, Giardia lamblia
GMKDGAGETA

SEQ ID NO: 3112251 - protein, 10 aa, Giardia lamblia
GMKDKDDNTA

SEQ ID NO: 3112252 - protein, 11 aa, Giardia lamblia
GMKKDNGDTAL

SEQ ID NO: 3112253 - protein, 14 aa, Giardia lamblia
GMKKDSSGSYTPVP

SEQ ID NO: 3112254 - protein, 9 aa, Giardia lamblia
GMKKRSGKT

SEQ ID NO: 3112255 - protein, 9 aa, Giardia lamblia
GMKNNEGKT

SEQ ID NO: 3112256 - protein, 8 aa, Giardia lamblia
GMKNSQPC

SEQ ID NO: 3112257 - protein, 8 aa, Giardia lamblia
GMKRNDGK

SEQ ID NO: 3112258 - protein, 17 aa, Giardia lamblia
GMKSTRESETIQHNSSS

SEQ ID NO: 3112259 - protein, 6 aa, Giardia lamblia
GMKTKR

SEQ ID NO: 3112260 - protein, 5 aa, Giardia lamblia
GMKVG

SEQ ID NO: 3112261 - protein, 11 aa, Giardia lamblia
GMNADEVEAQR

SEQ ID NO: 3112262 - protein, 7 aa, Giardia lamblia
GMNEEAQ

SEQ ID NO: 3112263 - protein, 12 aa, Giardia lamblia
GMPAPVRMANQN

SEQ ID NO: 3112264 - protein, 7 aa, Giardia lamblia
GMPKNRN

SEQ ID NO: 3112265 - protein, 9 aa, Giardia lamblia
GMPQGSQQN

SEQ ID NO: 3112266 - protein, 9 aa, Giardia lamblia
GMQDGEGNT

SEQ ID NO: 3112267 - protein, 10 aa, Giardia lamblia
GMQDNDGETA

SEQ ID NO: 3112268 - protein, 7 aa, Giardia lamblia
GMQDQDG

SEQ ID NO: 3112269 - protein, 9 aa, Giardia lamblia
GMQDQSGRK

SEQ ID NO: 3112270 - protein, 11 aa, Giardia lamblia
GMQDSDGKTAT

SEQ ID NO: 3112271 - protein, 9 aa, Giardia lamblia
GMQDSEGKT

SEQ ID NO: 3112272 - protein, 9 aa, Giardia lamblia
GMQDTEGRT

SEQ ID NO: 3112273 - protein, 10 aa, Giardia lamblia
GMQEKEKGQT

SEQ ID NO: 3112274 - protein, 9 aa, Giardia lamblia
GMQKDDGTT

SEQ ID NO: 3112275 - protein, 7 aa, Giardia lamblia
GMQRTDG

SEQ ID NO: 3112276 - protein, 8 aa, Giardia lamblia
GMQRTDGY

SEQ ID NO: 3112277 - protein, 9 aa, Giardia lamblia
GMQSNNGRT

SEQ ID NO: 3112278 - protein, 7 aa, Giardia lamblia
GMQTGND

SEQ ID NO: 3112279 - protein, 9 aa, Giardia lamblia
GMQTNDGRT

SEQ ID NO: 3112280 - protein, 13 aa, Giardia lamblia
GMQTNSSNCRGAG

SEQ ID NO: 3112281 - protein, 10 aa, Giardia lamblia
GMRDGSETTA

SEQ ID NO: 3112282 - protein, 6 aa, Giardia lamblia
GMRDIN

SEQ ID NO: 3112283 - protein, 18 aa, Giardia lamblia
GMRDTEQDYEDDHEEAPI

SEQ ID NO: 3112284 - protein, 8 aa, Giardia lamblia
GMRSRDGY

SEQ ID NO: 3112285 - protein, 7 aa, Giardia lamblia
GMRSSND

SEQ ID NO: 3112286 - protein, 7 aa, Giardia lamblia
GMRSSNE

SEQ ID NO: 3112287 - protein, 7 aa, Giardia lamblia
GMRSSNG

SEQ ID NO: 3112288 - protein, 8 aa, Giardia lamblia
GMRSVTGR

SEQ ID NO: 3112289 - protein, 8 aa, Giardia lamblia
GMSKTSGY

SEQ ID NO: 3112290 - protein, 5 aa, Giardia lamblia
GMSNC

SEQ ID NO: 3112291 - protein, 7 aa, Giardia lamblia
GMSRKDG

SEQ ID NO: 3112292 - protein, 4 aa, Giardia lamblia
GMTA

SEQ ID NO: 3112293 - protein, 9 aa, Giardia lamblia
GMTADESIP

SEQ ID NO: 3112294 - protein, 22 aa, Giardia lamblia
GMTERSSGPHAFPPDPRYDGES

SEQ ID NO: 3112295 - protein, 6 aa, Giardia lamblia
GMTQAD

SEQ ID NO: 3112296 - protein, 9 aa, Giardia lamblia
GMVDNSGST

SEQ ID NO: 3112297 - protein, 5 aa, Giardia lamblia
GMVDQ

SEQ ID NO: 3112298 - protein, 4 aa, Giardia lamblia
GNAD

SEQ ID NO: 3112299 - protein, 5 aa, Giardia lamblia
GNADE

SEQ ID NO: 3112300 - protein, 20 aa, Giardia lamblia
GNADRGSLGKQTQTPNPHTI

SEQ ID NO: 3112301 - protein, 4 aa, Giardia lamblia
GNAE

SEQ ID NO: 3112302 - protein, 6 aa, Giardia lamblia
GNAEEV

SEQ ID NO: 3112303 - protein, 9 aa, Giardia lamblia
GNAENTRLQ

SEQ ID NO: 3112304 - protein, 9 aa, Giardia lamblia
GNAGSSGGV

SEQ ID NO: 3112305 - protein, 9 aa, Giardia lamblia
GNALNTRGF

SEQ ID NO: 3112306 - protein, 10 aa, Giardia lamblia
GNAPDPSENC

SEQ ID NO: 3112307 - protein, 8 aa, Giardia lamblia
GNAPRSEA

SEQ ID NO: 3112308 - protein, 28 aa, Giardia lamblia
GNAQPAHGSRHVDPATSCSAVQTLKKTL

SEQ ID NO: 3112309 - protein, 9 aa, Giardia lamblia
GNARGVGSS

SEQ ID NO: 3112310 - protein, 4 aa, Giardia lamblia
GNAS

SEQ ID NO: 3112311 - protein, 6 aa, Giardia lamblia
GNATAA

SEQ ID NO: 3112312 - protein, 4 aa, Giardia lamblia
GNCN

SEQ ID NO: 3112313 - protein, 11 aa, Giardia lamblia
GNDAAQHSSEH

SEQ ID NO: 3112314 - protein, 8 aa, Giardia lamblia
GNDANSDH

SEQ ID NO: 3112315 - protein, 10 aa, Giardia lamblia
GNDDERTTYE

SEQ ID NO: 3112316 - protein, 5 aa, Giardia lamblia
GNDDG

SEQ ID NO: 3112317 - protein, 5 aa, Giardia lamblia
GNDFE

SEQ ID NO: 3112318 - protein, 6 aa, Giardia lamblia
GNDGLT

SEQ ID NO: 3112319 - protein, 25 aa, Giardia lamblia
GNDHHSPMTGGDVDAPLSQEQCSEE

SEQ ID NO: 3112320 - protein, 5 aa, Giardia lamblia
GNDKA

SEQ ID NO: 3112321 - protein, 7 aa, Giardia lamblia
GNDNGEV

SEQ ID NO: 3112322 - protein, 8 aa, Giardia lamblia
GNDNMQSG

SEQ ID NO: 3112323 - protein, 7 aa, Giardia lamblia
GNDPDRI

SEQ ID NO: 3112324 - protein, 6 aa, Giardia lamblia
GNDPQD

SEQ ID NO: 3112325 - protein, 9 aa, Giardia lamblia
GNDPQGEDI

SEQ ID NO: 3112326 - protein, 5 aa, Giardia lamblia
GNDQP

SEQ ID NO: 3112327 - protein, 4 aa, Giardia lamblia
GNEA

SEQ ID NO: 3112328 - protein, 5 aa, Giardia lamblia
GNEAA

SEQ ID NO: 3112329 - protein, 42 aa, Giardia lamblia
GNEDAGTAKKPATKVSATTKGKAKLKGASGAAKEKPAAKDQL

SEQ ID NO: 3112330 - protein, 16 aa, Giardia lamblia
GNEEDIRSTFQKETAD

SEQ ID NO: 3112331 - protein, 10 aa, Giardia lamblia
GNEETTSGHA

SEQ ID NO: 3112332 - protein, 4 aa, Giardia lamblia
GNEK

SEQ ID NO: 3112333 - protein, 4 aa, Giardia lamblia
GNEN

SEQ ID NO: 3112334 - protein, 4 aa, Giardia lamblia
GNEP

SEQ ID NO: 3112335 - protein, 9 aa, Giardia lamblia
GNEPGQGTA

SEQ ID NO: 3112336 - protein, 24 aa, Giardia lamblia
GNEPNNDNVESDDLSASIDTDETD

SEQ ID NO: 3112337 - protein, 5 aa, Giardia lamblia
GNEQS

SEQ ID NO: 3112338 - protein, 4 aa, Giardia lamblia
GNEV

SEQ ID NO: 3112339 - protein, 4 aa, Giardia lamblia
GNFD

SEQ ID NO: 3112340 - protein, 5 aa, Giardia lamblia
GNFDD

SEQ ID NO: 3112341 - protein, 4 aa, Giardia lamblia
GNFK

SEQ ID NO: 3112342 - protein, 11 aa, Giardia lamblia
GNFRPPSGVDV

SEQ ID NO: 3112343 - protein, 6 aa, Giardia lamblia
GNGGQH

SEQ ID NO: 3112344 - protein, 9 aa, Giardia lamblia
GNGGQPEAV

SEQ ID NO: 3112345 - protein, 8 aa, Giardia lamblia
GNGKVAGQ

SEQ ID NO: 3112346 - protein, 6 aa, Giardia lamblia
GNGLDN

SEQ ID NO: 3112347 - protein, 9 aa, Giardia lamblia
GNGLQDRNG

SEQ ID NO: 3112348 - protein, 8 aa, Giardia lamblia
GNGNAKDK

SEQ ID NO: 3112349 - protein, 10 aa, Giardia lamblia
GNGQAATEAI

SEQ ID NO: 3112350 - protein, 4 aa, Giardia lamblia
GNGS

SEQ ID NO: 3112351 - protein, 11 aa, Giardia lamblia
GNGSATDFESS

SEQ ID NO: 3112352 - protein, 4 aa, Giardia lamblia
GNGT

SEQ ID NO: 3112353 - protein, 15 aa, Giardia lamblia
GNGTGLQAKDPHTYP

SEQ ID NO: 3112354 - protein, 18 aa, Giardia lamblia
GNHGPEKHRAKGMSNKGI

SEQ ID NO: 3112355 - protein, 13 aa, Giardia lamblia
GNIDPEALQEDNY

SEQ ID NO: 3112356 - protein, 5 aa, Giardia lamblia
GNISE

SEQ ID NO: 3112357 - protein, 17 aa, Giardia lamblia
GNISRTKGAAARARQAA

SEQ ID NO: 3112358 - protein, 4 aa, Giardia lamblia
GNIT

SEQ ID NO: 3112359 - protein, 21 aa, Giardia lamblia
GNITDTNGRTAQDWASTAGHE

SEQ ID NO: 3112360 - protein, 6 aa, Giardia lamblia
GNITGE

SEQ ID NO: 3112361 - protein, 25 aa, Giardia lamblia
GNKAPVAANPSGGCCDNGGCKCGPS

SEQ ID NO: 3112362 - protein, 6 aa, Giardia lamblia
GNKESV

SEQ ID NO: 3112363 - protein, 8 aa, Giardia lamblia
GNKNAARA

SEQ ID NO: 3112364 - protein, 4 aa, Giardia lamblia
GNKR

SEQ ID NO: 3112365 - protein, 6 aa, Giardia lamblia
GNKTND

SEQ ID NO: 3112366 - protein, 14 aa, Giardia lamblia
GNKTTRIDGSALGG

SEQ ID NO: 3112367 - protein, 4 aa, Giardia lamblia
GNKV

SEQ ID NO: 3112368 - protein, 4 aa, Giardia lamblia
GNLA

SEQ ID NO: 3112369 - protein, 9 aa, Giardia lamblia
GNLSNSPQS

SEQ ID NO: 3112370 - protein, 8 aa, Giardia lamblia
GNLSSKQW

SEQ ID NO: 3112371 - protein, 9 aa, Giardia lamblia
GNMNNEGHS

SEQ ID NO: 3112372 - protein, 11 aa, Giardia lamblia
GNMSKRDYKTY

SEQ ID NO: 3112373 - protein, 6 aa, Giardia lamblia
GNMTDS

SEQ ID NO: 3112374 - protein, 20 aa, Giardia lamblia
GNNARASARGDPSKPRPSEQ

SEQ ID NO: 3112375 - protein, 4 aa, Giardia lamblia
GNNC

SEQ ID NO: 3112376 - protein, 14 aa, Giardia lamblia
GNNERAAELATSQA

SEQ ID NO: 3112377 - protein, 11 aa, Giardia lamblia
GNNGRDSRSQL

SEQ ID NO: 3112378 - protein, 4 aa, Giardia lamblia
GNNH

SEQ ID NO: 3112379 - protein, 9 aa, Giardia lamblia
GNNIGQRPT

SEQ ID NO: 3112380 - protein, 14 aa, Giardia lamblia
GNNITSDSATSRGS

SEQ ID NO: 3112381 - protein, 7 aa, Giardia lamblia
GNNPSNF

SEQ ID NO: 3112382 - protein, 8 aa, Giardia lamblia
GNNSAVSQ

SEQ ID NO: 3112383 - protein, 4 aa, Giardia lamblia
GNNT

SEQ ID NO: 3112384 - protein, 15 aa, Giardia lamblia
GNNTGEWGKIPGTSF

SEQ ID NO: 3112385 - protein, 4 aa, Giardia lamblia
GNPA

SEQ ID NO: 3112386 - protein, 15 aa, Giardia lamblia
GNPAPTDIRPTTPQI

SEQ ID NO: 3112387 - protein, 10 aa, Giardia lamblia
GNPCDGRHPE

SEQ ID NO: 3112388 - protein, 12 aa, Giardia lamblia
GNPCTRENKGEI

SEQ ID NO: 3112389 - protein, 4 aa, Giardia lamblia
GNPD

SEQ ID NO: 3112390 - protein, 25 aa, Giardia lamblia
GNPFAKKQAQQASGAPGAGHAPSAD

SEQ ID NO: 3112391 - protein, 21 aa, Giardia lamblia
GNPIQRDADPAVPDEADQGAT

SEQ ID NO: 3112392 - protein, 9 aa, Giardia lamblia
GNPKAEQLT

SEQ ID NO: 3112393 - protein, 13 aa, Giardia lamblia
GNPKSVTAWPPPL

SEQ ID NO: 3112394 - protein, 4 aa, Giardia lamblia
GNPL

SEQ ID NO: 3112395 - protein, 10 aa, Giardia lamblia
GNPQGVGQKP

SEQ ID NO: 3112396 - protein, 5 aa, Giardia lamblia
GNPRR

SEQ ID NO: 3112397 - protein, 12 aa, Giardia lamblia
GNPSNRNNLPDL

SEQ ID NO: 3112398 - protein, 9 aa, Giardia lamblia
GNPSNYSTG

SEQ ID NO: 3112399 - protein, 10 aa, Giardia lamblia
GNPSSHQKPS

SEQ ID NO: 3112400 - protein, 5 aa, Giardia lamblia
GNPSY

SEQ ID NO: 3112401 - protein, 5 aa, Giardia lamblia
GNPVF

SEQ ID NO: 3112402 - protein, 144 aa, Giardia lamblia
GNPYGGPPQMSSGGPYGAGAPQAGPGPYGSSMPSANAGPYGAPAGPYGAQAQGASGPYGASQAAPQPASGPYGSTAPGYGASAQPYGAAASTAGVGPYGAGAPSMGGSGVGGPGPYANPGGPYGSSGQPPAGLYGSGAQPGMMG

SEQ ID NO: 3112403 - protein, 6 aa, Giardia lamblia
GNPYGI

SEQ ID NO: 3112404 - protein, 13 aa, Giardia lamblia
GNQGVSGDSTKHT

SEQ ID NO: 3112405 - protein, 4 aa, Giardia lamblia
GNQK

SEQ ID NO: 3112406 - protein, 6 aa, Giardia lamblia
GNQKAE

SEQ ID NO: 3112407 - protein, 6 aa, Giardia lamblia
GNQRPN

SEQ ID NO: 3112408 - protein, 18 aa, Giardia lamblia
GNQSRIKAEDYKHSQYTD

SEQ ID NO: 3112409 - protein, 5 aa, Giardia lamblia
GNQTS

SEQ ID NO: 3112410 - protein, 12 aa, Giardia lamblia
GNRAESKGEVEK

SEQ ID NO: 3112411 - protein, 4 aa, Giardia lamblia
GNRD

SEQ ID NO: 3112412 - protein, 10 aa, Giardia lamblia
GNRDKAEGLR

SEQ ID NO: 3112413 - protein, 7 aa, Giardia lamblia
GNRDPDI

SEQ ID NO: 3112414 - protein, 6 aa, Giardia lamblia
GNRDPK

SEQ ID NO: 3112415 - protein, 4 aa, Giardia lamblia
GNRE

SEQ ID NO: 3112416 - protein, 5 aa, Giardia lamblia
GNREV

SEQ ID NO: 3112417 - protein, 4 aa, Giardia lamblia
GNRL

SEQ ID NO: 3112418 - protein, 8 aa, Giardia lamblia
GNRRMTPK

SEQ ID NO: 3112419 - protein, 11 aa, Giardia lamblia
GNRSTSDRVEL

SEQ ID NO: 3112420 - protein, 11 aa, Giardia lamblia
GNRVPAQFSGE

SEQ ID NO: 3112421 - protein, 6 aa, Giardia lamblia
GNSDGY

SEQ ID NO: 3112422 - protein, 4 aa, Giardia lamblia
GNSE

SEQ ID NO: 3112423 - protein, 8 aa, Giardia lamblia
GNSETRAD

SEQ ID NO: 3112424 - protein, 17 aa, Giardia lamblia
GNSGARNELSTSKRPYN

SEQ ID NO: 3112425 - protein, 9 aa, Giardia lamblia
GNSGPGRSL

SEQ ID NO: 3112426 - protein, 7 aa, Giardia lamblia
GNSGSTF

SEQ ID NO: 3112427 - protein, 6 aa, Giardia lamblia
GNSHPY

SEQ ID NO: 3112428 - protein, 6 aa, Giardia lamblia
GNSHST

SEQ ID NO: 3112429 - protein, 8 aa, Giardia lamblia
GNSIETDG

SEQ ID NO: 3112430 - protein, 8 aa, Giardia lamblia
GNSKLEEI

SEQ ID NO: 3112431 - protein, 8 aa, Giardia lamblia
GNSNVAEA

SEQ ID NO: 3112432 - protein, 17 aa, Giardia lamblia
GNSPDVQERDSALANKN

SEQ ID NO: 3112433 - protein, 5 aa, Giardia lamblia
GNSPE

SEQ ID NO: 3112434 - protein, 5 aa, Giardia lamblia
GNSPY

SEQ ID NO: 3112435 - protein, 5 aa, Giardia lamblia
GNSQS

SEQ ID NO: 3112436 - protein, 12 aa, Giardia lamblia
GNSRNPAGQSPL

SEQ ID NO: 3112437 - protein, 9 aa, Giardia lamblia
GNSVRSTEL

SEQ ID NO: 3112438 - protein, 4 aa, Giardia lamblia
GNTA

SEQ ID NO: 3112439 - protein, 5 aa, Giardia lamblia
GNTDS

SEQ ID NO: 3112440 - protein, 4 aa, Giardia lamblia
GNTE

SEQ ID NO: 3112441 - protein, 5 aa, Giardia lamblia
GNTEA

SEQ ID NO: 3112442 - protein, 18 aa, Giardia lamblia
GNTEETGHNHQEPGCSDR

SEQ ID NO: 3112443 - protein, 18 aa, Giardia lamblia
GNTEHAPMEASGDPYDPA

SEQ ID NO: 3112444 - protein, 8 aa, Giardia lamblia
GNTGGDGY

SEQ ID NO: 3112445 - protein, 7 aa, Giardia lamblia
GNTGTVY

SEQ ID NO: 3112446 - protein, 4 aa, Giardia lamblia
GNTN

SEQ ID NO: 3112447 - protein, 4 aa, Giardia lamblia
GNTP

SEQ ID NO: 3112448 - protein, 19 aa, Giardia lamblia
GNTQSPGLQLEDQSAEVTY

SEQ ID NO: 3112449 - protein, 4 aa, Giardia lamblia
GNTR

SEQ ID NO: 3112450 - protein, 18 aa, Giardia lamblia
GNTSAKEGELTEYTTGQY

SEQ ID NO: 3112451 - protein, 11 aa, Giardia lamblia
GNVASSADDLR

SEQ ID NO: 3112452 - protein, 7 aa, Giardia lamblia
GNVEGKI

SEQ ID NO: 3112453 - protein, 14 aa, Giardia lamblia
GNVESGDDLRQSTT

SEQ ID NO: 3112454 - protein, 5 aa, Giardia lamblia
GNVGA

SEQ ID NO: 3112455 - protein, 4 aa, Giardia lamblia
GNVK

SEQ ID NO: 3112456 - protein, 7 aa, Giardia lamblia
GNVKENY

SEQ ID NO: 3112457 - protein, 4 aa, Giardia lamblia
GNVN

SEQ ID NO: 3112458 - protein, 4 aa, Giardia lamblia
GNVS

SEQ ID NO: 3112459 - protein, 7 aa, Giardia lamblia
GNVSKDE

SEQ ID NO: 3112460 - protein, 4 aa, Giardia lamblia
GNVT

SEQ ID NO: 3112461 - protein, 4 aa, Giardia lamblia
GNYE

SEQ ID NO: 3112462 - protein, 9 aa, Giardia lamblia
GNYEDSSGY

SEQ ID NO: 3112463 - protein, 4 aa, Giardia lamblia
GNYN

SEQ ID NO: 3112464 - protein, 11 aa, Giardia lamblia
GPAAGTAGTLA

SEQ ID NO: 3112465 - protein, 7 aa, Giardia lamblia
GPAEDSN

SEQ ID NO: 3112466 - protein, 14 aa, Giardia lamblia
GPAESRERIEGGEA

SEQ ID NO: 3112467 - protein, 8 aa, Giardia lamblia
GPAGTGKT

SEQ ID NO: 3112468 - protein, 5 aa, Giardia lamblia
GPAGY

SEQ ID NO: 3112469 - protein, 16 aa, Giardia lamblia
GPAHSQPGGFKTDAPF

SEQ ID NO: 3112470 - protein, 4 aa, Giardia lamblia
GPAI

SEQ ID NO: 3112471 - protein, 12 aa, Giardia lamblia
GPAKASNAGGVS

SEQ ID NO: 3112472 - protein, 11 aa, Giardia lamblia
GPAKVNPADHT

SEQ ID NO: 3112473 - protein, 12 aa, Giardia lamblia
GPAPGADSNQGE

SEQ ID NO: 3112474 - protein, 13 aa, Giardia lamblia
GPAPRAKLNQQRS

SEQ ID NO: 3112475 - protein, 11 aa, Giardia lamblia
GPAQSSPPVVG

SEQ ID NO: 3112476 - protein, 8 aa, Giardia lamblia
GPASDMTT

SEQ ID NO: 3112477 - protein, 6 aa, Giardia lamblia
GPASNE

SEQ ID NO: 3112478 - protein, 19 aa, Giardia lamblia
GPASSGKSFTIEGNPDENC

SEQ ID NO: 3112479 - protein, 37 aa, Giardia lamblia
GPCSTSSSTVAAPQAPPPTAEEAKKASGQEEGTSSSF

SEQ ID NO: 3112480 - protein, 9 aa, Giardia lamblia
GPCTAGPGT

SEQ ID NO: 3112481 - protein, 5 aa, Giardia lamblia
GPDAE

SEQ ID NO: 3112482 - protein, 9 aa, Giardia lamblia
GPDDLKQRA

SEQ ID NO: 3112483 - protein, 13 aa, Giardia lamblia
GPDGSVAASGQPR

SEQ ID NO: 3112484 - protein, 5 aa, Giardia lamblia
GPDLD

SEQ ID NO: 3112485 - protein, 10 aa, Giardia lamblia
GPDNMRNSTT

SEQ ID NO: 3112486 - protein, 4 aa, Giardia lamblia
GPDQ

SEQ ID NO: 3112487 - protein, 10 aa, Giardia lamblia
GPDSASRIDH

SEQ ID NO: 3112488 - protein, 5 aa, Giardia lamblia
GPDSR

SEQ ID NO: 3112489 - protein, 12 aa, Giardia lamblia
GPEDAEVCPQSD

SEQ ID NO: 3112490 - protein, 8 aa, Giardia lamblia
GPEDLKKS

SEQ ID NO: 3112491 - protein, 5 aa, Giardia lamblia
GPEFP

SEQ ID NO: 3112492 - protein, 5 aa, Giardia lamblia
GPEIP

SEQ ID NO: 3112493 - protein, 12 aa, Giardia lamblia
GPEKAMNQERRS

SEQ ID NO: 3112494 - protein, 12 aa, Giardia lamblia
GPESMDTAESKS

SEQ ID NO: 3112495 - protein, 11 aa, Giardia lamblia
GPESSQEDVSA

SEQ ID NO: 3112496 - protein, 4 aa, Giardia lamblia
GPEV

SEQ ID NO: 3112497 - protein, 5 aa, Giardia lamblia
GPFPE

SEQ ID NO: 3112498 - protein, 8 aa, Giardia lamblia
GPFSSDTA

SEQ ID NO: 3112499 - protein, 6 aa, Giardia lamblia
GPGAYN

SEQ ID NO: 3112500 - protein, 6 aa, Giardia lamblia
GPGCGA

SEQ ID NO: 3112501 - protein, 4 aa, Giardia lamblia
GPGE

SEQ ID NO: 3112502 - protein, 13 aa, Giardia lamblia
GPGESDVTIPGTD

SEQ ID NO: 3112503 - protein, 19 aa, Giardia lamblia
GPGFTKAGRTPLPLAPDED

SEQ ID NO: 3112504 - protein, 6 aa, Giardia lamblia
GPGGAG

SEQ ID NO: 3112505 - protein, 6 aa, Giardia lamblia
GPGGRR

SEQ ID NO: 3112506 - protein, 5 aa, Giardia lamblia
GPGGY

SEQ ID NO: 3112507 - protein, 5 aa, Giardia lamblia
GPGKA

SEQ ID NO: 3112508 - protein, 7 aa, Giardia lamblia
GPGLGKT

SEQ ID NO: 3112509 - protein, 8 aa, Giardia lamblia
GPGPASVN

SEQ ID NO: 3112510 - protein, 14 aa, Giardia lamblia
GPGPEITRQTSTQH

SEQ ID NO: 3112511 - protein, 5 aa, Giardia lamblia
GPGPR

SEQ ID NO: 3112512 - protein, 26 aa, Giardia lamblia
GPGRSVQQPESSPKTISSTSRAPTIS

SEQ ID NO: 3112513 - protein, 8 aa, Giardia lamblia
GPGSEQFI

SEQ ID NO: 3112514 - protein, 31 aa, Giardia lamblia
GPGSVGHQHPSYKPPTKQQAPVVTGPRSLQN

SEQ ID NO: 3112515 - protein, 5 aa, Giardia lamblia
GPHMG

SEQ ID NO: 3112516 - protein, 7 aa, Giardia lamblia
GPHYETQ

SEQ ID NO: 3112517 - protein, 4 aa, Giardia lamblia
GPIG

SEQ ID NO: 3112518 - protein, 8 aa, Giardia lamblia
GPIKPPYD

SEQ ID NO: 3112519 - protein, 11 aa, Giardia lamblia
GPINSQPLDDD

SEQ ID NO: 3112520 - protein, 12 aa, Giardia lamblia
GPISPDSLREQL

SEQ ID NO: 3112521 - protein, 11 aa, Giardia lamblia
GPITGKPNLAS

SEQ ID NO: 3112522 - protein, 4 aa, Giardia lamblia
GPKA

SEQ ID NO: 3112523 - protein, 4 aa, Giardia lamblia
GPKD

SEQ ID NO: 3112524 - protein, 7 aa, Giardia lamblia
GPKDTIY

SEQ ID NO: 3112525 - protein, 6 aa, Giardia lamblia
GPKEHG

SEQ ID NO: 3112526 - protein, 6 aa, Giardia lamblia
GPKGLR

SEQ ID NO: 3112527 - protein, 6 aa, Giardia lamblia
GPKPKS

SEQ ID NO: 3112528 - protein, 9 aa, Giardia lamblia
GPKQDRGDL

SEQ ID NO: 3112529 - protein, 9 aa, Giardia lamblia
GPKRPPTLK

SEQ ID NO: 3112530 - protein, 13 aa, Giardia lamblia
GPKRTLSRDSITG

SEQ ID NO: 3112531 - protein, 7 aa, Giardia lamblia
GPKRTRD

SEQ ID NO: 3112532 - protein, 9 aa, Giardia lamblia
GPKSDCGLT

SEQ ID NO: 3112533 - protein, 18 aa, Giardia lamblia
GPKSVSPREFKRQQEKQV

SEQ ID NO: 3112534 - protein, 4 aa, Giardia lamblia
GPKT

SEQ ID NO: 3112535 - protein, 8 aa, Giardia lamblia
GPKTRARR

SEQ ID NO: 3112536 - protein, 4 aa, Giardia lamblia
GPLD

SEQ ID NO: 3112537 - protein, 7 aa, Giardia lamblia
GPLDSRE

SEQ ID NO: 3112538 - protein, 6 aa, Giardia lamblia
GPLGNS

SEQ ID NO: 3112539 - protein, 7 aa, Giardia lamblia
GPLLGPA

SEQ ID NO: 3112540 - protein, 4 aa, Giardia lamblia
GPLP

SEQ ID NO: 3112541 - protein, 5 aa, Giardia lamblia
GPLTP

SEQ ID NO: 3112542 - protein, 22 aa, Giardia lamblia
GPMSDTASSGFSGFSGFSRPSS

SEQ ID NO: 3112543 - protein, 9 aa, Giardia lamblia
GPNAGGKTT

SEQ ID NO: 3112544 - protein, 6 aa, Giardia lamblia
GPNAQT

SEQ ID NO: 3112545 - protein, 8 aa, Giardia lamblia
GPNDHDDL

SEQ ID NO: 3112546 - protein, 4 aa, Giardia lamblia
GPNG

SEQ ID NO: 3112547 - protein, 9 aa, Giardia lamblia
GPNGAGKSS

SEQ ID NO: 3112548 - protein, 6 aa, Giardia lamblia
GPNGED

SEQ ID NO: 3112549 - protein, 12 aa, Giardia lamblia
GPNGTGGHSTDQ

SEQ ID NO: 3112550 - protein, 5 aa, Giardia lamblia
GPNHD

SEQ ID NO: 3112551 - protein, 7 aa, Giardia lamblia
GPNPGDG

SEQ ID NO: 3112552 - protein, 8 aa, Giardia lamblia
GPNPSGPY

SEQ ID NO: 3112553 - protein, 11 aa, Giardia lamblia
GPNSRTPYSTP

SEQ ID NO: 3112554 - protein, 7 aa, Giardia lamblia
GPNTGPG

SEQ ID NO: 3112555 - protein, 8 aa, Giardia lamblia
GPNTPKQY

SEQ ID NO: 3112556 - protein, 4 aa, Giardia lamblia
GPNV

SEQ ID NO: 3112557 - protein, 15 aa, Giardia lamblia
GPPDEQEAKDKALRN

SEQ ID NO: 3112558 - protein, 6 aa, Giardia lamblia
GPPGCA

SEQ ID NO: 3112559 - protein, 10 aa, Giardia lamblia
GPPGCGKTTI

SEQ ID NO: 3112560 - protein, 11 aa, Giardia lamblia
GPPGGGRQTIT

SEQ ID NO: 3112561 - protein, 7 aa, Giardia lamblia
GPPGSGK

SEQ ID NO: 3112562 - protein, 8 aa, Giardia lamblia
GPPGTGKS

SEQ ID NO: 3112563 - protein, 9 aa, Giardia lamblia
GPPGTGKTS

SEQ ID NO: 3112564 - protein, 6 aa, Giardia lamblia
GPPGTL

SEQ ID NO: 3112565 - protein, 6 aa, Giardia lamblia
GPPGTR

SEQ ID NO: 3112566 - protein, 6 aa, Giardia lamblia
GPPKDH

SEQ ID NO: 3112567 - protein, 20 aa, Giardia lamblia
GPPKPHAPDGFYPFKRIDTG

SEQ ID NO: 3112568 - protein, 7 aa, Giardia lamblia
GPPNPLA

SEQ ID NO: 3112569 - protein, 12 aa, Giardia lamblia
GPPPAPSASSLR

SEQ ID NO: 3112570 - protein, 6 aa, Giardia lamblia
GPPPGL

SEQ ID NO: 3112571 - protein, 5 aa, Giardia lamblia
GPPRT

SEQ ID NO: 3112572 - protein, 5 aa, Giardia lamblia
GPPYL

SEQ ID NO: 3112573 - protein, 8 aa, Giardia lamblia
GPQAESQN

SEQ ID NO: 3112574 - protein, 4 aa, Giardia lamblia
GPQL

SEQ ID NO: 3112575 - protein, 7 aa, Giardia lamblia
GPQLDEA

SEQ ID NO: 3112576 - protein, 19 aa, Giardia lamblia
GPQSGFPSDFGKSQTVEPD

SEQ ID NO: 3112577 - protein, 8 aa, Giardia lamblia
GPQSSGRK

SEQ ID NO: 3112578 - protein, 4 aa, Giardia lamblia
GPQV

SEQ ID NO: 3112579 - protein, 14 aa, Giardia lamblia
GPQYASQDRVTSST

SEQ ID NO: 3112580 - protein, 4 aa, Giardia lamblia
GPRC

SEQ ID NO: 3112581 - protein, 27 aa, Giardia lamblia
GPRDSQASVRLSSNTSLSTSSKLKQST

SEQ ID NO: 3112582 - protein, 4 aa, Giardia lamblia
GPRE

SEQ ID NO: 3112583 - protein, 8 aa, Giardia lamblia
GPREAAER

SEQ ID NO: 3112584 - protein, 29 aa, Giardia lamblia
GPRGLAASRHTRPEQRSRHRSCSAEYPKS

SEQ ID NO: 3112585 - protein, 7 aa, Giardia lamblia
GPRGSGK

SEQ ID NO: 3112586 - protein, 18 aa, Giardia lamblia
GPRHSSSPHAQPHTQSHV

SEQ ID NO: 3112587 - protein, 5 aa, Giardia lamblia
GPRIS

SEQ ID NO: 3112588 - protein, 5 aa, Giardia lamblia
GPRNS

SEQ ID NO: 3112589 - protein, 8 aa, Giardia lamblia
GPRPADNV

SEQ ID NO: 3112590 - protein, 6 aa, Giardia lamblia
GPRPGF

SEQ ID NO: 3112591 - protein, 10 aa, Giardia lamblia
GPRPPTDRPD

SEQ ID NO: 3112592 - protein, 11 aa, Giardia lamblia
GPRQDPSSPYT

SEQ ID NO: 3112593 - protein, 5 aa, Giardia lamblia
GPRSG

SEQ ID NO: 3112594 - protein, 9 aa, Giardia lamblia
GPSADGATY

SEQ ID NO: 3112595 - protein, 22 aa, Giardia lamblia
GPSAGKQEVKAQQGQGKPLFPP

SEQ ID NO: 3112596 - protein, 9 aa, Giardia lamblia
GPSAPANDA

SEQ ID NO: 3112597 - protein, 8 aa, Giardia lamblia
GPSATWNE

SEQ ID NO: 3112598 - protein, 9 aa, Giardia lamblia
GPSCNTEGS

SEQ ID NO: 3112599 - protein, 19 aa, Giardia lamblia
GPSESTPKDPDTDASAVAK

SEQ ID NO: 3112600 - protein, 9 aa, Giardia lamblia
GPSGSGKST

SEQ ID NO: 3112601 - protein, 8 aa, Giardia lamblia
GPSGTGKS

SEQ ID NO: 3112602 - protein, 19 aa, Giardia lamblia
GPSHPVASGKTDNVAEDPV

SEQ ID NO: 3112603 - protein, 9 aa, Giardia lamblia
GPSIPETRG

SEQ ID NO: 3112604 - protein, 6 aa, Giardia lamblia
GPSNIP

SEQ ID NO: 3112605 - protein, 4 aa, Giardia lamblia
GPSP

SEQ ID NO: 3112606 - protein, 5 aa, Giardia lamblia
GPSPK

SEQ ID NO: 3112607 - protein, 4 aa, Giardia lamblia
GPSS

SEQ ID NO: 3112608 - protein, 6 aa, Giardia lamblia
GPSSAL

SEQ ID NO: 3112609 - protein, 16 aa, Giardia lamblia
GPSSLGSTSANNTTYS

SEQ ID NO: 3112610 - protein, 6 aa, Giardia lamblia
GPSSSA

SEQ ID NO: 3112611 - protein, 10 aa, Giardia lamblia
GPSSSGKTTF

SEQ ID NO: 3112612 - protein, 12 aa, Giardia lamblia
GPSSSSKTTFSN

SEQ ID NO: 3112613 - protein, 9 aa, Giardia lamblia
GPSSTGKTA

SEQ ID NO: 3112614 - protein, 13 aa, Giardia lamblia
GPSSTQDNAYETI

SEQ ID NO: 3112615 - protein, 6 aa, Giardia lamblia
GPSSTS

SEQ ID NO: 3112616 - protein, 11 aa, Giardia lamblia
GPSSYNYDESY

SEQ ID NO: 3112617 - protein, 4 aa, Giardia lamblia
GPST

SEQ ID NO: 3112618 - protein, 7 aa, Giardia lamblia
GPSTTEL

SEQ ID NO: 3112619 - protein, 8 aa, Giardia lamblia
GPSTTQEE

SEQ ID NO: 3112620 - protein, 4 aa, Giardia lamblia
GPSY

SEQ ID NO: 3112621 - protein, 13 aa, Giardia lamblia
GPTDPSKCDPSKH

SEQ ID NO: 3112622 - protein, 22 aa, Giardia lamblia
GPTFNTTADRLRSGDHCGSKGY

SEQ ID NO: 3112623 - protein, 16 aa, Giardia lamblia
GPTIAPSNESNNTDIR

SEQ ID NO: 3112624 - protein, 13 aa, Giardia lamblia
GPTIKNPHSPQEA

SEQ ID NO: 3112625 - protein, 13 aa, Giardia lamblia
GPTLPKQLPGYPR

SEQ ID NO: 3112626 - protein, 17 aa, Giardia lamblia
GPTNQQRNIKSTPNPFS

SEQ ID NO: 3112627 - protein, 5 aa, Giardia lamblia
GPTSL

SEQ ID NO: 3112628 - protein, 16 aa, Giardia lamblia
GPTSTSAVLPSGSLSS

SEQ ID NO: 3112629 - protein, 4 aa, Giardia lamblia
GPTT

SEQ ID NO: 3112630 - protein, 7 aa, Giardia lamblia
GPTTGVK

SEQ ID NO: 3112631 - protein, 8 aa, Giardia lamblia
GPTTPSPL

SEQ ID NO: 3112632 - protein, 20 aa, Giardia lamblia
GPTVQPRSPLQERTKPDAPS

SEQ ID NO: 3112633 - protein, 6 aa, Giardia lamblia
GPVAGK

SEQ ID NO: 3112634 - protein, 20 aa, Giardia lamblia
GPVPPESCKAATPGKPIVFF

SEQ ID NO: 3112635 - protein, 14 aa, Giardia lamblia
GPVRASSTRSRPIP

SEQ ID NO: 3112636 - protein, 4 aa, Giardia lamblia
GPVS

SEQ ID NO: 3112637 - protein, 8 aa, Giardia lamblia
GPVSGQGM

SEQ ID NO: 3112638 - protein, 16 aa, Giardia lamblia
GPVSKVAQKSRAEQLS

SEQ ID NO: 3112639 - protein, 12 aa, Giardia lamblia
GPVSNLKPSQSF

SEQ ID NO: 3112640 - protein, 18 aa, Giardia lamblia
GPVSTAREGPPVASPPGS

SEQ ID NO: 3112641 - protein, 5 aa, Giardia lamblia
GPVTN

SEQ ID NO: 3112642 - protein, 23 aa, Giardia lamblia
GPYGAQGQMGMGGPAPGYEQTRI

SEQ ID NO: 3112643 - protein, 4 aa, Giardia lamblia
GPYK

SEQ ID NO: 3112644 - protein, 14 aa, Giardia lamblia
GPYPEVYSSDRRDN

SEQ ID NO: 3112645 - protein, 4 aa, Giardia lamblia
GPYQ

SEQ ID NO: 3112646 - protein, 7 aa, Giardia lamblia
GPYSGYS

SEQ ID NO: 3112647 - protein, 9 aa, Giardia lamblia
GPYSPAKES

SEQ ID NO: 3112648 - protein, 9 aa, Giardia lamblia
GPYSPAVKT

SEQ ID NO: 3112649 - protein, 7 aa, Giardia lamblia
GPYSSTS

SEQ ID NO: 3112650 - protein, 10 aa, Giardia lamblia
GPYTETPEPT

SEQ ID NO: 3112651 - protein, 6 aa, Giardia lamblia
GQADDD

SEQ ID NO: 3112652 - protein, 8 aa, Giardia lamblia
GQADEDGW

SEQ ID NO: 3112653 - protein, 9 aa, Giardia lamblia
GQADSVDSV

SEQ ID NO: 3112654 - protein, 9 aa, Giardia lamblia
GQAGITKAS

SEQ ID NO: 3112655 - protein, 12 aa, Giardia lamblia
GQAGKKDVEGKT

SEQ ID NO: 3112656 - protein, 6 aa, Giardia lamblia
GQALQG

SEQ ID NO: 3112657 - protein, 21 aa, Giardia lamblia
GQALQGKGPTPTASSRAHQLP

SEQ ID NO: 3112658 - protein, 12 aa, Giardia lamblia
GQALQGKGTYSN

SEQ ID NO: 3112659 - protein, 8 aa, Giardia lamblia
GQANTEGV

SEQ ID NO: 3112660 - protein, 4 aa, Giardia lamblia
GQAP

SEQ ID NO: 3112661 - protein, 8 aa, Giardia lamblia
GQAPAQGW

SEQ ID NO: 3112662 - protein, 7 aa, Giardia lamblia
GQAQDQV

SEQ ID NO: 3112663 - protein, 5 aa, Giardia lamblia
GQASE

SEQ ID NO: 3112664 - protein, 7 aa, Giardia lamblia
GQATEEL

SEQ ID NO: 3112665 - protein, 20 aa, Giardia lamblia
GQATPDITSATKDDTPSLPS

SEQ ID NO: 3112666 - protein, 12 aa, Giardia lamblia
GQATRLGASVPK

SEQ ID NO: 3112667 - protein, 5 aa, Giardia lamblia
GQDDL

SEQ ID NO: 3112668 - protein, 4 aa, Giardia lamblia
GQDF

SEQ ID NO: 3112669 - protein, 9 aa, Giardia lamblia
GQDGSKYAN

SEQ ID NO: 3112670 - protein, 8 aa, Giardia lamblia
GQDKTNID

SEQ ID NO: 3112671 - protein, 7 aa, Giardia lamblia
GQDPSFS

SEQ ID NO: 3112672 - protein, 28 aa, Giardia lamblia
GQDPTSTIPNSTPITINPGQEKAANKAI

SEQ ID NO: 3112673 - protein, 5 aa, Giardia lamblia
GQDSI

SEQ ID NO: 3112674 - protein, 6 aa, Giardia lamblia
GQDTRA

SEQ ID NO: 3112675 - protein, 15 aa, Giardia lamblia
GQDVRTQQKTANNAM

SEQ ID NO: 3112676 - protein, 7 aa, Giardia lamblia
GQDYGPA

SEQ ID NO: 3112677 - protein, 8 aa, Giardia lamblia
GQEALPDS

SEQ ID NO: 3112678 - protein, 9 aa, Giardia lamblia
GQEANKRES

SEQ ID NO: 3112679 - protein, 9 aa, Giardia lamblia
GQEARKASA

SEQ ID NO: 3112680 - protein, 7 aa, Giardia lamblia
GQEEPYN

SEQ ID NO: 3112681 - protein, 4 aa, Giardia lamblia
GQEF

SEQ ID NO: 3112682 - protein, 4 aa, Giardia lamblia
GQES

SEQ ID NO: 3112683 - protein, 21 aa, Giardia lamblia
GQESKVSPSGKVYKAPNPEMS

SEQ ID NO: 3112684 - protein, 22 aa, Giardia lamblia
GQESQLNAKASNSLGTHEPSQY

SEQ ID NO: 3112685 - protein, 5 aa, Giardia lamblia
GQESS

SEQ ID NO: 3112686 - protein, 17 aa, Giardia lamblia
GQETFSEEGKESATHTT

SEQ ID NO: 3112687 - protein, 7 aa, Giardia lamblia
GQETHGH

SEQ ID NO: 3112688 - protein, 6 aa, Giardia lamblia
GQEYNE

SEQ ID NO: 3112689 - protein, 4 aa, Giardia lamblia
GQFE

SEQ ID NO: 3112690 - protein, 4 aa, Giardia lamblia
GQGC

SEQ ID NO: 3112691 - protein, 7 aa, Giardia lamblia
GQGDDAV

SEQ ID NO: 3112692 - protein, 27 aa, Giardia lamblia
GQGDTPAQAASKKKKLSSTTAEKSMTV

SEQ ID NO: 3112693 - protein, 17 aa, Giardia lamblia
GQGGDTQPKSNSYNIST

SEQ ID NO: 3112694 - protein, 6 aa, Giardia lamblia
GQGGFG

SEQ ID NO: 3112695 - protein, 4 aa, Giardia lamblia
GQGK

SEQ ID NO: 3112696 - protein, 5 aa, Giardia lamblia
GQGPF

SEQ ID NO: 3112697 - protein, 5 aa, Giardia lamblia
GQGQG

SEQ ID NO: 3112698 - protein, 4 aa, Giardia lamblia
GQGR

SEQ ID NO: 3112699 - protein, 6 aa, Giardia lamblia
GQGRPL

SEQ ID NO: 3112700 - protein, 8 aa, Giardia lamblia
GQGSGANV

SEQ ID NO: 3112701 - protein, 6 aa, Giardia lamblia
GQGSYG

SEQ ID NO: 3112702 - protein, 11 aa, Giardia lamblia
GQGVSQPQQTF

SEQ ID NO: 3112703 - protein, 4 aa, Giardia lamblia
GQIK

SEQ ID NO: 3112704 - protein, 5 aa, Giardia lamblia
GQIPP

SEQ ID NO: 3112705 - protein, 6 aa, Giardia lamblia
GQITKA

SEQ ID NO: 3112706 - protein, 14 aa, Giardia lamblia
GQITPDKIATERDS

SEQ ID NO: 3112707 - protein, 9 aa, Giardia lamblia
GQKELSNED

SEQ ID NO: 3112708 - protein, 8 aa, Giardia lamblia
GQKENNNI

SEQ ID NO: 3112709 - protein, 7 aa, Giardia lamblia
GQKPGTY

SEQ ID NO: 3112710 - protein, 4 aa, Giardia lamblia
GQKQ

SEQ ID NO: 3112711 - protein, 8 aa, Giardia lamblia
GQKRGLGT

SEQ ID NO: 3112712 - protein, 5 aa, Giardia lamblia
GQKYI

SEQ ID NO: 3112713 - protein, 5 aa, Giardia lamblia
GQLDS

SEQ ID NO: 3112714 - protein, 8 aa, Giardia lamblia
GQLEQDEA

SEQ ID NO: 3112715 - protein, 5 aa, Giardia lamblia
GQLET

SEQ ID NO: 3112716 - protein, 18 aa, Giardia lamblia
GQLGNSMTASAVNSPGMI

SEQ ID NO: 3112717 - protein, 6 aa, Giardia lamblia
GQLPEK

SEQ ID NO: 3112718 - protein, 13 aa, Giardia lamblia
GQLPRPITRPATR

SEQ ID NO: 3112719 - protein, 27 aa, Giardia lamblia
GQLSDDFEREDGGINPDQANSGPQCAA

SEQ ID NO: 3112720 - protein, 10 aa, Giardia lamblia
GQLSPQSVSD

SEQ ID NO: 3112721 - protein, 9 aa, Giardia lamblia
GQLTQAEQE

SEQ ID NO: 3112722 - protein, 5 aa, Giardia lamblia
GQNAD

SEQ ID NO: 3112723 - protein, 8 aa, Giardia lamblia
GQNAEAEL

SEQ ID NO: 3112724 - protein, 16 aa, Giardia lamblia
GQNGEVNNTGIPTTTA

SEQ ID NO: 3112725 - protein, 8 aa, Giardia lamblia
GQNPTEAD

SEQ ID NO: 3112726 - protein, 6 aa, Giardia lamblia
GQNSEI

SEQ ID NO: 3112727 - protein, 9 aa, Giardia lamblia
GQPADPNSC

SEQ ID NO: 3112728 - protein, 5 aa, Giardia lamblia
GQPEP

SEQ ID NO: 3112729 - protein, 7 aa, Giardia lamblia
GQPGSDG

SEQ ID NO: 3112730 - protein, 10 aa, Giardia lamblia
GQPIKSDKMD

SEQ ID NO: 3112731 - protein, 5 aa, Giardia lamblia
GQPSI

SEQ ID NO: 3112732 - protein, 8 aa, Giardia lamblia
GQPSIPSQ

SEQ ID NO: 3112733 - protein, 5 aa, Giardia lamblia
GQPVG

SEQ ID NO: 3112734 - protein, 7 aa, Giardia lamblia
GQQDYSG

SEQ ID NO: 3112735 - protein, 5 aa, Giardia lamblia
GQQED

SEQ ID NO: 3112736 - protein, 24 aa, Giardia lamblia
GQQGAATASAPGGLNNTPTPAPAV

SEQ ID NO: 3112737 - protein, 12 aa, Giardia lamblia
GQQNGNSEDPAT

SEQ ID NO: 3112738 - protein, 6 aa, Giardia lamblia
GQQPPE

SEQ ID NO: 3112739 - protein, 22 aa, Giardia lamblia
GQQPTQQNPFQNTQGNSLSSTF

SEQ ID NO: 3112740 - protein, 4 aa, Giardia lamblia
GQQQ

SEQ ID NO: 3112741 - protein, 6 aa, Giardia lamblia
GQQRLS

SEQ ID NO: 3112742 - protein, 9 aa, Giardia lamblia
GQQSTPASD

SEQ ID NO: 3112743 - protein, 5 aa, Giardia lamblia
GQQTI

SEQ ID NO: 3112744 - protein, 6 aa, Giardia lamblia
GQRADR

SEQ ID NO: 3112745 - protein, 4 aa, Giardia lamblia
GQRD

SEQ ID NO: 3112746 - protein, 7 aa, Giardia lamblia
GQRDEKK

SEQ ID NO: 3112747 - protein, 5 aa, Giardia lamblia
GQRDI

SEQ ID NO: 3112748 - protein, 11 aa, Giardia lamblia
GQRGAARAYDK

SEQ ID NO: 3112749 - protein, 9 aa, Giardia lamblia
GQRGSGSDF

SEQ ID NO: 3112750 - protein, 8 aa, Giardia lamblia
GQRPSVGS

SEQ ID NO: 3112751 - protein, 6 aa, Giardia lamblia
GQRQEI

SEQ ID NO: 3112752 - protein, 19 aa, Giardia lamblia
GQRSRANKRLSKRATFRQG

SEQ ID NO: 3112753 - protein, 7 aa, Giardia lamblia
GQRTSNR

SEQ ID NO: 3112754 - protein, 18 aa, Giardia lamblia
GQRYSNTDKSLGSAVSGA

SEQ ID NO: 3112755 - protein, 4 aa, Giardia lamblia
GQSD

SEQ ID NO: 3112756 - protein, 9 aa, Giardia lamblia
GQSDPTPRL

SEQ ID NO: 3112757 - protein, 4 aa, Giardia lamblia
GQSE

SEQ ID NO: 3112758 - protein, 8 aa, Giardia lamblia
GQSFSSPS

SEQ ID NO: 3112759 - protein, 5 aa, Giardia lamblia
GQSGE

SEQ ID NO: 3112760 - protein, 14 aa, Giardia lamblia
GQSGEEGESERETQ

SEQ ID NO: 3112761 - protein, 10 aa, Giardia lamblia
GQSGLDPSPI

SEQ ID NO: 3112762 - protein, 5 aa, Giardia lamblia
GQSIG

SEQ ID NO: 3112763 - protein, 6 aa, Giardia lamblia
GQSKPV

SEQ ID NO: 3112764 - protein, 8 aa, Giardia lamblia
GQSKSRKG

SEQ ID NO: 3112765 - protein, 11 aa, Giardia lamblia
GQSLSSITGPL

SEQ ID NO: 3112766 - protein, 8 aa, Giardia lamblia
GQSPGSAP

SEQ ID NO: 3112767 - protein, 6 aa, Giardia lamblia
GQSPTL

SEQ ID NO: 3112768 - protein, 5 aa, Giardia lamblia
GQSRL

SEQ ID NO: 3112769 - protein, 4 aa, Giardia lamblia
GQSS

SEQ ID NO: 3112770 - protein, 11 aa, Giardia lamblia
GQSSGTAGVSA

SEQ ID NO: 3112771 - protein, 16 aa, Giardia lamblia
GQSSTNQSLQKEARDL

SEQ ID NO: 3112772 - protein, 5 aa, Giardia lamblia
GQSTE

SEQ ID NO: 3112773 - protein, 13 aa, Giardia lamblia
GQSTPRTTERSSL

SEQ ID NO: 3112774 - protein, 24 aa, Giardia lamblia
GQSTTRKNDSHEDGDADQIDYSTE

SEQ ID NO: 3112775 - protein, 6 aa, Giardia lamblia
GQSYPD

SEQ ID NO: 3112776 - protein, 7 aa, Giardia lamblia
GQSYTPL

SEQ ID NO: 3112777 - protein, 16 aa, Giardia lamblia
GQTETAGKRSTSQSNV

SEQ ID NO: 3112778 - protein, 11 aa, Giardia lamblia
GQTGAGKSYTI

SEQ ID NO: 3112779 - protein, 22 aa, Giardia lamblia
GQTGAGKTWTMGGNKEEPGAIP

SEQ ID NO: 3112780 - protein, 8 aa, Giardia lamblia
GQTGSGKS

SEQ ID NO: 3112781 - protein, 21 aa, Giardia lamblia
GQTGSGKSYTMTGGSGSYNDR

SEQ ID NO: 3112782 - protein, 10 aa, Giardia lamblia
GQTGSGKTHT

SEQ ID NO: 3112783 - protein, 10 aa, Giardia lamblia
GQTGTGKSFT

SEQ ID NO: 3112784 - protein, 9 aa, Giardia lamblia
GQTGTGKTS

SEQ ID NO: 3112785 - protein, 9 aa, Giardia lamblia
GQTGTGKTY

SEQ ID NO: 3112786 - protein, 4 aa, Giardia lamblia
GQTI

SEQ ID NO: 3112787 - protein, 14 aa, Giardia lamblia
GQTLDNPQKVEASM

SEQ ID NO: 3112788 - protein, 10 aa, Giardia lamblia
GQTNSGKTYT

SEQ ID NO: 3112789 - protein, 11 aa, Giardia lamblia
GQTPEGATVEP

SEQ ID NO: 3112790 - protein, 6 aa, Giardia lamblia
GQTPRI

SEQ ID NO: 3112791 - protein, 9 aa, Giardia lamblia
GQTPVTKTA

SEQ ID NO: 3112792 - protein, 9 aa, Giardia lamblia
GQTSSGKTV

SEQ ID NO: 3112793 - protein, 9 aa, Giardia lamblia
GQTSSGKTY

SEQ ID NO: 3112794 - protein, 7 aa, Giardia lamblia
GQTSSNS

SEQ ID NO: 3112795 - protein, 8 aa, Giardia lamblia
GQTTGGLG

SEQ ID NO: 3112796 - protein, 6 aa, Giardia lamblia
GQTTTL

SEQ ID NO: 3112797 - protein, 25 aa, Giardia lamblia
GQTYTGTTQQSNSFGTLGSQTTSMG

SEQ ID NO: 3112798 - protein, 14 aa, Giardia lamblia
GQVAASNDLDIMVE

SEQ ID NO: 3112799 - protein, 8 aa, Giardia lamblia
GQVDDHGN

SEQ ID NO: 3112800 - protein, 5 aa, Giardia lamblia
GQVEK

SEQ ID NO: 3112801 - protein, 7 aa, Giardia lamblia
GQVESSR

SEQ ID NO: 3112802 - protein, 6 aa, Giardia lamblia
GQVGMQ

SEQ ID NO: 3112803 - protein, 9 aa, Giardia lamblia
GQVNSDGET

SEQ ID NO: 3112804 - protein, 9 aa, Giardia lamblia
GQVPTPRAS

SEQ ID NO: 3112805 - protein, 13 aa, Giardia lamblia
GQVQESMTEQRAA

SEQ ID NO: 3112806 - protein, 8 aa, Giardia lamblia
GQVVDSTR

SEQ ID NO: 3112807 - protein, 7 aa, Giardia lamblia
GQYDKAT

SEQ ID NO: 3112808 - protein, 6 aa, Giardia lamblia
GQYEDA

SEQ ID NO: 3112809 - protein, 4 aa, Giardia lamblia
GQYR

SEQ ID NO: 3112810 - protein, 4 aa, Giardia lamblia
GQYS

SEQ ID NO: 3112811 - protein, 14 aa, Giardia lamblia
GQYTSSSADEGSAA

SEQ ID NO: 3112812 - protein, 10 aa, Giardia lamblia
GRADSNASIS

SEQ ID NO: 3112813 - protein, 4 aa, Giardia lamblia
GRAE

SEQ ID NO: 3112814 - protein, 7 aa, Giardia lamblia
GRAEEIA

SEQ ID NO: 3112815 - protein, 6 aa, Giardia lamblia
GRAETT

SEQ ID NO: 3112816 - protein, 9 aa, Giardia lamblia
GRAGDSDWQ

SEQ ID NO: 3112817 - protein, 7 aa, Giardia lamblia
GRAGTKE

SEQ ID NO: 3112818 - protein, 21 aa, Giardia lamblia
GRALPPDSEIQRDAGQQDKHG

SEQ ID NO: 3112819 - protein, 13 aa, Giardia lamblia
GRAMTNPDLASSL

SEQ ID NO: 3112820 - protein, 5 aa, Giardia lamblia
GRAPR

SEQ ID NO: 3112821 - protein, 17 aa, Giardia lamblia
GRARGPYRGEQKIEDSP

SEQ ID NO: 3112822 - protein, 4 aa, Giardia lamblia
GRAS

SEQ ID NO: 3112823 - protein, 12 aa, Giardia lamblia
GRASHRASLGSS

SEQ ID NO: 3112824 - protein, 7 aa, Giardia lamblia
GRASRPL

SEQ ID NO: 3112825 - protein, 8 aa, Giardia lamblia
GRATLDGR

SEQ ID NO: 3112826 - protein, 12 aa, Giardia lamblia
GRATPSALQPLP

SEQ ID NO: 3112827 - protein, 25 aa, Giardia lamblia
GRATSAKRDSNSAKLNTLPRDPPID

SEQ ID NO: 3112828 - protein, 13 aa, Giardia lamblia
GRATTNNTYPSEL

SEQ ID NO: 3112829 - protein, 17 aa, Giardia lamblia
GRAVPTDASMGTGRGSV

SEQ ID NO: 3112830 - protein, 6 aa, Giardia lamblia
GRCPEP

SEQ ID NO: 3112831 - protein, 7 aa, Giardia lamblia
GRCRKRN

SEQ ID NO: 3112832 - protein, 7 aa, Giardia lamblia
GRDAAKA

SEQ ID NO: 3112833 - protein, 9 aa, Giardia lamblia
GRDAENAVS

SEQ ID NO: 3112834 - protein, 8 aa, Giardia lamblia
GRDAQSNE

SEQ ID NO: 3112835 - protein, 8 aa, Giardia lamblia
GRDATDTV

SEQ ID NO: 3112836 - protein, 4 aa, Giardia lamblia
GRDG

SEQ ID NO: 3112837 - protein, 5 aa, Giardia lamblia
GRDGK

SEQ ID NO: 3112838 - protein, 83 aa, Giardia lamblia
GRDGPGGRGPGNDRRDSGRSFGDRRPERPDFKRGDGGRGFGDRRGSGPPGGPDRGDRRGPRDGPGGRGGPGGPGGGFKGGAKT

SEQ ID NO: 3112839 - protein, 4 aa, Giardia lamblia
GRDH

SEQ ID NO: 3112840 - protein, 21 aa, Giardia lamblia
GRDIGTPMTNTPTQNSSLQEQ

SEQ ID NO: 3112841 - protein, 9 aa, Giardia lamblia
GRDSNTCPP

SEQ ID NO: 3112842 - protein, 9 aa, Giardia lamblia
GRDTTVNRT

SEQ ID NO: 3112843 - protein, 5 aa, Giardia lamblia
GRDVT

SEQ ID NO: 3112844 - protein, 5 aa, Giardia lamblia
GREAD

SEQ ID NO: 3112845 - protein, 6 aa, Giardia lamblia
GREEAV

SEQ ID NO: 3112846 - protein, 7 aa, Giardia lamblia
GREEPVS

SEQ ID NO: 3112847 - protein, 11 aa, Giardia lamblia
GREETEERSSL

SEQ ID NO: 3112848 - protein, 7 aa, Giardia lamblia
GREGTIT

SEQ ID NO: 3112849 - protein, 5 aa, Giardia lamblia
GREGV

SEQ ID NO: 3112850 - protein, 7 aa, Giardia lamblia
GREINGA

SEQ ID NO: 3112851 - protein, 20 aa, Giardia lamblia
GREKSSRGKSFICDKKADQA

SEQ ID NO: 3112852 - protein, 17 aa, Giardia lamblia
GREKVGQKCTRLFSVIR

SEQ ID NO: 3112853 - protein, 8 aa, Giardia lamblia
GRELAPDE

SEQ ID NO: 3112854 - protein, 9 aa, Giardia lamblia
GRENPDTDE

SEQ ID NO: 3112855 - protein, 22 aa, Giardia lamblia
GREPLFGGDPSIQVGPGDYDTS

SEQ ID NO: 3112856 - protein, 6 aa, Giardia lamblia
GRESDA

SEQ ID NO: 3112857 - protein, 6 aa, Giardia lamblia
GRETDR

SEQ ID NO: 3112858 - protein, 8 aa, Giardia lamblia
GRETPSIV

SEQ ID NO: 3112859 - protein, 5 aa, Giardia lamblia
GRFGR

SEQ ID NO: 3112860 - protein, 22 aa, Giardia lamblia
GRFPELGEGAGERGKVVFTPLA

SEQ ID NO: 3112861 - protein, 6 aa, Giardia lamblia
GRFTRR

SEQ ID NO: 3112862 - protein, 7 aa, Giardia lamblia
GRGAEVR

SEQ ID NO: 3112863 - protein, 10 aa, Giardia lamblia
GRGASGAGLT

SEQ ID NO: 3112864 - protein, 9 aa, Giardia lamblia
GRGDNQNSV

SEQ ID NO: 3112865 - protein, 8 aa, Giardia lamblia
GRGDPIEQ

SEQ ID NO: 3112866 - protein, 6 aa, Giardia lamblia
GRGDTR

SEQ ID NO: 3112867 - protein, 4 aa, Giardia lamblia
GRGE

SEQ ID NO: 3112868 - protein, 12 aa, Giardia lamblia
GRGELADRQQKL

SEQ ID NO: 3112869 - protein, 13 aa, Giardia lamblia
GRGELADRQQKLG

SEQ ID NO: 3112870 - protein, 11 aa, Giardia lamblia
GRGESKSPAAV

SEQ ID NO: 3112871 - protein, 10 aa, Giardia lamblia
GRGETQPSAY

SEQ ID NO: 3112872 - protein, 8 aa, Giardia lamblia
GRGFSDRS

SEQ ID NO: 3112873 - protein, 6 aa, Giardia lamblia
GRGGDL

SEQ ID NO: 3112874 - protein, 21 aa, Giardia lamblia
GRGKSVRKDATTRSSSSFDAY

SEQ ID NO: 3112875 - protein, 9 aa, Giardia lamblia
GRGNESPTL

SEQ ID NO: 3112876 - protein, 6 aa, Giardia lamblia
GRGNNR

SEQ ID NO: 3112877 - protein, 9 aa, Giardia lamblia
GRGNSGDTK

SEQ ID NO: 3112878 - protein, 4 aa, Giardia lamblia
GRGP

SEQ ID NO: 3112879 - protein, 8 aa, Giardia lamblia
GRGPSSGA

SEQ ID NO: 3112880 - protein, 5 aa, Giardia lamblia
GRGPW

SEQ ID NO: 3112881 - protein, 4 aa, Giardia lamblia
GRGQ

SEQ ID NO: 3112882 - protein, 5 aa, Giardia lamblia
GRGQG

SEQ ID NO: 3112883 - protein, 6 aa, Giardia lamblia
GRGQPL

SEQ ID NO: 3112884 - protein, 5 aa, Giardia lamblia
GRGQS

SEQ ID NO: 3112885 - protein, 13 aa, Giardia lamblia
GRGRAPANDQTSM

SEQ ID NO: 3112886 - protein, 9 aa, Giardia lamblia
GRGSKDAAV

SEQ ID NO: 3112887 - protein, 13 aa, Giardia lamblia
GRGSNSGSEDQIY

SEQ ID NO: 3112888 - protein, 14 aa, Giardia lamblia
GRGSQAAQGLPSPI

SEQ ID NO: 3112889 - protein, 12 aa, Giardia lamblia
GRGTDSTTGDAL

SEQ ID NO: 3112890 - protein, 10 aa, Giardia lamblia
GRGTSTAEGF

SEQ ID NO: 3112891 - protein, 4 aa, Giardia lamblia
GRGY

SEQ ID NO: 3112892 - protein, 5 aa, Giardia lamblia
GRGYT

SEQ ID NO: 3112893 - protein, 24 aa, Giardia lamblia
GRHADVEGSEDSDTPRVRIKHSRD

SEQ ID NO: 3112894 - protein, 6 aa, Giardia lamblia
GRHEQA

SEQ ID NO: 3112895 - protein, 5 aa, Giardia lamblia
GRHGH

SEQ ID NO: 3112896 - protein, 5 aa, Giardia lamblia
GRHKT

SEQ ID NO: 3112897 - protein, 27 aa, Giardia lamblia
GRHPQKGENIGPGPGAYRDHEGPRGPA

SEQ ID NO: 3112898 - protein, 4 aa, Giardia lamblia
GRHS

SEQ ID NO: 3112899 - protein, 19 aa, Giardia lamblia
GRHSQARGSGTDKGRWPEK

SEQ ID NO: 3112900 - protein, 25 aa, Giardia lamblia
GRHSQLNKSNNPGPGAYTPTTDQVK

SEQ ID NO: 3112901 - protein, 7 aa, Giardia lamblia
GRIEPSK

SEQ ID NO: 3112902 - protein, 5 aa, Giardia lamblia
GRILT

SEQ ID NO: 3112903 - protein, 9 aa, Giardia lamblia
GRITDAPGY

SEQ ID NO: 3112904 - protein, 9 aa, Giardia lamblia
GRKAPSDPA

SEQ ID NO: 3112905 - protein, 10 aa, Giardia lamblia
GRKDSDSNRL

SEQ ID NO: 3112906 - protein, 5 aa, Giardia lamblia
GRKDV

SEQ ID NO: 3112907 - protein, 8 aa, Giardia lamblia
GRKGNTRP

SEQ ID NO: 3112908 - protein, 9 aa, Giardia lamblia
GRKNKTAIA

SEQ ID NO: 3112909 - protein, 30 aa, Giardia lamblia
GRKPDSSGKSAEPMATPQQAQSSRRNSSLA

SEQ ID NO: 3112910 - protein, 14 aa, Giardia lamblia
GRKQPRPATPPDQW

SEQ ID NO: 3112911 - protein, 7 aa, Giardia lamblia
GRKRAYT

SEQ ID NO: 3112912 - protein, 5 aa, Giardia lamblia
GRKTM

SEQ ID NO: 3112913 - protein, 7 aa, Giardia lamblia
GRLATPS

SEQ ID NO: 3112914 - protein, 4 aa, Giardia lamblia
GRLD

SEQ ID NO: 3112915 - protein, 12 aa, Giardia lamblia
GRLDESLRGKID

SEQ ID NO: 3112916 - protein, 9 aa, Giardia lamblia
GRLGAGKNS

SEQ ID NO: 3112917 - protein, 19 aa, Giardia lamblia
GRLHPGSGNSIANTPSLPV

SEQ ID NO: 3112918 - protein, 16 aa, Giardia lamblia
GRLITSEGEEISPEQL

SEQ ID NO: 3112919 - protein, 8 aa, Giardia lamblia
GRLPTPDR

SEQ ID NO: 3112920 - protein, 4 aa, Giardia lamblia
GRLS

SEQ ID NO: 3112921 - protein, 7 aa, Giardia lamblia
GRLSEKE

SEQ ID NO: 3112922 - protein, 9 aa, Giardia lamblia
GRLTDGKGN

SEQ ID NO: 3112923 - protein, 10 aa, Giardia lamblia
GRLTSANEQL

SEQ ID NO: 3112924 - protein, 13 aa, Giardia lamblia
GRMDSSDLQRVPG

SEQ ID NO: 3112925 - protein, 7 aa, Giardia lamblia
GRMQNER

SEQ ID NO: 3112926 - protein, 7 aa, Giardia lamblia
GRMQRTD

SEQ ID NO: 3112927 - protein, 8 aa, Giardia lamblia
GRNGMDDI

SEQ ID NO: 3112928 - protein, 9 aa, Giardia lamblia
GRNGTGKSS

SEQ ID NO: 3112929 - protein, 9 aa, Giardia lamblia
GRNKKSNAF

SEQ ID NO: 3112930 - protein, 12 aa, Giardia lamblia
GRNNYKKSKKYP

SEQ ID NO: 3112931 - protein, 7 aa, Giardia lamblia
GRNPEDV

SEQ ID NO: 3112932 - protein, 6 aa, Giardia lamblia
GRNRTT

SEQ ID NO: 3112933 - protein, 8 aa, Giardia lamblia
GRPARDIA

SEQ ID NO: 3112934 - protein, 11 aa, Giardia lamblia
GRPDAKVPSTE

SEQ ID NO: 3112935 - protein, 7 aa, Giardia lamblia
GRPEDRD

SEQ ID NO: 3112936 - protein, 7 aa, Giardia lamblia
GRPEKVS

SEQ ID NO: 3112937 - protein, 13 aa, Giardia lamblia
GRPETVDAYRGEG

SEQ ID NO: 3112938 - protein, 4 aa, Giardia lamblia
GRPH

SEQ ID NO: 3112939 - protein, 9 aa, Giardia lamblia
GRPKGNELE

SEQ ID NO: 3112940 - protein, 10 aa, Giardia lamblia
GRPKGTGPEA

SEQ ID NO: 3112941 - protein, 4 aa, Giardia lamblia
GRPM

SEQ ID NO: 3112942 - protein, 6 aa, Giardia lamblia
GRPPMG

SEQ ID NO: 3112943 - protein, 16 aa, Giardia lamblia
GRPPPVDDHDGFTGTK

SEQ ID NO: 3112944 - protein, 9 aa, Giardia lamblia
GRPPQRGTK

SEQ ID NO: 3112945 - protein, 5 aa, Giardia lamblia
GRPQT

SEQ ID NO: 3112946 - protein, 8 aa, Giardia lamblia
GRPRRDAP

SEQ ID NO: 3112947 - protein, 5 aa, Giardia lamblia
GRPSM

SEQ ID NO: 3112948 - protein, 15 aa, Giardia lamblia
GRPSPLTLGSSNTIS

SEQ ID NO: 3112949 - protein, 9 aa, Giardia lamblia
GRPVTSGTA

SEQ ID NO: 3112950 - protein, 10 aa, Giardia lamblia
GRQDHDGTSA

SEQ ID NO: 3112951 - protein, 6 aa, Giardia lamblia
GRQDNC

SEQ ID NO: 3112952 - protein, 6 aa, Giardia lamblia
GRQGSP

SEQ ID NO: 3112953 - protein, 8 aa, Giardia lamblia
GRQKFRKE

SEQ ID NO: 3112954 - protein, 8 aa, Giardia lamblia
GRQNTYGK

SEQ ID NO: 3112955 - protein, 4 aa, Giardia lamblia
GRQQ

SEQ ID NO: 3112956 - protein, 9 aa, Giardia lamblia
GRQSSPSNA

SEQ ID NO: 3112957 - protein, 8 aa, Giardia lamblia
GRQSVSDD

SEQ ID NO: 3112958 - protein, 14 aa, Giardia lamblia
GRQTIAESNQTNGE

SEQ ID NO: 3112959 - protein, 8 aa, Giardia lamblia
GRQTNDGI

SEQ ID NO: 3112960 - protein, 9 aa, Giardia lamblia
GRQTTPKGV

SEQ ID NO: 3112961 - protein, 19 aa, Giardia lamblia
GRQYDSEDCAKVSKELADE

SEQ ID NO: 3112962 - protein, 8 aa, Giardia lamblia
GRRAHDGT

SEQ ID NO: 3112963 - protein, 9 aa, Giardia lamblia
GRRDEDGMT

SEQ ID NO: 3112964 - protein, 23 aa, Giardia lamblia
GRRDQTLAKERNNQAAKAELAKE

SEQ ID NO: 3112965 - protein, 24 aa, Giardia lamblia
GRRHANKRSWSRGKERHASLKPKN

SEQ ID NO: 3112966 - protein, 6 aa, Giardia lamblia
GRRHGR

SEQ ID NO: 3112967 - protein, 5 aa, Giardia lamblia
GRRHR

SEQ ID NO: 3112968 - protein, 4 aa, Giardia lamblia
GRRI

SEQ ID NO: 3112969 - protein, 17 aa, Giardia lamblia
GRRITRETTKRIPPNEV

SEQ ID NO: 3112970 - protein, 4 aa, Giardia lamblia
GRRK

SEQ ID NO: 3112971 - protein, 4 aa, Giardia lamblia
GRRL

SEQ ID NO: 3112972 - protein, 7 aa, Giardia lamblia
GRRNTVG

SEQ ID NO: 3112973 - protein, 4 aa, Giardia lamblia
GRRP

SEQ ID NO: 3112974 - protein, 14 aa, Giardia lamblia
GRRPARSSQSEPPR

SEQ ID NO: 3112975 - protein, 9 aa, Giardia lamblia
GRRPNQTSD

SEQ ID NO: 3112976 - protein, 27 aa, Giardia lamblia
GRRPPDESSSSSSSSSCECEAGHDERE

SEQ ID NO: 3112977 - protein, 7 aa, Giardia lamblia
GRRPTAR

SEQ ID NO: 3112978 - protein, 8 aa, Giardia lamblia
GRRPTARE

SEQ ID NO: 3112979 - protein, 11 aa, Giardia lamblia
GRRSDGHGSLK

SEQ ID NO: 3112980 - protein, 12 aa, Giardia lamblia
GRRTDGHSRSAS

SEQ ID NO: 3112981 - protein, 9 aa, Giardia lamblia
GRRTDTGET

SEQ ID NO: 3112982 - protein, 5 aa, Giardia lamblia
GRRTL

SEQ ID NO: 3112983 - protein, 9 aa, Giardia lamblia
GRRTPGGKT

SEQ ID NO: 3112984 - protein, 5 aa, Giardia lamblia
GRRTQ

SEQ ID NO: 3112985 - protein, 5 aa, Giardia lamblia
GRRTY

SEQ ID NO: 3112986 - protein, 10 aa, Giardia lamblia
GRSAGQNENA

SEQ ID NO: 3112987 - protein, 15 aa, Giardia lamblia
GRSDDPETCDRPGAV

SEQ ID NO: 3112988 - protein, 16 aa, Giardia lamblia
GRSDKLASETQLESDS

SEQ ID NO: 3112989 - protein, 16 aa, Giardia lamblia
GRSFSHDAAEEPELKR

SEQ ID NO: 3112990 - protein, 12 aa, Giardia lamblia
GRSFTPTQRTPS

SEQ ID NO: 3112991 - protein, 4 aa, Giardia lamblia
GRSG

SEQ ID NO: 3112992 - protein, 6 aa, Giardia lamblia
GRSGGF

SEQ ID NO: 3112993 - protein, 14 aa, Giardia lamblia
GRSGIRSNDPPVDY

SEQ ID NO: 3112994 - protein, 11 aa, Giardia lamblia
GRSKEKSSRFD

SEQ ID NO: 3112995 - protein, 5 aa, Giardia lamblia
GRSLA

SEQ ID NO: 3112996 - protein, 7 aa, Giardia lamblia
GRSMGPI

SEQ ID NO: 3112997 - protein, 9 aa, Giardia lamblia
GRSMKDGTT

SEQ ID NO: 3112998 - protein, 6 aa, Giardia lamblia
GRSNGY

SEQ ID NO: 3112999 - protein, 9 aa, Giardia lamblia
GRSPPLTTA

SEQ ID NO: 3113000 - protein, 8 aa, Giardia lamblia
GRSSENIE

SEQ ID NO: 3113001 - protein, 14 aa, Giardia lamblia
GRSSGASLTQEQEK

SEQ ID NO: 3113002 - protein, 10 aa, Giardia lamblia
GRSSGRPADL

SEQ ID NO: 3113003 - protein, 22 aa, Giardia lamblia
GRSSSNISHSNPFRSHSEQARS

SEQ ID NO: 3113004 - protein, 24 aa, Giardia lamblia
GRSVSKGRDQASDAPPPPPARSAA

SEQ ID NO: 3113005 - protein, 4 aa, Giardia lamblia
GRTD

SEQ ID NO: 3113006 - protein, 9 aa, Giardia lamblia
GRTDDASKG

SEQ ID NO: 3113007 - protein, 15 aa, Giardia lamblia
GRTDFPGGSSKQLKA

SEQ ID NO: 3113008 - protein, 11 aa, Giardia lamblia
GRTDSANRPVD

SEQ ID NO: 3113009 - protein, 21 aa, Giardia lamblia
GRTESEIESLQETAASKDQEI

SEQ ID NO: 3113010 - protein, 9 aa, Giardia lamblia
GRTGRAGKF

SEQ ID NO: 3113011 - protein, 10 aa, Giardia lamblia
GRTGRAGRPG

SEQ ID NO: 3113012 - protein, 22 aa, Giardia lamblia
GRTISGTARAVSGTGSSQQGRA

SEQ ID NO: 3113013 - protein, 12 aa, Giardia lamblia
GRTNPFTKQPHS

SEQ ID NO: 3113014 - protein, 6 aa, Giardia lamblia
GRTPND

SEQ ID NO: 3113015 - protein, 18 aa, Giardia lamblia
GRTPQGSSAAAGHTASLA

SEQ ID NO: 3113016 - protein, 5 aa, Giardia lamblia
GRTQP

SEQ ID NO: 3113017 - protein, 5 aa, Giardia lamblia
GRTRP

SEQ ID NO: 3113018 - protein, 7 aa, Giardia lamblia
GRTSTGK

SEQ ID NO: 3113019 - protein, 8 aa, Giardia lamblia
GRTTAGND

SEQ ID NO: 3113020 - protein, 18 aa, Giardia lamblia
GRTTATVGSSATHGERRG

SEQ ID NO: 3113021 - protein, 7 aa, Giardia lamblia
GRTTERA

SEQ ID NO: 3113022 - protein, 5 aa, Giardia lamblia
GRTTG

SEQ ID NO: 3113023 - protein, 8 aa, Giardia lamblia
GRTTQSGI

SEQ ID NO: 3113024 - protein, 8 aa, Giardia lamblia
GRVDISGG

SEQ ID NO: 3113025 - protein, 18 aa, Giardia lamblia
GRVETARDRKAQKPVRRE

SEQ ID NO: 3113026 - protein, 4 aa, Giardia lamblia
GRVF

SEQ ID NO: 3113027 - protein, 6 aa, Giardia lamblia
GRVPES

SEQ ID NO: 3113028 - protein, 7 aa, Giardia lamblia
GRVQATG

SEQ ID NO: 3113029 - protein, 11 aa, Giardia lamblia
GRVSGDPRKTP

SEQ ID NO: 3113030 - protein, 9 aa, Giardia lamblia
GRVSNTKST

SEQ ID NO: 3113031 - protein, 6 aa, Giardia lamblia
GRVTGR

SEQ ID NO: 3113032 - protein, 5 aa, Giardia lamblia
GRVTS

SEQ ID NO: 3113033 - protein, 4 aa, Giardia lamblia
GRWA

SEQ ID NO: 3113034 - protein, 5 aa, Giardia lamblia
GRYEY

SEQ ID NO: 3113035 - protein, 13 aa, Giardia lamblia
GRYNAKQRIQEAE

SEQ ID NO: 3113036 - protein, 6 aa, Giardia lamblia
GRYPKG

SEQ ID NO: 3113037 - protein, 4 aa, Giardia lamblia
GRYQ

SEQ ID NO: 3113038 - protein, 5 aa, Giardia lamblia
GRYST

SEQ ID NO: 3113039 - protein, 9 aa, Giardia lamblia
GSAANGDSV

SEQ ID NO: 3113040 - protein, 8 aa, Giardia lamblia
GSAASDLN

SEQ ID NO: 3113041 - protein, 8 aa, Giardia lamblia
GSACDSCD

SEQ ID NO: 3113042 - protein, 11 aa, Giardia lamblia
GSACTSQSLEP

SEQ ID NO: 3113043 - protein, 4 aa, Giardia lamblia
GSAD

SEQ ID NO: 3113044 - protein, 6 aa, Giardia lamblia
GSADGT

SEQ ID NO: 3113045 - protein, 8 aa, Giardia lamblia
GSADGTVS

SEQ ID NO: 3113046 - protein, 9 aa, Giardia lamblia
GSAGGGFTQ

SEQ ID NO: 3113047 - protein, 8 aa, Giardia lamblia
GSAGHAGD

SEQ ID NO: 3113048 - protein, 18 aa, Giardia lamblia
GSAGNTRFTDTRQDEKDR

SEQ ID NO: 3113049 - protein, 9 aa, Giardia lamblia
GSAGRDPVA

SEQ ID NO: 3113050 - protein, 8 aa, Giardia lamblia
GSAGTGKS

SEQ ID NO: 3113051 - protein, 8 aa, Giardia lamblia
GSAGTQLA

SEQ ID NO: 3113052 - protein, 17 aa, Giardia lamblia
GSAHSPYKLDTSSSESV

SEQ ID NO: 3113053 - protein, 5 aa, Giardia lamblia
GSAIN

SEQ ID NO: 3113054 - protein, 12 aa, Giardia lamblia
GSAKSTGSSTKM

SEQ ID NO: 3113055 - protein, 9 aa, Giardia lamblia
GSANGSNCE

SEQ ID NO: 3113056 - protein, 8 aa, Giardia lamblia
GSANNLGK

SEQ ID NO: 3113057 - protein, 5 aa, Giardia lamblia
GSAPA

SEQ ID NO: 3113058 - protein, 17 aa, Giardia lamblia
GSAPDVQLPETVSSRLD

SEQ ID NO: 3113059 - protein, 20 aa, Giardia lamblia
GSAPGRTSIGGQPDSGFDLS

SEQ ID NO: 3113060 - protein, 20 aa, Giardia lamblia
GSAPNSGKYTSQKSQTPTPV

SEQ ID NO: 3113061 - protein, 5 aa, Giardia lamblia
GSAPQ

SEQ ID NO: 3113062 - protein, 19 aa, Giardia lamblia
GSAPSNNPVQEKTKTLTSS

SEQ ID NO: 3113063 - protein, 8 aa, Giardia lamblia
GSAQDGKT

SEQ ID NO: 3113064 - protein, 6 aa, Giardia lamblia
GSAQGV

SEQ ID NO: 3113065 - protein, 15 aa, Giardia lamblia
GSARASASKREDEPC

SEQ ID NO: 3113066 - protein, 5 aa, Giardia lamblia
GSARQ

SEQ ID NO: 3113067 - protein, 12 aa, Giardia lamblia
GSARRLKDDSTH

SEQ ID NO: 3113068 - protein, 10 aa, Giardia lamblia
GSARRPKASD

SEQ ID NO: 3113069 - protein, 37 aa, Giardia lamblia
GSASAAPAPVTAGGAVAAAAAAAETAKKEESDDDEIV

SEQ ID NO: 3113070 - protein, 10 aa, Giardia lamblia
GSASATRKSV

SEQ ID NO: 3113071 - protein, 6 aa, Giardia lamblia
GSASGL

SEQ ID NO: 3113072 - protein, 7 aa, Giardia lamblia
GSASQHS

SEQ ID NO: 3113073 - protein, 5 aa, Giardia lamblia
GSASS

SEQ ID NO: 3113074 - protein, 8 aa, Giardia lamblia
GSASVQAS

SEQ ID NO: 3113075 - protein, 16 aa, Giardia lamblia
GSASVTTSSLPPYRPI

SEQ ID NO: 3113076 - protein, 6 aa, Giardia lamblia
GSAYKE

SEQ ID NO: 3113077 - protein, 6 aa, Giardia lamblia
GSCQGP

SEQ ID NO: 3113078 - protein, 4 aa, Giardia lamblia
GSCS

SEQ ID NO: 3113079 - protein, 56 aa, Giardia lamblia
GSDCSTKSSTQASGTNQNSSRRGQTSQLTSQRQTSLNQQTTQATGSRNIKKDPTFP

SEQ ID NO: 3113080 - protein, 6 aa, Giardia lamblia
GSDDAN

SEQ ID NO: 3113081 - protein, 27 aa, Giardia lamblia
GSDEAVESRSSRLSTNDDVHSPDTGPV

SEQ ID NO: 3113082 - protein, 9 aa, Giardia lamblia
GSDEKTEPV

SEQ ID NO: 3113083 - protein, 24 aa, Giardia lamblia
GSDESTSRNSSISEGRRPGGRLRT

SEQ ID NO: 3113084 - protein, 6 aa, Giardia lamblia
GSDGIA

SEQ ID NO: 3113085 - protein, 5 aa, Giardia lamblia
GSDGS

SEQ ID NO: 3113086 - protein, 5 aa, Giardia lamblia
GSDIR

SEQ ID NO: 3113087 - protein, 9 aa, Giardia lamblia
GSDPDTTAY

SEQ ID NO: 3113088 - protein, 5 aa, Giardia lamblia
GSDPI

SEQ ID NO: 3113089 - protein, 16 aa, Giardia lamblia
GSDPLFSSKDTVKPGM

SEQ ID NO: 3113090 - protein, 5 aa, Giardia lamblia
GSDPM

SEQ ID NO: 3113091 - protein, 9 aa, Giardia lamblia
GSDPTSQIE

SEQ ID NO: 3113092 - protein, 59 aa, Giardia lamblia
GSDSEEGPQVNDSQGTCVRGTSTDGSETDEKCTQDCSEVDNGNTYEKLKSSKGTFSSHS

SEQ ID NO: 3113093 - protein, 20 aa, Giardia lamblia
GSDSEESSEDTSRATPEEQA

SEQ ID NO: 3113094 - protein, 34 aa, Giardia lamblia
GSDSESDDEELKAEKEKLQASLENKKKPKNAKAE

SEQ ID NO: 3113095 - protein, 8 aa, Giardia lamblia
GSDVEPDM

SEQ ID NO: 3113096 - protein, 14 aa, Giardia lamblia
GSEAGMRDNEGHNS

SEQ ID NO: 3113097 - protein, 23 aa, Giardia lamblia
GSEEALRADDHEAGSPSPEFPPV

SEQ ID NO: 3113098 - protein, 11 aa, Giardia lamblia
GSEERSPTARV

SEQ ID NO: 3113099 - protein, 7 aa, Giardia lamblia
GSEESMD

SEQ ID NO: 3113100 - protein, 7 aa, Giardia lamblia
GSEFSGP

SEQ ID NO: 3113101 - protein, 4 aa, Giardia lamblia
GSEG

SEQ ID NO: 3113102 - protein, 10 aa, Giardia lamblia
GSEGLSDNDH

SEQ ID NO: 3113103 - protein, 4 aa, Giardia lamblia
GSEI

SEQ ID NO: 3113104 - protein, 13 aa, Giardia lamblia
GSEKASKTGAEGI

SEQ ID NO: 3113105 - protein, 10 aa, Giardia lamblia
GSEKKREIEE

SEQ ID NO: 3113106 - protein, 8 aa, Giardia lamblia
GSEKQSHL

SEQ ID NO: 3113107 - protein, 11 aa, Giardia lamblia
GSEKSENGHPF

SEQ ID NO: 3113108 - protein, 70 aa, Giardia lamblia
GSEKSKAAKLNTQAIERGNPYPNEEPLSSANTSNIQEDDPNESEDENDTVSTGTESDDSSCSHEEKDGHV

SEQ ID NO: 3113109 - protein, 4 aa, Giardia lamblia
GSEM

SEQ ID NO: 3113110 - protein, 15 aa, Giardia lamblia
GSENVEKSGAKEERL

SEQ ID NO: 3113111 - protein, 8 aa, Giardia lamblia
GSEPEAWE

SEQ ID NO: 3113112 - protein, 18 aa, Giardia lamblia
GSEPHMPGASKQVQQESS

SEQ ID NO: 3113113 - protein, 5 aa, Giardia lamblia
GSEPI

SEQ ID NO: 3113114 - protein, 8 aa, Giardia lamblia
GSEPNTHM

SEQ ID NO: 3113115 - protein, 6 aa, Giardia lamblia
GSEQSV

SEQ ID NO: 3113116 - protein, 13 aa, Giardia lamblia
GSERAKKSGATGL

SEQ ID NO: 3113117 - protein, 14 aa, Giardia lamblia
GSERAKKTSATGER

SEQ ID NO: 3113118 - protein, 12 aa, Giardia lamblia
GSERASASISVD

SEQ ID NO: 3113119 - protein, 21 aa, Giardia lamblia
GSERASDVQNSDRQTRMEGAE

SEQ ID NO: 3113120 - protein, 8 aa, Giardia lamblia
GSERDEKG

SEQ ID NO: 3113121 - protein, 12 aa, Giardia lamblia
GSERLASTGSVG

SEQ ID NO: 3113122 - protein, 17 aa, Giardia lamblia
GSERLSKSASDGTRKLE

SEQ ID NO: 3113123 - protein, 18 aa, Giardia lamblia
GSERQEKTGATGDRLKEA

SEQ ID NO: 3113124 - protein, 15 aa, Giardia lamblia
GSERQSKTEAAGRRL

SEQ ID NO: 3113125 - protein, 15 aa, Giardia lamblia
GSERQSKTGATGETL

SEQ ID NO: 3113126 - protein, 14 aa, Giardia lamblia
GSERQVKTNAIGER

SEQ ID NO: 3113127 - protein, 12 aa, Giardia lamblia
GSERVAKTHADG

SEQ ID NO: 3113128 - protein, 15 aa, Giardia lamblia
GSERVKASKSDGVRL

SEQ ID NO: 3113129 - protein, 25 aa, Giardia lamblia
GSERVSKTMSDGERLSEAKKINQSL

SEQ ID NO: 3113130 - protein, 23 aa, Giardia lamblia
GSERVSQSKVDGQRLEEAKRINS

SEQ ID NO: 3113131 - protein, 4 aa, Giardia lamblia
GSES

SEQ ID NO: 3113132 - protein, 21 aa, Giardia lamblia
GSESAGKSGASGDRQQEASKI

SEQ ID NO: 3113133 - protein, 7 aa, Giardia lamblia
GSESARP

SEQ ID NO: 3113134 - protein, 14 aa, Giardia lamblia
GSESGPDGARPNIE

SEQ ID NO: 3113135 - protein, 15 aa, Giardia lamblia
GSEVDPNTSAPLGSD

SEQ ID NO: 3113136 - protein, 16 aa, Giardia lamblia
GSEVPQPFPPPSTSKF

SEQ ID NO: 3113137 - protein, 4 aa, Giardia lamblia
GSFD

SEQ ID NO: 3113138 - protein, 9 aa, Giardia lamblia
GSFDSNGKT

SEQ ID NO: 3113139 - protein, 6 aa, Giardia lamblia
GSFGAT

SEQ ID NO: 3113140 - protein, 5 aa, Giardia lamblia
GSFHE

SEQ ID NO: 3113141 - protein, 11 aa, Giardia lamblia
GSFNNSTDVEY

SEQ ID NO: 3113142 - protein, 7 aa, Giardia lamblia
GSFNTQE

SEQ ID NO: 3113143 - protein, 8 aa, Giardia lamblia
GSFPESNH

SEQ ID NO: 3113144 - protein, 6 aa, Giardia lamblia
GSFPPF

SEQ ID NO: 3113145 - protein, 6 aa, Giardia lamblia
GSFTTA

SEQ ID NO: 3113146 - protein, 9 aa, Giardia lamblia
GSGALSSGL

SEQ ID NO: 3113147 - protein, 14 aa, Giardia lamblia
GSGAPQGVSLTTSG

SEQ ID NO: 3113148 - protein, 4 aa, Giardia lamblia
GSGC

SEQ ID NO: 3113149 - protein, 8 aa, Giardia lamblia
GSGDGTVS

SEQ ID NO: 3113150 - protein, 4 aa, Giardia lamblia
GSGE

SEQ ID NO: 3113151 - protein, 7 aa, Giardia lamblia
GSGGDMQ

SEQ ID NO: 3113152 - protein, 11 aa, Giardia lamblia
GSGGNTGTRRV

SEQ ID NO: 3113153 - protein, 12 aa, Giardia lamblia
GSGGVKSPHGLP

SEQ ID NO: 3113154 - protein, 14 aa, Giardia lamblia
GSGHGKPASSSTLT

SEQ ID NO: 3113155 - protein, 7 aa, Giardia lamblia
GSGHRQA

SEQ ID NO: 3113156 - protein, 6 aa, Giardia lamblia
GSGIPV

SEQ ID NO: 3113157 - protein, 5 aa, Giardia lamblia
GSGIS

SEQ ID NO: 3113158 - protein, 6 aa, Giardia lamblia
GSGITA

SEQ ID NO: 3113159 - protein, 10 aa, Giardia lamblia
GSGKHSPEQV

SEQ ID NO: 3113160 - protein, 6 aa, Giardia lamblia
GSGKSR

SEQ ID NO: 3113161 - protein, 8 aa, Giardia lamblia
GSGKTYSL

SEQ ID NO: 3113162 - protein, 7 aa, Giardia lamblia
GSGLDEN

SEQ ID NO: 3113163 - protein, 53 aa, Giardia lamblia
GSGLEEVGGTPKMRRRGSKVSLERTDSTGSIQDDQASAPTGAGTPKMKRRGSK

SEQ ID NO: 3113164 - protein, 8 aa, Giardia lamblia
GSGPTGLA

SEQ ID NO: 3113165 - protein, 15 aa, Giardia lamblia
GSGQVYSGGTPFHGD

SEQ ID NO: 3113166 - protein, 24 aa, Giardia lamblia
GSGRDKIAKPEDFDAAAKTAKDNN

SEQ ID NO: 3113167 - protein, 9 aa, Giardia lamblia
GSGRGLQGS

SEQ ID NO: 3113168 - protein, 7 aa, Giardia lamblia
GSGRGRR

SEQ ID NO: 3113169 - protein, 6 aa, Giardia lamblia
GSGRKD

SEQ ID NO: 3113170 - protein, 9 aa, Giardia lamblia
GSGRPGFTS

SEQ ID NO: 3113171 - protein, 6 aa, Giardia lamblia
GSGRRS

SEQ ID NO: 3113172 - protein, 5 aa, Giardia lamblia
GSGSF

SEQ ID NO: 3113173 - protein, 5 aa, Giardia lamblia
GSGSG

SEQ ID NO: 3113174 - protein, 13 aa, Giardia lamblia
GSGSQWEDRHPRV

SEQ ID NO: 3113175 - protein, 11 aa, Giardia lamblia
GSGSRKTGYKR

SEQ ID NO: 3113176 - protein, 6 aa, Giardia lamblia
GSGSVD

SEQ ID NO: 3113177 - protein, 9 aa, Giardia lamblia
GSGTESSVR

SEQ ID NO: 3113178 - protein, 5 aa, Giardia lamblia
GSGTY

SEQ ID NO: 3113179 - protein, 6 aa, Giardia lamblia
GSGVSN

SEQ ID NO: 3113180 - protein, 4 aa, Giardia lamblia
GSHA

SEQ ID NO: 3113181 - protein, 10 aa, Giardia lamblia
GSHNTTTSTM

SEQ ID NO: 3113182 - protein, 5 aa, Giardia lamblia
GSHPR

SEQ ID NO: 3113183 - protein, 25 aa, Giardia lamblia
GSHQPHAHGPSYGSYGGHSHNTYAN

SEQ ID NO: 3113184 - protein, 26 aa, Giardia lamblia
GSHRGTRNAATSDPQRGSGHTSNDLG

SEQ ID NO: 3113185 - protein, 6 aa, Giardia lamblia
GSHSNT

SEQ ID NO: 3113186 - protein, 7 aa, Giardia lamblia
GSHTLRD

SEQ ID NO: 3113187 - protein, 11 aa, Giardia lamblia
GSIAEAKKEVP

SEQ ID NO: 3113188 - protein, 11 aa, Giardia lamblia
GSIGQPQPQTL

SEQ ID NO: 3113189 - protein, 7 aa, Giardia lamblia
GSIPDDL

SEQ ID NO: 3113190 - protein, 14 aa, Giardia lamblia
GSIPPDPNATMGPA

SEQ ID NO: 3113191 - protein, 18 aa, Giardia lamblia
GSIPTGHPEKSAERLQDE

SEQ ID NO: 3113192 - protein, 9 aa, Giardia lamblia
GSIQGRAGA

SEQ ID NO: 3113193 - protein, 5 aa, Giardia lamblia
GSIRP

SEQ ID NO: 3113194 - protein, 16 aa, Giardia lamblia
GSISGDSSGAAGSAHL

SEQ ID NO: 3113195 - protein, 4 aa, Giardia lamblia
GSIT

SEQ ID NO: 3113196 - protein, 13 aa, Giardia lamblia
GSKAKKARPTDDM

SEQ ID NO: 3113197 - protein, 13 aa, Giardia lamblia
GSKAKSQAGLSNQ

SEQ ID NO: 3113198 - protein, 11 aa, Giardia lamblia
GSKASSKDGLI

SEQ ID NO: 3113199 - protein, 4 aa, Giardia lamblia
GSKD

SEQ ID NO: 3113200 - protein, 5 aa, Giardia lamblia
GSKDA

SEQ ID NO: 3113201 - protein, 7 aa, Giardia lamblia
GSKDGTV

SEQ ID NO: 3113202 - protein, 4 aa, Giardia lamblia
GSKE

SEQ ID NO: 3113203 - protein, 7 aa, Giardia lamblia
GSKEDTV

SEQ ID NO: 3113204 - protein, 8 aa, Giardia lamblia
GSKERQPL

SEQ ID NO: 3113205 - protein, 17 aa, Giardia lamblia
GSKERRSHTREFSPQYT

SEQ ID NO: 3113206 - protein, 7 aa, Giardia lamblia
GSKGGDI

SEQ ID NO: 3113207 - protein, 6 aa, Giardia lamblia
GSKGKK

SEQ ID NO: 3113208 - protein, 4 aa, Giardia lamblia
GSKI

SEQ ID NO: 3113209 - protein, 15 aa, Giardia lamblia
GSKKQKTRVEEPQHN

SEQ ID NO: 3113210 - protein, 10 aa, Giardia lamblia
GSKLGDSPQV

SEQ ID NO: 3113211 - protein, 9 aa, Giardia lamblia
GSKLTDKDF

SEQ ID NO: 3113212 - protein, 6 aa, Giardia lamblia
GSKMTS

SEQ ID NO: 3113213 - protein, 6 aa, Giardia lamblia
GSKPAT

SEQ ID NO: 3113214 - protein, 26 aa, Giardia lamblia
GSKPKQKKESVTREAQSNTKTTENAV

SEQ ID NO: 3113215 - protein, 9 aa, Giardia lamblia
GSKQRNNAT

SEQ ID NO: 3113216 - protein, 4 aa, Giardia lamblia
GSKR

SEQ ID NO: 3113217 - protein, 22 aa, Giardia lamblia
GSKRAESNEFTEPTDESESSCG

SEQ ID NO: 3113218 - protein, 5 aa, Giardia lamblia
GSKRG

SEQ ID NO: 3113219 - protein, 14 aa, Giardia lamblia
GSKRQSYDQIYGAP

SEQ ID NO: 3113220 - protein, 9 aa, Giardia lamblia
GSKSFETSI

SEQ ID NO: 3113221 - protein, 8 aa, Giardia lamblia
GSKSQTHS

SEQ ID NO: 3113222 - protein, 4 aa, Giardia lamblia
GSKT

SEQ ID NO: 3113223 - protein, 20 aa, Giardia lamblia
GSKTAQDKVEQQAKQKRELE

SEQ ID NO: 3113224 - protein, 6 aa, Giardia lamblia
GSKTAS

SEQ ID NO: 3113225 - protein, 6 aa, Giardia lamblia
GSKTGN

SEQ ID NO: 3113226 - protein, 48 aa, Giardia lamblia
GSKVFTPKDKSEEPSKFGRRNSKVVSSNAESKNSTPKMTQSKLQESEL

SEQ ID NO: 3113227 - protein, 7 aa, Giardia lamblia
GSKYEGE

SEQ ID NO: 3113228 - protein, 35 aa, Giardia lamblia
GSLDRSNLQGSTGTLKASSKAPEDSNDVRSPSAEL

SEQ ID NO: 3113229 - protein, 19 aa, Giardia lamblia
GSLDTKDTMTKADQPDSYA

SEQ ID NO: 3113230 - protein, 27 aa, Giardia lamblia
GSLESSLQQNREADSVNTKLQESLSES

SEQ ID NO: 3113231 - protein, 5 aa, Giardia lamblia
GSLGE

SEQ ID NO: 3113232 - protein, 8 aa, Giardia lamblia
GSLGQPSL

SEQ ID NO: 3113233 - protein, 6 aa, Giardia lamblia
GSLHPQ

SEQ ID NO: 3113234 - protein, 17 aa, Giardia lamblia
GSLHPSPRGTSRSSTWT

SEQ ID NO: 3113235 - protein, 13 aa, Giardia lamblia
GSLITKPTSTSLE

SEQ ID NO: 3113236 - protein, 7 aa, Giardia lamblia
GSLKEYR

SEQ ID NO: 3113237 - protein, 11 aa, Giardia lamblia
GSLKNSSPHLE

SEQ ID NO: 3113238 - protein, 8 aa, Giardia lamblia
GSLNDGGL

SEQ ID NO: 3113239 - protein, 8 aa, Giardia lamblia
GSLNENEH

SEQ ID NO: 3113240 - protein, 8 aa, Giardia lamblia
GSLPEREA

SEQ ID NO: 3113241 - protein, 6 aa, Giardia lamblia
GSLPNT

SEQ ID NO: 3113242 - protein, 10 aa, Giardia lamblia
GSLPPETSAA

SEQ ID NO: 3113243 - protein, 8 aa, Giardia lamblia
GSLPPTQS

SEQ ID NO: 3113244 - protein, 20 aa, Giardia lamblia
GSLPSKTFTNSRRKQARDAS

SEQ ID NO: 3113245 - protein, 5 aa, Giardia lamblia
GSLQE

SEQ ID NO: 3113246 - protein, 11 aa, Giardia lamblia
GSLQKRAEVTA

SEQ ID NO: 3113247 - protein, 5 aa, Giardia lamblia
GSLRA

SEQ ID NO: 3113248 - protein, 28 aa, Giardia lamblia
GSLSDNSAFSRPPMPMPDTANAGAPASA

SEQ ID NO: 3113249 - protein, 14 aa, Giardia lamblia
GSLSEAQANNQAEI

SEQ ID NO: 3113250 - protein, 27 aa, Giardia lamblia
GSLSKNNTPVRDMSSRTSRSITPYDSR

SEQ ID NO: 3113251 - protein, 7 aa, Giardia lamblia
GSLSNPG

SEQ ID NO: 3113252 - protein, 7 aa, Giardia lamblia
GSLSTGS

SEQ ID NO: 3113253 - protein, 16 aa, Giardia lamblia
GSLTTSDLKAPNMSRT

SEQ ID NO: 3113254 - protein, 12 aa, Giardia lamblia
GSMATLSSESVP

SEQ ID NO: 3113255 - protein, 9 aa, Giardia lamblia
GSMENSNYE

SEQ ID NO: 3113256 - protein, 8 aa, Giardia lamblia
GSMEPTDQ

SEQ ID NO: 3113257 - protein, 6 aa, Giardia lamblia
GSMGPK

SEQ ID NO: 3113258 - protein, 10 aa, Giardia lamblia
GSMQDNQGNT

SEQ ID NO: 3113259 - protein, 12 aa, Giardia lamblia
GSMSGSDGDSAR

SEQ ID NO: 3113260 - protein, 5 aa, Giardia lamblia
GSMTA

SEQ ID NO: 3113261 - protein, 7 aa, Giardia lamblia
GSMTRKR

SEQ ID NO: 3113262 - protein, 14 aa, Giardia lamblia
GSNATSDAIRAKED

SEQ ID NO: 3113263 - protein, 9 aa, Giardia lamblia
GSNEAFDRS

SEQ ID NO: 3113264 - protein, 4 aa, Giardia lamblia
GSNG

SEQ ID NO: 3113265 - protein, 28 aa, Giardia lamblia
GSNGSTPSSHSSSLKASRIGLNDPPSIN

SEQ ID NO: 3113266 - protein, 6 aa, Giardia lamblia
GSNITI

SEQ ID NO: 3113267 - protein, 7 aa, Giardia lamblia
GSNITSG

SEQ ID NO: 3113268 - protein, 4 aa, Giardia lamblia
GSNK

SEQ ID NO: 3113269 - protein, 5 aa, Giardia lamblia
GSNLQ

SEQ ID NO: 3113270 - protein, 6 aa, Giardia lamblia
GSNNTD

SEQ ID NO: 3113271 - protein, 5 aa, Giardia lamblia
GSNPF

SEQ ID NO: 3113272 - protein, 14 aa, Giardia lamblia
GSNSAQTKLGPQTK

SEQ ID NO: 3113273 - protein, 19 aa, Giardia lamblia
GSNSKETEDRVNEKSSINY

SEQ ID NO: 3113274 - protein, 7 aa, Giardia lamblia
GSNYDRM

SEQ ID NO: 3113275 - protein, 6 aa, Giardia lamblia
GSNYGK

SEQ ID NO: 3113276 - protein, 8 aa, Giardia lamblia
GSPAASSA

SEQ ID NO: 3113277 - protein, 8 aa, Giardia lamblia
GSPAATSR

SEQ ID NO: 3113278 - protein, 14 aa, Giardia lamblia
GSPAIPAYSDSEID

SEQ ID NO: 3113279 - protein, 10 aa, Giardia lamblia
GSPANDPGIT

SEQ ID NO: 3113280 - protein, 17 aa, Giardia lamblia
GSPDTREAVQADSEKYT

SEQ ID NO: 3113281 - protein, 6 aa, Giardia lamblia
GSPESV

SEQ ID NO: 3113282 - protein, 4 aa, Giardia lamblia
GSPG

SEQ ID NO: 3113283 - protein, 6 aa, Giardia lamblia
GSPGDA

SEQ ID NO: 3113284 - protein, 9 aa, Giardia lamblia
GSPGSGKTC

SEQ ID NO: 3113285 - protein, 11 aa, Giardia lamblia
GSPGSGKTLTA

SEQ ID NO: 3113286 - protein, 4 aa, Giardia lamblia
GSPH

SEQ ID NO: 3113287 - protein, 7 aa, Giardia lamblia
GSPHEDA

SEQ ID NO: 3113288 - protein, 8 aa, Giardia lamblia
GSPIGSTS

SEQ ID NO: 3113289 - protein, 13 aa, Giardia lamblia
GSPLPTGTADDAA

SEQ ID NO: 3113290 - protein, 4 aa, Giardia lamblia
GSPM

SEQ ID NO: 3113291 - protein, 18 aa, Giardia lamblia
GSPPLSPLRQRRPEAFPA

SEQ ID NO: 3113292 - protein, 11 aa, Giardia lamblia
GSPPPLSKIAA

SEQ ID NO: 3113293 - protein, 7 aa, Giardia lamblia
GSPPRHV

SEQ ID NO: 3113294 - protein, 4 aa, Giardia lamblia
GSPR

SEQ ID NO: 3113295 - protein, 6 aa, Giardia lamblia
GSPREK

SEQ ID NO: 3113296 - protein, 6 aa, Giardia lamblia
GSPRPL

SEQ ID NO: 3113297 - protein, 4 aa, Giardia lamblia
GSPS

SEQ ID NO: 3113298 - protein, 18 aa, Giardia lamblia
GSPSRSCSGLPRATEQSL

SEQ ID NO: 3113299 - protein, 7 aa, Giardia lamblia
GSPTKGI

SEQ ID NO: 3113300 - protein, 6 aa, Giardia lamblia
GSPVSS

SEQ ID NO: 3113301 - protein, 26 aa, Giardia lamblia
GSPVSVNADQKDSSISTAKPTNSNLN

SEQ ID NO: 3113302 - protein, 7 aa, Giardia lamblia
GSPYNYP

SEQ ID NO: 3113303 - protein, 15 aa, Giardia lamblia
GSQANLKTVDPNDLS

SEQ ID NO: 3113304 - protein, 8 aa, Giardia lamblia
GSQDEGFQ

SEQ ID NO: 3113305 - protein, 10 aa, Giardia lamblia
GSQDNQLPRK

SEQ ID NO: 3113306 - protein, 6 aa, Giardia lamblia
GSQDPF

SEQ ID NO: 3113307 - protein, 14 aa, Giardia lamblia
GSQGAPVGLSTRSY

SEQ ID NO: 3113308 - protein, 4 aa, Giardia lamblia
GSQL

SEQ ID NO: 3113309 - protein, 7 aa, Giardia lamblia
GSQPETT

SEQ ID NO: 3113310 - protein, 12 aa, Giardia lamblia
GSQPGKASQSTI

SEQ ID NO: 3113311 - protein, 12 aa, Giardia lamblia
GSQPGSNEGTRA

SEQ ID NO: 3113312 - protein, 10 aa, Giardia lamblia
GSQPQCDSTV

SEQ ID NO: 3113313 - protein, 8 aa, Giardia lamblia
GSQPVQIG

SEQ ID NO: 3113314 - protein, 10 aa, Giardia lamblia
GSQQPTGRCK

SEQ ID NO: 3113315 - protein, 4 aa, Giardia lamblia
GSQS

SEQ ID NO: 3113316 - protein, 10 aa, Giardia lamblia
GSQSAGKSSV

SEQ ID NO: 3113317 - protein, 5 aa, Giardia lamblia
GSQSM

SEQ ID NO: 3113318 - protein, 10 aa, Giardia lamblia
GSQYADLPET

SEQ ID NO: 3113319 - protein, 8 aa, Giardia lamblia
GSRANEVQ

SEQ ID NO: 3113320 - protein, 4 aa, Giardia lamblia
GSRD

SEQ ID NO: 3113321 - protein, 11 aa, Giardia lamblia
GSRDAAGETGL

SEQ ID NO: 3113322 - protein, 14 aa, Giardia lamblia
GSRDAKPTDPRSPL

SEQ ID NO: 3113323 - protein, 9 aa, Giardia lamblia
GSRDETGDT

SEQ ID NO: 3113324 - protein, 4 aa, Giardia lamblia
GSRE

SEQ ID NO: 3113325 - protein, 9 aa, Giardia lamblia
GSREVTEDS

SEQ ID NO: 3113326 - protein, 8 aa, Giardia lamblia
GSRGLGGA

SEQ ID NO: 3113327 - protein, 9 aa, Giardia lamblia
GSRGQSQSV

SEQ ID NO: 3113328 - protein, 8 aa, Giardia lamblia
GSRGVSGK

SEQ ID NO: 3113329 - protein, 7 aa, Giardia lamblia
GSRPKDI

SEQ ID NO: 3113330 - protein, 17 aa, Giardia lamblia
GSRPLAPSEAAPITASP

SEQ ID NO: 3113331 - protein, 15 aa, Giardia lamblia
GSRPPVGSATQTQPA

SEQ ID NO: 3113332 - protein, 8 aa, Giardia lamblia
GSRPVDKD

SEQ ID NO: 3113333 - protein, 7 aa, Giardia lamblia
GSRQSEL

SEQ ID NO: 3113334 - protein, 9 aa, Giardia lamblia
GSRRSNTEA

SEQ ID NO: 3113335 - protein, 11 aa, Giardia lamblia
GSRSDNRDELK

SEQ ID NO: 3113336 - protein, 5 aa, Giardia lamblia
GSRSI

SEQ ID NO: 3113337 - protein, 6 aa, Giardia lamblia
GSRSSV

SEQ ID NO: 3113338 - protein, 9 aa, Giardia lamblia
GSRSTGTHR

SEQ ID NO: 3113339 - protein, 9 aa, Giardia lamblia
GSRSTPGTV

SEQ ID NO: 3113340 - protein, 5 aa, Giardia lamblia
GSRTE

SEQ ID NO: 3113341 - protein, 12 aa, Giardia lamblia
GSRVESTEFEGT

SEQ ID NO: 3113342 - protein, 9 aa, Giardia lamblia
GSRVKEHGR

SEQ ID NO: 3113343 - protein, 8 aa, Giardia lamblia
GSSAGETI

SEQ ID NO: 3113344 - protein, 7 aa, Giardia lamblia
GSSAGTR

SEQ ID NO: 3113345 - protein, 13 aa, Giardia lamblia
GSSCSSMKRPCSS

SEQ ID NO: 3113346 - protein, 13 aa, Giardia lamblia
GSSCSSMKRSCSS

SEQ ID NO: 3113347 - protein, 5 aa, Giardia lamblia
GSSDD

SEQ ID NO: 3113348 - protein, 15 aa, Giardia lamblia
GSSDSSNDNDPAPIL

SEQ ID NO: 3113349 - protein, 4 aa, Giardia lamblia
GSSE

SEQ ID NO: 3113350 - protein, 17 aa, Giardia lamblia
GSSECLSRGTQRTRPRS

SEQ ID NO: 3113351 - protein, 5 aa, Giardia lamblia
GSSEL

SEQ ID NO: 3113352 - protein, 21 aa, Giardia lamblia
GSSEPSRNQSKRGSVEDIETR

SEQ ID NO: 3113353 - protein, 9 aa, Giardia lamblia
GSSESGQYA

SEQ ID NO: 3113354 - protein, 19 aa, Giardia lamblia
GSSETVAGPVDAPDSTTKA

SEQ ID NO: 3113355 - protein, 9 aa, Giardia lamblia
GSSFTQEEI

SEQ ID NO: 3113356 - protein, 6 aa, Giardia lamblia
GSSGNK

SEQ ID NO: 3113357 - protein, 15 aa, Giardia lamblia
GSSGQGDVDAGPQFT

SEQ ID NO: 3113358 - protein, 7 aa, Giardia lamblia
GSSGYGL

SEQ ID NO: 3113359 - protein, 12 aa, Giardia lamblia
GSSKEAQEESRK

SEQ ID NO: 3113360 - protein, 9 aa, Giardia lamblia
GSSKHETAL

SEQ ID NO: 3113361 - protein, 6 aa, Giardia lamblia
GSSKLE

SEQ ID NO: 3113362 - protein, 8 aa, Giardia lamblia
GSSKPVRT

SEQ ID NO: 3113363 - protein, 4 aa, Giardia lamblia
GSSL

SEQ ID NO: 3113364 - protein, 23 aa, Giardia lamblia
GSSLSSSSQRVVSPQTNSPPARL

SEQ ID NO: 3113365 - protein, 7 aa, Giardia lamblia
GSSNGES

SEQ ID NO: 3113366 - protein, 22 aa, Giardia lamblia
GSSPSSTSTTVVDRTSDLRQTD

SEQ ID NO: 3113367 - protein, 15 aa, Giardia lamblia
GSSQPSSQVPPASVA

SEQ ID NO: 3113368 - protein, 18 aa, Giardia lamblia
GSSRGTSIEESSSLALDW

SEQ ID NO: 3113369 - protein, 7 aa, Giardia lamblia
GSSRYKD

SEQ ID NO: 3113370 - protein, 4 aa, Giardia lamblia
GSSS

SEQ ID NO: 3113371 - protein, 10 aa, Giardia lamblia
GSSSAEQRER

SEQ ID NO: 3113372 - protein, 17 aa, Giardia lamblia
GSSSQEDASSVPHSTRD

SEQ ID NO: 3113373 - protein, 10 aa, Giardia lamblia
GSSSQLENST

SEQ ID NO: 3113374 - protein, 9 aa, Giardia lamblia
GSSSYSQSL

SEQ ID NO: 3113375 - protein, 6 aa, Giardia lamblia
GSSTDA

SEQ ID NO: 3113376 - protein, 9 aa, Giardia lamblia
GSSTDTRVI

SEQ ID NO: 3113377 - protein, 10 aa, Giardia lamblia
GSSTESSGAT

SEQ ID NO: 3113378 - protein, 8 aa, Giardia lamblia
GSSVPGRS

SEQ ID NO: 3113379 - protein, 25 aa, Giardia lamblia
GSSYGDSMTRSTAKLERGGKHDPEL

SEQ ID NO: 3113380 - protein, 8 aa, Giardia lamblia
GSSYKAVP

SEQ ID NO: 3113381 - protein, 13 aa, Giardia lamblia
GSTALENAEGYGG

SEQ ID NO: 3113382 - protein, 9 aa, Giardia lamblia
GSTANKDCN

SEQ ID NO: 3113383 - protein, 29 aa, Giardia lamblia
GSTARTQKQPVQHSRGLTGTAPNVTSAGL

SEQ ID NO: 3113384 - protein, 6 aa, Giardia lamblia
GSTDGY

SEQ ID NO: 3113385 - protein, 15 aa, Giardia lamblia
GSTDSGAYTTGSPVS

SEQ ID NO: 3113386 - protein, 4 aa, Giardia lamblia
GSTE

SEQ ID NO: 3113387 - protein, 7 aa, Giardia lamblia
GSTERGF

SEQ ID NO: 3113388 - protein, 4 aa, Giardia lamblia
GSTF

SEQ ID NO: 3113389 - protein, 7 aa, Giardia lamblia
GSTFDSD

SEQ ID NO: 3113390 - protein, 11 aa, Giardia lamblia
GSTGASDDYGE

SEQ ID NO: 3113391 - protein, 5 aa, Giardia lamblia
GSTGE

SEQ ID NO: 3113392 - protein, 7 aa, Giardia lamblia
GSTGGAS

SEQ ID NO: 3113393 - protein, 11 aa, Giardia lamblia
GSTGSGKSTQI

SEQ ID NO: 3113394 - protein, 5 aa, Giardia lamblia
GSTKE

SEQ ID NO: 3113395 - protein, 45 aa, Giardia lamblia
GSTLGGPAASLAGRTVTAKPDQTPGPGDYEQDVNPIKSAAPSYSL

SEQ ID NO: 3113396 - protein, 11 aa, Giardia lamblia
GSTLNTTSAEA

SEQ ID NO: 3113397 - protein, 7 aa, Giardia lamblia
GSTMNSG

SEQ ID NO: 3113398 - protein, 20 aa, Giardia lamblia
GSTNNTKKESNLDSVAPSSI

SEQ ID NO: 3113399 - protein, 7 aa, Giardia lamblia
GSTNTDG

SEQ ID NO: 3113400 - protein, 8 aa, Giardia lamblia
GSTPLNTQ

SEQ ID NO: 3113401 - protein, 58 aa, Giardia lamblia
GSTPPVHSSTYSDPSPGKLARRTASTPSSTEKLTSASFNSTVSGSITKPFRQKDPGVV

SEQ ID NO: 3113402 - protein, 7 aa, Giardia lamblia
GSTQAEL

SEQ ID NO: 3113403 - protein, 33 aa, Giardia lamblia
GSTSEDTKSNTSSNPPGPDSDLKKEETATGDSA

SEQ ID NO: 3113404 - protein, 14 aa, Giardia lamblia
GSTSISDSHGTRRQ

SEQ ID NO: 3113405 - protein, 15 aa, Giardia lamblia
GSTSTLEQKSDQTIR

SEQ ID NO: 3113406 - protein, 7 aa, Giardia lamblia
GSTTLGN

SEQ ID NO: 3113407 - protein, 5 aa, Giardia lamblia
GSTTT

SEQ ID NO: 3113408 - protein, 8 aa, Giardia lamblia
GSTTTIAT

SEQ ID NO: 3113409 - protein, 4 aa, Giardia lamblia
GSTV

SEQ ID NO: 3113410 - protein, 10 aa, Giardia lamblia
GSTVDTTGAA

SEQ ID NO: 3113411 - protein, 7 aa, Giardia lamblia
GSTYAGT

SEQ ID NO: 3113412 - protein, 14 aa, Giardia lamblia
GSVAADEQSQTRKD

SEQ ID NO: 3113413 - protein, 10 aa, Giardia lamblia
GSVDSEGSTA

SEQ ID NO: 3113414 - protein, 4 aa, Giardia lamblia
GSVE

SEQ ID NO: 3113415 - protein, 5 aa, Giardia lamblia
GSVEA

SEQ ID NO: 3113416 - protein, 11 aa, Giardia lamblia
GSVEPGRRSAC

SEQ ID NO: 3113417 - protein, 8 aa, Giardia lamblia
GSVEPNAS

SEQ ID NO: 3113418 - protein, 11 aa, Giardia lamblia
GSVEPTSKQAP

SEQ ID NO: 3113419 - protein, 5 aa, Giardia lamblia
GSVGD

SEQ ID NO: 3113420 - protein, 5 aa, Giardia lamblia
GSVGS

SEQ ID NO: 3113421 - protein, 4 aa, Giardia lamblia
GSVK

SEQ ID NO: 3113422 - protein, 15 aa, Giardia lamblia
GSVMGASTAAHNGVT

SEQ ID NO: 3113423 - protein, 9 aa, Giardia lamblia
GSVNSDGLT

SEQ ID NO: 3113424 - protein, 4 aa, Giardia lamblia
GSVP

SEQ ID NO: 3113425 - protein, 23 aa, Giardia lamblia
GSVPPPTSTLTTNIKTSANAQGV

SEQ ID NO: 3113426 - protein, 13 aa, Giardia lamblia
GSVPSTQNQDQIV

SEQ ID NO: 3113427 - protein, 6 aa, Giardia lamblia
GSVPTL

SEQ ID NO: 3113428 - protein, 13 aa, Giardia lamblia
GSVQGDDPASSSV

SEQ ID NO: 3113429 - protein, 4 aa, Giardia lamblia
GSVS

SEQ ID NO: 3113430 - protein, 17 aa, Giardia lamblia
GSVSGAEAGCQAETGVA

SEQ ID NO: 3113431 - protein, 11 aa, Giardia lamblia
GSVSGDVSNGS

SEQ ID NO: 3113432 - protein, 5 aa, Giardia lamblia
GSVSR

SEQ ID NO: 3113433 - protein, 32 aa, Giardia lamblia
GSVSSAGDYHTPNFTSTPHALNSEKGSLNTDH

SEQ ID NO: 3113434 - protein, 4 aa, Giardia lamblia
GSVT

SEQ ID NO: 3113435 - protein, 9 aa, Giardia lamblia
GSVTIRERD

SEQ ID NO: 3113436 - protein, 5 aa, Giardia lamblia
GSYDG

SEQ ID NO: 3113437 - protein, 5 aa, Giardia lamblia
GSYDT

SEQ ID NO: 3113438 - protein, 7 aa, Giardia lamblia
GSYEEPI

SEQ ID NO: 3113439 - protein, 4 aa, Giardia lamblia
GSYG

SEQ ID NO: 3113440 - protein, 8 aa, Giardia lamblia
GSYNKPFT

SEQ ID NO: 3113441 - protein, 5 aa, Giardia lamblia
GSYPA

SEQ ID NO: 3113442 - protein, 5 aa, Giardia lamblia
GSYSK

SEQ ID NO: 3113443 - protein, 8 aa, Giardia lamblia
GSYSPDGK

SEQ ID NO: 3113444 - protein, 5 aa, Giardia lamblia
GSYSY

SEQ ID NO: 3113445 - protein, 4 aa, Giardia lamblia
GSYV

SEQ ID NO: 3113446 - protein, 7 aa, Giardia lamblia
GTAAGAK

SEQ ID NO: 3113447 - protein, 4 aa, Giardia lamblia
GTAC

SEQ ID NO: 3113448 - protein, 5 aa, Giardia lamblia
GTADG

SEQ ID NO: 3113449 - protein, 9 aa, Giardia lamblia
GTADNTQGS

SEQ ID NO: 3113450 - protein, 11 aa, Giardia lamblia
GTADTADEQPV

SEQ ID NO: 3113451 - protein, 11 aa, Giardia lamblia
GTAEARTRKSM

SEQ ID NO: 3113452 - protein, 13 aa, Giardia lamblia
GTAEEDLGNYAVL

SEQ ID NO: 3113453 - protein, 12 aa, Giardia lamblia
GTAEKYAGEFSA

SEQ ID NO: 3113454 - protein, 9 aa, Giardia lamblia
GTAHAGVSP

SEQ ID NO: 3113455 - protein, 24 aa, Giardia lamblia
GTAHQDKGVNITSELSGRDHTLSG

SEQ ID NO: 3113456 - protein, 14 aa, Giardia lamblia
GTAINEEEKLNSAN

SEQ ID NO: 3113457 - protein, 5 aa, Giardia lamblia
GTANY

SEQ ID NO: 3113458 - protein, 23 aa, Giardia lamblia
GTAPSITQSNSTIDGSKLSTSQL

SEQ ID NO: 3113459 - protein, 4 aa, Giardia lamblia
GTAQ

SEQ ID NO: 3113460 - protein, 5 aa, Giardia lamblia
GTARN

SEQ ID NO: 3113461 - protein, 5 aa, Giardia lamblia
GTARS

SEQ ID NO: 3113462 - protein, 11 aa, Giardia lamblia
GTASKASSGHL

SEQ ID NO: 3113463 - protein, 10 aa, Giardia lamblia
GTATRSAYDA

SEQ ID NO: 3113464 - protein, 11 aa, Giardia lamblia
GTATTASSSSV

SEQ ID NO: 3113465 - protein, 8 aa, Giardia lamblia
GTDAPDSK

SEQ ID NO: 3113466 - protein, 5 aa, Giardia lamblia
GTDDY

SEQ ID NO: 3113467 - protein, 16 aa, Giardia lamblia
GTDETSKARSSRRPLS

SEQ ID NO: 3113468 - protein, 4 aa, Giardia lamblia
GTDG

SEQ ID NO: 3113469 - protein, 10 aa, Giardia lamblia
GTDGNSRLSE

SEQ ID NO: 3113470 - protein, 4 aa, Giardia lamblia
GTDK

SEQ ID NO: 3113471 - protein, 5 aa, Giardia lamblia
GTDKY

SEQ ID NO: 3113472 - protein, 25 aa, Giardia lamblia
GTDLPGAQSSITGSSAGAPSDPRQE

SEQ ID NO: 3113473 - protein, 5 aa, Giardia lamblia
GTDNG

SEQ ID NO: 3113474 - protein, 8 aa, Giardia lamblia
GTDPALAQ

SEQ ID NO: 3113475 - protein, 6 aa, Giardia lamblia
GTDPHA

SEQ ID NO: 3113476 - protein, 9 aa, Giardia lamblia
GTDQANHTQ

SEQ ID NO: 3113477 - protein, 9 aa, Giardia lamblia
GTDQKNNTL

SEQ ID NO: 3113478 - protein, 4 aa, Giardia lamblia
GTDS

SEQ ID NO: 3113479 - protein, 5 aa, Giardia lamblia
GTDSI

SEQ ID NO: 3113480 - protein, 8 aa, Giardia lamblia
GTDTDTSQ

SEQ ID NO: 3113481 - protein, 37 aa, Giardia lamblia
GTDVSTAGLGGTTATSEATDRTANKTKIKTKKQLTNT

SEQ ID NO: 3113482 - protein, 11 aa, Giardia lamblia
GTEALQTGERD

SEQ ID NO: 3113483 - protein, 11 aa, Giardia lamblia
GTEANLQNART

SEQ ID NO: 3113484 - protein, 55 aa, Giardia lamblia
GTECSGQSMTTQNTSASSTVLGASSGRSSAKPVLAKSGTKASSSKVHSRIPQIQD

SEQ ID NO: 3113485 - protein, 7 aa, Giardia lamblia
GTEDEKE

SEQ ID NO: 3113486 - protein, 12 aa, Giardia lamblia
GTEEDLTAARTG

SEQ ID NO: 3113487 - protein, 23 aa, Giardia lamblia
GTEEEWRPGSPPAGRLSQATARC

SEQ ID NO: 3113488 - protein, 5 aa, Giardia lamblia
GTEEY

SEQ ID NO: 3113489 - protein, 4 aa, Giardia lamblia
GTEI

SEQ ID NO: 3113490 - protein, 26 aa, Giardia lamblia
GTEKEGSKSHSTSQLSESDTAELTTP

SEQ ID NO: 3113491 - protein, 12 aa, Giardia lamblia
GTEKKRARGLEA

SEQ ID NO: 3113492 - protein, 17 aa, Giardia lamblia
GTENRLQRSGSRHRGLS

SEQ ID NO: 3113493 - protein, 7 aa, Giardia lamblia
GTEPAHR

SEQ ID NO: 3113494 - protein, 7 aa, Giardia lamblia
GTEPNLK

SEQ ID NO: 3113495 - protein, 5 aa, Giardia lamblia
GTERV

SEQ ID NO: 3113496 - protein, 11 aa, Giardia lamblia
GTESDASVDYP

SEQ ID NO: 3113497 - protein, 8 aa, Giardia lamblia
GTESDGET

SEQ ID NO: 3113498 - protein, 11 aa, Giardia lamblia
GTESDPENPRN

SEQ ID NO: 3113499 - protein, 6 aa, Giardia lamblia
GTESGD

SEQ ID NO: 3113500 - protein, 13 aa, Giardia lamblia
GTESSVDKAKSIK

SEQ ID NO: 3113501 - protein, 14 aa, Giardia lamblia
GTESTNRQIYEDTG

SEQ ID NO: 3113502 - protein, 6 aa, Giardia lamblia
GTEYNT

SEQ ID NO: 3113503 - protein, 6 aa, Giardia lamblia
GTEYQS

SEQ ID NO: 3113504 - protein, 5 aa, Giardia lamblia
GTFDT

SEQ ID NO: 3113505 - protein, 5 aa, Giardia lamblia
GTFGT

SEQ ID NO: 3113506 - protein, 5 aa, Giardia lamblia
GTFPG

SEQ ID NO: 3113507 - protein, 6 aa, Giardia lamblia
GTFRPE

SEQ ID NO: 3113508 - protein, 11 aa, Giardia lamblia
GTGASLDSRYS

SEQ ID NO: 3113509 - protein, 7 aa, Giardia lamblia
GTGCRSQ

SEQ ID NO: 3113510 - protein, 7 aa, Giardia lamblia
GTGEAAH

SEQ ID NO: 3113511 - protein, 6 aa, Giardia lamblia
GTGEMQ

SEQ ID NO: 3113512 - protein, 8 aa, Giardia lamblia
GTGGAGGA

SEQ ID NO: 3113513 - protein, 6 aa, Giardia lamblia
GTGLNT

SEQ ID NO: 3113514 - protein, 8 aa, Giardia lamblia
GTGLSGSS

SEQ ID NO: 3113515 - protein, 10 aa, Giardia lamblia
GTGNQSLNTL

SEQ ID NO: 3113516 - protein, 15 aa, Giardia lamblia
GTGPAHDGASRTLHE

SEQ ID NO: 3113517 - protein, 5 aa, Giardia lamblia
GTGPF

SEQ ID NO: 3113518 - protein, 15 aa, Giardia lamblia
GTGPSSSHTMGPRKA

SEQ ID NO: 3113519 - protein, 6 aa, Giardia lamblia
GTGQLT

SEQ ID NO: 3113520 - protein, 5 aa, Giardia lamblia
GTGQY

SEQ ID NO: 3113521 - protein, 16 aa, Giardia lamblia
GTGRARSAPTAPRPRW

SEQ ID NO: 3113522 - protein, 7 aa, Giardia lamblia
GTGRSSF

SEQ ID NO: 3113523 - protein, 6 aa, Giardia lamblia
GTGRST

SEQ ID NO: 3113524 - protein, 7 aa, Giardia lamblia
GTGRTGT

SEQ ID NO: 3113525 - protein, 4 aa, Giardia lamblia
GTGS

SEQ ID NO: 3113526 - protein, 27 aa, Giardia lamblia
GTGSKLSGTNTPISKTQTLNSTSPHSD

SEQ ID NO: 3113527 - protein, 5 aa, Giardia lamblia
GTGTF

SEQ ID NO: 3113528 - protein, 5 aa, Giardia lamblia
GTGTH

SEQ ID NO: 3113529 - protein, 6 aa, Giardia lamblia
GTGTHI

SEQ ID NO: 3113530 - protein, 26 aa, Giardia lamblia
GTGVGLRGSSRNRSNTPSGHYSVRGP

SEQ ID NO: 3113531 - protein, 20 aa, Giardia lamblia
GTHEQTMQSTGHTAVNAAQT

SEQ ID NO: 3113532 - protein, 4 aa, Giardia lamblia
GTHT

SEQ ID NO: 3113533 - protein, 15 aa, Giardia lamblia
GTIAAAEAADPYPKV

SEQ ID NO: 3113534 - protein, 4 aa, Giardia lamblia
GTID

SEQ ID NO: 3113535 - protein, 59 aa, Giardia lamblia
GTIDPKVGVQSASGIPRSNKAQVTPRTPGAASQNSRGSRPGQPQSSGRPGSMSGPRPSK

SEQ ID NO: 3113536 - protein, 18 aa, Giardia lamblia
GTIDSSAVAKNQQKTVAN

SEQ ID NO: 3113537 - protein, 51 aa, Giardia lamblia
GTIESGGCTPSFSTKGAQSSQVTPGTSNPQPKRSTTLSDTLQGGDVYGSTD

SEQ ID NO: 3113538 - protein, 11 aa, Giardia lamblia
GTIGSSALSKP

SEQ ID NO: 3113539 - protein, 19 aa, Giardia lamblia
GTINKHKTSVPATASSPTV

SEQ ID NO: 3113540 - protein, 13 aa, Giardia lamblia
GTIPAKEAPSSKL

SEQ ID NO: 3113541 - protein, 6 aa, Giardia lamblia
GTIPHE

SEQ ID NO: 3113542 - protein, 19 aa, Giardia lamblia
GTIQRSGAAEASAVGRSTS

SEQ ID NO: 3113543 - protein, 7 aa, Giardia lamblia
GTISTYE

SEQ ID NO: 3113544 - protein, 5 aa, Giardia lamblia
GTITG

SEQ ID NO: 3113545 - protein, 9 aa, Giardia lamblia
GTITGCEPE

SEQ ID NO: 3113546 - protein, 8 aa, Giardia lamblia
GTKAGNPY

SEQ ID NO: 3113547 - protein, 4 aa, Giardia lamblia
GTKD

SEQ ID NO: 3113548 - protein, 9 aa, Giardia lamblia
GTKDGKEHI

SEQ ID NO: 3113549 - protein, 4 aa, Giardia lamblia
GTKE

SEQ ID NO: 3113550 - protein, 9 aa, Giardia lamblia
GTKMSDGTT

SEQ ID NO: 3113551 - protein, 16 aa, Giardia lamblia
GTKQAAQFSGYGQSGL

SEQ ID NO: 3113552 - protein, 38 aa, Giardia lamblia
GTKQRPSTKVRSRPSSSVSALPKDEGQNQGNKPEASPS

SEQ ID NO: 3113553 - protein, 10 aa, Giardia lamblia
GTKRSVGAQG

SEQ ID NO: 3113554 - protein, 7 aa, Giardia lamblia
GTKRYGA

SEQ ID NO: 3113555 - protein, 10 aa, Giardia lamblia
GTKSGSGKTF

SEQ ID NO: 3113556 - protein, 10 aa, Giardia lamblia
GTKTSEAQNR

SEQ ID NO: 3113557 - protein, 8 aa, Giardia lamblia
GTKTSQTI

SEQ ID NO: 3113558 - protein, 7 aa, Giardia lamblia
GTKVMSD

SEQ ID NO: 3113559 - protein, 6 aa, Giardia lamblia
GTLEDA

SEQ ID NO: 3113560 - protein, 9 aa, Giardia lamblia
GTLEQAEQQ

SEQ ID NO: 3113561 - protein, 8 aa, Giardia lamblia
GTLGETDN

SEQ ID NO: 3113562 - protein, 33 aa, Giardia lamblia
GTLGVDESNRPSSRPNPPQKQGKGASESSTSKV

SEQ ID NO: 3113563 - protein, 7 aa, Giardia lamblia
GTLPANT

SEQ ID NO: 3113564 - protein, 6 aa, Giardia lamblia
GTLRDE

SEQ ID NO: 3113565 - protein, 9 aa, Giardia lamblia
GTLSETDES

SEQ ID NO: 3113566 - protein, 17 aa, Giardia lamblia
GTLSNATRQKCLDALAG

SEQ ID NO: 3113567 - protein, 8 aa, Giardia lamblia
GTLTNNDP

SEQ ID NO: 3113568 - protein, 6 aa, Giardia lamblia
GTNDPA

SEQ ID NO: 3113569 - protein, 8 aa, Giardia lamblia
GTNDSEHL

SEQ ID NO: 3113570 - protein, 4 aa, Giardia lamblia
GTNE

SEQ ID NO: 3113571 - protein, 6 aa, Giardia lamblia
GTNEAG

SEQ ID NO: 3113572 - protein, 6 aa, Giardia lamblia
GTNETE

SEQ ID NO: 3113573 - protein, 9 aa, Giardia lamblia
GTNKNHNKK

SEQ ID NO: 3113574 - protein, 63 aa, Giardia lamblia
GTNPLSPRSPSRPVSRPVRSNSTLTARDNWTASTDSMQSHTEQAVNTNDTISSLSNSKAANTY

SEQ ID NO: 3113575 - protein, 6 aa, Giardia lamblia
GTNSGS

SEQ ID NO: 3113576 - protein, 7 aa, Giardia lamblia
GTNTTVT

SEQ ID NO: 3113577 - protein, 21 aa, Giardia lamblia
GTPAKDFSHGESSDAESRDAC

SEQ ID NO: 3113578 - protein, 7 aa, Giardia lamblia
GTPAPEL

SEQ ID NO: 3113579 - protein, 10 aa, Giardia lamblia
GTPCGTQGVD

SEQ ID NO: 3113580 - protein, 16 aa, Giardia lamblia
GTPCSSTGPNASSATL

SEQ ID NO: 3113581 - protein, 7 aa, Giardia lamblia
GTPDSFR

SEQ ID NO: 3113582 - protein, 9 aa, Giardia lamblia
GTPDSPECG

SEQ ID NO: 3113583 - protein, 7 aa, Giardia lamblia
GTPETTE

SEQ ID NO: 3113584 - protein, 20 aa, Giardia lamblia
GTPGKSKSEYMTKRQSNPLD

SEQ ID NO: 3113585 - protein, 8 aa, Giardia lamblia
GTPGSGVT

SEQ ID NO: 3113586 - protein, 5 aa, Giardia lamblia
GTPGV

SEQ ID NO: 3113587 - protein, 6 aa, Giardia lamblia
GTPIEP

SEQ ID NO: 3113588 - protein, 14 aa, Giardia lamblia
GTPIHNDPSHGGLQ

SEQ ID NO: 3113589 - protein, 6 aa, Giardia lamblia
GTPISP

SEQ ID NO: 3113590 - protein, 7 aa, Giardia lamblia
GTPKAVS

SEQ ID NO: 3113591 - protein, 17 aa, Giardia lamblia
GTPKYSVAQETRRTRDP

SEQ ID NO: 3113592 - protein, 7 aa, Giardia lamblia
GTPLEDA

SEQ ID NO: 3113593 - protein, 17 aa, Giardia lamblia
GTPLGSKRVEGQSSNSV

SEQ ID NO: 3113594 - protein, 6 aa, Giardia lamblia
GTPNKT

SEQ ID NO: 3113595 - protein, 6 aa, Giardia lamblia
GTPPFS

SEQ ID NO: 3113596 - protein, 11 aa, Giardia lamblia
GTPQGSSPPAF

SEQ ID NO: 3113597 - protein, 10 aa, Giardia lamblia
GTPRRGTRAH

SEQ ID NO: 3113598 - protein, 8 aa, Giardia lamblia
GTPSAQTV

SEQ ID NO: 3113599 - protein, 9 aa, Giardia lamblia
GTPSPDQQK

SEQ ID NO: 3113600 - protein, 8 aa, Giardia lamblia
GTPVPGSR

SEQ ID NO: 3113601 - protein, 7 aa, Giardia lamblia
GTPVTQQ

SEQ ID NO: 3113602 - protein, 4 aa, Giardia lamblia
GTPW

SEQ ID NO: 3113603 - protein, 14 aa, Giardia lamblia
GTPYSRKEHPEGSE

SEQ ID NO: 3113604 - protein, 6 aa, Giardia lamblia
GTQAKC

SEQ ID NO: 3113605 - protein, 4 aa, Giardia lamblia
GTQE

SEQ ID NO: 3113606 - protein, 10 aa, Giardia lamblia
GTQGGRSSAP

SEQ ID NO: 3113607 - protein, 6 aa, Giardia lamblia
GTQGTL

SEQ ID NO: 3113608 - protein, 9 aa, Giardia lamblia
GTQLEQSKH

SEQ ID NO: 3113609 - protein, 8 aa, Giardia lamblia
GTQNADGL

SEQ ID NO: 3113610 - protein, 5 aa, Giardia lamblia
GTQNV

SEQ ID NO: 3113611 - protein, 18 aa, Giardia lamblia
GTQRMSSTLGGVEEATRT

SEQ ID NO: 3113612 - protein, 6 aa, Giardia lamblia
GTQSQL

SEQ ID NO: 3113613 - protein, 9 aa, Giardia lamblia
GTQSTVSNT

SEQ ID NO: 3113614 - protein, 10 aa, Giardia lamblia
GTQSYDSTKA

SEQ ID NO: 3113615 - protein, 5 aa, Giardia lamblia
GTQTG

SEQ ID NO: 3113616 - protein, 4 aa, Giardia lamblia
GTQV

SEQ ID NO: 3113617 - protein, 10 aa, Giardia lamblia
GTQVDDDIAA

SEQ ID NO: 3113618 - protein, 4 aa, Giardia lamblia
GTQY

SEQ ID NO: 3113619 - protein, 6 aa, Giardia lamblia
GTRAGS

SEQ ID NO: 3113620 - protein, 19 aa, Giardia lamblia
GTRARVAGSEDGVSAKGKE

SEQ ID NO: 3113621 - protein, 9 aa, Giardia lamblia
GTRAVGGQR

SEQ ID NO: 3113622 - protein, 5 aa, Giardia lamblia
GTRDQ

SEQ ID NO: 3113623 - protein, 10 aa, Giardia lamblia
GTREEKREIA

SEQ ID NO: 3113624 - protein, 16 aa, Giardia lamblia
GTRLRPMTDSTPKPLL

SEQ ID NO: 3113625 - protein, 9 aa, Giardia lamblia
GTRSDKDRL

SEQ ID NO: 3113626 - protein, 5 aa, Giardia lamblia
GTRSG

SEQ ID NO: 3113627 - protein, 9 aa, Giardia lamblia
GTRSVQGLP

SEQ ID NO: 3113628 - protein, 5 aa, Giardia lamblia
GTRVA

SEQ ID NO: 3113629 - protein, 6 aa, Giardia lamblia
GTRVHR

SEQ ID NO: 3113630 - protein, 4 aa, Giardia lamblia
GTSA

SEQ ID NO: 3113631 - protein, 19 aa, Giardia lamblia
GTSAAGAAAASSHTGALAG

SEQ ID NO: 3113632 - protein, 7 aa, Giardia lamblia
GTSAGDV

SEQ ID NO: 3113633 - protein, 5 aa, Giardia lamblia
GTSAY

SEQ ID NO: 3113634 - protein, 6 aa, Giardia lamblia
GTSCSA

SEQ ID NO: 3113635 - protein, 7 aa, Giardia lamblia
GTSDSNM

SEQ ID NO: 3113636 - protein, 4 aa, Giardia lamblia
GTSE

SEQ ID NO: 3113637 - protein, 10 aa, Giardia lamblia
GTSGASSPNY

SEQ ID NO: 3113638 - protein, 6 aa, Giardia lamblia
GTSGTY

SEQ ID NO: 3113639 - protein, 9 aa, Giardia lamblia
GTSKGPQIP

SEQ ID NO: 3113640 - protein, 13 aa, Giardia lamblia
GTSKLRPRRHSTS

SEQ ID NO: 3113641 - protein, 8 aa, Giardia lamblia
GTSKQLPL

SEQ ID NO: 3113642 - protein, 6 aa, Giardia lamblia
GTSKQP

SEQ ID NO: 3113643 - protein, 15 aa, Giardia lamblia
GTSLGSDSNSAPDNT

SEQ ID NO: 3113644 - protein, 60 aa, Giardia lamblia
GTSLQKDNSYDKQSDAKPQPSVEASKDSKNAPVRPTRSSNRGSNKSKLNPNDEDPKSVTA

SEQ ID NO: 3113645 - protein, 5 aa, Giardia lamblia
GTSPH

SEQ ID NO: 3113646 - protein, 7 aa, Giardia lamblia
GTSPLSA

SEQ ID NO: 3113647 - protein, 5 aa, Giardia lamblia
GTSRD

SEQ ID NO: 3113648 - protein, 9 aa, Giardia lamblia
GTSRDSADQ

SEQ ID NO: 3113649 - protein, 8 aa, Giardia lamblia
GTSRLRSK

SEQ ID NO: 3113650 - protein, 11 aa, Giardia lamblia
GTSRNSAGKQI

SEQ ID NO: 3113651 - protein, 30 aa, Giardia lamblia
GTSRTRGVQGTENKAAKAARELVEPGKPAF

SEQ ID NO: 3113652 - protein, 11 aa, Giardia lamblia
GTSRVFGPGNE

SEQ ID NO: 3113653 - protein, 7 aa, Giardia lamblia
GTSSDNV

SEQ ID NO: 3113654 - protein, 10 aa, Giardia lamblia
GTSSKKRPSN

SEQ ID NO: 3113655 - protein, 6 aa, Giardia lamblia
GTSTGV

SEQ ID NO: 3113656 - protein, 11 aa, Giardia lamblia
GTSTYSGAALD

SEQ ID NO: 3113657 - protein, 27 aa, Giardia lamblia
GTSYAPENPDGDRCDANSGVLSETQDL

SEQ ID NO: 3113658 - protein, 9 aa, Giardia lamblia
GTSYNSQSD

SEQ ID NO: 3113659 - protein, 8 aa, Giardia lamblia
GTSYTPTT

SEQ ID NO: 3113660 - protein, 14 aa, Giardia lamblia
GTTAMKTGPPGTSN

SEQ ID NO: 3113661 - protein, 6 aa, Giardia lamblia
GTTAQT

SEQ ID NO: 3113662 - protein, 10 aa, Giardia lamblia
GTTATLSKQA

SEQ ID NO: 3113663 - protein, 5 aa, Giardia lamblia
GTTDG

SEQ ID NO: 3113664 - protein, 5 aa, Giardia lamblia
GTTDS

SEQ ID NO: 3113665 - protein, 8 aa, Giardia lamblia
GTTEEDIE

SEQ ID NO: 3113666 - protein, 8 aa, Giardia lamblia
GTTEPLNS

SEQ ID NO: 3113667 - protein, 7 aa, Giardia lamblia
GTTEYEE

SEQ ID NO: 3113668 - protein, 7 aa, Giardia lamblia
GTTGEIY

SEQ ID NO: 3113669 - protein, 4 aa, Giardia lamblia
GTTI

SEQ ID NO: 3113670 - protein, 9 aa, Giardia lamblia
GTTKPEPND

SEQ ID NO: 3113671 - protein, 8 aa, Giardia lamblia
GTTLPQSI

SEQ ID NO: 3113672 - protein, 6 aa, Giardia lamblia
GTTLSQ

SEQ ID NO: 3113673 - protein, 6 aa, Giardia lamblia
GTTPKH

SEQ ID NO: 3113674 - protein, 7 aa, Giardia lamblia
GTTPKPI

SEQ ID NO: 3113675 - protein, 4 aa, Giardia lamblia
GTTQ

SEQ ID NO: 3113676 - protein, 9 aa, Giardia lamblia
GTTQTESHS

SEQ ID NO: 3113677 - protein, 18 aa, Giardia lamblia
GTTRKQPLKTDSQHRLPD

SEQ ID NO: 3113678 - protein, 5 aa, Giardia lamblia
GTTRS

SEQ ID NO: 3113679 - protein, 5 aa, Giardia lamblia
GTTRW

SEQ ID NO: 3113680 - protein, 7 aa, Giardia lamblia
GTTSEHD

SEQ ID NO: 3113681 - protein, 5 aa, Giardia lamblia
GTTSN

SEQ ID NO: 3113682 - protein, 5 aa, Giardia lamblia
GTTSP

SEQ ID NO: 3113683 - protein, 6 aa, Giardia lamblia
GTTSSP

SEQ ID NO: 3113684 - protein, 6 aa, Giardia lamblia
GTTSTT

SEQ ID NO: 3113685 - protein, 6 aa, Giardia lamblia
GTTTGQ

SEQ ID NO: 3113686 - protein, 12 aa, Giardia lamblia
GTTTKRGGTGGI

SEQ ID NO: 3113687 - protein, 7 aa, Giardia lamblia
GTTTVRS

SEQ ID NO: 3113688 - protein, 8 aa, Giardia lamblia
GTTVGDKT

SEQ ID NO: 3113689 - protein, 17 aa, Giardia lamblia
GTTVSAYATGPQLKRYL

SEQ ID NO: 3113690 - protein, 4 aa, Giardia lamblia
GTTY

SEQ ID NO: 3113691 - protein, 11 aa, Giardia lamblia
GTVADEDEHNL

SEQ ID NO: 3113692 - protein, 5 aa, Giardia lamblia
GTVAE

SEQ ID NO: 3113693 - protein, 5 aa, Giardia lamblia
GTVAQ

SEQ ID NO: 3113694 - protein, 10 aa, Giardia lamblia
GTVDRSDNTA

SEQ ID NO: 3113695 - protein, 4 aa, Giardia lamblia
GTVE

SEQ ID NO: 3113696 - protein, 13 aa, Giardia lamblia
GTVKNSSNEVLPR

SEQ ID NO: 3113697 - protein, 6 aa, Giardia lamblia
GTVPCK

SEQ ID NO: 3113698 - protein, 15 aa, Giardia lamblia
GTVPTADSPENADRD

SEQ ID NO: 3113699 - protein, 7 aa, Giardia lamblia
GTVQYGK

SEQ ID NO: 3113700 - protein, 12 aa, Giardia lamblia
GTVSERPSTCRN

SEQ ID NO: 3113701 - protein, 5 aa, Giardia lamblia
GTVSQ

SEQ ID NO: 3113702 - protein, 11 aa, Giardia lamblia
GTVTTAVSGRT

SEQ ID NO: 3113703 - protein, 6 aa, Giardia lamblia
GTYPVS

SEQ ID NO: 3113704 - protein, 6 aa, Giardia lamblia
GVADQA

SEQ ID NO: 3113705 - protein, 15 aa, Giardia lamblia
GVAGNGSQGPESNTL

SEQ ID NO: 3113706 - protein, 7 aa, Giardia lamblia
GVANSMG

SEQ ID NO: 3113707 - protein, 14 aa, Giardia lamblia
GVAPGSTSSQSGNI

SEQ ID NO: 3113708 - protein, 7 aa, Giardia lamblia
GVAPPEV

SEQ ID NO: 3113709 - protein, 5 aa, Giardia lamblia
GVAPS

SEQ ID NO: 3113710 - protein, 8 aa, Giardia lamblia
GVAQTTAT

SEQ ID NO: 3113711 - protein, 11 aa, Giardia lamblia
GVASNADTLSA

SEQ ID NO: 3113712 - protein, 7 aa, Giardia lamblia
GVCDNSG

SEQ ID NO: 3113713 - protein, 9 aa, Giardia lamblia
GVDATNISS

SEQ ID NO: 3113714 - protein, 5 aa, Giardia lamblia
GVDDQ

SEQ ID NO: 3113715 - protein, 9 aa, Giardia lamblia
GVDGNSGLL

SEQ ID NO: 3113716 - protein, 12 aa, Giardia lamblia
GVDGTGSVYNPD

SEQ ID NO: 3113717 - protein, 12 aa, Giardia lamblia
GVDSNTTGAEGS

SEQ ID NO: 3113718 - protein, 7 aa, Giardia lamblia
GVDTTKM

SEQ ID NO: 3113719 - protein, 5 aa, Giardia lamblia
GVEDA

SEQ ID NO: 3113720 - protein, 9 aa, Giardia lamblia
GVEDGKLNP

SEQ ID NO: 3113721 - protein, 9 aa, Giardia lamblia
GVEGKEATC

SEQ ID NO: 3113722 - protein, 9 aa, Giardia lamblia
GVEKYTPSQ

SEQ ID NO: 3113723 - protein, 7 aa, Giardia lamblia
GVENPYD

SEQ ID NO: 3113724 - protein, 14 aa, Giardia lamblia
GVERETLQKENASL

SEQ ID NO: 3113725 - protein, 23 aa, Giardia lamblia
GVEVDSGNIKSAMKSAKTKLGQH

SEQ ID NO: 3113726 - protein, 9 aa, Giardia lamblia
GVGADGHPY

SEQ ID NO: 3113727 - protein, 10 aa, Giardia lamblia
GVGADGRPYQ

SEQ ID NO: 3113728 - protein, 5 aa, Giardia lamblia
GVGDE

SEQ ID NO: 3113729 - protein, 16 aa, Giardia lamblia
GVGEKRARALRDAGYR

SEQ ID NO: 3113730 - protein, 4 aa, Giardia lamblia
GVGG

SEQ ID NO: 3113731 - protein, 7 aa, Giardia lamblia
GVGKTTS

SEQ ID NO: 3113732 - protein, 4 aa, Giardia lamblia
GVGL

SEQ ID NO: 3113733 - protein, 5 aa, Giardia lamblia
GVGLE

SEQ ID NO: 3113734 - protein, 4 aa, Giardia lamblia
GVGN

SEQ ID NO: 3113735 - protein, 6 aa, Giardia lamblia
GVGPVP

SEQ ID NO: 3113736 - protein, 5 aa, Giardia lamblia
GVGQA

SEQ ID NO: 3113737 - protein, 14 aa, Giardia lamblia
GVGRGNSTAKQLEE

SEQ ID NO: 3113738 - protein, 6 aa, Giardia lamblia
GVGRPA

SEQ ID NO: 3113739 - protein, 11 aa, Giardia lamblia
GVGSDRNFSGV

SEQ ID NO: 3113740 - protein, 9 aa, Giardia lamblia
GVGSSAEKL

SEQ ID NO: 3113741 - protein, 8 aa, Giardia lamblia
GVGTDTLS

SEQ ID NO: 3113742 - protein, 9 aa, Giardia lamblia
GVGTPSPVT

SEQ ID NO: 3113743 - protein, 8 aa, Giardia lamblia
GVGTQTPR

SEQ ID NO: 3113744 - protein, 7 aa, Giardia lamblia
GVGYSTA

SEQ ID NO: 3113745 - protein, 7 aa, Giardia lamblia
GVGYTGR

SEQ ID NO: 3113746 - protein, 17 aa, Giardia lamblia
GVHENEPLRRNSLKSGR

SEQ ID NO: 3113747 - protein, 9 aa, Giardia lamblia
GVHRSRQKF

SEQ ID NO: 3113748 - protein, 4 aa, Giardia lamblia
GVKD

SEQ ID NO: 3113749 - protein, 8 aa, Giardia lamblia
GVKDPESM

SEQ ID NO: 3113750 - protein, 8 aa, Giardia lamblia
GVKGATAD

SEQ ID NO: 3113751 - protein, 11 aa, Giardia lamblia
GVKGGPSPKEL

SEQ ID NO: 3113752 - protein, 19 aa, Giardia lamblia
GVKGSSFDHAAQADRSYGI

SEQ ID NO: 3113753 - protein, 5 aa, Giardia lamblia
GVKPE

SEQ ID NO: 3113754 - protein, 5 aa, Giardia lamblia
GVKQT

SEQ ID NO: 3113755 - protein, 9 aa, Giardia lamblia
GVKTDRDGY

SEQ ID NO: 3113756 - protein, 12 aa, Giardia lamblia
GVMTSSSPTYTY

SEQ ID NO: 3113757 - protein, 11 aa, Giardia lamblia
GVNDKSSETYR

SEQ ID NO: 3113758 - protein, 9 aa, Giardia lamblia
GVNETVDDN

SEQ ID NO: 3113759 - protein, 6 aa, Giardia lamblia
GVNRES

SEQ ID NO: 3113760 - protein, 4 aa, Giardia lamblia
GVPA

SEQ ID NO: 3113761 - protein, 17 aa, Giardia lamblia
GVPDAPPIKPGEEQPLT

SEQ ID NO: 3113762 - protein, 18 aa, Giardia lamblia
GVPDGEDQSAESFPIDQM

SEQ ID NO: 3113763 - protein, 8 aa, Giardia lamblia
GVPDSRWK

SEQ ID NO: 3113764 - protein, 11 aa, Giardia lamblia
GVPGSSRHGAN

SEQ ID NO: 3113765 - protein, 18 aa, Giardia lamblia
GVPLPTDARGIPKSATDV

SEQ ID NO: 3113766 - protein, 5 aa, Giardia lamblia
GVPMG

SEQ ID NO: 3113767 - protein, 8 aa, Giardia lamblia
GVPNQTSL

SEQ ID NO: 3113768 - protein, 7 aa, Giardia lamblia
GVPPDHN

SEQ ID NO: 3113769 - protein, 7 aa, Giardia lamblia
GVPPTRL

SEQ ID NO: 3113770 - protein, 9 aa, Giardia lamblia
GVPRGPSPL

SEQ ID NO: 3113771 - protein, 10 aa, Giardia lamblia
GVPSGSPSPE

SEQ ID NO: 3113772 - protein, 10 aa, Giardia lamblia
GVPSHKEKHV

SEQ ID NO: 3113773 - protein, 13 aa, Giardia lamblia
GVPSVGRDMGSSG

SEQ ID NO: 3113774 - protein, 5 aa, Giardia lamblia
GVPTG

SEQ ID NO: 3113775 - protein, 4 aa, Giardia lamblia
GVPV

SEQ ID NO: 3113776 - protein, 8 aa, Giardia lamblia
GVQDKDGY

SEQ ID NO: 3113777 - protein, 7 aa, Giardia lamblia
GVQDSEV

SEQ ID NO: 3113778 - protein, 8 aa, Giardia lamblia
GVQDVAGT

SEQ ID NO: 3113779 - protein, 6 aa, Giardia lamblia
GVQGPA

SEQ ID NO: 3113780 - protein, 10 aa, Giardia lamblia
GVQNAQDDNC

SEQ ID NO: 3113781 - protein, 26 aa, Giardia lamblia
GVQNRNDPRNHEERTEQQRKLEEQRD

SEQ ID NO: 3113782 - protein, 7 aa, Giardia lamblia
GVQSPRV

SEQ ID NO: 3113783 - protein, 8 aa, Giardia lamblia
GVQTPSTE

SEQ ID NO: 3113784 - protein, 10 aa, Giardia lamblia
GVRNESGATA

SEQ ID NO: 3113785 - protein, 6 aa, Giardia lamblia
GVRPDA

SEQ ID NO: 3113786 - protein, 7 aa, Giardia lamblia
GVRPEEK

SEQ ID NO: 3113787 - protein, 8 aa, Giardia lamblia
GVRQPSTQ

SEQ ID NO: 3113788 - protein, 17 aa, Giardia lamblia
GVRQTTPPDASPIEGPS

SEQ ID NO: 3113789 - protein, 8 aa, Giardia lamblia
GVRSENTQ

SEQ ID NO: 3113790 - protein, 23 aa, Giardia lamblia
GVRSETRESGVSPSVMKKSSQAL

SEQ ID NO: 3113791 - protein, 19 aa, Giardia lamblia
GVRSTSSHERSESKVSREQ

SEQ ID NO: 3113792 - protein, 5 aa, Giardia lamblia
GVSDA

SEQ ID NO: 3113793 - protein, 10 aa, Giardia lamblia
GVSDAQSTKI

SEQ ID NO: 3113794 - protein, 8 aa, Giardia lamblia
GVSDEQKK

SEQ ID NO: 3113795 - protein, 5 aa, Giardia lamblia
GVSDG

SEQ ID NO: 3113796 - protein, 12 aa, Giardia lamblia
GVSDGLGRTMGT

SEQ ID NO: 3113797 - protein, 8 aa, Giardia lamblia
GVSDQPSQ

SEQ ID NO: 3113798 - protein, 9 aa, Giardia lamblia
GVSDRSGHM

SEQ ID NO: 3113799 - protein, 16 aa, Giardia lamblia
GVSDTSAVRADEENEV

SEQ ID NO: 3113800 - protein, 5 aa, Giardia lamblia
GVSED

SEQ ID NO: 3113801 - protein, 8 aa, Giardia lamblia
GVSEETYK

SEQ ID NO: 3113802 - protein, 10 aa, Giardia lamblia
GVSEGGNPIF

SEQ ID NO: 3113803 - protein, 10 aa, Giardia lamblia
GVSGRSSLHA

SEQ ID NO: 3113804 - protein, 13 aa, Giardia lamblia
GVSKPSAPLTSSS

SEQ ID NO: 3113805 - protein, 8 aa, Giardia lamblia
GVSLPQQA

SEQ ID NO: 3113806 - protein, 9 aa, Giardia lamblia
GVSNAANVA

SEQ ID NO: 3113807 - protein, 11 aa, Giardia lamblia
GVSNKNSEEEE

SEQ ID NO: 3113808 - protein, 5 aa, Giardia lamblia
GVSPE

SEQ ID NO: 3113809 - protein, 7 aa, Giardia lamblia
GVSPEQS

SEQ ID NO: 3113810 - protein, 17 aa, Giardia lamblia
GVSPPPSSRTSENRSIT

SEQ ID NO: 3113811 - protein, 53 aa, Giardia lamblia; identical to SEQ ID NO: 3054966

SEQ ID NO: 3113812 - protein, 5 aa, Giardia lamblia
GVSRN

SEQ ID NO: 3113813 - protein, 20 aa, Giardia lamblia
GVSSMKKRQALSEQTTEQQV

SEQ ID NO: 3113814 - protein, 12 aa, Giardia lamblia
GVSSPYRDHVKR

SEQ ID NO: 3113815 - protein, 9 aa, Giardia lamblia
GVSTKDPHI

SEQ ID NO: 3113816 - protein, 11 aa, Giardia lamblia
GVSTVGNTQID

SEQ ID NO: 3113817 - protein, 10 aa, Giardia lamblia
GVTARSGQTF

SEQ ID NO: 3113818 - protein, 9 aa, Giardia lamblia
GVTDDHKDA

SEQ ID NO: 3113819 - protein, 8 aa, Giardia lamblia
GVTEEEGK

SEQ ID NO: 3113820 - protein, 12 aa, Giardia lamblia
GVTFSPEDTNSF

SEQ ID NO: 3113821 - protein, 4 aa, Giardia lamblia
GVTG

SEQ ID NO: 3113822 - protein, 10 aa, Giardia lamblia
GVTPDKIEEL

SEQ ID NO: 3113823 - protein, 6 aa, Giardia lamblia
GVTQAD

SEQ ID NO: 3113824 - protein, 24 aa, Giardia lamblia
GVTSASTFSDKNRNHNIDYSDGDA

SEQ ID NO: 3113825 - protein, 12 aa, Giardia lamblia
GVTSSSSNVVDK

SEQ ID NO: 3113826 - protein, 16 aa, Giardia lamblia
GVTTDGNQQPITTAGR

SEQ ID NO: 3113827 - protein, 7 aa, Giardia lamblia
GVVGANK

SEQ ID NO: 3113828 - protein, 5 aa, Giardia lamblia
GVVGT

SEQ ID NO: 3113829 - protein, 6 aa, Giardia lamblia
GVVPDK

SEQ ID NO: 3113830 - protein, 8 aa, Giardia lamblia
GVVSSSRA

SEQ ID NO: 3113831 - protein, 12 aa, Giardia lamblia
GVVTGKARDNYP

SEQ ID NO: 3113832 - protein, 9 aa, Giardia lamblia
GVYPNDESR

SEQ ID NO: 3113833 - protein, 8 aa, Giardia lamblia
GWDSDEAK

SEQ ID NO: 3113834 - protein, 18 aa, Giardia lamblia
GWDTRSSAIDNKPNLPLS

SEQ ID NO: 3113835 - protein, 18 aa, Giardia lamblia
GWNGSGTGVFGDETSLTP

SEQ ID NO: 3113836 - protein, 12 aa, Giardia lamblia
GWSGNSKQPDRV

SEQ ID NO: 3113837 - protein, 5 aa, Giardia lamblia
GWSGS

SEQ ID NO: 3113838 - protein, 11 aa, Giardia lamblia
GWTGSPDPKPC

SEQ ID NO: 3113839 - protein, 6 aa, Giardia lamblia
GWTPVS

SEQ ID NO: 3113840 - protein, 46 aa, Giardia lamblia
GYANTTRTQRHGCPADEHDKDFSRTLKDTAPKYYEQPAPVKQRTEK

SEQ ID NO: 3113841 - protein, 8 aa, Giardia lamblia
GYAPYGQP

SEQ ID NO: 3113842 - protein, 31 aa, Giardia lamblia
GYATKGAGGSRRAHAASASDQYRPRSAYSAF

SEQ ID NO: 3113843 - protein, 5 aa, Giardia lamblia
GYDED

SEQ ID NO: 3113844 - protein, 6 aa, Giardia lamblia
GYDPGP

SEQ ID NO: 3113845 - protein, 10 aa, Giardia lamblia
GYDPKKDPRF

SEQ ID NO: 3113846 - protein, 5 aa, Giardia lamblia
GYDPQ

SEQ ID NO: 3113847 - protein, 13 aa, Giardia lamblia
GYDPRNSAPSSCL

SEQ ID NO: 3113848 - protein, 4 aa, Giardia lamblia
GYED

SEQ ID NO: 3113849 - protein, 10 aa, Giardia lamblia
GYENSNTYAA

SEQ ID NO: 3113850 - protein, 5 aa, Giardia lamblia
GYEPE

SEQ ID NO: 3113851 - protein, 4 aa, Giardia lamblia
GYES

SEQ ID NO: 3113852 - protein, 17 aa, Giardia lamblia
GYGASEGKSGEKTARRD

SEQ ID NO: 3113853 - protein, 8 aa, Giardia lamblia
GYGDGTAR

SEQ ID NO: 3113854 - protein, 12 aa, Giardia lamblia
GYGGFGPAAGAH

SEQ ID NO: 3113855 - protein, 5 aa, Giardia lamblia
GYGKE

SEQ ID NO: 3113856 - protein, 4 aa, Giardia lamblia
GYGP

SEQ ID NO: 3113857 - protein, 4 aa, Giardia lamblia
GYGR

SEQ ID NO: 3113858 - protein, 12 aa, Giardia lamblia
GYGTAKQGTAAV

SEQ ID NO: 3113859 - protein, 5 aa, Giardia lamblia
GYHSS

SEQ ID NO: 3113860 - protein, 6 aa, Giardia lamblia
GYKPEH

SEQ ID NO: 3113861 - protein, 8 aa, Giardia lamblia
GYKQASQQ

SEQ ID NO: 3113862 - protein, 29 aa, Giardia lamblia
GYLESSSGIASSINTATNHKIETEDSYGD

SEQ ID NO: 3113863 - protein, 12 aa, Giardia lamblia
GYNATSADDFED

SEQ ID NO: 3113864 - protein, 9 aa, Giardia lamblia
GYNHRTTPR

SEQ ID NO: 3113865 - protein, 12 aa, Giardia lamblia
GYNSSSHNVHDA

SEQ ID NO: 3113866 - protein, 9 aa, Giardia lamblia
GYNTSSEDR

SEQ ID NO: 3113867 - protein, 9 aa, Giardia lamblia
GYNTTGSVR

SEQ ID NO: 3113868 - protein, 4 aa, Giardia lamblia
GYPD

SEQ ID NO: 3113869 - protein, 18 aa, Giardia lamblia
GYPDEGHQRRQRGTSAHN

SEQ ID NO: 3113870 - protein, 7 aa, Giardia lamblia
GYPGTGY

SEQ ID NO: 3113871 - protein, 10 aa, Giardia lamblia
GYPSEQPRPY

SEQ ID NO: 3113872 - protein, 5 aa, Giardia lamblia
GYPSF

SEQ ID NO: 3113873 - protein, 14 aa, Giardia lamblia
GYPSLEERQGLSQN

SEQ ID NO: 3113874 - protein, 8 aa, Giardia lamblia
GYPTGSGL

SEQ ID NO: 3113875 - protein, 10 aa, Giardia lamblia
GYPTTTKSGE

SEQ ID NO: 3113876 - protein, 6 aa, Giardia lamblia
GYQDKD

SEQ ID NO: 3113877 - protein, 11 aa, Giardia lamblia
GYQDTDGRTAT

SEQ ID NO: 3113878 - protein, 5 aa, Giardia lamblia
GYQEQ

SEQ ID NO: 3113879 - protein, 5 aa, Giardia lamblia
GYQTD

SEQ ID NO: 3113880 - protein, 47 aa, Giardia lamblia
GYQTDQYQHGQDYGSSAYGDHNNGYGQSYGYDTQASYYNNGQEGQGQ

SEQ ID NO: 3113881 - protein, 15 aa, Giardia lamblia
GYRAEAYSTDAARPA

SEQ ID NO: 3113882 - protein, 15 aa, Giardia lamblia
GYRARPGIKKLLASL

SEQ ID NO: 3113883 - protein, 14 aa, Giardia lamblia
GYRDQYGKELPDDI

SEQ ID NO: 3113884 - protein, 4 aa, Giardia lamblia
GYRE

SEQ ID NO: 3113885 - protein, 13 aa, Giardia lamblia
GYRGSIQAGRRVE

SEQ ID NO: 3113886 - protein, 5 aa, Giardia lamblia
GYRQR

SEQ ID NO: 3113887 - protein, 4 aa, Giardia lamblia
GYSN

SEQ ID NO: 3113888 - protein, 6 aa, Giardia lamblia
GYSPDD

SEQ ID NO: 3113889 - protein, 12 aa, Giardia lamblia
GYSPGGGDAGIE

SEQ ID NO: 3113890 - protein, 5 aa, Giardia lamblia
GYSPT

SEQ ID NO: 3113891 - protein, 15 aa, Giardia lamblia
GYSQGPVGGPQTIEP

SEQ ID NO: 3113892 - protein, 4 aa, Giardia lamblia
GYSS

SEQ ID NO: 3113893 - protein, 5 aa, Giardia lamblia
GYSSE

SEQ ID NO: 3113894 - protein, 7 aa, Giardia lamblia
GYSSSTA

SEQ ID NO: 3113895 - protein, 16 aa, Giardia lamblia
GYSTSLKKGSEVQTMN

SEQ ID NO: 3113896 - protein, 6 aa, Giardia lamblia
GYSTTK

SEQ ID NO: 3113897 - protein, 5 aa, Giardia lamblia
GYSWP

SEQ ID NO: 3113898 - protein, 4 aa, Giardia lamblia
GYTA

SEQ ID NO: 3113899 - protein, 4 aa, Giardia lamblia
GYTD

SEQ ID NO: 3113900 - protein, 11 aa, Giardia lamblia
GYTDEKHSKAV

SEQ ID NO: 3113901 - protein, 5 aa, Giardia lamblia
GYTEK

SEQ ID NO: 3113902 - protein, 6 aa, Giardia lamblia
GYTPNA

SEQ ID NO: 3113903 - protein, 6 aa, Giardia lamblia
GYTPPT

SEQ ID NO: 3113904 - protein, 10 aa, Giardia lamblia
GYTPQGQLPN

SEQ ID NO: 3113905 - protein, 5 aa, Giardia lamblia
GYTRE

SEQ ID NO: 3113906 - protein, 5 aa, Giardia lamblia
GYTRR

SEQ ID NO: 3113907 - protein, 21 aa, Giardia lamblia
GYTRRGDSTISSSDIEGDNRY

SEQ ID NO: 3113908 - protein, 18 aa, Giardia lamblia
GYYDKSTSINKTEKSRDS

SEQ ID NO: 3113909 - protein, 4 aa, Giardia lamblia
HAAG

SEQ ID NO: 3113910 - protein, 4 aa, Giardia lamblia
HAAH

SEQ ID NO: 3113911 - protein, 18 aa, Giardia lamblia
HAAKTKELKDAEKHDTQM

SEQ ID NO: 3113912 - protein, 11 aa, Giardia lamblia
HAASQPTGGPF

SEQ ID NO: 3113913 - protein, 4 aa, Giardia lamblia
HADD

SEQ ID NO: 3113914 - protein, 5 aa, Giardia lamblia
HADEA

SEQ ID NO: 3113915 - protein, 11 aa, Giardia lamblia
HADEKNSTGQT

SEQ ID NO: 3113916 - protein, 4 aa, Giardia lamblia
HADK

SEQ ID NO: 3113917 - protein, 5 aa, Giardia lamblia
HADSS

SEQ ID NO: 3113918 - protein, 4 aa, Giardia lamblia
HAED

SEQ ID NO: 3113919 - protein, 10 aa, Giardia lamblia
HAEDPNPRFR

SEQ ID NO: 3113920 - protein, 5 aa, Giardia lamblia
HAEDT

SEQ ID NO: 3113921 - protein, 8 aa, Giardia lamblia
HAEEGGHS

SEQ ID NO: 3113922 - protein, 18 aa, Giardia lamblia
HAEEQAHPVHGREDAPQG

SEQ ID NO: 3113923 - protein, 10 aa, Giardia lamblia
HAENNDNRPL

SEQ ID NO: 3113924 - protein, 17 aa, Giardia lamblia
HAERNAKRKSEEPVREG

SEQ ID NO: 3113925 - protein, 10 aa, Giardia lamblia
HAERRDKVDT

SEQ ID NO: 3113926 - protein, 12 aa, Giardia lamblia
HAGKREKNGATA

SEQ ID NO: 3113927 - protein, 14 aa, Giardia lamblia
HAGNEARKRPRAEQ

SEQ ID NO: 3113928 - protein, 8 aa, Giardia lamblia
HAGNTGEC

SEQ ID NO: 3113929 - protein, 11 aa, Giardia lamblia
HAGRKDDKGRT

SEQ ID NO: 3113930 - protein, 6 aa, Giardia lamblia
HAGRQE

SEQ ID NO: 3113931 - protein, 4 aa, Giardia lamblia
HAHE

SEQ ID NO: 3113932 - protein, 10 aa, Giardia lamblia
HAHEDSGDLP

SEQ ID NO: 3113933 - protein, 5 aa, Giardia lamblia
HAIEG

SEQ ID NO: 3113934 - protein, 7 aa, Giardia lamblia
HAKDQEL

SEQ ID NO: 3113935 - protein, 21 aa, Giardia lamblia
HAKHRAHSRSTSNDAHGRERS

SEQ ID NO: 3113936 - protein, 7 aa, Giardia lamblia
HAKNEPE

SEQ ID NO: 3113937 - protein, 7 aa, Giardia lamblia
HAKQSAS

SEQ ID NO: 3113938 - protein, 5 aa, Giardia lamblia
HAKRD

SEQ ID NO: 3113939 - protein, 7 aa, Giardia lamblia
HAKRRGK

SEQ ID NO: 3113940 - protein, 10 aa, Giardia lamblia
HAKSGEEHDH

SEQ ID NO: 3113941 - protein, 6 aa, Giardia lamblia
HAKSSA

SEQ ID NO: 3113942 - protein, 34 aa, Giardia lamblia
HALDSSLDSRPQGSRTKQRDSSSSRISPAVNPSL

SEQ ID NO: 3113943 - protein, 4 aa, Giardia lamblia
HANN

SEQ ID NO: 3113944 - protein, 7 aa, Giardia lamblia
HANPLAD

SEQ ID NO: 3113945 - protein, 15 aa, Giardia lamblia
HANSLAKKDKKLAEL

SEQ ID NO: 3113946 - protein, 11 aa, Giardia lamblia
HANSSRGTEIN

SEQ ID NO: 3113947 - protein, 16 aa, Giardia lamblia
HAPDDRAKKTLKDTNM

SEQ ID NO: 3113948 - protein, 5 aa, Giardia lamblia
HAPDN

SEQ ID NO: 3113949 - protein, 19 aa, Giardia lamblia
HAPELGSSAVENSQVRVVK

SEQ ID NO: 3113950 - protein, 23 aa, Giardia lamblia
HAPGPSDTIEGGGNERGAHTQPL

SEQ ID NO: 3113951 - protein, 19 aa, Giardia lamblia
HAPPAQRESPGPGAAPRIG

SEQ ID NO: 3113952 - protein, 23 aa, Giardia lamblia
HAPPPPPESFSTTKRDKTNTQKL

SEQ ID NO: 3113953 - protein, 27 aa, Giardia lamblia
HAPPVPPSAPNIGQASSGITNSSALND

SEQ ID NO: 3113954 - protein, 11 aa, Giardia lamblia
HAPSHQATTVN

SEQ ID NO: 3113955 - protein, 19 aa, Giardia lamblia
HAPYNQDAPTEEPSLKRPP

SEQ ID NO: 3113956 - protein, 5 aa, Giardia lamblia
HAQAL

SEQ ID NO: 3113957 - protein, 27 aa, Giardia lamblia
HAQAQSSDPPRSSTGGPRYQKTPTALR

SEQ ID NO: 3113958 - protein, 4 aa, Giardia lamblia
HAQE

SEQ ID NO: 3113959 - protein, 5 aa, Giardia lamblia
HAQEM

SEQ ID NO: 3113960 - protein, 10 aa, Giardia lamblia
HAQGSKAFTA

SEQ ID NO: 3113961 - protein, 29 aa, Giardia lamblia
HAQGTRQLSPERYRYSPQDEYLERESSDF

SEQ ID NO: 3113962 - protein, 4 aa, Giardia lamblia
HAQL

SEQ ID NO: 3113963 - protein, 20 aa, Giardia lamblia
HAQPPRAPSSLKPSSSCGDL

SEQ ID NO: 3113964 - protein, 13 aa, Giardia lamblia
HARDGMGSASRRR

SEQ ID NO: 3113965 - protein, 10 aa, Giardia lamblia
HARPGRSGRT

SEQ ID NO: 3113966 - protein, 16 aa, Giardia lamblia
HARPRPPSMDSGMRPN

SEQ ID NO: 3113967 - protein, 12 aa, Giardia lamblia
HASASSKKAQAE

SEQ ID NO: 3113968 - protein, 38 aa, Giardia lamblia
HASDRHSDARESVDARAQQDDTAENSKQHLPHASSPVP

SEQ ID NO: 3113969 - protein, 5 aa, Giardia lamblia
HASDS

SEQ ID NO: 3113970 - protein, 10 aa, Giardia lamblia
HASEKASSCS

SEQ ID NO: 3113971 - protein, 14 aa, Giardia lamblia
HASGAPSDGGSFDD

SEQ ID NO: 3113972 - protein, 7 aa, Giardia lamblia
HASGDLS

SEQ ID NO: 3113973 - protein, 8 aa, Giardia lamblia
HASGHLSE

SEQ ID NO: 3113974 - protein, 12 aa, Giardia lamblia
HASGSGAAFSEA

SEQ ID NO: 3113975 - protein, 12 aa, Giardia lamblia
HASNQPALQSDA

SEQ ID NO: 3113976 - protein, 38 aa, Giardia lamblia
HASPHSSKGAQMASPTRRASRASDRRASTQSPTRNRSE

SEQ ID NO: 3113977 - protein, 6 aa, Giardia lamblia
HASQCS

SEQ ID NO: 3113978 - protein, 6 aa, Giardia lamblia
HASRGS

SEQ ID NO: 3113979 - protein, 8 aa, Giardia lamblia
HASRSGHS

SEQ ID NO: 3113980 - protein, 18 aa, Giardia lamblia
HASSASSFKNVPGHAEEI

SEQ ID NO: 3113981 - protein, 5 aa, Giardia lamblia
HASST

SEQ ID NO: 3113982 - protein, 4 aa, Giardia lamblia
HAST

SEQ ID NO: 3113983 - protein, 34 aa, Giardia lamblia
HASTPGYYTPRTYGTEVQTPVGYEEGEGASLDSH

SEQ ID NO: 3113984 - protein, 15 aa, Giardia lamblia
HASTRKRRRRGRASG

SEQ ID NO: 3113985 - protein, 6 aa, Giardia lamblia
HATAAQ

SEQ ID NO: 3113986 - protein, 8 aa, Giardia lamblia
HATAPSSY

SEQ ID NO: 3113987 - protein, 16 aa, Giardia lamblia
HATATSYKSRLGSKER

SEQ ID NO: 3113988 - protein, 9 aa, Giardia lamblia
HATPEATTA

SEQ ID NO: 3113989 - protein, 8 aa, Giardia lamblia
HATPPRAY

SEQ ID NO: 3113990 - protein, 13 aa, Giardia lamblia
HATQRRLSSGSGA

SEQ ID NO: 3113991 - protein, 12 aa, Giardia lamblia
HATSEYTEQCAS

SEQ ID NO: 3113992 - protein, 6 aa, Giardia lamblia
HATSLR

SEQ ID NO: 3113993 - protein, 9 aa, Giardia lamblia
HATSPIRNK

SEQ ID NO: 3113994 - protein, 71 aa, Giardia lamblia
HATSTGQVSTPNQAASVTPSAPLSARGKASKSKADKNDKADKTKKGKKKGEASEASDTPASATASQIAAED

SEQ ID NO: 3113995 - protein, 5 aa, Giardia lamblia
HATTL

SEQ ID NO: 3113996 - protein, 8 aa, Giardia lamblia
HATTQTEY

SEQ ID NO: 3113997 - protein, 6 aa, Giardia lamblia
HAVSKS

SEQ ID NO: 3113998 - protein, 10 aa, Giardia lamblia
HCNSPGQPSV

SEQ ID NO: 3113999 - protein, 5 aa, Giardia lamblia
HCPQR

SEQ ID NO: 3114000 - protein, 6 aa, Giardia lamblia
HCPSPE

SEQ ID NO: 3114001 - protein, 12 aa, Giardia lamblia
HCSDSDGANITR

SEQ ID NO: 3114002 - protein, 4 aa, Giardia lamblia
HDAE

SEQ ID NO: 3114003 - protein, 13 aa, Giardia lamblia
HDAEERERSKAEA

SEQ ID NO: 3114004 - protein, 9 aa, Giardia lamblia
HDANRREHL

SEQ ID NO: 3114005 - protein, 8 aa, Giardia lamblia
HDAQTAPG

SEQ ID NO: 3114006 - protein, 4 aa, Giardia lamblia
HDAR

SEQ ID NO: 3114007 - protein, 7 aa, Giardia lamblia
HDASNGY

SEQ ID NO: 3114008 - protein, 14 aa, Giardia lamblia
HDCGTDGRGSPATL

SEQ ID NO: 3114009 - protein, 10 aa, Giardia lamblia
HDDHEFPRTR

SEQ ID NO: 3114010 - protein, 10 aa, Giardia lamblia
HDDPTDTEGV

SEQ ID NO: 3114011 - protein, 8 aa, Giardia lamblia
HDDSSSEH

SEQ ID NO: 3114012 - protein, 7 aa, Giardia lamblia
HDDTGTH

SEQ ID NO: 3114013 - protein, 5 aa, Giardia lamblia
HDDTP

SEQ ID NO: 3114014 - protein, 7 aa, Giardia lamblia
HDEDPNV

SEQ ID NO: 3114015 - protein, 7 aa, Giardia lamblia
HDEDSSR

SEQ ID NO: 3114016 - protein, 16 aa, Giardia lamblia
HDEESSVGDTPGRGGY

SEQ ID NO: 3114017 - protein, 6 aa, Giardia lamblia
HDEKNR

SEQ ID NO: 3114018 - protein, 11 aa, Giardia lamblia
HDENDDSSYHL

SEQ ID NO: 3114019 - protein, 10 aa, Giardia lamblia
HDEPDTDSAS

SEQ ID NO: 3114020 - protein, 10 aa, Giardia lamblia
HDESVVNPPD

SEQ ID NO: 3114021 - protein, 7 aa, Giardia lamblia
HDEVRSA

SEQ ID NO: 3114022 - protein, 22 aa, Giardia lamblia
HDFPRDGTLSPASSDDSGIGSS

SEQ ID NO: 3114023 - protein, 19 aa, Giardia lamblia
HDFSTTLSGPFASTVPRNT

SEQ ID NO: 3114024 - protein, 8 aa, Giardia lamblia
HDGDANGA

SEQ ID NO: 3114025 - protein, 6 aa, Giardia lamblia
HDGETA

SEQ ID NO: 3114026 - protein, 5 aa, Giardia lamblia
HDGEV

SEQ ID NO: 3114027 - protein, 5 aa, Giardia lamblia
HDGGD

SEQ ID NO: 3114028 - protein, 13 aa, Giardia lamblia
HDGHSDNQTDYRI

SEQ ID NO: 3114029 - protein, 15 aa, Giardia lamblia
HDGRDRSTRKFGPNA

SEQ ID NO: 3114030 - protein, 8 aa, Giardia lamblia
HDGRSEPI

SEQ ID NO: 3114031 - protein, 6 aa, Giardia lamblia
HDIGST

SEQ ID NO: 3114032 - protein, 4 aa, Giardia lamblia
HDIP

SEQ ID NO: 3114033 - protein, 8 aa, Giardia lamblia
HDKDGGRH

SEQ ID NO: 3114034 - protein, 15 aa, Giardia lamblia
HDKSCVSGYLSLQKI

SEQ ID NO: 3114035 - protein, 7 aa, Giardia lamblia
HDKTAKE

SEQ ID NO: 3114036 - protein, 6 aa, Giardia lamblia
HDLPES

SEQ ID NO: 3114037 - protein, 6 aa, Giardia lamblia
HDLTEE

SEQ ID NO: 3114038 - protein, 35 aa, Giardia lamblia
HDNEESEGRMQKEREVSTEEEYEYEKQEREPVRAA

SEQ ID NO: 3114039 - protein, 14 aa, Giardia lamblia
HDNGSSLSSLPEST

SEQ ID NO: 3114040 - protein, 10 aa, Giardia lamblia
HDNPRSHQLP

SEQ ID NO: 3114041 - protein, 26 aa, Giardia lamblia
HDNSPSITDEQEARGADLPAPGGRTT

SEQ ID NO: 3114042 - protein, 11 aa, Giardia lamblia
HDPANLAEQPY

SEQ ID NO: 3114043 - protein, 12 aa, Giardia lamblia
HDPEKKTQTFSR

SEQ ID NO: 3114044 - protein, 5 aa, Giardia lamblia
HDPER

SEQ ID NO: 3114045 - protein, 13 aa, Giardia lamblia
HDPESQGKPISDS

SEQ ID NO: 3114046 - protein, 9 aa, Giardia lamblia
HDPGSDALS

SEQ ID NO: 3114047 - protein, 7 aa, Giardia lamblia
HDPGSKN

SEQ ID NO: 3114048 - protein, 7 aa, Giardia lamblia
HDPGTSP

SEQ ID NO: 3114049 - protein, 9 aa, Giardia lamblia
HDPLPRKPA

SEQ ID NO: 3114050 - protein, 16 aa, Giardia lamblia
HDPSTANAGRGTSRSI

SEQ ID NO: 3114051 - protein, 11 aa, Giardia lamblia
HDPTSDCAGGV

SEQ ID NO: 3114052 - protein, 6 aa, Giardia lamblia
HDQKLK

SEQ ID NO: 3114053 - protein, 7 aa, Giardia lamblia
HDRDDED

SEQ ID NO: 3114054 - protein, 10 aa, Giardia lamblia
HDRDPDRTRI

SEQ ID NO: 3114055 - protein, 8 aa, Giardia lamblia
HDRDTPHA

SEQ ID NO: 3114056 - protein, 7 aa, Giardia lamblia
HDREGAK

SEQ ID NO: 3114057 - protein, 8 aa, Giardia lamblia
HDRSKGAD

SEQ ID NO: 3114058 - protein, 37 aa, Giardia lamblia
HDRSLGWNSSDSSFFSQSTANKEGEEFKGNIDGPDGL

SEQ ID NO: 3114059 - protein, 5 aa, Giardia lamblia
HDRTA

SEQ ID NO: 3114060 - protein, 8 aa, Giardia lamblia
HDSAHASS

SEQ ID NO: 3114061 - protein, 6 aa, Giardia lamblia
HDSESQ

SEQ ID NO: 3114062 - protein, 8 aa, Giardia lamblia
HDSGDSAH

SEQ ID NO: 3114063 - protein, 17 aa, Giardia lamblia
HDSKAVKESLSNAAVGP

SEQ ID NO: 3114064 - protein, 11 aa, Giardia lamblia
HDSNTKTNKIA

SEQ ID NO: 3114065 - protein, 11 aa, Giardia lamblia
HDSSLSDGQLS

SEQ ID NO: 3114066 - protein, 4 aa, Giardia lamblia
HDST

SEQ ID NO: 3114067 - protein, 6 aa, Giardia lamblia
HDSYRT

SEQ ID NO: 3114068 - protein, 6 aa, Giardia lamblia
HDSYTL

SEQ ID NO: 3114069 - protein, 4 aa, Giardia lamblia
HDTE

SEQ ID NO: 3114070 - protein, 4 aa, Giardia lamblia
HDTG

SEQ ID NO: 3114071 - protein, 8 aa, Giardia lamblia
HDTGAYPR

SEQ ID NO: 3114072 - protein, 15 aa, Giardia lamblia
HDTHGTHAMSGSTVA

SEQ ID NO: 3114073 - protein, 11 aa, Giardia lamblia
HDTNDTGQKEV

SEQ ID NO: 3114074 - protein, 38 aa, Giardia lamblia
HDTPGVSRAATAGLDAPSISVPAPLSGVTASQERQSVP

SEQ ID NO: 3114075 - protein, 7 aa, Giardia lamblia
HDTPQTR

SEQ ID NO: 3114076 - protein, 6 aa, Giardia lamblia
HDTSTG

SEQ ID NO: 3114077 - protein, 12 aa, Giardia lamblia
HDTTKLDRPRPV

SEQ ID NO: 3114078 - protein, 17 aa, Giardia lamblia
HDTTTTNVGEYTYKSSN

SEQ ID NO: 3114079 - protein, 5 aa, Giardia lamblia
HDTVE

SEQ ID NO: 3114080 - protein, 6 aa, Giardia lamblia
HDVKEE

SEQ ID NO: 3114081 - protein, 6 aa, Giardia lamblia
HDYSNM

SEQ ID NO: 3114082 - protein, 7 aa, Giardia lamblia
HEAALND

SEQ ID NO: 3114083 - protein, 10 aa, Giardia lamblia
HEADGKTGFT

SEQ ID NO: 3114084 - protein, 11 aa, Giardia lamblia
HEAGARRNDGV

SEQ ID NO: 3114085 - protein, 11 aa, Giardia lamblia
HEAGETNDKGY

SEQ ID NO: 3114086 - protein, 5 aa, Giardia lamblia
HEAGK

SEQ ID NO: 3114087 - protein, 11 aa, Giardia lamblia
HEAGSKDNGGM

SEQ ID NO: 3114088 - protein, 27 aa, Giardia lamblia
HEAMEANREAHQDQLQTPAGGSRTDAS

SEQ ID NO: 3114089 - protein, 12 aa, Giardia lamblia
HEANYRTDASNF

SEQ ID NO: 3114090 - protein, 8 aa, Giardia lamblia
HEAPGESS

SEQ ID NO: 3114091 - protein, 8 aa, Giardia lamblia
HEAPKDVS

SEQ ID NO: 3114092 - protein, 5 aa, Giardia lamblia
HEAQQ

SEQ ID NO: 3114093 - protein, 4 aa, Giardia lamblia
HEAR

SEQ ID NO: 3114094 - protein, 8 aa, Giardia lamblia
HEARHDRR

SEQ ID NO: 3114095 - protein, 10 aa, Giardia lamblia
HEASGRGDFD

SEQ ID NO: 3114096 - protein, 5 aa, Giardia lamblia
HEATG

SEQ ID NO: 3114097 - protein, 9 aa, Giardia lamblia
HEATQGYKG

SEQ ID NO: 3114098 - protein, 10 aa, Giardia lamblia
HEDDDKKKAL

SEQ ID NO: 3114099 - protein, 11 aa, Giardia lamblia
HEDNKKVRASS

SEQ ID NO: 3114100 - protein, 33 aa, Giardia lamblia
HEDQIQAAAQRRKQQEEAHRRRSLASRDTELAE

SEQ ID NO: 3114101 - protein, 4 aa, Giardia lamblia
HEDS

SEQ ID NO: 3114102 - protein, 7 aa, Giardia lamblia
HEDSSQF

SEQ ID NO: 3114103 - protein, 6 aa, Giardia lamblia
HEDSSW

SEQ ID NO: 3114104 - protein, 7 aa, Giardia lamblia
HEDSSWT

SEQ ID NO: 3114105 - protein, 8 aa, Giardia lamblia
HEDTRDPV

SEQ ID NO: 3114106 - protein, 8 aa, Giardia lamblia
HEDYPAGG

SEQ ID NO: 3114107 - protein, 5 aa, Giardia lamblia
HEEED

SEQ ID NO: 3114108 - protein, 10 aa, Giardia lamblia
HEEEQKRRAA

SEQ ID NO: 3114109 - protein, 14 aa, Giardia lamblia
HEEETKTLEKSKGA

SEQ ID NO: 3114110 - protein, 5 aa, Giardia lamblia
HEENT

SEQ ID NO: 3114111 - protein, 4 aa, Giardia lamblia
HEEP

SEQ ID NO: 3114112 - protein, 10 aa, Giardia lamblia
HEEPEEDISS

SEQ ID NO: 3114113 - protein, 5 aa, Giardia lamblia
HEEPV

SEQ ID NO: 3114114 - protein, 15 aa, Giardia lamblia
HEESMTDDADNPKKQ

SEQ ID NO: 3114115 - protein, 4 aa, Giardia lamblia
HEGG

SEQ ID NO: 3114116 - protein, 5 aa, Giardia lamblia
HEGNC

SEQ ID NO: 3114117 - protein, 12 aa, Giardia lamblia
HEGPAEDERRTL

SEQ ID NO: 3114118 - protein, 4 aa, Giardia lamblia
HEGV

SEQ ID NO: 3114119 - protein, 4 aa, Giardia lamblia
HEGY

SEQ ID NO: 3114120 - protein, 25 aa, Giardia lamblia
HEHGHTPRVPSETSRYVSSTPGHTV

SEQ ID NO: 3114121 - protein, 12 aa, Giardia lamblia
HEHSSRDPQGRT

SEQ ID NO: 3114122 - protein, 4 aa, Giardia lamblia
HEIR

SEQ ID NO: 3114123 - protein, 25 aa, Giardia lamblia
HEITPEKHRTTSDSTHKGEDNADNK

SEQ ID NO: 3114124 - protein, 5 aa, Giardia lamblia
HEITR

SEQ ID NO: 3114125 - protein, 8 aa, Giardia lamblia
HEKAPKRP

SEQ ID NO: 3114126 - protein, 5 aa, Giardia lamblia
HEKEI

SEQ ID NO: 3114127 - protein, 4 aa, Giardia lamblia
HEKG

SEQ ID NO: 3114128 - protein, 8 aa, Giardia lamblia
HEKGEKVG

SEQ ID NO: 3114129 - protein, 9 aa, Giardia lamblia
HEKGEKVGG

SEQ ID NO: 3114130 - protein, 4 aa, Giardia lamblia
HELA

SEQ ID NO: 3114131 - protein, 27 aa, Giardia lamblia
HELTDNDKKDRYNAHHGQTSIEDNTDF

SEQ ID NO: 3114132 - protein, 11 aa, Giardia lamblia
HELTSDEQAMG

SEQ ID NO: 3114133 - protein, 29 aa, Giardia lamblia
HEMPSSSSAIPPPGSGNFAEAPRTPNECE

SEQ ID NO: 3114134 - protein, 9 aa, Giardia lamblia
HENGEKVGG

SEQ ID NO: 3114135 - protein, 4 aa, Giardia lamblia
HENI

SEQ ID NO: 3114136 - protein, 9 aa, Giardia lamblia
HENIDSSQT

SEQ ID NO: 3114137 - protein, 16 aa, Giardia lamblia
HENNEIGREHDQLSRE

SEQ ID NO: 3114138 - protein, 9 aa, Giardia lamblia
HENTELKSQ

SEQ ID NO: 3114139 - protein, 4 aa, Giardia lamblia
HEPA

SEQ ID NO: 3114140 - protein, 7 aa, Giardia lamblia
HEPENES

SEQ ID NO: 3114141 - protein, 10 aa, Giardia lamblia
HEPGGSGCQR

SEQ ID NO: 3114142 - protein, 14 aa, Giardia lamblia
HEPNHEPEHDPYPE

SEQ ID NO: 3114143 - protein, 10 aa, Giardia lamblia
HEPRTEEPFE

SEQ ID NO: 3114144 - protein, 9 aa, Giardia lamblia
HEPSPLSGK

SEQ ID NO: 3114145 - protein, 4 aa, Giardia lamblia
HEQA

SEQ ID NO: 3114146 - protein, 12 aa, Giardia lamblia
HEQAPISSAPPL

SEQ ID NO: 3114147 - protein, 5 aa, Giardia lamblia
HEQEM

SEQ ID NO: 3114148 - protein, 16 aa, Giardia lamblia
HEQKTPPQVPQPRPAG

SEQ ID NO: 3114149 - protein, 8 aa, Giardia lamblia
HEQPYSDP

SEQ ID NO: 3114150 - protein, 8 aa, Giardia lamblia
HEQRPAAE

SEQ ID NO: 3114151 - protein, 11 aa, Giardia lamblia
HERDAKGRIPT

SEQ ID NO: 3114152 - protein, 8 aa, Giardia lamblia
HERDLKEQ

SEQ ID NO: 3114153 - protein, 6 aa, Giardia lamblia
HERDYN

SEQ ID NO: 3114154 - protein, 11 aa, Giardia lamblia
HERGQADNLGR

SEQ ID NO: 3114155 - protein, 4 aa, Giardia lamblia
HERN

SEQ ID NO: 3114156 - protein, 10 aa, Giardia lamblia
HERNDNYDPS

SEQ ID NO: 3114157 - protein, 7 aa, Giardia lamblia
HERPDSA

SEQ ID NO: 3114158 - protein, 5 aa, Giardia lamblia
HERSP

SEQ ID NO: 3114159 - protein, 6 aa, Giardia lamblia
HERSVS

SEQ ID NO: 3114160 - protein, 12 aa, Giardia lamblia
HESAASIRSSRH

SEQ ID NO: 3114161 - protein, 9 aa, Giardia lamblia
HESDSQDTH

SEQ ID NO: 3114162 - protein, 6 aa, Giardia lamblia
HESEER

SEQ ID NO: 3114163 - protein, 8 aa, Giardia lamblia
HESGDTNI

SEQ ID NO: 3114164 - protein, 11 aa, Giardia lamblia
HESGMKDDRGM

SEQ ID NO: 3114165 - protein, 8 aa, Giardia lamblia
HESISKAA

SEQ ID NO: 3114166 - protein, 10 aa, Giardia lamblia
HESKELNQRL

SEQ ID NO: 3114167 - protein, 22 aa, Giardia lamblia
HESNASVYERGKAQLTEGYERK

SEQ ID NO: 3114168 - protein, 10 aa, Giardia lamblia
HESNGQTSEI

SEQ ID NO: 3114169 - protein, 6 aa, Giardia lamblia
HESPSW

SEQ ID NO: 3114170 - protein, 4 aa, Giardia lamblia
HESR

SEQ ID NO: 3114171 - protein, 18 aa, Giardia lamblia
HESSSTKQTTDKQTTDEL

SEQ ID NO: 3114172 - protein, 10 aa, Giardia lamblia
HESTMRDRRG

SEQ ID NO: 3114173 - protein, 4 aa, Giardia lamblia
HETA

SEQ ID NO: 3114174 - protein, 6 aa, Giardia lamblia
HETGGL

SEQ ID NO: 3114175 - protein, 6 aa, Giardia lamblia
HETNMN

SEQ ID NO: 3114176 - protein, 9 aa, Giardia lamblia
HETQLSPSA

SEQ ID NO: 3114177 - protein, 14 aa, Giardia lamblia
HETQRTPSAAMADS

SEQ ID NO: 3114178 - protein, 17 aa, Giardia lamblia
HETQSCSSKTEKHVTPK

SEQ ID NO: 3114179 - protein, 4 aa, Giardia lamblia
HETR

SEQ ID NO: 3114180 - protein, 12 aa, Giardia lamblia
HETSSHEEDALE

SEQ ID NO: 3114181 - protein, 27 aa, Giardia lamblia
HETTDLQPNGRGASLKEECDERYSEEP

SEQ ID NO: 3114182 - protein, 14 aa, Giardia lamblia
HETTRASVKREQRE

SEQ ID NO: 3114183 - protein, 7 aa, Giardia lamblia
HEVTPES

SEQ ID NO: 3114184 - protein, 5 aa, Giardia lamblia
HEYNG

SEQ ID NO: 3114185 - protein, 11 aa, Giardia lamblia
HEYPHTNEEKL

SEQ ID NO: 3114186 - protein, 6 aa, Giardia lamblia
HFDQGT

SEQ ID NO: 3114187 - protein, 16 aa, Giardia lamblia
HFGQKPAKKDQLREDL

SEQ ID NO: 3114188 - protein, 5 aa, Giardia lamblia
HFQEQ

SEQ ID NO: 3114189 - protein, 5 aa, Giardia lamblia
HFTED

SEQ ID NO: 3114190 - protein, 5 aa, Giardia lamblia
HFTGD

SEQ ID NO: 3114191 - protein, 6 aa, Giardia lamblia
HGAAES

SEQ ID NO: 3114192 - protein, 8 aa, Giardia lamblia
HGAEVDTE

SEQ ID NO: 3114193 - protein, 7 aa, Giardia lamblia
HGAFQKS

SEQ ID NO: 3114194 - protein, 13 aa, Giardia lamblia
HGAKMSKSKGNVV

SEQ ID NO: 3114195 - protein, 8 aa, Giardia lamblia
HGAPTTQA

SEQ ID NO: 3114196 - protein, 9 aa, Giardia lamblia
HGAQSNGDQ

SEQ ID NO: 3114197 - protein, 18 aa, Giardia lamblia
HGARSHSSFSSSALQTPN

SEQ ID NO: 3114198 - protein, 7 aa, Giardia lamblia
HGASEQR

SEQ ID NO: 3114199 - protein, 7 aa, Giardia lamblia
HGDDAAA

SEQ ID NO: 3114200 - protein, 16 aa, Giardia lamblia
HGDKTYKKDSDRRALS

SEQ ID NO: 3114201 - protein, 5 aa, Giardia lamblia
HGDNS

SEQ ID NO: 3114202 - protein, 8 aa, Giardia lamblia
HGDPYNTE

SEQ ID NO: 3114203 - protein, 4 aa, Giardia lamblia
HGDR

SEQ ID NO: 3114204 - protein, 5 aa, Giardia lamblia
HGDSG

SEQ ID NO: 3114205 - protein, 39 aa, Giardia lamblia
HGDSPQYSSRIPPGGYEDARHPIDPAEKKKLVRSLFKQS

SEQ ID NO: 3114206 - protein, 17 aa, Giardia lamblia
HGDSSTPDSSASQDAHK

SEQ ID NO: 3114207 - protein, 19 aa, Giardia lamblia
HGDTDGENSEGASSIAGTY

SEQ ID NO: 3114208 - protein, 13 aa, Giardia lamblia
HGEGSVDEHGNSA

SEQ ID NO: 3114209 - protein, 6 aa, Giardia lamblia
HGESID

SEQ ID NO: 3114210 - protein, 5 aa, Giardia lamblia
HGETH

SEQ ID NO: 3114211 - protein, 8 aa, Giardia lamblia
HGGAARES

SEQ ID NO: 3114212 - protein, 7 aa, Giardia lamblia
HGGELQQ

SEQ ID NO: 3114213 - protein, 12 aa, Giardia lamblia
HGGGRAAAQGVS

SEQ ID NO: 3114214 - protein, 20 aa, Giardia lamblia
HGGPKGPGVPPGTENSAQKA

SEQ ID NO: 3114215 - protein, 25 aa, Giardia lamblia
HGGRLAKGKGEKQRTEKKKGDEAQM

SEQ ID NO: 3114216 - protein, 7 aa, Giardia lamblia
HGGSEEE

SEQ ID NO: 3114217 - protein, 11 aa, Giardia lamblia
HGGTDSEFELP

SEQ ID NO: 3114218 - protein, 7 aa, Giardia lamblia
HGGTECS

SEQ ID NO: 3114219 - protein, 9 aa, Giardia lamblia
HGHGSSLQS

SEQ ID NO: 3114220 - protein, 5 aa, Giardia lamblia
HGHSY

SEQ ID NO: 3114221 - protein, 7 aa, Giardia lamblia
HGHTNSR

SEQ ID NO: 3114222 - protein, 6 aa, Giardia lamblia
HGIERT

SEQ ID NO: 3114223 - protein, 4 aa, Giardia lamblia
HGIP

SEQ ID NO: 3114224 - protein, 4 aa, Giardia lamblia
HGKA

SEQ ID NO: 3114225 - protein, 7 aa, Giardia lamblia
HGKDYDD

SEQ ID NO: 3114226 - protein, 6 aa, Giardia lamblia
HGKGEF

SEQ ID NO: 3114227 - protein, 34 aa, Giardia lamblia
HGKGLSSGGFHDHGGQSDGADKVKRYPSGGPKEI

SEQ ID NO: 3114228 - protein, 14 aa, Giardia lamblia
HGKPLDKQRCLFLL

SEQ ID NO: 3114229 - protein, 10 aa, Giardia lamblia
HGKRNNNGRT

SEQ ID NO: 3114230 - protein, 10 aa, Giardia lamblia
HGKRSNNGRT

SEQ ID NO: 3114231 - protein, 5 aa, Giardia lamblia
HGKTT

SEQ ID NO: 3114232 - protein, 14 aa, Giardia lamblia
HGKTTSRPASMRRT

SEQ ID NO: 3114233 - protein, 12 aa, Giardia lamblia
HGMKDASGNRAI

SEQ ID NO: 3114234 - protein, 6 aa, Giardia lamblia
HGNAKS

SEQ ID NO: 3114235 - protein, 5 aa, Giardia lamblia
HGNDN

SEQ ID NO: 3114236 - protein, 6 aa, Giardia lamblia
HGNEEA

SEQ ID NO: 3114237 - protein, 9 aa, Giardia lamblia
HGNKDDQGM

SEQ ID NO: 3114238 - protein, 10 aa, Giardia lamblia
HGNKEFHKKE

SEQ ID NO: 3114239 - protein, 6 aa, Giardia lamblia
HGNLST

SEQ ID NO: 3114240 - protein, 6 aa, Giardia lamblia
HGNPGH

SEQ ID NO: 3114241 - protein, 12 aa, Giardia lamblia
HGNSASKEIQSL

SEQ ID NO: 3114242 - protein, 6 aa, Giardia lamblia
HGNSDE

SEQ ID NO: 3114243 - protein, 5 aa, Giardia lamblia
HGNSN

SEQ ID NO: 3114244 - protein, 4 aa, Giardia lamblia
HGNT

SEQ ID NO: 3114245 - protein, 8 aa, Giardia lamblia
HGNTDDHT

SEQ ID NO: 3114246 - protein, 5 aa, Giardia lamblia
HGPAI

SEQ ID NO: 3114247 - protein, 14 aa, Giardia lamblia
HGPDAPVPSNLRSQ

SEQ ID NO: 3114248 - protein, 7 aa, Giardia lamblia
HGPEYGE

SEQ ID NO: 3114249 - protein, 9 aa, Giardia lamblia
HGPKEDANH

SEQ ID NO: 3114250 - protein, 12 aa, Giardia lamblia
HGPLSGSRGGMM

SEQ ID NO: 3114251 - protein, 5 aa, Giardia lamblia
HGPNW

SEQ ID NO: 3114252 - protein, 10 aa, Giardia lamblia
HGPSADDSAE

SEQ ID NO: 3114253 - protein, 11 aa, Giardia lamblia
HGPSENSGEAV

SEQ ID NO: 3114254 - protein, 10 aa, Giardia lamblia
HGQADKSSHV

SEQ ID NO: 3114255 - protein, 6 aa, Giardia lamblia
HGQARD

SEQ ID NO: 3114256 - protein, 7 aa, Giardia lamblia
HGQGTHV

SEQ ID NO: 3114257 - protein, 10 aa, Giardia lamblia
HGQKDSRGRT

SEQ ID NO: 3114258 - protein, 21 aa, Giardia lamblia
HGQKQSTQASSDISPKDAKAI

SEQ ID NO: 3114259 - protein, 5 aa, Giardia lamblia
HGQPG

SEQ ID NO: 3114260 - protein, 18 aa, Giardia lamblia
HGQSQRAYPLPQSYTDGP

SEQ ID NO: 3114261 - protein, 7 aa, Giardia lamblia
HGRDGSV

SEQ ID NO: 3114262 - protein, 6 aa, Giardia lamblia
HGRDSA

SEQ ID NO: 3114263 - protein, 6 aa, Giardia lamblia
HGREDE

SEQ ID NO: 3114264 - protein, 4 aa, Giardia lamblia
HGRR

SEQ ID NO: 3114265 - protein, 16 aa, Giardia lamblia
HGRRNGPGPYHDRRGI

SEQ ID NO: 3114266 - protein, 10 aa, Giardia lamblia
HGRRNNNNRT

SEQ ID NO: 3114267 - protein, 4 aa, Giardia lamblia
HGRV

SEQ ID NO: 3114268 - protein, 19 aa, Giardia lamblia
HGSATPAAPITQPPAPDKL

SEQ ID NO: 3114269 - protein, 10 aa, Giardia lamblia
HGSCDKDGRT

SEQ ID NO: 3114270 - protein, 6 aa, Giardia lamblia
HGSDAT

SEQ ID NO: 3114271 - protein, 5 aa, Giardia lamblia
HGSDG

SEQ ID NO: 3114272 - protein, 15 aa, Giardia lamblia
HGSDNSTTSAPGGTR

SEQ ID NO: 3114273 - protein, 21 aa, Giardia lamblia
HGSDVQPNTPLNVDGPSGPLF

SEQ ID NO: 3114274 - protein, 17 aa, Giardia lamblia
HGSGDVSTGGSVTPIGS

SEQ ID NO: 3114275 - protein, 6 aa, Giardia lamblia
HGSGNV

SEQ ID NO: 3114276 - protein, 14 aa, Giardia lamblia
HGSGSIQYSDGTRF

SEQ ID NO: 3114277 - protein, 4 aa, Giardia lamblia
HGSH

SEQ ID NO: 3114278 - protein, 4 aa, Giardia lamblia
HGSK

SEQ ID NO: 3114279 - protein, 8 aa, Giardia lamblia
HGSNIGKS

SEQ ID NO: 3114280 - protein, 30 aa, Giardia lamblia
HGSPAASPKRSRSPVASQAPESSSGASGLH

SEQ ID NO: 3114281 - protein, 7 aa, Giardia lamblia
HGSPATD

SEQ ID NO: 3114282 - protein, 8 aa, Giardia lamblia
HGSQEVET

SEQ ID NO: 3114283 - protein, 6 aa, Giardia lamblia
HGSQIP

SEQ ID NO: 3114284 - protein, 14 aa, Giardia lamblia
HGSQSGEPGPLTSS

SEQ ID NO: 3114285 - protein, 11 aa, Giardia lamblia
HGSRQTTLKGT

SEQ ID NO: 3114286 - protein, 5 aa, Giardia lamblia
HGSSE

SEQ ID NO: 3114287 - protein, 6 aa, Giardia lamblia
HGSSSM

SEQ ID NO: 3114288 - protein, 7 aa, Giardia lamblia
HGSTAAV

SEQ ID NO: 3114289 - protein, 9 aa, Giardia lamblia
HGSTDKTLQ

SEQ ID NO: 3114290 - protein, 11 aa, Giardia lamblia
HGSTGQQSIAP

SEQ ID NO: 3114291 - protein, 6 aa, Giardia lamblia
HGSTQT

SEQ ID NO: 3114292 - protein, 4 aa, Giardia lamblia
HGSY

SEQ ID NO: 3114293 - protein, 6 aa, Giardia lamblia
HGSYNQ

SEQ ID NO: 3114294 - protein, 4 aa, Giardia lamblia
HGTD

SEQ ID NO: 3114295 - protein, 5 aa, Giardia lamblia
HGTDL

SEQ ID NO: 3114296 - protein, 10 aa, Giardia lamblia
HGTDLTDATD

SEQ ID NO: 3114297 - protein, 6 aa, Giardia lamblia
HGTGTE

SEQ ID NO: 3114298 - protein, 9 aa, Giardia lamblia
HGTGTECDR

SEQ ID NO: 3114299 - protein, 6 aa, Giardia lamblia
HGTGTM

SEQ ID NO: 3114300 - protein, 5 aa, Giardia lamblia
HGTKK

SEQ ID NO: 3114301 - protein, 20 aa, Giardia lamblia
HGTMPSAPNIAAAPSCPAPP

SEQ ID NO: 3114302 - protein, 12 aa, Giardia lamblia
HGTPSTASVTRP

SEQ ID NO: 3114303 - protein, 7 aa, Giardia lamblia
HGTPSTV

SEQ ID NO: 3114304 - protein, 18 aa, Giardia lamblia
HGTRHSKGDTDSGTVEDA

SEQ ID NO: 3114305 - protein, 4 aa, Giardia lamblia
HGTS

SEQ ID NO: 3114306 - protein, 5 aa, Giardia lamblia
HGTTV

SEQ ID NO: 3114307 - protein, 10 aa, Giardia lamblia
HGVQDGGKHS

SEQ ID NO: 3114308 - protein, 10 aa, Giardia lamblia
HGYDDSRGDY

SEQ ID NO: 3114309 - protein, 5 aa, Giardia lamblia
HGYDG

SEQ ID NO: 3114310 - protein, 5 aa, Giardia lamblia
HHGAP

SEQ ID NO: 3114311 - protein, 9 aa, Giardia lamblia
HHHPSNADG

SEQ ID NO: 3114312 - protein, 5 aa, Giardia lamblia
HHNSG

SEQ ID NO: 3114313 - protein, 5 aa, Giardia lamblia
HHPSG

SEQ ID NO: 3114314 - protein, 37 aa, Giardia lamblia
HHQEGSSSSVLPSATTVQKISGPEERRKSARNINKNS

SEQ ID NO: 3114315 - protein, 5 aa, Giardia lamblia
HHRPS

SEQ ID NO: 3114316 - protein, 6 aa, Giardia lamblia
HHSGAQ

SEQ ID NO: 3114317 - protein, 15 aa, Giardia lamblia
HHSPPLSRSGDTRLT

SEQ ID NO: 3114318 - protein, 9 aa, Giardia lamblia
HHTSESDRR

SEQ ID NO: 3114319 - protein, 7 aa, Giardia lamblia
HHTTGTS

SEQ ID NO: 3114320 - protein, 11 aa, Giardia lamblia
HIDTSSDSCEI

SEQ ID NO: 3114321 - protein, 11 aa, Giardia lamblia
HIEPPDSSNPI

SEQ ID NO: 3114322 - protein, 5 aa, Giardia lamblia
HIKGD

SEQ ID NO: 3114323 - protein, 11 aa, Giardia lamblia
HIKPSTHDISR

SEQ ID NO: 3114324 - protein, 17 aa, Giardia lamblia
HIPERSSSSRHATRPTV

SEQ ID NO: 3114325 - protein, 9 aa, Giardia lamblia
HIPQDKRTE

SEQ ID NO: 3114326 - protein, 9 aa, Giardia lamblia
HIRNGAGKT

SEQ ID NO: 3114327 - protein, 6 aa, Giardia lamblia
HISGSQ

SEQ ID NO: 3114328 - protein, 5 aa, Giardia lamblia
HISPG

SEQ ID NO: 3114329 - protein, 7 aa, Giardia lamblia
HISRGRR

SEQ ID NO: 3114330 - protein, 4 aa, Giardia lamblia
HITG

SEQ ID NO: 3114331 - protein, 4 aa, Giardia lamblia
HITT

SEQ ID NO: 3114332 - protein, 7 aa, Giardia lamblia
HKADSNA

SEQ ID NO: 3114333 - protein, 5 aa, Giardia lamblia
HKAEG

SEQ ID NO: 3114334 - protein, 24 aa, Giardia lamblia
HKAPSFNDFESPEDADEYAPSSVQ

SEQ ID NO: 3114335 - protein, 6 aa, Giardia lamblia
HKASDQ

SEQ ID NO: 3114336 - protein, 15 aa, Giardia lamblia
HKASLEENKAITTRA

SEQ ID NO: 3114337 - protein, 7 aa, Giardia lamblia
HKATNVE

SEQ ID NO: 3114338 - protein, 11 aa, Giardia lamblia
HKDRCDESNRR

SEQ ID NO: 3114339 - protein, 7 aa, Giardia lamblia
HKDRESL

SEQ ID NO: 3114340 - protein, 9 aa, Giardia lamblia
HKDTCPTSK

SEQ ID NO: 3114341 - protein, 8 aa, Giardia lamblia
HKDTKNTS

SEQ ID NO: 3114342 - protein, 7 aa, Giardia lamblia
HKDTNSA

SEQ ID NO: 3114343 - protein, 4 aa, Giardia lamblia
HKEA

SEQ ID NO: 3114344 - protein, 6 aa, Giardia lamblia
HKEFSS

SEQ ID NO: 3114345 - protein, 6 aa, Giardia lamblia
HKEGEG

SEQ ID NO: 3114346 - protein, 8 aa, Giardia lamblia
HKENSRVG

SEQ ID NO: 3114347 - protein, 4 aa, Giardia lamblia
HKEQ

SEQ ID NO: 3114348 - protein, 7 aa, Giardia lamblia
HKGDTVA

SEQ ID NO: 3114349 - protein, 7 aa, Giardia lamblia
HKGEAAA

SEQ ID NO: 3114350 - protein, 24 aa, Giardia lamblia
HKGKGEVMDADADTDIDIDANPQS

SEQ ID NO: 3114351 - protein, 7 aa, Giardia lamblia
HKGNESR

SEQ ID NO: 3114352 - protein, 6 aa, Giardia lamblia
HKGRDI

SEQ ID NO: 3114353 - protein, 7 aa, Giardia lamblia
HKGREEA

SEQ ID NO: 3114354 - protein, 8 aa, Giardia lamblia
HKGRLSAQ

SEQ ID NO: 3114355 - protein, 32 aa, Giardia lamblia
HKHDASPLNSLGASGSARNLKTPEQAASNGLP

SEQ ID NO: 3114356 - protein, 8 aa, Giardia lamblia
HKHEHSED

SEQ ID NO: 3114357 - protein, 8 aa, Giardia lamblia
HKITPDEA

SEQ ID NO: 3114358 - protein, 4 aa, Giardia lamblia
HKKL

SEQ ID NO: 3114359 - protein, 13 aa, Giardia lamblia
HKKQDQSLTEAKA

SEQ ID NO: 3114360 - protein, 13 aa, Giardia lamblia
HKKQLQNTSTYTH

SEQ ID NO: 3114361 - protein, 9 aa, Giardia lamblia
HKKRSEAHA

SEQ ID NO: 3114362 - protein, 4 aa, Giardia lamblia
HKKS

SEQ ID NO: 3114363 - protein, 10 aa, Giardia lamblia
HKKYESLTAS

SEQ ID NO: 3114364 - protein, 20 aa, Giardia lamblia
HKMDQSSDLDVGTKGTSKRK

SEQ ID NO: 3114365 - protein, 6 aa, Giardia lamblia
HKNGAV

SEQ ID NO: 3114366 - protein, 13 aa, Giardia lamblia
HKNGKQRPTDFAP

SEQ ID NO: 3114367 - protein, 9 aa, Giardia lamblia
HKNKLNSKQ

SEQ ID NO: 3114368 - protein, 23 aa, Giardia lamblia
HKPDYEGDTDDEGNEKSEKERIE

SEQ ID NO: 3114369 - protein, 26 aa, Giardia lamblia
HKPEQLPAALDGDDPTGDTEAQEQIG

SEQ ID NO: 3114370 - protein, 14 aa, Giardia lamblia
HKPPEQPKPHNPVP

SEQ ID NO: 3114371 - protein, 5 aa, Giardia lamblia
HKPPM

SEQ ID NO: 3114372 - protein, 6 aa, Giardia lamblia
HKPPRD

SEQ ID NO: 3114373 - protein, 7 aa, Giardia lamblia
HKPQDKL

SEQ ID NO: 3114374 - protein, 7 aa, Giardia lamblia
HKPSTLT

SEQ ID NO: 3114375 - protein, 8 aa, Giardia lamblia
HKPSTSNL

SEQ ID NO: 3114376 - protein, 5 aa, Giardia lamblia
HKPTG

SEQ ID NO: 3114377 - protein, 8 aa, Giardia lamblia
HKPTGSQE

SEQ ID NO: 3114378 - protein, 7 aa, Giardia lamblia
HKPTIRN

SEQ ID NO: 3114379 - protein, 4 aa, Giardia lamblia
HKPV

SEQ ID NO: 3114380 - protein, 7 aa, Giardia lamblia
HKQDAAA

SEQ ID NO: 3114381 - protein, 16 aa, Giardia lamblia
HKQQNAANPGTTAKYS

SEQ ID NO: 3114382 - protein, 15 aa, Giardia lamblia
HKQSNTSKKPAHTSP

SEQ ID NO: 3114383 - protein, 6 aa, Giardia lamblia
HKRDQS

SEQ ID NO: 3114384 - protein, 6 aa, Giardia lamblia
HKRKRL

SEQ ID NO: 3114385 - protein, 8 aa, Giardia lamblia
HKRNAQGI

SEQ ID NO: 3114386 - protein, 4 aa, Giardia lamblia
HKRQ

SEQ ID NO: 3114387 - protein, 9 aa, Giardia lamblia
HKSEQTKYA

SEQ ID NO: 3114388 - protein, 9 aa, Giardia lamblia
HKSKKLGNS

SEQ ID NO: 3114389 - protein, 16 aa, Giardia lamblia
HKSSTSATDPEYSRPP

SEQ ID NO: 3114390 - protein, 8 aa, Giardia lamblia
HKSTRLAA

SEQ ID NO: 3114391 - protein, 12 aa, Giardia lamblia
HKSTTADDRSIT

SEQ ID NO: 3114392 - protein, 10 aa, Giardia lamblia
HKSVDASLQD

SEQ ID NO: 3114393 - protein, 7 aa, Giardia lamblia
HKTDRRY

SEQ ID NO: 3114394 - protein, 5 aa, Giardia lamblia
HKTGL

SEQ ID NO: 3114395 - protein, 5 aa, Giardia lamblia
HKTGP

SEQ ID NO: 3114396 - protein, 8 aa, Giardia lamblia
HKTPTTAI

SEQ ID NO: 3114397 - protein, 10 aa, Giardia lamblia
HKTSEESQTA

SEQ ID NO: 3114398 - protein, 8 aa, Giardia lamblia
HKVNSKTL

SEQ ID NO: 3114399 - protein, 11 aa, Giardia lamblia
HKVTSGRPQPS

SEQ ID NO: 3114400 - protein, 12 aa, Giardia lamblia
HLAGGADSKGNT

SEQ ID NO: 3114401 - protein, 6 aa, Giardia lamblia
HLENDK

SEQ ID NO: 3114402 - protein, 15 aa, Giardia lamblia
HLGGPQTSESRLDSS

SEQ ID NO: 3114403 - protein, 6 aa, Giardia lamblia
HLGQQV

SEQ ID NO: 3114404 - protein, 4 aa, Giardia lamblia
HLPE

SEQ ID NO: 3114405 - protein, 5 aa, Giardia lamblia
HLPKE

SEQ ID NO: 3114406 - protein, 4 aa, Giardia lamblia
HLPP

SEQ ID NO: 3114407 - protein, 6 aa, Giardia lamblia
HLPTAS

SEQ ID NO: 3114408 - protein, 14 aa, Giardia lamblia
HLSDKDKKNNTGET

SEQ ID NO: 3114409 - protein, 14 aa, Giardia lamblia
HLSDKDKRNNNDET

SEQ ID NO: 3114410 - protein, 6 aa, Giardia lamblia
HLSTDK

SEQ ID NO: 3114411 - protein, 4 aa, Giardia lamblia
HLTG

SEQ ID NO: 3114412 - protein, 21 aa, Giardia lamblia
HLTTPTKRAATRRTPALSDPN

SEQ ID NO: 3114413 - protein, 6 aa, Giardia lamblia
HLTTQD

SEQ ID NO: 3114414 - protein, 4 aa, Giardia lamblia
HMPH

SEQ ID NO: 3114415 - protein, 6 aa, Giardia lamblia
HMPSET

SEQ ID NO: 3114416 - protein, 11 aa, Giardia lamblia
HMSSHKDEISS

SEQ ID NO: 3114417 - protein, 9 aa, Giardia lamblia
HMSTTESSI

SEQ ID NO: 3114418 - protein, 44 aa, Giardia lamblia
HMTNSGPSVELRSPSYALGGSLSGASRGLPGAVETHGGHTRPMS

SEQ ID NO: 3114419 - protein, 25 aa, Giardia lamblia
HNADQKKRGRTPQHATSDQKSNHKE

SEQ ID NO: 3114420 - protein, 4 aa, Giardia lamblia
HNAE

SEQ ID NO: 3114421 - protein, 9 aa, Giardia lamblia
HNAEDKGSL

SEQ ID NO: 3114422 - protein, 13 aa, Giardia lamblia
HNAGDGSTALTGP

SEQ ID NO: 3114423 - protein, 15 aa, Giardia lamblia
HNAGSQQSSTSPETN

SEQ ID NO: 3114424 - protein, 15 aa, Giardia lamblia
HNAPAKGLCTCLDAH

SEQ ID NO: 3114425 - protein, 5 aa, Giardia lamblia
HNARE

SEQ ID NO: 3114426 - protein, 7 aa, Giardia lamblia
HNASKEL

SEQ ID NO: 3114427 - protein, 28 aa, Giardia lamblia
HNDKGDTIKAHPSLPDTTRSTSGIRSQR

SEQ ID NO: 3114428 - protein, 4 aa, Giardia lamblia
HNEE

SEQ ID NO: 3114429 - protein, 5 aa, Giardia lamblia
HNEPE

SEQ ID NO: 3114430 - protein, 27 aa, Giardia lamblia
HNERDGSSSMKQSANVGTDEPEKRSIN

SEQ ID NO: 3114431 - protein, 6 aa, Giardia lamblia
HNERGS

SEQ ID NO: 3114432 - protein, 7 aa, Giardia lamblia
HNERVSK

SEQ ID NO: 3114433 - protein, 33 aa, Giardia lamblia
HNESDHESYGGIPGVTTKASSPIFQTPKTQADY

SEQ ID NO: 3114434 - protein, 4 aa, Giardia lamblia
HNFS

SEQ ID NO: 3114435 - protein, 17 aa, Giardia lamblia
HNGGSCSKLGDGARREY

SEQ ID NO: 3114436 - protein, 12 aa, Giardia lamblia
HNGIGEARPGKV

SEQ ID NO: 3114437 - protein, 6 aa, Giardia lamblia
HNGISS

SEQ ID NO: 3114438 - protein, 6 aa, Giardia lamblia
HNGNNN

SEQ ID NO: 3114439 - protein, 19 aa, Giardia lamblia
HNGTIDGYHPKSMNPPINE

SEQ ID NO: 3114440 - protein, 9 aa, Giardia lamblia
HNHEGGTDV

SEQ ID NO: 3114441 - protein, 15 aa, Giardia lamblia
HNHGKSSSTTHEATS

SEQ ID NO: 3114442 - protein, 14 aa, Giardia lamblia
HNIPEKKGLGLATR

SEQ ID NO: 3114443 - protein, 28 aa, Giardia lamblia
HNIQTDQRTCAEGCGARASSNQGVCHKN

SEQ ID NO: 3114444 - protein, 25 aa, Giardia lamblia
HNKDQTASLRSSVTKNKHTPSPDDP

SEQ ID NO: 3114445 - protein, 6 aa, Giardia lamblia
HNKEVR

SEQ ID NO: 3114446 - protein, 12 aa, Giardia lamblia
HNKNANPEKGLN

SEQ ID NO: 3114447 - protein, 8 aa, Giardia lamblia
HNKVNSAG

SEQ ID NO: 3114448 - protein, 28 aa, Giardia lamblia
HNLDPPAERQSTQALPQAHAADEQPTIE

SEQ ID NO: 3114449 - protein, 9 aa, Giardia lamblia
HNLSEGSIQ

SEQ ID NO: 3114450 - protein, 32 aa, Giardia lamblia
HNMAPDRPLEEEPIEESNHHDDDQNEQEAPAE

SEQ ID NO: 3114451 - protein, 13 aa, Giardia lamblia
HNNKGEGDEEQQD

SEQ ID NO: 3114452 - protein, 32 aa, Giardia lamblia
HNNNSRNRASDARDSALQGSTHKLSPSIPPIN

SEQ ID NO: 3114453 - protein, 7 aa, Giardia lamblia
HNNTHPY

SEQ ID NO: 3114454 - protein, 6 aa, Giardia lamblia
HNPAPV

SEQ ID NO: 3114455 - protein, 7 aa, Giardia lamblia
HNPGYPD

SEQ ID NO: 3114456 - protein, 14 aa, Giardia lamblia
HNPPTQDAEQSRPF

SEQ ID NO: 3114457 - protein, 9 aa, Giardia lamblia
HNPRPPLPS

SEQ ID NO: 3114458 - protein, 6 aa, Giardia lamblia
HNPSGI

SEQ ID NO: 3114459 - protein, 7 aa, Giardia lamblia
HNPTAQL

SEQ ID NO: 3114460 - protein, 16 aa, Giardia lamblia
HNPTTSSIPSVEGEHD

SEQ ID NO: 3114461 - protein, 6 aa, Giardia lamblia
HNQDDS

SEQ ID NO: 3114462 - protein, 11 aa, Giardia lamblia
HNQDKDDTAMK

SEQ ID NO: 3114463 - protein, 11 aa, Giardia lamblia
HNQPPPPQPQS

SEQ ID NO: 3114464 - protein, 10 aa, Giardia lamblia
HNQSGDRKSY

SEQ ID NO: 3114465 - protein, 5 aa, Giardia lamblia
HNRDN

SEQ ID NO: 3114466 - protein, 10 aa, Giardia lamblia
HNRPSSASMT

SEQ ID NO: 3114467 - protein, 11 aa, Giardia lamblia
HNRPTDRNGKT

SEQ ID NO: 3114468 - protein, 6 aa, Giardia lamblia
HNRQPP

SEQ ID NO: 3114469 - protein, 5 aa, Giardia lamblia
HNSDG

SEQ ID NO: 3114470 - protein, 5 aa, Giardia lamblia
HNSEE

SEQ ID NO: 3114471 - protein, 24 aa, Giardia lamblia
HNSEPEPDANANAELEASNQQAHA

SEQ ID NO: 3114472 - protein, 9 aa, Giardia lamblia
HNSESDNPS

SEQ ID NO: 3114473 - protein, 8 aa, Giardia lamblia
HNSETQAP

SEQ ID NO: 3114474 - protein, 8 aa, Giardia lamblia
HNSGTTIE

SEQ ID NO: 3114475 - protein, 10 aa, Giardia lamblia
HNSKDAREHL

SEQ ID NO: 3114476 - protein, 20 aa, Giardia lamblia
HNSKDITTNTSPSSSGEAQG

SEQ ID NO: 3114477 - protein, 16 aa, Giardia lamblia
HNSLPSADALDSPPCP

SEQ ID NO: 3114478 - protein, 18 aa, Giardia lamblia
HNSMDPQEQDAAETQEAK

SEQ ID NO: 3114479 - protein, 8 aa, Giardia lamblia
HNSNDTQS

SEQ ID NO: 3114480 - protein, 4 aa, Giardia lamblia
HNSP

SEQ ID NO: 3114481 - protein, 10 aa, Giardia lamblia
HNSPDSPDMR

SEQ ID NO: 3114482 - protein, 14 aa, Giardia lamblia
HNSPLGPDASGFHP

SEQ ID NO: 3114483 - protein, 10 aa, Giardia lamblia
HNSTARRDEV

SEQ ID NO: 3114484 - protein, 4 aa, Giardia lamblia
HNSY

SEQ ID NO: 3114485 - protein, 12 aa, Giardia lamblia
HNTAPSDARPTL

SEQ ID NO: 3114486 - protein, 10 aa, Giardia lamblia
HNTDEAVPKD

SEQ ID NO: 3114487 - protein, 7 aa, Giardia lamblia
HNTDGTT

SEQ ID NO: 3114488 - protein, 9 aa, Giardia lamblia
HNTEEKVEQ

SEQ ID NO: 3114489 - protein, 6 aa, Giardia lamblia
HNTETE

SEQ ID NO: 3114490 - protein, 4 aa, Giardia lamblia
HNTS

SEQ ID NO: 3114491 - protein, 22 aa, Giardia lamblia
HNTSCDAKTVEQEASDAALTAA

SEQ ID NO: 3114492 - protein, 5 aa, Giardia lamblia
HNTTI

SEQ ID NO: 3114493 - protein, 7 aa, Giardia lamblia
HNTTLGE

SEQ ID NO: 3114494 - protein, 16 aa, Giardia lamblia
HNVKGPESTEPPRKHS

SEQ ID NO: 3114495 - protein, 7 aa, Giardia lamblia
HNVPTNS

SEQ ID NO: 3114496 - protein, 13 aa, Giardia lamblia
HNVSRGPTKRYTA

SEQ ID NO: 3114497 - protein, 4 aa, Giardia lamblia
HNYE

SEQ ID NO: 3114498 - protein, 7 aa, Giardia lamblia
HNYGKTD

SEQ ID NO: 3114499 - protein, 12 aa, Giardia lamblia
HNYPRKAPKTTH

SEQ ID NO: 3114500 - protein, 12 aa, Giardia lamblia
HPANRAVSTSHI

SEQ ID NO: 3114501 - protein, 5 aa, Giardia lamblia
HPAPS

SEQ ID NO: 3114502 - protein, 19 aa, Giardia lamblia
HPAQKRSKSASSRQYSDGS

SEQ ID NO: 3114503 - protein, 6 aa, Giardia lamblia
HPASEA

SEQ ID NO: 3114504 - protein, 16 aa, Giardia lamblia
HPASNECEEHLSKLNS

SEQ ID NO: 3114505 - protein, 13 aa, Giardia lamblia
HPASQPVVASDGR

SEQ ID NO: 3114506 - protein, 10 aa, Giardia lamblia
HPDAYKQVSD

SEQ ID NO: 3114507 - protein, 5 aa, Giardia lamblia
HPDDD

SEQ ID NO: 3114508 - protein, 6 aa, Giardia lamblia
HPDELS

SEQ ID NO: 3114509 - protein, 36 aa, Giardia lamblia
HPDEPSTDLPPRAGSTISAPRGASQPLPAYEEENKR

SEQ ID NO: 3114510 - protein, 4 aa, Giardia lamblia
HPDG

SEQ ID NO: 3114511 - protein, 11 aa, Giardia lamblia
HPDSQDSNAPV

SEQ ID NO: 3114512 - protein, 6 aa, Giardia lamblia
HPDTDT

SEQ ID NO: 3114513 - protein, 5 aa, Giardia lamblia
HPDTG

SEQ ID NO: 3114514 - protein, 11 aa, Giardia lamblia
HPDTRVTPRYA

SEQ ID NO: 3114515 - protein, 7 aa, Giardia lamblia
HPDVAET

SEQ ID NO: 3114516 - protein, 20 aa, Giardia lamblia
HPEAAKRHRKLSDHRGRPSM

SEQ ID NO: 3114517 - protein, 12 aa, Giardia lamblia
HPEAERPGQSSL

SEQ ID NO: 3114518 - protein, 4 aa, Giardia lamblia
HPEC

SEQ ID NO: 3114519 - protein, 4 aa, Giardia lamblia
HPED

SEQ ID NO: 3114520 - protein, 5 aa, Giardia lamblia
HPEDA

SEQ ID NO: 3114521 - protein, 6 aa, Giardia lamblia
HPEEDT

SEQ ID NO: 3114522 - protein, 5 aa, Giardia lamblia
HPEEF

SEQ ID NO: 3114523 - protein, 8 aa, Giardia lamblia
HPEPLPKE

SEQ ID NO: 3114524 - protein, 4 aa, Giardia lamblia
HPES

SEQ ID NO: 3114525 - protein, 12 aa, Giardia lamblia
HPESFDPPTAAV

SEQ ID NO: 3114526 - protein, 9 aa, Giardia lamblia
HPESGEQIT

SEQ ID NO: 3114527 - protein, 8 aa, Giardia lamblia
HPESGKSG

SEQ ID NO: 3114528 - protein, 9 aa, Giardia lamblia
HPESGPPQL

SEQ ID NO: 3114529 - protein, 5 aa, Giardia lamblia
HPESP

SEQ ID NO: 3114530 - protein, 4 aa, Giardia lamblia
HPET

SEQ ID NO: 3114531 - protein, 7 aa, Giardia lamblia
HPETREP

SEQ ID NO: 3114532 - protein, 5 aa, Giardia lamblia
HPETW

SEQ ID NO: 3114533 - protein, 5 aa, Giardia lamblia
HPFGN

SEQ ID NO: 3114534 - protein, 28 aa, Giardia lamblia
HPFSSASSLNDSDELDEDMPEPHIKYQK

SEQ ID NO: 3114535 - protein, 9 aa, Giardia lamblia
HPGEAPGSY

SEQ ID NO: 3114536 - protein, 8 aa, Giardia lamblia
HPGEAQSS

SEQ ID NO: 3114537 - protein, 9 aa, Giardia lamblia
HPGETPGSY

SEQ ID NO: 3114538 - protein, 6 aa, Giardia lamblia
HPGEVP

SEQ ID NO: 3114539 - protein, 31 aa, Giardia lamblia
HPGKAHDTLSKQYTTDSHPHNVPSEASNSRL

SEQ ID NO: 3114540 - protein, 9 aa, Giardia lamblia
HPGLETAQD

SEQ ID NO: 3114541 - protein, 4 aa, Giardia lamblia
HPGN

SEQ ID NO: 3114542 - protein, 9 aa, Giardia lamblia
HPHGGGNHQ

SEQ ID NO: 3114543 - protein, 5 aa, Giardia lamblia
HPIQE

SEQ ID NO: 3114544 - protein, 4 aa, Giardia lamblia
HPKD

SEQ ID NO: 3114545 - protein, 9 aa, Giardia lamblia
HPKDASPRT

SEQ ID NO: 3114546 - protein, 8 aa, Giardia lamblia
HPKPTEEQ

SEQ ID NO: 3114547 - protein, 4 aa, Giardia lamblia
HPKR

SEQ ID NO: 3114548 - protein, 7 aa, Giardia lamblia
HPLPSSV

SEQ ID NO: 3114549 - protein, 18 aa, Giardia lamblia
HPLTTSEDATQTADEQPL

SEQ ID NO: 3114550 - protein, 15 aa, Giardia lamblia
HPNAPNPPNPRGIPT

SEQ ID NO: 3114551 - protein, 5 aa, Giardia lamblia
HPNAT

SEQ ID NO: 3114552 - protein, 5 aa, Giardia lamblia
HPNKQ

SEQ ID NO: 3114553 - protein, 5 aa, Giardia lamblia
HPNNS

SEQ ID NO: 3114554 - protein, 5 aa, Giardia lamblia
HPNVP

SEQ ID NO: 3114555 - protein, 6 aa, Giardia lamblia
HPPESL

SEQ ID NO: 3114556 - protein, 10 aa, Giardia lamblia
HPPGTTTQNK

SEQ ID NO: 3114557 - protein, 6 aa, Giardia lamblia
HPPKET

SEQ ID NO: 3114558 - protein, 23 aa, Giardia lamblia
HPPKQKTPERSMSSNDLATSIGR

SEQ ID NO: 3114559 - protein, 18 aa, Giardia lamblia
HPPKTQLATQAPVVSQSP

SEQ ID NO: 3114560 - protein, 37 aa, Giardia lamblia
HPPPGSPSPSRSPSPLSGSAPPPAAAEPSPSPTPDPV

SEQ ID NO: 3114561 - protein, 9 aa, Giardia lamblia
HPPPPNPSA

SEQ ID NO: 3114562 - protein, 7 aa, Giardia lamblia
HPPPSIV

SEQ ID NO: 3114563 - protein, 21 aa, Giardia lamblia
HPPTAVSSHSKPDPATTFASK

SEQ ID NO: 3114564 - protein, 10 aa, Giardia lamblia
HPPTGPTPIH

SEQ ID NO: 3114565 - protein, 10 aa, Giardia lamblia
HPPTRSSSLA

SEQ ID NO: 3114566 - protein, 8 aa, Giardia lamblia
HPQDTHAA

SEQ ID NO: 3114567 - protein, 6 aa, Giardia lamblia
HPQERT

SEQ ID NO: 3114568 - protein, 7 aa, Giardia lamblia
HPQNPSN

SEQ ID NO: 3114569 - protein, 6 aa, Giardia lamblia
HPQPLA

SEQ ID NO: 3114570 - protein, 6 aa, Giardia lamblia
HPQPPG

SEQ ID NO: 3114571 - protein, 20 aa, Giardia lamblia
HPQSSGRTVIDSESAEPIPV

SEQ ID NO: 3114572 - protein, 9 aa, Giardia lamblia
HPQTREPTK

SEQ ID NO: 3114573 - protein, 9 aa, Giardia lamblia
HPQTTTPEA

SEQ ID NO: 3114574 - protein, 38 aa, Giardia lamblia
HPRGRGGDPDAPRQPGVPDPDPRPVARRDQQRDPPPLP

SEQ ID NO: 3114575 - protein, 6 aa, Giardia lamblia
HPRVPP

SEQ ID NO: 3114576 - protein, 8 aa, Giardia lamblia
HPSASSAF

SEQ ID NO: 3114577 - protein, 29 aa, Giardia lamblia
HPSEDSVDVSSTVAGDSEPESGKEDSSKA

SEQ ID NO: 3114578 - protein, 4 aa, Giardia lamblia
HPSG

SEQ ID NO: 3114579 - protein, 47 aa, Giardia lamblia
HPSGSLDTQPNNKSKTPRPLRSGSRLSTSACPNSTSSFNKEADPASF

SEQ ID NO: 3114580 - protein, 5 aa, Giardia lamblia
HPSKT

SEQ ID NO: 3114581 - protein, 5 aa, Giardia lamblia
HPSLS

SEQ ID NO: 3114582 - protein, 7 aa, Giardia lamblia
HPSLSAS

SEQ ID NO: 3114583 - protein, 13 aa, Giardia lamblia
HPSLTGKEALHSQ

SEQ ID NO: 3114584 - protein, 11 aa, Giardia lamblia
HPSNYASPTLP

SEQ ID NO: 3114585 - protein, 8 aa, Giardia lamblia
HPSQTSDH

SEQ ID NO: 3114586 - protein, 5 aa, Giardia lamblia
HPSSI

SEQ ID NO: 3114587 - protein, 17 aa, Giardia lamblia
HPSSKSLPRKRASSTVT

SEQ ID NO: 3114588 - protein, 6 aa, Giardia lamblia
HPSSPR

SEQ ID NO: 3114589 - protein, 7 aa, Giardia lamblia
HPSSSTP

SEQ ID NO: 3114590 - protein, 9 aa, Giardia lamblia
HPSTPETYV

SEQ ID NO: 3114591 - protein, 7 aa, Giardia lamblia
HPSTTTS

SEQ ID NO: 3114592 - protein, 4 aa, Giardia lamblia
HPSV

SEQ ID NO: 3114593 - protein, 7 aa, Giardia lamblia
HPSWGSQ

SEQ ID NO: 3114594 - protein, 11 aa, Giardia lamblia
HPTAESGDPTV

SEQ ID NO: 3114595 - protein, 5 aa, Giardia lamblia
HPTAP

SEQ ID NO: 3114596 - protein, 4 aa, Giardia lamblia
HPTI

SEQ ID NO: 3114597 - protein, 5 aa, Giardia lamblia
HPTNG

SEQ ID NO: 3114598 - protein, 6 aa, Giardia lamblia
HPTPAQ

SEQ ID NO: 3114599 - protein, 8 aa, Giardia lamblia
HPTPPQCS

SEQ ID NO: 3114600 - protein, 11 aa, Giardia lamblia
HPTPSLADEQS

SEQ ID NO: 3114601 - protein, 8 aa, Giardia lamblia
HPTQRTSV

SEQ ID NO: 3114602 - protein, 10 aa, Giardia lamblia
HPTSQTCTSI

SEQ ID NO: 3114603 - protein, 21 aa, Giardia lamblia
HPYDNRTRQTQNWSTDKLTQK

SEQ ID NO: 3114604 - protein, 10 aa, Giardia lamblia
HQAANSSSYR

SEQ ID NO: 3114605 - protein, 4 aa, Giardia lamblia
HQAE

SEQ ID NO: 3114606 - protein, 6 aa, Giardia lamblia
HQAGSD

SEQ ID NO: 3114607 - protein, 7 aa, Giardia lamblia
HQAGSDA

SEQ ID NO: 3114608 - protein, 11 aa, Giardia lamblia
HQAGSTDQCGR

SEQ ID NO: 3114609 - protein, 9 aa, Giardia lamblia
HQAKRSLTR

SEQ ID NO: 3114610 - protein, 9 aa, Giardia lamblia
HQASELGRN

SEQ ID NO: 3114611 - protein, 5 aa, Giardia lamblia
HQATG

SEQ ID NO: 3114612 - protein, 23 aa, Giardia lamblia
HQDEDPIDAPRKRFQNNDPSYNE

SEQ ID NO: 3114613 - protein, 6 aa, Giardia lamblia
HQDHEN

SEQ ID NO: 3114614 - protein, 4 aa, Giardia lamblia
HQDK

SEQ ID NO: 3114615 - protein, 4 aa, Giardia lamblia
HQDP

SEQ ID NO: 3114616 - protein, 8 aa, Giardia lamblia
HQDPPLPQ

SEQ ID NO: 3114617 - protein, 6 aa, Giardia lamblia
HQDPQA

SEQ ID NO: 3114618 - protein, 12 aa, Giardia lamblia
HQDQSSSSSISL

SEQ ID NO: 3114619 - protein, 5 aa, Giardia lamblia
HQEGA

SEQ ID NO: 3114620 - protein, 6 aa, Giardia lamblia
HQEKTV

SEQ ID NO: 3114621 - protein, 10 aa, Giardia lamblia
HQERKTLSEL

SEQ ID NO: 3114622 - protein, 6 aa, Giardia lamblia
HQGSAS

SEQ ID NO: 3114623 - protein, 5 aa, Giardia lamblia
HQGSV

SEQ ID NO: 3114624 - protein, 13 aa, Giardia lamblia
HQHGSEGAGTQVP

SEQ ID NO: 3114625 - protein, 12 aa, Giardia lamblia
HQHNSEKAMREF

SEQ ID NO: 3114626 - protein, 17 aa, Giardia lamblia
HQHQQGPPHSLSPAEDV

SEQ ID NO: 3114627 - protein, 5 aa, Giardia lamblia
HQHQT

SEQ ID NO: 3114628 - protein, 10 aa, Giardia lamblia
HQIPAPGSWD

SEQ ID NO: 3114629 - protein, 30 aa, Giardia lamblia
HQIQPSEPGSTAPRPGPGSSVSASAYPGIQ

SEQ ID NO: 3114630 - protein, 6 aa, Giardia lamblia
HQITTP

SEQ ID NO: 3114631 - protein, 7 aa, Giardia lamblia
HQKAPPD

SEQ ID NO: 3114632 - protein, 12 aa, Giardia lamblia
HQKATQRRKDVQ

SEQ ID NO: 3114633 - protein, 8 aa, Giardia lamblia
HQKGPSQR

SEQ ID NO: 3114634 - protein, 5 aa, Giardia lamblia
HQKNE

SEQ ID NO: 3114635 - protein, 7 aa, Giardia lamblia
HQKQAGF

SEQ ID NO: 3114636 - protein, 10 aa, Giardia lamblia
HQLTDEEQAK

SEQ ID NO: 3114637 - protein, 9 aa, Giardia lamblia
HQLTPRERQ

SEQ ID NO: 3114638 - protein, 4 aa, Giardia lamblia
HQMN

SEQ ID NO: 3114639 - protein, 20 aa, Giardia lamblia
HQNKNDGQVPPEGSTTDGRF

SEQ ID NO: 3114640 - protein, 11 aa, Giardia lamblia
HQNLTSQAELD

SEQ ID NO: 3114641 - protein, 10 aa, Giardia lamblia
HQNNQNRSRL

SEQ ID NO: 3114642 - protein, 5 aa, Giardia lamblia
HQPEK

SEQ ID NO: 3114643 - protein, 15 aa, Giardia lamblia
HQPHKEEAASIPETA

SEQ ID NO: 3114644 - protein, 8 aa, Giardia lamblia
HQPLPRKN

SEQ ID NO: 3114645 - protein, 39 aa, Giardia lamblia
HQPPSFQSNPEQSFMPTGQPTIQYEDPTRASSSLTRPPQ

SEQ ID NO: 3114646 - protein, 12 aa, Giardia lamblia
HQPPTSSTPPSS

SEQ ID NO: 3114647 - protein, 15 aa, Giardia lamblia
HQPSSEFGYPKANSM

SEQ ID NO: 3114648 - protein, 7 aa, Giardia lamblia
HQQQPAV

SEQ ID NO: 3114649 - protein, 14 aa, Giardia lamblia
HQQRKPTRPPTTAM

SEQ ID NO: 3114650 - protein, 4 aa, Giardia lamblia
HQQS

SEQ ID NO: 3114651 - protein, 11 aa, Giardia lamblia
HQRDKEKKTML

SEQ ID NO: 3114652 - protein, 8 aa, Giardia lamblia
HQREERAR

SEQ ID NO: 3114653 - protein, 22 aa, Giardia lamblia
HQRHTKSGNYFDTTAAQNDDIT

SEQ ID NO: 3114654 - protein, 24 aa, Giardia lamblia
HQRQKYAQSVHDNSSTSEHASHSM

SEQ ID NO: 3114655 - protein, 48 aa, Giardia lamblia
HQRSIYEPKEKPLSPRNLNASNQASVNVPSGHQTLNTGMDSKSQEEYM

SEQ ID NO: 3114656 - protein, 5 aa, Giardia lamblia
HQRTS

SEQ ID NO: 3114657 - protein, 34 aa, Giardia lamblia
HQSGPSESCSVEPNAHHEESVPESVTSNEYTDLQ

SEQ ID NO: 3114658 - protein, 6 aa, Giardia lamblia
HQSKGN

SEQ ID NO: 3114659 - protein, 7 aa, Giardia lamblia
HQSRAVP

SEQ ID NO: 3114660 - protein, 11 aa, Giardia lamblia
HQSRSGSRSNV

SEQ ID NO: 3114661 - protein, 18 aa, Giardia lamblia
HQSSNNSSDLPPSEEPIK

SEQ ID NO: 3114662 - protein, 11 aa, Giardia lamblia
HQTAGPGSTAR

SEQ ID NO: 3114663 - protein, 14 aa, Giardia lamblia
HQTGGDDVEEENPL

SEQ ID NO: 3114664 - protein, 6 aa, Giardia lamblia
HQTPRS

SEQ ID NO: 3114665 - protein, 30 aa, Giardia lamblia
HQTSSDSSSYSSDDGELSRKDSDGKKRYVP

SEQ ID NO: 3114666 - protein, 5 aa, Giardia lamblia
HQVDT

SEQ ID NO: 3114667 - protein, 4 aa, Giardia lamblia
HQVE

SEQ ID NO: 3114668 - protein, 10 aa, Giardia lamblia
HRADPTNQTA

SEQ ID NO: 3114669 - protein, 13 aa, Giardia lamblia
HRAETYGAKNAKF

SEQ ID NO: 3114670 - protein, 6 aa, Giardia lamblia
HRAGRT

SEQ ID NO: 3114671 - protein, 13 aa, Giardia lamblia
HRAQSQSKNKAVR

SEQ ID NO: 3114672 - protein, 14 aa, Giardia lamblia
HRASSGDPADDADP

SEQ ID NO: 3114673 - protein, 12 aa, Giardia lamblia
HRDDSRRQHASP

SEQ ID NO: 3114674 - protein, 9 aa, Giardia lamblia
HRDKNGNTA

SEQ ID NO: 3114675 - protein, 4 aa, Giardia lamblia
HRDT

SEQ ID NO: 3114676 - protein, 9 aa, Giardia lamblia
HREAYSKDL

SEQ ID NO: 3114677 - protein, 5 aa, Giardia lamblia
HREGD

SEQ ID NO: 3114678 - protein, 6 aa, Giardia lamblia
HREKSI

SEQ ID NO: 3114679 - protein, 6 aa, Giardia lamblia
HRETEP

SEQ ID NO: 3114680 - protein, 5 aa, Giardia lamblia
HRGTE

SEQ ID NO: 3114681 - protein, 5 aa, Giardia lamblia
HRKEG

SEQ ID NO: 3114682 - protein, 9 aa, Giardia lamblia
HRKEGVGNM

SEQ ID NO: 3114683 - protein, 6 aa, Giardia lamblia
HRKEKE

SEQ ID NO: 3114684 - protein, 9 aa, Giardia lamblia
HRKKRSHRS

SEQ ID NO: 3114685 - protein, 5 aa, Giardia lamblia
HRKNP

SEQ ID NO: 3114686 - protein, 13 aa, Giardia lamblia
HRKSRKLNKEIEE

SEQ ID NO: 3114687 - protein, 10 aa, Giardia lamblia
HRLGDTQPPL

SEQ ID NO: 3114688 - protein, 5 aa, Giardia lamblia
HRNDG

SEQ ID NO: 3114689 - protein, 7 aa, Giardia lamblia
HRNSLGQ

SEQ ID NO: 3114690 - protein, 4 aa, Giardia lamblia
HRPA

SEQ ID NO: 3114691 - protein, 6 aa, Giardia lamblia
HRPAPA

SEQ ID NO: 3114692 - protein, 7 aa, Giardia lamblia
HRPDDGK

SEQ ID NO: 3114693 - protein, 10 aa, Giardia lamblia
HRPDSLGGHR

SEQ ID NO: 3114694 - protein, 8 aa, Giardia lamblia
HRPDTEAA

SEQ ID NO: 3114695 - protein, 4 aa, Giardia lamblia
HRPG

SEQ ID NO: 3114696 - protein, 10 aa, Giardia lamblia
HRPSTKRPDL

SEQ ID NO: 3114697 - protein, 6 aa, Giardia lamblia
HRPTDE

SEQ ID NO: 3114698 - protein, 20 aa, Giardia lamblia
HRPTHQTPAEDQQAQQTAAV

SEQ ID NO: 3114699 - protein, 18 aa, Giardia lamblia
HRPTMKQSQGIPDTQSLK

SEQ ID NO: 3114700 - protein, 7 aa, Giardia lamblia
HRPTSNE

SEQ ID NO: 3114701 - protein, 43 aa, Giardia lamblia
HRQAEERSECKRKQQADLEQQKRITADEAAKTAKRKADLHRTQ

SEQ ID NO: 3114702 - protein, 12 aa, Giardia lamblia
HRQIGGKVIGYF

SEQ ID NO: 3114703 - protein, 11 aa, Giardia lamblia
HRQRQKASSRY

SEQ ID NO: 3114704 - protein, 7 aa, Giardia lamblia
HRQRRKE

SEQ ID NO: 3114705 - protein, 16 aa, Giardia lamblia
HRQTTETLGPGPAGYH

SEQ ID NO: 3114706 - protein, 8 aa, Giardia lamblia
HRRDTTPE

SEQ ID NO: 3114707 - protein, 12 aa, Giardia lamblia
HRRNAAAATSAA

SEQ ID NO: 3114708 - protein, 56 aa, Giardia lamblia
HRRPRTTYSAHTGYTSSAKHEALSERPRRHSSTSQYSSRPQSDGTHGSSTSGYGVR

SEQ ID NO: 3114709 - protein, 5 aa, Giardia lamblia
HRRTG

SEQ ID NO: 3114710 - protein, 5 aa, Giardia lamblia
HRRTT

SEQ ID NO: 3114711 - protein, 18 aa, Giardia lamblia
HRSDSEVANNLTTTSTMR

SEQ ID NO: 3114712 - protein, 10 aa, Giardia lamblia
HRSGPEVDSP

SEQ ID NO: 3114713 - protein, 4 aa, Giardia lamblia
HRSN

SEQ ID NO: 3114714 - protein, 5 aa, Giardia lamblia
HRSNK

SEQ ID NO: 3114715 - protein, 7 aa, Giardia lamblia
HRSQPDS

SEQ ID NO: 3114716 - protein, 7 aa, Giardia lamblia
HRSSDAV

SEQ ID NO: 3114717 - protein, 10 aa, Giardia lamblia
HRSSSLSTGM

SEQ ID NO: 3114718 - protein, 9 aa, Giardia lamblia
HRSTLTNNT

SEQ ID NO: 3114719 - protein, 4 aa, Giardia lamblia
HRTE

SEQ ID NO: 3114720 - protein, 23 aa, Giardia lamblia
HRTERGTRDHQFNGSGKPGRRDV

SEQ ID NO: 3114721 - protein, 10 aa, Giardia lamblia
HRTPEQERAW

SEQ ID NO: 3114722 - protein, 6 aa, Giardia lamblia
HRTPTN

SEQ ID NO: 3114723 - protein, 9 aa, Giardia lamblia
HRVEESTRA

SEQ ID NO: 3114724 - protein, 19 aa, Giardia lamblia
HRVGTPEIEEPGRDNDGNT

SEQ ID NO: 3114725 - protein, 15 aa, Giardia lamblia
HSAAAGRSSGTGANS

SEQ ID NO: 3114726 - protein, 8 aa, Giardia lamblia
HSAGNEQN

SEQ ID NO: 3114727 - protein, 10 aa, Giardia lamblia
HSAKKDGHKL

SEQ ID NO: 3114728 - protein, 11 aa, Giardia lamblia
HSAKPSKANKH

SEQ ID NO: 3114729 - protein, 11 aa, Giardia lamblia
HSAQGTATEPA

SEQ ID NO: 3114730 - protein, 25 aa, Giardia lamblia
HSARDRDHDPVGDRAALGSNHVPGS

SEQ ID NO: 3114731 - protein, 13 aa, Giardia lamblia
HSARPPPPPFSPD

SEQ ID NO: 3114732 - protein, 5 aa, Giardia lamblia
HSASR

SEQ ID NO: 3114733 - protein, 15 aa, Giardia lamblia
HSCPGQNQVNKGEVL

SEQ ID NO: 3114734 - protein, 4 aa, Giardia lamblia
HSDA

SEQ ID NO: 3114735 - protein, 10 aa, Giardia lamblia
HSDENKETEL

SEQ ID NO: 3114736 - protein, 6 aa, Giardia lamblia
HSDLDT

SEQ ID NO: 3114737 - protein, 4 aa, Giardia lamblia
HSDR

SEQ ID NO: 3114738 - protein, 5 aa, Giardia lamblia
HSDRA

SEQ ID NO: 3114739 - protein, 4 aa, Giardia lamblia
HSEA

SEQ ID NO: 3114740 - protein, 16 aa, Giardia lamblia
HSEAGLTNYEGRTAGT

SEQ ID NO: 3114741 - protein, 61 aa, Giardia lamblia
HSEDATTDEAHKDNAIAAKESVGEHDHHDAPSTVDAPKTHTPLATREAAESANTKSREIVK

SEQ ID NO: 3114742 - protein, 10 aa, Giardia lamblia
HSEEEHGPAQ

SEQ ID NO: 3114743 - protein, 9 aa, Giardia lamblia
HSEEPSEEV

SEQ ID NO: 3114744 - protein, 6 aa, Giardia lamblia
HSEETI

SEQ ID NO: 3114745 - protein, 19 aa, Giardia lamblia
HSEGGSATRSPSCSTGGEL

SEQ ID NO: 3114746 - protein, 7 aa, Giardia lamblia
HSEGVSD

SEQ ID NO: 3114747 - protein, 8 aa, Giardia lamblia
HSEHPEQM

SEQ ID NO: 3114748 - protein, 9 aa, Giardia lamblia
HSEHQAEPV

SEQ ID NO: 3114749 - protein, 11 aa, Giardia lamblia
HSETHDDQRFE

SEQ ID NO: 3114750 - protein, 17 aa, Giardia lamblia
HSETNTNTEPPPGGTPS

SEQ ID NO: 3114751 - protein, 6 aa, Giardia lamblia
HSEVTN

SEQ ID NO: 3114752 - protein, 6 aa, Giardia lamblia
HSFNNA

SEQ ID NO: 3114753 - protein, 9 aa, Giardia lamblia
HSGAAGAPH

SEQ ID NO: 3114754 - protein, 4 aa, Giardia lamblia
HSGD

SEQ ID NO: 3114755 - protein, 10 aa, Giardia lamblia
HSGDKGQGQK

SEQ ID NO: 3114756 - protein, 7 aa, Giardia lamblia
HSGEESP

SEQ ID NO: 3114757 - protein, 10 aa, Giardia lamblia
HSGENSANSL

SEQ ID NO: 3114758 - protein, 6 aa, Giardia lamblia
HSGEVP

SEQ ID NO: 3114759 - protein, 5 aa, Giardia lamblia
HSGGP

SEQ ID NO: 3114760 - protein, 23 aa, Giardia lamblia
HSGGPSEYPKAAEPRHRTYNPQT

SEQ ID NO: 3114761 - protein, 7 aa, Giardia lamblia
HSGHTPA

SEQ ID NO: 3114762 - protein, 23 aa, Giardia lamblia
HSGNDALGNESTDEYSQPDDPGR

SEQ ID NO: 3114763 - protein, 8 aa, Giardia lamblia
HSGPADSL

SEQ ID NO: 3114764 - protein, 7 aa, Giardia lamblia
HSGQDSV

SEQ ID NO: 3114765 - protein, 17 aa, Giardia lamblia
HSGQTNSDGIQDPKKQS

SEQ ID NO: 3114766 - protein, 15 aa, Giardia lamblia
HSGRSANDHKGSRWA

SEQ ID NO: 3114767 - protein, 5 aa, Giardia lamblia
HSGSA

SEQ ID NO: 3114768 - protein, 12 aa, Giardia lamblia
HSGTVTDNGETG

SEQ ID NO: 3114769 - protein, 8 aa, Giardia lamblia
HSHESRRH

SEQ ID NO: 3114770 - protein, 7 aa, Giardia lamblia
HSHISDN

SEQ ID NO: 3114771 - protein, 15 aa, Giardia lamblia
HSHPQTSVRGDSVRQ

SEQ ID NO: 3114772 - protein, 9 aa, Giardia lamblia
HSHQAKQAA

SEQ ID NO: 3114773 - protein, 5 aa, Giardia lamblia
HSHQF

SEQ ID NO: 3114774 - protein, 17 aa, Giardia lamblia
HSHRQEPRQGDSRPSGQ

SEQ ID NO: 3114775 - protein, 15 aa, Giardia lamblia
HSHTAAAPKATTSMQ

SEQ ID NO: 3114776 - protein, 11 aa, Giardia lamblia
HSIGPGASSLV

SEQ ID NO: 3114777 - protein, 13 aa, Giardia lamblia
HSISEDREDIAKE

SEQ ID NO: 3114778 - protein, 12 aa, Giardia lamblia
HSISPTDNTGLD

SEQ ID NO: 3114779 - protein, 25 aa, Giardia lamblia
HSKDTDATVQSSHTSQTGSNTHTDE

SEQ ID NO: 3114780 - protein, 10 aa, Giardia lamblia
HSKKPDEPLA

SEQ ID NO: 3114781 - protein, 5 aa, Giardia lamblia
HSKLD

SEQ ID NO: 3114782 - protein, 4 aa, Giardia lamblia
HSKN

SEQ ID NO: 3114783 - protein, 11 aa, Giardia lamblia
HSKNIGRKSTI

SEQ ID NO: 3114784 - protein, 7 aa, Giardia lamblia
HSKPAPD

SEQ ID NO: 3114785 - protein, 6 aa, Giardia lamblia
HSKPQG

SEQ ID NO: 3114786 - protein, 20 aa, Giardia lamblia
HSKQGTPGQQHQQVSAAPAF

SEQ ID NO: 3114787 - protein, 9 aa, Giardia lamblia
HSKQKSPRK

SEQ ID NO: 3114788 - protein, 7 aa, Giardia lamblia
HSKRTAL

SEQ ID NO: 3114789 - protein, 75 aa, Giardia lamblia
HSKSGAKDLQKMKDNTKKEQVDGTLNTTNDPGNHSAEPARKQAPRSKAQSQDTISNASDPSQSYTTVPRTPFDDD

SEQ ID NO: 3114790 - protein, 8 aa, Giardia lamblia
HSKSRTVS

SEQ ID NO: 3114791 - protein, 16 aa, Giardia lamblia
HSKVTASSLRKGDSKE

SEQ ID NO: 3114792 - protein, 12 aa, Giardia lamblia
HSLKNSASIRTT

SEQ ID NO: 3114793 - protein, 9 aa, Giardia lamblia
HSLNSGQNS

SEQ ID NO: 3114794 - protein, 6 aa, Giardia lamblia
HSLRTG

SEQ ID NO: 3114795 - protein, 14 aa, Giardia lamblia
HSLSTYDARTKGGI

SEQ ID NO: 3114796 - protein, 11 aa, Giardia lamblia
HSLTAEDRRTA

SEQ ID NO: 3114797 - protein, 14 aa, Giardia lamblia
HSMGHSDASEPAQY

SEQ ID NO: 3114798 - protein, 7 aa, Giardia lamblia
HSMQQKR

SEQ ID NO: 3114799 - protein, 5 aa, Giardia lamblia
HSNDY

SEQ ID NO: 3114800 - protein, 6 aa, Giardia lamblia
HSNEEY

SEQ ID NO: 3114801 - protein, 10 aa, Giardia lamblia
HSNHSNAGLH

SEQ ID NO: 3114802 - protein, 5 aa, Giardia lamblia
HSNIG

SEQ ID NO: 3114803 - protein, 13 aa, Giardia lamblia
HSNQAEGQNDTEH

SEQ ID NO: 3114804 - protein, 11 aa, Giardia lamblia
HSNSEVASRKV

SEQ ID NO: 3114805 - protein, 18 aa, Giardia lamblia
HSNSMRNAQTSQKKRSYT

SEQ ID NO: 3114806 - protein, 8 aa, Giardia lamblia
HSNSPSRS

SEQ ID NO: 3114807 - protein, 9 aa, Giardia lamblia
HSNTIQQEN

SEQ ID NO: 3114808 - protein, 27 aa, Giardia lamblia
HSNTSDASTKDAVAQDPASDRGSQEKV

SEQ ID NO: 3114809 - protein, 22 aa, Giardia lamblia
HSNVPGVRNEPVTRSSLTPGAA

SEQ ID NO: 3114810 - protein, 12 aa, Giardia lamblia
HSPAGASDPGLR

SEQ ID NO: 3114811 - protein, 8 aa, Giardia lamblia
HSPEDEHG

SEQ ID NO: 3114812 - protein, 9 aa, Giardia lamblia
HSPELDPDK

SEQ ID NO: 3114813 - protein, 4 aa, Giardia lamblia
HSPF

SEQ ID NO: 3114814 - protein, 12 aa, Giardia lamblia
HSPGHKAREERR

SEQ ID NO: 3114815 - protein, 12 aa, Giardia lamblia
HSPGQSNNNDQL

SEQ ID NO: 3114816 - protein, 7 aa, Giardia lamblia
HSPGTTA

SEQ ID NO: 3114817 - protein, 4 aa, Giardia lamblia
HSPI

SEQ ID NO: 3114818 - protein, 11 aa, Giardia lamblia
HSPKTTRDPET

SEQ ID NO: 3114819 - protein, 7 aa, Giardia lamblia
HSPPSLA

SEQ ID NO: 3114820 - protein, 10 aa, Giardia lamblia
HSPREKRGNT

SEQ ID NO: 3114821 - protein, 7 aa, Giardia lamblia
HSPRQTM

SEQ ID NO: 3114822 - protein, 5 aa, Giardia lamblia
HSPSD

SEQ ID NO: 3114823 - protein, 7 aa, Giardia lamblia
HSPSKDI

SEQ ID NO: 3114824 - protein, 6 aa, Giardia lamblia
HSPSSR

SEQ ID NO: 3114825 - protein, 8 aa, Giardia lamblia
HSPSYPDG

SEQ ID NO: 3114826 - protein, 12 aa, Giardia lamblia
HSPTEPGSSSIV

SEQ ID NO: 3114827 - protein, 8 aa, Giardia lamblia
HSPTSAQY

SEQ ID NO: 3114828 - protein, 20 aa, Giardia lamblia
HSPTTGSPYSFSADSATTPK

SEQ ID NO: 3114829 - protein, 6 aa, Giardia lamblia
HSPVAG

SEQ ID NO: 3114830 - protein, 28 aa, Giardia lamblia
HSQEQPRHEATSSQSGDVVADVLRDLGL

SEQ ID NO: 3114831 - protein, 5 aa, Giardia lamblia
HSQKF

SEQ ID NO: 3114832 - protein, 9 aa, Giardia lamblia
HSQQMRSSE

SEQ ID NO: 3114833 - protein, 4 aa, Giardia lamblia
HSQR

SEQ ID NO: 3114834 - protein, 7 aa, Giardia lamblia
HSQSTSA

SEQ ID NO: 3114835 - protein, 4 aa, Giardia lamblia
HSRD

SEQ ID NO: 3114836 - protein, 7 aa, Giardia lamblia
HSRGTGP

SEQ ID NO: 3114837 - protein, 19 aa, Giardia lamblia
HSRLEEKDALSRAKRRQEV

SEQ ID NO: 3114838 - protein, 5 aa, Giardia lamblia
HSRLT

SEQ ID NO: 3114839 - protein, 6 aa, Giardia lamblia
HSRNAK

SEQ ID NO: 3114840 - protein, 17 aa, Giardia lamblia
HSRPDSPRRLPDNYSTM

SEQ ID NO: 3114841 - protein, 6 aa, Giardia lamblia
HSRPNS

SEQ ID NO: 3114842 - protein, 7 aa, Giardia lamblia
HSRSLTE

SEQ ID NO: 3114843 - protein, 39 aa, Giardia lamblia
HSRSNGEPPRKAKNVASSSSTTPTATKADLGTSSQMSTS

SEQ ID NO: 3114844 - protein, 37 aa, Giardia lamblia
HSRSSRHTGASEAVTPAKTPAKPSASINDTKEPAERW

SEQ ID NO: 3114845 - protein, 18 aa, Giardia lamblia
HSRSSSSILGSPGSNRRG

SEQ ID NO: 3114846 - protein, 4 aa, Giardia lamblia
HSRT

SEQ ID NO: 3114847 - protein, 10 aa, Giardia lamblia
HSRTRGKKTY

SEQ ID NO: 3114848 - protein, 5 aa, Giardia lamblia
HSSAH

SEQ ID NO: 3114849 - protein, 20 aa, Giardia lamblia
HSSCSSRKSEFRKKPGITPL

SEQ ID NO: 3114850 - protein, 19 aa, Giardia lamblia
HSSDGQGLLSEASQSSAID

SEQ ID NO: 3114851 - protein, 9 aa, Giardia lamblia
HSSDPYKPV

SEQ ID NO: 3114852 - protein, 7 aa, Giardia lamblia
HSSESRI

SEQ ID NO: 3114853 - protein, 7 aa, Giardia lamblia
HSSGDYY

SEQ ID NO: 3114854 - protein, 21 aa, Giardia lamblia
HSSPLNKAQPDSLTPATQPTV

SEQ ID NO: 3114855 - protein, 8 aa, Giardia lamblia
HSSPRSPR

SEQ ID NO: 3114856 - protein, 10 aa, Giardia lamblia
HSSPSSASGE

SEQ ID NO: 3114857 - protein, 6 aa, Giardia lamblia
HSSSER

SEQ ID NO: 3114858 - protein, 16 aa, Giardia lamblia
HSSSPKYVPPQLEQPP

SEQ ID NO: 3114859 - protein, 10 aa, Giardia lamblia
HSSSSARSFV

SEQ ID NO: 3114860 - protein, 6 aa, Giardia lamblia
HSSSSV

SEQ ID NO: 3114861 - protein, 12 aa, Giardia lamblia
HSSTPGSAIGLT

SEQ ID NO: 3114862 - protein, 7 aa, Giardia lamblia
HSTAELS

SEQ ID NO: 3114863 - protein, 11 aa, Giardia lamblia
HSTAGDAMQKQ

SEQ ID NO: 3114864 - protein, 25 aa, Giardia lamblia
HSTAGSTYPSVDRAQSQRPSSPQTT

SEQ ID NO: 3114865 - protein, 4 aa, Giardia lamblia
HSTD

SEQ ID NO: 3114866 - protein, 14 aa, Giardia lamblia
HSTELAEEQGKTTI

SEQ ID NO: 3114867 - protein, 15 aa, Giardia lamblia
HSTESAHESHDSASQ

SEQ ID NO: 3114868 - protein, 8 aa, Giardia lamblia
HSTESPRD

SEQ ID NO: 3114869 - protein, 11 aa, Giardia lamblia
HSTEVASQADQ

SEQ ID NO: 3114870 - protein, 9 aa, Giardia lamblia
HSTEVGQST

SEQ ID NO: 3114871 - protein, 5 aa, Giardia lamblia
HSTHH

SEQ ID NO: 3114872 - protein, 8 aa, Giardia lamblia
HSTKLETE

SEQ ID NO: 3114873 - protein, 7 aa, Giardia lamblia
HSTNEGH

SEQ ID NO: 3114874 - protein, 18 aa, Giardia lamblia
HSTPADAIPRRGRGCNQA

SEQ ID NO: 3114875 - protein, 22 aa, Giardia lamblia
HSTQPDSKGCARNYGSSSNFSS

SEQ ID NO: 3114876 - protein, 11 aa, Giardia lamblia
HSTQQAPDTTL

SEQ ID NO: 3114877 - protein, 8 aa, Giardia lamblia
HSTSEEAR

SEQ ID NO: 3114878 - protein, 7 aa, Giardia lamblia
HSTSEHN

SEQ ID NO: 3114879 - protein, 7 aa, Giardia lamblia
HSTSLRT

SEQ ID NO: 3114880 - protein, 8 aa, Giardia lamblia
HSTTDQQN

SEQ ID NO: 3114881 - protein, 4 aa, Giardia lamblia
HSTY

SEQ ID NO: 3114882 - protein, 12 aa, Giardia lamblia
HSTYGKDYSDSM

SEQ ID NO: 3114883 - protein, 9 aa, Giardia lamblia
HSVSEPATQ

SEQ ID NO: 3114884 - protein, 8 aa, Giardia lamblia
HSVSEQPN

SEQ ID NO: 3114885 - protein, 12 aa, Giardia lamblia
HSYSGAEKKGFG

SEQ ID NO: 3114886 - protein, 11 aa, Giardia lamblia
HSYSSIDPTRY

SEQ ID NO: 3114887 - protein, 9 aa, Giardia lamblia
HTAAPDAIK

SEQ ID NO: 3114888 - protein, 5 aa, Giardia lamblia
HTARD

SEQ ID NO: 3114889 - protein, 6 aa, Giardia lamblia
HTARPW

SEQ ID NO: 3114890 - protein, 10 aa, Giardia lamblia
HTASAPGSAV

SEQ ID NO: 3114891 - protein, 10 aa, Giardia lamblia
HTASEAYKTI

SEQ ID NO: 3114892 - protein, 6 aa, Giardia lamblia
HTASGN

SEQ ID NO: 3114893 - protein, 8 aa, Giardia lamblia
HTATENIG

SEQ ID NO: 3114894 - protein, 4 aa, Giardia lamblia
HTDK

SEQ ID NO: 3114895 - protein, 13 aa, Giardia lamblia
HTEATSESVENVE

SEQ ID NO: 3114896 - protein, 13 aa, Giardia lamblia
HTEEDEEKCNTEA

SEQ ID NO: 3114897 - protein, 17 aa, Giardia lamblia
HTEESTQTELDGNHTTN

SEQ ID NO: 3114898 - protein, 8 aa, Giardia lamblia
HTEGAGKL

SEQ ID NO: 3114899 - protein, 8 aa, Giardia lamblia
HTEKPKPV

SEQ ID NO: 3114900 - protein, 4 aa, Giardia lamblia
HTEN

SEQ ID NO: 3114901 - protein, 10 aa, Giardia lamblia
HTEPANAARA

SEQ ID NO: 3114902 - protein, 9 aa, Giardia lamblia
HTERDELER

SEQ ID NO: 3114903 - protein, 4 aa, Giardia lamblia
HTGA

SEQ ID NO: 3114904 - protein, 4 aa, Giardia lamblia
HTGE

SEQ ID NO: 3114905 - protein, 6 aa, Giardia lamblia
HTGEGD

SEQ ID NO: 3114906 - protein, 7 aa, Giardia lamblia
HTGEQSA

SEQ ID NO: 3114907 - protein, 6 aa, Giardia lamblia
HTGPIT

SEQ ID NO: 3114908 - protein, 7 aa, Giardia lamblia
HTGRNSD

SEQ ID NO: 3114909 - protein, 6 aa, Giardia lamblia
HTGSLS

SEQ ID NO: 3114910 - protein, 14 aa, Giardia lamblia
HTHSPGPPRGTPAW

SEQ ID NO: 3114911 - protein, 13 aa, Giardia lamblia
HTHTTEVESEEEV

SEQ ID NO: 3114912 - protein, 86 aa, Giardia lamblia
HTIPEAPQRPWKPDHRPSATTDSRSRSGNKAHTSISNKEACQGAEEAHSHISTQRENADNRSNRESSNATRGRRPQSARPKPAVGV

SEQ ID NO: 3114913 - protein, 9 aa, Giardia lamblia
HTIQKKDQE

SEQ ID NO: 3114914 - protein, 8 aa, Giardia lamblia
HTKAVSTH

SEQ ID NO: 3114915 - protein, 11 aa, Giardia lamblia
HTKKTLSSREK

SEQ ID NO: 3114916 - protein, 7 aa, Giardia lamblia
HTKNQRV

SEQ ID NO: 3114917 - protein, 8 aa, Giardia lamblia
HTKPQYAE

SEQ ID NO: 3114918 - protein, 8 aa, Giardia lamblia
HTKSGALE

SEQ ID NO: 3114919 - protein, 6 aa, Giardia lamblia
HTLPEQ

SEQ ID NO: 3114920 - protein, 46 aa, Giardia lamblia
HTLSPRSNKRDSNRSISAYSQQLGKEIEGRRSVSARSPSPQPKTAI

SEQ ID NO: 3114921 - protein, 5 aa, Giardia lamblia
HTNDP

SEQ ID NO: 3114922 - protein, 7 aa, Giardia lamblia
HTNDTET

SEQ ID NO: 3114923 - protein, 19 aa, Giardia lamblia
HTNKEFEDYTPNPTGAQPL

SEQ ID NO: 3114924 - protein, 5 aa, Giardia lamblia
HTNNS

SEQ ID NO: 3114925 - protein, 7 aa, Giardia lamblia
HTNNTET

SEQ ID NO: 3114926 - protein, 7 aa, Giardia lamblia
HTNPSKR

SEQ ID NO: 3114927 - protein, 7 aa, Giardia lamblia
HTNSTET

SEQ ID NO: 3114928 - protein, 5 aa, Giardia lamblia
HTPAD

SEQ ID NO: 3114929 - protein, 27 aa, Giardia lamblia
HTPASGQSGGVLTEEERALKEKGDSIM

SEQ ID NO: 3114930 - protein, 34 aa, Giardia lamblia
HTPGNRTVQSGDDDLSRRGSRSISTSRTSRPSSV

SEQ ID NO: 3114931 - protein, 10 aa, Giardia lamblia
HTPLDGATAG

SEQ ID NO: 3114932 - protein, 5 aa, Giardia lamblia
HTPPY

SEQ ID NO: 3114933 - protein, 9 aa, Giardia lamblia
HTPQTQQAR

SEQ ID NO: 3114934 - protein, 10 aa, Giardia lamblia
HTPSKSSTAD

SEQ ID NO: 3114935 - protein, 10 aa, Giardia lamblia
HTPSPSLPGV

SEQ ID NO: 3114936 - protein, 6 aa, Giardia lamblia
HTPSRA

SEQ ID NO: 3114937 - protein, 6 aa, Giardia lamblia
HTPSSN

SEQ ID NO: 3114938 - protein, 8 aa, Giardia lamblia
HTPTNPSV

SEQ ID NO: 3114939 - protein, 5 aa, Giardia lamblia
HTQIE

SEQ ID NO: 3114940 - protein, 12 aa, Giardia lamblia
HTQKSDAQSYSF

SEQ ID NO: 3114941 - protein, 6 aa, Giardia lamblia
HTQQIK

SEQ ID NO: 3114942 - protein, 9 aa, Giardia lamblia
HTQVSNTLP

SEQ ID NO: 3114943 - protein, 8 aa, Giardia lamblia
HTRPTQPC

SEQ ID NO: 3114944 - protein, 5 aa, Giardia lamblia
HTRRG

SEQ ID NO: 3114945 - protein, 10 aa, Giardia lamblia
HTRSAQSARL

SEQ ID NO: 3114946 - protein, 9 aa, Giardia lamblia
HTRSPADSG

SEQ ID NO: 3114947 - protein, 9 aa, Giardia lamblia
HTRSTAPKN

SEQ ID NO: 3114948 - protein, 6 aa, Giardia lamblia
HTSETQ

SEQ ID NO: 3114949 - protein, 4 aa, Giardia lamblia
HTSM

SEQ ID NO: 3114950 - protein, 17 aa, Giardia lamblia
HTSPNSSHSVPPSESST

SEQ ID NO: 3114951 - protein, 6 aa, Giardia lamblia
HTSPTQ

SEQ ID NO: 3114952 - protein, 12 aa, Giardia lamblia
HTSQDTDSISVL

SEQ ID NO: 3114953 - protein, 15 aa, Giardia lamblia
HTSSFSATKAHPTAM

SEQ ID NO: 3114954 - protein, 4 aa, Giardia lamblia
HTST

SEQ ID NO: 3114955 - protein, 9 aa, Giardia lamblia
HTSTTSTPG

SEQ ID NO: 3114956 - protein, 5 aa, Giardia lamblia
HTTDA

SEQ ID NO: 3114957 - protein, 7 aa, Giardia lamblia
HTTNGTT

SEQ ID NO: 3114958 - protein, 14 aa, Giardia lamblia
HTTPQDLEEGLDKS

SEQ ID NO: 3114959 - protein, 22 aa, Giardia lamblia
HTTPTEHGRGASAKLSSPERQF

SEQ ID NO: 3114960 - protein, 5 aa, Giardia lamblia
HTTSS

SEQ ID NO: 3114961 - protein, 21 aa, Giardia lamblia
HTTSSHSINPTAQSGQNIGAS

SEQ ID NO: 3114962 - protein, 5 aa, Giardia lamblia
HTVGA

SEQ ID NO: 3114963 - protein, 5 aa, Giardia lamblia
HTYAA

SEQ ID NO: 3114964 - protein, 12 aa, Giardia lamblia
HTYDETDNGTVV

SEQ ID NO: 3114965 - protein, 10 aa, Giardia lamblia
HTYDMSDPEV

SEQ ID NO: 3114966 - protein, 20 aa, Giardia lamblia
HVDGSKVSQTQTQQQGLPPI

SEQ ID NO: 3114967 - protein, 5 aa, Giardia lamblia
HVDNS

SEQ ID NO: 3114968 - protein, 19 aa, Giardia lamblia
HVEGGQARAPSDTPTGAPS

SEQ ID NO: 3114969 - protein, 10 aa, Giardia lamblia
HVEKKHNDKA

SEQ ID NO: 3114970 - protein, 10 aa, Giardia lamblia
HVNSQDQSSI

SEQ ID NO: 3114971 - protein, 4 aa, Giardia lamblia
HVPE

SEQ ID NO: 3114972 - protein, 5 aa, Giardia lamblia
HVPPT

SEQ ID NO: 3114973 - protein, 11 aa, Giardia lamblia
HVQSTNSKQTA

SEQ ID NO: 3114974 - protein, 42 aa, Giardia lamblia
HVSDTEESQPVSKSTLPISPTRESTQQTPSITISEKSPEIRE

SEQ ID NO: 3114975 - protein, 6 aa, Giardia lamblia
HVSGAA

SEQ ID NO: 3114976 - protein, 16 aa, Giardia lamblia
HVSNSTPDLQPTSISK

SEQ ID NO: 3114977 - protein, 9 aa, Giardia lamblia
HVSTGGGAS

SEQ ID NO: 3114978 - protein, 6 aa, Giardia lamblia
HVTEPD

SEQ ID NO: 3114979 - protein, 21 aa, Giardia lamblia
HVTERQGVHRKRRKTLNTKSM

SEQ ID NO: 3114980 - protein, 7 aa, Giardia lamblia
HYADNRK

SEQ ID NO: 3114981 - protein, 12 aa, Giardia lamblia
HYASAAPSATDA

SEQ ID NO: 3114982 - protein, 42 aa, Giardia lamblia
HYGGGEAPARAESARLPAPQASDPREARRSHASRPRTAGPRL

SEQ ID NO: 3114983 - protein, 15 aa, Giardia lamblia
HYGSGEPANNGTCGR

SEQ ID NO: 3114984 - protein, 4 aa, Giardia lamblia
HYKS

SEQ ID NO: 3114985 - protein, 7 aa, Giardia lamblia
HYQPSDL

SEQ ID NO: 3114986 - protein, 8 aa, Giardia lamblia
HYSEPGRK

SEQ ID NO: 3114987 - protein, 20 aa, Giardia lamblia
HYSRPGPRDVRPQRSAEYDY

SEQ ID NO: 3114988 - protein, 5 aa, Giardia lamblia
HYSSQ

SEQ ID NO: 3114989 - protein, 4 aa, Giardia lamblia
HYST

SEQ ID NO: 3114990 - protein, 12 aa, Giardia lamblia
HYTKTKELTTSR

SEQ ID NO: 3114991 - protein, 16 aa, Giardia lamblia
HYTPSKNAKIEAKIEI

SEQ ID NO: 3114992 - protein, 5 aa, Giardia lamblia
HYTRQ

SEQ ID NO: 3114993 - protein, 11 aa, Giardia lamblia
IAAENYKGAHE

SEQ ID NO: 3114994 - protein, 9 aa, Giardia lamblia
IAAGAQSEE

SEQ ID NO: 3114995 - protein, 8 aa, Giardia lamblia
IAAGDRGG

SEQ ID NO: 3114996 - protein, 10 aa, Giardia lamblia
IAAGNKTAFT

SEQ ID NO: 3114997 - protein, 9 aa, Giardia lamblia
IAAGSTHQL

SEQ ID NO: 3114998 - protein, 14 aa, Giardia lamblia
IAAHGKAKEEHEKK

SEQ ID NO: 3114999 - protein, 8 aa, Giardia lamblia
IAAKDGTT

SEQ ID NO: 3115000 - protein, 15 aa, Giardia lamblia
IAANDAGDVPPHADP

SEQ ID NO: 3115001 - protein, 17 aa, Giardia lamblia
IAANTSNDGARQITTGP

SEQ ID NO: 3115002 - protein, 9 aa, Giardia lamblia
IAAPAENRE

SEQ ID NO: 3115003 - protein, 28 aa, Giardia lamblia
IAAPANSKKLASRRTTTNQAPAGGVRRK

SEQ ID NO: 3115004 - protein, 12 aa, Giardia lamblia
IAARKHKREEQY

SEQ ID NO: 3115005 - protein, 6 aa, Giardia lamblia
IAASGD

SEQ ID NO: 3115006 - protein, 27 aa, Giardia lamblia
IAATKPKRDAASREARPKEPPKPPPSI

SEQ ID NO: 3115007 - protein, 14 aa, Giardia lamblia
IADAGTDDHTEVPH

SEQ ID NO: 3115008 - protein, 10 aa, Giardia lamblia
IADASSEEYQ

SEQ ID NO: 3115009 - protein, 6 aa, Giardia lamblia
IADGKK

SEQ ID NO: 3115010 - protein, 11 aa, Giardia lamblia
IADKQAKLSRK

SEQ ID NO: 3115011 - protein, 7 aa, Giardia lamblia
IADNSGM

SEQ ID NO: 3115012 - protein, 27 aa, Giardia lamblia
IADTRQHSLDSGLAGSRTGASQAPGFY

SEQ ID NO: 3115013 - protein, 8 aa, Giardia lamblia
IADTSSTG

SEQ ID NO: 3115014 - protein, 19 aa, Giardia lamblia
IADTTTSEEGGDPTRITPA

SEQ ID NO: 3115015 - protein, 18 aa, Giardia lamblia
IAEAKQRELQDKKSMMSE

SEQ ID NO: 3115016 - protein, 11 aa, Giardia lamblia
IAEKNRRKLQE

SEQ ID NO: 3115017 - protein, 9 aa, Giardia lamblia
IAEKQKKIE

SEQ ID NO: 3115018 - protein, 8 aa, Giardia lamblia
IAENSGKT

SEQ ID NO: 3115019 - protein, 4 aa, Giardia lamblia
IAEP

SEQ ID NO: 3115020 - protein, 18 aa, Giardia lamblia
IAERATEDVAASTPVDTS

SEQ ID NO: 3115021 - protein, 6 aa, Giardia lamblia
IAERDR

SEQ ID NO: 3115022 - protein, 34 aa, Giardia lamblia
IAEREAANNDSKEEESTGDDDDDEVVEDADKADD

SEQ ID NO: 3115023 - protein, 9 aa, Giardia lamblia
IAESEEARA

SEQ ID NO: 3115024 - protein, 11 aa, Giardia lamblia
IAESETAGDKL

SEQ ID NO: 3115025 - protein, 6 aa, Giardia lamblia
IAGDEE

SEQ ID NO: 3115026 - protein, 8 aa, Giardia lamblia
IAGDGRGA

SEQ ID NO: 3115027 - protein, 9 aa, Giardia lamblia
IAGGTGSGM

SEQ ID NO: 3115028 - protein, 25 aa, Giardia lamblia
IAGKAKQEGRRTLAQGGMAAESSKL

SEQ ID NO: 3115029 - protein, 5 aa, Giardia lamblia
IAGKE

SEQ ID NO: 3115030 - protein, 31 aa, Giardia lamblia
IAGKKSSSRRRTKGEDSESSAENVKASTIDV

SEQ ID NO: 3115031 - protein, 9 aa, Giardia lamblia
IAGNKRLSS

SEQ ID NO: 3115032 - protein, 8 aa, Giardia lamblia
IAGPDETM

SEQ ID NO: 3115033 - protein, 4 aa, Giardia lamblia
IAGS

SEQ ID NO: 3115034 - protein, 7 aa, Giardia lamblia
IAGSGGK

SEQ ID NO: 3115035 - protein, 12 aa, Giardia lamblia
IAGSKSAKSCVS

SEQ ID NO: 3115036 - protein, 5 aa, Giardia lamblia
IAKDT

SEQ ID NO: 3115037 - protein, 11 aa, Giardia lamblia
IAKETQEREEI

SEQ ID NO: 3115038 - protein, 11 aa, Giardia lamblia
IAKKPSSNPDI

SEQ ID NO: 3115039 - protein, 23 aa, Giardia lamblia
IAKPASKSTKYYQPHGSATSADL

SEQ ID NO: 3115040 - protein, 77 aa, Giardia lamblia
IAKPRKCSPRAAPGRDKNKDPGHGRDQEHHPPEHEAAGRARGPAGEGPRVRPPRARGPQGQPAPAARGRDVRDPGAH

SEQ ID NO: 3115041 - protein, 7 aa, Giardia lamblia
IAKQSDT

SEQ ID NO: 3115042 - protein, 6 aa, Giardia lamblia
IAKSEY

SEQ ID NO: 3115043 - protein, 10 aa, Giardia lamblia
IAKSGVEKSL

SEQ ID NO: 3115044 - protein, 7 aa, Giardia lamblia
IAKTAEP

SEQ ID NO: 3115045 - protein, 8 aa, Giardia lamblia
IANAEAKY

SEQ ID NO: 3115046 - protein, 8 aa, Giardia lamblia
IANATQDT

SEQ ID NO: 3115047 - protein, 5 aa, Giardia lamblia
IANEA

SEQ ID NO: 3115048 - protein, 9 aa, Giardia lamblia
IANKEQDVN

SEQ ID NO: 3115049 - protein, 20 aa, Giardia lamblia
IANTANSSRSTERPSIGATR

SEQ ID NO: 3115050 - protein, 5 aa, Giardia lamblia
IANTR

SEQ ID NO: 3115051 - protein, 19 aa, Giardia lamblia
IAPDEGEGSYSISGRKRTA

SEQ ID NO: 3115052 - protein, 11 aa, Giardia lamblia
IAPEATTTATR

SEQ ID NO: 3115053 - protein, 8 aa, Giardia lamblia
IAPKSGNT

SEQ ID NO: 3115054 - protein, 5 aa, Giardia lamblia
IAPPK

SEQ ID NO: 3115055 - protein, 15 aa, Giardia lamblia
IAPSSKKNPRARKVK

SEQ ID NO: 3115056 - protein, 9 aa, Giardia lamblia
IAPTKQREY

SEQ ID NO: 3115057 - protein, 8 aa, Giardia lamblia
IAPTSSQF

SEQ ID NO: 3115058 - protein, 4 aa, Giardia lamblia
IAPY

SEQ ID NO: 3115059 - protein, 15 aa, Giardia lamblia
IAQGGQQRREGARES

SEQ ID NO: 3115060 - protein, 9 aa, Giardia lamblia
IAQPEGDQV

SEQ ID NO: 3115061 - protein, 25 aa, Giardia lamblia
IARGGPSADPALESTSDASNSYPYV

SEQ ID NO: 3115062 - protein, 8 aa, Giardia lamblia
IARGGSAR

SEQ ID NO: 3115063 - protein, 9 aa, Giardia lamblia
IARKGNPNL

SEQ ID NO: 3115064 - protein, 8 aa, Giardia lamblia
IARKNETI

SEQ ID NO: 3115065 - protein, 32 aa, Giardia lamblia
IARKNSELIKQGQELKETRNTADDLQKTKQHL

SEQ ID NO: 3115066 - protein, 16 aa, Giardia lamblia
IARKSAASIRSSRHRR

SEQ ID NO: 3115067 - protein, 5 aa, Giardia lamblia
IARNY

SEQ ID NO: 3115068 - protein, 24 aa, Giardia lamblia
IARPRSSDRHQRPSSQKPAERDSK

SEQ ID NO: 3115069 - protein, 4 aa, Giardia lamblia
IARR

SEQ ID NO: 3115070 - protein, 15 aa, Giardia lamblia
IARSARAALADQEAA

SEQ ID NO: 3115071 - protein, 6 aa, Giardia lamblia
IARSGR

SEQ ID NO: 3115072 - protein, 8 aa, Giardia lamblia
IARSQNPM

SEQ ID NO: 3115073 - protein, 12 aa, Giardia lamblia
IARTGHSSTLDA

SEQ ID NO: 3115074 - protein, 11 aa, Giardia lamblia
IASADEPTTLK

SEQ ID NO: 3115075 - protein, 8 aa, Giardia lamblia
IASAPKGL

SEQ ID NO: 3115076 - protein, 10 aa, Giardia lamblia
IASASDNNIP

SEQ ID NO: 3115077 - protein, 7 aa, Giardia lamblia
IASDPGL

SEQ ID NO: 3115078 - protein, 19 aa, Giardia lamblia
IASEETNSHGGPTTSNSTI

SEQ ID NO: 3115079 - protein, 11 aa, Giardia lamblia
IASEMTPDRSL

SEQ ID NO: 3115080 - protein, 10 aa, Giardia lamblia
IASEQTAELH

SEQ ID NO: 3115081 - protein, 22 aa, Giardia lamblia
IASEYSDHVEKPRSVNESDDVM

SEQ ID NO: 3115082 - protein, 6 aa, Giardia lamblia
IASGGK

SEQ ID NO: 3115083 - protein, 8 aa, Giardia lamblia
IASKPSVE

SEQ ID NO: 3115084 - protein, 10 aa, Giardia lamblia
IASKQALKEQ

SEQ ID NO: 3115085 - protein, 6 aa, Giardia lamblia
IASNSN

SEQ ID NO: 3115086 - protein, 9 aa, Giardia lamblia
IASPADIRS

SEQ ID NO: 3115087 - protein, 6 aa, Giardia lamblia
IASPDE

SEQ ID NO: 3115088 - protein, 7 aa, Giardia lamblia
IASPSVQ

SEQ ID NO: 3115089 - protein, 14 aa, Giardia lamblia
IASQKTEACDEQPK

SEQ ID NO: 3115090 - protein, 10 aa, Giardia lamblia
IASQNNDGHP

SEQ ID NO: 3115091 - protein, 7 aa, Giardia lamblia
IASQNNV

SEQ ID NO: 3115092 - protein, 18 aa, Giardia lamblia
IASRNKELGERDIKATSI

SEQ ID NO: 3115093 - protein, 9 aa, Giardia lamblia
IASSAAGAA

SEQ ID NO: 3115094 - protein, 8 aa, Giardia lamblia
IASSNTGL

SEQ ID NO: 3115095 - protein, 8 aa, Giardia lamblia
IASSRPKV

SEQ ID NO: 3115096 - protein, 6 aa, Giardia lamblia
IASSSD

SEQ ID NO: 3115097 - protein, 9 aa, Giardia lamblia
IASSSNSQL

SEQ ID NO: 3115098 - protein, 8 aa, Giardia lamblia
IASSSTLP

SEQ ID NO: 3115099 - protein, 10 aa, Giardia lamblia
IASTPTSNAV

SEQ ID NO: 3115100 - protein, 16 aa, Giardia lamblia
IASTTARIESTGAQTA

SEQ ID NO: 3115101 - protein, 17 aa, Giardia lamblia
IASTTKSAAGKLPNPSL

SEQ ID NO: 3115102 - protein, 7 aa, Giardia lamblia
IATGASR

SEQ ID NO: 3115103 - protein, 11 aa, Giardia lamblia
IATNESDISEM

SEQ ID NO: 3115104 - protein, 6 aa, Giardia lamblia
IATREA

SEQ ID NO: 3115105 - protein, 6 aa, Giardia lamblia
IATSKL

SEQ ID NO: 3115106 - protein, 14 aa, Giardia lamblia
IATSPKPSLSRVPS

SEQ ID NO: 3115107 - protein, 31 aa, Giardia lamblia
IATTESANASISRHKSKIPGFESGASKVERE

SEQ ID NO: 3115108 - protein, 49 aa, Giardia lamblia
IAVPTPAQTAPPVSAEQTQQPAPFQSTAPQSQPQQQQQQPQFPAAPGDL

SEQ ID NO: 3115109 - protein, 4 aa, Giardia lamblia
ICEP

SEQ ID NO: 3115110 - protein, 5 aa, Giardia lamblia
ICPPA

SEQ ID NO: 3115111 - protein, 11 aa, Giardia lamblia
IDAGDEDKITK

SEQ ID NO: 3115112 - protein, 7 aa, Giardia lamblia
IDAKDEA

SEQ ID NO: 3115113 - protein, 8 aa, Giardia lamblia
IDAKPPQL

SEQ ID NO: 3115114 - protein, 13 aa, Giardia lamblia
IDAPPSLATSKAD

SEQ ID NO: 3115115 - protein, 11 aa, Giardia lamblia
IDARPSYDAPI

SEQ ID NO: 3115116 - protein, 12 aa, Giardia lamblia
IDASGATSLGEL

SEQ ID NO: 3115117 - protein, 8 aa, Giardia lamblia
IDASQRSS

SEQ ID NO: 3115118 - protein, 7 aa, Giardia lamblia
IDATKDE

SEQ ID NO: 3115119 - protein, 25 aa, Giardia lamblia
IDAYRSSSGSMDSFSPEEASYKKAL

SEQ ID NO: 3115120 - protein, 12 aa, Giardia lamblia
IDDANSSASSEH

SEQ ID NO: 3115121 - protein, 7 aa, Giardia lamblia
IDDEGKT

SEQ ID NO: 3115122 - protein, 5 aa, Giardia lamblia
IDDES

SEQ ID NO: 3115123 - protein, 13 aa, Giardia lamblia
IDDESPSKLVKRR

SEQ ID NO: 3115124 - protein, 8 aa, Giardia lamblia
IDDETARQ

SEQ ID NO: 3115125 - protein, 4 aa, Giardia lamblia
IDDL

SEQ ID NO: 3115126 - protein, 7 aa, Giardia lamblia
IDDPNKC

SEQ ID NO: 3115127 - protein, 11 aa, Giardia lamblia
IDDSDQHSLGT

SEQ ID NO: 3115128 - protein, 12 aa, Giardia lamblia
IDDTDTAAMGGR

SEQ ID NO: 3115129 - protein, 5 aa, Giardia lamblia
IDDTR

SEQ ID NO: 3115130 - protein, 10 aa, Giardia lamblia
IDEAGQQDLS

SEQ ID NO: 3115131 - protein, 19 aa, Giardia lamblia
IDEDSERPEEDDDADQRDL

SEQ ID NO: 3115132 - protein, 18 aa, Giardia lamblia
IDEESKADDRATHTVERP

SEQ ID NO: 3115133 - protein, 14 aa, Giardia lamblia
IDEGANSDLKKKDD

SEQ ID NO: 3115134 - protein, 8 aa, Giardia lamblia
IDEKQNTI

SEQ ID NO: 3115135 - protein, 10 aa, Giardia lamblia
IDEKRRGDLE

SEQ ID NO: 3115136 - protein, 8 aa, Giardia lamblia
IDELEGKD

SEQ ID NO: 3115137 - protein, 8 aa, Giardia lamblia
IDESEKAR

SEQ ID NO: 3115138 - protein, 7 aa, Giardia lamblia
IDESGRL

SEQ ID NO: 3115139 - protein, 6 aa, Giardia lamblia
IDETGL

SEQ ID NO: 3115140 - protein, 9 aa, Giardia lamblia
IDGANGQSI

SEQ ID NO: 3115141 - protein, 9 aa, Giardia lamblia
IDGEEASLG

SEQ ID NO: 3115142 - protein, 7 aa, Giardia lamblia
IDGEGKT

SEQ ID NO: 3115143 - protein, 19 aa, Giardia lamblia
IDGEPPQEPPDKAKSTPLS

SEQ ID NO: 3115144 - protein, 8 aa, Giardia lamblia
IDGEQDKV

SEQ ID NO: 3115145 - protein, 14 aa, Giardia lamblia
IDGPAGSSTARRRF

SEQ ID NO: 3115146 - protein, 7 aa, Giardia lamblia
IDGPTSI

SEQ ID NO: 3115147 - protein, 14 aa, Giardia lamblia
IDGQIEPLDPQQPR

SEQ ID NO: 3115148 - protein, 6 aa, Giardia lamblia
IDGQRN

SEQ ID NO: 3115149 - protein, 49 aa, Giardia lamblia
IDGSSSGEVDDKKKEKEKKAKKVADDGDGDEDGTKKKKKESTGLSARDE

SEQ ID NO: 3115150 - protein, 12 aa, Giardia lamblia
IDKAGSVNSVGN

SEQ ID NO: 3115151 - protein, 27 aa, Giardia lamblia
IDKDEQNSNLPDLSGNQTHESKTTIKD

SEQ ID NO: 3115152 - protein, 12 aa, Giardia lamblia
IDKDGNTVSQRE

SEQ ID NO: 3115153 - protein, 20 aa, Giardia lamblia
IDKYSRHGTGPGSATNREPW

SEQ ID NO: 3115154 - protein, 8 aa, Giardia lamblia
IDLSPENI

SEQ ID NO: 3115155 - protein, 5 aa, Giardia lamblia
IDMTS

SEQ ID NO: 3115156 - protein, 7 aa, Giardia lamblia
IDNATQV

SEQ ID NO: 3115157 - protein, 8 aa, Giardia lamblia
IDNEREKE

SEQ ID NO: 3115158 - protein, 5 aa, Giardia lamblia
IDNNG

SEQ ID NO: 3115159 - protein, 9 aa, Giardia lamblia
IDNNPDKNV

SEQ ID NO: 3115160 - protein, 12 aa, Giardia lamblia
IDNNSESNEVNL

SEQ ID NO: 3115161 - protein, 4 aa, Giardia lamblia
IDNP

SEQ ID NO: 3115162 - protein, 23 aa, Giardia lamblia
IDNSSPECPPSTSRKPRSDRSNL

SEQ ID NO: 3115163 - protein, 5 aa, Giardia lamblia
IDNTA

SEQ ID NO: 3115164 - protein, 15 aa, Giardia lamblia
IDNTSRQTKKPRSRS

SEQ ID NO: 3115165 - protein, 10 aa, Giardia lamblia
IDPATGKPLH

SEQ ID NO: 3115166 - protein, 12 aa, Giardia lamblia
IDPGEGDGEQTY

SEQ ID NO: 3115167 - protein, 13 aa, Giardia lamblia
IDPGSLETNEDTG

SEQ ID NO: 3115168 - protein, 10 aa, Giardia lamblia
IDPKERDKAA

SEQ ID NO: 3115169 - protein, 8 aa, Giardia lamblia
IDPKQSGW

SEQ ID NO: 3115170 - protein, 6 aa, Giardia lamblia
IDPNNN

SEQ ID NO: 3115171 - protein, 8 aa, Giardia lamblia
IDPNSTKG

SEQ ID NO: 3115172 - protein, 10 aa, Giardia lamblia
IDPPGGSDVP

SEQ ID NO: 3115173 - protein, 10 aa, Giardia lamblia
IDPPPTSPDE

SEQ ID NO: 3115174 - protein, 8 aa, Giardia lamblia
IDPPQRDA

SEQ ID NO: 3115175 - protein, 13 aa, Giardia lamblia
IDPQEQRTLANNT

SEQ ID NO: 3115176 - protein, 19 aa, Giardia lamblia
IDPSDHHNRTQETENRDDS

SEQ ID NO: 3115177 - protein, 9 aa, Giardia lamblia
IDPTDDRGV

SEQ ID NO: 3115178 - protein, 16 aa, Giardia lamblia
IDPTTDNTFKARAGDG

SEQ ID NO: 3115179 - protein, 4 aa, Giardia lamblia
IDPV

SEQ ID NO: 3115180 - protein, 9 aa, Giardia lamblia
IDQQDSNRA

SEQ ID NO: 3115181 - protein, 5 aa, Giardia lamblia
IDREE

SEQ ID NO: 3115182 - protein, 13 aa, Giardia lamblia
IDREGQEWDNRSD

SEQ ID NO: 3115183 - protein, 14 aa, Giardia lamblia
IDREKAERKEAEDK

SEQ ID NO: 3115184 - protein, 7 aa, Giardia lamblia
IDRPEPV

SEQ ID NO: 3115185 - protein, 10 aa, Giardia lamblia
IDRTRKKRRA

SEQ ID NO: 3115186 - protein, 7 aa, Giardia lamblia
IDSAGST

SEQ ID NO: 3115187 - protein, 7 aa, Giardia lamblia
IDSEGNT

SEQ ID NO: 3115188 - protein, 8 aa, Giardia lamblia
IDSEGRGA

SEQ ID NO: 3115189 - protein, 9 aa, Giardia lamblia
IDSETKSTA

SEQ ID NO: 3115190 - protein, 7 aa, Giardia lamblia
IDSETQA

SEQ ID NO: 3115191 - protein, 43 aa, Giardia lamblia
IDSGAGRDEDSHVTRSSSISRLSRPGSYAATHGGYMGTDGSSL

SEQ ID NO: 3115192 - protein, 7 aa, Giardia lamblia
IDSKGSS

SEQ ID NO: 3115193 - protein, 12 aa, Giardia lamblia
IDSKQGKLTPKE

SEQ ID NO: 3115194 - protein, 4 aa, Giardia lamblia
IDSL

SEQ ID NO: 3115195 - protein, 7 aa, Giardia lamblia
IDSNSLE

SEQ ID NO: 3115196 - protein, 10 aa, Giardia lamblia
IDSPKKEKKS

SEQ ID NO: 3115197 - protein, 8 aa, Giardia lamblia
IDSPLSPL

SEQ ID NO: 3115198 - protein, 33 aa, Giardia lamblia
IDSPSPSQDSHRGSYRESMHKDDSSVDENTKRY

SEQ ID NO: 3115199 - protein, 16 aa, Giardia lamblia
IDSPTASARSPPRGLT

SEQ ID NO: 3115200 - protein, 4 aa, Giardia lamblia
IDSS

SEQ ID NO: 3115201 - protein, 7 aa, Giardia lamblia
IDSSDST

SEQ ID NO: 3115202 - protein, 8 aa, Giardia lamblia
IDSTPTKV

SEQ ID NO: 3115203 - protein, 5 aa, Giardia lamblia
IDSTV

SEQ ID NO: 3115204 - protein, 7 aa, Giardia lamblia
IDTDGNG

SEQ ID NO: 3115205 - protein, 32 aa, Giardia lamblia
IDTDTLSSQNVSRAVTQDAAAHDVRGSNSAHA

SEQ ID NO: 3115206 - protein, 16 aa, Giardia lamblia
IDTEPRKKKPTKSQHV

SEQ ID NO: 3115207 - protein, 12 aa, Giardia lamblia
IDTKDARRKASQ

SEQ ID NO: 3115208 - protein, 5 aa, Giardia lamblia
IDTQL

SEQ ID NO: 3115209 - protein, 15 aa, Giardia lamblia
IDTSSITYSAQPPED

SEQ ID NO: 3115210 - protein, 25 aa, Giardia lamblia
IDTTDETDNIEDTEEEHLEEDDSTD

SEQ ID NO: 3115211 - protein, 4 aa, Giardia lamblia
IDVS

SEQ ID NO: 3115212 - protein, 8 aa, Giardia lamblia
IEADTTRR

SEQ ID NO: 3115213 - protein, 6 aa, Giardia lamblia
IEAERA

SEQ ID NO: 3115214 - protein, 6 aa, Giardia lamblia
IEAQNE

SEQ ID NO: 3115215 - protein, 8 aa, Giardia lamblia
IEARDNQI

SEQ ID NO: 3115216 - protein, 5 aa, Giardia lamblia
IEARE

SEQ ID NO: 3115217 - protein, 18 aa, Giardia lamblia
IEASSQKQRRSVSEHPAR

SEQ ID NO: 3115218 - protein, 6 aa, Giardia lamblia
IEATDS

SEQ ID NO: 3115219 - protein, 7 aa, Giardia lamblia
IEATTRA

SEQ ID NO: 3115220 - protein, 6 aa, Giardia lamblia
IEDDKK

SEQ ID NO: 3115221 - protein, 18 aa, Giardia lamblia
IEDEKKRLRDKEAQEKES

SEQ ID NO: 3115222 - protein, 7 aa, Giardia lamblia
IEDGKRH

SEQ ID NO: 3115223 - protein, 8 aa, Giardia lamblia
IEDGSDVE

SEQ ID NO: 3115224 - protein, 10 aa, Giardia lamblia
IEDGSSADDN

SEQ ID NO: 3115225 - protein, 11 aa, Giardia lamblia
IEDKPSAPTPP

SEQ ID NO: 3115226 - protein, 17 aa, Giardia lamblia
IEDLSEENGGLSSSNHS

SEQ ID NO: 3115227 - protein, 7 aa, Giardia lamblia
IEDPGLK

SEQ ID NO: 3115228 - protein, 6 aa, Giardia lamblia
IEDPTS

SEQ ID NO: 3115229 - protein, 5 aa, Giardia lamblia
IEDQK

SEQ ID NO: 3115230 - protein, 5 aa, Giardia lamblia
IEDSD

SEQ ID NO: 3115231 - protein, 6 aa, Giardia lamblia
IEEAEK

SEQ ID NO: 3115232 - protein, 9 aa, Giardia lamblia
IEEDGKNTK

SEQ ID NO: 3115233 - protein, 5 aa, Giardia lamblia
IEEDT

SEQ ID NO: 3115234 - protein, 4 aa, Giardia lamblia
IEEE

SEQ ID NO: 3115235 - protein, 10 aa, Giardia lamblia
IEEECRKKER

SEQ ID NO: 3115236 - protein, 20 aa, Giardia lamblia
IEEEDEHAGTSTSETDKTES

SEQ ID NO: 3115237 - protein, 12 aa, Giardia lamblia
IEEEQERSAEQR

SEQ ID NO: 3115238 - protein, 12 aa, Giardia lamblia
IEEEQRIKAEAR

SEQ ID NO: 3115239 - protein, 11 aa, Giardia lamblia
IEEERAEFTEN

SEQ ID NO: 3115240 - protein, 4 aa, Giardia lamblia
IEEG

SEQ ID NO: 3115241 - protein, 9 aa, Giardia lamblia
IEEGPSKEL

SEQ ID NO: 3115242 - protein, 8 aa, Giardia lamblia
IEEGSSEM

SEQ ID NO: 3115243 - protein, 5 aa, Giardia lamblia
IEEKN

SEQ ID NO: 3115244 - protein, 5 aa, Giardia lamblia
IEELP

SEQ ID NO: 3115245 - protein, 23 aa, Giardia lamblia
IEEPGSKRCGRDSTPINPKASRI

SEQ ID NO: 3115246 - protein, 12 aa, Giardia lamblia
IEEQKKRQEEKE

SEQ ID NO: 3115247 - protein, 10 aa, Giardia lamblia
IEEQKQKIKQ

SEQ ID NO: 3115248 - protein, 4 aa, Giardia lamblia
IEER

SEQ ID NO: 3115249 - protein, 6 aa, Giardia lamblia
IEEREA

SEQ ID NO: 3115250 - protein, 7 aa, Giardia lamblia
IEESEMN

SEQ ID NO: 3115251 - protein, 11 aa, Giardia lamblia
IEESKESADNP

SEQ ID NO: 3115252 - protein, 7 aa, Giardia lamblia
IEETQRK

SEQ ID NO: 3115253 - protein, 11 aa, Giardia lamblia
IEETRKAMSAD

SEQ ID NO: 3115254 - protein, 9 aa, Giardia lamblia
IEGAGPSFE

SEQ ID NO: 3115255 - protein, 8 aa, Giardia lamblia
IEGATEGL

SEQ ID NO: 3115256 - protein, 8 aa, Giardia lamblia
IEGPPTSS

SEQ ID NO: 3115257 - protein, 5 aa, Giardia lamblia
IEGRR

SEQ ID NO: 3115258 - protein, 5 aa, Giardia lamblia
IEGRS

SEQ ID NO: 3115259 - protein, 4 aa, Giardia lamblia
IEGS

SEQ ID NO: 3115260 - protein, 5 aa, Giardia lamblia
IEGSE

SEQ ID NO: 3115261 - protein, 11 aa, Giardia lamblia
IEGTEDEKESC

SEQ ID NO: 3115262 - protein, 12 aa, Giardia lamblia
IEGTERDSASRT

SEQ ID NO: 3115263 - protein, 4 aa, Giardia lamblia
IEHP

SEQ ID NO: 3115264 - protein, 11 aa, Giardia lamblia
IEKAERTKSTS

SEQ ID NO: 3115265 - protein, 10 aa, Giardia lamblia
IEKASGLAQN

SEQ ID NO: 3115266 - protein, 6 aa, Giardia lamblia
IEKGAI

SEQ ID NO: 3115267 - protein, 8 aa, Giardia lamblia
IEKKSKAA

SEQ ID NO: 3115268 - protein, 6 aa, Giardia lamblia
IEKPTA

SEQ ID NO: 3115269 - protein, 9 aa, Giardia lamblia
IEKQPLDAT

SEQ ID NO: 3115270 - protein, 11 aa, Giardia lamblia
IEKTEAEKLKK

SEQ ID NO: 3115271 - protein, 5 aa, Giardia lamblia
IEKTG

SEQ ID NO: 3115272 - protein, 10 aa, Giardia lamblia
IEKTGTGSYE

SEQ ID NO: 3115273 - protein, 9 aa, Giardia lamblia
IEKYTDKAS

SEQ ID NO: 3115274 - protein, 11 aa, Giardia lamblia
IELSQEGDTPL

SEQ ID NO: 3115275 - protein, 12 aa, Giardia lamblia
IENDTDAKAHMD

SEQ ID NO: 3115276 - protein, 49 aa, Giardia lamblia
IENEERKKRIESAKAQSKAPAIESDASSKGQEPEIQDGGDDESMSPADK

SEQ ID NO: 3115277 - protein, 8 aa, Giardia lamblia
IENKPWDG

SEQ ID NO: 3115278 - protein, 11 aa, Giardia lamblia
IENKTKYGYAN

SEQ ID NO: 3115279 - protein, 12 aa, Giardia lamblia
IENRSSDDLDAE

SEQ ID NO: 3115280 - protein, 6 aa, Giardia lamblia
IENSNL

SEQ ID NO: 3115281 - protein, 15 aa, Giardia lamblia
IENSRRRSDGEVSKY

SEQ ID NO: 3115282 - protein, 10 aa, Giardia lamblia
IENTRRREKH

SEQ ID NO: 3115283 - protein, 16 aa, Giardia lamblia
IEPDPQQSFTDKENVD

SEQ ID NO: 3115284 - protein, 7 aa, Giardia lamblia
IEPGDTQ

SEQ ID NO: 3115285 - protein, 6 aa, Giardia lamblia
IEPGIT

SEQ ID NO: 3115286 - protein, 12 aa, Giardia lamblia
IEPKTTPPKVTT

SEQ ID NO: 3115287 - protein, 22 aa, Giardia lamblia
IEPNASLTDPTTSQSLGTSDFS

SEQ ID NO: 3115288 - protein, 6 aa, Giardia lamblia
IEPNPT

SEQ ID NO: 3115289 - protein, 7 aa, Giardia lamblia
IEPPANP

SEQ ID NO: 3115290 - protein, 7 aa, Giardia lamblia
IEPQATR

SEQ ID NO: 3115291 - protein, 12 aa, Giardia lamblia
IEPRATPNAPKI

SEQ ID NO: 3115292 - protein, 15 aa, Giardia lamblia
IEPSEARPVLSPRRS

SEQ ID NO: 3115293 - protein, 12 aa, Giardia lamblia
IEPSHKGTTSVT

SEQ ID NO: 3115294 - protein, 5 aa, Giardia lamblia
IEPSR

SEQ ID NO: 3115295 - protein, 5 aa, Giardia lamblia
IEPTT

SEQ ID NO: 3115296 - protein, 9 aa, Giardia lamblia
IEPTTGSAM

SEQ ID NO: 3115297 - protein, 11 aa, Giardia lamblia
IEQARTKYSNK

SEQ ID NO: 3115298 - protein, 22 aa, Giardia lamblia
IEQGQSSKVLPDAAKNEGVTEE

SEQ ID NO: 3115299 - protein, 23 aa, Giardia lamblia
IEQGSESGTTGTADSTPTNDAES

SEQ ID NO: 3115300 - protein, 7 aa, Giardia lamblia
IEQNQSE

SEQ ID NO: 3115301 - protein, 5 aa, Giardia lamblia
IEQNR

SEQ ID NO: 3115302 - protein, 12 aa, Giardia lamblia
IEQQNADNEALR

SEQ ID NO: 3115303 - protein, 8 aa, Giardia lamblia
IEQRTTAA

SEQ ID NO: 3115304 - protein, 15 aa, Giardia lamblia
IEQTGPPSDYAYAGA

SEQ ID NO: 3115305 - protein, 20 aa, Giardia lamblia
IERANRKADREYQKLEAERK

SEQ ID NO: 3115306 - protein, 8 aa, Giardia lamblia
IEREPGPF

SEQ ID NO: 3115307 - protein, 17 aa, Giardia lamblia
IERNTASCEAADRTRQD

SEQ ID NO: 3115308 - protein, 12 aa, Giardia lamblia
IERQRSKEGGGL

SEQ ID NO: 3115309 - protein, 18 aa, Giardia lamblia
IERRRNEITSGTPVNPTT

SEQ ID NO: 3115310 - protein, 8 aa, Giardia lamblia
IERSGAPI

SEQ ID NO: 3115311 - protein, 5 aa, Giardia lamblia
IERSN

SEQ ID NO: 3115312 - protein, 4 aa, Giardia lamblia
IESA

SEQ ID NO: 3115313 - protein, 10 aa, Giardia lamblia
IESAKTDQTY

SEQ ID NO: 3115314 - protein, 8 aa, Giardia lamblia
IESDKRQA

SEQ ID NO: 3115315 - protein, 40 aa, Giardia lamblia
IESESSRSGSDGRRFRPESIRKRSSSWGSPHKSKEASDLR

SEQ ID NO: 3115316 - protein, 19 aa, Giardia lamblia
IESHESSELASASAGSAAN

SEQ ID NO: 3115317 - protein, 8 aa, Giardia lamblia
IESHQSTL

SEQ ID NO: 3115318 - protein, 9 aa, Giardia lamblia
IESKSREVL

SEQ ID NO: 3115319 - protein, 20 aa, Giardia lamblia
IESPKRGSSYGTMGPPRRTV

SEQ ID NO: 3115320 - protein, 4 aa, Giardia lamblia
IESR

SEQ ID NO: 3115321 - protein, 9 aa, Giardia lamblia
IESSDLNTR

SEQ ID NO: 3115322 - protein, 10 aa, Giardia lamblia
IESSNKYKSY

SEQ ID NO: 3115323 - protein, 4 aa, Giardia lamblia
IETA

SEQ ID NO: 3115324 - protein, 12 aa, Giardia lamblia
IETANKDTSDSV

SEQ ID NO: 3115325 - protein, 18 aa, Giardia lamblia
IETDSSLKVDGAVASAQN

SEQ ID NO: 3115326 - protein, 6 aa, Giardia lamblia
IETGKA

SEQ ID NO: 3115327 - protein, 7 aa, Giardia lamblia
IETKTRT

SEQ ID NO: 3115328 - protein, 11 aa, Giardia lamblia
IETLSKPTGIS

SEQ ID NO: 3115329 - protein, 9 aa, Giardia lamblia
IETPAPEDM

SEQ ID NO: 3115330 - protein, 10 aa, Giardia lamblia
IETRDQSALA

SEQ ID NO: 3115331 - protein, 4 aa, Giardia lamblia
IETS

SEQ ID NO: 3115332 - protein, 6 aa, Giardia lamblia
IETTNQ

SEQ ID NO: 3115333 - protein, 11 aa, Giardia lamblia
IETTQTDKPTA

SEQ ID NO: 3115334 - protein, 6 aa, Giardia lamblia
IEYTEE

SEQ ID NO: 3115335 - protein, 20 aa, Giardia lamblia
IFDDPTRKKGGKNAIKEDAV

SEQ ID NO: 3115336 - protein, 13 aa, Giardia lamblia
IFDGEKANSQLED

SEQ ID NO: 3115337 - protein, 5 aa, Giardia lamblia
IFPGA

SEQ ID NO: 3115338 - protein, 6 aa, Giardia lamblia
IGAAPG

SEQ ID NO: 3115339 - protein, 10 aa, Giardia lamblia
IGAASNPQYQ

SEQ ID NO: 3115340 - protein, 5 aa, Giardia lamblia
IGAND

SEQ ID NO: 3115341 - protein, 7 aa, Giardia lamblia
IGAPSQA

SEQ ID NO: 3115342 - protein, 5 aa, Giardia lamblia
IGARD

SEQ ID NO: 3115343 - protein, 8 aa, Giardia lamblia
IGASANSH

SEQ ID NO: 3115344 - protein, 6 aa, Giardia lamblia
IGASRK

SEQ ID NO: 3115345 - protein, 6 aa, Giardia lamblia
IGATPE

SEQ ID NO: 3115346 - protein, 10 aa, Giardia lamblia
IGDDETPLTP

SEQ ID NO: 3115347 - protein, 31 aa, Giardia lamblia
IGDETYDNPMSKADPTAYVPSHKDAPSVETK

SEQ ID NO: 3115348 - protein, 6 aa, Giardia lamblia
IGDKGA

SEQ ID NO: 3115349 - protein, 11 aa, Giardia lamblia
IGDMESSRNSA

SEQ ID NO: 3115350 - protein, 47 aa, Giardia lamblia
IGDQAREAPAVEDRGPNAVETSMQTDSPRNDVSDGQLEREDRDDSPS

SEQ ID NO: 3115351 - protein, 14 aa, Giardia lamblia
IGDRSGTDHPNAKR

SEQ ID NO: 3115352 - protein, 12 aa, Giardia lamblia
IGDSAKNQCALN

SEQ ID NO: 3115353 - protein, 6 aa, Giardia lamblia
IGDSPF

SEQ ID NO: 3115354 - protein, 6 aa, Giardia lamblia
IGDTDY

SEQ ID NO: 3115355 - protein, 5 aa, Giardia lamblia
IGEEI

SEQ ID NO: 3115356 - protein, 6 aa, Giardia lamblia
IGEGSF

SEQ ID NO: 3115357 - protein, 14 aa, Giardia lamblia
IGEMPEGAEFGPVD

SEQ ID NO: 3115358 - protein, 7 aa, Giardia lamblia
IGEPAEE

SEQ ID NO: 3115359 - protein, 6 aa, Giardia lamblia
IGESAT

SEQ ID NO: 3115360 - protein, 6 aa, Giardia lamblia
IGETSK

SEQ ID NO: 3115361 - protein, 5 aa, Giardia lamblia
IGEYT

SEQ ID NO: 3115362 - protein, 6 aa, Giardia lamblia
IGGADP

SEQ ID NO: 3115363 - protein, 7 aa, Giardia lamblia
IGGDPKD

SEQ ID NO: 3115364 - protein, 12 aa, Giardia lamblia
IGGEELDPDNIE

SEQ ID NO: 3115365 - protein, 10 aa, Giardia lamblia
IGGEFDTDSA

SEQ ID NO: 3115366 - protein, 10 aa, Giardia lamblia
IGGKDSVEQS

SEQ ID NO: 3115367 - protein, 5 aa, Giardia lamblia
IGGNC

SEQ ID NO: 3115368 - protein, 7 aa, Giardia lamblia
IGGPAAP

SEQ ID NO: 3115369 - protein, 7 aa, Giardia lamblia
IGGPEIQ

SEQ ID NO: 3115370 - protein, 23 aa, Giardia lamblia
IGGQTINGSFASSHGGKGSNQAI

SEQ ID NO: 3115371 - protein, 18 aa, Giardia lamblia
IGGRRSDTGGYDRDSTRT

SEQ ID NO: 3115372 - protein, 8 aa, Giardia lamblia
IGGRTSNI

SEQ ID NO: 3115373 - protein, 10 aa, Giardia lamblia
IGGSAPEIAS

SEQ ID NO: 3115374 - protein, 7 aa, Giardia lamblia
IGGSRGY

SEQ ID NO: 3115375 - protein, 12 aa, Giardia lamblia
IGGSTQTGKQTL

SEQ ID NO: 3115376 - protein, 8 aa, Giardia lamblia
IGHRDKSG

SEQ ID NO: 3115377 - protein, 12 aa, Giardia lamblia
IGKGPKSSLAAQ

SEQ ID NO: 3115378 - protein, 12 aa, Giardia lamblia
IGKGRGKGKLAE

SEQ ID NO: 3115379 - protein, 8 aa, Giardia lamblia
IGKGSYAD

SEQ ID NO: 3115380 - protein, 8 aa, Giardia lamblia
IGKIGGGQ

SEQ ID NO: 3115381 - protein, 5 aa, Giardia lamblia
IGKTV

SEQ ID NO: 3115382 - protein, 18 aa, Giardia lamblia
IGNDISPTTTHADRTDMQ

SEQ ID NO: 3115383 - protein, 15 aa, Giardia lamblia
IGNNDDPQSIAPSAG

SEQ ID NO: 3115384 - protein, 6 aa, Giardia lamblia
IGNNLG

SEQ ID NO: 3115385 - protein, 4 aa, Giardia lamblia
IGNY

SEQ ID NO: 3115386 - protein, 7 aa, Giardia lamblia
IGPAGTA

SEQ ID NO: 3115387 - protein, 12 aa, Giardia lamblia
IGPASPPTSHRQ

SEQ ID NO: 3115388 - protein, 4 aa, Giardia lamblia
IGPD

SEQ ID NO: 3115389 - protein, 9 aa, Giardia lamblia
IGPDDADGI

SEQ ID NO: 3115390 - protein, 6 aa, Giardia lamblia
IGPEDT

SEQ ID NO: 3115391 - protein, 14 aa, Giardia lamblia
IGPEPDKCTSCASG

SEQ ID NO: 3115392 - protein, 8 aa, Giardia lamblia
IGPGPNVG

SEQ ID NO: 3115393 - protein, 7 aa, Giardia lamblia
IGPGTGN

SEQ ID NO: 3115394 - protein, 7 aa, Giardia lamblia
IGPPTAQ

SEQ ID NO: 3115395 - protein, 14 aa, Giardia lamblia
IGPQGAESDAATSY

SEQ ID NO: 3115396 - protein, 4 aa, Giardia lamblia
IGPR

SEQ ID NO: 3115397 - protein, 8 aa, Giardia lamblia
IGPSAGST

SEQ ID NO: 3115398 - protein, 12 aa, Giardia lamblia
IGPSTTSYPEPS

SEQ ID NO: 3115399 - protein, 5 aa, Giardia lamblia
IGPTG

SEQ ID NO: 3115400 - protein, 9 aa, Giardia lamblia
IGPTPSSAK

SEQ ID NO: 3115401 - protein, 6 aa, Giardia lamblia
IGPTST

SEQ ID NO: 3115402 - protein, 11 aa, Giardia lamblia
IGQAAYEQADA

SEQ ID NO: 3115403 - protein, 6 aa, Giardia lamblia
IGQEPA

SEQ ID NO: 3115404 - protein, 11 aa, Giardia lamblia
IGQHKEADEWA

SEQ ID NO: 3115405 - protein, 8 aa, Giardia lamblia
IGQNKDDL

SEQ ID NO: 3115406 - protein, 6 aa, Giardia lamblia
IGQNSE

SEQ ID NO: 3115407 - protein, 7 aa, Giardia lamblia
IGQPKSR

SEQ ID NO: 3115408 - protein, 4 aa, Giardia lamblia
IGQR

SEQ ID NO: 3115409 - protein, 4 aa, Giardia lamblia
IGQS

SEQ ID NO: 3115410 - protein, 5 aa, Giardia lamblia
IGQST

SEQ ID NO: 3115411 - protein, 4 aa, Giardia lamblia
IGQT

SEQ ID NO: 3115412 - protein, 16 aa, Giardia lamblia
IGQTPSGQTLGSNSVD

SEQ ID NO: 3115413 - protein, 6 aa, Giardia lamblia
IGRART

SEQ ID NO: 3115414 - protein, 5 aa, Giardia lamblia
IGRGT

SEQ ID NO: 3115415 - protein, 5 aa, Giardia lamblia
IGRKA

SEQ ID NO: 3115416 - protein, 5 aa, Giardia lamblia
IGRQN

SEQ ID NO: 3115417 - protein, 13 aa, Giardia lamblia
IGSAAASRVTPSS

SEQ ID NO: 3115418 - protein, 6 aa, Giardia lamblia
IGSAEE

SEQ ID NO: 3115419 - protein, 8 aa, Giardia lamblia
IGSAEKEA

SEQ ID NO: 3115420 - protein, 30 aa, Giardia lamblia
IGSAGSTNGLRKSHASSRRGDSNSHRHTST

SEQ ID NO: 3115421 - protein, 8 aa, Giardia lamblia
IGSGGKIT

SEQ ID NO: 3115422 - protein, 6 aa, Giardia lamblia
IGSGSY

SEQ ID NO: 3115423 - protein, 9 aa, Giardia lamblia
IGSHAGDLG

SEQ ID NO: 3115424 - protein, 11 aa, Giardia lamblia
IGSNGDLEQTK

SEQ ID NO: 3115425 - protein, 65 aa, Giardia lamblia
IGSRTNAHPLRAPTSAFGTPAPFAGGTAQSPKRSQSATTGAKSGTRLDGTASRKGGGRPSSGITT

SEQ ID NO: 3115426 - protein, 14 aa, Giardia lamblia
IGSRYQRNKSLKNN

SEQ ID NO: 3115427 - protein, 4 aa, Giardia lamblia
IGSS

SEQ ID NO: 3115428 - protein, 7 aa, Giardia lamblia
IGSSEPW

SEQ ID NO: 3115429 - protein, 5 aa, Giardia lamblia
IGSSS

SEQ ID NO: 3115430 - protein, 7 aa, Giardia lamblia
IGSSSSP

SEQ ID NO: 3115431 - protein, 12 aa, Giardia lamblia
IGSTDNADDAND

SEQ ID NO: 3115432 - protein, 11 aa, Giardia lamblia
IGSTTAPQAPI

SEQ ID NO: 3115433 - protein, 9 aa, Giardia lamblia
IGSTTKTNR

SEQ ID NO: 3115434 - protein, 13 aa, Giardia lamblia
IGTAASEHTEITE

SEQ ID NO: 3115435 - protein, 5 aa, Giardia lamblia
IGTDQ

SEQ ID NO: 3115436 - protein, 7 aa, Giardia lamblia
IGTKADH

SEQ ID NO: 3115437 - protein, 6 aa, Giardia lamblia
IGTKEQ

SEQ ID NO: 3115438 - protein, 12 aa, Giardia lamblia
IGTKGGASPATF

SEQ ID NO: 3115439 - protein, 5 aa, Giardia lamblia
IGTPA

SEQ ID NO: 3115440 - protein, 6 aa, Giardia lamblia
IGTPAQ

SEQ ID NO: 3115441 - protein, 12 aa, Giardia lamblia
IGTPGPEEASSV

SEQ ID NO: 3115442 - protein, 11 aa, Giardia lamblia
IGTPLENTPRP

SEQ ID NO: 3115443 - protein, 10 aa, Giardia lamblia
IGTQDPRQPH

SEQ ID NO: 3115444 - protein, 20 aa, Giardia lamblia
IGTQGCSDRSNRVLVCTDLV

SEQ ID NO: 3115445 - protein, 5 aa, Giardia lamblia
IGTRE

SEQ ID NO: 3115446 - protein, 6 aa, Giardia lamblia
IGTREA

SEQ ID NO: 3115447 - protein, 31 aa, Giardia lamblia
IGTSPPPVPTASTAVEASPRKRRADAGRATI

SEQ ID NO: 3115448 - protein, 7 aa, Giardia lamblia
IGTSSNQ

SEQ ID NO: 3115449 - protein, 6 aa, Giardia lamblia
IGTSTC

SEQ ID NO: 3115450 - protein, 6 aa, Giardia lamblia
IGTTAG

SEQ ID NO: 3115451 - protein, 6 aa, Giardia lamblia
IGTVET

SEQ ID NO: 3115452 - protein, 10 aa, Giardia lamblia
IGTVSTKEGP

SEQ ID NO: 3115453 - protein, 18 aa, Giardia lamblia
IGVETGQKARQHRRKQRE

SEQ ID NO: 3115454 - protein, 5 aa, Giardia lamblia
IGVGK

SEQ ID NO: 3115455 - protein, 4 aa, Giardia lamblia
IGVP

SEQ ID NO: 3115456 - protein, 9 aa, Giardia lamblia
IGYQSNEVG

SEQ ID NO: 3115457 - protein, 12 aa, Giardia lamblia
IHETAENKIAQN

SEQ ID NO: 3115458 - protein, 20 aa, Giardia lamblia
IHGSTTKDKHTSGQDSIPTE

SEQ ID NO: 3115459 - protein, 11 aa, Giardia lamblia
IHGTEGSTMGD

SEQ ID NO: 3115460 - protein, 7 aa, Giardia lamblia
IHNGDER

SEQ ID NO: 3115461 - protein, 11 aa, Giardia lamblia
IHNGSGSLHSN

SEQ ID NO: 3115462 - protein, 4 aa, Giardia lamblia
IHPR

SEQ ID NO: 3115463 - protein, 6 aa, Giardia lamblia
IHPSET

SEQ ID NO: 3115464 - protein, 10 aa, Giardia lamblia
IHSDKAKSHY

SEQ ID NO: 3115465 - protein, 9 aa, Giardia lamblia
IHSDSDDSY

SEQ ID NO: 3115466 - protein, 6 aa, Giardia lamblia
IHSREQ

SEQ ID NO: 3115467 - protein, 10 aa, Giardia lamblia
IHTTNDADTA

SEQ ID NO: 3115468 - protein, 6 aa, Giardia lamblia
IIEDRT

SEQ ID NO: 3115469 - protein, 5 aa, Giardia lamblia
IIERS

SEQ ID NO: 3115470 - protein, 7 aa, Giardia lamblia
IIPGPGA

SEQ ID NO: 3115471 - protein, 5 aa, Giardia lamblia
IIPGS

SEQ ID NO: 3115472 - protein, 25 aa, Giardia lamblia
IIPGTRPSTTQATTHVEDTRTNEDA

SEQ ID NO: 3115473 - protein, 6 aa, Giardia lamblia
IIPNPG

SEQ ID NO: 3115474 - protein, 7 aa, Giardia lamblia
IIPPDDT

SEQ ID NO: 3115475 - protein, 24 aa, Giardia lamblia
IISSQGQSYGPMTRDSTAAAKQAH

SEQ ID NO: 3115476 - protein, 12 aa, Giardia lamblia
IITPQDAQRCNT

SEQ ID NO: 3115477 - protein, 15 aa, Giardia lamblia
IKAAESHDPEQSLKQ

SEQ ID NO: 3115478 - protein, 7 aa, Giardia lamblia
IKAATSE

SEQ ID NO: 3115479 - protein, 9 aa, Giardia lamblia
IKADEERRI

SEQ ID NO: 3115480 - protein, 12 aa, Giardia lamblia
IKADKSAADSHI

SEQ ID NO: 3115481 - protein, 4 aa, Giardia lamblia
IKAK

SEQ ID NO: 3115482 - protein, 9 aa, Giardia lamblia
IKAPPNSPY

SEQ ID NO: 3115483 - protein, 13 aa, Giardia lamblia
IKAPSEPAKSISA

SEQ ID NO: 3115484 - protein, 6 aa, Giardia lamblia
IKASAG

SEQ ID NO: 3115485 - protein, 11 aa, Giardia lamblia
IKASRHTPLPV

SEQ ID NO: 3115486 - protein, 7 aa, Giardia lamblia
IKDGDVS

SEQ ID NO: 3115487 - protein, 12 aa, Giardia lamblia
IKDGELADGVQA

SEQ ID NO: 3115488 - protein, 8 aa, Giardia lamblia
IKDGTRPH

SEQ ID NO: 3115489 - protein, 12 aa, Giardia lamblia
IKDKSGNDARTY

SEQ ID NO: 3115490 - protein, 4 aa, Giardia lamblia
IKDN

SEQ ID NO: 3115491 - protein, 8 aa, Giardia lamblia
IKDNKNRT

SEQ ID NO: 3115492 - protein, 6 aa, Giardia lamblia
IKDNSK

SEQ ID NO: 3115493 - protein, 6 aa, Giardia lamblia
IKDSQQ

SEQ ID NO: 3115494 - protein, 26 aa, Giardia lamblia
IKDSRNHPDRSSAKTPASKGQDTSHC

SEQ ID NO: 3115495 - protein, 9 aa, Giardia lamblia
IKDSSGNTA

SEQ ID NO: 3115496 - protein, 7 aa, Giardia lamblia
IKEDTIQ

SEQ ID NO: 3115497 - protein, 10 aa, Giardia lamblia
IKEEDQDSRL

SEQ ID NO: 3115498 - protein, 14 aa, Giardia lamblia
IKEEQDRVAEERRL

SEQ ID NO: 3115499 - protein, 12 aa, Giardia lamblia
IKEGDEAVDECS

SEQ ID NO: 3115500 - protein, 5 aa, Giardia lamblia
IKEGR

SEQ ID NO: 3115501 - protein, 8 aa, Giardia lamblia
IKEKDGDV

SEQ ID NO: 3115502 - protein, 4 aa, Giardia lamblia
IKEN

SEQ ID NO: 3115503 - protein, 8 aa, Giardia lamblia
IKENASGI

SEQ ID NO: 3115504 - protein, 8 aa, Giardia lamblia
IKEQSSNY

SEQ ID NO: 3115505 - protein, 7 aa, Giardia lamblia
IKERPYR

SEQ ID NO: 3115506 - protein, 7 aa, Giardia lamblia
IKERTRA

SEQ ID NO: 3115507 - protein, 16 aa, Giardia lamblia
IKETSSTARSRGSLTG

SEQ ID NO: 3115508 - protein, 75 aa, Giardia lamblia
IKGEPKPKKEHVPKTAPASKAKVQKPEEGLETAPTEPKRKRPAAAPVDTKKASAKRGKKEESSFTESETSATELD

SEQ ID NO: 3115509 - protein, 6 aa, Giardia lamblia
IKGERT

SEQ ID NO: 3115510 - protein, 10 aa, Giardia lamblia
IKGETGKTEA

SEQ ID NO: 3115511 - protein, 7 aa, Giardia lamblia
IKGGSAP

SEQ ID NO: 3115512 - protein, 4 aa, Giardia lamblia
IKGL

SEQ ID NO: 3115513 - protein, 4 aa, Giardia lamblia
IKGN

SEQ ID NO: 3115514 - protein, 8 aa, Giardia lamblia
IKGNTTSV

SEQ ID NO: 3115515 - protein, 23 aa, Giardia lamblia
IKGRQDGRSRVARPTSAPSLRTR

SEQ ID NO: 3115516 - protein, 6 aa, Giardia lamblia
IKGTRA

SEQ ID NO: 3115517 - protein, 6 aa, Giardia lamblia
IKKAGR

SEQ ID NO: 3115518 - protein, 9 aa, Giardia lamblia
IKKDPDDQA

SEQ ID NO: 3115519 - protein, 35 aa, Giardia lamblia
IKKGPARASSESRPTNSLPRAQRRAKSKSSIESMD

SEQ ID NO: 3115520 - protein, 16 aa, Giardia lamblia
IKKKKEMIGPDGQPLP

SEQ ID NO: 3115521 - protein, 7 aa, Giardia lamblia
IKKRGYT

SEQ ID NO: 3115522 - protein, 10 aa, Giardia lamblia
IKKSSTERER

SEQ ID NO: 3115523 - protein, 9 aa, Giardia lamblia
IKKTNEFGD

SEQ ID NO: 3115524 - protein, 9 aa, Giardia lamblia
IKNAAGDTA

SEQ ID NO: 3115525 - protein, 8 aa, Giardia lamblia
IKNKDGHT

SEQ ID NO: 3115526 - protein, 4 aa, Giardia lamblia
IKNL

SEQ ID NO: 3115527 - protein, 7 aa, Giardia lamblia
IKNRQEA

SEQ ID NO: 3115528 - protein, 8 aa, Giardia lamblia
IKNSPDNF

SEQ ID NO: 3115529 - protein, 12 aa, Giardia lamblia
IKPASSYASETS

SEQ ID NO: 3115530 - protein, 4 aa, Giardia lamblia
IKPD

SEQ ID NO: 3115531 - protein, 22 aa, Giardia lamblia
IKPGPSRSTRQKAARKERREQK

SEQ ID NO: 3115532 - protein, 23 aa, Giardia lamblia
IKPNNRDENKRLGRPKGLSDEET

SEQ ID NO: 3115533 - protein, 13 aa, Giardia lamblia
IKPNNSSCKDTTL

SEQ ID NO: 3115534 - protein, 5 aa, Giardia lamblia
IKPPK

SEQ ID NO: 3115535 - protein, 42 aa, Giardia lamblia
IKPPRQPKSGPQTRPATCKPSTKRIDNVSGASTVSSENRATV

SEQ ID NO: 3115536 - protein, 23 aa, Giardia lamblia
IKPPSTNRDGYERSRELDRRKDI

SEQ ID NO: 3115537 - protein, 19 aa, Giardia lamblia
IKPQWGSGYPSDPKTKKYL

SEQ ID NO: 3115538 - protein, 7 aa, Giardia lamblia
IKPRGRQ

SEQ ID NO: 3115539 - protein, 5 aa, Giardia lamblia
IKPSK

SEQ ID NO: 3115540 - protein, 8 aa, Giardia lamblia
IKPSSTPR

SEQ ID NO: 3115541 - protein, 9 aa, Giardia lamblia
IKPSTAPRL

SEQ ID NO: 3115542 - protein, 4 aa, Giardia lamblia
IKQA

SEQ ID NO: 3115543 - protein, 11 aa, Giardia lamblia
IKQDSAGNLPG

SEQ ID NO: 3115544 - protein, 7 aa, Giardia lamblia
IKQHDPS

SEQ ID NO: 3115545 - protein, 8 aa, Giardia lamblia
IKQPDHVS

SEQ ID NO: 3115546 - protein, 7 aa, Giardia lamblia
IKQPSAI

SEQ ID NO: 3115547 - protein, 8 aa, Giardia lamblia
IKQRAQER

SEQ ID NO: 3115548 - protein, 22 aa, Giardia lamblia
IKQRSSSESTRSTLDTKPPIDP

SEQ ID NO: 3115549 - protein, 14 aa, Giardia lamblia
IKQTTTTADAADEV

SEQ ID NO: 3115550 - protein, 4 aa, Giardia lamblia
IKRN

SEQ ID NO: 3115551 - protein, 16 aa, Giardia lamblia
IKRPISAYPSGSSSVL

SEQ ID NO: 3115552 - protein, 7 aa, Giardia lamblia
IKRRSQL

SEQ ID NO: 3115553 - protein, 9 aa, Giardia lamblia
IKRTGTPLT

SEQ ID NO: 3115554 - protein, 6 aa, Giardia lamblia
IKRTHG

SEQ ID NO: 3115555 - protein, 10 aa, Giardia lamblia
IKRYSGNTTA

SEQ ID NO: 3115556 - protein, 12 aa, Giardia lamblia
IKSGAPSRSERC

SEQ ID NO: 3115557 - protein, 9 aa, Giardia lamblia
IKSGDSTKV

SEQ ID NO: 3115558 - protein, 5 aa, Giardia lamblia
IKSGG

SEQ ID NO: 3115559 - protein, 10 aa, Giardia lamblia
IKSKPPAKPV

SEQ ID NO: 3115560 - protein, 12 aa, Giardia lamblia
IKSPARKKYSFY

SEQ ID NO: 3115561 - protein, 22 aa, Giardia lamblia
IKSQKEKFDKNLRDDPQNLEEG

SEQ ID NO: 3115562 - protein, 4 aa, Giardia lamblia
IKSS

SEQ ID NO: 3115563 - protein, 14 aa, Giardia lamblia
IKSSLHEKRRADIT

SEQ ID NO: 3115564 - protein, 6 aa, Giardia lamblia
IKSSSV

SEQ ID NO: 3115565 - protein, 10 aa, Giardia lamblia
IKTGKQEKKT

SEQ ID NO: 3115566 - protein, 9 aa, Giardia lamblia
IKTKSGSTA

SEQ ID NO: 3115567 - protein, 6 aa, Giardia lamblia
IKTNDT

SEQ ID NO: 3115568 - protein, 7 aa, Giardia lamblia
IKTNRNK

SEQ ID NO: 3115569 - protein, 8 aa, Giardia lamblia
IKTNSGLE

SEQ ID NO: 3115570 - protein, 7 aa, Giardia lamblia
IKTQEAS

SEQ ID NO: 3115571 - protein, 7 aa, Giardia lamblia
IKTQGRE

SEQ ID NO: 3115572 - protein, 11 aa, Giardia lamblia
IKTQGTNTGIF

SEQ ID NO: 3115573 - protein, 6 aa, Giardia lamblia
IKTSDD

SEQ ID NO: 3115574 - protein, 11 aa, Giardia lamblia
IKTSGGAPKQV

SEQ ID NO: 3115575 - protein, 24 aa, Giardia lamblia
IKYSGRKDFNRKYSERKKNDPITL

SEQ ID NO: 3115576 - protein, 12 aa, Giardia lamblia
ILGSSSTGGQSG

SEQ ID NO: 3115577 - protein, 21 aa, Giardia lamblia
ILPEERRRPPRTVDPNTGSIR

SEQ ID NO: 3115578 - protein, 5 aa, Giardia lamblia
ILPPE

SEQ ID NO: 3115579 - protein, 7 aa, Giardia lamblia
ILPPPQN

SEQ ID NO: 3115580 - protein, 12 aa, Giardia lamblia
ILPSDSATLTPS

SEQ ID NO: 3115581 - protein, 36 aa, Giardia lamblia
ILSKGGKGFDRPDPDAASFPSLPKECQGTTMASTAE

SEQ ID NO: 3115582 - protein, 18 aa, Giardia lamblia
IMSGEEKIEENNEFNEEV

SEQ ID NO: 3115583 - protein, 8 aa, Giardia lamblia
INAGNHTK

SEQ ID NO: 3115584 - protein, 40 aa, Giardia lamblia
INAKGNATSGLQQEKNPMDDVAENSDSDDKAPADDPTLQK

SEQ ID NO: 3115585 - protein, 88 aa, Giardia lamblia
INAQQQPKRAASSCKPRTKQPAKSSHRSRAPLRTQDTESRSVSTRVSKQYTPQLGTQNKPRSTTRSASTAKKPARSGSTQSGKAGKRK

SEQ ID NO: 3115586 - protein, 10 aa, Giardia lamblia
INASKQEIEN

SEQ ID NO: 3115587 - protein, 8 aa, Giardia lamblia
INASPAIV

SEQ ID NO: 3115588 - protein, 10 aa, Giardia lamblia
INATPAVEEE

SEQ ID NO: 3115589 - protein, 11 aa, Giardia lamblia
INDARSRGYTG

SEQ ID NO: 3115590 - protein, 11 aa, Giardia lamblia
INDATSHPHGA

SEQ ID NO: 3115591 - protein, 7 aa, Giardia lamblia
INDDTDA

SEQ ID NO: 3115592 - protein, 5 aa, Giardia lamblia
INDER

SEQ ID NO: 3115593 - protein, 19 aa, Giardia lamblia
INDSEEKGITPKEDARAPV

SEQ ID NO: 3115594 - protein, 4 aa, Giardia lamblia
INEK

SEQ ID NO: 3115595 - protein, 6 aa, Giardia lamblia
INEMTD

SEQ ID NO: 3115596 - protein, 5 aa, Giardia lamblia
INENG

SEQ ID NO: 3115597 - protein, 4 aa, Giardia lamblia
INES

SEQ ID NO: 3115598 - protein, 8 aa, Giardia lamblia
INESDSDI

SEQ ID NO: 3115599 - protein, 6 aa, Giardia lamblia
INESEA

SEQ ID NO: 3115600 - protein, 7 aa, Giardia lamblia
INESSTT

SEQ ID NO: 3115601 - protein, 25 aa, Giardia lamblia
INESTPNQDVTAPQAAMEPDQQQAI

SEQ ID NO: 3115602 - protein, 4 aa, Giardia lamblia
INEV

SEQ ID NO: 3115603 - protein, 9 aa, Giardia lamblia
INGNPQNQS

SEQ ID NO: 3115604 - protein, 7 aa, Giardia lamblia
INGNSSK

SEQ ID NO: 3115605 - protein, 5 aa, Giardia lamblia
INGSP

SEQ ID NO: 3115606 - protein, 11 aa, Giardia lamblia
INKAEESNQQI

SEQ ID NO: 3115607 - protein, 9 aa, Giardia lamblia
INKDQRTED

SEQ ID NO: 3115608 - protein, 19 aa, Giardia lamblia
INKEEQLERQKRQEEEERR

SEQ ID NO: 3115609 - protein, 9 aa, Giardia lamblia
INKGSAPKF

SEQ ID NO: 3115610 - protein, 13 aa, Giardia lamblia
INKLGKASERHEL

SEQ ID NO: 3115611 - protein, 6 aa, Giardia lamblia
INKPSY

SEQ ID NO: 3115612 - protein, 12 aa, Giardia lamblia
INKQNEKIKSLE

SEQ ID NO: 3115613 - protein, 18 aa, Giardia lamblia
INNDHEDETDDEQIDGTP

SEQ ID NO: 3115614 - protein, 5 aa, Giardia lamblia
INNEG

SEQ ID NO: 3115615 - protein, 7 aa, Giardia lamblia
INNKGET

SEQ ID NO: 3115616 - protein, 6 aa, Giardia lamblia
INPGSM

SEQ ID NO: 3115617 - protein, 5 aa, Giardia lamblia
INPGT

SEQ ID NO: 3115618 - protein, 4 aa, Giardia lamblia
INPN

SEQ ID NO: 3115619 - protein, 5 aa, Giardia lamblia
INPPS

SEQ ID NO: 3115620 - protein, 4 aa, Giardia lamblia
INPT

SEQ ID NO: 3115621 - protein, 5 aa, Giardia lamblia
INPTA

SEQ ID NO: 3115622 - protein, 12 aa, Giardia lamblia
INPTSTKPADTP

SEQ ID NO: 3115623 - protein, 4 aa, Giardia lamblia
INQE

SEQ ID NO: 3115624 - protein, 11 aa, Giardia lamblia
INQNNKNKSAQ

SEQ ID NO: 3115625 - protein, 9 aa, Giardia lamblia
INQPEAQAK

SEQ ID NO: 3115626 - protein, 8 aa, Giardia lamblia
INQQQKEL

SEQ ID NO: 3115627 - protein, 5 aa, Giardia lamblia
INQSD

SEQ ID NO: 3115628 - protein, 6 aa, Giardia lamblia
INQSSV

SEQ ID NO: 3115629 - protein, 5 aa, Giardia lamblia
INRDV

SEQ ID NO: 3115630 - protein, 11 aa, Giardia lamblia
INRKNKNIEEV

SEQ ID NO: 3115631 - protein, 5 aa, Giardia lamblia
INRKV

SEQ ID NO: 3115632 - protein, 6 aa, Giardia lamblia
INRMDP

SEQ ID NO: 3115633 - protein, 6 aa, Giardia lamblia
INRPDM

SEQ ID NO: 3115634 - protein, 6 aa, Giardia lamblia
INRRGE

SEQ ID NO: 3115635 - protein, 26 aa, Giardia lamblia
INRSTNQGNENWNSAEAAEPPTFAPP

SEQ ID NO: 3115636 - protein, 9 aa, Giardia lamblia
INSAESSTH

SEQ ID NO: 3115637 - protein, 7 aa, Giardia lamblia
INSELGD

SEQ ID NO: 3115638 - protein, 6 aa, Giardia lamblia
INSETE

SEQ ID NO: 3115639 - protein, 11 aa, Giardia lamblia
INSNDGCTDEQ

SEQ ID NO: 3115640 - protein, 9 aa, Giardia lamblia
INSNDGEES

SEQ ID NO: 3115641 - protein, 7 aa, Giardia lamblia
INSNEVP

SEQ ID NO: 3115642 - protein, 10 aa, Giardia lamblia
INSNNAAGLQ

SEQ ID NO: 3115643 - protein, 9 aa, Giardia lamblia
INSPDQLAQ

SEQ ID NO: 3115644 - protein, 29 aa, Giardia lamblia
INSPEGQPSPAHEAKEADYVPEQSRDISE

SEQ ID NO: 3115645 - protein, 7 aa, Giardia lamblia
INSPEIQ

SEQ ID NO: 3115646 - protein, 18 aa, Giardia lamblia
INSPGSPIGQPDAEGTPH

SEQ ID NO: 3115647 - protein, 6 aa, Giardia lamblia
INSPKN

SEQ ID NO: 3115648 - protein, 6 aa, Giardia lamblia
INSPPK

SEQ ID NO: 3115649 - protein, 8 aa, Giardia lamblia
INSPTGDA

SEQ ID NO: 3115650 - protein, 5 aa, Giardia lamblia
INSSR

SEQ ID NO: 3115651 - protein, 11 aa, Giardia lamblia
INSSSSPLNDK

SEQ ID NO: 3115652 - protein, 10 aa, Giardia lamblia
INSSTSHSNS

SEQ ID NO: 3115653 - protein, 8 aa, Giardia lamblia
INSTHRPP

SEQ ID NO: 3115654 - protein, 6 aa, Giardia lamblia
INSTNN

SEQ ID NO: 3115655 - protein, 7 aa, Giardia lamblia
INSTPSW

SEQ ID NO: 3115656 - protein, 13 aa, Giardia lamblia
INSTSEQPSNLTT

SEQ ID NO: 3115657 - protein, 9 aa, Giardia lamblia
INTANPQTQ

SEQ ID NO: 3115658 - protein, 7 aa, Giardia lamblia
INTAQRS

SEQ ID NO: 3115659 - protein, 7 aa, Giardia lamblia
INTDPNV

SEQ ID NO: 3115660 - protein, 6 aa, Giardia lamblia
INTEES

SEQ ID NO: 3115661 - protein, 4 aa, Giardia lamblia
INTK

SEQ ID NO: 3115662 - protein, 17 aa, Giardia lamblia
INTNDRIDPSKNLEEMP

SEQ ID NO: 3115663 - protein, 61 aa, Giardia lamblia
INTSAKSTRSTKEKKKSKRNSKDEKRKTTTEQSKDALTANRRGTASHHNQRGEQSKEKQNV

SEQ ID NO: 3115664 - protein, 9 aa, Giardia lamblia
INTSDNRTP

SEQ ID NO: 3115665 - protein, 12 aa, Giardia lamblia
INTSNSEEKRLR

SEQ ID NO: 3115666 - protein, 9 aa, Giardia lamblia
INTTDGGTH

SEQ ID NO: 3115667 - protein, 10 aa, Giardia lamblia
IPAADSSAET

SEQ ID NO: 3115668 - protein, 13 aa, Giardia lamblia
IPADGQLQTRAQA

SEQ ID NO: 3115669 - protein, 10 aa, Giardia lamblia
IPAKDGNTSK

SEQ ID NO: 3115670 - protein, 13 aa, Giardia lamblia
IPALTSSAQLEPH

SEQ ID NO: 3115671 - protein, 4 aa, Giardia lamblia
IPAP

SEQ ID NO: 3115672 - protein, 6 aa, Giardia lamblia
IPAPKV

SEQ ID NO: 3115673 - protein, 27 aa, Giardia lamblia
IPAPPAPAQMQPPQAVPDTDPFADSEY

SEQ ID NO: 3115674 - protein, 23 aa, Giardia lamblia
IPAPPDDQAKIRSASSDTATQLR

SEQ ID NO: 3115675 - protein, 7 aa, Giardia lamblia
IPAPSSM

SEQ ID NO: 3115676 - protein, 4 aa, Giardia lamblia
IPAR

SEQ ID NO: 3115677 - protein, 7 aa, Giardia lamblia
IPARTNS

SEQ ID NO: 3115678 - protein, 15 aa, Giardia lamblia
IPASDRQNSSSEISQ

SEQ ID NO: 3115679 - protein, 23 aa, Giardia lamblia
IPASKQAPLPPRSRSTSPTHSDT

SEQ ID NO: 3115680 - protein, 8 aa, Giardia lamblia
IPASPGAA

SEQ ID NO: 3115681 - protein, 7 aa, Giardia lamblia
IPASSSW

SEQ ID NO: 3115682 - protein, 6 aa, Giardia lamblia
IPASTI

SEQ ID NO: 3115683 - protein, 14 aa, Giardia lamblia
IPAYKGTPYDQRAD

SEQ ID NO: 3115684 - protein, 9 aa, Giardia lamblia
IPDAPTKTV

SEQ ID NO: 3115685 - protein, 4 aa, Giardia lamblia
IPDC

SEQ ID NO: 3115686 - protein, 4 aa, Giardia lamblia
IPDD

SEQ ID NO: 3115687 - protein, 8 aa, Giardia lamblia
IPDDPASC

SEQ ID NO: 3115688 - protein, 5 aa, Giardia lamblia
IPDFR

SEQ ID NO: 3115689 - protein, 34 aa, Giardia lamblia
IPDHPSGKKRSTSKPSNPRNSQSSVAGARPVRFG

SEQ ID NO: 3115690 - protein, 4 aa, Giardia lamblia
IPDK

SEQ ID NO: 3115691 - protein, 7 aa, Giardia lamblia
IPDPTKV

SEQ ID NO: 3115692 - protein, 7 aa, Giardia lamblia
IPDRSSN

SEQ ID NO: 3115693 - protein, 6 aa, Giardia lamblia
IPDSDA

SEQ ID NO: 3115694 - protein, 5 aa, Giardia lamblia
IPDST

SEQ ID NO: 3115695 - protein, 11 aa, Giardia lamblia
IPDTNPKNIGD

SEQ ID NO: 3115696 - protein, 5 aa, Giardia lamblia
IPDTP

SEQ ID NO: 3115697 - protein, 5 aa, Giardia lamblia
IPDVS

SEQ ID NO: 3115698 - protein, 5 aa, Giardia lamblia
IPEAA

SEQ ID NO: 3115699 - protein, 19 aa, Giardia lamblia
IPECDQQSDVEKDGAGNRI

SEQ ID NO: 3115700 - protein, 6 aa, Giardia lamblia
IPEDRA

SEQ ID NO: 3115701 - protein, 10 aa, Giardia lamblia
IPEDTTGADL

SEQ ID NO: 3115702 - protein, 4 aa, Giardia lamblia
IPEE

SEQ ID NO: 3115703 - protein, 4 aa, Giardia lamblia
IPEG

SEQ ID NO: 3115704 - protein, 5 aa, Giardia lamblia
IPEGA

SEQ ID NO: 3115705 - protein, 7 aa, Giardia lamblia
IPEKADE

SEQ ID NO: 3115706 - protein, 11 aa, Giardia lamblia
IPEPPLDATDL

SEQ ID NO: 3115707 - protein, 8 aa, Giardia lamblia
IPEQEKSY

SEQ ID NO: 3115708 - protein, 12 aa, Giardia lamblia
IPEQGIKQGRPI

SEQ ID NO: 3115709 - protein, 10 aa, Giardia lamblia
IPESKVTDEL

SEQ ID NO: 3115710 - protein, 4 aa, Giardia lamblia
IPET

SEQ ID NO: 3115711 - protein, 15 aa, Giardia lamblia
IPETPKGRIRYPTPK

SEQ ID NO: 3115712 - protein, 4 aa, Giardia lamblia
IPEY

SEQ ID NO: 3115713 - protein, 5 aa, Giardia lamblia
IPEYP

SEQ ID NO: 3115714 - protein, 7 aa, Giardia lamblia
IPGDAIG

SEQ ID NO: 3115715 - protein, 12 aa, Giardia lamblia
IPGDKSSSFQTG

SEQ ID NO: 3115716 - protein, 5 aa, Giardia lamblia
IPGED

SEQ ID NO: 3115717 - protein, 8 aa, Giardia lamblia
IPGKFDPS

SEQ ID NO: 3115718 - protein, 4 aa, Giardia lamblia
IPGP

SEQ ID NO: 3115719 - protein, 9 aa, Giardia lamblia
IPGPDTEAR

SEQ ID NO: 3115720 - protein, 11 aa, Giardia lamblia
IPGQEDQEVAR

SEQ ID NO: 3115721 - protein, 11 aa, Giardia lamblia
IPGQGSTYPRD

SEQ ID NO: 3115722 - protein, 4 aa, Giardia lamblia
IPGR

SEQ ID NO: 3115723 - protein, 9 aa, Giardia lamblia
IPGREPPSH

SEQ ID NO: 3115724 - protein, 42 aa, Giardia lamblia
IPGSAKTNSQQSRSSHGSISTGRDSGLSNKTRASRASKSSLS

SEQ ID NO: 3115725 - protein, 11 aa, Giardia lamblia
IPGTKYGPIST

SEQ ID NO: 3115726 - protein, 15 aa, Giardia lamblia
IPGTQEEIDALFVGF

SEQ ID NO: 3115727 - protein, 7 aa, Giardia lamblia
IPGTRPY

SEQ ID NO: 3115728 - protein, 5 aa, Giardia lamblia
IPGTT

SEQ ID NO: 3115729 - protein, 10 aa, Giardia lamblia
IPGTTDYSLE

SEQ ID NO: 3115730 - protein, 6 aa, Giardia lamblia
IPGWPG

SEQ ID NO: 3115731 - protein, 20 aa, Giardia lamblia
IPHDGTRKGTRSLSASAQTY

SEQ ID NO: 3115732 - protein, 4 aa, Giardia lamblia
IPHG

SEQ ID NO: 3115733 - protein, 7 aa, Giardia lamblia
IPIPSKR

SEQ ID NO: 3115734 - protein, 8 aa, Giardia lamblia
IPKESEDS

SEQ ID NO: 3115735 - protein, 8 aa, Giardia lamblia
IPKETADH

SEQ ID NO: 3115736 - protein, 7 aa, Giardia lamblia
IPKGETP

SEQ ID NO: 3115737 - protein, 7 aa, Giardia lamblia
IPKGFQS

SEQ ID NO: 3115738 - protein, 7 aa, Giardia lamblia
IPKGPRA

SEQ ID NO: 3115739 - protein, 55 aa, Giardia lamblia
IPKKETLTSISSDQIATADQYHDQDCPTVSAKPLDDSKASPCTFSSQPSDHGDSS

SEQ ID NO: 3115740 - protein, 20 aa, Giardia lamblia
IPKNPEITSLTRSKDPDIAN

SEQ ID NO: 3115741 - protein, 7 aa, Giardia lamblia
IPKNSKM

SEQ ID NO: 3115742 - protein, 6 aa, Giardia lamblia
IPKPGQ

SEQ ID NO: 3115743 - protein, 20 aa, Giardia lamblia
IPKPTVKPDKLARTPSNNAF

SEQ ID NO: 3115744 - protein, 5 aa, Giardia lamblia
IPKSA

SEQ ID NO: 3115745 - protein, 11 aa, Giardia lamblia
IPKTADKPGSV

SEQ ID NO: 3115746 - protein, 6 aa, Giardia lamblia
IPLSEG

SEQ ID NO: 3115747 - protein, 4 aa, Giardia lamblia
IPNA

SEQ ID NO: 3115748 - protein, 8 aa, Giardia lamblia
IPNDPRPE

SEQ ID NO: 3115749 - protein, 11 aa, Giardia lamblia
IPNGAKSKYYE

SEQ ID NO: 3115750 - protein, 11 aa, Giardia lamblia
IPNNQDPDTEV

SEQ ID NO: 3115751 - protein, 6 aa, Giardia lamblia
IPNPDY

SEQ ID NO: 3115752 - protein, 5 aa, Giardia lamblia
IPNPE

SEQ ID NO: 3115753 - protein, 5 aa, Giardia lamblia
IPNPT

SEQ ID NO: 3115754 - protein, 8 aa, Giardia lamblia
IPNPYSMP

SEQ ID NO: 3115755 - protein, 6 aa, Giardia lamblia
IPNTPL

SEQ ID NO: 3115756 - protein, 5 aa, Giardia lamblia
IPNTS

SEQ ID NO: 3115757 - protein, 4 aa, Giardia lamblia
IPNY

SEQ ID NO: 3115758 - protein, 21 aa, Giardia lamblia
IPPAGQQSVPPTDDHRQYPAG

SEQ ID NO: 3115759 - protein, 9 aa, Giardia lamblia
IPPAPAFSD

SEQ ID NO: 3115760 - protein, 11 aa, Giardia lamblia
IPPAPRGTPKI

SEQ ID NO: 3115761 - protein, 9 aa, Giardia lamblia
IPPASFGTN

SEQ ID NO: 3115762 - protein, 4 aa, Giardia lamblia
IPPD

SEQ ID NO: 3115763 - protein, 11 aa, Giardia lamblia
IPPDGKPYTQR

SEQ ID NO: 3115764 - protein, 11 aa, Giardia lamblia
IPPDNADEFPS

SEQ ID NO: 3115765 - protein, 11 aa, Giardia lamblia
IPPDPPPLPVD

SEQ ID NO: 3115766 - protein, 4 aa, Giardia lamblia
IPPG

SEQ ID NO: 3115767 - protein, 8 aa, Giardia lamblia
IPPGERDN

SEQ ID NO: 3115768 - protein, 5 aa, Giardia lamblia
IPPGG

SEQ ID NO: 3115769 - protein, 15 aa, Giardia lamblia
IPPGPPPAQDYEYEE

SEQ ID NO: 3115770 - protein, 12 aa, Giardia lamblia
IPPKPSKTVLTD

SEQ ID NO: 3115771 - protein, 12 aa, Giardia lamblia
IPPLGPSPRQQR

SEQ ID NO: 3115772 - protein, 4 aa, Giardia lamblia
IPPM

SEQ ID NO: 3115773 - protein, 9 aa, Giardia lamblia
IPPNSETDE

SEQ ID NO: 3115774 - protein, 4 aa, Giardia lamblia
IPPP

SEQ ID NO: 3115775 - protein, 34 aa, Giardia lamblia
IPPPDTGHQKHASITDARGMPGNSYDNSSAMEQS

SEQ ID NO: 3115776 - protein, 7 aa, Giardia lamblia
IPPPLPD

SEQ ID NO: 3115777 - protein, 9 aa, Giardia lamblia
IPPQSSFNA

SEQ ID NO: 3115778 - protein, 6 aa, Giardia lamblia
IPPTAF

SEQ ID NO: 3115779 - protein, 6 aa, Giardia lamblia
IPPTQS

SEQ ID NO: 3115780 - protein, 12 aa, Giardia lamblia
IPPVSGTPQEIE

SEQ ID NO: 3115781 - protein, 6 aa, Giardia lamblia
IPPYTN

SEQ ID NO: 3115782 - protein, 24 aa, Giardia lamblia
IPQANKSSGSASAVPSPNKASSLA

SEQ ID NO: 3115783 - protein, 5 aa, Giardia lamblia
IPQDS

SEQ ID NO: 3115784 - protein, 51 aa, Giardia lamblia
IPQESEGDNSLEASDNGLDGEKIADRQGPSGETPESNREGAETKPPNVTTT

SEQ ID NO: 3115785 - protein, 9 aa, Giardia lamblia
IPQGQEPQA

SEQ ID NO: 3115786 - protein, 17 aa, Giardia lamblia
IPQGTVSVPGEENPGAI

SEQ ID NO: 3115787 - protein, 18 aa, Giardia lamblia
IPQLPSPEVVPSTTGAEE

SEQ ID NO: 3115788 - protein, 23 aa, Giardia lamblia
IPQPPRGRINASNSYRPQSANNI

SEQ ID NO: 3115789 - protein, 6 aa, Giardia lamblia
IPQPVT

SEQ ID NO: 3115790 - protein, 4 aa, Giardia lamblia
IPQR

SEQ ID NO: 3115791 - protein, 25 aa, Giardia lamblia
IPQSKRGKHANPSAADKKLANDTNE

SEQ ID NO: 3115792 - protein, 9 aa, Giardia lamblia
IPQSRERRH

SEQ ID NO: 3115793 - protein, 13 aa, Giardia lamblia
IPQTDDRSTLDRS

SEQ ID NO: 3115794 - protein, 26 aa, Giardia lamblia
IPQTYEGRDHADNTFSEMNPASLSQI

SEQ ID NO: 3115795 - protein, 18 aa, Giardia lamblia
IPQVKSPEEIDVKAAFTG

SEQ ID NO: 3115796 - protein, 11 aa, Giardia lamblia
IPRANKSRLSD

SEQ ID NO: 3115797 - protein, 4 aa, Giardia lamblia
IPRD

SEQ ID NO: 3115798 - protein, 7 aa, Giardia lamblia
IPRDPAN

SEQ ID NO: 3115799 - protein, 6 aa, Giardia lamblia
IPRGVR

SEQ ID NO: 3115800 - protein, 5 aa, Giardia lamblia
IPRKH

SEQ ID NO: 3115801 - protein, 6 aa, Giardia lamblia
IPRPTD

SEQ ID NO: 3115802 - protein, 13 aa, Giardia lamblia
IPRSSSSNRKRAE

SEQ ID NO: 3115803 - protein, 8 aa, Giardia lamblia
IPRSTGEH

SEQ ID NO: 3115804 - protein, 10 aa, Giardia lamblia
IPSDDKAPTV

SEQ ID NO: 3115805 - protein, 7 aa, Giardia lamblia
IPSEGPF

SEQ ID NO: 3115806 - protein, 6 aa, Giardia lamblia
IPSEGS

SEQ ID NO: 3115807 - protein, 5 aa, Giardia lamblia
IPSEP

SEQ ID NO: 3115808 - protein, 8 aa, Giardia lamblia
IPSEQVDD

SEQ ID NO: 3115809 - protein, 5 aa, Giardia lamblia
IPSET

SEQ ID NO: 3115810 - protein, 4 aa, Giardia lamblia
IPSG

SEQ ID NO: 3115811 - protein, 11 aa, Giardia lamblia
IPSGDVGETDS

SEQ ID NO: 3115812 - protein, 6 aa, Giardia lamblia
IPSGEN

SEQ ID NO: 3115813 - protein, 5 aa, Giardia lamblia
IPSGK

SEQ ID NO: 3115814 - protein, 4 aa, Giardia lamblia
IPSI

SEQ ID NO: 3115815 - protein, 8 aa, Giardia lamblia
IPSPRGNL

SEQ ID NO: 3115816 - protein, 6 aa, Giardia lamblia
IPSPYV

SEQ ID NO: 3115817 - protein, 8 aa, Giardia lamblia
IPSQGSSV

SEQ ID NO: 3115818 - protein, 11 aa, Giardia lamblia
IPSRSQDSEAF

SEQ ID NO: 3115819 - protein, 8 aa, Giardia lamblia
IPSRTETL

SEQ ID NO: 3115820 - protein, 11 aa, Giardia lamblia
IPSSTGAAKAV

SEQ ID NO: 3115821 - protein, 8 aa, Giardia lamblia
IPSTPTQE

SEQ ID NO: 3115822 - protein, 17 aa, Giardia lamblia
IPSTSTVRTSAETSKDV

SEQ ID NO: 3115823 - protein, 5 aa, Giardia lamblia
IPSTY

SEQ ID NO: 3115824 - protein, 13 aa, Giardia lamblia
IPTAASSLQTTMG

SEQ ID NO: 3115825 - protein, 5 aa, Giardia lamblia
IPTAS

SEQ ID NO: 3115826 - protein, 14 aa, Giardia lamblia
IPTDTNDVVPTSTL

SEQ ID NO: 3115827 - protein, 5 aa, Giardia lamblia
IPTGE

SEQ ID NO: 3115828 - protein, 9 aa, Giardia lamblia
IPTKQGNYP

SEQ ID NO: 3115829 - protein, 5 aa, Giardia lamblia
IPTPN

SEQ ID NO: 3115830 - protein, 18 aa, Giardia lamblia
IPTQSASSNEKVGADNQR

SEQ ID NO: 3115831 - protein, 7 aa, Giardia lamblia
IPTQSDD

SEQ ID NO: 3115832 - protein, 7 aa, Giardia lamblia
IPTRPNQ

SEQ ID NO: 3115833 - protein, 5 aa, Giardia lamblia
IPTRR

SEQ ID NO: 3115834 - protein, 6 aa, Giardia lamblia
IPTRTQ

SEQ ID NO: 3115835 - protein, 10 aa, Giardia lamblia
IPTSQSGSAL

SEQ ID NO: 3115836 - protein, 11 aa, Giardia lamblia
IPVPDSIPTDD

SEQ ID NO: 3115837 - protein, 5 aa, Giardia lamblia
IPVPQ

SEQ ID NO: 3115838 - protein, 4 aa, Giardia lamblia
IPYQ

SEQ ID NO: 3115839 - protein, 15 aa, Giardia lamblia
IPYSVSNSTQSDGQQ

SEQ ID NO: 3115840 - protein, 5 aa, Giardia lamblia
IPYTK

SEQ ID NO: 3115841 - protein, 6 aa, Giardia lamblia
IPYTPN

SEQ ID NO: 3115842 - protein, 9 aa, Giardia lamblia
IQASKTAKG

SEQ ID NO: 3115843 - protein, 5 aa, Giardia lamblia
IQATD

SEQ ID NO: 3115844 - protein, 7 aa, Giardia lamblia
IQATPEN

SEQ ID NO: 3115845 - protein, 9 aa, Giardia lamblia
IQDAPRSGV

SEQ ID NO: 3115846 - protein, 8 aa, Giardia lamblia
IQDASGKT

SEQ ID NO: 3115847 - protein, 19 aa, Giardia lamblia
IQDDTGSSDDAESKSPLDD

SEQ ID NO: 3115848 - protein, 9 aa, Giardia lamblia
IQDENGETA

SEQ ID NO: 3115849 - protein, 6 aa, Giardia lamblia
IQDKTG

SEQ ID NO: 3115850 - protein, 9 aa, Giardia lamblia
IQDPDSTDY

SEQ ID NO: 3115851 - protein, 6 aa, Giardia lamblia
IQDQAG

SEQ ID NO: 3115852 - protein, 9 aa, Giardia lamblia
IQDQNGQTS

SEQ ID NO: 3115853 - protein, 8 aa, Giardia lamblia
IQDQTGST

SEQ ID NO: 3115854 - protein, 5 aa, Giardia lamblia
IQDQY

SEQ ID NO: 3115855 - protein, 16 aa, Giardia lamblia
IQDRQNQLKREREAEI

SEQ ID NO: 3115856 - protein, 17 aa, Giardia lamblia
IQDSQKERAKGQPLRQR

SEQ ID NO: 3115857 - protein, 8 aa, Giardia lamblia
IQDSRGRT

SEQ ID NO: 3115858 - protein, 5 aa, Giardia lamblia
IQDSS

SEQ ID NO: 3115859 - protein, 4 aa, Giardia lamblia
IQEA

SEQ ID NO: 3115860 - protein, 6 aa, Giardia lamblia
IQEDSR

SEQ ID NO: 3115861 - protein, 15 aa, Giardia lamblia
IQEELKQDASAQALP

SEQ ID NO: 3115862 - protein, 14 aa, Giardia lamblia
IQEEQGNTRDGQAL

SEQ ID NO: 3115863 - protein, 6 aa, Giardia lamblia
IQEPAS

SEQ ID NO: 3115864 - protein, 6 aa, Giardia lamblia
IQEQQN

SEQ ID NO: 3115865 - protein, 10 aa, Giardia lamblia
IQEQRTQTIS

SEQ ID NO: 3115866 - protein, 5 aa, Giardia lamblia
IQERD

SEQ ID NO: 3115867 - protein, 14 aa, Giardia lamblia
IQESKRNKKKITGY

SEQ ID NO: 3115868 - protein, 7 aa, Giardia lamblia
IQESRSF

SEQ ID NO: 3115869 - protein, 6 aa, Giardia lamblia
IQESYS

SEQ ID NO: 3115870 - protein, 12 aa, Giardia lamblia
IQETGEQYNSGK

SEQ ID NO: 3115871 - protein, 11 aa, Giardia lamblia
IQETKRTDKYG

SEQ ID NO: 3115872 - protein, 6 aa, Giardia lamblia
IQETSK

SEQ ID NO: 3115873 - protein, 30 aa, Giardia lamblia
IQGKDNGRTAQSSVHERRRPEDHVRDLFGA

SEQ ID NO: 3115874 - protein, 6 aa, Giardia lamblia
IQGYRG

SEQ ID NO: 3115875 - protein, 9 aa, Giardia lamblia
IQHQSPKSV

SEQ ID NO: 3115876 - protein, 9 aa, Giardia lamblia
IQKEKENNL

SEQ ID NO: 3115877 - protein, 12 aa, Giardia lamblia
IQKSRTVAVRDF

SEQ ID NO: 3115878 - protein, 6 aa, Giardia lamblia
IQKTEP

SEQ ID NO: 3115879 - protein, 18 aa, Giardia lamblia
IQKTQQSLEHYSNALEPQ

SEQ ID NO: 3115880 - protein, 40 aa, Giardia lamblia
IQLPTDSFKPNVPRFPEAQEEKEKSSITKRMSSAKDNDVH

SEQ ID NO: 3115881 - protein, 6 aa, Giardia lamblia
IQLSTT

SEQ ID NO: 3115882 - protein, 32 aa, Giardia lamblia
IQNARYPGQTQNRQQQSTAELNAKRKEEEKKA

SEQ ID NO: 3115883 - protein, 10 aa, Giardia lamblia
IQNDDSAGSA

SEQ ID NO: 3115884 - protein, 7 aa, Giardia lamblia
IQNDNGY

SEQ ID NO: 3115885 - protein, 6 aa, Giardia lamblia
IQNESG

SEQ ID NO: 3115886 - protein, 18 aa, Giardia lamblia
IQNSPTSVTLKENKPEVL

SEQ ID NO: 3115887 - protein, 9 aa, Giardia lamblia
IQNTPDVQT

SEQ ID NO: 3115888 - protein, 13 aa, Giardia lamblia
IQPANACGGSSTL

SEQ ID NO: 3115889 - protein, 10 aa, Giardia lamblia
IQPEDSVDTL

SEQ ID NO: 3115890 - protein, 12 aa, Giardia lamblia
IQPNPIVDTDSQ

SEQ ID NO: 3115891 - protein, 12 aa, Giardia lamblia
IQPNSTLSQSDQ

SEQ ID NO: 3115892 - protein, 13 aa, Giardia lamblia
IQPPNVSGGRKTE

SEQ ID NO: 3115893 - protein, 17 aa, Giardia lamblia
IQPRSTTEQSINTTPLT

SEQ ID NO: 3115894 - protein, 4 aa, Giardia lamblia
IQPS

SEQ ID NO: 3115895 - protein, 9 aa, Giardia lamblia
IQPSSGVDY

SEQ ID NO: 3115896 - protein, 15 aa, Giardia lamblia
IQPTSKCDENGNTDL

SEQ ID NO: 3115897 - protein, 11 aa, Giardia lamblia
IQPVPDPTPDV

SEQ ID NO: 3115898 - protein, 9 aa, Giardia lamblia
IQQATKEME

SEQ ID NO: 3115899 - protein, 13 aa, Giardia lamblia
IQQESAGVEEAND

SEQ ID NO: 3115900 - protein, 5 aa, Giardia lamblia
IQQNE

SEQ ID NO: 3115901 - protein, 4 aa, Giardia lamblia
IQQQ

SEQ ID NO: 3115902 - protein, 4 aa, Giardia lamblia
IQQR

SEQ ID NO: 3115903 - protein, 5 aa, Giardia lamblia
IQQSN

SEQ ID NO: 3115904 - protein, 6 aa, Giardia lamblia
IQQSNI

SEQ ID NO: 3115905 - protein, 7 aa, Giardia lamblia
IQRDGSD

SEQ ID NO: 3115906 - protein, 6 aa, Giardia lamblia
IQRKDG

SEQ ID NO: 3115907 - protein, 8 aa, Giardia lamblia
IQRSDATS

SEQ ID NO: 3115908 - protein, 9 aa, Giardia lamblia
IQSANDGKR

SEQ ID NO: 3115909 - protein, 9 aa, Giardia lamblia
IQSEPAGQT

SEQ ID NO: 3115910 - protein, 7 aa, Giardia lamblia
IQSEPQE

SEQ ID NO: 3115911 - protein, 11 aa, Giardia lamblia
IQSERAGIPNK

SEQ ID NO: 3115912 - protein, 13 aa, Giardia lamblia
IQSGESDNKDGAV

SEQ ID NO: 3115913 - protein, 6 aa, Giardia lamblia
IQSGST

SEQ ID NO: 3115914 - protein, 8 aa, Giardia lamblia
IQSNYGQT

SEQ ID NO: 3115915 - protein, 12 aa, Giardia lamblia
IQSPPAKPRTVS

SEQ ID NO: 3115916 - protein, 7 aa, Giardia lamblia
IQSPPKL

SEQ ID NO: 3115917 - protein, 7 aa, Giardia lamblia
IQSPQGL

SEQ ID NO: 3115918 - protein, 17 aa, Giardia lamblia
IQSPSESISETTNIQRT

SEQ ID NO: 3115919 - protein, 9 aa, Giardia lamblia
IQSQARSKY

SEQ ID NO: 3115920 - protein, 13 aa, Giardia lamblia
IQSSAGSSLDGAV

SEQ ID NO: 3115921 - protein, 9 aa, Giardia lamblia
IQSSNGQTA

SEQ ID NO: 3115922 - protein, 27 aa, Giardia lamblia
IQSSQSSAQEAPLVQPSQSYADDDQSV

SEQ ID NO: 3115923 - protein, 9 aa, Giardia lamblia
IQSTPSRQT

SEQ ID NO: 3115924 - protein, 5 aa, Giardia lamblia
IQSTT

SEQ ID NO: 3115925 - protein, 5 aa, Giardia lamblia
IQSYE

SEQ ID NO: 3115926 - protein, 4 aa, Giardia lamblia
IQTA

SEQ ID NO: 3115927 - protein, 11 aa, Giardia lamblia
IQTDRGMDDRL

SEQ ID NO: 3115928 - protein, 22 aa, Giardia lamblia
IQTDSAAAEPTVNRADEGLKRT

SEQ ID NO: 3115929 - protein, 6 aa, Giardia lamblia
IQTERG

SEQ ID NO: 3115930 - protein, 8 aa, Giardia lamblia
IQTHSGET

SEQ ID NO: 3115931 - protein, 9 aa, Giardia lamblia
IQTPDTQAS

SEQ ID NO: 3115932 - protein, 22 aa, Giardia lamblia
IQTPSQDSDDFYQTSNPSTYVP

SEQ ID NO: 3115933 - protein, 4 aa, Giardia lamblia
IQTV

SEQ ID NO: 3115934 - protein, 8 aa, Giardia lamblia
IRAGQSKL

SEQ ID NO: 3115935 - protein, 26 aa, Giardia lamblia
IRAGSRKGKAADVAHPAESVDDTDNL

SEQ ID NO: 3115936 - protein, 11 aa, Giardia lamblia
IRAKEDNLKAE

SEQ ID NO: 3115937 - protein, 13 aa, Giardia lamblia
IRANETRIKNNAD

SEQ ID NO: 3115938 - protein, 8 aa, Giardia lamblia
IRAQASEV

SEQ ID NO: 3115939 - protein, 5 aa, Giardia lamblia
IRAQR

SEQ ID NO: 3115940 - protein, 8 aa, Giardia lamblia
IRAQTKEY

SEQ ID NO: 3115941 - protein, 4 aa, Giardia lamblia
IRDD

SEQ ID NO: 3115942 - protein, 7 aa, Giardia lamblia
IRDDETR

SEQ ID NO: 3115943 - protein, 16 aa, Giardia lamblia
IRDEQRRKGIQPKDHM

SEQ ID NO: 3115944 - protein, 9 aa, Giardia lamblia
IRDKTGQSA

SEQ ID NO: 3115945 - protein, 8 aa, Giardia lamblia
IRDNMDET

SEQ ID NO: 3115946 - protein, 10 aa, Giardia lamblia
IRDNQGDTAA

SEQ ID NO: 3115947 - protein, 8 aa, Giardia lamblia
IRDNQGND

SEQ ID NO: 3115948 - protein, 7 aa, Giardia lamblia
IRDNRGM

SEQ ID NO: 3115949 - protein, 8 aa, Giardia lamblia
IRDPRGRT

SEQ ID NO: 3115950 - protein, 13 aa, Giardia lamblia
IRDPSPSKRGSMN

SEQ ID NO: 3115951 - protein, 8 aa, Giardia lamblia
IRDQNGRT

SEQ ID NO: 3115952 - protein, 7 aa, Giardia lamblia
IRDSSGR

SEQ ID NO: 3115953 - protein, 7 aa, Giardia lamblia
IRDTDDA

SEQ ID NO: 3115954 - protein, 17 aa, Giardia lamblia
IREEAERDRKNKENLRN

SEQ ID NO: 3115955 - protein, 5 aa, Giardia lamblia
IREGP

SEQ ID NO: 3115956 - protein, 5 aa, Giardia lamblia
IREKG

SEQ ID NO: 3115957 - protein, 13 aa, Giardia lamblia
IREKGHETAPQEV

SEQ ID NO: 3115958 - protein, 4 aa, Giardia lamblia
IRES

SEQ ID NO: 3115959 - protein, 8 aa, Giardia lamblia
IRESATAR

SEQ ID NO: 3115960 - protein, 5 aa, Giardia lamblia
IRESK

SEQ ID NO: 3115961 - protein, 9 aa, Giardia lamblia
IRESKEKGV

SEQ ID NO: 3115962 - protein, 40 aa, Giardia lamblia
IRGEERPVQDADSQTSSSRPSSHNSEQSGSEEDDSPIPKV

SEQ ID NO: 3115963 - protein, 6 aa, Giardia lamblia
IRGERR

SEQ ID NO: 3115964 - protein, 11 aa, Giardia lamblia
IRGHNPDENVL

SEQ ID NO: 3115965 - protein, 7 aa, Giardia lamblia
IRGPENL

SEQ ID NO: 3115966 - protein, 5 aa, Giardia lamblia
IRGSP

SEQ ID NO: 3115967 - protein, 17 aa, Giardia lamblia
IRKDETYMPPETRGTTI

SEQ ID NO: 3115968 - protein, 15 aa, Giardia lamblia
IRKEQAQMQEEQEQA

SEQ ID NO: 3115969 - protein, 8 aa, Giardia lamblia
IRKGTKVD

SEQ ID NO: 3115970 - protein, 6 aa, Giardia lamblia
IRKRDG

SEQ ID NO: 3115971 - protein, 6 aa, Giardia lamblia
IRKRSK

SEQ ID NO: 3115972 - protein, 7 aa, Giardia lamblia
IRKRSLR

SEQ ID NO: 3115973 - protein, 16 aa, Giardia lamblia
IRKSQPRFQYLACKIS

SEQ ID NO: 3115974 - protein, 11 aa, Giardia lamblia
IRKSTSLTSKN

SEQ ID NO: 3115975 - protein, 5 aa, Giardia lamblia
IRKTM

SEQ ID NO: 3115976 - protein, 9 aa, Giardia lamblia
IRNAQGKTA

SEQ ID NO: 3115977 - protein, 4 aa, Giardia lamblia
IRNN

SEQ ID NO: 3115978 - protein, 13 aa, Giardia lamblia
IRPASNVDERWDG

SEQ ID NO: 3115979 - protein, 17 aa, Giardia lamblia
IRPDDPTKQSPNTTAAG

SEQ ID NO: 3115980 - protein, 10 aa, Giardia lamblia
IRPHANGRFS

SEQ ID NO: 3115981 - protein, 8 aa, Giardia lamblia
IRPPDPLD

SEQ ID NO: 3115982 - protein, 4 aa, Giardia lamblia
IRPR

SEQ ID NO: 3115983 - protein, 9 aa, Giardia lamblia
IRPSSSNRV

SEQ ID NO: 3115984 - protein, 6 aa, Giardia lamblia
IRPTDT

SEQ ID NO: 3115985 - protein, 4 aa, Giardia lamblia
IRQE

SEQ ID NO: 3115986 - protein, 7 aa, Giardia lamblia
IRQETEH

SEQ ID NO: 3115987 - protein, 8 aa, Giardia lamblia
IRQGGGSR

SEQ ID NO: 3115988 - protein, 12 aa, Giardia lamblia
IRQGYQDESIED

SEQ ID NO: 3115989 - protein, 6 aa, Giardia lamblia
IRQKDD

SEQ ID NO: 3115990 - protein, 7 aa, Giardia lamblia
IRQKNDE

SEQ ID NO: 3115991 - protein, 18 aa, Giardia lamblia
IRQPTDRPVPEEEPPVPL

SEQ ID NO: 3115992 - protein, 17 aa, Giardia lamblia
IRQQTEKMETDSTEDTL

SEQ ID NO: 3115993 - protein, 12 aa, Giardia lamblia
IRQREKTERKQR

SEQ ID NO: 3115994 - protein, 12 aa, Giardia lamblia
IRRQQTTSEAVA

SEQ ID NO: 3115995 - protein, 17 aa, Giardia lamblia
IRRRRESRAPRPLTSQP

SEQ ID NO: 3115996 - protein, 16 aa, Giardia lamblia
IRRSSSSVEETSKAIG

SEQ ID NO: 3115997 - protein, 8 aa, Giardia lamblia
IRSESGVT

SEQ ID NO: 3115998 - protein, 5 aa, Giardia lamblia
IRSEV

SEQ ID NO: 3115999 - protein, 7 aa, Giardia lamblia
IRSKGGW

SEQ ID NO: 3116000 - protein, 7 aa, Giardia lamblia
IRSKQKD

SEQ ID NO: 3116001 - protein, 26 aa, Giardia lamblia
IRSPPTARSANTSVLSNGSTGNKSFN

SEQ ID NO: 3116002 - protein, 18 aa, Giardia lamblia
IRSQAESLKECNDENTEL

SEQ ID NO: 3116003 - protein, 9 aa, Giardia lamblia
IRSRDGQTA

SEQ ID NO: 3116004 - protein, 7 aa, Giardia lamblia
IRSRGQK

SEQ ID NO: 3116005 - protein, 9 aa, Giardia lamblia
IRSRPSISS

SEQ ID NO: 3116006 - protein, 5 aa, Giardia lamblia
IRSRS

SEQ ID NO: 3116007 - protein, 18 aa, Giardia lamblia
IRSSEKLRSVSSKVSSDT

SEQ ID NO: 3116008 - protein, 9 aa, Giardia lamblia
IRSTRTSKS

SEQ ID NO: 3116009 - protein, 10 aa, Giardia lamblia
IRTRDNTRLP

SEQ ID NO: 3116010 - protein, 8 aa, Giardia lamblia
IRTSSGRT

SEQ ID NO: 3116011 - protein, 4 aa, Giardia lamblia
IRTT

SEQ ID NO: 3116012 - protein, 11 aa, Giardia lamblia
IRTTQGNTKAL

SEQ ID NO: 3116013 - protein, 10 aa, Giardia lamblia
ISAAEEAHPL

SEQ ID NO: 3116014 - protein, 7 aa, Giardia lamblia
ISADNGM

SEQ ID NO: 3116015 - protein, 7 aa, Giardia lamblia
ISADTPV

SEQ ID NO: 3116016 - protein, 4 aa, Giardia lamblia
ISAE

SEQ ID NO: 3116017 - protein, 23 aa, Giardia lamblia
ISAEADAQFGTNGTSNRSTCTKN

SEQ ID NO: 3116018 - protein, 6 aa, Giardia lamblia
ISAEEA

SEQ ID NO: 3116019 - protein, 5 aa, Giardia lamblia
ISAEN

SEQ ID NO: 3116020 - protein, 8 aa, Giardia lamblia
ISAGADGG

SEQ ID NO: 3116021 - protein, 8 aa, Giardia lamblia
ISAGDAAT

SEQ ID NO: 3116022 - protein, 15 aa, Giardia lamblia
ISANNPVSASGPTDF

SEQ ID NO: 3116023 - protein, 40 aa, Giardia lamblia
ISAPPPEPLPSERGRRAPESRQQQQQPRPPEYGQEFTESG

SEQ ID NO: 3116024 - protein, 7 aa, Giardia lamblia
ISAPQNP

SEQ ID NO: 3116025 - protein, 24 aa, Giardia lamblia
ISAQSASSSLTESLESSRASSPFN

SEQ ID NO: 3116026 - protein, 4 aa, Giardia lamblia
ISAS

SEQ ID NO: 3116027 - protein, 6 aa, Giardia lamblia
ISASKS

SEQ ID NO: 3116028 - protein, 16 aa, Giardia lamblia
ISATESNYAQASSLKR

SEQ ID NO: 3116029 - protein, 5 aa, Giardia lamblia
ISDDG

SEQ ID NO: 3116030 - protein, 10 aa, Giardia lamblia
ISDDSGNTPL

SEQ ID NO: 3116031 - protein, 7 aa, Giardia lamblia
ISDEERR

SEQ ID NO: 3116032 - protein, 24 aa, Giardia lamblia
ISDEPAKDLTTGRITTANDATEKA

SEQ ID NO: 3116033 - protein, 7 aa, Giardia lamblia
ISDETTP

SEQ ID NO: 3116034 - protein, 10 aa, Giardia lamblia
ISDGDDCPDA

SEQ ID NO: 3116035 - protein, 7 aa, Giardia lamblia
ISDGPYD

SEQ ID NO: 3116036 - protein, 5 aa, Giardia lamblia
ISDHN

SEQ ID NO: 3116037 - protein, 11 aa, Giardia lamblia
ISDHPRKAVAS

SEQ ID NO: 3116038 - protein, 6 aa, Giardia lamblia
ISDKDT

SEQ ID NO: 3116039 - protein, 4 aa, Giardia lamblia
ISDL

SEQ ID NO: 3116040 - protein, 6 aa, Giardia lamblia
ISDPSG

SEQ ID NO: 3116041 - protein, 10 aa, Giardia lamblia
ISDQEKLHQE

SEQ ID NO: 3116042 - protein, 10 aa, Giardia lamblia
ISDSDSSSFP

SEQ ID NO: 3116043 - protein, 9 aa, Giardia lamblia
ISDSKTDYR

SEQ ID NO: 3116044 - protein, 11 aa, Giardia lamblia
ISDSSDDEAGM

SEQ ID NO: 3116045 - protein, 11 aa, Giardia lamblia
ISDSVSTDLPG

SEQ ID NO: 3116046 - protein, 13 aa, Giardia lamblia
ISEAAGHASTIPV

SEQ ID NO: 3116047 - protein, 6 aa, Giardia lamblia
ISEAPS

SEQ ID NO: 3116048 - protein, 8 aa, Giardia lamblia
ISEASNPA

SEQ ID NO: 3116049 - protein, 23 aa, Giardia lamblia
ISEEAGRHLGGNSMASSVNDGYN

SEQ ID NO: 3116050 - protein, 7 aa, Giardia lamblia
ISEGKKD

SEQ ID NO: 3116051 - protein, 8 aa, Giardia lamblia
ISEGLEQT

SEQ ID NO: 3116052 - protein, 5 aa, Giardia lamblia
ISEIG

SEQ ID NO: 3116053 - protein, 12 aa, Giardia lamblia
ISEKATLDSQIL

SEQ ID NO: 3116054 - protein, 17 aa, Giardia lamblia
ISEKETNLKERLAKAGL

SEQ ID NO: 3116055 - protein, 5 aa, Giardia lamblia
ISELE

SEQ ID NO: 3116056 - protein, 11 aa, Giardia lamblia
ISENEDLSKDR

SEQ ID NO: 3116057 - protein, 11 aa, Giardia lamblia
ISENVAGSTSI

SEQ ID NO: 3116058 - protein, 7 aa, Giardia lamblia
ISEPLTP

SEQ ID NO: 3116059 - protein, 4 aa, Giardia lamblia
ISEQ

SEQ ID NO: 3116060 - protein, 12 aa, Giardia lamblia
ISEQASSQLGAS

SEQ ID NO: 3116061 - protein, 8 aa, Giardia lamblia
ISEQEATI

SEQ ID NO: 3116062 - protein, 5 aa, Giardia lamblia
ISERD

SEQ ID NO: 3116063 - protein, 18 aa, Giardia lamblia
ISESCDSCEDPQKVVEDS

SEQ ID NO: 3116064 - protein, 6 aa, Giardia lamblia
ISESGM

SEQ ID NO: 3116065 - protein, 7 aa, Giardia lamblia
ISESPAS

SEQ ID NO: 3116066 - protein, 6 aa, Giardia lamblia
ISESPK

SEQ ID NO: 3116067 - protein, 8 aa, Giardia lamblia
ISESRKVK

SEQ ID NO: 3116068 - protein, 8 aa, Giardia lamblia
ISESTRPI

SEQ ID NO: 3116069 - protein, 4 aa, Giardia lamblia
ISET

SEQ ID NO: 3116070 - protein, 9 aa, Giardia lamblia
ISETEPPPI

SEQ ID NO: 3116071 - protein, 9 aa, Giardia lamblia
ISETGERSD

SEQ ID NO: 3116072 - protein, 4 aa, Giardia lamblia
ISEV

SEQ ID NO: 3116073 - protein, 9 aa, Giardia lamblia
ISGAAADRI

SEQ ID NO: 3116074 - protein, 9 aa, Giardia lamblia
ISGDGRTVR

SEQ ID NO: 3116075 - protein, 46 aa, Giardia lamblia
ISGDSGKKVAPPGLADEDSAPSMTLPEQNDPHYAPYNTGAHPTRYQ

SEQ ID NO: 3116076 - protein, 8 aa, Giardia lamblia
ISGEERRS

SEQ ID NO: 3116077 - protein, 9 aa, Giardia lamblia
ISGEGGIGA

SEQ ID NO: 3116078 - protein, 9 aa, Giardia lamblia
ISGETGEEV

SEQ ID NO: 3116079 - protein, 13 aa, Giardia lamblia
ISGGGSKAQGATK

SEQ ID NO: 3116080 - protein, 14 aa, Giardia lamblia
ISGGVPATSQTDNS

SEQ ID NO: 3116081 - protein, 7 aa, Giardia lamblia
ISGKSIE

SEQ ID NO: 3116082 - protein, 9 aa, Giardia lamblia
ISGKSKSAK

SEQ ID NO: 3116083 - protein, 5 aa, Giardia lamblia
ISGNR

SEQ ID NO: 3116084 - protein, 8 aa, Giardia lamblia
ISGPDSAT

SEQ ID NO: 3116085 - protein, 5 aa, Giardia lamblia
ISGQT

SEQ ID NO: 3116086 - protein, 26 aa, Giardia lamblia
ISGSYSNSTVTEGLKKSSSSASITKA

SEQ ID NO: 3116087 - protein, 9 aa, Giardia lamblia
ISGTDPDTY

SEQ ID NO: 3116088 - protein, 10 aa, Giardia lamblia
ISGTPTEPGI

SEQ ID NO: 3116089 - protein, 5 aa, Giardia lamblia
ISGYD

SEQ ID NO: 3116090 - protein, 8 aa, Giardia lamblia
ISHPSSAQ

SEQ ID NO: 3116091 - protein, 11 aa, Giardia lamblia
ISISSDEGRVT

SEQ ID NO: 3116092 - protein, 5 aa, Giardia lamblia
ISIST

SEQ ID NO: 3116093 - protein, 10 aa, Giardia lamblia
ISKDTEPKRE

SEQ ID NO: 3116094 - protein, 10 aa, Giardia lamblia
ISKEGTVATC

SEQ ID NO: 3116095 - protein, 8 aa, Giardia lamblia
ISKENNGD

SEQ ID NO: 3116096 - protein, 9 aa, Giardia lamblia
ISKPTTETL

SEQ ID NO: 3116097 - protein, 38 aa, Giardia lamblia
ISKQAQGYQDQPVTRAPATSLQKGSISRHSDSEESADA

SEQ ID NO: 3116098 - protein, 9 aa, Giardia lamblia
ISKQDRTRL

SEQ ID NO: 3116099 - protein, 18 aa, Giardia lamblia
ISKQSDEPVQPCPKDRRD

SEQ ID NO: 3116100 - protein, 9 aa, Giardia lamblia
ISKRTQQRS

SEQ ID NO: 3116101 - protein, 20 aa, Giardia lamblia
ISKSAKSVSSANGELKSSGT

SEQ ID NO: 3116102 - protein, 9 aa, Giardia lamblia
ISKSEHDYT

SEQ ID NO: 3116103 - protein, 9 aa, Giardia lamblia
ISKTDTYEP

SEQ ID NO: 3116104 - protein, 7 aa, Giardia lamblia
ISKYGNT

SEQ ID NO: 3116105 - protein, 7 aa, Giardia lamblia
ISLKTDK

SEQ ID NO: 3116106 - protein, 5 aa, Giardia lamblia
ISLPP

SEQ ID NO: 3116107 - protein, 7 aa, Giardia lamblia
ISLPSDT

SEQ ID NO: 3116108 - protein, 5 aa, Giardia lamblia
ISNDE

SEQ ID NO: 3116109 - protein, 7 aa, Giardia lamblia
ISNDSTK

SEQ ID NO: 3116110 - protein, 12 aa, Giardia lamblia
ISNEVSPHARTP

SEQ ID NO: 3116111 - protein, 4 aa, Giardia lamblia
ISNK

SEQ ID NO: 3116112 - protein, 18 aa, Giardia lamblia
ISNKRERDIRTGREDVSR

SEQ ID NO: 3116113 - protein, 14 aa, Giardia lamblia
ISNKSSSTPMRPGH

SEQ ID NO: 3116114 - protein, 7 aa, Giardia lamblia
ISNPEGM

SEQ ID NO: 3116115 - protein, 20 aa, Giardia lamblia
ISNQEAGDLPPSGKQRSTKN

SEQ ID NO: 3116116 - protein, 8 aa, Giardia lamblia
ISNQTYRD

SEQ ID NO: 3116117 - protein, 29 aa, Giardia lamblia
ISNSNSRNHKPNVPGEQRASSTSDAGSPF

SEQ ID NO: 3116118 - protein, 9 aa, Giardia lamblia
ISNTPRNMS

SEQ ID NO: 3116119 - protein, 7 aa, Giardia lamblia
ISNTQRG

SEQ ID NO: 3116120 - protein, 7 aa, Giardia lamblia
ISNTSHA

SEQ ID NO: 3116121 - protein, 9 aa, Giardia lamblia
ISNYSQCSS

SEQ ID NO: 3116122 - protein, 6 aa, Giardia lamblia
ISPAGE

SEQ ID NO: 3116123 - protein, 16 aa, Giardia lamblia
ISPAVDSKKYASQHFS

SEQ ID NO: 3116124 - protein, 7 aa, Giardia lamblia
ISPDGRV

SEQ ID NO: 3116125 - protein, 12 aa, Giardia lamblia
ISPDGSVQATLG

SEQ ID NO: 3116126 - protein, 11 aa, Giardia lamblia
ISPDTSTDAPP

SEQ ID NO: 3116127 - protein, 4 aa, Giardia lamblia
ISPE

SEQ ID NO: 3116128 - protein, 9 aa, Giardia lamblia
ISPEETGPF

SEQ ID NO: 3116129 - protein, 8 aa, Giardia lamblia
ISPETNSN

SEQ ID NO: 3116130 - protein, 6 aa, Giardia lamblia
ISPGKS

SEQ ID NO: 3116131 - protein, 12 aa, Giardia lamblia
ISPGPAAYSQNV

SEQ ID NO: 3116132 - protein, 7 aa, Giardia lamblia
ISPGQLT

SEQ ID NO: 3116133 - protein, 7 aa, Giardia lamblia
ISPGSTL

SEQ ID NO: 3116134 - protein, 5 aa, Giardia lamblia
ISPGY

SEQ ID NO: 3116135 - protein, 9 aa, Giardia lamblia
ISPHSLKDS

SEQ ID NO: 3116136 - protein, 8 aa, Giardia lamblia
ISPKSNSM

SEQ ID NO: 3116137 - protein, 4 aa, Giardia lamblia
ISPL

SEQ ID NO: 3116138 - protein, 8 aa, Giardia lamblia
ISPPITDT

SEQ ID NO: 3116139 - protein, 6 aa, Giardia lamblia
ISPPPL

SEQ ID NO: 3116140 - protein, 22 aa, Giardia lamblia
ISPQFTASARSQRPGLATPETF

SEQ ID NO: 3116141 - protein, 7 aa, Giardia lamblia
ISPQKQE

SEQ ID NO: 3116142 - protein, 4 aa, Giardia lamblia
ISPR

SEQ ID NO: 3116143 - protein, 5 aa, Giardia lamblia
ISPRN

SEQ ID NO: 3116144 - protein, 16 aa, Giardia lamblia
ISPRPLKRSTKPRPIP

SEQ ID NO: 3116145 - protein, 22 aa, Giardia lamblia
ISPRSAVTRTSAMSRSSGSLST

SEQ ID NO: 3116146 - protein, 4 aa, Giardia lamblia
ISPS

SEQ ID NO: 3116147 - protein, 6 aa, Giardia lamblia
ISPSAL

SEQ ID NO: 3116148 - protein, 27 aa, Giardia lamblia
ISPSASRKNLKSPAAGDASTREADRRE

SEQ ID NO: 3116149 - protein, 5 aa, Giardia lamblia
ISPSD

SEQ ID NO: 3116150 - protein, 5 aa, Giardia lamblia
ISPSP

SEQ ID NO: 3116151 - protein, 7 aa, Giardia lamblia
ISPTARP

SEQ ID NO: 3116152 - protein, 8 aa, Giardia lamblia
ISPTQAED

SEQ ID NO: 3116153 - protein, 4 aa, Giardia lamblia
ISPV

SEQ ID NO: 3116154 - protein, 17 aa, Giardia lamblia
ISPVKSYRQTSAVEARS

SEQ ID NO: 3116155 - protein, 7 aa, Giardia lamblia
ISPYPPS

SEQ ID NO: 3116156 - protein, 8 aa, Giardia lamblia
ISQESSAV

SEQ ID NO: 3116157 - protein, 4 aa, Giardia lamblia
ISQI

SEQ ID NO: 3116158 - protein, 8 aa, Giardia lamblia
ISQKTEEA

SEQ ID NO: 3116159 - protein, 5 aa, Giardia lamblia
ISQLS

SEQ ID NO: 3116160 - protein, 6 aa, Giardia lamblia
ISQNPL

SEQ ID NO: 3116161 - protein, 6 aa, Giardia lamblia
ISQPPQ

SEQ ID NO: 3116162 - protein, 8 aa, Giardia lamblia
ISQPTGVY

SEQ ID NO: 3116163 - protein, 7 aa, Giardia lamblia
ISQWGQP

SEQ ID NO: 3116164 - protein, 9 aa, Giardia lamblia
ISRDGSTAL

SEQ ID NO: 3116165 - protein, 12 aa, Giardia lamblia
ISREDHDANESI

SEQ ID NO: 3116166 - protein, 6 aa, Giardia lamblia
ISRESA

SEQ ID NO: 3116167 - protein, 10 aa, Giardia lamblia
ISRHEDSPKV

SEQ ID NO: 3116168 - protein, 8 aa, Giardia lamblia
ISRKDREI

SEQ ID NO: 3116169 - protein, 16 aa, Giardia lamblia
ISRNSDRNGHEDRGSL

SEQ ID NO: 3116170 - protein, 11 aa, Giardia lamblia
ISRPISSRSSM

SEQ ID NO: 3116171 - protein, 10 aa, Giardia lamblia
ISRPKSGDQN

SEQ ID NO: 3116172 - protein, 36 aa, Giardia lamblia
ISRPSPSRSSPKPALSGSTVSKPTTSTQDKQHTTVD

SEQ ID NO: 3116173 - protein, 9 aa, Giardia lamblia
ISRQPHDGI

SEQ ID NO: 3116174 - protein, 20 aa, Giardia lamblia
ISRSATPADRRTISRPREPP

SEQ ID NO: 3116175 - protein, 5 aa, Giardia lamblia
ISRSE

SEQ ID NO: 3116176 - protein, 7 aa, Giardia lamblia
ISRSKDK

SEQ ID NO: 3116177 - protein, 16 aa, Giardia lamblia
ISRSKGTVHQPEPQGV

SEQ ID NO: 3116178 - protein, 18 aa, Giardia lamblia
ISRSKKKRKGANPSSRKR

SEQ ID NO: 3116179 - protein, 20 aa, Giardia lamblia
ISRSPSPSSTSPQPPGPPQF

SEQ ID NO: 3116180 - protein, 15 aa, Giardia lamblia
ISRSQAALAQTAGIS

SEQ ID NO: 3116181 - protein, 11 aa, Giardia lamblia
ISRSREYTSGL

SEQ ID NO: 3116182 - protein, 14 aa, Giardia lamblia
ISRSSGSDNAYGQT

SEQ ID NO: 3116183 - protein, 15 aa, Giardia lamblia
ISRTSSRSNYGTGYP

SEQ ID NO: 3116184 - protein, 12 aa, Giardia lamblia
ISSAESKVSDYK

SEQ ID NO: 3116185 - protein, 17 aa, Giardia lamblia
ISSARNEVPGRKGYPPY

SEQ ID NO: 3116186 - protein, 4 aa, Giardia lamblia
ISSD

SEQ ID NO: 3116187 - protein, 9 aa, Giardia lamblia
ISSDEADRL

SEQ ID NO: 3116188 - protein, 10 aa, Giardia lamblia
ISSDRSSESI

SEQ ID NO: 3116189 - protein, 14 aa, Giardia lamblia
ISSDSIKPHTKQPF

SEQ ID NO: 3116190 - protein, 7 aa, Giardia lamblia
ISSDSYE

SEQ ID NO: 3116191 - protein, 25 aa, Giardia lamblia
ISSEQGSDPHEHSQNSLDKGAPDYD

SEQ ID NO: 3116192 - protein, 4 aa, Giardia lamblia
ISSG

SEQ ID NO: 3116193 - protein, 15 aa, Giardia lamblia
ISSGASPSSTVTKEI

SEQ ID NO: 3116194 - protein, 7 aa, Giardia lamblia
ISSGATQ

SEQ ID NO: 3116195 - protein, 8 aa, Giardia lamblia
ISSGDNYD

SEQ ID NO: 3116196 - protein, 11 aa, Giardia lamblia
ISSGGKASNHI

SEQ ID NO: 3116197 - protein, 8 aa, Giardia lamblia
ISSGGKYA

SEQ ID NO: 3116198 - protein, 9 aa, Giardia lamblia
ISSGKQDDL

SEQ ID NO: 3116199 - protein, 8 aa, Giardia lamblia
ISSGNQKN

SEQ ID NO: 3116200 - protein, 8 aa, Giardia lamblia
ISSGRDAQ

SEQ ID NO: 3116201 - protein, 7 aa, Giardia lamblia
ISSGTDS

SEQ ID NO: 3116202 - protein, 4 aa, Giardia lamblia
ISSI

SEQ ID NO: 3116203 - protein, 13 aa, Giardia lamblia
ISSKHESEGIATT

SEQ ID NO: 3116204 - protein, 8 aa, Giardia lamblia
ISSKKGVE

SEQ ID NO: 3116205 - protein, 10 aa, Giardia lamblia
ISSKTPADRK

SEQ ID NO: 3116206 - protein, 14 aa, Giardia lamblia
ISSLPTKSERESAL

SEQ ID NO: 3116207 - protein, 14 aa, Giardia lamblia
ISSMDTKNREEHRD

SEQ ID NO: 3116208 - protein, 4 aa, Giardia lamblia
ISSN

SEQ ID NO: 3116209 - protein, 5 aa, Giardia lamblia
ISSPD

SEQ ID NO: 3116210 - protein, 8 aa, Giardia lamblia
ISSPEDAV

SEQ ID NO: 3116211 - protein, 10 aa, Giardia lamblia
ISSPPTGQTL

SEQ ID NO: 3116212 - protein, 6 aa, Giardia lamblia
ISSPTK

SEQ ID NO: 3116213 - protein, 11 aa, Giardia lamblia
ISSPYEDSPYI

SEQ ID NO: 3116214 - protein, 22 aa, Giardia lamblia
ISSRRGSSVRQEKSDQSGRRNP

SEQ ID NO: 3116215 - protein, 7 aa, Giardia lamblia
ISSRSNL

SEQ ID NO: 3116216 - protein, 19 aa, Giardia lamblia
ISSRTSRNRNTTPHKPQQM

SEQ ID NO: 3116217 - protein, 10 aa, Giardia lamblia
ISSSTTNRPI

SEQ ID NO: 3116218 - protein, 4 aa, Giardia lamblia
ISST

SEQ ID NO: 3116219 - protein, 12 aa, Giardia lamblia
ISSTGSDAELSS

SEQ ID NO: 3116220 - protein, 9 aa, Giardia lamblia
ISSTKTAGR

SEQ ID NO: 3116221 - protein, 28 aa, Giardia lamblia
ISSTPRSPAITSAQPGLAGKSKPAHRKP

SEQ ID NO: 3116222 - protein, 50 aa, Giardia lamblia
ISSTSDPKLAKRRRAKDVPAGGLADADASQQATLKDDKKSMRLSDEEASL

SEQ ID NO: 3116223 - protein, 9 aa, Giardia lamblia
ISSYTRAEA

SEQ ID NO: 3116224 - protein, 11 aa, Giardia lamblia
ISTAQQEASVT

SEQ ID NO: 3116225 - protein, 13 aa, Giardia lamblia
ISTASTAAAANSL

SEQ ID NO: 3116226 - protein, 15 aa, Giardia lamblia
ISTAYEESKVSTDHH

SEQ ID NO: 3116227 - protein, 5 aa, Giardia lamblia
ISTDA

SEQ ID NO: 3116228 - protein, 6 aa, Giardia lamblia
ISTDNS

SEQ ID NO: 3116229 - protein, 8 aa, Giardia lamblia
ISTDQGKC

SEQ ID NO: 3116230 - protein, 26 aa, Giardia lamblia
ISTDTQGASRNVASAAKSEAADKSVE

SEQ ID NO: 3116231 - protein, 5 aa, Giardia lamblia
ISTED

SEQ ID NO: 3116232 - protein, 19 aa, Giardia lamblia
ISTGPNSMAGSPQRKESQI

SEQ ID NO: 3116233 - protein, 11 aa, Giardia lamblia
ISTGQAVEART

SEQ ID NO: 3116234 - protein, 6 aa, Giardia lamblia
ISTGSG

SEQ ID NO: 3116235 - protein, 8 aa, Giardia lamblia
ISTGSPNS

SEQ ID NO: 3116236 - protein, 8 aa, Giardia lamblia
ISTHNGTT

SEQ ID NO: 3116237 - protein, 7 aa, Giardia lamblia
ISTKDGY

SEQ ID NO: 3116238 - protein, 5 aa, Giardia lamblia
ISTLQ

SEQ ID NO: 3116239 - protein, 10 aa, Giardia lamblia
ISTPGTPQNV

SEQ ID NO: 3116240 - protein, 4 aa, Giardia lamblia
ISTR

SEQ ID NO: 3116241 - protein, 11 aa, Giardia lamblia
ISTRQGPRNTR

SEQ ID NO: 3116242 - protein, 22 aa, Giardia lamblia
ISTRSPSCESSKMRRQKDSHMP

SEQ ID NO: 3116243 - protein, 4 aa, Giardia lamblia
ISTS

SEQ ID NO: 3116244 - protein, 24 aa, Giardia lamblia
ISTSDEAGSENEHDDLEQTDENNS

SEQ ID NO: 3116245 - protein, 11 aa, Giardia lamblia
ISTSKTGKHGH

SEQ ID NO: 3116246 - protein, 8 aa, Giardia lamblia
ISTSQKRK

SEQ ID NO: 3116247 - protein, 13 aa, Giardia lamblia
ISTSTTGKTTKNI

SEQ ID NO: 3116248 - protein, 6 aa, Giardia lamblia
ISTSVA

SEQ ID NO: 3116249 - protein, 19 aa, Giardia lamblia
ISTTGSTFSSTLTTGNNST

SEQ ID NO: 3116250 - protein, 6 aa, Giardia lamblia
ISTTKC

SEQ ID NO: 3116251 - protein, 6 aa, Giardia lamblia
ISTTTK

SEQ ID NO: 3116252 - protein, 20 aa, Giardia lamblia
ISTTTSQAVGRRSKRQCGST

SEQ ID NO: 3116253 - protein, 8 aa, Giardia lamblia
ISVENDGV

SEQ ID NO: 3116254 - protein, 61 aa, Giardia lamblia
ISVPSANSGHFDHSNSGTNTGTMSISGSSDPPAQAYKSQEHTANEDSSGHASQARNRFDPL

SEQ ID NO: 3116255 - protein, 8 aa, Giardia lamblia
ISVPTGEV

SEQ ID NO: 3116256 - protein, 8 aa, Giardia lamblia
ISVSDEGD

SEQ ID NO: 3116257 - protein, 21 aa, Giardia lamblia
ISVSSADREHQAKKADKDIKT

SEQ ID NO: 3116258 - protein, 12 aa, Giardia lamblia
ISVSTDKDPSFQ

SEQ ID NO: 3116259 - protein, 13 aa, Giardia lamblia
ITAASTPTQGSTV

SEQ ID NO: 3116260 - protein, 9 aa, Giardia lamblia
ITADEEEVR

SEQ ID NO: 3116261 - protein, 6 aa, Giardia lamblia
ITAQDG

SEQ ID NO: 3116262 - protein, 7 aa, Giardia lamblia
ITAQHGD

SEQ ID NO: 3116263 - protein, 8 aa, Giardia lamblia
ITARPQET

SEQ ID NO: 3116264 - protein, 18 aa, Giardia lamblia
ITDADKQDVAVSPQESGS

SEQ ID NO: 3116265 - protein, 19 aa, Giardia lamblia
ITDDPHPSVPSSPLPSSSL

SEQ ID NO: 3116266 - protein, 7 aa, Giardia lamblia
ITDEQER

SEQ ID NO: 3116267 - protein, 17 aa, Giardia lamblia
ITDGPSTALNKNGQEVI

SEQ ID NO: 3116268 - protein, 12 aa, Giardia lamblia
ITDKNPSKQPVP

SEQ ID NO: 3116269 - protein, 11 aa, Giardia lamblia
ITDPSASQKTF

SEQ ID NO: 3116270 - protein, 5 aa, Giardia lamblia
ITDPT

SEQ ID NO: 3116271 - protein, 8 aa, Giardia lamblia
ITDREERT

SEQ ID NO: 3116272 - protein, 10 aa, Giardia lamblia
ITDSDTATRC

SEQ ID NO: 3116273 - protein, 10 aa, Giardia lamblia
ITDSQTANEL

SEQ ID NO: 3116274 - protein, 7 aa, Giardia lamblia
ITDSSGF

SEQ ID NO: 3116275 - protein, 9 aa, Giardia lamblia
ITEDGSLET

SEQ ID NO: 3116276 - protein, 5 aa, Giardia lamblia
ITEDY

SEQ ID NO: 3116277 - protein, 6 aa, Giardia lamblia
ITEEKE

SEQ ID NO: 3116278 - protein, 10 aa, Giardia lamblia
ITEEQDHAAE

SEQ ID NO: 3116279 - protein, 10 aa, Giardia lamblia
ITEERESLKE

SEQ ID NO: 3116280 - protein, 7 aa, Giardia lamblia
ITEGPGP

SEQ ID NO: 3116281 - protein, 11 aa, Giardia lamblia
ITEGTDESVSN

SEQ ID NO: 3116282 - protein, 7 aa, Giardia lamblia
ITEIPQD

SEQ ID NO: 3116283 - protein, 5 aa, Giardia lamblia
ITEKE

SEQ ID NO: 3116284 - protein, 15 aa, Giardia lamblia
ITELGQQTENYSGSD

SEQ ID NO: 3116285 - protein, 7 aa, Giardia lamblia
ITENEQS

SEQ ID NO: 3116286 - protein, 5 aa, Giardia lamblia
ITEPI

SEQ ID NO: 3116287 - protein, 9 aa, Giardia lamblia
ITEQNTLAN

SEQ ID NO: 3116288 - protein, 10 aa, Giardia lamblia
ITEQTRATRL

SEQ ID NO: 3116289 - protein, 5 aa, Giardia lamblia
ITEST

SEQ ID NO: 3116290 - protein, 4 aa, Giardia lamblia
ITEV

SEQ ID NO: 3116291 - protein, 10 aa, Giardia lamblia
ITGDSRSRTL

SEQ ID NO: 3116292 - protein, 8 aa, Giardia lamblia
ITGGTTAT

SEQ ID NO: 3116293 - protein, 4 aa, Giardia lamblia
ITGN

SEQ ID NO: 3116294 - protein, 5 aa, Giardia lamblia
ITGPD

SEQ ID NO: 3116295 - protein, 8 aa, Giardia lamblia
ITGPEDEN

SEQ ID NO: 3116296 - protein, 7 aa, Giardia lamblia
ITGSADD

SEQ ID NO: 3116297 - protein, 13 aa, Giardia lamblia
ITGSQARLDAYFR

SEQ ID NO: 3116298 - protein, 9 aa, Giardia lamblia
ITGSQDGTI

SEQ ID NO: 3116299 - protein, 16 aa, Giardia lamblia
ITGTDEGCGSTDNSTE

SEQ ID NO: 3116300 - protein, 5 aa, Giardia lamblia
ITGTT

SEQ ID NO: 3116301 - protein, 6 aa, Giardia lamblia
ITHRSG

SEQ ID NO: 3116302 - protein, 4 aa, Giardia lamblia
ITID

SEQ ID NO: 3116303 - protein, 14 aa, Giardia lamblia
ITKAESTPPSLPQQ

SEQ ID NO: 3116304 - protein, 9 aa, Giardia lamblia
ITKAGSPKF

SEQ ID NO: 3116305 - protein, 9 aa, Giardia lamblia
ITKAKARGR

SEQ ID NO: 3116306 - protein, 10 aa, Giardia lamblia
ITKEDGTAFT

SEQ ID NO: 3116307 - protein, 6 aa, Giardia lamblia
ITKENG

SEQ ID NO: 3116308 - protein, 34 aa, Giardia lamblia
ITKETAGKPNPPAAGGSRFAAKTSQDEDDNDDND

SEQ ID NO: 3116309 - protein, 10 aa, Giardia lamblia
ITKGAGEYSQ

SEQ ID NO: 3116310 - protein, 7 aa, Giardia lamblia
ITKGKTH

SEQ ID NO: 3116311 - protein, 7 aa, Giardia lamblia
ITKGSKV

SEQ ID NO: 3116312 - protein, 7 aa, Giardia lamblia
ITKNECD

SEQ ID NO: 3116313 - protein, 8 aa, Giardia lamblia
ITKPESAS

SEQ ID NO: 3116314 - protein, 10 aa, Giardia lamblia
ITKRSEESGL

SEQ ID NO: 3116315 - protein, 10 aa, Giardia lamblia
ITKSKTMHSE

SEQ ID NO: 3116316 - protein, 21 aa, Giardia lamblia
ITKSSGTQSSLKQESTTNAPS

SEQ ID NO: 3116317 - protein, 7 aa, Giardia lamblia
ITNDSYN

SEQ ID NO: 3116318 - protein, 6 aa, Giardia lamblia
ITNEAR

SEQ ID NO: 3116319 - protein, 11 aa, Giardia lamblia
ITNEPALSPLT

SEQ ID NO: 3116320 - protein, 4 aa, Giardia lamblia
ITNH

SEQ ID NO: 3116321 - protein, 16 aa, Giardia lamblia
ITNHPERDGCVNAVLL

SEQ ID NO: 3116322 - protein, 16 aa, Giardia lamblia
ITNKEAVRDLSKEEQK

SEQ ID NO: 3116323 - protein, 9 aa, Giardia lamblia
ITNNETEKI

SEQ ID NO: 3116324 - protein, 11 aa, Giardia lamblia
ITNTEYENASD

SEQ ID NO: 3116325 - protein, 10 aa, Giardia lamblia
ITNTGSRTTE

SEQ ID NO: 3116326 - protein, 7 aa, Giardia lamblia
ITNTQGA

SEQ ID NO: 3116327 - protein, 11 aa, Giardia lamblia
ITPAANEQEEQ

SEQ ID NO: 3116328 - protein, 7 aa, Giardia lamblia
ITPADET

SEQ ID NO: 3116329 - protein, 6 aa, Giardia lamblia
ITPDAT

SEQ ID NO: 3116330 - protein, 5 aa, Giardia lamblia
ITPNY

SEQ ID NO: 3116331 - protein, 5 aa, Giardia lamblia
ITPPI

SEQ ID NO: 3116332 - protein, 4 aa, Giardia lamblia
ITPR

SEQ ID NO: 3116333 - protein, 25 aa, Giardia lamblia
ITPRAGSRFAGPGSQVSASDQRATA

SEQ ID NO: 3116334 - protein, 15 aa, Giardia lamblia
ITPRRPLPSAKALRA

SEQ ID NO: 3116335 - protein, 34 aa, Giardia lamblia
ITPTEKALSSATLDSRSKTPITDESSKTDDQREA

SEQ ID NO: 3116336 - protein, 12 aa, Giardia lamblia
ITPTGRSLKKEA

SEQ ID NO: 3116337 - protein, 5 aa, Giardia lamblia
ITPYR

SEQ ID NO: 3116338 - protein, 6 aa, Giardia lamblia
ITQEAE

SEQ ID NO: 3116339 - protein, 8 aa, Giardia lamblia
ITQEDIGD

SEQ ID NO: 3116340 - protein, 4 aa, Giardia lamblia
ITQP

SEQ ID NO: 3116341 - protein, 9 aa, Giardia lamblia
ITQSESTPM

SEQ ID NO: 3116342 - protein, 5 aa, Giardia lamblia
ITQST

SEQ ID NO: 3116343 - protein, 6 aa, Giardia lamblia
ITRPDG

SEQ ID NO: 3116344 - protein, 6 aa, Giardia lamblia
ITRPSE

SEQ ID NO: 3116345 - protein, 13 aa, Giardia lamblia
ITRSNLKSNDSKL

SEQ ID NO: 3116346 - protein, 5 aa, Giardia lamblia
ITRTS

SEQ ID NO: 3116347 - protein, 28 aa, Giardia lamblia
ITRTSSAVSPVSRGGVDYGDSKSISPAY

SEQ ID NO: 3116348 - protein, 9 aa, Giardia lamblia
ITSERDGHT

SEQ ID NO: 3116349 - protein, 5 aa, Giardia lamblia
ITSGD

SEQ ID NO: 3116350 - protein, 7 aa, Giardia lamblia
ITSGEDE

SEQ ID NO: 3116351 - protein, 6 aa, Giardia lamblia
ITSGSS

SEQ ID NO: 3116352 - protein, 9 aa, Giardia lamblia
ITSHSNSAV

SEQ ID NO: 3116353 - protein, 9 aa, Giardia lamblia
ITSKEGENV

SEQ ID NO: 3116354 - protein, 5 aa, Giardia lamblia
ITSNE

SEQ ID NO: 3116355 - protein, 6 aa, Giardia lamblia
ITSNED

SEQ ID NO: 3116356 - protein, 4 aa, Giardia lamblia
ITSP

SEQ ID NO: 3116357 - protein, 15 aa, Giardia lamblia
ITSPKVSWGPSPEDM

SEQ ID NO: 3116358 - protein, 9 aa, Giardia lamblia
ITSPQQAQQ

SEQ ID NO: 3116359 - protein, 10 aa, Giardia lamblia
ITSPSADADA

SEQ ID NO: 3116360 - protein, 9 aa, Giardia lamblia
ITSPSTPVT

SEQ ID NO: 3116361 - protein, 16 aa, Giardia lamblia
ITSQNGQNSKNAQLTS

SEQ ID NO: 3116362 - protein, 12 aa, Giardia lamblia
ITSSSSPNDNDR

SEQ ID NO: 3116363 - protein, 5 aa, Giardia lamblia
ITSTS

SEQ ID NO: 3116364 - protein, 12 aa, Giardia lamblia
ITSTSGGTSWPE

SEQ ID NO: 3116365 - protein, 8 aa, Giardia lamblia
ITSTSNGS

SEQ ID NO: 3116366 - protein, 7 aa, Giardia lamblia
ITSTSTP

SEQ ID NO: 3116367 - protein, 10 aa, Giardia lamblia
ITTDKQRAGL

SEQ ID NO: 3116368 - protein, 6 aa, Giardia lamblia
ITTDTS

SEQ ID NO: 3116369 - protein, 10 aa, Giardia lamblia
ITTERESSAD

SEQ ID NO: 3116370 - protein, 8 aa, Giardia lamblia
ITTNPGAP

SEQ ID NO: 3116371 - protein, 4 aa, Giardia lamblia
ITTP

SEQ ID NO: 3116372 - protein, 12 aa, Giardia lamblia
ITTPAPPSDSAE

SEQ ID NO: 3116373 - protein, 8 aa, Giardia lamblia
ITTPSDTT

SEQ ID NO: 3116374 - protein, 4 aa, Giardia lamblia
ITTQ

SEQ ID NO: 3116375 - protein, 28 aa, Giardia lamblia
ITTQSTHTVADDRQAAVDEDPVQLLSAS

SEQ ID NO: 3116376 - protein, 4 aa, Giardia lamblia
ITTR

SEQ ID NO: 3116377 - protein, 7 aa, Giardia lamblia
ITTSKGN

SEQ ID NO: 3116378 - protein, 12 aa, Giardia lamblia
ITVQTTDKTWDP

SEQ ID NO: 3116379 - protein, 10 aa, Giardia lamblia
IVERGDSGLG

SEQ ID NO: 3116380 - protein, 11 aa, Giardia lamblia
IVGPKEKYASK

SEQ ID NO: 3116381 - protein, 19 aa, Giardia lamblia
IVKPESKTMLDQEPSQHDT

SEQ ID NO: 3116382 - protein, 4 aa, Giardia lamblia
IVKT

SEQ ID NO: 3116383 - protein, 8 aa, Giardia lamblia
IVSDPTEP

SEQ ID NO: 3116384 - protein, 8 aa, Giardia lamblia
IVTGGSDG

SEQ ID NO: 3116385 - protein, 5 aa, Giardia lamblia
IVTPS

SEQ ID NO: 3116386 - protein, 5 aa, Giardia lamblia
IVTSN

SEQ ID NO: 3116387 - protein, 8 aa, Giardia lamblia
IVTTEDDS

SEQ ID NO: 3116388 - protein, 4 aa, Giardia lamblia
IWTN

SEQ ID NO: 3116389 - protein, 11 aa, Giardia lamblia
IYDPNTGEEIP

SEQ ID NO: 3116390 - protein, 6 aa, Giardia lamblia
IYGPKG

SEQ ID NO: 3116391 - protein, 6 aa, Giardia lamblia
IYKDSS

SEQ ID NO: 3116392 - protein, 4 aa, Giardia lamblia
IYKK

SEQ ID NO: 3116393 - protein, 11 aa, Giardia lamblia
IYNQRDKTLPV

SEQ ID NO: 3116394 - protein, 10 aa, Giardia lamblia
IYNTADKNTR

SEQ ID NO: 3116395 - protein, 5 aa, Giardia lamblia
IYPSS

SEQ ID NO: 3116396 - protein, 7 aa, Giardia lamblia
IYSPNKA

SEQ ID NO: 3116397 - protein, 6 aa, Giardia lamblia
IYSTQQ

SEQ ID NO: 3116398 - protein, 4 aa, Giardia lamblia
IYTG

SEQ ID NO: 3116399 - protein, 6 aa, Giardia lamblia
IYTSSE

SEQ ID NO: 3116400 - protein, 5 aa, Giardia lamblia
KAAAL

SEQ ID NO: 3116401 - protein, 6 aa, Giardia lamblia
KAAAPV

SEQ ID NO: 3116402 - protein, 28 aa, Giardia lamblia
KAAASELSKTSGANKKSKNDAFKDGDSK

SEQ ID NO: 3116403 - protein, 6 aa, Giardia lamblia
KAAATS

SEQ ID NO: 3116404 - protein, 6 aa, Giardia lamblia
KAADAL

SEQ ID NO: 3116405 - protein, 10 aa, Giardia lamblia
KAADKAMDDL

SEQ ID NO: 3116406 - protein, 11 aa, Giardia lamblia
KAADKDPLEGT

SEQ ID NO: 3116407 - protein, 6 aa, Giardia lamblia
KAADRG

SEQ ID NO: 3116408 - protein, 71 aa, Giardia lamblia
KAADSSPNNLVSSTPQTDGKPVSDASPSGGQGSRLGSEATSPVPSPAMSPGSEGADRLSTKESTPKPPPKR

SEQ ID NO: 3116409 - protein, 20 aa, Giardia lamblia
KAAEAQAEKAISENKAASSR

SEQ ID NO: 3116410 - protein, 13 aa, Giardia lamblia
KAAEEKCKRTLGH

SEQ ID NO: 3116411 - protein, 5 aa, Giardia lamblia
KAAEG

SEQ ID NO: 3116412 - protein, 11 aa, Giardia lamblia
KAAEHSAPNGL

SEQ ID NO: 3116413 - protein, 14 aa, Giardia lamblia
KAAENGSHAEMNVV

SEQ ID NO: 3116414 - protein, 6 aa, Giardia lamblia
KAAGAG

SEQ ID NO: 3116415 - protein, 12 aa, Giardia lamblia
KAAGGIRSAEAA

SEQ ID NO: 3116416 - protein, 13 aa, Giardia lamblia
KAAGQNDKVQEFE

SEQ ID NO: 3116417 - protein, 6 aa, Giardia lamblia
KAAHAK

SEQ ID NO: 3116418 - protein, 7 aa, Giardia lamblia
KAAHKSA

SEQ ID NO: 3116419 - protein, 4 aa, Giardia lamblia
KAAK

SEQ ID NO: 3116420 - protein, 9 aa, Giardia lamblia
KAAKAAKAA

SEQ ID NO: 3116421 - protein, 17 aa, Giardia lamblia
KAALSDSCQQTDNPECV

SEQ ID NO: 3116422 - protein, 4 aa, Giardia lamblia
KAAN

SEQ ID NO: 3116423 - protein, 15 aa, Giardia lamblia
KAANEDSESSEEDIS

SEQ ID NO: 3116424 - protein, 6 aa, Giardia lamblia
KAANEG

SEQ ID NO: 3116425 - protein, 9 aa, Giardia lamblia
KAANNEREY

SEQ ID NO: 3116426 - protein, 6 aa, Giardia lamblia
KAANPL

SEQ ID NO: 3116427 - protein, 6 aa, Giardia lamblia
KAAPEL

SEQ ID NO: 3116428 - protein, 8 aa, Giardia lamblia
KAAPGADL

SEQ ID NO: 3116429 - protein, 30 aa, Giardia lamblia
KAAPINTNAEIPDDESYSYSYEEEEEEEQV

SEQ ID NO: 3116430 - protein, 6 aa, Giardia lamblia
KAAPLS

SEQ ID NO: 3116431 - protein, 11 aa, Giardia lamblia
KAAPQITDGMP

SEQ ID NO: 3116432 - protein, 11 aa, Giardia lamblia
KAAQAGADAQR

SEQ ID NO: 3116433 - protein, 15 aa, Giardia lamblia
KAAQEQRKTLEQGIE

SEQ ID NO: 3116434 - protein, 7 aa, Giardia lamblia
KAASDSI

SEQ ID NO: 3116435 - protein, 7 aa, Giardia lamblia
KAASLQR

SEQ ID NO: 3116436 - protein, 113 aa, Giardia lamblia
KAASPVLGGSPIESSPQTGGMTAARQGQETGSERSRNWRASTPLPKRRDAKGKRSSQPTSAQPARTPSGPTATIAAPAAGPSTAPPTLGPSRQLRPRYEKTEMRGEATPQLSQ

SEQ ID NO: 3116437 - protein, 9 aa, Giardia lamblia
KAASTSSIT

SEQ ID NO: 3116438 - protein, 21 aa, Giardia lamblia
KAATGPVTQVNRDGVQSKDAL

SEQ ID NO: 3116439 - protein, 13 aa, Giardia lamblia
KAAVTDSSANTFP

SEQ ID NO: 3116440 - protein, 4 aa, Giardia lamblia
KACE

SEQ ID NO: 3116441 - protein, 8 aa, Giardia lamblia
KACQRTTK

SEQ ID NO: 3116442 - protein, 5 aa, Giardia lamblia
KACSE

SEQ ID NO: 3116443 - protein, 6 aa, Giardia lamblia
KACTES

SEQ ID NO: 3116444 - protein, 5 aa, Giardia lamblia
KADAC

SEQ ID NO: 3116445 - protein, 7 aa, Giardia lamblia
KADAEAA

SEQ ID NO: 3116446 - protein, 7 aa, Giardia lamblia
KADEEYQ

SEQ ID NO: 3116447 - protein, 12 aa, Giardia lamblia
KADEIDTTTLTN

SEQ ID NO: 3116448 - protein, 7 aa, Giardia lamblia
KADGEEV

SEQ ID NO: 3116449 - protein, 38 aa, Giardia lamblia
KADGYTPFDEEDTTSSDSSGSNSADDTDNSSEESTESC

SEQ ID NO: 3116450 - protein, 6 aa, Giardia lamblia
KADIER

SEQ ID NO: 3116451 - protein, 14 aa, Giardia lamblia
KADIYTDKQRTDAV

SEQ ID NO: 3116452 - protein, 14 aa, Giardia lamblia
KADKLRAAGQVPAP

SEQ ID NO: 3116453 - protein, 12 aa, Giardia lamblia
KADLSSKEIKEL

SEQ ID NO: 3116454 - protein, 9 aa, Giardia lamblia
KADPSLTGD

SEQ ID NO: 3116455 - protein, 19 aa, Giardia lamblia
KADSETAEGDRSKLGSYTS

SEQ ID NO: 3116456 - protein, 27 aa, Giardia lamblia
KADTGYRAPSYTGMSTANTHKKCDSSG

SEQ ID NO: 3116457 - protein, 12 aa, Giardia lamblia
KADTPGRDVTTQ

SEQ ID NO: 3116458 - protein, 5 aa, Giardia lamblia
KADVD

SEQ ID NO: 3116459 - protein, 9 aa, Giardia lamblia
KADVPPEDV

SEQ ID NO: 3116460 - protein, 13 aa, Giardia lamblia
KADYESGASDGKI

SEQ ID NO: 3116461 - protein, 7 aa, Giardia lamblia
KADYRDA

SEQ ID NO: 3116462 - protein, 4 aa, Giardia lamblia
KAEA

SEQ ID NO: 3116463 - protein, 9 aa, Giardia lamblia
KAEAESEVH

SEQ ID NO: 3116464 - protein, 9 aa, Giardia lamblia
KAEASGVPD

SEQ ID NO: 3116465 - protein, 12 aa, Giardia lamblia
KAEATKKSNPKM

SEQ ID NO: 3116466 - protein, 7 aa, Giardia lamblia
KAEEERK

SEQ ID NO: 3116467 - protein, 29 aa, Giardia lamblia
KAEEPKTISNAGSVGKKKITQKRFNESTG

SEQ ID NO: 3116468 - protein, 10 aa, Giardia lamblia
KAEEQAKNKR

SEQ ID NO: 3116469 - protein, 5 aa, Giardia lamblia
KAEES

SEQ ID NO: 3116470 - protein, 9 aa, Giardia lamblia
KAEESFTKA

SEQ ID NO: 3116471 - protein, 5 aa, Giardia lamblia
KAEGD

SEQ ID NO: 3116472 - protein, 13 aa, Giardia lamblia
KAEGVGKSTSNYI

SEQ ID NO: 3116473 - protein, 8 aa, Giardia lamblia
KAEKALSD

SEQ ID NO: 3116474 - protein, 7 aa, Giardia lamblia
KAEKPMN

SEQ ID NO: 3116475 - protein, 8 aa, Giardia lamblia
KAEKPVTD

SEQ ID NO: 3116476 - protein, 6 aa, Giardia lamblia
KAELET

SEQ ID NO: 3116477 - protein, 9 aa, Giardia lamblia
KAENDTLKS

SEQ ID NO: 3116478 - protein, 6 aa, Giardia lamblia
KAENPE

SEQ ID NO: 3116479 - protein, 11 aa, Giardia lamblia
KAENVGDTAVT

SEQ ID NO: 3116480 - protein, 8 aa, Giardia lamblia
KAEQAYKR

SEQ ID NO: 3116481 - protein, 9 aa, Giardia lamblia
KAEQLERDL

SEQ ID NO: 3116482 - protein, 34 aa, Giardia lamblia
KAERDEHHRQRKEEKARRKMRTERTTAAKREKMR

SEQ ID NO: 3116483 - protein, 6 aa, Giardia lamblia
KAERMK

SEQ ID NO: 3116484 - protein, 6 aa, Giardia lamblia
KAERRD

SEQ ID NO: 3116485 - protein, 14 aa, Giardia lamblia
KAERRNYSTSYPDE

SEQ ID NO: 3116486 - protein, 8 aa, Giardia lamblia
KAERTAQQ

SEQ ID NO: 3116487 - protein, 6 aa, Giardia lamblia
KAERTS

SEQ ID NO: 3116488 - protein, 21 aa, Giardia lamblia
KAESDRKRRVSRKRKRMAGTV

SEQ ID NO: 3116489 - protein, 5 aa, Giardia lamblia
KAESQ

SEQ ID NO: 3116490 - protein, 9 aa, Giardia lamblia
KAESRVDRS

SEQ ID NO: 3116491 - protein, 17 aa, Giardia lamblia
KAESSVKSRNSNRLSTS

SEQ ID NO: 3116492 - protein, 11 aa, Giardia lamblia
KAESTEDVNNR

SEQ ID NO: 3116493 - protein, 6 aa, Giardia lamblia
KAETKL

SEQ ID NO: 3116494 - protein, 7 aa, Giardia lamblia
KAETYKS

SEQ ID NO: 3116495 - protein, 8 aa, Giardia lamblia
KAEYKPKE

SEQ ID NO: 3116496 - protein, 8 aa, Giardia lamblia
KAFEEAGN

SEQ ID NO: 3116497 - protein, 8 aa, Giardia lamblia
KAFPSDAQ

SEQ ID NO: 3116498 - protein, 8 aa, Giardia lamblia
KAFSESDH

SEQ ID NO: 3116499 - protein, 4 aa, Giardia lamblia
KAFT

SEQ ID NO: 3116500 - protein, 4 aa, Giardia lamblia
KAGA

SEQ ID NO: 3116501 - protein, 6 aa, Giardia lamblia
KAGALD

SEQ ID NO: 3116502 - protein, 6 aa, Giardia lamblia
KAGAQF

SEQ ID NO: 3116503 - protein, 18 aa, Giardia lamblia
KAGDDKGKGGGKSVDEAA

SEQ ID NO: 3116504 - protein, 7 aa, Giardia lamblia
KAGDEDM

SEQ ID NO: 3116505 - protein, 7 aa, Giardia lamblia
KAGDGLG

SEQ ID NO: 3116506 - protein, 4 aa, Giardia lamblia
KAGE

SEQ ID NO: 3116507 - protein, 6 aa, Giardia lamblia
KAGGDV

SEQ ID NO: 3116508 - protein, 9 aa, Giardia lamblia
KAGISTTLN

SEQ ID NO: 3116509 - protein, 5 aa, Giardia lamblia
KAGKT

SEQ ID NO: 3116510 - protein, 9 aa, Giardia lamblia
KAGKYPSTS

SEQ ID NO: 3116511 - protein, 5 aa, Giardia lamblia
KAGME

SEQ ID NO: 3116512 - protein, 7 aa, Giardia lamblia
KAGNTQI

SEQ ID NO: 3116513 - protein, 7 aa, Giardia lamblia
KAGPAQH

SEQ ID NO: 3116514 - protein, 7 aa, Giardia lamblia
KAGPQLH

SEQ ID NO: 3116515 - protein, 46 aa, Giardia lamblia
KAGPSFGVSTGQLGRVGGSEGHPTGRNASLHDDSTVSGANEIEDDD

SEQ ID NO: 3116516 - protein, 8 aa, Giardia lamblia
KAGQPPLK

SEQ ID NO: 3116517 - protein, 19 aa, Giardia lamblia
KAGRFPSTRKGALGPEAGM

SEQ ID NO: 3116518 - protein, 4 aa, Giardia lamblia
KAGV

SEQ ID NO: 3116519 - protein, 6 aa, Giardia lamblia
KAGVSR

SEQ ID NO: 3116520 - protein, 5 aa, Giardia lamblia
KAGWI

SEQ ID NO: 3116521 - protein, 9 aa, Giardia lamblia
KAGYGQADR

SEQ ID NO: 3116522 - protein, 7 aa, Giardia lamblia
KAHADQL

SEQ ID NO: 3116523 - protein, 10 aa, Giardia lamblia
KAHANGAVGG

SEQ ID NO: 3116524 - protein, 7 aa, Giardia lamblia
KAHEATG

SEQ ID NO: 3116525 - protein, 8 aa, Giardia lamblia
KAHELGEG

SEQ ID NO: 3116526 - protein, 6 aa, Giardia lamblia
KAHGAA

SEQ ID NO: 3116527 - protein, 8 aa, Giardia lamblia
KAHNGLPE

SEQ ID NO: 3116528 - protein, 6 aa, Giardia lamblia
KAHPPA

SEQ ID NO: 3116529 - protein, 4 aa, Giardia lamblia
KAHS

SEQ ID NO: 3116530 - protein, 6 aa, Giardia lamblia
KAHTDA

SEQ ID NO: 3116531 - protein, 6 aa, Giardia lamblia
KAIENN

SEQ ID NO: 3116532 - protein, 8 aa, Giardia lamblia
KAIGGTPE

SEQ ID NO: 3116533 - protein, 8 aa, Giardia lamblia
KAIGSKSH

SEQ ID NO: 3116534 - protein, 8 aa, Giardia lamblia
KAIGTNNH

SEQ ID NO: 3116535 - protein, 5 aa, Giardia lamblia
KAIPG

SEQ ID NO: 3116536 - protein, 6 aa, Giardia lamblia
KAIQTE

SEQ ID NO: 3116537 - protein, 9 aa, Giardia lamblia
KAISGGNAA

SEQ ID NO: 3116538 - protein, 17 aa, Giardia lamblia
KAISQQDLDSSRTEPFR

SEQ ID NO: 3116539 - protein, 5 aa, Giardia lamblia
KAITA

SEQ ID NO: 3116540 - protein, 5 aa, Giardia lamblia
KAITH

SEQ ID NO: 3116541 - protein, 6 aa, Giardia lamblia
KAKDET

SEQ ID NO: 3116542 - protein, 7 aa, Giardia lamblia
KAKDSYS

SEQ ID NO: 3116543 - protein, 10 aa, Giardia lamblia
KAKDTNMELP

SEQ ID NO: 3116544 - protein, 6 aa, Giardia lamblia
KAKEAL

SEQ ID NO: 3116545 - protein, 5 aa, Giardia lamblia
KAKEI

SEQ ID NO: 3116546 - protein, 34 aa, Giardia lamblia
KAKELADHRSTSSDQSDKDSRHSTAKKNSSYYPS

SEQ ID NO: 3116547 - protein, 29 aa, Giardia lamblia
KAKERAERARKKEREMARSNRTKRDPGIP

SEQ ID NO: 3116548 - protein, 8 aa, Giardia lamblia
KAKKPISF

SEQ ID NO: 3116549 - protein, 9 aa, Giardia lamblia
KAKLGESKE

SEQ ID NO: 3116550 - protein, 8 aa, Giardia lamblia
KAKNEISI

SEQ ID NO: 3116551 - protein, 13 aa, Giardia lamblia
KAKNTGKEASSLE

SEQ ID NO: 3116552 - protein, 6 aa, Giardia lamblia
KAKQSR

SEQ ID NO: 3116553 - protein, 8 aa, Giardia lamblia
KAKQSTEY

SEQ ID NO: 3116554 - protein, 16 aa, Giardia lamblia
KAKRVAHSQLDSDEFS

SEQ ID NO: 3116555 - protein, 8 aa, Giardia lamblia
KAKSEPMK

SEQ ID NO: 3116556 - protein, 10 aa, Giardia lamblia
KAKSPTDELS

SEQ ID NO: 3116557 - protein, 9 aa, Giardia lamblia
KAKSSELAT

SEQ ID NO: 3116558 - protein, 8 aa, Giardia lamblia
KAKSSITA

SEQ ID NO: 3116559 - protein, 26 aa, Giardia lamblia
KAKSSPQKASSAESSEDSNAFQSFPE

SEQ ID NO: 3116560 - protein, 8 aa, Giardia lamblia
KAKTTKKQ

SEQ ID NO: 3116561 - protein, 8 aa, Giardia lamblia
KALDSGVP

SEQ ID NO: 3116562 - protein, 8 aa, Giardia lamblia
KALEEKQR

SEQ ID NO: 3116563 - protein, 16 aa, Giardia lamblia
KALEETQDAIQETQRN

SEQ ID NO: 3116564 - protein, 7 aa, Giardia lamblia
KALENEL

SEQ ID NO: 3116565 - protein, 5 aa, Giardia lamblia
KALET

SEQ ID NO: 3116566 - protein, 12 aa, Giardia lamblia
KALETGKSIPDH

SEQ ID NO: 3116567 - protein, 4 aa, Giardia lamblia
KALG

SEQ ID NO: 3116568 - protein, 12 aa, Giardia lamblia
KALGQKPNQIPD

SEQ ID NO: 3116569 - protein, 10 aa, Giardia lamblia
KALKGGSEES

SEQ ID NO: 3116570 - protein, 8 aa, Giardia lamblia
KALKGSVD

SEQ ID NO: 3116571 - protein, 7 aa, Giardia lamblia
KALNGDR

SEQ ID NO: 3116572 - protein, 7 aa, Giardia lamblia
KALNKGK

SEQ ID NO: 3116573 - protein, 10 aa, Giardia lamblia
KALQDSSGRT

SEQ ID NO: 3116574 - protein, 8 aa, Giardia lamblia
KALQNSNG

SEQ ID NO: 3116575 - protein, 4 aa, Giardia lamblia
KALS

SEQ ID NO: 3116576 - protein, 19 aa, Giardia lamblia
KALSANKATRNPVKAAPNL

SEQ ID NO: 3116577 - protein, 13 aa, Giardia lamblia
KALSGSKARLGAS

SEQ ID NO: 3116578 - protein, 7 aa, Giardia lamblia
KALSVPK

SEQ ID NO: 3116579 - protein, 8 aa, Giardia lamblia
KALTGPYE

SEQ ID NO: 3116580 - protein, 8 aa, Giardia lamblia
KAMESEPK

SEQ ID NO: 3116581 - protein, 8 aa, Giardia lamblia
KAMHQQDT

SEQ ID NO: 3116582 - protein, 9 aa, Giardia lamblia
KAMRRNTSW

SEQ ID NO: 3116583 - protein, 13 aa, Giardia lamblia
KAMSPELLSKIRP

SEQ ID NO: 3116584 - protein, 10 aa, Giardia lamblia
KAMTTYPTED

SEQ ID NO: 3116585 - protein, 18 aa, Giardia lamblia
KANAERKEMRARARTENA

SEQ ID NO: 3116586 - protein, 11 aa, Giardia lamblia
KANATKRQSQV

SEQ ID NO: 3116587 - protein, 8 aa, Giardia lamblia
KANDDQKA

SEQ ID NO: 3116588 - protein, 9 aa, Giardia lamblia
KANDTRSNV

SEQ ID NO: 3116589 - protein, 8 aa, Giardia lamblia
KANEEELK

SEQ ID NO: 3116590 - protein, 7 aa, Giardia lamblia
KANEHPT

SEQ ID NO: 3116591 - protein, 7 aa, Giardia lamblia
KANESVH

SEQ ID NO: 3116592 - protein, 16 aa, Giardia lamblia
KANINGSLSGTQGSRH

SEQ ID NO: 3116593 - protein, 9 aa, Giardia lamblia
KANKTSPLT

SEQ ID NO: 3116594 - protein, 5 aa, Giardia lamblia
KANLT

SEQ ID NO: 3116595 - protein, 5 aa, Giardia lamblia
KANNG

SEQ ID NO: 3116596 - protein, 5 aa, Giardia lamblia
KANNK

SEQ ID NO: 3116597 - protein, 7 aa, Giardia lamblia
KANPAND

SEQ ID NO: 3116598 - protein, 5 aa, Giardia lamblia
KANPT

SEQ ID NO: 3116599 - protein, 8 aa, Giardia lamblia
KANSTANI

SEQ ID NO: 3116600 - protein, 10 aa, Giardia lamblia
KANTRQYTKT

SEQ ID NO: 3116601 - protein, 7 aa, Giardia lamblia
KANTTLG

SEQ ID NO: 3116602 - protein, 5 aa, Giardia lamblia
KAPAE

SEQ ID NO: 3116603 - protein, 8 aa, Giardia lamblia
KAPAPRPL

SEQ ID NO: 3116604 - protein, 18 aa, Giardia lamblia
KAPASKVDTSIERSMPTR

SEQ ID NO: 3116605 - protein, 25 aa, Giardia lamblia
KAPATSVVDQSSSALQQSGPQSARI

SEQ ID NO: 3116606 - protein, 12 aa, Giardia lamblia
KAPDEEGDTQVN

SEQ ID NO: 3116607 - protein, 6 aa, Giardia lamblia
KAPEAI

SEQ ID NO: 3116608 - protein, 13 aa, Giardia lamblia
KAPEEAKPSTNIY

SEQ ID NO: 3116609 - protein, 7 aa, Giardia lamblia
KAPELSK

SEQ ID NO: 3116610 - protein, 13 aa, Giardia lamblia
KAPETAVTDKTHE

SEQ ID NO: 3116611 - protein, 6 aa, Giardia lamblia
KAPHVR

SEQ ID NO: 3116612 - protein, 23 aa, Giardia lamblia
KAPKQSTGAQAPTCTQPLKPSVS

SEQ ID NO: 3116613 - protein, 4 aa, Giardia lamblia
KAPL

SEQ ID NO: 3116614 - protein, 7 aa, Giardia lamblia
KAPLPPD

SEQ ID NO: 3116615 - protein, 10 aa, Giardia lamblia
KAPLSDPYKK

SEQ ID NO: 3116616 - protein, 8 aa, Giardia lamblia
KAPLTDPA

SEQ ID NO: 3116617 - protein, 4 aa, Giardia lamblia
KAPM

SEQ ID NO: 3116618 - protein, 17 aa, Giardia lamblia
KAPNDSPFSLDETGQDI

SEQ ID NO: 3116619 - protein, 21 aa, Giardia lamblia
KAPNEDKKESKNSHETEPDDA

SEQ ID NO: 3116620 - protein, 7 aa, Giardia lamblia
KAPNGEL

SEQ ID NO: 3116621 - protein, 21 aa, Giardia lamblia
KAPNNDDESCTREDAHKSIAT

SEQ ID NO: 3116622 - protein, 5 aa, Giardia lamblia
KAPNW

SEQ ID NO: 3116623 - protein, 9 aa, Giardia lamblia
KAPPEYQPP

SEQ ID NO: 3116624 - protein, 30 aa, Giardia lamblia
KAPPPRPNTTPAGARLQKQTQKKVDERDQL

SEQ ID NO: 3116625 - protein, 7 aa, Giardia lamblia
KAPPRKW

SEQ ID NO: 3116626 - protein, 6 aa, Giardia lamblia
KAPQIN

SEQ ID NO: 3116627 - protein, 7 aa, Giardia lamblia
KAPQISK

SEQ ID NO: 3116628 - protein, 8 aa, Giardia lamblia
KAPQQDVH

SEQ ID NO: 3116629 - protein, 6 aa, Giardia lamblia
KAPQTY

SEQ ID NO: 3116630 - protein, 29 aa, Giardia lamblia
KAPRDPSKKPRWTPEQRSARAATSGNAGR

SEQ ID NO: 3116631 - protein, 7 aa, Giardia lamblia
KAPSAAV

SEQ ID NO: 3116632 - protein, 11 aa, Giardia lamblia
KAPSDDAYGVA

SEQ ID NO: 3116633 - protein, 6 aa, Giardia lamblia
KAPSLR

SEQ ID NO: 3116634 - protein, 7 aa, Giardia lamblia
KAPSPSL

SEQ ID NO: 3116635 - protein, 14 aa, Giardia lamblia
KAPSPSRGRQYTPL

SEQ ID NO: 3116636 - protein, 6 aa, Giardia lamblia
KAPSSI

SEQ ID NO: 3116637 - protein, 7 aa, Giardia lamblia
KAPTPDI

SEQ ID NO: 3116638 - protein, 9 aa, Giardia lamblia
KAPTQPPKF

SEQ ID NO: 3116639 - protein, 36 aa, Giardia lamblia
KAQAAQPDQQDGHASEFDASEQSLSVADTAASRLPL

SEQ ID NO: 3116640 - protein, 8 aa, Giardia lamblia
KAQASQLK

SEQ ID NO: 3116641 - protein, 8 aa, Giardia lamblia
KAQDGTKA

SEQ ID NO: 3116642 - protein, 8 aa, Giardia lamblia
KAQDSIGR

SEQ ID NO: 3116643 - protein, 12 aa, Giardia lamblia
KAQDTNNPRAGQ

SEQ ID NO: 3116644 - protein, 8 aa, Giardia lamblia
KAQECEGK

SEQ ID NO: 3116645 - protein, 8 aa, Giardia lamblia
KAQEGVET

SEQ ID NO: 3116646 - protein, 6 aa, Giardia lamblia
KAQGEK

SEQ ID NO: 3116647 - protein, 15 aa, Giardia lamblia
KAQKDAKQVKEVKTR

SEQ ID NO: 3116648 - protein, 10 aa, Giardia lamblia
KAQKTVGRVE

SEQ ID NO: 3116649 - protein, 10 aa, Giardia lamblia
KAQLDEKNAN

SEQ ID NO: 3116650 - protein, 19 aa, Giardia lamblia
KAQLSNEDTSGVKADVPEA

SEQ ID NO: 3116651 - protein, 49 aa, Giardia lamblia
KAQNAELSARRGSSITPALPPLGSTGSVQPGQPSQSQRSQRGSMFQRQK

SEQ ID NO: 3116652 - protein, 8 aa, Giardia lamblia
KAQNANCD

SEQ ID NO: 3116653 - protein, 9 aa, Giardia lamblia
KAQNGKSIE

SEQ ID NO: 3116654 - protein, 52 aa, Giardia lamblia
KAQQSKPKSNAKSRQTGEHGAASGSPAGNTLSEKSSVKKKKTPQASPGKGSV

SEQ ID NO: 3116655 - protein, 4 aa, Giardia lamblia
KAQS

SEQ ID NO: 3116656 - protein, 7 aa, Giardia lamblia
KAQSAQL

SEQ ID NO: 3116657 - protein, 18 aa, Giardia lamblia
KAQSCAARKYNEEGHDSV

SEQ ID NO: 3116658 - protein, 11 aa, Giardia lamblia
KAQSSVPSRIP

SEQ ID NO: 3116659 - protein, 6 aa, Giardia lamblia
KAQTSF

SEQ ID NO: 3116660 - protein, 8 aa, Giardia lamblia
KAQYPDGS

SEQ ID NO: 3116661 - protein, 4 aa, Giardia lamblia
KARA

SEQ ID NO: 3116662 - protein, 9 aa, Giardia lamblia
KARAKRDEL

SEQ ID NO: 3116663 - protein, 6 aa, Giardia lamblia
KARDAY

SEQ ID NO: 3116664 - protein, 9 aa, Giardia lamblia
KARDEARAA

SEQ ID NO: 3116665 - protein, 4 aa, Giardia lamblia
KARE

SEQ ID NO: 3116666 - protein, 22 aa, Giardia lamblia
KAREAELSLDGKDSYLTSPEAV

SEQ ID NO: 3116667 - protein, 7 aa, Giardia lamblia
KAREDLR

SEQ ID NO: 3116668 - protein, 9 aa, Giardia lamblia
KAREEDLRN

SEQ ID NO: 3116669 - protein, 7 aa, Giardia lamblia
KAREELE

SEQ ID NO: 3116670 - protein, 42 aa, Giardia lamblia
KAREGENAPHSQKDEEDSTNTIDTKSYRRVRREDKEREQPDH

SEQ ID NO: 3116671 - protein, 7 aa, Giardia lamblia
KAREGSL

SEQ ID NO: 3116672 - protein, 7 aa, Giardia lamblia
KAREQVA

SEQ ID NO: 3116673 - protein, 8 aa, Giardia lamblia
KARERETI

SEQ ID NO: 3116674 - protein, 8 aa, Giardia lamblia
KARERLKE

SEQ ID NO: 3116675 - protein, 6 aa, Giardia lamblia
KARERQ

SEQ ID NO: 3116676 - protein, 5 aa, Giardia lamblia
KAREV

SEQ ID NO: 3116677 - protein, 8 aa, Giardia lamblia
KARGPRVT

SEQ ID NO: 3116678 - protein, 16 aa, Giardia lamblia
KARKSVTMPPKADLPL

SEQ ID NO: 3116679 - protein, 15 aa, Giardia lamblia
KARLNQEGRRDGRIN

SEQ ID NO: 3116680 - protein, 7 aa, Giardia lamblia
KARLSER

SEQ ID NO: 3116681 - protein, 7 aa, Giardia lamblia
KARNRKF

SEQ ID NO: 3116682 - protein, 10 aa, Giardia lamblia
KARPAAEARD

SEQ ID NO: 3116683 - protein, 7 aa, Giardia lamblia
KARPGYT

SEQ ID NO: 3116684 - protein, 6 aa, Giardia lamblia
KARQEK

SEQ ID NO: 3116685 - protein, 10 aa, Giardia lamblia
KARQGDDLDS

SEQ ID NO: 3116686 - protein, 9 aa, Giardia lamblia
KARQLTDSE

SEQ ID NO: 3116687 - protein, 54 aa, Giardia lamblia
KARSASCTGRDENHHSGHRRPAKQHLSRSASSDREPRRVRKSGTPRSLHPSPEL

SEQ ID NO: 3116688 - protein, 7 aa, Giardia lamblia
KARTARQ

SEQ ID NO: 3116689 - protein, 15 aa, Giardia lamblia
KARTTRRKNKQPPPP

SEQ ID NO: 3116690 - protein, 13 aa, Giardia lamblia
KASAGSPLSQAVS

SEQ ID NO: 3116691 - protein, 9 aa, Giardia lamblia
KASAKSVYT

SEQ ID NO: 3116692 - protein, 9 aa, Giardia lamblia
KASATNRGK

SEQ ID NO: 3116693 - protein, 14 aa, Giardia lamblia
KASAVLSASTAAYY

SEQ ID NO: 3116694 - protein, 7 aa, Giardia lamblia
KASAYRG

SEQ ID NO: 3116695 - protein, 6 aa, Giardia lamblia
KASDCE

SEQ ID NO: 3116696 - protein, 7 aa, Giardia lamblia
KASDIEA

SEQ ID NO: 3116697 - protein, 7 aa, Giardia lamblia
KASDNSI

SEQ ID NO: 3116698 - protein, 13 aa, Giardia lamblia
KASDSLTAKRRVK

SEQ ID NO: 3116699 - protein, 7 aa, Giardia lamblia
KASDSSR

SEQ ID NO: 3116700 - protein, 7 aa, Giardia lamblia
KASEASG

SEQ ID NO: 3116701 - protein, 21 aa, Giardia lamblia
KASEPPSLPPPPSSDDTLPDG

SEQ ID NO: 3116702 - protein, 8 aa, Giardia lamblia
KASESKTA

SEQ ID NO: 3116703 - protein, 4 aa, Giardia lamblia
KASG

SEQ ID NO: 3116704 - protein, 27 aa, Giardia lamblia
KASGEQSGPQKAPPRQKQVAPPAIPKQ

SEQ ID NO: 3116705 - protein, 15 aa, Giardia lamblia
KASGKALRANSKTRS

SEQ ID NO: 3116706 - protein, 7 aa, Giardia lamblia
KASGPGY

SEQ ID NO: 3116707 - protein, 13 aa, Giardia lamblia
KASGRGPDPNLDE

SEQ ID NO: 3116708 - protein, 13 aa, Giardia lamblia
KASGTSRNGVAPQ

SEQ ID NO: 3116709 - protein, 9 aa, Giardia lamblia
KASHGDRSV

SEQ ID NO: 3116710 - protein, 5 aa, Giardia lamblia
KASKD

SEQ ID NO: 3116711 - protein, 7 aa, Giardia lamblia
KASKDQA

SEQ ID NO: 3116712 - protein, 6 aa, Giardia lamblia
KASKTV

SEQ ID NO: 3116713 - protein, 9 aa, Giardia lamblia
KASLDPDGT

SEQ ID NO: 3116714 - protein, 5 aa, Giardia lamblia
KASNA

SEQ ID NO: 3116715 - protein, 10 aa, Giardia lamblia
KASNEVDSRN

SEQ ID NO: 3116716 - protein, 9 aa, Giardia lamblia
KASNKSSVQ

SEQ ID NO: 3116717 - protein, 12 aa, Giardia lamblia
KASPHVTNPEGM

SEQ ID NO: 3116718 - protein, 14 aa, Giardia lamblia
KASPPPADNTNEYE

SEQ ID NO: 3116719 - protein, 9 aa, Giardia lamblia
KASQAAAEA

SEQ ID NO: 3116720 - protein, 15 aa, Giardia lamblia
KASQETPNTIEPSDV

SEQ ID NO: 3116721 - protein, 16 aa, Giardia lamblia
KASRKGAGAETESPPC

SEQ ID NO: 3116722 - protein, 15 aa, Giardia lamblia
KASRTSKCSDTSSSR

SEQ ID NO: 3116723 - protein, 7 aa, Giardia lamblia
KASSAED

SEQ ID NO: 3116724 - protein, 10 aa, Giardia lamblia
KASSPNNSGS

SEQ ID NO: 3116725 - protein, 8 aa, Giardia lamblia
KASSQQQL

SEQ ID NO: 3116726 - protein, 9 aa, Giardia lamblia
KASSTENSS

SEQ ID NO: 3116727 - protein, 9 aa, Giardia lamblia
KASSTSSDT

SEQ ID NO: 3116728 - protein, 6 aa, Giardia lamblia
KASTAD

SEQ ID NO: 3116729 - protein, 10 aa, Giardia lamblia
KASTDPETDD

SEQ ID NO: 3116730 - protein, 8 aa, Giardia lamblia
KASTKRIG

SEQ ID NO: 3116731 - protein, 5 aa, Giardia lamblia
KASYS

SEQ ID NO: 3116732 - protein, 13 aa, Giardia lamblia
KATAAEGRATTEG

SEQ ID NO: 3116733 - protein, 8 aa, Giardia lamblia
KATAAGTT

SEQ ID NO: 3116734 - protein, 9 aa, Giardia lamblia
KATAGTAPL

SEQ ID NO: 3116735 - protein, 6 aa, Giardia lamblia
KATDFS

SEQ ID NO: 3116736 - protein, 8 aa, Giardia lamblia
KATEDYAK

SEQ ID NO: 3116737 - protein, 9 aa, Giardia lamblia
KATEEGTDM

SEQ ID NO: 3116738 - protein, 8 aa, Giardia lamblia
KATEERQW

SEQ ID NO: 3116739 - protein, 7 aa, Giardia lamblia
KATEESL

SEQ ID NO: 3116740 - protein, 8 aa, Giardia lamblia
KATEESPI

SEQ ID NO: 3116741 - protein, 6 aa, Giardia lamblia
KATEET

SEQ ID NO: 3116742 - protein, 7 aa, Giardia lamblia
KATESDI

SEQ ID NO: 3116743 - protein, 8 aa, Giardia lamblia
KATGEGFE

SEQ ID NO: 3116744 - protein, 13 aa, Giardia lamblia
KATHTTQTAKSTF

SEQ ID NO: 3116745 - protein, 9 aa, Giardia lamblia
KATKEENAK

SEQ ID NO: 3116746 - protein, 8 aa, Giardia lamblia
KATKLNEN

SEQ ID NO: 3116747 - protein, 7 aa, Giardia lamblia
KATNIKH

SEQ ID NO: 3116748 - protein, 7 aa, Giardia lamblia
KATNLSV

SEQ ID NO: 3116749 - protein, 16 aa, Giardia lamblia
KATNTEDKDDTMQGYQ

SEQ ID NO: 3116750 - protein, 6 aa, Giardia lamblia
KATPCS

SEQ ID NO: 3116751 - protein, 18 aa, Giardia lamblia
KATPEATQINDDTPKYFA

SEQ ID NO: 3116752 - protein, 29 aa, Giardia lamblia
KATPSGHKERPNKSDKRKNSFKASHAKRL

SEQ ID NO: 3116753 - protein, 8 aa, Giardia lamblia
KATPSVPI

SEQ ID NO: 3116754 - protein, 6 aa, Giardia lamblia
KATQDI

SEQ ID NO: 3116755 - protein, 12 aa, Giardia lamblia
KATRFPKDYRED

SEQ ID NO: 3116756 - protein, 8 aa, Giardia lamblia
KATRGRRN

SEQ ID NO: 3116757 - protein, 9 aa, Giardia lamblia
KATSEVESL

SEQ ID NO: 3116758 - protein, 7 aa, Giardia lamblia
KATSPEV

SEQ ID NO: 3116759 - protein, 11 aa, Giardia lamblia
KATTRSKTPTV

SEQ ID NO: 3116760 - protein, 11 aa, Giardia lamblia
KATTVKPSQIE

SEQ ID NO: 3116761 - protein, 7 aa, Giardia lamblia
KATVDKF

SEQ ID NO: 3116762 - protein, 5 aa, Giardia lamblia
KATYE

SEQ ID NO: 3116763 - protein, 7 aa, Giardia lamblia
KATYKPR

SEQ ID NO: 3116764 - protein, 5 aa, Giardia lamblia
KATYS

SEQ ID NO: 3116765 - protein, 13 aa, Giardia lamblia
KATYSVTRSRTSK

SEQ ID NO: 3116766 - protein, 8 aa, Giardia lamblia
KAVDRDKV

SEQ ID NO: 3116767 - protein, 7 aa, Giardia lamblia
KAVERGE

SEQ ID NO: 3116768 - protein, 6 aa, Giardia lamblia
KAVGEK

SEQ ID NO: 3116769 - protein, 6 aa, Giardia lamblia
KAVGPV

SEQ ID NO: 3116770 - protein, 6 aa, Giardia lamblia
KAVKSS

SEQ ID NO: 3116771 - protein, 7 aa, Giardia lamblia
KAVNRAR

SEQ ID NO: 3116772 - protein, 6 aa, Giardia lamblia
KAVPKG

SEQ ID NO: 3116773 - protein, 8 aa, Giardia lamblia
KAVPTPAP

SEQ ID NO: 3116774 - protein, 10 aa, Giardia lamblia
KAVQAIPSDA

SEQ ID NO: 3116775 - protein, 16 aa, Giardia lamblia
KAVQEPSGEGTKDYSS

SEQ ID NO: 3116776 - protein, 12 aa, Giardia lamblia
KAVRQQQQDLRS

SEQ ID NO: 3116777 - protein, 43 aa, Giardia lamblia
KAVSRSESTSVSKDPERESSDNSEEQESKGIGRSKSEKFGTDI

SEQ ID NO: 3116778 - protein, 5 aa, Giardia lamblia
KAVTR

SEQ ID NO: 3116779 - protein, 9 aa, Giardia lamblia
KAVTSRSPT

SEQ ID NO: 3116780 - protein, 11 aa, Giardia lamblia
KAWDSKKELQD

SEQ ID NO: 3116781 - protein, 7 aa, Giardia lamblia
KAYDGLD

SEQ ID NO: 3116782 - protein, 16 aa, Giardia lamblia
KAYDRDDPADDDPNKN

SEQ ID NO: 3116783 - protein, 6 aa, Giardia lamblia
KAYGSI

SEQ ID NO: 3116784 - protein, 7 aa, Giardia lamblia
KAYNPSV

SEQ ID NO: 3116785 - protein, 7 aa, Giardia lamblia
KAYPPEA

SEQ ID NO: 3116786 - protein, 6 aa, Giardia lamblia
KAYSTA

SEQ ID NO: 3116787 - protein, 14 aa, Giardia lamblia
KCDDGDDDKAAVRA

SEQ ID NO: 3116788 - protein, 14 aa, Giardia lamblia
KCDEERRPKPYRSA

SEQ ID NO: 3116789 - protein, 4 aa, Giardia lamblia
KCEN

SEQ ID NO: 3116790 - protein, 4 aa, Giardia lamblia
KCET

SEQ ID NO: 3116791 - protein, 37 aa, Giardia lamblia
KCGQGTQVRANGETYSGHYNGDKRAGRGTCRYPDGSV

SEQ ID NO: 3116792 - protein, 9 aa, Giardia lamblia
KCGSDQPQY

SEQ ID NO: 3116793 - protein, 11 aa, Giardia lamblia
KCNATRTTGEM

SEQ ID NO: 3116794 - protein, 6 aa, Giardia lamblia
KCNPRL

SEQ ID NO: 3116795 - protein, 6 aa, Giardia lamblia
KCPENV

SEQ ID NO: 3116796 - protein, 4 aa, Giardia lamblia
KCPK

SEQ ID NO: 3116797 - protein, 6 aa, Giardia lamblia
KCSASS

SEQ ID NO: 3116798 - protein, 4 aa, Giardia lamblia
KCSE

SEQ ID NO: 3116799 - protein, 6 aa, Giardia lamblia
KCSPES

SEQ ID NO: 3116800 - protein, 10 aa, Giardia lamblia
KCSQENERLS

SEQ ID NO: 3116801 - protein, 6 aa, Giardia lamblia
KCSTED

SEQ ID NO: 3116802 - protein, 6 aa, Giardia lamblia
KCSTNI

SEQ ID NO: 3116803 - protein, 6 aa, Giardia lamblia
KCTAAL

SEQ ID NO: 3116804 - protein, 10 aa, Giardia lamblia
KCTAGEREKV

SEQ ID NO: 3116805 - protein, 13 aa, Giardia lamblia
KCTPDTSSLAQET

SEQ ID NO: 3116806 - protein, 7 aa, Giardia lamblia
KCVTDGQ

SEQ ID NO: 3116807 - protein, 5 aa, Giardia lamblia
KCYTN

SEQ ID NO: 3116808 - protein, 8 aa, Giardia lamblia
KDAAANDH

SEQ ID NO: 3116809 - protein, 12 aa, Giardia lamblia
KDAARKQNKSVS

SEQ ID NO: 3116810 - protein, 8 aa, Giardia lamblia
KDAAYSQA

SEQ ID NO: 3116811 - protein, 13 aa, Giardia lamblia
KDACAADIDIVES

SEQ ID NO: 3116812 - protein, 7 aa, Giardia lamblia
KDADAVK

SEQ ID NO: 3116813 - protein, 8 aa, Giardia lamblia
KDADGRVT

SEQ ID NO: 3116814 - protein, 16 aa, Giardia lamblia
KDADTRVRDLESENER

SEQ ID NO: 3116815 - protein, 4 aa, Giardia lamblia
KDAE

SEQ ID NO: 3116816 - protein, 7 aa, Giardia lamblia
KDAEACG

SEQ ID NO: 3116817 - protein, 5 aa, Giardia lamblia
KDAEI

SEQ ID NO: 3116818 - protein, 6 aa, Giardia lamblia
KDAEIE

SEQ ID NO: 3116819 - protein, 6 aa, Giardia lamblia
KDAEIS

SEQ ID NO: 3116820 - protein, 8 aa, Giardia lamblia
KDAEISNL

SEQ ID NO: 3116821 - protein, 5 aa, Giardia lamblia
KDAEL

SEQ ID NO: 3116822 - protein, 6 aa, Giardia lamblia
KDAELE

SEQ ID NO: 3116823 - protein, 14 aa, Giardia lamblia
KDAELGELRDESEA

SEQ ID NO: 3116824 - protein, 7 aa, Giardia lamblia
KDAELKK

SEQ ID NO: 3116825 - protein, 21 aa, Giardia lamblia
KDAELSKQREQVETAEKERSL

SEQ ID NO: 3116826 - protein, 9 aa, Giardia lamblia
KDAELSKQT

SEQ ID NO: 3116827 - protein, 19 aa, Giardia lamblia
KDAEQRQREETLAAENQQR

SEQ ID NO: 3116828 - protein, 7 aa, Giardia lamblia
KDAESQT

SEQ ID NO: 3116829 - protein, 8 aa, Giardia lamblia
KDAGEDRV

SEQ ID NO: 3116830 - protein, 12 aa, Giardia lamblia
KDAGSPNSNSNA

SEQ ID NO: 3116831 - protein, 10 aa, Giardia lamblia
KDAIEAGEVS

SEQ ID NO: 3116832 - protein, 10 aa, Giardia lamblia
KDAISNKEEL

SEQ ID NO: 3116833 - protein, 6 aa, Giardia lamblia
KDAKDF

SEQ ID NO: 3116834 - protein, 7 aa, Giardia lamblia
KDAKQIK

SEQ ID NO: 3116835 - protein, 7 aa, Giardia lamblia
KDAKSEV

SEQ ID NO: 3116836 - protein, 6 aa, Giardia lamblia
KDAMEE

SEQ ID NO: 3116837 - protein, 8 aa, Giardia lamblia
KDANESQA

SEQ ID NO: 3116838 - protein, 7 aa, Giardia lamblia
KDAQQAA

SEQ ID NO: 3116839 - protein, 30 aa, Giardia lamblia
KDAQRTGKADSDNVEADDKEDSIDSDEIDD

SEQ ID NO: 3116840 - protein, 7 aa, Giardia lamblia
KDARESE

SEQ ID NO: 3116841 - protein, 17 aa, Giardia lamblia
KDASAALKQSIRRLMTR

SEQ ID NO: 3116842 - protein, 5 aa, Giardia lamblia
KDASC

SEQ ID NO: 3116843 - protein, 28 aa, Giardia lamblia
KDASEEGAGNPTESPQTDDEGSVDEDGV

SEQ ID NO: 3116844 - protein, 28 aa, Giardia lamblia
KDASEEGAGNPTESSQTDDEGSVDEDGV

SEQ ID NO: 3116845 - protein, 10 aa, Giardia lamblia
KDASIKANRT

SEQ ID NO: 3116846 - protein, 13 aa, Giardia lamblia
KDASLNADSPVAV

SEQ ID NO: 3116847 - protein, 8 aa, Giardia lamblia
KDASPEAV

SEQ ID NO: 3116848 - protein, 10 aa, Giardia lamblia
KDASQSSTCS

SEQ ID NO: 3116849 - protein, 7 aa, Giardia lamblia
KDASTQK

SEQ ID NO: 3116850 - protein, 6 aa, Giardia lamblia
KDATYD

SEQ ID NO: 3116851 - protein, 5 aa, Giardia lamblia
KDAVD

SEQ ID NO: 3116852 - protein, 5 aa, Giardia lamblia
KDAYS

SEQ ID NO: 3116853 - protein, 5 aa, Giardia lamblia
KDCEE

SEQ ID NO: 3116854 - protein, 5 aa, Giardia lamblia
KDCGT

SEQ ID NO: 3116855 - protein, 13 aa, Giardia lamblia
KDCNKDTAFTAAE

SEQ ID NO: 3116856 - protein, 9 aa, Giardia lamblia
KDCRPSEKN

SEQ ID NO: 3116857 - protein, 14 aa, Giardia lamblia
KDCVSSQNKTAADY

SEQ ID NO: 3116858 - protein, 10 aa, Giardia lamblia
KDDDETVSQS

SEQ ID NO: 3116859 - protein, 5 aa, Giardia lamblia
KDDEI

SEQ ID NO: 3116860 - protein, 8 aa, Giardia lamblia
KDDEISQL

SEQ ID NO: 3116861 - protein, 7 aa, Giardia lamblia
KDDEISR

SEQ ID NO: 3116862 - protein, 18 aa, Giardia lamblia
KDDFETKALQKTKPELTW

SEQ ID NO: 3116863 - protein, 15 aa, Giardia lamblia
KDDFKESNNEERESP

SEQ ID NO: 3116864 - protein, 6 aa, Giardia lamblia
KDDGTT

SEQ ID NO: 3116865 - protein, 4 aa, Giardia lamblia
KDDM

SEQ ID NO: 3116866 - protein, 8 aa, Giardia lamblia
KDDNGSEY

SEQ ID NO: 3116867 - protein, 8 aa, Giardia lamblia
KDDPTLDD

SEQ ID NO: 3116868 - protein, 12 aa, Giardia lamblia
KDDQDGLLGLLG

SEQ ID NO: 3116869 - protein, 8 aa, Giardia lamblia
KDDQISEL

SEQ ID NO: 3116870 - protein, 8 aa, Giardia lamblia
KDDSDFQA

SEQ ID NO: 3116871 - protein, 7 aa, Giardia lamblia
KDDSRLN

SEQ ID NO: 3116872 - protein, 19 aa, Giardia lamblia
KDDSSPTRSSFEGHSSDDQ

SEQ ID NO: 3116873 - protein, 10 aa, Giardia lamblia
KDDTTTGEKM

SEQ ID NO: 3116874 - protein, 6 aa, Giardia lamblia
KDDVDT

SEQ ID NO: 3116875 - protein, 7 aa, Giardia lamblia
KDDVGRL

SEQ ID NO: 3116876 - protein, 14 aa, Giardia lamblia
KDEAAAKVSSVDSL

SEQ ID NO: 3116877 - protein, 9 aa, Giardia lamblia
KDEAARSEL

SEQ ID NO: 3116878 - protein, 11 aa, Giardia lamblia
KDEANEGYEQI

SEQ ID NO: 3116879 - protein, 10 aa, Giardia lamblia
KDEANTLPAK

SEQ ID NO: 3116880 - protein, 5 aa, Giardia lamblia
KDEDI

SEQ ID NO: 3116881 - protein, 9 aa, Giardia lamblia
KDEDSRVTA

SEQ ID NO: 3116882 - protein, 6 aa, Giardia lamblia
KDEDVD

SEQ ID NO: 3116883 - protein, 15 aa, Giardia lamblia
KDEEDARANPRMPKP

SEQ ID NO: 3116884 - protein, 8 aa, Giardia lamblia
KDEEGNEK

SEQ ID NO: 3116885 - protein, 9 aa, Giardia lamblia
KDEEGVDRG

SEQ ID NO: 3116886 - protein, 5 aa, Giardia lamblia
KDEEI

SEQ ID NO: 3116887 - protein, 7 aa, Giardia lamblia
KDEEITT

SEQ ID NO: 3116888 - protein, 6 aa, Giardia lamblia
KDEELA

SEQ ID NO: 3116889 - protein, 6 aa, Giardia lamblia
KDEGLT

SEQ ID NO: 3116890 - protein, 6 aa, Giardia lamblia
KDEGNI

SEQ ID NO: 3116891 - protein, 8 aa, Giardia lamblia
KDEGRLQD

SEQ ID NO: 3116892 - protein, 7 aa, Giardia lamblia
KDEITSL

SEQ ID NO: 3116893 - protein, 11 aa, Giardia lamblia
KDEKEDDLPTG

SEQ ID NO: 3116894 - protein, 10 aa, Giardia lamblia
KDEKGKTYEE

SEQ ID NO: 3116895 - protein, 4 aa, Giardia lamblia
KDEL

SEQ ID NO: 3116896 - protein, 5 aa, Giardia lamblia
KDELD

SEQ ID NO: 3116897 - protein, 13 aa, Giardia lamblia
KDELSKKNEELAR

SEQ ID NO: 3116898 - protein, 8 aa, Giardia lamblia
KDELSQKD

SEQ ID NO: 3116899 - protein, 8 aa, Giardia lamblia
KDENSQYQ

SEQ ID NO: 3116900 - protein, 29 aa, Giardia lamblia
KDENTTEAEKRSSAHGGPQGLDPRRGGTG

SEQ ID NO: 3116901 - protein, 7 aa, Giardia lamblia
KDERGRK

SEQ ID NO: 3116902 - protein, 5 aa, Giardia lamblia
KDERI

SEQ ID NO: 3116903 - protein, 6 aa, Giardia lamblia
KDERND

SEQ ID NO: 3116904 - protein, 10 aa, Giardia lamblia
KDERVTNSKT

SEQ ID NO: 3116905 - protein, 13 aa, Giardia lamblia
KDESKAKDKAIEN

SEQ ID NO: 3116906 - protein, 7 aa, Giardia lamblia
KDESPIF

SEQ ID NO: 3116907 - protein, 21 aa, Giardia lamblia
KDESTKSGAVDPEHRRKSKYS

SEQ ID NO: 3116908 - protein, 10 aa, Giardia lamblia
KDETGTSKHI

SEQ ID NO: 3116909 - protein, 13 aa, Giardia lamblia
KDETYQGPTGTTI

SEQ ID NO: 3116910 - protein, 6 aa, Giardia lamblia
KDEYRA

SEQ ID NO: 3116911 - protein, 7 aa, Giardia lamblia
KDEYRGY

SEQ ID NO: 3116912 - protein, 10 aa, Giardia lamblia
KDFDASSSLT

SEQ ID NO: 3116913 - protein, 10 aa, Giardia lamblia
KDFEDTANKL

SEQ ID NO: 3116914 - protein, 9 aa, Giardia lamblia
KDFNPKGDT

SEQ ID NO: 3116915 - protein, 6 aa, Giardia lamblia
KDFNTA

SEQ ID NO: 3116916 - protein, 5 aa, Giardia lamblia
KDFTT

SEQ ID NO: 3116917 - protein, 13 aa, Giardia lamblia
KDGATAPSVEPSI

SEQ ID NO: 3116918 - protein, 9 aa, Giardia lamblia
KDGATKQAE

SEQ ID NO: 3116919 - protein, 6 aa, Giardia lamblia
KDGELE

SEQ ID NO: 3116920 - protein, 8 aa, Giardia lamblia
KDGEQKSI

SEQ ID NO: 3116921 - protein, 4 aa, Giardia lamblia
KDGH

SEQ ID NO: 3116922 - protein, 18 aa, Giardia lamblia
KDGHNEQSASTGQPSYRI

SEQ ID NO: 3116923 - protein, 4 aa, Giardia lamblia
KDGI

SEQ ID NO: 3116924 - protein, 5 aa, Giardia lamblia
KDGNT

SEQ ID NO: 3116925 - protein, 7 aa, Giardia lamblia
KDGPGGD

SEQ ID NO: 3116926 - protein, 7 aa, Giardia lamblia
KDGPSVQ

SEQ ID NO: 3116927 - protein, 8 aa, Giardia lamblia
KDGQTTRY

SEQ ID NO: 3116928 - protein, 6 aa, Giardia lamblia
KDGRGW

SEQ ID NO: 3116929 - protein, 5 aa, Giardia lamblia
KDGRT

SEQ ID NO: 3116930 - protein, 6 aa, Giardia lamblia
KDGRTA

SEQ ID NO: 3116931 - protein, 5 aa, Giardia lamblia
KDGSI

SEQ ID NO: 3116932 - protein, 6 aa, Giardia lamblia
KDGSTA

SEQ ID NO: 3116933 - protein, 10 aa, Giardia lamblia
KDGSTTAGSP

SEQ ID NO: 3116934 - protein, 7 aa, Giardia lamblia
KDGTTAR

SEQ ID NO: 3116935 - protein, 6 aa, Giardia lamblia
KDGVDG

SEQ ID NO: 3116936 - protein, 5 aa, Giardia lamblia
KDGVE

SEQ ID NO: 3116937 - protein, 4 aa, Giardia lamblia
KDGY

SEQ ID NO: 3116938 - protein, 4 aa, Giardia lamblia
KDHD

SEQ ID NO: 3116939 - protein, 6 aa, Giardia lamblia
KDHDGR

SEQ ID NO: 3116940 - protein, 16 aa, Giardia lamblia
KDHKLADEDVVQIVLR

SEQ ID NO: 3116941 - protein, 21 aa, Giardia lamblia
KDHKPDDPTETRRIEASGGYV

SEQ ID NO: 3116942 - protein, 8 aa, Giardia lamblia
KDHKSKIS

SEQ ID NO: 3116943 - protein, 5 aa, Giardia lamblia
KDIEG

SEQ ID NO: 3116944 - protein, 15 aa, Giardia lamblia
KDIEKKQKAAEKEDV

SEQ ID NO: 3116945 - protein, 12 aa, Giardia lamblia
KDIKNNDRETAL

SEQ ID NO: 3116946 - protein, 7 aa, Giardia lamblia
KDIKYPK

SEQ ID NO: 3116947 - protein, 11 aa, Giardia lamblia
KDINTKTDRIS

SEQ ID NO: 3116948 - protein, 13 aa, Giardia lamblia
KDIQTEQARTNTI

SEQ ID NO: 3116949 - protein, 7 aa, Giardia lamblia
KDIREHR

SEQ ID NO: 3116950 - protein, 4 aa, Giardia lamblia
KDKA

SEQ ID NO: 3116951 - protein, 13 aa, Giardia lamblia
KDKDAIVQEQGDY

SEQ ID NO: 3116952 - protein, 6 aa, Giardia lamblia
KDKDGM

SEQ ID NO: 3116953 - protein, 7 aa, Giardia lamblia
KDKDITS

SEQ ID NO: 3116954 - protein, 7 aa, Giardia lamblia
KDKEALN

SEQ ID NO: 3116955 - protein, 10 aa, Giardia lamblia
KDKEQADAEL

SEQ ID NO: 3116956 - protein, 7 aa, Giardia lamblia
KDKETGQ

SEQ ID NO: 3116957 - protein, 17 aa, Giardia lamblia
KDKGKQTSVAGVPQGLP

SEQ ID NO: 3116958 - protein, 9 aa, Giardia lamblia
KDKGRKGPA

SEQ ID NO: 3116959 - protein, 4 aa, Giardia lamblia
KDKK

SEQ ID NO: 3116960 - protein, 9 aa, Giardia lamblia
KDKKDPTSE

SEQ ID NO: 3116961 - protein, 10 aa, Giardia lamblia
KDKKQSISIE

SEQ ID NO: 3116962 - protein, 6 aa, Giardia lamblia
KDKKTL

SEQ ID NO: 3116963 - protein, 9 aa, Giardia lamblia
KDKPISAQP

SEQ ID NO: 3116964 - protein, 6 aa, Giardia lamblia
KDKPLN

SEQ ID NO: 3116965 - protein, 9 aa, Giardia lamblia
KDKQLQDGT

SEQ ID NO: 3116966 - protein, 9 aa, Giardia lamblia
KDKQSRDDL

SEQ ID NO: 3116967 - protein, 11 aa, Giardia lamblia
KDKREDDRRES

SEQ ID NO: 3116968 - protein, 6 aa, Giardia lamblia
KDKSEA

SEQ ID NO: 3116969 - protein, 12 aa, Giardia lamblia
KDKTEADKTRQV

SEQ ID NO: 3116970 - protein, 8 aa, Giardia lamblia
KDKTGTSA

SEQ ID NO: 3116971 - protein, 5 aa, Giardia lamblia
KDKTH

SEQ ID NO: 3116972 - protein, 10 aa, Giardia lamblia
KDKTSIRAGE

SEQ ID NO: 3116973 - protein, 6 aa, Giardia lamblia
KDKTSL

SEQ ID NO: 3116974 - protein, 4 aa, Giardia lamblia
KDKY

SEQ ID NO: 3116975 - protein, 8 aa, Giardia lamblia
KDLCEEES

SEQ ID NO: 3116976 - protein, 4 aa, Giardia lamblia
KDLD

SEQ ID NO: 3116977 - protein, 6 aa, Giardia lamblia
KDLEAK

SEQ ID NO: 3116978 - protein, 52 aa, Giardia lamblia
KDLEDIKNPLQDTPQTSLSKRKPRGKPAGSTTLAAASSGIQNTSGTSRRRGL

SEQ ID NO: 3116979 - protein, 6 aa, Giardia lamblia
KDLEEK

SEQ ID NO: 3116980 - protein, 11 aa, Giardia lamblia
KDLESSSSSLP

SEQ ID NO: 3116981 - protein, 9 aa, Giardia lamblia
KDLETGIGT

SEQ ID NO: 3116982 - protein, 25 aa, Giardia lamblia
KDLETTNVDASRTKEELSATIETNK

SEQ ID NO: 3116983 - protein, 10 aa, Giardia lamblia
KDLGGTSRIS

SEQ ID NO: 3116984 - protein, 12 aa, Giardia lamblia
KDLLSGGKHGFD

SEQ ID NO: 3116985 - protein, 7 aa, Giardia lamblia
KDLNGYT

SEQ ID NO: 3116986 - protein, 6 aa, Giardia lamblia
KDLPQR

SEQ ID NO: 3116987 - protein, 7 aa, Giardia lamblia
KDLPTSQ

SEQ ID NO: 3116988 - protein, 7 aa, Giardia lamblia
KDLPTTD

SEQ ID NO: 3116989 - protein, 7 aa, Giardia lamblia
KDLQDEK

SEQ ID NO: 3116990 - protein, 7 aa, Giardia lamblia
KDLSGAK

SEQ ID NO: 3116991 - protein, 11 aa, Giardia lamblia
KDLSGKSSAVL

SEQ ID NO: 3116992 - protein, 6 aa, Giardia lamblia
KDLSSA

SEQ ID NO: 3116993 - protein, 6 aa, Giardia lamblia
KDLTDL

SEQ ID NO: 3116994 - protein, 5 aa, Giardia lamblia
KDMAG

SEQ ID NO: 3116995 - protein, 4 aa, Giardia lamblia
KDMD

SEQ ID NO: 3116996 - protein, 13 aa, Giardia lamblia
KDNAGNTKEIAET

SEQ ID NO: 3116997 - protein, 16 aa, Giardia lamblia
KDNDALSKRLDKSSSM

SEQ ID NO: 3116998 - protein, 8 aa, Giardia lamblia
KDNDGNTR

SEQ ID NO: 3116999 - protein, 28 aa, Giardia lamblia
KDNEEVQKAQDGTAKHAPKCPSASDADT

SEQ ID NO: 3117000 - protein, 8 aa, Giardia lamblia
KDNEGETA

SEQ ID NO: 3117001 - protein, 8 aa, Giardia lamblia
KDNKGATA

SEQ ID NO: 3117002 - protein, 6 aa, Giardia lamblia
KDNLSD

SEQ ID NO: 3117003 - protein, 14 aa, Giardia lamblia
KDNPCKQDKATLDD

SEQ ID NO: 3117004 - protein, 7 aa, Giardia lamblia
KDNPQIT

SEQ ID NO: 3117005 - protein, 13 aa, Giardia lamblia
KDNRLSASRYTQK

SEQ ID NO: 3117006 - protein, 4 aa, Giardia lamblia
KDNS

SEQ ID NO: 3117007 - protein, 5 aa, Giardia lamblia
KDNSD

SEQ ID NO: 3117008 - protein, 8 aa, Giardia lamblia
KDNSEETA

SEQ ID NO: 3117009 - protein, 7 aa, Giardia lamblia
KDNTDAV

SEQ ID NO: 3117010 - protein, 9 aa, Giardia lamblia
KDNVSNEDK

SEQ ID NO: 3117011 - protein, 6 aa, Giardia lamblia
KDNYGY

SEQ ID NO: 3117012 - protein, 15 aa, Giardia lamblia
KDPAASLASLPTKGG

SEQ ID NO: 3117013 - protein, 7 aa, Giardia lamblia
KDPAHSS

SEQ ID NO: 3117014 - protein, 10 aa, Giardia lamblia
KDPAKRPTAK

SEQ ID NO: 3117015 - protein, 7 aa, Giardia lamblia
KDPDSRW

SEQ ID NO: 3117016 - protein, 10 aa, Giardia lamblia
KDPDTNANAQ

SEQ ID NO: 3117017 - protein, 10 aa, Giardia lamblia
KDPEEKNPYE

SEQ ID NO: 3117018 - protein, 10 aa, Giardia lamblia
KDPEGEEETL

SEQ ID NO: 3117019 - protein, 13 aa, Giardia lamblia
KDPENPNKVSGAE

SEQ ID NO: 3117020 - protein, 8 aa, Giardia lamblia
KDPFNEVT

SEQ ID NO: 3117021 - protein, 7 aa, Giardia lamblia
KDPGGYG

SEQ ID NO: 3117022 - protein, 4 aa, Giardia lamblia
KDPH

SEQ ID NO: 3117023 - protein, 8 aa, Giardia lamblia
KDPKSAEC

SEQ ID NO: 3117024 - protein, 5 aa, Giardia lamblia
KDPMD

SEQ ID NO: 3117025 - protein, 9 aa, Giardia lamblia
KDPNKRPSV

SEQ ID NO: 3117026 - protein, 14 aa, Giardia lamblia
KDPNMDRNTSTVND

SEQ ID NO: 3117027 - protein, 7 aa, Giardia lamblia
KDPPGFI

SEQ ID NO: 3117028 - protein, 10 aa, Giardia lamblia
KDPPPDVSEL

SEQ ID NO: 3117029 - protein, 8 aa, Giardia lamblia
KDPPSHDH

SEQ ID NO: 3117030 - protein, 7 aa, Giardia lamblia
KDPQEVY

SEQ ID NO: 3117031 - protein, 6 aa, Giardia lamblia
KDPQLQ

SEQ ID NO: 3117032 - protein, 7 aa, Giardia lamblia
KDPQSAV

SEQ ID NO: 3117033 - protein, 13 aa, Giardia lamblia
KDPQVVPTSTDLT

SEQ ID NO: 3117034 - protein, 8 aa, Giardia lamblia
KDPRKPET

SEQ ID NO: 3117035 - protein, 9 aa, Giardia lamblia
KDPRPDGYE

SEQ ID NO: 3117036 - protein, 4 aa, Giardia lamblia
KDPS

SEQ ID NO: 3117037 - protein, 6 aa, Giardia lamblia
KDPSEI

SEQ ID NO: 3117038 - protein, 12 aa, Giardia lamblia
KDPTASAEGVEE

SEQ ID NO: 3117039 - protein, 7 aa, Giardia lamblia
KDPTDEN

SEQ ID NO: 3117040 - protein, 8 aa, Giardia lamblia
KDPTKRFN

SEQ ID NO: 3117041 - protein, 6 aa, Giardia lamblia
KDPTLS

SEQ ID NO: 3117042 - protein, 18 aa, Giardia lamblia
KDPVASAPHSKTSVELTP

SEQ ID NO: 3117043 - protein, 6 aa, Giardia lamblia
KDPYAE

SEQ ID NO: 3117044 - protein, 5 aa, Giardia lamblia
KDPYS

SEQ ID NO: 3117045 - protein, 6 aa, Giardia lamblia
KDPYTG

SEQ ID NO: 3117046 - protein, 6 aa, Giardia lamblia
KDQEDV

SEQ ID NO: 3117047 - protein, 5 aa, Giardia lamblia
KDQGD

SEQ ID NO: 3117048 - protein, 13 aa, Giardia lamblia
KDQHSKPKEDKPY

SEQ ID NO: 3117049 - protein, 4 aa, Giardia lamblia
KDQK

SEQ ID NO: 3117050 - protein, 4 aa, Giardia lamblia
KDQL

SEQ ID NO: 3117051 - protein, 5 aa, Giardia lamblia
KDQLN

SEQ ID NO: 3117052 - protein, 21 aa, Giardia lamblia
KDQNVRARGYGEPSGEPTAAA

SEQ ID NO: 3117053 - protein, 7 aa, Giardia lamblia
KDQPPIG

SEQ ID NO: 3117054 - protein, 7 aa, Giardia lamblia
KDQQPEL

SEQ ID NO: 3117055 - protein, 26 aa, Giardia lamblia
KDQQSTAVIPSESLTSSPSKDQAENP

SEQ ID NO: 3117056 - protein, 8 aa, Giardia lamblia
KDQRQQRH

SEQ ID NO: 3117057 - protein, 7 aa, Giardia lamblia
KDRAKSA

SEQ ID NO: 3117058 - protein, 9 aa, Giardia lamblia
KDRASDDPH

SEQ ID NO: 3117059 - protein, 5 aa, Giardia lamblia
KDREI

SEQ ID NO: 3117060 - protein, 6 aa, Giardia lamblia
KDRGKI

SEQ ID NO: 3117061 - protein, 11 aa, Giardia lamblia
KDRHRRGEKLN

SEQ ID NO: 3117062 - protein, 6 aa, Giardia lamblia
KDRLNN

SEQ ID NO: 3117063 - protein, 5 aa, Giardia lamblia
KDRMS

SEQ ID NO: 3117064 - protein, 6 aa, Giardia lamblia
KDRPDD

SEQ ID NO: 3117065 - protein, 13 aa, Giardia lamblia
KDRPQQEQEYTPQ

SEQ ID NO: 3117066 - protein, 7 aa, Giardia lamblia
KDRPSAH

SEQ ID NO: 3117067 - protein, 7 aa, Giardia lamblia
KDRQIGD

SEQ ID NO: 3117068 - protein, 5 aa, Giardia lamblia
KDRRC

SEQ ID NO: 3117069 - protein, 8 aa, Giardia lamblia
KDRRGRQA

SEQ ID NO: 3117070 - protein, 5 aa, Giardia lamblia
KDRRR

SEQ ID NO: 3117071 - protein, 13 aa, Giardia lamblia
KDRSSGSSRAQTR

SEQ ID NO: 3117072 - protein, 4 aa, Giardia lamblia
KDRT

SEQ ID NO: 3117073 - protein, 9 aa, Giardia lamblia
KDRTVDTKK

SEQ ID NO: 3117074 - protein, 14 aa, Giardia lamblia
KDRYNEALETAPTE

SEQ ID NO: 3117075 - protein, 16 aa, Giardia lamblia
KDSCEPDEPVDSKMAG

SEQ ID NO: 3117076 - protein, 9 aa, Giardia lamblia
KDSCTSGDL

SEQ ID NO: 3117077 - protein, 65 aa, Giardia lamblia
KDSDQNGSLPQGEYQDPESKEKDDNPEKLDEANEPDGQEGHEDLTESSDTVVTPRTEERRAAAEN

SEQ ID NO: 3117078 - protein, 8 aa, Giardia lamblia
KDSDSEQT

SEQ ID NO: 3117079 - protein, 38 aa, Giardia lamblia
KDSDSSEEDDAKYKTISQTGELSTSGLAGATTKQPGME

SEQ ID NO: 3117080 - protein, 7 aa, Giardia lamblia
KDSEAKI

SEQ ID NO: 3117081 - protein, 8 aa, Giardia lamblia
KDSHASAT

SEQ ID NO: 3117082 - protein, 10 aa, Giardia lamblia
KDSIGRGPKY

SEQ ID NO: 3117083 - protein, 7 aa, Giardia lamblia
KDSIGTT

SEQ ID NO: 3117084 - protein, 6 aa, Giardia lamblia
KDSISV

SEQ ID NO: 3117085 - protein, 9 aa, Giardia lamblia
KDSKPNAPH

SEQ ID NO: 3117086 - protein, 9 aa, Giardia lamblia
KDSMDEAER

SEQ ID NO: 3117087 - protein, 13 aa, Giardia lamblia
KDSMGKSARDWAT

SEQ ID NO: 3117088 - protein, 7 aa, Giardia lamblia
KDSNGKT

SEQ ID NO: 3117089 - protein, 18 aa, Giardia lamblia
KDSNKDERKRLQKERQAK

SEQ ID NO: 3117090 - protein, 9 aa, Giardia lamblia
KDSNTVKTA

SEQ ID NO: 3117091 - protein, 10 aa, Giardia lamblia
KDSPRPEADI

SEQ ID NO: 3117092 - protein, 21 aa, Giardia lamblia
KDSQRPISTTRPMGSAASTIG

SEQ ID NO: 3117093 - protein, 10 aa, Giardia lamblia
KDSQTSTLTS

SEQ ID NO: 3117094 - protein, 18 aa, Giardia lamblia
KDSQYEGSEFLMEDYDSG

SEQ ID NO: 3117095 - protein, 19 aa, Giardia lamblia
KDSREGTKYQYNESTLEKN

SEQ ID NO: 3117096 - protein, 7 aa, Giardia lamblia
KDSRGLS

SEQ ID NO: 3117097 - protein, 6 aa, Giardia lamblia
KDSRGW

SEQ ID NO: 3117098 - protein, 14 aa, Giardia lamblia
KDSRHIRAGRGKMR

SEQ ID NO: 3117099 - protein, 6 aa, Giardia lamblia
KDSRQM

SEQ ID NO: 3117100 - protein, 19 aa, Giardia lamblia
KDSSDLSLKNDGKQQAINT

SEQ ID NO: 3117101 - protein, 5 aa, Giardia lamblia
KDSSE

SEQ ID NO: 3117102 - protein, 10 aa, Giardia lamblia
KDSSSQESHE

SEQ ID NO: 3117103 - protein, 5 aa, Giardia lamblia
KDSSW

SEQ ID NO: 3117104 - protein, 4 aa, Giardia lamblia
KDST

SEQ ID NO: 3117105 - protein, 7 aa, Giardia lamblia
KDSTERA

SEQ ID NO: 3117106 - protein, 10 aa, Giardia lamblia
KDSTPQDANE

SEQ ID NO: 3117107 - protein, 5 aa, Giardia lamblia
KDSVE

SEQ ID NO: 3117108 - protein, 20 aa, Giardia lamblia
KDSVGSVGKGKDSKQREQMP

SEQ ID NO: 3117109 - protein, 7 aa, Giardia lamblia
KDSVKAL

SEQ ID NO: 3117110 - protein, 10 aa, Giardia lamblia
KDSVPTNKSL

SEQ ID NO: 3117111 - protein, 5 aa, Giardia lamblia
KDTCS

SEQ ID NO: 3117112 - protein, 30 aa, Giardia lamblia
KDTDDEDVGESSPTRSPQVTDEDEDEDGVT

SEQ ID NO: 3117113 - protein, 21 aa, Giardia lamblia
KDTDESSHPELDPTDPSAAYA

SEQ ID NO: 3117114 - protein, 7 aa, Giardia lamblia
KDTEADR

SEQ ID NO: 3117115 - protein, 8 aa, Giardia lamblia
KDTEPPLI

SEQ ID NO: 3117116 - protein, 5 aa, Giardia lamblia
KDTFG

SEQ ID NO: 3117117 - protein, 11 aa, Giardia lamblia
KDTGGGTEESH

SEQ ID NO: 3117118 - protein, 6 aa, Giardia lamblia
KDTGHS

SEQ ID NO: 3117119 - protein, 13 aa, Giardia lamblia
KDTGHTNSSIYGE

SEQ ID NO: 3117120 - protein, 8 aa, Giardia lamblia
KDTKEQCK

SEQ ID NO: 3117121 - protein, 7 aa, Giardia lamblia
KDTLAKN

SEQ ID NO: 3117122 - protein, 11 aa, Giardia lamblia
KDTLNQNKATL

SEQ ID NO: 3117123 - protein, 5 aa, Giardia lamblia
KDTLQ

SEQ ID NO: 3117124 - protein, 8 aa, Giardia lamblia
KDTMDNPG

SEQ ID NO: 3117125 - protein, 10 aa, Giardia lamblia
KDTMPSSNEP

SEQ ID NO: 3117126 - protein, 6 aa, Giardia lamblia
KDTNMP

SEQ ID NO: 3117127 - protein, 8 aa, Giardia lamblia
KDTNNKRR

SEQ ID NO: 3117128 - protein, 7 aa, Giardia lamblia
KDTPEEL

SEQ ID NO: 3117129 - protein, 5 aa, Giardia lamblia
KDTPI

SEQ ID NO: 3117130 - protein, 4 aa, Giardia lamblia
KDTQ

SEQ ID NO: 3117131 - protein, 10 aa, Giardia lamblia
KDTRNDNGDT

SEQ ID NO: 3117132 - protein, 16 aa, Giardia lamblia
KDTRTLDAERLSEETR

SEQ ID NO: 3117133 - protein, 20 aa, Giardia lamblia
KDTSSKKTALTRARTESGQA

SEQ ID NO: 3117134 - protein, 5 aa, Giardia lamblia
KDTVP

SEQ ID NO: 3117135 - protein, 5 aa, Giardia lamblia
KDTYT

SEQ ID NO: 3117136 - protein, 13 aa, Giardia lamblia
KDVDDLAANSTRY

SEQ ID NO: 3117137 - protein, 7 aa, Giardia lamblia
KDVESRR

SEQ ID NO: 3117138 - protein, 7 aa, Giardia lamblia
KDVKNSQ

SEQ ID NO: 3117139 - protein, 4 aa, Giardia lamblia
KDVQ

SEQ ID NO: 3117140 - protein, 4 aa, Giardia lamblia
KDVS

SEQ ID NO: 3117141 - protein, 11 aa, Giardia lamblia
KDVSDKKDSVP

SEQ ID NO: 3117142 - protein, 6 aa, Giardia lamblia
KDVSEN

SEQ ID NO: 3117143 - protein, 4 aa, Giardia lamblia
KDVT

SEQ ID NO: 3117144 - protein, 7 aa, Giardia lamblia
KDVYESS

SEQ ID NO: 3117145 - protein, 6 aa, Giardia lamblia
KDWNES

SEQ ID NO: 3117146 - protein, 7 aa, Giardia lamblia
KDYATRR

SEQ ID NO: 3117147 - protein, 6 aa, Giardia lamblia
KDYNGV

SEQ ID NO: 3117148 - protein, 4 aa, Giardia lamblia
KDYR

SEQ ID NO: 3117149 - protein, 7 aa, Giardia lamblia
KDYYASD

SEQ ID NO: 3117150 - protein, 5 aa, Giardia lamblia
KEAAE

SEQ ID NO: 3117151 - protein, 21 aa, Giardia lamblia
KEAAELNKTGSDIISFCRWLI

SEQ ID NO: 3117152 - protein, 15 aa, Giardia lamblia
KEAAPKPSKAKGGIS

SEQ ID NO: 3117153 - protein, 9 aa, Giardia lamblia
KEAAQYEVE

SEQ ID NO: 3117154 - protein, 9 aa, Giardia lamblia
KEAARRRAS

SEQ ID NO: 3117155 - protein, 7 aa, Giardia lamblia
KEADAVK

SEQ ID NO: 3117156 - protein, 9 aa, Giardia lamblia
KEADEAPLD

SEQ ID NO: 3117157 - protein, 8 aa, Giardia lamblia
KEAEETVE

SEQ ID NO: 3117158 - protein, 6 aa, Giardia lamblia
KEAEIE

SEQ ID NO: 3117159 - protein, 24 aa, Giardia lamblia
KEAEKKKKKGKAQKGGSHATGKSQ

SEQ ID NO: 3117160 - protein, 6 aa, Giardia lamblia
KEAERM

SEQ ID NO: 3117161 - protein, 6 aa, Giardia lamblia
KEAERT

SEQ ID NO: 3117162 - protein, 6 aa, Giardia lamblia
KEAESL

SEQ ID NO: 3117163 - protein, 8 aa, Giardia lamblia
KEAETELD

SEQ ID NO: 3117164 - protein, 7 aa, Giardia lamblia
KEAGHGS

SEQ ID NO: 3117165 - protein, 13 aa, Giardia lamblia
KEAGIRTKDGETA

SEQ ID NO: 3117166 - protein, 14 aa, Giardia lamblia
KEAGLCDKNGTTSL

SEQ ID NO: 3117167 - protein, 11 aa, Giardia lamblia
KEAGLQNNEGQ

SEQ ID NO: 3117168 - protein, 9 aa, Giardia lamblia
KEAGMRANN

SEQ ID NO: 3117169 - protein, 13 aa, Giardia lamblia
KEAGMRRDRYTGA

SEQ ID NO: 3117170 - protein, 10 aa, Giardia lamblia
KEAGQHDTNG

SEQ ID NO: 3117171 - protein, 5 aa, Giardia lamblia
KEAGR

SEQ ID NO: 3117172 - protein, 10 aa, Giardia lamblia
KEAGRADKNG

SEQ ID NO: 3117173 - protein, 8 aa, Giardia lamblia
KEAGRCTN

SEQ ID NO: 3117174 - protein, 10 aa, Giardia lamblia
KEAGRDREPF

SEQ ID NO: 3117175 - protein, 7 aa, Giardia lamblia
KEAGSFS

SEQ ID NO: 3117176 - protein, 8 aa, Giardia lamblia
KEAGTAAE

SEQ ID NO: 3117177 - protein, 13 aa, Giardia lamblia
KEAGTKGDTDTLA

SEQ ID NO: 3117178 - protein, 8 aa, Giardia lamblia
KEAGTRST

SEQ ID NO: 3117179 - protein, 5 aa, Giardia lamblia
KEAGY

SEQ ID NO: 3117180 - protein, 11 aa, Giardia lamblia
KEAHKYKASGI

SEQ ID NO: 3117181 - protein, 12 aa, Giardia lamblia
KEAIDAKGINST

SEQ ID NO: 3117182 - protein, 9 aa, Giardia lamblia
KEAITGQRS

SEQ ID NO: 3117183 - protein, 13 aa, Giardia lamblia
KEAKKVDARGKTA

SEQ ID NO: 3117184 - protein, 12 aa, Giardia lamblia
KEAKMTNSAGQT

SEQ ID NO: 3117185 - protein, 6 aa, Giardia lamblia
KEALDG

SEQ ID NO: 3117186 - protein, 23 aa, Giardia lamblia
KEALDQRSKLKTYNNEYKDKIAR

SEQ ID NO: 3117187 - protein, 9 aa, Giardia lamblia
KEALSNASN

SEQ ID NO: 3117188 - protein, 6 aa, Giardia lamblia
KEANAC

SEQ ID NO: 3117189 - protein, 5 aa, Giardia lamblia
KEANM

SEQ ID NO: 3117190 - protein, 27 aa, Giardia lamblia
KEANTGSSKKSKREVLGSEGATYTSER

SEQ ID NO: 3117191 - protein, 9 aa, Giardia lamblia
KEAPARAAT

SEQ ID NO: 3117192 - protein, 10 aa, Giardia lamblia
KEAPARAATR

SEQ ID NO: 3117193 - protein, 7 aa, Giardia lamblia
KEAPATS

SEQ ID NO: 3117194 - protein, 83 aa, Giardia lamblia
KEAPKEEQSSDTQGDGGVLEDPEDAQEHYSHKGPHADSSSNKDMQEDEQEHDEASVKDEAPEERADEELEESKHSEEAPNKAL

SEQ ID NO: 3117195 - protein, 6 aa, Giardia lamblia
KEAPYE

SEQ ID NO: 3117196 - protein, 5 aa, Giardia lamblia
KEAQD

SEQ ID NO: 3117197 - protein, 24 aa, Giardia lamblia
KEAQEARALREAEERAQEEEYKRR

SEQ ID NO: 3117198 - protein, 22 aa, Giardia lamblia
KEAQNDLRKRSTDDSTSPSNAA

SEQ ID NO: 3117199 - protein, 4 aa, Giardia lamblia
KEAR

SEQ ID NO: 3117200 - protein, 9 aa, Giardia lamblia
KEARERDSM

SEQ ID NO: 3117201 - protein, 6 aa, Giardia lamblia
KEARMR

SEQ ID NO: 3117202 - protein, 7 aa, Giardia lamblia
KEASENR

SEQ ID NO: 3117203 - protein, 13 aa, Giardia lamblia
KEASFKRPQDGAT

SEQ ID NO: 3117204 - protein, 11 aa, Giardia lamblia
KEASIGKDKEI

SEQ ID NO: 3117205 - protein, 10 aa, Giardia lamblia
KEASLTDNSG

SEQ ID NO: 3117206 - protein, 14 aa, Giardia lamblia
KEASNESGEKANQI

SEQ ID NO: 3117207 - protein, 17 aa, Giardia lamblia
KEASQATSMVSGEENTK

SEQ ID NO: 3117208 - protein, 4 aa, Giardia lamblia
KEAT

SEQ ID NO: 3117209 - protein, 6 aa, Giardia lamblia
KEATDR

SEQ ID NO: 3117210 - protein, 8 aa, Giardia lamblia
KEATKDVE

SEQ ID NO: 3117211 - protein, 8 aa, Giardia lamblia
KEATMTTN

SEQ ID NO: 3117212 - protein, 4 aa, Giardia lamblia
KEAY

SEQ ID NO: 3117213 - protein, 8 aa, Giardia lamblia
KECESNDK

SEQ ID NO: 3117214 - protein, 6 aa, Giardia lamblia
KECSTV

SEQ ID NO: 3117215 - protein, 33 aa, Giardia lamblia
KEDAAHDLGEHQPARTLEDGDHRPDHDGPGPHL

SEQ ID NO: 3117216 - protein, 6 aa, Giardia lamblia
KEDAIA

SEQ ID NO: 3117217 - protein, 8 aa, Giardia lamblia
KEDANDGK

SEQ ID NO: 3117218 - protein, 16 aa, Giardia lamblia
KEDATPKAKYNLAPSE

SEQ ID NO: 3117219 - protein, 7 aa, Giardia lamblia
KEDDGKV

SEQ ID NO: 3117220 - protein, 7 aa, Giardia lamblia
KEDDKPL

SEQ ID NO: 3117221 - protein, 9 aa, Giardia lamblia
KEDDQQLEP

SEQ ID NO: 3117222 - protein, 6 aa, Giardia lamblia
KEDEGL

SEQ ID NO: 3117223 - protein, 6 aa, Giardia lamblia
KEDGRW

SEQ ID NO: 3117224 - protein, 10 aa, Giardia lamblia
KEDGSLKQGS

SEQ ID NO: 3117225 - protein, 8 aa, Giardia lamblia
KEDGTVPF

SEQ ID NO: 3117226 - protein, 6 aa, Giardia lamblia
KEDMTN

SEQ ID NO: 3117227 - protein, 9 aa, Giardia lamblia
KEDSGGLDL

SEQ ID NO: 3117228 - protein, 10 aa, Giardia lamblia
KEDSISTNAR

SEQ ID NO: 3117229 - protein, 5 aa, Giardia lamblia
KEDSP

SEQ ID NO: 3117230 - protein, 32 aa, Giardia lamblia
KEDTDQAKANTADKDKKVKAPPPKKKDAEPVV

SEQ ID NO: 3117231 - protein, 12 aa, Giardia lamblia
KEDTEQSKSTEQ

SEQ ID NO: 3117232 - protein, 6 aa, Giardia lamblia
KEDTRA

SEQ ID NO: 3117233 - protein, 13 aa, Giardia lamblia
KEDYGTKRKRHDL

SEQ ID NO: 3117234 - protein, 4 aa, Giardia lamblia
KEEA

SEQ ID NO: 3117235 - protein, 10 aa, Giardia lamblia
KEEAASMPPY

SEQ ID NO: 3117236 - protein, 34 aa, Giardia lamblia
KEEATPADLSRATATGRDGYAQKDDSSDSEPQYE

SEQ ID NO: 3117237 - protein, 21 aa, Giardia lamblia
KEEAVRRAHESADRDLEDDDE

SEQ ID NO: 3117238 - protein, 6 aa, Giardia lamblia
KEECNP

SEQ ID NO: 3117239 - protein, 22 aa, Giardia lamblia
KEEDRLETAGGPDTDDGNSLSN

SEQ ID NO: 3117240 - protein, 16 aa, Giardia lamblia
KEEEGKNVLAFLVRDP

SEQ ID NO: 3117241 - protein, 8 aa, Giardia lamblia
KEEENRHM

SEQ ID NO: 3117242 - protein, 7 aa, Giardia lamblia
KEEERNQ

SEQ ID NO: 3117243 - protein, 16 aa, Giardia lamblia
KEEETASATNRSSPRV

SEQ ID NO: 3117244 - protein, 14 aa, Giardia lamblia
KEEEVTPQTPKSNV

SEQ ID NO: 3117245 - protein, 20 aa, Giardia lamblia
KEEGATYKSRAEKYDDARHE

SEQ ID NO: 3117246 - protein, 17 aa, Giardia lamblia
KEEGEVNTHQSHEDSAE

SEQ ID NO: 3117247 - protein, 8 aa, Giardia lamblia
KEEGKATV

SEQ ID NO: 3117248 - protein, 6 aa, Giardia lamblia
KEEGLR

SEQ ID NO: 3117249 - protein, 9 aa, Giardia lamblia
KEEHTQHIE

SEQ ID NO: 3117250 - protein, 8 aa, Giardia lamblia
KEEKRGVH

SEQ ID NO: 3117251 - protein, 15 aa, Giardia lamblia
KEELAASRRKFPVNK

SEQ ID NO: 3117252 - protein, 7 aa, Giardia lamblia
KEELKTS

SEQ ID NO: 3117253 - protein, 12 aa, Giardia lamblia
KEELRKQQEENT

SEQ ID NO: 3117254 - protein, 9 aa, Giardia lamblia
KEENDKLRA

SEQ ID NO: 3117255 - protein, 7 aa, Giardia lamblia
KEEPAPI

SEQ ID NO: 3117256 - protein, 6 aa, Giardia lamblia
KEEPDK

SEQ ID NO: 3117257 - protein, 8 aa, Giardia lamblia
KEEPPRRL

SEQ ID NO: 3117258 - protein, 6 aa, Giardia lamblia
KEEPTV

SEQ ID NO: 3117259 - protein, 10 aa, Giardia lamblia
KEEQSTRESI

SEQ ID NO: 3117260 - protein, 16 aa, Giardia lamblia
KEERHSLETHNKTVSS

SEQ ID NO: 3117261 - protein, 11 aa, Giardia lamblia
KEERKTKPHQE

SEQ ID NO: 3117262 - protein, 10 aa, Giardia lamblia
KEERWTGPKP

SEQ ID NO: 3117263 - protein, 20 aa, Giardia lamblia
KEESASRTPRTTSTETSHAT

SEQ ID NO: 3117264 - protein, 28 aa, Giardia lamblia
KEETEQKKGIEGNPEYVEEEQINPFDQP

SEQ ID NO: 3117265 - protein, 13 aa, Giardia lamblia
KEETNENEDNSEV

SEQ ID NO: 3117266 - protein, 7 aa, Giardia lamblia
KEEVKKS

SEQ ID NO: 3117267 - protein, 5 aa, Giardia lamblia
KEEVQ

SEQ ID NO: 3117268 - protein, 9 aa, Giardia lamblia
KEEVTKAHT

SEQ ID NO: 3117269 - protein, 32 aa, Giardia lamblia
KEEYEDLRERGELQYDGNNAHRISRKGPLNLK

SEQ ID NO: 3117270 - protein, 8 aa, Giardia lamblia
KEEYEKNR

SEQ ID NO: 3117271 - protein, 5 aa, Giardia lamblia
KEFEE

SEQ ID NO: 3117272 - protein, 4 aa, Giardia lamblia
KEFS

SEQ ID NO: 3117273 - protein, 9 aa, Giardia lamblia
KEGDDNLSS

SEQ ID NO: 3117274 - protein, 11 aa, Giardia lamblia
KEGDGTTQKDH

SEQ ID NO: 3117275 - protein, 8 aa, Giardia lamblia
KEGDIKTT

SEQ ID NO: 3117276 - protein, 5 aa, Giardia lamblia
KEGDT

SEQ ID NO: 3117277 - protein, 6 aa, Giardia lamblia
KEGDYD

SEQ ID NO: 3117278 - protein, 11 aa, Giardia lamblia
KEGGEQTDGGL

SEQ ID NO: 3117279 - protein, 12 aa, Giardia lamblia
KEGGIQDSEGKT

SEQ ID NO: 3117280 - protein, 6 aa, Giardia lamblia
KEGGKR

SEQ ID NO: 3117281 - protein, 16 aa, Giardia lamblia
KEGGLRDTDGKSAASY

SEQ ID NO: 3117282 - protein, 8 aa, Giardia lamblia
KEGGNPYE

SEQ ID NO: 3117283 - protein, 9 aa, Giardia lamblia
KEGGSRAFS

SEQ ID NO: 3117284 - protein, 12 aa, Giardia lamblia
KEGGVQDKSKRT

SEQ ID NO: 3117285 - protein, 6 aa, Giardia lamblia
KEGKAQ

SEQ ID NO: 3117286 - protein, 11 aa, Giardia lamblia
KEGKESKMGLT

SEQ ID NO: 3117287 - protein, 8 aa, Giardia lamblia
KEGKETAR

SEQ ID NO: 3117288 - protein, 13 aa, Giardia lamblia
KEGKMQARQGDTA

SEQ ID NO: 3117289 - protein, 6 aa, Giardia lamblia
KEGKYD

SEQ ID NO: 3117290 - protein, 12 aa, Giardia lamblia
KEGNMQDNDGGS

SEQ ID NO: 3117291 - protein, 9 aa, Giardia lamblia
KEGPELAEA

SEQ ID NO: 3117292 - protein, 6 aa, Giardia lamblia
KEGPGC

SEQ ID NO: 3117293 - protein, 5 aa, Giardia lamblia
KEGPV

SEQ ID NO: 3117294 - protein, 7 aa, Giardia lamblia
KEGQTVP

SEQ ID NO: 3117295 - protein, 11 aa, Giardia lamblia
KEGRLRNTHGD

SEQ ID NO: 3117296 - protein, 5 aa, Giardia lamblia
KEGRN

SEQ ID NO: 3117297 - protein, 16 aa, Giardia lamblia
KEGSGPALTQGKKASV

SEQ ID NO: 3117298 - protein, 14 aa, Giardia lamblia
KEGSITGLNGETPL

SEQ ID NO: 3117299 - protein, 10 aa, Giardia lamblia
KEGSSANAAR

SEQ ID NO: 3117300 - protein, 5 aa, Giardia lamblia
KEGSY

SEQ ID NO: 3117301 - protein, 6 aa, Giardia lamblia
KEGTAQ

SEQ ID NO: 3117302 - protein, 6 aa, Giardia lamblia
KEGTGT

SEQ ID NO: 3117303 - protein, 9 aa, Giardia lamblia
KEGTKSSTM

SEQ ID NO: 3117304 - protein, 5 aa, Giardia lamblia
KEGTV

SEQ ID NO: 3117305 - protein, 6 aa, Giardia lamblia
KEGTYN

SEQ ID NO: 3117306 - protein, 10 aa, Giardia lamblia
KEGVKSDTEA

SEQ ID NO: 3117307 - protein, 10 aa, Giardia lamblia
KEHAKEHEAL

SEQ ID NO: 3117308 - protein, 7 aa, Giardia lamblia
KEHDPIY

SEQ ID NO: 3117309 - protein, 8 aa, Giardia lamblia
KEHETVKS

SEQ ID NO: 3117310 - protein, 6 aa, Giardia lamblia
KEHGDS

SEQ ID NO: 3117311 - protein, 19 aa, Giardia lamblia
KEHGRLRGEHEDLKEKYEE

SEQ ID NO: 3117312 - protein, 6 aa, Giardia lamblia
KEHGTS

SEQ ID NO: 3117313 - protein, 7 aa, Giardia lamblia
KEHGTST

SEQ ID NO: 3117314 - protein, 26 aa, Giardia lamblia
KEHLGGAEKEKRQGKGASQKSAERRS

SEQ ID NO: 3117315 - protein, 6 aa, Giardia lamblia
KEHQEK

SEQ ID NO: 3117316 - protein, 6 aa, Giardia lamblia
KEHSGQ

SEQ ID NO: 3117317 - protein, 4 aa, Giardia lamblia
KEHT

SEQ ID NO: 3117318 - protein, 4 aa, Giardia lamblia
KEIA

SEQ ID NO: 3117319 - protein, 7 aa, Giardia lamblia
KEIDDQR

SEQ ID NO: 3117320 - protein, 5 aa, Giardia lamblia
KEIDE

SEQ ID NO: 3117321 - protein, 21 aa, Giardia lamblia
KEIDEERSLREKEANLATEYE

SEQ ID NO: 3117322 - protein, 7 aa, Giardia lamblia
KEIDTAA

SEQ ID NO: 3117323 - protein, 11 aa, Giardia lamblia
KEIEAEAKSYQ

SEQ ID NO: 3117324 - protein, 6 aa, Giardia lamblia
KEIEDV

SEQ ID NO: 3117325 - protein, 6 aa, Giardia lamblia
KEIGKA

SEQ ID NO: 3117326 - protein, 12 aa, Giardia lamblia
KEIGKTRRDGWT

SEQ ID NO: 3117327 - protein, 6 aa, Giardia lamblia
KEIGSK

SEQ ID NO: 3117328 - protein, 16 aa, Giardia lamblia
KEIKTVEKKAKQTISF

SEQ ID NO: 3117329 - protein, 6 aa, Giardia lamblia
KEIQDN

SEQ ID NO: 3117330 - protein, 4 aa, Giardia lamblia
KEIS

SEQ ID NO: 3117331 - protein, 20 aa, Giardia lamblia
KEKADADATYTASKRKTNNE

SEQ ID NO: 3117332 - protein, 10 aa, Giardia lamblia
KEKAKAIGKI

SEQ ID NO: 3117333 - protein, 7 aa, Giardia lamblia
KEKAKTL

SEQ ID NO: 3117334 - protein, 9 aa, Giardia lamblia
KEKEDRIRE

SEQ ID NO: 3117335 - protein, 5 aa, Giardia lamblia
KEKEL

SEQ ID NO: 3117336 - protein, 11 aa, Giardia lamblia
KEKESTSQPIR

SEQ ID NO: 3117337 - protein, 10 aa, Giardia lamblia
KEKETDPSVH

SEQ ID NO: 3117338 - protein, 5 aa, Giardia lamblia
KEKGA

SEQ ID NO: 3117339 - protein, 10 aa, Giardia lamblia
KEKGADKGLR

SEQ ID NO: 3117340 - protein, 7 aa, Giardia lamblia
KEKGEHL

SEQ ID NO: 3117341 - protein, 14 aa, Giardia lamblia
KEKGIKKRSRSQKV

SEQ ID NO: 3117342 - protein, 10 aa, Giardia lamblia
KEKGLKDSNG

SEQ ID NO: 3117343 - protein, 10 aa, Giardia lamblia
KEKGLQDNNG

SEQ ID NO: 3117344 - protein, 11 aa, Giardia lamblia
KEKGTTDKYGR

SEQ ID NO: 3117345 - protein, 15 aa, Giardia lamblia
KEKHVSKDEIPAADN

SEQ ID NO: 3117346 - protein, 45 aa, Giardia lamblia
KEKIANSDSSEITGSDGVSNENQSEGSSSDESTGGNTGVTTENPY

SEQ ID NO: 3117347 - protein, 6 aa, Giardia lamblia
KEKITQ

SEQ ID NO: 3117348 - protein, 19 aa, Giardia lamblia
KEKKDSEMEKKDAEEQPEA

SEQ ID NO: 3117349 - protein, 7 aa, Giardia lamblia
KEKLSRQ

SEQ ID NO: 3117350 - protein, 4 aa, Giardia lamblia
KEKM

SEQ ID NO: 3117351 - protein, 8 aa, Giardia lamblia
KEKNINRS

SEQ ID NO: 3117352 - protein, 17 aa, Giardia lamblia
KEKNQSPVSDERAEEVA

SEQ ID NO: 3117353 - protein, 9 aa, Giardia lamblia
KEKPASIEA

SEQ ID NO: 3117354 - protein, 6 aa, Giardia lamblia
KEKPEV

SEQ ID NO: 3117355 - protein, 9 aa, Giardia lamblia
KEKPTEEKE

SEQ ID NO: 3117356 - protein, 14 aa, Giardia lamblia
KEKQEKKSKKDKKQ

SEQ ID NO: 3117357 - protein, 18 aa, Giardia lamblia
KEKQKDLGDLPVSDAERE

SEQ ID NO: 3117358 - protein, 23 aa, Giardia lamblia
KEKQQLDDRRTAFKDKDSKLKEL

SEQ ID NO: 3117359 - protein, 7 aa, Giardia lamblia
KEKRLTA

SEQ ID NO: 3117360 - protein, 5 aa, Giardia lamblia
KEKRP

SEQ ID NO: 3117361 - protein, 9 aa, Giardia lamblia
KEKRQLEAS

SEQ ID NO: 3117362 - protein, 25 aa, Giardia lamblia
KEKSVNSPCPKSSFGVRSQQRDTVP

SEQ ID NO: 3117363 - protein, 9 aa, Giardia lamblia
KEKTASTVS

SEQ ID NO: 3117364 - protein, 9 aa, Giardia lamblia
KEKTDPQYG

SEQ ID NO: 3117365 - protein, 9 aa, Giardia lamblia
KEKTRLQTR

SEQ ID NO: 3117366 - protein, 5 aa, Giardia lamblia
KEKVD

SEQ ID NO: 3117367 - protein, 14 aa, Giardia lamblia
KELAEKKSSEYQDR

SEQ ID NO: 3117368 - protein, 6 aa, Giardia lamblia
KELAER

SEQ ID NO: 3117369 - protein, 18 aa, Giardia lamblia
KELAKKAEEDNKKYAELN

SEQ ID NO: 3117370 - protein, 5 aa, Giardia lamblia
KELDG

SEQ ID NO: 3117371 - protein, 8 aa, Giardia lamblia
KELDSNTE

SEQ ID NO: 3117372 - protein, 8 aa, Giardia lamblia
KELEDQRR

SEQ ID NO: 3117373 - protein, 8 aa, Giardia lamblia
KELEEEQT

SEQ ID NO: 3117374 - protein, 9 aa, Giardia lamblia
KELEEKNAE

SEQ ID NO: 3117375 - protein, 6 aa, Giardia lamblia
KELERK

SEQ ID NO: 3117376 - protein, 6 aa, Giardia lamblia
KELGES

SEQ ID NO: 3117377 - protein, 31 aa, Giardia lamblia
KELGKRIKTREEQSREQIEQGEVARAAANAL

SEQ ID NO: 3117378 - protein, 10 aa, Giardia lamblia
KELGLQEKTG

SEQ ID NO: 3117379 - protein, 12 aa, Giardia lamblia
KELNNAPPKVSK

SEQ ID NO: 3117380 - protein, 6 aa, Giardia lamblia
KELNPK

SEQ ID NO: 3117381 - protein, 12 aa, Giardia lamblia
KELNSANETRRE

SEQ ID NO: 3117382 - protein, 6 aa, Giardia lamblia
KELQAA

SEQ ID NO: 3117383 - protein, 12 aa, Giardia lamblia
KELQEKTAEASL

SEQ ID NO: 3117384 - protein, 6 aa, Giardia lamblia
KELQER

SEQ ID NO: 3117385 - protein, 6 aa, Giardia lamblia
KELQGK

SEQ ID NO: 3117386 - protein, 7 aa, Giardia lamblia
KELQSEN

SEQ ID NO: 3117387 - protein, 10 aa, Giardia lamblia
KELSESANAA

SEQ ID NO: 3117388 - protein, 11 aa, Giardia lamblia
KELSKETEELK

SEQ ID NO: 3117389 - protein, 6 aa, Giardia lamblia
KELTNS

SEQ ID NO: 3117390 - protein, 8 aa, Giardia lamblia
KELTSNDV

SEQ ID NO: 3117391 - protein, 7 aa, Giardia lamblia
KELYTKN

SEQ ID NO: 3117392 - protein, 24 aa, Giardia lamblia
KEMEAKRKANAERIAREKKEFTEQ

SEQ ID NO: 3117393 - protein, 7 aa, Giardia lamblia
KEMEERN

SEQ ID NO: 3117394 - protein, 8 aa, Giardia lamblia
KEMETEGL

SEQ ID NO: 3117395 - protein, 5 aa, Giardia lamblia
KEMGE

SEQ ID NO: 3117396 - protein, 13 aa, Giardia lamblia
KEMGRTDKYGASA

SEQ ID NO: 3117397 - protein, 10 aa, Giardia lamblia
KEMKSKQDRN

SEQ ID NO: 3117398 - protein, 11 aa, Giardia lamblia
KEMSDKELKQE

SEQ ID NO: 3117399 - protein, 4 aa, Giardia lamblia
KENA

SEQ ID NO: 3117400 - protein, 6 aa, Giardia lamblia
KENAPS

SEQ ID NO: 3117401 - protein, 7 aa, Giardia lamblia
KENDKVE

SEQ ID NO: 3117402 - protein, 9 aa, Giardia lamblia
KENDRLKEQ

SEQ ID NO: 3117403 - protein, 8 aa, Giardia lamblia
KENEDDLE

SEQ ID NO: 3117404 - protein, 17 aa, Giardia lamblia
KENHQNPSGKNSSTLYK

SEQ ID NO: 3117405 - protein, 4 aa, Giardia lamblia
KENI

SEQ ID NO: 3117406 - protein, 9 aa, Giardia lamblia
KENKALRGE

SEQ ID NO: 3117407 - protein, 10 aa, Giardia lamblia
KENKMTDKAG

SEQ ID NO: 3117408 - protein, 11 aa, Giardia lamblia
KENNAQLTSDR

SEQ ID NO: 3117409 - protein, 11 aa, Giardia lamblia
KENNESATLPP

SEQ ID NO: 3117410 - protein, 11 aa, Giardia lamblia
KENPGDGAFYG

SEQ ID NO: 3117411 - protein, 7 aa, Giardia lamblia
KENPKYK

SEQ ID NO: 3117412 - protein, 10 aa, Giardia lamblia
KENPSGVGAY

SEQ ID NO: 3117413 - protein, 6 aa, Giardia lamblia
KENPSL

SEQ ID NO: 3117414 - protein, 7 aa, Giardia lamblia
KENQGKI

SEQ ID NO: 3117415 - protein, 6 aa, Giardia lamblia
KENQRR

SEQ ID NO: 3117416 - protein, 6 aa, Giardia lamblia
KENQTI

SEQ ID NO: 3117417 - protein, 19 aa, Giardia lamblia
KENREIEADKRREKQARDY

SEQ ID NO: 3117418 - protein, 5 aa, Giardia lamblia
KENRL

SEQ ID NO: 3117419 - protein, 7 aa, Giardia lamblia
KENRRNG

SEQ ID NO: 3117420 - protein, 7 aa, Giardia lamblia
KENRTAR

SEQ ID NO: 3117421 - protein, 16 aa, Giardia lamblia
KENSKSKHIGSLEQTE

SEQ ID NO: 3117422 - protein, 6 aa, Giardia lamblia
KENSRT

SEQ ID NO: 3117423 - protein, 8 aa, Giardia lamblia
KENTAEAI

SEQ ID NO: 3117424 - protein, 7 aa, Giardia lamblia
KENTGIS

SEQ ID NO: 3117425 - protein, 5 aa, Giardia lamblia
KENTI

SEQ ID NO: 3117426 - protein, 6 aa, Giardia lamblia
KENTTG

SEQ ID NO: 3117427 - protein, 4 aa, Giardia lamblia
KENY

SEQ ID NO: 3117428 - protein, 5 aa, Giardia lamblia
KENYN

SEQ ID NO: 3117429 - protein, 7 aa, Giardia lamblia
KENYPAD

SEQ ID NO: 3117430 - protein, 13 aa, Giardia lamblia
KEPDAPLNVVKLM

SEQ ID NO: 3117431 - protein, 10 aa, Giardia lamblia
KEPGFKASKD

SEQ ID NO: 3117432 - protein, 6 aa, Giardia lamblia
KEPGPV

SEQ ID NO: 3117433 - protein, 5 aa, Giardia lamblia
KEPIP

SEQ ID NO: 3117434 - protein, 6 aa, Giardia lamblia
KEPNAK

SEQ ID NO: 3117435 - protein, 8 aa, Giardia lamblia
KEPPGQDS

SEQ ID NO: 3117436 - protein, 13 aa, Giardia lamblia
KEPPGSQPSVVAP

SEQ ID NO: 3117437 - protein, 8 aa, Giardia lamblia
KEPPRTPV

SEQ ID NO: 3117438 - protein, 6 aa, Giardia lamblia
KEPQFT

SEQ ID NO: 3117439 - protein, 15 aa, Giardia lamblia
KEPSISRRSAPSTPY

SEQ ID NO: 3117440 - protein, 8 aa, Giardia lamblia
KEPSKPVT

SEQ ID NO: 3117441 - protein, 8 aa, Giardia lamblia
KEPSSSVN

SEQ ID NO: 3117442 - protein, 8 aa, Giardia lamblia
KEPTEASD

SEQ ID NO: 3117443 - protein, 4 aa, Giardia lamblia
KEPV

SEQ ID NO: 3117444 - protein, 9 aa, Giardia lamblia
KEQANQRER

SEQ ID NO: 3117445 - protein, 17 aa, Giardia lamblia
KEQARRDRQEREEIDSN

SEQ ID NO: 3117446 - protein, 6 aa, Giardia lamblia
KEQASC

SEQ ID NO: 3117447 - protein, 8 aa, Giardia lamblia
KEQASEID

SEQ ID NO: 3117448 - protein, 10 aa, Giardia lamblia
KEQDETGRIS

SEQ ID NO: 3117449 - protein, 5 aa, Giardia lamblia
KEQDN

SEQ ID NO: 3117450 - protein, 9 aa, Giardia lamblia
KEQDRKQVE

SEQ ID NO: 3117451 - protein, 23 aa, Giardia lamblia
KEQDSTQQEDTAKKDGKEGTDVK

SEQ ID NO: 3117452 - protein, 9 aa, Giardia lamblia
KEQEADFNG

SEQ ID NO: 3117453 - protein, 5 aa, Giardia lamblia
KEQEI

SEQ ID NO: 3117454 - protein, 13 aa, Giardia lamblia
KEQEKTKNNVTNK

SEQ ID NO: 3117455 - protein, 32 aa, Giardia lamblia
KEQELEKKKKEELEQRRKKAEQRCKERAEKVA

SEQ ID NO: 3117456 - protein, 21 aa, Giardia lamblia
KEQERSDTDEKDDESKTEDAK

SEQ ID NO: 3117457 - protein, 4 aa, Giardia lamblia
KEQF

SEQ ID NO: 3117458 - protein, 18 aa, Giardia lamblia
KEQHDSDAITKKELNERL

SEQ ID NO: 3117459 - protein, 4 aa, Giardia lamblia
KEQI

SEQ ID NO: 3117460 - protein, 16 aa, Giardia lamblia
KEQLSTISKPEPSHSP

SEQ ID NO: 3117461 - protein, 4 aa, Giardia lamblia
KEQQ

SEQ ID NO: 3117462 - protein, 6 aa, Giardia lamblia
KEQQDQ

SEQ ID NO: 3117463 - protein, 4 aa, Giardia lamblia
KEQS

SEQ ID NO: 3117464 - protein, 12 aa, Giardia lamblia
KEQSDSSRPGPL

SEQ ID NO: 3117465 - protein, 7 aa, Giardia lamblia
KEQSDTI

SEQ ID NO: 3117466 - protein, 13 aa, Giardia lamblia
KEQSTDIQEQTKL

SEQ ID NO: 3117467 - protein, 8 aa, Giardia lamblia
KEQTEQID

SEQ ID NO: 3117468 - protein, 7 aa, Giardia lamblia
KEQTTMG

SEQ ID NO: 3117469 - protein, 5 aa, Giardia lamblia
KERAD

SEQ ID NO: 3117470 - protein, 8 aa, Giardia lamblia
KERAKELQ

SEQ ID NO: 3117471 - protein, 6 aa, Giardia lamblia
KERASV

SEQ ID NO: 3117472 - protein, 10 aa, Giardia lamblia
KERDERRDTD

SEQ ID NO: 3117473 - protein, 5 aa, Giardia lamblia
KERDN

SEQ ID NO: 3117474 - protein, 5 aa, Giardia lamblia
KERDT

SEQ ID NO: 3117475 - protein, 8 aa, Giardia lamblia
KERDTTGL

SEQ ID NO: 3117476 - protein, 5 aa, Giardia lamblia
KEREA

SEQ ID NO: 3117477 - protein, 8 aa, Giardia lamblia
KEREKTAK

SEQ ID NO: 3117478 - protein, 9 aa, Giardia lamblia
KEREPYTVR

SEQ ID NO: 3117479 - protein, 13 aa, Giardia lamblia
KEREQKDALSATV

SEQ ID NO: 3117480 - protein, 9 aa, Giardia lamblia
KERESKKHL

SEQ ID NO: 3117481 - protein, 12 aa, Giardia lamblia
KERFDNDPAFQK

SEQ ID NO: 3117482 - protein, 39 aa, Giardia lamblia
KERFNADGTGRGLAGRDSVAKGSGTVGGRVGDLSSQVSR

SEQ ID NO: 3117483 - protein, 12 aa, Giardia lamblia
KERGMRTKKGRT

SEQ ID NO: 3117484 - protein, 10 aa, Giardia lamblia
KERGMSDSNG

SEQ ID NO: 3117485 - protein, 5 aa, Giardia lamblia
KERGS

SEQ ID NO: 3117486 - protein, 6 aa, Giardia lamblia
KERHDK

SEQ ID NO: 3117487 - protein, 6 aa, Giardia lamblia
KERHGD

SEQ ID NO: 3117488 - protein, 5 aa, Giardia lamblia
KERKQ

SEQ ID NO: 3117489 - protein, 6 aa, Giardia lamblia
KERKRI

SEQ ID NO: 3117490 - protein, 6 aa, Giardia lamblia
KERKSL

SEQ ID NO: 3117491 - protein, 4 aa, Giardia lamblia
KERM

SEQ ID NO: 3117492 - protein, 22 aa, Giardia lamblia
KERNRSLSTKPSQPSSCTPDPT

SEQ ID NO: 3117493 - protein, 11 aa, Giardia lamblia
KERPDLEESKN

SEQ ID NO: 3117494 - protein, 5 aa, Giardia lamblia
KERPV

SEQ ID NO: 3117495 - protein, 9 aa, Giardia lamblia
KERQDSGAF

SEQ ID NO: 3117496 - protein, 4 aa, Giardia lamblia
KERR

SEQ ID NO: 3117497 - protein, 34 aa, Giardia lamblia
KERRATFQSSSRTEQPRRGSTTVVGPSGTSTQYY

SEQ ID NO: 3117498 - protein, 6 aa, Giardia lamblia
KERSEA

SEQ ID NO: 3117499 - protein, 15 aa, Giardia lamblia
KERSQKPRDNVKSTQ

SEQ ID NO: 3117500 - protein, 8 aa, Giardia lamblia
KERSRNCE

SEQ ID NO: 3117501 - protein, 9 aa, Giardia lamblia
KERTLKGNM

SEQ ID NO: 3117502 - protein, 11 aa, Giardia lamblia
KERTMQDVNGR

SEQ ID NO: 3117503 - protein, 9 aa, Giardia lamblia
KERTPTETL

SEQ ID NO: 3117504 - protein, 7 aa, Giardia lamblia
KERYDGL

SEQ ID NO: 3117505 - protein, 6 aa, Giardia lamblia
KERYSE

SEQ ID NO: 3117506 - protein, 4 aa, Giardia lamblia
KESA

SEQ ID NO: 3117507 - protein, 6 aa, Giardia lamblia
KESADN

SEQ ID NO: 3117508 - protein, 7 aa, Giardia lamblia
KESAMAG

SEQ ID NO: 3117509 - protein, 14 aa, Giardia lamblia
KESARRVGEGGTGG

SEQ ID NO: 3117510 - protein, 8 aa, Giardia lamblia
KESATDVD

SEQ ID NO: 3117511 - protein, 18 aa, Giardia lamblia
KESAYRARSNRVTESEKD

SEQ ID NO: 3117512 - protein, 6 aa, Giardia lamblia
KESDEL

SEQ ID NO: 3117513 - protein, 10 aa, Giardia lamblia
KESEEEGAVD

SEQ ID NO: 3117514 - protein, 6 aa, Giardia lamblia
KESEGL

SEQ ID NO: 3117515 - protein, 4 aa, Giardia lamblia
KESF

SEQ ID NO: 3117516 - protein, 8 aa, Giardia lamblia
KESGLADS

SEQ ID NO: 3117517 - protein, 11 aa, Giardia lamblia
KESGLKDETGM

SEQ ID NO: 3117518 - protein, 16 aa, Giardia lamblia
KESGLRTTASHPEGPD

SEQ ID NO: 3117519 - protein, 6 aa, Giardia lamblia
KESGQL

SEQ ID NO: 3117520 - protein, 10 aa, Giardia lamblia
KESGTPESTT

SEQ ID NO: 3117521 - protein, 12 aa, Giardia lamblia
KESGYLDEKGDT

SEQ ID NO: 3117522 - protein, 7 aa, Giardia lamblia
KESGYTG

SEQ ID NO: 3117523 - protein, 7 aa, Giardia lamblia
KESHDSA

SEQ ID NO: 3117524 - protein, 7 aa, Giardia lamblia
KESHKKL

SEQ ID NO: 3117525 - protein, 10 aa, Giardia lamblia
KESIATAARG

SEQ ID NO: 3117526 - protein, 14 aa, Giardia lamblia
KESKEAKEATVDGV

SEQ ID NO: 3117527 - protein, 17 aa, Giardia lamblia
KESKGLPSTADSRSSID

SEQ ID NO: 3117528 - protein, 7 aa, Giardia lamblia
KESKKQM

SEQ ID NO: 3117529 - protein, 6 aa, Giardia lamblia
KESKKV

SEQ ID NO: 3117530 - protein, 10 aa, Giardia lamblia
KESKLQEVSD

SEQ ID NO: 3117531 - protein, 8 aa, Giardia lamblia
KESKRDAF

SEQ ID NO: 3117532 - protein, 8 aa, Giardia lamblia
KESKTPLT

SEQ ID NO: 3117533 - protein, 10 aa, Giardia lamblia
KESKTQDSAG

SEQ ID NO: 3117534 - protein, 12 aa, Giardia lamblia
KESLGSTDQNGK

SEQ ID NO: 3117535 - protein, 13 aa, Giardia lamblia
KESMNEEKGRYKA

SEQ ID NO: 3117536 - protein, 7 aa, Giardia lamblia
KESNPEV

SEQ ID NO: 3117537 - protein, 5 aa, Giardia lamblia
KESNR

SEQ ID NO: 3117538 - protein, 10 aa, Giardia lamblia
KESPATLDAG

SEQ ID NO: 3117539 - protein, 8 aa, Giardia lamblia
KESPETID

SEQ ID NO: 3117540 - protein, 16 aa, Giardia lamblia
KESPHANTAPSPPVNS

SEQ ID NO: 3117541 - protein, 6 aa, Giardia lamblia
KESPHR

SEQ ID NO: 3117542 - protein, 24 aa, Giardia lamblia
KESPQGEKQRTGITKVPSKDSLDD

SEQ ID NO: 3117543 - protein, 6 aa, Giardia lamblia
KESPRI

SEQ ID NO: 3117544 - protein, 7 aa, Giardia lamblia
KESPSIA

SEQ ID NO: 3117545 - protein, 9 aa, Giardia lamblia
KESQHAQKA

SEQ ID NO: 3117546 - protein, 12 aa, Giardia lamblia
KESRITDRNGDT

SEQ ID NO: 3117547 - protein, 9 aa, Giardia lamblia
KESRPEAYK

SEQ ID NO: 3117548 - protein, 16 aa, Giardia lamblia
KESRPLTLSKSSGSAY

SEQ ID NO: 3117549 - protein, 24 aa, Giardia lamblia
KESRTEVKKTKKDEKQDRGSGNRL

SEQ ID NO: 3117550 - protein, 5 aa, Giardia lamblia
KESSD

SEQ ID NO: 3117551 - protein, 5 aa, Giardia lamblia
KESSE

SEQ ID NO: 3117552 - protein, 7 aa, Giardia lamblia
KESSGRL

SEQ ID NO: 3117553 - protein, 7 aa, Giardia lamblia
KESSLDA

SEQ ID NO: 3117554 - protein, 8 aa, Giardia lamblia
KESSSPLD

SEQ ID NO: 3117555 - protein, 15 aa, Giardia lamblia
KESSSTHDSTESEIG

SEQ ID NO: 3117556 - protein, 7 aa, Giardia lamblia
KESTASL

SEQ ID NO: 3117557 - protein, 5 aa, Giardia lamblia
KESTL

SEQ ID NO: 3117558 - protein, 7 aa, Giardia lamblia
KESTLTS

SEQ ID NO: 3117559 - protein, 8 aa, Giardia lamblia
KESTNMQT

SEQ ID NO: 3117560 - protein, 19 aa, Giardia lamblia
KESTSSTRLRSDHSTAQPI

SEQ ID NO: 3117561 - protein, 6 aa, Giardia lamblia
KESTSY

SEQ ID NO: 3117562 - protein, 7 aa, Giardia lamblia
KETASIK

SEQ ID NO: 3117563 - protein, 7 aa, Giardia lamblia
KETDKSH

SEQ ID NO: 3117564 - protein, 12 aa, Giardia lamblia
KETDPEKQREAI

SEQ ID NO: 3117565 - protein, 7 aa, Giardia lamblia
KETEHQA

SEQ ID NO: 3117566 - protein, 9 aa, Giardia lamblia
KETEPEDAK

SEQ ID NO: 3117567 - protein, 8 aa, Giardia lamblia
KETEYAQH

SEQ ID NO: 3117568 - protein, 4 aa, Giardia lamblia
KETG

SEQ ID NO: 3117569 - protein, 9 aa, Giardia lamblia
KETGKASLK

SEQ ID NO: 3117570 - protein, 7 aa, Giardia lamblia
KETGKDP

SEQ ID NO: 3117571 - protein, 7 aa, Giardia lamblia
KETGKPV

SEQ ID NO: 3117572 - protein, 10 aa, Giardia lamblia
KETGSPQKAA

SEQ ID NO: 3117573 - protein, 6 aa, Giardia lamblia
KETHAR

SEQ ID NO: 3117574 - protein, 8 aa, Giardia lamblia
KETIARER

SEQ ID NO: 3117575 - protein, 16 aa, Giardia lamblia
KETKEHTDAHNSDDSI

SEQ ID NO: 3117576 - protein, 7 aa, Giardia lamblia
KETKQTS

SEQ ID NO: 3117577 - protein, 12 aa, Giardia lamblia
KETNAGKEMAQS

SEQ ID NO: 3117578 - protein, 7 aa, Giardia lamblia
KETNQDL

SEQ ID NO: 3117579 - protein, 5 aa, Giardia lamblia
KETPA

SEQ ID NO: 3117580 - protein, 6 aa, Giardia lamblia
KETPLS

SEQ ID NO: 3117581 - protein, 7 aa, Giardia lamblia
KETPSNT

SEQ ID NO: 3117582 - protein, 6 aa, Giardia lamblia
KETPYP

SEQ ID NO: 3117583 - protein, 6 aa, Giardia lamblia
KETQNT

SEQ ID NO: 3117584 - protein, 8 aa, Giardia lamblia
KETRLESQ

SEQ ID NO: 3117585 - protein, 7 aa, Giardia lamblia
KETSANR

SEQ ID NO: 3117586 - protein, 23 aa, Giardia lamblia
KETTADRDKWKEHAERATEEIRA

SEQ ID NO: 3117587 - protein, 10 aa, Giardia lamblia
KETTSRQRQK

SEQ ID NO: 3117588 - protein, 8 aa, Giardia lamblia
KETTTKLE

SEQ ID NO: 3117589 - protein, 13 aa, Giardia lamblia
KETYADRDVERKA

SEQ ID NO: 3117590 - protein, 6 aa, Giardia lamblia
KETYER

SEQ ID NO: 3117591 - protein, 6 aa, Giardia lamblia
KETYQS

SEQ ID NO: 3117592 - protein, 7 aa, Giardia lamblia
KEVAEKD

SEQ ID NO: 3117593 - protein, 17 aa, Giardia lamblia
KEVDESLKKNAAEHTER

SEQ ID NO: 3117594 - protein, 13 aa, Giardia lamblia
KEVENKKAIAKLS

SEQ ID NO: 3117595 - protein, 7 aa, Giardia lamblia
KEVHDND

SEQ ID NO: 3117596 - protein, 14 aa, Giardia lamblia
KEVKPSSDKQSPYQ

SEQ ID NO: 3117597 - protein, 18 aa, Giardia lamblia
KEVKTDQVQEPKLKMGLK

SEQ ID NO: 3117598 - protein, 24 aa, Giardia lamblia
KEVPTTPDATEGDQEESSSSLADT

SEQ ID NO: 3117599 - protein, 7 aa, Giardia lamblia
KEVQRQE

SEQ ID NO: 3117600 - protein, 8 aa, Giardia lamblia
KEVSESIG

SEQ ID NO: 3117601 - protein, 6 aa, Giardia lamblia
KEVSPN

SEQ ID NO: 3117602 - protein, 7 aa, Giardia lamblia
KEVTGSI

SEQ ID NO: 3117603 - protein, 7 aa, Giardia lamblia
KEYDKKS

SEQ ID NO: 3117604 - protein, 5 aa, Giardia lamblia
KEYDL

SEQ ID NO: 3117605 - protein, 12 aa, Giardia lamblia
KEYDTRSATATA

SEQ ID NO: 3117606 - protein, 16 aa, Giardia lamblia
KEYEAAESKDYLEYIG

SEQ ID NO: 3117607 - protein, 10 aa, Giardia lamblia
KEYEDTRRRN

SEQ ID NO: 3117608 - protein, 5 aa, Giardia lamblia
KEYEQ

SEQ ID NO: 3117609 - protein, 4 aa, Giardia lamblia
KEYF

SEQ ID NO: 3117610 - protein, 8 aa, Giardia lamblia
KEYKDTAK

SEQ ID NO: 3117611 - protein, 4 aa, Giardia lamblia
KEYP

SEQ ID NO: 3117612 - protein, 4 aa, Giardia lamblia
KEYS

SEQ ID NO: 3117613 - protein, 8 aa, Giardia lamblia
KEYSDQSR

SEQ ID NO: 3117614 - protein, 6 aa, Giardia lamblia
KEYTDL

SEQ ID NO: 3117615 - protein, 8 aa, Giardia lamblia
KEYTDNGD

SEQ ID NO: 3117616 - protein, 11 aa, Giardia lamblia
KFADDSCKEGK

SEQ ID NO: 3117617 - protein, 16 aa, Giardia lamblia
KFASDTAKFCMECGSK

SEQ ID NO: 3117618 - protein, 11 aa, Giardia lamblia
KFASKQKTHEY

SEQ ID NO: 3117619 - protein, 10 aa, Giardia lamblia
KFASTEAYEE

SEQ ID NO: 3117620 - protein, 6 aa, Giardia lamblia
KFDATA

SEQ ID NO: 3117621 - protein, 8 aa, Giardia lamblia
KFDATARA

SEQ ID NO: 3117622 - protein, 12 aa, Giardia lamblia
KFDPPYKGSRGD

SEQ ID NO: 3117623 - protein, 13 aa, Giardia lamblia
KFDPRDYLGPGRD

SEQ ID NO: 3117624 - protein, 7 aa, Giardia lamblia
KFEDAQQ

SEQ ID NO: 3117625 - protein, 6 aa, Giardia lamblia
KFEPQA

SEQ ID NO: 3117626 - protein, 5 aa, Giardia lamblia
KFGGC

SEQ ID NO: 3117627 - protein, 15 aa, Giardia lamblia
KFGGRGARARRQKSY

SEQ ID NO: 3117628 - protein, 8 aa, Giardia lamblia
KFKDEEDR

SEQ ID NO: 3117629 - protein, 16 aa, Giardia lamblia
KFKDEQNQQQQSLEKS

SEQ ID NO: 3117630 - protein, 8 aa, Giardia lamblia
KFKEPAPL

SEQ ID NO: 3117631 - protein, 9 aa, Giardia lamblia
KFNASSAAT

SEQ ID NO: 3117632 - protein, 7 aa, Giardia lamblia
KFNSDNG

SEQ ID NO: 3117633 - protein, 11 aa, Giardia lamblia
KFPASFQPRTT

SEQ ID NO: 3117634 - protein, 7 aa, Giardia lamblia
KFPPGTD

SEQ ID NO: 3117635 - protein, 10 aa, Giardia lamblia
KFPPTNPTNR

SEQ ID NO: 3117636 - protein, 7 aa, Giardia lamblia
KFQQSGV

SEQ ID NO: 3117637 - protein, 7 aa, Giardia lamblia
KFQTRSS

SEQ ID NO: 3117638 - protein, 8 aa, Giardia lamblia
KFRNSSLQ

SEQ ID NO: 3117639 - protein, 5 aa, Giardia lamblia
KFSDG

SEQ ID NO: 3117640 - protein, 15 aa, Giardia lamblia
KFSEKGQVNQPPEEG

SEQ ID NO: 3117641 - protein, 6 aa, Giardia lamblia
KFSPPT

SEQ ID NO: 3117642 - protein, 8 aa, Giardia lamblia
KFSPPTDV

SEQ ID NO: 3117643 - protein, 6 aa, Giardia lamblia
KFSPQI

SEQ ID NO: 3117644 - protein, 6 aa, Giardia lamblia
KFSSST

SEQ ID NO: 3117645 - protein, 8 aa, Giardia lamblia
KFTGTSKT

SEQ ID NO: 3117646 - protein, 7 aa, Giardia lamblia
KFTPKQI

SEQ ID NO: 3117647 - protein, 8 aa, Giardia lamblia
KGAAGTTA

SEQ ID NO: 3117648 - protein, 9 aa, Giardia lamblia
KGAAQKGSL

SEQ ID NO: 3117649 - protein, 5 aa, Giardia lamblia
KGADI

SEQ ID NO: 3117650 - protein, 8 aa, Giardia lamblia
KGADQAKL

SEQ ID NO: 3117651 - protein, 4 aa, Giardia lamblia
KGAE

SEQ ID NO: 3117652 - protein, 7 aa, Giardia lamblia
KGAEDGL

SEQ ID NO: 3117653 - protein, 11 aa, Giardia lamblia
KGAGPNDTDEF

SEQ ID NO: 3117654 - protein, 5 aa, Giardia lamblia
KGAGR

SEQ ID NO: 3117655 - protein, 12 aa, Giardia lamblia
KGAKDTSKAREA

SEQ ID NO: 3117656 - protein, 10 aa, Giardia lamblia
KGAKEQADET

SEQ ID NO: 3117657 - protein, 20 aa, Giardia lamblia
KGAKNNPIKGDFPPQKGSGL

SEQ ID NO: 3117658 - protein, 12 aa, Giardia lamblia
KGAKTDEERREK

SEQ ID NO: 3117659 - protein, 8 aa, Giardia lamblia
KGALTNEK

SEQ ID NO: 3117660 - protein, 11 aa, Giardia lamblia
KGAMQNQEERR

SEQ ID NO: 3117661 - protein, 6 aa, Giardia lamblia
KGAPAL

SEQ ID NO: 3117662 - protein, 9 aa, Giardia lamblia
KGAPSQTSL

SEQ ID NO: 3117663 - protein, 9 aa, Giardia lamblia
KGARDNKGM

SEQ ID NO: 3117664 - protein, 7 aa, Giardia lamblia
KGARQRL

SEQ ID NO: 3117665 - protein, 7 aa, Giardia lamblia
KGARRSG

SEQ ID NO: 3117666 - protein, 10 aa, Giardia lamblia
KGASAEEMAG

SEQ ID NO: 3117667 - protein, 9 aa, Giardia lamblia
KGASCTPCS

SEQ ID NO: 3117668 - protein, 10 aa, Giardia lamblia
KGASEPGRKR

SEQ ID NO: 3117669 - protein, 24 aa, Giardia lamblia
KGASPSDHRQADASARSPVGTQSL

SEQ ID NO: 3117670 - protein, 24 aa, Giardia lamblia
KGASTRSASGVSSGTDKGLAGKNP

SEQ ID NO: 3117671 - protein, 13 aa, Giardia lamblia
KGATSKRNGETLD

SEQ ID NO: 3117672 - protein, 6 aa, Giardia lamblia
KGCPDP

SEQ ID NO: 3117673 - protein, 6 aa, Giardia lamblia
KGCSDA

SEQ ID NO: 3117674 - protein, 13 aa, Giardia lamblia
KGCSGMRDNYGNT

SEQ ID NO: 3117675 - protein, 5 aa, Giardia lamblia
KGCTE

SEQ ID NO: 3117676 - protein, 8 aa, Giardia lamblia
KGDAKSVQ

SEQ ID NO: 3117677 - protein, 9 aa, Giardia lamblia
KGDAKTIQT

SEQ ID NO: 3117678 - protein, 24 aa, Giardia lamblia
KGDAQRNEEEDEEEIQVDEDGNTP

SEQ ID NO: 3117679 - protein, 10 aa, Giardia lamblia
KGDAVDTDQS

SEQ ID NO: 3117680 - protein, 6 aa, Giardia lamblia
KGDEGA

SEQ ID NO: 3117681 - protein, 7 aa, Giardia lamblia
KGDEVTK

SEQ ID NO: 3117682 - protein, 8 aa, Giardia lamblia
KGDEYTQH

SEQ ID NO: 3117683 - protein, 4 aa, Giardia lamblia
KGDF

SEQ ID NO: 3117684 - protein, 15 aa, Giardia lamblia
KGDGNVDDDTTGPLD

SEQ ID NO: 3117685 - protein, 6 aa, Giardia lamblia
KGDGRP

SEQ ID NO: 3117686 - protein, 6 aa, Giardia lamblia
KGDHVS

SEQ ID NO: 3117687 - protein, 43 aa, Giardia lamblia
KGDKCKYSHNNDTSHREAPSKKEPVEEASAEAKAASGDEEKIS

SEQ ID NO: 3117688 - protein, 4 aa, Giardia lamblia
KGDL

SEQ ID NO: 3117689 - protein, 11 aa, Giardia lamblia
KGDLLSADQQA

SEQ ID NO: 3117690 - protein, 5 aa, Giardia lamblia
KGDLS

SEQ ID NO: 3117691 - protein, 5 aa, Giardia lamblia
KGDNI

SEQ ID NO: 3117692 - protein, 8 aa, Giardia lamblia
KGDPTIQG

SEQ ID NO: 3117693 - protein, 14 aa, Giardia lamblia
KGDQKTNSPASGSI

SEQ ID NO: 3117694 - protein, 7 aa, Giardia lamblia
KGDRDEV

SEQ ID NO: 3117695 - protein, 9 aa, Giardia lamblia
KGDRNTAKK

SEQ ID NO: 3117696 - protein, 4 aa, Giardia lamblia
KGDV

SEQ ID NO: 3117697 - protein, 6 aa, Giardia lamblia
KGDVAT

SEQ ID NO: 3117698 - protein, 5 aa, Giardia lamblia
KGDVL

SEQ ID NO: 3117699 - protein, 6 aa, Giardia lamblia
KGDVQK

SEQ ID NO: 3117700 - protein, 6 aa, Giardia lamblia
KGDVSA

SEQ ID NO: 3117701 - protein, 8 aa, Giardia lamblia
KGEASNLN

SEQ ID NO: 3117702 - protein, 5 aa, Giardia lamblia
KGEAV

SEQ ID NO: 3117703 - protein, 8 aa, Giardia lamblia
KGEDSATK

SEQ ID NO: 3117704 - protein, 5 aa, Giardia lamblia
KGEEL

SEQ ID NO: 3117705 - protein, 17 aa, Giardia lamblia
KGEFESGFERGGQTSEH

SEQ ID NO: 3117706 - protein, 6 aa, Giardia lamblia
KGEHKY

SEQ ID NO: 3117707 - protein, 6 aa, Giardia lamblia
KGEKEY

SEQ ID NO: 3117708 - protein, 9 aa, Giardia lamblia
KGELQSAEN

SEQ ID NO: 3117709 - protein, 6 aa, Giardia lamblia
KGENEA

SEQ ID NO: 3117710 - protein, 13 aa, Giardia lamblia
KGEQTNIPRPSHS

SEQ ID NO: 3117711 - protein, 8 aa, Giardia lamblia
KGERDVSG

SEQ ID NO: 3117712 - protein, 8 aa, Giardia lamblia
KGESASKK

SEQ ID NO: 3117713 - protein, 7 aa, Giardia lamblia
KGESFER

SEQ ID NO: 3117714 - protein, 7 aa, Giardia lamblia
KGESSTI

SEQ ID NO: 3117715 - protein, 8 aa, Giardia lamblia
KGETRNSK

SEQ ID NO: 3117716 - protein, 7 aa, Giardia lamblia
KGETRTA

SEQ ID NO: 3117717 - protein, 5 aa, Giardia lamblia
KGETY

SEQ ID NO: 3117718 - protein, 5 aa, Giardia lamblia
KGEVR

SEQ ID NO: 3117719 - protein, 6 aa, Giardia lamblia
KGEYIP

SEQ ID NO: 3117720 - protein, 14 aa, Giardia lamblia
KGEYKNGARNGYGT

SEQ ID NO: 3117721 - protein, 4 aa, Giardia lamblia
KGFT

SEQ ID NO: 3117722 - protein, 6 aa, Giardia lamblia
KGGADI

SEQ ID NO: 3117723 - protein, 9 aa, Giardia lamblia
KGGAGKSTL

SEQ ID NO: 3117724 - protein, 8 aa, Giardia lamblia
KGGAKGEL

SEQ ID NO: 3117725 - protein, 11 aa, Giardia lamblia
KGGAKGTEQVQ

SEQ ID NO: 3117726 - protein, 20 aa, Giardia lamblia
KGGAPQGPAGTGKTETTKDL

SEQ ID NO: 3117727 - protein, 8 aa, Giardia lamblia
KGGASDPD

SEQ ID NO: 3117728 - protein, 5 aa, Giardia lamblia
KGGAT

SEQ ID NO: 3117729 - protein, 38 aa, Giardia lamblia
KGGDDKPYRDEDIPDSDDTGTNPSTYVEDTPDSTQPVQ

SEQ ID NO: 3117730 - protein, 10 aa, Giardia lamblia
KGGEPDTRTV

SEQ ID NO: 3117731 - protein, 14 aa, Giardia lamblia
KGGGYDTVCLACSY

SEQ ID NO: 3117732 - protein, 5 aa, Giardia lamblia
KGGHN

SEQ ID NO: 3117733 - protein, 4 aa, Giardia lamblia
KGGL

SEQ ID NO: 3117734 - protein, 19 aa, Giardia lamblia
KGGNPEKVKESQRRRYAST

SEQ ID NO: 3117735 - protein, 6 aa, Giardia lamblia
KGGNTK

SEQ ID NO: 3117736 - protein, 9 aa, Giardia lamblia
KGGPIQKGS

SEQ ID NO: 3117737 - protein, 4 aa, Giardia lamblia
KGGQ

SEQ ID NO: 3117738 - protein, 6 aa, Giardia lamblia
KGGQCP

SEQ ID NO: 3117739 - protein, 7 aa, Giardia lamblia
KGGRTEA

SEQ ID NO: 3117740 - protein, 8 aa, Giardia lamblia
KGGTAHNA

SEQ ID NO: 3117741 - protein, 13 aa, Giardia lamblia
KGGVASAKHPRTM

SEQ ID NO: 3117742 - protein, 12 aa, Giardia lamblia
KGGVGKTTTSSS

SEQ ID NO: 3117743 - protein, 7 aa, Giardia lamblia
KGGYGDL

SEQ ID NO: 3117744 - protein, 5 aa, Giardia lamblia
KGHDS

SEQ ID NO: 3117745 - protein, 12 aa, Giardia lamblia
KGHEQKRRAQEA

SEQ ID NO: 3117746 - protein, 7 aa, Giardia lamblia
KGHKGAI

SEQ ID NO: 3117747 - protein, 4 aa, Giardia lamblia
KGHL

SEQ ID NO: 3117748 - protein, 6 aa, Giardia lamblia
KGHQQQ

SEQ ID NO: 3117749 - protein, 4 aa, Giardia lamblia
KGHR

SEQ ID NO: 3117750 - protein, 4 aa, Giardia lamblia
KGHT

SEQ ID NO: 3117751 - protein, 9 aa, Giardia lamblia
KGIADKEAE

SEQ ID NO: 3117752 - protein, 7 aa, Giardia lamblia
KGIDTEQ

SEQ ID NO: 3117753 - protein, 5 aa, Giardia lamblia
KGIKD

SEQ ID NO: 3117754 - protein, 10 aa, Giardia lamblia
KGIKDKQNHN

SEQ ID NO: 3117755 - protein, 5 aa, Giardia lamblia
KGILQ

SEQ ID NO: 3117756 - protein, 8 aa, Giardia lamblia
KGINESSI

SEQ ID NO: 3117757 - protein, 9 aa, Giardia lamblia
KGIPGQSTY

SEQ ID NO: 3117758 - protein, 9 aa, Giardia lamblia
KGIRDHSGR

SEQ ID NO: 3117759 - protein, 8 aa, Giardia lamblia
KGISGSRS

SEQ ID NO: 3117760 - protein, 5 aa, Giardia lamblia
KGISN

SEQ ID NO: 3117761 - protein, 7 aa, Giardia lamblia
KGISPSG

SEQ ID NO: 3117762 - protein, 7 aa, Giardia lamblia
KGITPPL

SEQ ID NO: 3117763 - protein, 7 aa, Giardia lamblia
KGKEGLS

SEQ ID NO: 3117764 - protein, 13 aa, Giardia lamblia
KGKEHQKDGAGGV

SEQ ID NO: 3117765 - protein, 6 aa, Giardia lamblia
KGKGHL

SEQ ID NO: 3117766 - protein, 5 aa, Giardia lamblia
KGKKE

SEQ ID NO: 3117767 - protein, 7 aa, Giardia lamblia
KGKKGTL

SEQ ID NO: 3117768 - protein, 8 aa, Giardia lamblia
KGKLRSSY

SEQ ID NO: 3117769 - protein, 19 aa, Giardia lamblia
KGKNNSKSKRGADQDPSQD

SEQ ID NO: 3117770 - protein, 8 aa, Giardia lamblia
KGKPIPQE

SEQ ID NO: 3117771 - protein, 9 aa, Giardia lamblia
KGKPPPGLA

SEQ ID NO: 3117772 - protein, 6 aa, Giardia lamblia
KGKPSD

SEQ ID NO: 3117773 - protein, 11 aa, Giardia lamblia
KGKPTVSNDGA

SEQ ID NO: 3117774 - protein, 10 aa, Giardia lamblia
KGKRSHIPYR

SEQ ID NO: 3117775 - protein, 10 aa, Giardia lamblia
KGKTKVAASS

SEQ ID NO: 3117776 - protein, 7 aa, Giardia lamblia
KGKTTFL

SEQ ID NO: 3117777 - protein, 4 aa, Giardia lamblia
KGKY

SEQ ID NO: 3117778 - protein, 11 aa, Giardia lamblia
KGLAPDSPPAM

SEQ ID NO: 3117779 - protein, 12 aa, Giardia lamblia
KGLEDKGKNDLD

SEQ ID NO: 3117780 - protein, 11 aa, Giardia lamblia
KGLESQPVDSS

SEQ ID NO: 3117781 - protein, 4 aa, Giardia lamblia
KGLG

SEQ ID NO: 3117782 - protein, 17 aa, Giardia lamblia
KGLGQSASTYNGGQSAD

SEQ ID NO: 3117783 - protein, 7 aa, Giardia lamblia
KGLGSSA

SEQ ID NO: 3117784 - protein, 9 aa, Giardia lamblia
KGLKDKQHH

SEQ ID NO: 3117785 - protein, 10 aa, Giardia lamblia
KGLKDNTGCT

SEQ ID NO: 3117786 - protein, 5 aa, Giardia lamblia
KGLPR

SEQ ID NO: 3117787 - protein, 7 aa, Giardia lamblia
KGLPVPP

SEQ ID NO: 3117788 - protein, 15 aa, Giardia lamblia
KGLSGDLGSMRSGTS

SEQ ID NO: 3117789 - protein, 7 aa, Giardia lamblia
KGLSQDS

SEQ ID NO: 3117790 - protein, 5 aa, Giardia lamblia
KGLSS

SEQ ID NO: 3117791 - protein, 10 aa, Giardia lamblia
KGLTDSRGST

SEQ ID NO: 3117792 - protein, 8 aa, Giardia lamblia
KGMEDAAG

SEQ ID NO: 3117793 - protein, 6 aa, Giardia lamblia
KGMKAP

SEQ ID NO: 3117794 - protein, 10 aa, Giardia lamblia
KGMKDNKDMT

SEQ ID NO: 3117795 - protein, 11 aa, Giardia lamblia
KGMKDNKGRTA

SEQ ID NO: 3117796 - protein, 9 aa, Giardia lamblia
KGMKNSKGM

SEQ ID NO: 3117797 - protein, 4 aa, Giardia lamblia
KGMQ

SEQ ID NO: 3117798 - protein, 8 aa, Giardia lamblia
KGMQKKDG

SEQ ID NO: 3117799 - protein, 16 aa, Giardia lamblia
KGMQTREEYKGIPAGA

SEQ ID NO: 3117800 - protein, 11 aa, Giardia lamblia
KGMRDARGRNA

SEQ ID NO: 3117801 - protein, 11 aa, Giardia lamblia
KGMTADNGQTA

SEQ ID NO: 3117802 - protein, 21 aa, Giardia lamblia
KGNANRVTAATNMNDTSSRSH

SEQ ID NO: 3117803 - protein, 6 aa, Giardia lamblia
KGNEEA

SEQ ID NO: 3117804 - protein, 6 aa, Giardia lamblia
KGNIDN

SEQ ID NO: 3117805 - protein, 5 aa, Giardia lamblia
KGNIE

SEQ ID NO: 3117806 - protein, 6 aa, Giardia lamblia
KGNITG

SEQ ID NO: 3117807 - protein, 4 aa, Giardia lamblia
KGNL

SEQ ID NO: 3117808 - protein, 5 aa, Giardia lamblia
KGNLP

SEQ ID NO: 3117809 - protein, 4 aa, Giardia lamblia
KGNM

SEQ ID NO: 3117810 - protein, 5 aa, Giardia lamblia
KGNNL

SEQ ID NO: 3117811 - protein, 14 aa, Giardia lamblia
KGNNYNEKEEKTNY

SEQ ID NO: 3117812 - protein, 8 aa, Giardia lamblia
KGNPPTFP

SEQ ID NO: 3117813 - protein, 5 aa, Giardia lamblia
KGNQD

SEQ ID NO: 3117814 - protein, 9 aa, Giardia lamblia
KGNQDASGW

SEQ ID NO: 3117815 - protein, 5 aa, Giardia lamblia
KGNTD

SEQ ID NO: 3117816 - protein, 8 aa, Giardia lamblia
KGNTGSKI

SEQ ID NO: 3117817 - protein, 6 aa, Giardia lamblia
KGNTNS

SEQ ID NO: 3117818 - protein, 6 aa, Giardia lamblia
KGNTPL

SEQ ID NO: 3117819 - protein, 6 aa, Giardia lamblia
KGNVDQ

SEQ ID NO: 3117820 - protein, 7 aa, Giardia lamblia
KGNYGAV

SEQ ID NO: 3117821 - protein, 6 aa, Giardia lamblia
KGNYPT

SEQ ID NO: 3117822 - protein, 7 aa, Giardia lamblia
KGPARNG

SEQ ID NO: 3117823 - protein, 11 aa, Giardia lamblia
KGPASTKGSAI

SEQ ID NO: 3117824 - protein, 5 aa, Giardia lamblia
KGPDV

SEQ ID NO: 3117825 - protein, 10 aa, Giardia lamblia
KGPGASSLTK

SEQ ID NO: 3117826 - protein, 4 aa, Giardia lamblia
KGPI

SEQ ID NO: 3117827 - protein, 6 aa, Giardia lamblia
KGPIIR

SEQ ID NO: 3117828 - protein, 6 aa, Giardia lamblia
KGPIKP

SEQ ID NO: 3117829 - protein, 7 aa, Giardia lamblia
KGPISPT

SEQ ID NO: 3117830 - protein, 7 aa, Giardia lamblia
KGPKQLK

SEQ ID NO: 3117831 - protein, 4 aa, Giardia lamblia
KGPL

SEQ ID NO: 3117832 - protein, 19 aa, Giardia lamblia
KGPLTEAGEKPRSARQEGV

SEQ ID NO: 3117833 - protein, 9 aa, Giardia lamblia
KGPPKVQPH

SEQ ID NO: 3117834 - protein, 7 aa, Giardia lamblia
KGPSDHN

SEQ ID NO: 3117835 - protein, 9 aa, Giardia lamblia
KGPSGPINM

SEQ ID NO: 3117836 - protein, 7 aa, Giardia lamblia
KGPTISK

SEQ ID NO: 3117837 - protein, 8 aa, Giardia lamblia
KGQAEEAI

SEQ ID NO: 3117838 - protein, 8 aa, Giardia lamblia
KGQDEEVT

SEQ ID NO: 3117839 - protein, 21 aa, Giardia lamblia
KGQETGPSAAIPEAANKKADA

SEQ ID NO: 3117840 - protein, 6 aa, Giardia lamblia
KGQHCQ

SEQ ID NO: 3117841 - protein, 6 aa, Giardia lamblia
KGQPLQ

SEQ ID NO: 3117842 - protein, 6 aa, Giardia lamblia
KGQPVP

SEQ ID NO: 3117843 - protein, 7 aa, Giardia lamblia
KGQQPKL

SEQ ID NO: 3117844 - protein, 14 aa, Giardia lamblia
KGQTPIEKAEKNVK

SEQ ID NO: 3117845 - protein, 4 aa, Giardia lamblia
KGRA

SEQ ID NO: 3117846 - protein, 8 aa, Giardia lamblia
KGRAADSS

SEQ ID NO: 3117847 - protein, 5 aa, Giardia lamblia
KGRAT

SEQ ID NO: 3117848 - protein, 7 aa, Giardia lamblia
KGREEHS

SEQ ID NO: 3117849 - protein, 8 aa, Giardia lamblia
KGREHKTN

SEQ ID NO: 3117850 - protein, 5 aa, Giardia lamblia
KGRES

SEQ ID NO: 3117851 - protein, 7 aa, Giardia lamblia
KGRKAEY

SEQ ID NO: 3117852 - protein, 6 aa, Giardia lamblia
KGRPNS

SEQ ID NO: 3117853 - protein, 10 aa, Giardia lamblia
KGRQRNDGAS

SEQ ID NO: 3117854 - protein, 6 aa, Giardia lamblia
KGRSLN

SEQ ID NO: 3117855 - protein, 9 aa, Giardia lamblia
KGRTTKGSE

SEQ ID NO: 3117856 - protein, 7 aa, Giardia lamblia
KGSAEAA

SEQ ID NO: 3117857 - protein, 9 aa, Giardia lamblia
KGSANGSRA

SEQ ID NO: 3117858 - protein, 6 aa, Giardia lamblia
KGSAPL

SEQ ID NO: 3117859 - protein, 8 aa, Giardia lamblia
KGSATIDP

SEQ ID NO: 3117860 - protein, 6 aa, Giardia lamblia
KGSDAS

SEQ ID NO: 3117861 - protein, 4 aa, Giardia lamblia
KGSF

SEQ ID NO: 3117862 - protein, 5 aa, Giardia lamblia
KGSGC

SEQ ID NO: 3117863 - protein, 7 aa, Giardia lamblia
KGSGDFN

SEQ ID NO: 3117864 - protein, 13 aa, Giardia lamblia
KGSGNPPLPQPKR

SEQ ID NO: 3117865 - protein, 5 aa, Giardia lamblia
KGSHP

SEQ ID NO: 3117866 - protein, 5 aa, Giardia lamblia
KGSIE

SEQ ID NO: 3117867 - protein, 15 aa, Giardia lamblia
KGSISSQDAQKNKEL

SEQ ID NO: 3117868 - protein, 8 aa, Giardia lamblia
KGSMSDRD

SEQ ID NO: 3117869 - protein, 7 aa, Giardia lamblia
KGSPKSV

SEQ ID NO: 3117870 - protein, 5 aa, Giardia lamblia
KGSPL

SEQ ID NO: 3117871 - protein, 7 aa, Giardia lamblia
KGSPSSV

SEQ ID NO: 3117872 - protein, 9 aa, Giardia lamblia
KGSQDAGGW

SEQ ID NO: 3117873 - protein, 7 aa, Giardia lamblia
KGSQDDQ

SEQ ID NO: 3117874 - protein, 7 aa, Giardia lamblia
KGSQFSS

SEQ ID NO: 3117875 - protein, 4 aa, Giardia lamblia
KGSR

SEQ ID NO: 3117876 - protein, 7 aa, Giardia lamblia
KGSRRNV

SEQ ID NO: 3117877 - protein, 13 aa, Giardia lamblia
KGSRTDRNTEKLP

SEQ ID NO: 3117878 - protein, 11 aa, Giardia lamblia
KGSSAYASTLP

SEQ ID NO: 3117879 - protein, 16 aa, Giardia lamblia
KGSSLSADNAYRPERV

SEQ ID NO: 3117880 - protein, 9 aa, Giardia lamblia
KGSSRGRIR

SEQ ID NO: 3117881 - protein, 9 aa, Giardia lamblia
KGSSSMTQE

SEQ ID NO: 3117882 - protein, 6 aa, Giardia lamblia
KGSTPM

SEQ ID NO: 3117883 - protein, 5 aa, Giardia lamblia
KGSVI

SEQ ID NO: 3117884 - protein, 32 aa, Giardia lamblia
KGTAPDSKAEKQPPDHSVAEDQAIPGKGPNCD

SEQ ID NO: 3117885 - protein, 6 aa, Giardia lamblia
KGTARV

SEQ ID NO: 3117886 - protein, 4 aa, Giardia lamblia
KGTD

SEQ ID NO: 3117887 - protein, 9 aa, Giardia lamblia
KGTDPDGDF

SEQ ID NO: 3117888 - protein, 9 aa, Giardia lamblia
KGTDVAQSS

SEQ ID NO: 3117889 - protein, 6 aa, Giardia lamblia
KGTEAE

SEQ ID NO: 3117890 - protein, 8 aa, Giardia lamblia
KGTEEYEN

SEQ ID NO: 3117891 - protein, 7 aa, Giardia lamblia
KGTESIK

SEQ ID NO: 3117892 - protein, 5 aa, Giardia lamblia
KGTFK

SEQ ID NO: 3117893 - protein, 5 aa, Giardia lamblia
KGTGI

SEQ ID NO: 3117894 - protein, 5 aa, Giardia lamblia
KGTHA

SEQ ID NO: 3117895 - protein, 9 aa, Giardia lamblia
KGTKQHSKH

SEQ ID NO: 3117896 - protein, 6 aa, Giardia lamblia
KGTKYL

SEQ ID NO: 3117897 - protein, 4 aa, Giardia lamblia
KGTL

SEQ ID NO: 3117898 - protein, 10 aa, Giardia lamblia
KGTLQASTLP

SEQ ID NO: 3117899 - protein, 8 aa, Giardia lamblia
KGTLSKKD

SEQ ID NO: 3117900 - protein, 53 aa, Giardia lamblia
KGTNTDASKKNKKGGYSSVSRSSSTRNLYGSDGHVSKDDGSTDPSSARGIPPD

SEQ ID NO: 3117901 - protein, 7 aa, Giardia lamblia
KGTPRHT

SEQ ID NO: 3117902 - protein, 12 aa, Giardia lamblia
KGTQELAATQQR

SEQ ID NO: 3117903 - protein, 6 aa, Giardia lamblia
KGTSTI

SEQ ID NO: 3117904 - protein, 4 aa, Giardia lamblia
KGTY

SEQ ID NO: 3117905 - protein, 9 aa, Giardia lamblia
KGVDKNHPH

SEQ ID NO: 3117906 - protein, 6 aa, Giardia lamblia
KGVEGQ

SEQ ID NO: 3117907 - protein, 10 aa, Giardia lamblia
KGVEQTNSTR

SEQ ID NO: 3117908 - protein, 12 aa, Giardia lamblia
KGVKDNLGRTAR

SEQ ID NO: 3117909 - protein, 11 aa, Giardia lamblia
KGVLEDGQSTI

SEQ ID NO: 3117910 - protein, 40 aa, Giardia lamblia
KGVMGGNDDPEYGDSTAVPPATPGSTKRKSVSRASSKSNR

SEQ ID NO: 3117911 - protein, 5 aa, Giardia lamblia
KGVPM

SEQ ID NO: 3117912 - protein, 11 aa, Giardia lamblia
KGVSTNSKTPL

SEQ ID NO: 3117913 - protein, 9 aa, Giardia lamblia
KGVTRQGAV

SEQ ID NO: 3117914 - protein, 7 aa, Giardia lamblia
KGVYSGD

SEQ ID NO: 3117915 - protein, 14 aa, Giardia lamblia
KGYAGRRNKKGKTA

SEQ ID NO: 3117916 - protein, 7 aa, Giardia lamblia
KGYDDSI

SEQ ID NO: 3117917 - protein, 7 aa, Giardia lamblia
KGYFNDD

SEQ ID NO: 3117918 - protein, 5 aa, Giardia lamblia
KGYFT

SEQ ID NO: 3117919 - protein, 8 aa, Giardia lamblia
KGYPDAAT

SEQ ID NO: 3117920 - protein, 4 aa, Giardia lamblia
KGYS

SEQ ID NO: 3117921 - protein, 4 aa, Giardia lamblia
KGYV

SEQ ID NO: 3117922 - protein, 6 aa, Giardia lamblia
KHAAER

SEQ ID NO: 3117923 - protein, 9 aa, Giardia lamblia
KHADKGVAE

SEQ ID NO: 3117924 - protein, 16 aa, Giardia lamblia
KHADSQLAEAVNKSGL

SEQ ID NO: 3117925 - protein, 7 aa, Giardia lamblia
KHAERHR

SEQ ID NO: 3117926 - protein, 15 aa, Giardia lamblia
KHAEVTKGMLLHLID

SEQ ID NO: 3117927 - protein, 31 aa, Giardia lamblia
KHAHTKKGAQSRRESLGSSNLETGHGGKVTG

SEQ ID NO: 3117928 - protein, 5 aa, Giardia lamblia
KHARE

SEQ ID NO: 3117929 - protein, 10 aa, Giardia lamblia
KHCAGSRTQV

SEQ ID NO: 3117930 - protein, 6 aa, Giardia lamblia
KHDAAR

SEQ ID NO: 3117931 - protein, 4 aa, Giardia lamblia
KHDD

SEQ ID NO: 3117932 - protein, 4 aa, Giardia lamblia
KHDG

SEQ ID NO: 3117933 - protein, 7 aa, Giardia lamblia
KHDITPS

SEQ ID NO: 3117934 - protein, 7 aa, Giardia lamblia
KHDMDTD

SEQ ID NO: 3117935 - protein, 7 aa, Giardia lamblia
KHDPTGK

SEQ ID NO: 3117936 - protein, 10 aa, Giardia lamblia
KHDSTLKTTI

SEQ ID NO: 3117937 - protein, 11 aa, Giardia lamblia
KHEDPNAARER

SEQ ID NO: 3117938 - protein, 7 aa, Giardia lamblia
KHEECDS

SEQ ID NO: 3117939 - protein, 7 aa, Giardia lamblia
KHEERGV

SEQ ID NO: 3117940 - protein, 9 aa, Giardia lamblia
KHESRRSLS

SEQ ID NO: 3117941 - protein, 4 aa, Giardia lamblia
KHET

SEQ ID NO: 3117942 - protein, 13 aa, Giardia lamblia
KHGEAYNSRHGGK

SEQ ID NO: 3117943 - protein, 6 aa, Giardia lamblia
KHGKLP

SEQ ID NO: 3117944 - protein, 20 aa, Giardia lamblia
KHGNRKELSGAHAGSSLNTS

SEQ ID NO: 3117945 - protein, 9 aa, Giardia lamblia
KHGPLRAPE

SEQ ID NO: 3117946 - protein, 19 aa, Giardia lamblia
KHGQEATNARFKRNTSQKY

SEQ ID NO: 3117947 - protein, 8 aa, Giardia lamblia
KHGRPRRL

SEQ ID NO: 3117948 - protein, 7 aa, Giardia lamblia
KHGSTTA

SEQ ID NO: 3117949 - protein, 7 aa, Giardia lamblia
KHHEEKA

SEQ ID NO: 3117950 - protein, 8 aa, Giardia lamblia
KHHNPDRC

SEQ ID NO: 3117951 - protein, 7 aa, Giardia lamblia
KHHRRQE

SEQ ID NO: 3117952 - protein, 7 aa, Giardia lamblia
KHIPYRD

SEQ ID NO: 3117953 - protein, 5 aa, Giardia lamblia
KHIRR

SEQ ID NO: 3117954 - protein, 6 aa, Giardia lamblia
KHKNTD

SEQ ID NO: 3117955 - protein, 7 aa, Giardia lamblia
KHKSERI

SEQ ID NO: 3117956 - protein, 9 aa, Giardia lamblia
KHKSRKQAE

SEQ ID NO: 3117957 - protein, 27 aa, Giardia lamblia
KHKTSNQKLREDMRRKDNNSRLTSEQL

SEQ ID NO: 3117958 - protein, 4 aa, Giardia lamblia
KHKY

SEQ ID NO: 3117959 - protein, 15 aa, Giardia lamblia
KHLSDKDKKNSEGDT

SEQ ID NO: 3117960 - protein, 18 aa, Giardia lamblia
KHNGAHSRGKTAKNASLS

SEQ ID NO: 3117961 - protein, 17 aa, Giardia lamblia
KHNSSGKICGKSQLSST

SEQ ID NO: 3117962 - protein, 16 aa, Giardia lamblia
KHPDKIAKAAKRGQLD

SEQ ID NO: 3117963 - protein, 7 aa, Giardia lamblia
KHPENAI

SEQ ID NO: 3117964 - protein, 6 aa, Giardia lamblia
KHPGGR

SEQ ID NO: 3117965 - protein, 4 aa, Giardia lamblia
KHPQ

SEQ ID NO: 3117966 - protein, 24 aa, Giardia lamblia
KHPRKYNNGRYNVGSTEGASASGP

SEQ ID NO: 3117967 - protein, 13 aa, Giardia lamblia
KHPRNGVDQGPLD

SEQ ID NO: 3117968 - protein, 12 aa, Giardia lamblia
KHPSLSALSTTR

SEQ ID NO: 3117969 - protein, 8 aa, Giardia lamblia
KHPSSDSC

SEQ ID NO: 3117970 - protein, 7 aa, Giardia lamblia
KHQDAKT

SEQ ID NO: 3117971 - protein, 7 aa, Giardia lamblia
KHQDSSA

SEQ ID NO: 3117972 - protein, 13 aa, Giardia lamblia
KHQELSTAAEEAG

SEQ ID NO: 3117973 - protein, 7 aa, Giardia lamblia
KHQGGAR

SEQ ID NO: 3117974 - protein, 51 aa, Giardia lamblia
KHQSPDHLGTTRTLDGESSDVTNSPLSAHSSSANNATAKGLTLPSNSTGVT

SEQ ID NO: 3117975 - protein, 6 aa, Giardia lamblia
KHREAT

SEQ ID NO: 3117976 - protein, 8 aa, Giardia lamblia
KHREDTQE

SEQ ID NO: 3117977 - protein, 50 aa, Giardia lamblia
KHRGSSTANSMTDTSPNHSRTPASSTAYSAVPSGTMSDASRSKKTDYVGS

SEQ ID NO: 3117978 - protein, 9 aa, Giardia lamblia
KHRNNKKET

SEQ ID NO: 3117979 - protein, 39 aa, Giardia lamblia
KHRPSTTQPQTKTSVYAAESSPSPMRTPQQNPLTASQMT

SEQ ID NO: 3117980 - protein, 10 aa, Giardia lamblia
KHRQEAEDKF

SEQ ID NO: 3117981 - protein, 7 aa, Giardia lamblia
KHRQRGE

SEQ ID NO: 3117982 - protein, 4 aa, Giardia lamblia
KHSE

SEQ ID NO: 3117983 - protein, 7 aa, Giardia lamblia
KHSFSRK

SEQ ID NO: 3117984 - protein, 9 aa, Giardia lamblia
KHSKEEVRD

SEQ ID NO: 3117985 - protein, 4 aa, Giardia lamblia
KHSL

SEQ ID NO: 3117986 - protein, 22 aa, Giardia lamblia
KHSNKYTKTSEPHYDGSYPSFN

SEQ ID NO: 3117987 - protein, 7 aa, Giardia lamblia
KHSPASD

SEQ ID NO: 3117988 - protein, 7 aa, Giardia lamblia
KHSPRSL

SEQ ID NO: 3117989 - protein, 10 aa, Giardia lamblia
KHSQLKNEHD

SEQ ID NO: 3117990 - protein, 15 aa, Giardia lamblia
KHSTVTKSTPSLPAM

SEQ ID NO: 3117991 - protein, 5 aa, Giardia lamblia
KHSVP

SEQ ID NO: 3117992 - protein, 48 aa, Giardia lamblia
KHSVSTQRSTSTKSQPDKSDAGVPGAASNNSAGPFGSSSGGASGPGSA

SEQ ID NO: 3117993 - protein, 13 aa, Giardia lamblia
KHTDPTGGSKLTP

SEQ ID NO: 3117994 - protein, 18 aa, Giardia lamblia
KHTFQSNRQMKSEDYSAL

SEQ ID NO: 3117995 - protein, 7 aa, Giardia lamblia
KHTKESA

SEQ ID NO: 3117996 - protein, 5 aa, Giardia lamblia
KHTSE

SEQ ID NO: 3117997 - protein, 13 aa, Giardia lamblia
KHTSQARRVESSE

SEQ ID NO: 3117998 - protein, 37 aa, Giardia lamblia
KHTVQSYKNEPTPGPLTEHTNNNASLAEGDNKAGMDV

SEQ ID NO: 3117999 - protein, 11 aa, Giardia lamblia
KHVPKKQARLE

SEQ ID NO: 3118000 - protein, 12 aa, Giardia lamblia
KHYEEERNKELR

SEQ ID NO: 3118001 - protein, 6 aa, Giardia lamblia
KHYGDA

SEQ ID NO: 3118002 - protein, 5 aa, Giardia lamblia
KHYNN

SEQ ID NO: 3118003 - protein, 8 aa, Giardia lamblia
KIAANGKP

SEQ ID NO: 3118004 - protein, 14 aa, Giardia lamblia
KIAANKQETERVKK

SEQ ID NO: 3118005 - protein, 6 aa, Giardia lamblia
KIAESE

SEQ ID NO: 3118006 - protein, 43 aa, Giardia lamblia
KIATNTTSEAKYAPNVDHSPPVASPATSTATLSSLSNEQQKLS

SEQ ID NO: 3118007 - protein, 16 aa, Giardia lamblia
KIDEENRDDDFLEDEM

SEQ ID NO: 3118008 - protein, 29 aa, Giardia lamblia
KIDPVKKQRDQLEKEANEALSKNNPDRLD

SEQ ID NO: 3118009 - protein, 8 aa, Giardia lamblia
KIDQEKKK

SEQ ID NO: 3118010 - protein, 5 aa, Giardia lamblia
KIDRS

SEQ ID NO: 3118011 - protein, 7 aa, Giardia lamblia
KIDYQKK

SEQ ID NO: 3118012 - protein, 5 aa, Giardia lamblia
KIEDT

SEQ ID NO: 3118013 - protein, 6 aa, Giardia lamblia
KIEEEE

SEQ ID NO: 3118014 - protein, 12 aa, Giardia lamblia
KIEEGAEGVPIP

SEQ ID NO: 3118015 - protein, 7 aa, Giardia lamblia
KIEERSE

SEQ ID NO: 3118016 - protein, 9 aa, Giardia lamblia
KIEETATDK

SEQ ID NO: 3118017 - protein, 8 aa, Giardia lamblia
KIEETERA

SEQ ID NO: 3118018 - protein, 14 aa, Giardia lamblia
KIEPDLTADPATNP

SEQ ID NO: 3118019 - protein, 13 aa, Giardia lamblia
KIEPKKKQAPPKD

SEQ ID NO: 3118020 - protein, 9 aa, Giardia lamblia
KIEPNKNEI

SEQ ID NO: 3118021 - protein, 4 aa, Giardia lamblia
KIEQ

SEQ ID NO: 3118022 - protein, 24 aa, Giardia lamblia
KIESQRKDKHKKKSSSKDGDLGEI

SEQ ID NO: 3118023 - protein, 6 aa, Giardia lamblia
KIETAG

SEQ ID NO: 3118024 - protein, 10 aa, Giardia lamblia
KIGDTPGTYI

SEQ ID NO: 3118025 - protein, 6 aa, Giardia lamblia
KIGGKL

SEQ ID NO: 3118026 - protein, 25 aa, Giardia lamblia
KIGGSTITAYENPKRGSGEKTPDEL

SEQ ID NO: 3118027 - protein, 37 aa, Giardia lamblia
KIGNPKKSRTSNTLSPSRKPTRPASATQIRKASGSVL

SEQ ID NO: 3118028 - protein, 7 aa, Giardia lamblia
KIGPDGS

SEQ ID NO: 3118029 - protein, 7 aa, Giardia lamblia
KIGREYE

SEQ ID NO: 3118030 - protein, 12 aa, Giardia lamblia
KIGRKGGLTHSS

SEQ ID NO: 3118031 - protein, 5 aa, Giardia lamblia
KIGRN

SEQ ID NO: 3118032 - protein, 9 aa, Giardia lamblia
KIGSPAADT

SEQ ID NO: 3118033 - protein, 9 aa, Giardia lamblia
KIGTTANPL

SEQ ID NO: 3118034 - protein, 11 aa, Giardia lamblia
KIHNGDKTLDT

SEQ ID NO: 3118035 - protein, 21 aa, Giardia lamblia
KIHSESQRAEITAAIQKYMRA

SEQ ID NO: 3118036 - protein, 19 aa, Giardia lamblia
KIKCKNGKSAYDYAASKNH

SEQ ID NO: 3118037 - protein, 7 aa, Giardia lamblia
KIKEQNE

SEQ ID NO: 3118038 - protein, 13 aa, Giardia lamblia
KIKNRDPDPLLPG

SEQ ID NO: 3118039 - protein, 16 aa, Giardia lamblia
KIKREEKTLHGPGEYT

SEQ ID NO: 3118040 - protein, 4 aa, Giardia lamblia
KIKS

SEQ ID NO: 3118041 - protein, 7 aa, Giardia lamblia
KIKSTGN

SEQ ID NO: 3118042 - protein, 4 aa, Giardia lamblia
KINA

SEQ ID NO: 3118043 - protein, 5 aa, Giardia lamblia
KINKG

SEQ ID NO: 3118044 - protein, 13 aa, Giardia lamblia
KINPTNASEGGNP

SEQ ID NO: 3118045 - protein, 14 aa, Giardia lamblia
KIPDEVKQSSDPKV

SEQ ID NO: 3118046 - protein, 5 aa, Giardia lamblia
KIPEN

SEQ ID NO: 3118047 - protein, 8 aa, Giardia lamblia
KIPENDRN

SEQ ID NO: 3118048 - protein, 7 aa, Giardia lamblia
KIPESQR

SEQ ID NO: 3118049 - protein, 4 aa, Giardia lamblia
KIPG

SEQ ID NO: 3118050 - protein, 7 aa, Giardia lamblia
KIPGSDY

SEQ ID NO: 3118051 - protein, 7 aa, Giardia lamblia
KIPKTNV

SEQ ID NO: 3118052 - protein, 8 aa, Giardia lamblia
KIPPKSKT

SEQ ID NO: 3118053 - protein, 7 aa, Giardia lamblia
KIPQEEY

SEQ ID NO: 3118054 - protein, 13 aa, Giardia lamblia
KIPTHGKATSFQD

SEQ ID NO: 3118055 - protein, 11 aa, Giardia lamblia
KIPVSRTDAGI

SEQ ID NO: 3118056 - protein, 30 aa, Giardia lamblia
KIPYKKKPATPKAQSVVQTPSSNEAPAQAY

SEQ ID NO: 3118057 - protein, 12 aa, Giardia lamblia
KIQDKEGIPPDQ

SEQ ID NO: 3118058 - protein, 11 aa, Giardia lamblia
KIQEDGEEHGV

SEQ ID NO: 3118059 - protein, 6 aa, Giardia lamblia
KIQGSN

SEQ ID NO: 3118060 - protein, 10 aa, Giardia lamblia
KIQKRKKGEV

SEQ ID NO: 3118061 - protein, 6 aa, Giardia lamblia
KIQPER

SEQ ID NO: 3118062 - protein, 36 aa, Giardia lamblia
KIQPTKKQEDWSFSSDTSENSPQHSKLTSPPPPHLE

SEQ ID NO: 3118063 - protein, 6 aa, Giardia lamblia
KIRSNL

SEQ ID NO: 3118064 - protein, 8 aa, Giardia lamblia
KIRSPTEH

SEQ ID NO: 3118065 - protein, 10 aa, Giardia lamblia
KISDQKQQLQ

SEQ ID NO: 3118066 - protein, 13 aa, Giardia lamblia
KISEADDQSTAFN

SEQ ID NO: 3118067 - protein, 6 aa, Giardia lamblia
KISEAG

SEQ ID NO: 3118068 - protein, 8 aa, Giardia lamblia
KISEDRTT

SEQ ID NO: 3118069 - protein, 11 aa, Giardia lamblia
KISESPNQTDY

SEQ ID NO: 3118070 - protein, 6 aa, Giardia lamblia
KISETR

SEQ ID NO: 3118071 - protein, 5 aa, Giardia lamblia
KISGA

SEQ ID NO: 3118072 - protein, 13 aa, Giardia lamblia
KISGDPASTEEKQ

SEQ ID NO: 3118073 - protein, 6 aa, Giardia lamblia
KISKLQ

SEQ ID NO: 3118074 - protein, 15 aa, Giardia lamblia
KISNTDSSCSLPSTG

SEQ ID NO: 3118075 - protein, 8 aa, Giardia lamblia
KISPEYNT

SEQ ID NO: 3118076 - protein, 13 aa, Giardia lamblia
KISRSKAKLNASS

SEQ ID NO: 3118077 - protein, 10 aa, Giardia lamblia
KITAERDEAL

SEQ ID NO: 3118078 - protein, 11 aa, Giardia lamblia
KITDESLKTTV

SEQ ID NO: 3118079 - protein, 11 aa, Giardia lamblia
KITDPPTSPRS

SEQ ID NO: 3118080 - protein, 6 aa, Giardia lamblia
KITEAA

SEQ ID NO: 3118081 - protein, 28 aa, Giardia lamblia
KITETTKNIQPAAPLSPMSANKASYEAQ

SEQ ID NO: 3118082 - protein, 7 aa, Giardia lamblia
KITKETV

SEQ ID NO: 3118083 - protein, 11 aa, Giardia lamblia
KITKGNWPAEE

SEQ ID NO: 3118084 - protein, 6 aa, Giardia lamblia
KITKGS

SEQ ID NO: 3118085 - protein, 11 aa, Giardia lamblia
KITKGYSSSDG

SEQ ID NO: 3118086 - protein, 4 aa, Giardia lamblia
KITP

SEQ ID NO: 3118087 - protein, 7 aa, Giardia lamblia
KITPAKD

SEQ ID NO: 3118088 - protein, 7 aa, Giardia lamblia
KITPAQD

SEQ ID NO: 3118089 - protein, 5 aa, Giardia lamblia
KITPE

SEQ ID NO: 3118090 - protein, 12 aa, Giardia lamblia
KITQRKNPDPYL

SEQ ID NO: 3118091 - protein, 7 aa, Giardia lamblia
KITVPQP

SEQ ID NO: 3118092 - protein, 9 aa, Giardia lamblia
KKAADQNKA

SEQ ID NO: 3118093 - protein, 8 aa, Giardia lamblia
KKAAIEAE

SEQ ID NO: 3118094 - protein, 8 aa, Giardia lamblia
KKAAKNAR

SEQ ID NO: 3118095 - protein, 14 aa, Giardia lamblia
KKAAQLRSEKEQKE

SEQ ID NO: 3118096 - protein, 8 aa, Giardia lamblia
KKAARGLN

SEQ ID NO: 3118097 - protein, 8 aa, Giardia lamblia
KKAATDIS

SEQ ID NO: 3118098 - protein, 4 aa, Giardia lamblia
KKAD

SEQ ID NO: 3118099 - protein, 10 aa, Giardia lamblia
KKADTANMGG

SEQ ID NO: 3118100 - protein, 6 aa, Giardia lamblia
KKADVA

SEQ ID NO: 3118101 - protein, 6 aa, Giardia lamblia
KKADYD

SEQ ID NO: 3118102 - protein, 19 aa, Giardia lamblia
KKAELNSPGPPTLQGSPPV

SEQ ID NO: 3118103 - protein, 7 aa, Giardia lamblia
KKAERKE

SEQ ID NO: 3118104 - protein, 8 aa, Giardia lamblia
KKAFNSLP

SEQ ID NO: 3118105 - protein, 7 aa, Giardia lamblia
KKAGDTC

SEQ ID NO: 3118106 - protein, 8 aa, Giardia lamblia
KKAHETSD

SEQ ID NO: 3118107 - protein, 7 aa, Giardia lamblia
KKAITSA

SEQ ID NO: 3118108 - protein, 22 aa, Giardia lamblia
KKAKPVPAKTQGNKAKTTPSDA

SEQ ID NO: 3118109 - protein, 10 aa, Giardia lamblia
KKAKSLADSI

SEQ ID NO: 3118110 - protein, 7 aa, Giardia lamblia
KKANDMV

SEQ ID NO: 3118111 - protein, 7 aa, Giardia lamblia
KKAQPPL

SEQ ID NO: 3118112 - protein, 14 aa, Giardia lamblia
KKARDADGSSLFGK

SEQ ID NO: 3118113 - protein, 11 aa, Giardia lamblia
KKASTSQESSF

SEQ ID NO: 3118114 - protein, 8 aa, Giardia lamblia
KKASVKRG

SEQ ID NO: 3118115 - protein, 7 aa, Giardia lamblia
KKATADI

SEQ ID NO: 3118116 - protein, 6 aa, Giardia lamblia
KKATKH

SEQ ID NO: 3118117 - protein, 13 aa, Giardia lamblia
KKAVEVEANTTKE

SEQ ID NO: 3118118 - protein, 12 aa, Giardia lamblia
KKAYAASSVPSI

SEQ ID NO: 3118119 - protein, 10 aa, Giardia lamblia
KKAYQEDRKR

SEQ ID NO: 3118120 - protein, 11 aa, Giardia lamblia
KKCEQEKGTVK

SEQ ID NO: 3118121 - protein, 4 aa, Giardia lamblia
KKCP

SEQ ID NO: 3118122 - protein, 6 aa, Giardia lamblia
KKCQST

SEQ ID NO: 3118123 - protein, 9 aa, Giardia lamblia
KKCSERKAR

SEQ ID NO: 3118124 - protein, 12 aa, Giardia lamblia
KKDAQNSSSSIS

SEQ ID NO: 3118125 - protein, 12 aa, Giardia lamblia
KKDEEESKRGET

SEQ ID NO: 3118126 - protein, 6 aa, Giardia lamblia
KKDFGR

SEQ ID NO: 3118127 - protein, 14 aa, Giardia lamblia
KKDGTERPSSPRRI

SEQ ID NO: 3118128 - protein, 6 aa, Giardia lamblia
KKDHKE

SEQ ID NO: 3118129 - protein, 23 aa, Giardia lamblia
KKDKESLKKDKEALKERKDTEDI

SEQ ID NO: 3118130 - protein, 9 aa, Giardia lamblia
KKDLADKYE

SEQ ID NO: 3118131 - protein, 24 aa, Giardia lamblia
KKDLRDSAGSINASHVSTEEGRKF

SEQ ID NO: 3118132 - protein, 7 aa, Giardia lamblia
KKDMRPS

SEQ ID NO: 3118133 - protein, 9 aa, Giardia lamblia
KKDPDEDPI

SEQ ID NO: 3118134 - protein, 8 aa, Giardia lamblia
KKDPDIPY

SEQ ID NO: 3118135 - protein, 8 aa, Giardia lamblia
KKDPKQAI

SEQ ID NO: 3118136 - protein, 9 aa, Giardia lamblia
KKDPSLGTI

SEQ ID NO: 3118137 - protein, 11 aa, Giardia lamblia
KKDSAVETPSA

SEQ ID NO: 3118138 - protein, 19 aa, Giardia lamblia
KKDSHAKAGGGAPNSGDTF

SEQ ID NO: 3118139 - protein, 6 aa, Giardia lamblia
KKDTIS

SEQ ID NO: 3118140 - protein, 7 aa, Giardia lamblia
KKDVERP

SEQ ID NO: 3118141 - protein, 10 aa, Giardia lamblia
KKDVESLPAK

SEQ ID NO: 3118142 - protein, 5 aa, Giardia lamblia
KKDVQ

SEQ ID NO: 3118143 - protein, 17 aa, Giardia lamblia
KKDVQAAKDMEKESKKK

SEQ ID NO: 3118144 - protein, 13 aa, Giardia lamblia
KKDVSAAKQAYEA

SEQ ID NO: 3118145 - protein, 6 aa, Giardia lamblia
KKDYDT

SEQ ID NO: 3118146 - protein, 6 aa, Giardia lamblia
KKEADA

SEQ ID NO: 3118147 - protein, 9 aa, Giardia lamblia
KKEAEHKGF

SEQ ID NO: 3118148 - protein, 8 aa, Giardia lamblia
KKEAENTV

SEQ ID NO: 3118149 - protein, 7 aa, Giardia lamblia
KKEASDE

SEQ ID NO: 3118150 - protein, 11 aa, Giardia lamblia
KKEATDKGLAN

SEQ ID NO: 3118151 - protein, 8 aa, Giardia lamblia
KKEDCSIS

SEQ ID NO: 3118152 - protein, 6 aa, Giardia lamblia
KKEEAV

SEQ ID NO: 3118153 - protein, 7 aa, Giardia lamblia
KKEEQIS

SEQ ID NO: 3118154 - protein, 9 aa, Giardia lamblia
KKEEQRVEG

SEQ ID NO: 3118155 - protein, 9 aa, Giardia lamblia
KKEGAGSSF

SEQ ID NO: 3118156 - protein, 10 aa, Giardia lamblia
KKEGDRFGSP

SEQ ID NO: 3118157 - protein, 9 aa, Giardia lamblia
KKEGEDKFR

SEQ ID NO: 3118158 - protein, 6 aa, Giardia lamblia
KKEGGL

SEQ ID NO: 3118159 - protein, 7 aa, Giardia lamblia
KKEIKTQ

SEQ ID NO: 3118160 - protein, 12 aa, Giardia lamblia
KKEIQQAKSTLK

SEQ ID NO: 3118161 - protein, 12 aa, Giardia lamblia
KKEIRSKSLKED

SEQ ID NO: 3118162 - protein, 18 aa, Giardia lamblia
KKEKANILPGTSHQQSGS

SEQ ID NO: 3118163 - protein, 11 aa, Giardia lamblia
KKEKDASPPFT

SEQ ID NO: 3118164 - protein, 7 aa, Giardia lamblia
KKEKEAT

SEQ ID NO: 3118165 - protein, 14 aa, Giardia lamblia
KKELSEITAPPREG

SEQ ID NO: 3118166 - protein, 17 aa, Giardia lamblia
KKEPKVSHAESAHLDPQ

SEQ ID NO: 3118167 - protein, 6 aa, Giardia lamblia
KKEPNK

SEQ ID NO: 3118168 - protein, 57 aa, Giardia lamblia
KKEQERAAGEEAAHTTDEDDDSGSEASSNNEEHPKEGDEPPKKNRAERDKPKRNAPY

SEQ ID NO: 3118169 - protein, 6 aa, Giardia lamblia
KKEQGN

SEQ ID NO: 3118170 - protein, 15 aa, Giardia lamblia
KKEQGSNSFKNNQHK

SEQ ID NO: 3118171 - protein, 10 aa, Giardia lamblia
KKEQKSSRVE

SEQ ID NO: 3118172 - protein, 8 aa, Giardia lamblia
KKERARKR

SEQ ID NO: 3118173 - protein, 8 aa, Giardia lamblia
KKERDYVD

SEQ ID NO: 3118174 - protein, 7 aa, Giardia lamblia
KKEREVR

SEQ ID NO: 3118175 - protein, 33 aa, Giardia lamblia
KKERQTPASRAKKGHVERKKDYKVRAEQSHAKE

SEQ ID NO: 3118176 - protein, 6 aa, Giardia lamblia
KKESEI

SEQ ID NO: 3118177 - protein, 8 aa, Giardia lamblia
KKETATIN

SEQ ID NO: 3118178 - protein, 7 aa, Giardia lamblia
KKETFSA

SEQ ID NO: 3118179 - protein, 7 aa, Giardia lamblia
KKEVETS

SEQ ID NO: 3118180 - protein, 5 aa, Giardia lamblia
KKFSE

SEQ ID NO: 3118181 - protein, 8 aa, Giardia lamblia
KKGAGAFS

SEQ ID NO: 3118182 - protein, 8 aa, Giardia lamblia
KKGAQGKL

SEQ ID NO: 3118183 - protein, 8 aa, Giardia lamblia
KKGAQKSI

SEQ ID NO: 3118184 - protein, 7 aa, Giardia lamblia
KKGDTDR

SEQ ID NO: 3118185 - protein, 5 aa, Giardia lamblia
KKGGR

SEQ ID NO: 3118186 - protein, 8 aa, Giardia lamblia
KKGGTTYG

SEQ ID NO: 3118187 - protein, 14 aa, Giardia lamblia
KKGIESAKARLQDE

SEQ ID NO: 3118188 - protein, 9 aa, Giardia lamblia
KKGLPTPTS

SEQ ID NO: 3118189 - protein, 9 aa, Giardia lamblia
KKGLTEHRE

SEQ ID NO: 3118190 - protein, 9 aa, Giardia lamblia
KKGNDDVIG

SEQ ID NO: 3118191 - protein, 16 aa, Giardia lamblia
KKGPIKSSTWGLNFSS

SEQ ID NO: 3118192 - protein, 8 aa, Giardia lamblia
KKGQPGTL

SEQ ID NO: 3118193 - protein, 10 aa, Giardia lamblia
KKGRSMNSEF

SEQ ID NO: 3118194 - protein, 8 aa, Giardia lamblia
KKGSEEGQ

SEQ ID NO: 3118195 - protein, 5 aa, Giardia lamblia
KKGSI

SEQ ID NO: 3118196 - protein, 13 aa, Giardia lamblia
KKGSKEQPQPAEE

SEQ ID NO: 3118197 - protein, 9 aa, Giardia lamblia
KKGSRNFTT

SEQ ID NO: 3118198 - protein, 7 aa, Giardia lamblia
KKGSVGA

SEQ ID NO: 3118199 - protein, 8 aa, Giardia lamblia
KKGTFTTA

SEQ ID NO: 3118200 - protein, 8 aa, Giardia lamblia
KKGTPPSR

SEQ ID NO: 3118201 - protein, 14 aa, Giardia lamblia
KKGTVAGLTTDERR

SEQ ID NO: 3118202 - protein, 8 aa, Giardia lamblia
KKGVSKPS

SEQ ID NO: 3118203 - protein, 10 aa, Giardia lamblia
KKGVSRPSQY

SEQ ID NO: 3118204 - protein, 5 aa, Giardia lamblia
KKGYQ

SEQ ID NO: 3118205 - protein, 13 aa, Giardia lamblia
KKGYQPSNDLTAQ

SEQ ID NO: 3118206 - protein, 42 aa, Giardia lamblia
KKGYSSDHNSRRPNSVKARPKKESIPTSSERSHSAKVPDTLS

SEQ ID NO: 3118207 - protein, 14 aa, Giardia lamblia
KKGYVGAPRSARST

SEQ ID NO: 3118208 - protein, 12 aa, Giardia lamblia
KKHAVKDKGSHR

SEQ ID NO: 3118209 - protein, 5 aa, Giardia lamblia
KKHEL

SEQ ID NO: 3118210 - protein, 13 aa, Giardia lamblia
KKHGKDISGSNRA

SEQ ID NO: 3118211 - protein, 10 aa, Giardia lamblia
KKHGRGGQSS

SEQ ID NO: 3118212 - protein, 4 aa, Giardia lamblia
KKHH

SEQ ID NO: 3118213 - protein, 16 aa, Giardia lamblia
KKHKKGSKTRTTEAAQ

SEQ ID NO: 3118214 - protein, 27 aa, Giardia lamblia
KKHPKKDSEREAPEDRLRNEGERKRIE

SEQ ID NO: 3118215 - protein, 16 aa, Giardia lamblia
KKHYGKMQSSAERGSL

SEQ ID NO: 3118216 - protein, 17 aa, Giardia lamblia
KKIADEKVHSNKVASYT

SEQ ID NO: 3118217 - protein, 7 aa, Giardia lamblia
KKIAEDS

SEQ ID NO: 3118218 - protein, 12 aa, Giardia lamblia
KKINKGNITTET

SEQ ID NO: 3118219 - protein, 11 aa, Giardia lamblia
KKISGDVPSAR

SEQ ID NO: 3118220 - protein, 8 aa, Giardia lamblia
KKKAPAFS

SEQ ID NO: 3118221 - protein, 7 aa, Giardia lamblia
KKKAPEL

SEQ ID NO: 3118222 - protein, 6 aa, Giardia lamblia
KKKDDY

SEQ ID NO: 3118223 - protein, 13 aa, Giardia lamblia
KKKDHKEIVDILS

SEQ ID NO: 3118224 - protein, 22 aa, Giardia lamblia
KKKDNSLAEAEAAAKDETEKLT

SEQ ID NO: 3118225 - protein, 22 aa, Giardia lamblia
KKKDRSRAATPVASSKRIPQDL

SEQ ID NO: 3118226 - protein, 9 aa, Giardia lamblia
KKKEAGTIT

SEQ ID NO: 3118227 - protein, 12 aa, Giardia lamblia
KKKEEEEKRIEE

SEQ ID NO: 3118228 - protein, 13 aa, Giardia lamblia
KKKGHKEIVDILS

SEQ ID NO: 3118229 - protein, 7 aa, Giardia lamblia
KKKKAME

SEQ ID NO: 3118230 - protein, 24 aa, Giardia lamblia
KKKKEQKPKKPRKLKKKKTRDNDL

SEQ ID NO: 3118231 - protein, 4 aa, Giardia lamblia
KKKL

SEQ ID NO: 3118232 - protein, 17 aa, Giardia lamblia
KKKLKRQAADDAKKHKA

SEQ ID NO: 3118233 - protein, 4 aa, Giardia lamblia
KKKN

SEQ ID NO: 3118234 - protein, 8 aa, Giardia lamblia
KKKNETKD

SEQ ID NO: 3118235 - protein, 8 aa, Giardia lamblia
KKKNRLPG

SEQ ID NO: 3118236 - protein, 6 aa, Giardia lamblia
KKKNSV

SEQ ID NO: 3118237 - protein, 13 aa, Giardia lamblia
KKKPDEPGSARRV

SEQ ID NO: 3118238 - protein, 7 aa, Giardia lamblia
KKKRTQM

SEQ ID NO: 3118239 - protein, 8 aa, Giardia lamblia
KKKSHYEQ

SEQ ID NO: 3118240 - protein, 8 aa, Giardia lamblia
KKKTDDNI

SEQ ID NO: 3118241 - protein, 8 aa, Giardia lamblia
KKKTDPDC

SEQ ID NO: 3118242 - protein, 22 aa, Giardia lamblia
KKKTPSRVSTEARLDKQSQNVS

SEQ ID NO: 3118243 - protein, 8 aa, Giardia lamblia
KKKTVEKQ

SEQ ID NO: 3118244 - protein, 15 aa, Giardia lamblia
KKKVEGSGLRVLPMR

SEQ ID NO: 3118245 - protein, 16 aa, Giardia lamblia
KKLDDGNAETKKKDEL

SEQ ID NO: 3118246 - protein, 6 aa, Giardia lamblia
KKLEKK

SEQ ID NO: 3118247 - protein, 14 aa, Giardia lamblia
KKLEKTKVEDRDVK

SEQ ID NO: 3118248 - protein, 7 aa, Giardia lamblia
KKLEPRG

SEQ ID NO: 3118249 - protein, 4 aa, Giardia lamblia
KKLG

SEQ ID NO: 3118250 - protein, 4 aa, Giardia lamblia
KKLP

SEQ ID NO: 3118251 - protein, 22 aa, Giardia lamblia
KKLPANPKYANVTSTINSGPTI

SEQ ID NO: 3118252 - protein, 12 aa, Giardia lamblia
KKLRDSSGHTAE

SEQ ID NO: 3118253 - protein, 8 aa, Giardia lamblia
KKLSPDEI

SEQ ID NO: 3118254 - protein, 11 aa, Giardia lamblia
KKLSSTSPEEM

SEQ ID NO: 3118255 - protein, 7 aa, Giardia lamblia
KKLTDAQ

SEQ ID NO: 3118256 - protein, 14 aa, Giardia lamblia
KKLVGQDQSSGSVS

SEQ ID NO: 3118257 - protein, 10 aa, Giardia lamblia
KKNAADGSDP

SEQ ID NO: 3118258 - protein, 44 aa, Giardia lamblia
KKNAKRESATPSSQERSSQQAAKPPKPSGDKKDTTLVTNDNEAW

SEQ ID NO: 3118259 - protein, 11 aa, Giardia lamblia
KKNDKDGAERK

SEQ ID NO: 3118260 - protein, 4 aa, Giardia lamblia
KKNE

SEQ ID NO: 3118261 - protein, 8 aa, Giardia lamblia
KKNEDEVP

SEQ ID NO: 3118262 - protein, 7 aa, Giardia lamblia
KKNIESR

SEQ ID NO: 3118263 - protein, 7 aa, Giardia lamblia
KKNNDDY

SEQ ID NO: 3118264 - protein, 11 aa, Giardia lamblia
KKNNQESDQQV

SEQ ID NO: 3118265 - protein, 10 aa, Giardia lamblia
KKNPRGADAV

SEQ ID NO: 3118266 - protein, 9 aa, Giardia lamblia
KKNPTALTT

SEQ ID NO: 3118267 - protein, 7 aa, Giardia lamblia
KKNPTYN

SEQ ID NO: 3118268 - protein, 6 aa, Giardia lamblia
KKNQVE

SEQ ID NO: 3118269 - protein, 8 aa, Giardia lamblia
KKNRTPFE

SEQ ID NO: 3118270 - protein, 9 aa, Giardia lamblia
KKNSGYSIS

SEQ ID NO: 3118271 - protein, 10 aa, Giardia lamblia
KKNSRKSECD

SEQ ID NO: 3118272 - protein, 8 aa, Giardia lamblia
KKNSTVSG

SEQ ID NO: 3118273 - protein, 6 aa, Giardia lamblia
KKNTDA

SEQ ID NO: 3118274 - protein, 25 aa, Giardia lamblia
KKNTKPYKPAKVAKRKREKQEAAIS

SEQ ID NO: 3118275 - protein, 21 aa, Giardia lamblia
KKPAESKKSADTKEEEEPTAV

SEQ ID NO: 3118276 - protein, 8 aa, Giardia lamblia
KKPDERKL

SEQ ID NO: 3118277 - protein, 29 aa, Giardia lamblia
KKPDSEEPKNDKPAEAKASEKDVEEVGDK

SEQ ID NO: 3118278 - protein, 8 aa, Giardia lamblia
KKPDTDSA

SEQ ID NO: 3118279 - protein, 15 aa, Giardia lamblia
KKPETPTLSHTPKRL

SEQ ID NO: 3118280 - protein, 6 aa, Giardia lamblia
KKPFTE

SEQ ID NO: 3118281 - protein, 24 aa, Giardia lamblia
KKPGAETSGTQQVSVPGSKGDPLS

SEQ ID NO: 3118282 - protein, 12 aa, Giardia lamblia
KKPGASLSSLSD

SEQ ID NO: 3118283 - protein, 8 aa, Giardia lamblia
KKPHDEKY

SEQ ID NO: 3118284 - protein, 4 aa, Giardia lamblia
KKPK

SEQ ID NO: 3118285 - protein, 8 aa, Giardia lamblia
KKPMNPSE

SEQ ID NO: 3118286 - protein, 12 aa, Giardia lamblia
KKPPKAQDTPTR

SEQ ID NO: 3118287 - protein, 8 aa, Giardia lamblia
KKPPQLEG

SEQ ID NO: 3118288 - protein, 8 aa, Giardia lamblia
KKPPRAIT

SEQ ID NO: 3118289 - protein, 7 aa, Giardia lamblia
KKPQHIA

SEQ ID NO: 3118290 - protein, 6 aa, Giardia lamblia
KKPQRF

SEQ ID NO: 3118291 - protein, 13 aa, Giardia lamblia
KKPRLPADESDTL

SEQ ID NO: 3118292 - protein, 8 aa, Giardia lamblia
KKPRSRLG

SEQ ID NO: 3118293 - protein, 7 aa, Giardia lamblia
KKPSLDD

SEQ ID NO: 3118294 - protein, 7 aa, Giardia lamblia
KKPSVDA

SEQ ID NO: 3118295 - protein, 4 aa, Giardia lamblia
KKPT

SEQ ID NO: 3118296 - protein, 16 aa, Giardia lamblia
KKPTPKRRSTLPAARS

SEQ ID NO: 3118297 - protein, 8 aa, Giardia lamblia
KKPTPVTA

SEQ ID NO: 3118298 - protein, 27 aa, Giardia lamblia
KKPTTNNANKKPAGTYDKDPGDNAFGP

SEQ ID NO: 3118299 - protein, 8 aa, Giardia lamblia
KKQAHGGI

SEQ ID NO: 3118300 - protein, 8 aa, Giardia lamblia
KKQEDEIR

SEQ ID NO: 3118301 - protein, 8 aa, Giardia lamblia
KKQKADMA

SEQ ID NO: 3118302 - protein, 6 aa, Giardia lamblia
KKQKIA

SEQ ID NO: 3118303 - protein, 6 aa, Giardia lamblia
KKQKNI

SEQ ID NO: 3118304 - protein, 39 aa, Giardia lamblia
KKQKTQQKETKKIDYRSERKLTPDITATEAKRKASQERI

SEQ ID NO: 3118305 - protein, 14 aa, Giardia lamblia
KKQLQQESANLTDQ

SEQ ID NO: 3118306 - protein, 5 aa, Giardia lamblia
KKQLR

SEQ ID NO: 3118307 - protein, 7 aa, Giardia lamblia
KKQNSEK

SEQ ID NO: 3118308 - protein, 15 aa, Giardia lamblia
KKQPPTHLQVLRPFH

SEQ ID NO: 3118309 - protein, 8 aa, Giardia lamblia
KKQPQTSA

SEQ ID NO: 3118310 - protein, 9 aa, Giardia lamblia
KKQRGTGPD

SEQ ID NO: 3118311 - protein, 25 aa, Giardia lamblia
KKQRRASSRTGKATVQSRGSMTGTR

SEQ ID NO: 3118312 - protein, 7 aa, Giardia lamblia
KKQSAQH

SEQ ID NO: 3118313 - protein, 11 aa, Giardia lamblia
KKQSEADAKGT

SEQ ID NO: 3118314 - protein, 9 aa, Giardia lamblia
KKQTAVNPK

SEQ ID NO: 3118315 - protein, 6 aa, Giardia lamblia
KKQTFP

SEQ ID NO: 3118316 - protein, 8 aa, Giardia lamblia
KKQTGNGL

SEQ ID NO: 3118317 - protein, 7 aa, Giardia lamblia
KKQTRSF

SEQ ID NO: 3118318 - protein, 8 aa, Giardia lamblia
KKQYDEAK

SEQ ID NO: 3118319 - protein, 8 aa, Giardia lamblia
KKRAGNIY

SEQ ID NO: 3118320 - protein, 7 aa, Giardia lamblia
KKRAQKN

SEQ ID NO: 3118321 - protein, 13 aa, Giardia lamblia
KKRATLANDTTAP

SEQ ID NO: 3118322 - protein, 10 aa, Giardia lamblia
KKRCANGRFQ

SEQ ID NO: 3118323 - protein, 13 aa, Giardia lamblia
KKRDKRLSVTNAP

SEQ ID NO: 3118324 - protein, 7 aa, Giardia lamblia
KKRDSNS

SEQ ID NO: 3118325 - protein, 34 aa, Giardia lamblia
KKREEEERRAREEEEQEEQEEQENPEEPEEEYEY

SEQ ID NO: 3118326 - protein, 8 aa, Giardia lamblia
KKREESFA

SEQ ID NO: 3118327 - protein, 15 aa, Giardia lamblia
KKRESNPPTKKLTRA

SEQ ID NO: 3118328 - protein, 7 aa, Giardia lamblia
KKRGTTH

SEQ ID NO: 3118329 - protein, 9 aa, Giardia lamblia
KKRKDGLSC

SEQ ID NO: 3118330 - protein, 10 aa, Giardia lamblia
KKRNKEGSTA

SEQ ID NO: 3118331 - protein, 8 aa, Giardia lamblia
KKRPSATQ

SEQ ID NO: 3118332 - protein, 9 aa, Giardia lamblia
KKRQQEFSE

SEQ ID NO: 3118333 - protein, 7 aa, Giardia lamblia
KKRRNSV

SEQ ID NO: 3118334 - protein, 8 aa, Giardia lamblia
KKRSLRAK

SEQ ID NO: 3118335 - protein, 12 aa, Giardia lamblia
KKRSVSARANTY

SEQ ID NO: 3118336 - protein, 14 aa, Giardia lamblia
KKRTHTRSTTETGR

SEQ ID NO: 3118337 - protein, 9 aa, Giardia lamblia
KKRTVERRE

SEQ ID NO: 3118338 - protein, 8 aa, Giardia lamblia
KKRYRTPR

SEQ ID NO: 3118339 - protein, 9 aa, Giardia lamblia
KKSASGGPC

SEQ ID NO: 3118340 - protein, 7 aa, Giardia lamblia
KKSASSE

SEQ ID NO: 3118341 - protein, 13 aa, Giardia lamblia
KKSASSSNIPDDQ

SEQ ID NO: 3118342 - protein, 22 aa, Giardia lamblia
KKSCSEEPNYTTTQSRQADESD

SEQ ID NO: 3118343 - protein, 4 aa, Giardia lamblia
KKSE

SEQ ID NO: 3118344 - protein, 10 aa, Giardia lamblia
KKSEATMKRT

SEQ ID NO: 3118345 - protein, 7 aa, Giardia lamblia
KKSEGNS

SEQ ID NO: 3118346 - protein, 7 aa, Giardia lamblia
KKSEHED

SEQ ID NO: 3118347 - protein, 8 aa, Giardia lamblia
KKSENPRA

SEQ ID NO: 3118348 - protein, 6 aa, Giardia lamblia
KKSFSQ

SEQ ID NO: 3118349 - protein, 15 aa, Giardia lamblia
KKSHEESISQHKSEI

SEQ ID NO: 3118350 - protein, 26 aa, Giardia lamblia
KKSKGERKPVDDVEASNSCSEDSSAE

SEQ ID NO: 3118351 - protein, 7 aa, Giardia lamblia
KKSKMAY

SEQ ID NO: 3118352 - protein, 9 aa, Giardia lamblia
KKSKNLSNK

SEQ ID NO: 3118353 - protein, 15 aa, Giardia lamblia
KKSKTGRRRQYSDER

SEQ ID NO: 3118354 - protein, 8 aa, Giardia lamblia
KKSKTQIS

SEQ ID NO: 3118355 - protein, 13 aa, Giardia lamblia
KKSLDKDDQAAGE

SEQ ID NO: 3118356 - protein, 7 aa, Giardia lamblia
KKSLEEF

SEQ ID NO: 3118357 - protein, 6 aa, Giardia lamblia
KKSLNS

SEQ ID NO: 3118358 - protein, 6 aa, Giardia lamblia
KKSNDA

SEQ ID NO: 3118359 - protein, 8 aa, Giardia lamblia
KKSNKELL

SEQ ID NO: 3118360 - protein, 11 aa, Giardia lamblia
KKSNTDTPGST

SEQ ID NO: 3118361 - protein, 13 aa, Giardia lamblia
KKSPSLSAYTALF

SEQ ID NO: 3118362 - protein, 6 aa, Giardia lamblia
KKSPVA

SEQ ID NO: 3118363 - protein, 11 aa, Giardia lamblia
KKSRDGGGETA

SEQ ID NO: 3118364 - protein, 8 aa, Giardia lamblia
KKSRVDKK

SEQ ID NO: 3118365 - protein, 8 aa, Giardia lamblia
KKSTEDRI

SEQ ID NO: 3118366 - protein, 10 aa, Giardia lamblia
KKSTESTTLQ

SEQ ID NO: 3118367 - protein, 11 aa, Giardia lamblia
KKSTSFSPTGE

SEQ ID NO: 3118368 - protein, 6 aa, Giardia lamblia
KKTAEK

SEQ ID NO: 3118369 - protein, 14 aa, Giardia lamblia
KKTASGAVSTKTRE

SEQ ID NO: 3118370 - protein, 8 aa, Giardia lamblia
KKTDFSPP

SEQ ID NO: 3118371 - protein, 8 aa, Giardia lamblia
KKTEKYAQ

SEQ ID NO: 3118372 - protein, 4 aa, Giardia lamblia
KKTG

SEQ ID NO: 3118373 - protein, 4 aa, Giardia lamblia
KKTL

SEQ ID NO: 3118374 - protein, 25 aa, Giardia lamblia
KKTPGAPSAAAVPSKSNTATKSGER

SEQ ID NO: 3118375 - protein, 8 aa, Giardia lamblia
KKTPVNEY

SEQ ID NO: 3118376 - protein, 6 aa, Giardia lamblia
KKTQED

SEQ ID NO: 3118377 - protein, 11 aa, Giardia lamblia
KKTRPSVDQSA

SEQ ID NO: 3118378 - protein, 11 aa, Giardia lamblia
KKTRYNESKVT

SEQ ID NO: 3118379 - protein, 7 aa, Giardia lamblia
KKTSANL

SEQ ID NO: 3118380 - protein, 9 aa, Giardia lamblia
KKTSSDEVY

SEQ ID NO: 3118381 - protein, 6 aa, Giardia lamblia
KKTTTI

SEQ ID NO: 3118382 - protein, 11 aa, Giardia lamblia
KKTVDSGNRPV

SEQ ID NO: 3118383 - protein, 17 aa, Giardia lamblia
KKTVSTALGITGEFDYL

SEQ ID NO: 3118384 - protein, 4 aa, Giardia lamblia
KKVE

SEQ ID NO: 3118385 - protein, 6 aa, Giardia lamblia
KKVKAA

SEQ ID NO: 3118386 - protein, 16 aa, Giardia lamblia
KKVNELQEQRNLAETT

SEQ ID NO: 3118387 - protein, 9 aa, Giardia lamblia
KKVSDGQTQ

SEQ ID NO: 3118388 - protein, 9 aa, Giardia lamblia
KKVSESPTL

SEQ ID NO: 3118389 - protein, 12 aa, Giardia lamblia
KKVSPGSISSYE

SEQ ID NO: 3118390 - protein, 21 aa, Giardia lamblia
KKVTPHQAQPSEKHSIDSREE

SEQ ID NO: 3118391 - protein, 19 aa, Giardia lamblia
KKWGSRKDNKFDRAIRSSK

SEQ ID NO: 3118392 - protein, 35 aa, Giardia lamblia
KKYANATRSASELAAENEALRGELSETKGALDTYK

SEQ ID NO: 3118393 - protein, 20 aa, Giardia lamblia
KKYENLDKRNTEVQRENKPG

SEQ ID NO: 3118394 - protein, 8 aa, Giardia lamblia
KKYETSEI

SEQ ID NO: 3118395 - protein, 4 aa, Giardia lamblia
KKYN

SEQ ID NO: 3118396 - protein, 4 aa, Giardia lamblia
KKYP

SEQ ID NO: 3118397 - protein, 7 aa, Giardia lamblia
KKYPGLT

SEQ ID NO: 3118398 - protein, 10 aa, Giardia lamblia
KKYQDEEGVT

SEQ ID NO: 3118399 - protein, 6 aa, Giardia lamblia
KKYRKA

SEQ ID NO: 3118400 - protein, 12 aa, Giardia lamblia
KKYSEMQATAKA

SEQ ID NO: 3118401 - protein, 9 aa, Giardia lamblia
KKYTDSSWN

SEQ ID NO: 3118402 - protein, 10 aa, Giardia lamblia
KLADTPLDQI

SEQ ID NO: 3118403 - protein, 17 aa, Giardia lamblia
KLAEDLKTEYKTTDSDA

SEQ ID NO: 3118404 - protein, 10 aa, Giardia lamblia
KLAEEKEKAR

SEQ ID NO: 3118405 - protein, 5 aa, Giardia lamblia
KLAGA

SEQ ID NO: 3118406 - protein, 10 aa, Giardia lamblia
KLAGPGAPEY

SEQ ID NO: 3118407 - protein, 7 aa, Giardia lamblia
KLAGSEV

SEQ ID NO: 3118408 - protein, 8 aa, Giardia lamblia
KLAGSNGI

SEQ ID NO: 3118409 - protein, 4 aa, Giardia lamblia
KLAP

SEQ ID NO: 3118410 - protein, 7 aa, Giardia lamblia
KLAPKQL

SEQ ID NO: 3118411 - protein, 7 aa, Giardia lamblia
KLAQAKE

SEQ ID NO: 3118412 - protein, 7 aa, Giardia lamblia
KLARPDG

SEQ ID NO: 3118413 - protein, 12 aa, Giardia lamblia
KLDATERQNRSY

SEQ ID NO: 3118414 - protein, 8 aa, Giardia lamblia
KLDDDAEN

SEQ ID NO: 3118415 - protein, 14 aa, Giardia lamblia
KLDDSQQSLKPSQI

SEQ ID NO: 3118416 - protein, 11 aa, Giardia lamblia
KLDEKNTQIQG

SEQ ID NO: 3118417 - protein, 8 aa, Giardia lamblia
KLDERDKH

SEQ ID NO: 3118418 - protein, 12 aa, Giardia lamblia
KLDESSKNNRYD

SEQ ID NO: 3118419 - protein, 7 aa, Giardia lamblia
KLDGGSD

SEQ ID NO: 3118420 - protein, 7 aa, Giardia lamblia
KLDNDGC

SEQ ID NO: 3118421 - protein, 9 aa, Giardia lamblia
KLDNEKQSL

SEQ ID NO: 3118422 - protein, 17 aa, Giardia lamblia
KLDNQQGNTEAPSTNGV

SEQ ID NO: 3118423 - protein, 6 aa, Giardia lamblia
KLDPEE

SEQ ID NO: 3118424 - protein, 15 aa, Giardia lamblia
KLDPQVGKKDDDMGF

SEQ ID NO: 3118425 - protein, 6 aa, Giardia lamblia
KLDPTE

SEQ ID NO: 3118426 - protein, 14 aa, Giardia lamblia
KLDPYGGWTPNPHS

SEQ ID NO: 3118427 - protein, 5 aa, Giardia lamblia
KLDQQ

SEQ ID NO: 3118428 - protein, 7 aa, Giardia lamblia
KLDQRSN

SEQ ID NO: 3118429 - protein, 9 aa, Giardia lamblia
KLDSEANQL

SEQ ID NO: 3118430 - protein, 17 aa, Giardia lamblia
KLDSKGNKVVKTSHSLN

SEQ ID NO: 3118431 - protein, 13 aa, Giardia lamblia
KLDVSAEEAAELE

SEQ ID NO: 3118432 - protein, 11 aa, Giardia lamblia
KLEASKTYSTI

SEQ ID NO: 3118433 - protein, 16 aa, Giardia lamblia
KLEASTQLAKDNSVKS

SEQ ID NO: 3118434 - protein, 7 aa, Giardia lamblia
KLEDERR

SEQ ID NO: 3118435 - protein, 4 aa, Giardia lamblia
KLEE

SEQ ID NO: 3118436 - protein, 8 aa, Giardia lamblia
KLEEDRDQ

SEQ ID NO: 3118437 - protein, 11 aa, Giardia lamblia
KLEEPDPKDTF

SEQ ID NO: 3118438 - protein, 12 aa, Giardia lamblia
KLEGEVRSDVKE

SEQ ID NO: 3118439 - protein, 6 aa, Giardia lamblia
KLEGPV

SEQ ID NO: 3118440 - protein, 8 aa, Giardia lamblia
KLEKGGSA

SEQ ID NO: 3118441 - protein, 6 aa, Giardia lamblia
KLEKPD

SEQ ID NO: 3118442 - protein, 6 aa, Giardia lamblia
KLEQEL

SEQ ID NO: 3118443 - protein, 13 aa, Giardia lamblia
KLEQKVADNVDSS

SEQ ID NO: 3118444 - protein, 19 aa, Giardia lamblia
KLESGGLAQPTSAQTAYRT

SEQ ID NO: 3118445 - protein, 18 aa, Giardia lamblia
KLESNKSLSNIQKQKTTK

SEQ ID NO: 3118446 - protein, 5 aa, Giardia lamblia
KLESR

SEQ ID NO: 3118447 - protein, 5 aa, Giardia lamblia
KLEYK

SEQ ID NO: 3118448 - protein, 9 aa, Giardia lamblia
KLGAGRRIA

SEQ ID NO: 3118449 - protein, 81 aa, Giardia lamblia
KLGAPSVPSRSSQVASSLQAKRTASAGTGRIATNKVRSSGYASSIPWSEQQKLKQEKLSKQKQVSLPNNTSSLTSLGKEEE

SEQ ID NO: 3118450 - protein, 5 aa, Giardia lamblia
KLGEK

SEQ ID NO: 3118451 - protein, 7 aa, Giardia lamblia
KLGERER

SEQ ID NO: 3118452 - protein, 9 aa, Giardia lamblia
KLGKDRHAR

SEQ ID NO: 3118453 - protein, 6 aa, Giardia lamblia
KLGQAA

SEQ ID NO: 3118454 - protein, 7 aa, Giardia lamblia
KLGQEAQ

SEQ ID NO: 3118455 - protein, 6 aa, Giardia lamblia
KLGQGD

SEQ ID NO: 3118456 - protein, 5 aa, Giardia lamblia
KLGQT

SEQ ID NO: 3118457 - protein, 5 aa, Giardia lamblia
KLGSS

SEQ ID NO: 3118458 - protein, 47 aa, Giardia lamblia
KLISTPSSELNSAANTPTGPGITDTRRMRGARESTVGKQSGITSSFT

SEQ ID NO: 3118459 - protein, 4 aa, Giardia lamblia
KLKA

SEQ ID NO: 3118460 - protein, 32 aa, Giardia lamblia
KLKAEAEAKKGKKGKKGKKGKKGGKGKKGKAL

SEQ ID NO: 3118461 - protein, 7 aa, Giardia lamblia
KLKAEQA

SEQ ID NO: 3118462 - protein, 11 aa, Giardia lamblia
KLKAGETEETV

SEQ ID NO: 3118463 - protein, 11 aa, Giardia lamblia
KLKASDGKLRD

SEQ ID NO: 3118464 - protein, 4 aa, Giardia lamblia
KLKD

SEQ ID NO: 3118465 - protein, 5 aa, Giardia lamblia
KLKDE

SEQ ID NO: 3118466 - protein, 8 aa, Giardia lamblia
KLKDPNLK

SEQ ID NO: 3118467 - protein, 5 aa, Giardia lamblia
KLKEE

SEQ ID NO: 3118468 - protein, 7 aa, Giardia lamblia
KLKEKEN

SEQ ID NO: 3118469 - protein, 18 aa, Giardia lamblia
KLKGKSAWETGASDPSPL

SEQ ID NO: 3118470 - protein, 11 aa, Giardia lamblia
KLKRSDPDANE

SEQ ID NO: 3118471 - protein, 5 aa, Giardia lamblia
KLKTE

SEQ ID NO: 3118472 - protein, 14 aa, Giardia lamblia
KLKTKDQRLQEKRE

SEQ ID NO: 3118473 - protein, 78 aa, Giardia lamblia
KLNASKSGKSLKKSTTGGKSSSKKRAGSHRASMGKSKSPLRKPSTSKRVARSTSTTTGYASKQTSMMSESANTSMTDV

SEQ ID NO: 3118474 - protein, 10 aa, Giardia lamblia
KLNGDDKSTV

SEQ ID NO: 3118475 - protein, 16 aa, Giardia lamblia
KLNKSSNVEPGRAGGR

SEQ ID NO: 3118476 - protein, 6 aa, Giardia lamblia
KLNNRK

SEQ ID NO: 3118477 - protein, 17 aa, Giardia lamblia
KLNSETASLEQSNAALQ

SEQ ID NO: 3118478 - protein, 8 aa, Giardia lamblia
KLPAEYSK

SEQ ID NO: 3118479 - protein, 8 aa, Giardia lamblia
KLPDESKR

SEQ ID NO: 3118480 - protein, 6 aa, Giardia lamblia
KLPDPL

SEQ ID NO: 3118481 - protein, 8 aa, Giardia lamblia
KLPGDVES

SEQ ID NO: 3118482 - protein, 34 aa, Giardia lamblia
KLPGYDDDKNATNNEFRQRTSIDTAMKDSTDHEH

SEQ ID NO: 3118483 - protein, 6 aa, Giardia lamblia
KLPHTR

SEQ ID NO: 3118484 - protein, 4 aa, Giardia lamblia
KLPK

SEQ ID NO: 3118485 - protein, 11 aa, Giardia lamblia
KLPNDTKAFPV

SEQ ID NO: 3118486 - protein, 7 aa, Giardia lamblia
KLPNGQD

SEQ ID NO: 3118487 - protein, 10 aa, Giardia lamblia
KLPNKRPSCD

SEQ ID NO: 3118488 - protein, 7 aa, Giardia lamblia
KLPPPER

SEQ ID NO: 3118489 - protein, 12 aa, Giardia lamblia
KLPPPSRSNSKL

SEQ ID NO: 3118490 - protein, 7 aa, Giardia lamblia
KLPPRDA

SEQ ID NO: 3118491 - protein, 5 aa, Giardia lamblia
KLPPS

SEQ ID NO: 3118492 - protein, 23 aa, Giardia lamblia
KLPPSKMKGGPVDRRSDKRHANE

SEQ ID NO: 3118493 - protein, 10 aa, Giardia lamblia
KLPPSVSKTE

SEQ ID NO: 3118494 - protein, 16 aa, Giardia lamblia
KLPQSNNGSSCGEGKI

SEQ ID NO: 3118495 - protein, 5 aa, Giardia lamblia
KLPRG

SEQ ID NO: 3118496 - protein, 14 aa, Giardia lamblia
KLPSKLSDQQTSEK

SEQ ID NO: 3118497 - protein, 9 aa, Giardia lamblia
KLPSSPEEF

SEQ ID NO: 3118498 - protein, 9 aa, Giardia lamblia
KLPSSQQEA

SEQ ID NO: 3118499 - protein, 29 aa, Giardia lamblia
KLPSSSITKEKRPTSAKKDNAKRAGSRQY

SEQ ID NO: 3118500 - protein, 6 aa, Giardia lamblia
KLPSYG

SEQ ID NO: 3118501 - protein, 7 aa, Giardia lamblia
KLPTARE

SEQ ID NO: 3118502 - protein, 6 aa, Giardia lamblia
KLPTHP

SEQ ID NO: 3118503 - protein, 24 aa, Giardia lamblia
KLPTPASGEVPRGRASLAEWLRRG

SEQ ID NO: 3118504 - protein, 7 aa, Giardia lamblia
KLQDNKG

SEQ ID NO: 3118505 - protein, 53 aa, Giardia lamblia
KLQEKGVKGKKGKKGNKKGSRAASASVAKPTPLPPARSTPQVPGTQAPGASTI

SEQ ID NO: 3118506 - protein, 11 aa, Giardia lamblia
KLQETDTQYTK

SEQ ID NO: 3118507 - protein, 5 aa, Giardia lamblia
KLQGN

SEQ ID NO: 3118508 - protein, 8 aa, Giardia lamblia
KLQPSGAF

SEQ ID NO: 3118509 - protein, 9 aa, Giardia lamblia
KLQQENSDL

SEQ ID NO: 3118510 - protein, 14 aa, Giardia lamblia
KLQTNKEDNCGEST

SEQ ID NO: 3118511 - protein, 6 aa, Giardia lamblia
KLQTPT

SEQ ID NO: 3118512 - protein, 11 aa, Giardia lamblia
KLQYEADRKSA

SEQ ID NO: 3118513 - protein, 8 aa, Giardia lamblia
KLRANSRI

SEQ ID NO: 3118514 - protein, 23 aa, Giardia lamblia
KLRAPPQRNHAAKSAALNTTAYD

SEQ ID NO: 3118515 - protein, 10 aa, Giardia lamblia
KLRKSDPVSN

SEQ ID NO: 3118516 - protein, 8 aa, Giardia lamblia
KLRKTEDN

SEQ ID NO: 3118517 - protein, 6 aa, Giardia lamblia
KLRNTT

SEQ ID NO: 3118518 - protein, 6 aa, Giardia lamblia
KLRPKT

SEQ ID NO: 3118519 - protein, 8 aa, Giardia lamblia
KLRQSEKL

SEQ ID NO: 3118520 - protein, 8 aa, Giardia lamblia
KLRQSQGE

SEQ ID NO: 3118521 - protein, 7 aa, Giardia lamblia
KLRSSDR

SEQ ID NO: 3118522 - protein, 12 aa, Giardia lamblia
KLRSTDPEADAN

SEQ ID NO: 3118523 - protein, 5 aa, Giardia lamblia
KLRTQ

SEQ ID NO: 3118524 - protein, 11 aa, Giardia lamblia
KLSAEAQKSIE

SEQ ID NO: 3118525 - protein, 16 aa, Giardia lamblia
KLSASGPSEDTPQEIE

SEQ ID NO: 3118526 - protein, 6 aa, Giardia lamblia
KLSDDQ

SEQ ID NO: 3118527 - protein, 11 aa, Giardia lamblia
KLSEESNTPMP

SEQ ID NO: 3118528 - protein, 5 aa, Giardia lamblia
KLSEG

SEQ ID NO: 3118529 - protein, 9 aa, Giardia lamblia
KLSEKEEAR

SEQ ID NO: 3118530 - protein, 4 aa, Giardia lamblia
KLSG

SEQ ID NO: 3118531 - protein, 12 aa, Giardia lamblia
KLSGPDHTATRK

SEQ ID NO: 3118532 - protein, 7 aa, Giardia lamblia
KLSGSSG

SEQ ID NO: 3118533 - protein, 7 aa, Giardia lamblia
KLSKAAT

SEQ ID NO: 3118534 - protein, 19 aa, Giardia lamblia
KLSNEGMPHEEITKKNNSF

SEQ ID NO: 3118535 - protein, 10 aa, Giardia lamblia
KLSNSGTRNY

SEQ ID NO: 3118536 - protein, 6 aa, Giardia lamblia
KLSPDA

SEQ ID NO: 3118537 - protein, 6 aa, Giardia lamblia
KLSPPV

SEQ ID NO: 3118538 - protein, 11 aa, Giardia lamblia
KLSPRRRHKGR

SEQ ID NO: 3118539 - protein, 10 aa, Giardia lamblia
KLSPRTASPL

SEQ ID NO: 3118540 - protein, 5 aa, Giardia lamblia
KLSPT

SEQ ID NO: 3118541 - protein, 8 aa, Giardia lamblia
KLSPTSER

SEQ ID NO: 3118542 - protein, 15 aa, Giardia lamblia
KLSQANKKNQTLSEN

SEQ ID NO: 3118543 - protein, 8 aa, Giardia lamblia
KLSQGRVT

SEQ ID NO: 3118544 - protein, 6 aa, Giardia lamblia
KLSSDD

SEQ ID NO: 3118545 - protein, 9 aa, Giardia lamblia
KLSSDNPKV

SEQ ID NO: 3118546 - protein, 8 aa, Giardia lamblia
KLSSEVDE

SEQ ID NO: 3118547 - protein, 27 aa, Giardia lamblia
KLSSGYAHRHQKTESASPSKGKSATDL

SEQ ID NO: 3118548 - protein, 10 aa, Giardia lamblia
KLSSKGQSLT

SEQ ID NO: 3118549 - protein, 13 aa, Giardia lamblia
KLSSNKRKRNKEF

SEQ ID NO: 3118550 - protein, 10 aa, Giardia lamblia
KLSSPNDSID

SEQ ID NO: 3118551 - protein, 6 aa, Giardia lamblia
KLSTEL

SEQ ID NO: 3118552 - protein, 15 aa, Giardia lamblia
KLSTGPGQSSFGGFG

SEQ ID NO: 3118553 - protein, 6 aa, Giardia lamblia
KLTDEE

SEQ ID NO: 3118554 - protein, 31 aa, Giardia lamblia
KLTDTGAGAVADSTQLPTADVPSSSKDSEEC

SEQ ID NO: 3118555 - protein, 14 aa, Giardia lamblia
KLTEEAANKQIAQS

SEQ ID NO: 3118556 - protein, 19 aa, Giardia lamblia
KLTGKEAVSAENERIRSEL

SEQ ID NO: 3118557 - protein, 11 aa, Giardia lamblia
KLTKGNEETLR

SEQ ID NO: 3118558 - protein, 9 aa, Giardia lamblia
KLTKQKADL

SEQ ID NO: 3118559 - protein, 4 aa, Giardia lamblia
KLTN

SEQ ID NO: 3118560 - protein, 7 aa, Giardia lamblia
KLTPKGI

SEQ ID NO: 3118561 - protein, 19 aa, Giardia lamblia
KLTRESNKCTSPPLYDDAT

SEQ ID NO: 3118562 - protein, 12 aa, Giardia lamblia
KLTSDEDIPPNA

SEQ ID NO: 3118563 - protein, 5 aa, Giardia lamblia
KLTSL

SEQ ID NO: 3118564 - protein, 13 aa, Giardia lamblia
KLTSTTNVSTSPF

SEQ ID NO: 3118565 - protein, 8 aa, Giardia lamblia
KLTTATQA

SEQ ID NO: 3118566 - protein, 19 aa, Giardia lamblia
KLTTQSSKSCTTSAVSDTL

SEQ ID NO: 3118567 - protein, 12 aa, Giardia lamblia
KLVASNSKGALK

SEQ ID NO: 3118568 - protein, 12 aa, Giardia lamblia
KLYENTGTINDD

SEQ ID NO: 3118569 - protein, 5 aa, Giardia lamblia
KMAQE

SEQ ID NO: 3118570 - protein, 4 aa, Giardia lamblia
KMAT

SEQ ID NO: 3118571 - protein, 9 aa, Giardia lamblia
KMATPSGTT

SEQ ID NO: 3118572 - protein, 7 aa, Giardia lamblia
KMDAHKG

SEQ ID NO: 3118573 - protein, 19 aa, Giardia lamblia
KMDTRKRKPVELQRNPSYE

SEQ ID NO: 3118574 - protein, 9 aa, Giardia lamblia
KMEENSNAT

SEQ ID NO: 3118575 - protein, 9 aa, Giardia lamblia
KMEESKDGS

SEQ ID NO: 3118576 - protein, 5 aa, Giardia lamblia
KMEGV

SEQ ID NO: 3118577 - protein, 13 aa, Giardia lamblia
KMEQEKREEEERK

SEQ ID NO: 3118578 - protein, 8 aa, Giardia lamblia
KMHKEGAQ

SEQ ID NO: 3118579 - protein, 20 aa, Giardia lamblia
KMISTSSNPPMKATRPRVPI

SEQ ID NO: 3118580 - protein, 7 aa, Giardia lamblia
KMKSPAA

SEQ ID NO: 3118581 - protein, 15 aa, Giardia lamblia
KMNKESNDLKEDQWD

SEQ ID NO: 3118582 - protein, 6 aa, Giardia lamblia
KMPDGT

SEQ ID NO: 3118583 - protein, 16 aa, Giardia lamblia
KMPEVSNAPLKDPDFD

SEQ ID NO: 3118584 - protein, 8 aa, Giardia lamblia
KMPPSEIP

SEQ ID NO: 3118585 - protein, 6 aa, Giardia lamblia
KMPQSH

SEQ ID NO: 3118586 - protein, 6 aa, Giardia lamblia
KMPTPQ

SEQ ID NO: 3118587 - protein, 7 aa, Giardia lamblia
KMQDNLG

SEQ ID NO: 3118588 - protein, 5 aa, Giardia lamblia
KMQDP

SEQ ID NO: 3118589 - protein, 8 aa, Giardia lamblia
KMQRKSGE

SEQ ID NO: 3118590 - protein, 9 aa, Giardia lamblia
KMQSKDGHT

SEQ ID NO: 3118591 - protein, 9 aa, Giardia lamblia
KMQSNDQRT

SEQ ID NO: 3118592 - protein, 8 aa, Giardia lamblia
KMQTERGK

SEQ ID NO: 3118593 - protein, 5 aa, Giardia lamblia
KMSAT

SEQ ID NO: 3118594 - protein, 8 aa, Giardia lamblia
KMSKATGN

SEQ ID NO: 3118595 - protein, 8 aa, Giardia lamblia
KMSSEDKD

SEQ ID NO: 3118596 - protein, 6 aa, Giardia lamblia
KMSSKE

SEQ ID NO: 3118597 - protein, 8 aa, Giardia lamblia
KMSSKEKE

SEQ ID NO: 3118598 - protein, 7 aa, Giardia lamblia
KMSTNAK

SEQ ID NO: 3118599 - protein, 9 aa, Giardia lamblia
KMTDKKGHT

SEQ ID NO: 3118600 - protein, 7 aa, Giardia lamblia
KMTEESG

SEQ ID NO: 3118601 - protein, 5 aa, Giardia lamblia
KMTEH

SEQ ID NO: 3118602 - protein, 7 aa, Giardia lamblia
KMTEKYK

SEQ ID NO: 3118603 - protein, 6 aa, Giardia lamblia
KMTRGT

SEQ ID NO: 3118604 - protein, 8 aa, Giardia lamblia
KMTTPTGH

SEQ ID NO: 3118605 - protein, 13 aa, Giardia lamblia
KNAAEDTGTGMNA

SEQ ID NO: 3118606 - protein, 12 aa, Giardia lamblia
KNADGSFNISMQ

SEQ ID NO: 3118607 - protein, 20 aa, Giardia lamblia
KNADIRKNTNDLAISLNFFN

SEQ ID NO: 3118608 - protein, 8 aa, Giardia lamblia
KNADLQAR

SEQ ID NO: 3118609 - protein, 4 aa, Giardia lamblia
KNAE

SEQ ID NO: 3118610 - protein, 9 aa, Giardia lamblia
KNAGGTDGR

SEQ ID NO: 3118611 - protein, 7 aa, Giardia lamblia
KNAHGNT

SEQ ID NO: 3118612 - protein, 18 aa, Giardia lamblia
KNAHTEGVTSTAPLTNNP

SEQ ID NO: 3118613 - protein, 8 aa, Giardia lamblia
KNAKKLSE

SEQ ID NO: 3118614 - protein, 8 aa, Giardia lamblia
KNAPAGLI

SEQ ID NO: 3118615 - protein, 9 aa, Giardia lamblia
KNAPNESDY

SEQ ID NO: 3118616 - protein, 6 aa, Giardia lamblia
KNAPVS

SEQ ID NO: 3118617 - protein, 7 aa, Giardia lamblia
KNAQAET

SEQ ID NO: 3118618 - protein, 10 aa, Giardia lamblia
KNAQALKEGD

SEQ ID NO: 3118619 - protein, 16 aa, Giardia lamblia
KNAQGSESKKAAREKE

SEQ ID NO: 3118620 - protein, 5 aa, Giardia lamblia
KNARS

SEQ ID NO: 3118621 - protein, 19 aa, Giardia lamblia
KNASPSDEDEQQSKPNKRY

SEQ ID NO: 3118622 - protein, 14 aa, Giardia lamblia
KNASTGLLADDDKQ

SEQ ID NO: 3118623 - protein, 12 aa, Giardia lamblia
KNASTSSKDPLR

SEQ ID NO: 3118624 - protein, 7 aa, Giardia lamblia
KNATKYD

SEQ ID NO: 3118625 - protein, 18 aa, Giardia lamblia
KNATPKPQSLSAPVPLKP

SEQ ID NO: 3118626 - protein, 6 aa, Giardia lamblia
KNATSE

SEQ ID NO: 3118627 - protein, 5 aa, Giardia lamblia
KNATT

SEQ ID NO: 3118628 - protein, 4 aa, Giardia lamblia
KNCN

SEQ ID NO: 3118629 - protein, 7 aa, Giardia lamblia
KNCSPDS

SEQ ID NO: 3118630 - protein, 8 aa, Giardia lamblia
KNDAERDL

SEQ ID NO: 3118631 - protein, 4 aa, Giardia lamblia
KNDD

SEQ ID NO: 3118632 - protein, 8 aa, Giardia lamblia
KNDESARL

SEQ ID NO: 3118633 - protein, 6 aa, Giardia lamblia
KNDGSS

SEQ ID NO: 3118634 - protein, 9 aa, Giardia lamblia
KNDKANLTA

SEQ ID NO: 3118635 - protein, 8 aa, Giardia lamblia
KNDKGNTR

SEQ ID NO: 3118636 - protein, 6 aa, Giardia lamblia
KNDNGE

SEQ ID NO: 3118637 - protein, 4 aa, Giardia lamblia
KNDQ

SEQ ID NO: 3118638 - protein, 7 aa, Giardia lamblia
KNDQPNF

SEQ ID NO: 3118639 - protein, 24 aa, Giardia lamblia
KNDQVSTCDSPSLDSEKDPKDESM

SEQ ID NO: 3118640 - protein, 14 aa, Giardia lamblia
KNDRTTDDWPGPRC

SEQ ID NO: 3118641 - protein, 7 aa, Giardia lamblia
KNDSGET

SEQ ID NO: 3118642 - protein, 11 aa, Giardia lamblia
KNDSMEKAGQI

SEQ ID NO: 3118643 - protein, 9 aa, Giardia lamblia
KNDSSVEYE

SEQ ID NO: 3118644 - protein, 11 aa, Giardia lamblia
KNEAANIGNPV

SEQ ID NO: 3118645 - protein, 7 aa, Giardia lamblia
KNEAEIT

SEQ ID NO: 3118646 - protein, 13 aa, Giardia lamblia
KNEALRSDAAVRK

SEQ ID NO: 3118647 - protein, 5 aa, Giardia lamblia
KNEAN

SEQ ID NO: 3118648 - protein, 9 aa, Giardia lamblia
KNEDANARL

SEQ ID NO: 3118649 - protein, 9 aa, Giardia lamblia
KNEDGNTAL

SEQ ID NO: 3118650 - protein, 7 aa, Giardia lamblia
KNEDVQQ

SEQ ID NO: 3118651 - protein, 9 aa, Giardia lamblia
KNEELYNEP

SEQ ID NO: 3118652 - protein, 10 aa, Giardia lamblia
KNEERINKPS

SEQ ID NO: 3118653 - protein, 8 aa, Giardia lamblia
KNEHKSSS

SEQ ID NO: 3118654 - protein, 9 aa, Giardia lamblia
KNEKHNRYV

SEQ ID NO: 3118655 - protein, 7 aa, Giardia lamblia
KNEKYRS

SEQ ID NO: 3118656 - protein, 14 aa, Giardia lamblia
KNELKREGIRQSQN

SEQ ID NO: 3118657 - protein, 42 aa, Giardia lamblia
KNELKRRQKLREKETKGPAPPAKAAGSGSEPVEGAPEEIDPT

SEQ ID NO: 3118658 - protein, 9 aa, Giardia lamblia
KNEQEEKNT

SEQ ID NO: 3118659 - protein, 6 aa, Giardia lamblia
KNEQGQ

SEQ ID NO: 3118660 - protein, 6 aa, Giardia lamblia
KNERER

SEQ ID NO: 3118661 - protein, 5 aa, Giardia lamblia
KNESI

SEQ ID NO: 3118662 - protein, 34 aa, Giardia lamblia
KNESSLNSSAVENSRIEDRPGNGQRDQSTLDDRS

SEQ ID NO: 3118663 - protein, 9 aa, Giardia lamblia
KNESVKKSI

SEQ ID NO: 3118664 - protein, 5 aa, Giardia lamblia
KNGAL

SEQ ID NO: 3118665 - protein, 7 aa, Giardia lamblia
KNGDSNS

SEQ ID NO: 3118666 - protein, 11 aa, Giardia lamblia
KNGEPVDAAGK

SEQ ID NO: 3118667 - protein, 8 aa, Giardia lamblia
KNGETAFQ

SEQ ID NO: 3118668 - protein, 5 aa, Giardia lamblia
KNGFT

SEQ ID NO: 3118669 - protein, 6 aa, Giardia lamblia
KNGHKE

SEQ ID NO: 3118670 - protein, 6 aa, Giardia lamblia
KNGHSD

SEQ ID NO: 3118671 - protein, 10 aa, Giardia lamblia
KNGNIKSSTC

SEQ ID NO: 3118672 - protein, 8 aa, Giardia lamblia
KNGNTGLE

SEQ ID NO: 3118673 - protein, 7 aa, Giardia lamblia
KNGPGNL

SEQ ID NO: 3118674 - protein, 8 aa, Giardia lamblia
KNGPKGKV

SEQ ID NO: 3118675 - protein, 6 aa, Giardia lamblia
KNGPMS

SEQ ID NO: 3118676 - protein, 6 aa, Giardia lamblia
KNGPYE

SEQ ID NO: 3118677 - protein, 30 aa, Giardia lamblia
KNGQDTSSSQGRDYRPQEPQQQNAQQAPVP

SEQ ID NO: 3118678 - protein, 18 aa, Giardia lamblia
KNGQLDKYGGINKDTPKE

SEQ ID NO: 3118679 - protein, 10 aa, Giardia lamblia
KNGQQNSIDD

SEQ ID NO: 3118680 - protein, 6 aa, Giardia lamblia
KNGSKD

SEQ ID NO: 3118681 - protein, 6 aa, Giardia lamblia
KNGSTD

SEQ ID NO: 3118682 - protein, 6 aa, Giardia lamblia
KNGTRV

SEQ ID NO: 3118683 - protein, 5 aa, Giardia lamblia
KNGYS

SEQ ID NO: 3118684 - protein, 7 aa, Giardia lamblia
KNHAAKS

SEQ ID NO: 3118685 - protein, 7 aa, Giardia lamblia
KNHAGIR

SEQ ID NO: 3118686 - protein, 7 aa, Giardia lamblia
KNHPMTK

SEQ ID NO: 3118687 - protein, 6 aa, Giardia lamblia
KNHSAI

SEQ ID NO: 3118688 - protein, 5 aa, Giardia lamblia
KNHSG

SEQ ID NO: 3118689 - protein, 5 aa, Giardia lamblia
KNHSQ

SEQ ID NO: 3118690 - protein, 5 aa, Giardia lamblia
KNHVD

SEQ ID NO: 3118691 - protein, 26 aa, Giardia lamblia
KNIAANTAIDNQNNQIEELTQDKQKL

SEQ ID NO: 3118692 - protein, 5 aa, Giardia lamblia
KNIAS

SEQ ID NO: 3118693 - protein, 6 aa, Giardia lamblia
KNIDNK

SEQ ID NO: 3118694 - protein, 13 aa, Giardia lamblia
KNIDSTSMSGGRQ

SEQ ID NO: 3118695 - protein, 6 aa, Giardia lamblia
KNIGSV

SEQ ID NO: 3118696 - protein, 16 aa, Giardia lamblia
KNIRPRSATSQPTSAA

SEQ ID NO: 3118697 - protein, 29 aa, Giardia lamblia
KNIRPSSTNEAHRTESRKRSQTASSRDVS

SEQ ID NO: 3118698 - protein, 9 aa, Giardia lamblia
KNIRSKDSR

SEQ ID NO: 3118699 - protein, 13 aa, Giardia lamblia
KNITEANRSVSQL

SEQ ID NO: 3118700 - protein, 8 aa, Giardia lamblia
KNKETGEL

SEQ ID NO: 3118701 - protein, 10 aa, Giardia lamblia
KNKINDSTSV

SEQ ID NO: 3118702 - protein, 11 aa, Giardia lamblia
KNKNKSKKVQE

SEQ ID NO: 3118703 - protein, 14 aa, Giardia lamblia
KNKPDYQDCLKESF

SEQ ID NO: 3118704 - protein, 5 aa, Giardia lamblia
KNKPE

SEQ ID NO: 3118705 - protein, 8 aa, Giardia lamblia
KNKPSERV

SEQ ID NO: 3118706 - protein, 8 aa, Giardia lamblia
KNKPYPKS

SEQ ID NO: 3118707 - protein, 6 aa, Giardia lamblia
KNKQID

SEQ ID NO: 3118708 - protein, 8 aa, Giardia lamblia
KNKQTIEP

SEQ ID NO: 3118709 - protein, 8 aa, Giardia lamblia
KNKSITEL

SEQ ID NO: 3118710 - protein, 6 aa, Giardia lamblia
KNKTLG

SEQ ID NO: 3118711 - protein, 12 aa, Giardia lamblia
KNLDKTKKKRVK

SEQ ID NO: 3118712 - protein, 8 aa, Giardia lamblia
KNLDSRNV

SEQ ID NO: 3118713 - protein, 12 aa, Giardia lamblia
KNLETSVARQSS

SEQ ID NO: 3118714 - protein, 14 aa, Giardia lamblia
KNLPEVTTKISGKS

SEQ ID NO: 3118715 - protein, 4 aa, Giardia lamblia
KNLQ

SEQ ID NO: 3118716 - protein, 4 aa, Giardia lamblia
KNLR

SEQ ID NO: 3118717 - protein, 11 aa, Giardia lamblia
KNLSAAQAEVE

SEQ ID NO: 3118718 - protein, 16 aa, Giardia lamblia
KNLSQTGLRTTNSSTA

SEQ ID NO: 3118719 - protein, 6 aa, Giardia lamblia
KNLSRY

SEQ ID NO: 3118720 - protein, 7 aa, Giardia lamblia
KNNDGHT

SEQ ID NO: 3118721 - protein, 8 aa, Giardia lamblia
KNNEKIES

SEQ ID NO: 3118722 - protein, 5 aa, Giardia lamblia
KNNEM

SEQ ID NO: 3118723 - protein, 5 aa, Giardia lamblia
KNNLE

SEQ ID NO: 3118724 - protein, 5 aa, Giardia lamblia
KNNNE

SEQ ID NO: 3118725 - protein, 6 aa, Giardia lamblia
KNNNKD

SEQ ID NO: 3118726 - protein, 10 aa, Giardia lamblia
KNNPEEAERI

SEQ ID NO: 3118727 - protein, 7 aa, Giardia lamblia
KNNRPST

SEQ ID NO: 3118728 - protein, 6 aa, Giardia lamblia
KNNSAQ

SEQ ID NO: 3118729 - protein, 4 aa, Giardia lamblia
KNNT

SEQ ID NO: 3118730 - protein, 5 aa, Giardia lamblia
KNNTL

SEQ ID NO: 3118731 - protein, 4 aa, Giardia lamblia
KNNV

SEQ ID NO: 3118732 - protein, 5 aa, Giardia lamblia
KNNVN

SEQ ID NO: 3118733 - protein, 5 aa, Giardia lamblia
KNNYN

SEQ ID NO: 3118734 - protein, 6 aa, Giardia lamblia
KNPDPY

SEQ ID NO: 3118735 - protein, 8 aa, Giardia lamblia
KNPDSDSV

SEQ ID NO: 3118736 - protein, 4 aa, Giardia lamblia
KNPE

SEQ ID NO: 3118737 - protein, 12 aa, Giardia lamblia
KNPEPDHSRTDL

SEQ ID NO: 3118738 - protein, 6 aa, Giardia lamblia
KNPERF

SEQ ID NO: 3118739 - protein, 9 aa, Giardia lamblia
KNPGITSSS

SEQ ID NO: 3118740 - protein, 6 aa, Giardia lamblia
KNPGNY

SEQ ID NO: 3118741 - protein, 5 aa, Giardia lamblia
KNPHI

SEQ ID NO: 3118742 - protein, 5 aa, Giardia lamblia
KNPKL

SEQ ID NO: 3118743 - protein, 8 aa, Giardia lamblia
KNPNAANE

SEQ ID NO: 3118744 - protein, 12 aa, Giardia lamblia
KNPPDAPEANRS

SEQ ID NO: 3118745 - protein, 10 aa, Giardia lamblia
KNPPNPQQVP

SEQ ID NO: 3118746 - protein, 6 aa, Giardia lamblia
KNPQYE

SEQ ID NO: 3118747 - protein, 5 aa, Giardia lamblia
KNPRF

SEQ ID NO: 3118748 - protein, 6 aa, Giardia lamblia
KNPSPE

SEQ ID NO: 3118749 - protein, 7 aa, Giardia lamblia
KNPSSHL

SEQ ID NO: 3118750 - protein, 11 aa, Giardia lamblia
KNPTFANKSKT

SEQ ID NO: 3118751 - protein, 23 aa, Giardia lamblia
KNQAAEEEQDEDEDDKEKTTSNI

SEQ ID NO: 3118752 - protein, 10 aa, Giardia lamblia
KNQAQNTYVG

SEQ ID NO: 3118753 - protein, 6 aa, Giardia lamblia
KNQIPA

SEQ ID NO: 3118754 - protein, 9 aa, Giardia lamblia
KNQNTDDKY

SEQ ID NO: 3118755 - protein, 8 aa, Giardia lamblia
KNQRDMSE

SEQ ID NO: 3118756 - protein, 6 aa, Giardia lamblia
KNQSGM

SEQ ID NO: 3118757 - protein, 6 aa, Giardia lamblia
KNQTPS

SEQ ID NO: 3118758 - protein, 12 aa, Giardia lamblia
KNRASSKRWSTH

SEQ ID NO: 3118759 - protein, 4 aa, Giardia lamblia
KNRD

SEQ ID NO: 3118760 - protein, 6 aa, Giardia lamblia
KNRELT

SEQ ID NO: 3118761 - protein, 8 aa, Giardia lamblia
KNRGVTGI

SEQ ID NO: 3118762 - protein, 7 aa, Giardia lamblia
KNRHRQT

SEQ ID NO: 3118763 - protein, 6 aa, Giardia lamblia
KNRLSQ

SEQ ID NO: 3118764 - protein, 5 aa, Giardia lamblia
KNRPE

SEQ ID NO: 3118765 - protein, 11 aa, Giardia lamblia
KNRQENSLPPD

SEQ ID NO: 3118766 - protein, 7 aa, Giardia lamblia
KNRQPTV

SEQ ID NO: 3118767 - protein, 6 aa, Giardia lamblia
KNRYPS

SEQ ID NO: 3118768 - protein, 11 aa, Giardia lamblia
KNSAEKARDQY

SEQ ID NO: 3118769 - protein, 5 aa, Giardia lamblia
KNSAQ

SEQ ID NO: 3118770 - protein, 8 aa, Giardia lamblia
KNSASAEP

SEQ ID NO: 3118771 - protein, 7 aa, Giardia lamblia
KNSEERR

SEQ ID NO: 3118772 - protein, 20 aa, Giardia lamblia
KNSEQHKTAVATQEHHSPAK

SEQ ID NO: 3118773 - protein, 9 aa, Giardia lamblia
KNSEVKEDS

SEQ ID NO: 3118774 - protein, 4 aa, Giardia lamblia
KNSF

SEQ ID NO: 3118775 - protein, 16 aa, Giardia lamblia
KNSGLTSESDPASGFP

SEQ ID NO: 3118776 - protein, 14 aa, Giardia lamblia
KNSGTLGASSDPFQ

SEQ ID NO: 3118777 - protein, 6 aa, Giardia lamblia
KNSGVS

SEQ ID NO: 3118778 - protein, 8 aa, Giardia lamblia
KNSKPWNP

SEQ ID NO: 3118779 - protein, 5 aa, Giardia lamblia
KNSLQ

SEQ ID NO: 3118780 - protein, 5 aa, Giardia lamblia
KNSNG

SEQ ID NO: 3118781 - protein, 8 aa, Giardia lamblia
KNSNHTRT

SEQ ID NO: 3118782 - protein, 13 aa, Giardia lamblia
KNSNSIEQRSSAI

SEQ ID NO: 3118783 - protein, 11 aa, Giardia lamblia
KNSPGSDSLQQ

SEQ ID NO: 3118784 - protein, 10 aa, Giardia lamblia
KNSPNDTRSQ

SEQ ID NO: 3118785 - protein, 36 aa, Giardia lamblia
KNSPTRTANTRSSNYDGATSKSSYQGALTTGRVGSS

SEQ ID NO: 3118786 - protein, 6 aa, Giardia lamblia
KNSQIK

SEQ ID NO: 3118787 - protein, 11 aa, Giardia lamblia
KNSQITTQDEA

SEQ ID NO: 3118788 - protein, 7 aa, Giardia lamblia
KNSQLSG

SEQ ID NO: 3118789 - protein, 8 aa, Giardia lamblia
KNSRCNYY

SEQ ID NO: 3118790 - protein, 6 aa, Giardia lamblia
KNSRPL

SEQ ID NO: 3118791 - protein, 10 aa, Giardia lamblia
KNSRSISRGM

SEQ ID NO: 3118792 - protein, 16 aa, Giardia lamblia
KNSSDTGLGGAASGGH

SEQ ID NO: 3118793 - protein, 7 aa, Giardia lamblia
KNSSGTT

SEQ ID NO: 3118794 - protein, 9 aa, Giardia lamblia
KNSTANNQL

SEQ ID NO: 3118795 - protein, 7 aa, Giardia lamblia
KNSTDEV

SEQ ID NO: 3118796 - protein, 8 aa, Giardia lamblia
KNSTEKSV

SEQ ID NO: 3118797 - protein, 7 aa, Giardia lamblia
KNSTMSS

SEQ ID NO: 3118798 - protein, 14 aa, Giardia lamblia
KNSTNYDSRADGAK

SEQ ID NO: 3118799 - protein, 7 aa, Giardia lamblia
KNSTTTL

SEQ ID NO: 3118800 - protein, 13 aa, Giardia lamblia
KNTCTTSSMSKDY

SEQ ID NO: 3118801 - protein, 7 aa, Giardia lamblia
KNTDGQI

SEQ ID NO: 3118802 - protein, 5 aa, Giardia lamblia
KNTDL

SEQ ID NO: 3118803 - protein, 4 aa, Giardia lamblia
KNTG

SEQ ID NO: 3118804 - protein, 8 aa, Giardia lamblia
KNTGDPTR

SEQ ID NO: 3118805 - protein, 5 aa, Giardia lamblia
KNTGI

SEQ ID NO: 3118806 - protein, 7 aa, Giardia lamblia
KNTIAEA

SEQ ID NO: 3118807 - protein, 17 aa, Giardia lamblia
KNTKDVSLKQDTPSDVH

SEQ ID NO: 3118808 - protein, 14 aa, Giardia lamblia
KNTKSSDPPPSNCS

SEQ ID NO: 3118809 - protein, 5 aa, Giardia lamblia
KNTKT

SEQ ID NO: 3118810 - protein, 4 aa, Giardia lamblia
KNTL

SEQ ID NO: 3118811 - protein, 7 aa, Giardia lamblia
KNTMTSE

SEQ ID NO: 3118812 - protein, 19 aa, Giardia lamblia
KNTNIKQGADQYSLAETGP

SEQ ID NO: 3118813 - protein, 6 aa, Giardia lamblia
KNTPTA

SEQ ID NO: 3118814 - protein, 8 aa, Giardia lamblia
KNTPVSEP

SEQ ID NO: 3118815 - protein, 7 aa, Giardia lamblia
KNTQAHK

SEQ ID NO: 3118816 - protein, 6 aa, Giardia lamblia
KNTQLE

SEQ ID NO: 3118817 - protein, 5 aa, Giardia lamblia
KNTRE

SEQ ID NO: 3118818 - protein, 6 aa, Giardia lamblia
KNTRTD

SEQ ID NO: 3118819 - protein, 6 aa, Giardia lamblia
KNTRVT

SEQ ID NO: 3118820 - protein, 8 aa, Giardia lamblia
KNTSAPNQ

SEQ ID NO: 3118821 - protein, 28 aa, Giardia lamblia
KNTSEESAGNSTESSQTDDEGSVDEDGV

SEQ ID NO: 3118822 - protein, 7 aa, Giardia lamblia
KNTSSQI

SEQ ID NO: 3118823 - protein, 13 aa, Giardia lamblia
KNTSSSSTQLESP

SEQ ID NO: 3118824 - protein, 5 aa, Giardia lamblia
KNTTD

SEQ ID NO: 3118825 - protein, 14 aa, Giardia lamblia
KNTTEEFSGTTQGA

SEQ ID NO: 3118826 - protein, 12 aa, Giardia lamblia
KNTTPANTTTQV

SEQ ID NO: 3118827 - protein, 7 aa, Giardia lamblia
KNTTSAT

SEQ ID NO: 3118828 - protein, 7 aa, Giardia lamblia
KNVEATA

SEQ ID NO: 3118829 - protein, 6 aa, Giardia lamblia
KNVGGM

SEQ ID NO: 3118830 - protein, 8 aa, Giardia lamblia
KNVKQKGK

SEQ ID NO: 3118831 - protein, 10 aa, Giardia lamblia
KNVNNKEMQQ

SEQ ID NO: 3118832 - protein, 6 aa, Giardia lamblia
KNVPEN

SEQ ID NO: 3118833 - protein, 8 aa, Giardia lamblia
KNVSGETN

SEQ ID NO: 3118834 - protein, 4 aa, Giardia lamblia
KNVT

SEQ ID NO: 3118835 - protein, 13 aa, Giardia lamblia
KNYAQNINKDLYE

SEQ ID NO: 3118836 - protein, 9 aa, Giardia lamblia
KNYEEADDS

SEQ ID NO: 3118837 - protein, 15 aa, Giardia lamblia
KNYEKELSKYQSEVE

SEQ ID NO: 3118838 - protein, 12 aa, Giardia lamblia
KNYEQDAKNEKA

SEQ ID NO: 3118839 - protein, 4 aa, Giardia lamblia
KNYG

SEQ ID NO: 3118840 - protein, 23 aa, Giardia lamblia
KNYGEISAASAAFSKSVDQEGNT

SEQ ID NO: 3118841 - protein, 4 aa, Giardia lamblia
KNYI

SEQ ID NO: 3118842 - protein, 4 aa, Giardia lamblia
KNYL

SEQ ID NO: 3118843 - protein, 4 aa, Giardia lamblia
KNYQ

SEQ ID NO: 3118844 - protein, 6 aa, Giardia lamblia
KNYSET

SEQ ID NO: 3118845 - protein, 20 aa, Giardia lamblia
KNYTERETTGVAEPAPSSST

SEQ ID NO: 3118846 - protein, 6 aa, Giardia lamblia
KNYTRE

SEQ ID NO: 3118847 - protein, 19 aa, Giardia lamblia
KNYTTTQSVDKKDYQNKNS

SEQ ID NO: 3118848 - protein, 4 aa, Giardia lamblia
KPAA

SEQ ID NO: 3118849 - protein, 15 aa, Giardia lamblia
KPAAARASTTDVPDC

SEQ ID NO: 3118850 - protein, 11 aa, Giardia lamblia
KPAAPRESEAD

SEQ ID NO: 3118851 - protein, 11 aa, Giardia lamblia
KPADPDKRITP

SEQ ID NO: 3118852 - protein, 12 aa, Giardia lamblia
KPAEDGATQDTL

SEQ ID NO: 3118853 - protein, 11 aa, Giardia lamblia
KPAESAPGTIR

SEQ ID NO: 3118854 - protein, 11 aa, Giardia lamblia
KPAKKKKVHPA

SEQ ID NO: 3118855 - protein, 27 aa, Giardia lamblia
KPALGSNHDGATGAQSSPSKKKIGTFD

SEQ ID NO: 3118856 - protein, 27 aa, Giardia lamblia
KPALRPGTGSISAQRCPSRSKSPAIYT

SEQ ID NO: 3118857 - protein, 4 aa, Giardia lamblia
KPAM

SEQ ID NO: 3118858 - protein, 7 aa, Giardia lamblia
KPANKDL

SEQ ID NO: 3118859 - protein, 12 aa, Giardia lamblia
KPASGTGIASRG

SEQ ID NO: 3118860 - protein, 14 aa, Giardia lamblia
KPASKTCSSTITVS

SEQ ID NO: 3118861 - protein, 17 aa, Giardia lamblia
KPASQEGCANSSFTSIT

SEQ ID NO: 3118862 - protein, 6 aa, Giardia lamblia
KPASRD

SEQ ID NO: 3118863 - protein, 20 aa, Giardia lamblia
KPASSNSNAGGGTSSYADSI

SEQ ID NO: 3118864 - protein, 5 aa, Giardia lamblia
KPATL

SEQ ID NO: 3118865 - protein, 6 aa, Giardia lamblia
KPAVTR

SEQ ID NO: 3118866 - protein, 6 aa, Giardia lamblia
KPAVTT

SEQ ID NO: 3118867 - protein, 12 aa, Giardia lamblia
KPCAESGVTSAQ

SEQ ID NO: 3118868 - protein, 11 aa, Giardia lamblia
KPCASNTNNLQ

SEQ ID NO: 3118869 - protein, 6 aa, Giardia lamblia
KPCQEN

SEQ ID NO: 3118870 - protein, 5 aa, Giardia lamblia
KPDAC

SEQ ID NO: 3118871 - protein, 6 aa, Giardia lamblia
KPDADK

SEQ ID NO: 3118872 - protein, 5 aa, Giardia lamblia
KPDAS

SEQ ID NO: 3118873 - protein, 19 aa, Giardia lamblia
KPDATSVKSHNATSATPYL

SEQ ID NO: 3118874 - protein, 8 aa, Giardia lamblia
KPDDTPYF

SEQ ID NO: 3118875 - protein, 9 aa, Giardia lamblia
KPDEQTQIG

SEQ ID NO: 3118876 - protein, 4 aa, Giardia lamblia
KPDG

SEQ ID NO: 3118877 - protein, 15 aa, Giardia lamblia
KPDGDKFSPHDPTPI

SEQ ID NO: 3118878 - protein, 84 aa, Giardia lamblia
KPDHATNRHEPTKNDRKPNNPSYGERKGGHGKGGENQTDPRSRMRGDQNDRTAKQEEWERQRQERFDEKQKEIEDMNAENEGRL

SEQ ID NO: 3118879 - protein, 6 aa, Giardia lamblia
KPDMSE

SEQ ID NO: 3118880 - protein, 6 aa, Giardia lamblia
KPDNPC

SEQ ID NO: 3118881 - protein, 10 aa, Giardia lamblia
KPDPDPSTIG

SEQ ID NO: 3118882 - protein, 8 aa, Giardia lamblia
KPDPSDKF

SEQ ID NO: 3118883 - protein, 6 aa, Giardia lamblia
KPDREL

SEQ ID NO: 3118884 - protein, 9 aa, Giardia lamblia
KPDSPDLLS

SEQ ID NO: 3118885 - protein, 13 aa, Giardia lamblia
KPDSRGSNFAKDY

SEQ ID NO: 3118886 - protein, 10 aa, Giardia lamblia
KPDTDPKIPA

SEQ ID NO: 3118887 - protein, 5 aa, Giardia lamblia
KPDTE

SEQ ID NO: 3118888 - protein, 5 aa, Giardia lamblia
KPDVK

SEQ ID NO: 3118889 - protein, 5 aa, Giardia lamblia
KPDYT

SEQ ID NO: 3118890 - protein, 4 aa, Giardia lamblia
KPEA

SEQ ID NO: 3118891 - protein, 18 aa, Giardia lamblia
KPEANITTNAKSTYGEGA

SEQ ID NO: 3118892 - protein, 6 aa, Giardia lamblia
KPEDLP

SEQ ID NO: 3118893 - protein, 10 aa, Giardia lamblia
KPEGIQPGSI

SEQ ID NO: 3118894 - protein, 5 aa, Giardia lamblia
KPEIS

SEQ ID NO: 3118895 - protein, 9 aa, Giardia lamblia
KPEKAKAAL

SEQ ID NO: 3118896 - protein, 14 aa, Giardia lamblia
KPEKKTTSKPKPVN

SEQ ID NO: 3118897 - protein, 6 aa, Giardia lamblia
KPELKN

SEQ ID NO: 3118898 - protein, 4 aa, Giardia lamblia
KPEM

SEQ ID NO: 3118899 - protein, 4 aa, Giardia lamblia
KPEN

SEQ ID NO: 3118900 - protein, 4 aa, Giardia lamblia
KPEP

SEQ ID NO: 3118901 - protein, 7 aa, Giardia lamblia
KPEPDLN

SEQ ID NO: 3118902 - protein, 9 aa, Giardia lamblia
KPEPPPPQY

SEQ ID NO: 3118903 - protein, 14 aa, Giardia lamblia
KPEPVATEAETSIY

SEQ ID NO: 3118904 - protein, 9 aa, Giardia lamblia
KPERKDDPW

SEQ ID NO: 3118905 - protein, 9 aa, Giardia lamblia
KPESEDTKK

SEQ ID NO: 3118906 - protein, 17 aa, Giardia lamblia
KPESREGSAEEGGWHEN

SEQ ID NO: 3118907 - protein, 4 aa, Giardia lamblia
KPFS

SEQ ID NO: 3118908 - protein, 44 aa, Giardia lamblia
KPFSHKQKKEQLKEKRQANIAKEHDATSREQKKLPSTKAKQDPS

SEQ ID NO: 3118909 - protein, 4 aa, Giardia lamblia
KPFT

SEQ ID NO: 3118910 - protein, 9 aa, Giardia lamblia
KPGAKSRGR

SEQ ID NO: 3118911 - protein, 6 aa, Giardia lamblia
KPGCNP

SEQ ID NO: 3118912 - protein, 4 aa, Giardia lamblia
KPGD

SEQ ID NO: 3118913 - protein, 6 aa, Giardia lamblia
KPGDRV

SEQ ID NO: 3118914 - protein, 8 aa, Giardia lamblia
KPGEAPYR

SEQ ID NO: 3118915 - protein, 8 aa, Giardia lamblia
KPGEQAVG

SEQ ID NO: 3118916 - protein, 13 aa, Giardia lamblia
KPGGKSANSTKEI

SEQ ID NO: 3118917 - protein, 6 aa, Giardia lamblia
KPGGTL

SEQ ID NO: 3118918 - protein, 4 aa, Giardia lamblia
KPGH

SEQ ID NO: 3118919 - protein, 4 aa, Giardia lamblia
KPGL

SEQ ID NO: 3118920 - protein, 6 aa, Giardia lamblia
KPGLDP

SEQ ID NO: 3118921 - protein, 6 aa, Giardia lamblia
KPGPVA

SEQ ID NO: 3118922 - protein, 5 aa, Giardia lamblia
KPGRS

SEQ ID NO: 3118923 - protein, 10 aa, Giardia lamblia
KPGSLAPENL

SEQ ID NO: 3118924 - protein, 4 aa, Giardia lamblia
KPGT

SEQ ID NO: 3118925 - protein, 8 aa, Giardia lamblia
KPGTGKTT

SEQ ID NO: 3118926 - protein, 19 aa, Giardia lamblia
KPGTITAPKPRPGKRTSPF

SEQ ID NO: 3118927 - protein, 6 aa, Giardia lamblia
KPGTTV

SEQ ID NO: 3118928 - protein, 18 aa, Giardia lamblia
KPGTVPRKKDGVTTGPRV

SEQ ID NO: 3118929 - protein, 6 aa, Giardia lamblia
KPHPKY

SEQ ID NO: 3118930 - protein, 6 aa, Giardia lamblia
KPHRSI

SEQ ID NO: 3118931 - protein, 6 aa, Giardia lamblia
KPHSET

SEQ ID NO: 3118932 - protein, 18 aa, Giardia lamblia
KPHSYTNRSSSTTESDHS

SEQ ID NO: 3118933 - protein, 4 aa, Giardia lamblia
KPHT

SEQ ID NO: 3118934 - protein, 23 aa, Giardia lamblia
KPINAASTLQSTRGGRAKNHQPI

SEQ ID NO: 3118935 - protein, 8 aa, Giardia lamblia
KPIQISNA

SEQ ID NO: 3118936 - protein, 8 aa, Giardia lamblia
KPISPSRR

SEQ ID NO: 3118937 - protein, 11 aa, Giardia lamblia
KPISSDYSNDM

SEQ ID NO: 3118938 - protein, 6 aa, Giardia lamblia
KPISSN

SEQ ID NO: 3118939 - protein, 7 aa, Giardia lamblia
KPITQSD

SEQ ID NO: 3118940 - protein, 6 aa, Giardia lamblia
KPIYGE

SEQ ID NO: 3118941 - protein, 4 aa, Giardia lamblia
KPKD

SEQ ID NO: 3118942 - protein, 13 aa, Giardia lamblia
KPKEARRKTSKGY

SEQ ID NO: 3118943 - protein, 15 aa, Giardia lamblia
KPKELTSTTADGRTP

SEQ ID NO: 3118944 - protein, 7 aa, Giardia lamblia
KPKFDEA

SEQ ID NO: 3118945 - protein, 9 aa, Giardia lamblia
KPKIATTIK

SEQ ID NO: 3118946 - protein, 23 aa, Giardia lamblia
KPKIRSRPQSSKRPLQNTQLSQT

SEQ ID NO: 3118947 - protein, 7 aa, Giardia lamblia
KPKPRDP

SEQ ID NO: 3118948 - protein, 8 aa, Giardia lamblia
KPKPTREK

SEQ ID NO: 3118949 - protein, 7 aa, Giardia lamblia
KPKPTVW

SEQ ID NO: 3118950 - protein, 21 aa, Giardia lamblia
KPKQKASRVPSAVQSEPLSES

SEQ ID NO: 3118951 - protein, 15 aa, Giardia lamblia
KPKSIGASEGCQQQQ

SEQ ID NO: 3118952 - protein, 8 aa, Giardia lamblia
KPKTHTRA

SEQ ID NO: 3118953 - protein, 12 aa, Giardia lamblia
KPKVKAKQKPAA

SEQ ID NO: 3118954 - protein, 10 aa, Giardia lamblia
KPLATTRTGK

SEQ ID NO: 3118955 - protein, 7 aa, Giardia lamblia
KPLDGSE

SEQ ID NO: 3118956 - protein, 14 aa, Giardia lamblia
KPLDPAGQATTNTI

SEQ ID NO: 3118957 - protein, 9 aa, Giardia lamblia
KPLGSAGNN

SEQ ID NO: 3118958 - protein, 4 aa, Giardia lamblia
KPLL

SEQ ID NO: 3118959 - protein, 5 aa, Giardia lamblia
KPLPP

SEQ ID NO: 3118960 - protein, 6 aa, Giardia lamblia
KPLPPT

SEQ ID NO: 3118961 - protein, 7 aa, Giardia lamblia
KPLPQGG

SEQ ID NO: 3118962 - protein, 12 aa, Giardia lamblia
KPLPSNAEETCR

SEQ ID NO: 3118963 - protein, 10 aa, Giardia lamblia
KPLPSSESSA

SEQ ID NO: 3118964 - protein, 6 aa, Giardia lamblia
KPLPVA

SEQ ID NO: 3118965 - protein, 15 aa, Giardia lamblia
KPLQDETENPNSGAS

SEQ ID NO: 3118966 - protein, 28 aa, Giardia lamblia
KPLQRRPTRIPKPTTPPCATQQYAPSTP

SEQ ID NO: 3118967 - protein, 20 aa, Giardia lamblia
KPLRPHTTNDASEATSTTSR

SEQ ID NO: 3118968 - protein, 11 aa, Giardia lamblia
KPLSKSNDRAI

SEQ ID NO: 3118969 - protein, 8 aa, Giardia lamblia
KPLSNNEQ

SEQ ID NO: 3118970 - protein, 8 aa, Giardia lamblia
KPLTQGSE

SEQ ID NO: 3118971 - protein, 16 aa, Giardia lamblia
KPNCSPRSKANQSCPQ

SEQ ID NO: 3118972 - protein, 9 aa, Giardia lamblia
KPNDDESDM

SEQ ID NO: 3118973 - protein, 7 aa, Giardia lamblia
KPNDIES

SEQ ID NO: 3118974 - protein, 4 aa, Giardia lamblia
KPNF

SEQ ID NO: 3118975 - protein, 7 aa, Giardia lamblia
KPNGSSE

SEQ ID NO: 3118976 - protein, 7 aa, Giardia lamblia
KPNIDRD

SEQ ID NO: 3118977 - protein, 10 aa, Giardia lamblia
KPNINTSSQA

SEQ ID NO: 3118978 - protein, 6 aa, Giardia lamblia
KPNIPV

SEQ ID NO: 3118979 - protein, 7 aa, Giardia lamblia
KPNKTVE

SEQ ID NO: 3118980 - protein, 4 aa, Giardia lamblia
KPNL

SEQ ID NO: 3118981 - protein, 14 aa, Giardia lamblia
KPNLPAEKTRIERA

SEQ ID NO: 3118982 - protein, 11 aa, Giardia lamblia
KPNRQQPANTI

SEQ ID NO: 3118983 - protein, 6 aa, Giardia lamblia
KPNVQD

SEQ ID NO: 3118984 - protein, 16 aa, Giardia lamblia
KPPADEPKSTPVAPTA

SEQ ID NO: 3118985 - protein, 4 aa, Giardia lamblia
KPPD

SEQ ID NO: 3118986 - protein, 30 aa, Giardia lamblia
KPPDIRSAEKAAAEARRTSLKKDGDVQCPS

SEQ ID NO: 3118987 - protein, 8 aa, Giardia lamblia
KPPEDAAR

SEQ ID NO: 3118988 - protein, 5 aa, Giardia lamblia
KPPEY

SEQ ID NO: 3118989 - protein, 5 aa, Giardia lamblia
KPPFH

SEQ ID NO: 3118990 - protein, 6 aa, Giardia lamblia
KPPLTT

SEQ ID NO: 3118991 - protein, 8 aa, Giardia lamblia
KPPNAKLE

SEQ ID NO: 3118992 - protein, 23 aa, Giardia lamblia
KPPPPSTMTDTSQNLSEDVSKKS

SEQ ID NO: 3118993 - protein, 9 aa, Giardia lamblia
KPPQHGRRA

SEQ ID NO: 3118994 - protein, 4 aa, Giardia lamblia
KPPR

SEQ ID NO: 3118995 - protein, 8 aa, Giardia lamblia
KPPREGSL

SEQ ID NO: 3118996 - protein, 6 aa, Giardia lamblia
KPPSFT

SEQ ID NO: 3118997 - protein, 8 aa, Giardia lamblia
KPPSNPKL

SEQ ID NO: 3118998 - protein, 11 aa, Giardia lamblia
KPPSPVTDPDG

SEQ ID NO: 3118999 - protein, 4 aa, Giardia lamblia
KPPV

SEQ ID NO: 3119000 - protein, 8 aa, Giardia lamblia
KPQDSEDH

SEQ ID NO: 3119001 - protein, 7 aa, Giardia lamblia
KPQEDSH

SEQ ID NO: 3119002 - protein, 18 aa, Giardia lamblia
KPQELPRANGNSMTREEI

SEQ ID NO: 3119003 - protein, 8 aa, Giardia lamblia
KPQEQTAY

SEQ ID NO: 3119004 - protein, 72 aa, Giardia lamblia
KPQESGSSTVSEEAESATTLPRIGTSASNRKSARSIRSYPSGHSAKSLPSGVSGRTPSSALKPPKSGEGNYY

SEQ ID NO: 3119005 - protein, 4 aa, Giardia lamblia
KPQF

SEQ ID NO: 3119006 - protein, 5 aa, Giardia lamblia
KPQGG

SEQ ID NO: 3119007 - protein, 8 aa, Giardia lamblia
KPQPHDQS

SEQ ID NO: 3119008 - protein, 5 aa, Giardia lamblia
KPQPV

SEQ ID NO: 3119009 - protein, 9 aa, Giardia lamblia
KPQQIEGKR

SEQ ID NO: 3119010 - protein, 7 aa, Giardia lamblia
KPQQLSA

SEQ ID NO: 3119011 - protein, 10 aa, Giardia lamblia
KPQSGKAISQ

SEQ ID NO: 3119012 - protein, 11 aa, Giardia lamblia
KPQSQSKREAK

SEQ ID NO: 3119013 - protein, 8 aa, Giardia lamblia
KPRAGKVD

SEQ ID NO: 3119014 - protein, 30 aa, Giardia lamblia
KPRAQQSEPPLKAPDPDLSSDSQDSNDCSE

SEQ ID NO: 3119015 - protein, 8 aa, Giardia lamblia
KPRAQSNR

SEQ ID NO: 3119016 - protein, 10 aa, Giardia lamblia
KPREREEALT

SEQ ID NO: 3119017 - protein, 5 aa, Giardia lamblia
KPRLG

SEQ ID NO: 3119018 - protein, 6 aa, Giardia lamblia
KPRLSS

SEQ ID NO: 3119019 - protein, 23 aa, Giardia lamblia
KPRNQVERTENMTEEDKLKKRDE

SEQ ID NO: 3119020 - protein, 5 aa, Giardia lamblia
KPRPL

SEQ ID NO: 3119021 - protein, 4 aa, Giardia lamblia
KPRS

SEQ ID NO: 3119022 - protein, 16 aa, Giardia lamblia
KPRSQRLDQSGRAVQT

SEQ ID NO: 3119023 - protein, 6 aa, Giardia lamblia
KPRSVS

SEQ ID NO: 3119024 - protein, 6 aa, Giardia lamblia
KPRVSS

SEQ ID NO: 3119025 - protein, 5 aa, Giardia lamblia
KPRYQ

SEQ ID NO: 3119026 - protein, 13 aa, Giardia lamblia
KPSAYKTYGTSSE

SEQ ID NO: 3119027 - protein, 7 aa, Giardia lamblia
KPSEDEF

SEQ ID NO: 3119028 - protein, 8 aa, Giardia lamblia
KPSHTNQT

SEQ ID NO: 3119029 - protein, 5 aa, Giardia lamblia
KPSIT

SEQ ID NO: 3119030 - protein, 12 aa, Giardia lamblia
KPSKAEISLQAS

SEQ ID NO: 3119031 - protein, 13 aa, Giardia lamblia
KPSKTGYGGSRDD

SEQ ID NO: 3119032 - protein, 19 aa, Giardia lamblia
KPSKVDEQPNADVPPDVDN

SEQ ID NO: 3119033 - protein, 4 aa, Giardia lamblia
KPSL

SEQ ID NO: 3119034 - protein, 9 aa, Giardia lamblia
KPSLPRKDP

SEQ ID NO: 3119035 - protein, 8 aa, Giardia lamblia
KPSPNTSI

SEQ ID NO: 3119036 - protein, 6 aa, Giardia lamblia
KPSQSF

SEQ ID NO: 3119037 - protein, 19 aa, Giardia lamblia
KPSSHRSARPVSAAAATGM

SEQ ID NO: 3119038 - protein, 11 aa, Giardia lamblia
KPSSREFTQQN

SEQ ID NO: 3119039 - protein, 9 aa, Giardia lamblia
KPSSSTIEQ

SEQ ID NO: 3119040 - protein, 15 aa, Giardia lamblia
KPSTEPSSNGISKGE

SEQ ID NO: 3119041 - protein, 13 aa, Giardia lamblia
KPSVPKGENIGRD

SEQ ID NO: 3119042 - protein, 4 aa, Giardia lamblia
KPSW

SEQ ID NO: 3119043 - protein, 8 aa, Giardia lamblia
KPTDSPRL

SEQ ID NO: 3119044 - protein, 12 aa, Giardia lamblia
KPTGKRHEAGNN

SEQ ID NO: 3119045 - protein, 5 aa, Giardia lamblia
KPTHS

SEQ ID NO: 3119046 - protein, 12 aa, Giardia lamblia
KPTISTSNTNSV

SEQ ID NO: 3119047 - protein, 7 aa, Giardia lamblia
KPTLPSK

SEQ ID NO: 3119048 - protein, 7 aa, Giardia lamblia
KPTNTLT

SEQ ID NO: 3119049 - protein, 6 aa, Giardia lamblia
KPTPVS

SEQ ID NO: 3119050 - protein, 8 aa, Giardia lamblia
KPTQQSDY

SEQ ID NO: 3119051 - protein, 8 aa, Giardia lamblia
KPTSTTEL

SEQ ID NO: 3119052 - protein, 5 aa, Giardia lamblia
KPTVT

SEQ ID NO: 3119053 - protein, 5 aa, Giardia lamblia
KPTVY

SEQ ID NO: 3119054 - protein, 18 aa, Giardia lamblia
KPVEQKKGTDIDDVDPGE

SEQ ID NO: 3119055 - protein, 6 aa, Giardia lamblia
KPVERS

SEQ ID NO: 3119056 - protein, 4 aa, Giardia lamblia
KPVG

SEQ ID NO: 3119057 - protein, 4 aa, Giardia lamblia
KPVM

SEQ ID NO: 3119058 - protein, 16 aa, Giardia lamblia
KPVNVPDSKLRTREQR

SEQ ID NO: 3119059 - protein, 5 aa, Giardia lamblia
KPVPE

SEQ ID NO: 3119060 - protein, 4 aa, Giardia lamblia
KPVQ

SEQ ID NO: 3119061 - protein, 7 aa, Giardia lamblia
KPVTGGG

SEQ ID NO: 3119062 - protein, 8 aa, Giardia lamblia
KPYAGQKL

SEQ ID NO: 3119063 - protein, 14 aa, Giardia lamblia
KPYASTTDLTSRET

SEQ ID NO: 3119064 - protein, 6 aa, Giardia lamblia
KPYGEK

SEQ ID NO: 3119065 - protein, 8 aa, Giardia lamblia
KPYGGETV

SEQ ID NO: 3119066 - protein, 5 aa, Giardia lamblia
KPYPK

SEQ ID NO: 3119067 - protein, 18 aa, Giardia lamblia
KPYVSSKPSYISPGTEKT

SEQ ID NO: 3119068 - protein, 14 aa, Giardia lamblia
KQAAADARKREQGG

SEQ ID NO: 3119069 - protein, 8 aa, Giardia lamblia
KQAAEDDK

SEQ ID NO: 3119070 - protein, 37 aa, Giardia lamblia
KQAAEPADGPLPKPTTESKKTKTNEASENATKESTAT

SEQ ID NO: 3119071 - protein, 8 aa, Giardia lamblia
KQAAETAK

SEQ ID NO: 3119072 - protein, 14 aa, Giardia lamblia
KQAAKKAQHTGYSS

SEQ ID NO: 3119073 - protein, 8 aa, Giardia lamblia
KQADSKIA

SEQ ID NO: 3119074 - protein, 5 aa, Giardia lamblia
KQADV

SEQ ID NO: 3119075 - protein, 8 aa, Giardia lamblia
KQAEETTK

SEQ ID NO: 3119076 - protein, 31 aa, Giardia lamblia
KQAEHNAAQAAQDANQSKNKKPPQSAPKDTL

SEQ ID NO: 3119077 - protein, 13 aa, Giardia lamblia
KQAEQRPDGASTI

SEQ ID NO: 3119078 - protein, 10 aa, Giardia lamblia
KQAITSEPPV

SEQ ID NO: 3119079 - protein, 10 aa, Giardia lamblia
KQAKKFSEYT

SEQ ID NO: 3119080 - protein, 5 aa, Giardia lamblia
KQAKL

SEQ ID NO: 3119081 - protein, 9 aa, Giardia lamblia
KQAKPEEIQ

SEQ ID NO: 3119082 - protein, 9 aa, Giardia lamblia
KQAKSDDRT

SEQ ID NO: 3119083 - protein, 21 aa, Giardia lamblia
KQANDRLSDQHQQRKREIAAS

SEQ ID NO: 3119084 - protein, 8 aa, Giardia lamblia
KQANGKEY

SEQ ID NO: 3119085 - protein, 62 aa, Giardia lamblia
KQANITPKRPDTDRRASRGQPRGPSPTQAERSASGRNHRAALPASQRTNNDKHTPSPKIDSE

SEQ ID NO: 3119086 - protein, 7 aa, Giardia lamblia
KQANTDS

SEQ ID NO: 3119087 - protein, 8 aa, Giardia lamblia
KQAPLNAN

SEQ ID NO: 3119088 - protein, 8 aa, Giardia lamblia
KQAPTSPS

SEQ ID NO: 3119089 - protein, 5 aa, Giardia lamblia
KQAQA

SEQ ID NO: 3119090 - protein, 22 aa, Giardia lamblia
KQAQAQQYSYSQGSFASDAAQP

SEQ ID NO: 3119091 - protein, 11 aa, Giardia lamblia
KQARPKPAFSN

SEQ ID NO: 3119092 - protein, 11 aa, Giardia lamblia
KQATEDDNARY

SEQ ID NO: 3119093 - protein, 7 aa, Giardia lamblia
KQATKNK

SEQ ID NO: 3119094 - protein, 5 aa, Giardia lamblia
KQCAN

SEQ ID NO: 3119095 - protein, 4 aa, Giardia lamblia
KQCH

SEQ ID NO: 3119096 - protein, 10 aa, Giardia lamblia
KQDAKHNQAY

SEQ ID NO: 3119097 - protein, 13 aa, Giardia lamblia
KQDDDSVSSPRTY

SEQ ID NO: 3119098 - protein, 6 aa, Giardia lamblia
KQDEQP

SEQ ID NO: 3119099 - protein, 4 aa, Giardia lamblia
KQDF

SEQ ID NO: 3119100 - protein, 9 aa, Giardia lamblia
KQDFTSEGG

SEQ ID NO: 3119101 - protein, 7 aa, Giardia lamblia
KQDGAGM

SEQ ID NO: 3119102 - protein, 13 aa, Giardia lamblia
KQDGDHSKHTSFA

SEQ ID NO: 3119103 - protein, 7 aa, Giardia lamblia
KQDIDEA

SEQ ID NO: 3119104 - protein, 10 aa, Giardia lamblia
KQDIDERDDE

SEQ ID NO: 3119105 - protein, 6 aa, Giardia lamblia
KQDLEG

SEQ ID NO: 3119106 - protein, 6 aa, Giardia lamblia
KQDNYG

SEQ ID NO: 3119107 - protein, 32 aa, Giardia lamblia
KQDPVPAEAKAPEKHRKRKKRSASSVKLTEEA

SEQ ID NO: 3119108 - protein, 7 aa, Giardia lamblia
KQDQESV

SEQ ID NO: 3119109 - protein, 5 aa, Giardia lamblia
KQDQP

SEQ ID NO: 3119110 - protein, 11 aa, Giardia lamblia
KQDSDPSLANL

SEQ ID NO: 3119111 - protein, 14 aa, Giardia lamblia
KQDSRGRNHSDDSS

SEQ ID NO: 3119112 - protein, 9 aa, Giardia lamblia
KQDTCAGSV

SEQ ID NO: 3119113 - protein, 9 aa, Giardia lamblia
KQDTELKAQ

SEQ ID NO: 3119114 - protein, 5 aa, Giardia lamblia
KQDVK

SEQ ID NO: 3119115 - protein, 7 aa, Giardia lamblia
KQDWDTA

SEQ ID NO: 3119116 - protein, 7 aa, Giardia lamblia
KQEAEEF

SEQ ID NO: 3119117 - protein, 5 aa, Giardia lamblia
KQEAN

SEQ ID NO: 3119118 - protein, 24 aa, Giardia lamblia
KQEAREEDPNLSVSAGGADYETLN

SEQ ID NO: 3119119 - protein, 5 aa, Giardia lamblia
KQEDA

SEQ ID NO: 3119120 - protein, 19 aa, Giardia lamblia
KQEDPGPISEDEQCSDSEE

SEQ ID NO: 3119121 - protein, 4 aa, Giardia lamblia
KQEE

SEQ ID NO: 3119122 - protein, 8 aa, Giardia lamblia
KQEEEART

SEQ ID NO: 3119123 - protein, 8 aa, Giardia lamblia
KQEEMERQ

SEQ ID NO: 3119124 - protein, 4 aa, Giardia lamblia
KQEF

SEQ ID NO: 3119125 - protein, 13 aa, Giardia lamblia
KQEGNRDAATNSA

SEQ ID NO: 3119126 - protein, 20 aa, Giardia lamblia
KQEGSTKASTRKEDKKAKPF

SEQ ID NO: 3119127 - protein, 11 aa, Giardia lamblia
KQEKEHLQREE

SEQ ID NO: 3119128 - protein, 7 aa, Giardia lamblia
KQEKFKA

SEQ ID NO: 3119129 - protein, 9 aa, Giardia lamblia
KQEKKGQRT

SEQ ID NO: 3119130 - protein, 4 aa, Giardia lamblia
KQEL

SEQ ID NO: 3119131 - protein, 8 aa, Giardia lamblia
KQELEGPC

SEQ ID NO: 3119132 - protein, 5 aa, Giardia lamblia
KQEQR

SEQ ID NO: 3119133 - protein, 32 aa, Giardia lamblia
KQEQTQPAFTEEASDDTSSSASPESDTDDIQA

SEQ ID NO: 3119134 - protein, 16 aa, Giardia lamblia
KQERDEQARDERDEAK

SEQ ID NO: 3119135 - protein, 16 aa, Giardia lamblia
KQERKNMQEAPTNKQR

SEQ ID NO: 3119136 - protein, 5 aa, Giardia lamblia
KQERL

SEQ ID NO: 3119137 - protein, 6 aa, Giardia lamblia
KQERPI

SEQ ID NO: 3119138 - protein, 11 aa, Giardia lamblia
KQERSGKVSEV

SEQ ID NO: 3119139 - protein, 6 aa, Giardia lamblia
KQESPF

SEQ ID NO: 3119140 - protein, 8 aa, Giardia lamblia
KQESSSKN

SEQ ID NO: 3119141 - protein, 4 aa, Giardia lamblia
KQET

SEQ ID NO: 3119142 - protein, 6 aa, Giardia lamblia
KQETEQ

SEQ ID NO: 3119143 - protein, 7 aa, Giardia lamblia
KQETHGD

SEQ ID NO: 3119144 - protein, 6 aa, Giardia lamblia
KQEVER

SEQ ID NO: 3119145 - protein, 5 aa, Giardia lamblia
KQFDR

SEQ ID NO: 3119146 - protein, 24 aa, Giardia lamblia
KQFEGGASLERSAQGGAMGEGLAS

SEQ ID NO: 3119147 - protein, 11 aa, Giardia lamblia
KQFQSSTKYDG

SEQ ID NO: 3119148 - protein, 8 aa, Giardia lamblia
KQFTDTTE

SEQ ID NO: 3119149 - protein, 6 aa, Giardia lamblia
KQGDHA

SEQ ID NO: 3119150 - protein, 6 aa, Giardia lamblia
KQGEHK

SEQ ID NO: 3119151 - protein, 7 aa, Giardia lamblia
KQGKGHH

SEQ ID NO: 3119152 - protein, 20 aa, Giardia lamblia
KQGKNKGTTNTDDDSDLDSF

SEQ ID NO: 3119153 - protein, 7 aa, Giardia lamblia
KQGPQKF

SEQ ID NO: 3119154 - protein, 5 aa, Giardia lamblia
KQHAR

SEQ ID NO: 3119155 - protein, 24 aa, Giardia lamblia
KQHEKRVKKDHSSVSGDVGIEPTL

SEQ ID NO: 3119156 - protein, 10 aa, Giardia lamblia
KQHEKSITEA

SEQ ID NO: 3119157 - protein, 30 aa, Giardia lamblia
KQHERQSESIQSRSLSARPRQIRPANPYKA

SEQ ID NO: 3119158 - protein, 13 aa, Giardia lamblia
KQIAAAKRDECEA

SEQ ID NO: 3119159 - protein, 4 aa, Giardia lamblia
KQID

SEQ ID NO: 3119160 - protein, 10 aa, Giardia lamblia
KQIDNTDKEV

SEQ ID NO: 3119161 - protein, 14 aa, Giardia lamblia
KQIHKKSTETLSSK

SEQ ID NO: 3119162 - protein, 10 aa, Giardia lamblia
KQIKAQQKKI

SEQ ID NO: 3119163 - protein, 6 aa, Giardia lamblia
KQIQNS

SEQ ID NO: 3119164 - protein, 18 aa, Giardia lamblia
KQISEFSGSQSDRTASSI

SEQ ID NO: 3119165 - protein, 14 aa, Giardia lamblia
KQISERDRDNESLR

SEQ ID NO: 3119166 - protein, 14 aa, Giardia lamblia
KQISPDELRSGKNF

SEQ ID NO: 3119167 - protein, 6 aa, Giardia lamblia
KQISSE

SEQ ID NO: 3119168 - protein, 10 aa, Giardia lamblia
KQISTETETL

SEQ ID NO: 3119169 - protein, 18 aa, Giardia lamblia
KQITEAETVANESRAEAE

SEQ ID NO: 3119170 - protein, 8 aa, Giardia lamblia
KQIVSTNN

SEQ ID NO: 3119171 - protein, 10 aa, Giardia lamblia
KQKAKRDEQA

SEQ ID NO: 3119172 - protein, 9 aa, Giardia lamblia
KQKECTQRA

SEQ ID NO: 3119173 - protein, 6 aa, Giardia lamblia
KQKEIE

SEQ ID NO: 3119174 - protein, 7 aa, Giardia lamblia
KQKEPRL

SEQ ID NO: 3119175 - protein, 10 aa, Giardia lamblia
KQKESELRKE

SEQ ID NO: 3119176 - protein, 15 aa, Giardia lamblia
KQKGISINDAKQEIE

SEQ ID NO: 3119177 - protein, 18 aa, Giardia lamblia
KQKGQSENQFPGSTQPVS

SEQ ID NO: 3119178 - protein, 14 aa, Giardia lamblia
KQKKALPKGMEPVP

SEQ ID NO: 3119179 - protein, 17 aa, Giardia lamblia
KQKNALEELTRKQQTRI

SEQ ID NO: 3119180 - protein, 6 aa, Giardia lamblia
KQKPID

SEQ ID NO: 3119181 - protein, 10 aa, Giardia lamblia
KQKRDKLDSD

SEQ ID NO: 3119182 - protein, 5 aa, Giardia lamblia
KQKTI

SEQ ID NO: 3119183 - protein, 5 aa, Giardia lamblia
KQKTS

SEQ ID NO: 3119184 - protein, 9 aa, Giardia lamblia
KQKTVDETL

SEQ ID NO: 3119185 - protein, 6 aa, Giardia lamblia
KQLARK

SEQ ID NO: 3119186 - protein, 8 aa, Giardia lamblia
KQLDGTDA

SEQ ID NO: 3119187 - protein, 7 aa, Giardia lamblia
KQLDNRQ

SEQ ID NO: 3119188 - protein, 6 aa, Giardia lamblia
KQLDTK

SEQ ID NO: 3119189 - protein, 12 aa, Giardia lamblia
KQLEAARKATGS

SEQ ID NO: 3119190 - protein, 21 aa, Giardia lamblia
KQLEDSRTEVTEATSSGRAEI

SEQ ID NO: 3119191 - protein, 12 aa, Giardia lamblia
KQLEQSARIQKD

SEQ ID NO: 3119192 - protein, 5 aa, Giardia lamblia
KQLES

SEQ ID NO: 3119193 - protein, 9 aa, Giardia lamblia
KQLGGPNQE

SEQ ID NO: 3119194 - protein, 11 aa, Giardia lamblia
KQLSAEREKIS

SEQ ID NO: 3119195 - protein, 7 aa, Giardia lamblia
KQLSRRT

SEQ ID NO: 3119196 - protein, 13 aa, Giardia lamblia
KQLTGQSALTTQT

SEQ ID NO: 3119197 - protein, 9 aa, Giardia lamblia
KQMEDQGLK

SEQ ID NO: 3119198 - protein, 5 aa, Giardia lamblia
KQMES

SEQ ID NO: 3119199 - protein, 13 aa, Giardia lamblia
KQMESQARRLETD

SEQ ID NO: 3119200 - protein, 7 aa, Giardia lamblia
KQNDEKM

SEQ ID NO: 3119201 - protein, 21 aa, Giardia lamblia
KQNEHARSARPSSTEGRPDPL

SEQ ID NO: 3119202 - protein, 14 aa, Giardia lamblia
KQNEPFDRDCEGNT

SEQ ID NO: 3119203 - protein, 14 aa, Giardia lamblia
KQNHPQDRSTPGRF

SEQ ID NO: 3119204 - protein, 11 aa, Giardia lamblia
KQNKKVSRKDQ

SEQ ID NO: 3119205 - protein, 9 aa, Giardia lamblia
KQNRRPRNP

SEQ ID NO: 3119206 - protein, 9 aa, Giardia lamblia
KQNRTLQEE

SEQ ID NO: 3119207 - protein, 6 aa, Giardia lamblia
KQNSNY

SEQ ID NO: 3119208 - protein, 6 aa, Giardia lamblia
KQNYTL

SEQ ID NO: 3119209 - protein, 25 aa, Giardia lamblia
KQPCPDSSNDADDPFKNNKKFGKSL

SEQ ID NO: 3119210 - protein, 4 aa, Giardia lamblia
KQPG

SEQ ID NO: 3119211 - protein, 8 aa, Giardia lamblia
KQPGFAGE

SEQ ID NO: 3119212 - protein, 9 aa, Giardia lamblia
KQPGSSSCQ

SEQ ID NO: 3119213 - protein, 19 aa, Giardia lamblia
KQPGTGTLQPGSSGPSSAV

SEQ ID NO: 3119214 - protein, 5 aa, Giardia lamblia
KQPLP

SEQ ID NO: 3119215 - protein, 8 aa, Giardia lamblia
KQPPPNNI

SEQ ID NO: 3119216 - protein, 14 aa, Giardia lamblia
KQPRVDYNSESSRE

SEQ ID NO: 3119217 - protein, 13 aa, Giardia lamblia
KQPSAEAEEETGP

SEQ ID NO: 3119218 - protein, 5 aa, Giardia lamblia
KQPYQ

SEQ ID NO: 3119219 - protein, 9 aa, Giardia lamblia
KQQAESAAL

SEQ ID NO: 3119220 - protein, 10 aa, Giardia lamblia
KQQAQDSSKS

SEQ ID NO: 3119221 - protein, 26 aa, Giardia lamblia
KQQEAIADGSGGHQNPTNGEEDPSPF

SEQ ID NO: 3119222 - protein, 7 aa, Giardia lamblia
KQQEANP

SEQ ID NO: 3119223 - protein, 5 aa, Giardia lamblia
KQQEE

SEQ ID NO: 3119224 - protein, 60 aa, Giardia lamblia
KQQKEEEEAAAAPEGDTGTDAEDAPGVDVKKETEKAASSEPAKDAKVQQGQPSSREQYEY

SEQ ID NO: 3119225 - protein, 9 aa, Giardia lamblia
KQQKPVTID

SEQ ID NO: 3119226 - protein, 6 aa, Giardia lamblia
KQQMRS

SEQ ID NO: 3119227 - protein, 17 aa, Giardia lamblia
KQQPDTIPLEGDDLDQQ

SEQ ID NO: 3119228 - protein, 14 aa, Giardia lamblia
KQQQEYAEQETRKA

SEQ ID NO: 3119229 - protein, 9 aa, Giardia lamblia
KQQQVENQR

SEQ ID NO: 3119230 - protein, 61 aa, Giardia lamblia
KQQRIEEEKRRYKEKKEKERKEMEAKEAAKREQIQARQEAHKKQLEEEARRRNQEQEEKNR

SEQ ID NO: 3119231 - protein, 11 aa, Giardia lamblia
KQQRREQEAEE

SEQ ID NO: 3119232 - protein, 8 aa, Giardia lamblia
KQQSHKKD

SEQ ID NO: 3119233 - protein, 17 aa, Giardia lamblia
KQQSKDQSPETSEASAS

SEQ ID NO: 3119234 - protein, 10 aa, Giardia lamblia
KQQSKPGPRH

SEQ ID NO: 3119235 - protein, 32 aa, Giardia lamblia
KQQSRPSSGGTGSPYRMTTSNPDQPVQPTDEV

SEQ ID NO: 3119236 - protein, 10 aa, Giardia lamblia
KQQTGSVRSE

SEQ ID NO: 3119237 - protein, 6 aa, Giardia lamblia
KQQTRR

SEQ ID NO: 3119238 - protein, 9 aa, Giardia lamblia
KQRAGSNIG

SEQ ID NO: 3119239 - protein, 8 aa, Giardia lamblia
KQREQNVS

SEQ ID NO: 3119240 - protein, 4 aa, Giardia lamblia
KQRG

SEQ ID NO: 3119241 - protein, 6 aa, Giardia lamblia
KQRGLE

SEQ ID NO: 3119242 - protein, 7 aa, Giardia lamblia
KQRGPDV

SEQ ID NO: 3119243 - protein, 13 aa, Giardia lamblia
KQRGSNEMMALLL

SEQ ID NO: 3119244 - protein, 8 aa, Giardia lamblia
KQRGSSNV

SEQ ID NO: 3119245 - protein, 23 aa, Giardia lamblia
KQRGTQPGSSSASRYISRSSSIG

SEQ ID NO: 3119246 - protein, 14 aa, Giardia lamblia
KQRHQRQSSHKVAQ

SEQ ID NO: 3119247 - protein, 8 aa, Giardia lamblia
KQRKSAVK

SEQ ID NO: 3119248 - protein, 6 aa, Giardia lamblia
KQRKTL

SEQ ID NO: 3119249 - protein, 4 aa, Giardia lamblia
KQRL

SEQ ID NO: 3119250 - protein, 5 aa, Giardia lamblia
KQRMT

SEQ ID NO: 3119251 - protein, 16 aa, Giardia lamblia
KQRMTASTVRNDVSSR

SEQ ID NO: 3119252 - protein, 6 aa, Giardia lamblia
KQRPRK

SEQ ID NO: 3119253 - protein, 6 aa, Giardia lamblia
KQRQSM

SEQ ID NO: 3119254 - protein, 11 aa, Giardia lamblia
KQRTPQTRETE

SEQ ID NO: 3119255 - protein, 7 aa, Giardia lamblia
KQRYDRQ

SEQ ID NO: 3119256 - protein, 7 aa, Giardia lamblia
KQSAESV

SEQ ID NO: 3119257 - protein, 45 aa, Giardia lamblia
KQSARAIQPESLADQSEQVQTGSASALDKKTGESIATATSGMGTH

SEQ ID NO: 3119258 - protein, 29 aa, Giardia lamblia
KQSDQDSAQQQQQQQVPTDGSGAEKKAEK

SEQ ID NO: 3119259 - protein, 4 aa, Giardia lamblia
KQSE

SEQ ID NO: 3119260 - protein, 7 aa, Giardia lamblia
KQSETYT

SEQ ID NO: 3119261 - protein, 5 aa, Giardia lamblia
KQSIQ

SEQ ID NO: 3119262 - protein, 8 aa, Giardia lamblia
KQSIRPPA

SEQ ID NO: 3119263 - protein, 6 aa, Giardia lamblia
KQSISA

SEQ ID NO: 3119264 - protein, 10 aa, Giardia lamblia
KQSKETERLK

SEQ ID NO: 3119265 - protein, 13 aa, Giardia lamblia
KQSKGLGEKKNKV

SEQ ID NO: 3119266 - protein, 15 aa, Giardia lamblia
KQSKQALTLPEDSEP

SEQ ID NO: 3119267 - protein, 8 aa, Giardia lamblia
KQSKQKGF

SEQ ID NO: 3119268 - protein, 8 aa, Giardia lamblia
KQSKSNDL

SEQ ID NO: 3119269 - protein, 7 aa, Giardia lamblia
KQSLEQD

SEQ ID NO: 3119270 - protein, 6 aa, Giardia lamblia
KQSLPD

SEQ ID NO: 3119271 - protein, 14 aa, Giardia lamblia
KQSLTTPAKGPLPP

SEQ ID NO: 3119272 - protein, 5 aa, Giardia lamblia
KQSMP

SEQ ID NO: 3119273 - protein, 8 aa, Giardia lamblia
KQSNANSL

SEQ ID NO: 3119274 - protein, 7 aa, Giardia lamblia
KQSPERD

SEQ ID NO: 3119275 - protein, 21 aa, Giardia lamblia
KQSPGPQPRSQKRSQASVQQS

SEQ ID NO: 3119276 - protein, 79 aa, Giardia lamblia
KQSPRNQIHGSGGTPRRQTPRNRRSPRSRSGSATRTRTPKSRSGSTKIGPRSGSTQGGSEQNKSKRSPGNKRSSQGMRS

SEQ ID NO: 3119277 - protein, 9 aa, Giardia lamblia
KQSQETKIK

SEQ ID NO: 3119278 - protein, 8 aa, Giardia lamblia
KQSRAIES

SEQ ID NO: 3119279 - protein, 8 aa, Giardia lamblia
KQSRGKNI

SEQ ID NO: 3119280 - protein, 7 aa, Giardia lamblia
KQSRSLS

SEQ ID NO: 3119281 - protein, 7 aa, Giardia lamblia
KQSSERD

SEQ ID NO: 3119282 - protein, 9 aa, Giardia lamblia
KQSSGTALD

SEQ ID NO: 3119283 - protein, 19 aa, Giardia lamblia
KQSSRREKKEQVHGGPQLS

SEQ ID NO: 3119284 - protein, 9 aa, Giardia lamblia
KQSSTSKHG

SEQ ID NO: 3119285 - protein, 6 aa, Giardia lamblia
KQSTEL

SEQ ID NO: 3119286 - protein, 20 aa, Giardia lamblia
KQSVETAKLQKEAAETEKEL

SEQ ID NO: 3119287 - protein, 29 aa, Giardia lamblia
KQSVKQMDSRPGHDSASEPISKMPTGTMD

SEQ ID NO: 3119288 - protein, 9 aa, Giardia lamblia
KQSVSSASY

SEQ ID NO: 3119289 - protein, 14 aa, Giardia lamblia
KQTARLQDPRASQK

SEQ ID NO: 3119290 - protein, 13 aa, Giardia lamblia
KQTGNDKFRATDG

SEQ ID NO: 3119291 - protein, 15 aa, Giardia lamblia
KQTGSRDITEIIFSY

SEQ ID NO: 3119292 - protein, 8 aa, Giardia lamblia
KQTHDKTT

SEQ ID NO: 3119293 - protein, 12 aa, Giardia lamblia
KQTHSTDNDTTV

SEQ ID NO: 3119294 - protein, 8 aa, Giardia lamblia
KQTKAGKT

SEQ ID NO: 3119295 - protein, 7 aa, Giardia lamblia
KQTPAID

SEQ ID NO: 3119296 - protein, 8 aa, Giardia lamblia
KQTPANKQ

SEQ ID NO: 3119297 - protein, 10 aa, Giardia lamblia
KQTQKAEEQE

SEQ ID NO: 3119298 - protein, 6 aa, Giardia lamblia
KQTQKG

SEQ ID NO: 3119299 - protein, 5 aa, Giardia lamblia
KQTQV

SEQ ID NO: 3119300 - protein, 4 aa, Giardia lamblia
KQTR

SEQ ID NO: 3119301 - protein, 5 aa, Giardia lamblia
KQTRK

SEQ ID NO: 3119302 - protein, 12 aa, Giardia lamblia
KQTRSADEATTI

SEQ ID NO: 3119303 - protein, 13 aa, Giardia lamblia
KQTRTAIIELFGG

SEQ ID NO: 3119304 - protein, 4 aa, Giardia lamblia
KQTS

SEQ ID NO: 3119305 - protein, 10 aa, Giardia lamblia
KQTTAGQRTR

SEQ ID NO: 3119306 - protein, 9 aa, Giardia lamblia
KQTTDGATY

SEQ ID NO: 3119307 - protein, 12 aa, Giardia lamblia
KQTYESQPFTEE

SEQ ID NO: 3119308 - protein, 9 aa, Giardia lamblia
KQVAGGQVP

SEQ ID NO: 3119309 - protein, 8 aa, Giardia lamblia
KQVGSSQH

SEQ ID NO: 3119310 - protein, 4 aa, Giardia lamblia
KQVN

SEQ ID NO: 3119311 - protein, 7 aa, Giardia lamblia
KQVNDNH

SEQ ID NO: 3119312 - protein, 7 aa, Giardia lamblia
KQVNRGK

SEQ ID NO: 3119313 - protein, 14 aa, Giardia lamblia
KQVQDQDECNNRMK

SEQ ID NO: 3119314 - protein, 21 aa, Giardia lamblia
KQVSQGSSKLSSSSAGSGVGL

SEQ ID NO: 3119315 - protein, 5 aa, Giardia lamblia
KQYAN

SEQ ID NO: 3119316 - protein, 8 aa, Giardia lamblia
KQYEDSGM

SEQ ID NO: 3119317 - protein, 7 aa, Giardia lamblia
KQYKDSK

SEQ ID NO: 3119318 - protein, 4 aa, Giardia lamblia
KQYP

SEQ ID NO: 3119319 - protein, 6 aa, Giardia lamblia
KQYPNM

SEQ ID NO: 3119320 - protein, 6 aa, Giardia lamblia
KQYTDN

SEQ ID NO: 3119321 - protein, 11 aa, Giardia lamblia
KRAADRKQERL

SEQ ID NO: 3119322 - protein, 7 aa, Giardia lamblia
KRAASLE

SEQ ID NO: 3119323 - protein, 9 aa, Giardia lamblia
KRADSGKNY

SEQ ID NO: 3119324 - protein, 8 aa, Giardia lamblia
KRADSQEY

SEQ ID NO: 3119325 - protein, 8 aa, Giardia lamblia
KRAEESAQ

SEQ ID NO: 3119326 - protein, 24 aa, Giardia lamblia
KRAERAKIAARAKPIQRTQAEKDR

SEQ ID NO: 3119327 - protein, 6 aa, Giardia lamblia
KRAETV

SEQ ID NO: 3119328 - protein, 4 aa, Giardia lamblia
KRAF

SEQ ID NO: 3119329 - protein, 5 aa, Giardia lamblia
KRAFS

SEQ ID NO: 3119330 - protein, 52 aa, Giardia lamblia
KRAGNKMARTKHTARKTTSATKAPRKTIARKAARKTASSTSGIKKTGRKKQG

SEQ ID NO: 3119331 - protein, 8 aa, Giardia lamblia
KRAKQDMK

SEQ ID NO: 3119332 - protein, 11 aa, Giardia lamblia
KRAKSSATKQL

SEQ ID NO: 3119333 - protein, 4 aa, Giardia lamblia
KRAN

SEQ ID NO: 3119334 - protein, 14 aa, Giardia lamblia
KRAQEEEDRRRAEI

SEQ ID NO: 3119335 - protein, 5 aa, Giardia lamblia
KRAQL

SEQ ID NO: 3119336 - protein, 6 aa, Giardia lamblia
KRAQQA

SEQ ID NO: 3119337 - protein, 11 aa, Giardia lamblia
KRASDAEFKRS

SEQ ID NO: 3119338 - protein, 11 aa, Giardia lamblia
KRASDDDEMDQ

SEQ ID NO: 3119339 - protein, 9 aa, Giardia lamblia
KRASEKESI

SEQ ID NO: 3119340 - protein, 14 aa, Giardia lamblia
KRASNLPQRQGNTS

SEQ ID NO: 3119341 - protein, 10 aa, Giardia lamblia
KRASSAPSDY

SEQ ID NO: 3119342 - protein, 6 aa, Giardia lamblia
KRASSH

SEQ ID NO: 3119343 - protein, 12 aa, Giardia lamblia
KRASYASKSEYR

SEQ ID NO: 3119344 - protein, 6 aa, Giardia lamblia
KRATDI

SEQ ID NO: 3119345 - protein, 7 aa, Giardia lamblia
KRATTEE

SEQ ID NO: 3119346 - protein, 11 aa, Giardia lamblia
KRAVNKDGRSA

SEQ ID NO: 3119347 - protein, 12 aa, Giardia lamblia
KRAVTQPLSQQN

SEQ ID NO: 3119348 - protein, 4 aa, Giardia lamblia
KRAY

SEQ ID NO: 3119349 - protein, 7 aa, Giardia lamblia
KRAYDTS

SEQ ID NO: 3119350 - protein, 6 aa, Giardia lamblia
KRAYRK

SEQ ID NO: 3119351 - protein, 10 aa, Giardia lamblia
KRCKRSSCNG

SEQ ID NO: 3119352 - protein, 8 aa, Giardia lamblia
KRCSSTDM

SEQ ID NO: 3119353 - protein, 9 aa, Giardia lamblia
KRDDAASAI

SEQ ID NO: 3119354 - protein, 5 aa, Giardia lamblia
KRDEE

SEQ ID NO: 3119355 - protein, 6 aa, Giardia lamblia
KRDIKH

SEQ ID NO: 3119356 - protein, 6 aa, Giardia lamblia
KRDPAR

SEQ ID NO: 3119357 - protein, 4 aa, Giardia lamblia
KRDR

SEQ ID NO: 3119358 - protein, 5 aa, Giardia lamblia
KRDRD

SEQ ID NO: 3119359 - protein, 7 aa, Giardia lamblia
KRDSDTI

SEQ ID NO: 3119360 - protein, 35 aa, Giardia lamblia
KRDSPPASKSNLSQPEISTSGDQYARAYMNFMNNI

SEQ ID NO: 3119361 - protein, 25 aa, Giardia lamblia
KRDSSSKKPAETGKQDTAQSATYGG

SEQ ID NO: 3119362 - protein, 17 aa, Giardia lamblia
KREADAAEAARRRHRYQ

SEQ ID NO: 3119363 - protein, 6 aa, Giardia lamblia
KREAGD

SEQ ID NO: 3119364 - protein, 14 aa, Giardia lamblia
KREAQERRTREELT

SEQ ID NO: 3119365 - protein, 7 aa, Giardia lamblia
KREDEAL

SEQ ID NO: 3119366 - protein, 5 aa, Giardia lamblia
KREDV

SEQ ID NO: 3119367 - protein, 10 aa, Giardia lamblia
KREEDAETGV

SEQ ID NO: 3119368 - protein, 22 aa, Giardia lamblia
KREEEGEDQGEEEEDPSDPDDL

SEQ ID NO: 3119369 - protein, 10 aa, Giardia lamblia
KREEEKEDEA

SEQ ID NO: 3119370 - protein, 7 aa, Giardia lamblia
KREEISG

SEQ ID NO: 3119371 - protein, 26 aa, Giardia lamblia
KREEQGVTEQNEKRNKWRLEKRRGVK

SEQ ID NO: 3119372 - protein, 8 aa, Giardia lamblia
KREEVPSK

SEQ ID NO: 3119373 - protein, 11 aa, Giardia lamblia
KREGGDRPDNH

SEQ ID NO: 3119374 - protein, 11 aa, Giardia lamblia
KREGQLQRQQE

SEQ ID NO: 3119375 - protein, 8 aa, Giardia lamblia
KREIEQKN

SEQ ID NO: 3119376 - protein, 10 aa, Giardia lamblia
KREKQREKNM

SEQ ID NO: 3119377 - protein, 6 aa, Giardia lamblia
KRELDA

SEQ ID NO: 3119378 - protein, 6 aa, Giardia lamblia
KRELSN

SEQ ID NO: 3119379 - protein, 6 aa, Giardia lamblia
KREMAA

SEQ ID NO: 3119380 - protein, 9 aa, Giardia lamblia
KREQELDAA

SEQ ID NO: 3119381 - protein, 6 aa, Giardia lamblia
KRERGA

SEQ ID NO: 3119382 - protein, 8 aa, Giardia lamblia
KRERRAQK

SEQ ID NO: 3119383 - protein, 18 aa, Giardia lamblia
KRESDSASEGASVPDGVE

SEQ ID NO: 3119384 - protein, 5 aa, Giardia lamblia
KRESF

SEQ ID NO: 3119385 - protein, 19 aa, Giardia lamblia
KREVTTQELTNTQEECNEK

SEQ ID NO: 3119386 - protein, 5 aa, Giardia lamblia
KRFAA

SEQ ID NO: 3119387 - protein, 7 aa, Giardia lamblia
KRFPEDK

SEQ ID NO: 3119388 - protein, 5 aa, Giardia lamblia
KRFQR

SEQ ID NO: 3119389 - protein, 8 aa, Giardia lamblia
KRGANEAL

SEQ ID NO: 3119390 - protein, 4 aa, Giardia lamblia
KRGD

SEQ ID NO: 3119391 - protein, 8 aa, Giardia lamblia
KRGDCDAA

SEQ ID NO: 3119392 - protein, 8 aa, Giardia lamblia
KRGDGEAE

SEQ ID NO: 3119393 - protein, 10 aa, Giardia lamblia
KRGEQVKDPS

SEQ ID NO: 3119394 - protein, 7 aa, Giardia lamblia
KRGETIK

SEQ ID NO: 3119395 - protein, 13 aa, Giardia lamblia
KRGEWGDPTQDVS

SEQ ID NO: 3119396 - protein, 12 aa, Giardia lamblia
KRGFYSDKQPIA

SEQ ID NO: 3119397 - protein, 6 aa, Giardia lamblia
KRGGKT

SEQ ID NO: 3119398 - protein, 9 aa, Giardia lamblia
KRGNKKGVT

SEQ ID NO: 3119399 - protein, 6 aa, Giardia lamblia
KRGPDG

SEQ ID NO: 3119400 - protein, 13 aa, Giardia lamblia
KRGPEDLSESEFD

SEQ ID NO: 3119401 - protein, 7 aa, Giardia lamblia
KRGPGRI

SEQ ID NO: 3119402 - protein, 11 aa, Giardia lamblia
KRGQDVLSPDT

SEQ ID NO: 3119403 - protein, 7 aa, Giardia lamblia
KRGQPDV

SEQ ID NO: 3119404 - protein, 6 aa, Giardia lamblia
KRGRTA

SEQ ID NO: 3119405 - protein, 7 aa, Giardia lamblia
KRGSEIA

SEQ ID NO: 3119406 - protein, 6 aa, Giardia lamblia
KRGSHG

SEQ ID NO: 3119407 - protein, 6 aa, Giardia lamblia
KRGSQR

SEQ ID NO: 3119408 - protein, 8 aa, Giardia lamblia
KRGSTESV

SEQ ID NO: 3119409 - protein, 5 aa, Giardia lamblia
KRGSV

SEQ ID NO: 3119410 - protein, 5 aa, Giardia lamblia
KRGTD

SEQ ID NO: 3119411 - protein, 7 aa, Giardia lamblia
KRGTDVP

SEQ ID NO: 3119412 - protein, 6 aa, Giardia lamblia
KRHEPY

SEQ ID NO: 3119413 - protein, 17 aa, Giardia lamblia
KRHHQRKPKCYSTTPSN

SEQ ID NO: 3119414 - protein, 8 aa, Giardia lamblia
KRHKSNGE

SEQ ID NO: 3119415 - protein, 6 aa, Giardia lamblia
KRHPDE

SEQ ID NO: 3119416 - protein, 6 aa, Giardia lamblia
KRHSTD

SEQ ID NO: 3119417 - protein, 13 aa, Giardia lamblia
KRHYHTERTNDRS

SEQ ID NO: 3119418 - protein, 13 aa, Giardia lamblia
KRIDDSLDRSRLA

SEQ ID NO: 3119419 - protein, 14 aa, Giardia lamblia
KRIDNEKKSSLYTG

SEQ ID NO: 3119420 - protein, 4 aa, Giardia lamblia
KRIE

SEQ ID NO: 3119421 - protein, 6 aa, Giardia lamblia
KRIEED

SEQ ID NO: 3119422 - protein, 6 aa, Giardia lamblia
KRIGSE

SEQ ID NO: 3119423 - protein, 5 aa, Giardia lamblia
KRIGT

SEQ ID NO: 3119424 - protein, 6 aa, Giardia lamblia
KRIKTN

SEQ ID NO: 3119425 - protein, 10 aa, Giardia lamblia
KRINNDPDTC

SEQ ID NO: 3119426 - protein, 5 aa, Giardia lamblia
KRIQD

SEQ ID NO: 3119427 - protein, 6 aa, Giardia lamblia
KRIQQE

SEQ ID NO: 3119428 - protein, 5 aa, Giardia lamblia
KRIRP

SEQ ID NO: 3119429 - protein, 8 aa, Giardia lamblia
KRITADKE

SEQ ID NO: 3119430 - protein, 14 aa, Giardia lamblia
KRITASEAAKHPKV

SEQ ID NO: 3119431 - protein, 24 aa, Giardia lamblia
KRKAKAERREQRKLRRQADRQTRK

SEQ ID NO: 3119432 - protein, 8 aa, Giardia lamblia
KRKDDTGM

SEQ ID NO: 3119433 - protein, 7 aa, Giardia lamblia
KRKEFPR

SEQ ID NO: 3119434 - protein, 16 aa, Giardia lamblia
KRKESQDTTKKLQEIG

SEQ ID NO: 3119435 - protein, 10 aa, Giardia lamblia
KRKGERSLGK

SEQ ID NO: 3119436 - protein, 7 aa, Giardia lamblia
KRKGEVV

SEQ ID NO: 3119437 - protein, 7 aa, Giardia lamblia
KRKHPKV

SEQ ID NO: 3119438 - protein, 11 aa, Giardia lamblia
KRKIPKTSTTS

SEQ ID NO: 3119439 - protein, 9 aa, Giardia lamblia
KRKLDEASS

SEQ ID NO: 3119440 - protein, 8 aa, Giardia lamblia
KRKPIPSC

SEQ ID NO: 3119441 - protein, 6 aa, Giardia lamblia
KRKQDL

SEQ ID NO: 3119442 - protein, 21 aa, Giardia lamblia
KRKQEQLDELTSQSERAYPAY

SEQ ID NO: 3119443 - protein, 9 aa, Giardia lamblia
KRKTKEHAL

SEQ ID NO: 3119444 - protein, 12 aa, Giardia lamblia
KRKTPGPGSKGT

SEQ ID NO: 3119445 - protein, 9 aa, Giardia lamblia
KRKTPRSPS

SEQ ID NO: 3119446 - protein, 8 aa, Giardia lamblia
KRKTSEAL

SEQ ID NO: 3119447 - protein, 5 aa, Giardia lamblia
KRKYE

SEQ ID NO: 3119448 - protein, 8 aa, Giardia lamblia
KRLDYGTG

SEQ ID NO: 3119449 - protein, 13 aa, Giardia lamblia
KRLEAKKAIEQEN

SEQ ID NO: 3119450 - protein, 19 aa, Giardia lamblia
KRLEDATKTFASRQEDLAQ

SEQ ID NO: 3119451 - protein, 6 aa, Giardia lamblia
KRLEEN

SEQ ID NO: 3119452 - protein, 14 aa, Giardia lamblia
KRLEGRRERTDPPL

SEQ ID NO: 3119453 - protein, 13 aa, Giardia lamblia
KRLESKEKKTRTA

SEQ ID NO: 3119454 - protein, 5 aa, Giardia lamblia
KRLNP

SEQ ID NO: 3119455 - protein, 17 aa, Giardia lamblia
KRLNTSLQASVNKDQLS

SEQ ID NO: 3119456 - protein, 7 aa, Giardia lamblia
KRLPPER

SEQ ID NO: 3119457 - protein, 21 aa, Giardia lamblia
KRLPQSKPRSRPVKSHRQSTL

SEQ ID NO: 3119458 - protein, 7 aa, Giardia lamblia
KRLQDGD

SEQ ID NO: 3119459 - protein, 20 aa, Giardia lamblia
KRLQQEKVQQEKLEKQRLER

SEQ ID NO: 3119460 - protein, 5 aa, Giardia lamblia
KRLSA

SEQ ID NO: 3119461 - protein, 6 aa, Giardia lamblia
KRLSAS

SEQ ID NO: 3119462 - protein, 6 aa, Giardia lamblia
KRLSEY

SEQ ID NO: 3119463 - protein, 13 aa, Giardia lamblia
KRLSQREHDDLQR

SEQ ID NO: 3119464 - protein, 8 aa, Giardia lamblia
KRLSSHKV

SEQ ID NO: 3119465 - protein, 4 aa, Giardia lamblia
KRLT

SEQ ID NO: 3119466 - protein, 11 aa, Giardia lamblia
KRLTDESGSQV

SEQ ID NO: 3119467 - protein, 17 aa, Giardia lamblia
KRLTEADEKCKELTETN

SEQ ID NO: 3119468 - protein, 9 aa, Giardia lamblia
KRLTNYDGA

SEQ ID NO: 3119469 - protein, 5 aa, Giardia lamblia
KRLTP

SEQ ID NO: 3119470 - protein, 6 aa, Giardia lamblia
KRNAAL

SEQ ID NO: 3119471 - protein, 6 aa, Giardia lamblia
KRNALP

SEQ ID NO: 3119472 - protein, 10 aa, Giardia lamblia
KRNCPADLSQ

SEQ ID NO: 3119473 - protein, 11 aa, Giardia lamblia
KRNDTAEELQK

SEQ ID NO: 3119474 - protein, 13 aa, Giardia lamblia
KRNEALESTTAEV

SEQ ID NO: 3119475 - protein, 11 aa, Giardia lamblia
KRNGLYGSEQT

SEQ ID NO: 3119476 - protein, 6 aa, Giardia lamblia
KRNGTS

SEQ ID NO: 3119477 - protein, 7 aa, Giardia lamblia
KRNLDGG

SEQ ID NO: 3119478 - protein, 5 aa, Giardia lamblia
KRNLE

SEQ ID NO: 3119479 - protein, 11 aa, Giardia lamblia
KRNPDLDTPEY

SEQ ID NO: 3119480 - protein, 10 aa, Giardia lamblia
KRNPTEPNNV

SEQ ID NO: 3119481 - protein, 8 aa, Giardia lamblia
KRNQGLEK

SEQ ID NO: 3119482 - protein, 39 aa, Giardia lamblia
KRNRERVQDDASDELAEEASDDSAPGSSLSTKNAFAGPR

SEQ ID NO: 3119483 - protein, 10 aa, Giardia lamblia
KRNSKQSLGS

SEQ ID NO: 3119484 - protein, 7 aa, Giardia lamblia
KRNSQGL

SEQ ID NO: 3119485 - protein, 10 aa, Giardia lamblia
KRNSTKDSLS

SEQ ID NO: 3119486 - protein, 6 aa, Giardia lamblia
KRPAAN

SEQ ID NO: 3119487 - protein, 5 aa, Giardia lamblia
KRPDF

SEQ ID NO: 3119488 - protein, 6 aa, Giardia lamblia
KRPDIQ

SEQ ID NO: 3119489 - protein, 7 aa, Giardia lamblia
KRPDLAK

SEQ ID NO: 3119490 - protein, 9 aa, Giardia lamblia
KRPDQAQRR

SEQ ID NO: 3119491 - protein, 16 aa, Giardia lamblia
KRPDSKYLKMVRGNLF

SEQ ID NO: 3119492 - protein, 5 aa, Giardia lamblia
KRPDV

SEQ ID NO: 3119493 - protein, 5 aa, Giardia lamblia
KRPDY

SEQ ID NO: 3119494 - protein, 5 aa, Giardia lamblia
KRPEC

SEQ ID NO: 3119495 - protein, 6 aa, Giardia lamblia
KRPFTG

SEQ ID NO: 3119496 - protein, 31 aa, Giardia lamblia
KRPGSAKPLGSSRNDYKEMGDADQNTLDTET

SEQ ID NO: 3119497 - protein, 5 aa, Giardia lamblia
KRPMQ

SEQ ID NO: 3119498 - protein, 6 aa, Giardia lamblia
KRPPEI

SEQ ID NO: 3119499 - protein, 18 aa, Giardia lamblia
KRPPKRKEHILGGCVIKP

SEQ ID NO: 3119500 - protein, 10 aa, Giardia lamblia
KRPPQPTNEI

SEQ ID NO: 3119501 - protein, 26 aa, Giardia lamblia
KRPQGKQTKEGKQSCKSTKKDSKPTE

SEQ ID NO: 3119502 - protein, 5 aa, Giardia lamblia
KRPQI

SEQ ID NO: 3119503 - protein, 6 aa, Giardia lamblia
KRPRNT

SEQ ID NO: 3119504 - protein, 7 aa, Giardia lamblia
KRPSATE

SEQ ID NO: 3119505 - protein, 5 aa, Giardia lamblia
KRPSM

SEQ ID NO: 3119506 - protein, 9 aa, Giardia lamblia
KRPSSKLPT

SEQ ID NO: 3119507 - protein, 19 aa, Giardia lamblia
KRPSYAEPVTSSNAPPSRA

SEQ ID NO: 3119508 - protein, 5 aa, Giardia lamblia
KRPTA

SEQ ID NO: 3119509 - protein, 7 aa, Giardia lamblia
KRPTARE

SEQ ID NO: 3119510 - protein, 24 aa, Giardia lamblia
KRPTAVSHANQPPTETKTSFPSQY

SEQ ID NO: 3119511 - protein, 16 aa, Giardia lamblia
KRQAREAQHKAEMEER

SEQ ID NO: 3119512 - protein, 6 aa, Giardia lamblia
KRQDIR

SEQ ID NO: 3119513 - protein, 16 aa, Giardia lamblia
KRQEANEKNDISGLQS

SEQ ID NO: 3119514 - protein, 10 aa, Giardia lamblia
KRQEEWKEKH

SEQ ID NO: 3119515 - protein, 8 aa, Giardia lamblia
KRQEFSQQ

SEQ ID NO: 3119516 - protein, 5 aa, Giardia lamblia
KRQEG

SEQ ID NO: 3119517 - protein, 14 aa, Giardia lamblia
KRQELAARETQTKS

SEQ ID NO: 3119518 - protein, 21 aa, Giardia lamblia
KRQERPYSHSEKTSSTEPRRV

SEQ ID NO: 3119519 - protein, 11 aa, Giardia lamblia
KRQGRKKPTVR

SEQ ID NO: 3119520 - protein, 14 aa, Giardia lamblia
KRQGTSADAVHNTA

SEQ ID NO: 3119521 - protein, 6 aa, Giardia lamblia
KRQGVG

SEQ ID NO: 3119522 - protein, 6 aa, Giardia lamblia
KRQIED

SEQ ID NO: 3119523 - protein, 35 aa, Giardia lamblia
KRQKEELAEELDGAKEAYSNANKDRADATATQQRA

SEQ ID NO: 3119524 - protein, 7 aa, Giardia lamblia
KRQMGSE

SEQ ID NO: 3119525 - protein, 5 aa, Giardia lamblia
KRQNL

SEQ ID NO: 3119526 - protein, 14 aa, Giardia lamblia
KRQPNYNPDIQSSA

SEQ ID NO: 3119527 - protein, 11 aa, Giardia lamblia
KRQRKQSPSHL

SEQ ID NO: 3119528 - protein, 8 aa, Giardia lamblia
KRQRSGRT

SEQ ID NO: 3119529 - protein, 8 aa, Giardia lamblia
KRQRSTSI

SEQ ID NO: 3119530 - protein, 6 aa, Giardia lamblia
KRQSRE

SEQ ID NO: 3119531 - protein, 20 aa, Giardia lamblia
KRQSTSCSLNSSHEQLSNSH

SEQ ID NO: 3119532 - protein, 6 aa, Giardia lamblia
KRQVAN

SEQ ID NO: 3119533 - protein, 10 aa, Giardia lamblia
KRRAAKESHA

SEQ ID NO: 3119534 - protein, 7 aa, Giardia lamblia
KRRAEED

SEQ ID NO: 3119535 - protein, 14 aa, Giardia lamblia
KRRAEKDSNGNGLE

SEQ ID NO: 3119536 - protein, 9 aa, Giardia lamblia
KRRAGNRPF

SEQ ID NO: 3119537 - protein, 22 aa, Giardia lamblia
KRRALPPLSQRPSSKERSSKEL

SEQ ID NO: 3119538 - protein, 7 aa, Giardia lamblia
KRRDDKG

SEQ ID NO: 3119539 - protein, 6 aa, Giardia lamblia
KRRDEV

SEQ ID NO: 3119540 - protein, 22 aa, Giardia lamblia
KRREAEDVRDTALRDATAKRMR

SEQ ID NO: 3119541 - protein, 13 aa, Giardia lamblia
KRREEELQRTPDC

SEQ ID NO: 3119542 - protein, 7 aa, Giardia lamblia
KRREGNT

SEQ ID NO: 3119543 - protein, 6 aa, Giardia lamblia
KRRELA

SEQ ID NO: 3119544 - protein, 26 aa, Giardia lamblia
KRRGCTRGGWKRPNSGYLRQSCNRAK

SEQ ID NO: 3119545 - protein, 8 aa, Giardia lamblia
KRRGELPT

SEQ ID NO: 3119546 - protein, 27 aa, Giardia lamblia
KRRGPRPKDGSDYEPDDAKPATARKRK

SEQ ID NO: 3119547 - protein, 10 aa, Giardia lamblia
KRRKEDAERM

SEQ ID NO: 3119548 - protein, 7 aa, Giardia lamblia
KRRKTPV

SEQ ID NO: 3119549 - protein, 6 aa, Giardia lamblia
KRRPGF

SEQ ID NO: 3119550 - protein, 9 aa, Giardia lamblia
KRRPPRPRS

SEQ ID NO: 3119551 - protein, 7 aa, Giardia lamblia
KRRPSIE

SEQ ID NO: 3119552 - protein, 4 aa, Giardia lamblia
KRRQ

SEQ ID NO: 3119553 - protein, 9 aa, Giardia lamblia
KRRQDGKGY

SEQ ID NO: 3119554 - protein, 11 aa, Giardia lamblia
KRRQKEAQPVR

SEQ ID NO: 3119555 - protein, 8 aa, Giardia lamblia
KRRRSGGS

SEQ ID NO: 3119556 - protein, 11 aa, Giardia lamblia
KRRRSNRPHES

SEQ ID NO: 3119557 - protein, 22 aa, Giardia lamblia
KRRTASLQSELQAQQTDVEGSL

SEQ ID NO: 3119558 - protein, 19 aa, Giardia lamblia
KRRYTRSLAPRDAGQDMNV

SEQ ID NO: 3119559 - protein, 5 aa, Giardia lamblia
KRSAL

SEQ ID NO: 3119560 - protein, 4 aa, Giardia lamblia
KRSD

SEQ ID NO: 3119561 - protein, 20 aa, Giardia lamblia
KRSESTRSEQHTETQPAAPS

SEQ ID NO: 3119562 - protein, 9 aa, Giardia lamblia
KRSGDGLPH

SEQ ID NO: 3119563 - protein, 7 aa, Giardia lamblia
KRSHEGY

SEQ ID NO: 3119564 - protein, 16 aa, Giardia lamblia
KRSHSRGHAGLSGPAG

SEQ ID NO: 3119565 - protein, 14 aa, Giardia lamblia
KRSKAKQDDYKRQL

SEQ ID NO: 3119566 - protein, 5 aa, Giardia lamblia
KRSND

SEQ ID NO: 3119567 - protein, 9 aa, Giardia lamblia
KRSQAARTE

SEQ ID NO: 3119568 - protein, 10 aa, Giardia lamblia
KRSQDDAGRT

SEQ ID NO: 3119569 - protein, 18 aa, Giardia lamblia
KRSQSNLQTKPEALQSPV

SEQ ID NO: 3119570 - protein, 14 aa, Giardia lamblia
KRSSQPASKGINPS

SEQ ID NO: 3119571 - protein, 13 aa, Giardia lamblia
KRSTEKPSSTASY

SEQ ID NO: 3119572 - protein, 43 aa, Giardia lamblia
KRSTGATSGQSGSLDQTTRARSKNRFDAEEEEQGAKRNNIDDR

SEQ ID NO: 3119573 - protein, 6 aa, Giardia lamblia
KRSTYA

SEQ ID NO: 3119574 - protein, 21 aa, Giardia lamblia
KRSVSATVDPNSQGSSSPDPM

SEQ ID NO: 3119575 - protein, 21 aa, Giardia lamblia
KRTAAKKGQEAKRIRTEAGNA

SEQ ID NO: 3119576 - protein, 6 aa, Giardia lamblia
KRTDEI

SEQ ID NO: 3119577 - protein, 16 aa, Giardia lamblia
KRTDSQASTSGSMSNM

SEQ ID NO: 3119578 - protein, 6 aa, Giardia lamblia
KRTHDG

SEQ ID NO: 3119579 - protein, 6 aa, Giardia lamblia
KRTHEE

SEQ ID NO: 3119580 - protein, 5 aa, Giardia lamblia
KRTKI

SEQ ID NO: 3119581 - protein, 8 aa, Giardia lamblia
KRTKNLED

SEQ ID NO: 3119582 - protein, 12 aa, Giardia lamblia
KRTKQVPLPGSH

SEQ ID NO: 3119583 - protein, 6 aa, Giardia lamblia
KRTLDG

SEQ ID NO: 3119584 - protein, 8 aa, Giardia lamblia
KRTNRSFS

SEQ ID NO: 3119585 - protein, 8 aa, Giardia lamblia
KRTNSGKT

SEQ ID NO: 3119586 - protein, 8 aa, Giardia lamblia
KRTPGNRL

SEQ ID NO: 3119587 - protein, 6 aa, Giardia lamblia
KRTPQI

SEQ ID NO: 3119588 - protein, 7 aa, Giardia lamblia
KRTQEAD

SEQ ID NO: 3119589 - protein, 8 aa, Giardia lamblia
KRTRKGTW

SEQ ID NO: 3119590 - protein, 5 aa, Giardia lamblia
KRTRS

SEQ ID NO: 3119591 - protein, 10 aa, Giardia lamblia
KRTSGKRFDP

SEQ ID NO: 3119592 - protein, 10 aa, Giardia lamblia
KRTSQYEEKE

SEQ ID NO: 3119593 - protein, 39 aa, Giardia lamblia
KRVEKPPRKTEAELKRERQQEYAKNIPRPAVRPQTDRET

SEQ ID NO: 3119594 - protein, 7 aa, Giardia lamblia
KRVENQS

SEQ ID NO: 3119595 - protein, 6 aa, Giardia lamblia
KRVGRR

SEQ ID NO: 3119596 - protein, 11 aa, Giardia lamblia
KRVKGDKKSCA

SEQ ID NO: 3119597 - protein, 10 aa, Giardia lamblia
KRVPQPTPPQ

SEQ ID NO: 3119598 - protein, 24 aa, Giardia lamblia
KRVQDDAQAAIRASEKARQAAREA

SEQ ID NO: 3119599 - protein, 8 aa, Giardia lamblia
KRVRSDGK

SEQ ID NO: 3119600 - protein, 7 aa, Giardia lamblia
KRVSDAD

SEQ ID NO: 3119601 - protein, 15 aa, Giardia lamblia
KRVSERKDSKRSHTA

SEQ ID NO: 3119602 - protein, 5 aa, Giardia lamblia
KRVSP

SEQ ID NO: 3119603 - protein, 8 aa, Giardia lamblia
KRVSPGTG

SEQ ID NO: 3119604 - protein, 7 aa, Giardia lamblia
KRVSRSS

SEQ ID NO: 3119605 - protein, 13 aa, Giardia lamblia
KRYAQEAQKWNDE

SEQ ID NO: 3119606 - protein, 11 aa, Giardia lamblia
KRYDDLKKEHE

SEQ ID NO: 3119607 - protein, 15 aa, Giardia lamblia
KRYDEREDGCEDRDE

SEQ ID NO: 3119608 - protein, 14 aa, Giardia lamblia
KRYPARDASVATDT

SEQ ID NO: 3119609 - protein, 6 aa, Giardia lamblia
KRYQDL

SEQ ID NO: 3119610 - protein, 7 aa, Giardia lamblia
KRYQKPV

SEQ ID NO: 3119611 - protein, 4 aa, Giardia lamblia
KRYT

SEQ ID NO: 3119612 - protein, 21 aa, Giardia lamblia
KRYTDKMERQRNALKQQREMD

SEQ ID NO: 3119613 - protein, 8 aa, Giardia lamblia
KRYTDTLR

SEQ ID NO: 3119614 - protein, 19 aa, Giardia lamblia
KSAADSDTFQRVRALLMQC

SEQ ID NO: 3119615 - protein, 11 aa, Giardia lamblia
KSAAGISRAST

SEQ ID NO: 3119616 - protein, 5 aa, Giardia lamblia
KSAAQ

SEQ ID NO: 3119617 - protein, 7 aa, Giardia lamblia
KSAASSR

SEQ ID NO: 3119618 - protein, 12 aa, Giardia lamblia
KSADNAPKGPRD

SEQ ID NO: 3119619 - protein, 7 aa, Giardia lamblia
KSADSAL

SEQ ID NO: 3119620 - protein, 9 aa, Giardia lamblia
KSADSPFIT

SEQ ID NO: 3119621 - protein, 8 aa, Giardia lamblia
KSAEDREK

SEQ ID NO: 3119622 - protein, 8 aa, Giardia lamblia
KSAEDSEL

SEQ ID NO: 3119623 - protein, 7 aa, Giardia lamblia
KSAEEKA

SEQ ID NO: 3119624 - protein, 5 aa, Giardia lamblia
KSAEI

SEQ ID NO: 3119625 - protein, 9 aa, Giardia lamblia
KSAEKEREQ

SEQ ID NO: 3119626 - protein, 27 aa, Giardia lamblia
KSAEKSAKKGLFSKPNPDAALSDYREA

SEQ ID NO: 3119627 - protein, 5 aa, Giardia lamblia
KSAES

SEQ ID NO: 3119628 - protein, 16 aa, Giardia lamblia
KSAIGKGRTREDHPDV

SEQ ID NO: 3119629 - protein, 8 aa, Giardia lamblia
KSAISALN

SEQ ID NO: 3119630 - protein, 7 aa, Giardia lamblia
KSAITEK

SEQ ID NO: 3119631 - protein, 7 aa, Giardia lamblia
KSAKEDK

SEQ ID NO: 3119632 - protein, 4 aa, Giardia lamblia
KSAL

SEQ ID NO: 3119633 - protein, 13 aa, Giardia lamblia
KSALEAENRELSA

SEQ ID NO: 3119634 - protein, 7 aa, Giardia lamblia
KSAMATD

SEQ ID NO: 3119635 - protein, 31 aa, Giardia lamblia
KSANARSSTGTGGKAAGPSFTKKKASSSKQL

SEQ ID NO: 3119636 - protein, 7 aa, Giardia lamblia
KSANPID

SEQ ID NO: 3119637 - protein, 10 aa, Giardia lamblia
KSANSARDEC

SEQ ID NO: 3119638 - protein, 8 aa, Giardia lamblia
KSAPASLY

SEQ ID NO: 3119639 - protein, 8 aa, Giardia lamblia
KSAPDTLP

SEQ ID NO: 3119640 - protein, 7 aa, Giardia lamblia
KSAPFRQ

SEQ ID NO: 3119641 - protein, 9 aa, Giardia lamblia
KSAQEDEGR

SEQ ID NO: 3119642 - protein, 12 aa, Giardia lamblia
KSAQEKNKLSDR

SEQ ID NO: 3119643 - protein, 10 aa, Giardia lamblia
KSASEEVSRD

SEQ ID NO: 3119644 - protein, 17 aa, Giardia lamblia
KSASGNIVKNTSSPYYG

SEQ ID NO: 3119645 - protein, 9 aa, Giardia lamblia
KSASLSGVK

SEQ ID NO: 3119646 - protein, 9 aa, Giardia lamblia
KSASPTTHR

SEQ ID NO: 3119647 - protein, 12 aa, Giardia lamblia
KSASSGSIPDRQ

SEQ ID NO: 3119648 - protein, 8 aa, Giardia lamblia
KSASTNIQ

SEQ ID NO: 3119649 - protein, 9 aa, Giardia lamblia
KSASVQTQL

SEQ ID NO: 3119650 - protein, 10 aa, Giardia lamblia
KSCKDTSNGH

SEQ ID NO: 3119651 - protein, 8 aa, Giardia lamblia
KSCSTAAV

SEQ ID NO: 3119652 - protein, 8 aa, Giardia lamblia
KSCTANRT

SEQ ID NO: 3119653 - protein, 8 aa, Giardia lamblia
KSDAQSAL

SEQ ID NO: 3119654 - protein, 6 aa, Giardia lamblia
KSDDDY

SEQ ID NO: 3119655 - protein, 8 aa, Giardia lamblia
KSDDLSAA

SEQ ID NO: 3119656 - protein, 5 aa, Giardia lamblia
KSDEH

SEQ ID NO: 3119657 - protein, 18 aa, Giardia lamblia
KSDEPYTPTKEKQEKKRL

SEQ ID NO: 3119658 - protein, 10 aa, Giardia lamblia
KSDESKTQRI

SEQ ID NO: 3119659 - protein, 7 aa, Giardia lamblia
KSDGHID

SEQ ID NO: 3119660 - protein, 11 aa, Giardia lamblia
KSDGPLGSSED

SEQ ID NO: 3119661 - protein, 4 aa, Giardia lamblia
KSDI

SEQ ID NO: 3119662 - protein, 7 aa, Giardia lamblia
KSDKNLS

SEQ ID NO: 3119663 - protein, 7 aa, Giardia lamblia
KSDKTDI

SEQ ID NO: 3119664 - protein, 5 aa, Giardia lamblia
KSDLA

SEQ ID NO: 3119665 - protein, 5 aa, Giardia lamblia
KSDLG

SEQ ID NO: 3119666 - protein, 6 aa, Giardia lamblia
KSDPAV

SEQ ID NO: 3119667 - protein, 7 aa, Giardia lamblia
KSDPEYR

SEQ ID NO: 3119668 - protein, 14 aa, Giardia lamblia
KSDPQDAPEERRRP

SEQ ID NO: 3119669 - protein, 6 aa, Giardia lamblia
KSDPRI

SEQ ID NO: 3119670 - protein, 12 aa, Giardia lamblia
KSDQAAALLATY

SEQ ID NO: 3119671 - protein, 17 aa, Giardia lamblia
KSDQAEHRAVKQQDAER

SEQ ID NO: 3119672 - protein, 10 aa, Giardia lamblia
KSDSAASSRV

SEQ ID NO: 3119673 - protein, 7 aa, Giardia lamblia
KSDSQDQ

SEQ ID NO: 3119674 - protein, 6 aa, Giardia lamblia
KSDSRC

SEQ ID NO: 3119675 - protein, 16 aa, Giardia lamblia
KSDSTYERRKDADTIE

SEQ ID NO: 3119676 - protein, 11 aa, Giardia lamblia
KSDVSKSIDTV

SEQ ID NO: 3119677 - protein, 9 aa, Giardia lamblia
KSEANRREA

SEQ ID NO: 3119678 - protein, 5 aa, Giardia lamblia
KSEAP

SEQ ID NO: 3119679 - protein, 14 aa, Giardia lamblia
KSEAQSLSASTAQK

SEQ ID NO: 3119680 - protein, 14 aa, Giardia lamblia
KSEASIQKESASIE

SEQ ID NO: 3119681 - protein, 6 aa, Giardia lamblia
KSECVS

SEQ ID NO: 3119682 - protein, 6 aa, Giardia lamblia
KSEDRD

SEQ ID NO: 3119683 - protein, 7 aa, Giardia lamblia
KSEEAGP

SEQ ID NO: 3119684 - protein, 7 aa, Giardia lamblia
KSEEDQE

SEQ ID NO: 3119685 - protein, 6 aa, Giardia lamblia
KSEEFE

SEQ ID NO: 3119686 - protein, 10 aa, Giardia lamblia
KSEELAAETQ

SEQ ID NO: 3119687 - protein, 20 aa, Giardia lamblia
KSEELAPPKENAAAAHQEAQ

SEQ ID NO: 3119688 - protein, 18 aa, Giardia lamblia
KSEHRLTTAASAAYQPSS

SEQ ID NO: 3119689 - protein, 5 aa, Giardia lamblia
KSEKS

SEQ ID NO: 3119690 - protein, 6 aa, Giardia lamblia
KSENRR

SEQ ID NO: 3119691 - protein, 9 aa, Giardia lamblia
KSESDLSEA

SEQ ID NO: 3119692 - protein, 13 aa, Giardia lamblia
KSESGRQNKDGYS

SEQ ID NO: 3119693 - protein, 9 aa, Giardia lamblia
KSESTSRAG

SEQ ID NO: 3119694 - protein, 6 aa, Giardia lamblia
KSETFD

SEQ ID NO: 3119695 - protein, 37 aa, Giardia lamblia
KSETKPETGTGKPRNRERRAKASKREAEDQGGATDED

SEQ ID NO: 3119696 - protein, 4 aa, Giardia lamblia
KSEW

SEQ ID NO: 3119697 - protein, 6 aa, Giardia lamblia
KSEYPD

SEQ ID NO: 3119698 - protein, 8 aa, Giardia lamblia
KSFASGSA

SEQ ID NO: 3119699 - protein, 12 aa, Giardia lamblia
KSFAVPEGKPPV

SEQ ID NO: 3119700 - protein, 4 aa, Giardia lamblia
KSFD

SEQ ID NO: 3119701 - protein, 6 aa, Giardia lamblia
KSFENR

SEQ ID NO: 3119702 - protein, 9 aa, Giardia lamblia
KSFGASTGI

SEQ ID NO: 3119703 - protein, 5 aa, Giardia lamblia
KSFGI

SEQ ID NO: 3119704 - protein, 8 aa, Giardia lamblia
KSFPPSAY

SEQ ID NO: 3119705 - protein, 4 aa, Giardia lamblia
KSFS

SEQ ID NO: 3119706 - protein, 6 aa, Giardia lamblia
KSGASH

SEQ ID NO: 3119707 - protein, 6 aa, Giardia lamblia
KSGAVQ

SEQ ID NO: 3119708 - protein, 4 aa, Giardia lamblia
KSGD

SEQ ID NO: 3119709 - protein, 6 aa, Giardia lamblia
KSGDPY

SEQ ID NO: 3119710 - protein, 6 aa, Giardia lamblia
KSGETI

SEQ ID NO: 3119711 - protein, 6 aa, Giardia lamblia
KSGFDR

SEQ ID NO: 3119712 - protein, 16 aa, Giardia lamblia
KSGGARSRSAPRRKLK

SEQ ID NO: 3119713 - protein, 11 aa, Giardia lamblia
KSGGTAETATN

SEQ ID NO: 3119714 - protein, 5 aa, Giardia lamblia
KSGHR

SEQ ID NO: 3119715 - protein, 19 aa, Giardia lamblia
KSGHSRSESLEKNNEIAYR

SEQ ID NO: 3119716 - protein, 5 aa, Giardia lamblia
KSGIP

SEQ ID NO: 3119717 - protein, 6 aa, Giardia lamblia
KSGKPI

SEQ ID NO: 3119718 - protein, 6 aa, Giardia lamblia
KSGLLD

SEQ ID NO: 3119719 - protein, 9 aa, Giardia lamblia
KSGLQPKDI

SEQ ID NO: 3119720 - protein, 17 aa, Giardia lamblia
KSGLSPLKYASKGKQEA

SEQ ID NO: 3119721 - protein, 6 aa, Giardia lamblia
KSGLTA

SEQ ID NO: 3119722 - protein, 6 aa, Giardia lamblia
KSGMAD

SEQ ID NO: 3119723 - protein, 6 aa, Giardia lamblia
KSGNKL

SEQ ID NO: 3119724 - protein, 5 aa, Giardia lamblia
KSGNR

SEQ ID NO: 3119725 - protein, 24 aa, Giardia lamblia
KSGPCRKPSDVGPSNRSISPFPTT

SEQ ID NO: 3119726 - protein, 18 aa, Giardia lamblia
KSGPRSSSRSTSRSGSRA

SEQ ID NO: 3119727 - protein, 8 aa, Giardia lamblia
KSGQLTKK

SEQ ID NO: 3119728 - protein, 22 aa, Giardia lamblia
KSGRAVVQSPDSTRSENSRREE

SEQ ID NO: 3119729 - protein, 7 aa, Giardia lamblia
KSGRDCT

SEQ ID NO: 3119730 - protein, 7 aa, Giardia lamblia
KSGRTGL

SEQ ID NO: 3119731 - protein, 4 aa, Giardia lamblia
KSGS

SEQ ID NO: 3119732 - protein, 5 aa, Giardia lamblia
KSGSE

SEQ ID NO: 3119733 - protein, 10 aa, Giardia lamblia
KSGSKIQESN

SEQ ID NO: 3119734 - protein, 9 aa, Giardia lamblia
KSGSNTGKK

SEQ ID NO: 3119735 - protein, 6 aa, Giardia lamblia
KSGTEG

SEQ ID NO: 3119736 - protein, 6 aa, Giardia lamblia
KSGTLP

SEQ ID NO: 3119737 - protein, 12 aa, Giardia lamblia
KSGVQRDAEGQT

SEQ ID NO: 3119738 - protein, 16 aa, Giardia lamblia
KSHADDASVDESRQYS

SEQ ID NO: 3119739 - protein, 6 aa, Giardia lamblia
KSHENE

SEQ ID NO: 3119740 - protein, 7 aa, Giardia lamblia
KSHGSAT

SEQ ID NO: 3119741 - protein, 9 aa, Giardia lamblia
KSHNGPSLS

SEQ ID NO: 3119742 - protein, 8 aa, Giardia lamblia
KSHPVEAS

SEQ ID NO: 3119743 - protein, 8 aa, Giardia lamblia
KSHSSDPF

SEQ ID NO: 3119744 - protein, 9 aa, Giardia lamblia
KSIAKDAYR

SEQ ID NO: 3119745 - protein, 10 aa, Giardia lamblia
KSIEGNPYRD

SEQ ID NO: 3119746 - protein, 6 aa, Giardia lamblia
KSIGDL

SEQ ID NO: 3119747 - protein, 7 aa, Giardia lamblia
KSIGGND

SEQ ID NO: 3119748 - protein, 8 aa, Giardia lamblia
KSIGSNGI

SEQ ID NO: 3119749 - protein, 35 aa, Giardia lamblia
KSIGSSPPGVNTSSPSVSSASSGSFKTGSDYSPGV

SEQ ID NO: 3119750 - protein, 6 aa, Giardia lamblia
KSINPV

SEQ ID NO: 3119751 - protein, 8 aa, Giardia lamblia
KSINTPVN

SEQ ID NO: 3119752 - protein, 5 aa, Giardia lamblia
KSIPD

SEQ ID NO: 3119753 - protein, 6 aa, Giardia lamblia
KSIPES

SEQ ID NO: 3119754 - protein, 6 aa, Giardia lamblia
KSIPRT

SEQ ID NO: 3119755 - protein, 6 aa, Giardia lamblia
KSISIG

SEQ ID NO: 3119756 - protein, 10 aa, Giardia lamblia
KSISNKEPLA

SEQ ID NO: 3119757 - protein, 7 aa, Giardia lamblia
KSISNTI

SEQ ID NO: 3119758 - protein, 9 aa, Giardia lamblia
KSISNYRGQ

SEQ ID NO: 3119759 - protein, 5 aa, Giardia lamblia
KSISQ

SEQ ID NO: 3119760 - protein, 10 aa, Giardia lamblia
KSISSTSQSI

SEQ ID NO: 3119761 - protein, 13 aa, Giardia lamblia
KSISTSVQAQGDE

SEQ ID NO: 3119762 - protein, 7 aa, Giardia lamblia
KSIYGEN

SEQ ID NO: 3119763 - protein, 8 aa, Giardia lamblia
KSKADTEQ

SEQ ID NO: 3119764 - protein, 17 aa, Giardia lamblia
KSKADTRPAPPASLNNT

SEQ ID NO: 3119765 - protein, 22 aa, Giardia lamblia
KSKAQTPTSSMTKSLNSTGQRI

SEQ ID NO: 3119766 - protein, 7 aa, Giardia lamblia
KSKCGRY

SEQ ID NO: 3119767 - protein, 13 aa, Giardia lamblia
KSKCSNKKKRIEG

SEQ ID NO: 3119768 - protein, 8 aa, Giardia lamblia
KSKELADS

SEQ ID NO: 3119769 - protein, 7 aa, Giardia lamblia
KSKENES

SEQ ID NO: 3119770 - protein, 4 aa, Giardia lamblia
KSKG

SEQ ID NO: 3119771 - protein, 8 aa, Giardia lamblia
KSKGEGTS

SEQ ID NO: 3119772 - protein, 5 aa, Giardia lamblia
KSKMV

SEQ ID NO: 3119773 - protein, 9 aa, Giardia lamblia
KSKNDMVNE

SEQ ID NO: 3119774 - protein, 10 aa, Giardia lamblia
KSKNKALESQ

SEQ ID NO: 3119775 - protein, 9 aa, Giardia lamblia
KSKNPPLDA

SEQ ID NO: 3119776 - protein, 4 aa, Giardia lamblia
KSKP

SEQ ID NO: 3119777 - protein, 8 aa, Giardia lamblia
KSKPSRSC

SEQ ID NO: 3119778 - protein, 8 aa, Giardia lamblia
KSKSDEKV

SEQ ID NO: 3119779 - protein, 5 aa, Giardia lamblia
KSKSF

SEQ ID NO: 3119780 - protein, 10 aa, Giardia lamblia
KSKSKDETDV

SEQ ID NO: 3119781 - protein, 9 aa, Giardia lamblia
KSKSLEKDM

SEQ ID NO: 3119782 - protein, 6 aa, Giardia lamblia
KSKSPT

SEQ ID NO: 3119783 - protein, 12 aa, Giardia lamblia
KSKSRARSTSTN

SEQ ID NO: 3119784 - protein, 8 aa, Giardia lamblia
KSKSSTEW

SEQ ID NO: 3119785 - protein, 7 aa, Giardia lamblia
KSKTDGL

SEQ ID NO: 3119786 - protein, 8 aa, Giardia lamblia
KSKTHTLT

SEQ ID NO: 3119787 - protein, 8 aa, Giardia lamblia
KSKTPRRG

SEQ ID NO: 3119788 - protein, 8 aa, Giardia lamblia
KSKTSGQI

SEQ ID NO: 3119789 - protein, 9 aa, Giardia lamblia
KSKVNEKEV

SEQ ID NO: 3119790 - protein, 5 aa, Giardia lamblia
KSKYS

SEQ ID NO: 3119791 - protein, 5 aa, Giardia lamblia
KSLAE

SEQ ID NO: 3119792 - protein, 10 aa, Giardia lamblia
KSLAGQSSGI

SEQ ID NO: 3119793 - protein, 6 aa, Giardia lamblia
KSLAGV

SEQ ID NO: 3119794 - protein, 6 aa, Giardia lamblia
KSLAPW

SEQ ID NO: 3119795 - protein, 8 aa, Giardia lamblia
KSLASAQS

SEQ ID NO: 3119796 - protein, 20 aa, Giardia lamblia
KSLDEPSDMHPPQPNSGDEM

SEQ ID NO: 3119797 - protein, 4 aa, Giardia lamblia
KSLE

SEQ ID NO: 3119798 - protein, 17 aa, Giardia lamblia
KSLEASNASLQQKLADS

SEQ ID NO: 3119799 - protein, 5 aa, Giardia lamblia
KSLED

SEQ ID NO: 3119800 - protein, 13 aa, Giardia lamblia
KSLEDARSAPTLS

SEQ ID NO: 3119801 - protein, 15 aa, Giardia lamblia
KSLEEASQIKNTDIS

SEQ ID NO: 3119802 - protein, 6 aa, Giardia lamblia
KSLERQ

SEQ ID NO: 3119803 - protein, 12 aa, Giardia lamblia
KSLFPADKAPTV

SEQ ID NO: 3119804 - protein, 11 aa, Giardia lamblia
KSLGGSGELSE

SEQ ID NO: 3119805 - protein, 10 aa, Giardia lamblia
KSLGSHSPQI

SEQ ID NO: 3119806 - protein, 13 aa, Giardia lamblia
KSLKEAELNTTEE

SEQ ID NO: 3119807 - protein, 8 aa, Giardia lamblia
KSLKQNTY

SEQ ID NO: 3119808 - protein, 9 aa, Giardia lamblia
KSLNEERDE

SEQ ID NO: 3119809 - protein, 15 aa, Giardia lamblia
KSLNEKYKETSQGGL

SEQ ID NO: 3119810 - protein, 5 aa, Giardia lamblia
KSLPT

SEQ ID NO: 3119811 - protein, 8 aa, Giardia lamblia
KSLQEKSH

SEQ ID NO: 3119812 - protein, 11 aa, Giardia lamblia
KSLRDKQTEDL

SEQ ID NO: 3119813 - protein, 8 aa, Giardia lamblia
KSLREHTS

SEQ ID NO: 3119814 - protein, 28 aa, Giardia lamblia
KSLRGPSTPSPMQSKQQGLASLPVLSKV

SEQ ID NO: 3119815 - protein, 7 aa, Giardia lamblia
KSLRSPY

SEQ ID NO: 3119816 - protein, 4 aa, Giardia lamblia
KSLS

SEQ ID NO: 3119817 - protein, 13 aa, Giardia lamblia
KSLSEIKKNNETQ

SEQ ID NO: 3119818 - protein, 8 aa, Giardia lamblia
KSLSNASD

SEQ ID NO: 3119819 - protein, 13 aa, Giardia lamblia
KSLSTTYRGRSEE

SEQ ID NO: 3119820 - protein, 5 aa, Giardia lamblia
KSLTE

SEQ ID NO: 3119821 - protein, 7 aa, Giardia lamblia
KSLTGTA

SEQ ID NO: 3119822 - protein, 4 aa, Giardia lamblia
KSMA

SEQ ID NO: 3119823 - protein, 5 aa, Giardia lamblia
KSMAP

SEQ ID NO: 3119824 - protein, 17 aa, Giardia lamblia
KSMASSNVSDRGEGNSI

SEQ ID NO: 3119825 - protein, 35 aa, Giardia lamblia
KSMDPNKARERARVEEKRIKKQKRDEERSARREIR

SEQ ID NO: 3119826 - protein, 8 aa, Giardia lamblia
KSMDTQQE

SEQ ID NO: 3119827 - protein, 12 aa, Giardia lamblia
KSMLPENLMPLA

SEQ ID NO: 3119828 - protein, 13 aa, Giardia lamblia
KSMSDRSGRATIP

SEQ ID NO: 3119829 - protein, 15 aa, Giardia lamblia
KSMTDTRPPKPQPLV

SEQ ID NO: 3119830 - protein, 12 aa, Giardia lamblia
KSMTGESRHAQR

SEQ ID NO: 3119831 - protein, 6 aa, Giardia lamblia
KSMTTV

SEQ ID NO: 3119832 - protein, 46 aa, Giardia lamblia
KSNAKSRQTGEHGAASGSPAGNTLSEKSSVKKKKKTPQASPGKGSV

SEQ ID NO: 3119833 - protein, 48 aa, Giardia lamblia
KSNDRASFGNAPAEAHTAEESHATSSTMEPNLSQNQQLSSLTAENQEL

SEQ ID NO: 3119834 - protein, 13 aa, Giardia lamblia
KSNEWSGEKTYRR

SEQ ID NO: 3119835 - protein, 9 aa, Giardia lamblia
KSNEWTGEK

SEQ ID NO: 3119836 - protein, 12 aa, Giardia lamblia
KSNEWTGEKSYR

SEQ ID NO: 3119837 - protein, 19 aa, Giardia lamblia
KSNGSNSDSDFVEDDPDVA

SEQ ID NO: 3119838 - protein, 9 aa, Giardia lamblia
KSNHEQVNS

SEQ ID NO: 3119839 - protein, 21 aa, Giardia lamblia
KSNLRPHDKTAPITATKPNLI

SEQ ID NO: 3119840 - protein, 10 aa, Giardia lamblia
KSNLTPQSAP

SEQ ID NO: 3119841 - protein, 8 aa, Giardia lamblia
KSNNAQAV

SEQ ID NO: 3119842 - protein, 22 aa, Giardia lamblia
KSNNLKQSDINEPSSSLRTAET

SEQ ID NO: 3119843 - protein, 6 aa, Giardia lamblia
KSNPYE

SEQ ID NO: 3119844 - protein, 23 aa, Giardia lamblia
KSNQESEESEEASENSGLDEGQN

SEQ ID NO: 3119845 - protein, 24 aa, Giardia lamblia
KSNRSNKSCTGTSTRSGSTNRTPL

SEQ ID NO: 3119846 - protein, 6 aa, Giardia lamblia
KSNSHL

SEQ ID NO: 3119847 - protein, 5 aa, Giardia lamblia
KSNTL

SEQ ID NO: 3119848 - protein, 8 aa, Giardia lamblia
KSNTSEAR

SEQ ID NO: 3119849 - protein, 9 aa, Giardia lamblia
KSNVSSGDA

SEQ ID NO: 3119850 - protein, 10 aa, Giardia lamblia
KSPDGSVNTL

SEQ ID NO: 3119851 - protein, 7 aa, Giardia lamblia
KSPDIAR

SEQ ID NO: 3119852 - protein, 8 aa, Giardia lamblia
KSPDYKKS

SEQ ID NO: 3119853 - protein, 9 aa, Giardia lamblia
KSPEIAADE

SEQ ID NO: 3119854 - protein, 14 aa, Giardia lamblia
KSPELSSISSTASL

SEQ ID NO: 3119855 - protein, 6 aa, Giardia lamblia
KSPEYS

SEQ ID NO: 3119856 - protein, 7 aa, Giardia lamblia
KSPGKSP

SEQ ID NO: 3119857 - protein, 5 aa, Giardia lamblia
KSPGP

SEQ ID NO: 3119858 - protein, 4 aa, Giardia lamblia
KSPI

SEQ ID NO: 3119859 - protein, 26 aa, Giardia lamblia
KSPIGSSRVPAKASSTQDRREEAQAE

SEQ ID NO: 3119860 - protein, 7 aa, Giardia lamblia
KSPNMSL

SEQ ID NO: 3119861 - protein, 7 aa, Giardia lamblia
KSPRDPD

SEQ ID NO: 3119862 - protein, 10 aa, Giardia lamblia
KSPRPTRPAW

SEQ ID NO: 3119863 - protein, 9 aa, Giardia lamblia
KSPSPDSTF

SEQ ID NO: 3119864 - protein, 20 aa, Giardia lamblia
KSPSQYAAEGATKPSYGSLP

SEQ ID NO: 3119865 - protein, 9 aa, Giardia lamblia
KSPTESPIG

SEQ ID NO: 3119866 - protein, 9 aa, Giardia lamblia
KSPTTTDQG

SEQ ID NO: 3119867 - protein, 9 aa, Giardia lamblia
KSPVGTQSH

SEQ ID NO: 3119868 - protein, 7 aa, Giardia lamblia
KSQDIDP

SEQ ID NO: 3119869 - protein, 12 aa, Giardia lamblia
KSQDSEIGDGTT

SEQ ID NO: 3119870 - protein, 7 aa, Giardia lamblia
KSQGPEA

SEQ ID NO: 3119871 - protein, 4 aa, Giardia lamblia
KSQI

SEQ ID NO: 3119872 - protein, 21 aa, Giardia lamblia
KSQKSGTKKVSLTRSDFPKDS

SEQ ID NO: 3119873 - protein, 4 aa, Giardia lamblia
KSQL

SEQ ID NO: 3119874 - protein, 8 aa, Giardia lamblia
KSQNFTKA

SEQ ID NO: 3119875 - protein, 6 aa, Giardia lamblia
KSQPDA

SEQ ID NO: 3119876 - protein, 12 aa, Giardia lamblia
KSQQMGETPPIS

SEQ ID NO: 3119877 - protein, 12 aa, Giardia lamblia
KSQQPPNPDPTW

SEQ ID NO: 3119878 - protein, 8 aa, Giardia lamblia
KSQQTSVT

SEQ ID NO: 3119879 - protein, 8 aa, Giardia lamblia
KSQSIADD

SEQ ID NO: 3119880 - protein, 6 aa, Giardia lamblia
KSQSLR

SEQ ID NO: 3119881 - protein, 9 aa, Giardia lamblia
KSQSPQGLR

SEQ ID NO: 3119882 - protein, 5 aa, Giardia lamblia
KSQSR

SEQ ID NO: 3119883 - protein, 5 aa, Giardia lamblia
KSQSV

SEQ ID NO: 3119884 - protein, 6 aa, Giardia lamblia
KSQTIS

SEQ ID NO: 3119885 - protein, 8 aa, Giardia lamblia
KSQYNDEC

SEQ ID NO: 3119886 - protein, 9 aa, Giardia lamblia
KSQYRPRRS

SEQ ID NO: 3119887 - protein, 7 aa, Giardia lamblia
KSRAGAP

SEQ ID NO: 3119888 - protein, 10 aa, Giardia lamblia
KSRANGPRLP

SEQ ID NO: 3119889 - protein, 7 aa, Giardia lamblia
KSRAQNI

SEQ ID NO: 3119890 - protein, 4 aa, Giardia lamblia
KSRC

SEQ ID NO: 3119891 - protein, 8 aa, Giardia lamblia
KSRDDTEV

SEQ ID NO: 3119892 - protein, 9 aa, Giardia lamblia
KSRDSSGNT

SEQ ID NO: 3119893 - protein, 7 aa, Giardia lamblia
KSRDSSK

SEQ ID NO: 3119894 - protein, 10 aa, Giardia lamblia
KSRDYAKKPF

SEQ ID NO: 3119895 - protein, 6 aa, Giardia lamblia
KSREDR

SEQ ID NO: 3119896 - protein, 4 aa, Giardia lamblia
KSRG

SEQ ID NO: 3119897 - protein, 6 aa, Giardia lamblia
KSRGRM

SEQ ID NO: 3119898 - protein, 13 aa, Giardia lamblia
KSRKMHGSEECSD

SEQ ID NO: 3119899 - protein, 4 aa, Giardia lamblia
KSRM

SEQ ID NO: 3119900 - protein, 6 aa, Giardia lamblia
KSRPAQ

SEQ ID NO: 3119901 - protein, 7 aa, Giardia lamblia
KSRPMPE

SEQ ID NO: 3119902 - protein, 11 aa, Giardia lamblia
KSRQSTMPSNM

SEQ ID NO: 3119903 - protein, 16 aa, Giardia lamblia
KSRRDGVKASFKNTYS

SEQ ID NO: 3119904 - protein, 21 aa, Giardia lamblia
KSRRGYGHKISSDNDNINSSV

SEQ ID NO: 3119905 - protein, 45 aa, Giardia lamblia
KSRSRSSSYGAHKRKESGKVARTASSGAKRARSTGGSGTASTKVT

SEQ ID NO: 3119906 - protein, 18 aa, Giardia lamblia
KSRSTSTPLARSHGPDIT

SEQ ID NO: 3119907 - protein, 19 aa, Giardia lamblia
KSRTGLGDDPVTAPADEET

SEQ ID NO: 3119908 - protein, 9 aa, Giardia lamblia
KSRTSTTES

SEQ ID NO: 3119909 - protein, 18 aa, Giardia lamblia
KSRTTQESQNTNPGPGAY

SEQ ID NO: 3119910 - protein, 26 aa, Giardia lamblia
KSRYRSSSNRTITKSDADEKREQKNT

SEQ ID NO: 3119911 - protein, 4 aa, Giardia lamblia
KSSA

SEQ ID NO: 3119912 - protein, 6 aa, Giardia lamblia
KSSAEK

SEQ ID NO: 3119913 - protein, 6 aa, Giardia lamblia
KSSAIH

SEQ ID NO: 3119914 - protein, 9 aa, Giardia lamblia
KSSAKQTAA

SEQ ID NO: 3119915 - protein, 7 aa, Giardia lamblia
KSSDAPS

SEQ ID NO: 3119916 - protein, 10 aa, Giardia lamblia
KSSDKQKPSV

SEQ ID NO: 3119917 - protein, 21 aa, Giardia lamblia
KSSDLTAKSVSQTKPLSSITA

SEQ ID NO: 3119918 - protein, 11 aa, Giardia lamblia
KSSDQGPTQLG

SEQ ID NO: 3119919 - protein, 8 aa, Giardia lamblia
KSSDYGNA

SEQ ID NO: 3119920 - protein, 7 aa, Giardia lamblia
KSSEQEL

SEQ ID NO: 3119921 - protein, 5 aa, Giardia lamblia
KSSET

SEQ ID NO: 3119922 - protein, 4 aa, Giardia lamblia
KSSF

SEQ ID NO: 3119923 - protein, 6 aa, Giardia lamblia
KSSFDS

SEQ ID NO: 3119924 - protein, 11 aa, Giardia lamblia
KSSGGARCSEK

SEQ ID NO: 3119925 - protein, 11 aa, Giardia lamblia
KSSGLEQNGRR

SEQ ID NO: 3119926 - protein, 9 aa, Giardia lamblia
KSSGQDLSQ

SEQ ID NO: 3119927 - protein, 7 aa, Giardia lamblia
KSSGRGP

SEQ ID NO: 3119928 - protein, 5 aa, Giardia lamblia
KSSHW

SEQ ID NO: 3119929 - protein, 5 aa, Giardia lamblia
KSSID

SEQ ID NO: 3119930 - protein, 25 aa, Giardia lamblia
KSSISTSRKGSVGRRNEPGRSNSVT

SEQ ID NO: 3119931 - protein, 10 aa, Giardia lamblia
KSSKFSKYSP

SEQ ID NO: 3119932 - protein, 8 aa, Giardia lamblia
KSSKQCGH

SEQ ID NO: 3119933 - protein, 7 aa, Giardia lamblia
KSSKRAD

SEQ ID NO: 3119934 - protein, 9 aa, Giardia lamblia
KSSKSTRYA

SEQ ID NO: 3119935 - protein, 6 aa, Giardia lamblia
KSSNCS

SEQ ID NO: 3119936 - protein, 13 aa, Giardia lamblia
KSSPHATDQTQDP

SEQ ID NO: 3119937 - protein, 7 aa, Giardia lamblia
KSSPHKV

SEQ ID NO: 3119938 - protein, 21 aa, Giardia lamblia
KSSPNSQSNAQELKPGEGADN

SEQ ID NO: 3119939 - protein, 8 aa, Giardia lamblia
KSSPRRMA

SEQ ID NO: 3119940 - protein, 9 aa, Giardia lamblia
KSSPSPLQT

SEQ ID NO: 3119941 - protein, 7 aa, Giardia lamblia
KSSPTDV

SEQ ID NO: 3119942 - protein, 6 aa, Giardia lamblia
KSSQPQ

SEQ ID NO: 3119943 - protein, 16 aa, Giardia lamblia
KSSSRQSGDDPQRHSQ

SEQ ID NO: 3119944 - protein, 7 aa, Giardia lamblia
KSSSRSH

SEQ ID NO: 3119945 - protein, 7 aa, Giardia lamblia
KSSSSHK

SEQ ID NO: 3119946 - protein, 14 aa, Giardia lamblia
KSSSTLAGDTTTED

SEQ ID NO: 3119947 - protein, 6 aa, Giardia lamblia
KSSSYF

SEQ ID NO: 3119948 - protein, 7 aa, Giardia lamblia
KSSTASL

SEQ ID NO: 3119949 - protein, 6 aa, Giardia lamblia
KSSTLT

SEQ ID NO: 3119950 - protein, 6 aa, Giardia lamblia
KSSTPT

SEQ ID NO: 3119951 - protein, 10 aa, Giardia lamblia
KSSTQEQEDQ

SEQ ID NO: 3119952 - protein, 15 aa, Giardia lamblia
KSSTQSTPSTTPPSN

SEQ ID NO: 3119953 - protein, 14 aa, Giardia lamblia
KSSTSSGGRQSSKV

SEQ ID NO: 3119954 - protein, 10 aa, Giardia lamblia
KSSTTLPESL

SEQ ID NO: 3119955 - protein, 6 aa, Giardia lamblia
KSSVTG

SEQ ID NO: 3119956 - protein, 9 aa, Giardia lamblia
KSSVTPKVE

SEQ ID NO: 3119957 - protein, 13 aa, Giardia lamblia
KSTDGTAEYPPSY

SEQ ID NO: 3119958 - protein, 5 aa, Giardia lamblia
KSTDI

SEQ ID NO: 3119959 - protein, 14 aa, Giardia lamblia
KSTDSLKAATDTID

SEQ ID NO: 3119960 - protein, 29 aa, Giardia lamblia
KSTEQNLKEATSRRRKEAALQASRHRKQQ

SEQ ID NO: 3119961 - protein, 13 aa, Giardia lamblia
KSTFDYRANELLN

SEQ ID NO: 3119962 - protein, 7 aa, Giardia lamblia
KSTGDKI

SEQ ID NO: 3119963 - protein, 10 aa, Giardia lamblia
KSTGSKPREK

SEQ ID NO: 3119964 - protein, 6 aa, Giardia lamblia
KSTGSM

SEQ ID NO: 3119965 - protein, 13 aa, Giardia lamblia
KSTGTGPASKSVI

SEQ ID NO: 3119966 - protein, 9 aa, Giardia lamblia
KSTHGSSAE

SEQ ID NO: 3119967 - protein, 4 aa, Giardia lamblia
KSTI

SEQ ID NO: 3119968 - protein, 14 aa, Giardia lamblia
KSTIAHAQDTTEDR

SEQ ID NO: 3119969 - protein, 5 aa, Giardia lamblia
KSTID

SEQ ID NO: 3119970 - protein, 19 aa, Giardia lamblia
KSTIPGNGGSSTNHENHIP

SEQ ID NO: 3119971 - protein, 8 aa, Giardia lamblia
KSTKERTK

SEQ ID NO: 3119972 - protein, 9 aa, Giardia lamblia
KSTKRKSSF

SEQ ID NO: 3119973 - protein, 7 aa, Giardia lamblia
KSTKSQE

SEQ ID NO: 3119974 - protein, 7 aa, Giardia lamblia
KSTKVSV

SEQ ID NO: 3119975 - protein, 10 aa, Giardia lamblia
KSTLNNPTKV

SEQ ID NO: 3119976 - protein, 7 aa, Giardia lamblia
KSTLNPS

SEQ ID NO: 3119977 - protein, 7 aa, Giardia lamblia
KSTLPPS

SEQ ID NO: 3119978 - protein, 9 aa, Giardia lamblia
KSTNETGNT

SEQ ID NO: 3119979 - protein, 8 aa, Giardia lamblia
KSTNEYSG

SEQ ID NO: 3119980 - protein, 4 aa, Giardia lamblia
KSTP

SEQ ID NO: 3119981 - protein, 6 aa, Giardia lamblia
KSTPEL

SEQ ID NO: 3119982 - protein, 7 aa, Giardia lamblia
KSTPTAQ

SEQ ID NO: 3119983 - protein, 5 aa, Giardia lamblia
KSTQK

SEQ ID NO: 3119984 - protein, 9 aa, Giardia lamblia
KSTQKASGQ

SEQ ID NO: 3119985 - protein, 17 aa, Giardia lamblia
KSTRGSTARQAKDQDQL

SEQ ID NO: 3119986 - protein, 5 aa, Giardia lamblia
KSTRP

SEQ ID NO: 3119987 - protein, 10 aa, Giardia lamblia
KSTRSDNNAT

SEQ ID NO: 3119988 - protein, 4 aa, Giardia lamblia
KSTS

SEQ ID NO: 3119989 - protein, 8 aa, Giardia lamblia
KSTSDRQA

SEQ ID NO: 3119990 - protein, 5 aa, Giardia lamblia
KSTST

SEQ ID NO: 3119991 - protein, 77 aa, Giardia lamblia
KSTTKEMNSDKVPKEGTSGFERPQHHRGSDYHNKRDRQATGDRFNRSSFDRGSGHGNGRHHNNNNNNSNNNSKYGGP

SEQ ID NO: 3119992 - protein, 5 aa, Giardia lamblia
KSTTL

SEQ ID NO: 3119993 - protein, 6 aa, Giardia lamblia
KSTTVG

SEQ ID NO: 3119994 - protein, 29 aa, Giardia lamblia
KSTVPPETTSKSTRASQQATSLTRPTHVD

SEQ ID NO: 3119995 - protein, 20 aa, Giardia lamblia
KSVASTPSQIAKRSDQSSKN

SEQ ID NO: 3119996 - protein, 14 aa, Giardia lamblia
KSVDPSSQEYASAY

SEQ ID NO: 3119997 - protein, 23 aa, Giardia lamblia
KSVDYEGNQPQAYSASTDNEALN

SEQ ID NO: 3119998 - protein, 7 aa, Giardia lamblia
KSVKGSN

SEQ ID NO: 3119999 - protein, 7 aa, Giardia lamblia
KSVLSDN

SEQ ID NO: 3120000 - protein, 7 aa, Giardia lamblia
KSVNENG

SEQ ID NO: 3120001 - protein, 11 aa, Giardia lamblia
KSVPEPAADPV

SEQ ID NO: 3120002 - protein, 8 aa, Giardia lamblia
KSVPTKEE

SEQ ID NO: 3120003 - protein, 7 aa, Giardia lamblia
KSVPVRR

SEQ ID NO: 3120004 - protein, 7 aa, Giardia lamblia
KSVQEAI

SEQ ID NO: 3120005 - protein, 17 aa, Giardia lamblia
KSVRAASKAYDSDSTVA

SEQ ID NO: 3120006 - protein, 9 aa, Giardia lamblia
KSVRNTQKC

SEQ ID NO: 3120007 - protein, 33 aa, Giardia lamblia
KSVRSAYGVTNNATANDSAAGKSGIPSSHNDTE

SEQ ID NO: 3120008 - protein, 4 aa, Giardia lamblia
KSVS

SEQ ID NO: 3120009 - protein, 21 aa, Giardia lamblia
KSVSSSVSKPPISPEEHPDTV

SEQ ID NO: 3120010 - protein, 5 aa, Giardia lamblia
KSVTV

SEQ ID NO: 3120011 - protein, 5 aa, Giardia lamblia
KSYAG

SEQ ID NO: 3120012 - protein, 7 aa, Giardia lamblia
KSYASLG

SEQ ID NO: 3120013 - protein, 6 aa, Giardia lamblia
KSYDAR

SEQ ID NO: 3120014 - protein, 5 aa, Giardia lamblia
KSYDE

SEQ ID NO: 3120015 - protein, 8 aa, Giardia lamblia
KSYDKNGL

SEQ ID NO: 3120016 - protein, 4 aa, Giardia lamblia
KSYE

SEQ ID NO: 3120017 - protein, 7 aa, Giardia lamblia
KSYESRT

SEQ ID NO: 3120018 - protein, 20 aa, Giardia lamblia
KSYGAKDKLTPLQAAETGKT

SEQ ID NO: 3120019 - protein, 26 aa, Giardia lamblia
KSYRQGTTTCEPPSPAVNDNADHELG

SEQ ID NO: 3120020 - protein, 4 aa, Giardia lamblia
KSYT

SEQ ID NO: 3120021 - protein, 7 aa, Giardia lamblia
KSYTDED

SEQ ID NO: 3120022 - protein, 4 aa, Giardia lamblia
KTAA

SEQ ID NO: 3120023 - protein, 8 aa, Giardia lamblia
KTAAHNKR

SEQ ID NO: 3120024 - protein, 17 aa, Giardia lamblia
KTADAERHMRKDADKTV

SEQ ID NO: 3120025 - protein, 8 aa, Giardia lamblia
KTADAQQA

SEQ ID NO: 3120026 - protein, 5 aa, Giardia lamblia
KTADG

SEQ ID NO: 3120027 - protein, 5 aa, Giardia lamblia
KTADL

SEQ ID NO: 3120028 - protein, 4 aa, Giardia lamblia
KTAE

SEQ ID NO: 3120029 - protein, 13 aa, Giardia lamblia
KTAEEAPSSAISS

SEQ ID NO: 3120030 - protein, 7 aa, Giardia lamblia
KTAEEVS

SEQ ID NO: 3120031 - protein, 5 aa, Giardia lamblia
KTAEI

SEQ ID NO: 3120032 - protein, 5 aa, Giardia lamblia
KTAEN

SEQ ID NO: 3120033 - protein, 10 aa, Giardia lamblia
KTAFTESQKT

SEQ ID NO: 3120034 - protein, 9 aa, Giardia lamblia
KTAGDGTRA

SEQ ID NO: 3120035 - protein, 15 aa, Giardia lamblia
KTAGGKTTSGFSPPE

SEQ ID NO: 3120036 - protein, 6 aa, Giardia lamblia
KTAGKK

SEQ ID NO: 3120037 - protein, 10 aa, Giardia lamblia
KTAGMDLGAQ

SEQ ID NO: 3120038 - protein, 8 aa, Giardia lamblia
KTAGPSSH

SEQ ID NO: 3120039 - protein, 8 aa, Giardia lamblia
KTAGTIAD

SEQ ID NO: 3120040 - protein, 63 aa, Giardia lamblia
KTAGVSPKAAKTQAKNPTLIDSSNPDLIQESSNTKTNPSASSSTGNLDQSKENRKVSEQQNTS

SEQ ID NO: 3120041 - protein, 6 aa, Giardia lamblia
KTAHPE

SEQ ID NO: 3120042 - protein, 14 aa, Giardia lamblia
KTAHPTSYQDDCTD

SEQ ID NO: 3120043 - protein, 9 aa, Giardia lamblia
KTAKESQQR

SEQ ID NO: 3120044 - protein, 12 aa, Giardia lamblia
KTAKKGNIRTNR

SEQ ID NO: 3120045 - protein, 4 aa, Giardia lamblia
KTAL

SEQ ID NO: 3120046 - protein, 8 aa, Giardia lamblia
KTALETQS

SEQ ID NO: 3120047 - protein, 6 aa, Giardia lamblia
KTANLG

SEQ ID NO: 3120048 - protein, 9 aa, Giardia lamblia
KTAPIPGET

SEQ ID NO: 3120049 - protein, 18 aa, Giardia lamblia
KTAQANYKQEVSTSTELK

SEQ ID NO: 3120050 - protein, 20 aa, Giardia lamblia
KTAQDAPILPPRAGNDNKPT

SEQ ID NO: 3120051 - protein, 12 aa, Giardia lamblia
KTARDHGEQRVS

SEQ ID NO: 3120052 - protein, 8 aa, Giardia lamblia
KTARPMSA

SEQ ID NO: 3120053 - protein, 7 aa, Giardia lamblia
KTARTEA

SEQ ID NO: 3120054 - protein, 4 aa, Giardia lamblia
KTAS

SEQ ID NO: 3120055 - protein, 22 aa, Giardia lamblia
KTASAPSGTATSSAESNNDAVE

SEQ ID NO: 3120056 - protein, 15 aa, Giardia lamblia
KTASDTSEARGTAAT

SEQ ID NO: 3120057 - protein, 9 aa, Giardia lamblia
KTASESATT

SEQ ID NO: 3120058 - protein, 8 aa, Giardia lamblia
KTASKASI

SEQ ID NO: 3120059 - protein, 15 aa, Giardia lamblia
KTASLPDSMTTRTSK

SEQ ID NO: 3120060 - protein, 15 aa, Giardia lamblia
KTASLQNSEKSQADY

SEQ ID NO: 3120061 - protein, 9 aa, Giardia lamblia
KTASTKDAL

SEQ ID NO: 3120062 - protein, 12 aa, Giardia lamblia
KTATKNTDEALE

SEQ ID NO: 3120063 - protein, 42 aa, Giardia lamblia
KTATRKNRVVSSDTKTETDGSSTECKDSSTNFDTSREAVPCP

SEQ ID NO: 3120064 - protein, 11 aa, Giardia lamblia
KTATSSKPPHM

SEQ ID NO: 3120065 - protein, 9 aa, Giardia lamblia
KTAVPTESD

SEQ ID NO: 3120066 - protein, 13 aa, Giardia lamblia
KTAYTQNKPVLES

SEQ ID NO: 3120067 - protein, 8 aa, Giardia lamblia
KTDARGRT

SEQ ID NO: 3120068 - protein, 6 aa, Giardia lamblia
KTDDEN

SEQ ID NO: 3120069 - protein, 5 aa, Giardia lamblia
KTDDT

SEQ ID NO: 3120070 - protein, 7 aa, Giardia lamblia
KTDEDQK

SEQ ID NO: 3120071 - protein, 11 aa, Giardia lamblia
KTDENTTQIEK

SEQ ID NO: 3120072 - protein, 5 aa, Giardia lamblia
KTDGT

SEQ ID NO: 3120073 - protein, 10 aa, Giardia lamblia
KTDKNDDIKA

SEQ ID NO: 3120074 - protein, 7 aa, Giardia lamblia
KTDKNDF

SEQ ID NO: 3120075 - protein, 4 aa, Giardia lamblia
KTDN

SEQ ID NO: 3120076 - protein, 5 aa, Giardia lamblia
KTDNL

SEQ ID NO: 3120077 - protein, 7 aa, Giardia lamblia
KTDPDFR

SEQ ID NO: 3120078 - protein, 10 aa, Giardia lamblia
KTDQKAAEAA

SEQ ID NO: 3120079 - protein, 13 aa, Giardia lamblia
KTDQSNKQLQTSP

SEQ ID NO: 3120080 - protein, 8 aa, Giardia lamblia
KTDRESSR

SEQ ID NO: 3120081 - protein, 6 aa, Giardia lamblia
KTDRRY

SEQ ID NO: 3120082 - protein, 11 aa, Giardia lamblia
KTDRTEAQHSA

SEQ ID NO: 3120083 - protein, 4 aa, Giardia lamblia
KTDS

SEQ ID NO: 3120084 - protein, 8 aa, Giardia lamblia
KTDSSSLQ

SEQ ID NO: 3120085 - protein, 7 aa, Giardia lamblia
KTDTDID

SEQ ID NO: 3120086 - protein, 20 aa, Giardia lamblia
KTDTELRSAQTADAWSKQTD

SEQ ID NO: 3120087 - protein, 5 aa, Giardia lamblia
KTDTM

SEQ ID NO: 3120088 - protein, 6 aa, Giardia lamblia
KTDVEE

SEQ ID NO: 3120089 - protein, 18 aa, Giardia lamblia
KTDYRNDADLSSEDTIPP

SEQ ID NO: 3120090 - protein, 8 aa, Giardia lamblia
KTEAEATA

SEQ ID NO: 3120091 - protein, 10 aa, Giardia lamblia
KTEAEKQLSE

SEQ ID NO: 3120092 - protein, 12 aa, Giardia lamblia
KTEAKNMSYGET

SEQ ID NO: 3120093 - protein, 7 aa, Giardia lamblia
KTEAMGD

SEQ ID NO: 3120094 - protein, 11 aa, Giardia lamblia
KTEARSGPGAR

SEQ ID NO: 3120095 - protein, 8 aa, Giardia lamblia
KTEDEATM

SEQ ID NO: 3120096 - protein, 8 aa, Giardia lamblia
KTEDFPKE

SEQ ID NO: 3120097 - protein, 13 aa, Giardia lamblia
KTEDGVDNQSQME

SEQ ID NO: 3120098 - protein, 5 aa, Giardia lamblia
KTEED

SEQ ID NO: 3120099 - protein, 6 aa, Giardia lamblia
KTEEEA

SEQ ID NO: 3120100 - protein, 10 aa, Giardia lamblia
KTEEESYRTK

SEQ ID NO: 3120101 - protein, 15 aa, Giardia lamblia
KTEEGGHPSTRPSAP

SEQ ID NO: 3120102 - protein, 12 aa, Giardia lamblia
KTEEKQAGHSTR

SEQ ID NO: 3120103 - protein, 27 aa, Giardia lamblia
KTEEQIAQAEKKARQTRGRLDKEAKRE

SEQ ID NO: 3120104 - protein, 6 aa, Giardia lamblia
KTEESM

SEQ ID NO: 3120105 - protein, 6 aa, Giardia lamblia
KTEFED

SEQ ID NO: 3120106 - protein, 8 aa, Giardia lamblia
KTEGHSQD

SEQ ID NO: 3120107 - protein, 8 aa, Giardia lamblia
KTEGRACS

SEQ ID NO: 3120108 - protein, 5 aa, Giardia lamblia
KTEGS

SEQ ID NO: 3120109 - protein, 5 aa, Giardia lamblia
KTEIT

SEQ ID NO: 3120110 - protein, 5 aa, Giardia lamblia
KTEKD

SEQ ID NO: 3120111 - protein, 6 aa, Giardia lamblia
KTEPEN

SEQ ID NO: 3120112 - protein, 8 aa, Giardia lamblia
KTEQAEAR

SEQ ID NO: 3120113 - protein, 5 aa, Giardia lamblia
KTERG

SEQ ID NO: 3120114 - protein, 7 aa, Giardia lamblia
KTERGKV

SEQ ID NO: 3120115 - protein, 6 aa, Giardia lamblia
KTERGY

SEQ ID NO: 3120116 - protein, 13 aa, Giardia lamblia
KTESFKPVRARED

SEQ ID NO: 3120117 - protein, 29 aa, Giardia lamblia
KTESKEAGNEPESTSKDLANPSEPAAPAI

SEQ ID NO: 3120118 - protein, 5 aa, Giardia lamblia
KTESP

SEQ ID NO: 3120119 - protein, 4 aa, Giardia lamblia
KTET

SEQ ID NO: 3120120 - protein, 24 aa, Giardia lamblia
KTETDETDETDEMEESEESEEPEK

SEQ ID NO: 3120121 - protein, 6 aa, Giardia lamblia
KTEYRY

SEQ ID NO: 3120122 - protein, 6 aa, Giardia lamblia
KTEYTY

SEQ ID NO: 3120123 - protein, 8 aa, Giardia lamblia
KTFGDNTN

SEQ ID NO: 3120124 - protein, 6 aa, Giardia lamblia
KTFGGG

SEQ ID NO: 3120125 - protein, 9 aa, Giardia lamblia
KTFPPDVQG

SEQ ID NO: 3120126 - protein, 13 aa, Giardia lamblia
KTFQGTKNAQGET

SEQ ID NO: 3120127 - protein, 4 aa, Giardia lamblia
KTFS

SEQ ID NO: 3120128 - protein, 6 aa, Giardia lamblia
KTGAAT

SEQ ID NO: 3120129 - protein, 11 aa, Giardia lamblia
KTGASTLNQNQ

SEQ ID NO: 3120130 - protein, 12 aa, Giardia lamblia
KTGDAVEASTTS

SEQ ID NO: 3120131 - protein, 4 aa, Giardia lamblia
KTGE

SEQ ID NO: 3120132 - protein, 6 aa, Giardia lamblia
KTGEQI

SEQ ID NO: 3120133 - protein, 8 aa, Giardia lamblia
KTGGGQGM

SEQ ID NO: 3120134 - protein, 12 aa, Giardia lamblia
KTGGKLGARKGI

SEQ ID NO: 3120135 - protein, 5 aa, Giardia lamblia
KTGHA

SEQ ID NO: 3120136 - protein, 12 aa, Giardia lamblia
KTGHSGTLDPGV

SEQ ID NO: 3120137 - protein, 4 aa, Giardia lamblia
KTGK

SEQ ID NO: 3120138 - protein, 5 aa, Giardia lamblia
KTGKR

SEQ ID NO: 3120139 - protein, 5 aa, Giardia lamblia
KTGKS

SEQ ID NO: 3120140 - protein, 7 aa, Giardia lamblia
KTGKVKP

SEQ ID NO: 3120141 - protein, 20 aa, Giardia lamblia
KTGKWTGKSQGDNGEKNQRG

SEQ ID NO: 3120142 - protein, 13 aa, Giardia lamblia
KTGPQTNSKDGSK

SEQ ID NO: 3120143 - protein, 8 aa, Giardia lamblia
KTGQLETE

SEQ ID NO: 3120144 - protein, 4 aa, Giardia lamblia
KTGS

SEQ ID NO: 3120145 - protein, 9 aa, Giardia lamblia
KTGSFDKPR

SEQ ID NO: 3120146 - protein, 9 aa, Giardia lamblia
KTGTEALAS

SEQ ID NO: 3120147 - protein, 16 aa, Giardia lamblia
KTGTPEDFTPSDPITI

SEQ ID NO: 3120148 - protein, 5 aa, Giardia lamblia
KTGVD

SEQ ID NO: 3120149 - protein, 16 aa, Giardia lamblia
KTGVNGVDSESTVSRA

SEQ ID NO: 3120150 - protein, 4 aa, Giardia lamblia
KTGY

SEQ ID NO: 3120151 - protein, 6 aa, Giardia lamblia
KTGYIS

SEQ ID NO: 3120152 - protein, 8 aa, Giardia lamblia
KTGYSSGA

SEQ ID NO: 3120153 - protein, 18 aa, Giardia lamblia
KTHDDEKALAAPTGLTSA

SEQ ID NO: 3120154 - protein, 7 aa, Giardia lamblia
KTHNGGV

SEQ ID NO: 3120155 - protein, 7 aa, Giardia lamblia
KTHNTTY

SEQ ID NO: 3120156 - protein, 8 aa, Giardia lamblia
KTHPVSTS

SEQ ID NO: 3120157 - protein, 15 aa, Giardia lamblia
KTHSPSSSIPDGSEQ

SEQ ID NO: 3120158 - protein, 21 aa, Giardia lamblia
KTHTPGKQYSQLDAEQSFSEA

SEQ ID NO: 3120159 - protein, 6 aa, Giardia lamblia
KTHTTK

SEQ ID NO: 3120160 - protein, 9 aa, Giardia lamblia
KTIDSPPIE

SEQ ID NO: 3120161 - protein, 4 aa, Giardia lamblia
KTIE

SEQ ID NO: 3120162 - protein, 5 aa, Giardia lamblia
KTIEA

SEQ ID NO: 3120163 - protein, 11 aa, Giardia lamblia
KTIEKRPGLST

SEQ ID NO: 3120164 - protein, 7 aa, Giardia lamblia
KTIPTSN

SEQ ID NO: 3120165 - protein, 5 aa, Giardia lamblia
KTIQS

SEQ ID NO: 3120166 - protein, 12 aa, Giardia lamblia
KTIRQGKASMPD

SEQ ID NO: 3120167 - protein, 5 aa, Giardia lamblia
KTISE

SEQ ID NO: 3120168 - protein, 17 aa, Giardia lamblia
KTISESEKAVKARTQRQ

SEQ ID NO: 3120169 - protein, 7 aa, Giardia lamblia
KTISGDT

SEQ ID NO: 3120170 - protein, 10 aa, Giardia lamblia
KTISKQTELP

SEQ ID NO: 3120171 - protein, 4 aa, Giardia lamblia
KTIT

SEQ ID NO: 3120172 - protein, 12 aa, Giardia lamblia
KTITPPELVYET

SEQ ID NO: 3120173 - protein, 8 aa, Giardia lamblia
KTKDLRKR

SEQ ID NO: 3120174 - protein, 6 aa, Giardia lamblia
KTKEGI

SEQ ID NO: 3120175 - protein, 9 aa, Giardia lamblia
KTKEKEVDR

SEQ ID NO: 3120176 - protein, 12 aa, Giardia lamblia
KTKETTEGVKEK

SEQ ID NO: 3120177 - protein, 9 aa, Giardia lamblia
KTKEVGQSA

SEQ ID NO: 3120178 - protein, 6 aa, Giardia lamblia
KTKGGC

SEQ ID NO: 3120179 - protein, 8 aa, Giardia lamblia
KTKGKEDF

SEQ ID NO: 3120180 - protein, 6 aa, Giardia lamblia
KTKPVE

SEQ ID NO: 3120181 - protein, 24 aa, Giardia lamblia
KTKQRAVGKPRTPDQRNQSATTSM

SEQ ID NO: 3120182 - protein, 27 aa, Giardia lamblia
KTKRATKTRASKTSHMKSGKDKAFHNP

SEQ ID NO: 3120183 - protein, 7 aa, Giardia lamblia
KTKRDAS

SEQ ID NO: 3120184 - protein, 13 aa, Giardia lamblia
KTKRKAAAKAGIV

SEQ ID NO: 3120185 - protein, 6 aa, Giardia lamblia
KTKSPE

SEQ ID NO: 3120186 - protein, 8 aa, Giardia lamblia
KTKSVGPN

SEQ ID NO: 3120187 - protein, 13 aa, Giardia lamblia
KTKSVGPNKLPNL

SEQ ID NO: 3120188 - protein, 6 aa, Giardia lamblia
KTKTRS

SEQ ID NO: 3120189 - protein, 11 aa, Giardia lamblia
KTKVADKETNL

SEQ ID NO: 3120190 - protein, 8 aa, Giardia lamblia
KTKYTENI

SEQ ID NO: 3120191 - protein, 4 aa, Giardia lamblia
KTLA

SEQ ID NO: 3120192 - protein, 9 aa, Giardia lamblia
KTLAGQADA

SEQ ID NO: 3120193 - protein, 11 aa, Giardia lamblia
KTLASRVQQQQ

SEQ ID NO: 3120194 - protein, 17 aa, Giardia lamblia
KTLEGDPSVDIPEEYSN

SEQ ID NO: 3120195 - protein, 6 aa, Giardia lamblia
KTLGED

SEQ ID NO: 3120196 - protein, 13 aa, Giardia lamblia
KTLGPRMSAEDKD

SEQ ID NO: 3120197 - protein, 10 aa, Giardia lamblia
KTLGTTSDLT

SEQ ID NO: 3120198 - protein, 9 aa, Giardia lamblia
KTLKATTAA

SEQ ID NO: 3120199 - protein, 7 aa, Giardia lamblia
KTLPGGF

SEQ ID NO: 3120200 - protein, 7 aa, Giardia lamblia
KTLPSGT

SEQ ID NO: 3120201 - protein, 7 aa, Giardia lamblia
KTLRGDD

SEQ ID NO: 3120202 - protein, 6 aa, Giardia lamblia
KTLSAR

SEQ ID NO: 3120203 - protein, 9 aa, Giardia lamblia
KTLSDANET

SEQ ID NO: 3120204 - protein, 9 aa, Giardia lamblia
KTLTSNGED

SEQ ID NO: 3120205 - protein, 51 aa, Giardia lamblia
KTLTSSGDHDSRSPPIKSSSNAAARGKPFGGKGMGGSAPFGGGGGGMNDGR

SEQ ID NO: 3120206 - protein, 6 aa, Giardia lamblia
KTMAGG

SEQ ID NO: 3120207 - protein, 6 aa, Giardia lamblia
KTMKTP

SEQ ID NO: 3120208 - protein, 7 aa, Giardia lamblia
KTMNEYG

SEQ ID NO: 3120209 - protein, 4 aa, Giardia lamblia
KTMQ

SEQ ID NO: 3120210 - protein, 51 aa, Giardia lamblia
KTMSDDPGLSYSSSPPSKMDASDRCHGSMTESTLQASTRRSTRLTPSEVED

SEQ ID NO: 3120211 - protein, 23 aa, Giardia lamblia
KTMTPGPANKPSKIADGSTIDPS

SEQ ID NO: 3120212 - protein, 7 aa, Giardia lamblia
KTMTPGV

SEQ ID NO: 3120213 - protein, 13 aa, Giardia lamblia
KTNALKAQAEDAL

SEQ ID NO: 3120214 - protein, 20 aa, Giardia lamblia
KTNARSPKDAHGARELTPAQ

SEQ ID NO: 3120215 - protein, 5 aa, Giardia lamblia
KTNDM

SEQ ID NO: 3120216 - protein, 15 aa, Giardia lamblia
KTNDSSMKERVEKNK

SEQ ID NO: 3120217 - protein, 4 aa, Giardia lamblia
KTNE

SEQ ID NO: 3120218 - protein, 5 aa, Giardia lamblia
KTNEL

SEQ ID NO: 3120219 - protein, 9 aa, Giardia lamblia
KTNMGKTRA

SEQ ID NO: 3120220 - protein, 4 aa, Giardia lamblia
KTNN

SEQ ID NO: 3120221 - protein, 7 aa, Giardia lamblia
KTNQGAN

SEQ ID NO: 3120222 - protein, 5 aa, Giardia lamblia
KTNSN

SEQ ID NO: 3120223 - protein, 6 aa, Giardia lamblia
KTNSPI

SEQ ID NO: 3120224 - protein, 9 aa, Giardia lamblia
KTNSSEQAT

SEQ ID NO: 3120225 - protein, 6 aa, Giardia lamblia
KTNTRI

SEQ ID NO: 3120226 - protein, 10 aa, Giardia lamblia
KTNTTLQSSY

SEQ ID NO: 3120227 - protein, 9 aa, Giardia lamblia
KTNTYEQHQ

SEQ ID NO: 3120228 - protein, 19 aa, Giardia lamblia
KTPAEQAKEAGKDNLSSTT

SEQ ID NO: 3120229 - protein, 13 aa, Giardia lamblia
KTPAGSVSEPDLK

SEQ ID NO: 3120230 - protein, 13 aa, Giardia lamblia
KTPAMTPAPVANE

SEQ ID NO: 3120231 - protein, 7 aa, Giardia lamblia
KTPANYK

SEQ ID NO: 3120232 - protein, 13 aa, Giardia lamblia
KTPEESSNKNTIT

SEQ ID NO: 3120233 - protein, 6 aa, Giardia lamblia
KTPEET

SEQ ID NO: 3120234 - protein, 5 aa, Giardia lamblia
KTPEH

SEQ ID NO: 3120235 - protein, 16 aa, Giardia lamblia
KTPERKQYAKKPTTRL

SEQ ID NO: 3120236 - protein, 4 aa, Giardia lamblia
KTPG

SEQ ID NO: 3120237 - protein, 7 aa, Giardia lamblia
KTPGLTN

SEQ ID NO: 3120238 - protein, 6 aa, Giardia lamblia
KTPGQL

SEQ ID NO: 3120239 - protein, 15 aa, Giardia lamblia
KTPGRGRWDRDPTGY

SEQ ID NO: 3120240 - protein, 6 aa, Giardia lamblia
KTPGSV

SEQ ID NO: 3120241 - protein, 4 aa, Giardia lamblia
KTPI

SEQ ID NO: 3120242 - protein, 7 aa, Giardia lamblia
KTPIGTR

SEQ ID NO: 3120243 - protein, 9 aa, Giardia lamblia
KTPIPPASK

SEQ ID NO: 3120244 - protein, 7 aa, Giardia lamblia
KTPKGLR

SEQ ID NO: 3120245 - protein, 10 aa, Giardia lamblia
KTPLAEDGSY

SEQ ID NO: 3120246 - protein, 14 aa, Giardia lamblia
KTPLSVSGTRPLGV

SEQ ID NO: 3120247 - protein, 7 aa, Giardia lamblia
KTPPENQ

SEQ ID NO: 3120248 - protein, 13 aa, Giardia lamblia
KTPPLSRAGDSAV

SEQ ID NO: 3120249 - protein, 7 aa, Giardia lamblia
KTPPVVS

SEQ ID NO: 3120250 - protein, 5 aa, Giardia lamblia
KTPRR

SEQ ID NO: 3120251 - protein, 42 aa, Giardia lamblia
KTPRVNETSQPLTAADPNTELPAIGNTAASLQAARAQVPASA

SEQ ID NO: 3120252 - protein, 9 aa, Giardia lamblia
KTPSKRTTH

SEQ ID NO: 3120253 - protein, 17 aa, Giardia lamblia
KTPSSQTSKEVTPSSSL

SEQ ID NO: 3120254 - protein, 9 aa, Giardia lamblia
KTPTFTPDV

SEQ ID NO: 3120255 - protein, 6 aa, Giardia lamblia
KTPVPV

SEQ ID NO: 3120256 - protein, 12 aa, Giardia lamblia
KTPYDLRKDTGT

SEQ ID NO: 3120257 - protein, 7 aa, Giardia lamblia
KTPYNEK

SEQ ID NO: 3120258 - protein, 4 aa, Giardia lamblia
KTQA

SEQ ID NO: 3120259 - protein, 8 aa, Giardia lamblia
KTQAQNLG

SEQ ID NO: 3120260 - protein, 43 aa, Giardia lamblia
KTQASAPSISDATINDGTSMTVSNQERDSTVIRSGDNTTLETT

SEQ ID NO: 3120261 - protein, 8 aa, Giardia lamblia
KTQASQEK

SEQ ID NO: 3120262 - protein, 4 aa, Giardia lamblia
KTQD

SEQ ID NO: 3120263 - protein, 7 aa, Giardia lamblia
KTQDEIE

SEQ ID NO: 3120264 - protein, 6 aa, Giardia lamblia
KTQEIQ

SEQ ID NO: 3120265 - protein, 6 aa, Giardia lamblia
KTQEKS

SEQ ID NO: 3120266 - protein, 5 aa, Giardia lamblia
KTQFP

SEQ ID NO: 3120267 - protein, 14 aa, Giardia lamblia
KTQKDTAESDLSRV

SEQ ID NO: 3120268 - protein, 8 aa, Giardia lamblia
KTQKRKKY

SEQ ID NO: 3120269 - protein, 7 aa, Giardia lamblia
KTQLQAE

SEQ ID NO: 3120270 - protein, 24 aa, Giardia lamblia
KTQNKHSPTGPNHLQDSPNNEHSV

SEQ ID NO: 3120271 - protein, 7 aa, Giardia lamblia
KTQPQEH

SEQ ID NO: 3120272 - protein, 23 aa, Giardia lamblia
KTQQQPDQRLPSASNKSSKAQYS

SEQ ID NO: 3120273 - protein, 6 aa, Giardia lamblia
KTQQSY

SEQ ID NO: 3120274 - protein, 7 aa, Giardia lamblia
KTQRAQL

SEQ ID NO: 3120275 - protein, 7 aa, Giardia lamblia
KTQRNSS

SEQ ID NO: 3120276 - protein, 4 aa, Giardia lamblia
KTQS

SEQ ID NO: 3120277 - protein, 9 aa, Giardia lamblia
KTQSARVRQ

SEQ ID NO: 3120278 - protein, 20 aa, Giardia lamblia
KTQSIKKSMSRSLTAQDLSE

SEQ ID NO: 3120279 - protein, 7 aa, Giardia lamblia
KTQSSNF

SEQ ID NO: 3120280 - protein, 9 aa, Giardia lamblia
KTQSVPKMA

SEQ ID NO: 3120281 - protein, 4 aa, Giardia lamblia
KTQT

SEQ ID NO: 3120282 - protein, 5 aa, Giardia lamblia
KTRAD

SEQ ID NO: 3120283 - protein, 15 aa, Giardia lamblia
KTRAGLSRGRSPQPL

SEQ ID NO: 3120284 - protein, 6 aa, Giardia lamblia
KTRAQE

SEQ ID NO: 3120285 - protein, 6 aa, Giardia lamblia
KTRAQG

SEQ ID NO: 3120286 - protein, 7 aa, Giardia lamblia
KTRDALG

SEQ ID NO: 3120287 - protein, 11 aa, Giardia lamblia
KTRDDVEREHS

SEQ ID NO: 3120288 - protein, 13 aa, Giardia lamblia
KTRDLPPAIYGES

SEQ ID NO: 3120289 - protein, 6 aa, Giardia lamblia
KTRDNI

SEQ ID NO: 3120290 - protein, 14 aa, Giardia lamblia
KTRDSLSKTLSSDS

SEQ ID NO: 3120291 - protein, 6 aa, Giardia lamblia
KTREDL

SEQ ID NO: 3120292 - protein, 13 aa, Giardia lamblia
KTRGGSKSAKRAY

SEQ ID NO: 3120293 - protein, 13 aa, Giardia lamblia
KTRGSGSDDDQDV

SEQ ID NO: 3120294 - protein, 7 aa, Giardia lamblia
KTRIAER

SEQ ID NO: 3120295 - protein, 4 aa, Giardia lamblia
KTRN

SEQ ID NO: 3120296 - protein, 13 aa, Giardia lamblia
KTRPAPKPKTFEG

SEQ ID NO: 3120297 - protein, 16 aa, Giardia lamblia
KTRQYKSKGAEFTEEW

SEQ ID NO: 3120298 - protein, 11 aa, Giardia lamblia
KTRSTKRYDRE

SEQ ID NO: 3120299 - protein, 7 aa, Giardia lamblia
KTRTAYS

SEQ ID NO: 3120300 - protein, 12 aa, Giardia lamblia
KTRTKQQEDEIA

SEQ ID NO: 3120301 - protein, 9 aa, Giardia lamblia
KTRTTDRKA

SEQ ID NO: 3120302 - protein, 19 aa, Giardia lamblia
KTRVANPPVGQYSVPPSKF

SEQ ID NO: 3120303 - protein, 15 aa, Giardia lamblia
KTRYGRKTDPELTAD

SEQ ID NO: 3120304 - protein, 11 aa, Giardia lamblia
KTSAPQPIPPQ

SEQ ID NO: 3120305 - protein, 9 aa, Giardia lamblia
KTSASKERA

SEQ ID NO: 3120306 - protein, 6 aa, Giardia lamblia
KTSDQC

SEQ ID NO: 3120307 - protein, 9 aa, Giardia lamblia
KTSDSDALS

SEQ ID NO: 3120308 - protein, 13 aa, Giardia lamblia
KTSEEKSQTDVQR

SEQ ID NO: 3120309 - protein, 15 aa, Giardia lamblia
KTSETPSSNNKKSPL

SEQ ID NO: 3120310 - protein, 7 aa, Giardia lamblia
KTSFKRN

SEQ ID NO: 3120311 - protein, 8 aa, Giardia lamblia
KTSFTDST

SEQ ID NO: 3120312 - protein, 14 aa, Giardia lamblia
KTSGPGGTRKTTIM

SEQ ID NO: 3120313 - protein, 6 aa, Giardia lamblia
KTSHGR

SEQ ID NO: 3120314 - protein, 19 aa, Giardia lamblia
KTSKAARRKTGGRRKKNPA

SEQ ID NO: 3120315 - protein, 9 aa, Giardia lamblia
KTSKASGNV

SEQ ID NO: 3120316 - protein, 23 aa, Giardia lamblia
KTSLSSEKQRNKRLAEDVESGVS

SEQ ID NO: 3120317 - protein, 11 aa, Giardia lamblia
KTSNSSLSQRD

SEQ ID NO: 3120318 - protein, 10 aa, Giardia lamblia
KTSPDQLAKD

SEQ ID NO: 3120319 - protein, 7 aa, Giardia lamblia
KTSPTSL

SEQ ID NO: 3120320 - protein, 11 aa, Giardia lamblia
KTSQARAPGRA

SEQ ID NO: 3120321 - protein, 4 aa, Giardia lamblia
KTSR

SEQ ID NO: 3120322 - protein, 10 aa, Giardia lamblia
KTSSDSDKVA

SEQ ID NO: 3120323 - protein, 10 aa, Giardia lamblia
KTSSQYSDGM

SEQ ID NO: 3120324 - protein, 11 aa, Giardia lamblia
KTSSSANPQSV

SEQ ID NO: 3120325 - protein, 10 aa, Giardia lamblia
KTSTEKGPSL

SEQ ID NO: 3120326 - protein, 11 aa, Giardia lamblia
KTSTTTELQTE

SEQ ID NO: 3120327 - protein, 15 aa, Giardia lamblia
KTSVGTDITDQDSDR

SEQ ID NO: 3120328 - protein, 4 aa, Giardia lamblia
KTTA

SEQ ID NO: 3120329 - protein, 8 aa, Giardia lamblia
KTTADLSG

SEQ ID NO: 3120330 - protein, 7 aa, Giardia lamblia
KTTAGRT

SEQ ID NO: 3120331 - protein, 19 aa, Giardia lamblia
KTTAGTTSQTINAKNQGAF

SEQ ID NO: 3120332 - protein, 8 aa, Giardia lamblia
KTTAPSTI

SEQ ID NO: 3120333 - protein, 8 aa, Giardia lamblia
KTTASTGR

SEQ ID NO: 3120334 - protein, 7 aa, Giardia lamblia
KTTDGIV

SEQ ID NO: 3120335 - protein, 6 aa, Giardia lamblia
KTTDHD

SEQ ID NO: 3120336 - protein, 8 aa, Giardia lamblia
KTTEAQGL

SEQ ID NO: 3120337 - protein, 9 aa, Giardia lamblia
KTTERGVSQ

SEQ ID NO: 3120338 - protein, 11 aa, Giardia lamblia
KTTGTDGGRSA

SEQ ID NO: 3120339 - protein, 7 aa, Giardia lamblia
KTTISTP

SEQ ID NO: 3120340 - protein, 9 aa, Giardia lamblia
KTTKAAKQL

SEQ ID NO: 3120341 - protein, 6 aa, Giardia lamblia
KTTKNT

SEQ ID NO: 3120342 - protein, 14 aa, Giardia lamblia
KTTKTSHRDERYTQ

SEQ ID NO: 3120343 - protein, 21 aa, Giardia lamblia
KTTLRTSSRPTQSSTSEGIDT

SEQ ID NO: 3120344 - protein, 10 aa, Giardia lamblia
KTTNASDSSF

SEQ ID NO: 3120345 - protein, 8 aa, Giardia lamblia
KTTNDAIK

SEQ ID NO: 3120346 - protein, 11 aa, Giardia lamblia
KTTNDASSSMR

SEQ ID NO: 3120347 - protein, 8 aa, Giardia lamblia
KTTNLGGL

SEQ ID NO: 3120348 - protein, 7 aa, Giardia lamblia
KTTPADR

SEQ ID NO: 3120349 - protein, 4 aa, Giardia lamblia
KTTR

SEQ ID NO: 3120350 - protein, 16 aa, Giardia lamblia
KTTRREKRTLKPFSNG

SEQ ID NO: 3120351 - protein, 8 aa, Giardia lamblia
KTTSDCSS

SEQ ID NO: 3120352 - protein, 31 aa, Giardia lamblia
KTTSTTVAGEPSKSNQSTAKPRSKSARDAND

SEQ ID NO: 3120353 - protein, 6 aa, Giardia lamblia
KTTTER

SEQ ID NO: 3120354 - protein, 6 aa, Giardia lamblia
KTTVGT

SEQ ID NO: 3120355 - protein, 26 aa, Giardia lamblia
KTVARKAISKSEKAVTRRARPGSQVR

SEQ ID NO: 3120356 - protein, 17 aa, Giardia lamblia
KTVEKKAQLAPKSGVGR

SEQ ID NO: 3120357 - protein, 12 aa, Giardia lamblia
KTVKEKETAKVA

SEQ ID NO: 3120358 - protein, 5 aa, Giardia lamblia
KTVLG

SEQ ID NO: 3120359 - protein, 11 aa, Giardia lamblia
KTVPSSREYKP

SEQ ID NO: 3120360 - protein, 6 aa, Giardia lamblia
KTVQQD

SEQ ID NO: 3120361 - protein, 8 aa, Giardia lamblia
KTVTGKTK

SEQ ID NO: 3120362 - protein, 8 aa, Giardia lamblia
KTVVGGES

SEQ ID NO: 3120363 - protein, 9 aa, Giardia lamblia
KTWPSSDSI

SEQ ID NO: 3120364 - protein, 16 aa, Giardia lamblia
KTYDEGRGPDSDEEGH

SEQ ID NO: 3120365 - protein, 4 aa, Giardia lamblia
KTYE

SEQ ID NO: 3120366 - protein, 15 aa, Giardia lamblia
KTYGGGVRREDEAQQ

SEQ ID NO: 3120367 - protein, 5 aa, Giardia lamblia
KTYGS

SEQ ID NO: 3120368 - protein, 7 aa, Giardia lamblia
KTYKPSK

SEQ ID NO: 3120369 - protein, 6 aa, Giardia lamblia
KTYNAN

SEQ ID NO: 3120370 - protein, 7 aa, Giardia lamblia
KTYPGAN

SEQ ID NO: 3120371 - protein, 6 aa, Giardia lamblia
KTYSQR

SEQ ID NO: 3120372 - protein, 5 aa, Giardia lamblia
KTYST

SEQ ID NO: 3120373 - protein, 15 aa, Giardia lamblia
KTYSTPKKPFTKPRL

SEQ ID NO: 3120374 - protein, 23 aa, Giardia lamblia
KTYTPKPVAESNDQRADAEEQRL

SEQ ID NO: 3120375 - protein, 6 aa, Giardia lamblia
KVAENK

SEQ ID NO: 3120376 - protein, 7 aa, Giardia lamblia
KVAEQEK

SEQ ID NO: 3120377 - protein, 7 aa, Giardia lamblia
KVAGSDI

SEQ ID NO: 3120378 - protein, 9 aa, Giardia lamblia
KVANSQKTQ

SEQ ID NO: 3120379 - protein, 11 aa, Giardia lamblia
KVAPITTQPSA

SEQ ID NO: 3120380 - protein, 44 aa, Giardia lamblia
KVASESDEVEDNQAVDNEQDENTHSGSYTDENGEQRKAPPLINP

SEQ ID NO: 3120381 - protein, 8 aa, Giardia lamblia
KVASNGDT

SEQ ID NO: 3120382 - protein, 4 aa, Giardia lamblia
KVAY

SEQ ID NO: 3120383 - protein, 7 aa, Giardia lamblia
KVDADQA

SEQ ID NO: 3120384 - protein, 7 aa, Giardia lamblia
KVDGAQD

SEQ ID NO: 3120385 - protein, 7 aa, Giardia lamblia
KVDNDPK

SEQ ID NO: 3120386 - protein, 6 aa, Giardia lamblia
KVDPLD

SEQ ID NO: 3120387 - protein, 11 aa, Giardia lamblia
KVDQKSKADTR

SEQ ID NO: 3120388 - protein, 8 aa, Giardia lamblia
KVDREGRS

SEQ ID NO: 3120389 - protein, 18 aa, Giardia lamblia
KVDRPPQDALSVSSSATS

SEQ ID NO: 3120390 - protein, 4 aa, Giardia lamblia
KVDS

SEQ ID NO: 3120391 - protein, 9 aa, Giardia lamblia
KVDSDTNNL

SEQ ID NO: 3120392 - protein, 5 aa, Giardia lamblia
KVDSN

SEQ ID NO: 3120393 - protein, 6 aa, Giardia lamblia
KVEDPG

SEQ ID NO: 3120394 - protein, 15 aa, Giardia lamblia
KVEKSESSILSDWAD

SEQ ID NO: 3120395 - protein, 4 aa, Giardia lamblia
KVEN

SEQ ID NO: 3120396 - protein, 11 aa, Giardia lamblia
KVEPQKYYSTE

SEQ ID NO: 3120397 - protein, 8 aa, Giardia lamblia
KVERDPGY

SEQ ID NO: 3120398 - protein, 24 aa, Giardia lamblia
KVESSSLREQLAETEKRSNSLTDE

SEQ ID NO: 3120399 - protein, 10 aa, Giardia lamblia
KVESTTSDGV

SEQ ID NO: 3120400 - protein, 4 aa, Giardia lamblia
KVEY

SEQ ID NO: 3120401 - protein, 5 aa, Giardia lamblia
KVGDL

SEQ ID NO: 3120402 - protein, 8 aa, Giardia lamblia
KVGGRKPA

SEQ ID NO: 3120403 - protein, 6 aa, Giardia lamblia
KVGKTT

SEQ ID NO: 3120404 - protein, 7 aa, Giardia lamblia
KVGPGDA

SEQ ID NO: 3120405 - protein, 5 aa, Giardia lamblia
KVGRR

SEQ ID NO: 3120406 - protein, 42 aa, Giardia lamblia
KVGSESNSITAEEAPKPATTDPRRGSDAKEMRSSVDKEGSTA

SEQ ID NO: 3120407 - protein, 8 aa, Giardia lamblia
KVGSPGGF

SEQ ID NO: 3120408 - protein, 8 aa, Giardia lamblia
KVHGRAPR

SEQ ID NO: 3120409 - protein, 12 aa, Giardia lamblia
KVHSEDAKTPVQ

SEQ ID NO: 3120410 - protein, 10 aa, Giardia lamblia
KVHTTVKTNG

SEQ ID NO: 3120411 - protein, 10 aa, Giardia lamblia
KVISTRTGVP

SEQ ID NO: 3120412 - protein, 4 aa, Giardia lamblia
KVKD

SEQ ID NO: 3120413 - protein, 5 aa, Giardia lamblia
KVKEE

SEQ ID NO: 3120414 - protein, 14 aa, Giardia lamblia
KVKGLDDDEYANAK

SEQ ID NO: 3120415 - protein, 15 aa, Giardia lamblia
KVKKSQSATFAPRRP

SEQ ID NO: 3120416 - protein, 4 aa, Giardia lamblia
KVKP

SEQ ID NO: 3120417 - protein, 15 aa, Giardia lamblia
KVLDNSKKLKELSKK

SEQ ID NO: 3120418 - protein, 8 aa, Giardia lamblia
KVLKSGQW

SEQ ID NO: 3120419 - protein, 5 aa, Giardia lamblia
KVNKN

SEQ ID NO: 3120420 - protein, 8 aa, Giardia lamblia
KVPAPGSV

SEQ ID NO: 3120421 - protein, 5 aa, Giardia lamblia
KVPDK

SEQ ID NO: 3120422 - protein, 9 aa, Giardia lamblia
KVPDTSEPA

SEQ ID NO: 3120423 - protein, 7 aa, Giardia lamblia
KVPMPSG

SEQ ID NO: 3120424 - protein, 5 aa, Giardia lamblia
KVPPF

SEQ ID NO: 3120425 - protein, 8 aa, Giardia lamblia
KVPPQPLQ

SEQ ID NO: 3120426 - protein, 6 aa, Giardia lamblia
KVPSYH

SEQ ID NO: 3120427 - protein, 4 aa, Giardia lamblia
KVPT

SEQ ID NO: 3120428 - protein, 18 aa, Giardia lamblia
KVPTSQYSGISGMEPEGL

SEQ ID NO: 3120429 - protein, 6 aa, Giardia lamblia
KVQAKI

SEQ ID NO: 3120430 - protein, 4 aa, Giardia lamblia
KVQK

SEQ ID NO: 3120431 - protein, 10 aa, Giardia lamblia
KVQKGSDYPE

SEQ ID NO: 3120432 - protein, 9 aa, Giardia lamblia
KVQNEYEEK

SEQ ID NO: 3120433 - protein, 10 aa, Giardia lamblia
KVQQEKDKLT

SEQ ID NO: 3120434 - protein, 51 aa, Giardia lamblia
KVQRQKEEQERRIREAKEKQRAEWEKRNREYEKQMEEKRKAAQAAEDREKE

SEQ ID NO: 3120435 - protein, 7 aa, Giardia lamblia
KVREARE

SEQ ID NO: 3120436 - protein, 8 aa, Giardia lamblia
KVRKGQID

SEQ ID NO: 3120437 - protein, 22 aa, Giardia lamblia
KVRKGSQSGSSRSSADTVNPEE

SEQ ID NO: 3120438 - protein, 8 aa, Giardia lamblia
KVRQEAGN

SEQ ID NO: 3120439 - protein, 8 aa, Giardia lamblia
KVRQRRAA

SEQ ID NO: 3120440 - protein, 5 aa, Giardia lamblia
KVRRT

SEQ ID NO: 3120441 - protein, 8 aa, Giardia lamblia
KVRSSEDF

SEQ ID NO: 3120442 - protein, 8 aa, Giardia lamblia
KVRYDEPS

SEQ ID NO: 3120443 - protein, 14 aa, Giardia lamblia
KVSATGTPSLNEPY

SEQ ID NO: 3120444 - protein, 9 aa, Giardia lamblia
KVSDESKPV

SEQ ID NO: 3120445 - protein, 5 aa, Giardia lamblia
KVSLS

SEQ ID NO: 3120446 - protein, 7 aa, Giardia lamblia
KVSPHDV

SEQ ID NO: 3120447 - protein, 24 aa, Giardia lamblia
KVSQNPFAAGRTNDGTASPGPGYY

SEQ ID NO: 3120448 - protein, 6 aa, Giardia lamblia
KVSQTE

SEQ ID NO: 3120449 - protein, 11 aa, Giardia lamblia
KVSRREQGEHL

SEQ ID NO: 3120450 - protein, 14 aa, Giardia lamblia
KVSRSTQVYANQEK

SEQ ID NO: 3120451 - protein, 4 aa, Giardia lamblia
KVST

SEQ ID NO: 3120452 - protein, 7 aa, Giardia lamblia
KVTDDGN

SEQ ID NO: 3120453 - protein, 6 aa, Giardia lamblia
KVTDGQ

SEQ ID NO: 3120454 - protein, 9 aa, Giardia lamblia
KVTDQEAKL

SEQ ID NO: 3120455 - protein, 4 aa, Giardia lamblia
KVTE

SEQ ID NO: 3120456 - protein, 11 aa, Giardia lamblia
KVTEDKSNISR

SEQ ID NO: 3120457 - protein, 15 aa, Giardia lamblia
KVTGEELGKAGSKLK

SEQ ID NO: 3120458 - protein, 5 aa, Giardia lamblia
KVTPT

SEQ ID NO: 3120459 - protein, 4 aa, Giardia lamblia
KVTR

SEQ ID NO: 3120460 - protein, 8 aa, Giardia lamblia
KVTSDGTT

SEQ ID NO: 3120461 - protein, 21 aa, Giardia lamblia
KVTSEPLKESSKEPPKDQGHG

SEQ ID NO: 3120462 - protein, 20 aa, Giardia lamblia
KVTSGVTKSLTRQSRIEIYH

SEQ ID NO: 3120463 - protein, 9 aa, Giardia lamblia
KVTTAGENI

SEQ ID NO: 3120464 - protein, 7 aa, Giardia lamblia
KVTTRNE

SEQ ID NO: 3120465 - protein, 9 aa, Giardia lamblia
KVTVPTNNE

SEQ ID NO: 3120466 - protein, 11 aa, Giardia lamblia
KWGTSRAAKER

SEQ ID NO: 3120467 - protein, 7 aa, Giardia lamblia
KWKSSDD

SEQ ID NO: 3120468 - protein, 7 aa, Giardia lamblia
KWNGEKK

SEQ ID NO: 3120469 - protein, 6 aa, Giardia lamblia
KWNTDD

SEQ ID NO: 3120470 - protein, 7 aa, Giardia lamblia
KWPDNDL

SEQ ID NO: 3120471 - protein, 7 aa, Giardia lamblia
KWQQPAK

SEQ ID NO: 3120472 - protein, 8 aa, Giardia lamblia
KWTPEDDN

SEQ ID NO: 3120473 - protein, 5 aa, Giardia lamblia
KYAAT

SEQ ID NO: 3120474 - protein, 6 aa, Giardia lamblia
KYAEAI

SEQ ID NO: 3120475 - protein, 10 aa, Giardia lamblia
KYAEEPITAT

SEQ ID NO: 3120476 - protein, 10 aa, Giardia lamblia
KYAGATTTSH

SEQ ID NO: 3120477 - protein, 11 aa, Giardia lamblia
KYAGTRNDDGC

SEQ ID NO: 3120478 - protein, 51 aa, Giardia lamblia
KYAPRPHSKLPGSTIGSGISSAQSPPRLTPSASFSTPSCGTSTPSSCASSV

SEQ ID NO: 3120479 - protein, 7 aa, Giardia lamblia
KYAPTQK

SEQ ID NO: 3120480 - protein, 12 aa, Giardia lamblia
KYASERTRKKEE

SEQ ID NO: 3120481 - protein, 13 aa, Giardia lamblia
KYASQGSAKNGTD

SEQ ID NO: 3120482 - protein, 9 aa, Giardia lamblia
KYATQKRTE

SEQ ID NO: 3120483 - protein, 36 aa, Giardia lamblia
KYAVPDKPHTAATDNLESSKRFSRKRRSTDDLTPAA

SEQ ID NO: 3120484 - protein, 10 aa, Giardia lamblia
KYDDETNKYP

SEQ ID NO: 3120485 - protein, 5 aa, Giardia lamblia
KYDDQ

SEQ ID NO: 3120486 - protein, 4 aa, Giardia lamblia
KYDE

SEQ ID NO: 3120487 - protein, 11 aa, Giardia lamblia
KYDGHSGASTS

SEQ ID NO: 3120488 - protein, 6 aa, Giardia lamblia
KYDPDK

SEQ ID NO: 3120489 - protein, 5 aa, Giardia lamblia
KYDPK

SEQ ID NO: 3120490 - protein, 10 aa, Giardia lamblia
KYDSSTTAGH

SEQ ID NO: 3120491 - protein, 5 aa, Giardia lamblia
KYEDE

SEQ ID NO: 3120492 - protein, 9 aa, Giardia lamblia
KYEDSCPSS

SEQ ID NO: 3120493 - protein, 7 aa, Giardia lamblia
KYEGEKA

SEQ ID NO: 3120494 - protein, 4 aa, Giardia lamblia
KYEH

SEQ ID NO: 3120495 - protein, 8 aa, Giardia lamblia
KYESKQQQ

SEQ ID NO: 3120496 - protein, 7 aa, Giardia lamblia
KYETHAE

SEQ ID NO: 3120497 - protein, 5 aa, Giardia lamblia
KYGED

SEQ ID NO: 3120498 - protein, 22 aa, Giardia lamblia
KYGIPKNPQSRGALLPKIRDTR

SEQ ID NO: 3120499 - protein, 7 aa, Giardia lamblia
KYGKRDE

SEQ ID NO: 3120500 - protein, 8 aa, Giardia lamblia
KYGPTSAG

SEQ ID NO: 3120501 - protein, 4 aa, Giardia lamblia
KYGR

SEQ ID NO: 3120502 - protein, 15 aa, Giardia lamblia
KYGSSISNPPGKEVG

SEQ ID NO: 3120503 - protein, 5 aa, Giardia lamblia
KYGTV

SEQ ID NO: 3120504 - protein, 7 aa, Giardia lamblia
KYGVETS

SEQ ID NO: 3120505 - protein, 5 aa, Giardia lamblia
KYHNP

SEQ ID NO: 3120506 - protein, 25 aa, Giardia lamblia
KYIRSSSTSSLSTESSDSSTASQER

SEQ ID NO: 3120507 - protein, 9 aa, Giardia lamblia
KYITPESAR

SEQ ID NO: 3120508 - protein, 20 aa, Giardia lamblia
KYKAEGGPLTRELTRGDEFS

SEQ ID NO: 3120509 - protein, 11 aa, Giardia lamblia
KYKDSPRDAIN

SEQ ID NO: 3120510 - protein, 7 aa, Giardia lamblia
KYKEEQR

SEQ ID NO: 3120511 - protein, 6 aa, Giardia lamblia
KYKPEL

SEQ ID NO: 3120512 - protein, 29 aa, Giardia lamblia
KYKSRSGAANTPTAEGRTPQQHSTPLSMT

SEQ ID NO: 3120513 - protein, 6 aa, Giardia lamblia
KYKTHT

SEQ ID NO: 3120514 - protein, 8 aa, Giardia lamblia
KYKTSDNI

SEQ ID NO: 3120515 - protein, 4 aa, Giardia lamblia
KYNC

SEQ ID NO: 3120516 - protein, 9 aa, Giardia lamblia
KYNDELTNT

SEQ ID NO: 3120517 - protein, 5 aa, Giardia lamblia
KYNEI

SEQ ID NO: 3120518 - protein, 11 aa, Giardia lamblia
KYNGDSLRAGV

SEQ ID NO: 3120519 - protein, 9 aa, Giardia lamblia
KYPKPVAPE

SEQ ID NO: 3120520 - protein, 6 aa, Giardia lamblia
KYPPQA

SEQ ID NO: 3120521 - protein, 4 aa, Giardia lamblia
KYPR

SEQ ID NO: 3120522 - protein, 4 aa, Giardia lamblia
KYPS

SEQ ID NO: 3120523 - protein, 10 aa, Giardia lamblia
KYPSSMGGKF

SEQ ID NO: 3120524 - protein, 6 aa, Giardia lamblia
KYQEAV

SEQ ID NO: 3120525 - protein, 6 aa, Giardia lamblia
KYQEDN

SEQ ID NO: 3120526 - protein, 4 aa, Giardia lamblia
KYQP

SEQ ID NO: 3120527 - protein, 4 aa, Giardia lamblia
KYQR

SEQ ID NO: 3120528 - protein, 11 aa, Giardia lamblia
KYRANTDTKQH

SEQ ID NO: 3120529 - protein, 16 aa, Giardia lamblia
KYRDETDGSLHPKSKR

SEQ ID NO: 3120530 - protein, 33 aa, Giardia lamblia
KYRDQTERAQRSREDERAARSTFNSTGPARSVR

SEQ ID NO: 3120531 - protein, 5 aa, Giardia lamblia
KYRDS

SEQ ID NO: 3120532 - protein, 11 aa, Giardia lamblia
KYRGSKEIDAS

SEQ ID NO: 3120533 - protein, 5 aa, Giardia lamblia
KYRSQ

SEQ ID NO: 3120534 - protein, 7 aa, Giardia lamblia
KYRSTAN

SEQ ID NO: 3120535 - protein, 6 aa, Giardia lamblia
KYRTHP

SEQ ID NO: 3120536 - protein, 11 aa, Giardia lamblia
KYSAGEPLPTE

SEQ ID NO: 3120537 - protein, 9 aa, Giardia lamblia
KYSASSSNI

SEQ ID NO: 3120538 - protein, 20 aa, Giardia lamblia
KYSATNSSQNLSEISSMYIS

SEQ ID NO: 3120539 - protein, 35 aa, Giardia lamblia
KYSDSSSKQQSFSSGSYLNENSGDYSATARKQTAR

SEQ ID NO: 3120540 - protein, 12 aa, Giardia lamblia
KYSGYTESDTKK

SEQ ID NO: 3120541 - protein, 7 aa, Giardia lamblia
KYSPASD

SEQ ID NO: 3120542 - protein, 11 aa, Giardia lamblia
KYSPESKEEHK

SEQ ID NO: 3120543 - protein, 5 aa, Giardia lamblia
KYSPG

SEQ ID NO: 3120544 - protein, 7 aa, Giardia lamblia
KYSPSSD

SEQ ID NO: 3120545 - protein, 5 aa, Giardia lamblia
KYSQT

SEQ ID NO: 3120546 - protein, 8 aa, Giardia lamblia
KYSSEGAR

SEQ ID NO: 3120547 - protein, 11 aa, Giardia lamblia
KYTASGAPVSY

SEQ ID NO: 3120548 - protein, 5 aa, Giardia lamblia
KYTEG

SEQ ID NO: 3120549 - protein, 7 aa, Giardia lamblia
KYTEPSA

SEQ ID NO: 3120550 - protein, 10 aa, Giardia lamblia
KYTGEEHEAD

SEQ ID NO: 3120551 - protein, 7 aa, Giardia lamblia
KYTLGTD

SEQ ID NO: 3120552 - protein, 13 aa, Giardia lamblia
KYTNQTQDVEDKQ

SEQ ID NO: 3120553 - protein, 6 aa, Giardia lamblia
KYTPYK

SEQ ID NO: 3120554 - protein, 17 aa, Giardia lamblia
KYTSSANSSEHIDGKPD

SEQ ID NO: 3120555 - protein, 10 aa, Giardia lamblia
KYTTTGYGTN

SEQ ID NO: 3120556 - protein, 10 aa, Giardia lamblia
KYVPKSDSSK

SEQ ID NO: 3120557 - protein, 6 aa, Giardia lamblia
KYVSED

SEQ ID NO: 3120558 - protein, 11 aa, Giardia lamblia
KYVSERRRRRI

SEQ ID NO: 3120559 - protein, 10 aa, Giardia lamblia
LAAAQRPISV

SEQ ID NO: 3120560 - protein, 16 aa, Giardia lamblia
LAAEGKSLDEDQQKAL

SEQ ID NO: 3120561 - protein, 8 aa, Giardia lamblia
LAAKASQL

SEQ ID NO: 3120562 - protein, 8 aa, Giardia lamblia
LAAKDRGL

SEQ ID NO: 3120563 - protein, 6 aa, Giardia lamblia
LAAKEE

SEQ ID NO: 3120564 - protein, 9 aa, Giardia lamblia
LAAKGTLTA

SEQ ID NO: 3120565 - protein, 23 aa, Giardia lamblia
LAAKSAGADIPKEQFGETSKTLE

SEQ ID NO: 3120566 - protein, 8 aa, Giardia lamblia
LAAKSPMR

SEQ ID NO: 3120567 - protein, 12 aa, Giardia lamblia
LAAPKSSIPETD

SEQ ID NO: 3120568 - protein, 11 aa, Giardia lamblia
LAAPPPETADV

SEQ ID NO: 3120569 - protein, 16 aa, Giardia lamblia
LAAPRKPASPTQNRLA

SEQ ID NO: 3120570 - protein, 15 aa, Giardia lamblia
LAAQEEQEEAEEEEE

SEQ ID NO: 3120571 - protein, 7 aa, Giardia lamblia
LAAQNEE

SEQ ID NO: 3120572 - protein, 8 aa, Giardia lamblia
LAAQSGAK

SEQ ID NO: 3120573 - protein, 7 aa, Giardia lamblia
LAASANA

SEQ ID NO: 3120574 - protein, 10 aa, Giardia lamblia
LAASKAKIKS

SEQ ID NO: 3120575 - protein, 22 aa, Giardia lamblia
LAASNELNTDLTSNSESSVKSI

SEQ ID NO: 3120576 - protein, 7 aa, Giardia lamblia
LAASSES

SEQ ID NO: 3120577 - protein, 8 aa, Giardia lamblia
LAATRDEY

SEQ ID NO: 3120578 - protein, 7 aa, Giardia lamblia
LAATSER

SEQ ID NO: 3120579 - protein, 8 aa, Giardia lamblia
LADAKEAR

SEQ ID NO: 3120580 - protein, 12 aa, Giardia lamblia
LADAKNADEDRK

SEQ ID NO: 3120581 - protein, 6 aa, Giardia lamblia
LADDRK

SEQ ID NO: 3120582 - protein, 12 aa, Giardia lamblia
LADGSASREWGS

SEQ ID NO: 3120583 - protein, 5 aa, Giardia lamblia
LADGT

SEQ ID NO: 3120584 - protein, 8 aa, Giardia lamblia
LADNDGKT

SEQ ID NO: 3120585 - protein, 8 aa, Giardia lamblia
LADNEGST

SEQ ID NO: 3120586 - protein, 7 aa, Giardia lamblia
LADNRSM

SEQ ID NO: 3120587 - protein, 8 aa, Giardia lamblia
LADNSSTK

SEQ ID NO: 3120588 - protein, 12 aa, Giardia lamblia
LADPEEAPSSNV

SEQ ID NO: 3120589 - protein, 11 aa, Giardia lamblia
LADQHEREEQL

SEQ ID NO: 3120590 - protein, 5 aa, Giardia lamblia
LADQY

SEQ ID NO: 3120591 - protein, 11 aa, Giardia lamblia
LADSKADHARE

SEQ ID NO: 3120592 - protein, 13 aa, Giardia lamblia
LADTKQTRKRGRF

SEQ ID NO: 3120593 - protein, 7 aa, Giardia lamblia
LADTQNK

SEQ ID NO: 3120594 - protein, 17 aa, Giardia lamblia
LADTSNSLKDECARERA

SEQ ID NO: 3120595 - protein, 10 aa, Giardia lamblia
LAEARQQIAN

SEQ ID NO: 3120596 - protein, 10 aa, Giardia lamblia
LAEATDTIET

SEQ ID NO: 3120597 - protein, 6 aa, Giardia lamblia
LAEDMN

SEQ ID NO: 3120598 - protein, 12 aa, Giardia lamblia
LAEEDGDALVES

SEQ ID NO: 3120599 - protein, 38 aa, Giardia lamblia
LAEEEDKTQSKKGSGSAGKRTGQIPEQQKRSESRRTLS

SEQ ID NO: 3120600 - protein, 13 aa, Giardia lamblia
LAEEKDMVDNDGR

SEQ ID NO: 3120601 - protein, 8 aa, Giardia lamblia
LAEENEKL

SEQ ID NO: 3120602 - protein, 8 aa, Giardia lamblia
LAEESGIP

SEQ ID NO: 3120603 - protein, 5 aa, Giardia lamblia
LAEGG

SEQ ID NO: 3120604 - protein, 12 aa, Giardia lamblia
LAEGSAREREAP

SEQ ID NO: 3120605 - protein, 10 aa, Giardia lamblia
LAEKEGPISG

SEQ ID NO: 3120606 - protein, 11 aa, Giardia lamblia
LAEKGEPGIVP

SEQ ID NO: 3120607 - protein, 16 aa, Giardia lamblia
LAEKQQELDDAHTDYE

SEQ ID NO: 3120608 - protein, 20 aa, Giardia lamblia
LAEKTREAESLRGETTSTKL

SEQ ID NO: 3120609 - protein, 11 aa, Giardia lamblia
LAEPRKDFNAT

SEQ ID NO: 3120610 - protein, 22 aa, Giardia lamblia
LAEQEKNLGESWRSALQPALES

SEQ ID NO: 3120611 - protein, 5 aa, Giardia lamblia
LAEQG

SEQ ID NO: 3120612 - protein, 5 aa, Giardia lamblia
LAEQS

SEQ ID NO: 3120613 - protein, 10 aa, Giardia lamblia
LAEQSRANSA

SEQ ID NO: 3120614 - protein, 4 aa, Giardia lamblia
LAER

SEQ ID NO: 3120615 - protein, 7 aa, Giardia lamblia
LAERQEE

SEQ ID NO: 3120616 - protein, 8 aa, Giardia lamblia
LAERSGKT

SEQ ID NO: 3120617 - protein, 8 aa, Giardia lamblia
LAESETEY

SEQ ID NO: 3120618 - protein, 12 aa, Giardia lamblia
LAESGRSDYRHE

SEQ ID NO: 3120619 - protein, 7 aa, Giardia lamblia
LAESPTY

SEQ ID NO: 3120620 - protein, 9 aa, Giardia lamblia
LAESQGEIA

SEQ ID NO: 3120621 - protein, 11 aa, Giardia lamblia
LAESSQRNAAL

SEQ ID NO: 3120622 - protein, 10 aa, Giardia lamblia
LAESTPEAAA

SEQ ID NO: 3120623 - protein, 5 aa, Giardia lamblia
LAETV

SEQ ID NO: 3120624 - protein, 7 aa, Giardia lamblia
LAEYDEE

SEQ ID NO: 3120625 - protein, 6 aa, Giardia lamblia
LAFSSE

SEQ ID NO: 3120626 - protein, 10 aa, Giardia lamblia
LAGAKGGNGL

SEQ ID NO: 3120627 - protein, 12 aa, Giardia lamblia
LAGAPESEADKA

SEQ ID NO: 3120628 - protein, 13 aa, Giardia lamblia
LAGDKAREAEEAR

SEQ ID NO: 3120629 - protein, 61 aa, Giardia lamblia
LAGDTTTSQPIQGKSTPKGNTSSPVRGSMSARAAKQTRISPGIDTTGDPHDVETSIAEASQ

SEQ ID NO: 3120630 - protein, 7 aa, Giardia lamblia
LAGEPYG

SEQ ID NO: 3120631 - protein, 8 aa, Giardia lamblia
LAGGDTAA

SEQ ID NO: 3120632 - protein, 7 aa, Giardia lamblia
LAGGSPT

SEQ ID NO: 3120633 - protein, 4 aa, Giardia lamblia
LAGI

SEQ ID NO: 3120634 - protein, 5 aa, Giardia lamblia
LAGIS

SEQ ID NO: 3120635 - protein, 8 aa, Giardia lamblia
LAGKEPDQ

SEQ ID NO: 3120636 - protein, 11 aa, Giardia lamblia
LAGKGTRSSTQ

SEQ ID NO: 3120637 - protein, 9 aa, Giardia lamblia
LAGKTTLAN

SEQ ID NO: 3120638 - protein, 17 aa, Giardia lamblia
LAGNRERAISAGEPSDM

SEQ ID NO: 3120639 - protein, 8 aa, Giardia lamblia
LAGNSPTK

SEQ ID NO: 3120640 - protein, 4 aa, Giardia lamblia
LAGP

SEQ ID NO: 3120641 - protein, 8 aa, Giardia lamblia
LAGQGAGF

SEQ ID NO: 3120642 - protein, 14 aa, Giardia lamblia
LAGQSRDGGPLQTV

SEQ ID NO: 3120643 - protein, 15 aa, Giardia lamblia
LAGRKGEGLDPDLSK

SEQ ID NO: 3120644 - protein, 7 aa, Giardia lamblia
LAGRPVS

SEQ ID NO: 3120645 - protein, 9 aa, Giardia lamblia
LAGTSPTKR

SEQ ID NO: 3120646 - protein, 12 aa, Giardia lamblia
LAGTTAPNIGDP

SEQ ID NO: 3120647 - protein, 4 aa, Giardia lamblia
LAKA

SEQ ID NO: 3120648 - protein, 14 aa, Giardia lamblia
LAKAQGDAENERRK

SEQ ID NO: 3120649 - protein, 13 aa, Giardia lamblia
LAKATDGDNELGQ

SEQ ID NO: 3120650 - protein, 9 aa, Giardia lamblia
LAKDQEIDQ

SEQ ID NO: 3120651 - protein, 9 aa, Giardia lamblia
LAKEKDSAY

SEQ ID NO: 3120652 - protein, 7 aa, Giardia lamblia
LAKGSNI

SEQ ID NO: 3120653 - protein, 8 aa, Giardia lamblia
LAKKDGST

SEQ ID NO: 3120654 - protein, 15 aa, Giardia lamblia
LAKKPDAQEGLQTPV

SEQ ID NO: 3120655 - protein, 19 aa, Giardia lamblia
LAKLQSSSGSHSRKYSSIS

SEQ ID NO: 3120656 - protein, 10 aa, Giardia lamblia
LAKPDSIKNP

SEQ ID NO: 3120657 - protein, 15 aa, Giardia lamblia
LAKSGNASLTPGASA

SEQ ID NO: 3120658 - protein, 15 aa, Giardia lamblia
LAKSRGVEASLGPER

SEQ ID NO: 3120659 - protein, 6 aa, Giardia lamblia
LAKSVA

SEQ ID NO: 3120660 - protein, 13 aa, Giardia lamblia
LAKTKSAKEQLKD

SEQ ID NO: 3120661 - protein, 13 aa, Giardia lamblia
LANASTAPQSQYR

SEQ ID NO: 3120662 - protein, 8 aa, Giardia lamblia
LANGNETD

SEQ ID NO: 3120663 - protein, 20 aa, Giardia lamblia
LANPRTKEDSVIETEPKATI

SEQ ID NO: 3120664 - protein, 8 aa, Giardia lamblia
LANSATSL

SEQ ID NO: 3120665 - protein, 9 aa, Giardia lamblia
LANSEDQIQ

SEQ ID NO: 3120666 - protein, 18 aa, Giardia lamblia
LANTDKSDLQMGPSMSRS

SEQ ID NO: 3120667 - protein, 5 aa, Giardia lamblia
LANTS

SEQ ID NO: 3120668 - protein, 57 aa, Giardia lamblia
LANTTSPDRHAATSRSGASGSNPMHSPSRSSPTRGVVNSSPSRQPDIARTSGTDRVR

SEQ ID NO: 3120669 - protein, 5 aa, Giardia lamblia
LANYE

SEQ ID NO: 3120670 - protein, 4 aa, Giardia lamblia
LAPA

SEQ ID NO: 3120671 - protein, 17 aa, Giardia lamblia
LAPAPLKEQAKDARERE

SEQ ID NO: 3120672 - protein, 4 aa, Giardia lamblia
LAPD

SEQ ID NO: 3120673 - protein, 6 aa, Giardia lamblia
LAPDLA

SEQ ID NO: 3120674 - protein, 6 aa, Giardia lamblia
LAPDSK

SEQ ID NO: 3120675 - protein, 11 aa, Giardia lamblia
LAPDSTNVQYK

SEQ ID NO: 3120676 - protein, 8 aa, Giardia lamblia
LAPEAPAS

SEQ ID NO: 3120677 - protein, 6 aa, Giardia lamblia
LAPEIP

SEQ ID NO: 3120678 - protein, 5 aa, Giardia lamblia
LAPER

SEQ ID NO: 3120679 - protein, 5 aa, Giardia lamblia
LAPFT

SEQ ID NO: 3120680 - protein, 4 aa, Giardia lamblia
LAPG

SEQ ID NO: 3120681 - protein, 6 aa, Giardia lamblia
LAPGEQ

SEQ ID NO: 3120682 - protein, 7 aa, Giardia lamblia
LAPGETQ

SEQ ID NO: 3120683 - protein, 7 aa, Giardia lamblia
LAPGTSQ

SEQ ID NO: 3120684 - protein, 7 aa, Giardia lamblia
LAPKGLK

SEQ ID NO: 3120685 - protein, 6 aa, Giardia lamblia
LAPNSS

SEQ ID NO: 3120686 - protein, 4 aa, Giardia lamblia
LAPP

SEQ ID NO: 3120687 - protein, 18 aa, Giardia lamblia
LAPPEKSEEHKRLEAEEH

SEQ ID NO: 3120688 - protein, 6 aa, Giardia lamblia
LAPPES

SEQ ID NO: 3120689 - protein, 6 aa, Giardia lamblia
LAPPGA

SEQ ID NO: 3120690 - protein, 18 aa, Giardia lamblia
LAPPGAPRLPRSDDDPPL

SEQ ID NO: 3120691 - protein, 8 aa, Giardia lamblia
LAPPKPSW

SEQ ID NO: 3120692 - protein, 8 aa, Giardia lamblia
LAPPSQWD

SEQ ID NO: 3120693 - protein, 4 aa, Giardia lamblia
LAPQ

SEQ ID NO: 3120694 - protein, 26 aa, Giardia lamblia
LAPQAEPEPEPESSTAAHDSKPPVYN

SEQ ID NO: 3120695 - protein, 4 aa, Giardia lamblia
LAPR

SEQ ID NO: 3120696 - protein, 14 aa, Giardia lamblia
LAPSALAQSQGPVP

SEQ ID NO: 3120697 - protein, 11 aa, Giardia lamblia
LAPSDLPGRQI

SEQ ID NO: 3120698 - protein, 7 aa, Giardia lamblia
LAPSEGR

SEQ ID NO: 3120699 - protein, 22 aa, Giardia lamblia
LAPSGSMTPVGNSSAKRTPQEG

SEQ ID NO: 3120700 - protein, 6 aa, Giardia lamblia
LAPVES

SEQ ID NO: 3120701 - protein, 6 aa, Giardia lamblia
LAQAST

SEQ ID NO: 3120702 - protein, 10 aa, Giardia lamblia
LAQDKKDLSA

SEQ ID NO: 3120703 - protein, 6 aa, Giardia lamblia
LAQEPA

SEQ ID NO: 3120704 - protein, 11 aa, Giardia lamblia
LAQERENAASE

SEQ ID NO: 3120705 - protein, 7 aa, Giardia lamblia
LAQESEK

SEQ ID NO: 3120706 - protein, 22 aa, Giardia lamblia
LAQGSTNNMAASTSMASGQGPQ

SEQ ID NO: 3120707 - protein, 4 aa, Giardia lamblia
LAQK

SEQ ID NO: 3120708 - protein, 10 aa, Giardia lamblia
LAQKERRRER

SEQ ID NO: 3120709 - protein, 4 aa, Giardia lamblia
LAQP

SEQ ID NO: 3120710 - protein, 38 aa, Giardia lamblia
LAQPATAKAATKPEAADVKPGTETKARPPPKSSVPAPL

SEQ ID NO: 3120711 - protein, 9 aa, Giardia lamblia
LAQPETSNA

SEQ ID NO: 3120712 - protein, 5 aa, Giardia lamblia
LAQPV

SEQ ID NO: 3120713 - protein, 12 aa, Giardia lamblia
LAQQERAAERAI

SEQ ID NO: 3120714 - protein, 14 aa, Giardia lamblia
LAQRDGSIEALSSQ

SEQ ID NO: 3120715 - protein, 16 aa, Giardia lamblia
LAQRTDAEEVEGEASY

SEQ ID NO: 3120716 - protein, 11 aa, Giardia lamblia
LAQSASNEECK

SEQ ID NO: 3120717 - protein, 5 aa, Giardia lamblia
LAQSG

SEQ ID NO: 3120718 - protein, 14 aa, Giardia lamblia
LAQTAALDTGNSVG

SEQ ID NO: 3120719 - protein, 11 aa, Giardia lamblia
LAQTKEALAKA

SEQ ID NO: 3120720 - protein, 11 aa, Giardia lamblia
LAQTPEKDPYL

SEQ ID NO: 3120721 - protein, 10 aa, Giardia lamblia
LARGPPPPCP

SEQ ID NO: 3120722 - protein, 7 aa, Giardia lamblia
LARGTSY

SEQ ID NO: 3120723 - protein, 12 aa, Giardia lamblia
LARKKVEEQKLR

SEQ ID NO: 3120724 - protein, 12 aa, Giardia lamblia
LARLDPSGTVMP

SEQ ID NO: 3120725 - protein, 5 aa, Giardia lamblia
LARPS

SEQ ID NO: 3120726 - protein, 15 aa, Giardia lamblia
LARQASSTGQSPREL

SEQ ID NO: 3120727 - protein, 11 aa, Giardia lamblia
LARQQASAAIE

SEQ ID NO: 3120728 - protein, 11 aa, Giardia lamblia
LARQTSQLSGS

SEQ ID NO: 3120729 - protein, 8 aa, Giardia lamblia
LARRDGTT

SEQ ID NO: 3120730 - protein, 34 aa, Giardia lamblia
LARSSMSRDSTMGLSSGSPAVSHGRPLPRGVGDG

SEQ ID NO: 3120731 - protein, 8 aa, Giardia lamblia
LARSTKPV

SEQ ID NO: 3120732 - protein, 14 aa, Giardia lamblia
LARTKERLKESEEQ

SEQ ID NO: 3120733 - protein, 7 aa, Giardia lamblia
LARTREE

SEQ ID NO: 3120734 - protein, 9 aa, Giardia lamblia
LARTSARKT

SEQ ID NO: 3120735 - protein, 13 aa, Giardia lamblia
LARTTKLKDDEIR

SEQ ID NO: 3120736 - protein, 8 aa, Giardia lamblia
LASAARNI

SEQ ID NO: 3120737 - protein, 11 aa, Giardia lamblia
LASAEKKVDDL

SEQ ID NO: 3120738 - protein, 10 aa, Giardia lamblia
LASAPSGISN

SEQ ID NO: 3120739 - protein, 10 aa, Giardia lamblia
LASDSRPLTR

SEQ ID NO: 3120740 - protein, 20 aa, Giardia lamblia
LASDTSKCFPSDTLDDQQTD

SEQ ID NO: 3120741 - protein, 8 aa, Giardia lamblia
LASEDPIG

SEQ ID NO: 3120742 - protein, 8 aa, Giardia lamblia
LASEQTRL

SEQ ID NO: 3120743 - protein, 15 aa, Giardia lamblia
LASEREKERPPSEEE

SEQ ID NO: 3120744 - protein, 14 aa, Giardia lamblia
LASGNDGNIVAFCP

SEQ ID NO: 3120745 - protein, 9 aa, Giardia lamblia
LASGNSKEL

SEQ ID NO: 3120746 - protein, 8 aa, Giardia lamblia
LASGPGPF

SEQ ID NO: 3120747 - protein, 8 aa, Giardia lamblia
LASGSSDT

SEQ ID NO: 3120748 - protein, 7 aa, Giardia lamblia
LASGTTD

SEQ ID NO: 3120749 - protein, 7 aa, Giardia lamblia
LASHKDR

SEQ ID NO: 3120750 - protein, 16 aa, Giardia lamblia
LASKASTHSNQYDTSD

SEQ ID NO: 3120751 - protein, 8 aa, Giardia lamblia
LASKATSF

SEQ ID NO: 3120752 - protein, 36 aa, Giardia lamblia
LASKPEQKANPAETSKPEEKTNPPLVRSYADKFLGR

SEQ ID NO: 3120753 - protein, 10 aa, Giardia lamblia
LASKRAAAQE

SEQ ID NO: 3120754 - protein, 18 aa, Giardia lamblia
LASNASPRQSVGSSSRQQ

SEQ ID NO: 3120755 - protein, 8 aa, Giardia lamblia
LASNGEYA

SEQ ID NO: 3120756 - protein, 7 aa, Giardia lamblia
LASNKKD

SEQ ID NO: 3120757 - protein, 5 aa, Giardia lamblia
LASPT

SEQ ID NO: 3120758 - protein, 15 aa, Giardia lamblia
LASQGVGAAQPHSDE

SEQ ID NO: 3120759 - protein, 9 aa, Giardia lamblia
LASQQEERT

SEQ ID NO: 3120760 - protein, 4 aa, Giardia lamblia
LASR

SEQ ID NO: 3120761 - protein, 16 aa, Giardia lamblia
LASRPESKSCNDPTSH

SEQ ID NO: 3120762 - protein, 6 aa, Giardia lamblia
LASRQM

SEQ ID NO: 3120763 - protein, 12 aa, Giardia lamblia
LASRRGGSVPSN

SEQ ID NO: 3120764 - protein, 11 aa, Giardia lamblia
LASSAGLETRM

SEQ ID NO: 3120765 - protein, 7 aa, Giardia lamblia
LASSEPL

SEQ ID NO: 3120766 - protein, 7 aa, Giardia lamblia
LASSEPM

SEQ ID NO: 3120767 - protein, 6 aa, Giardia lamblia
LASSGS

SEQ ID NO: 3120768 - protein, 5 aa, Giardia lamblia
LASSH

SEQ ID NO: 3120769 - protein, 7 aa, Giardia lamblia
LASSNLT

SEQ ID NO: 3120770 - protein, 18 aa, Giardia lamblia
LASSTGVPRMDGSTYSMP

SEQ ID NO: 3120771 - protein, 6 aa, Giardia lamblia
LASSYS

SEQ ID NO: 3120772 - protein, 38 aa, Giardia lamblia
LASTGGATKFGTTGGKKSSSAAQNKRGPPTNLRGETQS

SEQ ID NO: 3120773 - protein, 9 aa, Giardia lamblia
LASTPTREV

SEQ ID NO: 3120774 - protein, 10 aa, Giardia lamblia
LASTRSHSTI

SEQ ID NO: 3120775 - protein, 13 aa, Giardia lamblia
LATAAGASQVQGD

SEQ ID NO: 3120776 - protein, 5 aa, Giardia lamblia
LATAD

SEQ ID NO: 3120777 - protein, 39 aa, Giardia lamblia
LATAPPADPHAGTSSLAQELPSQTSNLPPNRLSDPESVS

SEQ ID NO: 3120778 - protein, 15 aa, Giardia lamblia
LATARPAKSPSPPQL

SEQ ID NO: 3120779 - protein, 5 aa, Giardia lamblia
LATDH

SEQ ID NO: 3120780 - protein, 11 aa, Giardia lamblia
LATDPEPTVPL

SEQ ID NO: 3120781 - protein, 7 aa, Giardia lamblia
LATESRT

SEQ ID NO: 3120782 - protein, 14 aa, Giardia lamblia
LATESYVSADGDYY

SEQ ID NO: 3120783 - protein, 7 aa, Giardia lamblia
LATGGYD

SEQ ID NO: 3120784 - protein, 8 aa, Giardia lamblia
LATGSISS

SEQ ID NO: 3120785 - protein, 10 aa, Giardia lamblia
LATGSKDGTV

SEQ ID NO: 3120786 - protein, 6 aa, Giardia lamblia
LATNAG

SEQ ID NO: 3120787 - protein, 8 aa, Giardia lamblia
LATPDEKW

SEQ ID NO: 3120788 - protein, 13 aa, Giardia lamblia
LATPKHGDSGQAP

SEQ ID NO: 3120789 - protein, 11 aa, Giardia lamblia
LATPSIDTVEQ

SEQ ID NO: 3120790 - protein, 5 aa, Giardia lamblia
LATPT

SEQ ID NO: 3120791 - protein, 9 aa, Giardia lamblia
LATQPDCSS

SEQ ID NO: 3120792 - protein, 15 aa, Giardia lamblia
LATQTSTFEKDVSEE

SEQ ID NO: 3120793 - protein, 15 aa, Giardia lamblia
LATRDSLTGAPQTPT

SEQ ID NO: 3120794 - protein, 8 aa, Giardia lamblia
LATSEDLA

SEQ ID NO: 3120795 - protein, 15 aa, Giardia lamblia
LATYSSAQSISGQGT

SEQ ID NO: 3120796 - protein, 8 aa, Giardia lamblia
LAVQEKNA

SEQ ID NO: 3120797 - protein, 17 aa, Giardia lamblia
LCDPTESAENLKTDADV

SEQ ID NO: 3120798 - protein, 9 aa, Giardia lamblia
LCPPEKDSQ

SEQ ID NO: 3120799 - protein, 11 aa, Giardia lamblia
LCSSPSGNQTI

SEQ ID NO: 3120800 - protein, 20 aa, Giardia lamblia
LDAAERTEAERRALDEKRHA

SEQ ID NO: 3120801 - protein, 8 aa, Giardia lamblia
LDAATQDQ

SEQ ID NO: 3120802 - protein, 7 aa, Giardia lamblia
LDADEDS

SEQ ID NO: 3120803 - protein, 32 aa, Giardia lamblia
LDADSDNENTAKDAESKEGQKGETSTTFGTPG

SEQ ID NO: 3120804 - protein, 4 aa, Giardia lamblia
LDAE

SEQ ID NO: 3120805 - protein, 7 aa, Giardia lamblia
LDAEQAA

SEQ ID NO: 3120806 - protein, 12 aa, Giardia lamblia
LDAEQDKIETKS

SEQ ID NO: 3120807 - protein, 4 aa, Giardia lamblia
LDAG

SEQ ID NO: 3120808 - protein, 6 aa, Giardia lamblia
LDAGAS

SEQ ID NO: 3120809 - protein, 12 aa, Giardia lamblia
LDAGGSDPAHFT

SEQ ID NO: 3120810 - protein, 4 aa, Giardia lamblia
LDAK

SEQ ID NO: 3120811 - protein, 15 aa, Giardia lamblia
LDAKSSDVKNTSNFG

SEQ ID NO: 3120812 - protein, 26 aa, Giardia lamblia
LDANDGSTRGSRSSACPCQEVALTCC

SEQ ID NO: 3120813 - protein, 13 aa, Giardia lamblia
LDANSADNRERAA

SEQ ID NO: 3120814 - protein, 13 aa, Giardia lamblia
LDASGSGAPSYGV

SEQ ID NO: 3120815 - protein, 9 aa, Giardia lamblia
LDATTDGDK

SEQ ID NO: 3120816 - protein, 15 aa, Giardia lamblia
LDDDSEGKAMTGDEL

SEQ ID NO: 3120817 - protein, 6 aa, Giardia lamblia
LDDEES

SEQ ID NO: 3120818 - protein, 12 aa, Giardia lamblia
LDDKIAKSKETV

SEQ ID NO: 3120819 - protein, 29 aa, Giardia lamblia
LDDQDCEGCPKAQIDDGRHGTPSVAPSSS

SEQ ID NO: 3120820 - protein, 7 aa, Giardia lamblia
LDDRTEQ

SEQ ID NO: 3120821 - protein, 8 aa, Giardia lamblia
LDDSEEDI

SEQ ID NO: 3120822 - protein, 6 aa, Giardia lamblia
LDDSSF

SEQ ID NO: 3120823 - protein, 6 aa, Giardia lamblia
LDEAEE

SEQ ID NO: 3120824 - protein, 15 aa, Giardia lamblia
LDEAKTLGDYSIGES

SEQ ID NO: 3120825 - protein, 16 aa, Giardia lamblia
LDEASSDYDDDDLGTV

SEQ ID NO: 3120826 - protein, 26 aa, Giardia lamblia
LDEDAKRRKGKKGKKGKKGKKGTKGK

SEQ ID NO: 3120827 - protein, 6 aa, Giardia lamblia
LDEDEV

SEQ ID NO: 3120828 - protein, 11 aa, Giardia lamblia
LDEDRKLSRKN

SEQ ID NO: 3120829 - protein, 11 aa, Giardia lamblia
LDEEDKRTAQR

SEQ ID NO: 3120830 - protein, 6 aa, Giardia lamblia
LDEEQA

SEQ ID NO: 3120831 - protein, 6 aa, Giardia lamblia
LDEEQS

SEQ ID NO: 3120832 - protein, 5 aa, Giardia lamblia
LDEGR

SEQ ID NO: 3120833 - protein, 7 aa, Giardia lamblia
LDEKERV

SEQ ID NO: 3120834 - protein, 13 aa, Giardia lamblia
LDEKGHKDKQGQT

SEQ ID NO: 3120835 - protein, 12 aa, Giardia lamblia
LDEKGKKDRQGL

SEQ ID NO: 3120836 - protein, 13 aa, Giardia lamblia
LDEKGQRDKRGQT

SEQ ID NO: 3120837 - protein, 17 aa, Giardia lamblia
LDEKTRKQYTDSYEEQT

SEQ ID NO: 3120838 - protein, 9 aa, Giardia lamblia
LDELADKST

SEQ ID NO: 3120839 - protein, 9 aa, Giardia lamblia
LDELQNKGL

SEQ ID NO: 3120840 - protein, 9 aa, Giardia lamblia
LDENGNSTV

SEQ ID NO: 3120841 - protein, 20 aa, Giardia lamblia
LDENPSENTLDTTITDQDRD

SEQ ID NO: 3120842 - protein, 6 aa, Giardia lamblia
LDEQGG

SEQ ID NO: 3120843 - protein, 8 aa, Giardia lamblia
LDERKAAA

SEQ ID NO: 3120844 - protein, 10 aa, Giardia lamblia
LDERKANRTM

SEQ ID NO: 3120845 - protein, 6 aa, Giardia lamblia
LDERVT

SEQ ID NO: 3120846 - protein, 6 aa, Giardia lamblia
LDESGN

SEQ ID NO: 3120847 - protein, 12 aa, Giardia lamblia
LDESLAKESTLS

SEQ ID NO: 3120848 - protein, 12 aa, Giardia lamblia
LDESRQDNTKKA

SEQ ID NO: 3120849 - protein, 11 aa, Giardia lamblia
LDESSHGEGTD

SEQ ID NO: 3120850 - protein, 13 aa, Giardia lamblia
LDESVEGTAGPIN

SEQ ID NO: 3120851 - protein, 18 aa, Giardia lamblia
LDETRAQKVTVEAGKNDL

SEQ ID NO: 3120852 - protein, 12 aa, Giardia lamblia
LDFPDEPGCEGQ

SEQ ID NO: 3120853 - protein, 9 aa, Giardia lamblia
LDGARSETS

SEQ ID NO: 3120854 - protein, 5 aa, Giardia lamblia
LDGAS

SEQ ID NO: 3120855 - protein, 14 aa, Giardia lamblia
LDGDGKPRAEDGGF

SEQ ID NO: 3120856 - protein, 11 aa, Giardia lamblia
LDGDTSENGDL

SEQ ID NO: 3120857 - protein, 21 aa, Giardia lamblia
LDGEKGRTIAPPNGAQGERNN

SEQ ID NO: 3120858 - protein, 9 aa, Giardia lamblia
LDGGAPKTY

SEQ ID NO: 3120859 - protein, 14 aa, Giardia lamblia
LDGGSGQAASRFTR

SEQ ID NO: 3120860 - protein, 10 aa, Giardia lamblia
LDGKDQEGGK

SEQ ID NO: 3120861 - protein, 10 aa, Giardia lamblia
LDGKKPDEAR

SEQ ID NO: 3120862 - protein, 9 aa, Giardia lamblia
LDGLGKGNV

SEQ ID NO: 3120863 - protein, 10 aa, Giardia lamblia
LDGNQGDVHR

SEQ ID NO: 3120864 - protein, 7 aa, Giardia lamblia
LDGPLRA

SEQ ID NO: 3120865 - protein, 33 aa, Giardia lamblia
LDGPSASPPTKTKEPRGKPAKGPKGSKGTLSRR

SEQ ID NO: 3120866 - protein, 23 aa, Giardia lamblia
LDGQDDNTNITGSYADELRPTRE

SEQ ID NO: 3120867 - protein, 5 aa, Giardia lamblia
LDGRG

SEQ ID NO: 3120868 - protein, 10 aa, Giardia lamblia
LDGRSANAAR

SEQ ID NO: 3120869 - protein, 27 aa, Giardia lamblia
LDGSEPSSSTLKEKARLEKKSEEITEQ

SEQ ID NO: 3120870 - protein, 6 aa, Giardia lamblia
LDGSTP

SEQ ID NO: 3120871 - protein, 25 aa, Giardia lamblia
LDHAKRASSRSSNELIQDSTQNVTI

SEQ ID NO: 3120872 - protein, 13 aa, Giardia lamblia
LDHDSGSFRQATP

SEQ ID NO: 3120873 - protein, 6 aa, Giardia lamblia
LDHEPK

SEQ ID NO: 3120874 - protein, 11 aa, Giardia lamblia
LDIRKGRGQID

SEQ ID NO: 3120875 - protein, 4 aa, Giardia lamblia
LDKA

SEQ ID NO: 3120876 - protein, 7 aa, Giardia lamblia
LDKAEEE

SEQ ID NO: 3120877 - protein, 4 aa, Giardia lamblia
LDKE

SEQ ID NO: 3120878 - protein, 20 aa, Giardia lamblia
LDKEETTSHNSSSQISSDRL

SEQ ID NO: 3120879 - protein, 9 aa, Giardia lamblia
LDKELSSVK

SEQ ID NO: 3120880 - protein, 6 aa, Giardia lamblia
LDKETE

SEQ ID NO: 3120881 - protein, 4 aa, Giardia lamblia
LDKG

SEQ ID NO: 3120882 - protein, 7 aa, Giardia lamblia
LDKKDER

SEQ ID NO: 3120883 - protein, 6 aa, Giardia lamblia
LDKNPK

SEQ ID NO: 3120884 - protein, 8 aa, Giardia lamblia
LDKNPTIR

SEQ ID NO: 3120885 - protein, 8 aa, Giardia lamblia
LDKNSADA

SEQ ID NO: 3120886 - protein, 8 aa, Giardia lamblia
LDKQDQYD

SEQ ID NO: 3120887 - protein, 5 aa, Giardia lamblia
LDKRQ

SEQ ID NO: 3120888 - protein, 5 aa, Giardia lamblia
LDKTD

SEQ ID NO: 3120889 - protein, 8 aa, Giardia lamblia
LDKTGSPI

SEQ ID NO: 3120890 - protein, 6 aa, Giardia lamblia
LDMTGT

SEQ ID NO: 3120891 - protein, 7 aa, Giardia lamblia
LDNANAS

SEQ ID NO: 3120892 - protein, 8 aa, Giardia lamblia
LDNANQTI

SEQ ID NO: 3120893 - protein, 7 aa, Giardia lamblia
LDNEEDK

SEQ ID NO: 3120894 - protein, 17 aa, Giardia lamblia
LDNGRSLSVTKRGTNID

SEQ ID NO: 3120895 - protein, 14 aa, Giardia lamblia
LDNKDSKPRYPMSS

SEQ ID NO: 3120896 - protein, 8 aa, Giardia lamblia
LDNPDNSD

SEQ ID NO: 3120897 - protein, 9 aa, Giardia lamblia
LDNPKDEHD

SEQ ID NO: 3120898 - protein, 11 aa, Giardia lamblia
LDNRERVKERG

SEQ ID NO: 3120899 - protein, 8 aa, Giardia lamblia
LDNSPSPC

SEQ ID NO: 3120900 - protein, 15 aa, Giardia lamblia
LDPDSLPNRGVPSTI

SEQ ID NO: 3120901 - protein, 4 aa, Giardia lamblia
LDPE

SEQ ID NO: 3120902 - protein, 8 aa, Giardia lamblia
LDPERAKL

SEQ ID NO: 3120903 - protein, 9 aa, Giardia lamblia
LDPFDQSTT

SEQ ID NO: 3120904 - protein, 7 aa, Giardia lamblia
LDPGDLS

SEQ ID NO: 3120905 - protein, 13 aa, Giardia lamblia
LDPPDTKAAIRTA

SEQ ID NO: 3120906 - protein, 7 aa, Giardia lamblia
LDPPQRL

SEQ ID NO: 3120907 - protein, 14 aa, Giardia lamblia
LDPQARNSSNPSRL

SEQ ID NO: 3120908 - protein, 16 aa, Giardia lamblia
LDPSEAQEKTSAANTY

SEQ ID NO: 3120909 - protein, 9 aa, Giardia lamblia
LDPSQLQNK

SEQ ID NO: 3120910 - protein, 6 aa, Giardia lamblia
LDPSQQ

SEQ ID NO: 3120911 - protein, 7 aa, Giardia lamblia
LDPSSPR

SEQ ID NO: 3120912 - protein, 7 aa, Giardia lamblia
LDPTDTG

SEQ ID NO: 3120913 - protein, 13 aa, Giardia lamblia
LDPTEPQNGRQNI

SEQ ID NO: 3120914 - protein, 15 aa, Giardia lamblia
LDPTSGAISSTEQGL

SEQ ID NO: 3120915 - protein, 6 aa, Giardia lamblia
LDPTTS

SEQ ID NO: 3120916 - protein, 7 aa, Giardia lamblia
LDPTTTL

SEQ ID NO: 3120917 - protein, 20 aa, Giardia lamblia
LDPVPEDRPGTEAPPAPASA

SEQ ID NO: 3120918 - protein, 9 aa, Giardia lamblia
LDPYRQQLT

SEQ ID NO: 3120919 - protein, 12 aa, Giardia lamblia
LDQARKTITQNQ

SEQ ID NO: 3120920 - protein, 11 aa, Giardia lamblia
LDQGDWESAAR

SEQ ID NO: 3120921 - protein, 8 aa, Giardia lamblia
LDQGKAKS

SEQ ID NO: 3120922 - protein, 7 aa, Giardia lamblia
LDQGPGN

SEQ ID NO: 3120923 - protein, 9 aa, Giardia lamblia
LDQKQQEEL

SEQ ID NO: 3120924 - protein, 22 aa, Giardia lamblia
LDQKSGSRGGKATRGSSEPSSF

SEQ ID NO: 3120925 - protein, 15 aa, Giardia lamblia
LDQQNSGGDQENSKM

SEQ ID NO: 3120926 - protein, 11 aa, Giardia lamblia
LDQRAKSDKSV

SEQ ID NO: 3120927 - protein, 10 aa, Giardia lamblia
LDRDATSTSL

SEQ ID NO: 3120928 - protein, 9 aa, Giardia lamblia
LDRGSHLPE

SEQ ID NO: 3120929 - protein, 7 aa, Giardia lamblia
LDRKSND

SEQ ID NO: 3120930 - protein, 4 aa, Giardia lamblia
LDRN

SEQ ID NO: 3120931 - protein, 10 aa, Giardia lamblia
LDRNKYTGEE

SEQ ID NO: 3120932 - protein, 7 aa, Giardia lamblia
LDRPDSE

SEQ ID NO: 3120933 - protein, 6 aa, Giardia lamblia
LDRPPW

SEQ ID NO: 3120934 - protein, 7 aa, Giardia lamblia
LDRPSAA

SEQ ID NO: 3120935 - protein, 8 aa, Giardia lamblia
LDRPSAAD

SEQ ID NO: 3120936 - protein, 6 aa, Giardia lamblia
LDRPSY

SEQ ID NO: 3120937 - protein, 6 aa, Giardia lamblia
LDRQDK

SEQ ID NO: 3120938 - protein, 13 aa, Giardia lamblia
LDRRPTGEDEKAR

SEQ ID NO: 3120939 - protein, 8 aa, Giardia lamblia
LDRSDPDF

SEQ ID NO: 3120940 - protein, 9 aa, Giardia lamblia
LDRTQQPGI

SEQ ID NO: 3120941 - protein, 6 aa, Giardia lamblia
LDSDER

SEQ ID NO: 3120942 - protein, 16 aa, Giardia lamblia
LDSDSGVKEGGAEGTE

SEQ ID NO: 3120943 - protein, 8 aa, Giardia lamblia
LDSERQAA

SEQ ID NO: 3120944 - protein, 7 aa, Giardia lamblia
LDSKGET

SEQ ID NO: 3120945 - protein, 6 aa, Giardia lamblia
LDSKQR

SEQ ID NO: 3120946 - protein, 9 aa, Giardia lamblia
LDSNADTEY

SEQ ID NO: 3120947 - protein, 8 aa, Giardia lamblia
LDSNGKIQ

SEQ ID NO: 3120948 - protein, 7 aa, Giardia lamblia
LDSPEAY

SEQ ID NO: 3120949 - protein, 8 aa, Giardia lamblia
LDSPRAEY

SEQ ID NO: 3120950 - protein, 6 aa, Giardia lamblia
LDSPSS

SEQ ID NO: 3120951 - protein, 11 aa, Giardia lamblia
LDSQSGEDRQL

SEQ ID NO: 3120952 - protein, 8 aa, Giardia lamblia
LDSRPAFT

SEQ ID NO: 3120953 - protein, 12 aa, Giardia lamblia
LDSSNENHRAEL

SEQ ID NO: 3120954 - protein, 37 aa, Giardia lamblia
LDSSRQSTAPSSMSSSTIHTAEPSQQAPPTPSIAQSS

SEQ ID NO: 3120955 - protein, 6 aa, Giardia lamblia
LDSSSE

SEQ ID NO: 3120956 - protein, 5 aa, Giardia lamblia
LDSST

SEQ ID NO: 3120957 - protein, 6 aa, Giardia lamblia
LDSSTK

SEQ ID NO: 3120958 - protein, 16 aa, Giardia lamblia
LDSTSTVDDPVTGFET

SEQ ID NO: 3120959 - protein, 9 aa, Giardia lamblia
LDSTTQGID

SEQ ID NO: 3120960 - protein, 10 aa, Giardia lamblia
LDSTVPQDDA

SEQ ID NO: 3120961 - protein, 9 aa, Giardia lamblia
LDSVPRGPE

SEQ ID NO: 3120962 - protein, 27 aa, Giardia lamblia
LDTAPTAETIAPPPSALAKDGKPANYT

SEQ ID NO: 3120963 - protein, 20 aa, Giardia lamblia
LDTARDTSERADSLSEREVY

SEQ ID NO: 3120964 - protein, 9 aa, Giardia lamblia
LDTASSAAD

SEQ ID NO: 3120965 - protein, 12 aa, Giardia lamblia
LDTATDTTVDTA

SEQ ID NO: 3120966 - protein, 14 aa, Giardia lamblia
LDTDADSISRATQT

SEQ ID NO: 3120967 - protein, 4 aa, Giardia lamblia
LDTE

SEQ ID NO: 3120968 - protein, 6 aa, Giardia lamblia
LDTENI

SEQ ID NO: 3120969 - protein, 6 aa, Giardia lamblia
LDTGAS

SEQ ID NO: 3120970 - protein, 8 aa, Giardia lamblia
LDTGSRAK

SEQ ID NO: 3120971 - protein, 7 aa, Giardia lamblia
LDTKSGG

SEQ ID NO: 3120972 - protein, 10 aa, Giardia lamblia
LDTNNSDPDS

SEQ ID NO: 3120973 - protein, 12 aa, Giardia lamblia
LDTNPKKRIQQE

SEQ ID NO: 3120974 - protein, 4 aa, Giardia lamblia
LDTP

SEQ ID NO: 3120975 - protein, 6 aa, Giardia lamblia
LDTPYS

SEQ ID NO: 3120976 - protein, 13 aa, Giardia lamblia
LDTQKATTSQANE

SEQ ID NO: 3120977 - protein, 4 aa, Giardia lamblia
LDTR

SEQ ID NO: 3120978 - protein, 5 aa, Giardia lamblia
LDTSD

SEQ ID NO: 3120979 - protein, 19 aa, Giardia lamblia
LDTSQDGCSEDRSAHNEDY

SEQ ID NO: 3120980 - protein, 15 aa, Giardia lamblia
LDTTKRENSSLKDER

SEQ ID NO: 3120981 - protein, 10 aa, Giardia lamblia
LDVDGRPSSL

SEQ ID NO: 3120982 - protein, 8 aa, Giardia lamblia
LDVSGDAC

SEQ ID NO: 3120983 - protein, 4 aa, Giardia lamblia
LDVT

SEQ ID NO: 3120984 - protein, 5 aa, Giardia lamblia
LEAAP

SEQ ID NO: 3120985 - protein, 11 aa, Giardia lamblia
LEAATSSTAEY

SEQ ID NO: 3120986 - protein, 8 aa, Giardia lamblia
LEADNDRL

SEQ ID NO: 3120987 - protein, 4 aa, Giardia lamblia
LEAE

SEQ ID NO: 3120988 - protein, 6 aa, Giardia lamblia
LEAEEL

SEQ ID NO: 3120989 - protein, 6 aa, Giardia lamblia
LEAERD

SEQ ID NO: 3120990 - protein, 12 aa, Giardia lamblia
LEAERDSLASEK

SEQ ID NO: 3120991 - protein, 22 aa, Giardia lamblia
LEAERSSVESKLHTQKRESEKI

SEQ ID NO: 3120992 - protein, 8 aa, Giardia lamblia
LEAETQDG

SEQ ID NO: 3120993 - protein, 7 aa, Giardia lamblia
LEAGENM

SEQ ID NO: 3120994 - protein, 5 aa, Giardia lamblia
LEAGR

SEQ ID NO: 3120995 - protein, 14 aa, Giardia lamblia
LEANNEGDTPYTSA

SEQ ID NO: 3120996 - protein, 5 aa, Giardia lamblia
LEAPE

SEQ ID NO: 3120997 - protein, 37 aa, Giardia lamblia
LEAPTLRNKKDTFDRPGEDGLDGGDETAAEEPQEELD

SEQ ID NO: 3120998 - protein, 5 aa, Giardia lamblia
LEAQN

SEQ ID NO: 3120999 - protein, 21 aa, Giardia lamblia
LEAQPTATTVYPESGEEVGDA

SEQ ID NO: 3121000 - protein, 9 aa, Giardia lamblia
LEARESDLS

SEQ ID NO: 3121001 - protein, 7 aa, Giardia lamblia
LEARGAE

SEQ ID NO: 3121002 - protein, 16 aa, Giardia lamblia
LEARGKMGTEEEYESI

SEQ ID NO: 3121003 - protein, 20 aa, Giardia lamblia
LEARNADSLAAKKASQENEA

SEQ ID NO: 3121004 - protein, 11 aa, Giardia lamblia
LEARQKGGDDF

SEQ ID NO: 3121005 - protein, 11 aa, Giardia lamblia
LEARSTELSEL

SEQ ID NO: 3121006 - protein, 8 aa, Giardia lamblia
LEASDRER

SEQ ID NO: 3121007 - protein, 7 aa, Giardia lamblia
LEASDVP

SEQ ID NO: 3121008 - protein, 8 aa, Giardia lamblia
LEASEATV

SEQ ID NO: 3121009 - protein, 11 aa, Giardia lamblia
LEASEDAQNLR

SEQ ID NO: 3121010 - protein, 7 aa, Giardia lamblia
LEASPLT

SEQ ID NO: 3121011 - protein, 7 aa, Giardia lamblia
LEASSEA

SEQ ID NO: 3121012 - protein, 7 aa, Giardia lamblia
LEATRKE

SEQ ID NO: 3121013 - protein, 28 aa, Giardia lamblia
LEATTARTLGKPPEAPRKQSKELSPQEL

SEQ ID NO: 3121014 - protein, 5 aa, Giardia lamblia
LEAYN

SEQ ID NO: 3121015 - protein, 5 aa, Giardia lamblia
LEDAQ

SEQ ID NO: 3121016 - protein, 6 aa, Giardia lamblia
LEDAQE

SEQ ID NO: 3121017 - protein, 12 aa, Giardia lamblia
LEDASDLSDIDK

SEQ ID NO: 3121018 - protein, 10 aa, Giardia lamblia
LEDASEAQAV

SEQ ID NO: 3121019 - protein, 6 aa, Giardia lamblia
LEDDNS

SEQ ID NO: 3121020 - protein, 9 aa, Giardia lamblia
LEDENDSLR

SEQ ID NO: 3121021 - protein, 20 aa, Giardia lamblia
LEDEQSGSDSDADRELERKA

SEQ ID NO: 3121022 - protein, 9 aa, Giardia lamblia
LEDGGSENS

SEQ ID NO: 3121023 - protein, 9 aa, Giardia lamblia
LEDGKGNVQ

SEQ ID NO: 3121024 - protein, 7 aa, Giardia lamblia
LEDGTTA

SEQ ID NO: 3121025 - protein, 8 aa, Giardia lamblia
LEDKSRLD

SEQ ID NO: 3121026 - protein, 19 aa, Giardia lamblia
LEDPKDSLKKEVAAEDPLD

SEQ ID NO: 3121027 - protein, 6 aa, Giardia lamblia
LEDPRL

SEQ ID NO: 3121028 - protein, 11 aa, Giardia lamblia
LEDPTKQASQI

SEQ ID NO: 3121029 - protein, 8 aa, Giardia lamblia
LEDQDNER

SEQ ID NO: 3121030 - protein, 16 aa, Giardia lamblia
LEDQSNDNKEEFSSTK

SEQ ID NO: 3121031 - protein, 7 aa, Giardia lamblia
LEDSEKL

SEQ ID NO: 3121032 - protein, 26 aa, Giardia lamblia
LEDSSNTTEQSQSKADPDPEKARRRI

SEQ ID NO: 3121033 - protein, 8 aa, Giardia lamblia
LEDTENQR

SEQ ID NO: 3121034 - protein, 14 aa, Giardia lamblia
LEDTGQAGQRSTSY

SEQ ID NO: 3121035 - protein, 7 aa, Giardia lamblia
LEDTRDE

SEQ ID NO: 3121036 - protein, 6 aa, Giardia lamblia
LEDYRS

SEQ ID NO: 3121037 - protein, 9 aa, Giardia lamblia
LEEAAEQSD

SEQ ID NO: 3121038 - protein, 13 aa, Giardia lamblia
LEEAARTASEEKR

SEQ ID NO: 3121039 - protein, 18 aa, Giardia lamblia
LEEADDEEMTYSSEQEED

SEQ ID NO: 3121040 - protein, 7 aa, Giardia lamblia
LEEADRT

SEQ ID NO: 3121041 - protein, 17 aa, Giardia lamblia
LEEANDKSAAESQHEPV

SEQ ID NO: 3121042 - protein, 10 aa, Giardia lamblia
LEEAQDKDHG

SEQ ID NO: 3121043 - protein, 17 aa, Giardia lamblia
LEEARDANLHSANDERT

SEQ ID NO: 3121044 - protein, 15 aa, Giardia lamblia
LEEARSQSLNSGDQI

SEQ ID NO: 3121045 - protein, 12 aa, Giardia lamblia
LEEATTKQAELS

SEQ ID NO: 3121046 - protein, 42 aa, Giardia lamblia
LEEDVPSENSVADISEKEEADLPDHDADQPRKKKGKRVKPVS

SEQ ID NO: 3121047 - protein, 7 aa, Giardia lamblia
LEEDYGK

SEQ ID NO: 3121048 - protein, 4 aa, Giardia lamblia
LEEE

SEQ ID NO: 3121049 - protein, 9 aa, Giardia lamblia
LEEEPEEAL

SEQ ID NO: 3121050 - protein, 9 aa, Giardia lamblia
LEEERASIE

SEQ ID NO: 3121051 - protein, 19 aa, Giardia lamblia
LEEHRRATAAALADLRRPG

SEQ ID NO: 3121052 - protein, 11 aa, Giardia lamblia
LEEKTKIQDAL

SEQ ID NO: 3121053 - protein, 4 aa, Giardia lamblia
LEEL

SEQ ID NO: 3121054 - protein, 27 aa, Giardia lamblia
LEELDNDSKDKEVSLSSQKAKQLKDSL

SEQ ID NO: 3121055 - protein, 5 aa, Giardia lamblia
LEEME

SEQ ID NO: 3121056 - protein, 6 aa, Giardia lamblia
LEENNT

SEQ ID NO: 3121057 - protein, 5 aa, Giardia lamblia
LEEPA

SEQ ID NO: 3121058 - protein, 55 aa, Giardia lamblia
LEEPSEVSKTVEGTQKEGHPRARMEPEKQQGLDPGRGKRRGENRGQHSAAGGPGL

SEQ ID NO: 3121059 - protein, 17 aa, Giardia lamblia
LEEQASDFKREKNEASE

SEQ ID NO: 3121060 - protein, 9 aa, Giardia lamblia
LEEQATRTY

SEQ ID NO: 3121061 - protein, 9 aa, Giardia lamblia
LEEQGKEEK

SEQ ID NO: 3121062 - protein, 5 aa, Giardia lamblia
LEEQT

SEQ ID NO: 3121063 - protein, 7 aa, Giardia lamblia
LEEQTGI

SEQ ID NO: 3121064 - protein, 9 aa, Giardia lamblia
LEEQTRQTF

SEQ ID NO: 3121065 - protein, 14 aa, Giardia lamblia
LEERAQKAKNAVRE

SEQ ID NO: 3121066 - protein, 18 aa, Giardia lamblia
LEERQRNDRALRASGPLK

SEQ ID NO: 3121067 - protein, 7 aa, Giardia lamblia
LEERTRA

SEQ ID NO: 3121068 - protein, 4 aa, Giardia lamblia
LEES

SEQ ID NO: 3121069 - protein, 9 aa, Giardia lamblia
LEESEQRTA

SEQ ID NO: 3121070 - protein, 11 aa, Giardia lamblia
LEESERKYKAM

SEQ ID NO: 3121071 - protein, 34 aa, Giardia lamblia
LEESGDSPEEATSSESESFDDETKRPADLPEDSI

SEQ ID NO: 3121072 - protein, 35 aa, Giardia lamblia
LEESPNTTQREETNRKPQARRAKASTRGSRQVADS

SEQ ID NO: 3121073 - protein, 7 aa, Giardia lamblia
LEESRSN

SEQ ID NO: 3121074 - protein, 10 aa, Giardia lamblia
LEESRTSLAD

SEQ ID NO: 3121075 - protein, 4 aa, Giardia lamblia
LEET

SEQ ID NO: 3121076 - protein, 10 aa, Giardia lamblia
LEETEQSLKK

SEQ ID NO: 3121077 - protein, 8 aa, Giardia lamblia
LEETEREE

SEQ ID NO: 3121078 - protein, 4 aa, Giardia lamblia
LEEV

SEQ ID NO: 3121079 - protein, 8 aa, Giardia lamblia
LEEVPDEE

SEQ ID NO: 3121080 - protein, 4 aa, Giardia lamblia
LEGA

SEQ ID NO: 3121081 - protein, 22 aa, Giardia lamblia
LEGAEKENAALQRSHSRAEALQ

SEQ ID NO: 3121082 - protein, 35 aa, Giardia lamblia
LEGDTESSTSESCDNPQEVNATNKEGVLDNTDTDH

SEQ ID NO: 3121083 - protein, 5 aa, Giardia lamblia
LEGEA

SEQ ID NO: 3121084 - protein, 7 aa, Giardia lamblia
LEGEELS

SEQ ID NO: 3121085 - protein, 29 aa, Giardia lamblia
LEGETDANSSQARRPLDKHSKATKRVPYK

SEQ ID NO: 3121086 - protein, 7 aa, Giardia lamblia
LEGETGI

SEQ ID NO: 3121087 - protein, 4 aa, Giardia lamblia
LEGG

SEQ ID NO: 3121088 - protein, 11 aa, Giardia lamblia
LEGGNISKPVE

SEQ ID NO: 3121089 - protein, 8 aa, Giardia lamblia
LEGGPTGQ

SEQ ID NO: 3121090 - protein, 6 aa, Giardia lamblia
LEGHTE

SEQ ID NO: 3121091 - protein, 8 aa, Giardia lamblia
LEGIGPKT

SEQ ID NO: 3121092 - protein, 10 aa, Giardia lamblia
LEGKAHGSRA

SEQ ID NO: 3121093 - protein, 7 aa, Giardia lamblia
LEGKHPD

SEQ ID NO: 3121094 - protein, 8 aa, Giardia lamblia
LEGNSTTP

SEQ ID NO: 3121095 - protein, 7 aa, Giardia lamblia
LEGPESY

SEQ ID NO: 3121096 - protein, 10 aa, Giardia lamblia
LEGQAGSSLG

SEQ ID NO: 3121097 - protein, 12 aa, Giardia lamblia
LEGQEASPPSLP

SEQ ID NO: 3121098 - protein, 7 aa, Giardia lamblia
LEGSTEK

SEQ ID NO: 3121099 - protein, 8 aa, Giardia lamblia
LEGSTRDA

SEQ ID NO: 3121100 - protein, 9 aa, Giardia lamblia
LEGTNTASV

SEQ ID NO: 3121101 - protein, 18 aa, Giardia lamblia
LEGTPPKKISTPVSADEQ

SEQ ID NO: 3121102 - protein, 9 aa, Giardia lamblia
LEGTRDGSV

SEQ ID NO: 3121103 - protein, 4 aa, Giardia lamblia
LEGY

SEQ ID NO: 3121104 - protein, 10 aa, Giardia lamblia
LEHERKKAEI

SEQ ID NO: 3121105 - protein, 6 aa, Giardia lamblia
LEHGQK

SEQ ID NO: 3121106 - protein, 9 aa, Giardia lamblia
LEHSEENSG

SEQ ID NO: 3121107 - protein, 5 aa, Giardia lamblia
LEHTR

SEQ ID NO: 3121108 - protein, 12 aa, Giardia lamblia
LEKDAVDSIETR

SEQ ID NO: 3121109 - protein, 7 aa, Giardia lamblia
LEKDPTL

SEQ ID NO: 3121110 - protein, 25 aa, Giardia lamblia
LEKDYTPGDMRTSYSTYEPKTDNKY

SEQ ID NO: 3121111 - protein, 9 aa, Giardia lamblia
LEKEGGDNA

SEQ ID NO: 3121112 - protein, 8 aa, Giardia lamblia
LEKEKQSV

SEQ ID NO: 3121113 - protein, 21 aa, Giardia lamblia
LEKENEKMKKAAKAQPSAISR

SEQ ID NO: 3121114 - protein, 22 aa, Giardia lamblia
LEKERSDLESQLETAKATSTTI

SEQ ID NO: 3121115 - protein, 12 aa, Giardia lamblia
LEKETNKAKEVP

SEQ ID NO: 3121116 - protein, 7 aa, Giardia lamblia
LEKHPGA

SEQ ID NO: 3121117 - protein, 7 aa, Giardia lamblia
LEKKTSI

SEQ ID NO: 3121118 - protein, 7 aa, Giardia lamblia
LEKLESK

SEQ ID NO: 3121119 - protein, 8 aa, Giardia lamblia
LEKLTDGK

SEQ ID NO: 3121120 - protein, 19 aa, Giardia lamblia
LEKNAASDKPKKDIDSTQC

SEQ ID NO: 3121121 - protein, 6 aa, Giardia lamblia
LEKNPK

SEQ ID NO: 3121122 - protein, 17 aa, Giardia lamblia
LEKNQELQSESKKAQHA

SEQ ID NO: 3121123 - protein, 19 aa, Giardia lamblia
LEKNRELEKQLAKSNDLST

SEQ ID NO: 3121124 - protein, 12 aa, Giardia lamblia
LEKPDPEEGSYD

SEQ ID NO: 3121125 - protein, 8 aa, Giardia lamblia
LEKPPPHL

SEQ ID NO: 3121126 - protein, 4 aa, Giardia lamblia
LEKR

SEQ ID NO: 3121127 - protein, 8 aa, Giardia lamblia
LEKSEKAY

SEQ ID NO: 3121128 - protein, 14 aa, Giardia lamblia
LEKSLKASGPTRAN

SEQ ID NO: 3121129 - protein, 9 aa, Giardia lamblia
LEKSQADLE

SEQ ID NO: 3121130 - protein, 8 aa, Giardia lamblia
LEKSQELE

SEQ ID NO: 3121131 - protein, 15 aa, Giardia lamblia
LEKSSTTGISASARS

SEQ ID NO: 3121132 - protein, 15 aa, Giardia lamblia
LEKSTASNHTTNQSF

SEQ ID NO: 3121133 - protein, 10 aa, Giardia lamblia
LEKTNDSIKS

SEQ ID NO: 3121134 - protein, 5 aa, Giardia lamblia
LEKTP

SEQ ID NO: 3121135 - protein, 8 aa, Giardia lamblia
LELETSRG

SEQ ID NO: 3121136 - protein, 4 aa, Giardia lamblia
LELG

SEQ ID NO: 3121137 - protein, 8 aa, Giardia lamblia
LELNPDSS

SEQ ID NO: 3121138 - protein, 14 aa, Giardia lamblia
LELPGSVTASENAI

SEQ ID NO: 3121139 - protein, 13 aa, Giardia lamblia
LENANEQDHANDV

SEQ ID NO: 3121140 - protein, 13 aa, Giardia lamblia
LENESQKTEEERQ

SEQ ID NO: 3121141 - protein, 9 aa, Giardia lamblia
LENKEGEGL

SEQ ID NO: 3121142 - protein, 7 aa, Giardia lamblia
LENKTDK

SEQ ID NO: 3121143 - protein, 5 aa, Giardia lamblia
LENLK

SEQ ID NO: 3121144 - protein, 30 aa, Giardia lamblia
LENNTGILSGEDTVKASSQRSKKDNPPSLR

SEQ ID NO: 3121145 - protein, 4 aa, Giardia lamblia
LENP

SEQ ID NO: 3121146 - protein, 7 aa, Giardia lamblia
LENPPQQ

SEQ ID NO: 3121147 - protein, 14 aa, Giardia lamblia
LENPRSTQQQAQNQ

SEQ ID NO: 3121148 - protein, 16 aa, Giardia lamblia
LENRPSEVDALGQEPR

SEQ ID NO: 3121149 - protein, 22 aa, Giardia lamblia
LENRPSKTSSLGQEPRLKTPGI

SEQ ID NO: 3121150 - protein, 6 aa, Giardia lamblia
LENSQL

SEQ ID NO: 3121151 - protein, 11 aa, Giardia lamblia
LENTHTGKAST

SEQ ID NO: 3121152 - protein, 8 aa, Giardia lamblia
LENTPEAI

SEQ ID NO: 3121153 - protein, 8 aa, Giardia lamblia
LEPDGPEI

SEQ ID NO: 3121154 - protein, 11 aa, Giardia lamblia
LEPDKEGTDYT

SEQ ID NO: 3121155 - protein, 7 aa, Giardia lamblia
LEPEPRQ

SEQ ID NO: 3121156 - protein, 14 aa, Giardia lamblia
LEPESERSTAAPTL

SEQ ID NO: 3121157 - protein, 10 aa, Giardia lamblia
LEPISTETRT

SEQ ID NO: 3121158 - protein, 4 aa, Giardia lamblia
LEPK

SEQ ID NO: 3121159 - protein, 12 aa, Giardia lamblia
LEPKGKKKAVDQ

SEQ ID NO: 3121160 - protein, 8 aa, Giardia lamblia
LEPLSPKQ

SEQ ID NO: 3121161 - protein, 7 aa, Giardia lamblia
LEPNEDN

SEQ ID NO: 3121162 - protein, 9 aa, Giardia lamblia
LEPNKSTDD

SEQ ID NO: 3121163 - protein, 13 aa, Giardia lamblia
LEPNSVLPTSNQD

SEQ ID NO: 3121164 - protein, 15 aa, Giardia lamblia
LEPPADSEISSANGL

SEQ ID NO: 3121165 - protein, 6 aa, Giardia lamblia
LEPPVA

SEQ ID NO: 3121166 - protein, 7 aa, Giardia lamblia
LEPQEQP

SEQ ID NO: 3121167 - protein, 19 aa, Giardia lamblia
LEPQGTNAGPKTHPHDTAH

SEQ ID NO: 3121168 - protein, 7 aa, Giardia lamblia
LEPREPV

SEQ ID NO: 3121169 - protein, 8 aa, Giardia lamblia
LEPRPGQR

SEQ ID NO: 3121170 - protein, 19 aa, Giardia lamblia
LEPSARRVEKPDGVSESVS

SEQ ID NO: 3121171 - protein, 5 aa, Giardia lamblia
LEPSL

SEQ ID NO: 3121172 - protein, 54 aa, Giardia lamblia
LEPSLKQSTMPGRGFTPQDRRPAIKRGKEMSADDVKDAHPLSQEEKLAARRRAE

SEQ ID NO: 3121173 - protein, 6 aa, Giardia lamblia
LEPSST

SEQ ID NO: 3121174 - protein, 6 aa, Giardia lamblia
LEPTDE

SEQ ID NO: 3121175 - protein, 8 aa, Giardia lamblia
LEPTPQEI

SEQ ID NO: 3121176 - protein, 5 aa, Giardia lamblia
LEPVK

SEQ ID NO: 3121177 - protein, 4 aa, Giardia lamblia
LEPY

SEQ ID NO: 3121178 - protein, 5 aa, Giardia lamblia
LEPYS

SEQ ID NO: 3121179 - protein, 4 aa, Giardia lamblia
LEQA

SEQ ID NO: 3121180 - protein, 26 aa, Giardia lamblia
LEQAASRLSEAESALQKERASEKVPL

SEQ ID NO: 3121181 - protein, 11 aa, Giardia lamblia
LEQAEKGDPDL

SEQ ID NO: 3121182 - protein, 43 aa, Giardia lamblia
LEQANSSKNKLSAQRGIKPGIAPKEPRDQKDQELTISTNPNLY

SEQ ID NO: 3121183 - protein, 10 aa, Giardia lamblia
LEQAQKDLRT

SEQ ID NO: 3121184 - protein, 16 aa, Giardia lamblia
LEQASEAASSVKPPPY

SEQ ID NO: 3121185 - protein, 24 aa, Giardia lamblia
LEQDGSQPPQTDVSSEGSRDEVSA

SEQ ID NO: 3121186 - protein, 5 aa, Giardia lamblia
LEQDL

SEQ ID NO: 3121187 - protein, 5 aa, Giardia lamblia
LEQEE

SEQ ID NO: 3121188 - protein, 12 aa, Giardia lamblia
LEQEGKKHTKTL

SEQ ID NO: 3121189 - protein, 9 aa, Giardia lamblia
LEQEREKHL

SEQ ID NO: 3121190 - protein, 8 aa, Giardia lamblia
LEQERRRP

SEQ ID NO: 3121191 - protein, 8 aa, Giardia lamblia
LEQERSKI

SEQ ID NO: 3121192 - protein, 16 aa, Giardia lamblia
LEQGESGSLGQKADCS

SEQ ID NO: 3121193 - protein, 4 aa, Giardia lamblia
LEQL

SEQ ID NO: 3121194 - protein, 8 aa, Giardia lamblia
LEQNGKSK

SEQ ID NO: 3121195 - protein, 20 aa, Giardia lamblia
LEQPEDNQENTDASKAVRDE

SEQ ID NO: 3121196 - protein, 11 aa, Giardia lamblia
LEQPEDTSTAY

SEQ ID NO: 3121197 - protein, 4 aa, Giardia lamblia
LEQQ

SEQ ID NO: 3121198 - protein, 14 aa, Giardia lamblia
LEQQQRTATVRETE

SEQ ID NO: 3121199 - protein, 4 aa, Giardia lamblia
LEQR

SEQ ID NO: 3121200 - protein, 6 aa, Giardia lamblia
LEQRIE

SEQ ID NO: 3121201 - protein, 18 aa, Giardia lamblia
LEQRNLEKKHNPMTNPQQ

SEQ ID NO: 3121202 - protein, 8 aa, Giardia lamblia
LEQSLTEN

SEQ ID NO: 3121203 - protein, 10 aa, Giardia lamblia
LEQSSKNVEA

SEQ ID NO: 3121204 - protein, 7 aa, Giardia lamblia
LEQSSND

SEQ ID NO: 3121205 - protein, 9 aa, Giardia lamblia
LEQSSTRGL

SEQ ID NO: 3121206 - protein, 7 aa, Giardia lamblia
LEQTNSE

SEQ ID NO: 3121207 - protein, 9 aa, Giardia lamblia
LERAKHRSR

SEQ ID NO: 3121208 - protein, 14 aa, Giardia lamblia
LERATELTETQQEH

SEQ ID NO: 3121209 - protein, 33 aa, Giardia lamblia
LEREDNGTDTLSDSSSVLSAQTPTSVTSDRGRR

SEQ ID NO: 3121210 - protein, 6 aa, Giardia lamblia
LEREHS

SEQ ID NO: 3121211 - protein, 23 aa, Giardia lamblia
LEREKEQQEAARREAQEYAQREL

SEQ ID NO: 3121212 - protein, 34 aa, Giardia lamblia
LEREKPSSEPASETSYRPIRTPSIESSTTHESIA

SEQ ID NO: 3121213 - protein, 11 aa, Giardia lamblia
LEREKQEQEKF

SEQ ID NO: 3121214 - protein, 14 aa, Giardia lamblia
LERESDSVEYDPSV

SEQ ID NO: 3121215 - protein, 10 aa, Giardia lamblia
LERGRAEYQE

SEQ ID NO: 3121216 - protein, 9 aa, Giardia lamblia
LERNPSSVE

SEQ ID NO: 3121217 - protein, 22 aa, Giardia lamblia
LERPKPAATHLTGKTNVKSQGR

SEQ ID NO: 3121218 - protein, 7 aa, Giardia lamblia
LERPQGN

SEQ ID NO: 3121219 - protein, 6 aa, Giardia lamblia
LERQAE

SEQ ID NO: 3121220 - protein, 5 aa, Giardia lamblia
LERQE

SEQ ID NO: 3121221 - protein, 27 aa, Giardia lamblia
LERRGRDDLSAQPTDSTGSQSAGPTNT

SEQ ID NO: 3121222 - protein, 8 aa, Giardia lamblia
LERSKQAL

SEQ ID NO: 3121223 - protein, 7 aa, Giardia lamblia
LERTDRR

SEQ ID NO: 3121224 - protein, 17 aa, Giardia lamblia
LESAGCTPNARLFAKIG

SEQ ID NO: 3121225 - protein, 5 aa, Giardia lamblia
LESAK

SEQ ID NO: 3121226 - protein, 5 aa, Giardia lamblia
LESDT

SEQ ID NO: 3121227 - protein, 9 aa, Giardia lamblia
LESEATELT

SEQ ID NO: 3121228 - protein, 6 aa, Giardia lamblia
LESEKE

SEQ ID NO: 3121229 - protein, 10 aa, Giardia lamblia
LESEKGAPSH

SEQ ID NO: 3121230 - protein, 9 aa, Giardia lamblia
LESEKVSSE

SEQ ID NO: 3121231 - protein, 12 aa, Giardia lamblia
LESENTGQPIPQ

SEQ ID NO: 3121232 - protein, 11 aa, Giardia lamblia
LESERERARKF

SEQ ID NO: 3121233 - protein, 13 aa, Giardia lamblia
LESKEGSKDDSAV

SEQ ID NO: 3121234 - protein, 23 aa, Giardia lamblia
LESKGSKKSAGNTTSSVTESNNK

SEQ ID NO: 3121235 - protein, 12 aa, Giardia lamblia
LESKKFKGKGRA

SEQ ID NO: 3121236 - protein, 6 aa, Giardia lamblia
LESLSQ

SEQ ID NO: 3121237 - protein, 12 aa, Giardia lamblia
LESNYKDSKERL

SEQ ID NO: 3121238 - protein, 26 aa, Giardia lamblia
LESPADAEAKKAYAGYAQQKTAQDFP

SEQ ID NO: 3121239 - protein, 26 aa, Giardia lamblia
LESPADAETKRAYAGYAQQKTAQDFP

SEQ ID NO: 3121240 - protein, 9 aa, Giardia lamblia
LESPISSGY

SEQ ID NO: 3121241 - protein, 6 aa, Giardia lamblia
LESPKD

SEQ ID NO: 3121242 - protein, 6 aa, Giardia lamblia
LESPST

SEQ ID NO: 3121243 - protein, 15 aa, Giardia lamblia
LESQQRLDKENSEFT

SEQ ID NO: 3121244 - protein, 21 aa, Giardia lamblia
LESRLSEEAELKAAAEAAGNI

SEQ ID NO: 3121245 - protein, 9 aa, Giardia lamblia
LESSGASAV

SEQ ID NO: 3121246 - protein, 13 aa, Giardia lamblia
LESTLQQKPPFDM

SEQ ID NO: 3121247 - protein, 29 aa, Giardia lamblia
LESTLTSKSRGTTSSVNQDDSDATARLTG

SEQ ID NO: 3121248 - protein, 7 aa, Giardia lamblia
LETDADR

SEQ ID NO: 3121249 - protein, 5 aa, Giardia lamblia
LETEN

SEQ ID NO: 3121250 - protein, 12 aa, Giardia lamblia
LETGVSDRSKMK

SEQ ID NO: 3121251 - protein, 13 aa, Giardia lamblia
LETNSSTAGTHQG

SEQ ID NO: 3121252 - protein, 24 aa, Giardia lamblia
LETNTNLEEQQKKLEKKANEKTQL

SEQ ID NO: 3121253 - protein, 27 aa, Giardia lamblia
LETPDARSTRGSGADPGPSRRQKESYI

SEQ ID NO: 3121254 - protein, 31 aa, Giardia lamblia
LETPSPERSLPSTSSETIGSTHEKSLTASSL

SEQ ID NO: 3121255 - protein, 9 aa, Giardia lamblia
LETQKDEYV

SEQ ID NO: 3121256 - protein, 8 aa, Giardia lamblia
LETRDNEI

SEQ ID NO: 3121257 - protein, 5 aa, Giardia lamblia
LETSQ

SEQ ID NO: 3121258 - protein, 6 aa, Giardia lamblia
LETTKV

SEQ ID NO: 3121259 - protein, 9 aa, Giardia lamblia
LETTSTAIN

SEQ ID NO: 3121260 - protein, 11 aa, Giardia lamblia
LETTTNRSTVE

SEQ ID NO: 3121261 - protein, 7 aa, Giardia lamblia
LETVSRD

SEQ ID NO: 3121262 - protein, 11 aa, Giardia lamblia
LEVPEDPPRGS

SEQ ID NO: 3121263 - protein, 4 aa, Giardia lamblia
LFEG

SEQ ID NO: 3121264 - protein, 12 aa, Giardia lamblia
LFGSARKSVQQS

SEQ ID NO: 3121265 - protein, 6 aa, Giardia lamblia
LFPGDT

SEQ ID NO: 3121266 - protein, 11 aa, Giardia lamblia
LFSSTSTKKEL

SEQ ID NO: 3121267 - protein, 10 aa, Giardia lamblia
LGADEARRGY

SEQ ID NO: 3121268 - protein, 10 aa, Giardia lamblia
LGADTEIQQQ

SEQ ID NO: 3121269 - protein, 5 aa, Giardia lamblia
LGAGA

SEQ ID NO: 3121270 - protein, 5 aa, Giardia lamblia
LGAGS

SEQ ID NO: 3121271 - protein, 19 aa, Giardia lamblia
LGAGSTTAQQTLQDSYRDD

SEQ ID NO: 3121272 - protein, 8 aa, Giardia lamblia
LGAKSTEL

SEQ ID NO: 3121273 - protein, 4 aa, Giardia lamblia
LGAR

SEQ ID NO: 3121274 - protein, 6 aa, Giardia lamblia
LGARGE

SEQ ID NO: 3121275 - protein, 9 aa, Giardia lamblia
LGDAEQSIA

SEQ ID NO: 3121276 - protein, 6 aa, Giardia lamblia
LGDAST

SEQ ID NO: 3121277 - protein, 6 aa, Giardia lamblia
LGDDNT

SEQ ID NO: 3121278 - protein, 23 aa, Giardia lamblia
LGDDQGFSPIQEPEGPDGPYADL

SEQ ID NO: 3121279 - protein, 4 aa, Giardia lamblia
LGDE

SEQ ID NO: 3121280 - protein, 19 aa, Giardia lamblia
LGDEDQAQFAASAGQVSIG

SEQ ID NO: 3121281 - protein, 8 aa, Giardia lamblia
LGDEPDKL

SEQ ID NO: 3121282 - protein, 62 aa, Giardia lamblia
LGDERADDFTAESARRTERRTGNMQEDDKLSDAGTVYTNDDTVSDAGTAYTAATQETATNSM

SEQ ID NO: 3121283 - protein, 12 aa, Giardia lamblia
LGDESSGSPESP

SEQ ID NO: 3121284 - protein, 7 aa, Giardia lamblia
LGDKQSS

SEQ ID NO: 3121285 - protein, 7 aa, Giardia lamblia
LGDLTET

SEQ ID NO: 3121286 - protein, 7 aa, Giardia lamblia
LGDNGSA

SEQ ID NO: 3121287 - protein, 9 aa, Giardia lamblia
LGDNGTTAQ

SEQ ID NO: 3121288 - protein, 8 aa, Giardia lamblia
LGDPERPL

SEQ ID NO: 3121289 - protein, 6 aa, Giardia lamblia
LGDPQS

SEQ ID NO: 3121290 - protein, 28 aa, Giardia lamblia
LGDRATLAATSSKSPFTSPGAKQYTTSV

SEQ ID NO: 3121291 - protein, 22 aa, Giardia lamblia
LGDSGSCQSRSSCPDPQQTATP

SEQ ID NO: 3121292 - protein, 9 aa, Giardia lamblia
LGDSPSDEF

SEQ ID NO: 3121293 - protein, 6 aa, Giardia lamblia
LGDTKG

SEQ ID NO: 3121294 - protein, 5 aa, Giardia lamblia
LGDTY

SEQ ID NO: 3121295 - protein, 31 aa, Giardia lamblia
LGEDELDSSYSYSNKDSSEDENDNDSELSRV

SEQ ID NO: 3121296 - protein, 15 aa, Giardia lamblia
LGEDNKEKDKVSELQ

SEQ ID NO: 3121297 - protein, 5 aa, Giardia lamblia
LGEEE

SEQ ID NO: 3121298 - protein, 8 aa, Giardia lamblia
LGEEHPGD

SEQ ID NO: 3121299 - protein, 8 aa, Giardia lamblia
LGEENDTM

SEQ ID NO: 3121300 - protein, 5 aa, Giardia lamblia
LGEGT

SEQ ID NO: 3121301 - protein, 7 aa, Giardia lamblia
LGEGTYG

SEQ ID NO: 3121302 - protein, 10 aa, Giardia lamblia
LGENPSVAGN

SEQ ID NO: 3121303 - protein, 11 aa, Giardia lamblia
LGENTEELKER

SEQ ID NO: 3121304 - protein, 6 aa, Giardia lamblia
LGEQSS

SEQ ID NO: 3121305 - protein, 7 aa, Giardia lamblia
LGERRAT

SEQ ID NO: 3121306 - protein, 4 aa, Giardia lamblia
LGES

SEQ ID NO: 3121307 - protein, 8 aa, Giardia lamblia
LGESGLNN

SEQ ID NO: 3121308 - protein, 7 aa, Giardia lamblia
LGETAES

SEQ ID NO: 3121309 - protein, 6 aa, Giardia lamblia
LGETPL

SEQ ID NO: 3121310 - protein, 8 aa, Giardia lamblia
LGFEPSNR

SEQ ID NO: 3121311 - protein, 13 aa, Giardia lamblia
LGGAPSQDGSSTL

SEQ ID NO: 3121312 - protein, 5 aa, Giardia lamblia
LGGKH

SEQ ID NO: 3121313 - protein, 8 aa, Giardia lamblia
LGGNDLDK

SEQ ID NO: 3121314 - protein, 12 aa, Giardia lamblia
LGGNLSNSGVHT

SEQ ID NO: 3121315 - protein, 6 aa, Giardia lamblia
LGGPEM

SEQ ID NO: 3121316 - protein, 9 aa, Giardia lamblia
LGGPQSVPQ

SEQ ID NO: 3121317 - protein, 10 aa, Giardia lamblia
LGGQDNEIGH

SEQ ID NO: 3121318 - protein, 6 aa, Giardia lamblia
LGGQPE

SEQ ID NO: 3121319 - protein, 13 aa, Giardia lamblia
LGGRTGGWDPADH

SEQ ID NO: 3121320 - protein, 9 aa, Giardia lamblia
LGGSNERAT

SEQ ID NO: 3121321 - protein, 34 aa, Giardia lamblia
LGGSSGISLDRSEKRAVSSKVSSQDIPKKTSGVV

SEQ ID NO: 3121322 - protein, 20 aa, Giardia lamblia
LGGTPGLSAPGITSVEAEPH

SEQ ID NO: 3121323 - protein, 6 aa, Giardia lamblia
LGHPPP

SEQ ID NO: 3121324 - protein, 7 aa, Giardia lamblia
LGHPQSP

SEQ ID NO: 3121325 - protein, 30 aa, Giardia lamblia
LGHRTSNKDGDRHGGKCSQRPNSVGKCSGT

SEQ ID NO: 3121326 - protein, 33 aa, Giardia lamblia
LGHSTGAPPGTGTHSFSNGTQHASTGALPSSQN

SEQ ID NO: 3121327 - protein, 5 aa, Giardia lamblia
LGIND

SEQ ID NO: 3121328 - protein, 28 aa, Giardia lamblia
LGIPGASLPNPGSTRISPSPPTKAGSIT

SEQ ID NO: 3121329 - protein, 7 aa, Giardia lamblia
LGKDEPA

SEQ ID NO: 3121330 - protein, 10 aa, Giardia lamblia
LGKDEREKAL

SEQ ID NO: 3121331 - protein, 17 aa, Giardia lamblia
LGKDNALDNSGASDTGF

SEQ ID NO: 3121332 - protein, 8 aa, Giardia lamblia
LGKGSRST

SEQ ID NO: 3121333 - protein, 5 aa, Giardia lamblia
LGKKY

SEQ ID NO: 3121334 - protein, 4 aa, Giardia lamblia
LGKN

SEQ ID NO: 3121335 - protein, 10 aa, Giardia lamblia
LGKPEAPWNS

SEQ ID NO: 3121336 - protein, 10 aa, Giardia lamblia
LGKTNASRRV

SEQ ID NO: 3121337 - protein, 4 aa, Giardia lamblia
LGLP

SEQ ID NO: 3121338 - protein, 23 aa, Giardia lamblia
LGLQGKRKTIDEGVRTGHMSANG

SEQ ID NO: 3121339 - protein, 11 aa, Giardia lamblia
LGNDGEEPLDN

SEQ ID NO: 3121340 - protein, 5 aa, Giardia lamblia
LGNDP

SEQ ID NO: 3121341 - protein, 4 aa, Giardia lamblia
LGNI

SEQ ID NO: 3121342 - protein, 8 aa, Giardia lamblia
LGNKADDC

SEQ ID NO: 3121343 - protein, 23 aa, Giardia lamblia
LGNNDGRNLSQEKQFRSKEISKT

SEQ ID NO: 3121344 - protein, 6 aa, Giardia lamblia
LGNNSK

SEQ ID NO: 3121345 - protein, 24 aa, Giardia lamblia
LGNPPQTALPPSSQQFNPYSPSTI

SEQ ID NO: 3121346 - protein, 4 aa, Giardia lamblia
LGNS

SEQ ID NO: 3121347 - protein, 32 aa, Giardia lamblia
LGNTQQKPQSGFSFGQSNTNTFGGGLGQPFGQ

SEQ ID NO: 3121348 - protein, 8 aa, Giardia lamblia
LGPANEHT

SEQ ID NO: 3121349 - protein, 6 aa, Giardia lamblia
LGPDDD

SEQ ID NO: 3121350 - protein, 6 aa, Giardia lamblia
LGPDEY

SEQ ID NO: 3121351 - protein, 5 aa, Giardia lamblia
LGPDG

SEQ ID NO: 3121352 - protein, 9 aa, Giardia lamblia
LGPGLSEND

SEQ ID NO: 3121353 - protein, 7 aa, Giardia lamblia
LGPGSAN

SEQ ID NO: 3121354 - protein, 7 aa, Giardia lamblia
LGPPNQI

SEQ ID NO: 3121355 - protein, 14 aa, Giardia lamblia
LGPQGHEQLEDHTK

SEQ ID NO: 3121356 - protein, 9 aa, Giardia lamblia
LGPQPEELS

SEQ ID NO: 3121357 - protein, 10 aa, Giardia lamblia
LGPRAPSLQR

SEQ ID NO: 3121358 - protein, 5 aa, Giardia lamblia
LGPRG

SEQ ID NO: 3121359 - protein, 25 aa, Giardia lamblia
LGPRQAATEMASYNKTGSKPTPTES

SEQ ID NO: 3121360 - protein, 10 aa, Giardia lamblia
LGPSAEKERW

SEQ ID NO: 3121361 - protein, 9 aa, Giardia lamblia
LGPSAQNHM

SEQ ID NO: 3121362 - protein, 16 aa, Giardia lamblia
LGPSGQRHSRVPTTMN

SEQ ID NO: 3121363 - protein, 10 aa, Giardia lamblia
LGPSPPPRGR

SEQ ID NO: 3121364 - protein, 6 aa, Giardia lamblia
LGPSPY

SEQ ID NO: 3121365 - protein, 12 aa, Giardia lamblia
LGPSSEKPAETD

SEQ ID NO: 3121366 - protein, 18 aa, Giardia lamblia
LGPSSGSWATMAPEDKGI

SEQ ID NO: 3121367 - protein, 7 aa, Giardia lamblia
LGPSSQL

SEQ ID NO: 3121368 - protein, 6 aa, Giardia lamblia
LGPTGM

SEQ ID NO: 3121369 - protein, 6 aa, Giardia lamblia
LGPTRK

SEQ ID NO: 3121370 - protein, 5 aa, Giardia lamblia
LGQAR

SEQ ID NO: 3121371 - protein, 13 aa, Giardia lamblia
LGQDRNALNAYKA

SEQ ID NO: 3121372 - protein, 11 aa, Giardia lamblia
LGQEQPAKPLQ

SEQ ID NO: 3121373 - protein, 6 aa, Giardia lamblia
LGQGIG

SEQ ID NO: 3121374 - protein, 8 aa, Giardia lamblia
LGQGQGAI

SEQ ID NO: 3121375 - protein, 8 aa, Giardia lamblia
LGQGQQEV

SEQ ID NO: 3121376 - protein, 28 aa, Giardia lamblia
LGQQTSGPTEWHQSTQDLTPNYTPTDPV

SEQ ID NO: 3121377 - protein, 19 aa, Giardia lamblia
LGQRSTPKPKSLPEQEDPM

SEQ ID NO: 3121378 - protein, 4 aa, Giardia lamblia
LGQS

SEQ ID NO: 3121379 - protein, 11 aa, Giardia lamblia
LGQSGKVATTC

SEQ ID NO: 3121380 - protein, 9 aa, Giardia lamblia
LGQSNVSSF

SEQ ID NO: 3121381 - protein, 12 aa, Giardia lamblia
LGQSRDSVQPRN

SEQ ID NO: 3121382 - protein, 8 aa, Giardia lamblia
LGQSSGQN

SEQ ID NO: 3121383 - protein, 4 aa, Giardia lamblia
LGQT

SEQ ID NO: 3121384 - protein, 6 aa, Giardia lamblia
LGRAGA

SEQ ID NO: 3121385 - protein, 6 aa, Giardia lamblia
LGRAGR

SEQ ID NO: 3121386 - protein, 24 aa, Giardia lamblia
LGRGRSQSYSRPSFSGKRSYTNPA

SEQ ID NO: 3121387 - protein, 5 aa, Giardia lamblia
LGRGS

SEQ ID NO: 3121388 - protein, 20 aa, Giardia lamblia
LGRHSGHGKRRGTREARMPS

SEQ ID NO: 3121389 - protein, 8 aa, Giardia lamblia
LGRKDQHG

SEQ ID NO: 3121390 - protein, 15 aa, Giardia lamblia
LGRNNDESNEEVDGE

SEQ ID NO: 3121391 - protein, 45 aa, Giardia lamblia
LGRSTGPRKRESEEESRVTPRPGNSLAESSYKRITSSVEKRAHTS

SEQ ID NO: 3121392 - protein, 4 aa, Giardia lamblia
LGSA

SEQ ID NO: 3121393 - protein, 7 aa, Giardia lamblia
LGSAKGE

SEQ ID NO: 3121394 - protein, 5 aa, Giardia lamblia
LGSDA

SEQ ID NO: 3121395 - protein, 5 aa, Giardia lamblia
LGSDP

SEQ ID NO: 3121396 - protein, 21 aa, Giardia lamblia
LGSENANAGVERDNDDDDAPI

SEQ ID NO: 3121397 - protein, 8 aa, Giardia lamblia
LGSETQHV

SEQ ID NO: 3121398 - protein, 20 aa, Giardia lamblia
LGSGNIADGGDTAQGGGTGI

SEQ ID NO: 3121399 - protein, 7 aa, Giardia lamblia
LGSGSFG

SEQ ID NO: 3121400 - protein, 6 aa, Giardia lamblia
LGSGSG

SEQ ID NO: 3121401 - protein, 14 aa, Giardia lamblia
LGSGTDSDLKKHVR

SEQ ID NO: 3121402 - protein, 9 aa, Giardia lamblia
LGSIPSESA

SEQ ID NO: 3121403 - protein, 5 aa, Giardia lamblia
LGSKT

SEQ ID NO: 3121404 - protein, 4 aa, Giardia lamblia
LGSL

SEQ ID NO: 3121405 - protein, 5 aa, Giardia lamblia
LGSME

SEQ ID NO: 3121406 - protein, 10 aa, Giardia lamblia
LGSNSEKEEF

SEQ ID NO: 3121407 - protein, 4 aa, Giardia lamblia
LGSP

SEQ ID NO: 3121408 - protein, 15 aa, Giardia lamblia
LGSPHKSQHKSAHQA

SEQ ID NO: 3121409 - protein, 11 aa, Giardia lamblia
LGSPSGRTGDL

SEQ ID NO: 3121410 - protein, 5 aa, Giardia lamblia
LGSQN

SEQ ID NO: 3121411 - protein, 8 aa, Giardia lamblia
LGSSGANI

SEQ ID NO: 3121412 - protein, 11 aa, Giardia lamblia
LGSSNTTDAKQ

SEQ ID NO: 3121413 - protein, 8 aa, Giardia lamblia
LGSSPEVS

SEQ ID NO: 3121414 - protein, 8 aa, Giardia lamblia
LGSSSKDA

SEQ ID NO: 3121415 - protein, 10 aa, Giardia lamblia
LGSSSLISPQ

SEQ ID NO: 3121416 - protein, 6 aa, Giardia lamblia
LGSTAG

SEQ ID NO: 3121417 - protein, 7 aa, Giardia lamblia
LGSTGIT

SEQ ID NO: 3121418 - protein, 5 aa, Giardia lamblia
LGSTQ

SEQ ID NO: 3121419 - protein, 9 aa, Giardia lamblia
LGSTRGVSE

SEQ ID NO: 3121420 - protein, 8 aa, Giardia lamblia
LGSTRHAS

SEQ ID NO: 3121421 - protein, 7 aa, Giardia lamblia
LGSYQTN

SEQ ID NO: 3121422 - protein, 13 aa, Giardia lamblia
LGTAGLSAGGVPM

SEQ ID NO: 3121423 - protein, 4 aa, Giardia lamblia
LGTG

SEQ ID NO: 3121424 - protein, 6 aa, Giardia lamblia
LGTGGH

SEQ ID NO: 3121425 - protein, 9 aa, Giardia lamblia
LGTGPNKTV

SEQ ID NO: 3121426 - protein, 5 aa, Giardia lamblia
LGTIG

SEQ ID NO: 3121427 - protein, 27 aa, Giardia lamblia
LGTKPSELSAPQNQKTKDTGSQSRGNI

SEQ ID NO: 3121428 - protein, 15 aa, Giardia lamblia
LGTNPTIQKCTSEKL

SEQ ID NO: 3121429 - protein, 8 aa, Giardia lamblia
LGTPATAQ

SEQ ID NO: 3121430 - protein, 11 aa, Giardia lamblia
LGTPDKQSWPD

SEQ ID NO: 3121431 - protein, 10 aa, Giardia lamblia
LGTPSYTAPE

SEQ ID NO: 3121432 - protein, 7 aa, Giardia lamblia
LGTQEAA

SEQ ID NO: 3121433 - protein, 7 aa, Giardia lamblia
LGTQETR

SEQ ID NO: 3121434 - protein, 8 aa, Giardia lamblia
LGTRASSL

SEQ ID NO: 3121435 - protein, 8 aa, Giardia lamblia
LGTRPTRG

SEQ ID NO: 3121436 - protein, 8 aa, Giardia lamblia
LGTRPTSS

SEQ ID NO: 3121437 - protein, 4 aa, Giardia lamblia
LGTS

SEQ ID NO: 3121438 - protein, 6 aa, Giardia lamblia
LGTSSD

SEQ ID NO: 3121439 - protein, 8 aa, Giardia lamblia
LGTSSTTD

SEQ ID NO: 3121440 - protein, 16 aa, Giardia lamblia
LGTSTGSGLSVSGKAS

SEQ ID NO: 3121441 - protein, 18 aa, Giardia lamblia
LGTSTGTSIHNHNKPDTV

SEQ ID NO: 3121442 - protein, 7 aa, Giardia lamblia
LGTSYTT

SEQ ID NO: 3121443 - protein, 29 aa, Giardia lamblia
LGTTNTGPNSPYNPSFTEGGAQRHQTSTL

SEQ ID NO: 3121444 - protein, 17 aa, Giardia lamblia
LGTTTTAPGSLAKSAIP

SEQ ID NO: 3121445 - protein, 11 aa, Giardia lamblia
LGTVSERNIET

SEQ ID NO: 3121446 - protein, 4 aa, Giardia lamblia
LGTY

SEQ ID NO: 3121447 - protein, 7 aa, Giardia lamblia
LGVAPSS

SEQ ID NO: 3121448 - protein, 13 aa, Giardia lamblia
LGYDPSQASINKK

SEQ ID NO: 3121449 - protein, 5 aa, Giardia lamblia
LGYEP

SEQ ID NO: 3121450 - protein, 11 aa, Giardia lamblia
LHADNQSSISK

SEQ ID NO: 3121451 - protein, 11 aa, Giardia lamblia
LHAPGASANNR

SEQ ID NO: 3121452 - protein, 4 aa, Giardia lamblia
LHAQ

SEQ ID NO: 3121453 - protein, 7 aa, Giardia lamblia
LHDPTTD

SEQ ID NO: 3121454 - protein, 6 aa, Giardia lamblia
LHDQDG

SEQ ID NO: 3121455 - protein, 9 aa, Giardia lamblia
LHDSPEKRQ

SEQ ID NO: 3121456 - protein, 10 aa, Giardia lamblia
LHEKDAEINE

SEQ ID NO: 3121457 - protein, 11 aa, Giardia lamblia
LHEKGRQDDAG

SEQ ID NO: 3121458 - protein, 6 aa, Giardia lamblia
LHEKGS

SEQ ID NO: 3121459 - protein, 10 aa, Giardia lamblia
LHESQDTISK

SEQ ID NO: 3121460 - protein, 5 aa, Giardia lamblia
LHGDE

SEQ ID NO: 3121461 - protein, 8 aa, Giardia lamblia
LHGEEQPA

SEQ ID NO: 3121462 - protein, 8 aa, Giardia lamblia
LHGGQNHA

SEQ ID NO: 3121463 - protein, 24 aa, Giardia lamblia
LHGPPGSRNVQRVGNPSQKRKNIT

SEQ ID NO: 3121464 - protein, 13 aa, Giardia lamblia
LHGSHTNEEESSF

SEQ ID NO: 3121465 - protein, 6 aa, Giardia lamblia
LHGTSV

SEQ ID NO: 3121466 - protein, 8 aa, Giardia lamblia
LHKDNDGE

SEQ ID NO: 3121467 - protein, 7 aa, Giardia lamblia
LHKKETS

SEQ ID NO: 3121468 - protein, 9 aa, Giardia lamblia
LHNDNGQTV

SEQ ID NO: 3121469 - protein, 9 aa, Giardia lamblia
LHNKKGETA

SEQ ID NO: 3121470 - protein, 13 aa, Giardia lamblia
LHPDRSTGKEAAF

SEQ ID NO: 3121471 - protein, 12 aa, Giardia lamblia
LHPDSHQSYSRD

SEQ ID NO: 3121472 - protein, 17 aa, Giardia lamblia
LHPDTDSSAPDGFEPPD

SEQ ID NO: 3121473 - protein, 12 aa, Giardia lamblia
LHPHPPPPLYAP

SEQ ID NO: 3121474 - protein, 6 aa, Giardia lamblia
LHPSTT

SEQ ID NO: 3121475 - protein, 4 aa, Giardia lamblia
LHPT

SEQ ID NO: 3121476 - protein, 7 aa, Giardia lamblia
LHREESH

SEQ ID NO: 3121477 - protein, 16 aa, Giardia lamblia
LHRPPSGAATGAQRNK

SEQ ID NO: 3121478 - protein, 48 aa, Giardia lamblia
LHRPSGHGGPNPRRREYNDRRPNRNEHKRQQTAKHTGPTNGEGSTKAV

SEQ ID NO: 3121479 - protein, 23 aa, Giardia lamblia
LHSATSAQPRPGSTKDEGNHTES

SEQ ID NO: 3121480 - protein, 15 aa, Giardia lamblia
LHSDGSAAFDSNNRD

SEQ ID NO: 3121481 - protein, 4 aa, Giardia lamblia
LHSE

SEQ ID NO: 3121482 - protein, 10 aa, Giardia lamblia
LHSGGLGGGH

SEQ ID NO: 3121483 - protein, 16 aa, Giardia lamblia
LHSSPRAHSIESNDPS

SEQ ID NO: 3121484 - protein, 17 aa, Giardia lamblia
LHSSSGKREDSGSSAEI

SEQ ID NO: 3121485 - protein, 10 aa, Giardia lamblia
LHSSSGPAIK

SEQ ID NO: 3121486 - protein, 6 aa, Giardia lamblia
LHSSSL

SEQ ID NO: 3121487 - protein, 12 aa, Giardia lamblia
LHSTEEPELDEG

SEQ ID NO: 3121488 - protein, 9 aa, Giardia lamblia
LHTERNSAS

SEQ ID NO: 3121489 - protein, 7 aa, Giardia lamblia
LHTETSN

SEQ ID NO: 3121490 - protein, 10 aa, Giardia lamblia
LHTGSKAGHD

SEQ ID NO: 3121491 - protein, 5 aa, Giardia lamblia
LHTGT

SEQ ID NO: 3121492 - protein, 8 aa, Giardia lamblia
LHTNEEPT

SEQ ID NO: 3121493 - protein, 4 aa, Giardia lamblia
LHTS

SEQ ID NO: 3121494 - protein, 21 aa, Giardia lamblia
LIANGSQSLSATATESRKSNA

SEQ ID NO: 3121495 - protein, 21 aa, Giardia lamblia
LIPGNTQNAQEQQTTEGQIDE

SEQ ID NO: 3121496 - protein, 14 aa, Giardia lamblia
LIPTESQSKHLPQK

SEQ ID NO: 3121497 - protein, 10 aa, Giardia lamblia
LIQNGPSDNM

SEQ ID NO: 3121498 - protein, 8 aa, Giardia lamblia
LIQPSTDD

SEQ ID NO: 3121499 - protein, 10 aa, Giardia lamblia
LISGETASSF

SEQ ID NO: 3121500 - protein, 7 aa, Giardia lamblia
LISSSED

SEQ ID NO: 3121501 - protein, 14 aa, Giardia lamblia
LKADDNAQGPPVAE

SEQ ID NO: 3121502 - protein, 7 aa, Giardia lamblia
LKAEPND

SEQ ID NO: 3121503 - protein, 11 aa, Giardia lamblia
LKAGPEQQHND

SEQ ID NO: 3121504 - protein, 11 aa, Giardia lamblia
LKAKAEHRHNA

SEQ ID NO: 3121505 - protein, 9 aa, Giardia lamblia
LKAKNSNLN

SEQ ID NO: 3121506 - protein, 8 aa, Giardia lamblia
LKANSGRI

SEQ ID NO: 3121507 - protein, 9 aa, Giardia lamblia
LKAPEAADK

SEQ ID NO: 3121508 - protein, 6 aa, Giardia lamblia
LKAQSV

SEQ ID NO: 3121509 - protein, 5 aa, Giardia lamblia
LKASN

SEQ ID NO: 3121510 - protein, 8 aa, Giardia lamblia
LKASQDVE

SEQ ID NO: 3121511 - protein, 10 aa, Giardia lamblia
LKASSAVNNT

SEQ ID NO: 3121512 - protein, 6 aa, Giardia lamblia
LKATGE

SEQ ID NO: 3121513 - protein, 16 aa, Giardia lamblia
LKDANERADAKERELT

SEQ ID NO: 3121514 - protein, 6 aa, Giardia lamblia
LKDDES

SEQ ID NO: 3121515 - protein, 19 aa, Giardia lamblia
LKDDRPSQASYYDVAAPNA

SEQ ID NO: 3121516 - protein, 9 aa, Giardia lamblia
LKDEDARKA

SEQ ID NO: 3121517 - protein, 6 aa, Giardia lamblia
LKDEDS

SEQ ID NO: 3121518 - protein, 8 aa, Giardia lamblia
LKDGKTAL

SEQ ID NO: 3121519 - protein, 10 aa, Giardia lamblia
LKDGKTRTLN

SEQ ID NO: 3121520 - protein, 8 aa, Giardia lamblia
LKDGSTPL

SEQ ID NO: 3121521 - protein, 7 aa, Giardia lamblia
LKDGTTG

SEQ ID NO: 3121522 - protein, 21 aa, Giardia lamblia
LKDGVDAQGKPCKVSAESGQP

SEQ ID NO: 3121523 - protein, 22 aa, Giardia lamblia
LKDISDRVKQEKLKKEAETRQE

SEQ ID NO: 3121524 - protein, 9 aa, Giardia lamblia
LKDKQPVKP

SEQ ID NO: 3121525 - protein, 25 aa, Giardia lamblia
LKDNEIAESMDEGTFSNQQQKISDL

SEQ ID NO: 3121526 - protein, 6 aa, Giardia lamblia
LKDNEK

SEQ ID NO: 3121527 - protein, 7 aa, Giardia lamblia
LKDNIGK

SEQ ID NO: 3121528 - protein, 5 aa, Giardia lamblia
LKDNM

SEQ ID NO: 3121529 - protein, 8 aa, Giardia lamblia
LKDNNGET

SEQ ID NO: 3121530 - protein, 8 aa, Giardia lamblia
LKDNSGQT

SEQ ID NO: 3121531 - protein, 4 aa, Giardia lamblia
LKDQ

SEQ ID NO: 3121532 - protein, 7 aa, Giardia lamblia
LKDQTEK

SEQ ID NO: 3121533 - protein, 8 aa, Giardia lamblia
LKDSERNA

SEQ ID NO: 3121534 - protein, 9 aa, Giardia lamblia
LKDSSDKQF

SEQ ID NO: 3121535 - protein, 32 aa, Giardia lamblia
LKDTESKLREANATITNYNQERAKYEKDIQEL

SEQ ID NO: 3121536 - protein, 7 aa, Giardia lamblia
LKDYNTG

SEQ ID NO: 3121537 - protein, 40 aa, Giardia lamblia
LKEANAKREEAARKQRKKNRERREKNARAASGEQKISNAK

SEQ ID NO: 3121538 - protein, 41 aa, Giardia lamblia
LKEANVSKKSLEQSSSNSSKKIASLSSAKTSLEKQLSTANA

SEQ ID NO: 3121539 - protein, 12 aa, Giardia lamblia
LKEARESEPSAF

SEQ ID NO: 3121540 - protein, 4 aa, Giardia lamblia
LKED

SEQ ID NO: 3121541 - protein, 9 aa, Giardia lamblia
LKEEASSEQ

SEQ ID NO: 3121542 - protein, 9 aa, Giardia lamblia
LKEESEQCD

SEQ ID NO: 3121543 - protein, 8 aa, Giardia lamblia
LKEETRTV

SEQ ID NO: 3121544 - protein, 7 aa, Giardia lamblia
LKEGAES

SEQ ID NO: 3121545 - protein, 12 aa, Giardia lamblia
LKEGEPQNTNDA

SEQ ID NO: 3121546 - protein, 8 aa, Giardia lamblia
LKEGKPPI

SEQ ID NO: 3121547 - protein, 25 aa, Giardia lamblia
LKEGPGSDTETSSDDSDEDPEAARE

SEQ ID NO: 3121548 - protein, 8 aa, Giardia lamblia
LKEGPRNS

SEQ ID NO: 3121549 - protein, 7 aa, Giardia lamblia
LKEGRRL

SEQ ID NO: 3121550 - protein, 5 aa, Giardia lamblia
LKEKD

SEQ ID NO: 3121551 - protein, 7 aa, Giardia lamblia
LKEKDHE

SEQ ID NO: 3121552 - protein, 9 aa, Giardia lamblia
LKEKEDQYT

SEQ ID NO: 3121553 - protein, 11 aa, Giardia lamblia
LKEKKAAATEI

SEQ ID NO: 3121554 - protein, 7 aa, Giardia lamblia
LKEKNAS

SEQ ID NO: 3121555 - protein, 8 aa, Giardia lamblia
LKEKTRQL

SEQ ID NO: 3121556 - protein, 8 aa, Giardia lamblia
LKENGSGL

SEQ ID NO: 3121557 - protein, 8 aa, Giardia lamblia
LKENTAHV

SEQ ID NO: 3121558 - protein, 34 aa, Giardia lamblia
LKEPGTMSAGTGKRSRLSKMAKGNKANRVQANDI

SEQ ID NO: 3121559 - protein, 17 aa, Giardia lamblia
LKEPPMPCTGTKPLNKG

SEQ ID NO: 3121560 - protein, 10 aa, Giardia lamblia
LKEPSCSSNP

SEQ ID NO: 3121561 - protein, 14 aa, Giardia lamblia
LKEQGPDSSAGNDC

SEQ ID NO: 3121562 - protein, 7 aa, Giardia lamblia
LKEQNQI

SEQ ID NO: 3121563 - protein, 12 aa, Giardia lamblia
LKEQRAKRYQVE

SEQ ID NO: 3121564 - protein, 11 aa, Giardia lamblia
LKERDAQLSEK

SEQ ID NO: 3121565 - protein, 7 aa, Giardia lamblia
LKERDRT

SEQ ID NO: 3121566 - protein, 8 aa, Giardia lamblia
LKERKAPV

SEQ ID NO: 3121567 - protein, 21 aa, Giardia lamblia
LKERQEELQAAESLASGTLDP

SEQ ID NO: 3121568 - protein, 8 aa, Giardia lamblia
LKESDEQA

SEQ ID NO: 3121569 - protein, 20 aa, Giardia lamblia
LKESSEEENVAQNDNQNKNA

SEQ ID NO: 3121570 - protein, 18 aa, Giardia lamblia
LKETQDSLAHSSAETAAL

SEQ ID NO: 3121571 - protein, 17 aa, Giardia lamblia
LKETTNATCGDRYRGDF

SEQ ID NO: 3121572 - protein, 12 aa, Giardia lamblia
LKGDDEACEEDV

SEQ ID NO: 3121573 - protein, 11 aa, Giardia lamblia
LKGDTDEYRIS

SEQ ID NO: 3121574 - protein, 9 aa, Giardia lamblia
LKGENESLR

SEQ ID NO: 3121575 - protein, 4 aa, Giardia lamblia
LKGG

SEQ ID NO: 3121576 - protein, 13 aa, Giardia lamblia
LKGGAGSQGQGGV

SEQ ID NO: 3121577 - protein, 8 aa, Giardia lamblia
LKGGAQDS

SEQ ID NO: 3121578 - protein, 10 aa, Giardia lamblia
LKGGGARTAA

SEQ ID NO: 3121579 - protein, 38 aa, Giardia lamblia
LKGKKKKGKKGSKGSKGKTAAPSKGAAEEAVEDPDKAK

SEQ ID NO: 3121580 - protein, 13 aa, Giardia lamblia
LKGNKDKSFSNTT

SEQ ID NO: 3121581 - protein, 8 aa, Giardia lamblia
LKGNKKTP

SEQ ID NO: 3121582 - protein, 6 aa, Giardia lamblia
LKGNSE

SEQ ID NO: 3121583 - protein, 4 aa, Giardia lamblia
LKGR

SEQ ID NO: 3121584 - protein, 10 aa, Giardia lamblia
LKGRSMRADS

SEQ ID NO: 3121585 - protein, 18 aa, Giardia lamblia
LKGRTSSAVQGEGPGPGL

SEQ ID NO: 3121586 - protein, 6 aa, Giardia lamblia
LKGSKT

SEQ ID NO: 3121587 - protein, 12 aa, Giardia lamblia
LKGSSSQQARQP

SEQ ID NO: 3121588 - protein, 7 aa, Giardia lamblia
LKGSTQA

SEQ ID NO: 3121589 - protein, 12 aa, Giardia lamblia
LKGTLKTREGEL

SEQ ID NO: 3121590 - protein, 4 aa, Giardia lamblia
LKIK

SEQ ID NO: 3121591 - protein, 7 aa, Giardia lamblia
LKIPEED

SEQ ID NO: 3121592 - protein, 6 aa, Giardia lamblia
LKITDS

SEQ ID NO: 3121593 - protein, 7 aa, Giardia lamblia
LKKAEDL

SEQ ID NO: 3121594 - protein, 15 aa, Giardia lamblia
LKKANEESTSDITST

SEQ ID NO: 3121595 - protein, 7 aa, Giardia lamblia
LKKENAE

SEQ ID NO: 3121596 - protein, 4 aa, Giardia lamblia
LKKK

SEQ ID NO: 3121597 - protein, 16 aa, Giardia lamblia
LKKKRPKGLEKKPSPV

SEQ ID NO: 3121598 - protein, 14 aa, Giardia lamblia
LKKPPLNSESRVHS

SEQ ID NO: 3121599 - protein, 9 aa, Giardia lamblia
LKKPRTDEL

SEQ ID NO: 3121600 - protein, 7 aa, Giardia lamblia
LKKRDGF

SEQ ID NO: 3121601 - protein, 13 aa, Giardia lamblia
LKKSGSESSPHET

SEQ ID NO: 3121602 - protein, 8 aa, Giardia lamblia
LKKTSQVA

SEQ ID NO: 3121603 - protein, 8 aa, Giardia lamblia
LKKTTEGI

SEQ ID NO: 3121604 - protein, 11 aa, Giardia lamblia
LKNGDLDGRRR

SEQ ID NO: 3121605 - protein, 11 aa, Giardia lamblia
LKNGEKKLKYP

SEQ ID NO: 3121606 - protein, 6 aa, Giardia lamblia
LKNGGT

SEQ ID NO: 3121607 - protein, 8 aa, Giardia lamblia
LKNGPTEN

SEQ ID NO: 3121608 - protein, 8 aa, Giardia lamblia
LKNGQTAL

SEQ ID NO: 3121609 - protein, 6 aa, Giardia lamblia
LKNKAH

SEQ ID NO: 3121610 - protein, 6 aa, Giardia lamblia
LKNNDE

SEQ ID NO: 3121611 - protein, 9 aa, Giardia lamblia
LKNPEEDVL

SEQ ID NO: 3121612 - protein, 9 aa, Giardia lamblia
LKNPQKRQI

SEQ ID NO: 3121613 - protein, 6 aa, Giardia lamblia
LKNRNA

SEQ ID NO: 3121614 - protein, 7 aa, Giardia lamblia
LKNSRKR

SEQ ID NO: 3121615 - protein, 7 aa, Giardia lamblia
LKNSSAI

SEQ ID NO: 3121616 - protein, 7 aa, Giardia lamblia
LKNTAMR

SEQ ID NO: 3121617 - protein, 9 aa, Giardia lamblia
LKNTGKSLQ

SEQ ID NO: 3121618 - protein, 32 aa, Giardia lamblia
LKNTKSASMSISTQEQVTANGATISGVQQRDS

SEQ ID NO: 3121619 - protein, 6 aa, Giardia lamblia
LKNTSL

SEQ ID NO: 3121620 - protein, 9 aa, Giardia lamblia
LKPDLNRQK

SEQ ID NO: 3121621 - protein, 4 aa, Giardia lamblia
LKPE

SEQ ID NO: 3121622 - protein, 6 aa, Giardia lamblia
LKPEEV

SEQ ID NO: 3121623 - protein, 7 aa, Giardia lamblia
LKPEYAD

SEQ ID NO: 3121624 - protein, 5 aa, Giardia lamblia
LKPGQ

SEQ ID NO: 3121625 - protein, 6 aa, Giardia lamblia
LKPGQR

SEQ ID NO: 3121626 - protein, 10 aa, Giardia lamblia
LKPKKSAPYN

SEQ ID NO: 3121627 - protein, 12 aa, Giardia lamblia
LKPNTSMSSNAK

SEQ ID NO: 3121628 - protein, 10 aa, Giardia lamblia
LKPPLKPADY

SEQ ID NO: 3121629 - protein, 14 aa, Giardia lamblia
LKPPPEYATLPPKS

SEQ ID NO: 3121630 - protein, 12 aa, Giardia lamblia
LKPQRDARYGYG

SEQ ID NO: 3121631 - protein, 15 aa, Giardia lamblia
LKPSNISISDCVEDS

SEQ ID NO: 3121632 - protein, 17 aa, Giardia lamblia
LKPSTQTQIGRDTEATA

SEQ ID NO: 3121633 - protein, 4 aa, Giardia lamblia
LKPT

SEQ ID NO: 3121634 - protein, 8 aa, Giardia lamblia
LKPTTDLR

SEQ ID NO: 3121635 - protein, 16 aa, Giardia lamblia
LKPTTQPKNIDGDAPA

SEQ ID NO: 3121636 - protein, 19 aa, Giardia lamblia
LKQEPGTSSIGPARARSTE

SEQ ID NO: 3121637 - protein, 7 aa, Giardia lamblia
LKQEQQQ

SEQ ID NO: 3121638 - protein, 19 aa, Giardia lamblia
LKQPPATVPLSSARAQSVP

SEQ ID NO: 3121639 - protein, 10 aa, Giardia lamblia
LKQQGPGQIA

SEQ ID NO: 3121640 - protein, 15 aa, Giardia lamblia
LKQRPVSSSSTANLS

SEQ ID NO: 3121641 - protein, 12 aa, Giardia lamblia
LKQSEESRRRQA

SEQ ID NO: 3121642 - protein, 21 aa, Giardia lamblia
LKQTSEGGTGAPSTSQTLPFG

SEQ ID NO: 3121643 - protein, 11 aa, Giardia lamblia
LKRAAEKRAAL

SEQ ID NO: 3121644 - protein, 8 aa, Giardia lamblia
LKRDASGA

SEQ ID NO: 3121645 - protein, 5 aa, Giardia lamblia
LKRDD

SEQ ID NO: 3121646 - protein, 7 aa, Giardia lamblia
LKRGSPD

SEQ ID NO: 3121647 - protein, 4 aa, Giardia lamblia
LKRK

SEQ ID NO: 3121648 - protein, 11 aa, Giardia lamblia
LKRNNPEVEKL

SEQ ID NO: 3121649 - protein, 11 aa, Giardia lamblia
LKRNPDDKGMA

SEQ ID NO: 3121650 - protein, 7 aa, Giardia lamblia
LKRQEQE

SEQ ID NO: 3121651 - protein, 8 aa, Giardia lamblia
LKRTQNGK

SEQ ID NO: 3121652 - protein, 9 aa, Giardia lamblia
LKRTTTELS

SEQ ID NO: 3121653 - protein, 4 aa, Giardia lamblia
LKSA

SEQ ID NO: 3121654 - protein, 6 aa, Giardia lamblia
LKSAGH

SEQ ID NO: 3121655 - protein, 7 aa, Giardia lamblia
LKSCTKQ

SEQ ID NO: 3121656 - protein, 11 aa, Giardia lamblia
LKSDSTATKER

SEQ ID NO: 3121657 - protein, 13 aa, Giardia lamblia
LKSEHASAVAERD

SEQ ID NO: 3121658 - protein, 6 aa, Giardia lamblia
LKSESF

SEQ ID NO: 3121659 - protein, 7 aa, Giardia lamblia
LKSGEKI

SEQ ID NO: 3121660 - protein, 11 aa, Giardia lamblia
LKSGITEDGAM

SEQ ID NO: 3121661 - protein, 6 aa, Giardia lamblia
LKSGRV

SEQ ID NO: 3121662 - protein, 47 aa, Giardia lamblia
LKSNNAKKQKNMAAADKDSHDERECSENGASTINRSAEPSLTDRGRL

SEQ ID NO: 3121663 - protein, 15 aa, Giardia lamblia
LKSNNEQASSSEAIV

SEQ ID NO: 3121664 - protein, 8 aa, Giardia lamblia
LKSNTATI

SEQ ID NO: 3121665 - protein, 10 aa, Giardia lamblia
LKSPSDSTEG

SEQ ID NO: 3121666 - protein, 5 aa, Giardia lamblia
LKSRD

SEQ ID NO: 3121667 - protein, 13 aa, Giardia lamblia
LKSSANKNDTIQE

SEQ ID NO: 3121668 - protein, 6 aa, Giardia lamblia
LKSSDP

SEQ ID NO: 3121669 - protein, 43 aa, Giardia lamblia
LKSSGTELSDQAARYSPSQNKQLTLSEASTGEPKSSDKAAKGT

SEQ ID NO: 3121670 - protein, 8 aa, Giardia lamblia
LKSSIDET

SEQ ID NO: 3121671 - protein, 6 aa, Giardia lamblia
LKSSNA

SEQ ID NO: 3121672 - protein, 6 aa, Giardia lamblia
LKSSQV

SEQ ID NO: 3121673 - protein, 12 aa, Giardia lamblia
LKSSSARGSSVP

SEQ ID NO: 3121674 - protein, 14 aa, Giardia lamblia
LKSSSGGSSTDDEV

SEQ ID NO: 3121675 - protein, 12 aa, Giardia lamblia
LKSSSSKAISPE

SEQ ID NO: 3121676 - protein, 8 aa, Giardia lamblia
LKSSTQKD

SEQ ID NO: 3121677 - protein, 34 aa, Giardia lamblia
LKSSYNSEKLQNSGSGDAKISKKDSAETEKLKNQ

SEQ ID NO: 3121678 - protein, 7 aa, Giardia lamblia
LKSTTSY

SEQ ID NO: 3121679 - protein, 10 aa, Giardia lamblia
LKTDEKISGK

SEQ ID NO: 3121680 - protein, 4 aa, Giardia lamblia
LKTG

SEQ ID NO: 3121681 - protein, 20 aa, Giardia lamblia
LKTGESQKNNAHGDKKGCSV

SEQ ID NO: 3121682 - protein, 6 aa, Giardia lamblia
LKTGET

SEQ ID NO: 3121683 - protein, 10 aa, Giardia lamblia
LKTGRERAAN

SEQ ID NO: 3121684 - protein, 11 aa, Giardia lamblia
LKTHEQGVQSD

SEQ ID NO: 3121685 - protein, 9 aa, Giardia lamblia
LKTKSVPNS

SEQ ID NO: 3121686 - protein, 21 aa, Giardia lamblia
LKTKTELCSKNRAKSPMSSSD

SEQ ID NO: 3121687 - protein, 10 aa, Giardia lamblia
LKTKTRQLQT

SEQ ID NO: 3121688 - protein, 10 aa, Giardia lamblia
LKTPDGAKKY

SEQ ID NO: 3121689 - protein, 8 aa, Giardia lamblia
LKTPEGLT

SEQ ID NO: 3121690 - protein, 8 aa, Giardia lamblia
LKTPNGLP

SEQ ID NO: 3121691 - protein, 21 aa, Giardia lamblia
LKTPPVQEPVKKGTKGKEEPL

SEQ ID NO: 3121692 - protein, 7 aa, Giardia lamblia
LKTPQKY

SEQ ID NO: 3121693 - protein, 7 aa, Giardia lamblia
LKTRESN

SEQ ID NO: 3121694 - protein, 4 aa, Giardia lamblia
LKTT

SEQ ID NO: 3121695 - protein, 15 aa, Giardia lamblia
LKTVRSNKKMTKRQR

SEQ ID NO: 3121696 - protein, 10 aa, Giardia lamblia
LLDGDGDQFK

SEQ ID NO: 3121697 - protein, 23 aa, Giardia lamblia
LLETQGNQQSAPNLGKPTGNQGG

SEQ ID NO: 3121698 - protein, 5 aa, Giardia lamblia
LLGGN

SEQ ID NO: 3121699 - protein, 5 aa, Giardia lamblia
LLPDA

SEQ ID NO: 3121700 - protein, 11 aa, Giardia lamblia
LLPGQNNTRAV

SEQ ID NO: 3121701 - protein, 11 aa, Giardia lamblia
LLPPPTEDQYN

SEQ ID NO: 3121702 - protein, 13 aa, Giardia lamblia
LLPPSQDSKFPMP

SEQ ID NO: 3121703 - protein, 13 aa, Giardia lamblia
LLPRNTSRYNEKL

SEQ ID NO: 3121704 - protein, 6 aa, Giardia lamblia
LLPSSD

SEQ ID NO: 3121705 - protein, 15 aa, Giardia lamblia
LLPSSGRNYKGTWTK

SEQ ID NO: 3121706 - protein, 8 aa, Giardia lamblia
LLPTPEKS

SEQ ID NO: 3121707 - protein, 33 aa, Giardia lamblia
LLRPPKSPISANKNDVRQGAPSKESKASDPLSA

SEQ ID NO: 3121708 - protein, 5 aa, Giardia lamblia
LLSQS

SEQ ID NO: 3121709 - protein, 45 aa, Giardia lamblia
LLSSSRKPSRKSQDLEGSSISSTSSCQPANQSSPRLPQPNDPSLK

SEQ ID NO: 3121710 - protein, 4 aa, Giardia lamblia
LLST

SEQ ID NO: 3121711 - protein, 24 aa, Giardia lamblia
LLSTRSPTATSLNGSKAGFEAQGL

SEQ ID NO: 3121712 - protein, 16 aa, Giardia lamblia
LNADPSNNSAASPGRI

SEQ ID NO: 3121713 - protein, 50 aa, Giardia lamblia
LNADSGSLTTPVQDKKTKNSDYDDSQDDSQAPATSKVPQKTDTNAGPDVK

SEQ ID NO: 3121714 - protein, 20 aa, Giardia lamblia
LNANSRSKSVDKSGVDRQKP

SEQ ID NO: 3121715 - protein, 8 aa, Giardia lamblia
LNAPDSEI

SEQ ID NO: 3121716 - protein, 10 aa, Giardia lamblia
LNAPGFNTTK

SEQ ID NO: 3121717 - protein, 11 aa, Giardia lamblia
LNAPRYGQHES

SEQ ID NO: 3121718 - protein, 11 aa, Giardia lamblia
LNAREADYKDL

SEQ ID NO: 3121719 - protein, 17 aa, Giardia lamblia
LNASLDATDQVLSLSTS

SEQ ID NO: 3121720 - protein, 10 aa, Giardia lamblia
LNASSGNPRI

SEQ ID NO: 3121721 - protein, 7 aa, Giardia lamblia
LNATGSN

SEQ ID NO: 3121722 - protein, 9 aa, Giardia lamblia
LNDAKRALG

SEQ ID NO: 3121723 - protein, 6 aa, Giardia lamblia
LNDANN

SEQ ID NO: 3121724 - protein, 4 aa, Giardia lamblia
LNDC

SEQ ID NO: 3121725 - protein, 33 aa, Giardia lamblia
LNDDQSADSDSTDSTSNSLSSEISEDDADQKSV

SEQ ID NO: 3121726 - protein, 14 aa, Giardia lamblia
LNDDSDDSESSEHL

SEQ ID NO: 3121727 - protein, 17 aa, Giardia lamblia
LNDEQEQESQDSTLDTA

SEQ ID NO: 3121728 - protein, 9 aa, Giardia lamblia
LNDGDGKEL

SEQ ID NO: 3121729 - protein, 29 aa, Giardia lamblia
LNDGGQDTQSGLSSTGRSDTSASTPVPGT

SEQ ID NO: 3121730 - protein, 7 aa, Giardia lamblia
LNDGHSY

SEQ ID NO: 3121731 - protein, 7 aa, Giardia lamblia
LNDNERV

SEQ ID NO: 3121732 - protein, 4 aa, Giardia lamblia
LNDP

SEQ ID NO: 3121733 - protein, 24 aa, Giardia lamblia
LNDSGPTALPSSPSRRMTEASNRN

SEQ ID NO: 3121734 - protein, 5 aa, Giardia lamblia
LNDSK

SEQ ID NO: 3121735 - protein, 22 aa, Giardia lamblia
LNDTDEDQQYLNATSSKEGTLA

SEQ ID NO: 3121736 - protein, 9 aa, Giardia lamblia
LNDTGQMSI

SEQ ID NO: 3121737 - protein, 6 aa, Giardia lamblia
LNEAEN

SEQ ID NO: 3121738 - protein, 11 aa, Giardia lamblia
LNEEKKERSRF

SEQ ID NO: 3121739 - protein, 6 aa, Giardia lamblia
LNEERG

SEQ ID NO: 3121740 - protein, 10 aa, Giardia lamblia
LNEGATDYHG

SEQ ID NO: 3121741 - protein, 14 aa, Giardia lamblia
LNEHEEFTSTDSVH

SEQ ID NO: 3121742 - protein, 4 aa, Giardia lamblia
LNEN

SEQ ID NO: 3121743 - protein, 4 aa, Giardia lamblia
LNEP

SEQ ID NO: 3121744 - protein, 7 aa, Giardia lamblia
LNEQQSR

SEQ ID NO: 3121745 - protein, 8 aa, Giardia lamblia
LNEQSTQI

SEQ ID NO: 3121746 - protein, 7 aa, Giardia lamblia
LNERDSM

SEQ ID NO: 3121747 - protein, 8 aa, Giardia lamblia
LNETTSET

SEQ ID NO: 3121748 - protein, 11 aa, Giardia lamblia
LNGATQSPAIS

SEQ ID NO: 3121749 - protein, 5 aa, Giardia lamblia
LNGEP

SEQ ID NO: 3121750 - protein, 4 aa, Giardia lamblia
LNGF

SEQ ID NO: 3121751 - protein, 5 aa, Giardia lamblia
LNGNP

SEQ ID NO: 3121752 - protein, 4 aa, Giardia lamblia
LNGP

SEQ ID NO: 3121753 - protein, 12 aa, Giardia lamblia
LNGSLRSEKVDK

SEQ ID NO: 3121754 - protein, 19 aa, Giardia lamblia
LNGSSLGSSMGSRRFGTSY

SEQ ID NO: 3121755 - protein, 9 aa, Giardia lamblia
LNGSSVPQE

SEQ ID NO: 3121756 - protein, 9 aa, Giardia lamblia
LNGSYAESS

SEQ ID NO: 3121757 - protein, 11 aa, Giardia lamblia
LNGVEEKEELK

SEQ ID NO: 3121758 - protein, 27 aa, Giardia lamblia
LNHDSAGLTHEPPSLAKERPEDKAVTE

SEQ ID NO: 3121759 - protein, 8 aa, Giardia lamblia
LNIRSKDQ

SEQ ID NO: 3121760 - protein, 7 aa, Giardia lamblia
LNKQGSL

SEQ ID NO: 3121761 - protein, 10 aa, Giardia lamblia
LNKQKNETEE

SEQ ID NO: 3121762 - protein, 10 aa, Giardia lamblia
LNKSRQEVDD

SEQ ID NO: 3121763 - protein, 5 aa, Giardia lamblia
LNMQS

SEQ ID NO: 3121764 - protein, 4 aa, Giardia lamblia
LNNE

SEQ ID NO: 3121765 - protein, 7 aa, Giardia lamblia
LNNEGST

SEQ ID NO: 3121766 - protein, 19 aa, Giardia lamblia
LNNEHDKISEKAYKEYSTE

SEQ ID NO: 3121767 - protein, 14 aa, Giardia lamblia
LNNGPNETEDDVVE

SEQ ID NO: 3121768 - protein, 10 aa, Giardia lamblia
LNNQDNGSDP

SEQ ID NO: 3121769 - protein, 5 aa, Giardia lamblia
LNNQI

SEQ ID NO: 3121770 - protein, 6 aa, Giardia lamblia
LNNQRK

SEQ ID NO: 3121771 - protein, 19 aa, Giardia lamblia
LNNTPRTNTSTNNAGLSGS

SEQ ID NO: 3121772 - protein, 4 aa, Giardia lamblia
LNNY

SEQ ID NO: 3121773 - protein, 4 aa, Giardia lamblia
LNPD

SEQ ID NO: 3121774 - protein, 6 aa, Giardia lamblia
LNPDDV

SEQ ID NO: 3121775 - protein, 7 aa, Giardia lamblia
LNPDGTV

SEQ ID NO: 3121776 - protein, 11 aa, Giardia lamblia
LNPDNKKTLQP

SEQ ID NO: 3121777 - protein, 7 aa, Giardia lamblia
LNPEPAP

SEQ ID NO: 3121778 - protein, 12 aa, Giardia lamblia
LNPEQQQSVQDH

SEQ ID NO: 3121779 - protein, 20 aa, Giardia lamblia
LNPFSSQDDVNLSEPIANSG

SEQ ID NO: 3121780 - protein, 12 aa, Giardia lamblia
LNPGAEDLNGNT

SEQ ID NO: 3121781 - protein, 7 aa, Giardia lamblia
LNPGDGD

SEQ ID NO: 3121782 - protein, 20 aa, Giardia lamblia
LNPKREGGQVRKGANKEDDF

SEQ ID NO: 3121783 - protein, 15 aa, Giardia lamblia
LNPLGAASKAVTTYA

SEQ ID NO: 3121784 - protein, 4 aa, Giardia lamblia
LNPR

SEQ ID NO: 3121785 - protein, 6 aa, Giardia lamblia
LNPRDR

SEQ ID NO: 3121786 - protein, 10 aa, Giardia lamblia
LNPRSHPGTV

SEQ ID NO: 3121787 - protein, 8 aa, Giardia lamblia
LNPRSSKY

SEQ ID NO: 3121788 - protein, 14 aa, Giardia lamblia
LNPSGKTGKPYTIP

SEQ ID NO: 3121789 - protein, 26 aa, Giardia lamblia
LNPSTGVPSAPQPGGASTAGLTQDES

SEQ ID NO: 3121790 - protein, 9 aa, Giardia lamblia
LNPTGKDDL

SEQ ID NO: 3121791 - protein, 6 aa, Giardia lamblia
LNPVST

SEQ ID NO: 3121792 - protein, 9 aa, Giardia lamblia
LNPYSDETK

SEQ ID NO: 3121793 - protein, 5 aa, Giardia lamblia
LNQDR

SEQ ID NO: 3121794 - protein, 6 aa, Giardia lamblia
LNQEAY

SEQ ID NO: 3121795 - protein, 7 aa, Giardia lamblia
LNQSKKD

SEQ ID NO: 3121796 - protein, 12 aa, Giardia lamblia
LNRDTRHTELGN

SEQ ID NO: 3121797 - protein, 5 aa, Giardia lamblia
LNRER

SEQ ID NO: 3121798 - protein, 17 aa, Giardia lamblia
LNRGSLSDEAKPQAEQQ

SEQ ID NO: 3121799 - protein, 8 aa, Giardia lamblia
LNRQDKTE

SEQ ID NO: 3121800 - protein, 20 aa, Giardia lamblia
LNRRGSIGNLSARKDSPPID

SEQ ID NO: 3121801 - protein, 11 aa, Giardia lamblia
LNRRTTPSVNH

SEQ ID NO: 3121802 - protein, 8 aa, Giardia lamblia
LNRSGPYM

SEQ ID NO: 3121803 - protein, 7 aa, Giardia lamblia
LNRSSTL

SEQ ID NO: 3121804 - protein, 19 aa, Giardia lamblia
LNRSWKSRPTATSDQNQKP

SEQ ID NO: 3121805 - protein, 22 aa, Giardia lamblia
LNSAKDREQKISGQYFTNFTDD

SEQ ID NO: 3121806 - protein, 9 aa, Giardia lamblia
LNSDDLSTT

SEQ ID NO: 3121807 - protein, 4 aa, Giardia lamblia
LNSE

SEQ ID NO: 3121808 - protein, 5 aa, Giardia lamblia
LNSEG

SEQ ID NO: 3121809 - protein, 8 aa, Giardia lamblia
LNSEKKPL

SEQ ID NO: 3121810 - protein, 16 aa, Giardia lamblia
LNSGNSVRKENISATT

SEQ ID NO: 3121811 - protein, 7 aa, Giardia lamblia
LNSGRKE

SEQ ID NO: 3121812 - protein, 9 aa, Giardia lamblia
LNSGSNPMA

SEQ ID NO: 3121813 - protein, 8 aa, Giardia lamblia
LNSKSHEC

SEQ ID NO: 3121814 - protein, 15 aa, Giardia lamblia
LNSNEALSSITPKMP

SEQ ID NO: 3121815 - protein, 5 aa, Giardia lamblia
LNSQD

SEQ ID NO: 3121816 - protein, 8 aa, Giardia lamblia
LNSSGGMA

SEQ ID NO: 3121817 - protein, 8 aa, Giardia lamblia
LNSSNGAM

SEQ ID NO: 3121818 - protein, 10 aa, Giardia lamblia
LNSSTAESGV

SEQ ID NO: 3121819 - protein, 8 aa, Giardia lamblia
LNSSTGQI

SEQ ID NO: 3121820 - protein, 11 aa, Giardia lamblia
LNSTEGTTSSA

SEQ ID NO: 3121821 - protein, 7 aa, Giardia lamblia
LNSTNAR

SEQ ID NO: 3121822 - protein, 10 aa, Giardia lamblia
LNSTRTQLRG

SEQ ID NO: 3121823 - protein, 18 aa, Giardia lamblia
LNSYKDKRKSRKHPPASA

SEQ ID NO: 3121824 - protein, 7 aa, Giardia lamblia
LNTAEEA

SEQ ID NO: 3121825 - protein, 5 aa, Giardia lamblia
LNTAK

SEQ ID NO: 3121826 - protein, 15 aa, Giardia lamblia
LNTECNGDSSGENIA

SEQ ID NO: 3121827 - protein, 7 aa, Giardia lamblia
LNTGQDC

SEQ ID NO: 3121828 - protein, 22 aa, Giardia lamblia
LNTGQGNVFGQPQNQFTTSSSN

SEQ ID NO: 3121829 - protein, 9 aa, Giardia lamblia
LNTKEAELK

SEQ ID NO: 3121830 - protein, 15 aa, Giardia lamblia
LNTKEQSLRAREEHV

SEQ ID NO: 3121831 - protein, 6 aa, Giardia lamblia
LNTMSS

SEQ ID NO: 3121832 - protein, 19 aa, Giardia lamblia
LNTNNGSTITGATGIQYTK

SEQ ID NO: 3121833 - protein, 25 aa, Giardia lamblia
LNTPEAPRHTRSRKRLRDTSPPPLL

SEQ ID NO: 3121834 - protein, 8 aa, Giardia lamblia
LNTPKVSS

SEQ ID NO: 3121835 - protein, 9 aa, Giardia lamblia
LNTQNDDLQ

SEQ ID NO: 3121836 - protein, 12 aa, Giardia lamblia
LNTSASSRTHGL

SEQ ID NO: 3121837 - protein, 25 aa, Giardia lamblia
LNTSKDALGSSSPRKDYKIASSGDY

SEQ ID NO: 3121838 - protein, 10 aa, Giardia lamblia
LNTSSSPRQI

SEQ ID NO: 3121839 - protein, 7 aa, Giardia lamblia
LNTTDHG

SEQ ID NO: 3121840 - protein, 18 aa, Giardia lamblia
LNTTNPPVQVDTKRGSPM

SEQ ID NO: 3121841 - protein, 9 aa, Giardia lamblia
LNTVSSRSH

SEQ ID NO: 3121842 - protein, 6 aa, Giardia lamblia
LNVPSS

SEQ ID NO: 3121843 - protein, 7 aa, Giardia lamblia
LPAADDK

SEQ ID NO: 3121844 - protein, 20 aa, Giardia lamblia
LPACNSAEGIKQVTNKNDQV

SEQ ID NO: 3121845 - protein, 9 aa, Giardia lamblia
LPADDELEK

SEQ ID NO: 3121846 - protein, 4 aa, Giardia lamblia
LPAE

SEQ ID NO: 3121847 - protein, 8 aa, Giardia lamblia
LPAECSNS

SEQ ID NO: 3121848 - protein, 7 aa, Giardia lamblia
LPAEDET

SEQ ID NO: 3121849 - protein, 15 aa, Giardia lamblia
LPAEEAATAPNTRES

SEQ ID NO: 3121850 - protein, 8 aa, Giardia lamblia
LPAGAQQS

SEQ ID NO: 3121851 - protein, 6 aa, Giardia lamblia
LPAGTK

SEQ ID NO: 3121852 - protein, 10 aa, Giardia lamblia
LPAKNNNSEA

SEQ ID NO: 3121853 - protein, 6 aa, Giardia lamblia
LPAPLD

SEQ ID NO: 3121854 - protein, 13 aa, Giardia lamblia
LPAPPPIEEPPSD

SEQ ID NO: 3121855 - protein, 8 aa, Giardia lamblia
LPAPYGLP

SEQ ID NO: 3121856 - protein, 22 aa, Giardia lamblia
LPARPSCPAPSEEVSSSSTTVS

SEQ ID NO: 3121857 - protein, 11 aa, Giardia lamblia
LPASGGREDRI

SEQ ID NO: 3121858 - protein, 42 aa, Giardia lamblia
LPASSAESRTTTQPSSASSTPQTSQTPISGDKKTSSKSNSRL

SEQ ID NO: 3121859 - protein, 10 aa, Giardia lamblia
LPASVTNAGY

SEQ ID NO: 3121860 - protein, 11 aa, Giardia lamblia
LPCSQQTKPVT

SEQ ID NO: 3121861 - protein, 8 aa, Giardia lamblia
LPDDGSGR

SEQ ID NO: 3121862 - protein, 10 aa, Giardia lamblia
LPDDTQRHQA

SEQ ID NO: 3121863 - protein, 8 aa, Giardia lamblia
LPDEDPTE

SEQ ID NO: 3121864 - protein, 17 aa, Giardia lamblia
LPDEEDENIDEYKPDLP

SEQ ID NO: 3121865 - protein, 35 aa, Giardia lamblia
LPDEVDKAADGDTNYARTREPDPSRFKKNGTTGFN

SEQ ID NO: 3121866 - protein, 5 aa, Giardia lamblia
LPDGR

SEQ ID NO: 3121867 - protein, 6 aa, Giardia lamblia
LPDGRT

SEQ ID NO: 3121868 - protein, 6 aa, Giardia lamblia
LPDGTS

SEQ ID NO: 3121869 - protein, 7 aa, Giardia lamblia
LPDHDTS

SEQ ID NO: 3121870 - protein, 6 aa, Giardia lamblia
LPDKDN

SEQ ID NO: 3121871 - protein, 15 aa, Giardia lamblia
LPDKPWRSRDCTPAK

SEQ ID NO: 3121872 - protein, 9 aa, Giardia lamblia
LPDKRHVTR

SEQ ID NO: 3121873 - protein, 11 aa, Giardia lamblia
LPDKTSSITEE

SEQ ID NO: 3121874 - protein, 11 aa, Giardia lamblia
LPDMETAPPLE

SEQ ID NO: 3121875 - protein, 12 aa, Giardia lamblia
LPDNRSTDTPCD

SEQ ID NO: 3121876 - protein, 4 aa, Giardia lamblia
LPDP

SEQ ID NO: 3121877 - protein, 14 aa, Giardia lamblia
LPDPPHASRSSKAL

SEQ ID NO: 3121878 - protein, 11 aa, Giardia lamblia
LPDPTYNPNNI

SEQ ID NO: 3121879 - protein, 9 aa, Giardia lamblia
LPDQKGREE

SEQ ID NO: 3121880 - protein, 10 aa, Giardia lamblia
LPDSDQDMPV

SEQ ID NO: 3121881 - protein, 9 aa, Giardia lamblia
LPDSNSVRP

SEQ ID NO: 3121882 - protein, 4 aa, Giardia lamblia
LPDT

SEQ ID NO: 3121883 - protein, 5 aa, Giardia lamblia
LPDTL

SEQ ID NO: 3121884 - protein, 5 aa, Giardia lamblia
LPDYS

SEQ ID NO: 3121885 - protein, 6 aa, Giardia lamblia
LPDYSD

SEQ ID NO: 3121886 - protein, 5 aa, Giardia lamblia
LPEDA

SEQ ID NO: 3121887 - protein, 15 aa, Giardia lamblia
LPEDKGPKKTKDGSI

SEQ ID NO: 3121888 - protein, 11 aa, Giardia lamblia
LPEDLESNATA

SEQ ID NO: 3121889 - protein, 11 aa, Giardia lamblia
LPEDSMDQLDP

SEQ ID NO: 3121890 - protein, 4 aa, Giardia lamblia
LPEE

SEQ ID NO: 3121891 - protein, 6 aa, Giardia lamblia
LPEEAN

SEQ ID NO: 3121892 - protein, 14 aa, Giardia lamblia
LPEEERGQYTNQPY

SEQ ID NO: 3121893 - protein, 9 aa, Giardia lamblia
LPEEKGDDS

SEQ ID NO: 3121894 - protein, 7 aa, Giardia lamblia
LPEESPK

SEQ ID NO: 3121895 - protein, 9 aa, Giardia lamblia
LPEESSNVQ

SEQ ID NO: 3121896 - protein, 10 aa, Giardia lamblia
LPEGDSDSGI

SEQ ID NO: 3121897 - protein, 7 aa, Giardia lamblia
LPEGEEA

SEQ ID NO: 3121898 - protein, 37 aa, Giardia lamblia
LPEGGGRGHTGEGRREGAEGRVDGALQGTRGQPPRIP

SEQ ID NO: 3121899 - protein, 5 aa, Giardia lamblia
LPEGT

SEQ ID NO: 3121900 - protein, 13 aa, Giardia lamblia
LPEKDPQTGHPTT

SEQ ID NO: 3121901 - protein, 11 aa, Giardia lamblia
LPEKPIARTGR

SEQ ID NO: 3121902 - protein, 9 aa, Giardia lamblia
LPENSTQAI

SEQ ID NO: 3121903 - protein, 4 aa, Giardia lamblia
LPEP

SEQ ID NO: 3121904 - protein, 17 aa, Giardia lamblia
LPEPAAPALPESEPSLD

SEQ ID NO: 3121905 - protein, 5 aa, Giardia lamblia
LPEPR

SEQ ID NO: 3121906 - protein, 17 aa, Giardia lamblia
LPEQDQVGGLEKDIPNK

SEQ ID NO: 3121907 - protein, 8 aa, Giardia lamblia
LPEQSDYG

SEQ ID NO: 3121908 - protein, 5 aa, Giardia lamblia
LPESL

SEQ ID NO: 3121909 - protein, 11 aa, Giardia lamblia
LPESNSPLSQA

SEQ ID NO: 3121910 - protein, 8 aa, Giardia lamblia
LPESNSSI

SEQ ID NO: 3121911 - protein, 18 aa, Giardia lamblia
LPFSRGRTSATSRSQELD

SEQ ID NO: 3121912 - protein, 5 aa, Giardia lamblia
LPGDI

SEQ ID NO: 3121913 - protein, 8 aa, Giardia lamblia
LPGDPFSA

SEQ ID NO: 3121914 - protein, 15 aa, Giardia lamblia
LPGEGEPKWSFPADT

SEQ ID NO: 3121915 - protein, 5 aa, Giardia lamblia
LPGEL

SEQ ID NO: 3121916 - protein, 6 aa, Giardia lamblia
LPGETR

SEQ ID NO: 3121917 - protein, 4 aa, Giardia lamblia
LPGG

SEQ ID NO: 3121918 - protein, 9 aa, Giardia lamblia
LPGGLGNRG

SEQ ID NO: 3121919 - protein, 14 aa, Giardia lamblia
LPGHMKEESNQELD

SEQ ID NO: 3121920 - protein, 12 aa, Giardia lamblia
LPGHTSGHPEMD

SEQ ID NO: 3121921 - protein, 6 aa, Giardia lamblia
LPGIPD

SEQ ID NO: 3121922 - protein, 11 aa, Giardia lamblia
LPGKSDVTPTA

SEQ ID NO: 3121923 - protein, 9 aa, Giardia lamblia
LPGLTKNSI

SEQ ID NO: 3121924 - protein, 7 aa, Giardia lamblia
LPGNGKS

SEQ ID NO: 3121925 - protein, 5 aa, Giardia lamblia
LPGNS

SEQ ID NO: 3121926 - protein, 23 aa, Giardia lamblia
LPGNSDDNDVKDTEPFKEPYLKQ

SEQ ID NO: 3121927 - protein, 44 aa, Giardia lamblia
LPGNSRTRQAPDPSSSASEAQPALDSPTEQQLSNSGSLRRHPHD

SEQ ID NO: 3121928 - protein, 11 aa, Giardia lamblia
LPGPDYRQEQA

SEQ ID NO: 3121929 - protein, 6 aa, Giardia lamblia
LPGPES

SEQ ID NO: 3121930 - protein, 4 aa, Giardia lamblia
LPGQ

SEQ ID NO: 3121931 - protein, 8 aa, Giardia lamblia
LPGQTNVP

SEQ ID NO: 3121932 - protein, 8 aa, Giardia lamblia
LPGRGSPT

SEQ ID NO: 3121933 - protein, 5 aa, Giardia lamblia
LPGRI

SEQ ID NO: 3121934 - protein, 6 aa, Giardia lamblia
LPGSAD

SEQ ID NO: 3121935 - protein, 17 aa, Giardia lamblia
LPGSGMTDKCPFDCDCC

SEQ ID NO: 3121936 - protein, 11 aa, Giardia lamblia
LPGSKESRNEL

SEQ ID NO: 3121937 - protein, 6 aa, Giardia lamblia
LPGSQT

SEQ ID NO: 3121938 - protein, 7 aa, Giardia lamblia
LPGSSGF

SEQ ID NO: 3121939 - protein, 6 aa, Giardia lamblia
LPGSVY

SEQ ID NO: 3121940 - protein, 7 aa, Giardia lamblia
LPGTCEG

SEQ ID NO: 3121941 - protein, 6 aa, Giardia lamblia
LPGTPT

SEQ ID NO: 3121942 - protein, 5 aa, Giardia lamblia
LPGVE

SEQ ID NO: 3121943 - protein, 11 aa, Giardia lamblia
LPGVPKEKGGL

SEQ ID NO: 3121944 - protein, 12 aa, Giardia lamblia
LPGVSSTPTATA

SEQ ID NO: 3121945 - protein, 4 aa, Giardia lamblia
LPGY

SEQ ID NO: 3121946 - protein, 13 aa, Giardia lamblia
LPHDHGPASDPKL

SEQ ID NO: 3121947 - protein, 4 aa, Giardia lamblia
LPHE

SEQ ID NO: 3121948 - protein, 8 aa, Giardia lamblia
LPHGKGEY

SEQ ID NO: 3121949 - protein, 8 aa, Giardia lamblia
LPHGQQPV

SEQ ID NO: 3121950 - protein, 5 aa, Giardia lamblia
LPHGS

SEQ ID NO: 3121951 - protein, 11 aa, Giardia lamblia
LPHPDEDSNTV

SEQ ID NO: 3121952 - protein, 4 aa, Giardia lamblia
LPHT

SEQ ID NO: 3121953 - protein, 4 aa, Giardia lamblia
LPIN

SEQ ID NO: 3121954 - protein, 21 aa, Giardia lamblia
LPKDATTLHKDNSRLADCGNQ

SEQ ID NO: 3121955 - protein, 6 aa, Giardia lamblia
LPKEDF

SEQ ID NO: 3121956 - protein, 5 aa, Giardia lamblia
LPKEE

SEQ ID NO: 3121957 - protein, 11 aa, Giardia lamblia
LPKENEKELKT

SEQ ID NO: 3121958 - protein, 8 aa, Giardia lamblia
LPKENEKY

SEQ ID NO: 3121959 - protein, 9 aa, Giardia lamblia
LPKIPTDEE

SEQ ID NO: 3121960 - protein, 9 aa, Giardia lamblia
LPKKHNPPL

SEQ ID NO: 3121961 - protein, 12 aa, Giardia lamblia
LPKNSSEKQAAR

SEQ ID NO: 3121962 - protein, 44 aa, Giardia lamblia
LPKPPKKQRVARRATSQACKKSRAPNPPRAPRAPRSSSFAAPKL

SEQ ID NO: 3121963 - protein, 8 aa, Giardia lamblia
LPKPVRAQ

SEQ ID NO: 3121964 - protein, 8 aa, Giardia lamblia
LPKQPHSG

SEQ ID NO: 3121965 - protein, 8 aa, Giardia lamblia
LPKRKEFE

SEQ ID NO: 3121966 - protein, 9 aa, Giardia lamblia
LPKSDQEKY

SEQ ID NO: 3121967 - protein, 14 aa, Giardia lamblia
LPKSLTGASPKPSD

SEQ ID NO: 3121968 - protein, 9 aa, Giardia lamblia
LPKSQEQQL

SEQ ID NO: 3121969 - protein, 15 aa, Giardia lamblia
LPKSSGERIKHRPPS

SEQ ID NO: 3121970 - protein, 8 aa, Giardia lamblia
LPKSTTGY

SEQ ID NO: 3121971 - protein, 17 aa, Giardia lamblia
LPKTEEDLEEEKRRDEE

SEQ ID NO: 3121972 - protein, 16 aa, Giardia lamblia
LPKTEPVEGSGDLRYP

SEQ ID NO: 3121973 - protein, 15 aa, Giardia lamblia
LPKTGMASQSYHQAN

SEQ ID NO: 3121974 - protein, 13 aa, Giardia lamblia
LPLESSNTPVAAE

SEQ ID NO: 3121975 - protein, 9 aa, Giardia lamblia
LPLQPEPIP

SEQ ID NO: 3121976 - protein, 20 aa, Giardia lamblia
LPLSSPSPSDAPITSPQPVT

SEQ ID NO: 3121977 - protein, 5 aa, Giardia lamblia
LPNAQ

SEQ ID NO: 3121978 - protein, 4 aa, Giardia lamblia
LPNC

SEQ ID NO: 3121979 - protein, 14 aa, Giardia lamblia
LPNDPTNDQAPDYN

SEQ ID NO: 3121980 - protein, 11 aa, Giardia lamblia
LPNDTDPGVTD

SEQ ID NO: 3121981 - protein, 15 aa, Giardia lamblia
LPNEASTLSPPRDEY

SEQ ID NO: 3121982 - protein, 9 aa, Giardia lamblia
LPNETHKKV

SEQ ID NO: 3121983 - protein, 6 aa, Giardia lamblia
LPNETI

SEQ ID NO: 3121984 - protein, 7 aa, Giardia lamblia
LPNGAKG

SEQ ID NO: 3121985 - protein, 8 aa, Giardia lamblia
LPNKEKYG

SEQ ID NO: 3121986 - protein, 8 aa, Giardia lamblia
LPNNCSSY

SEQ ID NO: 3121987 - protein, 8 aa, Giardia lamblia
LPNPSLSP

SEQ ID NO: 3121988 - protein, 6 aa, Giardia lamblia
LPNPTA

SEQ ID NO: 3121989 - protein, 13 aa, Giardia lamblia
LPNPVQASAATRL

SEQ ID NO: 3121990 - protein, 8 aa, Giardia lamblia
LPNQTTST

SEQ ID NO: 3121991 - protein, 6 aa, Giardia lamblia
LPNRPL

SEQ ID NO: 3121992 - protein, 7 aa, Giardia lamblia
LPNSPTN

SEQ ID NO: 3121993 - protein, 9 aa, Giardia lamblia
LPNSRNYGK

SEQ ID NO: 3121994 - protein, 7 aa, Giardia lamblia
LPNTMTQ

SEQ ID NO: 3121995 - protein, 4 aa, Giardia lamblia
LPPA

SEQ ID NO: 3121996 - protein, 9 aa, Giardia lamblia
LPPAQDADI

SEQ ID NO: 3121997 - protein, 5 aa, Giardia lamblia
LPPAS

SEQ ID NO: 3121998 - protein, 11 aa, Giardia lamblia
LPPASADDRID

SEQ ID NO: 3121999 - protein, 7 aa, Giardia lamblia
LPPDAKE

SEQ ID NO: 3122000 - protein, 13 aa, Giardia lamblia
LPPDEVPTSAQPG

SEQ ID NO: 3122001 - protein, 7 aa, Giardia lamblia
LPPDQQE

SEQ ID NO: 3122002 - protein, 5 aa, Giardia lamblia
LPPDS

SEQ ID NO: 3122003 - protein, 6 aa, Giardia lamblia
LPPDSE

SEQ ID NO: 3122004 - protein, 6 aa, Giardia lamblia
LPPDTP

SEQ ID NO: 3122005 - protein, 5 aa, Giardia lamblia
LPPDV

SEQ ID NO: 3122006 - protein, 8 aa, Giardia lamblia
LPPDYDTK

SEQ ID NO: 3122007 - protein, 19 aa, Giardia lamblia
LPPEEDSASTAAHDNSTKS

SEQ ID NO: 3122008 - protein, 12 aa, Giardia lamblia
LPPEPEESRRKP

SEQ ID NO: 3122009 - protein, 16 aa, Giardia lamblia
LPPEPPKDSPEQKADQ

SEQ ID NO: 3122010 - protein, 5 aa, Giardia lamblia
LPPES

SEQ ID NO: 3122011 - protein, 6 aa, Giardia lamblia
LPPEYN

SEQ ID NO: 3122012 - protein, 9 aa, Giardia lamblia
LPPGLTRQN

SEQ ID NO: 3122013 - protein, 8 aa, Giardia lamblia
LPPGPRGS

SEQ ID NO: 3122014 - protein, 8 aa, Giardia lamblia
LPPGRNGP

SEQ ID NO: 3122015 - protein, 8 aa, Giardia lamblia
LPPGSMQS

SEQ ID NO: 3122016 - protein, 6 aa, Giardia lamblia
LPPHPV

SEQ ID NO: 3122017 - protein, 4 aa, Giardia lamblia
LPPI

SEQ ID NO: 3122018 - protein, 15 aa, Giardia lamblia
LPPITPSPPNTALPE

SEQ ID NO: 3122019 - protein, 4 aa, Giardia lamblia
LPPK

SEQ ID NO: 3122020 - protein, 5 aa, Giardia lamblia
LPPKA

SEQ ID NO: 3122021 - protein, 9 aa, Giardia lamblia
LPPKDSPFH

SEQ ID NO: 3122022 - protein, 5 aa, Giardia lamblia
LPPKE

SEQ ID NO: 3122023 - protein, 7 aa, Giardia lamblia
LPPKEGC

SEQ ID NO: 3122024 - protein, 8 aa, Giardia lamblia
LPPKHEQR

SEQ ID NO: 3122025 - protein, 39 aa, Giardia lamblia
LPPKPEKDMKSKTSPTKSNAPQKDQKLPTKSELVPQEGK

SEQ ID NO: 3122026 - protein, 4 aa, Giardia lamblia
LPPN

SEQ ID NO: 3122027 - protein, 5 aa, Giardia lamblia
LPPNG

SEQ ID NO: 3122028 - protein, 8 aa, Giardia lamblia
LPPNLTDE

SEQ ID NO: 3122029 - protein, 29 aa, Giardia lamblia
LPPNPPPDKHDRGPRQRAVAGDKTVSNRK

SEQ ID NO: 3122030 - protein, 12 aa, Giardia lamblia
LPPNSDKAQLIT

SEQ ID NO: 3122031 - protein, 15 aa, Giardia lamblia
LPPNTSEEPSSGSTH

SEQ ID NO: 3122032 - protein, 44 aa, Giardia lamblia
LPPPKGFSLPGSPKESSRRSSRESSTGKDVQALPPTKEPNSSTL

SEQ ID NO: 3122033 - protein, 5 aa, Giardia lamblia
LPPPR

SEQ ID NO: 3122034 - protein, 9 aa, Giardia lamblia
LPPPSIDAT

SEQ ID NO: 3122035 - protein, 6 aa, Giardia lamblia
LPPPSV

SEQ ID NO: 3122036 - protein, 15 aa, Giardia lamblia
LPPQNQGQGLTRESS

SEQ ID NO: 3122037 - protein, 5 aa, Giardia lamblia
LPPQT

SEQ ID NO: 3122038 - protein, 9 aa, Giardia lamblia
LPPQTDTGF

SEQ ID NO: 3122039 - protein, 6 aa, Giardia lamblia
LPPQYS

SEQ ID NO: 3122040 - protein, 17 aa, Giardia lamblia
LPPRAGPFSAGPPTLPA

SEQ ID NO: 3122041 - protein, 44 aa, Giardia lamblia
LPPRGSSRKRSPLKARAHADPDPVQQTSHPEPAQQTSARAGPPF

SEQ ID NO: 3122042 - protein, 14 aa, Giardia lamblia
LPPRQLEDKEESVL

SEQ ID NO: 3122043 - protein, 7 aa, Giardia lamblia
LPPSDKY

SEQ ID NO: 3122044 - protein, 6 aa, Giardia lamblia
LPPSPS

SEQ ID NO: 3122045 - protein, 21 aa, Giardia lamblia
LPPSQRQSRQGSRPGTPRVDE

SEQ ID NO: 3122046 - protein, 7 aa, Giardia lamblia
LPPSSLP

SEQ ID NO: 3122047 - protein, 20 aa, Giardia lamblia
LPPSSSTNSLNDRQTSSAGS

SEQ ID NO: 3122048 - protein, 10 aa, Giardia lamblia
LPPSSSVRMR

SEQ ID NO: 3122049 - protein, 8 aa, Giardia lamblia
LPPSTSTI

SEQ ID NO: 3122050 - protein, 5 aa, Giardia lamblia
LPPSY

SEQ ID NO: 3122051 - protein, 8 aa, Giardia lamblia
LPPSYDKD

SEQ ID NO: 3122052 - protein, 4 aa, Giardia lamblia
LPPT

SEQ ID NO: 3122053 - protein, 7 aa, Giardia lamblia
LPPTGGI

SEQ ID NO: 3122054 - protein, 13 aa, Giardia lamblia
LPPTHPDHRNPKD

SEQ ID NO: 3122055 - protein, 28 aa, Giardia lamblia
LPPVSPTNLTASHGNARQHIGSREAMGS

SEQ ID NO: 3122056 - protein, 9 aa, Giardia lamblia
LPQAHTDAV

SEQ ID NO: 3122057 - protein, 22 aa, Giardia lamblia
LPQAPASVKAATDKLQHSRKEE

SEQ ID NO: 3122058 - protein, 6 aa, Giardia lamblia
LPQDNN

SEQ ID NO: 3122059 - protein, 6 aa, Giardia lamblia
LPQDRP

SEQ ID NO: 3122060 - protein, 6 aa, Giardia lamblia
LPQGSL

SEQ ID NO: 3122061 - protein, 12 aa, Giardia lamblia
LPQKQSPPSTVR

SEQ ID NO: 3122062 - protein, 7 aa, Giardia lamblia
LPQNEDE

SEQ ID NO: 3122063 - protein, 8 aa, Giardia lamblia
LPQPDPHL

SEQ ID NO: 3122064 - protein, 9 aa, Giardia lamblia
LPQPPGSDD

SEQ ID NO: 3122065 - protein, 11 aa, Giardia lamblia
LPQPSSQSDLQ

SEQ ID NO: 3122066 - protein, 22 aa, Giardia lamblia
LPQPSVDAERNQSISEPKDVKQ

SEQ ID NO: 3122067 - protein, 7 aa, Giardia lamblia
LPQQNSR

SEQ ID NO: 3122068 - protein, 23 aa, Giardia lamblia
LPQQSSLPISSPRGPQQSHIPQS

SEQ ID NO: 3122069 - protein, 8 aa, Giardia lamblia
LPQSQHQS

SEQ ID NO: 3122070 - protein, 7 aa, Giardia lamblia
LPQSSGV

SEQ ID NO: 3122071 - protein, 13 aa, Giardia lamblia
LPQTTRTDGDPEA

SEQ ID NO: 3122072 - protein, 5 aa, Giardia lamblia
LPQYD

SEQ ID NO: 3122073 - protein, 6 aa, Giardia lamblia
LPRAPS

SEQ ID NO: 3122074 - protein, 8 aa, Giardia lamblia
LPRFDGKE

SEQ ID NO: 3122075 - protein, 13 aa, Giardia lamblia
LPRGQKKTAPSVA

SEQ ID NO: 3122076 - protein, 24 aa, Giardia lamblia
LPRGSDNYNKLKPDIDSHRSVASN

SEQ ID NO: 3122077 - protein, 4 aa, Giardia lamblia
LPRK

SEQ ID NO: 3122078 - protein, 15 aa, Giardia lamblia
LPRPPTKGKHCTHDS

SEQ ID NO: 3122079 - protein, 26 aa, Giardia lamblia
LPRPSLSTIDDPTAESSVDNDDMDIS

SEQ ID NO: 3122080 - protein, 10 aa, Giardia lamblia
LPRPTYISPG

SEQ ID NO: 3122081 - protein, 6 aa, Giardia lamblia
LPRQSY

SEQ ID NO: 3122082 - protein, 9 aa, Giardia lamblia
LPRRTADQC

SEQ ID NO: 3122083 - protein, 5 aa, Giardia lamblia
LPRST

SEQ ID NO: 3122084 - protein, 9 aa, Giardia lamblia
LPRTADRSD

SEQ ID NO: 3122085 - protein, 9 aa, Giardia lamblia
LPRTGQGAS

SEQ ID NO: 3122086 - protein, 6 aa, Giardia lamblia
LPRTSS

SEQ ID NO: 3122087 - protein, 17 aa, Giardia lamblia
LPSAEDQRVEDSSAHEY

SEQ ID NO: 3122088 - protein, 26 aa, Giardia lamblia
LPSAPDSGLVSPASADNKIAYDSSTS

SEQ ID NO: 3122089 - protein, 8 aa, Giardia lamblia
LPSAPSDE

SEQ ID NO: 3122090 - protein, 5 aa, Giardia lamblia
LPSAS

SEQ ID NO: 3122091 - protein, 40 aa, Giardia lamblia
LPSASTSAVDPEASSSRSGNETSTHFGTQQQKQPDHAMGS

SEQ ID NO: 3122092 - protein, 26 aa, Giardia lamblia
LPSATTSSTTSLANYDATESIQVPDP

SEQ ID NO: 3122093 - protein, 10 aa, Giardia lamblia
LPSDAISKSN

SEQ ID NO: 3122094 - protein, 10 aa, Giardia lamblia
LPSDAPATYA

SEQ ID NO: 3122095 - protein, 8 aa, Giardia lamblia
LPSDNHSI

SEQ ID NO: 3122096 - protein, 12 aa, Giardia lamblia
LPSDSKQKVTAT

SEQ ID NO: 3122097 - protein, 9 aa, Giardia lamblia
LPSDYSYAS

SEQ ID NO: 3122098 - protein, 6 aa, Giardia lamblia
LPSENG

SEQ ID NO: 3122099 - protein, 4 aa, Giardia lamblia
LPSG

SEQ ID NO: 3122100 - protein, 6 aa, Giardia lamblia
LPSGDA

SEQ ID NO: 3122101 - protein, 8 aa, Giardia lamblia
LPSGGNEI

SEQ ID NO: 3122102 - protein, 8 aa, Giardia lamblia
LPSGQTVA

SEQ ID NO: 3122103 - protein, 22 aa, Giardia lamblia
LPSGSRKESTDGYDRYSTTVAP

SEQ ID NO: 3122104 - protein, 7 aa, Giardia lamblia
LPSGTDL

SEQ ID NO: 3122105 - protein, 16 aa, Giardia lamblia
LPSKESLPNEEQSAFG

SEQ ID NO: 3122106 - protein, 10 aa, Giardia lamblia
LPSKSANRRH

SEQ ID NO: 3122107 - protein, 8 aa, Giardia lamblia
LPSKSTNV

SEQ ID NO: 3122108 - protein, 4 aa, Giardia lamblia
LPSL

SEQ ID NO: 3122109 - protein, 15 aa, Giardia lamblia
LPSLNRSHSDTRPVN

SEQ ID NO: 3122110 - protein, 14 aa, Giardia lamblia
LPSMPDRSDELNSD

SEQ ID NO: 3122111 - protein, 48 aa, Giardia lamblia
LPSNKPQQPASPVAPPPKSKQVSNTRSSVTSSSHAYTGPAKRSGRDHR

SEQ ID NO: 3122112 - protein, 16 aa, Giardia lamblia
LPSNNALKSEHDEPEI

SEQ ID NO: 3122113 - protein, 8 aa, Giardia lamblia
LPSNPAEL

SEQ ID NO: 3122114 - protein, 5 aa, Giardia lamblia
LPSNS

SEQ ID NO: 3122115 - protein, 8 aa, Giardia lamblia
LPSPESDR

SEQ ID NO: 3122116 - protein, 18 aa, Giardia lamblia
LPSPSSSRSDSVEAAPGH

SEQ ID NO: 3122117 - protein, 9 aa, Giardia lamblia
LPSQDGGES

SEQ ID NO: 3122118 - protein, 8 aa, Giardia lamblia
LPSQEISS

SEQ ID NO: 3122119 - protein, 5 aa, Giardia lamblia
LPSQK

SEQ ID NO: 3122120 - protein, 7 aa, Giardia lamblia
LPSQRRT

SEQ ID NO: 3122121 - protein, 11 aa, Giardia lamblia
LPSRPRQGRCQ

SEQ ID NO: 3122122 - protein, 21 aa, Giardia lamblia
LPSRRSTRPNQNSAQKTAQKG

SEQ ID NO: 3122123 - protein, 17 aa, Giardia lamblia
LPSSAQQNTKKTSTVAA

SEQ ID NO: 3122124 - protein, 6 aa, Giardia lamblia
LPSSDA

SEQ ID NO: 3122125 - protein, 23 aa, Giardia lamblia
LPSSDQAGGKDANPKDPLTKADD

SEQ ID NO: 3122126 - protein, 6 aa, Giardia lamblia
LPSSDT

SEQ ID NO: 3122127 - protein, 12 aa, Giardia lamblia
LPSSKHGKRPRN

SEQ ID NO: 3122128 - protein, 29 aa, Giardia lamblia
LPSSKKSSDESVRYTNPRRGTDQGDHPPI

SEQ ID NO: 3122129 - protein, 7 aa, Giardia lamblia
LPSSPEA

SEQ ID NO: 3122130 - protein, 7 aa, Giardia lamblia
LPSSQQL

SEQ ID NO: 3122131 - protein, 11 aa, Giardia lamblia
LPSSRHTSDGM

SEQ ID NO: 3122132 - protein, 39 aa, Giardia lamblia
LPSSTIPPSGADIAGSNSAPVVPKRSSTSSTVSSGKDIR

SEQ ID NO: 3122133 - protein, 4 aa, Giardia lamblia
LPST

SEQ ID NO: 3122134 - protein, 11 aa, Giardia lamblia
LPSTAAQGIGG

SEQ ID NO: 3122135 - protein, 14 aa, Giardia lamblia
LPSTDDDSDEYQED

SEQ ID NO: 3122136 - protein, 8 aa, Giardia lamblia
LPSTPNHY

SEQ ID NO: 3122137 - protein, 10 aa, Giardia lamblia
LPSTSPQTHT

SEQ ID NO: 3122138 - protein, 6 aa, Giardia lamblia
LPSVPK

SEQ ID NO: 3122139 - protein, 13 aa, Giardia lamblia
LPSYGDAQKSYED

SEQ ID NO: 3122140 - protein, 21 aa, Giardia lamblia
LPTAANPPTVMPRGPTRISSR

SEQ ID NO: 3122141 - protein, 7 aa, Giardia lamblia
LPTAESA

SEQ ID NO: 3122142 - protein, 16 aa, Giardia lamblia
LPTAGESLAENNETSC

SEQ ID NO: 3122143 - protein, 11 aa, Giardia lamblia
LPTAGNCKEAV

SEQ ID NO: 3122144 - protein, 12 aa, Giardia lamblia
LPTATEQEVQDG

SEQ ID NO: 3122145 - protein, 5 aa, Giardia lamblia
LPTDA

SEQ ID NO: 3122146 - protein, 6 aa, Giardia lamblia
LPTDEF

SEQ ID NO: 3122147 - protein, 23 aa, Giardia lamblia
LPTDKSTLPGNRQSTSSDMTTAA

SEQ ID NO: 3122148 - protein, 12 aa, Giardia lamblia
LPTDSKSTPIND

SEQ ID NO: 3122149 - protein, 11 aa, Giardia lamblia
LPTDTSSDTSY

SEQ ID NO: 3122150 - protein, 13 aa, Giardia lamblia
LPTESDAKSTSLN

SEQ ID NO: 3122151 - protein, 7 aa, Giardia lamblia
LPTGQPP

SEQ ID NO: 3122152 - protein, 17 aa, Giardia lamblia
LPTKQIPSNNGSPNVMQ

SEQ ID NO: 3122153 - protein, 14 aa, Giardia lamblia
LPTLDNDSAQLDGK

SEQ ID NO: 3122154 - protein, 6 aa, Giardia lamblia
LPTLPR

SEQ ID NO: 3122155 - protein, 8 aa, Giardia lamblia
LPTNSNLS

SEQ ID NO: 3122156 - protein, 6 aa, Giardia lamblia
LPTNST

SEQ ID NO: 3122157 - protein, 22 aa, Giardia lamblia
LPTNTQKSGASLTEASANNSYT

SEQ ID NO: 3122158 - protein, 4 aa, Giardia lamblia
LPTP

SEQ ID NO: 3122159 - protein, 13 aa, Giardia lamblia
LPTPASRASKNTI

SEQ ID NO: 3122160 - protein, 10 aa, Giardia lamblia
LPTPEASKRK

SEQ ID NO: 3122161 - protein, 7 aa, Giardia lamblia
LPTPNGL

SEQ ID NO: 3122162 - protein, 15 aa, Giardia lamblia
LPTPNTEGDASEKSY

SEQ ID NO: 3122163 - protein, 6 aa, Giardia lamblia
LPTPTS

SEQ ID NO: 3122164 - protein, 19 aa, Giardia lamblia
LPTQTASRTSTRSSSGATI

SEQ ID NO: 3122165 - protein, 10 aa, Giardia lamblia
LPTSPGYSED

SEQ ID NO: 3122166 - protein, 7 aa, Giardia lamblia
LPTSPRT

SEQ ID NO: 3122167 - protein, 4 aa, Giardia lamblia
LPTT

SEQ ID NO: 3122168 - protein, 17 aa, Giardia lamblia
LPTTHSTEAEDDNEHCS

SEQ ID NO: 3122169 - protein, 6 aa, Giardia lamblia
LPTTQK

SEQ ID NO: 3122170 - protein, 6 aa, Giardia lamblia
LPTTTN

SEQ ID NO: 3122171 - protein, 13 aa, Giardia lamblia
LPTTTTKKAEDLR

SEQ ID NO: 3122172 - protein, 4 aa, Giardia lamblia
LPTV

SEQ ID NO: 3122173 - protein, 17 aa, Giardia lamblia
LPVDGPSKKDWRGGRSC

SEQ ID NO: 3122174 - protein, 20 aa, Giardia lamblia
LPVETANESDNAGDRGPIGL

SEQ ID NO: 3122175 - protein, 7 aa, Giardia lamblia
LPVGPSN

SEQ ID NO: 3122176 - protein, 14 aa, Giardia lamblia
LPVSTSSQRKLEDE

SEQ ID NO: 3122177 - protein, 6 aa, Giardia lamblia
LPYEAQ

SEQ ID NO: 3122178 - protein, 7 aa, Giardia lamblia
LPYSKKD

SEQ ID NO: 3122179 - protein, 10 aa, Giardia lamblia
LQAAKDEIDR

SEQ ID NO: 3122180 - protein, 13 aa, Giardia lamblia
LQAAKDNLERSVG

SEQ ID NO: 3122181 - protein, 15 aa, Giardia lamblia
LQAANSSLADQVSDL

SEQ ID NO: 3122182 - protein, 9 aa, Giardia lamblia
LQADNDVTQ

SEQ ID NO: 3122183 - protein, 11 aa, Giardia lamblia
LQAEEPTDGYD

SEQ ID NO: 3122184 - protein, 5 aa, Giardia lamblia
LQAEK

SEQ ID NO: 3122185 - protein, 6 aa, Giardia lamblia
LQAGTR

SEQ ID NO: 3122186 - protein, 10 aa, Giardia lamblia
LQAKTEQVEK

SEQ ID NO: 3122187 - protein, 7 aa, Giardia lamblia
LQARPSV

SEQ ID NO: 3122188 - protein, 19 aa, Giardia lamblia
LQASGSKPHEDSFDESTAR

SEQ ID NO: 3122189 - protein, 9 aa, Giardia lamblia
LQASGSPKD

SEQ ID NO: 3122190 - protein, 12 aa, Giardia lamblia
LQASKGAPPRVT

SEQ ID NO: 3122191 - protein, 7 aa, Giardia lamblia
LQASPRR

SEQ ID NO: 3122192 - protein, 7 aa, Giardia lamblia
LQDAEGH

SEQ ID NO: 3122193 - protein, 11 aa, Giardia lamblia
LQDAGQAADDE

SEQ ID NO: 3122194 - protein, 16 aa, Giardia lamblia
LQDAQEQWKNEMKLLV

SEQ ID NO: 3122195 - protein, 7 aa, Giardia lamblia
LQDAQGH

SEQ ID NO: 3122196 - protein, 8 aa, Giardia lamblia
LQDARGTT

SEQ ID NO: 3122197 - protein, 8 aa, Giardia lamblia
LQDARKEL

SEQ ID NO: 3122198 - protein, 20 aa, Giardia lamblia
LQDASFGKGKYNGNKRPKYD

SEQ ID NO: 3122199 - protein, 8 aa, Giardia lamblia
LQDEEGRT

SEQ ID NO: 3122200 - protein, 7 aa, Giardia lamblia
LQDEGDQ

SEQ ID NO: 3122201 - protein, 9 aa, Giardia lamblia
LQDERRNEI

SEQ ID NO: 3122202 - protein, 9 aa, Giardia lamblia
LQDKGQEHN

SEQ ID NO: 3122203 - protein, 11 aa, Giardia lamblia
LQDKQENGALP

SEQ ID NO: 3122204 - protein, 8 aa, Giardia lamblia
LQDNEGQT

SEQ ID NO: 3122205 - protein, 32 aa, Giardia lamblia
LQDQAATKMNATAKSEGELEQADKVSDEAAYE

SEQ ID NO: 3122206 - protein, 8 aa, Giardia lamblia
LQDRSSVN

SEQ ID NO: 3122207 - protein, 12 aa, Giardia lamblia
LQDSEATTVSTR

SEQ ID NO: 3122208 - protein, 8 aa, Giardia lamblia
LQDSEGRT

SEQ ID NO: 3122209 - protein, 12 aa, Giardia lamblia
LQDSGRRPRYNA

SEQ ID NO: 3122210 - protein, 11 aa, Giardia lamblia
LQDSSSSLDAQ

SEQ ID NO: 3122211 - protein, 8 aa, Giardia lamblia
LQEARSSR

SEQ ID NO: 3122212 - protein, 12 aa, Giardia lamblia
LQEDAEKAREQR

SEQ ID NO: 3122213 - protein, 6 aa, Giardia lamblia
LQEEEA

SEQ ID NO: 3122214 - protein, 6 aa, Giardia lamblia
LQEELP

SEQ ID NO: 3122215 - protein, 13 aa, Giardia lamblia
LQEESADTPSKGF

SEQ ID NO: 3122216 - protein, 8 aa, Giardia lamblia
LQEGSNSC

SEQ ID NO: 3122217 - protein, 5 aa, Giardia lamblia
LQELE

SEQ ID NO: 3122218 - protein, 4 aa, Giardia lamblia
LQEN

SEQ ID NO: 3122219 - protein, 8 aa, Giardia lamblia
LQEPKKAH

SEQ ID NO: 3122220 - protein, 14 aa, Giardia lamblia
LQEQENAPSDSPLQ

SEQ ID NO: 3122221 - protein, 6 aa, Giardia lamblia
LQEQES

SEQ ID NO: 3122222 - protein, 17 aa, Giardia lamblia
LQEQHGKELAEKDGQIQ

SEQ ID NO: 3122223 - protein, 7 aa, Giardia lamblia
LQERRKQ

SEQ ID NO: 3122224 - protein, 8 aa, Giardia lamblia
LQESDVGT

SEQ ID NO: 3122225 - protein, 8 aa, Giardia lamblia
LQESEVRR

SEQ ID NO: 3122226 - protein, 9 aa, Giardia lamblia
LQESSTREI

SEQ ID NO: 3122227 - protein, 7 aa, Giardia lamblia
LQETREL

SEQ ID NO: 3122228 - protein, 19 aa, Giardia lamblia
LQGDPETVAREKARAASRI

SEQ ID NO: 3122229 - protein, 9 aa, Giardia lamblia
LQGDYGPGF

SEQ ID NO: 3122230 - protein, 18 aa, Giardia lamblia
LQGESMESSEQTDKEKKF

SEQ ID NO: 3122231 - protein, 65 aa, Giardia lamblia
LQGGAFPTTQSLSAKGQSAKHQLSTDSKKKRRSKDKHKSRSDDALDSEETPSLSYKASAEAQAIE

SEQ ID NO: 3122232 - protein, 11 aa, Giardia lamblia
LQGGQKATGDV

SEQ ID NO: 3122233 - protein, 12 aa, Giardia lamblia
LQGHKQNEERLR

SEQ ID NO: 3122234 - protein, 7 aa, Giardia lamblia
LQGIQSD

SEQ ID NO: 3122235 - protein, 10 aa, Giardia lamblia
LQGKATDIEQ

SEQ ID NO: 3122236 - protein, 10 aa, Giardia lamblia
LQGPDAEYTE

SEQ ID NO: 3122237 - protein, 8 aa, Giardia lamblia
LQGPGDDN

SEQ ID NO: 3122238 - protein, 10 aa, Giardia lamblia
LQGPNGQERV

SEQ ID NO: 3122239 - protein, 9 aa, Giardia lamblia
LQGRGVSGR

SEQ ID NO: 3122240 - protein, 4 aa, Giardia lamblia
LQGS

SEQ ID NO: 3122241 - protein, 16 aa, Giardia lamblia
LQGSGTKMSASDPNSA

SEQ ID NO: 3122242 - protein, 9 aa, Giardia lamblia
LQGSTKKNM

SEQ ID NO: 3122243 - protein, 4 aa, Giardia lamblia
LQGT

SEQ ID NO: 3122244 - protein, 6 aa, Giardia lamblia
LQHGKG

SEQ ID NO: 3122245 - protein, 7 aa, Giardia lamblia
LQIPDGQ

SEQ ID NO: 3122246 - protein, 9 aa, Giardia lamblia
LQKAQSEVD

SEQ ID NO: 3122247 - protein, 10 aa, Giardia lamblia
LQKDEIRDSL

SEQ ID NO: 3122248 - protein, 31 aa, Giardia lamblia
LQKEQEALADARARHRAEQANKQRRDRQKLT

SEQ ID NO: 3122249 - protein, 21 aa, Giardia lamblia
LQKGHKKQGAHTKKSSQELTR

SEQ ID NO: 3122250 - protein, 4 aa, Giardia lamblia
LQKN

SEQ ID NO: 3122251 - protein, 9 aa, Giardia lamblia
LQKQPAEQL

SEQ ID NO: 3122252 - protein, 12 aa, Giardia lamblia
LQKTETKLHADE

SEQ ID NO: 3122253 - protein, 12 aa, Giardia lamblia
LQKTGTQEKSSL

SEQ ID NO: 3122254 - protein, 16 aa, Giardia lamblia
LQLPNSGALASTYSSP

SEQ ID NO: 3122255 - protein, 11 aa, Giardia lamblia
LQLPQSDAPSI

SEQ ID NO: 3122256 - protein, 12 aa, Giardia lamblia
LQMGSTNAGVTE

SEQ ID NO: 3122257 - protein, 6 aa, Giardia lamblia
LQMPSS

SEQ ID NO: 3122258 - protein, 8 aa, Giardia lamblia
LQNDQEVA

SEQ ID NO: 3122259 - protein, 12 aa, Giardia lamblia
LQNDTRQQSRCS

SEQ ID NO: 3122260 - protein, 6 aa, Giardia lamblia
LQNEQK

SEQ ID NO: 3122261 - protein, 6 aa, Giardia lamblia
LQNGPQ

SEQ ID NO: 3122262 - protein, 7 aa, Giardia lamblia
LQNKDGY

SEQ ID NO: 3122263 - protein, 6 aa, Giardia lamblia
LQNNDG

SEQ ID NO: 3122264 - protein, 9 aa, Giardia lamblia
LQNNEQTKR

SEQ ID NO: 3122265 - protein, 9 aa, Giardia lamblia
LQNNRGKTA

SEQ ID NO: 3122266 - protein, 4 aa, Giardia lamblia
LQNP

SEQ ID NO: 3122267 - protein, 15 aa, Giardia lamblia
LQNPASSTQAERASE

SEQ ID NO: 3122268 - protein, 17 aa, Giardia lamblia
LQNPYAPQQRTAGQTGE

SEQ ID NO: 3122269 - protein, 5 aa, Giardia lamblia
LQNQD

SEQ ID NO: 3122270 - protein, 12 aa, Giardia lamblia
LQNSKDATVTEN

SEQ ID NO: 3122271 - protein, 10 aa, Giardia lamblia
LQNSQEKKGL

SEQ ID NO: 3122272 - protein, 8 aa, Giardia lamblia
LQNSRGNT

SEQ ID NO: 3122273 - protein, 6 aa, Giardia lamblia
LQPDDV

SEQ ID NO: 3122274 - protein, 12 aa, Giardia lamblia
LQPDEEGSSTRF

SEQ ID NO: 3122275 - protein, 5 aa, Giardia lamblia
LQPDR

SEQ ID NO: 3122276 - protein, 9 aa, Giardia lamblia
LQPGDKAGG

SEQ ID NO: 3122277 - protein, 6 aa, Giardia lamblia
LQPGKH

SEQ ID NO: 3122278 - protein, 7 aa, Giardia lamblia
LQPGPPR

SEQ ID NO: 3122279 - protein, 10 aa, Giardia lamblia
LQPKSDQRHM

SEQ ID NO: 3122280 - protein, 6 aa, Giardia lamblia
LQPPAE

SEQ ID NO: 3122281 - protein, 5 aa, Giardia lamblia
LQPPD

SEQ ID NO: 3122282 - protein, 6 aa, Giardia lamblia
LQPPGE

SEQ ID NO: 3122283 - protein, 6 aa, Giardia lamblia
LQPPSC

SEQ ID NO: 3122284 - protein, 7 aa, Giardia lamblia
LQPPTGE

SEQ ID NO: 3122285 - protein, 28 aa, Giardia lamblia
LQPPTQDLATEPSMSASAPIPYPTNREN

SEQ ID NO: 3122286 - protein, 4 aa, Giardia lamblia
LQPQ

SEQ ID NO: 3122287 - protein, 11 aa, Giardia lamblia
LQPRSLTATPV

SEQ ID NO: 3122288 - protein, 14 aa, Giardia lamblia
LQPRSTTSMGPVGG

SEQ ID NO: 3122289 - protein, 4 aa, Giardia lamblia
LQPS

SEQ ID NO: 3122290 - protein, 6 aa, Giardia lamblia
LQPSGK

SEQ ID NO: 3122291 - protein, 14 aa, Giardia lamblia
LQPSMASTGRTGLE

SEQ ID NO: 3122292 - protein, 7 aa, Giardia lamblia
LQPTETA

SEQ ID NO: 3122293 - protein, 6 aa, Giardia lamblia
LQQAEN

SEQ ID NO: 3122294 - protein, 4 aa, Giardia lamblia
LQQD

SEQ ID NO: 3122295 - protein, 18 aa, Giardia lamblia
LQQDDTLSKAGSGYTESL

SEQ ID NO: 3122296 - protein, 15 aa, Giardia lamblia
LQQDKKSMQDGYEEK

SEQ ID NO: 3122297 - protein, 7 aa, Giardia lamblia
LQQDTGL

SEQ ID NO: 3122298 - protein, 14 aa, Giardia lamblia
LQQEATALRTERDA

SEQ ID NO: 3122299 - protein, 9 aa, Giardia lamblia
LQQEEDDKQ

SEQ ID NO: 3122300 - protein, 6 aa, Giardia lamblia
LQQEES

SEQ ID NO: 3122301 - protein, 8 aa, Giardia lamblia
LQQERESR

SEQ ID NO: 3122302 - protein, 7 aa, Giardia lamblia
LQQGGAS

SEQ ID NO: 3122303 - protein, 10 aa, Giardia lamblia
LQQKGSSVSV

SEQ ID NO: 3122304 - protein, 16 aa, Giardia lamblia
LQQKSRELDRTTDTEM

SEQ ID NO: 3122305 - protein, 6 aa, Giardia lamblia
LQQNES

SEQ ID NO: 3122306 - protein, 6 aa, Giardia lamblia
LQQPGA

SEQ ID NO: 3122307 - protein, 5 aa, Giardia lamblia
LQQPN

SEQ ID NO: 3122308 - protein, 10 aa, Giardia lamblia
LQQRDAYKQN

SEQ ID NO: 3122309 - protein, 7 aa, Giardia lamblia
LQQRDRP

SEQ ID NO: 3122310 - protein, 5 aa, Giardia lamblia
LQQSI

SEQ ID NO: 3122311 - protein, 9 aa, Giardia lamblia
LQQSQSDSV

SEQ ID NO: 3122312 - protein, 11 aa, Giardia lamblia
LQQVPAEGHHG

SEQ ID NO: 3122313 - protein, 16 aa, Giardia lamblia
LQRAAAEKAAAEAAEL

SEQ ID NO: 3122314 - protein, 8 aa, Giardia lamblia
LQRAEASH

SEQ ID NO: 3122315 - protein, 14 aa, Giardia lamblia
LQRNPDSKEAKEVT

SEQ ID NO: 3122316 - protein, 12 aa, Giardia lamblia
LQRPPEGSKAAL

SEQ ID NO: 3122317 - protein, 7 aa, Giardia lamblia
LQRRDGR

SEQ ID NO: 3122318 - protein, 12 aa, Giardia lamblia
LQRSATKNADQE

SEQ ID NO: 3122319 - protein, 8 aa, Giardia lamblia
LQRSRTRE

SEQ ID NO: 3122320 - protein, 9 aa, Giardia lamblia
LQRSSEEAM

SEQ ID NO: 3122321 - protein, 4 aa, Giardia lamblia
LQRT

SEQ ID NO: 3122322 - protein, 21 aa, Giardia lamblia
LQRTGRRTDEHEVQMVRSLPA

SEQ ID NO: 3122323 - protein, 7 aa, Giardia lamblia
LQRTKKE

SEQ ID NO: 3122324 - protein, 4 aa, Giardia lamblia
LQSA

SEQ ID NO: 3122325 - protein, 17 aa, Giardia lamblia
LQSAHPGPQRVNQQPKP

SEQ ID NO: 3122326 - protein, 12 aa, Giardia lamblia
LQSAQSDADDNN

SEQ ID NO: 3122327 - protein, 21 aa, Giardia lamblia
LQSATRAGSVKRPAPRTSQEN

SEQ ID NO: 3122328 - protein, 4 aa, Giardia lamblia
LQSD

SEQ ID NO: 3122329 - protein, 15 aa, Giardia lamblia
LQSDTVNSLSDRVNP

SEQ ID NO: 3122330 - protein, 6 aa, Giardia lamblia
LQSEDH

SEQ ID NO: 3122331 - protein, 8 aa, Giardia lamblia
LQSEEDQG

SEQ ID NO: 3122332 - protein, 8 aa, Giardia lamblia
LQSEQTPD

SEQ ID NO: 3122333 - protein, 7 aa, Giardia lamblia
LQSERNQ

SEQ ID NO: 3122334 - protein, 11 aa, Giardia lamblia
LQSGDKGVSNN

SEQ ID NO: 3122335 - protein, 26 aa, Giardia lamblia
LQSGGQASGTIYEPDPPSPPRRGRIT

SEQ ID NO: 3122336 - protein, 11 aa, Giardia lamblia
LQSGPSDSFDE

SEQ ID NO: 3122337 - protein, 15 aa, Giardia lamblia
LQSKPGVSTKSEAHT

SEQ ID NO: 3122338 - protein, 7 aa, Giardia lamblia
LQSNDIQ

SEQ ID NO: 3122339 - protein, 7 aa, Giardia lamblia
LQSNDMD

SEQ ID NO: 3122340 - protein, 10 aa, Giardia lamblia
LQSNKGASHL

SEQ ID NO: 3122341 - protein, 22 aa, Giardia lamblia
LQSNNRAKDTRLERTNDAHDKQ

SEQ ID NO: 3122342 - protein, 7 aa, Giardia lamblia
LQSQDTL

SEQ ID NO: 3122343 - protein, 5 aa, Giardia lamblia
LQSRA

SEQ ID NO: 3122344 - protein, 9 aa, Giardia lamblia
LQSRTPGNL

SEQ ID NO: 3122345 - protein, 4 aa, Giardia lamblia
LQSS

SEQ ID NO: 3122346 - protein, 5 aa, Giardia lamblia
LQSSA

SEQ ID NO: 3122347 - protein, 12 aa, Giardia lamblia
LQSSATKAEVDA

SEQ ID NO: 3122348 - protein, 10 aa, Giardia lamblia
LQSSNEEASV

SEQ ID NO: 3122349 - protein, 7 aa, Giardia lamblia
LQSTGSY

SEQ ID NO: 3122350 - protein, 8 aa, Giardia lamblia
LQSTTQDY

SEQ ID NO: 3122351 - protein, 15 aa, Giardia lamblia
LQTAHNQKTQAEAKV

SEQ ID NO: 3122352 - protein, 24 aa, Giardia lamblia
LQTEAQPSGSNAKGYEDEESIDIL

SEQ ID NO: 3122353 - protein, 11 aa, Giardia lamblia
LQTEKRKTSIY

SEQ ID NO: 3122354 - protein, 7 aa, Giardia lamblia
LQTGDGV

SEQ ID NO: 3122355 - protein, 6 aa, Giardia lamblia
LQTGSL

SEQ ID NO: 3122356 - protein, 13 aa, Giardia lamblia
LQTNNLHSKGAGY

SEQ ID NO: 3122357 - protein, 9 aa, Giardia lamblia
LQTNPERHT

SEQ ID NO: 3122358 - protein, 11 aa, Giardia lamblia
LQTPGPRRPNY

SEQ ID NO: 3122359 - protein, 11 aa, Giardia lamblia
LQTQSKVSSSL

SEQ ID NO: 3122360 - protein, 4 aa, Giardia lamblia
LQTR

SEQ ID NO: 3122361 - protein, 6 aa, Giardia lamblia
LQTRDN

SEQ ID NO: 3122362 - protein, 15 aa, Giardia lamblia
LQTRRRQEEQRACRE

SEQ ID NO: 3122363 - protein, 13 aa, Giardia lamblia
LQTRTNSIAAETG

SEQ ID NO: 3122364 - protein, 11 aa, Giardia lamblia
LQTSANKLTEI

SEQ ID NO: 3122365 - protein, 16 aa, Giardia lamblia
LQTSDSTTTTASTDVK

SEQ ID NO: 3122366 - protein, 22 aa, Giardia lamblia
LQTSKSGTKQQGKPGTKGAPVA

SEQ ID NO: 3122367 - protein, 11 aa, Giardia lamblia
LQTSNKVEDHR

SEQ ID NO: 3122368 - protein, 4 aa, Giardia lamblia
LQVP

SEQ ID NO: 3122369 - protein, 10 aa, Giardia lamblia
LQVPTTNVEE

SEQ ID NO: 3122370 - protein, 11 aa, Giardia lamblia
LQYQSDEPWEY

SEQ ID NO: 3122371 - protein, 5 aa, Giardia lamblia
LRAEN

SEQ ID NO: 3122372 - protein, 8 aa, Giardia lamblia
LRAERTPF

SEQ ID NO: 3122373 - protein, 14 aa, Giardia lamblia
LRAKEHRGKGLSSY

SEQ ID NO: 3122374 - protein, 8 aa, Giardia lamblia
LRANDGRT

SEQ ID NO: 3122375 - protein, 5 aa, Giardia lamblia
LRAQE

SEQ ID NO: 3122376 - protein, 11 aa, Giardia lamblia
LRARKDKENEV

SEQ ID NO: 3122377 - protein, 9 aa, Giardia lamblia
LRASQPASI

SEQ ID NO: 3122378 - protein, 10 aa, Giardia lamblia
LRDAEDADEL

SEQ ID NO: 3122379 - protein, 7 aa, Giardia lamblia
LRDAKDK

SEQ ID NO: 3122380 - protein, 6 aa, Giardia lamblia
LRDDQR

SEQ ID NO: 3122381 - protein, 8 aa, Giardia lamblia
LRDEDGRT

SEQ ID NO: 3122382 - protein, 9 aa, Giardia lamblia
LRDEEDREG

SEQ ID NO: 3122383 - protein, 9 aa, Giardia lamblia
LRDEGKLEQ

SEQ ID NO: 3122384 - protein, 24 aa, Giardia lamblia
LRDESGQGTKNAVYTKNTVPASRN

SEQ ID NO: 3122385 - protein, 11 aa, Giardia lamblia
LRDGASAPSIR

SEQ ID NO: 3122386 - protein, 8 aa, Giardia lamblia
LRDGNTKR

SEQ ID NO: 3122387 - protein, 4 aa, Giardia lamblia
LRDH

SEQ ID NO: 3122388 - protein, 8 aa, Giardia lamblia
LRDKEGKT

SEQ ID NO: 3122389 - protein, 9 aa, Giardia lamblia
LRDKGGETA

SEQ ID NO: 3122390 - protein, 25 aa, Giardia lamblia
LRDKKGRSAAEYAKSEVAKNEFTQN

SEQ ID NO: 3122391 - protein, 9 aa, Giardia lamblia
LRDNNGNTA

SEQ ID NO: 3122392 - protein, 6 aa, Giardia lamblia
LRDPLG

SEQ ID NO: 3122393 - protein, 6 aa, Giardia lamblia
LRDQDD

SEQ ID NO: 3122394 - protein, 4 aa, Giardia lamblia
LRDS

SEQ ID NO: 3122395 - protein, 13 aa, Giardia lamblia
LRDSEEDCRATAD

SEQ ID NO: 3122396 - protein, 8 aa, Giardia lamblia
LRDSNNRT

SEQ ID NO: 3122397 - protein, 7 aa, Giardia lamblia
LRDSRGN

SEQ ID NO: 3122398 - protein, 8 aa, Giardia lamblia
LRDSRGNP

SEQ ID NO: 3122399 - protein, 10 aa, Giardia lamblia
LRDSSANRRF

SEQ ID NO: 3122400 - protein, 9 aa, Giardia lamblia
LRDTEEYDD

SEQ ID NO: 3122401 - protein, 16 aa, Giardia lamblia
LRDTGKASAAPRSPVL

SEQ ID NO: 3122402 - protein, 16 aa, Giardia lamblia
LRDTKKKSQTALNENT

SEQ ID NO: 3122403 - protein, 8 aa, Giardia lamblia
LREDGAAR

SEQ ID NO: 3122404 - protein, 12 aa, Giardia lamblia
LREEEAAGLRKE

SEQ ID NO: 3122405 - protein, 5 aa, Giardia lamblia
LREEY

SEQ ID NO: 3122406 - protein, 4 aa, Giardia lamblia
LREG

SEQ ID NO: 3122407 - protein, 7 aa, Giardia lamblia
LREGEPK

SEQ ID NO: 3122408 - protein, 10 aa, Giardia lamblia
LREGSNLPSI

SEQ ID NO: 3122409 - protein, 6 aa, Giardia lamblia
LREKDS

SEQ ID NO: 3122410 - protein, 11 aa, Giardia lamblia
LREKQEEDALK

SEQ ID NO: 3122411 - protein, 7 aa, Giardia lamblia
LREKQNK

SEQ ID NO: 3122412 - protein, 13 aa, Giardia lamblia
LREKTQKQSSPNT

SEQ ID NO: 3122413 - protein, 5 aa, Giardia lamblia
LRENA

SEQ ID NO: 3122414 - protein, 22 aa, Giardia lamblia
LREPPASGTGEGRPAGQEDPFE

SEQ ID NO: 3122415 - protein, 8 aa, Giardia lamblia
LRERNENL

SEQ ID NO: 3122416 - protein, 9 aa, Giardia lamblia
LRERQQNYQ

SEQ ID NO: 3122417 - protein, 9 aa, Giardia lamblia
LRESTKTNE

SEQ ID NO: 3122418 - protein, 16 aa, Giardia lamblia
LRETTEDLQAAEEEIS

SEQ ID NO: 3122419 - protein, 10 aa, Giardia lamblia
LRGAQNCKNN

SEQ ID NO: 3122420 - protein, 12 aa, Giardia lamblia
LRGDNKDSHNRI

SEQ ID NO: 3122421 - protein, 11 aa, Giardia lamblia
LRGDRPSGQVV

SEQ ID NO: 3122422 - protein, 10 aa, Giardia lamblia
LRGDWTGDSV

SEQ ID NO: 3122423 - protein, 9 aa, Giardia lamblia
LRGEKSRLR

SEQ ID NO: 3122424 - protein, 13 aa, Giardia lamblia
LRGETGPASDVGS

SEQ ID NO: 3122425 - protein, 10 aa, Giardia lamblia
LRGGEKADPH

SEQ ID NO: 3122426 - protein, 8 aa, Giardia lamblia
LRGGGDVT

SEQ ID NO: 3122427 - protein, 5 aa, Giardia lamblia
LRGNS

SEQ ID NO: 3122428 - protein, 6 aa, Giardia lamblia
LRGPES

SEQ ID NO: 3122429 - protein, 13 aa, Giardia lamblia
LRGPKGDYIDVMD

SEQ ID NO: 3122430 - protein, 19 aa, Giardia lamblia
LRGRSKSNKPTSSTSTPWL

SEQ ID NO: 3122431 - protein, 19 aa, Giardia lamblia
LRGTTFDSPDSPEEKPITS

SEQ ID NO: 3122432 - protein, 5 aa, Giardia lamblia
LRHQT

SEQ ID NO: 3122433 - protein, 8 aa, Giardia lamblia
LRKASAAK

SEQ ID NO: 3122434 - protein, 6 aa, Giardia lamblia
LRKEEQ

SEQ ID NO: 3122435 - protein, 39 aa, Giardia lamblia
LRKERRELQRAERKMAKDQARQLKSKSQVDDLAETADSV

SEQ ID NO: 3122436 - protein, 6 aa, Giardia lamblia
LRKRER

SEQ ID NO: 3122437 - protein, 11 aa, Giardia lamblia
LRKSSRNSLST

SEQ ID NO: 3122438 - protein, 11 aa, Giardia lamblia
LRKSTTQEERP

SEQ ID NO: 3122439 - protein, 11 aa, Giardia lamblia
LRKTQPAQSPM

SEQ ID NO: 3122440 - protein, 5 aa, Giardia lamblia
LRNAE

SEQ ID NO: 3122441 - protein, 4 aa, Giardia lamblia
LRNE

SEQ ID NO: 3122442 - protein, 19 aa, Giardia lamblia
LRNENGTLKAENADKGLSR

SEQ ID NO: 3122443 - protein, 5 aa, Giardia lamblia
LRNEP

SEQ ID NO: 3122444 - protein, 4 aa, Giardia lamblia
LRNK

SEQ ID NO: 3122445 - protein, 9 aa, Giardia lamblia
LRNKNNETA

SEQ ID NO: 3122446 - protein, 7 aa, Giardia lamblia
LRNNDSR

SEQ ID NO: 3122447 - protein, 43 aa, Giardia lamblia
LRNSGKLYSSSSAVDGVGKRVSTATSAHTKGTSSKSRGSCDGQ

SEQ ID NO: 3122448 - protein, 6 aa, Giardia lamblia
LRNSQG

SEQ ID NO: 3122449 - protein, 7 aa, Giardia lamblia
LRNSQTA

SEQ ID NO: 3122450 - protein, 7 aa, Giardia lamblia
LRNYPTT

SEQ ID NO: 3122451 - protein, 5 aa, Giardia lamblia
LRPDA

SEQ ID NO: 3122452 - protein, 6 aa, Giardia lamblia
LRPDEL

SEQ ID NO: 3122453 - protein, 6 aa, Giardia lamblia
LRPDQQ

SEQ ID NO: 3122454 - protein, 12 aa, Giardia lamblia
LRPEEKMEHSIN

SEQ ID NO: 3122455 - protein, 4 aa, Giardia lamblia
LRPG

SEQ ID NO: 3122456 - protein, 9 aa, Giardia lamblia
LRPGAPNPV

SEQ ID NO: 3122457 - protein, 38 aa, Giardia lamblia
LRPLPPNDSRFSASSSTALLPDPSLTGGSDSRTSRSSL

SEQ ID NO: 3122458 - protein, 7 aa, Giardia lamblia
LRPNDPV

SEQ ID NO: 3122459 - protein, 13 aa, Giardia lamblia
LRPNSVSHESFSP

SEQ ID NO: 3122460 - protein, 4 aa, Giardia lamblia
LRPP

SEQ ID NO: 3122461 - protein, 8 aa, Giardia lamblia
LRPPPIRE

SEQ ID NO: 3122462 - protein, 17 aa, Giardia lamblia
LRPPQTPQSPPQIPRTS

SEQ ID NO: 3122463 - protein, 9 aa, Giardia lamblia
LRPPSSEQQ

SEQ ID NO: 3122464 - protein, 10 aa, Giardia lamblia
LRPPTPPRKL

SEQ ID NO: 3122465 - protein, 25 aa, Giardia lamblia
LRPQDKPQAHYKGTIPEAKRSSSSF

SEQ ID NO: 3122466 - protein, 32 aa, Giardia lamblia
LRPRSRAKPGRKQSNRKSDVSTHSYAKSSAEN

SEQ ID NO: 3122467 - protein, 6 aa, Giardia lamblia
LRPSMS

SEQ ID NO: 3122468 - protein, 6 aa, Giardia lamblia
LRPSNP

SEQ ID NO: 3122469 - protein, 30 aa, Giardia lamblia
LRPSSTSRSPSSAMTSSARNTKYAKPATEN

SEQ ID NO: 3122470 - protein, 15 aa, Giardia lamblia
LRPTKRFPNQQKRQN

SEQ ID NO: 3122471 - protein, 6 aa, Giardia lamblia
LRPTQR

SEQ ID NO: 3122472 - protein, 15 aa, Giardia lamblia
LRPTSSYAPVRVRYH

SEQ ID NO: 3122473 - protein, 7 aa, Giardia lamblia
LRQEDTP

SEQ ID NO: 3122474 - protein, 7 aa, Giardia lamblia
LRQGTSN

SEQ ID NO: 3122475 - protein, 16 aa, Giardia lamblia
LRQGYDDDLEAKRVNQ

SEQ ID NO: 3122476 - protein, 11 aa, Giardia lamblia
LRQHADSQNRS

SEQ ID NO: 3122477 - protein, 13 aa, Giardia lamblia
LRQNGADAVSSQQ

SEQ ID NO: 3122478 - protein, 10 aa, Giardia lamblia
LRQNSSEVLT

SEQ ID NO: 3122479 - protein, 19 aa, Giardia lamblia
LRQQDAAMDRRKSRREQRR

SEQ ID NO: 3122480 - protein, 11 aa, Giardia lamblia
LRQQGRQPTYP

SEQ ID NO: 3122481 - protein, 10 aa, Giardia lamblia
LRQQKNADAL

SEQ ID NO: 3122482 - protein, 6 aa, Giardia lamblia
LRQQND

SEQ ID NO: 3122483 - protein, 7 aa, Giardia lamblia
LRQQTTI

SEQ ID NO: 3122484 - protein, 6 aa, Giardia lamblia
LRQSKR

SEQ ID NO: 3122485 - protein, 6 aa, Giardia lamblia
LRQSMN

SEQ ID NO: 3122486 - protein, 8 aa, Giardia lamblia
LRQSTDQI

SEQ ID NO: 3122487 - protein, 11 aa, Giardia lamblia
LRRDPKDRYNI

SEQ ID NO: 3122488 - protein, 5 aa, Giardia lamblia
LRRED

SEQ ID NO: 3122489 - protein, 16 aa, Giardia lamblia
LRRESEARNADSSISK

SEQ ID NO: 3122490 - protein, 11 aa, Giardia lamblia
LRRGYQPDQTY

SEQ ID NO: 3122491 - protein, 9 aa, Giardia lamblia
LRRRGGPAV

SEQ ID NO: 3122492 - protein, 6 aa, Giardia lamblia
LRSDKS

SEQ ID NO: 3122493 - protein, 4 aa, Giardia lamblia
LRSE

SEQ ID NO: 3122494 - protein, 7 aa, Giardia lamblia
LRSEKRT

SEQ ID NO: 3122495 - protein, 6 aa, Giardia lamblia
LRSEYQ

SEQ ID NO: 3122496 - protein, 4 aa, Giardia lamblia
LRSG

SEQ ID NO: 3122497 - protein, 18 aa, Giardia lamblia
LRSGARSANIQNVQQSGS

SEQ ID NO: 3122498 - protein, 7 aa, Giardia lamblia
LRSGHSY

SEQ ID NO: 3122499 - protein, 10 aa, Giardia lamblia
LRSGKGLSSV

SEQ ID NO: 3122500 - protein, 10 aa, Giardia lamblia
LRSNESFAPY

SEQ ID NO: 3122501 - protein, 16 aa, Giardia lamblia
LRSNGSRVSKHSCAEQ

SEQ ID NO: 3122502 - protein, 15 aa, Giardia lamblia
LRSNSTERSGDTSNP

SEQ ID NO: 3122503 - protein, 4 aa, Giardia lamblia
LRSP

SEQ ID NO: 3122504 - protein, 42 aa, Giardia lamblia
LRSPSPMRQTAQPMRQERQRNYSSKRGASGSSVGGMTEPRND

SEQ ID NO: 3122505 - protein, 11 aa, Giardia lamblia
LRSQANEDKFS

SEQ ID NO: 3122506 - protein, 7 aa, Giardia lamblia
LRSQPNH

SEQ ID NO: 3122507 - protein, 22 aa, Giardia lamblia
LRSSADRERDSEVSSKKASVQR

SEQ ID NO: 3122508 - protein, 13 aa, Giardia lamblia
LRSSARDAEDLQQ

SEQ ID NO: 3122509 - protein, 6 aa, Giardia lamblia
LRSSTE

SEQ ID NO: 3122510 - protein, 20 aa, Giardia lamblia
LRSTESKKRLTEEKAQLTQE

SEQ ID NO: 3122511 - protein, 12 aa, Giardia lamblia
LRSTEVKSSNKD

SEQ ID NO: 3122512 - protein, 6 aa, Giardia lamblia
LRSTND

SEQ ID NO: 3122513 - protein, 7 aa, Giardia lamblia
LRTDTDV

SEQ ID NO: 3122514 - protein, 10 aa, Giardia lamblia
LRTENSQLNA

SEQ ID NO: 3122515 - protein, 8 aa, Giardia lamblia
LRTGRESA

SEQ ID NO: 3122516 - protein, 30 aa, Giardia lamblia
LRTKGRAKRQDHQTPSLSDNNDTGSTSSFD

SEQ ID NO: 3122517 - protein, 7 aa, Giardia lamblia
LRTNSPG

SEQ ID NO: 3122518 - protein, 6 aa, Giardia lamblia
LRTPQG

SEQ ID NO: 3122519 - protein, 8 aa, Giardia lamblia
LRTQDGTT

SEQ ID NO: 3122520 - protein, 20 aa, Giardia lamblia
LRTRSPSVVSDAARDSTALG

SEQ ID NO: 3122521 - protein, 15 aa, Giardia lamblia
LRTSSGDEKIPSSNS

SEQ ID NO: 3122522 - protein, 7 aa, Giardia lamblia
LRTSSGM

SEQ ID NO: 3122523 - protein, 6 aa, Giardia lamblia
LRTSTR

SEQ ID NO: 3122524 - protein, 10 aa, Giardia lamblia
LRTTTAELSS

SEQ ID NO: 3122525 - protein, 17 aa, Giardia lamblia
LSAADGRAKAATTAKAI

SEQ ID NO: 3122526 - protein, 11 aa, Giardia lamblia
LSAAPSLEAIE

SEQ ID NO: 3122527 - protein, 15 aa, Giardia lamblia
LSAATKSLDKHTERV

SEQ ID NO: 3122528 - protein, 8 aa, Giardia lamblia
LSADNATL

SEQ ID NO: 3122529 - protein, 8 aa, Giardia lamblia
LSADPRQR

SEQ ID NO: 3122530 - protein, 23 aa, Giardia lamblia
LSADSAGTKSQALDKSATQKQAI

SEQ ID NO: 3122531 - protein, 23 aa, Giardia lamblia
LSAEAPDELTDAGGLRPIGGGKQ

SEQ ID NO: 3122532 - protein, 21 aa, Giardia lamblia
LSAENPRAHTIKNNDSPQQTA

SEQ ID NO: 3122533 - protein, 10 aa, Giardia lamblia
LSAERRPSLR

SEQ ID NO: 3122534 - protein, 6 aa, Giardia lamblia
LSAGDS

SEQ ID NO: 3122535 - protein, 8 aa, Giardia lamblia
LSAGKARQ

SEQ ID NO: 3122536 - protein, 7 aa, Giardia lamblia
LSAGRSV

SEQ ID NO: 3122537 - protein, 10 aa, Giardia lamblia
LSAKSPKVLS

SEQ ID NO: 3122538 - protein, 11 aa, Giardia lamblia
LSAKSVGSSVQ

SEQ ID NO: 3122539 - protein, 4 aa, Giardia lamblia
LSAL

SEQ ID NO: 3122540 - protein, 9 aa, Giardia lamblia
LSALGGPGV

SEQ ID NO: 3122541 - protein, 9 aa, Giardia lamblia
LSANSADTT

SEQ ID NO: 3122542 - protein, 15 aa, Giardia lamblia
LSAPAPGPADYTPKV

SEQ ID NO: 3122543 - protein, 17 aa, Giardia lamblia
LSAPSASSDITGDPTRL

SEQ ID NO: 3122544 - protein, 9 aa, Giardia lamblia
LSAPSGPKH

SEQ ID NO: 3122545 - protein, 30 aa, Giardia lamblia
LSAPSGSQVQGSGRPGSNYGQSTSSLPTGI

SEQ ID NO: 3122546 - protein, 9 aa, Giardia lamblia
LSARDSDSL

SEQ ID NO: 3122547 - protein, 6 aa, Giardia lamblia
LSARED

SEQ ID NO: 3122548 - protein, 8 aa, Giardia lamblia
LSARHPLA

SEQ ID NO: 3122549 - protein, 7 aa, Giardia lamblia
LSARKAP

SEQ ID NO: 3122550 - protein, 8 aa, Giardia lamblia
LSASESRA

SEQ ID NO: 3122551 - protein, 20 aa, Giardia lamblia
LSASNYGHSSHKQTANQPLD

SEQ ID NO: 3122552 - protein, 24 aa, Giardia lamblia
LSASPDDGMDDRAPASSKGHASSR

SEQ ID NO: 3122553 - protein, 7 aa, Giardia lamblia
LSASPPV

SEQ ID NO: 3122554 - protein, 35 aa, Giardia lamblia
LSASRSATRSKPHQKPRSKVQSQDQRNAPAPAITV

SEQ ID NO: 3122555 - protein, 13 aa, Giardia lamblia
LSASSGSQRNLPS

SEQ ID NO: 3122556 - protein, 12 aa, Giardia lamblia
LSASTTDLAERK

SEQ ID NO: 3122557 - protein, 5 aa, Giardia lamblia
LSATE

SEQ ID NO: 3122558 - protein, 11 aa, Giardia lamblia
LSATPSARESI

SEQ ID NO: 3122559 - protein, 12 aa, Giardia lamblia
LSATRSPADGLQ

SEQ ID NO: 3122560 - protein, 8 aa, Giardia lamblia
LSATTQRF

SEQ ID NO: 3122561 - protein, 26 aa, Giardia lamblia
LSAYDSKQEDFSKTPQLSGSNVRGED

SEQ ID NO: 3122562 - protein, 23 aa, Giardia lamblia
LSCQSASHSRLQAQRPRTSGVDG

SEQ ID NO: 3122563 - protein, 13 aa, Giardia lamblia
LSDAETAKSATQH

SEQ ID NO: 3122564 - protein, 5 aa, Giardia lamblia
LSDAI

SEQ ID NO: 3122565 - protein, 9 aa, Giardia lamblia
LSDANSTEM

SEQ ID NO: 3122566 - protein, 6 aa, Giardia lamblia
LSDATH

SEQ ID NO: 3122567 - protein, 10 aa, Giardia lamblia
LSDDANGLGT

SEQ ID NO: 3122568 - protein, 8 aa, Giardia lamblia
LSDDNKYN

SEQ ID NO: 3122569 - protein, 4 aa, Giardia lamblia
LSDE

SEQ ID NO: 3122570 - protein, 6 aa, Giardia lamblia
LSDEAR

SEQ ID NO: 3122571 - protein, 10 aa, Giardia lamblia
LSDEYTDYST

SEQ ID NO: 3122572 - protein, 8 aa, Giardia lamblia
LSDGPSSF

SEQ ID NO: 3122573 - protein, 8 aa, Giardia lamblia
LSDGSEHS

SEQ ID NO: 3122574 - protein, 7 aa, Giardia lamblia
LSDGSGY

SEQ ID NO: 3122575 - protein, 4 aa, Giardia lamblia
LSDH

SEQ ID NO: 3122576 - protein, 4 aa, Giardia lamblia
LSDK

SEQ ID NO: 3122577 - protein, 13 aa, Giardia lamblia
LSDKDKKNNDGET

SEQ ID NO: 3122578 - protein, 14 aa, Giardia lamblia
LSDKDKKNSDGETA

SEQ ID NO: 3122579 - protein, 13 aa, Giardia lamblia
LSDKDKKNSNGDT

SEQ ID NO: 3122580 - protein, 7 aa, Giardia lamblia
LSDKEAE

SEQ ID NO: 3122581 - protein, 6 aa, Giardia lamblia
LSDKLG

SEQ ID NO: 3122582 - protein, 4 aa, Giardia lamblia
LSDL

SEQ ID NO: 3122583 - protein, 18 aa, Giardia lamblia
LSDNSSKARVDLSGCLGS

SEQ ID NO: 3122584 - protein, 22 aa, Giardia lamblia
LSDPAGKASADGQDAKGDHQRG

SEQ ID NO: 3122585 - protein, 13 aa, Giardia lamblia
LSDPATKKDSKGC

SEQ ID NO: 3122586 - protein, 11 aa, Giardia lamblia
LSDPETGADMR

SEQ ID NO: 3122587 - protein, 17 aa, Giardia lamblia
LSDPHTSQGSSRHTPVS

SEQ ID NO: 3122588 - protein, 13 aa, Giardia lamblia
LSDPNQADVDVPI

SEQ ID NO: 3122589 - protein, 6 aa, Giardia lamblia
LSDPQY

SEQ ID NO: 3122590 - protein, 6 aa, Giardia lamblia
LSDPRG

SEQ ID NO: 3122591 - protein, 10 aa, Giardia lamblia
LSDPTERAYY

SEQ ID NO: 3122592 - protein, 18 aa, Giardia lamblia
LSDPTSGESESTKDIPPN

SEQ ID NO: 3122593 - protein, 4 aa, Giardia lamblia
LSDQ

SEQ ID NO: 3122594 - protein, 8 aa, Giardia lamblia
LSDRDQQA

SEQ ID NO: 3122595 - protein, 9 aa, Giardia lamblia
LSDREEAIE

SEQ ID NO: 3122596 - protein, 13 aa, Giardia lamblia
LSDRPSKRPRAMK

SEQ ID NO: 3122597 - protein, 25 aa, Giardia lamblia
LSDRPSLPSSSAGSELSESLSAGDG

SEQ ID NO: 3122598 - protein, 6 aa, Giardia lamblia
LSDRRR

SEQ ID NO: 3122599 - protein, 4 aa, Giardia lamblia
LSDS

SEQ ID NO: 3122600 - protein, 7 aa, Giardia lamblia
LSDSDDY

SEQ ID NO: 3122601 - protein, 13 aa, Giardia lamblia
LSDSDGEDADYDE

SEQ ID NO: 3122602 - protein, 8 aa, Giardia lamblia
LSDSEEAR

SEQ ID NO: 3122603 - protein, 8 aa, Giardia lamblia
LSDSMTSL

SEQ ID NO: 3122604 - protein, 9 aa, Giardia lamblia
LSDSRTSLL

SEQ ID NO: 3122605 - protein, 7 aa, Giardia lamblia
LSDSTKE

SEQ ID NO: 3122606 - protein, 8 aa, Giardia lamblia
LSDTGDIP

SEQ ID NO: 3122607 - protein, 11 aa, Giardia lamblia
LSDTHNSTTTV

SEQ ID NO: 3122608 - protein, 7 aa, Giardia lamblia
LSDTQAE

SEQ ID NO: 3122609 - protein, 7 aa, Giardia lamblia
LSDTTRR

SEQ ID NO: 3122610 - protein, 5 aa, Giardia lamblia
LSDVT

SEQ ID NO: 3122611 - protein, 5 aa, Giardia lamblia
LSEAK

SEQ ID NO: 3122612 - protein, 7 aa, Giardia lamblia
LSEDDTA

SEQ ID NO: 3122613 - protein, 6 aa, Giardia lamblia
LSEDPR

SEQ ID NO: 3122614 - protein, 11 aa, Giardia lamblia
LSEDRADTEDM

SEQ ID NO: 3122615 - protein, 16 aa, Giardia lamblia
LSEDSGTVSKSMRKPQ

SEQ ID NO: 3122616 - protein, 4 aa, Giardia lamblia
LSEE

SEQ ID NO: 3122617 - protein, 9 aa, Giardia lamblia
LSEEDNAQV

SEQ ID NO: 3122618 - protein, 26 aa, Giardia lamblia
LSEEHNNSTDDEDAKRVSTTSLSSSV

SEQ ID NO: 3122619 - protein, 15 aa, Giardia lamblia
LSEEKARNGLRENEL

SEQ ID NO: 3122620 - protein, 13 aa, Giardia lamblia
LSEEYDKELEEKH

SEQ ID NO: 3122621 - protein, 10 aa, Giardia lamblia
LSEGEKSRQE

SEQ ID NO: 3122622 - protein, 6 aa, Giardia lamblia
LSEGLA

SEQ ID NO: 3122623 - protein, 10 aa, Giardia lamblia
LSEGRKEAPE

SEQ ID NO: 3122624 - protein, 13 aa, Giardia lamblia
LSEGRSKHVPYRD

SEQ ID NO: 3122625 - protein, 29 aa, Giardia lamblia
LSEGTEEPEEIKNPRTKKPMSLDESPDLK

SEQ ID NO: 3122626 - protein, 5 aa, Giardia lamblia
LSEKD

SEQ ID NO: 3122627 - protein, 7 aa, Giardia lamblia
LSEKPSI

SEQ ID NO: 3122628 - protein, 6 aa, Giardia lamblia
LSEKSC

SEQ ID NO: 3122629 - protein, 9 aa, Giardia lamblia
LSEKSGTKI

SEQ ID NO: 3122630 - protein, 24 aa, Giardia lamblia
LSEKSSDSHSSLDESGNGSSNTAD

SEQ ID NO: 3122631 - protein, 14 aa, Giardia lamblia
LSELSGGKEAAPCQ

SEQ ID NO: 3122632 - protein, 8 aa, Giardia lamblia
LSENDAAV

SEQ ID NO: 3122633 - protein, 9 aa, Giardia lamblia
LSENIREKE

SEQ ID NO: 3122634 - protein, 7 aa, Giardia lamblia
LSENISD

SEQ ID NO: 3122635 - protein, 10 aa, Giardia lamblia
LSENKALKNV

SEQ ID NO: 3122636 - protein, 8 aa, Giardia lamblia
LSEPGFGT

SEQ ID NO: 3122637 - protein, 6 aa, Giardia lamblia
LSEPGP

SEQ ID NO: 3122638 - protein, 8 aa, Giardia lamblia
LSEPGYAI

SEQ ID NO: 3122639 - protein, 7 aa, Giardia lamblia
LSEPHET

SEQ ID NO: 3122640 - protein, 7 aa, Giardia lamblia
LSEPHQA

SEQ ID NO: 3122641 - protein, 7 aa, Giardia lamblia
LSEPPSK

SEQ ID NO: 3122642 - protein, 9 aa, Giardia lamblia
LSEPSDEKA

SEQ ID NO: 3122643 - protein, 11 aa, Giardia lamblia
LSEPSSATNPI

SEQ ID NO: 3122644 - protein, 8 aa, Giardia lamblia
LSEPSTKG

SEQ ID NO: 3122645 - protein, 4 aa, Giardia lamblia
LSEQ

SEQ ID NO: 3122646 - protein, 8 aa, Giardia lamblia
LSEQEGAS

SEQ ID NO: 3122647 - protein, 10 aa, Giardia lamblia
LSEQERDSLD

SEQ ID NO: 3122648 - protein, 10 aa, Giardia lamblia
LSEQNDPDVA

SEQ ID NO: 3122649 - protein, 14 aa, Giardia lamblia
LSEQQENPKSTETK

SEQ ID NO: 3122650 - protein, 18 aa, Giardia lamblia
LSEQSQHSQDSVDASSSV

SEQ ID NO: 3122651 - protein, 11 aa, Giardia lamblia
LSEQTAGMEDQ

SEQ ID NO: 3122652 - protein, 6 aa, Giardia lamblia
LSEQTK

SEQ ID NO: 3122653 - protein, 4 aa, Giardia lamblia
LSER

SEQ ID NO: 3122654 - protein, 18 aa, Giardia lamblia
LSERAEKAENELDATSKE

SEQ ID NO: 3122655 - protein, 6 aa, Giardia lamblia
LSERNS

SEQ ID NO: 3122656 - protein, 14 aa, Giardia lamblia
LSERPNRSFSARDT

SEQ ID NO: 3122657 - protein, 4 aa, Giardia lamblia
LSES

SEQ ID NO: 3122658 - protein, 9 aa, Giardia lamblia
LSESAEELY

SEQ ID NO: 3122659 - protein, 8 aa, Giardia lamblia
LSESHSAP

SEQ ID NO: 3122660 - protein, 18 aa, Giardia lamblia
LSESQRGDDAAKLRSSYA

SEQ ID NO: 3122661 - protein, 6 aa, Giardia lamblia
LSESSG

SEQ ID NO: 3122662 - protein, 17 aa, Giardia lamblia
LSETDRQEADSEDDLYE

SEQ ID NO: 3122663 - protein, 8 aa, Giardia lamblia
LSETQSRI

SEQ ID NO: 3122664 - protein, 4 aa, Giardia lamblia
LSEY

SEQ ID NO: 3122665 - protein, 5 aa, Giardia lamblia
LSGAE

SEQ ID NO: 3122666 - protein, 19 aa, Giardia lamblia
LSGAPAEKLTPSSSKDIPS

SEQ ID NO: 3122667 - protein, 25 aa, Giardia lamblia
LSGAPIRTSISTEKKNSSKSRITRR

SEQ ID NO: 3122668 - protein, 31 aa, Giardia lamblia
LSGASAANEDAADVPGANLGTDPLASGRTHQ

SEQ ID NO: 3122669 - protein, 9 aa, Giardia lamblia
LSGDPQSEV

SEQ ID NO: 3122670 - protein, 9 aa, Giardia lamblia
LSGDSETAV

SEQ ID NO: 3122671 - protein, 4 aa, Giardia lamblia
LSGE

SEQ ID NO: 3122672 - protein, 14 aa, Giardia lamblia
LSGEHSLNAKNAQD

SEQ ID NO: 3122673 - protein, 11 aa, Giardia lamblia
LSGEPLKGRPE

SEQ ID NO: 3122674 - protein, 7 aa, Giardia lamblia
LSGEPSA

SEQ ID NO: 3122675 - protein, 16 aa, Giardia lamblia
LSGERKRWSQQARELD

SEQ ID NO: 3122676 - protein, 23 aa, Giardia lamblia
LSGESDRSTTQLQKDIGDNVSSD

SEQ ID NO: 3122677 - protein, 5 aa, Giardia lamblia
LSGET

SEQ ID NO: 3122678 - protein, 8 aa, Giardia lamblia
LSGETAAN

SEQ ID NO: 3122679 - protein, 9 aa, Giardia lamblia
LSGFDEQGN

SEQ ID NO: 3122680 - protein, 7 aa, Giardia lamblia
LSGGHSG

SEQ ID NO: 3122681 - protein, 7 aa, Giardia lamblia
LSGGKDS

SEQ ID NO: 3122682 - protein, 10 aa, Giardia lamblia
LSGGPGTNRT

SEQ ID NO: 3122683 - protein, 13 aa, Giardia lamblia
LSGGSGKSGTAEI

SEQ ID NO: 3122684 - protein, 35 aa, Giardia lamblia
LSGINSSGRVGDAPSVQGDSVQEDIPNSDGSKPDI

SEQ ID NO: 3122685 - protein, 6 aa, Giardia lamblia
LSGKND

SEQ ID NO: 3122686 - protein, 9 aa, Giardia lamblia
LSGKNDEAA

SEQ ID NO: 3122687 - protein, 9 aa, Giardia lamblia
LSGKNNKSA

SEQ ID NO: 3122688 - protein, 10 aa, Giardia lamblia
LSGKQTKEGL

SEQ ID NO: 3122689 - protein, 15 aa, Giardia lamblia
LSGKSVTKKTAQQSE

SEQ ID NO: 3122690 - protein, 4 aa, Giardia lamblia
LSGN

SEQ ID NO: 3122691 - protein, 9 aa, Giardia lamblia
LSGNDSERL

SEQ ID NO: 3122692 - protein, 9 aa, Giardia lamblia
LSGNEEYED

SEQ ID NO: 3122693 - protein, 7 aa, Giardia lamblia
LSGNERA

SEQ ID NO: 3122694 - protein, 6 aa, Giardia lamblia
LSGPCN

SEQ ID NO: 3122695 - protein, 8 aa, Giardia lamblia
LSGPGPTL

SEQ ID NO: 3122696 - protein, 9 aa, Giardia lamblia
LSGPQANQH

SEQ ID NO: 3122697 - protein, 10 aa, Giardia lamblia
LSGPYSSGKT

SEQ ID NO: 3122698 - protein, 9 aa, Giardia lamblia
LSGQEAQSL

SEQ ID NO: 3122699 - protein, 5 aa, Giardia lamblia
LSGQS

SEQ ID NO: 3122700 - protein, 6 aa, Giardia lamblia
LSGQTH

SEQ ID NO: 3122701 - protein, 4 aa, Giardia lamblia
LSGR

SEQ ID NO: 3122702 - protein, 7 aa, Giardia lamblia
LSGRATL

SEQ ID NO: 3122703 - protein, 7 aa, Giardia lamblia
LSGRDSR

SEQ ID NO: 3122704 - protein, 5 aa, Giardia lamblia
LSGRN

SEQ ID NO: 3122705 - protein, 8 aa, Giardia lamblia
LSGRNTAD

SEQ ID NO: 3122706 - protein, 8 aa, Giardia lamblia
LSGRPIDS

SEQ ID NO: 3122707 - protein, 36 aa, Giardia lamblia
LSGRSSFSGGIPMPQSNAVQQNPFAPPGSLTSRPAF

SEQ ID NO: 3122708 - protein, 9 aa, Giardia lamblia
LSGRSTSAP

SEQ ID NO: 3122709 - protein, 4 aa, Giardia lamblia
LSGS

SEQ ID NO: 3122710 - protein, 16 aa, Giardia lamblia
LSGSASSDRFSRSKSI

SEQ ID NO: 3122711 - protein, 5 aa, Giardia lamblia
LSGSH

SEQ ID NO: 3122712 - protein, 20 aa, Giardia lamblia
LSGSLTQDSFPHPSNPNGNI

SEQ ID NO: 3122713 - protein, 19 aa, Giardia lamblia
LSGSNTSSLANSLSNCPDL

SEQ ID NO: 3122714 - protein, 12 aa, Giardia lamblia
LSGSPKYVDQKT

SEQ ID NO: 3122715 - protein, 37 aa, Giardia lamblia
LSGSPNRGSRVGSPTRGSNTSPQLTAEQLEQRKRDAA

SEQ ID NO: 3122716 - protein, 7 aa, Giardia lamblia
LSGSSAH

SEQ ID NO: 3122717 - protein, 8 aa, Giardia lamblia
LSGSSGFN

SEQ ID NO: 3122718 - protein, 17 aa, Giardia lamblia
LSGSTALAKGAAPAGDY

SEQ ID NO: 3122719 - protein, 8 aa, Giardia lamblia
LSGTDVRD

SEQ ID NO: 3122720 - protein, 5 aa, Giardia lamblia
LSGTR

SEQ ID NO: 3122721 - protein, 9 aa, Giardia lamblia
LSGTSPVDT

SEQ ID NO: 3122722 - protein, 7 aa, Giardia lamblia
LSGTTGK

SEQ ID NO: 3122723 - protein, 5 aa, Giardia lamblia
LSGYS

SEQ ID NO: 3122724 - protein, 4 aa, Giardia lamblia
LSHA

SEQ ID NO: 3122725 - protein, 8 aa, Giardia lamblia
LSHNGTSM

SEQ ID NO: 3122726 - protein, 4 aa, Giardia lamblia
LSHP

SEQ ID NO: 3122727 - protein, 9 aa, Giardia lamblia
LSHPDGGQP

SEQ ID NO: 3122728 - protein, 7 aa, Giardia lamblia
LSHTDDA

SEQ ID NO: 3122729 - protein, 32 aa, Giardia lamblia
LSHTGTGYTGPPSHAAARQHRPSRPASATQQR

SEQ ID NO: 3122730 - protein, 19 aa, Giardia lamblia
LSIETDSQGVGTISTTNIN

SEQ ID NO: 3122731 - protein, 27 aa, Giardia lamblia
LSIPNSATITDHQADQTRASDPPLSSM

SEQ ID NO: 3122732 - protein, 4 aa, Giardia lamblia
LSKA

SEQ ID NO: 3122733 - protein, 14 aa, Giardia lamblia
LSKAKEQNKDQSVV

SEQ ID NO: 3122734 - protein, 9 aa, Giardia lamblia
LSKAPPSFT

SEQ ID NO: 3122735 - protein, 8 aa, Giardia lamblia
LSKAQEEE

SEQ ID NO: 3122736 - protein, 10 aa, Giardia lamblia
LSKASRDSKA

SEQ ID NO: 3122737 - protein, 31 aa, Giardia lamblia
LSKDATYKTNGMPLPPSFNQEHNTLRLTLCI

SEQ ID NO: 3122738 - protein, 7 aa, Giardia lamblia
LSKDSHA

SEQ ID NO: 3122739 - protein, 5 aa, Giardia lamblia
LSKEA

SEQ ID NO: 3122740 - protein, 10 aa, Giardia lamblia
LSKEAEYKTL

SEQ ID NO: 3122741 - protein, 8 aa, Giardia lamblia
LSKEDNSE

SEQ ID NO: 3122742 - protein, 8 aa, Giardia lamblia
LSKEEELR

SEQ ID NO: 3122743 - protein, 8 aa, Giardia lamblia
LSKEERAL

SEQ ID NO: 3122744 - protein, 8 aa, Giardia lamblia
LSKEGKTG

SEQ ID NO: 3122745 - protein, 21 aa, Giardia lamblia
LSKEPPDKHTTNESAHKRYKR

SEQ ID NO: 3122746 - protein, 9 aa, Giardia lamblia
LSKESPSQA

SEQ ID NO: 3122747 - protein, 11 aa, Giardia lamblia
LSKETGSCAQS

SEQ ID NO: 3122748 - protein, 7 aa, Giardia lamblia
LSKETLD

SEQ ID NO: 3122749 - protein, 7 aa, Giardia lamblia
LSKGTAM

SEQ ID NO: 3122750 - protein, 12 aa, Giardia lamblia
LSKHREKLGDEC

SEQ ID NO: 3122751 - protein, 30 aa, Giardia lamblia
LSKKDDSDERDPKARLPMNQPGSSALSSTD

SEQ ID NO: 3122752 - protein, 14 aa, Giardia lamblia
LSKKPKSPSSALTQ

SEQ ID NO: 3122753 - protein, 10 aa, Giardia lamblia
LSKNPSKYSQ

SEQ ID NO: 3122754 - protein, 21 aa, Giardia lamblia
LSKPSAPSTASLTDNYPPDPV

SEQ ID NO: 3122755 - protein, 8 aa, Giardia lamblia
LSKPSDWT

SEQ ID NO: 3122756 - protein, 11 aa, Giardia lamblia
LSKQAKEAEGL

SEQ ID NO: 3122757 - protein, 21 aa, Giardia lamblia
LSKQEKGWDENSNAQRSQRHG

SEQ ID NO: 3122758 - protein, 59 aa, Giardia lamblia
LSKQNEEKEIAEQKRRAEEEAARNREKIRKRERDSFTTGAPELSETAKARLDEKRRYEQ

SEQ ID NO: 3122759 - protein, 9 aa, Giardia lamblia
LSKQPDYDK

SEQ ID NO: 3122760 - protein, 7 aa, Giardia lamblia
LSKSAQD

SEQ ID NO: 3122761 - protein, 8 aa, Giardia lamblia
LSKSEQQI

SEQ ID NO: 3122762 - protein, 28 aa, Giardia lamblia
LSKSLTSDSSDSDSKEPSEIANCESTDS

SEQ ID NO: 3122763 - protein, 7 aa, Giardia lamblia
LSKSQDR

SEQ ID NO: 3122764 - protein, 19 aa, Giardia lamblia
LSKSQRHDEHSSGLPDSDA

SEQ ID NO: 3122765 - protein, 7 aa, Giardia lamblia
LSKSQVP

SEQ ID NO: 3122766 - protein, 9 aa, Giardia lamblia
LSKTKKSDH

SEQ ID NO: 3122767 - protein, 8 aa, Giardia lamblia
LSKTPANQ

SEQ ID NO: 3122768 - protein, 20 aa, Giardia lamblia
LSKTPSQYKDAVANVLASFL

SEQ ID NO: 3122769 - protein, 27 aa, Giardia lamblia
LSKTSTGARGSRRDDTPVTSGPRGDSV

SEQ ID NO: 3122770 - protein, 4 aa, Giardia lamblia
LSKY

SEQ ID NO: 3122771 - protein, 5 aa, Giardia lamblia
LSLEG

SEQ ID NO: 3122772 - protein, 6 aa, Giardia lamblia
LSLETE

SEQ ID NO: 3122773 - protein, 4 aa, Giardia lamblia
LSLG

SEQ ID NO: 3122774 - protein, 9 aa, Giardia lamblia
LSLSDNSER

SEQ ID NO: 3122775 - protein, 10 aa, Giardia lamblia
LSLSRDEAGN

SEQ ID NO: 3122776 - protein, 6 aa, Giardia lamblia
LSNAKW

SEQ ID NO: 3122777 - protein, 11 aa, Giardia lamblia
LSNANPSTLSP

SEQ ID NO: 3122778 - protein, 30 aa, Giardia lamblia
LSNDANDSNDESSSESDKVNEDEENEDEDE

SEQ ID NO: 3122779 - protein, 9 aa, Giardia lamblia
LSNDGSTVP

SEQ ID NO: 3122780 - protein, 15 aa, Giardia lamblia
LSNDLKKEKERAGTA

SEQ ID NO: 3122781 - protein, 18 aa, Giardia lamblia
LSNEAKGKELESLRNGSK

SEQ ID NO: 3122782 - protein, 12 aa, Giardia lamblia
LSNEQRDTKPQL

SEQ ID NO: 3122783 - protein, 11 aa, Giardia lamblia
LSNESREKSNL

SEQ ID NO: 3122784 - protein, 15 aa, Giardia lamblia
LSNGPTTSSAPSHDS

SEQ ID NO: 3122785 - protein, 44 aa, Giardia lamblia
LSNIPKRKSAIHETKNVRSQESSATSSTGKATLTSDTGSDIATE

SEQ ID NO: 3122786 - protein, 9 aa, Giardia lamblia
LSNPKNGTT

SEQ ID NO: 3122787 - protein, 20 aa, Giardia lamblia
LSNPPNPTKKEHSQAETPSI

SEQ ID NO: 3122788 - protein, 11 aa, Giardia lamblia
LSNQTRDTGDS

SEQ ID NO: 3122789 - protein, 15 aa, Giardia lamblia
LSNRGSAQGSICSVE

SEQ ID NO: 3122790 - protein, 10 aa, Giardia lamblia
LSNSIGTKSQ

SEQ ID NO: 3122791 - protein, 9 aa, Giardia lamblia
LSNSRTGRT

SEQ ID NO: 3122792 - protein, 4 aa, Giardia lamblia
LSNT

SEQ ID NO: 3122793 - protein, 19 aa, Giardia lamblia
LSNTDDQDQTKDSQDAAQT

SEQ ID NO: 3122794 - protein, 12 aa, Giardia lamblia
LSNTKPALKDQA

SEQ ID NO: 3122795 - protein, 10 aa, Giardia lamblia
LSNTKSQGLQ

SEQ ID NO: 3122796 - protein, 6 aa, Giardia lamblia
LSNTSN

SEQ ID NO: 3122797 - protein, 7 aa, Giardia lamblia
LSNTSPV

SEQ ID NO: 3122798 - protein, 11 aa, Giardia lamblia
LSPADAQGAPY

SEQ ID NO: 3122799 - protein, 6 aa, Giardia lamblia
LSPADS

SEQ ID NO: 3122800 - protein, 10 aa, Giardia lamblia
LSPAGTGRLS

SEQ ID NO: 3122801 - protein, 4 aa, Giardia lamblia
LSPD

SEQ ID NO: 3122802 - protein, 5 aa, Giardia lamblia
LSPDE

SEQ ID NO: 3122803 - protein, 14 aa, Giardia lamblia
LSPDERISEEPEPL

SEQ ID NO: 3122804 - protein, 6 aa, Giardia lamblia
LSPDGR

SEQ ID NO: 3122805 - protein, 16 aa, Giardia lamblia
LSPDKSVKENKHENDQ

SEQ ID NO: 3122806 - protein, 18 aa, Giardia lamblia
LSPDTAAHARRAAEIQGK

SEQ ID NO: 3122807 - protein, 7 aa, Giardia lamblia
LSPDTTA

SEQ ID NO: 3122808 - protein, 4 aa, Giardia lamblia
LSPE

SEQ ID NO: 3122809 - protein, 8 aa, Giardia lamblia
LSPEKEGE

SEQ ID NO: 3122810 - protein, 6 aa, Giardia lamblia
LSPELS

SEQ ID NO: 3122811 - protein, 4 aa, Giardia lamblia
LSPG

SEQ ID NO: 3122812 - protein, 9 aa, Giardia lamblia
LSPGKAPLT

SEQ ID NO: 3122813 - protein, 14 aa, Giardia lamblia
LSPGLSENDASHTQ

SEQ ID NO: 3122814 - protein, 10 aa, Giardia lamblia
LSPGQTPLTS

SEQ ID NO: 3122815 - protein, 15 aa, Giardia lamblia
LSPGSKRGGATGWAA

SEQ ID NO: 3122816 - protein, 7 aa, Giardia lamblia
LSPGTPH

SEQ ID NO: 3122817 - protein, 14 aa, Giardia lamblia
LSPGTSGPKKQGRA

SEQ ID NO: 3122818 - protein, 4 aa, Giardia lamblia
LSPH

SEQ ID NO: 3122819 - protein, 12 aa, Giardia lamblia
LSPHGSRSLTSP

SEQ ID NO: 3122820 - protein, 4 aa, Giardia lamblia
LSPK

SEQ ID NO: 3122821 - protein, 7 aa, Giardia lamblia
LSPKELD

SEQ ID NO: 3122822 - protein, 7 aa, Giardia lamblia
LSPKNTS

SEQ ID NO: 3122823 - protein, 10 aa, Giardia lamblia
LSPKTVTSDV

SEQ ID NO: 3122824 - protein, 9 aa, Giardia lamblia
LSPNASGAE

SEQ ID NO: 3122825 - protein, 7 aa, Giardia lamblia
LSPNAST

SEQ ID NO: 3122826 - protein, 9 aa, Giardia lamblia
LSPNPDANA

SEQ ID NO: 3122827 - protein, 10 aa, Giardia lamblia
LSPPEGSFEA

SEQ ID NO: 3122828 - protein, 9 aa, Giardia lamblia
LSPPEIDTK

SEQ ID NO: 3122829 - protein, 18 aa, Giardia lamblia
LSPPEQAKTLYCTSGQQI

SEQ ID NO: 3122830 - protein, 23 aa, Giardia lamblia
LSPPISTPAYNSASIQQEVPNVS

SEQ ID NO: 3122831 - protein, 10 aa, Giardia lamblia
LSPPSEPAHT

SEQ ID NO: 3122832 - protein, 5 aa, Giardia lamblia
LSPPT

SEQ ID NO: 3122833 - protein, 7 aa, Giardia lamblia
LSPQKAN

SEQ ID NO: 3122834 - protein, 12 aa, Giardia lamblia
LSPQMNKATAYT

SEQ ID NO: 3122835 - protein, 9 aa, Giardia lamblia
LSPQNKSDC

SEQ ID NO: 3122836 - protein, 10 aa, Giardia lamblia
LSPQQGPGQH

SEQ ID NO: 3122837 - protein, 29 aa, Giardia lamblia
LSPQRRSVSSMNTTKSSARSGTGSGRSSV

SEQ ID NO: 3122838 - protein, 22 aa, Giardia lamblia
LSPQSPDTTAAPTSTSIPAPDS

SEQ ID NO: 3122839 - protein, 17 aa, Giardia lamblia
LSPRRSLSKSSPQSSIL

SEQ ID NO: 3122840 - protein, 17 aa, Giardia lamblia
LSPRTTKAKVPRQPQVP

SEQ ID NO: 3122841 - protein, 4 aa, Giardia lamblia
LSPS

SEQ ID NO: 3122842 - protein, 67 aa, Giardia lamblia
LSPSANPTTQADNLTQASVSSSSSNSLSNQPTDTKGSSSSDAVSSKSTASIEGSLSSSSGPTDTTSV

SEQ ID NO: 3122843 - protein, 11 aa, Giardia lamblia
LSPSASRPPLS

SEQ ID NO: 3122844 - protein, 7 aa, Giardia lamblia
LSPSDPQ

SEQ ID NO: 3122845 - protein, 9 aa, Giardia lamblia
LSPSGTNTI

SEQ ID NO: 3122846 - protein, 7 aa, Giardia lamblia
LSPSKQF

SEQ ID NO: 3122847 - protein, 8 aa, Giardia lamblia
LSPSSPTF

SEQ ID NO: 3122848 - protein, 9 aa, Giardia lamblia
LSPSTSSMR

SEQ ID NO: 3122849 - protein, 7 aa, Giardia lamblia
LSPSYDG

SEQ ID NO: 3122850 - protein, 16 aa, Giardia lamblia
LSPTGDSRSEETSDGI

SEQ ID NO: 3122851 - protein, 5 aa, Giardia lamblia
LSPTR

SEQ ID NO: 3122852 - protein, 6 aa, Giardia lamblia
LSPTTG

SEQ ID NO: 3122853 - protein, 16 aa, Giardia lamblia
LSPTTRSRSVSPPVSP

SEQ ID NO: 3122854 - protein, 4 aa, Giardia lamblia
LSPV

SEQ ID NO: 3122855 - protein, 9 aa, Giardia lamblia
LSPVDANAP

SEQ ID NO: 3122856 - protein, 9 aa, Giardia lamblia
LSPVTTGRH

SEQ ID NO: 3122857 - protein, 10 aa, Giardia lamblia
LSPYKGETNL

SEQ ID NO: 3122858 - protein, 10 aa, Giardia lamblia
LSQAESEVTE

SEQ ID NO: 3122859 - protein, 10 aa, Giardia lamblia
LSQAKTNVGT

SEQ ID NO: 3122860 - protein, 11 aa, Giardia lamblia
LSQASPATVSR

SEQ ID NO: 3122861 - protein, 14 aa, Giardia lamblia
LSQASRVTSRNASR

SEQ ID NO: 3122862 - protein, 10 aa, Giardia lamblia
LSQDSTNTDL

SEQ ID NO: 3122863 - protein, 12 aa, Giardia lamblia
LSQEAEYHKGQA

SEQ ID NO: 3122864 - protein, 10 aa, Giardia lamblia
LSQEGEEQKL

SEQ ID NO: 3122865 - protein, 5 aa, Giardia lamblia
LSQGD

SEQ ID NO: 3122866 - protein, 14 aa, Giardia lamblia
LSQKVKQREEARKA

SEQ ID NO: 3122867 - protein, 9 aa, Giardia lamblia
LSQNKFGKL

SEQ ID NO: 3122868 - protein, 4 aa, Giardia lamblia
LSQP

SEQ ID NO: 3122869 - protein, 6 aa, Giardia lamblia
LSQPAS

SEQ ID NO: 3122870 - protein, 23 aa, Giardia lamblia
LSQPKTKLRPRLAPTDNSVQKSN

SEQ ID NO: 3122871 - protein, 6 aa, Giardia lamblia
LSQQEQ

SEQ ID NO: 3122872 - protein, 8 aa, Giardia lamblia
LSQQKRLD

SEQ ID NO: 3122873 - protein, 10 aa, Giardia lamblia
LSQQSSSATK

SEQ ID NO: 3122874 - protein, 7 aa, Giardia lamblia
LSQRAAD

SEQ ID NO: 3122875 - protein, 22 aa, Giardia lamblia
LSQRAQSAECRAHSAASRLQEV

SEQ ID NO: 3122876 - protein, 14 aa, Giardia lamblia
LSQRSKVSSDLQGE

SEQ ID NO: 3122877 - protein, 9 aa, Giardia lamblia
LSQRTNDAE

SEQ ID NO: 3122878 - protein, 13 aa, Giardia lamblia
LSQRTPSSKGRGV

SEQ ID NO: 3122879 - protein, 10 aa, Giardia lamblia
LSQSGRSNHQ

SEQ ID NO: 3122880 - protein, 9 aa, Giardia lamblia
LSQSNTDAQ

SEQ ID NO: 3122881 - protein, 8 aa, Giardia lamblia
LSQTDGQA

SEQ ID NO: 3122882 - protein, 16 aa, Giardia lamblia
LSQTKSNKDGGIPPSV

SEQ ID NO: 3122883 - protein, 6 aa, Giardia lamblia
LSQTNK

SEQ ID NO: 3122884 - protein, 5 aa, Giardia lamblia
LSQYS

SEQ ID NO: 3122885 - protein, 8 aa, Giardia lamblia
LSRADGRR

SEQ ID NO: 3122886 - protein, 9 aa, Giardia lamblia
LSRAEAEVK

SEQ ID NO: 3122887 - protein, 13 aa, Giardia lamblia
LSRANERVDQQPV

SEQ ID NO: 3122888 - protein, 13 aa, Giardia lamblia
LSRDDFNKASTIK

SEQ ID NO: 3122889 - protein, 13 aa, Giardia lamblia
LSRDEQKKVEGTS

SEQ ID NO: 3122890 - protein, 18 aa, Giardia lamblia
LSREDKTTGENKDFYSRD

SEQ ID NO: 3122891 - protein, 7 aa, Giardia lamblia
LSREGSP

SEQ ID NO: 3122892 - protein, 7 aa, Giardia lamblia
LSREQSC

SEQ ID NO: 3122893 - protein, 14 aa, Giardia lamblia
LSRERQRKLQERQR

SEQ ID NO: 3122894 - protein, 7 aa, Giardia lamblia
LSRERSD

SEQ ID NO: 3122895 - protein, 8 aa, Giardia lamblia
LSREVDAE

SEQ ID NO: 3122896 - protein, 8 aa, Giardia lamblia
LSRGEQAD

SEQ ID NO: 3122897 - protein, 16 aa, Giardia lamblia
LSRGQEAEDAKRRKIK

SEQ ID NO: 3122898 - protein, 20 aa, Giardia lamblia
LSRGRGSKASPGTPQVSRPI

SEQ ID NO: 3122899 - protein, 24 aa, Giardia lamblia
LSRGSRASRGHGSRSMGPGGSRPY

SEQ ID NO: 3122900 - protein, 5 aa, Giardia lamblia
LSRPD

SEQ ID NO: 3122901 - protein, 7 aa, Giardia lamblia
LSRPLTH

SEQ ID NO: 3122902 - protein, 7 aa, Giardia lamblia
LSRPTPQ

SEQ ID NO: 3122903 - protein, 24 aa, Giardia lamblia
LSRPTSASSRSSSRASSRRGSFTE

SEQ ID NO: 3122904 - protein, 6 aa, Giardia lamblia
LSRPVD

SEQ ID NO: 3122905 - protein, 4 aa, Giardia lamblia
LSRQ

SEQ ID NO: 3122906 - protein, 16 aa, Giardia lamblia
LSRQEAKLATKSSEYH

SEQ ID NO: 3122907 - protein, 6 aa, Giardia lamblia
LSRQQE

SEQ ID NO: 3122908 - protein, 4 aa, Giardia lamblia
LSRS

SEQ ID NO: 3122909 - protein, 7 aa, Giardia lamblia
LSRSKGY

SEQ ID NO: 3122910 - protein, 7 aa, Giardia lamblia
LSRSSSR

SEQ ID NO: 3122911 - protein, 11 aa, Giardia lamblia
LSRTANGKLQG

SEQ ID NO: 3122912 - protein, 8 aa, Giardia lamblia
LSRTGETV

SEQ ID NO: 3122913 - protein, 5 aa, Giardia lamblia
LSRTK

SEQ ID NO: 3122914 - protein, 8 aa, Giardia lamblia
LSRTPGGN

SEQ ID NO: 3122915 - protein, 12 aa, Giardia lamblia
LSRTQESPEERH

SEQ ID NO: 3122916 - protein, 14 aa, Giardia lamblia
LSRTQRLTAAEDAG

SEQ ID NO: 3122917 - protein, 7 aa, Giardia lamblia
LSRTSAR

SEQ ID NO: 3122918 - protein, 18 aa, Giardia lamblia
LSSAQRDISAKQATLESM

SEQ ID NO: 3122919 - protein, 23 aa, Giardia lamblia
LSSASTAIPLSRPEKKGTSNQDM

SEQ ID NO: 3122920 - protein, 8 aa, Giardia lamblia
LSSDEQHR

SEQ ID NO: 3122921 - protein, 13 aa, Giardia lamblia
LSSDIERERADRH

SEQ ID NO: 3122922 - protein, 7 aa, Giardia lamblia
LSSDNKS

SEQ ID NO: 3122923 - protein, 8 aa, Giardia lamblia
LSSDPSNI

SEQ ID NO: 3122924 - protein, 11 aa, Giardia lamblia
LSSDSKKLTPI

SEQ ID NO: 3122925 - protein, 22 aa, Giardia lamblia
LSSDYAEATRQANAATGGTYDT

SEQ ID NO: 3122926 - protein, 10 aa, Giardia lamblia
LSSEEASRVS

SEQ ID NO: 3122927 - protein, 12 aa, Giardia lamblia
LSSEELSQDRTT

SEQ ID NO: 3122928 - protein, 8 aa, Giardia lamblia
LSSETKTE

SEQ ID NO: 3122929 - protein, 5 aa, Giardia lamblia
LSSEV

SEQ ID NO: 3122930 - protein, 11 aa, Giardia lamblia
LSSGKGSRKAL

SEQ ID NO: 3122931 - protein, 8 aa, Giardia lamblia
LSSGKKNY

SEQ ID NO: 3122932 - protein, 12 aa, Giardia lamblia
LSSGPGSSIDRK

SEQ ID NO: 3122933 - protein, 7 aa, Giardia lamblia
LSSGPYG

SEQ ID NO: 3122934 - protein, 10 aa, Giardia lamblia
LSSGSPTIKQ

SEQ ID NO: 3122935 - protein, 22 aa, Giardia lamblia
LSSGSTAPAFRAGGGAGSAVQP

SEQ ID NO: 3122936 - protein, 9 aa, Giardia lamblia
LSSIPDPSL

SEQ ID NO: 3122937 - protein, 6 aa, Giardia lamblia
LSSKDV

SEQ ID NO: 3122938 - protein, 12 aa, Giardia lamblia
LSSKEAKRSVQH

SEQ ID NO: 3122939 - protein, 7 aa, Giardia lamblia
LSSKSHH

SEQ ID NO: 3122940 - protein, 17 aa, Giardia lamblia
LSSKTESTSPLKPTQVS

SEQ ID NO: 3122941 - protein, 8 aa, Giardia lamblia
LSSKTKEL

SEQ ID NO: 3122942 - protein, 17 aa, Giardia lamblia
LSSKTSECSKKTKTIET

SEQ ID NO: 3122943 - protein, 4 aa, Giardia lamblia
LSSN

SEQ ID NO: 3122944 - protein, 10 aa, Giardia lamblia
LSSNASDNGQ

SEQ ID NO: 3122945 - protein, 7 aa, Giardia lamblia
LSSNEVS

SEQ ID NO: 3122946 - protein, 6 aa, Giardia lamblia
LSSNNR

SEQ ID NO: 3122947 - protein, 9 aa, Giardia lamblia
LSSNPTEFT

SEQ ID NO: 3122948 - protein, 9 aa, Giardia lamblia
LSSNTEPLS

SEQ ID NO: 3122949 - protein, 14 aa, Giardia lamblia
LSSNTTKTAEKPVT

SEQ ID NO: 3122950 - protein, 4 aa, Giardia lamblia
LSSP

SEQ ID NO: 3122951 - protein, 5 aa, Giardia lamblia
LSSPG

SEQ ID NO: 3122952 - protein, 15 aa, Giardia lamblia
LSSPIESLTRGQPTE

SEQ ID NO: 3122953 - protein, 6 aa, Giardia lamblia
LSSPNF

SEQ ID NO: 3122954 - protein, 7 aa, Giardia lamblia
LSSPQEL

SEQ ID NO: 3122955 - protein, 8 aa, Giardia lamblia
LSSPRPFQ

SEQ ID NO: 3122956 - protein, 10 aa, Giardia lamblia
LSSPRSPTRI

SEQ ID NO: 3122957 - protein, 4 aa, Giardia lamblia
LSSQ

SEQ ID NO: 3122958 - protein, 16 aa, Giardia lamblia
LSSQAEALSTNKRLQD

SEQ ID NO: 3122959 - protein, 19 aa, Giardia lamblia
LSSQASRRGSSVRASETGL

SEQ ID NO: 3122960 - protein, 17 aa, Giardia lamblia
LSSQHSSQHSSQISSQL

SEQ ID NO: 3122961 - protein, 5 aa, Giardia lamblia
LSSQN

SEQ ID NO: 3122962 - protein, 14 aa, Giardia lamblia
LSSQQIKRKHPPHY

SEQ ID NO: 3122963 - protein, 6 aa, Giardia lamblia
LSSQQK

SEQ ID NO: 3122964 - protein, 20 aa, Giardia lamblia
LSSQQSDNSARNSVSSPIRG

SEQ ID NO: 3122965 - protein, 19 aa, Giardia lamblia
LSSQQSLANEQEDGALDEP

SEQ ID NO: 3122966 - protein, 8 aa, Giardia lamblia
LSSRDDLQ

SEQ ID NO: 3122967 - protein, 13 aa, Giardia lamblia
LSSRNAYLTQEKD

SEQ ID NO: 3122968 - protein, 26 aa, Giardia lamblia
LSSRPSTEISRTTSQKKPSEPARSRS

SEQ ID NO: 3122969 - protein, 32 aa, Giardia lamblia
LSSRSSSSRRAYSARPSRSSDVLSASQSKAAA

SEQ ID NO: 3122970 - protein, 4 aa, Giardia lamblia
LSSS

SEQ ID NO: 3122971 - protein, 8 aa, Giardia lamblia
LSSSEKVE

SEQ ID NO: 3122972 - protein, 13 aa, Giardia lamblia
LSSSESSSPSIDN

SEQ ID NO: 3122973 - protein, 13 aa, Giardia lamblia
LSSSKRGSSEEHI

SEQ ID NO: 3122974 - protein, 15 aa, Giardia lamblia
LSSSKSPEASTSGSK

SEQ ID NO: 3122975 - protein, 11 aa, Giardia lamblia
LSSSLQDACGD

SEQ ID NO: 3122976 - protein, 15 aa, Giardia lamblia
LSSSQRDHRASCTTA

SEQ ID NO: 3122977 - protein, 9 aa, Giardia lamblia
LSSSQSTEL

SEQ ID NO: 3122978 - protein, 59 aa, Giardia lamblia
LSSSSGGKRSSRPSSARAASRPGSAQKSHSVHKKTKEHRESSSRHKYDSTHSRDYRESD

SEQ ID NO: 3122979 - protein, 10 aa, Giardia lamblia
LSSSSGKRSM

SEQ ID NO: 3122980 - protein, 10 aa, Giardia lamblia
LSSSSKKEEN

SEQ ID NO: 3122981 - protein, 8 aa, Giardia lamblia
LSSSSKPV

SEQ ID NO: 3122982 - protein, 29 aa, Giardia lamblia
LSSSSRRDSLSKAKNVRDGLRSGAISRKH

SEQ ID NO: 3122983 - protein, 13 aa, Giardia lamblia
LSSSSRTSLAVLL

SEQ ID NO: 3122984 - protein, 16 aa, Giardia lamblia
LSSSSSPSSPSPSPVH

SEQ ID NO: 3122985 - protein, 10 aa, Giardia lamblia
LSSSSSRRRT

SEQ ID NO: 3122986 - protein, 14 aa, Giardia lamblia
LSSSSVSATPPCGP

SEQ ID NO: 3122987 - protein, 4 aa, Giardia lamblia
LSST

SEQ ID NO: 3122988 - protein, 12 aa, Giardia lamblia
LSSTASTGARSM

SEQ ID NO: 3122989 - protein, 5 aa, Giardia lamblia
LSSTE

SEQ ID NO: 3122990 - protein, 6 aa, Giardia lamblia
LSSTEH

SEQ ID NO: 3122991 - protein, 23 aa, Giardia lamblia
LSSTERGDKESQSTTRKNVTPSL

SEQ ID NO: 3122992 - protein, 8 aa, Giardia lamblia
LSSTGSDC

SEQ ID NO: 3122993 - protein, 8 aa, Giardia lamblia
LSSTIGNT

SEQ ID NO: 3122994 - protein, 5 aa, Giardia lamblia
LSSTL

SEQ ID NO: 3122995 - protein, 8 aa, Giardia lamblia
LSSTQQES

SEQ ID NO: 3122996 - protein, 5 aa, Giardia lamblia
LSSVD

SEQ ID NO: 3122997 - protein, 14 aa, Giardia lamblia
LSSVRKENAAITTE

SEQ ID NO: 3122998 - protein, 5 aa, Giardia lamblia
LSSVT

SEQ ID NO: 3122999 - protein, 16 aa, Giardia lamblia
LSTAADANKDALTKDI

SEQ ID NO: 3123000 - protein, 21 aa, Giardia lamblia
LSTAATGGSTAQVGAVSNQAV

SEQ ID NO: 3123001 - protein, 6 aa, Giardia lamblia
LSTADH

SEQ ID NO: 3123002 - protein, 18 aa, Giardia lamblia
LSTAQKGANGVRSSNYTN

SEQ ID NO: 3123003 - protein, 4 aa, Giardia lamblia
LSTD

SEQ ID NO: 3123004 - protein, 5 aa, Giardia lamblia
LSTDR

SEQ ID NO: 3123005 - protein, 10 aa, Giardia lamblia
LSTDSKLSQK

SEQ ID NO: 3123006 - protein, 11 aa, Giardia lamblia
LSTDTPISASK

SEQ ID NO: 3123007 - protein, 4 aa, Giardia lamblia
LSTE

SEQ ID NO: 3123008 - protein, 8 aa, Giardia lamblia
LSTEDPGE

SEQ ID NO: 3123009 - protein, 16 aa, Giardia lamblia
LSTEKQMREAENSRAQ

SEQ ID NO: 3123010 - protein, 12 aa, Giardia lamblia
LSTEKRASQPAK

SEQ ID NO: 3123011 - protein, 10 aa, Giardia lamblia
LSTEPSASIE

SEQ ID NO: 3123012 - protein, 8 aa, Giardia lamblia
LSTETSPD

SEQ ID NO: 3123013 - protein, 6 aa, Giardia lamblia
LSTGDA

SEQ ID NO: 3123014 - protein, 15 aa, Giardia lamblia
LSTGDQHIKDDTDAE

SEQ ID NO: 3123015 - protein, 32 aa, Giardia lamblia
LSTGKDAPAASLSGRHPDLAKNTNPGPGAYNV

SEQ ID NO: 3123016 - protein, 7 aa, Giardia lamblia
LSTGVGD

SEQ ID NO: 3123017 - protein, 10 aa, Giardia lamblia
LSTKDKRVTS

SEQ ID NO: 3123018 - protein, 11 aa, Giardia lamblia
LSTKEDAADRI

SEQ ID NO: 3123019 - protein, 8 aa, Giardia lamblia
LSTKSPDL

SEQ ID NO: 3123020 - protein, 4 aa, Giardia lamblia
LSTL

SEQ ID NO: 3123021 - protein, 9 aa, Giardia lamblia
LSTNDPSAI

SEQ ID NO: 3123022 - protein, 6 aa, Giardia lamblia
LSTNRA

SEQ ID NO: 3123023 - protein, 4 aa, Giardia lamblia
LSTP

SEQ ID NO: 3123024 - protein, 6 aa, Giardia lamblia
LSTPAT

SEQ ID NO: 3123025 - protein, 7 aa, Giardia lamblia
LSTPIAS

SEQ ID NO: 3123026 - protein, 21 aa, Giardia lamblia
LSTPKKAASDEEDNYNLDGWE

SEQ ID NO: 3123027 - protein, 6 aa, Giardia lamblia
LSTPKS

SEQ ID NO: 3123028 - protein, 10 aa, Giardia lamblia
LSTPPATRES

SEQ ID NO: 3123029 - protein, 17 aa, Giardia lamblia
LSTPPCSPGAMRKPQTP

SEQ ID NO: 3123030 - protein, 6 aa, Giardia lamblia
LSTPQD

SEQ ID NO: 3123031 - protein, 11 aa, Giardia lamblia
LSTPQVGGFNS

SEQ ID NO: 3123032 - protein, 11 aa, Giardia lamblia
LSTPRNDRNDF

SEQ ID NO: 3123033 - protein, 17 aa, Giardia lamblia
LSTQERRRRVEEKKQEI

SEQ ID NO: 3123034 - protein, 26 aa, Giardia lamblia
LSTQGQNDSVGIGAAPTKSIASAMRT

SEQ ID NO: 3123035 - protein, 6 aa, Giardia lamblia
LSTQPD

SEQ ID NO: 3123036 - protein, 16 aa, Giardia lamblia
LSTQTDTVTDTITTPV

SEQ ID NO: 3123037 - protein, 7 aa, Giardia lamblia
LSTRDKQ

SEQ ID NO: 3123038 - protein, 13 aa, Giardia lamblia
LSTRSTKSARRPL

SEQ ID NO: 3123039 - protein, 12 aa, Giardia lamblia
LSTSASEEEQKL

SEQ ID NO: 3123040 - protein, 9 aa, Giardia lamblia
LSTSEKTGV

SEQ ID NO: 3123041 - protein, 5 aa, Giardia lamblia
LSTSK

SEQ ID NO: 3123042 - protein, 7 aa, Giardia lamblia
LSTSPFA

SEQ ID NO: 3123043 - protein, 7 aa, Giardia lamblia
LSTSRRR

SEQ ID NO: 3123044 - protein, 10 aa, Giardia lamblia
LSTSSSSELS

SEQ ID NO: 3123045 - protein, 40 aa, Giardia lamblia
LSTSTNSVTPSTGSRAQSSQKDRAKSEAKEDSKQDRNSSA

SEQ ID NO: 3123046 - protein, 12 aa, Giardia lamblia
LSTSTTTSTPVL

SEQ ID NO: 3123047 - protein, 6 aa, Giardia lamblia
LSTSVS

SEQ ID NO: 3123048 - protein, 17 aa, Giardia lamblia
LSTTASGPGRPEGDAHY

SEQ ID NO: 3123049 - protein, 11 aa, Giardia lamblia
LSTTDGNPILQ

SEQ ID NO: 3123050 - protein, 5 aa, Giardia lamblia
LSTTE

SEQ ID NO: 3123051 - protein, 22 aa, Giardia lamblia
LSTTEKKKNTGATNNPSSNSYA

SEQ ID NO: 3123052 - protein, 15 aa, Giardia lamblia
LSTTGSQPSMPPTTM

SEQ ID NO: 3123053 - protein, 11 aa, Giardia lamblia
LSTTPSYSGTV

SEQ ID NO: 3123054 - protein, 6 aa, Giardia lamblia
LSTTQH

SEQ ID NO: 3123055 - protein, 10 aa, Giardia lamblia
LSTYEDEKSR

SEQ ID NO: 3123056 - protein, 14 aa, Giardia lamblia
LSVAPSDQSGAEYV

SEQ ID NO: 3123057 - protein, 4 aa, Giardia lamblia
LSVP

SEQ ID NO: 3123058 - protein, 6 aa, Giardia lamblia
LSVPGR

SEQ ID NO: 3123059 - protein, 5 aa, Giardia lamblia
LSVQS

SEQ ID NO: 3123060 - protein, 6 aa, Giardia lamblia
LSYGPN

SEQ ID NO: 3123061 - protein, 5 aa, Giardia lamblia
LSYSG

SEQ ID NO: 3123062 - protein, 5 aa, Giardia lamblia
LSYSR

SEQ ID NO: 3123063 - protein, 30 aa, Giardia lamblia
LTADPSNPKYREARDRVSEGRPEQATPDLS

SEQ ID NO: 3123064 - protein, 6 aa, Giardia lamblia
LTADVD

SEQ ID NO: 3123065 - protein, 6 aa, Giardia lamblia
LTAEQI

SEQ ID NO: 3123066 - protein, 9 aa, Giardia lamblia
LTAGGAGDA

SEQ ID NO: 3123067 - protein, 11 aa, Giardia lamblia
LTAGTPSEKLT

SEQ ID NO: 3123068 - protein, 4 aa, Giardia lamblia
LTAN

SEQ ID NO: 3123069 - protein, 11 aa, Giardia lamblia
LTANTPADTAK

SEQ ID NO: 3123070 - protein, 6 aa, Giardia lamblia
LTAQNS

SEQ ID NO: 3123071 - protein, 10 aa, Giardia lamblia
LTAQQQKRPR

SEQ ID NO: 3123072 - protein, 19 aa, Giardia lamblia
LTARAKKTTLIEDQPSEPV

SEQ ID NO: 3123073 - protein, 8 aa, Giardia lamblia
LTARKRRS

SEQ ID NO: 3123074 - protein, 10 aa, Giardia lamblia
LTASADGLTR

SEQ ID NO: 3123075 - protein, 7 aa, Giardia lamblia
LTASEKD

SEQ ID NO: 3123076 - protein, 10 aa, Giardia lamblia
LTASRVNKEE

SEQ ID NO: 3123077 - protein, 5 aa, Giardia lamblia
LTASS

SEQ ID NO: 3123078 - protein, 7 aa, Giardia lamblia
LTATAEA

SEQ ID NO: 3123079 - protein, 18 aa, Giardia lamblia
LTATAGAHLSDAGQQDNI

SEQ ID NO: 3123080 - protein, 6 aa, Giardia lamblia
LTATSD

SEQ ID NO: 3123081 - protein, 7 aa, Giardia lamblia
LTATTDT

SEQ ID NO: 3123082 - protein, 10 aa, Giardia lamblia
LTDAERDTAS

SEQ ID NO: 3123083 - protein, 18 aa, Giardia lamblia
LTDDKEVKVTPKDGESTL

SEQ ID NO: 3123084 - protein, 7 aa, Giardia lamblia
LTDEERN

SEQ ID NO: 3123085 - protein, 9 aa, Giardia lamblia
LTDEKASAL

SEQ ID NO: 3123086 - protein, 7 aa, Giardia lamblia
LTDERSQ

SEQ ID NO: 3123087 - protein, 7 aa, Giardia lamblia
LTDIGRD

SEQ ID NO: 3123088 - protein, 11 aa, Giardia lamblia
LTDKPSVSRTF

SEQ ID NO: 3123089 - protein, 10 aa, Giardia lamblia
LTDNKGRSAY

SEQ ID NO: 3123090 - protein, 11 aa, Giardia lamblia
LTDPADTANYE

SEQ ID NO: 3123091 - protein, 7 aa, Giardia lamblia
LTDPPGI

SEQ ID NO: 3123092 - protein, 7 aa, Giardia lamblia
LTDPTVP

SEQ ID NO: 3123093 - protein, 12 aa, Giardia lamblia
LTDQQEQGKVPA

SEQ ID NO: 3123094 - protein, 7 aa, Giardia lamblia
LTDRQQV

SEQ ID NO: 3123095 - protein, 5 aa, Giardia lamblia
LTDRR

SEQ ID NO: 3123096 - protein, 7 aa, Giardia lamblia
LTDRTKL

SEQ ID NO: 3123097 - protein, 8 aa, Giardia lamblia
LTDSSRSL

SEQ ID NO: 3123098 - protein, 9 aa, Giardia lamblia
LTDSTGSTA

SEQ ID NO: 3123099 - protein, 9 aa, Giardia lamblia
LTDTDDETA

SEQ ID NO: 3123100 - protein, 11 aa, Giardia lamblia
LTEAARSASGM

SEQ ID NO: 3123101 - protein, 8 aa, Giardia lamblia
LTEAEDEY

SEQ ID NO: 3123102 - protein, 7 aa, Giardia lamblia
LTEAKKI

SEQ ID NO: 3123103 - protein, 7 aa, Giardia lamblia
LTEARDK

SEQ ID NO: 3123104 - protein, 16 aa, Giardia lamblia
LTEATQPGHPSAEKSA

SEQ ID NO: 3123105 - protein, 5 aa, Giardia lamblia
LTEDG

SEQ ID NO: 3123106 - protein, 4 aa, Giardia lamblia
LTEE

SEQ ID NO: 3123107 - protein, 16 aa, Giardia lamblia
LTEEEEKEEELQPQDA

SEQ ID NO: 3123108 - protein, 9 aa, Giardia lamblia
LTEESYKDS

SEQ ID NO: 3123109 - protein, 10 aa, Giardia lamblia
LTEKNKQIDD

SEQ ID NO: 3123110 - protein, 14 aa, Giardia lamblia
LTEKRGTEVQPEQR

SEQ ID NO: 3123111 - protein, 25 aa, Giardia lamblia
LTEKSAGPPSPRRDSLEEENAALRE

SEQ ID NO: 3123112 - protein, 11 aa, Giardia lamblia
LTELEKNNPEI

SEQ ID NO: 3123113 - protein, 28 aa, Giardia lamblia
LTENAKDESFPLPPTITNSSYKPAAKLD

SEQ ID NO: 3123114 - protein, 11 aa, Giardia lamblia
LTENGIKDERD

SEQ ID NO: 3123115 - protein, 7 aa, Giardia lamblia
LTENKNE

SEQ ID NO: 3123116 - protein, 6 aa, Giardia lamblia
LTENQN

SEQ ID NO: 3123117 - protein, 11 aa, Giardia lamblia
LTEPANQEDAR

SEQ ID NO: 3123118 - protein, 8 aa, Giardia lamblia
LTEPQDAK

SEQ ID NO: 3123119 - protein, 5 aa, Giardia lamblia
LTEQK

SEQ ID NO: 3123120 - protein, 5 aa, Giardia lamblia
LTEQT

SEQ ID NO: 3123121 - protein, 7 aa, Giardia lamblia
LTEQTSS

SEQ ID NO: 3123122 - protein, 8 aa, Giardia lamblia
LTERSNNT

SEQ ID NO: 3123123 - protein, 10 aa, Giardia lamblia
LTESETPQLS

SEQ ID NO: 3123124 - protein, 12 aa, Giardia lamblia
LTETDAQAAKVE

SEQ ID NO: 3123125 - protein, 5 aa, Giardia lamblia
LTETE

SEQ ID NO: 3123126 - protein, 12 aa, Giardia lamblia
LTETTMRPRNPD

SEQ ID NO: 3123127 - protein, 13 aa, Giardia lamblia
LTGDARGGSASPM

SEQ ID NO: 3123128 - protein, 7 aa, Giardia lamblia
LTGEDRV

SEQ ID NO: 3123129 - protein, 6 aa, Giardia lamblia
LTGEGL

SEQ ID NO: 3123130 - protein, 6 aa, Giardia lamblia
LTGEIR

SEQ ID NO: 3123131 - protein, 6 aa, Giardia lamblia
LTGENA

SEQ ID NO: 3123132 - protein, 5 aa, Giardia lamblia
LTGGG

SEQ ID NO: 3123133 - protein, 11 aa, Giardia lamblia
LTGGLSPPDCK

SEQ ID NO: 3123134 - protein, 6 aa, Giardia lamblia
LTGGVS

SEQ ID NO: 3123135 - protein, 4 aa, Giardia lamblia
LTGK

SEQ ID NO: 3123136 - protein, 10 aa, Giardia lamblia
LTGKIKDKQA

SEQ ID NO: 3123137 - protein, 37 aa, Giardia lamblia
LTGKNTHSLPSTSCTQEANSAIRSYDNSHSAAQKART

SEQ ID NO: 3123138 - protein, 4 aa, Giardia lamblia
LTGN

SEQ ID NO: 3123139 - protein, 8 aa, Giardia lamblia
LTGNEGVE

SEQ ID NO: 3123140 - protein, 5 aa, Giardia lamblia
LTGPL

SEQ ID NO: 3123141 - protein, 31 aa, Giardia lamblia
LTGPLSSAKARPNSARQLATPTSSRSPSPSC

SEQ ID NO: 3123142 - protein, 17 aa, Giardia lamblia
LTGQSDKSITRSEFADP

SEQ ID NO: 3123143 - protein, 27 aa, Giardia lamblia
LTGRKQNISDSQNYKELSERTSQQHSS

SEQ ID NO: 3123144 - protein, 23 aa, Giardia lamblia
LTGRPVPQRKALNSDDSNDFTDD

SEQ ID NO: 3123145 - protein, 6 aa, Giardia lamblia
LTGRSV

SEQ ID NO: 3123146 - protein, 6 aa, Giardia lamblia
LTGSGI

SEQ ID NO: 3123147 - protein, 12 aa, Giardia lamblia
LTGSKDSAMKSQ

SEQ ID NO: 3123148 - protein, 5 aa, Giardia lamblia
LTGSR

SEQ ID NO: 3123149 - protein, 9 aa, Giardia lamblia
LTGTGPTAL

SEQ ID NO: 3123150 - protein, 11 aa, Giardia lamblia
LTGTRSHVSDT

SEQ ID NO: 3123151 - protein, 4 aa, Giardia lamblia
LTHD

SEQ ID NO: 3123152 - protein, 9 aa, Giardia lamblia
LTHSADKNP

SEQ ID NO: 3123153 - protein, 11 aa, Giardia lamblia
LTHSPPRNKVE

SEQ ID NO: 3123154 - protein, 5 aa, Giardia lamblia
LTIKS

SEQ ID NO: 3123155 - protein, 8 aa, Giardia lamblia
LTITNDGA

SEQ ID NO: 3123156 - protein, 17 aa, Giardia lamblia
LTKAASAQYARKDYEKA

SEQ ID NO: 3123157 - protein, 25 aa, Giardia lamblia
LTKAETRSGQEYEELQKTKATISSL

SEQ ID NO: 3123158 - protein, 14 aa, Giardia lamblia
LTKAKRDGAEKVSR

SEQ ID NO: 3123159 - protein, 8 aa, Giardia lamblia
LTKAQRAL

SEQ ID NO: 3123160 - protein, 5 aa, Giardia lamblia
LTKEA

SEQ ID NO: 3123161 - protein, 15 aa, Giardia lamblia
LTKEATKLSSHASTT

SEQ ID NO: 3123162 - protein, 18 aa, Giardia lamblia
LTKEGGRNVNFGTSSNSL

SEQ ID NO: 3123163 - protein, 6 aa, Giardia lamblia
LTKKDR

SEQ ID NO: 3123164 - protein, 12 aa, Giardia lamblia
LTKNAPTAERGN

SEQ ID NO: 3123165 - protein, 10 aa, Giardia lamblia
LTKQEKTAAL

SEQ ID NO: 3123166 - protein, 8 aa, Giardia lamblia
LTKQGTHV

SEQ ID NO: 3123167 - protein, 11 aa, Giardia lamblia
LTKQQSKRLQD

SEQ ID NO: 3123168 - protein, 5 aa, Giardia lamblia
LTKRN

SEQ ID NO: 3123169 - protein, 11 aa, Giardia lamblia
LTKSQSNEGTF

SEQ ID NO: 3123170 - protein, 5 aa, Giardia lamblia
LTKSS

SEQ ID NO: 3123171 - protein, 15 aa, Giardia lamblia
LTKSTAFRDKDGNTA

SEQ ID NO: 3123172 - protein, 9 aa, Giardia lamblia
LTKTQQGSL

SEQ ID NO: 3123173 - protein, 5 aa, Giardia lamblia
LTKTV

SEQ ID NO: 3123174 - protein, 8 aa, Giardia lamblia
LTLPTSPV

SEQ ID NO: 3123175 - protein, 10 aa, Giardia lamblia
LTNAENESIS

SEQ ID NO: 3123176 - protein, 11 aa, Giardia lamblia
LTNAKKYTGIS

SEQ ID NO: 3123177 - protein, 10 aa, Giardia lamblia
LTNDAERLRG

SEQ ID NO: 3123178 - protein, 11 aa, Giardia lamblia
LTNDPASGCRA

SEQ ID NO: 3123179 - protein, 7 aa, Giardia lamblia
LTNEAAQ

SEQ ID NO: 3123180 - protein, 5 aa, Giardia lamblia
LTNER

SEQ ID NO: 3123181 - protein, 11 aa, Giardia lamblia
LTNGRPGSMGS

SEQ ID NO: 3123182 - protein, 6 aa, Giardia lamblia
LTNKDG

SEQ ID NO: 3123183 - protein, 7 aa, Giardia lamblia
LTNKDGL

SEQ ID NO: 3123184 - protein, 15 aa, Giardia lamblia
LTNKEKSSETDRAEN

SEQ ID NO: 3123185 - protein, 15 aa, Giardia lamblia
LTNKNKIEAQANADV

SEQ ID NO: 3123186 - protein, 8 aa, Giardia lamblia
LTNNAGET

SEQ ID NO: 3123187 - protein, 14 aa, Giardia lamblia
LTNNKVPEVTEDRE

SEQ ID NO: 3123188 - protein, 7 aa, Giardia lamblia
LTNPGLA

SEQ ID NO: 3123189 - protein, 97 aa, Giardia lamblia
LTNPPETYAPSTFSPSGTQLTTTFPQSTEVVEGDPSFASSGKKSRSASKTGRAKTPKEKTSRAKTPKAKTPKTKTPKTKGKSLRDAESTEYYDPPTA

SEQ ID NO: 3123190 - protein, 11 aa, Giardia lamblia
LTNPQASAALT

SEQ ID NO: 3123191 - protein, 9 aa, Giardia lamblia
LTNSPGHIT

SEQ ID NO: 3123192 - protein, 9 aa, Giardia lamblia
LTNTRTRAL

SEQ ID NO: 3123193 - protein, 4 aa, Giardia lamblia
LTPA

SEQ ID NO: 3123194 - protein, 5 aa, Giardia lamblia
LTPAA

SEQ ID NO: 3123195 - protein, 18 aa, Giardia lamblia
LTPAADDNREESSKESSK

SEQ ID NO: 3123196 - protein, 11 aa, Giardia lamblia
LTPADPSSPNL

SEQ ID NO: 3123197 - protein, 11 aa, Giardia lamblia
LTPADQRESPC

SEQ ID NO: 3123198 - protein, 8 aa, Giardia lamblia
LTPAEQEK

SEQ ID NO: 3123199 - protein, 10 aa, Giardia lamblia
LTPDEEDMTG

SEQ ID NO: 3123200 - protein, 17 aa, Giardia lamblia
LTPDGTGLAEKTCKGHT

SEQ ID NO: 3123201 - protein, 7 aa, Giardia lamblia
LTPDLSG

SEQ ID NO: 3123202 - protein, 10 aa, Giardia lamblia
LTPDQERMTS

SEQ ID NO: 3123203 - protein, 6 aa, Giardia lamblia
LTPDTH

SEQ ID NO: 3123204 - protein, 4 aa, Giardia lamblia
LTPE

SEQ ID NO: 3123205 - protein, 5 aa, Giardia lamblia
LTPEE

SEQ ID NO: 3123206 - protein, 6 aa, Giardia lamblia
LTPEQL

SEQ ID NO: 3123207 - protein, 27 aa, Giardia lamblia
LTPGQELRGTAPTEKESQRNLDLLLAI

SEQ ID NO: 3123208 - protein, 27 aa, Giardia lamblia
LTPGQELRGTAPTEKESQRNLDLLLAV

SEQ ID NO: 3123209 - protein, 10 aa, Giardia lamblia
LTPIEQTDPH

SEQ ID NO: 3123210 - protein, 4 aa, Giardia lamblia
LTPK

SEQ ID NO: 3123211 - protein, 9 aa, Giardia lamblia
LTPKDTAIP

SEQ ID NO: 3123212 - protein, 10 aa, Giardia lamblia
LTPNESIQEP

SEQ ID NO: 3123213 - protein, 5 aa, Giardia lamblia
LTPNH

SEQ ID NO: 3123214 - protein, 6 aa, Giardia lamblia
LTPNIN

SEQ ID NO: 3123215 - protein, 24 aa, Giardia lamblia
LTPNVDTPPEKQKPKEKRYKLTPR

SEQ ID NO: 3123216 - protein, 6 aa, Giardia lamblia
LTPPDA

SEQ ID NO: 3123217 - protein, 62 aa, Giardia lamblia
LTPPETPPRPTKSTKGKKGKKGAKGKKGRPSTGAKSNTASRPSTTRKLTTPPQTAMPGKRRP

SEQ ID NO: 3123218 - protein, 7 aa, Giardia lamblia
LTPPGAE

SEQ ID NO: 3123219 - protein, 7 aa, Giardia lamblia
LTPPQGI

SEQ ID NO: 3123220 - protein, 10 aa, Giardia lamblia
LTPPSHLGSK

SEQ ID NO: 3123221 - protein, 45 aa, Giardia lamblia
LTPQPSLATAQPSTQPSPQQAPPAYAPAAGPYASMQSNAYNTSYN

SEQ ID NO: 3123222 - protein, 12 aa, Giardia lamblia
LTPQSRGSHSDI

SEQ ID NO: 3123223 - protein, 8 aa, Giardia lamblia
LTPRTRDR

SEQ ID NO: 3123224 - protein, 8 aa, Giardia lamblia
LTPSGETS

SEQ ID NO: 3123225 - protein, 9 aa, Giardia lamblia
LTPSKRGKN

SEQ ID NO: 3123226 - protein, 5 aa, Giardia lamblia
LTPST

SEQ ID NO: 3123227 - protein, 17 aa, Giardia lamblia
LTPTGKQASPSGASPLQ

SEQ ID NO: 3123228 - protein, 14 aa, Giardia lamblia
LTPTNTAPSFSADS

SEQ ID NO: 3123229 - protein, 20 aa, Giardia lamblia
LTPYQQEAHPAPAVGPPTLE

SEQ ID NO: 3123230 - protein, 9 aa, Giardia lamblia
LTQEEEDTV

SEQ ID NO: 3123231 - protein, 7 aa, Giardia lamblia
LTQPQAP

SEQ ID NO: 3123232 - protein, 14 aa, Giardia lamblia
LTQQNNQMKNTTDN

SEQ ID NO: 3123233 - protein, 6 aa, Giardia lamblia
LTQRRT

SEQ ID NO: 3123234 - protein, 6 aa, Giardia lamblia
LTQRTM

SEQ ID NO: 3123235 - protein, 4 aa, Giardia lamblia
LTQS

SEQ ID NO: 3123236 - protein, 5 aa, Giardia lamblia
LTQSR

SEQ ID NO: 3123237 - protein, 6 aa, Giardia lamblia
LTRAEK

SEQ ID NO: 3123238 - protein, 9 aa, Giardia lamblia
LTRASEAGY

SEQ ID NO: 3123239 - protein, 17 aa, Giardia lamblia
LTRATAASGGTTAPDVR

SEQ ID NO: 3123240 - protein, 12 aa, Giardia lamblia
LTREEESSCSRP

SEQ ID NO: 3123241 - protein, 7 aa, Giardia lamblia
LTREEPS

SEQ ID NO: 3123242 - protein, 11 aa, Giardia lamblia
LTREKRELEAK

SEQ ID NO: 3123243 - protein, 24 aa, Giardia lamblia
LTRESSSTPETASVSAREAIPTRT

SEQ ID NO: 3123244 - protein, 7 aa, Giardia lamblia
LTRGKSE

SEQ ID NO: 3123245 - protein, 11 aa, Giardia lamblia
LTRKEDENTKL

SEQ ID NO: 3123246 - protein, 6 aa, Giardia lamblia
LTRQDP

SEQ ID NO: 3123247 - protein, 5 aa, Giardia lamblia
LTRSG

SEQ ID NO: 3123248 - protein, 17 aa, Giardia lamblia
LTRSTTSSRISRPSSGY

SEQ ID NO: 3123249 - protein, 4 aa, Giardia lamblia
LTSD

SEQ ID NO: 3123250 - protein, 5 aa, Giardia lamblia
LTSDC

SEQ ID NO: 3123251 - protein, 8 aa, Giardia lamblia
LTSDDTRK

SEQ ID NO: 3123252 - protein, 8 aa, Giardia lamblia
LTSDQQLA

SEQ ID NO: 3123253 - protein, 9 aa, Giardia lamblia
LTSEDTKDC

SEQ ID NO: 3123254 - protein, 12 aa, Giardia lamblia
LTSGSSTSDASY

SEQ ID NO: 3123255 - protein, 34 aa, Giardia lamblia
LTSGTTPHSSPVNRHQPSPNAAALKGSEATEDAE

SEQ ID NO: 3123256 - protein, 6 aa, Giardia lamblia
LTSIAS

SEQ ID NO: 3123257 - protein, 4 aa, Giardia lamblia
LTSK

SEQ ID NO: 3123258 - protein, 10 aa, Giardia lamblia
LTSKESKGTF

SEQ ID NO: 3123259 - protein, 6 aa, Giardia lamblia
LTSLSE

SEQ ID NO: 3123260 - protein, 12 aa, Giardia lamblia
LTSPGERRAPQS

SEQ ID NO: 3123261 - protein, 9 aa, Giardia lamblia
LTSPGTATK

SEQ ID NO: 3123262 - protein, 5 aa, Giardia lamblia
LTSPQ

SEQ ID NO: 3123263 - protein, 8 aa, Giardia lamblia
LTSQLTPE

SEQ ID NO: 3123264 - protein, 5 aa, Giardia lamblia
LTSQQ

SEQ ID NO: 3123265 - protein, 9 aa, Giardia lamblia
LTSQQTSDV

SEQ ID NO: 3123266 - protein, 5 aa, Giardia lamblia
LTSRE

SEQ ID NO: 3123267 - protein, 31 aa, Giardia lamblia
LTSSERSKRIPTVSSEHGTSSILTAPGTILA

SEQ ID NO: 3123268 - protein, 9 aa, Giardia lamblia
LTSSNGGNA

SEQ ID NO: 3123269 - protein, 11 aa, Giardia lamblia
LTSSNKDPGLM

SEQ ID NO: 3123270 - protein, 14 aa, Giardia lamblia
LTSSNLKKKNDTSE

SEQ ID NO: 3123271 - protein, 8 aa, Giardia lamblia
LTSSNPNI

SEQ ID NO: 3123272 - protein, 7 aa, Giardia lamblia
LTSSNTF

SEQ ID NO: 3123273 - protein, 9 aa, Giardia lamblia
LTSSPPRYN

SEQ ID NO: 3123274 - protein, 10 aa, Giardia lamblia
LTSSQPTIRP

SEQ ID NO: 3123275 - protein, 5 aa, Giardia lamblia
LTSSR

SEQ ID NO: 3123276 - protein, 8 aa, Giardia lamblia
LTSSSNRE

SEQ ID NO: 3123277 - protein, 19 aa, Giardia lamblia
LTSSSTQTDRQTSHVPTDI

SEQ ID NO: 3123278 - protein, 7 aa, Giardia lamblia
LTSSTPL

SEQ ID NO: 3123279 - protein, 40 aa, Giardia lamblia
LTSSTSGKHSQLHPGATSVPNTGKHDERRRPGTDIDPRLG

SEQ ID NO: 3123280 - protein, 12 aa, Giardia lamblia
LTSTESQRISDP

SEQ ID NO: 3123281 - protein, 6 aa, Giardia lamblia
LTSTGD

SEQ ID NO: 3123282 - protein, 7 aa, Giardia lamblia
LTSTPEH

SEQ ID NO: 3123283 - protein, 46 aa, Giardia lamblia
LTSTRNFGTETDRPRDRSDDRVAKDVRKRKKADPGATQVTKTSVQL

SEQ ID NO: 3123284 - protein, 9 aa, Giardia lamblia
LTSTSDAEG

SEQ ID NO: 3123285 - protein, 10 aa, Giardia lamblia
LTSTYSNSRI

SEQ ID NO: 3123286 - protein, 4 aa, Giardia lamblia
LTSV

SEQ ID NO: 3123287 - protein, 5 aa, Giardia lamblia
LTTAA

SEQ ID NO: 3123288 - protein, 17 aa, Giardia lamblia
LTTDKSESSQEAAPGTL

SEQ ID NO: 3123289 - protein, 4 aa, Giardia lamblia
LTTG

SEQ ID NO: 3123290 - protein, 11 aa, Giardia lamblia
LTTGATDPLLP

SEQ ID NO: 3123291 - protein, 7 aa, Giardia lamblia
LTTGPDL

SEQ ID NO: 3123292 - protein, 22 aa, Giardia lamblia
LTTGQKPSSATTATDTNKQSLA

SEQ ID NO: 3123293 - protein, 6 aa, Giardia lamblia
LTTHPE

SEQ ID NO: 3123294 - protein, 6 aa, Giardia lamblia
LTTHPP

SEQ ID NO: 3123295 - protein, 5 aa, Giardia lamblia
LTTIT

SEQ ID NO: 3123296 - protein, 18 aa, Giardia lamblia
LTTKADTLAARTDISERE

SEQ ID NO: 3123297 - protein, 9 aa, Giardia lamblia
LTTKDREAG

SEQ ID NO: 3123298 - protein, 9 aa, Giardia lamblia
LTTKNSVAS

SEQ ID NO: 3123299 - protein, 11 aa, Giardia lamblia
LTTMNPDESVS

SEQ ID NO: 3123300 - protein, 9 aa, Giardia lamblia
LTTNEYKTA

SEQ ID NO: 3123301 - protein, 14 aa, Giardia lamblia
LTTPRDQESTHRTK

SEQ ID NO: 3123302 - protein, 4 aa, Giardia lamblia
LTTQ

SEQ ID NO: 3123303 - protein, 7 aa, Giardia lamblia
LTTQNAS

SEQ ID NO: 3123304 - protein, 9 aa, Giardia lamblia
LTTQTGPDV

SEQ ID NO: 3123305 - protein, 10 aa, Giardia lamblia
LTTRPDQKHK

SEQ ID NO: 3123306 - protein, 13 aa, Giardia lamblia
LTTRSNNTRTEHY

SEQ ID NO: 3123307 - protein, 4 aa, Giardia lamblia
LTTS

SEQ ID NO: 3123308 - protein, 10 aa, Giardia lamblia
LTTSAVTAST

SEQ ID NO: 3123309 - protein, 5 aa, Giardia lamblia
LTTSG

SEQ ID NO: 3123310 - protein, 7 aa, Giardia lamblia
LTTSPTL

SEQ ID NO: 3123311 - protein, 7 aa, Giardia lamblia
LTTSSKK

SEQ ID NO: 3123312 - protein, 33 aa, Giardia lamblia
LTTSTQGRKSEVSPRPRFTSSSNVSRSQRTKDT

SEQ ID NO: 3123313 - protein, 16 aa, Giardia lamblia
LTTTGPSSRAISSYKP

SEQ ID NO: 3123314 - protein, 6 aa, Giardia lamblia
LTTTRS

SEQ ID NO: 3123315 - protein, 12 aa, Giardia lamblia
LTVDDDEKDVED

SEQ ID NO: 3123316 - protein, 7 aa, Giardia lamblia
LTVSSDP

SEQ ID NO: 3123317 - protein, 10 aa, Giardia lamblia
LTYETSEQTL

SEQ ID NO: 3123318 - protein, 39 aa, Giardia lamblia
LVDETPEEHMEAEQSGSHESANQQPTEECAEEPLEEQPE

SEQ ID NO: 3123319 - protein, 8 aa, Giardia lamblia
LVDSSGKT

SEQ ID NO: 3123320 - protein, 35 aa, Giardia lamblia
LVETTGDEEPANIDPSTLSQTEPRSLNYPKSSSKP

SEQ ID NO: 3123321 - protein, 20 aa, Giardia lamblia
LVNSSSHDPSISRNQSVNGT

SEQ ID NO: 3123322 - protein, 5 aa, Giardia lamblia
LVPPE

SEQ ID NO: 3123323 - protein, 5 aa, Giardia lamblia
LVPQE

SEQ ID NO: 3123324 - protein, 12 aa, Giardia lamblia
LVQSPKGVTASS

SEQ ID NO: 3123325 - protein, 15 aa, Giardia lamblia
LVQSSSSMTRSQTGI

SEQ ID NO: 3123326 - protein, 7 aa, Giardia lamblia
LVRPDGK

SEQ ID NO: 3123327 - protein, 10 aa, Giardia lamblia
LVRSTSRNKW

SEQ ID NO: 3123328 - protein, 9 aa, Giardia lamblia
LVSPTTGSM

SEQ ID NO: 3123329 - protein, 13 aa, Giardia lamblia
LVSRTRSDRGRNY

SEQ ID NO: 3123330 - protein, 12 aa, Giardia lamblia
LVSTPSGSTAYA

SEQ ID NO: 3123331 - protein, 4 aa, Giardia lamblia
LVTQ

SEQ ID NO: 3123332 - protein, 8 aa, Giardia lamblia
LYDGSPDS

SEQ ID NO: 3123333 - protein, 13 aa, Giardia lamblia
LYDPADPAEPPKI

SEQ ID NO: 3123334 - protein, 9 aa, Giardia lamblia
LYDSEDKWT

SEQ ID NO: 3123335 - protein, 4 aa, Giardia lamblia
LYGN

SEQ ID NO: 3123336 - protein, 31 aa, Giardia lamblia
LYKKGKDSLLAQGKRRYDRKQRGFGGQTKPI

SEQ ID NO: 3123337 - protein, 11 aa, Giardia lamblia
LYNGESVGEFK

SEQ ID NO: 3123338 - protein, 4 aa, Giardia lamblia
LYPD

SEQ ID NO: 3123339 - protein, 4 aa, Giardia lamblia
LYPG

SEQ ID NO: 3123340 - protein, 12 aa, Giardia lamblia
LYPGQAEGITSS

SEQ ID NO: 3123341 - protein, 5 aa, Giardia lamblia
LYPKG

SEQ ID NO: 3123342 - protein, 6 aa, Giardia lamblia
LYPPPD

SEQ ID NO: 3123343 - protein, 11 aa, Giardia lamblia
LYSPGAKRANL

SEQ ID NO: 3123344 - protein, 11 aa, Giardia lamblia
LYSSQSSSSSV

SEQ ID NO: 3123345 - protein, 5 aa, Giardia lamblia
MADGS

SEQ ID NO: 3123346 - protein, 11 aa, Giardia lamblia
MADTPKKPVPL

SEQ ID NO: 3123347 - protein, 12 aa, Giardia lamblia
MAEDSRAKGSSY

SEQ ID NO: 3123348 - protein, 13 aa, Giardia lamblia
MAEENEASTYNPH

SEQ ID NO: 3123349 - protein, 6 aa, Giardia lamblia
MAEQAS

SEQ ID NO: 3123350 - protein, 18 aa, Giardia lamblia
MAEQSKKSDPTKLPGGEN

SEQ ID NO: 3123351 - protein, 6 aa, Giardia lamblia
MAERAS

SEQ ID NO: 3123352 - protein, 9 aa, Giardia lamblia
MAGSTSEVS

SEQ ID NO: 3123353 - protein, 8 aa, Giardia lamblia
MAGTSGQD

SEQ ID NO: 3123354 - protein, 9 aa, Giardia lamblia
MAKDREIDE

SEQ ID NO: 3123355 - protein, 15 aa, Giardia lamblia
MAKDSLQTSRSFGPE

SEQ ID NO: 3123356 - protein, 11 aa, Giardia lamblia
MANSTEAEVDR

SEQ ID NO: 3123357 - protein, 28 aa, Giardia lamblia
MAPASIRQASAAGEPPEEAAKEPNPASI

SEQ ID NO: 3123358 - protein, 17 aa, Giardia lamblia
MAPENRDRYQEDSGSFA

SEQ ID NO: 3123359 - protein, 9 aa, Giardia lamblia
MAPKSGLHS

SEQ ID NO: 3123360 - protein, 19 aa, Giardia lamblia
MAPPPIKRSASENPSDDAL

SEQ ID NO: 3123361 - protein, 9 aa, Giardia lamblia
MAPQPLNSS

SEQ ID NO: 3123362 - protein, 18 aa, Giardia lamblia
MAPSSTRSAFASDTASVS

SEQ ID NO: 3123363 - protein, 10 aa, Giardia lamblia
MASQNNTVAS

SEQ ID NO: 3123364 - protein, 8 aa, Giardia lamblia
MASQQQKE

SEQ ID NO: 3123365 - protein, 4 aa, Giardia lamblia
MATD

SEQ ID NO: 3123366 - protein, 7 aa, Giardia lamblia
MATDTTY

SEQ ID NO: 3123367 - protein, 4 aa, Giardia lamblia
MATG

SEQ ID NO: 3123368 - protein, 30 aa, Giardia lamblia
MCGSRSVSKSGSRLTSRTGSRAISRTTSEI

SEQ ID NO: 3123369 - protein, 17 aa, Giardia lamblia
MCSKESELQATPYVPST

SEQ ID NO: 3123370 - protein, 10 aa, Giardia lamblia
MDAEPSRIST

SEQ ID NO: 3123371 - protein, 7 aa, Giardia lamblia
MDAERAR

SEQ ID NO: 3123372 - protein, 19 aa, Giardia lamblia
MDDDEEAVPLENKTSAYSK

SEQ ID NO: 3123373 - protein, 4 aa, Giardia lamblia
MDDE

SEQ ID NO: 3123374 - protein, 4 aa, Giardia lamblia
MDDG

SEQ ID NO: 3123375 - protein, 12 aa, Giardia lamblia
MDDNEEGENQPR

SEQ ID NO: 3123376 - protein, 4 aa, Giardia lamblia
MDDP

SEQ ID NO: 3123377 - protein, 17 aa, Giardia lamblia
MDDTSSAFSSGTSMANL

SEQ ID NO: 3123378 - protein, 8 aa, Giardia lamblia
MDENPHTQ

SEQ ID NO: 3123379 - protein, 4 aa, Giardia lamblia
MDEQ

SEQ ID NO: 3123380 - protein, 15 aa, Giardia lamblia
MDEQHPSSQSTPYSI

SEQ ID NO: 3123381 - protein, 5 aa, Giardia lamblia
MDESS

SEQ ID NO: 3123382 - protein, 8 aa, Giardia lamblia
MDETTTAL

SEQ ID NO: 3123383 - protein, 5 aa, Giardia lamblia
MDGNS

SEQ ID NO: 3123384 - protein, 6 aa, Giardia lamblia
MDGNVS

SEQ ID NO: 3123385 - protein, 7 aa, Giardia lamblia
MDGRGAD

SEQ ID NO: 3123386 - protein, 15 aa, Giardia lamblia
MDHTDGSSDNGVFTS

SEQ ID NO: 3123387 - protein, 15 aa, Giardia lamblia
MDKKEAEAKKAGVPF

SEQ ID NO: 3123388 - protein, 8 aa, Giardia lamblia
MDNKKTEL

SEQ ID NO: 3123389 - protein, 11 aa, Giardia lamblia
MDPASEAPPPW

SEQ ID NO: 3123390 - protein, 9 aa, Giardia lamblia
MDPEDEEYK

SEQ ID NO: 3123391 - protein, 5 aa, Giardia lamblia
MDPES

SEQ ID NO: 3123392 - protein, 7 aa, Giardia lamblia
MDPPANT

SEQ ID NO: 3123393 - protein, 26 aa, Giardia lamblia
MDPPPRFTKRTRESGNAISRFFHNIF

SEQ ID NO: 3123394 - protein, 11 aa, Giardia lamblia
MDPRANNPNLR

SEQ ID NO: 3123395 - protein, 5 aa, Giardia lamblia
MDQDG

SEQ ID NO: 3123396 - protein, 10 aa, Giardia lamblia
MDRDRSTAPV

SEQ ID NO: 3123397 - protein, 4 aa, Giardia lamblia
MDRK

SEQ ID NO: 3123398 - protein, 11 aa, Giardia lamblia
MDRRSSAHNYN

SEQ ID NO: 3123399 - protein, 9 aa, Giardia lamblia
MDSGGEAYT

SEQ ID NO: 3123400 - protein, 24 aa, Giardia lamblia
MDSGSFTDSLTREHTSVSASALKS

SEQ ID NO: 3123401 - protein, 6 aa, Giardia lamblia
MDSHQR

SEQ ID NO: 3123402 - protein, 14 aa, Giardia lamblia
MDSKPTDTKTEDIS

SEQ ID NO: 3123403 - protein, 9 aa, Giardia lamblia
MDSSDDEWN

SEQ ID NO: 3123404 - protein, 7 aa, Giardia lamblia
MDSSITT

SEQ ID NO: 3123405 - protein, 12 aa, Giardia lamblia
MDSSSKGVPATT

SEQ ID NO: 3123406 - protein, 11 aa, Giardia lamblia
MDTPDSGRPYY

SEQ ID NO: 3123407 - protein, 26 aa, Giardia lamblia
MDTQQESQIQQPTSATTHLTTSQQEE

SEQ ID NO: 3123408 - protein, 12 aa, Giardia lamblia
MDYSTQEARNTL

SEQ ID NO: 3123409 - protein, 15 aa, Giardia lamblia
MEAKENKTQRAKKLK

SEQ ID NO: 3123410 - protein, 8 aa, Giardia lamblia
MEAQPHER

SEQ ID NO: 3123411 - protein, 4 aa, Giardia lamblia
MEDA

SEQ ID NO: 3123412 - protein, 12 aa, Giardia lamblia
MEDPEVPEEIRS

SEQ ID NO: 3123413 - protein, 14 aa, Giardia lamblia
MEDPSNDKKESNKA

SEQ ID NO: 3123414 - protein, 11 aa, Giardia lamblia
MEDRSGRTPLD

SEQ ID NO: 3123415 - protein, 6 aa, Giardia lamblia
MEEADS

SEQ ID NO: 3123416 - protein, 9 aa, Giardia lamblia
MEEESPREV

SEQ ID NO: 3123417 - protein, 11 aa, Giardia lamblia
MEEQARRDGVS

SEQ ID NO: 3123418 - protein, 11 aa, Giardia lamblia
MEESGPRTPSE

SEQ ID NO: 3123419 - protein, 29 aa, Giardia lamblia
MEGSHGKTSNLSPKTLDARAQSLQARTGY

SEQ ID NO: 3123420 - protein, 18 aa, Giardia lamblia
MEGYGGELSASDLAKPFN

SEQ ID NO: 3123421 - protein, 14 aa, Giardia lamblia
MEKGESAAENEKLK

SEQ ID NO: 3123422 - protein, 7 aa, Giardia lamblia
MEKPDSG

SEQ ID NO: 3123423 - protein, 13 aa, Giardia lamblia
MEKRRKGVYGPVA

SEQ ID NO: 3123424 - protein, 5 aa, Giardia lamblia
MEKRT

SEQ ID NO: 3123425 - protein, 8 aa, Giardia lamblia
MENDAAEA

SEQ ID NO: 3123426 - protein, 32 aa, Giardia lamblia
MENDTDQAADSARNTVTPSKDIPISEHTTGVA

SEQ ID NO: 3123427 - protein, 11 aa, Giardia lamblia
MENEPEPGTTS

SEQ ID NO: 3123428 - protein, 10 aa, Giardia lamblia
MENGASTGHA

SEQ ID NO: 3123429 - protein, 7 aa, Giardia lamblia
MENPGLQ

SEQ ID NO: 3123430 - protein, 15 aa, Giardia lamblia
MEPEPNPSHGATNPS

SEQ ID NO: 3123431 - protein, 13 aa, Giardia lamblia
MEPGPDERKKPSW

SEQ ID NO: 3123432 - protein, 12 aa, Giardia lamblia
MEPKEQKRLQEG

SEQ ID NO: 3123433 - protein, 7 aa, Giardia lamblia
MEPNNRP

SEQ ID NO: 3123434 - protein, 4 aa, Giardia lamblia
MEQH

SEQ ID NO: 3123435 - protein, 6 aa, Giardia lamblia
MEQQAP

SEQ ID NO: 3123436 - protein, 13 aa, Giardia lamblia
MERAQGSAGSSTP

SEQ ID NO: 3123437 - protein, 21 aa, Giardia lamblia
MERDKEKKTAKQQADDAKKLA

SEQ ID NO: 3123438 - protein, 7 aa, Giardia lamblia
MERGDDE

SEQ ID NO: 3123439 - protein, 4 aa, Giardia lamblia
MERP

SEQ ID NO: 3123440 - protein, 9 aa, Giardia lamblia
MESGKASIN

SEQ ID NO: 3123441 - protein, 8 aa, Giardia lamblia
MESKARDD

SEQ ID NO: 3123442 - protein, 13 aa, Giardia lamblia
MESKSRAERQRMN

SEQ ID NO: 3123443 - protein, 41 aa, Giardia lamblia
MESNDDSKSTDAVSSAASNLLSSSSKGERKRARSRSGLSIP

SEQ ID NO: 3123444 - protein, 9 aa, Giardia lamblia
MESPSPLGL

SEQ ID NO: 3123445 - protein, 15 aa, Giardia lamblia
MESSKGSSRFKTRVL

SEQ ID NO: 3123446 - protein, 49 aa, Giardia lamblia
MESSQISRKSVSNKPISTTASAVESTRASQALEEGSKTVTGQASSGDYE

SEQ ID NO: 3123447 - protein, 6 aa, Giardia lamblia
MESTAT

SEQ ID NO: 3123448 - protein, 6 aa, Giardia lamblia
MESTEA

SEQ ID NO: 3123449 - protein, 5 aa, Giardia lamblia
METQD

SEQ ID NO: 3123450 - protein, 8 aa, Giardia lamblia
METQSATM

SEQ ID NO: 3123451 - protein, 21 aa, Giardia lamblia
METTESDAANQRYSKLQGEQE

SEQ ID NO: 3123452 - protein, 5 aa, Giardia lamblia
METTG

SEQ ID NO: 3123453 - protein, 7 aa, Giardia lamblia
MGADPQE

SEQ ID NO: 3123454 - protein, 13 aa, Giardia lamblia
MGDHRSYTRSVEE

SEQ ID NO: 3123455 - protein, 6 aa, Giardia lamblia
MGDPEY

SEQ ID NO: 3123456 - protein, 8 aa, Giardia lamblia
MGDTRAYE

SEQ ID NO: 3123457 - protein, 5 aa, Giardia lamblia
MGELS

SEQ ID NO: 3123458 - protein, 44 aa, Giardia lamblia
MGEPSQSAADLKPQKGGRASRAGSKQSSVRRTPKLETASFSNST

SEQ ID NO: 3123459 - protein, 4 aa, Giardia lamblia
MGES

SEQ ID NO: 3123460 - protein, 14 aa, Giardia lamblia
MGGPSADGLASTSD

SEQ ID NO: 3123461 - protein, 9 aa, Giardia lamblia
MGHGSNCQV

SEQ ID NO: 3123462 - protein, 15 aa, Giardia lamblia
MGKDGRPTAGRERKT

SEQ ID NO: 3123463 - protein, 25 aa, Giardia lamblia
MGKHSERSAMSTMKNDSDGAKDSDL

SEQ ID NO: 3123464 - protein, 10 aa, Giardia lamblia
MGKTTADGTT

SEQ ID NO: 3123465 - protein, 6 aa, Giardia lamblia
MGNKNA

SEQ ID NO: 3123466 - protein, 4 aa, Giardia lamblia
MGNR

SEQ ID NO: 3123467 - protein, 4 aa, Giardia lamblia
MGNS

SEQ ID NO: 3123468 - protein, 12 aa, Giardia lamblia
MGPAEKDTNDRF

SEQ ID NO: 3123469 - protein, 7 aa, Giardia lamblia
MGPQDSV

SEQ ID NO: 3123470 - protein, 21 aa, Giardia lamblia
MGPTKAGLSGIATASNLTTQD

SEQ ID NO: 3123471 - protein, 6 aa, Giardia lamblia
MGPWDG

SEQ ID NO: 3123472 - protein, 22 aa, Giardia lamblia
MGQAGQGAYNRTSSDPTVRSGS

SEQ ID NO: 3123473 - protein, 9 aa, Giardia lamblia
MGQQDDEGF

SEQ ID NO: 3123474 - protein, 10 aa, Giardia lamblia
MGRPTENTQQ

SEQ ID NO: 3123475 - protein, 5 aa, Giardia lamblia
MGSDY

SEQ ID NO: 3123476 - protein, 14 aa, Giardia lamblia
MGTNQGLESASTAA

SEQ ID NO: 3123477 - protein, 7 aa, Giardia lamblia
MGTPESD

SEQ ID NO: 3123478 - protein, 24 aa, Giardia lamblia
MGTSSDKAKKAPQAKDEPHEETTN

SEQ ID NO: 3123479 - protein, 21 aa, Giardia lamblia
MGTSTQQRNISPTASRSSYVD

SEQ ID NO: 3123480 - protein, 10 aa, Giardia lamblia
MGVQENDGGT

SEQ ID NO: 3123481 - protein, 9 aa, Giardia lamblia
MHGENKDKL

SEQ ID NO: 3123482 - protein, 5 aa, Giardia lamblia
MHPDR

SEQ ID NO: 3123483 - protein, 14 aa, Giardia lamblia
MHPGSKASTRTKDQ

SEQ ID NO: 3123484 - protein, 7 aa, Giardia lamblia
MHPNNSP

SEQ ID NO: 3123485 - protein, 51 aa, Giardia lamblia
MHQTDGGAKRASSTGPNSRGNTTVAGMSTNASINPNANRGSAGGLSNDNKQ

SEQ ID NO: 3123486 - protein, 10 aa, Giardia lamblia
MHRRESKTKK

SEQ ID NO: 3123487 - protein, 4 aa, Giardia lamblia
MHTE

SEQ ID NO: 3123488 - protein, 13 aa, Giardia lamblia
MHTPKRSTVPKPS

SEQ ID NO: 3123489 - protein, 6 aa, Giardia lamblia
MISGTA

SEQ ID NO: 3123490 - protein, 7 aa, Giardia lamblia
MKAGKRH

SEQ ID NO: 3123491 - protein, 11 aa, Giardia lamblia
MKAKRKRLESL

SEQ ID NO: 3123492 - protein, 13 aa, Giardia lamblia
MKAQGAHPKRVGV

SEQ ID NO: 3123493 - protein, 8 aa, Giardia lamblia
MKATSTDS

SEQ ID NO: 3123494 - protein, 7 aa, Giardia lamblia
MKDDNGW

SEQ ID NO: 3123495 - protein, 5 aa, Giardia lamblia
MKDDR

SEQ ID NO: 3123496 - protein, 7 aa, Giardia lamblia
MKDKNGI

SEQ ID NO: 3123497 - protein, 9 aa, Giardia lamblia
MKDNANLDV

SEQ ID NO: 3123498 - protein, 5 aa, Giardia lamblia
MKDPA

SEQ ID NO: 3123499 - protein, 8 aa, Giardia lamblia
MKDRGGDT

SEQ ID NO: 3123500 - protein, 8 aa, Giardia lamblia
MKDRNGET

SEQ ID NO: 3123501 - protein, 15 aa, Giardia lamblia
MKDSGISEEAAPRAL

SEQ ID NO: 3123502 - protein, 8 aa, Giardia lamblia
MKDSNGKT

SEQ ID NO: 3123503 - protein, 14 aa, Giardia lamblia
MKDYAAQRSAEHAE

SEQ ID NO: 3123504 - protein, 7 aa, Giardia lamblia
MKEASAD

SEQ ID NO: 3123505 - protein, 16 aa, Giardia lamblia
MKEPKAPTRELPTPTL

SEQ ID NO: 3123506 - protein, 7 aa, Giardia lamblia
MKERSEK

SEQ ID NO: 3123507 - protein, 20 aa, Giardia lamblia
MKGETKNGVSTNSASEGRDE

SEQ ID NO: 3123508 - protein, 9 aa, Giardia lamblia
MKGPGSAGR

SEQ ID NO: 3123509 - protein, 6 aa, Giardia lamblia
MKGRDG

SEQ ID NO: 3123510 - protein, 9 aa, Giardia lamblia
MKGSKYARA

SEQ ID NO: 3123511 - protein, 31 aa, Giardia lamblia
MKGSSSEIASPGAGTRRGRRRAPARSQVGPP

SEQ ID NO: 3123512 - protein, 9 aa, Giardia lamblia
MKGTRAYQP

SEQ ID NO: 3123513 - protein, 7 aa, Giardia lamblia
MKKSSGW

SEQ ID NO: 3123514 - protein, 7 aa, Giardia lamblia
MKNGETA

SEQ ID NO: 3123515 - protein, 7 aa, Giardia lamblia
MKNKNGV

SEQ ID NO: 3123516 - protein, 17 aa, Giardia lamblia
MKNTKPPRIEDVRDKKK

SEQ ID NO: 3123517 - protein, 7 aa, Giardia lamblia
MKNTTAT

SEQ ID NO: 3123518 - protein, 8 aa, Giardia lamblia
MKPGSQVD

SEQ ID NO: 3123519 - protein, 49 aa, Giardia lamblia
MKPLGEQKSLADYERGSSVPKNLPRWPSKKVTKGISPIAPTDPSTSTTS

SEQ ID NO: 3123520 - protein, 8 aa, Giardia lamblia
MKPNPKTD

SEQ ID NO: 3123521 - protein, 15 aa, Giardia lamblia
MKPREPQPNKYDEEQ

SEQ ID NO: 3123522 - protein, 56 aa, Giardia lamblia
MKQNQLRKEEKKRKIEAGEEVSEDEPTEEEEEFDETGRRKRTTPKPKPFKDAPKVP

SEQ ID NO: 3123523 - protein, 15 aa, Giardia lamblia
MKRYSQTGQPGSSRQ

SEQ ID NO: 3123524 - protein, 45 aa, Giardia lamblia
MKSAERRERRSESFDGSSQHLKKSRKPRTASHSREKKDVSTNANS

SEQ ID NO: 3123525 - protein, 6 aa, Giardia lamblia
MKSEDE

SEQ ID NO: 3123526 - protein, 11 aa, Giardia lamblia
MKSEGAEEGRL

SEQ ID NO: 3123527 - protein, 5 aa, Giardia lamblia
MKSHA

SEQ ID NO: 3123528 - protein, 12 aa, Giardia lamblia
MKSPDSKQPRLV

SEQ ID NO: 3123529 - protein, 9 aa, Giardia lamblia
MKSQTGRTA

SEQ ID NO: 3123530 - protein, 4 aa, Giardia lamblia
MKTG

SEQ ID NO: 3123531 - protein, 8 aa, Giardia lamblia
MKTRNGST

SEQ ID NO: 3123532 - protein, 12 aa, Giardia lamblia
MKTSSAKNLPLP

SEQ ID NO: 3123533 - protein, 5 aa, Giardia lamblia
MKTST

SEQ ID NO: 3123534 - protein, 8 aa, Giardia lamblia
MLPGDERP

SEQ ID NO: 3123535 - protein, 4 aa, Giardia lamblia
MLPT

SEQ ID NO: 3123536 - protein, 4 aa, Giardia lamblia
MNDA

SEQ ID NO: 3123537 - protein, 4 aa, Giardia lamblia
MNDP

SEQ ID NO: 3123538 - protein, 5 aa, Giardia lamblia
MNEPT

SEQ ID NO: 3123539 - protein, 9 aa, Giardia lamblia
MNERSSRSH

SEQ ID NO: 3123540 - protein, 17 aa, Giardia lamblia
MNESSADDDAKDESSSL

SEQ ID NO: 3123541 - protein, 5 aa, Giardia lamblia
MNETD

SEQ ID NO: 3123542 - protein, 12 aa, Giardia lamblia
MNETENPASLKD

SEQ ID NO: 3123543 - protein, 32 aa, Giardia lamblia
MNGESDRDPQDQARGDSVPQDKVSSEKGGQLT

SEQ ID NO: 3123544 - protein, 7 aa, Giardia lamblia
MNGSTSH

SEQ ID NO: 3123545 - protein, 8 aa, Giardia lamblia
MNITNDGA

SEQ ID NO: 3123546 - protein, 12 aa, Giardia lamblia
MNKGHDGSGADS

SEQ ID NO: 3123547 - protein, 5 aa, Giardia lamblia
MNKNK

SEQ ID NO: 3123548 - protein, 4 aa, Giardia lamblia
MNNQ

SEQ ID NO: 3123549 - protein, 8 aa, Giardia lamblia
MNNSSAAT

SEQ ID NO: 3123550 - protein, 12 aa, Giardia lamblia
MNPDINLDDSFT

SEQ ID NO: 3123551 - protein, 26 aa, Giardia lamblia
MNPPASVSVEPTLQDEEDLGEDATEF

SEQ ID NO: 3123552 - protein, 4 aa, Giardia lamblia
MNPT

SEQ ID NO: 3123553 - protein, 9 aa, Giardia lamblia
MNPTETRGT

SEQ ID NO: 3123554 - protein, 8 aa, Giardia lamblia
MNQASSRS

SEQ ID NO: 3123555 - protein, 5 aa, Giardia lamblia
MNQPQ

SEQ ID NO: 3123556 - protein, 9 aa, Giardia lamblia
MNQQSDPTI

SEQ ID NO: 3123557 - protein, 19 aa, Giardia lamblia
MNQRSTSSKRAKTPSEPRT

SEQ ID NO: 3123558 - protein, 5 aa, Giardia lamblia
MNRGT

SEQ ID NO: 3123559 - protein, 6 aa, Giardia lamblia
MNRSSN

SEQ ID NO: 3123560 - protein, 5 aa, Giardia lamblia
MNSDS

SEQ ID NO: 3123561 - protein, 11 aa, Giardia lamblia
MNSEGAAAGAL

SEQ ID NO: 3123562 - protein, 19 aa, Giardia lamblia
MNSGAEVKEAAKREKEAEL

SEQ ID NO: 3123563 - protein, 11 aa, Giardia lamblia
MNSGETSGPNV

SEQ ID NO: 3123564 - protein, 8 aa, Giardia lamblia
MNSRYPKD

SEQ ID NO: 3123565 - protein, 6 aa, Giardia lamblia
MNSTSG

SEQ ID NO: 3123566 - protein, 18 aa, Giardia lamblia
MNTSTSNSALSTRSPVSA

SEQ ID NO: 3123567 - protein, 7 aa, Giardia lamblia
MPAGRSI

SEQ ID NO: 3123568 - protein, 17 aa, Giardia lamblia
MPAPQATMAPGLNDLLS

SEQ ID NO: 3123569 - protein, 12 aa, Giardia lamblia
MPAQEKKEDTYR

SEQ ID NO: 3123570 - protein, 5 aa, Giardia lamblia
MPDEM

SEQ ID NO: 3123571 - protein, 12 aa, Giardia lamblia
MPDERAAQRSHS

SEQ ID NO: 3123572 - protein, 10 aa, Giardia lamblia
MPDIDKGEQH

SEQ ID NO: 3123573 - protein, 13 aa, Giardia lamblia
MPDTDFSSDDVNE

SEQ ID NO: 3123574 - protein, 4 aa, Giardia lamblia
MPDY

SEQ ID NO: 3123575 - protein, 7 aa, Giardia lamblia
MPEAPEK

SEQ ID NO: 3123576 - protein, 7 aa, Giardia lamblia
MPEASPD

SEQ ID NO: 3123577 - protein, 15 aa, Giardia lamblia
MPEENNGHQDYNQNQ

SEQ ID NO: 3123578 - protein, 35 aa, Giardia lamblia
MPEGADFGDEEDDDNKDEEDGPDEEKKESGEEKAE

SEQ ID NO: 3123579 - protein, 5 aa, Giardia lamblia
MPENQ

SEQ ID NO: 3123580 - protein, 16 aa, Giardia lamblia
MPENVDDEESNGRRCE

SEQ ID NO: 3123581 - protein, 10 aa, Giardia lamblia
MPESPEDTKR

SEQ ID NO: 3123582 - protein, 5 aa, Giardia lamblia
MPGGQ

SEQ ID NO: 3123583 - protein, 11 aa, Giardia lamblia
MPGGQQDTVTD

SEQ ID NO: 3123584 - protein, 19 aa, Giardia lamblia
MPGHNAPPASHSDVLGCED

SEQ ID NO: 3123585 - protein, 5 aa, Giardia lamblia
MPKAE

SEQ ID NO: 3123586 - protein, 6 aa, Giardia lamblia
MPKEQT

SEQ ID NO: 3123587 - protein, 32 aa, Giardia lamblia
MPKTSGKEKPAKVPKATPRSSAQPSDGHGEYS

SEQ ID NO: 3123588 - protein, 5 aa, Giardia lamblia
MPNGP

SEQ ID NO: 3123589 - protein, 8 aa, Giardia lamblia
MPNMPSPV

SEQ ID NO: 3123590 - protein, 5 aa, Giardia lamblia
MPNPD

SEQ ID NO: 3123591 - protein, 5 aa, Giardia lamblia
MPPEA

SEQ ID NO: 3123592 - protein, 35 aa, Giardia lamblia
MPPHRAGSNLGGREKDDPQPESSKTSSITPAPNVQ

SEQ ID NO: 3123593 - protein, 21 aa, Giardia lamblia
MPPKPQSSGQASTNQANPIGL

SEQ ID NO: 3123594 - protein, 5 aa, Giardia lamblia
MPPLQ

SEQ ID NO: 3123595 - protein, 7 aa, Giardia lamblia
MPPPSQQ

SEQ ID NO: 3123596 - protein, 4 aa, Giardia lamblia
MPPR

SEQ ID NO: 3123597 - protein, 14 aa, Giardia lamblia
MPPRGAVRDASTPF

SEQ ID NO: 3123598 - protein, 5 aa, Giardia lamblia
MPPSF

SEQ ID NO: 3123599 - protein, 6 aa, Giardia lamblia
MPPTRT

SEQ ID NO: 3123600 - protein, 5 aa, Giardia lamblia
MPQQD

SEQ ID NO: 3123601 - protein, 24 aa, Giardia lamblia
MPRKASVEDLSSDSPEDSRECTSR

SEQ ID NO: 3123602 - protein, 10 aa, Giardia lamblia
MPRKDGLTSE

SEQ ID NO: 3123603 - protein, 4 aa, Giardia lamblia
MPRP

SEQ ID NO: 3123604 - protein, 8 aa, Giardia lamblia
MPRPAGAI

SEQ ID NO: 3123605 - protein, 18 aa, Giardia lamblia
MPRSGPPPISDSQQHPIS

SEQ ID NO: 3123606 - protein, 19 aa, Giardia lamblia
MPRSPTTARPSAEPADDTT

SEQ ID NO: 3123607 - protein, 31 aa, Giardia lamblia
MPSAGSKLKQYSARSSQLDSNLTPRYQNTGR

SEQ ID NO: 3123608 - protein, 5 aa, Giardia lamblia
MPSNT

SEQ ID NO: 3123609 - protein, 12 aa, Giardia lamblia
MPSPIRKRGTLG

SEQ ID NO: 3123610 - protein, 8 aa, Giardia lamblia
MPSPTNSH

SEQ ID NO: 3123611 - protein, 4 aa, Giardia lamblia
MPSQ

SEQ ID NO: 3123612 - protein, 12 aa, Giardia lamblia
MPSRRAKAQRWP

SEQ ID NO: 3123613 - protein, 27 aa, Giardia lamblia
MPSSGGGDAFNGNGGDAGNMDSDGGMP

SEQ ID NO: 3123614 - protein, 5 aa, Giardia lamblia
MPTDL

SEQ ID NO: 3123615 - protein, 15 aa, Giardia lamblia
MPTDSSFSESAPAIS

SEQ ID NO: 3123616 - protein, 12 aa, Giardia lamblia
MPTELSAENPGL

SEQ ID NO: 3123617 - protein, 14 aa, Giardia lamblia
MPTRASPISQTNSA

SEQ ID NO: 3123618 - protein, 5 aa, Giardia lamblia
MPTST

SEQ ID NO: 3123619 - protein, 6 aa, Giardia lamblia
MPTTGT

SEQ ID NO: 3123620 - protein, 13 aa, Giardia lamblia
MPTTSKRPADHPV

SEQ ID NO: 3123621 - protein, 8 aa, Giardia lamblia
MPVAPSQV

SEQ ID NO: 3123622 - protein, 33 aa, Giardia lamblia
MPVGPGPQQYQQFGNQQGSQMPPPIQPQGQLGA

SEQ ID NO: 3123623 - protein, 7 aa, Giardia lamblia
MQANEDS

SEQ ID NO: 3123624 - protein, 10 aa, Giardia lamblia
MQARKTTQEK

SEQ ID NO: 3123625 - protein, 8 aa, Giardia lamblia
MQDDEGRT

SEQ ID NO: 3123626 - protein, 7 aa, Giardia lamblia
MQDGNGV

SEQ ID NO: 3123627 - protein, 7 aa, Giardia lamblia
MQDISGN

SEQ ID NO: 3123628 - protein, 6 aa, Giardia lamblia
MQDKAG

SEQ ID NO: 3123629 - protein, 5 aa, Giardia lamblia
MQDND

SEQ ID NO: 3123630 - protein, 7 aa, Giardia lamblia
MQDNYGN

SEQ ID NO: 3123631 - protein, 10 aa, Giardia lamblia
MQDPQSAKQI

SEQ ID NO: 3123632 - protein, 4 aa, Giardia lamblia
MQEV

SEQ ID NO: 3123633 - protein, 14 aa, Giardia lamblia
MQGAVSSEKVPDGC

SEQ ID NO: 3123634 - protein, 9 aa, Giardia lamblia
MQGQERDDL

SEQ ID NO: 3123635 - protein, 10 aa, Giardia lamblia
MQGSTAPKPI

SEQ ID NO: 3123636 - protein, 4 aa, Giardia lamblia
MQGV

SEQ ID NO: 3123637 - protein, 8 aa, Giardia lamblia
MQKATGET

SEQ ID NO: 3123638 - protein, 8 aa, Giardia lamblia
MQKGTGRW

SEQ ID NO: 3123639 - protein, 7 aa, Giardia lamblia
MQKPNGV

SEQ ID NO: 3123640 - protein, 8 aa, Giardia lamblia
MQKTDGTT

SEQ ID NO: 3123641 - protein, 7 aa, Giardia lamblia
MQNTDGY

SEQ ID NO: 3123642 - protein, 6 aa, Giardia lamblia
MQNTGG

SEQ ID NO: 3123643 - protein, 6 aa, Giardia lamblia
MQPAGP

SEQ ID NO: 3123644 - protein, 9 aa, Giardia lamblia
MQPNDPPPW

SEQ ID NO: 3123645 - protein, 10 aa, Giardia lamblia
MQPPAPASDI

SEQ ID NO: 3123646 - protein, 15 aa, Giardia lamblia
MQPQDKAERDTLERE

SEQ ID NO: 3123647 - protein, 23 aa, Giardia lamblia
MQPQPQAQQRQSSRRYSEGTRQD

SEQ ID NO: 3123648 - protein, 7 aa, Giardia lamblia
MQPSEQA

SEQ ID NO: 3123649 - protein, 10 aa, Giardia lamblia
MQQADKNTIQ

SEQ ID NO: 3123650 - protein, 6 aa, Giardia lamblia
MQQDTT

SEQ ID NO: 3123651 - protein, 16 aa, Giardia lamblia
MQQESQADAAATAKDM

SEQ ID NO: 3123652 - protein, 5 aa, Giardia lamblia
MQQEV

SEQ ID NO: 3123653 - protein, 9 aa, Giardia lamblia
MQQKDSEAA

SEQ ID NO: 3123654 - protein, 55 aa, Giardia lamblia
MQQTRAKDAAHSDNGETCTQGSSRQRQRPLSASKSKPKGRINSRASSRSASRNSS

SEQ ID NO: 3123655 - protein, 4 aa, Giardia lamblia
MQRA

SEQ ID NO: 3123656 - protein, 9 aa, Giardia lamblia
MQRASDDCS

SEQ ID NO: 3123657 - protein, 8 aa, Giardia lamblia
MQRREGST

SEQ ID NO: 3123658 - protein, 79 aa, Giardia lamblia
MQRTGESQPYMEKNPRSRSEKRASSTPKTPKTSRDSAASPVVEEKTQPTADNTKKASQDTTLRQGKFKKGDDSVNLDSD

SEQ ID NO: 3123659 - protein, 9 aa, Giardia lamblia
MQSDTENSV

SEQ ID NO: 3123660 - protein, 4 aa, Giardia lamblia
MQSE

SEQ ID NO: 3123661 - protein, 10 aa, Giardia lamblia
MQSPTTEDAR

SEQ ID NO: 3123662 - protein, 6 aa, Giardia lamblia
MQSQTL

SEQ ID NO: 3123663 - protein, 8 aa, Giardia lamblia
MQSSNGTT

SEQ ID NO: 3123664 - protein, 9 aa, Giardia lamblia
MQSVEAAAK

SEQ ID NO: 3123665 - protein, 6 aa, Giardia lamblia
MQTESG

SEQ ID NO: 3123666 - protein, 5 aa, Giardia lamblia
MQTGQ

SEQ ID NO: 3123667 - protein, 8 aa, Giardia lamblia
MQTGTGET

SEQ ID NO: 3123668 - protein, 9 aa, Giardia lamblia
MQTKTGSTA

SEQ ID NO: 3123669 - protein, 7 aa, Giardia lamblia
MQTSTQE

SEQ ID NO: 3123670 - protein, 13 aa, Giardia lamblia
MQTTGDGEYEAGE

SEQ ID NO: 3123671 - protein, 19 aa, Giardia lamblia
MQTTSNGCYKSGKNDYPFP

SEQ ID NO: 3123672 - protein, 6 aa, Giardia lamblia
MQVTPQ

SEQ ID NO: 3123673 - protein, 12 aa, Giardia lamblia
MRAPRGSKSRLI

SEQ ID NO: 3123674 - protein, 13 aa, Giardia lamblia
MRDEIDAKITAGL

SEQ ID NO: 3123675 - protein, 9 aa, Giardia lamblia
MRDKDGENA

SEQ ID NO: 3123676 - protein, 8 aa, Giardia lamblia
MRDKYDET

SEQ ID NO: 3123677 - protein, 8 aa, Giardia lamblia
MRDSSGYT

SEQ ID NO: 3123678 - protein, 8 aa, Giardia lamblia
MRDTAGKR

SEQ ID NO: 3123679 - protein, 6 aa, Giardia lamblia
MREEQE

SEQ ID NO: 3123680 - protein, 10 aa, Giardia lamblia
MREGGNEEIK

SEQ ID NO: 3123681 - protein, 8 aa, Giardia lamblia
MRENSGKI

SEQ ID NO: 3123682 - protein, 61 aa, Giardia lamblia
MRGGAHAQTPASAPTPAPPAPSEPASSSAGHKPADDKPVEEPPAEASKPAEPTPKVEEVKP

SEQ ID NO: 3123683 - protein, 7 aa, Giardia lamblia
MRGGYGS

SEQ ID NO: 3123684 - protein, 23 aa, Giardia lamblia
MRNNQGRRPRGKAASKPQKPKFP

SEQ ID NO: 3123685 - protein, 10 aa, Giardia lamblia
MRPASQQLTR

SEQ ID NO: 3123686 - protein, 25 aa, Giardia lamblia
MRPDSVYQAPDSQYVRPGKDTKQDY

SEQ ID NO: 3123687 - protein, 9 aa, Giardia lamblia
MRPKNPTSL

SEQ ID NO: 3123688 - protein, 15 aa, Giardia lamblia
MRPNSANSVGLSTND

SEQ ID NO: 3123689 - protein, 38 aa, Giardia lamblia
MRPPLGNEQVPTDSPAPFSKNPVGPPSQAGQLDKYRQS

SEQ ID NO: 3123690 - protein, 8 aa, Giardia lamblia
MRPQTDDR

SEQ ID NO: 3123691 - protein, 11 aa, Giardia lamblia
MRPSIEASDVT

SEQ ID NO: 3123692 - protein, 7 aa, Giardia lamblia
MRPSPKW

SEQ ID NO: 3123693 - protein, 23 aa, Giardia lamblia
MRPTSGTQSHAQEQVPSKNPYSM

SEQ ID NO: 3123694 - protein, 37 aa, Giardia lamblia
MRQATKGRGKKSTIKRRAANAKQHESAPRAERIHPGT

SEQ ID NO: 3123695 - protein, 14 aa, Giardia lamblia
MRQKEERAKLAEEA

SEQ ID NO: 3123696 - protein, 8 aa, Giardia lamblia
MRQKEQAY

SEQ ID NO: 3123697 - protein, 8 aa, Giardia lamblia
MRRKDGRT

SEQ ID NO: 3123698 - protein, 8 aa, Giardia lamblia
MRRNDHQR

SEQ ID NO: 3123699 - protein, 4 aa, Giardia lamblia
MRRS

SEQ ID NO: 3123700 - protein, 9 aa, Giardia lamblia
MRRTTDNRN

SEQ ID NO: 3123701 - protein, 8 aa, Giardia lamblia
MRSGAGES

SEQ ID NO: 3123702 - protein, 9 aa, Giardia lamblia
MRSKQTPKY

SEQ ID NO: 3123703 - protein, 15 aa, Giardia lamblia
MRSPQRQKNKPYTEA

SEQ ID NO: 3123704 - protein, 11 aa, Giardia lamblia
MRTGASPSLSS

SEQ ID NO: 3123705 - protein, 7 aa, Giardia lamblia
MSAEDKK

SEQ ID NO: 3123706 - protein, 4 aa, Giardia lamblia
MSAG

SEQ ID NO: 3123707 - protein, 32 aa, Giardia lamblia
MSAPSAGSSSNAGEAGSEPSKQFTCPSAASSL

SEQ ID NO: 3123708 - protein, 12 aa, Giardia lamblia
MSASRSSSTQQP

SEQ ID NO: 3123709 - protein, 16 aa, Giardia lamblia
MSATSASNKSTERRAL

SEQ ID NO: 3123710 - protein, 8 aa, Giardia lamblia
MSCSNGRT

SEQ ID NO: 3123711 - protein, 11 aa, Giardia lamblia
MSDDESSASSA

SEQ ID NO: 3123712 - protein, 6 aa, Giardia lamblia
MSDKDE

SEQ ID NO: 3123713 - protein, 24 aa, Giardia lamblia
MSDPRVAKGSTWAREAGGSNYGRS

SEQ ID NO: 3123714 - protein, 9 aa, Giardia lamblia
MSDRNDEIT

SEQ ID NO: 3123715 - protein, 22 aa, Giardia lamblia
MSDTGKLTTDAKDHGPSAQVSL

SEQ ID NO: 3123716 - protein, 5 aa, Giardia lamblia
MSEDQ

SEQ ID NO: 3123717 - protein, 9 aa, Giardia lamblia
MSEEERAEL

SEQ ID NO: 3123718 - protein, 8 aa, Giardia lamblia
MSEEERRE

SEQ ID NO: 3123719 - protein, 4 aa, Giardia lamblia
MSEG

SEQ ID NO: 3123720 - protein, 11 aa, Giardia lamblia
MSESAKASAEG

SEQ ID NO: 3123721 - protein, 19 aa, Giardia lamblia
MSESPVDNQTFNEDTTARD

SEQ ID NO: 3123722 - protein, 6 aa, Giardia lamblia
MSGDDE

SEQ ID NO: 3123723 - protein, 9 aa, Giardia lamblia
MSGDQQSLG

SEQ ID NO: 3123724 - protein, 8 aa, Giardia lamblia
MSGGESNV

SEQ ID NO: 3123725 - protein, 9 aa, Giardia lamblia
MSGGTDDAS

SEQ ID NO: 3123726 - protein, 7 aa, Giardia lamblia
MSGKSTA

SEQ ID NO: 3123727 - protein, 34 aa, Giardia lamblia
MSGLEDSDEAVSPSNLNSTNSKQPKSQTNGRDYR

SEQ ID NO: 3123728 - protein, 6 aa, Giardia lamblia
MSGPTT

SEQ ID NO: 3123729 - protein, 29 aa, Giardia lamblia
MSGSTTSQSKPKKPDGSPSNLIPSSSTSS

SEQ ID NO: 3123730 - protein, 16 aa, Giardia lamblia
MSKATPCNTAHCSSAL

SEQ ID NO: 3123731 - protein, 9 aa, Giardia lamblia
MSKPSNENP

SEQ ID NO: 3123732 - protein, 10 aa, Giardia lamblia
MSKSKKNFKT

SEQ ID NO: 3123733 - protein, 11 aa, Giardia lamblia
MSLQPEKKHTL

SEQ ID NO: 3123734 - protein, 14 aa, Giardia lamblia
MSLTSDKPLSSRSP

SEQ ID NO: 3123735 - protein, 16 aa, Giardia lamblia
MSNESYEGYEDPEEPF

SEQ ID NO: 3123736 - protein, 6 aa, Giardia lamblia
MSNNDG

SEQ ID NO: 3123737 - protein, 22 aa, Giardia lamblia
MSNRSTVHRNSTLADPSQPDLH

SEQ ID NO: 3123738 - protein, 13 aa, Giardia lamblia
MSNRTTTESIPRL

SEQ ID NO: 3123739 - protein, 4 aa, Giardia lamblia
MSPC

SEQ ID NO: 3123740 - protein, 7 aa, Giardia lamblia
MSPKEAD

SEQ ID NO: 3123741 - protein, 6 aa, Giardia lamblia
MSPNAA

SEQ ID NO: 3123742 - protein, 4 aa, Giardia lamblia
MSPP

SEQ ID NO: 3123743 - protein, 16 aa, Giardia lamblia
MSPPRVVPKPPSKKYN

SEQ ID NO: 3123744 - protein, 15 aa, Giardia lamblia
MSPVAGSGSFRNNRP

SEQ ID NO: 3123745 - protein, 9 aa, Giardia lamblia
MSQGDTKEI

SEQ ID NO: 3123746 - protein, 27 aa, Giardia lamblia
MSQPDTSREASSRPYAPTTLNPGINST

SEQ ID NO: 3123747 - protein, 26 aa, Giardia lamblia
MSRDETINAPGEGVSGDGAGADPAEL

SEQ ID NO: 3123748 - protein, 40 aa, Giardia lamblia
MSRKDNKKYSGSHIKTRSKKAEKRDEMRHRGNAKKKPGDK

SEQ ID NO: 3123749 - protein, 6 aa, Giardia lamblia
MSRKEK

SEQ ID NO: 3123750 - protein, 16 aa, Giardia lamblia
MSRPSEDAVPSHPRRK

SEQ ID NO: 3123751 - protein, 8 aa, Giardia lamblia
MSRSGEKK

SEQ ID NO: 3123752 - protein, 18 aa, Giardia lamblia
MSRTTSRYTNTDKQNLSQ

SEQ ID NO: 3123753 - protein, 51 aa, Giardia lamblia
MSSADDSDHCSQEHDDTPPLAPEKDTSEEGAGNPTEPSEMDDEGSVDEDGV

SEQ ID NO: 3123754 - protein, 8 aa, Giardia lamblia
MSSAYASA

SEQ ID NO: 3123755 - protein, 13 aa, Giardia lamblia
MSSEASDLKKDRA

SEQ ID NO: 3123756 - protein, 5 aa, Giardia lamblia
MSSEE

SEQ ID NO: 3123757 - protein, 4 aa, Giardia lamblia
MSSM

SEQ ID NO: 3123758 - protein, 6 aa, Giardia lamblia
MSSNGD

SEQ ID NO: 3123759 - protein, 8 aa, Giardia lamblia
MSSPGKSP

SEQ ID NO: 3123760 - protein, 29 aa, Giardia lamblia
MSSQASQQPGNQRGPPQGALRNRPRKTGA

SEQ ID NO: 3123761 - protein, 11 aa, Giardia lamblia
MSSQPDAASLS

SEQ ID NO: 3123762 - protein, 30 aa, Giardia lamblia
MSSSDSTQASESRPRKREKIDKELRTDKPV

SEQ ID NO: 3123763 - protein, 6 aa, Giardia lamblia
MSSSEL

SEQ ID NO: 3123764 - protein, 35 aa, Giardia lamblia
MSSSRTGSRMGSRAGSRAGSRASSRTGSRSSTATI

SEQ ID NO: 3123765 - protein, 10 aa, Giardia lamblia
MSTKPQDRSD

SEQ ID NO: 3123766 - protein, 4 aa, Giardia lamblia
MSTM

SEQ ID NO: 3123767 - protein, 7 aa, Giardia lamblia
MSTPTTI

SEQ ID NO: 3123768 - protein, 7 aa, Giardia lamblia
MSTPVGE

SEQ ID NO: 3123769 - protein, 5 aa, Giardia lamblia
MSTRN

SEQ ID NO: 3123770 - protein, 5 aa, Giardia lamblia
MSTSK

SEQ ID NO: 3123771 - protein, 20 aa, Giardia lamblia
MSTSNSTTSCVSQTSQATHS

SEQ ID NO: 3123772 - protein, 12 aa, Giardia lamblia
MSTSPKDPRGPT

SEQ ID NO: 3123773 - protein, 20 aa, Giardia lamblia
MSTSRSGSPSLKGESPTTKN

SEQ ID NO: 3123774 - protein, 17 aa, Giardia lamblia
MSTSSAAASNDSQGTLQ

SEQ ID NO: 3123775 - protein, 10 aa, Giardia lamblia
MSTSTKSSVA

SEQ ID NO: 3123776 - protein, 10 aa, Giardia lamblia
MSTSTRCRSE

SEQ ID NO: 3123777 - protein, 8 aa, Giardia lamblia
MSTTQPEL

SEQ ID NO: 3123778 - protein, 14 aa, Giardia lamblia
MSVPEQSSTGRPQS

SEQ ID NO: 3123779 - protein, 12 aa, Giardia lamblia
MSVQSGKQAGAT

SEQ ID NO: 3123780 - protein, 4 aa, Giardia lamblia
MSVT

SEQ ID NO: 3123781 - protein, 14 aa, Giardia lamblia
MSYENTAASIRNSG

SEQ ID NO: 3123782 - protein, 7 aa, Giardia lamblia
MTAEKSD

SEQ ID NO: 3123783 - protein, 5 aa, Giardia lamblia
MTAQE

SEQ ID NO: 3123784 - protein, 10 aa, Giardia lamblia
MTASENSYQS

SEQ ID NO: 3123785 - protein, 12 aa, Giardia lamblia
MTASYKTASIPN

SEQ ID NO: 3123786 - protein, 8 aa, Giardia lamblia
MTDATGRT

SEQ ID NO: 3123787 - protein, 19 aa, Giardia lamblia
MTDTSSTYDEYDDYEGLEN

SEQ ID NO: 3123788 - protein, 4 aa, Giardia lamblia
MTEA

SEQ ID NO: 3123789 - protein, 8 aa, Giardia lamblia
MTEDWGGK

SEQ ID NO: 3123790 - protein, 4 aa, Giardia lamblia
MTEE

SEQ ID NO: 3123791 - protein, 20 aa, Giardia lamblia
MTETQASGGSTKQASSPIPI

SEQ ID NO: 3123792 - protein, 5 aa, Giardia lamblia
MTGAS

SEQ ID NO: 3123793 - protein, 13 aa, Giardia lamblia
MTGPSSVGKENQM

SEQ ID NO: 3123794 - protein, 32 aa, Giardia lamblia
MTGSDKDGTRNRRTASAASSAVSSATKGSDDF

SEQ ID NO: 3123795 - protein, 28 aa, Giardia lamblia
MTKEEEKTLGWEDPSKLQASRDGKNAGD

SEQ ID NO: 3123796 - protein, 6 aa, Giardia lamblia
MTKPDG

SEQ ID NO: 3123797 - protein, 7 aa, Giardia lamblia
MTKSREE

SEQ ID NO: 3123798 - protein, 4 aa, Giardia lamblia
MTMS

SEQ ID NO: 3123799 - protein, 4 aa, Giardia lamblia
MTNE

SEQ ID NO: 3123800 - protein, 15 aa, Giardia lamblia
MTNKMKTSDSADGNN

SEQ ID NO: 3123801 - protein, 9 aa, Giardia lamblia
MTNNKGKAA

SEQ ID NO: 3123802 - protein, 8 aa, Giardia lamblia
MTNNRGQT

SEQ ID NO: 3123803 - protein, 6 aa, Giardia lamblia
MTNSRK

SEQ ID NO: 3123804 - protein, 4 aa, Giardia lamblia
MTPE

SEQ ID NO: 3123805 - protein, 4 aa, Giardia lamblia
MTPN

SEQ ID NO: 3123806 - protein, 5 aa, Giardia lamblia
MTPQS

SEQ ID NO: 3123807 - protein, 6 aa, Giardia lamblia
MTPSDL

SEQ ID NO: 3123808 - protein, 29 aa, Giardia lamblia
MTPTSGALSPRRARSCENTPPKDEAVTSE

SEQ ID NO: 3123809 - protein, 11 aa, Giardia lamblia
MTPTTAEWDER

SEQ ID NO: 3123810 - protein, 10 aa, Giardia lamblia
MTRPPPEFAE

SEQ ID NO: 3123811 - protein, 20 aa, Giardia lamblia
MTRQSESQGDSVQDDRQDAV

SEQ ID NO: 3123812 - protein, 7 aa, Giardia lamblia
MTRRNGR

SEQ ID NO: 3123813 - protein, 14 aa, Giardia lamblia
MTSEANSVGSSRVT

SEQ ID NO: 3123814 - protein, 10 aa, Giardia lamblia
MTSINPKKSV

SEQ ID NO: 3123815 - protein, 5 aa, Giardia lamblia
MTSPR

SEQ ID NO: 3123816 - protein, 13 aa, Giardia lamblia
MTSSPRPGECGSP

SEQ ID NO: 3123817 - protein, 5 aa, Giardia lamblia
MTSSS

SEQ ID NO: 3123818 - protein, 6 aa, Giardia lamblia
MTSVGK

SEQ ID NO: 3123819 - protein, 14 aa, Giardia lamblia
MTTGTGKTALDYAK

SEQ ID NO: 3123820 - protein, 6 aa, Giardia lamblia
MTTNQG

SEQ ID NO: 3123821 - protein, 11 aa, Giardia lamblia
MTTSSLSEGYK

SEQ ID NO: 3123822 - protein, 12 aa, Giardia lamblia
MVGQSKSQLDSA

SEQ ID NO: 3123823 - protein, 8 aa, Giardia lamblia
MVPTGNSS

SEQ ID NO: 3123824 - protein, 9 aa, Giardia lamblia
MVSQDDESI

SEQ ID NO: 3123825 - protein, 13 aa, Giardia lamblia
MYEESAKPQTHPT

SEQ ID NO: 3123826 - protein, 7 aa, Giardia lamblia
MYSDNEG

SEQ ID NO: 3123827 - protein, 7 aa, Giardia lamblia
MYSNGET

SEQ ID NO: 3123828 - protein, 4 aa, Giardia lamblia
MYTD

SEQ ID NO: 3123829 - protein, 7 aa, Giardia lamblia
NAADPQS

SEQ ID NO: 3123830 - protein, 7 aa, Giardia lamblia
NAADTDI

SEQ ID NO: 3123831 - protein, 6 aa, Giardia lamblia
NAAESD

SEQ ID NO: 3123832 - protein, 21 aa, Giardia lamblia
NAAESGHEKKDCKLKGPPAHL

SEQ ID NO: 3123833 - protein, 15 aa, Giardia lamblia
NAAETTAAEEDEAGL

SEQ ID NO: 3123834 - protein, 7 aa, Giardia lamblia
NAAGNPV

SEQ ID NO: 3123835 - protein, 9 aa, Giardia lamblia
NAAKDEEIA

SEQ ID NO: 3123836 - protein, 6 aa, Giardia lamblia
NAALNK

SEQ ID NO: 3123837 - protein, 12 aa, Giardia lamblia
NAANSGHPGTPI

SEQ ID NO: 3123838 - protein, 14 aa, Giardia lamblia
NAANTIQNNARTHP

SEQ ID NO: 3123839 - protein, 9 aa, Giardia lamblia
NAAPPTEEA

SEQ ID NO: 3123840 - protein, 9 aa, Giardia lamblia
NAAPQSEAD

SEQ ID NO: 3123841 - protein, 16 aa, Giardia lamblia
NAAPSLEDGGNGDKPL

SEQ ID NO: 3123842 - protein, 9 aa, Giardia lamblia
NAAQPKRLK

SEQ ID NO: 3123843 - protein, 8 aa, Giardia lamblia
NAAQPTKS

SEQ ID NO: 3123844 - protein, 7 aa, Giardia lamblia
NAARTGV

SEQ ID NO: 3123845 - protein, 22 aa, Giardia lamblia
NAASIRNAKKKWKGSKDNDGNT

SEQ ID NO: 3123846 - protein, 7 aa, Giardia lamblia
NAATAQE

SEQ ID NO: 3123847 - protein, 5 aa, Giardia lamblia
NAATP

SEQ ID NO: 3123848 - protein, 12 aa, Giardia lamblia
NAATSPDTKNGD

SEQ ID NO: 3123849 - protein, 9 aa, Giardia lamblia
NAATTASSN

SEQ ID NO: 3123850 - protein, 7 aa, Giardia lamblia
NAATTSI

SEQ ID NO: 3123851 - protein, 12 aa, Giardia lamblia
NADANANKDNTI

SEQ ID NO: 3123852 - protein, 8 aa, Giardia lamblia
NADARDDV

SEQ ID NO: 3123853 - protein, 5 aa, Giardia lamblia
NADDI

SEQ ID NO: 3123854 - protein, 6 aa, Giardia lamblia
NADEET

SEQ ID NO: 3123855 - protein, 9 aa, Giardia lamblia
NADEGIPAT

SEQ ID NO: 3123856 - protein, 10 aa, Giardia lamblia
NADESSQHIE

SEQ ID NO: 3123857 - protein, 7 aa, Giardia lamblia
NADEYVS

SEQ ID NO: 3123858 - protein, 7 aa, Giardia lamblia
NADGNVE

SEQ ID NO: 3123859 - protein, 6 aa, Giardia lamblia
NADGVS

SEQ ID NO: 3123860 - protein, 5 aa, Giardia lamblia
NADKY

SEQ ID NO: 3123861 - protein, 6 aa, Giardia lamblia
NADLGT

SEQ ID NO: 3123862 - protein, 7 aa, Giardia lamblia
NADNGYQ

SEQ ID NO: 3123863 - protein, 13 aa, Giardia lamblia
NADNTQKEEDLNA

SEQ ID NO: 3123864 - protein, 14 aa, Giardia lamblia
NADPESSPKSYTAY

SEQ ID NO: 3123865 - protein, 20 aa, Giardia lamblia
NADPSESTANQTYGPEPDKY

SEQ ID NO: 3123866 - protein, 10 aa, Giardia lamblia
NADQEPAPKR

SEQ ID NO: 3123867 - protein, 12 aa, Giardia lamblia
NADQKQKQLEER

SEQ ID NO: 3123868 - protein, 6 aa, Giardia lamblia
NADSET

SEQ ID NO: 3123869 - protein, 7 aa, Giardia lamblia
NADTINS

SEQ ID NO: 3123870 - protein, 10 aa, Giardia lamblia
NADTLQKRYE

SEQ ID NO: 3123871 - protein, 9 aa, Giardia lamblia
NAEAECQRR

SEQ ID NO: 3123872 - protein, 6 aa, Giardia lamblia
NAEAEL

SEQ ID NO: 3123873 - protein, 9 aa, Giardia lamblia
NAEDALTEN

SEQ ID NO: 3123874 - protein, 9 aa, Giardia lamblia
NAEDFPSPN

SEQ ID NO: 3123875 - protein, 7 aa, Giardia lamblia
NAEDSLT

SEQ ID NO: 3123876 - protein, 7 aa, Giardia lamblia
NAEEGTQ

SEQ ID NO: 3123877 - protein, 8 aa, Giardia lamblia
NAEESNKR

SEQ ID NO: 3123878 - protein, 7 aa, Giardia lamblia
NAEGETA

SEQ ID NO: 3123879 - protein, 8 aa, Giardia lamblia
NAEGTLSG

SEQ ID NO: 3123880 - protein, 5 aa, Giardia lamblia
NAEHR

SEQ ID NO: 3123881 - protein, 6 aa, Giardia lamblia
NAEKLP

SEQ ID NO: 3123882 - protein, 9 aa, Giardia lamblia
NAEKYPPDM

SEQ ID NO: 3123883 - protein, 9 aa, Giardia lamblia
NAELNKSTS

SEQ ID NO: 3123884 - protein, 7 aa, Giardia lamblia
NAENERL

SEQ ID NO: 3123885 - protein, 8 aa, Giardia lamblia
NAENGDLS

SEQ ID NO: 3123886 - protein, 4 aa, Giardia lamblia
NAEQ

SEQ ID NO: 3123887 - protein, 8 aa, Giardia lamblia
NAEQAQNL

SEQ ID NO: 3123888 - protein, 11 aa, Giardia lamblia
NAEQKREAKNN

SEQ ID NO: 3123889 - protein, 9 aa, Giardia lamblia
NAEQTAKRV

SEQ ID NO: 3123890 - protein, 13 aa, Giardia lamblia
NAERQANKKLTDD

SEQ ID NO: 3123891 - protein, 5 aa, Giardia lamblia
NAESL

SEQ ID NO: 3123892 - protein, 8 aa, Giardia lamblia
NAESPQRS

SEQ ID NO: 3123893 - protein, 8 aa, Giardia lamblia
NAESSTKH

SEQ ID NO: 3123894 - protein, 6 aa, Giardia lamblia
NAEVER

SEQ ID NO: 3123895 - protein, 18 aa, Giardia lamblia
NAEYQNQELHKDNDQIRS

SEQ ID NO: 3123896 - protein, 5 aa, Giardia lamblia
NAFTG

SEQ ID NO: 3123897 - protein, 5 aa, Giardia lamblia
NAGDA

SEQ ID NO: 3123898 - protein, 6 aa, Giardia lamblia
NAGKHP

SEQ ID NO: 3123899 - protein, 6 aa, Giardia lamblia
NAGKST

SEQ ID NO: 3123900 - protein, 7 aa, Giardia lamblia
NAGKTDF

SEQ ID NO: 3123901 - protein, 8 aa, Giardia lamblia
NAGMTGAG

SEQ ID NO: 3123902 - protein, 6 aa, Giardia lamblia
NAGPDE

SEQ ID NO: 3123903 - protein, 9 aa, Giardia lamblia
NAGPNTNGS

SEQ ID NO: 3123904 - protein, 6 aa, Giardia lamblia
NAGSTF

SEQ ID NO: 3123905 - protein, 7 aa, Giardia lamblia
NAGVRET

SEQ ID NO: 3123906 - protein, 8 aa, Giardia lamblia
NAHAGKDE

SEQ ID NO: 3123907 - protein, 23 aa, Giardia lamblia
NAHANNKSRHSLPSEQRPTHDAH

SEQ ID NO: 3123908 - protein, 30 aa, Giardia lamblia
NAHDGHSMPEKDLTTSDISATVATKKEAPN

SEQ ID NO: 3123909 - protein, 5 aa, Giardia lamblia
NAHSK

SEQ ID NO: 3123910 - protein, 7 aa, Giardia lamblia
NAHSTDK

SEQ ID NO: 3123911 - protein, 4 aa, Giardia lamblia
NAHT

SEQ ID NO: 3123912 - protein, 4 aa, Giardia lamblia
NAID

SEQ ID NO: 3123913 - protein, 8 aa, Giardia lamblia
NAIDSERV

SEQ ID NO: 3123914 - protein, 11 aa, Giardia lamblia
NAITEGARSIT

SEQ ID NO: 3123915 - protein, 8 aa, Giardia lamblia
NAITPGTP

SEQ ID NO: 3123916 - protein, 7 aa, Giardia lamblia
NAITSRG

SEQ ID NO: 3123917 - protein, 7 aa, Giardia lamblia
NAKAELR

SEQ ID NO: 3123918 - protein, 10 aa, Giardia lamblia
NAKDKDGNNF

SEQ ID NO: 3123919 - protein, 8 aa, Giardia lamblia
NAKEADLS

SEQ ID NO: 3123920 - protein, 9 aa, Giardia lamblia
NAKEQEATI

SEQ ID NO: 3123921 - protein, 9 aa, Giardia lamblia
NAKIGTTEL

SEQ ID NO: 3123922 - protein, 16 aa, Giardia lamblia
NAKKAFDDHSEQSTAH

SEQ ID NO: 3123923 - protein, 10 aa, Giardia lamblia
NAKRPSSPSL

SEQ ID NO: 3123924 - protein, 13 aa, Giardia lamblia
NAKRTEPNPPYQT

SEQ ID NO: 3123925 - protein, 16 aa, Giardia lamblia
NAKRVDDENLAGKSEL

SEQ ID NO: 3123926 - protein, 12 aa, Giardia lamblia
NAKSAKSKETLN

SEQ ID NO: 3123927 - protein, 46 aa, Giardia lamblia
NAKSSSATTNKEDENIVTSSAATTATKGTAQQPSGEEEQKPTSQLG

SEQ ID NO: 3123928 - protein, 31 aa, Giardia lamblia
NAKVSLKSRPSSGRPSGQRGSVDDLPPHHSP

SEQ ID NO: 3123929 - protein, 9 aa, Giardia lamblia
NALAQGEEH

SEQ ID NO: 3123930 - protein, 10 aa, Giardia lamblia
NALENAKNTI

SEQ ID NO: 3123931 - protein, 5 aa, Giardia lamblia
NALGR

SEQ ID NO: 3123932 - protein, 7 aa, Giardia lamblia
NALNDDR

SEQ ID NO: 3123933 - protein, 6 aa, Giardia lamblia
NALNSS

SEQ ID NO: 3123934 - protein, 5 aa, Giardia lamblia
NALPR

SEQ ID NO: 3123935 - protein, 5 aa, Giardia lamblia
NALQK

SEQ ID NO: 3123936 - protein, 12 aa, Giardia lamblia
NALQSNKKTFQK

SEQ ID NO: 3123937 - protein, 15 aa, Giardia lamblia
NAMPPKDNSRKSRSL

SEQ ID NO: 3123938 - protein, 23 aa, Giardia lamblia
NANANFSASPVATAAKASVESAR

SEQ ID NO: 3123939 - protein, 17 aa, Giardia lamblia
NANASKPKGPVLPPPGV

SEQ ID NO: 3123940 - protein, 16 aa, Giardia lamblia
NANDSMARSSTNYMGE

SEQ ID NO: 3123941 - protein, 9 aa, Giardia lamblia
NANKKQMAK

SEQ ID NO: 3123942 - protein, 22 aa, Giardia lamblia
NANNKSCGGTPDEVDNDNETPE

SEQ ID NO: 3123943 - protein, 7 aa, Giardia lamblia
NANNYDD

SEQ ID NO: 3123944 - protein, 8 aa, Giardia lamblia
NANPERVQ

SEQ ID NO: 3123945 - protein, 9 aa, Giardia lamblia
NANPRGGQD

SEQ ID NO: 3123946 - protein, 33 aa, Giardia lamblia
NANQSPPRIPPRSEKSRKPSASEREDCGPSITD

SEQ ID NO: 3123947 - protein, 9 aa, Giardia lamblia
NANQTFPRS

SEQ ID NO: 3123948 - protein, 4 aa, Giardia lamblia
NANR

SEQ ID NO: 3123949 - protein, 8 aa, Giardia lamblia
NANTGGCC

SEQ ID NO: 3123950 - protein, 10 aa, Giardia lamblia
NAPGRKPREV

SEQ ID NO: 3123951 - protein, 16 aa, Giardia lamblia
NAPKTKLATNEAEAAT

SEQ ID NO: 3123952 - protein, 9 aa, Giardia lamblia
NAPPDYSPF

SEQ ID NO: 3123953 - protein, 43 aa, Giardia lamblia
NAPPSRDAKRSTVSSIQRGDPPLSTGSDDINSKLSDAAASGMT

SEQ ID NO: 3123954 - protein, 9 aa, Giardia lamblia
NAPPTTREG

SEQ ID NO: 3123955 - protein, 15 aa, Giardia lamblia
NAPRNATCRSVGETK

SEQ ID NO: 3123956 - protein, 23 aa, Giardia lamblia
NAPSQATSRTSFPDAESNNSCTA

SEQ ID NO: 3123957 - protein, 10 aa, Giardia lamblia
NAPTAQKTKL

SEQ ID NO: 3123958 - protein, 6 aa, Giardia lamblia
NAPTEA

SEQ ID NO: 3123959 - protein, 7 aa, Giardia lamblia
NAPTTES

SEQ ID NO: 3123960 - protein, 17 aa, Giardia lamblia
NAPVNEQASVSMSIASD

SEQ ID NO: 3123961 - protein, 10 aa, Giardia lamblia
NAQAEQQQQQ

SEQ ID NO: 3123962 - protein, 7 aa, Giardia lamblia
NAQASLD

SEQ ID NO: 3123963 - protein, 4 aa, Giardia lamblia
NAQE

SEQ ID NO: 3123964 - protein, 12 aa, Giardia lamblia
NAQENPRPQDPT

SEQ ID NO: 3123965 - protein, 7 aa, Giardia lamblia
NAQERTA

SEQ ID NO: 3123966 - protein, 6 aa, Giardia lamblia
NAQGED

SEQ ID NO: 3123967 - protein, 6 aa, Giardia lamblia
NAQGQT

SEQ ID NO: 3123968 - protein, 5 aa, Giardia lamblia
NAQIR

SEQ ID NO: 3123969 - protein, 9 aa, Giardia lamblia
NAQKQRDKF

SEQ ID NO: 3123970 - protein, 6 aa, Giardia lamblia
NAQLAA

SEQ ID NO: 3123971 - protein, 11 aa, Giardia lamblia
NAQNKTHKQEV

SEQ ID NO: 3123972 - protein, 4 aa, Giardia lamblia
NAQQ

SEQ ID NO: 3123973 - protein, 7 aa, Giardia lamblia
NAQQYSP

SEQ ID NO: 3123974 - protein, 8 aa, Giardia lamblia
NAQREQDM

SEQ ID NO: 3123975 - protein, 28 aa, Giardia lamblia
NAQRGDSAALSQEVNQEAEGDDDDPDNL

SEQ ID NO: 3123976 - protein, 14 aa, Giardia lamblia
NAQRIASLKEMLGD

SEQ ID NO: 3123977 - protein, 15 aa, Giardia lamblia
NAQTTYQQKKATRRY

SEQ ID NO: 3123978 - protein, 10 aa, Giardia lamblia
NARAKEKSTV

SEQ ID NO: 3123979 - protein, 21 aa, Giardia lamblia
NARGQMPTNSKISKPAIAYKV

SEQ ID NO: 3123980 - protein, 15 aa, Giardia lamblia
NARLAEETRKHNRQM

SEQ ID NO: 3123981 - protein, 5 aa, Giardia lamblia
NARLR

SEQ ID NO: 3123982 - protein, 4 aa, Giardia lamblia
NARP

SEQ ID NO: 3123983 - protein, 6 aa, Giardia lamblia
NARPKS

SEQ ID NO: 3123984 - protein, 7 aa, Giardia lamblia
NARPNVD

SEQ ID NO: 3123985 - protein, 10 aa, Giardia lamblia
NARPSSSELA

SEQ ID NO: 3123986 - protein, 6 aa, Giardia lamblia
NARQRA

SEQ ID NO: 3123987 - protein, 23 aa, Giardia lamblia
NARQRDKREQQAHMQSANPAAET

SEQ ID NO: 3123988 - protein, 9 aa, Giardia lamblia
NARRHPPNI

SEQ ID NO: 3123989 - protein, 9 aa, Giardia lamblia
NARSDQYYN

SEQ ID NO: 3123990 - protein, 21 aa, Giardia lamblia
NARTHVRKQADDSRDMTGLSG

SEQ ID NO: 3123991 - protein, 9 aa, Giardia lamblia
NARTTSLET

SEQ ID NO: 3123992 - protein, 10 aa, Giardia lamblia
NASANADKEH

SEQ ID NO: 3123993 - protein, 8 aa, Giardia lamblia
NASANSTA

SEQ ID NO: 3123994 - protein, 10 aa, Giardia lamblia
NASAPSENAF

SEQ ID NO: 3123995 - protein, 5 aa, Giardia lamblia
NASAS

SEQ ID NO: 3123996 - protein, 13 aa, Giardia lamblia
NASASDEQKRQFS

SEQ ID NO: 3123997 - protein, 8 aa, Giardia lamblia
NASASPLS

SEQ ID NO: 3123998 - protein, 18 aa, Giardia lamblia
NASASRDASARRSLSAQK

SEQ ID NO: 3123999 - protein, 5 aa, Giardia lamblia
NASDC

SEQ ID NO: 3124000 - protein, 18 aa, Giardia lamblia
NASDEEEDEEDADVTTPR

SEQ ID NO: 3124001 - protein, 9 aa, Giardia lamblia
NASEANDVY

SEQ ID NO: 3124002 - protein, 6 aa, Giardia lamblia
NASECT

SEQ ID NO: 3124003 - protein, 7 aa, Giardia lamblia
NASETEA

SEQ ID NO: 3124004 - protein, 9 aa, Giardia lamblia
NASGAEEIP

SEQ ID NO: 3124005 - protein, 6 aa, Giardia lamblia
NASGLT

SEQ ID NO: 3124006 - protein, 6 aa, Giardia lamblia
NASIED

SEQ ID NO: 3124007 - protein, 19 aa, Giardia lamblia
NASKRIGPLEEDTSDTTTL

SEQ ID NO: 3124008 - protein, 18 aa, Giardia lamblia
NASKTNNNYPTDQSGPLV

SEQ ID NO: 3124009 - protein, 14 aa, Giardia lamblia
NASLEKDAQLAQQK

SEQ ID NO: 3124010 - protein, 11 aa, Giardia lamblia
NASLGTDCTGR

SEQ ID NO: 3124011 - protein, 8 aa, Giardia lamblia
NASLQESV

SEQ ID NO: 3124012 - protein, 8 aa, Giardia lamblia
NASLSQDA

SEQ ID NO: 3124013 - protein, 11 aa, Giardia lamblia
NASMEEDPIQS

SEQ ID NO: 3124014 - protein, 6 aa, Giardia lamblia
NASNYQ

SEQ ID NO: 3124015 - protein, 11 aa, Giardia lamblia
NASPLTAEKAD

SEQ ID NO: 3124016 - protein, 24 aa, Giardia lamblia
NASQTDIADSQLTTDNTPDGDAPG

SEQ ID NO: 3124017 - protein, 4 aa, Giardia lamblia
NASS

SEQ ID NO: 3124018 - protein, 7 aa, Giardia lamblia
NASSEES

SEQ ID NO: 3124019 - protein, 5 aa, Giardia lamblia
NASSH

SEQ ID NO: 3124020 - protein, 9 aa, Giardia lamblia
NASSKHPKD

SEQ ID NO: 3124021 - protein, 5 aa, Giardia lamblia
NASSM

SEQ ID NO: 3124022 - protein, 9 aa, Giardia lamblia
NASSRWGSG

SEQ ID NO: 3124023 - protein, 7 aa, Giardia lamblia
NASTAPC

SEQ ID NO: 3124024 - protein, 6 aa, Giardia lamblia
NASTAT

SEQ ID NO: 3124025 - protein, 25 aa, Giardia lamblia
NASTQTTEQSRAQHTDDNCGAVDVV

SEQ ID NO: 3124026 - protein, 9 aa, Giardia lamblia
NASTYTHED

SEQ ID NO: 3124027 - protein, 7 aa, Giardia lamblia
NASVPDK

SEQ ID NO: 3124028 - protein, 8 aa, Giardia lamblia
NASVSNTA

SEQ ID NO: 3124029 - protein, 7 aa, Giardia lamblia
NASVSSD

SEQ ID NO: 3124030 - protein, 12 aa, Giardia lamblia
NASVTTPNPDAD

SEQ ID NO: 3124031 - protein, 4 aa, Giardia lamblia
NASY

SEQ ID NO: 3124032 - protein, 5 aa, Giardia lamblia
NASYS

SEQ ID NO: 3124033 - protein, 4 aa, Giardia lamblia
NATA

SEQ ID NO: 3124034 - protein, 8 aa, Giardia lamblia
NATASGDF

SEQ ID NO: 3124035 - protein, 10 aa, Giardia lamblia
NATDASGNTA

SEQ ID NO: 3124036 - protein, 11 aa, Giardia lamblia
NATDGTKQSTP

SEQ ID NO: 3124037 - protein, 16 aa, Giardia lamblia
NATDTADTTDTTDTVD

SEQ ID NO: 3124038 - protein, 14 aa, Giardia lamblia
NATELDDPEWLQQL

SEQ ID NO: 3124039 - protein, 7 aa, Giardia lamblia
NATESSL

SEQ ID NO: 3124040 - protein, 5 aa, Giardia lamblia
NATGV

SEQ ID NO: 3124041 - protein, 15 aa, Giardia lamblia
NATIGKERKAWGNKT

SEQ ID NO: 3124042 - protein, 12 aa, Giardia lamblia
NATKEKLAETTA

SEQ ID NO: 3124043 - protein, 12 aa, Giardia lamblia
NATLSKTTPQES

SEQ ID NO: 3124044 - protein, 16 aa, Giardia lamblia
NATNGCTTEEQTREDL

SEQ ID NO: 3124045 - protein, 5 aa, Giardia lamblia
NATPA

SEQ ID NO: 3124046 - protein, 11 aa, Giardia lamblia
NATPIGTNEGE

SEQ ID NO: 3124047 - protein, 9 aa, Giardia lamblia
NATPLSPAD

SEQ ID NO: 3124048 - protein, 15 aa, Giardia lamblia
NATPRASSKPAQGIA

SEQ ID NO: 3124049 - protein, 11 aa, Giardia lamblia
NATPSTTKVES

SEQ ID NO: 3124050 - protein, 7 aa, Giardia lamblia
NATQQSK

SEQ ID NO: 3124051 - protein, 5 aa, Giardia lamblia
NATQS

SEQ ID NO: 3124052 - protein, 8 aa, Giardia lamblia
NATSEALA

SEQ ID NO: 3124053 - protein, 25 aa, Giardia lamblia
NATSIEPPSVSPEDAPSHSSTLSGG

SEQ ID NO: 3124054 - protein, 5 aa, Giardia lamblia
NATST

SEQ ID NO: 3124055 - protein, 4 aa, Giardia lamblia
NATT

SEQ ID NO: 3124056 - protein, 7 aa, Giardia lamblia
NATTEVY

SEQ ID NO: 3124057 - protein, 8 aa, Giardia lamblia
NATTVTED

SEQ ID NO: 3124058 - protein, 7 aa, Giardia lamblia
NAVDKTQ

SEQ ID NO: 3124059 - protein, 14 aa, Giardia lamblia
NAVETPNMSEEAQI

SEQ ID NO: 3124060 - protein, 8 aa, Giardia lamblia
NAVNPGPN

SEQ ID NO: 3124061 - protein, 15 aa, Giardia lamblia
NAVPETRPVPSITPR

SEQ ID NO: 3124062 - protein, 10 aa, Giardia lamblia
NAVQDSSSCS

SEQ ID NO: 3124063 - protein, 15 aa, Giardia lamblia
NAVSKKEKTAQEALD

SEQ ID NO: 3124064 - protein, 14 aa, Giardia lamblia
NAVSPSDQPQQTIY

SEQ ID NO: 3124065 - protein, 25 aa, Giardia lamblia
NAVSTGDPVGHAASEESTDGSALEG

SEQ ID NO: 3124066 - protein, 4 aa, Giardia lamblia
NAVT

SEQ ID NO: 3124067 - protein, 16 aa, Giardia lamblia
NAYTEEKDKKREEGNF

SEQ ID NO: 3124068 - protein, 7 aa, Giardia lamblia
NAYTNAD

SEQ ID NO: 3124069 - protein, 6 aa, Giardia lamblia
NCDPNG

SEQ ID NO: 3124070 - protein, 7 aa, Giardia lamblia
NCGDSRT

SEQ ID NO: 3124071 - protein, 6 aa, Giardia lamblia
NCGHGK

SEQ ID NO: 3124072 - protein, 7 aa, Giardia lamblia
NCGTGRK

SEQ ID NO: 3124073 - protein, 5 aa, Giardia lamblia
NCKGI

SEQ ID NO: 3124074 - protein, 4 aa, Giardia lamblia
NCNT

SEQ ID NO: 3124075 - protein, 5 aa, Giardia lamblia
NCPRN

SEQ ID NO: 3124076 - protein, 7 aa, Giardia lamblia
NCQNGGA

SEQ ID NO: 3124077 - protein, 15 aa, Giardia lamblia
NCQTAGSSSDDNLAR

SEQ ID NO: 3124078 - protein, 10 aa, Giardia lamblia
NCRTESGQTA

SEQ ID NO: 3124079 - protein, 6 aa, Giardia lamblia
NCSTDI

SEQ ID NO: 3124080 - protein, 12 aa, Giardia lamblia
NCTGNANNTDVS

SEQ ID NO: 3124081 - protein, 10 aa, Giardia lamblia
NCTTENADVP

SEQ ID NO: 3124082 - protein, 7 aa, Giardia lamblia
NDAAQRS

SEQ ID NO: 3124083 - protein, 12 aa, Giardia lamblia
NDADSAQKGKVT

SEQ ID NO: 3124084 - protein, 6 aa, Giardia lamblia
NDAEQQ

SEQ ID NO: 3124085 - protein, 7 aa, Giardia lamblia
NDAKGQA

SEQ ID NO: 3124086 - protein, 29 aa, Giardia lamblia
NDALRDPYRASVKGAGHTGRDAGMYEGIF

SEQ ID NO: 3124087 - protein, 6 aa, Giardia lamblia
NDANDM

SEQ ID NO: 3124088 - protein, 15 aa, Giardia lamblia
NDAPPAQTDAKGKLV

SEQ ID NO: 3124089 - protein, 6 aa, Giardia lamblia
NDATYK

SEQ ID NO: 3124090 - protein, 9 aa, Giardia lamblia
NDAVDTSNK

SEQ ID NO: 3124091 - protein, 47 aa, Giardia lamblia
NDDANEGDSDSSYSYYSTDNDNDDNDDIPDPAPDGETHSAVPDPATN

SEQ ID NO: 3124092 - protein, 8 aa, Giardia lamblia
NDDELDDL

SEQ ID NO: 3124093 - protein, 21 aa, Giardia lamblia
NDDGVPSAVEPSSAAPVLPRA

SEQ ID NO: 3124094 - protein, 5 aa, Giardia lamblia
NDDHT

SEQ ID NO: 3124095 - protein, 4 aa, Giardia lamblia
NDDI

SEQ ID NO: 3124096 - protein, 4 aa, Giardia lamblia
NDDL

SEQ ID NO: 3124097 - protein, 5 aa, Giardia lamblia
NDDPK

SEQ ID NO: 3124098 - protein, 9 aa, Giardia lamblia
NDDQQRSTD

SEQ ID NO: 3124099 - protein, 7 aa, Giardia lamblia
NDDSRAD

SEQ ID NO: 3124100 - protein, 13 aa, Giardia lamblia
NDDSSDALPGALS

SEQ ID NO: 3124101 - protein, 6 aa, Giardia lamblia
NDDTFS

SEQ ID NO: 3124102 - protein, 5 aa, Giardia lamblia
NDDTV

SEQ ID NO: 3124103 - protein, 9 aa, Giardia lamblia
NDDVSSIGK

SEQ ID NO: 3124104 - protein, 11 aa, Giardia lamblia
NDDYSNDPLRN

SEQ ID NO: 3124105 - protein, 11 aa, Giardia lamblia
NDEDKNKRKDA

SEQ ID NO: 3124106 - protein, 7 aa, Giardia lamblia
NDEDNDD

SEQ ID NO: 3124107 - protein, 11 aa, Giardia lamblia
NDEEQHDSKDY

SEQ ID NO: 3124108 - protein, 10 aa, Giardia lamblia
NDEIAEKTAR

SEQ ID NO: 3124109 - protein, 5 aa, Giardia lamblia
NDEIE

SEQ ID NO: 3124110 - protein, 9 aa, Giardia lamblia
NDELDARER

SEQ ID NO: 3124111 - protein, 15 aa, Giardia lamblia
NDENEKRAGPRASTQ

SEQ ID NO: 3124112 - protein, 7 aa, Giardia lamblia
NDEQRNK

SEQ ID NO: 3124113 - protein, 4 aa, Giardia lamblia
NDET

SEQ ID NO: 3124114 - protein, 5 aa, Giardia lamblia
NDETH

SEQ ID NO: 3124115 - protein, 6 aa, Giardia lamblia
NDETKV

SEQ ID NO: 3124116 - protein, 6 aa, Giardia lamblia
NDETRA

SEQ ID NO: 3124117 - protein, 7 aa, Giardia lamblia
NDEWPGT

SEQ ID NO: 3124118 - protein, 21 aa, Giardia lamblia
NDFDSQKRSAEIANQTSPTAG

SEQ ID NO: 3124119 - protein, 7 aa, Giardia lamblia
NDFESGK

SEQ ID NO: 3124120 - protein, 14 aa, Giardia lamblia
NDFKGSRDLDGDTG

SEQ ID NO: 3124121 - protein, 13 aa, Giardia lamblia
NDFPSFSPQDMQK

SEQ ID NO: 3124122 - protein, 6 aa, Giardia lamblia
NDFTKE

SEQ ID NO: 3124123 - protein, 8 aa, Giardia lamblia
NDGASAGM

SEQ ID NO: 3124124 - protein, 11 aa, Giardia lamblia
NDGDPTLPGRG

SEQ ID NO: 3124125 - protein, 4 aa, Giardia lamblia
NDGF

SEQ ID NO: 3124126 - protein, 6 aa, Giardia lamblia
NDGGET

SEQ ID NO: 3124127 - protein, 5 aa, Giardia lamblia
NDGHR

SEQ ID NO: 3124128 - protein, 6 aa, Giardia lamblia
NDGIRK

SEQ ID NO: 3124129 - protein, 7 aa, Giardia lamblia
NDGLTAA

SEQ ID NO: 3124130 - protein, 20 aa, Giardia lamblia
NDGMEKNQREADEVKERNAA

SEQ ID NO: 3124131 - protein, 7 aa, Giardia lamblia
NDGSDGR

SEQ ID NO: 3124132 - protein, 5 aa, Giardia lamblia
NDGSL

SEQ ID NO: 3124133 - protein, 4 aa, Giardia lamblia
NDGY

SEQ ID NO: 3124134 - protein, 5 aa, Giardia lamblia
NDGYS

SEQ ID NO: 3124135 - protein, 4 aa, Giardia lamblia
NDHR

SEQ ID NO: 3124136 - protein, 4 aa, Giardia lamblia
NDIE

SEQ ID NO: 3124137 - protein, 9 aa, Giardia lamblia
NDIESQRKA

SEQ ID NO: 3124138 - protein, 8 aa, Giardia lamblia
NDINPNYD

SEQ ID NO: 3124139 - protein, 35 aa, Giardia lamblia
NDIPSRDNRDRSMTIGPEDTGMRASPSTAVSDRYD

SEQ ID NO: 3124140 - protein, 9 aa, Giardia lamblia
NDITNKSAA

SEQ ID NO: 3124141 - protein, 42 aa, Giardia lamblia
NDITSANSNRLEAGTNGDMTPGSASAANGPHASMRQTNSIKN

SEQ ID NO: 3124142 - protein, 10 aa, Giardia lamblia
NDITTKEQQT

SEQ ID NO: 3124143 - protein, 5 aa, Giardia lamblia
NDKAL

SEQ ID NO: 3124144 - protein, 9 aa, Giardia lamblia
NDKDAEIKT

SEQ ID NO: 3124145 - protein, 4 aa, Giardia lamblia
NDKG

SEQ ID NO: 3124146 - protein, 13 aa, Giardia lamblia
NDKRSRSKSDAWS

SEQ ID NO: 3124147 - protein, 13 aa, Giardia lamblia
NDKSDSDRTENEY

SEQ ID NO: 3124148 - protein, 10 aa, Giardia lamblia
NDKSTHTKMT

SEQ ID NO: 3124149 - protein, 5 aa, Giardia lamblia
NDKTL

SEQ ID NO: 3124150 - protein, 10 aa, Giardia lamblia
NDKTRETEEL

SEQ ID NO: 3124151 - protein, 7 aa, Giardia lamblia
NDLGSSP

SEQ ID NO: 3124152 - protein, 8 aa, Giardia lamblia
NDLKDARP

SEQ ID NO: 3124153 - protein, 11 aa, Giardia lamblia
NDLKSNTTDYA

SEQ ID NO: 3124154 - protein, 14 aa, Giardia lamblia
NDLPAGTSSFGPSS

SEQ ID NO: 3124155 - protein, 13 aa, Giardia lamblia
NDLPEEHRSPSAY

SEQ ID NO: 3124156 - protein, 4 aa, Giardia lamblia
NDLT

SEQ ID NO: 3124157 - protein, 6 aa, Giardia lamblia
NDLTDT

SEQ ID NO: 3124158 - protein, 12 aa, Giardia lamblia
NDMSGPNTAQSS

SEQ ID NO: 3124159 - protein, 9 aa, Giardia lamblia
NDNASQEQI

SEQ ID NO: 3124160 - protein, 8 aa, Giardia lamblia
NDNDPDSG

SEQ ID NO: 3124161 - protein, 5 aa, Giardia lamblia
NDNGK

SEQ ID NO: 3124162 - protein, 8 aa, Giardia lamblia
NDNGKPSI

SEQ ID NO: 3124163 - protein, 7 aa, Giardia lamblia
NDNNHST

SEQ ID NO: 3124164 - protein, 12 aa, Giardia lamblia
NDNPEDETVPNK

SEQ ID NO: 3124165 - protein, 8 aa, Giardia lamblia
NDNQRRDM

SEQ ID NO: 3124166 - protein, 6 aa, Giardia lamblia
NDNSGL

SEQ ID NO: 3124167 - protein, 17 aa, Giardia lamblia
NDNSPSHSVTSEKPYKS

SEQ ID NO: 3124168 - protein, 11 aa, Giardia lamblia
NDNSSSVSAAG

SEQ ID NO: 3124169 - protein, 8 aa, Giardia lamblia
NDNTFDQE

SEQ ID NO: 3124170 - protein, 22 aa, Giardia lamblia
NDPAAKEEADKPKEPAADTSSL

SEQ ID NO: 3124171 - protein, 8 aa, Giardia lamblia
NDPAVDKG

SEQ ID NO: 3124172 - protein, 4 aa, Giardia lamblia
NDPD

SEQ ID NO: 3124173 - protein, 9 aa, Giardia lamblia
NDPDSAYTE

SEQ ID NO: 3124174 - protein, 7 aa, Giardia lamblia
NDPDVAQ

SEQ ID NO: 3124175 - protein, 5 aa, Giardia lamblia
NDPEL

SEQ ID NO: 3124176 - protein, 9 aa, Giardia lamblia
NDPGNNSLA

SEQ ID NO: 3124177 - protein, 8 aa, Giardia lamblia
NDPLPKPE

SEQ ID NO: 3124178 - protein, 5 aa, Giardia lamblia
NDPLT

SEQ ID NO: 3124179 - protein, 6 aa, Giardia lamblia
NDPNAI

SEQ ID NO: 3124180 - protein, 9 aa, Giardia lamblia
NDPNERPSA

SEQ ID NO: 3124181 - protein, 6 aa, Giardia lamblia
NDPNGS

SEQ ID NO: 3124182 - protein, 9 aa, Giardia lamblia
NDPNIPQQT

SEQ ID NO: 3124183 - protein, 5 aa, Giardia lamblia
NDPPG

SEQ ID NO: 3124184 - protein, 6 aa, Giardia lamblia
NDPPIG

SEQ ID NO: 3124185 - protein, 37 aa, Giardia lamblia
NDPPPPPVEEAPPPPQGKKSRKNSKQGSRKSSKSKKK

SEQ ID NO: 3124186 - protein, 5 aa, Giardia lamblia
NDPSL

SEQ ID NO: 3124187 - protein, 4 aa, Giardia lamblia
NDPT

SEQ ID NO: 3124188 - protein, 4 aa, Giardia lamblia
NDPV

SEQ ID NO: 3124189 - protein, 5 aa, Giardia lamblia
NDPVG

SEQ ID NO: 3124190 - protein, 4 aa, Giardia lamblia
NDQD

SEQ ID NO: 3124191 - protein, 10 aa, Giardia lamblia
NDQERGAESP

SEQ ID NO: 3124192 - protein, 6 aa, Giardia lamblia
NDQGEL

SEQ ID NO: 3124193 - protein, 5 aa, Giardia lamblia
NDQQR

SEQ ID NO: 3124194 - protein, 8 aa, Giardia lamblia
NDQQVKEV

SEQ ID NO: 3124195 - protein, 9 aa, Giardia lamblia
NDQRRATEL

SEQ ID NO: 3124196 - protein, 8 aa, Giardia lamblia
NDQYCGPS

SEQ ID NO: 3124197 - protein, 9 aa, Giardia lamblia
NDRAEAMQQ

SEQ ID NO: 3124198 - protein, 14 aa, Giardia lamblia
NDRDNSLSSVATDE

SEQ ID NO: 3124199 - protein, 4 aa, Giardia lamblia
NDRG

SEQ ID NO: 3124200 - protein, 6 aa, Giardia lamblia
NDRGEN

SEQ ID NO: 3124201 - protein, 9 aa, Giardia lamblia
NDRGTSGSF

SEQ ID NO: 3124202 - protein, 7 aa, Giardia lamblia
NDRHGQT

SEQ ID NO: 3124203 - protein, 9 aa, Giardia lamblia
NDRKPEAEE

SEQ ID NO: 3124204 - protein, 4 aa, Giardia lamblia
NDRL

SEQ ID NO: 3124205 - protein, 11 aa, Giardia lamblia
NDRLSDSFTTE

SEQ ID NO: 3124206 - protein, 8 aa, Giardia lamblia
NDRPGVDG

SEQ ID NO: 3124207 - protein, 8 aa, Giardia lamblia
NDRRHGPG

SEQ ID NO: 3124208 - protein, 4 aa, Giardia lamblia
NDRS

SEQ ID NO: 3124209 - protein, 10 aa, Giardia lamblia
NDRSSSCHPR

SEQ ID NO: 3124210 - protein, 6 aa, Giardia lamblia
NDRTDT

SEQ ID NO: 3124211 - protein, 10 aa, Giardia lamblia
NDSAKTAPSI

SEQ ID NO: 3124212 - protein, 13 aa, Giardia lamblia
NDSDCVDSSDQLS

SEQ ID NO: 3124213 - protein, 7 aa, Giardia lamblia
NDSDETY

SEQ ID NO: 3124214 - protein, 26 aa, Giardia lamblia
NDSDSCGKVPEGGTSTYTGTSRNSYP

SEQ ID NO: 3124215 - protein, 22 aa, Giardia lamblia
NDSDSSDDEFGDNDQDPRGSLS

SEQ ID NO: 3124216 - protein, 5 aa, Giardia lamblia
NDSEK

SEQ ID NO: 3124217 - protein, 7 aa, Giardia lamblia
NDSEKHL

SEQ ID NO: 3124218 - protein, 5 aa, Giardia lamblia
NDSET

SEQ ID NO: 3124219 - protein, 5 aa, Giardia lamblia
NDSEV

SEQ ID NO: 3124220 - protein, 12 aa, Giardia lamblia
NDSFESEDNDLG

SEQ ID NO: 3124221 - protein, 8 aa, Giardia lamblia
NDSGEELQ

SEQ ID NO: 3124222 - protein, 18 aa, Giardia lamblia
NDSGSSDRYGQGPNFEPE

SEQ ID NO: 3124223 - protein, 20 aa, Giardia lamblia
NDSKQSSAISTVKSSPGKSG

SEQ ID NO: 3124224 - protein, 20 aa, Giardia lamblia
NDSKTDTNSLDVSEDGDVGK

SEQ ID NO: 3124225 - protein, 7 aa, Giardia lamblia
NDSQKHA

SEQ ID NO: 3124226 - protein, 17 aa, Giardia lamblia
NDSRQNLPNQSELHESK

SEQ ID NO: 3124227 - protein, 8 aa, Giardia lamblia
NDSRTGIK

SEQ ID NO: 3124228 - protein, 8 aa, Giardia lamblia
NDSRVEST

SEQ ID NO: 3124229 - protein, 10 aa, Giardia lamblia
NDSSESITPQ

SEQ ID NO: 3124230 - protein, 5 aa, Giardia lamblia
NDSST

SEQ ID NO: 3124231 - protein, 6 aa, Giardia lamblia
NDSSTL

SEQ ID NO: 3124232 - protein, 11 aa, Giardia lamblia
NDSSYIGSGGL

SEQ ID NO: 3124233 - protein, 8 aa, Giardia lamblia
NDSTDEKF

SEQ ID NO: 3124234 - protein, 6 aa, Giardia lamblia
NDSTDS

SEQ ID NO: 3124235 - protein, 11 aa, Giardia lamblia
NDSTGGTATIE

SEQ ID NO: 3124236 - protein, 5 aa, Giardia lamblia
NDSTI

SEQ ID NO: 3124237 - protein, 6 aa, Giardia lamblia
NDSTKH

SEQ ID NO: 3124238 - protein, 5 aa, Giardia lamblia
NDSTP

SEQ ID NO: 3124239 - protein, 7 aa, Giardia lamblia
NDSTTSA

SEQ ID NO: 3124240 - protein, 8 aa, Giardia lamblia
NDSVPVYP

SEQ ID NO: 3124241 - protein, 8 aa, Giardia lamblia
NDTDAQRT

SEQ ID NO: 3124242 - protein, 4 aa, Giardia lamblia
NDTE

SEQ ID NO: 3124243 - protein, 5 aa, Giardia lamblia
NDTGA

SEQ ID NO: 3124244 - protein, 12 aa, Giardia lamblia
NDTGADFDDFEA

SEQ ID NO: 3124245 - protein, 29 aa, Giardia lamblia
NDTGGEAWNSSTEHDATGPASTFNDEGNP

SEQ ID NO: 3124246 - protein, 12 aa, Giardia lamblia
NDTHERTLKQTN

SEQ ID NO: 3124247 - protein, 14 aa, Giardia lamblia
NDTLPEPDVNPHYT

SEQ ID NO: 3124248 - protein, 16 aa, Giardia lamblia
NDTMGGTDPMDQTRGK

SEQ ID NO: 3124249 - protein, 13 aa, Giardia lamblia
NDTRASEKKASDM

SEQ ID NO: 3124250 - protein, 15 aa, Giardia lamblia
NDTREQREETRRSIT

SEQ ID NO: 3124251 - protein, 17 aa, Giardia lamblia
NDTRSEPQQETPDLGTP

SEQ ID NO: 3124252 - protein, 17 aa, Giardia lamblia
NDTSAADGQAGEEERAR

SEQ ID NO: 3124253 - protein, 8 aa, Giardia lamblia
NDTSPASD

SEQ ID NO: 3124254 - protein, 7 aa, Giardia lamblia
NDTSQEI

SEQ ID NO: 3124255 - protein, 21 aa, Giardia lamblia
NDTTSDRRSNKVSASEAFSQK

SEQ ID NO: 3124256 - protein, 25 aa, Giardia lamblia
NDVPGPSQYTNIQPNLSKAGHTDNI

SEQ ID NO: 3124257 - protein, 9 aa, Giardia lamblia
NDVPPDADL

SEQ ID NO: 3124258 - protein, 5 aa, Giardia lamblia
NDVSS

SEQ ID NO: 3124259 - protein, 8 aa, Giardia lamblia
NDVTEATP

SEQ ID NO: 3124260 - protein, 10 aa, Giardia lamblia
NDVTSNPYYT

SEQ ID NO: 3124261 - protein, 4 aa, Giardia lamblia
NDYA

SEQ ID NO: 3124262 - protein, 10 aa, Giardia lamblia
NDYNDQNSKQ

SEQ ID NO: 3124263 - protein, 11 aa, Giardia lamblia
NDYPSAIGGDD

SEQ ID NO: 3124264 - protein, 4 aa, Giardia lamblia
NDYS

SEQ ID NO: 3124265 - protein, 13 aa, Giardia lamblia
NDYTQPTAGPSDD

SEQ ID NO: 3124266 - protein, 6 aa, Giardia lamblia
NEAANH

SEQ ID NO: 3124267 - protein, 18 aa, Giardia lamblia
NEAARPKSKESTKAEEQR

SEQ ID NO: 3124268 - protein, 16 aa, Giardia lamblia
NEADMNGARGVTNEGF

SEQ ID NO: 3124269 - protein, 10 aa, Giardia lamblia
NEADTKGCQE

SEQ ID NO: 3124270 - protein, 7 aa, Giardia lamblia
NEAEAPV

SEQ ID NO: 3124271 - protein, 6 aa, Giardia lamblia
NEAEEL

SEQ ID NO: 3124272 - protein, 14 aa, Giardia lamblia
NEAEIDSKAEADKK

SEQ ID NO: 3124273 - protein, 5 aa, Giardia lamblia
NEAEL

SEQ ID NO: 3124274 - protein, 10 aa, Giardia lamblia
NEAEPSTPMS

SEQ ID NO: 3124275 - protein, 9 aa, Giardia lamblia
NEAEVSSTR

SEQ ID NO: 3124276 - protein, 5 aa, Giardia lamblia
NEAGQ

SEQ ID NO: 3124277 - protein, 5 aa, Giardia lamblia
NEAGV

SEQ ID NO: 3124278 - protein, 6 aa, Giardia lamblia
NEAHLS

SEQ ID NO: 3124279 - protein, 5 aa, Giardia lamblia
NEAIY

SEQ ID NO: 3124280 - protein, 4 aa, Giardia lamblia
NEAL

SEQ ID NO: 3124281 - protein, 16 aa, Giardia lamblia
NEALQGSKDGAEEAQD

SEQ ID NO: 3124282 - protein, 10 aa, Giardia lamblia
NEANASLRQS

SEQ ID NO: 3124283 - protein, 13 aa, Giardia lamblia
NEANSTGYDGSSP

SEQ ID NO: 3124284 - protein, 15 aa, Giardia lamblia
NEAPDAPASQEDGVY

SEQ ID NO: 3124285 - protein, 7 aa, Giardia lamblia
NEAQRHQ

SEQ ID NO: 3124286 - protein, 16 aa, Giardia lamblia
NEARRRAGAAESEANY

SEQ ID NO: 3124287 - protein, 15 aa, Giardia lamblia
NEARTSDYEQQGKEL

SEQ ID NO: 3124288 - protein, 8 aa, Giardia lamblia
NEASKQKP

SEQ ID NO: 3124289 - protein, 13 aa, Giardia lamblia
NEATADPAPTESM

SEQ ID NO: 3124290 - protein, 6 aa, Giardia lamblia
NEATEL

SEQ ID NO: 3124291 - protein, 10 aa, Giardia lamblia
NEATGFEDAT

SEQ ID NO: 3124292 - protein, 13 aa, Giardia lamblia
NEATNEKANIPGG

SEQ ID NO: 3124293 - protein, 17 aa, Giardia lamblia
NECGIESHSQGFYFIAS

SEQ ID NO: 3124294 - protein, 6 aa, Giardia lamblia
NECLET

SEQ ID NO: 3124295 - protein, 9 aa, Giardia lamblia
NECNAESRQ

SEQ ID NO: 3124296 - protein, 16 aa, Giardia lamblia
NECPTCSGKAGDQDPS

SEQ ID NO: 3124297 - protein, 6 aa, Giardia lamblia
NECTDR

SEQ ID NO: 3124298 - protein, 9 aa, Giardia lamblia
NEDDDNYDS

SEQ ID NO: 3124299 - protein, 9 aa, Giardia lamblia
NEDDQQNAS

SEQ ID NO: 3124300 - protein, 5 aa, Giardia lamblia
NEDGL

SEQ ID NO: 3124301 - protein, 9 aa, Giardia lamblia
NEDLAGSRG

SEQ ID NO: 3124302 - protein, 18 aa, Giardia lamblia
NEDMNQNRRRVSSTQGEV

SEQ ID NO: 3124303 - protein, 30 aa, Giardia lamblia
NEDNAMGSDTSFPPSQSSQDPSSSTTDDLS

SEQ ID NO: 3124304 - protein, 13 aa, Giardia lamblia
NEDPAQSPPGYES

SEQ ID NO: 3124305 - protein, 17 aa, Giardia lamblia
NEDPTQAATDLDKYRET

SEQ ID NO: 3124306 - protein, 6 aa, Giardia lamblia
NEDRDS

SEQ ID NO: 3124307 - protein, 7 aa, Giardia lamblia
NEDSDSL

SEQ ID NO: 3124308 - protein, 11 aa, Giardia lamblia
NEDSPERASTC

SEQ ID NO: 3124309 - protein, 6 aa, Giardia lamblia
NEDSRK

SEQ ID NO: 3124310 - protein, 8 aa, Giardia lamblia
NEDTTSMG

SEQ ID NO: 3124311 - protein, 8 aa, Giardia lamblia
NEEALEPV

SEQ ID NO: 3124312 - protein, 6 aa, Giardia lamblia
NEEDSI

SEQ ID NO: 3124313 - protein, 21 aa, Giardia lamblia
NEEEQSSYHDKAELAKARRAI

SEQ ID NO: 3124314 - protein, 11 aa, Giardia lamblia
NEEERAEATET

SEQ ID NO: 3124315 - protein, 5 aa, Giardia lamblia
NEEGP

SEQ ID NO: 3124316 - protein, 8 aa, Giardia lamblia
NEEHSTNS

SEQ ID NO: 3124317 - protein, 4 aa, Giardia lamblia
NEEI

SEQ ID NO: 3124318 - protein, 16 aa, Giardia lamblia
NEEIARRRQELERRRD

SEQ ID NO: 3124319 - protein, 13 aa, Giardia lamblia
NEEKPNEEKGFTR

SEQ ID NO: 3124320 - protein, 9 aa, Giardia lamblia
NEELPSREG

SEQ ID NO: 3124321 - protein, 8 aa, Giardia lamblia
NEENRNLR

SEQ ID NO: 3124322 - protein, 23 aa, Giardia lamblia
NEEQDTLRDQEHDTISTTSRCTL

SEQ ID NO: 3124323 - protein, 5 aa, Giardia lamblia
NEERA

SEQ ID NO: 3124324 - protein, 7 aa, Giardia lamblia
NEEREAL

SEQ ID NO: 3124325 - protein, 5 aa, Giardia lamblia
NEERR

SEQ ID NO: 3124326 - protein, 20 aa, Giardia lamblia
NEESREGKSGPRGVKGSERM

SEQ ID NO: 3124327 - protein, 7 aa, Giardia lamblia
NEETQNY

SEQ ID NO: 3124328 - protein, 6 aa, Giardia lamblia
NEFNNG

SEQ ID NO: 3124329 - protein, 5 aa, Giardia lamblia
NEGAS

SEQ ID NO: 3124330 - protein, 12 aa, Giardia lamblia
NEGDRDKASAIA

SEQ ID NO: 3124331 - protein, 14 aa, Giardia lamblia
NEGEPGSSKLNGTI

SEQ ID NO: 3124332 - protein, 6 aa, Giardia lamblia
NEGGGS

SEQ ID NO: 3124333 - protein, 6 aa, Giardia lamblia
NEGKTA

SEQ ID NO: 3124334 - protein, 8 aa, Giardia lamblia
NEGPELNT

SEQ ID NO: 3124335 - protein, 6 aa, Giardia lamblia
NEGPHY

SEQ ID NO: 3124336 - protein, 5 aa, Giardia lamblia
NEGPV

SEQ ID NO: 3124337 - protein, 8 aa, Giardia lamblia
NEGTLPNE

SEQ ID NO: 3124338 - protein, 14 aa, Giardia lamblia
NEGVGTEDLEPAMS

SEQ ID NO: 3124339 - protein, 18 aa, Giardia lamblia
NEGVQAGATSSKPEADVQ

SEQ ID NO: 3124340 - protein, 5 aa, Giardia lamblia
NEGYN

SEQ ID NO: 3124341 - protein, 6 aa, Giardia lamblia
NEHAKP

SEQ ID NO: 3124342 - protein, 6 aa, Giardia lamblia
NEHGPY

SEQ ID NO: 3124343 - protein, 10 aa, Giardia lamblia
NEHLPKPKDI

SEQ ID NO: 3124344 - protein, 10 aa, Giardia lamblia
NEHNKRISEQ

SEQ ID NO: 3124345 - protein, 4 aa, Giardia lamblia
NEHR

SEQ ID NO: 3124346 - protein, 5 aa, Giardia lamblia
NEHTD

SEQ ID NO: 3124347 - protein, 7 aa, Giardia lamblia
NEHTSAY

SEQ ID NO: 3124348 - protein, 10 aa, Giardia lamblia
NEIDCKSTPV

SEQ ID NO: 3124349 - protein, 6 aa, Giardia lamblia
NEIEEK

SEQ ID NO: 3124350 - protein, 13 aa, Giardia lamblia
NEIQKKTTPSYRA

SEQ ID NO: 3124351 - protein, 14 aa, Giardia lamblia
NEIRARSNQKSQTV

SEQ ID NO: 3124352 - protein, 9 aa, Giardia lamblia
NEKAQKELN

SEQ ID NO: 3124353 - protein, 5 aa, Giardia lamblia
NEKAS

SEQ ID NO: 3124354 - protein, 7 aa, Giardia lamblia
NEKDKVK

SEQ ID NO: 3124355 - protein, 7 aa, Giardia lamblia
NEKDTLD

SEQ ID NO: 3124356 - protein, 4 aa, Giardia lamblia
NEKE

SEQ ID NO: 3124357 - protein, 4 aa, Giardia lamblia
NEKG

SEQ ID NO: 3124358 - protein, 10 aa, Giardia lamblia
NEKGSRDRES

SEQ ID NO: 3124359 - protein, 4 aa, Giardia lamblia
NEKL

SEQ ID NO: 3124360 - protein, 6 aa, Giardia lamblia
NEKNIE

SEQ ID NO: 3124361 - protein, 7 aa, Giardia lamblia
NEKNNDL

SEQ ID NO: 3124362 - protein, 5 aa, Giardia lamblia
NEKNS

SEQ ID NO: 3124363 - protein, 9 aa, Giardia lamblia
NEKQSEVPD

SEQ ID NO: 3124364 - protein, 9 aa, Giardia lamblia
NEKQSYETM

SEQ ID NO: 3124365 - protein, 12 aa, Giardia lamblia
NEKQTVFSSATS

SEQ ID NO: 3124366 - protein, 4 aa, Giardia lamblia
NEKT

SEQ ID NO: 3124367 - protein, 8 aa, Giardia lamblia
NEKTPRAV

SEQ ID NO: 3124368 - protein, 5 aa, Giardia lamblia
NEKTS

SEQ ID NO: 3124369 - protein, 8 aa, Giardia lamblia
NEKTSTQL

SEQ ID NO: 3124370 - protein, 12 aa, Giardia lamblia
NEKWNENRRLGD

SEQ ID NO: 3124371 - protein, 19 aa, Giardia lamblia
NEKYGTSSMSLPDDSLSKS

SEQ ID NO: 3124372 - protein, 5 aa, Giardia lamblia
NELAG

SEQ ID NO: 3124373 - protein, 11 aa, Giardia lamblia
NELAQKSKEDA

SEQ ID NO: 3124374 - protein, 9 aa, Giardia lamblia
NELESRQAQ

SEQ ID NO: 3124375 - protein, 18 aa, Giardia lamblia
NELKTKRRSGAAALASSS

SEQ ID NO: 3124376 - protein, 8 aa, Giardia lamblia
NELPPDTK

SEQ ID NO: 3124377 - protein, 18 aa, Giardia lamblia
NELQNVASSTSPKVEATI

SEQ ID NO: 3124378 - protein, 8 aa, Giardia lamblia
NELQQTSN

SEQ ID NO: 3124379 - protein, 7 aa, Giardia lamblia
NEMSDAD

SEQ ID NO: 3124380 - protein, 4 aa, Giardia lamblia
NEMT

SEQ ID NO: 3124381 - protein, 10 aa, Giardia lamblia
NENDPEPFED

SEQ ID NO: 3124382 - protein, 6 aa, Giardia lamblia
NENKTL

SEQ ID NO: 3124383 - protein, 5 aa, Giardia lamblia
NENKY

SEQ ID NO: 3124384 - protein, 8 aa, Giardia lamblia
NENNQLRE

SEQ ID NO: 3124385 - protein, 6 aa, Giardia lamblia
NENPDI

SEQ ID NO: 3124386 - protein, 5 aa, Giardia lamblia
NENRK

SEQ ID NO: 3124387 - protein, 8 aa, Giardia lamblia
NENSGLGV

SEQ ID NO: 3124388 - protein, 12 aa, Giardia lamblia
NENSRMEGGGAL

SEQ ID NO: 3124389 - protein, 5 aa, Giardia lamblia
NEPAN

SEQ ID NO: 3124390 - protein, 8 aa, Giardia lamblia
NEPASEHI

SEQ ID NO: 3124391 - protein, 10 aa, Giardia lamblia
NEPDRDQDCP

SEQ ID NO: 3124392 - protein, 12 aa, Giardia lamblia
NEPGTGTDDYNA

SEQ ID NO: 3124393 - protein, 9 aa, Giardia lamblia
NEPQTTDVD

SEQ ID NO: 3124394 - protein, 20 aa, Giardia lamblia
NEPRCTSESNSVMSDAPSTH

SEQ ID NO: 3124395 - protein, 7 aa, Giardia lamblia
NEPSSDV

SEQ ID NO: 3124396 - protein, 14 aa, Giardia lamblia
NEPTRASKSLQSLS

SEQ ID NO: 3124397 - protein, 6 aa, Giardia lamblia
NEPVSS

SEQ ID NO: 3124398 - protein, 4 aa, Giardia lamblia
NEQE

SEQ ID NO: 3124399 - protein, 36 aa, Giardia lamblia
NEQEAQRSKADALDDERFNPYEGYERRGETEPSYAK

SEQ ID NO: 3124400 - protein, 5 aa, Giardia lamblia
NEQEL

SEQ ID NO: 3124401 - protein, 4 aa, Giardia lamblia
NEQF

SEQ ID NO: 3124402 - protein, 9 aa, Giardia lamblia
NEQGQEFSQ

SEQ ID NO: 3124403 - protein, 7 aa, Giardia lamblia
NEQHEPD

SEQ ID NO: 3124404 - protein, 12 aa, Giardia lamblia
NEQIESSSISQP

SEQ ID NO: 3124405 - protein, 4 aa, Giardia lamblia
NEQL

SEQ ID NO: 3124406 - protein, 4 aa, Giardia lamblia
NEQN

SEQ ID NO: 3124407 - protein, 9 aa, Giardia lamblia
NEQPTSDAV

SEQ ID NO: 3124408 - protein, 4 aa, Giardia lamblia
NEQQ

SEQ ID NO: 3124409 - protein, 6 aa, Giardia lamblia
NEQQEC

SEQ ID NO: 3124410 - protein, 4 aa, Giardia lamblia
NEQR

SEQ ID NO: 3124411 - protein, 4 aa, Giardia lamblia
NEQS

SEQ ID NO: 3124412 - protein, 8 aa, Giardia lamblia
NERAGDMP

SEQ ID NO: 3124413 - protein, 9 aa, Giardia lamblia
NERDALNTE

SEQ ID NO: 3124414 - protein, 11 aa, Giardia lamblia
NERDSDGGPWS

SEQ ID NO: 3124415 - protein, 6 aa, Giardia lamblia
NERGRT

SEQ ID NO: 3124416 - protein, 10 aa, Giardia lamblia
NERGVQDGLD

SEQ ID NO: 3124417 - protein, 4 aa, Giardia lamblia
NERI

SEQ ID NO: 3124418 - protein, 4 aa, Giardia lamblia
NERL

SEQ ID NO: 3124419 - protein, 14 aa, Giardia lamblia
NERLSRANTKLTDE

SEQ ID NO: 3124420 - protein, 4 aa, Giardia lamblia
NERN

SEQ ID NO: 3124421 - protein, 12 aa, Giardia lamblia
NERNARPSSTAV

SEQ ID NO: 3124422 - protein, 12 aa, Giardia lamblia
NERPRPKKQWYN

SEQ ID NO: 3124423 - protein, 4 aa, Giardia lamblia
NERR

SEQ ID NO: 3124424 - protein, 5 aa, Giardia lamblia
NERSQ

SEQ ID NO: 3124425 - protein, 4 aa, Giardia lamblia
NERT

SEQ ID NO: 3124426 - protein, 7 aa, Giardia lamblia
NERTRSK

SEQ ID NO: 3124427 - protein, 6 aa, Giardia lamblia
NERTTM

SEQ ID NO: 3124428 - protein, 5 aa, Giardia lamblia
NERVN

SEQ ID NO: 3124429 - protein, 7 aa, Giardia lamblia
NERYKSK

SEQ ID NO: 3124430 - protein, 7 aa, Giardia lamblia
NESADTT

SEQ ID NO: 3124431 - protein, 10 aa, Giardia lamblia
NESAHTPREL

SEQ ID NO: 3124432 - protein, 11 aa, Giardia lamblia
NESAQTNTNQR

SEQ ID NO: 3124433 - protein, 7 aa, Giardia lamblia
NESDAIP

SEQ ID NO: 3124434 - protein, 8 aa, Giardia lamblia
NESDDGNT

SEQ ID NO: 3124435 - protein, 5 aa, Giardia lamblia
NESDV

SEQ ID NO: 3124436 - protein, 13 aa, Giardia lamblia
NESEEELQNTTGV

SEQ ID NO: 3124437 - protein, 8 aa, Giardia lamblia
NESGLTSN

SEQ ID NO: 3124438 - protein, 19 aa, Giardia lamblia
NESGNPTPTKAPTGASPPQ

SEQ ID NO: 3124439 - protein, 8 aa, Giardia lamblia
NESGTSLT

SEQ ID NO: 3124440 - protein, 5 aa, Giardia lamblia
NESLG

SEQ ID NO: 3124441 - protein, 15 aa, Giardia lamblia
NESPNPEASDTHSSV

SEQ ID NO: 3124442 - protein, 6 aa, Giardia lamblia
NESPVT

SEQ ID NO: 3124443 - protein, 7 aa, Giardia lamblia
NESQKQR

SEQ ID NO: 3124444 - protein, 9 aa, Giardia lamblia
NESQLPQEL

SEQ ID NO: 3124445 - protein, 9 aa, Giardia lamblia
NESSPASDV

SEQ ID NO: 3124446 - protein, 4 aa, Giardia lamblia
NEST

SEQ ID NO: 3124447 - protein, 13 aa, Giardia lamblia
NESTIQDNNGNTA

SEQ ID NO: 3124448 - protein, 7 aa, Giardia lamblia
NESTPPI

SEQ ID NO: 3124449 - protein, 8 aa, Giardia lamblia
NESTTGTV

SEQ ID NO: 3124450 - protein, 5 aa, Giardia lamblia
NESVS

SEQ ID NO: 3124451 - protein, 5 aa, Giardia lamblia
NESYQ

SEQ ID NO: 3124452 - protein, 9 aa, Giardia lamblia
NETDKQGYT

SEQ ID NO: 3124453 - protein, 5 aa, Giardia lamblia
NETGK

SEQ ID NO: 3124454 - protein, 12 aa, Giardia lamblia
NETGRPQSMDDH

SEQ ID NO: 3124455 - protein, 6 aa, Giardia lamblia
NETGTR

SEQ ID NO: 3124456 - protein, 11 aa, Giardia lamblia
NETHGSSELSP

SEQ ID NO: 3124457 - protein, 22 aa, Giardia lamblia
NETNSSQHKSHSGPTQDYGSSI

SEQ ID NO: 3124458 - protein, 8 aa, Giardia lamblia
NETQKRDA

SEQ ID NO: 3124459 - protein, 7 aa, Giardia lamblia
NETQQRA

SEQ ID NO: 3124460 - protein, 8 aa, Giardia lamblia
NETREEAS

SEQ ID NO: 3124461 - protein, 6 aa, Giardia lamblia
NETSEE

SEQ ID NO: 3124462 - protein, 30 aa, Giardia lamblia
NETSKAPNTIEQHTSSHITKAQEDNGTLGS

SEQ ID NO: 3124463 - protein, 5 aa, Giardia lamblia
NETSN

SEQ ID NO: 3124464 - protein, 16 aa, Giardia lamblia
NETSNLKTQDLSENAH

SEQ ID NO: 3124465 - protein, 8 aa, Giardia lamblia
NETSPASD

SEQ ID NO: 3124466 - protein, 16 aa, Giardia lamblia
NETTGDIEDTTGRTIG

SEQ ID NO: 3124467 - protein, 11 aa, Giardia lamblia
NETTSQGREKE

SEQ ID NO: 3124468 - protein, 4 aa, Giardia lamblia
NEVE

SEQ ID NO: 3124469 - protein, 6 aa, Giardia lamblia
NEVEYN

SEQ ID NO: 3124470 - protein, 34 aa, Giardia lamblia
NEVKGEARRNELEAADRSVEPSQPLTQNSPAFTT

SEQ ID NO: 3124471 - protein, 17 aa, Giardia lamblia
NEVNRQRAKDDAERRAS

SEQ ID NO: 3124472 - protein, 5 aa, Giardia lamblia
NEVNS

SEQ ID NO: 3124473 - protein, 18 aa, Giardia lamblia
NEVSDTQDHVPSYKDPVG

SEQ ID NO: 3124474 - protein, 6 aa, Giardia lamblia
NEVSKV

SEQ ID NO: 3124475 - protein, 4 aa, Giardia lamblia
NEWS

SEQ ID NO: 3124476 - protein, 8 aa, Giardia lamblia
NEYAESLR

SEQ ID NO: 3124477 - protein, 12 aa, Giardia lamblia
NEYDRPDDYKEQ

SEQ ID NO: 3124478 - protein, 7 aa, Giardia lamblia
NEYGNTP

SEQ ID NO: 3124479 - protein, 7 aa, Giardia lamblia
NEYKENM

SEQ ID NO: 3124480 - protein, 7 aa, Giardia lamblia
NEYPATA

SEQ ID NO: 3124481 - protein, 7 aa, Giardia lamblia
NEYSPAH

SEQ ID NO: 3124482 - protein, 8 aa, Giardia lamblia
NEYTEKAN

SEQ ID NO: 3124483 - protein, 13 aa, Giardia lamblia
NFAPNHKKHRSME

SEQ ID NO: 3124484 - protein, 8 aa, Giardia lamblia
NFDSKSGI

SEQ ID NO: 3124485 - protein, 12 aa, Giardia lamblia
NFEQTKQDMETK

SEQ ID NO: 3124486 - protein, 6 aa, Giardia lamblia
NFGPNT

SEQ ID NO: 3124487 - protein, 7 aa, Giardia lamblia
NFGPQDR

SEQ ID NO: 3124488 - protein, 7 aa, Giardia lamblia
NFKQPES

SEQ ID NO: 3124489 - protein, 5 aa, Giardia lamblia
NFNGE

SEQ ID NO: 3124490 - protein, 7 aa, Giardia lamblia
NFPAGGG

SEQ ID NO: 3124491 - protein, 12 aa, Giardia lamblia
NFPDEGSLHTDD

SEQ ID NO: 3124492 - protein, 36 aa, Giardia lamblia
NFPKQSSTKELPYTNTNVRQGCNSRQQTATAQPNRL

SEQ ID NO: 3124493 - protein, 4 aa, Giardia lamblia
NFPS

SEQ ID NO: 3124494 - protein, 9 aa, Giardia lamblia
NFPTGGSMN

SEQ ID NO: 3124495 - protein, 8 aa, Giardia lamblia
NFQSESNK

SEQ ID NO: 3124496 - protein, 5 aa, Giardia lamblia
NFREE

SEQ ID NO: 3124497 - protein, 7 aa, Giardia lamblia
NFSGGQV

SEQ ID NO: 3124498 - protein, 6 aa, Giardia lamblia
NFSHRA

SEQ ID NO: 3124499 - protein, 30 aa, Giardia lamblia
NFSSDTPEESDTQSGTEGNEHSEEDDTREH

SEQ ID NO: 3124500 - protein, 4 aa, Giardia lamblia
NFTD

SEQ ID NO: 3124501 - protein, 12 aa, Giardia lamblia
NFTEDSKSHYKG

SEQ ID NO: 3124502 - protein, 5 aa, Giardia lamblia
NFTRT

SEQ ID NO: 3124503 - protein, 14 aa, Giardia lamblia
NFTSSQAGQPRYSE

SEQ ID NO: 3124504 - protein, 24 aa, Giardia lamblia
NGADDDRRGSIGDDLEADGYNPHV

SEQ ID NO: 3124505 - protein, 6 aa, Giardia lamblia
NGAELS

SEQ ID NO: 3124506 - protein, 17 aa, Giardia lamblia
NGAIEKSKQAAKDPGSL

SEQ ID NO: 3124507 - protein, 7 aa, Giardia lamblia
NGAITKQ

SEQ ID NO: 3124508 - protein, 6 aa, Giardia lamblia
NGAKQI

SEQ ID NO: 3124509 - protein, 14 aa, Giardia lamblia
NGALSGSLKPADIK

SEQ ID NO: 3124510 - protein, 7 aa, Giardia lamblia
NGANCGS

SEQ ID NO: 3124511 - protein, 6 aa, Giardia lamblia
NGANNR

SEQ ID NO: 3124512 - protein, 7 aa, Giardia lamblia
NGANTRG

SEQ ID NO: 3124513 - protein, 4 aa, Giardia lamblia
NGAP

SEQ ID NO: 3124514 - protein, 9 aa, Giardia lamblia
NGAPASQGV

SEQ ID NO: 3124515 - protein, 9 aa, Giardia lamblia
NGAPYSTGL

SEQ ID NO: 3124516 - protein, 18 aa, Giardia lamblia
NGAQRQPDDQGPREDYDG

SEQ ID NO: 3124517 - protein, 8 aa, Giardia lamblia
NGARDSLP

SEQ ID NO: 3124518 - protein, 8 aa, Giardia lamblia
NGASIPSD

SEQ ID NO: 3124519 - protein, 5 aa, Giardia lamblia
NGASP

SEQ ID NO: 3124520 - protein, 5 aa, Giardia lamblia
NGASR

SEQ ID NO: 3124521 - protein, 6 aa, Giardia lamblia
NGASSA

SEQ ID NO: 3124522 - protein, 26 aa, Giardia lamblia
NGASSSQSSKRHTEAHTLPSKPANES

SEQ ID NO: 3124523 - protein, 10 aa, Giardia lamblia
NGASTGPFSP

SEQ ID NO: 3124524 - protein, 7 aa, Giardia lamblia
NGATARG

SEQ ID NO: 3124525 - protein, 6 aa, Giardia lamblia
NGATIT

SEQ ID NO: 3124526 - protein, 8 aa, Giardia lamblia
NGAWTGET

SEQ ID NO: 3124527 - protein, 8 aa, Giardia lamblia
NGAYPTSN

SEQ ID NO: 3124528 - protein, 19 aa, Giardia lamblia
NGCDEPCDKNGGVRNLNPA

SEQ ID NO: 3124529 - protein, 13 aa, Giardia lamblia
NGCPNPQSQSSID

SEQ ID NO: 3124530 - protein, 4 aa, Giardia lamblia
NGCT

SEQ ID NO: 3124531 - protein, 6 aa, Giardia lamblia
NGCTTK

SEQ ID NO: 3124532 - protein, 8 aa, Giardia lamblia
NGDANQVK

SEQ ID NO: 3124533 - protein, 5 aa, Giardia lamblia
NGDAR

SEQ ID NO: 3124534 - protein, 4 aa, Giardia lamblia
NGDE

SEQ ID NO: 3124535 - protein, 9 aa, Giardia lamblia
NGDEVADPT

SEQ ID NO: 3124536 - protein, 9 aa, Giardia lamblia
NGDGNITTA

SEQ ID NO: 3124537 - protein, 6 aa, Giardia lamblia
NGDGYV

SEQ ID NO: 3124538 - protein, 7 aa, Giardia lamblia
NGDNDQF

SEQ ID NO: 3124539 - protein, 8 aa, Giardia lamblia
NGDNPDHE

SEQ ID NO: 3124540 - protein, 8 aa, Giardia lamblia
NGDQYIPS

SEQ ID NO: 3124541 - protein, 6 aa, Giardia lamblia
NGDREK

SEQ ID NO: 3124542 - protein, 23 aa, Giardia lamblia
NGDSHDPSSSTGLSAERKKAKTL

SEQ ID NO: 3124543 - protein, 5 aa, Giardia lamblia
NGDSR

SEQ ID NO: 3124544 - protein, 5 aa, Giardia lamblia
NGDTA

SEQ ID NO: 3124545 - protein, 6 aa, Giardia lamblia
NGDTAL

SEQ ID NO: 3124546 - protein, 5 aa, Giardia lamblia
NGDTD

SEQ ID NO: 3124547 - protein, 5 aa, Giardia lamblia
NGEAK

SEQ ID NO: 3124548 - protein, 25 aa, Giardia lamblia
NGEGYTRRQRGAKKSRAVTSDDPIP

SEQ ID NO: 3124549 - protein, 5 aa, Giardia lamblia
NGEKD

SEQ ID NO: 3124550 - protein, 13 aa, Giardia lamblia
NGELETSASPLGG

SEQ ID NO: 3124551 - protein, 15 aa, Giardia lamblia
NGELSRAKAGQARLQ

SEQ ID NO: 3124552 - protein, 11 aa, Giardia lamblia
NGELSSGTNEI

SEQ ID NO: 3124553 - protein, 7 aa, Giardia lamblia
NGENSLV

SEQ ID NO: 3124554 - protein, 6 aa, Giardia lamblia
NGEPKQ

SEQ ID NO: 3124555 - protein, 41 aa, Giardia lamblia
NGERKKKSLVEDTETPEEANEEDEGRKKRKRKVKPEPPTEH

SEQ ID NO: 3124556 - protein, 15 aa, Giardia lamblia
NGERLEETKKINSSL

SEQ ID NO: 3124557 - protein, 4 aa, Giardia lamblia
NGES

SEQ ID NO: 3124558 - protein, 9 aa, Giardia lamblia
NGESFSGGE

SEQ ID NO: 3124559 - protein, 10 aa, Giardia lamblia
NGESKSVTDS

SEQ ID NO: 3124560 - protein, 5 aa, Giardia lamblia
NGEVD

SEQ ID NO: 3124561 - protein, 14 aa, Giardia lamblia
NGEVHTDGNSGQAS

SEQ ID NO: 3124562 - protein, 4 aa, Giardia lamblia
NGFS

SEQ ID NO: 3124563 - protein, 4 aa, Giardia lamblia
NGFT

SEQ ID NO: 3124564 - protein, 6 aa, Giardia lamblia
NGGDPS

SEQ ID NO: 3124565 - protein, 14 aa, Giardia lamblia
NGGGGGYAVCLRRI

SEQ ID NO: 3124566 - protein, 16 aa, Giardia lamblia
NGGGGPGGTCSATSKA

SEQ ID NO: 3124567 - protein, 6 aa, Giardia lamblia
NGGKDN

SEQ ID NO: 3124568 - protein, 4 aa, Giardia lamblia
NGGL

SEQ ID NO: 3124569 - protein, 5 aa, Giardia lamblia
NGGNM

SEQ ID NO: 3124570 - protein, 8 aa, Giardia lamblia
NGGPEPSN

SEQ ID NO: 3124571 - protein, 7 aa, Giardia lamblia
NGGQAHR

SEQ ID NO: 3124572 - protein, 24 aa, Giardia lamblia
NGGQGQAPMTISSSSGGPYSYSSA

SEQ ID NO: 3124573 - protein, 11 aa, Giardia lamblia
NGGSRRESDAS

SEQ ID NO: 3124574 - protein, 5 aa, Giardia lamblia
NGGTL

SEQ ID NO: 3124575 - protein, 8 aa, Giardia lamblia
NGGYDGEE

SEQ ID NO: 3124576 - protein, 16 aa, Giardia lamblia
NGGYQPPAANQKLSAA

SEQ ID NO: 3124577 - protein, 5 aa, Giardia lamblia
NGHAD

SEQ ID NO: 3124578 - protein, 4 aa, Giardia lamblia
NGHD

SEQ ID NO: 3124579 - protein, 4 aa, Giardia lamblia
NGHE

SEQ ID NO: 3124580 - protein, 4 aa, Giardia lamblia
NGHL

SEQ ID NO: 3124581 - protein, 7 aa, Giardia lamblia
NGHPANA

SEQ ID NO: 3124582 - protein, 6 aa, Giardia lamblia
NGHPGA

SEQ ID NO: 3124583 - protein, 16 aa, Giardia lamblia
NGHRSNEEKALEEVER

SEQ ID NO: 3124584 - protein, 4 aa, Giardia lamblia
NGHS

SEQ ID NO: 3124585 - protein, 5 aa, Giardia lamblia
NGHSD

SEQ ID NO: 3124586 - protein, 5 aa, Giardia lamblia
NGHTA

SEQ ID NO: 3124587 - protein, 5 aa, Giardia lamblia
NGHTD

SEQ ID NO: 3124588 - protein, 6 aa, Giardia lamblia
NGHTEA

SEQ ID NO: 3124589 - protein, 8 aa, Giardia lamblia
NGIARQSD

SEQ ID NO: 3124590 - protein, 22 aa, Giardia lamblia
NGIDTPVEQASAPPVSPTKTIS

SEQ ID NO: 3124591 - protein, 8 aa, Giardia lamblia
NGIGKSTA

SEQ ID NO: 3124592 - protein, 11 aa, Giardia lamblia
NGIGSSSDKAL

SEQ ID NO: 3124593 - protein, 12 aa, Giardia lamblia
NGISTDGGDIDS

SEQ ID NO: 3124594 - protein, 9 aa, Giardia lamblia
NGKAVKMPS

SEQ ID NO: 3124595 - protein, 4 aa, Giardia lamblia
NGKD

SEQ ID NO: 3124596 - protein, 9 aa, Giardia lamblia
NGKDPMSKR

SEQ ID NO: 3124597 - protein, 8 aa, Giardia lamblia
NGKEISTK

SEQ ID NO: 3124598 - protein, 5 aa, Giardia lamblia
NGKHS

SEQ ID NO: 3124599 - protein, 6 aa, Giardia lamblia
NGKNAI

SEQ ID NO: 3124600 - protein, 9 aa, Giardia lamblia
NGKNNEADH

SEQ ID NO: 3124601 - protein, 5 aa, Giardia lamblia
NGKPN

SEQ ID NO: 3124602 - protein, 9 aa, Giardia lamblia
NGKRAGADH

SEQ ID NO: 3124603 - protein, 5 aa, Giardia lamblia
NGKRL

SEQ ID NO: 3124604 - protein, 13 aa, Giardia lamblia
NGKRRAHLNPNGF

SEQ ID NO: 3124605 - protein, 10 aa, Giardia lamblia
NGKSSIVEGQ

SEQ ID NO: 3124606 - protein, 7 aa, Giardia lamblia
NGKTAEV

SEQ ID NO: 3124607 - protein, 8 aa, Giardia lamblia
NGLKPNDT

SEQ ID NO: 3124608 - protein, 11 aa, Giardia lamblia
NGLKSTEASSL

SEQ ID NO: 3124609 - protein, 9 aa, Giardia lamblia
NGLPPDTSG

SEQ ID NO: 3124610 - protein, 9 aa, Giardia lamblia
NGLQSNNGM

SEQ ID NO: 3124611 - protein, 19 aa, Giardia lamblia
NGLQTDSHHESQDSPKVRV

SEQ ID NO: 3124612 - protein, 4 aa, Giardia lamblia
NGLR

SEQ ID NO: 3124613 - protein, 9 aa, Giardia lamblia
NGLRNGNGT

SEQ ID NO: 3124614 - protein, 7 aa, Giardia lamblia
NGLTDAE

SEQ ID NO: 3124615 - protein, 13 aa, Giardia lamblia
NGMKATKRSLPSF

SEQ ID NO: 3124616 - protein, 9 aa, Giardia lamblia
NGMKSSTEL

SEQ ID NO: 3124617 - protein, 4 aa, Giardia lamblia
NGMQ

SEQ ID NO: 3124618 - protein, 5 aa, Giardia lamblia
NGMTG

SEQ ID NO: 3124619 - protein, 5 aa, Giardia lamblia
NGNAS

SEQ ID NO: 3124620 - protein, 5 aa, Giardia lamblia
NGNAY

SEQ ID NO: 3124621 - protein, 10 aa, Giardia lamblia
NGNESISRSV

SEQ ID NO: 3124622 - protein, 5 aa, Giardia lamblia
NGNHG

SEQ ID NO: 3124623 - protein, 4 aa, Giardia lamblia
NGNI

SEQ ID NO: 3124624 - protein, 5 aa, Giardia lamblia
NGNIV

SEQ ID NO: 3124625 - protein, 5 aa, Giardia lamblia
NGNLD

SEQ ID NO: 3124626 - protein, 7 aa, Giardia lamblia
NGNLTEA

SEQ ID NO: 3124627 - protein, 5 aa, Giardia lamblia
NGNPE

SEQ ID NO: 3124628 - protein, 6 aa, Giardia lamblia
NGNPTV

SEQ ID NO: 3124629 - protein, 9 aa, Giardia lamblia
NGNRYPGAV

SEQ ID NO: 3124630 - protein, 8 aa, Giardia lamblia
NGNSCTDT

SEQ ID NO: 3124631 - protein, 8 aa, Giardia lamblia
NGNTSVKH

SEQ ID NO: 3124632 - protein, 4 aa, Giardia lamblia
NGNV

SEQ ID NO: 3124633 - protein, 18 aa, Giardia lamblia
NGPANAGSEANPSKGGME

SEQ ID NO: 3124634 - protein, 14 aa, Giardia lamblia
NGPEAQDAGTADDE

SEQ ID NO: 3124635 - protein, 8 aa, Giardia lamblia
NGPEPAEN

SEQ ID NO: 3124636 - protein, 7 aa, Giardia lamblia
NGPKGLM

SEQ ID NO: 3124637 - protein, 9 aa, Giardia lamblia
NGPTVTQDV

SEQ ID NO: 3124638 - protein, 19 aa, Giardia lamblia
NGPVSQQEVDKRTPPRTVR

SEQ ID NO: 3124639 - protein, 14 aa, Giardia lamblia
NGQARTSAQARQVE

SEQ ID NO: 3124640 - protein, 4 aa, Giardia lamblia
NGQD

SEQ ID NO: 3124641 - protein, 8 aa, Giardia lamblia
NGQEKAAQ

SEQ ID NO: 3124642 - protein, 9 aa, Giardia lamblia
NGQKTHGSS

SEQ ID NO: 3124643 - protein, 8 aa, Giardia lamblia
NGQNKTAC

SEQ ID NO: 3124644 - protein, 21 aa, Giardia lamblia
NGQRATSRPPLQRTYGEEPQA

SEQ ID NO: 3124645 - protein, 4 aa, Giardia lamblia
NGQT

SEQ ID NO: 3124646 - protein, 4 aa, Giardia lamblia
NGQV

SEQ ID NO: 3124647 - protein, 7 aa, Giardia lamblia
NGRAETF

SEQ ID NO: 3124648 - protein, 8 aa, Giardia lamblia
NGRAGLDK

SEQ ID NO: 3124649 - protein, 7 aa, Giardia lamblia
NGRAPTA

SEQ ID NO: 3124650 - protein, 10 aa, Giardia lamblia
NGRDSADASI

SEQ ID NO: 3124651 - protein, 5 aa, Giardia lamblia
NGRDV

SEQ ID NO: 3124652 - protein, 4 aa, Giardia lamblia
NGRE

SEQ ID NO: 3124653 - protein, 5 aa, Giardia lamblia
NGREK

SEQ ID NO: 3124654 - protein, 5 aa, Giardia lamblia
NGRKS

SEQ ID NO: 3124655 - protein, 4 aa, Giardia lamblia
NGRL

SEQ ID NO: 3124656 - protein, 10 aa, Giardia lamblia
NGRQIGGGGL

SEQ ID NO: 3124657 - protein, 26 aa, Giardia lamblia
NGRSTKETPWEEDNDQVGCNSDGSIA

SEQ ID NO: 3124658 - protein, 4 aa, Giardia lamblia
NGRT

SEQ ID NO: 3124659 - protein, 6 aa, Giardia lamblia
NGRTGK

SEQ ID NO: 3124660 - protein, 4 aa, Giardia lamblia
NGRV

SEQ ID NO: 3124661 - protein, 9 aa, Giardia lamblia
NGRVYGSEA

SEQ ID NO: 3124662 - protein, 4 aa, Giardia lamblia
NGSA

SEQ ID NO: 3124663 - protein, 8 aa, Giardia lamblia
NGSEETNI

SEQ ID NO: 3124664 - protein, 7 aa, Giardia lamblia
NGSFNTR

SEQ ID NO: 3124665 - protein, 4 aa, Giardia lamblia
NGSI

SEQ ID NO: 3124666 - protein, 13 aa, Giardia lamblia
NGSIANSISGGNR

SEQ ID NO: 3124667 - protein, 5 aa, Giardia lamblia
NGSIN

SEQ ID NO: 3124668 - protein, 13 aa, Giardia lamblia
NGSISGAEAGCQA

SEQ ID NO: 3124669 - protein, 4 aa, Giardia lamblia
NGSL

SEQ ID NO: 3124670 - protein, 6 aa, Giardia lamblia
NGSLSA

SEQ ID NO: 3124671 - protein, 11 aa, Giardia lamblia
NGSMDASLGPG

SEQ ID NO: 3124672 - protein, 6 aa, Giardia lamblia
NGSNVR

SEQ ID NO: 3124673 - protein, 10 aa, Giardia lamblia
NGSPGPLPPN

SEQ ID NO: 3124674 - protein, 10 aa, Giardia lamblia
NGSPNLDGES

SEQ ID NO: 3124675 - protein, 5 aa, Giardia lamblia
NGSPQ

SEQ ID NO: 3124676 - protein, 8 aa, Giardia lamblia
NGSQGNNS

SEQ ID NO: 3124677 - protein, 25 aa, Giardia lamblia
NGSREGFSGNNRGGCKPHKMLLVNG

SEQ ID NO: 3124678 - protein, 7 aa, Giardia lamblia
NGSSPLD

SEQ ID NO: 3124679 - protein, 11 aa, Giardia lamblia
NGSSSRPDTAK

SEQ ID NO: 3124680 - protein, 10 aa, Giardia lamblia
NGSSVKSTLG

SEQ ID NO: 3124681 - protein, 5 aa, Giardia lamblia
NGSTR

SEQ ID NO: 3124682 - protein, 11 aa, Giardia lamblia
NGTDGPKPASI

SEQ ID NO: 3124683 - protein, 8 aa, Giardia lamblia
NGTDSKLM

SEQ ID NO: 3124684 - protein, 7 aa, Giardia lamblia
NGTEATV

SEQ ID NO: 3124685 - protein, 5 aa, Giardia lamblia
NGTGN

SEQ ID NO: 3124686 - protein, 6 aa, Giardia lamblia
NGTINP

SEQ ID NO: 3124687 - protein, 5 aa, Giardia lamblia
NGTIT

SEQ ID NO: 3124688 - protein, 20 aa, Giardia lamblia
NGTKSSDTPMPIENPSDTIG

SEQ ID NO: 3124689 - protein, 5 aa, Giardia lamblia
NGTNF

SEQ ID NO: 3124690 - protein, 6 aa, Giardia lamblia
NGTNTY

SEQ ID NO: 3124691 - protein, 5 aa, Giardia lamblia
NGTPE

SEQ ID NO: 3124692 - protein, 10 aa, Giardia lamblia
NGTPLQQPHS

SEQ ID NO: 3124693 - protein, 11 aa, Giardia lamblia
NGTPPVPGSSS

SEQ ID NO: 3124694 - protein, 6 aa, Giardia lamblia
NGTRTQ

SEQ ID NO: 3124695 - protein, 6 aa, Giardia lamblia
NGTSNM

SEQ ID NO: 3124696 - protein, 5 aa, Giardia lamblia
NGTST

SEQ ID NO: 3124697 - protein, 4 aa, Giardia lamblia
NGTT

SEQ ID NO: 3124698 - protein, 4 aa, Giardia lamblia
NGTV

SEQ ID NO: 3124699 - protein, 9 aa, Giardia lamblia
NGTVAEGSE

SEQ ID NO: 3124700 - protein, 5 aa, Giardia lamblia
NGTVN

SEQ ID NO: 3124701 - protein, 10 aa, Giardia lamblia
NGTYDQQAQD

SEQ ID NO: 3124702 - protein, 12 aa, Giardia lamblia
NGVGGKTADAIK

SEQ ID NO: 3124703 - protein, 14 aa, Giardia lamblia
NGVGGSSSSSASVA

SEQ ID NO: 3124704 - protein, 9 aa, Giardia lamblia
NGVKRDTYQ

SEQ ID NO: 3124705 - protein, 5 aa, Giardia lamblia
NGVSS

SEQ ID NO: 3124706 - protein, 5 aa, Giardia lamblia
NGVTD

SEQ ID NO: 3124707 - protein, 5 aa, Giardia lamblia
NGVTP

SEQ ID NO: 3124708 - protein, 8 aa, Giardia lamblia
NGWRPKDN

SEQ ID NO: 3124709 - protein, 20 aa, Giardia lamblia
NGYDQPVSDSDDSQPPEYEI

SEQ ID NO: 3124710 - protein, 4 aa, Giardia lamblia
NGYE

SEQ ID NO: 3124711 - protein, 4 aa, Giardia lamblia
NGYS

SEQ ID NO: 3124712 - protein, 5 aa, Giardia lamblia
NGYSE

SEQ ID NO: 3124713 - protein, 11 aa, Giardia lamblia
NGYSGSKGSKP

SEQ ID NO: 3124714 - protein, 5 aa, Giardia lamblia
NGYSN

SEQ ID NO: 3124715 - protein, 11 aa, Giardia lamblia
NGYSPGPDSRL

SEQ ID NO: 3124716 - protein, 7 aa, Giardia lamblia
NGYSSPK

SEQ ID NO: 3124717 - protein, 4 aa, Giardia lamblia
NGYT

SEQ ID NO: 3124718 - protein, 8 aa, Giardia lamblia
NHAPTSAN

SEQ ID NO: 3124719 - protein, 8 aa, Giardia lamblia
NHCPNKSE

SEQ ID NO: 3124720 - protein, 9 aa, Giardia lamblia
NHDESPDAY

SEQ ID NO: 3124721 - protein, 9 aa, Giardia lamblia
NHDPGKSYP

SEQ ID NO: 3124722 - protein, 7 aa, Giardia lamblia
NHDPKNA

SEQ ID NO: 3124723 - protein, 5 aa, Giardia lamblia
NHDQK

SEQ ID NO: 3124724 - protein, 10 aa, Giardia lamblia
NHDTATCTTR

SEQ ID NO: 3124725 - protein, 6 aa, Giardia lamblia
NHEDEK

SEQ ID NO: 3124726 - protein, 5 aa, Giardia lamblia
NHEGH

SEQ ID NO: 3124727 - protein, 10 aa, Giardia lamblia
NHENSEDTSV

SEQ ID NO: 3124728 - protein, 7 aa, Giardia lamblia
NHESRQI

SEQ ID NO: 3124729 - protein, 16 aa, Giardia lamblia
NHETESVNSNYSLPAE

SEQ ID NO: 3124730 - protein, 33 aa, Giardia lamblia
NHETKEHDSVQSQGPVAEDKSVDVEGGEEPLRK

SEQ ID NO: 3124731 - protein, 5 aa, Giardia lamblia
NHFEH

SEQ ID NO: 3124732 - protein, 8 aa, Giardia lamblia
NHFGQNGG

SEQ ID NO: 3124733 - protein, 11 aa, Giardia lamblia
NHGCGYQGGPC

SEQ ID NO: 3124734 - protein, 6 aa, Giardia lamblia
NHGRSR

SEQ ID NO: 3124735 - protein, 5 aa, Giardia lamblia
NHGTT

SEQ ID NO: 3124736 - protein, 8 aa, Giardia lamblia
NHHPEKNN

SEQ ID NO: 3124737 - protein, 7 aa, Giardia lamblia
NHINGGE

SEQ ID NO: 3124738 - protein, 7 aa, Giardia lamblia
NHKATSA

SEQ ID NO: 3124739 - protein, 36 aa, Giardia lamblia
NHKTEDDSSDSNDDDDGSSIGSDEPQHGKHSKHSKD

SEQ ID NO: 3124740 - protein, 17 aa, Giardia lamblia
NHLTDKSLSDLKSTSLR

SEQ ID NO: 3124741 - protein, 7 aa, Giardia lamblia
NHNPGTI

SEQ ID NO: 3124742 - protein, 5 aa, Giardia lamblia
NHNTA

SEQ ID NO: 3124743 - protein, 9 aa, Giardia lamblia
NHPEAGIDT

SEQ ID NO: 3124744 - protein, 18 aa, Giardia lamblia
NHPEAYSSVKQANESSKK

SEQ ID NO: 3124745 - protein, 6 aa, Giardia lamblia
NHPEEY

SEQ ID NO: 3124746 - protein, 20 aa, Giardia lamblia
NHPHKKQSKQSHGARAQTSY

SEQ ID NO: 3124747 - protein, 9 aa, Giardia lamblia
NHPQRGPFH

SEQ ID NO: 3124748 - protein, 6 aa, Giardia lamblia
NHQSSS

SEQ ID NO: 3124749 - protein, 6 aa, Giardia lamblia
NHREVS

SEQ ID NO: 3124750 - protein, 10 aa, Giardia lamblia
NHRKEEDTRQ

SEQ ID NO: 3124751 - protein, 5 aa, Giardia lamblia
NHSGF

SEQ ID NO: 3124752 - protein, 8 aa, Giardia lamblia
NHSGQEIS

SEQ ID NO: 3124753 - protein, 8 aa, Giardia lamblia
NHSITNPV

SEQ ID NO: 3124754 - protein, 4 aa, Giardia lamblia
NHSN

SEQ ID NO: 3124755 - protein, 12 aa, Giardia lamblia
NHSPADSAAELE

SEQ ID NO: 3124756 - protein, 9 aa, Giardia lamblia
NHSPTPDMV

SEQ ID NO: 3124757 - protein, 9 aa, Giardia lamblia
NHTGKINPQ

SEQ ID NO: 3124758 - protein, 12 aa, Giardia lamblia
NHTGRNLRGRRS

SEQ ID NO: 3124759 - protein, 18 aa, Giardia lamblia
NHTSQPRSSTIPKTTGSQ

SEQ ID NO: 3124760 - protein, 8 aa, Giardia lamblia
NHYPPTEL

SEQ ID NO: 3124761 - protein, 8 aa, Giardia lamblia
NHYTGGHA

SEQ ID NO: 3124762 - protein, 10 aa, Giardia lamblia
NIAPSQAGID

SEQ ID NO: 3124763 - protein, 10 aa, Giardia lamblia
NIATEDDRKR

SEQ ID NO: 3124764 - protein, 5 aa, Giardia lamblia
NICPS

SEQ ID NO: 3124765 - protein, 7 aa, Giardia lamblia
NIDNTER

SEQ ID NO: 3124766 - protein, 8 aa, Giardia lamblia
NIDSSYYN

SEQ ID NO: 3124767 - protein, 5 aa, Giardia lamblia
NIGEE

SEQ ID NO: 3124768 - protein, 7 aa, Giardia lamblia
NIGETQT

SEQ ID NO: 3124769 - protein, 5 aa, Giardia lamblia
NIGNY

SEQ ID NO: 3124770 - protein, 6 aa, Giardia lamblia
NIGPGA

SEQ ID NO: 3124771 - protein, 4 aa, Giardia lamblia
NIGT

SEQ ID NO: 3124772 - protein, 7 aa, Giardia lamblia
NIHTPHD

SEQ ID NO: 3124773 - protein, 18 aa, Giardia lamblia
NIKAPAQQDYASLDPATA

SEQ ID NO: 3124774 - protein, 9 aa, Giardia lamblia
NIKEDDMKN

SEQ ID NO: 3124775 - protein, 5 aa, Giardia lamblia
NIKEP

SEQ ID NO: 3124776 - protein, 9 aa, Giardia lamblia
NIKLPNGDT

SEQ ID NO: 3124777 - protein, 4 aa, Giardia lamblia
NIKP

SEQ ID NO: 3124778 - protein, 7 aa, Giardia lamblia
NIKPKTL

SEQ ID NO: 3124779 - protein, 4 aa, Giardia lamblia
NINK

SEQ ID NO: 3124780 - protein, 13 aa, Giardia lamblia
NIPARSADSRPTI

SEQ ID NO: 3124781 - protein, 12 aa, Giardia lamblia
NIPATNKAVSRQ

SEQ ID NO: 3124782 - protein, 7 aa, Giardia lamblia
NIPDQFT

SEQ ID NO: 3124783 - protein, 19 aa, Giardia lamblia
NIPGPTPSNPSVTQQSEQQ

SEQ ID NO: 3124784 - protein, 9 aa, Giardia lamblia
NIPGYNAKA

SEQ ID NO: 3124785 - protein, 6 aa, Giardia lamblia
NIPKTD

SEQ ID NO: 3124786 - protein, 11 aa, Giardia lamblia
NIPSTEESQEQ

SEQ ID NO: 3124787 - protein, 7 aa, Giardia lamblia
NIPSTTL

SEQ ID NO: 3124788 - protein, 7 aa, Giardia lamblia
NIPTADN

SEQ ID NO: 3124789 - protein, 10 aa, Giardia lamblia
NIPTDSRPDT

SEQ ID NO: 3124790 - protein, 4 aa, Giardia lamblia
NIPV

SEQ ID NO: 3124791 - protein, 7 aa, Giardia lamblia
NIQPGSR

SEQ ID NO: 3124792 - protein, 5 aa, Giardia lamblia
NIQPS

SEQ ID NO: 3124793 - protein, 12 aa, Giardia lamblia
NIQRRQAIPEAE

SEQ ID NO: 3124794 - protein, 9 aa, Giardia lamblia
NIRASSPSH

SEQ ID NO: 3124795 - protein, 5 aa, Giardia lamblia
NIRDG

SEQ ID NO: 3124796 - protein, 12 aa, Giardia lamblia
NIRSRSPSTQLA

SEQ ID NO: 3124797 - protein, 16 aa, Giardia lamblia
NIRTRKTELEQSKRAS

SEQ ID NO: 3124798 - protein, 13 aa, Giardia lamblia
NISAENPQTTEYK

SEQ ID NO: 3124799 - protein, 13 aa, Giardia lamblia
NISKEQRKKLETY

SEQ ID NO: 3124800 - protein, 6 aa, Giardia lamblia
NISPGD

SEQ ID NO: 3124801 - protein, 13 aa, Giardia lamblia
NISPSKKCNSTDP

SEQ ID NO: 3124802 - protein, 5 aa, Giardia lamblia
NITDD

SEQ ID NO: 3124803 - protein, 5 aa, Giardia lamblia
NITEA

SEQ ID NO: 3124804 - protein, 15 aa, Giardia lamblia
NITESGTSRKGPRTE

SEQ ID NO: 3124805 - protein, 9 aa, Giardia lamblia
NITPPISNS

SEQ ID NO: 3124806 - protein, 8 aa, Giardia lamblia
NITPPTAP

SEQ ID NO: 3124807 - protein, 8 aa, Giardia lamblia
NITQRDEQ

SEQ ID NO: 3124808 - protein, 26 aa, Giardia lamblia
NITSNDNITENRAPQPLTSDMSSASS

SEQ ID NO: 3124809 - protein, 17 aa, Giardia lamblia
NITSNRDKETAPPELPG

SEQ ID NO: 3124810 - protein, 14 aa, Giardia lamblia
NITSTPGKAPTSIP

SEQ ID NO: 3124811 - protein, 17 aa, Giardia lamblia
NITTPRRLSSGGLSENK

SEQ ID NO: 3124812 - protein, 23 aa, Giardia lamblia
NIYGPDDVKSAALTANNSGYPDM

SEQ ID NO: 3124813 - protein, 16 aa, Giardia lamblia
NKAASSTVSRRSSDLP

SEQ ID NO: 3124814 - protein, 8 aa, Giardia lamblia
NKADGSLA

SEQ ID NO: 3124815 - protein, 6 aa, Giardia lamblia
NKADPT

SEQ ID NO: 3124816 - protein, 4 aa, Giardia lamblia
NKAE

SEQ ID NO: 3124817 - protein, 9 aa, Giardia lamblia
NKAEDAAAF

SEQ ID NO: 3124818 - protein, 8 aa, Giardia lamblia
NKAESAET

SEQ ID NO: 3124819 - protein, 9 aa, Giardia lamblia
NKAETKDSK

SEQ ID NO: 3124820 - protein, 6 aa, Giardia lamblia
NKAGRT

SEQ ID NO: 3124821 - protein, 8 aa, Giardia lamblia
NKAKRCQD

SEQ ID NO: 3124822 - protein, 11 aa, Giardia lamblia
NKAQMNSSKAP

SEQ ID NO: 3124823 - protein, 7 aa, Giardia lamblia
NKARAAD

SEQ ID NO: 3124824 - protein, 6 aa, Giardia lamblia
NKAREE

SEQ ID NO: 3124825 - protein, 10 aa, Giardia lamblia
NKARETDKGV

SEQ ID NO: 3124826 - protein, 7 aa, Giardia lamblia
NKASPSY

SEQ ID NO: 3124827 - protein, 5 aa, Giardia lamblia
NKCEE

SEQ ID NO: 3124828 - protein, 4 aa, Giardia lamblia
NKCK

SEQ ID NO: 3124829 - protein, 6 aa, Giardia lamblia
NKDEEI

SEQ ID NO: 3124830 - protein, 8 aa, Giardia lamblia
NKDEETEF

SEQ ID NO: 3124831 - protein, 6 aa, Giardia lamblia
NKDESD

SEQ ID NO: 3124832 - protein, 7 aa, Giardia lamblia
NKDGGRE

SEQ ID NO: 3124833 - protein, 8 aa, Giardia lamblia
NKDGKGVG

SEQ ID NO: 3124834 - protein, 6 aa, Giardia lamblia
NKDGKT

SEQ ID NO: 3124835 - protein, 5 aa, Giardia lamblia
NKDGL

SEQ ID NO: 3124836 - protein, 5 aa, Giardia lamblia
NKDGM

SEQ ID NO: 3124837 - protein, 6 aa, Giardia lamblia
NKDGQT

SEQ ID NO: 3124838 - protein, 9 aa, Giardia lamblia
NKDKAEHAY

SEQ ID NO: 3124839 - protein, 9 aa, Giardia lamblia
NKDKEMTTR

SEQ ID NO: 3124840 - protein, 8 aa, Giardia lamblia
NKDKETFE

SEQ ID NO: 3124841 - protein, 12 aa, Giardia lamblia
NKDKLGDDKPLR

SEQ ID NO: 3124842 - protein, 57 aa, Giardia lamblia
NKDNSCTTYGTASVNGDSQSESRTRVSSRQGSRASSRSRQRRSDASVDSNRTGRVDS

SEQ ID NO: 3124843 - protein, 16 aa, Giardia lamblia
NKDPHTDGAAPTADNN

SEQ ID NO: 3124844 - protein, 5 aa, Giardia lamblia
NKDRY

SEQ ID NO: 3124845 - protein, 4 aa, Giardia lamblia
NKDS

SEQ ID NO: 3124846 - protein, 9 aa, Giardia lamblia
NKDSAEQVY

SEQ ID NO: 3124847 - protein, 6 aa, Giardia lamblia
NKDSIA

SEQ ID NO: 3124848 - protein, 29 aa, Giardia lamblia
NKDSYNSLGYSGYNQNRPGSPQKSSGRAN

SEQ ID NO: 3124849 - protein, 4 aa, Giardia lamblia
NKDT

SEQ ID NO: 3124850 - protein, 6 aa, Giardia lamblia
NKDTIE

SEQ ID NO: 3124851 - protein, 15 aa, Giardia lamblia
NKDTQEAEVRPRPSI

SEQ ID NO: 3124852 - protein, 4 aa, Giardia lamblia
NKEE

SEQ ID NO: 3124853 - protein, 9 aa, Giardia lamblia
NKEEENAAL

SEQ ID NO: 3124854 - protein, 7 aa, Giardia lamblia
NKEEGDA

SEQ ID NO: 3124855 - protein, 5 aa, Giardia lamblia
NKEFY

SEQ ID NO: 3124856 - protein, 8 aa, Giardia lamblia
NKEGESNI

SEQ ID NO: 3124857 - protein, 9 aa, Giardia lamblia
NKEGNITAR

SEQ ID NO: 3124858 - protein, 6 aa, Giardia lamblia
NKEHDA

SEQ ID NO: 3124859 - protein, 6 aa, Giardia lamblia
NKEHNY

SEQ ID NO: 3124860 - protein, 4 aa, Giardia lamblia
NKEK

SEQ ID NO: 3124861 - protein, 12 aa, Giardia lamblia
NKEKANKTISDL

SEQ ID NO: 3124862 - protein, 6 aa, Giardia lamblia
NKEPNV

SEQ ID NO: 3124863 - protein, 23 aa, Giardia lamblia
NKEPSSVTGDTESSRSEMGTSHS

SEQ ID NO: 3124864 - protein, 8 aa, Giardia lamblia
NKEQEQTI

SEQ ID NO: 3124865 - protein, 16 aa, Giardia lamblia
NKEQKHAGTTPRSTAF

SEQ ID NO: 3124866 - protein, 4 aa, Giardia lamblia
NKER

SEQ ID NO: 3124867 - protein, 14 aa, Giardia lamblia
NKERGLRTKHNNTA

SEQ ID NO: 3124868 - protein, 26 aa, Giardia lamblia
NKERQSPNPVANDQSNGRPGDLPSGL

SEQ ID NO: 3124869 - protein, 4 aa, Giardia lamblia
NKES

SEQ ID NO: 3124870 - protein, 14 aa, Giardia lamblia
NKESIKEKEERTLQ

SEQ ID NO: 3124871 - protein, 6 aa, Giardia lamblia
NKESTA

SEQ ID NO: 3124872 - protein, 9 aa, Giardia lamblia
NKESTSDPR

SEQ ID NO: 3124873 - protein, 6 aa, Giardia lamblia
NKETGK

SEQ ID NO: 3124874 - protein, 6 aa, Giardia lamblia
NKETGY

SEQ ID NO: 3124875 - protein, 7 aa, Giardia lamblia
NKFTGQH

SEQ ID NO: 3124876 - protein, 4 aa, Giardia lamblia
NKGA

SEQ ID NO: 3124877 - protein, 7 aa, Giardia lamblia
NKGAIDQ

SEQ ID NO: 3124878 - protein, 8 aa, Giardia lamblia
NKGARDPV

SEQ ID NO: 3124879 - protein, 7 aa, Giardia lamblia
NKGDLSG

SEQ ID NO: 3124880 - protein, 4 aa, Giardia lamblia
NKGE

SEQ ID NO: 3124881 - protein, 4 aa, Giardia lamblia
NKGG

SEQ ID NO: 3124882 - protein, 8 aa, Giardia lamblia
NKGGGQTV

SEQ ID NO: 3124883 - protein, 4 aa, Giardia lamblia
NKGQ

SEQ ID NO: 3124884 - protein, 9 aa, Giardia lamblia
NKGSVDLPD

SEQ ID NO: 3124885 - protein, 8 aa, Giardia lamblia
NKGTEDGQ

SEQ ID NO: 3124886 - protein, 8 aa, Giardia lamblia
NKGTRDPV

SEQ ID NO: 3124887 - protein, 9 aa, Giardia lamblia
NKGVTISEQ

SEQ ID NO: 3124888 - protein, 9 aa, Giardia lamblia
NKHDADEIA

SEQ ID NO: 3124889 - protein, 7 aa, Giardia lamblia
NKHDASQ

SEQ ID NO: 3124890 - protein, 6 aa, Giardia lamblia
NKHDYV

SEQ ID NO: 3124891 - protein, 5 aa, Giardia lamblia
NKHEI

SEQ ID NO: 3124892 - protein, 4 aa, Giardia lamblia
NKHL

SEQ ID NO: 3124893 - protein, 11 aa, Giardia lamblia
NKIEKSSALAK

SEQ ID NO: 3124894 - protein, 6 aa, Giardia lamblia
NKIGNI

SEQ ID NO: 3124895 - protein, 4 aa, Giardia lamblia
NKIR

SEQ ID NO: 3124896 - protein, 7 aa, Giardia lamblia
NKISDSP

SEQ ID NO: 3124897 - protein, 10 aa, Giardia lamblia
NKISGTLTTS

SEQ ID NO: 3124898 - protein, 15 aa, Giardia lamblia
NKISSTGQQQDEQEV

SEQ ID NO: 3124899 - protein, 7 aa, Giardia lamblia
NKITEEK

SEQ ID NO: 3124900 - protein, 4 aa, Giardia lamblia
NKKA

SEQ ID NO: 3124901 - protein, 10 aa, Giardia lamblia
NKKASDDPDT

SEQ ID NO: 3124902 - protein, 9 aa, Giardia lamblia
NKKASKVSD

SEQ ID NO: 3124903 - protein, 9 aa, Giardia lamblia
NKKESKFNT

SEQ ID NO: 3124904 - protein, 9 aa, Giardia lamblia
NKKGATATY

SEQ ID NO: 3124905 - protein, 7 aa, Giardia lamblia
NKKGETA

SEQ ID NO: 3124906 - protein, 20 aa, Giardia lamblia
NKKGQESHVIPSDSSATYDE

SEQ ID NO: 3124907 - protein, 17 aa, Giardia lamblia
NKKHQQTVNEAAAESRE

SEQ ID NO: 3124908 - protein, 12 aa, Giardia lamblia
NKKIDSSDFSRR

SEQ ID NO: 3124909 - protein, 7 aa, Giardia lamblia
NKKKPVA

SEQ ID NO: 3124910 - protein, 10 aa, Giardia lamblia
NKKRKTRKLP

SEQ ID NO: 3124911 - protein, 8 aa, Giardia lamblia
NKKRPQKH

SEQ ID NO: 3124912 - protein, 9 aa, Giardia lamblia
NKKSSLSQK

SEQ ID NO: 3124913 - protein, 6 aa, Giardia lamblia
NKKSYS

SEQ ID NO: 3124914 - protein, 38 aa, Giardia lamblia
NKKTALDVTTQQSQRSLSASAHGAPHRRHSKTRPVNKT

SEQ ID NO: 3124915 - protein, 6 aa, Giardia lamblia
NKKVCS

SEQ ID NO: 3124916 - protein, 6 aa, Giardia lamblia
NKLAQD

SEQ ID NO: 3124917 - protein, 6 aa, Giardia lamblia
NKLDTL

SEQ ID NO: 3124918 - protein, 23 aa, Giardia lamblia
NKLGEATIKQDELEDTISDAQIK

SEQ ID NO: 3124919 - protein, 10 aa, Giardia lamblia
NKLKDEGNDL

SEQ ID NO: 3124920 - protein, 6 aa, Giardia lamblia
NKLNND

SEQ ID NO: 3124921 - protein, 9 aa, Giardia lamblia
NKLPPPDSI

SEQ ID NO: 3124922 - protein, 7 aa, Giardia lamblia
NKLRPDD

SEQ ID NO: 3124923 - protein, 6 aa, Giardia lamblia
NKLRSA

SEQ ID NO: 3124924 - protein, 14 aa, Giardia lamblia
NKLSAKAETNLTAN

SEQ ID NO: 3124925 - protein, 14 aa, Giardia lamblia
NKLSPSAEPDLSSR

SEQ ID NO: 3124926 - protein, 5 aa, Giardia lamblia
NKLSR

SEQ ID NO: 3124927 - protein, 8 aa, Giardia lamblia
NKLTPPKT

SEQ ID NO: 3124928 - protein, 6 aa, Giardia lamblia
NKMNQR

SEQ ID NO: 3124929 - protein, 8 aa, Giardia lamblia
NKMTTESG

SEQ ID NO: 3124930 - protein, 8 aa, Giardia lamblia
NKNEHPRA

SEQ ID NO: 3124931 - protein, 7 aa, Giardia lamblia
NKNGDAL

SEQ ID NO: 3124932 - protein, 8 aa, Giardia lamblia
NKNGEKAL

SEQ ID NO: 3124933 - protein, 7 aa, Giardia lamblia
NKNGLEA

SEQ ID NO: 3124934 - protein, 7 aa, Giardia lamblia
NKNGTIE

SEQ ID NO: 3124935 - protein, 6 aa, Giardia lamblia
NKNKQR

SEQ ID NO: 3124936 - protein, 7 aa, Giardia lamblia
NKNKSLT

SEQ ID NO: 3124937 - protein, 12 aa, Giardia lamblia
NKNNIDFGKDFY

SEQ ID NO: 3124938 - protein, 6 aa, Giardia lamblia
NKNRNI

SEQ ID NO: 3124939 - protein, 13 aa, Giardia lamblia
NKNSAKVKAVTNN

SEQ ID NO: 3124940 - protein, 16 aa, Giardia lamblia
NKNSLRNQLHGLSEIR

SEQ ID NO: 3124941 - protein, 15 aa, Giardia lamblia
NKPAISNFPPPDERR

SEQ ID NO: 3124942 - protein, 5 aa, Giardia lamblia
NKPAR

SEQ ID NO: 3124943 - protein, 6 aa, Giardia lamblia
NKPARG

SEQ ID NO: 3124944 - protein, 7 aa, Giardia lamblia
NKPASIH

SEQ ID NO: 3124945 - protein, 6 aa, Giardia lamblia
NKPDFH

SEQ ID NO: 3124946 - protein, 9 aa, Giardia lamblia
NKPDGQTIG

SEQ ID NO: 3124947 - protein, 8 aa, Giardia lamblia
NKPENQSL

SEQ ID NO: 3124948 - protein, 9 aa, Giardia lamblia
NKPGLRPPL

SEQ ID NO: 3124949 - protein, 8 aa, Giardia lamblia
NKPGTNVT

SEQ ID NO: 3124950 - protein, 6 aa, Giardia lamblia
NKPGYD

SEQ ID NO: 3124951 - protein, 5 aa, Giardia lamblia
NKPLD

SEQ ID NO: 3124952 - protein, 8 aa, Giardia lamblia
NKPNTDLA

SEQ ID NO: 3124953 - protein, 8 aa, Giardia lamblia
NKPPDYFG

SEQ ID NO: 3124954 - protein, 7 aa, Giardia lamblia
NKPPEIC

SEQ ID NO: 3124955 - protein, 7 aa, Giardia lamblia
NKPPHAD

SEQ ID NO: 3124956 - protein, 14 aa, Giardia lamblia
NKPPRPKRQQPADF

SEQ ID NO: 3124957 - protein, 6 aa, Giardia lamblia
NKPQVS

SEQ ID NO: 3124958 - protein, 4 aa, Giardia lamblia
NKPS

SEQ ID NO: 3124959 - protein, 10 aa, Giardia lamblia
NKPSPARKRA

SEQ ID NO: 3124960 - protein, 8 aa, Giardia lamblia
NKPTRPEH

SEQ ID NO: 3124961 - protein, 4 aa, Giardia lamblia
NKPV

SEQ ID NO: 3124962 - protein, 4 aa, Giardia lamblia
NKQA

SEQ ID NO: 3124963 - protein, 10 aa, Giardia lamblia
NKQAADLQQQ

SEQ ID NO: 3124964 - protein, 13 aa, Giardia lamblia
NKQAASRSLEDAQ

SEQ ID NO: 3124965 - protein, 16 aa, Giardia lamblia
NKQAFEPNTPIQESPY

SEQ ID NO: 3124966 - protein, 6 aa, Giardia lamblia
NKQAKD

SEQ ID NO: 3124967 - protein, 17 aa, Giardia lamblia
NKQDAKARKLEEEELRS

SEQ ID NO: 3124968 - protein, 8 aa, Giardia lamblia
NKQDERLK

SEQ ID NO: 3124969 - protein, 10 aa, Giardia lamblia
NKQEAEQESG

SEQ ID NO: 3124970 - protein, 6 aa, Giardia lamblia
NKQGKY

SEQ ID NO: 3124971 - protein, 7 aa, Giardia lamblia
NKQLSTQ

SEQ ID NO: 3124972 - protein, 13 aa, Giardia lamblia
NKQNDTTPQNSYS

SEQ ID NO: 3124973 - protein, 9 aa, Giardia lamblia
NKQPFTPYG

SEQ ID NO: 3124974 - protein, 4 aa, Giardia lamblia
NKQR

SEQ ID NO: 3124975 - protein, 8 aa, Giardia lamblia
NKQSGEAS

SEQ ID NO: 3124976 - protein, 7 aa, Giardia lamblia
NKQSLEQ

SEQ ID NO: 3124977 - protein, 24 aa, Giardia lamblia
NKQSPEPTGQVKPGAKSKAPPIEA

SEQ ID NO: 3124978 - protein, 12 aa, Giardia lamblia
NKQTSADEDVLS

SEQ ID NO: 3124979 - protein, 15 aa, Giardia lamblia
NKQYESSGQGGAGEE

SEQ ID NO: 3124980 - protein, 4 aa, Giardia lamblia
NKRE

SEQ ID NO: 3124981 - protein, 10 aa, Giardia lamblia
NKREEQEGAT

SEQ ID NO: 3124982 - protein, 5 aa, Giardia lamblia
NKREK

SEQ ID NO: 3124983 - protein, 6 aa, Giardia lamblia
NKRFSE

SEQ ID NO: 3124984 - protein, 6 aa, Giardia lamblia
NKRGKT

SEQ ID NO: 3124985 - protein, 10 aa, Giardia lamblia
NKRKQSQENL

SEQ ID NO: 3124986 - protein, 7 aa, Giardia lamblia
NKRLDER

SEQ ID NO: 3124987 - protein, 7 aa, Giardia lamblia
NKRLQQQ

SEQ ID NO: 3124988 - protein, 7 aa, Giardia lamblia
NKRLTAE

SEQ ID NO: 3124989 - protein, 7 aa, Giardia lamblia
NKRNGKS

SEQ ID NO: 3124990 - protein, 51 aa, Giardia lamblia
NKRNQFNTSSTSRRSSESERGANHAMQRSSSSGAWKATQHSSWDDSRNGEM

SEQ ID NO: 3124991 - protein, 58 aa, Giardia lamblia
NKRNSRTPISQRGRDQEQKEREEREREEREREERERLETEESAAPASQSAKTKAKTVL

SEQ ID NO: 3124992 - protein, 14 aa, Giardia lamblia
NKRNTSLEAEKEQL

SEQ ID NO: 3124993 - protein, 7 aa, Giardia lamblia
NKRRYNE

SEQ ID NO: 3124994 - protein, 6 aa, Giardia lamblia
NKRSAL

SEQ ID NO: 3124995 - protein, 12 aa, Giardia lamblia
NKRSDNAIASTE

SEQ ID NO: 3124996 - protein, 29 aa, Giardia lamblia
NKRTSAASAPLPASTSKSKGTIDPGSSTR

SEQ ID NO: 3124997 - protein, 10 aa, Giardia lamblia
NKRVNPDKTV

SEQ ID NO: 3124998 - protein, 14 aa, Giardia lamblia
NKRVSGELARAEQR

SEQ ID NO: 3124999 - protein, 8 aa, Giardia lamblia
NKSAHTKY

SEQ ID NO: 3125000 - protein, 6 aa, Giardia lamblia
NKSAPV

SEQ ID NO: 3125001 - protein, 25 aa, Giardia lamblia
NKSDAFSAGPANPDPSPDDKPLTMD

SEQ ID NO: 3125002 - protein, 7 aa, Giardia lamblia
NKSDSNQ

SEQ ID NO: 3125003 - protein, 16 aa, Giardia lamblia
NKSGADGDSAMGATKS

SEQ ID NO: 3125004 - protein, 9 aa, Giardia lamblia
NKSGAVPEL

SEQ ID NO: 3125005 - protein, 8 aa, Giardia lamblia
NKSGSQSI

SEQ ID NO: 3125006 - protein, 18 aa, Giardia lamblia
NKSIESETHSYTLKGHNS

SEQ ID NO: 3125007 - protein, 7 aa, Giardia lamblia
NKSLKTE

SEQ ID NO: 3125008 - protein, 8 aa, Giardia lamblia
NKSLPPDT

SEQ ID NO: 3125009 - protein, 18 aa, Giardia lamblia
NKSNEALERANTAKDKEL

SEQ ID NO: 3125010 - protein, 7 aa, Giardia lamblia
NKSPQQI

SEQ ID NO: 3125011 - protein, 18 aa, Giardia lamblia
NKSQTSAEGSSDASTLST

SEQ ID NO: 3125012 - protein, 8 aa, Giardia lamblia
NKSRKQQA

SEQ ID NO: 3125013 - protein, 5 aa, Giardia lamblia
NKSTE

SEQ ID NO: 3125014 - protein, 9 aa, Giardia lamblia
NKSTGGTLG

SEQ ID NO: 3125015 - protein, 17 aa, Giardia lamblia
NKSTPEEARQSSRENQE

SEQ ID NO: 3125016 - protein, 5 aa, Giardia lamblia
NKSYD

SEQ ID NO: 3125017 - protein, 12 aa, Giardia lamblia
NKSYGVSTAPPL

SEQ ID NO: 3125018 - protein, 10 aa, Giardia lamblia
NKSYKDSQGE

SEQ ID NO: 3125019 - protein, 7 aa, Giardia lamblia
NKSYTEK

SEQ ID NO: 3125020 - protein, 8 aa, Giardia lamblia
NKTANARQ

SEQ ID NO: 3125021 - protein, 42 aa, Giardia lamblia
NKTAYTASSFRKSTAASSSSKRTSAHKPRSPQSARQSALETY

SEQ ID NO: 3125022 - protein, 5 aa, Giardia lamblia
NKTGY

SEQ ID NO: 3125023 - protein, 5 aa, Giardia lamblia
NKTIR

SEQ ID NO: 3125024 - protein, 6 aa, Giardia lamblia
NKTLDE

SEQ ID NO: 3125025 - protein, 7 aa, Giardia lamblia
NKTNANE

SEQ ID NO: 3125026 - protein, 10 aa, Giardia lamblia
NKTNSLSSQN

SEQ ID NO: 3125027 - protein, 6 aa, Giardia lamblia
NKTPDI

SEQ ID NO: 3125028 - protein, 5 aa, Giardia lamblia
NKTPM

SEQ ID NO: 3125029 - protein, 17 aa, Giardia lamblia
NKTPRKKPSKSKNPMWD

SEQ ID NO: 3125030 - protein, 5 aa, Giardia lamblia
NKTRF

SEQ ID NO: 3125031 - protein, 15 aa, Giardia lamblia
NKTRQPADKIPEDIA

SEQ ID NO: 3125032 - protein, 11 aa, Giardia lamblia
NKTSEQAQSAF

SEQ ID NO: 3125033 - protein, 8 aa, Giardia lamblia
NKTSPASD

SEQ ID NO: 3125034 - protein, 7 aa, Giardia lamblia
NKTSTYS

SEQ ID NO: 3125035 - protein, 6 aa, Giardia lamblia
NKTTGF

SEQ ID NO: 3125036 - protein, 5 aa, Giardia lamblia
NKTTH

SEQ ID NO: 3125037 - protein, 7 aa, Giardia lamblia
NKTTIDQ

SEQ ID NO: 3125038 - protein, 9 aa, Giardia lamblia
NKTTPNYTS

SEQ ID NO: 3125039 - protein, 9 aa, Giardia lamblia
NKVAQSVGL

SEQ ID NO: 3125040 - protein, 10 aa, Giardia lamblia
NKVDEANGVT

SEQ ID NO: 3125041 - protein, 9 aa, Giardia lamblia
NKVDPTGQT

SEQ ID NO: 3125042 - protein, 5 aa, Giardia lamblia
NKVDQ

SEQ ID NO: 3125043 - protein, 4 aa, Giardia lamblia
NKVG

SEQ ID NO: 3125044 - protein, 17 aa, Giardia lamblia
NKVGALSSAGRRDKRGV

SEQ ID NO: 3125045 - protein, 16 aa, Giardia lamblia
NKVGDKEQFEAKKKEL

SEQ ID NO: 3125046 - protein, 9 aa, Giardia lamblia
NKVPGDDKD

SEQ ID NO: 3125047 - protein, 4 aa, Giardia lamblia
NKVQ

SEQ ID NO: 3125048 - protein, 10 aa, Giardia lamblia
NKVSASQGLQ

SEQ ID NO: 3125049 - protein, 6 aa, Giardia lamblia
NKYADG

SEQ ID NO: 3125050 - protein, 6 aa, Giardia lamblia
NKYATP

SEQ ID NO: 3125051 - protein, 6 aa, Giardia lamblia
NKYNVS

SEQ ID NO: 3125052 - protein, 8 aa, Giardia lamblia
NKYPSKQA

SEQ ID NO: 3125053 - protein, 8 aa, Giardia lamblia
NKYSAKTS

SEQ ID NO: 3125054 - protein, 10 aa, Giardia lamblia
NLAASADAES

SEQ ID NO: 3125055 - protein, 6 aa, Giardia lamblia
NLAESA

SEQ ID NO: 3125056 - protein, 7 aa, Giardia lamblia
NLANGNS

SEQ ID NO: 3125057 - protein, 12 aa, Giardia lamblia
NLANSSQANPLT

SEQ ID NO: 3125058 - protein, 43 aa, Giardia lamblia
NLDAPSAIPTRGYGSRSQSSPHSSISSASGLDDAEDPRNSECG

SEQ ID NO: 3125059 - protein, 11 aa, Giardia lamblia
NLDDKARDIST

SEQ ID NO: 3125060 - protein, 11 aa, Giardia lamblia
NLDEDPVEARQ

SEQ ID NO: 3125061 - protein, 11 aa, Giardia lamblia
NLDEEDADQYH

SEQ ID NO: 3125062 - protein, 7 aa, Giardia lamblia
NLDKNEE

SEQ ID NO: 3125063 - protein, 7 aa, Giardia lamblia
NLDNAST

SEQ ID NO: 3125064 - protein, 4 aa, Giardia lamblia
NLDQ

SEQ ID NO: 3125065 - protein, 14 aa, Giardia lamblia
NLDQAGSYNARGQT

SEQ ID NO: 3125066 - protein, 16 aa, Giardia lamblia
NLDRRSKDTLGPPGGR

SEQ ID NO: 3125067 - protein, 5 aa, Giardia lamblia
NLDSD

SEQ ID NO: 3125068 - protein, 6 aa, Giardia lamblia
NLDSND

SEQ ID NO: 3125069 - protein, 10 aa, Giardia lamblia
NLDSRAATRH

SEQ ID NO: 3125070 - protein, 20 aa, Giardia lamblia
NLDSSTTSAGLSSSAVNNEA

SEQ ID NO: 3125071 - protein, 8 aa, Giardia lamblia
NLEADETG

SEQ ID NO: 3125072 - protein, 5 aa, Giardia lamblia
NLEKP

SEQ ID NO: 3125073 - protein, 12 aa, Giardia lamblia
NLENRSGKRTHK

SEQ ID NO: 3125074 - protein, 7 aa, Giardia lamblia
NLEPQDV

SEQ ID NO: 3125075 - protein, 5 aa, Giardia lamblia
NLEQE

SEQ ID NO: 3125076 - protein, 8 aa, Giardia lamblia
NLEQQRNE

SEQ ID NO: 3125077 - protein, 8 aa, Giardia lamblia
NLERNNKK

SEQ ID NO: 3125078 - protein, 14 aa, Giardia lamblia
NLETGDATEEPAKA

SEQ ID NO: 3125079 - protein, 17 aa, Giardia lamblia
NLGDTGNTTQAAAVQDG

SEQ ID NO: 3125080 - protein, 15 aa, Giardia lamblia
NLGEPSQARSDDDRM

SEQ ID NO: 3125081 - protein, 5 aa, Giardia lamblia
NLGGD

SEQ ID NO: 3125082 - protein, 6 aa, Giardia lamblia
NLGKAS

SEQ ID NO: 3125083 - protein, 6 aa, Giardia lamblia
NLGNQR

SEQ ID NO: 3125084 - protein, 5 aa, Giardia lamblia
NLGPH

SEQ ID NO: 3125085 - protein, 5 aa, Giardia lamblia
NLGPP

SEQ ID NO: 3125086 - protein, 7 aa, Giardia lamblia
NLHTQSN

SEQ ID NO: 3125087 - protein, 5 aa, Giardia lamblia
NLKDR

SEQ ID NO: 3125088 - protein, 11 aa, Giardia lamblia
NLKKTKSEEEV

SEQ ID NO: 3125089 - protein, 4 aa, Giardia lamblia
NLKP

SEQ ID NO: 3125090 - protein, 9 aa, Giardia lamblia
NLKQKAKDC

SEQ ID NO: 3125091 - protein, 11 aa, Giardia lamblia
NLKTQEQDAER

SEQ ID NO: 3125092 - protein, 30 aa, Giardia lamblia
NLNNNTSDRSHALQGTAPTGIHQDDDNSDE

SEQ ID NO: 3125093 - protein, 5 aa, Giardia lamblia
NLNNV

SEQ ID NO: 3125094 - protein, 4 aa, Giardia lamblia
NLNP

SEQ ID NO: 3125095 - protein, 4 aa, Giardia lamblia
NLNV

SEQ ID NO: 3125096 - protein, 6 aa, Giardia lamblia
NLPEEL

SEQ ID NO: 3125097 - protein, 11 aa, Giardia lamblia
NLPGITTGQDY

SEQ ID NO: 3125098 - protein, 15 aa, Giardia lamblia
NLPHSPSRKKPSGYQ

SEQ ID NO: 3125099 - protein, 16 aa, Giardia lamblia
NLPKESKGSSPQEGRA

SEQ ID NO: 3125100 - protein, 9 aa, Giardia lamblia
NLPPEAKQA

SEQ ID NO: 3125101 - protein, 8 aa, Giardia lamblia
NLPPPITD

SEQ ID NO: 3125102 - protein, 17 aa, Giardia lamblia
NLPPSGRSSANTPGSYL

SEQ ID NO: 3125103 - protein, 7 aa, Giardia lamblia
NLPQGER

SEQ ID NO: 3125104 - protein, 61 aa, Giardia lamblia
NLPSQSDKSAPAQSVPEEDSGVKNKKPAEQLSNSDTDLRNENDQKSTDRTEEEPAQEQQKT

SEQ ID NO: 3125105 - protein, 7 aa, Giardia lamblia
NLPTTRS

SEQ ID NO: 3125106 - protein, 8 aa, Giardia lamblia
NLPYQPTD

SEQ ID NO: 3125107 - protein, 16 aa, Giardia lamblia
NLQANSDLGQNYSNGI

SEQ ID NO: 3125108 - protein, 9 aa, Giardia lamblia
NLQDDEGNT

SEQ ID NO: 3125109 - protein, 5 aa, Giardia lamblia
NLQED

SEQ ID NO: 3125110 - protein, 5 aa, Giardia lamblia
NLQET

SEQ ID NO: 3125111 - protein, 19 aa, Giardia lamblia
NLQGNHTAYPSEAVGVDED

SEQ ID NO: 3125112 - protein, 19 aa, Giardia lamblia
NLQPGNSHAPTNNDEDEVD

SEQ ID NO: 3125113 - protein, 12 aa, Giardia lamblia
NLQQGSKDSFCS

SEQ ID NO: 3125114 - protein, 11 aa, Giardia lamblia
NLQSSTSFPDN

SEQ ID NO: 3125115 - protein, 18 aa, Giardia lamblia
NLQTTSPRRSNYVTPGQA

SEQ ID NO: 3125116 - protein, 7 aa, Giardia lamblia
NLRANAT

SEQ ID NO: 3125117 - protein, 10 aa, Giardia lamblia
NLREANTELR

SEQ ID NO: 3125118 - protein, 10 aa, Giardia lamblia
NLREDVPPSA

SEQ ID NO: 3125119 - protein, 7 aa, Giardia lamblia
NLREGTG

SEQ ID NO: 3125120 - protein, 31 aa, Giardia lamblia
NLRKQGPGSKKSDHSEAKACSTLESGSHVPE

SEQ ID NO: 3125121 - protein, 13 aa, Giardia lamblia
NLRPETGDVESTT

SEQ ID NO: 3125122 - protein, 9 aa, Giardia lamblia
NLRQSANSL

SEQ ID NO: 3125123 - protein, 5 aa, Giardia lamblia
NLRRS

SEQ ID NO: 3125124 - protein, 6 aa, Giardia lamblia
NLRSSY

SEQ ID NO: 3125125 - protein, 31 aa, Giardia lamblia
NLSASEADITKTNSLPCSPQTAQAKARDYTR

SEQ ID NO: 3125126 - protein, 19 aa, Giardia lamblia
NLSDSSSLARVSSSHAPVD

SEQ ID NO: 3125127 - protein, 6 aa, Giardia lamblia
NLSGGE

SEQ ID NO: 3125128 - protein, 6 aa, Giardia lamblia
NLSGSI

SEQ ID NO: 3125129 - protein, 36 aa, Giardia lamblia
NLSGTEDAEQGDSATAFRPSESRSTGPSNSKYTSFA

SEQ ID NO: 3125130 - protein, 4 aa, Giardia lamblia
NLSK

SEQ ID NO: 3125131 - protein, 8 aa, Giardia lamblia
NLSKERNS

SEQ ID NO: 3125132 - protein, 10 aa, Giardia lamblia
NLSNGQGNTA

SEQ ID NO: 3125133 - protein, 8 aa, Giardia lamblia
NLSNNKTP

SEQ ID NO: 3125134 - protein, 6 aa, Giardia lamblia
NLSQQS

SEQ ID NO: 3125135 - protein, 14 aa, Giardia lamblia
NLSRERDRTKAMEQ

SEQ ID NO: 3125136 - protein, 5 aa, Giardia lamblia
NLSSH

SEQ ID NO: 3125137 - protein, 12 aa, Giardia lamblia
NLSSSEGREPMT

SEQ ID NO: 3125138 - protein, 19 aa, Giardia lamblia
NLSTTSDSCTQSESSNENN

SEQ ID NO: 3125139 - protein, 4 aa, Giardia lamblia
NLTD

SEQ ID NO: 3125140 - protein, 14 aa, Giardia lamblia
NLTDGGTFPPQSKL

SEQ ID NO: 3125141 - protein, 26 aa, Giardia lamblia
NLTDKKGRKCEAYARTETVRRILAKL

SEQ ID NO: 3125142 - protein, 8 aa, Giardia lamblia
NLTDTRPN

SEQ ID NO: 3125143 - protein, 4 aa, Giardia lamblia
NLTG

SEQ ID NO: 3125144 - protein, 6 aa, Giardia lamblia
NLTGLK

SEQ ID NO: 3125145 - protein, 9 aa, Giardia lamblia
NLTKKGQTQ

SEQ ID NO: 3125146 - protein, 10 aa, Giardia lamblia
NLTNGKGETS

SEQ ID NO: 3125147 - protein, 7 aa, Giardia lamblia
NLTNYQR

SEQ ID NO: 3125148 - protein, 4 aa, Giardia lamblia
NLTP

SEQ ID NO: 3125149 - protein, 20 aa, Giardia lamblia
NLTPSRQKTTNFEDNPRKQN

SEQ ID NO: 3125150 - protein, 5 aa, Giardia lamblia
NLTQL

SEQ ID NO: 3125151 - protein, 6 aa, Giardia lamblia
NLTRKP

SEQ ID NO: 3125152 - protein, 10 aa, Giardia lamblia
NLTTTNGSSA

SEQ ID NO: 3125153 - protein, 10 aa, Giardia lamblia
NLVDSKRKRA

SEQ ID NO: 3125154 - protein, 6 aa, Giardia lamblia
NMAGNP

SEQ ID NO: 3125155 - protein, 11 aa, Giardia lamblia
NMASGQTGPMT

SEQ ID NO: 3125156 - protein, 8 aa, Giardia lamblia
NMDGSSNN

SEQ ID NO: 3125157 - protein, 5 aa, Giardia lamblia
NMDPG

SEQ ID NO: 3125158 - protein, 7 aa, Giardia lamblia
NMDQQPR

SEQ ID NO: 3125159 - protein, 5 aa, Giardia lamblia
NMDSG

SEQ ID NO: 3125160 - protein, 14 aa, Giardia lamblia
NMEPSKEALDDRRN

SEQ ID NO: 3125161 - protein, 9 aa, Giardia lamblia
NMESGRKTD

SEQ ID NO: 3125162 - protein, 4 aa, Giardia lamblia
NMPA

SEQ ID NO: 3125163 - protein, 12 aa, Giardia lamblia
NMPSTPNHRLRD

SEQ ID NO: 3125164 - protein, 4 aa, Giardia lamblia
NMPT

SEQ ID NO: 3125165 - protein, 7 aa, Giardia lamblia
NMQDNRG

SEQ ID NO: 3125166 - protein, 10 aa, Giardia lamblia
NMQGKSLTSL

SEQ ID NO: 3125167 - protein, 9 aa, Giardia lamblia
NMQKDNDRR

SEQ ID NO: 3125168 - protein, 7 aa, Giardia lamblia
NMRNDPN

SEQ ID NO: 3125169 - protein, 5 aa, Giardia lamblia
NMRNK

SEQ ID NO: 3125170 - protein, 10 aa, Giardia lamblia
NMSESLSQHT

SEQ ID NO: 3125171 - protein, 9 aa, Giardia lamblia
NMTDKNGRN

SEQ ID NO: 3125172 - protein, 5 aa, Giardia lamblia
NMTEG

SEQ ID NO: 3125173 - protein, 20 aa, Giardia lamblia
NMTGSQPLASHSGEDVCSSQ

SEQ ID NO: 3125174 - protein, 5 aa, Giardia lamblia
NMTPS

SEQ ID NO: 3125175 - protein, 8 aa, Giardia lamblia
NMTSPSNL

SEQ ID NO: 3125176 - protein, 7 aa, Giardia lamblia
NNAADSA

SEQ ID NO: 3125177 - protein, 5 aa, Giardia lamblia
NNAAG

SEQ ID NO: 3125178 - protein, 8 aa, Giardia lamblia
NNAATNPV

SEQ ID NO: 3125179 - protein, 13 aa, Giardia lamblia
NNACTPSATSLSG

SEQ ID NO: 3125180 - protein, 6 aa, Giardia lamblia
NNAEQA

SEQ ID NO: 3125181 - protein, 7 aa, Giardia lamblia
NNAETSM

SEQ ID NO: 3125182 - protein, 7 aa, Giardia lamblia
NNAGQTA

SEQ ID NO: 3125183 - protein, 10 aa, Giardia lamblia
NNAKPPATNV

SEQ ID NO: 3125184 - protein, 8 aa, Giardia lamblia
NNARRTSN

SEQ ID NO: 3125185 - protein, 6 aa, Giardia lamblia
NNASDN

SEQ ID NO: 3125186 - protein, 8 aa, Giardia lamblia
NNASGIGA

SEQ ID NO: 3125187 - protein, 19 aa, Giardia lamblia
NNASPAPSPRHTSSWANTP

SEQ ID NO: 3125188 - protein, 6 aa, Giardia lamblia
NNASSK

SEQ ID NO: 3125189 - protein, 10 aa, Giardia lamblia
NNASTNPTDF

SEQ ID NO: 3125190 - protein, 8 aa, Giardia lamblia
NNATLSNR

SEQ ID NO: 3125191 - protein, 27 aa, Giardia lamblia
NNATTSATRAGRKELTEDHYSNGANRR

SEQ ID NO: 3125192 - protein, 4 aa, Giardia lamblia
NNDA

SEQ ID NO: 3125193 - protein, 5 aa, Giardia lamblia
NNDAC

SEQ ID NO: 3125194 - protein, 5 aa, Giardia lamblia
NNDAI

SEQ ID NO: 3125195 - protein, 8 aa, Giardia lamblia
NNDEAQVR

SEQ ID NO: 3125196 - protein, 8 aa, Giardia lamblia
NNDENTAY

SEQ ID NO: 3125197 - protein, 6 aa, Giardia lamblia
NNDETG

SEQ ID NO: 3125198 - protein, 6 aa, Giardia lamblia
NNDGET

SEQ ID NO: 3125199 - protein, 6 aa, Giardia lamblia
NNDNRS

SEQ ID NO: 3125200 - protein, 7 aa, Giardia lamblia
NNDPEQV

SEQ ID NO: 3125201 - protein, 7 aa, Giardia lamblia
NNDPTRE

SEQ ID NO: 3125202 - protein, 6 aa, Giardia lamblia
NNDRHS

SEQ ID NO: 3125203 - protein, 11 aa, Giardia lamblia
NNDTAEPETLS

SEQ ID NO: 3125204 - protein, 18 aa, Giardia lamblia
NNEDGSVSGVVQGPKEQV

SEQ ID NO: 3125205 - protein, 4 aa, Giardia lamblia
NNEE

SEQ ID NO: 3125206 - protein, 4 aa, Giardia lamblia
NNEF

SEQ ID NO: 3125207 - protein, 5 aa, Giardia lamblia
NNEGH

SEQ ID NO: 3125208 - protein, 7 aa, Giardia lamblia
NNEKNIR

SEQ ID NO: 3125209 - protein, 11 aa, Giardia lamblia
NNEKSNDKQAS

SEQ ID NO: 3125210 - protein, 5 aa, Giardia lamblia
NNELK

SEQ ID NO: 3125211 - protein, 5 aa, Giardia lamblia
NNELS

SEQ ID NO: 3125212 - protein, 11 aa, Giardia lamblia
NNEPPSPEDLA

SEQ ID NO: 3125213 - protein, 6 aa, Giardia lamblia
NNEQGM

SEQ ID NO: 3125214 - protein, 4 aa, Giardia lamblia
NNER

SEQ ID NO: 3125215 - protein, 8 aa, Giardia lamblia
NNESPPMS

SEQ ID NO: 3125216 - protein, 9 aa, Giardia lamblia
NNESSDISN

SEQ ID NO: 3125217 - protein, 4 aa, Giardia lamblia
NNEV

SEQ ID NO: 3125218 - protein, 5 aa, Giardia lamblia
NNEVD

SEQ ID NO: 3125219 - protein, 7 aa, Giardia lamblia
NNEVSGC

SEQ ID NO: 3125220 - protein, 5 aa, Giardia lamblia
NNEYA

SEQ ID NO: 3125221 - protein, 17 aa, Giardia lamblia
NNGEPSSLNTASYNGNG

SEQ ID NO: 3125222 - protein, 17 aa, Giardia lamblia
NNGFDSQTSSPSHTSGI

SEQ ID NO: 3125223 - protein, 10 aa, Giardia lamblia
NNGGSPTPHY

SEQ ID NO: 3125224 - protein, 6 aa, Giardia lamblia
NNGNAD

SEQ ID NO: 3125225 - protein, 10 aa, Giardia lamblia
NNGPEAGQEV

SEQ ID NO: 3125226 - protein, 4 aa, Giardia lamblia
NNGS

SEQ ID NO: 3125227 - protein, 4 aa, Giardia lamblia
NNHA

SEQ ID NO: 3125228 - protein, 5 aa, Giardia lamblia
NNHAD

SEQ ID NO: 3125229 - protein, 6 aa, Giardia lamblia
NNHDGA

SEQ ID NO: 3125230 - protein, 18 aa, Giardia lamblia
NNHGPGLDERYASLNPCQ

SEQ ID NO: 3125231 - protein, 5 aa, Giardia lamblia
NNHPG

SEQ ID NO: 3125232 - protein, 4 aa, Giardia lamblia
NNID

SEQ ID NO: 3125233 - protein, 6 aa, Giardia lamblia
NNIDKG

SEQ ID NO: 3125234 - protein, 6 aa, Giardia lamblia
NNINDN

SEQ ID NO: 3125235 - protein, 14 aa, Giardia lamblia
NNIQNQDKQDRTYL

SEQ ID NO: 3125236 - protein, 4 aa, Giardia lamblia
NNIS

SEQ ID NO: 3125237 - protein, 13 aa, Giardia lamblia
NNISNSKDSIKDS

SEQ ID NO: 3125238 - protein, 6 aa, Giardia lamblia
NNKADA

SEQ ID NO: 3125239 - protein, 7 aa, Giardia lamblia
NNKAREL

SEQ ID NO: 3125240 - protein, 8 aa, Giardia lamblia
NNKGETAL

SEQ ID NO: 3125241 - protein, 7 aa, Giardia lamblia
NNKPDSV

SEQ ID NO: 3125242 - protein, 8 aa, Giardia lamblia
NNKPGAGL

SEQ ID NO: 3125243 - protein, 4 aa, Giardia lamblia
NNLA

SEQ ID NO: 3125244 - protein, 14 aa, Giardia lamblia
NNLEDESLKDGKNM

SEQ ID NO: 3125245 - protein, 5 aa, Giardia lamblia
NNLEE

SEQ ID NO: 3125246 - protein, 7 aa, Giardia lamblia
NNLKAGE

SEQ ID NO: 3125247 - protein, 4 aa, Giardia lamblia
NNLN

SEQ ID NO: 3125248 - protein, 6 aa, Giardia lamblia
NNLPNG

SEQ ID NO: 3125249 - protein, 7 aa, Giardia lamblia
NNLPTAN

SEQ ID NO: 3125250 - protein, 6 aa, Giardia lamblia
NNLQQS

SEQ ID NO: 3125251 - protein, 9 aa, Giardia lamblia
NNLQSTPPN

SEQ ID NO: 3125252 - protein, 11 aa, Giardia lamblia
NNLSADDKKVE

SEQ ID NO: 3125253 - protein, 5 aa, Giardia lamblia
NNLTA

SEQ ID NO: 3125254 - protein, 8 aa, Giardia lamblia
NNMKDTGT

SEQ ID NO: 3125255 - protein, 9 aa, Giardia lamblia
NNMSSAKAK

SEQ ID NO: 3125256 - protein, 16 aa, Giardia lamblia
NNNADLAKELKKILYK

SEQ ID NO: 3125257 - protein, 4 aa, Giardia lamblia
NNND

SEQ ID NO: 3125258 - protein, 6 aa, Giardia lamblia
NNNGAT

SEQ ID NO: 3125259 - protein, 5 aa, Giardia lamblia
NNNGY

SEQ ID NO: 3125260 - protein, 4 aa, Giardia lamblia
NNNI

SEQ ID NO: 3125261 - protein, 4 aa, Giardia lamblia
NNNL

SEQ ID NO: 3125262 - protein, 5 aa, Giardia lamblia
NNNLT

SEQ ID NO: 3125263 - protein, 4 aa, Giardia lamblia
NNNP

SEQ ID NO: 3125264 - protein, 8 aa, Giardia lamblia
NNNQPATG

SEQ ID NO: 3125265 - protein, 14 aa, Giardia lamblia
NNNRRSIGGNTDTY

SEQ ID NO: 3125266 - protein, 5 aa, Giardia lamblia
NNNSG

SEQ ID NO: 3125267 - protein, 22 aa, Giardia lamblia
NNNSLNAGGGATGAKSQIGPND

SEQ ID NO: 3125268 - protein, 21 aa, Giardia lamblia
NNNSTSVSNTDSLRKKHASDC

SEQ ID NO: 3125269 - protein, 7 aa, Giardia lamblia
NNNTASI

SEQ ID NO: 3125270 - protein, 6 aa, Giardia lamblia
NNNVEA

SEQ ID NO: 3125271 - protein, 8 aa, Giardia lamblia
NNPAHRDA

SEQ ID NO: 3125272 - protein, 7 aa, Giardia lamblia
NNPAPKA

SEQ ID NO: 3125273 - protein, 12 aa, Giardia lamblia
NNPDDVPADAGQ

SEQ ID NO: 3125274 - protein, 9 aa, Giardia lamblia
NNPEASPND

SEQ ID NO: 3125275 - protein, 10 aa, Giardia lamblia
NNPGDSQEKH

SEQ ID NO: 3125276 - protein, 5 aa, Giardia lamblia
NNPGE

SEQ ID NO: 3125277 - protein, 5 aa, Giardia lamblia
NNPKI

SEQ ID NO: 3125278 - protein, 20 aa, Giardia lamblia
NNPLSDKKERADLIFGSDLV

SEQ ID NO: 3125279 - protein, 6 aa, Giardia lamblia
NNPNDI

SEQ ID NO: 3125280 - protein, 5 aa, Giardia lamblia
NNPNI

SEQ ID NO: 3125281 - protein, 20 aa, Giardia lamblia
NNPQFQPNNPSAYPQSQTPI

SEQ ID NO: 3125282 - protein, 6 aa, Giardia lamblia
NNPRSF

SEQ ID NO: 3125283 - protein, 4 aa, Giardia lamblia
NNPS

SEQ ID NO: 3125284 - protein, 7 aa, Giardia lamblia
NNPSTFR

SEQ ID NO: 3125285 - protein, 9 aa, Giardia lamblia
NNPTGKSTQ

SEQ ID NO: 3125286 - protein, 6 aa, Giardia lamblia
NNPTLQ

SEQ ID NO: 3125287 - protein, 9 aa, Giardia lamblia
NNPTTPTPI

SEQ ID NO: 3125288 - protein, 13 aa, Giardia lamblia
NNPVGMRGREGSL

SEQ ID NO: 3125289 - protein, 4 aa, Giardia lamblia
NNPW

SEQ ID NO: 3125290 - protein, 8 aa, Giardia lamblia
NNPYSQSA

SEQ ID NO: 3125291 - protein, 5 aa, Giardia lamblia
NNQGT

SEQ ID NO: 3125292 - protein, 4 aa, Giardia lamblia
NNQR

SEQ ID NO: 3125293 - protein, 22 aa, Giardia lamblia
NNQRPPPPVNQYQSNVKQPGIM

SEQ ID NO: 3125294 - protein, 18 aa, Giardia lamblia
NNQRSQGLYTDDPPTPCE

SEQ ID NO: 3125295 - protein, 4 aa, Giardia lamblia
NNQV

SEQ ID NO: 3125296 - protein, 6 aa, Giardia lamblia
NNQYPE

SEQ ID NO: 3125297 - protein, 8 aa, Giardia lamblia
NNRAPENL

SEQ ID NO: 3125298 - protein, 9 aa, Giardia lamblia
NNRELANTK

SEQ ID NO: 3125299 - protein, 7 aa, Giardia lamblia
NNREVSN

SEQ ID NO: 3125300 - protein, 5 aa, Giardia lamblia
NNRGK

SEQ ID NO: 3125301 - protein, 9 aa, Giardia lamblia
NNRKADSEL

SEQ ID NO: 3125302 - protein, 5 aa, Giardia lamblia
NNRLS

SEQ ID NO: 3125303 - protein, 6 aa, Giardia lamblia
NNRNGS

SEQ ID NO: 3125304 - protein, 16 aa, Giardia lamblia
NNRNKEKSGSSETVKK

SEQ ID NO: 3125305 - protein, 7 aa, Giardia lamblia
NNRPDIA

SEQ ID NO: 3125306 - protein, 5 aa, Giardia lamblia
NNRPF

SEQ ID NO: 3125307 - protein, 11 aa, Giardia lamblia
NNRQADRATEQ

SEQ ID NO: 3125308 - protein, 6 aa, Giardia lamblia
NNRQTA

SEQ ID NO: 3125309 - protein, 4 aa, Giardia lamblia
NNRR

SEQ ID NO: 3125310 - protein, 22 aa, Giardia lamblia
NNRSRERTRASRTSRGSKSSGI

SEQ ID NO: 3125311 - protein, 4 aa, Giardia lamblia
NNRY

SEQ ID NO: 3125312 - protein, 4 aa, Giardia lamblia
NNSA

SEQ ID NO: 3125313 - protein, 15 aa, Giardia lamblia
NNSAVESSPGPADYT

SEQ ID NO: 3125314 - protein, 9 aa, Giardia lamblia
NNSDDSTTD

SEQ ID NO: 3125315 - protein, 5 aa, Giardia lamblia
NNSDM

SEQ ID NO: 3125316 - protein, 8 aa, Giardia lamblia
NNSDSEPV

SEQ ID NO: 3125317 - protein, 8 aa, Giardia lamblia
NNSGKSHL

SEQ ID NO: 3125318 - protein, 5 aa, Giardia lamblia
NNSGN

SEQ ID NO: 3125319 - protein, 5 aa, Giardia lamblia
NNSID

SEQ ID NO: 3125320 - protein, 6 aa, Giardia lamblia
NNSIDS

SEQ ID NO: 3125321 - protein, 4 aa, Giardia lamblia
NNSL

SEQ ID NO: 3125322 - protein, 11 aa, Giardia lamblia
NNSLQKASETL

SEQ ID NO: 3125323 - protein, 10 aa, Giardia lamblia
NNSQKHEDVS

SEQ ID NO: 3125324 - protein, 8 aa, Giardia lamblia
NNSRAAEW

SEQ ID NO: 3125325 - protein, 5 aa, Giardia lamblia
NNSSK

SEQ ID NO: 3125326 - protein, 7 aa, Giardia lamblia
NNSSTAQ

SEQ ID NO: 3125327 - protein, 6 aa, Giardia lamblia
NNSTDL

SEQ ID NO: 3125328 - protein, 19 aa, Giardia lamblia
NNSTITPSNQQQQARPPTL

SEQ ID NO: 3125329 - protein, 5 aa, Giardia lamblia
NNTAE

SEQ ID NO: 3125330 - protein, 12 aa, Giardia lamblia
NNTASSTLSAEA

SEQ ID NO: 3125331 - protein, 4 aa, Giardia lamblia
NNTD

SEQ ID NO: 3125332 - protein, 5 aa, Giardia lamblia
NNTEY

SEQ ID NO: 3125333 - protein, 6 aa, Giardia lamblia
NNTNAK

SEQ ID NO: 3125334 - protein, 5 aa, Giardia lamblia
NNTPL

SEQ ID NO: 3125335 - protein, 5 aa, Giardia lamblia
NNTQM

SEQ ID NO: 3125336 - protein, 5 aa, Giardia lamblia
NNTTP

SEQ ID NO: 3125337 - protein, 19 aa, Giardia lamblia
NNTVKSARLPGSPDDAGFD

SEQ ID NO: 3125338 - protein, 15 aa, Giardia lamblia
NNVEAGKQVENDESL

SEQ ID NO: 3125339 - protein, 9 aa, Giardia lamblia
NNVNKEPNL

SEQ ID NO: 3125340 - protein, 5 aa, Giardia lamblia
NNVPG

SEQ ID NO: 3125341 - protein, 4 aa, Giardia lamblia
NNVT

SEQ ID NO: 3125342 - protein, 5 aa, Giardia lamblia
NNYDT

SEQ ID NO: 3125343 - protein, 5 aa, Giardia lamblia
NNYGD

SEQ ID NO: 3125344 - protein, 13 aa, Giardia lamblia
NNYGSNAANDGEI

SEQ ID NO: 3125345 - protein, 16 aa, Giardia lamblia
NNYGSTGLSEKPTELC

SEQ ID NO: 3125346 - protein, 5 aa, Giardia lamblia
NPADR

SEQ ID NO: 3125347 - protein, 34 aa, Giardia lamblia
NPADYSDSKKYQKADTSHFSTEVSDESTLRTEPT

SEQ ID NO: 3125348 - protein, 20 aa, Giardia lamblia
NPAEQQQQKQQPAPKPPQAQ

SEQ ID NO: 3125349 - protein, 5 aa, Giardia lamblia
NPAKL

SEQ ID NO: 3125350 - protein, 8 aa, Giardia lamblia
NPAKRFSA

SEQ ID NO: 3125351 - protein, 8 aa, Giardia lamblia
NPANDSYD

SEQ ID NO: 3125352 - protein, 7 aa, Giardia lamblia
NPANRPS

SEQ ID NO: 3125353 - protein, 9 aa, Giardia lamblia
NPANSRPNI

SEQ ID NO: 3125354 - protein, 6 aa, Giardia lamblia
NPANTN

SEQ ID NO: 3125355 - protein, 8 aa, Giardia lamblia
NPAPPSLN

SEQ ID NO: 3125356 - protein, 8 aa, Giardia lamblia
NPAPRKIS

SEQ ID NO: 3125357 - protein, 9 aa, Giardia lamblia
NPASEQPSS

SEQ ID NO: 3125358 - protein, 8 aa, Giardia lamblia
NPASTSSS

SEQ ID NO: 3125359 - protein, 9 aa, Giardia lamblia
NPATGRDCD

SEQ ID NO: 3125360 - protein, 9 aa, Giardia lamblia
NPATRKSPS

SEQ ID NO: 3125361 - protein, 21 aa, Giardia lamblia
NPATSKGPSTGSKDIDSSNLQ

SEQ ID NO: 3125362 - protein, 4 aa, Giardia lamblia
NPCP

SEQ ID NO: 3125363 - protein, 15 aa, Giardia lamblia
NPCPRDSSTVRQSTP

SEQ ID NO: 3125364 - protein, 10 aa, Giardia lamblia
NPCRSKAASA

SEQ ID NO: 3125365 - protein, 6 aa, Giardia lamblia
NPDAAE

SEQ ID NO: 3125366 - protein, 6 aa, Giardia lamblia
NPDAIK

SEQ ID NO: 3125367 - protein, 6 aa, Giardia lamblia
NPDAYK

SEQ ID NO: 3125368 - protein, 6 aa, Giardia lamblia
NPDDLA

SEQ ID NO: 3125369 - protein, 9 aa, Giardia lamblia
NPDDQYSSN

SEQ ID NO: 3125370 - protein, 5 aa, Giardia lamblia
NPDDR

SEQ ID NO: 3125371 - protein, 6 aa, Giardia lamblia
NPDEGV

SEQ ID NO: 3125372 - protein, 6 aa, Giardia lamblia
NPDERP

SEQ ID NO: 3125373 - protein, 11 aa, Giardia lamblia
NPDESKYKVTG

SEQ ID NO: 3125374 - protein, 4 aa, Giardia lamblia
NPDG

SEQ ID NO: 3125375 - protein, 14 aa, Giardia lamblia
NPDGSRPAPPQQYI

SEQ ID NO: 3125376 - protein, 10 aa, Giardia lamblia
NPDIKSTQQH

SEQ ID NO: 3125377 - protein, 9 aa, Giardia lamblia
NPDKDTPTD

SEQ ID NO: 3125378 - protein, 10 aa, Giardia lamblia
NPDKIGSTIQ

SEQ ID NO: 3125379 - protein, 11 aa, Giardia lamblia
NPDLKSSMDSL

SEQ ID NO: 3125380 - protein, 10 aa, Giardia lamblia
NPDPKKRPTA

SEQ ID NO: 3125381 - protein, 10 aa, Giardia lamblia
NPDQRVEATR

SEQ ID NO: 3125382 - protein, 4 aa, Giardia lamblia
NPDS

SEQ ID NO: 3125383 - protein, 9 aa, Giardia lamblia
NPDSYMGSK

SEQ ID NO: 3125384 - protein, 6 aa, Giardia lamblia
NPDTLD

SEQ ID NO: 3125385 - protein, 7 aa, Giardia lamblia
NPDTPVQ

SEQ ID NO: 3125386 - protein, 9 aa, Giardia lamblia
NPEAKSTLV

SEQ ID NO: 3125387 - protein, 8 aa, Giardia lamblia
NPEARASV

SEQ ID NO: 3125388 - protein, 17 aa, Giardia lamblia
NPEEASGNVVSKSRMDQ

SEQ ID NO: 3125389 - protein, 8 aa, Giardia lamblia
NPEELSAN

SEQ ID NO: 3125390 - protein, 5 aa, Giardia lamblia
NPEFA

SEQ ID NO: 3125391 - protein, 7 aa, Giardia lamblia
NPEGITE

SEQ ID NO: 3125392 - protein, 5 aa, Giardia lamblia
NPEGN

SEQ ID NO: 3125393 - protein, 4 aa, Giardia lamblia
NPEI

SEQ ID NO: 3125394 - protein, 4 aa, Giardia lamblia
NPEK

SEQ ID NO: 3125395 - protein, 6 aa, Giardia lamblia
NPEKNV

SEQ ID NO: 3125396 - protein, 7 aa, Giardia lamblia
NPEPLSG

SEQ ID NO: 3125397 - protein, 18 aa, Giardia lamblia
NPEPQEFNSSFDSDGSID

SEQ ID NO: 3125398 - protein, 10 aa, Giardia lamblia
NPEPSGDKTE

SEQ ID NO: 3125399 - protein, 8 aa, Giardia lamblia
NPEQLTAE

SEQ ID NO: 3125400 - protein, 6 aa, Giardia lamblia
NPEQQC

SEQ ID NO: 3125401 - protein, 15 aa, Giardia lamblia
NPEQQPASAPGTKVP

SEQ ID NO: 3125402 - protein, 5 aa, Giardia lamblia
NPEQT

SEQ ID NO: 3125403 - protein, 7 aa, Giardia lamblia
NPESASK

SEQ ID NO: 3125404 - protein, 5 aa, Giardia lamblia
NPEVV

SEQ ID NO: 3125405 - protein, 12 aa, Giardia lamblia
NPEYGQTRRPPL

SEQ ID NO: 3125406 - protein, 5 aa, Giardia lamblia
NPEYS

SEQ ID NO: 3125407 - protein, 21 aa, Giardia lamblia
NPFAPPEAVAPAKGPLLPSQE

SEQ ID NO: 3125408 - protein, 8 aa, Giardia lamblia
NPFATEKE

SEQ ID NO: 3125409 - protein, 6 aa, Giardia lamblia
NPFSTQ

SEQ ID NO: 3125410 - protein, 8 aa, Giardia lamblia
NPGDPAAV

SEQ ID NO: 3125411 - protein, 6 aa, Giardia lamblia
NPGDTP

SEQ ID NO: 3125412 - protein, 6 aa, Giardia lamblia
NPGETL

SEQ ID NO: 3125413 - protein, 8 aa, Giardia lamblia
NPGGMSPA

SEQ ID NO: 3125414 - protein, 8 aa, Giardia lamblia
NPGGRPLL

SEQ ID NO: 3125415 - protein, 19 aa, Giardia lamblia
NPGKPPTLATQPPASAFER

SEQ ID NO: 3125416 - protein, 4 aa, Giardia lamblia
NPGM

SEQ ID NO: 3125417 - protein, 6 aa, Giardia lamblia
NPGNLS

SEQ ID NO: 3125418 - protein, 6 aa, Giardia lamblia
NPGPAF

SEQ ID NO: 3125419 - protein, 8 aa, Giardia lamblia
NPGPTSRR

SEQ ID NO: 3125420 - protein, 6 aa, Giardia lamblia
NPGQPL

SEQ ID NO: 3125421 - protein, 5 aa, Giardia lamblia
NPGRE

SEQ ID NO: 3125422 - protein, 7 aa, Giardia lamblia
NPGRQGL

SEQ ID NO: 3125423 - protein, 7 aa, Giardia lamblia
NPGTAYH

SEQ ID NO: 3125424 - protein, 4 aa, Giardia lamblia
NPGV

SEQ ID NO: 3125425 - protein, 5 aa, Giardia lamblia
NPHDQ

SEQ ID NO: 3125426 - protein, 5 aa, Giardia lamblia
NPHEL

SEQ ID NO: 3125427 - protein, 10 aa, Giardia lamblia
NPHKRPLSPT

SEQ ID NO: 3125428 - protein, 12 aa, Giardia lamblia
NPHNTAPKVDDK

SEQ ID NO: 3125429 - protein, 13 aa, Giardia lamblia
NPHPPLDTATEPV

SEQ ID NO: 3125430 - protein, 24 aa, Giardia lamblia
NPIAEESSSMNSSASHPNPRDGGE

SEQ ID NO: 3125431 - protein, 6 aa, Giardia lamblia
NPIDET

SEQ ID NO: 3125432 - protein, 54 aa, Giardia lamblia
NPIPGSDSEETLASASEDARSQSHSTNTDLDKSSGSESVDSADAKATTATKTLR

SEQ ID NO: 3125433 - protein, 5 aa, Giardia lamblia
NPIPQ

SEQ ID NO: 3125434 - protein, 5 aa, Giardia lamblia
NPIRQ

SEQ ID NO: 3125435 - protein, 6 aa, Giardia lamblia
NPITIG

SEQ ID NO: 3125436 - protein, 7 aa, Giardia lamblia
NPKALQQ

SEQ ID NO: 3125437 - protein, 16 aa, Giardia lamblia
NPKEAARLEKKAKSAG

SEQ ID NO: 3125438 - protein, 6 aa, Giardia lamblia
NPKEID

SEQ ID NO: 3125439 - protein, 8 aa, Giardia lamblia
NPKGIKPD

SEQ ID NO: 3125440 - protein, 7 aa, Giardia lamblia
NPKHNQE

SEQ ID NO: 3125441 - protein, 5 aa, Giardia lamblia
NPKKA

SEQ ID NO: 3125442 - protein, 8 aa, Giardia lamblia
NPKKTEPV

SEQ ID NO: 3125443 - protein, 5 aa, Giardia lamblia
NPKPR

SEQ ID NO: 3125444 - protein, 18 aa, Giardia lamblia
NPKPRNGHSIQNSLGPSY

SEQ ID NO: 3125445 - protein, 6 aa, Giardia lamblia
NPKQLK

SEQ ID NO: 3125446 - protein, 9 aa, Giardia lamblia
NPKQTSGAN

SEQ ID NO: 3125447 - protein, 7 aa, Giardia lamblia
NPKRSGH

SEQ ID NO: 3125448 - protein, 5 aa, Giardia lamblia
NPKRT

SEQ ID NO: 3125449 - protein, 6 aa, Giardia lamblia
NPKSLS

SEQ ID NO: 3125450 - protein, 6 aa, Giardia lamblia
NPKSQL

SEQ ID NO: 3125451 - protein, 8 aa, Giardia lamblia
NPKSRPHL

SEQ ID NO: 3125452 - protein, 7 aa, Giardia lamblia
NPKTQTS

SEQ ID NO: 3125453 - protein, 14 aa, Giardia lamblia
NPKVEAEKREEAEA

SEQ ID NO: 3125454 - protein, 11 aa, Giardia lamblia
NPLDDDERNRL

SEQ ID NO: 3125455 - protein, 8 aa, Giardia lamblia
NPLESKDG

SEQ ID NO: 3125456 - protein, 14 aa, Giardia lamblia
NPLGGSGGNGPKQL

SEQ ID NO: 3125457 - protein, 5 aa, Giardia lamblia
NPLGL

SEQ ID NO: 3125458 - protein, 8 aa, Giardia lamblia
NPLGLTEG

SEQ ID NO: 3125459 - protein, 5 aa, Giardia lamblia
NPLGS

SEQ ID NO: 3125460 - protein, 9 aa, Giardia lamblia
NPLKNPPLK

SEQ ID NO: 3125461 - protein, 11 aa, Giardia lamblia
NPLLPDPSTYL

SEQ ID NO: 3125462 - protein, 13 aa, Giardia lamblia
NPLPENLETPGYA

SEQ ID NO: 3125463 - protein, 8 aa, Giardia lamblia
NPLPPSVP

SEQ ID NO: 3125464 - protein, 4 aa, Giardia lamblia
NPLQ

SEQ ID NO: 3125465 - protein, 12 aa, Giardia lamblia
NPLQSPGDEFEK

SEQ ID NO: 3125466 - protein, 5 aa, Giardia lamblia
NPLSD

SEQ ID NO: 3125467 - protein, 13 aa, Giardia lamblia
NPLTAASTLEPIS

SEQ ID NO: 3125468 - protein, 8 aa, Giardia lamblia
NPLTNESI

SEQ ID NO: 3125469 - protein, 14 aa, Giardia lamblia
NPLYSNPPLSTKTL

SEQ ID NO: 3125470 - protein, 21 aa, Giardia lamblia
NPNAPDGNGGPGSLDKAEKAA

SEQ ID NO: 3125471 - protein, 6 aa, Giardia lamblia
NPNAPF

SEQ ID NO: 3125472 - protein, 12 aa, Giardia lamblia
NPNDTMETSDVS

SEQ ID NO: 3125473 - protein, 7 aa, Giardia lamblia
NPNFSSV

SEQ ID NO: 3125474 - protein, 6 aa, Giardia lamblia
NPNGED

SEQ ID NO: 3125475 - protein, 20 aa, Giardia lamblia
NPNGNPNGSQPDKKASSGIA

SEQ ID NO: 3125476 - protein, 5 aa, Giardia lamblia
NPNIK

SEQ ID NO: 3125477 - protein, 8 aa, Giardia lamblia
NPNKFADK

SEQ ID NO: 3125478 - protein, 4 aa, Giardia lamblia
NPNN

SEQ ID NO: 3125479 - protein, 5 aa, Giardia lamblia
NPNNA

SEQ ID NO: 3125480 - protein, 7 aa, Giardia lamblia
NPNPTTA

SEQ ID NO: 3125481 - protein, 5 aa, Giardia lamblia
NPNPV

SEQ ID NO: 3125482 - protein, 4 aa, Giardia lamblia
NPNQ

SEQ ID NO: 3125483 - protein, 10 aa, Giardia lamblia
NPNTGRTPAQ

SEQ ID NO: 3125484 - protein, 5 aa, Giardia lamblia
NPPAL

SEQ ID NO: 3125485 - protein, 7 aa, Giardia lamblia
NPPALPP

SEQ ID NO: 3125486 - protein, 10 aa, Giardia lamblia
NPPCESPPWA

SEQ ID NO: 3125487 - protein, 16 aa, Giardia lamblia
NPPDSGDSQASRGHSY

SEQ ID NO: 3125488 - protein, 4 aa, Giardia lamblia
NPPG

SEQ ID NO: 3125489 - protein, 12 aa, Giardia lamblia
NPPGQESGYWGN

SEQ ID NO: 3125490 - protein, 12 aa, Giardia lamblia
NPPKSDDEDKKH

SEQ ID NO: 3125491 - protein, 12 aa, Giardia lamblia
NPPPGFADTEKE

SEQ ID NO: 3125492 - protein, 11 aa, Giardia lamblia
NPPPGTQHKPG

SEQ ID NO: 3125493 - protein, 54 aa, Giardia lamblia
NPPPKEVDDEGIDEEAEEKEEAEEEQIEDPEKSIEEEADEEAGEEKKEDMATDR

SEQ ID NO: 3125494 - protein, 14 aa, Giardia lamblia
NPPPKTSTSSLKSC

SEQ ID NO: 3125495 - protein, 6 aa, Giardia lamblia
NPPPTK

SEQ ID NO: 3125496 - protein, 26 aa, Giardia lamblia
NPPPWQKPRASTPVDTKVSPVPPNQP

SEQ ID NO: 3125497 - protein, 5 aa, Giardia lamblia
NPPQF

SEQ ID NO: 3125498 - protein, 4 aa, Giardia lamblia
NPPR

SEQ ID NO: 3125499 - protein, 6 aa, Giardia lamblia
NPPSRK

SEQ ID NO: 3125500 - protein, 11 aa, Giardia lamblia
NPPTASKTPLS

SEQ ID NO: 3125501 - protein, 6 aa, Giardia lamblia
NPPTLE

SEQ ID NO: 3125502 - protein, 7 aa, Giardia lamblia
NPPVEYT

SEQ ID NO: 3125503 - protein, 13 aa, Giardia lamblia
NPPVPVPSVQPNM

SEQ ID NO: 3125504 - protein, 4 aa, Giardia lamblia
NPQC

SEQ ID NO: 3125505 - protein, 5 aa, Giardia lamblia
NPQEL

SEQ ID NO: 3125506 - protein, 7 aa, Giardia lamblia
NPQERIS

SEQ ID NO: 3125507 - protein, 12 aa, Giardia lamblia
NPQESSSKGMDN

SEQ ID NO: 3125508 - protein, 12 aa, Giardia lamblia
NPQGETSDMDRS

SEQ ID NO: 3125509 - protein, 4 aa, Giardia lamblia
NPQH

SEQ ID NO: 3125510 - protein, 10 aa, Giardia lamblia
NPQKPKRSIE

SEQ ID NO: 3125511 - protein, 5 aa, Giardia lamblia
NPQME

SEQ ID NO: 3125512 - protein, 6 aa, Giardia lamblia
NPQQAI

SEQ ID NO: 3125513 - protein, 13 aa, Giardia lamblia
NPQSSEDAKTIEN

SEQ ID NO: 3125514 - protein, 8 aa, Giardia lamblia
NPQSYPRQ

SEQ ID NO: 3125515 - protein, 8 aa, Giardia lamblia
NPQTRQIQ

SEQ ID NO: 3125516 - protein, 5 aa, Giardia lamblia
NPQYS

SEQ ID NO: 3125517 - protein, 4 aa, Giardia lamblia
NPRA

SEQ ID NO: 3125518 - protein, 7 aa, Giardia lamblia
NPRGEKK

SEQ ID NO: 3125519 - protein, 22 aa, Giardia lamblia
NPRGRTVQGDKDTPAGKDGELS

SEQ ID NO: 3125520 - protein, 4 aa, Giardia lamblia
NPRI

SEQ ID NO: 3125521 - protein, 8 aa, Giardia lamblia
NPRPKADK

SEQ ID NO: 3125522 - protein, 6 aa, Giardia lamblia
NPRQGY

SEQ ID NO: 3125523 - protein, 5 aa, Giardia lamblia
NPRRD

SEQ ID NO: 3125524 - protein, 4 aa, Giardia lamblia
NPRS

SEQ ID NO: 3125525 - protein, 6 aa, Giardia lamblia
NPRSRS

SEQ ID NO: 3125526 - protein, 12 aa, Giardia lamblia
NPRSSSNSALGE

SEQ ID NO: 3125527 - protein, 24 aa, Giardia lamblia
NPRSVSPSRKASVPAEPASPTRCT

SEQ ID NO: 3125528 - protein, 6 aa, Giardia lamblia
NPRYTA

SEQ ID NO: 3125529 - protein, 10 aa, Giardia lamblia
NPSAPCSPTL

SEQ ID NO: 3125530 - protein, 5 aa, Giardia lamblia
NPSCS

SEQ ID NO: 3125531 - protein, 11 aa, Giardia lamblia
NPSCSIPDGSQ

SEQ ID NO: 3125532 - protein, 4 aa, Giardia lamblia
NPSD

SEQ ID NO: 3125533 - protein, 5 aa, Giardia lamblia
NPSDC

SEQ ID NO: 3125534 - protein, 10 aa, Giardia lamblia
NPSDQPQEAL

SEQ ID NO: 3125535 - protein, 10 aa, Giardia lamblia
NPSDRPSAEQ

SEQ ID NO: 3125536 - protein, 14 aa, Giardia lamblia
NPSEILPDADSYDT

SEQ ID NO: 3125537 - protein, 5 aa, Giardia lamblia
NPSEP

SEQ ID NO: 3125538 - protein, 5 aa, Giardia lamblia
NPSFS

SEQ ID NO: 3125539 - protein, 11 aa, Giardia lamblia
NPSFSKGKIST

SEQ ID NO: 3125540 - protein, 7 aa, Giardia lamblia
NPSGKTA

SEQ ID NO: 3125541 - protein, 8 aa, Giardia lamblia
NPSGYKST

SEQ ID NO: 3125542 - protein, 6 aa, Giardia lamblia
NPSIPG

SEQ ID NO: 3125543 - protein, 35 aa, Giardia lamblia
NPSKSKPQRKRLSSSSGTGLPMSGSRSSVSPEGIE

SEQ ID NO: 3125544 - protein, 8 aa, Giardia lamblia
NPSLRPDY

SEQ ID NO: 3125545 - protein, 4 aa, Giardia lamblia
NPSM

SEQ ID NO: 3125546 - protein, 8 aa, Giardia lamblia
NPSPDEVE

SEQ ID NO: 3125547 - protein, 10 aa, Giardia lamblia
NPSQFSPDQG

SEQ ID NO: 3125548 - protein, 5 aa, Giardia lamblia
NPSRI

SEQ ID NO: 3125549 - protein, 5 aa, Giardia lamblia
NPSRQ

SEQ ID NO: 3125550 - protein, 10 aa, Giardia lamblia
NPSSASTGTA

SEQ ID NO: 3125551 - protein, 8 aa, Giardia lamblia
NPSSLYTN

SEQ ID NO: 3125552 - protein, 6 aa, Giardia lamblia
NPSSPV

SEQ ID NO: 3125553 - protein, 7 aa, Giardia lamblia
NPSSQGY

SEQ ID NO: 3125554 - protein, 9 aa, Giardia lamblia
NPSSSGDEV

SEQ ID NO: 3125555 - protein, 15 aa, Giardia lamblia
NPSTEAAAKAGTPSF

SEQ ID NO: 3125556 - protein, 25 aa, Giardia lamblia
NPSTRDGAPGVSGWQRRTDPAHTGE

SEQ ID NO: 3125557 - protein, 12 aa, Giardia lamblia
NPSYKAYATAED

SEQ ID NO: 3125558 - protein, 34 aa, Giardia lamblia
NPSYPKSTSPKVSEKPLSKSSVRHNAGSSAPQFS

SEQ ID NO: 3125559 - protein, 11 aa, Giardia lamblia
NPTAEDARTQV

SEQ ID NO: 3125560 - protein, 5 aa, Giardia lamblia
NPTAV

SEQ ID NO: 3125561 - protein, 5 aa, Giardia lamblia
NPTDD

SEQ ID NO: 3125562 - protein, 6 aa, Giardia lamblia
NPTDSA

SEQ ID NO: 3125563 - protein, 5 aa, Giardia lamblia
NPTEK

SEQ ID NO: 3125564 - protein, 6 aa, Giardia lamblia
NPTETL

SEQ ID NO: 3125565 - protein, 8 aa, Giardia lamblia
NPTIDDQS

SEQ ID NO: 3125566 - protein, 6 aa, Giardia lamblia
NPTKIK

SEQ ID NO: 3125567 - protein, 16 aa, Giardia lamblia
NPTNLSPSSSQTSQVL

SEQ ID NO: 3125568 - protein, 7 aa, Giardia lamblia
NPTSSSV

SEQ ID NO: 3125569 - protein, 9 aa, Giardia lamblia
NPTSTQIKS

SEQ ID NO: 3125570 - protein, 6 aa, Giardia lamblia
NPTTGE

SEQ ID NO: 3125571 - protein, 13 aa, Giardia lamblia
NPTTTHKSNQTLG

SEQ ID NO: 3125572 - protein, 67 aa, Giardia lamblia
NPTYDDNVAPQRPVQHSPPPPQQQQQSDEKPKDSVKEDRIPEPRSPERPKSAIQRDEPTDPRSVPDP

SEQ ID NO: 3125573 - protein, 7 aa, Giardia lamblia
NPTYDNS

SEQ ID NO: 3125574 - protein, 9 aa, Giardia lamblia
NPVGASHNN

SEQ ID NO: 3125575 - protein, 6 aa, Giardia lamblia
NPVKKN

SEQ ID NO: 3125576 - protein, 15 aa, Giardia lamblia
NPVQRDSKQRGTYIP

SEQ ID NO: 3125577 - protein, 7 aa, Giardia lamblia
NPVQTSQ

SEQ ID NO: 3125578 - protein, 6 aa, Giardia lamblia
NPVSGQ

SEQ ID NO: 3125579 - protein, 11 aa, Giardia lamblia
NPVTAASDHGI

SEQ ID NO: 3125580 - protein, 8 aa, Giardia lamblia
NPVTGANK

SEQ ID NO: 3125581 - protein, 5 aa, Giardia lamblia
NPVYQ

SEQ ID NO: 3125582 - protein, 6 aa, Giardia lamblia
NPYNDK

SEQ ID NO: 3125583 - protein, 4 aa, Giardia lamblia
NPYP

SEQ ID NO: 3125584 - protein, 7 aa, Giardia lamblia
NPYPPNR

SEQ ID NO: 3125585 - protein, 4 aa, Giardia lamblia
NPYS

SEQ ID NO: 3125586 - protein, 10 aa, Giardia lamblia
NQAAAGVSPE

SEQ ID NO: 3125587 - protein, 8 aa, Giardia lamblia
NQAASIAD

SEQ ID NO: 3125588 - protein, 19 aa, Giardia lamblia
NQADNSQSSGQRYEDIEDR

SEQ ID NO: 3125589 - protein, 8 aa, Giardia lamblia
NQAKNYEQ

SEQ ID NO: 3125590 - protein, 5 aa, Giardia lamblia
NQAKV

SEQ ID NO: 3125591 - protein, 6 aa, Giardia lamblia
NQAQTA

SEQ ID NO: 3125592 - protein, 7 aa, Giardia lamblia
NQASANA

SEQ ID NO: 3125593 - protein, 9 aa, Giardia lamblia
NQASDALNT

SEQ ID NO: 3125594 - protein, 4 aa, Giardia lamblia
NQAT

SEQ ID NO: 3125595 - protein, 4 aa, Giardia lamblia
NQDE

SEQ ID NO: 3125596 - protein, 6 aa, Giardia lamblia
NQDGSY

SEQ ID NO: 3125597 - protein, 6 aa, Giardia lamblia
NQDLSN

SEQ ID NO: 3125598 - protein, 15 aa, Giardia lamblia
NQDPANAGVDTRCTS

SEQ ID NO: 3125599 - protein, 10 aa, Giardia lamblia
NQDQLDPKHT

SEQ ID NO: 3125600 - protein, 6 aa, Giardia lamblia
NQDSPQ

SEQ ID NO: 3125601 - protein, 12 aa, Giardia lamblia
NQEDNVDGSGNE

SEQ ID NO: 3125602 - protein, 6 aa, Giardia lamblia
NQEEYD

SEQ ID NO: 3125603 - protein, 14 aa, Giardia lamblia
NQEGAHSAKSAPKV

SEQ ID NO: 3125604 - protein, 6 aa, Giardia lamblia
NQEKEA

SEQ ID NO: 3125605 - protein, 5 aa, Giardia lamblia
NQELR

SEQ ID NO: 3125606 - protein, 5 aa, Giardia lamblia
NQEQE

SEQ ID NO: 3125607 - protein, 6 aa, Giardia lamblia
NQEQSF

SEQ ID NO: 3125608 - protein, 31 aa, Giardia lamblia
NQESGGAPDQRSQSPRQTDLSVEPDKDGNTT

SEQ ID NO: 3125609 - protein, 10 aa, Giardia lamblia
NQETENPKFD

SEQ ID NO: 3125610 - protein, 5 aa, Giardia lamblia
NQFNR

SEQ ID NO: 3125611 - protein, 7 aa, Giardia lamblia
NQFPPTS

SEQ ID NO: 3125612 - protein, 7 aa, Giardia lamblia
NQGAGVR

SEQ ID NO: 3125613 - protein, 6 aa, Giardia lamblia
NQGDAS

SEQ ID NO: 3125614 - protein, 4 aa, Giardia lamblia
NQGN

SEQ ID NO: 3125615 - protein, 7 aa, Giardia lamblia
NQGPPHG

SEQ ID NO: 3125616 - protein, 8 aa, Giardia lamblia
NQGSMGTT

SEQ ID NO: 3125617 - protein, 13 aa, Giardia lamblia
NQGSNESPLRDAS

SEQ ID NO: 3125618 - protein, 11 aa, Giardia lamblia
NQGSSTGTTVI

SEQ ID NO: 3125619 - protein, 9 aa, Giardia lamblia
NQGVSSMPP

SEQ ID NO: 3125620 - protein, 10 aa, Giardia lamblia
NQHDNVDTAH

SEQ ID NO: 3125621 - protein, 27 aa, Giardia lamblia
NQIEDAAREANRLSGSSSRGNGYGYGG

SEQ ID NO: 3125622 - protein, 4 aa, Giardia lamblia
NQIG

SEQ ID NO: 3125623 - protein, 11 aa, Giardia lamblia
NQIRSSKTSLD

SEQ ID NO: 3125624 - protein, 27 aa, Giardia lamblia
NQIRTQQAAQLNEPSPINNDPHHDSVE

SEQ ID NO: 3125625 - protein, 12 aa, Giardia lamblia
NQISRDTSGSIR

SEQ ID NO: 3125626 - protein, 7 aa, Giardia lamblia
NQKKQNI

SEQ ID NO: 3125627 - protein, 6 aa, Giardia lamblia
NQKNAD

SEQ ID NO: 3125628 - protein, 13 aa, Giardia lamblia
NQKQQQQQQPIDS

SEQ ID NO: 3125629 - protein, 5 aa, Giardia lamblia
NQKRY

SEQ ID NO: 3125630 - protein, 14 aa, Giardia lamblia
NQKTSTADGTIGRP

SEQ ID NO: 3125631 - protein, 8 aa, Giardia lamblia
NQKTTITE

SEQ ID NO: 3125632 - protein, 8 aa, Giardia lamblia
NQKYKNHT

SEQ ID NO: 3125633 - protein, 4 aa, Giardia lamblia
NQLP

SEQ ID NO: 3125634 - protein, 7 aa, Giardia lamblia
NQLPANP

SEQ ID NO: 3125635 - protein, 17 aa, Giardia lamblia
NQLSDKEKKNDDGDTAL

SEQ ID NO: 3125636 - protein, 9 aa, Giardia lamblia
NQLSERDAT

SEQ ID NO: 3125637 - protein, 22 aa, Giardia lamblia
NQLYPTDSKGREYYASADGNEI

SEQ ID NO: 3125638 - protein, 8 aa, Giardia lamblia
NQMSANQI

SEQ ID NO: 3125639 - protein, 7 aa, Giardia lamblia
NQMSRER

SEQ ID NO: 3125640 - protein, 4 aa, Giardia lamblia
NQNG

SEQ ID NO: 3125641 - protein, 4 aa, Giardia lamblia
NQPA

SEQ ID NO: 3125642 - protein, 6 aa, Giardia lamblia
NQPAHS

SEQ ID NO: 3125643 - protein, 5 aa, Giardia lamblia
NQPES

SEQ ID NO: 3125644 - protein, 6 aa, Giardia lamblia
NQPLPR

SEQ ID NO: 3125645 - protein, 7 aa, Giardia lamblia
NQPPAQL

SEQ ID NO: 3125646 - protein, 5 aa, Giardia lamblia
NQPQS

SEQ ID NO: 3125647 - protein, 6 aa, Giardia lamblia
NQPRGA

SEQ ID NO: 3125648 - protein, 7 aa, Giardia lamblia
NQPRPVM

SEQ ID NO: 3125649 - protein, 15 aa, Giardia lamblia
NQPSTKTIQKEKQKI

SEQ ID NO: 3125650 - protein, 20 aa, Giardia lamblia
NQQAKKAKSNPNSIDNDEAV

SEQ ID NO: 3125651 - protein, 7 aa, Giardia lamblia
NQQAQIE

SEQ ID NO: 3125652 - protein, 4 aa, Giardia lamblia
NQQC

SEQ ID NO: 3125653 - protein, 47 aa, Giardia lamblia
NQQGNQLDAPSSASKAGTDRALTKGPSLLSASTSGHRDNGATSLNDE

SEQ ID NO: 3125654 - protein, 20 aa, Giardia lamblia
NQQITRESCHSTKSNSEEPL

SEQ ID NO: 3125655 - protein, 4 aa, Giardia lamblia
NQQL

SEQ ID NO: 3125656 - protein, 5 aa, Giardia lamblia
NQQRS

SEQ ID NO: 3125657 - protein, 7 aa, Giardia lamblia
NQQSPSP

SEQ ID NO: 3125658 - protein, 12 aa, Giardia lamblia
NQQSRLSGARPS

SEQ ID NO: 3125659 - protein, 8 aa, Giardia lamblia
NQRAARPG

SEQ ID NO: 3125660 - protein, 10 aa, Giardia lamblia
NQRKQYSSGR

SEQ ID NO: 3125661 - protein, 28 aa, Giardia lamblia
NQRPSATTETPNENQRTNTAGCMQESAG

SEQ ID NO: 3125662 - protein, 7 aa, Giardia lamblia
NQRQDSM

SEQ ID NO: 3125663 - protein, 4 aa, Giardia lamblia
NQRR

SEQ ID NO: 3125664 - protein, 12 aa, Giardia lamblia
NQRRTPTSGNQL

SEQ ID NO: 3125665 - protein, 7 aa, Giardia lamblia
NQRSNVP

SEQ ID NO: 3125666 - protein, 20 aa, Giardia lamblia
NQRTEQKRVDDEQAEITDDD

SEQ ID NO: 3125667 - protein, 14 aa, Giardia lamblia
NQRTSKEHKRPDSI

SEQ ID NO: 3125668 - protein, 6 aa, Giardia lamblia
NQSDDS

SEQ ID NO: 3125669 - protein, 6 aa, Giardia lamblia
NQSDPT

SEQ ID NO: 3125670 - protein, 7 aa, Giardia lamblia
NQSDTPI

SEQ ID NO: 3125671 - protein, 10 aa, Giardia lamblia
NQSFSQRTGE

SEQ ID NO: 3125672 - protein, 16 aa, Giardia lamblia
NQSGPTVATPPSKRRN

SEQ ID NO: 3125673 - protein, 7 aa, Giardia lamblia
NQSIETE

SEQ ID NO: 3125674 - protein, 13 aa, Giardia lamblia
NQSISQQPAIASG

SEQ ID NO: 3125675 - protein, 4 aa, Giardia lamblia
NQSL

SEQ ID NO: 3125676 - protein, 7 aa, Giardia lamblia
NQSLPNN

SEQ ID NO: 3125677 - protein, 10 aa, Giardia lamblia
NQSLTATKEL

SEQ ID NO: 3125678 - protein, 21 aa, Giardia lamblia
NQSMQSTDAFNTSTMSTGNIP

SEQ ID NO: 3125679 - protein, 13 aa, Giardia lamblia
NQSPAQSGDAQTV

SEQ ID NO: 3125680 - protein, 17 aa, Giardia lamblia
NQSQAVADGHDSGVLDS

SEQ ID NO: 3125681 - protein, 7 aa, Giardia lamblia
NQSQHQE

SEQ ID NO: 3125682 - protein, 5 aa, Giardia lamblia
NQSTS

SEQ ID NO: 3125683 - protein, 24 aa, Giardia lamblia
NQSTSTVKNHGTVTSPAEALPVSS

SEQ ID NO: 3125684 - protein, 11 aa, Giardia lamblia
NQTAYSSNASL

SEQ ID NO: 3125685 - protein, 9 aa, Giardia lamblia
NQTDPQRPK

SEQ ID NO: 3125686 - protein, 5 aa, Giardia lamblia
NQTDS

SEQ ID NO: 3125687 - protein, 4 aa, Giardia lamblia
NQTE

SEQ ID NO: 3125688 - protein, 7 aa, Giardia lamblia
NQTEDAN

SEQ ID NO: 3125689 - protein, 6 aa, Giardia lamblia
NQTPQK

SEQ ID NO: 3125690 - protein, 12 aa, Giardia lamblia
NQTRGYSPWDTG

SEQ ID NO: 3125691 - protein, 6 aa, Giardia lamblia
NQTSEI

SEQ ID NO: 3125692 - protein, 6 aa, Giardia lamblia
NQTTGA

SEQ ID NO: 3125693 - protein, 16 aa, Giardia lamblia
NQVAEGEKLKRETSDA

SEQ ID NO: 3125694 - protein, 7 aa, Giardia lamblia
NQVAKTA

SEQ ID NO: 3125695 - protein, 7 aa, Giardia lamblia
NQVPPSN

SEQ ID NO: 3125696 - protein, 7 aa, Giardia lamblia
NQVQNGD

SEQ ID NO: 3125697 - protein, 13 aa, Giardia lamblia
NQVSDSSTDVNSH

SEQ ID NO: 3125698 - protein, 5 aa, Giardia lamblia
NQVTR

SEQ ID NO: 3125699 - protein, 4 aa, Giardia lamblia
NQWG

SEQ ID NO: 3125700 - protein, 6 aa, Giardia lamblia
NQYSAA

SEQ ID NO: 3125701 - protein, 5 aa, Giardia lamblia
NRAED

SEQ ID NO: 3125702 - protein, 7 aa, Giardia lamblia
NRAGETP

SEQ ID NO: 3125703 - protein, 4 aa, Giardia lamblia
NRAI

SEQ ID NO: 3125704 - protein, 7 aa, Giardia lamblia
NRALESQ

SEQ ID NO: 3125705 - protein, 9 aa, Giardia lamblia
NRAMKDGTT

SEQ ID NO: 3125706 - protein, 7 aa, Giardia lamblia
NRAPGTT

SEQ ID NO: 3125707 - protein, 6 aa, Giardia lamblia
NRAPTW

SEQ ID NO: 3125708 - protein, 13 aa, Giardia lamblia
NRASAPSTPGTQL

SEQ ID NO: 3125709 - protein, 13 aa, Giardia lamblia
NRAVPEPRKLNDN

SEQ ID NO: 3125710 - protein, 9 aa, Giardia lamblia
NRCSNSYYK

SEQ ID NO: 3125711 - protein, 4 aa, Giardia lamblia
NRDK

SEQ ID NO: 3125712 - protein, 6 aa, Giardia lamblia
NRDLDS

SEQ ID NO: 3125713 - protein, 4 aa, Giardia lamblia
NRDT

SEQ ID NO: 3125714 - protein, 6 aa, Giardia lamblia
NRDTRL

SEQ ID NO: 3125715 - protein, 10 aa, Giardia lamblia
NREATQGETE

SEQ ID NO: 3125716 - protein, 22 aa, Giardia lamblia
NREFGVPRSDAACTGNLPPRSL

SEQ ID NO: 3125717 - protein, 24 aa, Giardia lamblia
NREISAEQDHRQSGVNRGKNLTQS

SEQ ID NO: 3125718 - protein, 5 aa, Giardia lamblia
NREKY

SEQ ID NO: 3125719 - protein, 5 aa, Giardia lamblia
NRELR

SEQ ID NO: 3125720 - protein, 12 aa, Giardia lamblia
NRENRSASEIRD

SEQ ID NO: 3125721 - protein, 19 aa, Giardia lamblia
NREPSGTPYSDPVDDDGVQ

SEQ ID NO: 3125722 - protein, 11 aa, Giardia lamblia
NREPSRTEKEA

SEQ ID NO: 3125723 - protein, 8 aa, Giardia lamblia
NREQGSPV

SEQ ID NO: 3125724 - protein, 6 aa, Giardia lamblia
NRESGR

SEQ ID NO: 3125725 - protein, 15 aa, Giardia lamblia
NRESIGDRGSVSSSF

SEQ ID NO: 3125726 - protein, 13 aa, Giardia lamblia
NREVSADDAKGVN

SEQ ID NO: 3125727 - protein, 4 aa, Giardia lamblia
NRGA

SEQ ID NO: 3125728 - protein, 8 aa, Giardia lamblia
NRGAPQSH

SEQ ID NO: 3125729 - protein, 9 aa, Giardia lamblia
NRGELQEEE

SEQ ID NO: 3125730 - protein, 6 aa, Giardia lamblia
NRGGEI

SEQ ID NO: 3125731 - protein, 6 aa, Giardia lamblia
NRGLSG

SEQ ID NO: 3125732 - protein, 7 aa, Giardia lamblia
NRGPSTH

SEQ ID NO: 3125733 - protein, 4 aa, Giardia lamblia
NRGR

SEQ ID NO: 3125734 - protein, 5 aa, Giardia lamblia
NRGYT

SEQ ID NO: 3125735 - protein, 9 aa, Giardia lamblia
NRHPASGMG

SEQ ID NO: 3125736 - protein, 5 aa, Giardia lamblia
NRHYQ

SEQ ID NO: 3125737 - protein, 20 aa, Giardia lamblia
NRIDSPQGEISLTEDDTVET

SEQ ID NO: 3125738 - protein, 13 aa, Giardia lamblia
NRIDTVPHTARSV

SEQ ID NO: 3125739 - protein, 5 aa, Giardia lamblia
NRIED

SEQ ID NO: 3125740 - protein, 8 aa, Giardia lamblia
NRIEGSEE

SEQ ID NO: 3125741 - protein, 5 aa, Giardia lamblia
NRIET

SEQ ID NO: 3125742 - protein, 17 aa, Giardia lamblia
NRIKARGQELQKASSCL

SEQ ID NO: 3125743 - protein, 8 aa, Giardia lamblia
NRIQQKDE

SEQ ID NO: 3125744 - protein, 6 aa, Giardia lamblia
NRIQRE

SEQ ID NO: 3125745 - protein, 4 aa, Giardia lamblia
NRIS

SEQ ID NO: 3125746 - protein, 11 aa, Giardia lamblia
NRISAEERARL

SEQ ID NO: 3125747 - protein, 5 aa, Giardia lamblia
NRKEL

SEQ ID NO: 3125748 - protein, 8 aa, Giardia lamblia
NRKPISDD

SEQ ID NO: 3125749 - protein, 5 aa, Giardia lamblia
NRKSI

SEQ ID NO: 3125750 - protein, 6 aa, Giardia lamblia
NRKSLA

SEQ ID NO: 3125751 - protein, 11 aa, Giardia lamblia
NRKSLQTATTA

SEQ ID NO: 3125752 - protein, 14 aa, Giardia lamblia
NRKSYQSASATFRG

SEQ ID NO: 3125753 - protein, 7 aa, Giardia lamblia
NRKTDFT

SEQ ID NO: 3125754 - protein, 7 aa, Giardia lamblia
NRKTLAE

SEQ ID NO: 3125755 - protein, 8 aa, Giardia lamblia
NRKTNETV

SEQ ID NO: 3125756 - protein, 6 aa, Giardia lamblia
NRLDEH

SEQ ID NO: 3125757 - protein, 7 aa, Giardia lamblia
NRLGNAG

SEQ ID NO: 3125758 - protein, 6 aa, Giardia lamblia
NRLNQE

SEQ ID NO: 3125759 - protein, 16 aa, Giardia lamblia
NRLSGADALGQGPRLK

SEQ ID NO: 3125760 - protein, 6 aa, Giardia lamblia
NRLSTE

SEQ ID NO: 3125761 - protein, 7 aa, Giardia lamblia
NRLTSTG

SEQ ID NO: 3125762 - protein, 10 aa, Giardia lamblia
NRMQAGTLSQ

SEQ ID NO: 3125763 - protein, 25 aa, Giardia lamblia
NRNAKSTPEPVSTLAPKSARPASPS

SEQ ID NO: 3125764 - protein, 7 aa, Giardia lamblia
NRNETPL

SEQ ID NO: 3125765 - protein, 8 aa, Giardia lamblia
NRNGIAEK

SEQ ID NO: 3125766 - protein, 6 aa, Giardia lamblia
NRNNGS

SEQ ID NO: 3125767 - protein, 13 aa, Giardia lamblia
NRNQEMREQPIAE

SEQ ID NO: 3125768 - protein, 8 aa, Giardia lamblia
NRNRDADI

SEQ ID NO: 3125769 - protein, 8 aa, Giardia lamblia
NRNSPITA

SEQ ID NO: 3125770 - protein, 8 aa, Giardia lamblia
NRNVDTGV

SEQ ID NO: 3125771 - protein, 5 aa, Giardia lamblia
NRPCS

SEQ ID NO: 3125772 - protein, 7 aa, Giardia lamblia
NRPDAQR

SEQ ID NO: 3125773 - protein, 6 aa, Giardia lamblia
NRPDTI

SEQ ID NO: 3125774 - protein, 6 aa, Giardia lamblia
NRPGSL

SEQ ID NO: 3125775 - protein, 6 aa, Giardia lamblia
NRPGVS

SEQ ID NO: 3125776 - protein, 5 aa, Giardia lamblia
NRPHY

SEQ ID NO: 3125777 - protein, 4 aa, Giardia lamblia
NRPN

SEQ ID NO: 3125778 - protein, 6 aa, Giardia lamblia
NRPNSS

SEQ ID NO: 3125779 - protein, 10 aa, Giardia lamblia
NRPNSSVDRH

SEQ ID NO: 3125780 - protein, 5 aa, Giardia lamblia
NRPNV

SEQ ID NO: 3125781 - protein, 10 aa, Giardia lamblia
NRPPPSQHSR

SEQ ID NO: 3125782 - protein, 10 aa, Giardia lamblia
NRPPRDTTET

SEQ ID NO: 3125783 - protein, 6 aa, Giardia lamblia
NRPREA

SEQ ID NO: 3125784 - protein, 4 aa, Giardia lamblia
NRPS

SEQ ID NO: 3125785 - protein, 5 aa, Giardia lamblia
NRPSE

SEQ ID NO: 3125786 - protein, 11 aa, Giardia lamblia
NRPTKSAVQQE

SEQ ID NO: 3125787 - protein, 10 aa, Giardia lamblia
NRQAGPEEPL

SEQ ID NO: 3125788 - protein, 22 aa, Giardia lamblia
NRQAPSHSATSLRARNSNKPLS

SEQ ID NO: 3125789 - protein, 8 aa, Giardia lamblia
NRQDGTGW

SEQ ID NO: 3125790 - protein, 7 aa, Giardia lamblia
NRQGLAQ

SEQ ID NO: 3125791 - protein, 11 aa, Giardia lamblia
NRQLPGGSNGF

SEQ ID NO: 3125792 - protein, 5 aa, Giardia lamblia
NRQSI

SEQ ID NO: 3125793 - protein, 11 aa, Giardia lamblia
NRRASAYTTND

SEQ ID NO: 3125794 - protein, 9 aa, Giardia lamblia
NRRDLENSK

SEQ ID NO: 3125795 - protein, 5 aa, Giardia lamblia
NRRIT

SEQ ID NO: 3125796 - protein, 4 aa, Giardia lamblia
NRRL

SEQ ID NO: 3125797 - protein, 7 aa, Giardia lamblia
NRRLTQP

SEQ ID NO: 3125798 - protein, 13 aa, Giardia lamblia
NRRPRAADKGDLA

SEQ ID NO: 3125799 - protein, 16 aa, Giardia lamblia
NRRSPRPTRSARSREL

SEQ ID NO: 3125800 - protein, 5 aa, Giardia lamblia
NRRSV

SEQ ID NO: 3125801 - protein, 5 aa, Giardia lamblia
NRRVE

SEQ ID NO: 3125802 - protein, 9 aa, Giardia lamblia
NRSEKFSEE

SEQ ID NO: 3125803 - protein, 8 aa, Giardia lamblia
NRSEPAFS

SEQ ID NO: 3125804 - protein, 9 aa, Giardia lamblia
NRSEQPADL

SEQ ID NO: 3125805 - protein, 10 aa, Giardia lamblia
NRSESPKSTP

SEQ ID NO: 3125806 - protein, 22 aa, Giardia lamblia
NRSFESSTNYADQTASRLTNGS

SEQ ID NO: 3125807 - protein, 21 aa, Giardia lamblia
NRSGAESLTLDPPSLSQSGGY

SEQ ID NO: 3125808 - protein, 7 aa, Giardia lamblia
NRSGDKQ

SEQ ID NO: 3125809 - protein, 5 aa, Giardia lamblia
NRSGL

SEQ ID NO: 3125810 - protein, 5 aa, Giardia lamblia
NRSGQ

SEQ ID NO: 3125811 - protein, 5 aa, Giardia lamblia
NRSRY

SEQ ID NO: 3125812 - protein, 5 aa, Giardia lamblia
NRSSF

SEQ ID NO: 3125813 - protein, 8 aa, Giardia lamblia
NRSTGKPA

SEQ ID NO: 3125814 - protein, 4 aa, Giardia lamblia
NRSV

SEQ ID NO: 3125815 - protein, 6 aa, Giardia lamblia
NRSYPT

SEQ ID NO: 3125816 - protein, 4 aa, Giardia lamblia
NRTA

SEQ ID NO: 3125817 - protein, 8 aa, Giardia lamblia
NRTATETV

SEQ ID NO: 3125818 - protein, 8 aa, Giardia lamblia
NRTDGPCT

SEQ ID NO: 3125819 - protein, 6 aa, Giardia lamblia
NRTGQW

SEQ ID NO: 3125820 - protein, 13 aa, Giardia lamblia
NRTGTAKPKGLTA

SEQ ID NO: 3125821 - protein, 4 aa, Giardia lamblia
NRTI

SEQ ID NO: 3125822 - protein, 5 aa, Giardia lamblia
NRTIP

SEQ ID NO: 3125823 - protein, 6 aa, Giardia lamblia
NRTKSL

SEQ ID NO: 3125824 - protein, 5 aa, Giardia lamblia
NRTQQ

SEQ ID NO: 3125825 - protein, 8 aa, Giardia lamblia
NRTSLRSE

SEQ ID NO: 3125826 - protein, 8 aa, Giardia lamblia
NRTTGAMN

SEQ ID NO: 3125827 - protein, 11 aa, Giardia lamblia
NRTYDGETPER

SEQ ID NO: 3125828 - protein, 9 aa, Giardia lamblia
NRVDSNGST

SEQ ID NO: 3125829 - protein, 12 aa, Giardia lamblia
NRVQDKDKPGQF

SEQ ID NO: 3125830 - protein, 15 aa, Giardia lamblia
NRVREEAEQAIRDAR

SEQ ID NO: 3125831 - protein, 9 aa, Giardia lamblia
NRWTSTGNE

SEQ ID NO: 3125832 - protein, 12 aa, Giardia lamblia
NRYAKERDREYA

SEQ ID NO: 3125833 - protein, 6 aa, Giardia lamblia
NRYDAK

SEQ ID NO: 3125834 - protein, 8 aa, Giardia lamblia
NSAEKLEN

SEQ ID NO: 3125835 - protein, 7 aa, Giardia lamblia
NSAELTK

SEQ ID NO: 3125836 - protein, 6 aa, Giardia lamblia
NSAEST

SEQ ID NO: 3125837 - protein, 10 aa, Giardia lamblia
NSAETNDELG

SEQ ID NO: 3125838 - protein, 4 aa, Giardia lamblia
NSAF

SEQ ID NO: 3125839 - protein, 4 aa, Giardia lamblia
NSAG

SEQ ID NO: 3125840 - protein, 8 aa, Giardia lamblia
NSAKIEGK

SEQ ID NO: 3125841 - protein, 22 aa, Giardia lamblia
NSAKSADDTGQPNQPTESSSIK

SEQ ID NO: 3125842 - protein, 6 aa, Giardia lamblia
NSANAS

SEQ ID NO: 3125843 - protein, 8 aa, Giardia lamblia
NSAPNRAT

SEQ ID NO: 3125844 - protein, 8 aa, Giardia lamblia
NSAQQNTS

SEQ ID NO: 3125845 - protein, 8 aa, Giardia lamblia
NSAQQTLT

SEQ ID NO: 3125846 - protein, 9 aa, Giardia lamblia
NSARGTPAN

SEQ ID NO: 3125847 - protein, 9 aa, Giardia lamblia
NSARTNTTG

SEQ ID NO: 3125848 - protein, 9 aa, Giardia lamblia
NSASETADL

SEQ ID NO: 3125849 - protein, 15 aa, Giardia lamblia
NSASINEVEANKKIQ

SEQ ID NO: 3125850 - protein, 40 aa, Giardia lamblia
NSATGSVVDGRGSYLSTGNYGASSASRKAYEDNINNDNGA

SEQ ID NO: 3125851 - protein, 34 aa, Giardia lamblia
NSAVSSSNLNPQKKNQTKTQRTASKPARNHALSA

SEQ ID NO: 3125852 - protein, 8 aa, Giardia lamblia
NSCIGPKK

SEQ ID NO: 3125853 - protein, 9 aa, Giardia lamblia
NSCSTHQRP

SEQ ID NO: 3125854 - protein, 27 aa, Giardia lamblia
NSCTSSRAADEDVACNPGDEPKTGPAE

SEQ ID NO: 3125855 - protein, 4 aa, Giardia lamblia
NSDA

SEQ ID NO: 3125856 - protein, 9 aa, Giardia lamblia
NSDAGGGSM

SEQ ID NO: 3125857 - protein, 13 aa, Giardia lamblia
NSDAGSRNSPTIK

SEQ ID NO: 3125858 - protein, 10 aa, Giardia lamblia
NSDASEGASD

SEQ ID NO: 3125859 - protein, 7 aa, Giardia lamblia
NSDDDGF

SEQ ID NO: 3125860 - protein, 12 aa, Giardia lamblia
NSDDRKLGVPPV

SEQ ID NO: 3125861 - protein, 10 aa, Giardia lamblia
NSDEAARFAK

SEQ ID NO: 3125862 - protein, 7 aa, Giardia lamblia
NSDEYKR

SEQ ID NO: 3125863 - protein, 4 aa, Giardia lamblia
NSDG

SEQ ID NO: 3125864 - protein, 6 aa, Giardia lamblia
NSDGAE

SEQ ID NO: 3125865 - protein, 18 aa, Giardia lamblia
NSDGTLTLESRGRQRTKI

SEQ ID NO: 3125866 - protein, 23 aa, Giardia lamblia
NSDHPTSVPATSLPTPSYSGSAH

SEQ ID NO: 3125867 - protein, 5 aa, Giardia lamblia
NSDIA

SEQ ID NO: 3125868 - protein, 5 aa, Giardia lamblia
NSDIE

SEQ ID NO: 3125869 - protein, 9 aa, Giardia lamblia
NSDKTPGEY

SEQ ID NO: 3125870 - protein, 11 aa, Giardia lamblia
NSDLRGQSTAL

SEQ ID NO: 3125871 - protein, 10 aa, Giardia lamblia
NSDNDIKGKI

SEQ ID NO: 3125872 - protein, 5 aa, Giardia lamblia
NSDNK

SEQ ID NO: 3125873 - protein, 9 aa, Giardia lamblia
NSDPGEETL

SEQ ID NO: 3125874 - protein, 7 aa, Giardia lamblia
NSDPKFK

SEQ ID NO: 3125875 - protein, 8 aa, Giardia lamblia
NSDRSASR

SEQ ID NO: 3125876 - protein, 9 aa, Giardia lamblia
NSDSAAYEA

SEQ ID NO: 3125877 - protein, 6 aa, Giardia lamblia
NSDSDD

SEQ ID NO: 3125878 - protein, 7 aa, Giardia lamblia
NSDSEEL

SEQ ID NO: 3125879 - protein, 6 aa, Giardia lamblia
NSDSSY

SEQ ID NO: 3125880 - protein, 8 aa, Giardia lamblia
NSDSTPTW

SEQ ID NO: 3125881 - protein, 12 aa, Giardia lamblia
NSDYSGGEHDGS

SEQ ID NO: 3125882 - protein, 6 aa, Giardia lamblia
NSEADG

SEQ ID NO: 3125883 - protein, 12 aa, Giardia lamblia
NSEADGAGATNI

SEQ ID NO: 3125884 - protein, 10 aa, Giardia lamblia
NSEAEHTINS

SEQ ID NO: 3125885 - protein, 4 aa, Giardia lamblia
NSED

SEQ ID NO: 3125886 - protein, 33 aa, Giardia lamblia
NSEDETEAISPRTPNCPETPGSRRITPRSQSTV

SEQ ID NO: 3125887 - protein, 6 aa, Giardia lamblia
NSEDVS

SEQ ID NO: 3125888 - protein, 6 aa, Giardia lamblia
NSEGKT

SEQ ID NO: 3125889 - protein, 5 aa, Giardia lamblia
NSEIA

SEQ ID NO: 3125890 - protein, 6 aa, Giardia lamblia
NSEIET

SEQ ID NO: 3125891 - protein, 7 aa, Giardia lamblia
NSEISEL

SEQ ID NO: 3125892 - protein, 7 aa, Giardia lamblia
NSEITEL

SEQ ID NO: 3125893 - protein, 4 aa, Giardia lamblia
NSEN

SEQ ID NO: 3125894 - protein, 6 aa, Giardia lamblia
NSEPIG

SEQ ID NO: 3125895 - protein, 11 aa, Giardia lamblia
NSEPMKDKPYT

SEQ ID NO: 3125896 - protein, 9 aa, Giardia lamblia
NSEPYGKKS

SEQ ID NO: 3125897 - protein, 19 aa, Giardia lamblia
NSERGKTKPYYTYNPGTSM

SEQ ID NO: 3125898 - protein, 7 aa, Giardia lamblia
NSERPDC

SEQ ID NO: 3125899 - protein, 7 aa, Giardia lamblia
NSESVSY

SEQ ID NO: 3125900 - protein, 7 aa, Giardia lamblia
NSETSNV

SEQ ID NO: 3125901 - protein, 10 aa, Giardia lamblia
NSEVDGSDHR

SEQ ID NO: 3125902 - protein, 5 aa, Giardia lamblia
NSEYH

SEQ ID NO: 3125903 - protein, 14 aa, Giardia lamblia
NSFEGDDNEDEDDA

SEQ ID NO: 3125904 - protein, 4 aa, Giardia lamblia
NSFI

SEQ ID NO: 3125905 - protein, 10 aa, Giardia lamblia
NSFNNPEGEY

SEQ ID NO: 3125906 - protein, 6 aa, Giardia lamblia
NSFQPG

SEQ ID NO: 3125907 - protein, 7 aa, Giardia lamblia
NSFSSPS

SEQ ID NO: 3125908 - protein, 12 aa, Giardia lamblia
NSGAAPPPSLPS

SEQ ID NO: 3125909 - protein, 6 aa, Giardia lamblia
NSGDRE

SEQ ID NO: 3125910 - protein, 7 aa, Giardia lamblia
NSGGTMN

SEQ ID NO: 3125911 - protein, 7 aa, Giardia lamblia
NSGGYNT

SEQ ID NO: 3125912 - protein, 13 aa, Giardia lamblia
NSGHNLHEDDPNT

SEQ ID NO: 3125913 - protein, 11 aa, Giardia lamblia
NSGIGGNSGIP

SEQ ID NO: 3125914 - protein, 13 aa, Giardia lamblia
NSGIHGVNDPEHV

SEQ ID NO: 3125915 - protein, 7 aa, Giardia lamblia
NSGKELS

SEQ ID NO: 3125916 - protein, 6 aa, Giardia lamblia
NSGKTT

SEQ ID NO: 3125917 - protein, 4 aa, Giardia lamblia
NSGN

SEQ ID NO: 3125918 - protein, 9 aa, Giardia lamblia
NSGNVGTAR

SEQ ID NO: 3125919 - protein, 9 aa, Giardia lamblia
NSGPGSSIR

SEQ ID NO: 3125920 - protein, 7 aa, Giardia lamblia
NSGSDLQ

SEQ ID NO: 3125921 - protein, 8 aa, Giardia lamblia
NSGSGKTT

SEQ ID NO: 3125922 - protein, 13 aa, Giardia lamblia
NSGSSASVRNRST

SEQ ID NO: 3125923 - protein, 5 aa, Giardia lamblia
NSGVA

SEQ ID NO: 3125924 - protein, 6 aa, Giardia lamblia
NSHAEA

SEQ ID NO: 3125925 - protein, 7 aa, Giardia lamblia
NSHDSSI

SEQ ID NO: 3125926 - protein, 6 aa, Giardia lamblia
NSHFTR

SEQ ID NO: 3125927 - protein, 13 aa, Giardia lamblia
NSHGPDPAKAGKL

SEQ ID NO: 3125928 - protein, 10 aa, Giardia lamblia
NSHGPDPSLD

SEQ ID NO: 3125929 - protein, 7 aa, Giardia lamblia
NSHGVSA

SEQ ID NO: 3125930 - protein, 10 aa, Giardia lamblia
NSIAGSRRIA

SEQ ID NO: 3125931 - protein, 5 aa, Giardia lamblia
NSIAT

SEQ ID NO: 3125932 - protein, 11 aa, Giardia lamblia
NSIDSNSLSQM

SEQ ID NO: 3125933 - protein, 5 aa, Giardia lamblia
NSIEQ

SEQ ID NO: 3125934 - protein, 7 aa, Giardia lamblia
NSIEQDH

SEQ ID NO: 3125935 - protein, 5 aa, Giardia lamblia
NSIGS

SEQ ID NO: 3125936 - protein, 8 aa, Giardia lamblia
NSINETTK

SEQ ID NO: 3125937 - protein, 22 aa, Giardia lamblia
NSINSRGASRATSPNHGARSSG

SEQ ID NO: 3125938 - protein, 14 aa, Giardia lamblia
NSIPVKTANDCPVA

SEQ ID NO: 3125939 - protein, 14 aa, Giardia lamblia
NSIRSRKISNTETD

SEQ ID NO: 3125940 - protein, 7 aa, Giardia lamblia
NSISHTG

SEQ ID NO: 3125941 - protein, 21 aa, Giardia lamblia
NSISQIKKTTDLGRSSDVPRV

SEQ ID NO: 3125942 - protein, 5 aa, Giardia lamblia
NSITT

SEQ ID NO: 3125943 - protein, 5 aa, Giardia lamblia
NSKAA

SEQ ID NO: 3125944 - protein, 7 aa, Giardia lamblia
NSKADIS

SEQ ID NO: 3125945 - protein, 5 aa, Giardia lamblia
NSKAY

SEQ ID NO: 3125946 - protein, 9 aa, Giardia lamblia
NSKDANTIE

SEQ ID NO: 3125947 - protein, 25 aa, Giardia lamblia
NSKDSKDNKGNKQQKARDGQEDKHD

SEQ ID NO: 3125948 - protein, 6 aa, Giardia lamblia
NSKEEL

SEQ ID NO: 3125949 - protein, 8 aa, Giardia lamblia
NSKGFGDF

SEQ ID NO: 3125950 - protein, 8 aa, Giardia lamblia
NSKGQDCR

SEQ ID NO: 3125951 - protein, 7 aa, Giardia lamblia
NSKHDAS

SEQ ID NO: 3125952 - protein, 8 aa, Giardia lamblia
NSKHNCPK

SEQ ID NO: 3125953 - protein, 17 aa, Giardia lamblia
NSKHTASSKAKAKVTHT

SEQ ID NO: 3125954 - protein, 5 aa, Giardia lamblia
NSKKS

SEQ ID NO: 3125955 - protein, 9 aa, Giardia lamblia
NSKLDASRI

SEQ ID NO: 3125956 - protein, 9 aa, Giardia lamblia
NSKLSADAA

SEQ ID NO: 3125957 - protein, 7 aa, Giardia lamblia
NSKSPAM

SEQ ID NO: 3125958 - protein, 34 aa, Giardia lamblia
NSKSQSSVEKGAHTQDTGTCDEKDDNNELVISEV

SEQ ID NO: 3125959 - protein, 8 aa, Giardia lamblia
NSKSSTWH

SEQ ID NO: 3125960 - protein, 9 aa, Giardia lamblia
NSKTGSPMN

SEQ ID NO: 3125961 - protein, 6 aa, Giardia lamblia
NSKTHN

SEQ ID NO: 3125962 - protein, 5 aa, Giardia lamblia
NSKTL

SEQ ID NO: 3125963 - protein, 9 aa, Giardia lamblia
NSKVTSAEI

SEQ ID NO: 3125964 - protein, 7 aa, Giardia lamblia
NSLAPSN

SEQ ID NO: 3125965 - protein, 5 aa, Giardia lamblia
NSLDA

SEQ ID NO: 3125966 - protein, 11 aa, Giardia lamblia
NSLDTNGQQNH

SEQ ID NO: 3125967 - protein, 5 aa, Giardia lamblia
NSLED

SEQ ID NO: 3125968 - protein, 4 aa, Giardia lamblia
NSLG

SEQ ID NO: 3125969 - protein, 8 aa, Giardia lamblia
NSLGQNAE

SEQ ID NO: 3125970 - protein, 25 aa, Giardia lamblia
NSLGTATASSTQDLEGVNDSSAMGS

SEQ ID NO: 3125971 - protein, 11 aa, Giardia lamblia
NSLNPSDARTD

SEQ ID NO: 3125972 - protein, 6 aa, Giardia lamblia
NSLQRG

SEQ ID NO: 3125973 - protein, 6 aa, Giardia lamblia
NSLRPN

SEQ ID NO: 3125974 - protein, 9 aa, Giardia lamblia
NSLSEARRK

SEQ ID NO: 3125975 - protein, 14 aa, Giardia lamblia
NSLSNDAANTHSTE

SEQ ID NO: 3125976 - protein, 14 aa, Giardia lamblia
NSLSPEASPPSPGV

SEQ ID NO: 3125977 - protein, 11 aa, Giardia lamblia
NSLSPPSLEGL

SEQ ID NO: 3125978 - protein, 7 aa, Giardia lamblia
NSLSSRS

SEQ ID NO: 3125979 - protein, 4 aa, Giardia lamblia
NSME

SEQ ID NO: 3125980 - protein, 4 aa, Giardia lamblia
NSMG

SEQ ID NO: 3125981 - protein, 30 aa, Giardia lamblia
NSMKAEGEKVRQKGQVVDGDTGAKANEGAH

SEQ ID NO: 3125982 - protein, 6 aa, Giardia lamblia
NSMPPR

SEQ ID NO: 3125983 - protein, 7 aa, Giardia lamblia
NSMSDEE

SEQ ID NO: 3125984 - protein, 9 aa, Giardia lamblia
NSNAESKID

SEQ ID NO: 3125985 - protein, 6 aa, Giardia lamblia
NSNAPD

SEQ ID NO: 3125986 - protein, 14 aa, Giardia lamblia
NSNASDKAIYDENG

SEQ ID NO: 3125987 - protein, 6 aa, Giardia lamblia
NSNDKR

SEQ ID NO: 3125988 - protein, 12 aa, Giardia lamblia
NSNEHSTSPMFP

SEQ ID NO: 3125989 - protein, 6 aa, Giardia lamblia
NSNETE

SEQ ID NO: 3125990 - protein, 13 aa, Giardia lamblia
NSNHNAFTSHPKS

SEQ ID NO: 3125991 - protein, 5 aa, Giardia lamblia
NSNNV

SEQ ID NO: 3125992 - protein, 4 aa, Giardia lamblia
NSNP

SEQ ID NO: 3125993 - protein, 9 aa, Giardia lamblia
NSNPITNTQ

SEQ ID NO: 3125994 - protein, 7 aa, Giardia lamblia
NSNPKIE

SEQ ID NO: 3125995 - protein, 29 aa, Giardia lamblia
NSNPTGKQYQYSTTNSIKPHGEFDSDGLD

SEQ ID NO: 3125996 - protein, 15 aa, Giardia lamblia
NSNQSNSGTIGLDGT

SEQ ID NO: 3125997 - protein, 15 aa, Giardia lamblia
NSNRRYSSTAFGGPG

SEQ ID NO: 3125998 - protein, 8 aa, Giardia lamblia
NSNSVSAQ

SEQ ID NO: 3125999 - protein, 11 aa, Giardia lamblia
NSNSYSSDDNI

SEQ ID NO: 3126000 - protein, 7 aa, Giardia lamblia
NSNTEGE

SEQ ID NO: 3126001 - protein, 9 aa, Giardia lamblia
NSNVTEEGY

SEQ ID NO: 3126002 - protein, 8 aa, Giardia lamblia
NSPASRSV

SEQ ID NO: 3126003 - protein, 4 aa, Giardia lamblia
NSPD

SEQ ID NO: 3126004 - protein, 7 aa, Giardia lamblia
NSPDDSH

SEQ ID NO: 3126005 - protein, 6 aa, Giardia lamblia
NSPDKL

SEQ ID NO: 3126006 - protein, 4 aa, Giardia lamblia
NSPE

SEQ ID NO: 3126007 - protein, 7 aa, Giardia lamblia
NSPEGEY

SEQ ID NO: 3126008 - protein, 6 aa, Giardia lamblia
NSPEYK

SEQ ID NO: 3126009 - protein, 7 aa, Giardia lamblia
NSPGIRP

SEQ ID NO: 3126010 - protein, 9 aa, Giardia lamblia
NSPGSRVTP

SEQ ID NO: 3126011 - protein, 8 aa, Giardia lamblia
NSPHGAAH

SEQ ID NO: 3126012 - protein, 5 aa, Giardia lamblia
NSPQL

SEQ ID NO: 3126013 - protein, 35 aa, Giardia lamblia
NSPQQTSRLDSDSDSDYITQTPTVKQRKVQGNDSV

SEQ ID NO: 3126014 - protein, 9 aa, Giardia lamblia
NSPQSHAGD

SEQ ID NO: 3126015 - protein, 5 aa, Giardia lamblia
NSPRF

SEQ ID NO: 3126016 - protein, 7 aa, Giardia lamblia
NSPSALT

SEQ ID NO: 3126017 - protein, 8 aa, Giardia lamblia
NSPSTGVS

SEQ ID NO: 3126018 - protein, 23 aa, Giardia lamblia
NSPTGSTNPASRTSSVSAPSNID

SEQ ID NO: 3126019 - protein, 6 aa, Giardia lamblia
NSPTYP

SEQ ID NO: 3126020 - protein, 7 aa, Giardia lamblia
NSPVPYI

SEQ ID NO: 3126021 - protein, 16 aa, Giardia lamblia
NSPVRRSPEQRKPKPN

SEQ ID NO: 3126022 - protein, 6 aa, Giardia lamblia
NSQATR

SEQ ID NO: 3126023 - protein, 6 aa, Giardia lamblia
NSQCKA

SEQ ID NO: 3126024 - protein, 11 aa, Giardia lamblia
NSQDMRKRSRE

SEQ ID NO: 3126025 - protein, 8 aa, Giardia lamblia
NSQEPSEE

SEQ ID NO: 3126026 - protein, 12 aa, Giardia lamblia
NSQGSSEGYTEA

SEQ ID NO: 3126027 - protein, 9 aa, Giardia lamblia
NSQKLSGDQ

SEQ ID NO: 3126028 - protein, 4 aa, Giardia lamblia
NSQL

SEQ ID NO: 3126029 - protein, 13 aa, Giardia lamblia
NSQNGSQDEEDRT

SEQ ID NO: 3126030 - protein, 7 aa, Giardia lamblia
NSQNSLS

SEQ ID NO: 3126031 - protein, 17 aa, Giardia lamblia
NSQPIVPPTGIKGSARL

SEQ ID NO: 3126032 - protein, 8 aa, Giardia lamblia
NSQRNGSL

SEQ ID NO: 3126033 - protein, 6 aa, Giardia lamblia
NSQVSH

SEQ ID NO: 3126034 - protein, 7 aa, Giardia lamblia
NSRDIYG

SEQ ID NO: 3126035 - protein, 6 aa, Giardia lamblia
NSRDRI

SEQ ID NO: 3126036 - protein, 8 aa, Giardia lamblia
NSREKDMK

SEQ ID NO: 3126037 - protein, 15 aa, Giardia lamblia
NSRKESADRASSEAD

SEQ ID NO: 3126038 - protein, 12 aa, Giardia lamblia
NSRLTKSQDKLQ

SEQ ID NO: 3126039 - protein, 6 aa, Giardia lamblia
NSRNKP

SEQ ID NO: 3126040 - protein, 4 aa, Giardia lamblia
NSRP

SEQ ID NO: 3126041 - protein, 13 aa, Giardia lamblia
NSRPLRSSSNGDG

SEQ ID NO: 3126042 - protein, 10 aa, Giardia lamblia
NSRQFNPGLQ

SEQ ID NO: 3126043 - protein, 11 aa, Giardia lamblia
NSRQPSTSAST

SEQ ID NO: 3126044 - protein, 7 aa, Giardia lamblia
NSRSNRA

SEQ ID NO: 3126045 - protein, 25 aa, Giardia lamblia
NSRSQPTSALQDSNKSLQRPKINPT

SEQ ID NO: 3126046 - protein, 26 aa, Giardia lamblia
NSRSQSGSHLSERERINRERERLQKE

SEQ ID NO: 3126047 - protein, 7 aa, Giardia lamblia
NSRTPGA

SEQ ID NO: 3126048 - protein, 20 aa, Giardia lamblia
NSRTPGADDCNDHQAAPRSH

SEQ ID NO: 3126049 - protein, 12 aa, Giardia lamblia
NSRVDNGGKDST

SEQ ID NO: 3126050 - protein, 13 aa, Giardia lamblia
NSSAAHQQQGQTT

SEQ ID NO: 3126051 - protein, 6 aa, Giardia lamblia
NSSASL

SEQ ID NO: 3126052 - protein, 12 aa, Giardia lamblia
NSSATSEIGDEV

SEQ ID NO: 3126053 - protein, 9 aa, Giardia lamblia
NSSCESKKK

SEQ ID NO: 3126054 - protein, 4 aa, Giardia lamblia
NSSD

SEQ ID NO: 3126055 - protein, 17 aa, Giardia lamblia
NSSDPPGYKTPPPPSFI

SEQ ID NO: 3126056 - protein, 10 aa, Giardia lamblia
NSSDSSMNSS

SEQ ID NO: 3126057 - protein, 7 aa, Giardia lamblia
NSSDTQL

SEQ ID NO: 3126058 - protein, 6 aa, Giardia lamblia
NSSEFD

SEQ ID NO: 3126059 - protein, 7 aa, Giardia lamblia
NSSGPCS

SEQ ID NO: 3126060 - protein, 8 aa, Giardia lamblia
NSSGTRSS

SEQ ID NO: 3126061 - protein, 16 aa, Giardia lamblia
NSSHQAFSADKPLPKQ

SEQ ID NO: 3126062 - protein, 6 aa, Giardia lamblia
NSSHTS

SEQ ID NO: 3126063 - protein, 4 aa, Giardia lamblia
NSSK

SEQ ID NO: 3126064 - protein, 5 aa, Giardia lamblia
NSSKC

SEQ ID NO: 3126065 - protein, 6 aa, Giardia lamblia
NSSKCG

SEQ ID NO: 3126066 - protein, 4 aa, Giardia lamblia
NSSL

SEQ ID NO: 3126067 - protein, 15 aa, Giardia lamblia
NSSLELEKRSKKEQL

SEQ ID NO: 3126068 - protein, 8 aa, Giardia lamblia
NSSLTTAS

SEQ ID NO: 3126069 - protein, 7 aa, Giardia lamblia
NSSMNTA

SEQ ID NO: 3126070 - protein, 4 aa, Giardia lamblia
NSSN

SEQ ID NO: 3126071 - protein, 31 aa, Giardia lamblia
NSSPASNKPLVNQQPAIDQDPKDDGDTAQQL

SEQ ID NO: 3126072 - protein, 11 aa, Giardia lamblia
NSSPPDDDEAA

SEQ ID NO: 3126073 - protein, 8 aa, Giardia lamblia
NSSPSHTL

SEQ ID NO: 3126074 - protein, 10 aa, Giardia lamblia
NSSQRSSVTG

SEQ ID NO: 3126075 - protein, 4 aa, Giardia lamblia
NSSS

SEQ ID NO: 3126076 - protein, 9 aa, Giardia lamblia
NSSSAPTAV

SEQ ID NO: 3126077 - protein, 14 aa, Giardia lamblia
NSSSDNEEGADIEE

SEQ ID NO: 3126078 - protein, 9 aa, Giardia lamblia
NSSSNKIKE

SEQ ID NO: 3126079 - protein, 18 aa, Giardia lamblia
NSSSPTRRDIGRKGEEIA

SEQ ID NO: 3126080 - protein, 7 aa, Giardia lamblia
NSSSSNQ

SEQ ID NO: 3126081 - protein, 7 aa, Giardia lamblia
NSSSSNY

SEQ ID NO: 3126082 - protein, 39 aa, Giardia lamblia
NSSSTSRSSSVNSAANSSDISTSSDLGNSSEKSPSISRS

SEQ ID NO: 3126083 - protein, 12 aa, Giardia lamblia
NSSTAHKDMKTT

SEQ ID NO: 3126084 - protein, 8 aa, Giardia lamblia
NSSTAVQP

SEQ ID NO: 3126085 - protein, 18 aa, Giardia lamblia
NSSTGTWEYDTRKQDALE

SEQ ID NO: 3126086 - protein, 6 aa, Giardia lamblia
NSSTIQ

SEQ ID NO: 3126087 - protein, 8 aa, Giardia lamblia
NSSTSMNT

SEQ ID NO: 3126088 - protein, 11 aa, Giardia lamblia
NSSVSNTTDQA

SEQ ID NO: 3126089 - protein, 18 aa, Giardia lamblia
NSSYSSKISELKNQSQET

SEQ ID NO: 3126090 - protein, 25 aa, Giardia lamblia
NSTARQHQSALPDPIERNPDNFDFF

SEQ ID NO: 3126091 - protein, 11 aa, Giardia lamblia
NSTDSITDNTY

SEQ ID NO: 3126092 - protein, 4 aa, Giardia lamblia
NSTE

SEQ ID NO: 3126093 - protein, 9 aa, Giardia lamblia
NSTELPDHT

SEQ ID NO: 3126094 - protein, 4 aa, Giardia lamblia
NSTG

SEQ ID NO: 3126095 - protein, 23 aa, Giardia lamblia
NSTGNSYRQAKAKRKSGSFSGGS

SEQ ID NO: 3126096 - protein, 7 aa, Giardia lamblia
NSTIQDN

SEQ ID NO: 3126097 - protein, 6 aa, Giardia lamblia
NSTKAS

SEQ ID NO: 3126098 - protein, 5 aa, Giardia lamblia
NSTLL

SEQ ID NO: 3126099 - protein, 8 aa, Giardia lamblia
NSTLSSSV

SEQ ID NO: 3126100 - protein, 4 aa, Giardia lamblia
NSTM

SEQ ID NO: 3126101 - protein, 12 aa, Giardia lamblia
NSTMGSEENSRV

SEQ ID NO: 3126102 - protein, 8 aa, Giardia lamblia
NSTPHGPI

SEQ ID NO: 3126103 - protein, 5 aa, Giardia lamblia
NSTPI

SEQ ID NO: 3126104 - protein, 10 aa, Giardia lamblia
NSTPREYNNQ

SEQ ID NO: 3126105 - protein, 13 aa, Giardia lamblia
NSTPYSSSKYSFA

SEQ ID NO: 3126106 - protein, 7 aa, Giardia lamblia
NSTPYTT

SEQ ID NO: 3126107 - protein, 8 aa, Giardia lamblia
NSTRAPQV

SEQ ID NO: 3126108 - protein, 15 aa, Giardia lamblia
NSTRNPTPSRSKHPI

SEQ ID NO: 3126109 - protein, 14 aa, Giardia lamblia
NSTRQSPSNTTKES

SEQ ID NO: 3126110 - protein, 7 aa, Giardia lamblia
NSTRYNS

SEQ ID NO: 3126111 - protein, 10 aa, Giardia lamblia
NSTSDTQATL

SEQ ID NO: 3126112 - protein, 8 aa, Giardia lamblia
NSTSEPCR

SEQ ID NO: 3126113 - protein, 8 aa, Giardia lamblia
NSTSISEE

SEQ ID NO: 3126114 - protein, 6 aa, Giardia lamblia
NSTSRY

SEQ ID NO: 3126115 - protein, 8 aa, Giardia lamblia
NSTSSQQK

SEQ ID NO: 3126116 - protein, 28 aa, Giardia lamblia
NSTTTAQPLQPSSQQPEDVQSGSNSAQL

SEQ ID NO: 3126117 - protein, 6 aa, Giardia lamblia
NSVAAE

SEQ ID NO: 3126118 - protein, 7 aa, Giardia lamblia
NSVEDSK

SEQ ID NO: 3126119 - protein, 12 aa, Giardia lamblia
NSVGAERKKGFS

SEQ ID NO: 3126120 - protein, 10 aa, Giardia lamblia
NSVKPSPNPV

SEQ ID NO: 3126121 - protein, 8 aa, Giardia lamblia
NSVPEQTS

SEQ ID NO: 3126122 - protein, 8 aa, Giardia lamblia
NSVPSKLR

SEQ ID NO: 3126123 - protein, 4 aa, Giardia lamblia
NSVQ

SEQ ID NO: 3126124 - protein, 32 aa, Giardia lamblia
NSVQPADVYEGRPNRYREQPSSMHISSIQSSM

SEQ ID NO: 3126125 - protein, 4 aa, Giardia lamblia
NSVS

SEQ ID NO: 3126126 - protein, 7 aa, Giardia lamblia
NSVSGTI

SEQ ID NO: 3126127 - protein, 6 aa, Giardia lamblia
NSYGAA

SEQ ID NO: 3126128 - protein, 6 aa, Giardia lamblia
NSYKST

SEQ ID NO: 3126129 - protein, 12 aa, Giardia lamblia
NSYNDKQEPEPL

SEQ ID NO: 3126130 - protein, 22 aa, Giardia lamblia
NSYQPPTKESKDSPEETESLRA

SEQ ID NO: 3126131 - protein, 10 aa, Giardia lamblia
NSYRGTNEDI

SEQ ID NO: 3126132 - protein, 4 aa, Giardia lamblia
NSYS

SEQ ID NO: 3126133 - protein, 15 aa, Giardia lamblia
NSYSEQLEASELEGK

SEQ ID NO: 3126134 - protein, 4 aa, Giardia lamblia
NSYT

SEQ ID NO: 3126135 - protein, 6 aa, Giardia lamblia
NTAAES

SEQ ID NO: 3126136 - protein, 7 aa, Giardia lamblia
NTADPQS

SEQ ID NO: 3126137 - protein, 28 aa, Giardia lamblia
NTADYTGTFNRSGSTQAYPAHEAQPGYM

SEQ ID NO: 3126138 - protein, 4 aa, Giardia lamblia
NTAE

SEQ ID NO: 3126139 - protein, 7 aa, Giardia lamblia
NTAEFTQ

SEQ ID NO: 3126140 - protein, 14 aa, Giardia lamblia
NTAEGNEEILAILS

SEQ ID NO: 3126141 - protein, 19 aa, Giardia lamblia
NTAFNPDGEMSSAYGDDLP

SEQ ID NO: 3126142 - protein, 7 aa, Giardia lamblia
NTAGDLT

SEQ ID NO: 3126143 - protein, 13 aa, Giardia lamblia
NTAGESPAGNTND

SEQ ID NO: 3126144 - protein, 8 aa, Giardia lamblia
NTAGGDRA

SEQ ID NO: 3126145 - protein, 5 aa, Giardia lamblia
NTAPK

SEQ ID NO: 3126146 - protein, 8 aa, Giardia lamblia
NTASPDVG

SEQ ID NO: 3126147 - protein, 13 aa, Giardia lamblia
NTAYYASGSPMPS

SEQ ID NO: 3126148 - protein, 14 aa, Giardia lamblia
NTDASGGSPRARRQ

SEQ ID NO: 3126149 - protein, 7 aa, Giardia lamblia
NTDATGP

SEQ ID NO: 3126150 - protein, 5 aa, Giardia lamblia
NTDGT

SEQ ID NO: 3126151 - protein, 15 aa, Giardia lamblia
NTDGVSSATSSQEVA

SEQ ID NO: 3126152 - protein, 8 aa, Giardia lamblia
NTDNSISS

SEQ ID NO: 3126153 - protein, 6 aa, Giardia lamblia
NTDNTI

SEQ ID NO: 3126154 - protein, 7 aa, Giardia lamblia
NTDPASF

SEQ ID NO: 3126155 - protein, 7 aa, Giardia lamblia
NTDQKSD

SEQ ID NO: 3126156 - protein, 25 aa, Giardia lamblia
NTDRDTEVVQSAGQRYTENLSRAQD

SEQ ID NO: 3126157 - protein, 11 aa, Giardia lamblia
NTDSRSEAGRG

SEQ ID NO: 3126158 - protein, 5 aa, Giardia lamblia
NTDTC

SEQ ID NO: 3126159 - protein, 6 aa, Giardia lamblia
NTDTSK

SEQ ID NO: 3126160 - protein, 9 aa, Giardia lamblia
NTDTSKEKL

SEQ ID NO: 3126161 - protein, 5 aa, Giardia lamblia
NTDVS

SEQ ID NO: 3126162 - protein, 49 aa, Giardia lamblia
NTEATTKTSTGSRQVTSKDYLSDNPYAPRSSSVDELNEGASPNRRPTVP

SEQ ID NO: 3126163 - protein, 5 aa, Giardia lamblia
NTEED

SEQ ID NO: 3126164 - protein, 17 aa, Giardia lamblia
NTEEGKQKKLDSNEMVQ

SEQ ID NO: 3126165 - protein, 7 aa, Giardia lamblia
NTEGPDI

SEQ ID NO: 3126166 - protein, 5 aa, Giardia lamblia
NTEGQ

SEQ ID NO: 3126167 - protein, 5 aa, Giardia lamblia
NTEHR

SEQ ID NO: 3126168 - protein, 9 aa, Giardia lamblia
NTEKDTKAA

SEQ ID NO: 3126169 - protein, 7 aa, Giardia lamblia
NTEKQLN

SEQ ID NO: 3126170 - protein, 13 aa, Giardia lamblia
NTEKRSMGGAETA

SEQ ID NO: 3126171 - protein, 4 aa, Giardia lamblia
NTEL

SEQ ID NO: 3126172 - protein, 10 aa, Giardia lamblia
NTEMQKRTEE

SEQ ID NO: 3126173 - protein, 7 aa, Giardia lamblia
NTENTLV

SEQ ID NO: 3126174 - protein, 5 aa, Giardia lamblia
NTEQA

SEQ ID NO: 3126175 - protein, 9 aa, Giardia lamblia
NTEQEISEK

SEQ ID NO: 3126176 - protein, 9 aa, Giardia lamblia
NTEQKRTQR

SEQ ID NO: 3126177 - protein, 14 aa, Giardia lamblia
NTETDKATSTSEAL

SEQ ID NO: 3126178 - protein, 5 aa, Giardia lamblia
NTEVD

SEQ ID NO: 3126179 - protein, 6 aa, Giardia lamblia
NTFERQ

SEQ ID NO: 3126180 - protein, 13 aa, Giardia lamblia
NTFSATPKTETIE

SEQ ID NO: 3126181 - protein, 6 aa, Giardia lamblia
NTFSKG

SEQ ID NO: 3126182 - protein, 6 aa, Giardia lamblia
NTFSTP

SEQ ID NO: 3126183 - protein, 11 aa, Giardia lamblia
NTGDDSGTGVG

SEQ ID NO: 3126184 - protein, 6 aa, Giardia lamblia
NTGEDF

SEQ ID NO: 3126185 - protein, 6 aa, Giardia lamblia
NTGEIQ

SEQ ID NO: 3126186 - protein, 8 aa, Giardia lamblia
NTGFENEK

SEQ ID NO: 3126187 - protein, 13 aa, Giardia lamblia
NTGGQKSKATSIG

SEQ ID NO: 3126188 - protein, 8 aa, Giardia lamblia
NTGGRKLP

SEQ ID NO: 3126189 - protein, 10 aa, Giardia lamblia
NTGHRRREIS

SEQ ID NO: 3126190 - protein, 5 aa, Giardia lamblia
NTGKE

SEQ ID NO: 3126191 - protein, 8 aa, Giardia lamblia
NTGKHDFS

SEQ ID NO: 3126192 - protein, 5 aa, Giardia lamblia
NTGKT

SEQ ID NO: 3126193 - protein, 5 aa, Giardia lamblia
NTGPS

SEQ ID NO: 3126194 - protein, 24 aa, Giardia lamblia
NTGRAQSKKWSKELYSGAKTPSID

SEQ ID NO: 3126195 - protein, 27 aa, Giardia lamblia
NTGTSSTSNNRQMSQPRTQSENSFSST

SEQ ID NO: 3126196 - protein, 4 aa, Giardia lamblia
NTGY

SEQ ID NO: 3126197 - protein, 5 aa, Giardia lamblia
NTHFT

SEQ ID NO: 3126198 - protein, 4 aa, Giardia lamblia
NTID

SEQ ID NO: 3126199 - protein, 8 aa, Giardia lamblia
NTIDTSTR

SEQ ID NO: 3126200 - protein, 10 aa, Giardia lamblia
NTIEDQRQAR

SEQ ID NO: 3126201 - protein, 6 aa, Giardia lamblia
NTIEGR

SEQ ID NO: 3126202 - protein, 8 aa, Giardia lamblia
NTIGSSSH

SEQ ID NO: 3126203 - protein, 6 aa, Giardia lamblia
NTIKSK

SEQ ID NO: 3126204 - protein, 6 aa, Giardia lamblia
NTINAS

SEQ ID NO: 3126205 - protein, 12 aa, Giardia lamblia
NTISTSAPSLNS

SEQ ID NO: 3126206 - protein, 4 aa, Giardia lamblia
NTKA

SEQ ID NO: 3126207 - protein, 6 aa, Giardia lamblia
NTKASM

SEQ ID NO: 3126208 - protein, 9 aa, Giardia lamblia
NTKFSSGAG

SEQ ID NO: 3126209 - protein, 25 aa, Giardia lamblia
NTKHKATKSTRGRKNKLKKRENVRE

SEQ ID NO: 3126210 - protein, 12 aa, Giardia lamblia
NTKKDIQSAPEK

SEQ ID NO: 3126211 - protein, 9 aa, Giardia lamblia
NTKKKSDAS

SEQ ID NO: 3126212 - protein, 6 aa, Giardia lamblia
NTKLPD

SEQ ID NO: 3126213 - protein, 9 aa, Giardia lamblia
NTKLTRGAK

SEQ ID NO: 3126214 - protein, 22 aa, Giardia lamblia
NTKLTSTAETRNMASERTLTSS

SEQ ID NO: 3126215 - protein, 4 aa, Giardia lamblia
NTKP

SEQ ID NO: 3126216 - protein, 7 aa, Giardia lamblia
NTKQDGC

SEQ ID NO: 3126217 - protein, 30 aa, Giardia lamblia
NTKQTSTQKPQDQAHSSRKKTEQRVKSVED

SEQ ID NO: 3126218 - protein, 7 aa, Giardia lamblia
NTKQVPV

SEQ ID NO: 3126219 - protein, 6 aa, Giardia lamblia
NTKSQI

SEQ ID NO: 3126220 - protein, 11 aa, Giardia lamblia
NTKYDEPLSPT

SEQ ID NO: 3126221 - protein, 17 aa, Giardia lamblia
NTLAPANRLASSGGIRG

SEQ ID NO: 3126222 - protein, 9 aa, Giardia lamblia
NTLATSTGD

SEQ ID NO: 3126223 - protein, 6 aa, Giardia lamblia
NTLGGG

SEQ ID NO: 3126224 - protein, 4 aa, Giardia lamblia
NTLM

SEQ ID NO: 3126225 - protein, 4 aa, Giardia lamblia
NTLP

SEQ ID NO: 3126226 - protein, 4 aa, Giardia lamblia
NTLQ

SEQ ID NO: 3126227 - protein, 9 aa, Giardia lamblia
NTLQSASQI

SEQ ID NO: 3126228 - protein, 36 aa, Giardia lamblia
NTLQSEKCSSGPLPFKGAEASSAVSALGRDSSLEDA

SEQ ID NO: 3126229 - protein, 5 aa, Giardia lamblia
NTLRE

SEQ ID NO: 3126230 - protein, 8 aa, Giardia lamblia
NTLTSTGY

SEQ ID NO: 3126231 - protein, 10 aa, Giardia lamblia
NTNDTGPAFT

SEQ ID NO: 3126232 - protein, 19 aa, Giardia lamblia
NTNEATQLKVSSEQALRAE

SEQ ID NO: 3126233 - protein, 18 aa, Giardia lamblia
NTNGGGSINATITGSTHY

SEQ ID NO: 3126234 - protein, 14 aa, Giardia lamblia
NTNGKLQPPQSDED

SEQ ID NO: 3126235 - protein, 9 aa, Giardia lamblia
NTNNLQPEI

SEQ ID NO: 3126236 - protein, 6 aa, Giardia lamblia
NTNNTK

SEQ ID NO: 3126237 - protein, 33 aa, Giardia lamblia
NTNPGPGAYNQDIRPTKASAPSYSLSGRPENAA

SEQ ID NO: 3126238 - protein, 10 aa, Giardia lamblia
NTNPGPGTYE

SEQ ID NO: 3126239 - protein, 6 aa, Giardia lamblia
NTNPNH

SEQ ID NO: 3126240 - protein, 10 aa, Giardia lamblia
NTNPTEEIDD

SEQ ID NO: 3126241 - protein, 16 aa, Giardia lamblia
NTNQSMSKLEKQARTI

SEQ ID NO: 3126242 - protein, 4 aa, Giardia lamblia
NTNS

SEQ ID NO: 3126243 - protein, 12 aa, Giardia lamblia
NTNSAEKQNAEF

SEQ ID NO: 3126244 - protein, 14 aa, Giardia lamblia
NTNSAYRKHRPHQA

SEQ ID NO: 3126245 - protein, 7 aa, Giardia lamblia
NTPAPGL

SEQ ID NO: 3126246 - protein, 23 aa, Giardia lamblia
NTPHQSSQPAQTAVRPSSVKKSR

SEQ ID NO: 3126247 - protein, 5 aa, Giardia lamblia
NTPKG

SEQ ID NO: 3126248 - protein, 9 aa, Giardia lamblia
NTPKPEGTI

SEQ ID NO: 3126249 - protein, 12 aa, Giardia lamblia
NTPLEANETEEE

SEQ ID NO: 3126250 - protein, 13 aa, Giardia lamblia
NTPMDKAYPSSTV

SEQ ID NO: 3126251 - protein, 4 aa, Giardia lamblia
NTPN

SEQ ID NO: 3126252 - protein, 17 aa, Giardia lamblia
NTPPRQADLPPSRGGVG

SEQ ID NO: 3126253 - protein, 21 aa, Giardia lamblia
NTPQNTLGVTTSKPKSSTPIR

SEQ ID NO: 3126254 - protein, 6 aa, Giardia lamblia
NTPRND

SEQ ID NO: 3126255 - protein, 19 aa, Giardia lamblia
NTPRTANSSFTSRNSSANS

SEQ ID NO: 3126256 - protein, 10 aa, Giardia lamblia
NTPSAKEELS

SEQ ID NO: 3126257 - protein, 15 aa, Giardia lamblia
NTPSKSYMTDEKNAG

SEQ ID NO: 3126258 - protein, 19 aa, Giardia lamblia
NTPSNGSTSKYSYRNPEDP

SEQ ID NO: 3126259 - protein, 26 aa, Giardia lamblia
NTPSSLSAISPEEGCDRVRDEGSSLD

SEQ ID NO: 3126260 - protein, 6 aa, Giardia lamblia
NTPSWP

SEQ ID NO: 3126261 - protein, 12 aa, Giardia lamblia
NTPTTGSDREQN

SEQ ID NO: 3126262 - protein, 9 aa, Giardia lamblia
NTPVPRDTL

SEQ ID NO: 3126263 - protein, 11 aa, Giardia lamblia
NTPVTDGAGTT

SEQ ID NO: 3126264 - protein, 7 aa, Giardia lamblia
NTQASAA

SEQ ID NO: 3126265 - protein, 5 aa, Giardia lamblia
NTQGY

SEQ ID NO: 3126266 - protein, 8 aa, Giardia lamblia
NTQKDGTT

SEQ ID NO: 3126267 - protein, 14 aa, Giardia lamblia
NTQKEKSGDEANGP

SEQ ID NO: 3126268 - protein, 5 aa, Giardia lamblia
NTQLA

SEQ ID NO: 3126269 - protein, 31 aa, Giardia lamblia
NTQLSSSRAPSGPSTEKSDGGVTPQGHIGSS

SEQ ID NO: 3126270 - protein, 4 aa, Giardia lamblia
NTQN

SEQ ID NO: 3126271 - protein, 7 aa, Giardia lamblia
NTQQKPL

SEQ ID NO: 3126272 - protein, 7 aa, Giardia lamblia
NTQRATE

SEQ ID NO: 3126273 - protein, 7 aa, Giardia lamblia
NTQSAKV

SEQ ID NO: 3126274 - protein, 15 aa, Giardia lamblia
NTQSERDSAKRNSKY

SEQ ID NO: 3126275 - protein, 5 aa, Giardia lamblia
NTQTG

SEQ ID NO: 3126276 - protein, 31 aa, Giardia lamblia
NTQTTMQSAPLTTTKTNKLHGKSKHKSKKSI

SEQ ID NO: 3126277 - protein, 8 aa, Giardia lamblia
NTRADKNQ

SEQ ID NO: 3126278 - protein, 8 aa, Giardia lamblia
NTRKYSGY

SEQ ID NO: 3126279 - protein, 4 aa, Giardia lamblia
NTRL

SEQ ID NO: 3126280 - protein, 8 aa, Giardia lamblia
NTRSTNPS

SEQ ID NO: 3126281 - protein, 23 aa, Giardia lamblia
NTSADSSSQLQKISTRQQESVQR

SEQ ID NO: 3126282 - protein, 15 aa, Giardia lamblia
NTSAPPTDTQGGRQI

SEQ ID NO: 3126283 - protein, 12 aa, Giardia lamblia
NTSAQHSNYQAN

SEQ ID NO: 3126284 - protein, 6 aa, Giardia lamblia
NTSARD

SEQ ID NO: 3126285 - protein, 8 aa, Giardia lamblia
NTSARKHS

SEQ ID NO: 3126286 - protein, 6 aa, Giardia lamblia
NTSDNS

SEQ ID NO: 3126287 - protein, 11 aa, Giardia lamblia
NTSEQENSRRV

SEQ ID NO: 3126288 - protein, 5 aa, Giardia lamblia
NTSFG

SEQ ID NO: 3126289 - protein, 18 aa, Giardia lamblia
NTSFKGAPELVSESGPIY

SEQ ID NO: 3126290 - protein, 6 aa, Giardia lamblia
NTSGAY

SEQ ID NO: 3126291 - protein, 7 aa, Giardia lamblia
NTSGISN

SEQ ID NO: 3126292 - protein, 7 aa, Giardia lamblia
NTSGPIS

SEQ ID NO: 3126293 - protein, 27 aa, Giardia lamblia
NTSIEQSVTRATSINDQRSNNHDYTTS

SEQ ID NO: 3126294 - protein, 7 aa, Giardia lamblia
NTSKELR

SEQ ID NO: 3126295 - protein, 16 aa, Giardia lamblia
NTSKKHQADLRTAKED

SEQ ID NO: 3126296 - protein, 5 aa, Giardia lamblia
NTSLK

SEQ ID NO: 3126297 - protein, 5 aa, Giardia lamblia
NTSLP

SEQ ID NO: 3126298 - protein, 23 aa, Giardia lamblia
NTSLSESANAQCTATSVRDSLSS

SEQ ID NO: 3126299 - protein, 14 aa, Giardia lamblia
NTSMQSNNTSFSQQ

SEQ ID NO: 3126300 - protein, 6 aa, Giardia lamblia
NTSPDA

SEQ ID NO: 3126301 - protein, 8 aa, Giardia lamblia
NTSPSLAG

SEQ ID NO: 3126302 - protein, 16 aa, Giardia lamblia
NTSQYNAQQVADENDH

SEQ ID NO: 3126303 - protein, 16 aa, Giardia lamblia
NTSRASVLQSQSASFS

SEQ ID NO: 3126304 - protein, 30 aa, Giardia lamblia
NTSRSASRDTTIRNANDSYGSGKASDHQSL

SEQ ID NO: 3126305 - protein, 53 aa, Giardia lamblia
NTSSDEESQSTSGAFSAKHTNNSAQDESDESELSSYTSASEEHSGTTFPNEAS

SEQ ID NO: 3126306 - protein, 7 aa, Giardia lamblia
NTSSKWE

SEQ ID NO: 3126307 - protein, 8 aa, Giardia lamblia
NTSSSTSL

SEQ ID NO: 3126308 - protein, 9 aa, Giardia lamblia
NTSSSTVRT

SEQ ID NO: 3126309 - protein, 8 aa, Giardia lamblia
NTSTEEAR

SEQ ID NO: 3126310 - protein, 9 aa, Giardia lamblia
NTSTGTQSS

SEQ ID NO: 3126311 - protein, 5 aa, Giardia lamblia
NTSTN

SEQ ID NO: 3126312 - protein, 9 aa, Giardia lamblia
NTSVRAPAD

SEQ ID NO: 3126313 - protein, 8 aa, Giardia lamblia
NTSYASQA

SEQ ID NO: 3126314 - protein, 6 aa, Giardia lamblia
NTSYDG

SEQ ID NO: 3126315 - protein, 5 aa, Giardia lamblia
NTSYP

SEQ ID NO: 3126316 - protein, 11 aa, Giardia lamblia
NTTAENLSSPN

SEQ ID NO: 3126317 - protein, 5 aa, Giardia lamblia
NTTDP

SEQ ID NO: 3126318 - protein, 12 aa, Giardia lamblia
NTTEAQQKSIEG

SEQ ID NO: 3126319 - protein, 6 aa, Giardia lamblia
NTTEES

SEQ ID NO: 3126320 - protein, 7 aa, Giardia lamblia
NTTEPPS

SEQ ID NO: 3126321 - protein, 6 aa, Giardia lamblia
NTTERH

SEQ ID NO: 3126322 - protein, 8 aa, Giardia lamblia
NTTGDSFS

SEQ ID NO: 3126323 - protein, 5 aa, Giardia lamblia
NTTGH

SEQ ID NO: 3126324 - protein, 6 aa, Giardia lamblia
NTTGQT

SEQ ID NO: 3126325 - protein, 5 aa, Giardia lamblia
NTTLT

SEQ ID NO: 3126326 - protein, 9 aa, Giardia lamblia
NTTMGTPSY

SEQ ID NO: 3126327 - protein, 18 aa, Giardia lamblia
NTTNNPNNELSETSATIY

SEQ ID NO: 3126328 - protein, 14 aa, Giardia lamblia
NTTNPAEDGKNIKA

SEQ ID NO: 3126329 - protein, 9 aa, Giardia lamblia
NTTNPNTYL

SEQ ID NO: 3126330 - protein, 12 aa, Giardia lamblia
NTTNSITLQEGS

SEQ ID NO: 3126331 - protein, 25 aa, Giardia lamblia
NTTPAKQHSLTGTLASSTFSTSGVS

SEQ ID NO: 3126332 - protein, 13 aa, Giardia lamblia
NTTPLPANDPQIT

SEQ ID NO: 3126333 - protein, 17 aa, Giardia lamblia
NTTPPDDEDVLSENSGI

SEQ ID NO: 3126334 - protein, 8 aa, Giardia lamblia
NTTQYTEN

SEQ ID NO: 3126335 - protein, 8 aa, Giardia lamblia
NTTTPPGI

SEQ ID NO: 3126336 - protein, 7 aa, Giardia lamblia
NTVAPPT

SEQ ID NO: 3126337 - protein, 22 aa, Giardia lamblia
NTVAQQGESPHARSDGEASSII

SEQ ID NO: 3126338 - protein, 12 aa, Giardia lamblia
NTVEERRQVGQT

SEQ ID NO: 3126339 - protein, 4 aa, Giardia lamblia
NTVI

SEQ ID NO: 3126340 - protein, 4 aa, Giardia lamblia
NTVK

SEQ ID NO: 3126341 - protein, 26 aa, Giardia lamblia
NTVKHSTPSDIRPATAKPPKEPEGDI

SEQ ID NO: 3126342 - protein, 4 aa, Giardia lamblia
NTVN

SEQ ID NO: 3126343 - protein, 8 aa, Giardia lamblia
NTVPPGGS

SEQ ID NO: 3126344 - protein, 6 aa, Giardia lamblia
NTVPRA

SEQ ID NO: 3126345 - protein, 4 aa, Giardia lamblia
NTVQ

SEQ ID NO: 3126346 - protein, 7 aa, Giardia lamblia
NTVSEAS

SEQ ID NO: 3126347 - protein, 5 aa, Giardia lamblia
NTVSG

SEQ ID NO: 3126348 - protein, 9 aa, Giardia lamblia
NTVSPEKEP

SEQ ID NO: 3126349 - protein, 13 aa, Giardia lamblia
NTVTKASSDLETT

SEQ ID NO: 3126350 - protein, 6 aa, Giardia lamblia
NTVTSK

SEQ ID NO: 3126351 - protein, 5 aa, Giardia lamblia
NTYGR

SEQ ID NO: 3126352 - protein, 4 aa, Giardia lamblia
NTYL

SEQ ID NO: 3126353 - protein, 9 aa, Giardia lamblia
NTYNDSKRY

SEQ ID NO: 3126354 - protein, 10 aa, Giardia lamblia
NTYNTSNLNR

SEQ ID NO: 3126355 - protein, 5 aa, Giardia lamblia
NTYQH

SEQ ID NO: 3126356 - protein, 5 aa, Giardia lamblia
NVAND

SEQ ID NO: 3126357 - protein, 23 aa, Giardia lamblia
NVAPYNPMTDAPTTGEVYQSTEE

SEQ ID NO: 3126358 - protein, 16 aa, Giardia lamblia
NVASFSDTSSESSASF

SEQ ID NO: 3126359 - protein, 22 aa, Giardia lamblia
NVASGGSGDHEEDAMDPSGPVI

SEQ ID NO: 3126360 - protein, 10 aa, Giardia lamblia
NVDAQGCTGK

SEQ ID NO: 3126361 - protein, 9 aa, Giardia lamblia
NVDESNPNM

SEQ ID NO: 3126362 - protein, 15 aa, Giardia lamblia
NVDLPSKSQQQDPEQ

SEQ ID NO: 3126363 - protein, 21 aa, Giardia lamblia
NVDNAKRLEDAERENKALEES

SEQ ID NO: 3126364 - protein, 28 aa, Giardia lamblia
NVDPGKTNGIKAGYGPPDAQSETRETDR

SEQ ID NO: 3126365 - protein, 7 aa, Giardia lamblia
NVDQVQQ

SEQ ID NO: 3126366 - protein, 6 aa, Giardia lamblia
NVDRGA

SEQ ID NO: 3126367 - protein, 15 aa, Giardia lamblia
NVDSTPSRAKHMEKT

SEQ ID NO: 3126368 - protein, 9 aa, Giardia lamblia
NVEATSDMT

SEQ ID NO: 3126369 - protein, 4 aa, Giardia lamblia
NVEG

SEQ ID NO: 3126370 - protein, 24 aa, Giardia lamblia
NVEKAEKDEIINEPSIKRSGPVQS

SEQ ID NO: 3126371 - protein, 10 aa, Giardia lamblia
NVEKGDAGAN

SEQ ID NO: 3126372 - protein, 6 aa, Giardia lamblia
NVETNL

SEQ ID NO: 3126373 - protein, 5 aa, Giardia lamblia
NVGKG

SEQ ID NO: 3126374 - protein, 6 aa, Giardia lamblia
NVHPPE

SEQ ID NO: 3126375 - protein, 12 aa, Giardia lamblia
NVKAHSTSRPFS

SEQ ID NO: 3126376 - protein, 9 aa, Giardia lamblia
NVKARDAVG

SEQ ID NO: 3126377 - protein, 10 aa, Giardia lamblia
NVKDGEPYRM

SEQ ID NO: 3126378 - protein, 13 aa, Giardia lamblia
NVKGNDGLRPAEL

SEQ ID NO: 3126379 - protein, 6 aa, Giardia lamblia
NVKSAR

SEQ ID NO: 3126380 - protein, 8 aa, Giardia lamblia
NVNGDESR

SEQ ID NO: 3126381 - protein, 6 aa, Giardia lamblia
NVNTPP

SEQ ID NO: 3126382 - protein, 6 aa, Giardia lamblia
NVPEES

SEQ ID NO: 3126383 - protein, 5 aa, Giardia lamblia
NVPES

SEQ ID NO: 3126384 - protein, 9 aa, Giardia lamblia
NVPETSDYA

SEQ ID NO: 3126385 - protein, 5 aa, Giardia lamblia
NVPGG

SEQ ID NO: 3126386 - protein, 8 aa, Giardia lamblia
NVPGKETK

SEQ ID NO: 3126387 - protein, 4 aa, Giardia lamblia
NVPP

SEQ ID NO: 3126388 - protein, 11 aa, Giardia lamblia
NVPPADTLPNT

SEQ ID NO: 3126389 - protein, 11 aa, Giardia lamblia
NVPQDKEGNIT

SEQ ID NO: 3126390 - protein, 22 aa, Giardia lamblia
NVPRAAPQSYFSTGSPAPIPKG

SEQ ID NO: 3126391 - protein, 6 aa, Giardia lamblia
NVPRDS

SEQ ID NO: 3126392 - protein, 9 aa, Giardia lamblia
NVPRPGNVA

SEQ ID NO: 3126393 - protein, 16 aa, Giardia lamblia
NVPSKAVQAKKTLGIN

SEQ ID NO: 3126394 - protein, 18 aa, Giardia lamblia
NVPTTEGAQLHNDPGDIT

SEQ ID NO: 3126395 - protein, 4 aa, Giardia lamblia
NVQE

SEQ ID NO: 3126396 - protein, 9 aa, Giardia lamblia
NVQSGPDTI

SEQ ID NO: 3126397 - protein, 15 aa, Giardia lamblia
NVRAPSSLASTAKSF

SEQ ID NO: 3126398 - protein, 8 aa, Giardia lamblia
NVREEDYK

SEQ ID NO: 3126399 - protein, 5 aa, Giardia lamblia
NVSDQ

SEQ ID NO: 3126400 - protein, 5 aa, Giardia lamblia
NVSDT

SEQ ID NO: 3126401 - protein, 8 aa, Giardia lamblia
NVSESKNV

SEQ ID NO: 3126402 - protein, 5 aa, Giardia lamblia
NVSGY

SEQ ID NO: 3126403 - protein, 15 aa, Giardia lamblia
NVSLRGDSTSGQGRA

SEQ ID NO: 3126404 - protein, 12 aa, Giardia lamblia
NVSPELDNPDGV

SEQ ID NO: 3126405 - protein, 10 aa, Giardia lamblia
NVSPEPSPSI

SEQ ID NO: 3126406 - protein, 7 aa, Giardia lamblia
NVSPRED

SEQ ID NO: 3126407 - protein, 49 aa, Giardia lamblia
NVSPSQHTDKLGKVESPNSTSGAPKKGSPALPVEKSPQSFGRATSTLKA

SEQ ID NO: 3126408 - protein, 8 aa, Giardia lamblia
NVSPSSVD

SEQ ID NO: 3126409 - protein, 20 aa, Giardia lamblia
NVSRSDDSDVYEYSSDSVSI

SEQ ID NO: 3126410 - protein, 4 aa, Giardia lamblia
NVSS

SEQ ID NO: 3126411 - protein, 24 aa, Giardia lamblia
NVSSITGPRPARKNRQQGSTAISK

SEQ ID NO: 3126412 - protein, 8 aa, Giardia lamblia
NVTATASL

SEQ ID NO: 3126413 - protein, 9 aa, Giardia lamblia
NVTDENYAS

SEQ ID NO: 3126414 - protein, 7 aa, Giardia lamblia
NVTGESV

SEQ ID NO: 3126415 - protein, 5 aa, Giardia lamblia
NVTGS

SEQ ID NO: 3126416 - protein, 5 aa, Giardia lamblia
NVTGT

SEQ ID NO: 3126417 - protein, 6 aa, Giardia lamblia
NVTPKG

SEQ ID NO: 3126418 - protein, 15 aa, Giardia lamblia
NVTPPNHLTGDTSIT

SEQ ID NO: 3126419 - protein, 6 aa, Giardia lamblia
NVTPQG

SEQ ID NO: 3126420 - protein, 8 aa, Giardia lamblia
NVTRPQPC

SEQ ID NO: 3126421 - protein, 8 aa, Giardia lamblia
NVTSGRDG

SEQ ID NO: 3126422 - protein, 12 aa, Giardia lamblia
NVTTGSSLSKSQ

SEQ ID NO: 3126423 - protein, 4 aa, Giardia lamblia
NVVS

SEQ ID NO: 3126424 - protein, 12 aa, Giardia lamblia
NVYDNTPPTAIQ

SEQ ID NO: 3126425 - protein, 8 aa, Giardia lamblia
NWAPEEDE

SEQ ID NO: 3126426 - protein, 5 aa, Giardia lamblia
NWKER

SEQ ID NO: 3126427 - protein, 8 aa, Giardia lamblia
NWSRPPTE

SEQ ID NO: 3126428 - protein, 10 aa, Giardia lamblia
NWSSYTNKHE

SEQ ID NO: 3126429 - protein, 8 aa, Giardia lamblia
NYASAKSL

SEQ ID NO: 3126430 - protein, 11 aa, Giardia lamblia
NYDDQSDYSTL

SEQ ID NO: 3126431 - protein, 9 aa, Giardia lamblia
NYDDTRRDI

SEQ ID NO: 3126432 - protein, 13 aa, Giardia lamblia
NYDKGDLSRLSSS

SEQ ID NO: 3126433 - protein, 5 aa, Giardia lamblia
NYDKK

SEQ ID NO: 3126434 - protein, 14 aa, Giardia lamblia
NYDTELDEDGLPPV

SEQ ID NO: 3126435 - protein, 6 aa, Giardia lamblia
NYEAAA

SEQ ID NO: 3126436 - protein, 6 aa, Giardia lamblia
NYEAEN

SEQ ID NO: 3126437 - protein, 10 aa, Giardia lamblia
NYESTTEDGI

SEQ ID NO: 3126438 - protein, 9 aa, Giardia lamblia
NYGEGAKKL

SEQ ID NO: 3126439 - protein, 16 aa, Giardia lamblia
NYGFQDSSKPNEHDND

SEQ ID NO: 3126440 - protein, 11 aa, Giardia lamblia
NYIGQRDEQGM

SEQ ID NO: 3126441 - protein, 8 aa, Giardia lamblia
NYKPGESI

SEQ ID NO: 3126442 - protein, 6 aa, Giardia lamblia
NYNNSQ

SEQ ID NO: 3126443 - protein, 8 aa, Giardia lamblia
NYPAEPPA

SEQ ID NO: 3126444 - protein, 14 aa, Giardia lamblia
NYPAKVADKAGHGG

SEQ ID NO: 3126445 - protein, 4 aa, Giardia lamblia
NYPD

SEQ ID NO: 3126446 - protein, 13 aa, Giardia lamblia
NYPHETSVDRERR

SEQ ID NO: 3126447 - protein, 7 aa, Giardia lamblia
NYPPGTT

SEQ ID NO: 3126448 - protein, 7 aa, Giardia lamblia
NYPPNSD

SEQ ID NO: 3126449 - protein, 12 aa, Giardia lamblia
NYPSSTINNPTT

SEQ ID NO: 3126450 - protein, 10 aa, Giardia lamblia
NYQRKKDQEL

SEQ ID NO: 3126451 - protein, 7 aa, Giardia lamblia
NYQRTTR

SEQ ID NO: 3126452 - protein, 4 aa, Giardia lamblia
NYRA

SEQ ID NO: 3126453 - protein, 5 aa, Giardia lamblia
NYRAA

SEQ ID NO: 3126454 - protein, 13 aa, Giardia lamblia
NYSIDSTNVSHQA

SEQ ID NO: 3126455 - protein, 26 aa, Giardia lamblia
NYSNDGNVQSYNGTNPPARHTRSAVR

SEQ ID NO: 3126456 - protein, 8 aa, Giardia lamblia
NYSPDKKV

SEQ ID NO: 3126457 - protein, 4 aa, Giardia lamblia
NYSS

SEQ ID NO: 3126458 - protein, 5 aa, Giardia lamblia
NYSTS

SEQ ID NO: 3126459 - protein, 7 aa, Giardia lamblia
NYSYRTK

SEQ ID NO: 3126460 - protein, 10 aa, Giardia lamblia
NYSYRTKNSA

SEQ ID NO: 3126461 - protein, 12 aa, Giardia lamblia
NYTESDVEEANK

SEQ ID NO: 3126462 - protein, 8 aa, Giardia lamblia
NYTKAGEA

SEQ ID NO: 3126463 - protein, 4 aa, Giardia lamblia
NYTN

SEQ ID NO: 3126464 - protein, 6 aa, Giardia lamblia
NYTPQE

SEQ ID NO: 3126465 - protein, 8 aa, Giardia lamblia
NYTSTGTT

SEQ ID NO: 3126466 - protein, 22 aa, Giardia lamblia
NYYDPDGNEDLKDAYEKSRSAK

SEQ ID NO: 3126467 - protein, 11 aa, Giardia lamblia
PAAAAQNAATV

SEQ ID NO: 3126468 - protein, 18 aa, Giardia lamblia
PAAAKQDSTHQTNSSYSH

SEQ ID NO: 3126469 - protein, 5 aa, Giardia lamblia
PAAAP

SEQ ID NO: 3126470 - protein, 14 aa, Giardia lamblia
PAAASQTPKSPLVA

SEQ ID NO: 3126471 - protein, 12 aa, Giardia lamblia
PAADIKKPATED

SEQ ID NO: 3126472 - protein, 13 aa, Giardia lamblia
PAAEMTDSSVTNH

SEQ ID NO: 3126473 - protein, 8 aa, Giardia lamblia
PAAERERA

SEQ ID NO: 3126474 - protein, 7 aa, Giardia lamblia
PAAGTGC

SEQ ID NO: 3126475 - protein, 7 aa, Giardia lamblia
PAAHRGP

SEQ ID NO: 3126476 - protein, 6 aa, Giardia lamblia
PAAIQT

SEQ ID NO: 3126477 - protein, 8 aa, Giardia lamblia
PAAKIPGN

SEQ ID NO: 3126478 - protein, 4 aa, Giardia lamblia
PAAP

SEQ ID NO: 3126479 - protein, 5 aa, Giardia lamblia
PAAPR

SEQ ID NO: 3126480 - protein, 8 aa, Giardia lamblia
PAARPRAS

SEQ ID NO: 3126481 - protein, 22 aa, Giardia lamblia
PAARSALEDEAVGRGAKGGRRH

SEQ ID NO: 3126482 - protein, 22 aa, Giardia lamblia
PAARSALKDEAVGRGAKGGRRH

SEQ ID NO: 3126483 - protein, 8 aa, Giardia lamblia
PAASAPVV

SEQ ID NO: 3126484 - protein, 14 aa, Giardia lamblia
PAASPPVAPPTSTQ

SEQ ID NO: 3126485 - protein, 10 aa, Giardia lamblia
PAATAPPAPA

SEQ ID NO: 3126486 - protein, 11 aa, Giardia lamblia
PAATDSSSGSL

SEQ ID NO: 3126487 - protein, 19 aa, Giardia lamblia
PAAVPTKRGMEPLAPGTYL

SEQ ID NO: 3126488 - protein, 12 aa, Giardia lamblia
PACNDGSQGQDY

SEQ ID NO: 3126489 - protein, 4 aa, Giardia lamblia
PADA

SEQ ID NO: 3126490 - protein, 10 aa, Giardia lamblia
PADAPSTGTV

SEQ ID NO: 3126491 - protein, 12 aa, Giardia lamblia
PADASMSMTSQP

SEQ ID NO: 3126492 - protein, 5 aa, Giardia lamblia
PADDN

SEQ ID NO: 3126493 - protein, 7 aa, Giardia lamblia
PADENGQ

SEQ ID NO: 3126494 - protein, 8 aa, Giardia lamblia
PADESQQY

SEQ ID NO: 3126495 - protein, 20 aa, Giardia lamblia
PADGAKAQQKPGKDQKEVSD

SEQ ID NO: 3126496 - protein, 11 aa, Giardia lamblia
PADHTGSTAVK

SEQ ID NO: 3126497 - protein, 6 aa, Giardia lamblia
PADKAA

SEQ ID NO: 3126498 - protein, 8 aa, Giardia lamblia
PADKQAAV

SEQ ID NO: 3126499 - protein, 13 aa, Giardia lamblia
PADMHENGRIYMI

SEQ ID NO: 3126500 - protein, 7 aa, Giardia lamblia
PADPNDT

SEQ ID NO: 3126501 - protein, 5 aa, Giardia lamblia
PADQN

SEQ ID NO: 3126502 - protein, 4 aa, Giardia lamblia
PADT

SEQ ID NO: 3126503 - protein, 6 aa, Giardia lamblia
PADTEW

SEQ ID NO: 3126504 - protein, 14 aa, Giardia lamblia
PAEAAKSSASTRTI

SEQ ID NO: 3126505 - protein, 10 aa, Giardia lamblia
PAEAQESVAP

SEQ ID NO: 3126506 - protein, 17 aa, Giardia lamblia
PAEEKPEAKKSSNADLF

SEQ ID NO: 3126507 - protein, 9 aa, Giardia lamblia
PAEGNPKHA

SEQ ID NO: 3126508 - protein, 6 aa, Giardia lamblia
PAELAT

SEQ ID NO: 3126509 - protein, 10 aa, Giardia lamblia
PAEPAPRTRY

SEQ ID NO: 3126510 - protein, 11 aa, Giardia lamblia
PAEPIPNRSGS

SEQ ID NO: 3126511 - protein, 11 aa, Giardia lamblia
PAEPPDSQRAM

SEQ ID NO: 3126512 - protein, 16 aa, Giardia lamblia
PAEQYNLDSGREKPVD

SEQ ID NO: 3126513 - protein, 4 aa, Giardia lamblia
PAER

SEQ ID NO: 3126514 - protein, 9 aa, Giardia lamblia
PAERPSATQ

SEQ ID NO: 3126515 - protein, 9 aa, Giardia lamblia
PAERRAGRA

SEQ ID NO: 3126516 - protein, 6 aa, Giardia lamblia
PAESPS

SEQ ID NO: 3126517 - protein, 8 aa, Giardia lamblia
PAETPETW

SEQ ID NO: 3126518 - protein, 13 aa, Giardia lamblia
PAETTEKECSPNT

SEQ ID NO: 3126519 - protein, 12 aa, Giardia lamblia
PAETVADTTAIS

SEQ ID NO: 3126520 - protein, 31 aa, Giardia lamblia
PAEVSPPEQHDQGNYGTHYDNSGNNDPYQQG

SEQ ID NO: 3126521 - protein, 4 aa, Giardia lamblia
PAEY

SEQ ID NO: 3126522 - protein, 16 aa, Giardia lamblia
PAFAPDGSAIYSATGD

SEQ ID NO: 3126523 - protein, 4 aa, Giardia lamblia
PAFS

SEQ ID NO: 3126524 - protein, 35 aa, Giardia lamblia
PAFSESSSTIGSSAEYSNRLSNNSTSYSHTDRGLK

SEQ ID NO: 3126525 - protein, 7 aa, Giardia lamblia
PAFSSEL

SEQ ID NO: 3126526 - protein, 24 aa, Giardia lamblia
PAGANSSPPALSATQEQPINDSER

SEQ ID NO: 3126527 - protein, 11 aa, Giardia lamblia
PAGFSRTTKQV

SEQ ID NO: 3126528 - protein, 10 aa, Giardia lamblia
PAGHSSRHAS

SEQ ID NO: 3126529 - protein, 13 aa, Giardia lamblia
PAGLRNSQPDPSL

SEQ ID NO: 3126530 - protein, 10 aa, Giardia lamblia
PAGRQIQGGR

SEQ ID NO: 3126531 - protein, 5 aa, Giardia lamblia
PAGSA

SEQ ID NO: 3126532 - protein, 13 aa, Giardia lamblia
PAGSAHNTGTKPV

SEQ ID NO: 3126533 - protein, 7 aa, Giardia lamblia
PAGSHGA

SEQ ID NO: 3126534 - protein, 18 aa, Giardia lamblia
PAGSPNSAKSASKTSIQA

SEQ ID NO: 3126535 - protein, 7 aa, Giardia lamblia
PAGTGKT

SEQ ID NO: 3126536 - protein, 11 aa, Giardia lamblia
PAGTGKTTTLS

SEQ ID NO: 3126537 - protein, 4 aa, Giardia lamblia
PAGY

SEQ ID NO: 3126538 - protein, 17 aa, Giardia lamblia
PAGYEESAANVKNDDLA

SEQ ID NO: 3126539 - protein, 5 aa, Giardia lamblia
PAGYG

SEQ ID NO: 3126540 - protein, 10 aa, Giardia lamblia
PAHRDASSVV

SEQ ID NO: 3126541 - protein, 25 aa, Giardia lamblia
PAHTAQHSSDSTSSYDDGSSRSSGF

SEQ ID NO: 3126542 - protein, 10 aa, Giardia lamblia
PAKATESGPQ

SEQ ID NO: 3126543 - protein, 8 aa, Giardia lamblia
PAKDPSNV

SEQ ID NO: 3126544 - protein, 31 aa, Giardia lamblia
PAKDQDEPSYDPNKEQAYDEDPNVSSNTDNL

SEQ ID NO: 3126545 - protein, 9 aa, Giardia lamblia
PAKGDRQDW

SEQ ID NO: 3126546 - protein, 7 aa, Giardia lamblia
PAKGGIA

SEQ ID NO: 3126547 - protein, 9 aa, Giardia lamblia
PAKGTSDIS

SEQ ID NO: 3126548 - protein, 15 aa, Giardia lamblia
PAKGYKRANLTPEEE

SEQ ID NO: 3126549 - protein, 6 aa, Giardia lamblia
PAKHGG

SEQ ID NO: 3126550 - protein, 21 aa, Giardia lamblia
PAKKQNTGEPVESAHSSQPSY

SEQ ID NO: 3126551 - protein, 12 aa, Giardia lamblia
PAKNPTDLSRDS

SEQ ID NO: 3126552 - protein, 7 aa, Giardia lamblia
PAKPISS

SEQ ID NO: 3126553 - protein, 10 aa, Giardia lamblia
PAKPSPGAHE

SEQ ID NO: 3126554 - protein, 5 aa, Giardia lamblia
PAKQT

SEQ ID NO: 3126555 - protein, 6 aa, Giardia lamblia
PAKRPG

SEQ ID NO: 3126556 - protein, 7 aa, Giardia lamblia
PAKRPSF

SEQ ID NO: 3126557 - protein, 20 aa, Giardia lamblia
PAKRSGPVRDDSVDPTGRIR

SEQ ID NO: 3126558 - protein, 8 aa, Giardia lamblia
PAKTEATR

SEQ ID NO: 3126559 - protein, 8 aa, Giardia lamblia
PAKTTCKT

SEQ ID NO: 3126560 - protein, 23 aa, Giardia lamblia
PALAGGSPSSSVSESVPERPPAR

SEQ ID NO: 3126561 - protein, 17 aa, Giardia lamblia
PALDADPLTASREGYAA

SEQ ID NO: 3126562 - protein, 7 aa, Giardia lamblia
PALDDSK

SEQ ID NO: 3126563 - protein, 5 aa, Giardia lamblia
PALEE

SEQ ID NO: 3126564 - protein, 10 aa, Giardia lamblia
PALEKAEKAL

SEQ ID NO: 3126565 - protein, 7 aa, Giardia lamblia
PALKKRN

SEQ ID NO: 3126566 - protein, 46 aa, Giardia lamblia
PALPNANSPAHGGGKFSSQRPQGFTSESNRSERDAAGGNVEDGEED

SEQ ID NO: 3126567 - protein, 6 aa, Giardia lamblia
PALPRA

SEQ ID NO: 3126568 - protein, 7 aa, Giardia lamblia
PALPSET

SEQ ID NO: 3126569 - protein, 5 aa, Giardia lamblia
PALQS

SEQ ID NO: 3126570 - protein, 4 aa, Giardia lamblia
PALS

SEQ ID NO: 3126571 - protein, 6 aa, Giardia lamblia
PALSKK

SEQ ID NO: 3126572 - protein, 6 aa, Giardia lamblia
PALSPS

SEQ ID NO: 3126573 - protein, 18 aa, Giardia lamblia
PALTQGGDAKARGYHEEK

SEQ ID NO: 3126574 - protein, 11 aa, Giardia lamblia
PALTSAAGRSA

SEQ ID NO: 3126575 - protein, 7 aa, Giardia lamblia
PAMGGTC

SEQ ID NO: 3126576 - protein, 6 aa, Giardia lamblia
PAMPAS

SEQ ID NO: 3126577 - protein, 19 aa, Giardia lamblia
PANALGDRSAHGSGKLSKQ

SEQ ID NO: 3126578 - protein, 36 aa, Giardia lamblia
PANDQSDAYRPPGPPEATEDDRGTDGYAESDSSTTD

SEQ ID NO: 3126579 - protein, 9 aa, Giardia lamblia
PANENAQKK

SEQ ID NO: 3126580 - protein, 9 aa, Giardia lamblia
PANENMPED

SEQ ID NO: 3126581 - protein, 5 aa, Giardia lamblia
PANIN

SEQ ID NO: 3126582 - protein, 12 aa, Giardia lamblia
PANIPDKSKHTG

SEQ ID NO: 3126583 - protein, 10 aa, Giardia lamblia
PANIQPQHKD

SEQ ID NO: 3126584 - protein, 8 aa, Giardia lamblia
PANKPPVS

SEQ ID NO: 3126585 - protein, 12 aa, Giardia lamblia
PANLGPGQNQQG

SEQ ID NO: 3126586 - protein, 11 aa, Giardia lamblia
PANQGPDPITK

SEQ ID NO: 3126587 - protein, 8 aa, Giardia lamblia
PANRPTAA

SEQ ID NO: 3126588 - protein, 52 aa, Giardia lamblia
PANSQTSSTSSLSGDKGLRSKPQERLGSAKAPGSAGALAPLSGSRVKPQALA

SEQ ID NO: 3126589 - protein, 6 aa, Giardia lamblia
PANSST

SEQ ID NO: 3126590 - protein, 5 aa, Giardia lamblia
PANTY

SEQ ID NO: 3126591 - protein, 8 aa, Giardia lamblia
PANVDPPD

SEQ ID NO: 3126592 - protein, 7 aa, Giardia lamblia
PAPAAIQ

SEQ ID NO: 3126593 - protein, 5 aa, Giardia lamblia
PAPAG

SEQ ID NO: 3126594 - protein, 14 aa, Giardia lamblia
PAPAPAPKPSGYLP

SEQ ID NO: 3126595 - protein, 16 aa, Giardia lamblia
PAPARPADASYSAPSS

SEQ ID NO: 3126596 - protein, 35 aa, Giardia lamblia
PAPATPSSAVRVPGSACTAPPPAAGPPEAAPAESV

SEQ ID NO: 3126597 - protein, 18 aa, Giardia lamblia
PAPCEKADAARIFSESFY

SEQ ID NO: 3126598 - protein, 7 aa, Giardia lamblia
PAPCPQA

SEQ ID NO: 3126599 - protein, 4 aa, Giardia lamblia
PAPE

SEQ ID NO: 3126600 - protein, 6 aa, Giardia lamblia
PAPENP

SEQ ID NO: 3126601 - protein, 5 aa, Giardia lamblia
PAPES

SEQ ID NO: 3126602 - protein, 35 aa, Giardia lamblia
PAPESPKREDKKTSPLAEKLSPKQKRTSPGKSGFE

SEQ ID NO: 3126603 - protein, 7 aa, Giardia lamblia
PAPESYA

SEQ ID NO: 3126604 - protein, 9 aa, Giardia lamblia
PAPGAYDAY

SEQ ID NO: 3126605 - protein, 9 aa, Giardia lamblia
PAPKATDPL

SEQ ID NO: 3126606 - protein, 5 aa, Giardia lamblia
PAPLA

SEQ ID NO: 3126607 - protein, 12 aa, Giardia lamblia
PAPLDPTRATYT

SEQ ID NO: 3126608 - protein, 6 aa, Giardia lamblia
PAPLQT

SEQ ID NO: 3126609 - protein, 7 aa, Giardia lamblia
PAPMPTR

SEQ ID NO: 3126610 - protein, 7 aa, Giardia lamblia
PAPMYTD

SEQ ID NO: 3126611 - protein, 4 aa, Giardia lamblia
PAPN

SEQ ID NO: 3126612 - protein, 18 aa, Giardia lamblia
PAPNALGPKIGPYGLPPK

SEQ ID NO: 3126613 - protein, 5 aa, Giardia lamblia
PAPPD

SEQ ID NO: 3126614 - protein, 7 aa, Giardia lamblia
PAPPNSK

SEQ ID NO: 3126615 - protein, 10 aa, Giardia lamblia
PAPQAEPDVE

SEQ ID NO: 3126616 - protein, 14 aa, Giardia lamblia
PAPSHDGSRESRTI

SEQ ID NO: 3126617 - protein, 35 aa, Giardia lamblia
PAPSVTNSNTVVSARDGASSLPPPTTTNSGISTAP

SEQ ID NO: 3126618 - protein, 4 aa, Giardia lamblia
PAPT

SEQ ID NO: 3126619 - protein, 8 aa, Giardia lamblia
PAPTDNEG

SEQ ID NO: 3126620 - protein, 5 aa, Giardia lamblia
PAPVH

SEQ ID NO: 3126621 - protein, 4 aa, Giardia lamblia
PAPY

SEQ ID NO: 3126622 - protein, 11 aa, Giardia lamblia
PAPYVPPPQGI

SEQ ID NO: 3126623 - protein, 9 aa, Giardia lamblia
PAQASHGIS

SEQ ID NO: 3126624 - protein, 10 aa, Giardia lamblia
PAQDALQGSM

SEQ ID NO: 3126625 - protein, 8 aa, Giardia lamblia
PAQDPQST

SEQ ID NO: 3126626 - protein, 32 aa, Giardia lamblia
PAQDQSLSDDQDTETSESTDAPQHHPFDGSDT

SEQ ID NO: 3126627 - protein, 4 aa, Giardia lamblia
PAQE

SEQ ID NO: 3126628 - protein, 22 aa, Giardia lamblia
PAQHEGSNPSHSASSIGAKPSV

SEQ ID NO: 3126629 - protein, 11 aa, Giardia lamblia
PAQHPDTSIPL

SEQ ID NO: 3126630 - protein, 12 aa, Giardia lamblia
PAQITTSQAPLD

SEQ ID NO: 3126631 - protein, 4 aa, Giardia lamblia
PAQK

SEQ ID NO: 3126632 - protein, 10 aa, Giardia lamblia
PAQNQPTTAR

SEQ ID NO: 3126633 - protein, 14 aa, Giardia lamblia
PAQPCNTKPEININ

SEQ ID NO: 3126634 - protein, 5 aa, Giardia lamblia
PAQPD

SEQ ID NO: 3126635 - protein, 10 aa, Giardia lamblia
PAQPSKPKID

SEQ ID NO: 3126636 - protein, 5 aa, Giardia lamblia
PAQRK

SEQ ID NO: 3126637 - protein, 30 aa, Giardia lamblia
PAQSHKNQVDPEDRLQPRSDGPKPPQSQEA

SEQ ID NO: 3126638 - protein, 4 aa, Giardia lamblia
PAQT

SEQ ID NO: 3126639 - protein, 7 aa, Giardia lamblia
PARPLEQ

SEQ ID NO: 3126640 - protein, 4 aa, Giardia lamblia
PARQ

SEQ ID NO: 3126641 - protein, 8 aa, Giardia lamblia
PARSLGPL

SEQ ID NO: 3126642 - protein, 10 aa, Giardia lamblia
PARSSCSSTQ

SEQ ID NO: 3126643 - protein, 6 aa, Giardia lamblia
PARTAK

SEQ ID NO: 3126644 - protein, 4 aa, Giardia lamblia
PARY

SEQ ID NO: 3126645 - protein, 5 aa, Giardia lamblia
PASAI

SEQ ID NO: 3126646 - protein, 7 aa, Giardia lamblia
PASARLS

SEQ ID NO: 3126647 - protein, 10 aa, Giardia lamblia
PASATEQSIT

SEQ ID NO: 3126648 - protein, 4 aa, Giardia lamblia
PASD

SEQ ID NO: 3126649 - protein, 14 aa, Giardia lamblia
PASDATNELTAQKE

SEQ ID NO: 3126650 - protein, 10 aa, Giardia lamblia
PASDPRSEEN

SEQ ID NO: 3126651 - protein, 4 aa, Giardia lamblia
PASE

SEQ ID NO: 3126652 - protein, 7 aa, Giardia lamblia
PASEDFR

SEQ ID NO: 3126653 - protein, 29 aa, Giardia lamblia
PASEEPRSPLTAGAKAELDYQSAPSAPLD

SEQ ID NO: 3126654 - protein, 5 aa, Giardia lamblia
PASGD

SEQ ID NO: 3126655 - protein, 5 aa, Giardia lamblia
PASGF

SEQ ID NO: 3126656 - protein, 6 aa, Giardia lamblia
PASGGM

SEQ ID NO: 3126657 - protein, 10 aa, Giardia lamblia
PASGSTQSIY

SEQ ID NO: 3126658 - protein, 9 aa, Giardia lamblia
PASGTVQAG

SEQ ID NO: 3126659 - protein, 7 aa, Giardia lamblia
PASGTVS

SEQ ID NO: 3126660 - protein, 4 aa, Giardia lamblia
PASK

SEQ ID NO: 3126661 - protein, 4 aa, Giardia lamblia
PASL

SEQ ID NO: 3126662 - protein, 6 aa, Giardia lamblia
PASLED

SEQ ID NO: 3126663 - protein, 7 aa, Giardia lamblia
PASLQES

SEQ ID NO: 3126664 - protein, 9 aa, Giardia lamblia
PASNAGARK

SEQ ID NO: 3126665 - protein, 9 aa, Giardia lamblia
PASNPTYGG

SEQ ID NO: 3126666 - protein, 6 aa, Giardia lamblia
PASPIS

SEQ ID NO: 3126667 - protein, 20 aa, Giardia lamblia
PASPLPSGPKDITTPLSTGQ

SEQ ID NO: 3126668 - protein, 21 aa, Giardia lamblia
PASPTLRNAAQRKGVGKGNRC

SEQ ID NO: 3126669 - protein, 6 aa, Giardia lamblia
PASQDE

SEQ ID NO: 3126670 - protein, 19 aa, Giardia lamblia
PASRKSVRESTGKSESTLN

SEQ ID NO: 3126671 - protein, 14 aa, Giardia lamblia
PASRQRNPSRQSWE

SEQ ID NO: 3126672 - protein, 7 aa, Giardia lamblia
PASRQSL

SEQ ID NO: 3126673 - protein, 11 aa, Giardia lamblia
PASSDPSSGLT

SEQ ID NO: 3126674 - protein, 35 aa, Giardia lamblia
PASSLTGMDTPPRHYGEDSDGVQMDEHSGNAAGAH

SEQ ID NO: 3126675 - protein, 8 aa, Giardia lamblia
PASTGAAS

SEQ ID NO: 3126676 - protein, 9 aa, Giardia lamblia
PASTNYDET

SEQ ID NO: 3126677 - protein, 8 aa, Giardia lamblia
PASVDTEN

SEQ ID NO: 3126678 - protein, 9 aa, Giardia lamblia
PASVPSGPN

SEQ ID NO: 3126679 - protein, 4 aa, Giardia lamblia
PATD

SEQ ID NO: 3126680 - protein, 6 aa, Giardia lamblia
PATDDV

SEQ ID NO: 3126681 - protein, 7 aa, Giardia lamblia
PATEEAC

SEQ ID NO: 3126682 - protein, 13 aa, Giardia lamblia
PATEESQSKISAE

SEQ ID NO: 3126683 - protein, 5 aa, Giardia lamblia
PATFP

SEQ ID NO: 3126684 - protein, 5 aa, Giardia lamblia
PATGD

SEQ ID NO: 3126685 - protein, 15 aa, Giardia lamblia
PATGEWNDGALSSAA

SEQ ID NO: 3126686 - protein, 15 aa, Giardia lamblia
PATGGSDGTPGDSYD

SEQ ID NO: 3126687 - protein, 7 aa, Giardia lamblia
PATGSAY

SEQ ID NO: 3126688 - protein, 7 aa, Giardia lamblia
PATGTGC

SEQ ID NO: 3126689 - protein, 5 aa, Giardia lamblia
PATLS

SEQ ID NO: 3126690 - protein, 15 aa, Giardia lamblia
PATNAAGKPLTRGTS

SEQ ID NO: 3126691 - protein, 8 aa, Giardia lamblia
PATPEFES

SEQ ID NO: 3126692 - protein, 8 aa, Giardia lamblia
PATPNDRR

SEQ ID NO: 3126693 - protein, 10 aa, Giardia lamblia
PATPPNQDKI

SEQ ID NO: 3126694 - protein, 7 aa, Giardia lamblia
PATPSSA

SEQ ID NO: 3126695 - protein, 7 aa, Giardia lamblia
PATQKAH

SEQ ID NO: 3126696 - protein, 5 aa, Giardia lamblia
PATRI

SEQ ID NO: 3126697 - protein, 5 aa, Giardia lamblia
PATSL

SEQ ID NO: 3126698 - protein, 11 aa, Giardia lamblia
PATSSDLSGEH

SEQ ID NO: 3126699 - protein, 13 aa, Giardia lamblia
PATTDLSSQPSKA

SEQ ID NO: 3126700 - protein, 8 aa, Giardia lamblia
PATTLGSA

SEQ ID NO: 3126701 - protein, 9 aa, Giardia lamblia
PATTNPFSA

SEQ ID NO: 3126702 - protein, 14 aa, Giardia lamblia
PATVEGKNLSETAA

SEQ ID NO: 3126703 - protein, 5 aa, Giardia lamblia
PAVAP

SEQ ID NO: 3126704 - protein, 5 aa, Giardia lamblia
PAVEQ

SEQ ID NO: 3126705 - protein, 6 aa, Giardia lamblia
PAVGNN

SEQ ID NO: 3126706 - protein, 9 aa, Giardia lamblia
PAVNGGAPV

SEQ ID NO: 3126707 - protein, 10 aa, Giardia lamblia
PAVPNDPATV

SEQ ID NO: 3126708 - protein, 6 aa, Giardia lamblia
PAVPNK

SEQ ID NO: 3126709 - protein, 8 aa, Giardia lamblia
PAVPPAPL

SEQ ID NO: 3126710 - protein, 12 aa, Giardia lamblia
PAVQKQDSVTYR

SEQ ID NO: 3126711 - protein, 7 aa, Giardia lamblia
PAVSEPD

SEQ ID NO: 3126712 - protein, 21 aa, Giardia lamblia
PAYHDTDGALSCPDSATEEDM

SEQ ID NO: 3126713 - protein, 5 aa, Giardia lamblia
PAYKN

SEQ ID NO: 3126714 - protein, 7 aa, Giardia lamblia
PAYQPST

SEQ ID NO: 3126715 - protein, 5 aa, Giardia lamblia
PAYSS

SEQ ID NO: 3126716 - protein, 11 aa, Giardia lamblia
PAYTGTQSYQA

SEQ ID NO: 3126717 - protein, 17 aa, Giardia lamblia
PCASSSLKEDESVPQNY

SEQ ID NO: 3126718 - protein, 8 aa, Giardia lamblia
PCEDEQRS

SEQ ID NO: 3126719 - protein, 21 aa, Giardia lamblia
PCGPSSEPQEDQERVSDLPQA

SEQ ID NO: 3126720 - protein, 6 aa, Giardia lamblia
PCNPCP

SEQ ID NO: 3126721 - protein, 15 aa, Giardia lamblia
PCPDMSSTSYSTAPT

SEQ ID NO: 3126722 - protein, 26 aa, Giardia lamblia
PCPDRSGASDNTPRRAAARPASSTER

SEQ ID NO: 3126723 - protein, 10 aa, Giardia lamblia
PCPQNGEDPD

SEQ ID NO: 3126724 - protein, 12 aa, Giardia lamblia
PCPSCKKSRSEL

SEQ ID NO: 3126725 - protein, 5 aa, Giardia lamblia
PCQTP

SEQ ID NO: 3126726 - protein, 5 aa, Giardia lamblia
PCSED

SEQ ID NO: 3126727 - protein, 11 aa, Giardia lamblia
PCSGDGTLRKA

SEQ ID NO: 3126728 - protein, 6 aa, Giardia lamblia
PCSGKS

SEQ ID NO: 3126729 - protein, 13 aa, Giardia lamblia
PCSKAKNKAAEKI

SEQ ID NO: 3126730 - protein, 10 aa, Giardia lamblia
PCSQITPNSH

SEQ ID NO: 3126731 - protein, 11 aa, Giardia lamblia
PCTEEKTRAIG

SEQ ID NO: 3126732 - protein, 7 aa, Giardia lamblia
PCVPPEK

SEQ ID NO: 3126733 - protein, 4 aa, Giardia lamblia
PDAA

SEQ ID NO: 3126734 - protein, 10 aa, Giardia lamblia
PDAAAAGARG

SEQ ID NO: 3126735 - protein, 9 aa, Giardia lamblia
PDAGGATRC

SEQ ID NO: 3126736 - protein, 6 aa, Giardia lamblia
PDAGSN

SEQ ID NO: 3126737 - protein, 8 aa, Giardia lamblia
PDAHNDSY

SEQ ID NO: 3126738 - protein, 8 aa, Giardia lamblia
PDALNTED

SEQ ID NO: 3126739 - protein, 6 aa, Giardia lamblia
PDAPLD

SEQ ID NO: 3126740 - protein, 8 aa, Giardia lamblia
PDAPLPGM

SEQ ID NO: 3126741 - protein, 6 aa, Giardia lamblia
PDAPRT

SEQ ID NO: 3126742 - protein, 8 aa, Giardia lamblia
PDAPTVSD

SEQ ID NO: 3126743 - protein, 10 aa, Giardia lamblia
PDASDFNTNN

SEQ ID NO: 3126744 - protein, 8 aa, Giardia lamblia
PDASSLSA

SEQ ID NO: 3126745 - protein, 7 aa, Giardia lamblia
PDATEER

SEQ ID NO: 3126746 - protein, 4 aa, Giardia lamblia
PDAV

SEQ ID NO: 3126747 - protein, 7 aa, Giardia lamblia
PDAVPPL

SEQ ID NO: 3126748 - protein, 8 aa, Giardia lamblia
PDCGGPVS

SEQ ID NO: 3126749 - protein, 5 aa, Giardia lamblia
PDCKG

SEQ ID NO: 3126750 - protein, 6 aa, Giardia lamblia
PDDAER

SEQ ID NO: 3126751 - protein, 32 aa, Giardia lamblia
PDDMPAAKSIDQAPKPANCISTDPDSSQRPAV

SEQ ID NO: 3126752 - protein, 17 aa, Giardia lamblia
PDDPQDQSGSKTTRSHV

SEQ ID NO: 3126753 - protein, 7 aa, Giardia lamblia
PDDSEFD

SEQ ID NO: 3126754 - protein, 12 aa, Giardia lamblia
PDDSGDSKWASQ

SEQ ID NO: 3126755 - protein, 5 aa, Giardia lamblia
PDDST

SEQ ID NO: 3126756 - protein, 11 aa, Giardia lamblia
PDDTDMGNSEV

SEQ ID NO: 3126757 - protein, 4 aa, Giardia lamblia
PDEA

SEQ ID NO: 3126758 - protein, 29 aa, Giardia lamblia
PDEDDGNDTDSLSKTHDDTEPELKRRGSL

SEQ ID NO: 3126759 - protein, 8 aa, Giardia lamblia
PDEEIKER

SEQ ID NO: 3126760 - protein, 5 aa, Giardia lamblia
PDEFD

SEQ ID NO: 3126761 - protein, 7 aa, Giardia lamblia
PDEGSIM

SEQ ID NO: 3126762 - protein, 6 aa, Giardia lamblia
PDEGYE

SEQ ID NO: 3126763 - protein, 13 aa, Giardia lamblia
PDEHASADLSGSA

SEQ ID NO: 3126764 - protein, 7 aa, Giardia lamblia
PDEKEKI

SEQ ID NO: 3126765 - protein, 5 aa, Giardia lamblia
PDEKK

SEQ ID NO: 3126766 - protein, 6 aa, Giardia lamblia
PDEKPQ

SEQ ID NO: 3126767 - protein, 12 aa, Giardia lamblia
PDELASKTSMQT

SEQ ID NO: 3126768 - protein, 4 aa, Giardia lamblia
PDEN

SEQ ID NO: 3126769 - protein, 6 aa, Giardia lamblia
PDENGR

SEQ ID NO: 3126770 - protein, 4 aa, Giardia lamblia
PDEQ

SEQ ID NO: 3126771 - protein, 4 aa, Giardia lamblia
PDER

SEQ ID NO: 3126772 - protein, 8 aa, Giardia lamblia
PDERASDG

SEQ ID NO: 3126773 - protein, 5 aa, Giardia lamblia
PDERG

SEQ ID NO: 3126774 - protein, 8 aa, Giardia lamblia
PDESEYNR

SEQ ID NO: 3126775 - protein, 12 aa, Giardia lamblia
PDESTASTTSKS

SEQ ID NO: 3126776 - protein, 8 aa, Giardia lamblia
PDETGKEW

SEQ ID NO: 3126777 - protein, 5 aa, Giardia lamblia
PDETN

SEQ ID NO: 3126778 - protein, 5 aa, Giardia lamblia
PDEVD

SEQ ID NO: 3126779 - protein, 7 aa, Giardia lamblia
PDEVSPG

SEQ ID NO: 3126780 - protein, 4 aa, Giardia lamblia
PDFD

SEQ ID NO: 3126781 - protein, 6 aa, Giardia lamblia
PDFPTS

SEQ ID NO: 3126782 - protein, 11 aa, Giardia lamblia
PDFRSKGTGLY

SEQ ID NO: 3126783 - protein, 12 aa, Giardia lamblia
PDFSNAPQTDVK

SEQ ID NO: 3126784 - protein, 8 aa, Giardia lamblia
PDFSSRSP

SEQ ID NO: 3126785 - protein, 7 aa, Giardia lamblia
PDGEVPR

SEQ ID NO: 3126786 - protein, 16 aa, Giardia lamblia
PDGKEAGEQNINPPVD

SEQ ID NO: 3126787 - protein, 10 aa, Giardia lamblia
PDGKTTEIPA

SEQ ID NO: 3126788 - protein, 4 aa, Giardia lamblia
PDGN

SEQ ID NO: 3126789 - protein, 8 aa, Giardia lamblia
PDGPPTIN

SEQ ID NO: 3126790 - protein, 7 aa, Giardia lamblia
PDGQGLS

SEQ ID NO: 3126791 - protein, 6 aa, Giardia lamblia
PDGRKY

SEQ ID NO: 3126792 - protein, 6 aa, Giardia lamblia
PDGRVH

SEQ ID NO: 3126793 - protein, 9 aa, Giardia lamblia
PDGSCPPDK

SEQ ID NO: 3126794 - protein, 6 aa, Giardia lamblia
PDGSDP

SEQ ID NO: 3126795 - protein, 6 aa, Giardia lamblia
PDGSGT

SEQ ID NO: 3126796 - protein, 5 aa, Giardia lamblia
PDGSL

SEQ ID NO: 3126797 - protein, 9 aa, Giardia lamblia
PDGSRNKPL

SEQ ID NO: 3126798 - protein, 7 aa, Giardia lamblia
PDGTAQT

SEQ ID NO: 3126799 - protein, 16 aa, Giardia lamblia
PDGTPSAVPSENATAL

SEQ ID NO: 3126800 - protein, 6 aa, Giardia lamblia
PDGTSI

SEQ ID NO: 3126801 - protein, 11 aa, Giardia lamblia
PDGTTVATGCT

SEQ ID NO: 3126802 - protein, 5 aa, Giardia lamblia
PDGTY

SEQ ID NO: 3126803 - protein, 7 aa, Giardia lamblia
PDGVSTQ

SEQ ID NO: 3126804 - protein, 9 aa, Giardia lamblia
PDHERETSK

SEQ ID NO: 3126805 - protein, 6 aa, Giardia lamblia
PDHHKR

SEQ ID NO: 3126806 - protein, 11 aa, Giardia lamblia
PDHLPGGQPAS

SEQ ID NO: 3126807 - protein, 12 aa, Giardia lamblia
PDHNPLAGTPAP

SEQ ID NO: 3126808 - protein, 19 aa, Giardia lamblia
PDHSIGEVSSKEPYSVDEH

SEQ ID NO: 3126809 - protein, 14 aa, Giardia lamblia
PDIDGSGKLKQPSE

SEQ ID NO: 3126810 - protein, 14 aa, Giardia lamblia
PDIEEPSKARKGTS

SEQ ID NO: 3126811 - protein, 10 aa, Giardia lamblia
PDIPPDRPYA

SEQ ID NO: 3126812 - protein, 15 aa, Giardia lamblia
PDISSTTPTNSDALP

SEQ ID NO: 3126813 - protein, 6 aa, Giardia lamblia
PDITSS

SEQ ID NO: 3126814 - protein, 7 aa, Giardia lamblia
PDKAGNM

SEQ ID NO: 3126815 - protein, 8 aa, Giardia lamblia
PDKDARKL

SEQ ID NO: 3126816 - protein, 11 aa, Giardia lamblia
PDKGQQSVQDE

SEQ ID NO: 3126817 - protein, 11 aa, Giardia lamblia
PDKHIGAPSTV

SEQ ID NO: 3126818 - protein, 4 aa, Giardia lamblia
PDKL

SEQ ID NO: 3126819 - protein, 11 aa, Giardia lamblia
PDKNRDNPERA

SEQ ID NO: 3126820 - protein, 14 aa, Giardia lamblia
PDKNRDNRQEAEAR

SEQ ID NO: 3126821 - protein, 7 aa, Giardia lamblia
PDKPQTH

SEQ ID NO: 3126822 - protein, 4 aa, Giardia lamblia
PDKR

SEQ ID NO: 3126823 - protein, 35 aa, Giardia lamblia
PDKRARKSALRSGEGDDLDVQDDEGCKEDAEASRI

SEQ ID NO: 3126824 - protein, 4 aa, Giardia lamblia
PDKS

SEQ ID NO: 3126825 - protein, 8 aa, Giardia lamblia
PDKSNKGK

SEQ ID NO: 3126826 - protein, 4 aa, Giardia lamblia
PDKT

SEQ ID NO: 3126827 - protein, 8 aa, Giardia lamblia
PDKTRRLG

SEQ ID NO: 3126828 - protein, 12 aa, Giardia lamblia
PDLASKKPLGVT

SEQ ID NO: 3126829 - protein, 11 aa, Giardia lamblia
PDLETPSNAFR

SEQ ID NO: 3126830 - protein, 12 aa, Giardia lamblia
PDLETRKPYPAV

SEQ ID NO: 3126831 - protein, 4 aa, Giardia lamblia
PDLG

SEQ ID NO: 3126832 - protein, 7 aa, Giardia lamblia
PDLGKNT

SEQ ID NO: 3126833 - protein, 7 aa, Giardia lamblia
PDLNPRG

SEQ ID NO: 3126834 - protein, 12 aa, Giardia lamblia
PDLRPSAEDIHE

SEQ ID NO: 3126835 - protein, 13 aa, Giardia lamblia
PDLSSSSWTAGIG

SEQ ID NO: 3126836 - protein, 6 aa, Giardia lamblia
PDLSTN

SEQ ID NO: 3126837 - protein, 11 aa, Giardia lamblia
PDLTEEQKHEI

SEQ ID NO: 3126838 - protein, 8 aa, Giardia lamblia
PDMEENDA

SEQ ID NO: 3126839 - protein, 5 aa, Giardia lamblia
PDNCG

SEQ ID NO: 3126840 - protein, 15 aa, Giardia lamblia
PDNEREKPDYTKKNG

SEQ ID NO: 3126841 - protein, 6 aa, Giardia lamblia
PDNGYP

SEQ ID NO: 3126842 - protein, 4 aa, Giardia lamblia
PDNI

SEQ ID NO: 3126843 - protein, 4 aa, Giardia lamblia
PDNL

SEQ ID NO: 3126844 - protein, 16 aa, Giardia lamblia
PDNPETAYLGEESRAA

SEQ ID NO: 3126845 - protein, 7 aa, Giardia lamblia
PDNPMND

SEQ ID NO: 3126846 - protein, 6 aa, Giardia lamblia
PDNPRD

SEQ ID NO: 3126847 - protein, 6 aa, Giardia lamblia
PDNQRR

SEQ ID NO: 3126848 - protein, 4 aa, Giardia lamblia
PDNT

SEQ ID NO: 3126849 - protein, 15 aa, Giardia lamblia
PDPAKLSKDDPTVSS

SEQ ID NO: 3126850 - protein, 6 aa, Giardia lamblia
PDPDQS

SEQ ID NO: 3126851 - protein, 8 aa, Giardia lamblia
PDPETGKA

SEQ ID NO: 3126852 - protein, 13 aa, Giardia lamblia
PDPGEEQGGTYTG

SEQ ID NO: 3126853 - protein, 8 aa, Giardia lamblia
PDPGSPSG

SEQ ID NO: 3126854 - protein, 11 aa, Giardia lamblia
PDPKARPTAEQ

SEQ ID NO: 3126855 - protein, 7 aa, Giardia lamblia
PDPKEYS

SEQ ID NO: 3126856 - protein, 7 aa, Giardia lamblia
PDPLQRP

SEQ ID NO: 3126857 - protein, 15 aa, Giardia lamblia
PDPMPPGADNSPAEH

SEQ ID NO: 3126858 - protein, 8 aa, Giardia lamblia
PDPNVDGR

SEQ ID NO: 3126859 - protein, 11 aa, Giardia lamblia
PDPNVTSKEVE

SEQ ID NO: 3126860 - protein, 6 aa, Giardia lamblia
PDPPFL

SEQ ID NO: 3126861 - protein, 7 aa, Giardia lamblia
PDPPGAP

SEQ ID NO: 3126862 - protein, 9 aa, Giardia lamblia
PDPQGMSEA

SEQ ID NO: 3126863 - protein, 5 aa, Giardia lamblia
PDPQL

SEQ ID NO: 3126864 - protein, 5 aa, Giardia lamblia
PDPRL

SEQ ID NO: 3126865 - protein, 8 aa, Giardia lamblia
PDPRTRPD

SEQ ID NO: 3126866 - protein, 9 aa, Giardia lamblia
PDPSARSSV

SEQ ID NO: 3126867 - protein, 6 aa, Giardia lamblia
PDPSCA

SEQ ID NO: 3126868 - protein, 7 aa, Giardia lamblia
PDPSFNA

SEQ ID NO: 3126869 - protein, 15 aa, Giardia lamblia
PDPSPADSKAEQYPL

SEQ ID NO: 3126870 - protein, 17 aa, Giardia lamblia
PDPSQLGGSNDGESDRL

SEQ ID NO: 3126871 - protein, 8 aa, Giardia lamblia
PDPSSANE

SEQ ID NO: 3126872 - protein, 6 aa, Giardia lamblia
PDPSYL

SEQ ID NO: 3126873 - protein, 76 aa, Giardia lamblia
PDPTEAPEPAAPLATTQSAKQATKPSLKNTIRPAPEKQPVGRPTHSMPDKPKAAAGLAKPELPNGQTGTGASAKNL

SEQ ID NO: 3126874 - protein, 6 aa, Giardia lamblia
PDPTGR

SEQ ID NO: 3126875 - protein, 8 aa, Giardia lamblia
PDPTHNEN

SEQ ID NO: 3126876 - protein, 12 aa, Giardia lamblia
PDPTNTTDDPSG

SEQ ID NO: 3126877 - protein, 7 aa, Giardia lamblia
PDPVKRP

SEQ ID NO: 3126878 - protein, 4 aa, Giardia lamblia
PDQA

SEQ ID NO: 3126879 - protein, 6 aa, Giardia lamblia
PDQAPS

SEQ ID NO: 3126880 - protein, 8 aa, Giardia lamblia
PDQGDTLD

SEQ ID NO: 3126881 - protein, 7 aa, Giardia lamblia
PDQGNEF

SEQ ID NO: 3126882 - protein, 11 aa, Giardia lamblia
PDQGYRPTAGD

SEQ ID NO: 3126883 - protein, 7 aa, Giardia lamblia
PDQINTS

SEQ ID NO: 3126884 - protein, 20 aa, Giardia lamblia
PDQKAEATTDFTPSSDEFSQ

SEQ ID NO: 3126885 - protein, 7 aa, Giardia lamblia
PDQKDER

SEQ ID NO: 3126886 - protein, 6 aa, Giardia lamblia
PDQLGG

SEQ ID NO: 3126887 - protein, 8 aa, Giardia lamblia
PDQPLDGD

SEQ ID NO: 3126888 - protein, 5 aa, Giardia lamblia
PDQRM

SEQ ID NO: 3126889 - protein, 8 aa, Giardia lamblia
PDQSKPED

SEQ ID NO: 3126890 - protein, 24 aa, Giardia lamblia
PDQSVCSTEQPQPAVGTEQQDDIN

SEQ ID NO: 3126891 - protein, 16 aa, Giardia lamblia
PDQTAPSQQHAHRSPP

SEQ ID NO: 3126892 - protein, 9 aa, Giardia lamblia
PDQTTPDGM

SEQ ID NO: 3126893 - protein, 42 aa, Giardia lamblia
PDQYTEEEQHSTDGQPAQDEQVSPPSSSIDIERNKQRLKEKE

SEQ ID NO: 3126894 - protein, 4 aa, Giardia lamblia
PDRA

SEQ ID NO: 3126895 - protein, 11 aa, Giardia lamblia
PDRATDSPDPK

SEQ ID NO: 3126896 - protein, 8 aa, Giardia lamblia
PDREADTG

SEQ ID NO: 3126897 - protein, 5 aa, Giardia lamblia
PDRKA

SEQ ID NO: 3126898 - protein, 6 aa, Giardia lamblia
PDRKGN

SEQ ID NO: 3126899 - protein, 6 aa, Giardia lamblia
PDRKTV

SEQ ID NO: 3126900 - protein, 5 aa, Giardia lamblia
PDRRS

SEQ ID NO: 3126901 - protein, 5 aa, Giardia lamblia
PDRTE

SEQ ID NO: 3126902 - protein, 9 aa, Giardia lamblia
PDRTTKSGA

SEQ ID NO: 3126903 - protein, 15 aa, Giardia lamblia
PDSAEHAATLDPSNY

SEQ ID NO: 3126904 - protein, 7 aa, Giardia lamblia
PDSATDK

SEQ ID NO: 3126905 - protein, 6 aa, Giardia lamblia
PDSGDL

SEQ ID NO: 3126906 - protein, 5 aa, Giardia lamblia
PDSGS

SEQ ID NO: 3126907 - protein, 10 aa, Giardia lamblia
PDSKPYDSGQ

SEQ ID NO: 3126908 - protein, 4 aa, Giardia lamblia
PDSL

SEQ ID NO: 3126909 - protein, 5 aa, Giardia lamblia
PDSLQ

SEQ ID NO: 3126910 - protein, 7 aa, Giardia lamblia
PDSNREF

SEQ ID NO: 3126911 - protein, 7 aa, Giardia lamblia
PDSPQSE

SEQ ID NO: 3126912 - protein, 5 aa, Giardia lamblia
PDSQD

SEQ ID NO: 3126913 - protein, 14 aa, Giardia lamblia
PDSQEFRGTPIAPT

SEQ ID NO: 3126914 - protein, 9 aa, Giardia lamblia
PDSSAYKEA

SEQ ID NO: 3126915 - protein, 6 aa, Giardia lamblia
PDSSDA

SEQ ID NO: 3126916 - protein, 24 aa, Giardia lamblia
PDSSNEKGCQEPIPEQPKDKRPQP

SEQ ID NO: 3126917 - protein, 18 aa, Giardia lamblia
PDSSNYRHNYEGDDDMPA

SEQ ID NO: 3126918 - protein, 5 aa, Giardia lamblia
PDSSQ

SEQ ID NO: 3126919 - protein, 8 aa, Giardia lamblia
PDSTDRTY

SEQ ID NO: 3126920 - protein, 10 aa, Giardia lamblia
PDSTETRGLQ

SEQ ID NO: 3126921 - protein, 8 aa, Giardia lamblia
PDSTPNEL

SEQ ID NO: 3126922 - protein, 8 aa, Giardia lamblia
PDSTTHSL

SEQ ID NO: 3126923 - protein, 5 aa, Giardia lamblia
PDSTV

SEQ ID NO: 3126924 - protein, 25 aa, Giardia lamblia
PDTALTGDGDSSQLRDCTRSTDSSL

SEQ ID NO: 3126925 - protein, 4 aa, Giardia lamblia
PDTD

SEQ ID NO: 3126926 - protein, 9 aa, Giardia lamblia
PDTDDDGDG

SEQ ID NO: 3126927 - protein, 34 aa, Giardia lamblia
PDTGIQGTTPPKAPGSANKGASALSKANPYDDNT

SEQ ID NO: 3126928 - protein, 6 aa, Giardia lamblia
PDTGKK

SEQ ID NO: 3126929 - protein, 13 aa, Giardia lamblia
PDTLSSDTSEQLK

SEQ ID NO: 3126930 - protein, 10 aa, Giardia lamblia
PDTPSSSQLA

SEQ ID NO: 3126931 - protein, 5 aa, Giardia lamblia
PDTPV

SEQ ID NO: 3126932 - protein, 4 aa, Giardia lamblia
PDTR

SEQ ID NO: 3126933 - protein, 16 aa, Giardia lamblia
PDTSEQREEITKSLPG

SEQ ID NO: 3126934 - protein, 6 aa, Giardia lamblia
PDTSYN

SEQ ID NO: 3126935 - protein, 11 aa, Giardia lamblia
PDTYEANIDGG

SEQ ID NO: 3126936 - protein, 8 aa, Giardia lamblia
PDVEGGPS

SEQ ID NO: 3126937 - protein, 12 aa, Giardia lamblia
PDVPTAPLSYTP

SEQ ID NO: 3126938 - protein, 4 aa, Giardia lamblia
PDVS

SEQ ID NO: 3126939 - protein, 15 aa, Giardia lamblia
PDVVKGGPKVDENGN

SEQ ID NO: 3126940 - protein, 4 aa, Giardia lamblia
PDVY

SEQ ID NO: 3126941 - protein, 8 aa, Giardia lamblia
PDYNSRPT

SEQ ID NO: 3126942 - protein, 9 aa, Giardia lamblia
PEAAQHGPA

SEQ ID NO: 3126943 - protein, 12 aa, Giardia lamblia
PEAAQPPATENT

SEQ ID NO: 3126944 - protein, 5 aa, Giardia lamblia
PEAEH

SEQ ID NO: 3126945 - protein, 8 aa, Giardia lamblia
PEAETIER

SEQ ID NO: 3126946 - protein, 5 aa, Giardia lamblia
PEAFP

SEQ ID NO: 3126947 - protein, 14 aa, Giardia lamblia
PEAGKQSSLKNPTL

SEQ ID NO: 3126948 - protein, 4 aa, Giardia lamblia
PEAI

SEQ ID NO: 3126949 - protein, 7 aa, Giardia lamblia
PEALSNN

SEQ ID NO: 3126950 - protein, 6 aa, Giardia lamblia
PEAPQA

SEQ ID NO: 3126951 - protein, 17 aa, Giardia lamblia
PEAQPRKYLSPEKLTND

SEQ ID NO: 3126952 - protein, 4 aa, Giardia lamblia
PEAR

SEQ ID NO: 3126953 - protein, 6 aa, Giardia lamblia
PEARIT

SEQ ID NO: 3126954 - protein, 8 aa, Giardia lamblia
PEASKKVQ

SEQ ID NO: 3126955 - protein, 12 aa, Giardia lamblia
PEASNDRSMDRH

SEQ ID NO: 3126956 - protein, 7 aa, Giardia lamblia
PEASNGY

SEQ ID NO: 3126957 - protein, 7 aa, Giardia lamblia
PEASTQR

SEQ ID NO: 3126958 - protein, 4 aa, Giardia lamblia
PEAT

SEQ ID NO: 3126959 - protein, 6 aa, Giardia lamblia
PEATGY

SEQ ID NO: 3126960 - protein, 7 aa, Giardia lamblia
PEATKAE

SEQ ID NO: 3126961 - protein, 6 aa, Giardia lamblia
PEATSS

SEQ ID NO: 3126962 - protein, 4 aa, Giardia lamblia
PEAV

SEQ ID NO: 3126963 - protein, 10 aa, Giardia lamblia
PECAPNASEP

SEQ ID NO: 3126964 - protein, 16 aa, Giardia lamblia
PECDGGSRKNQLNRAS

SEQ ID NO: 3126965 - protein, 9 aa, Giardia lamblia
PEDDSQSLR

SEQ ID NO: 3126966 - protein, 4 aa, Giardia lamblia
PEDE

SEQ ID NO: 3126967 - protein, 4 aa, Giardia lamblia
PEDF

SEQ ID NO: 3126968 - protein, 8 aa, Giardia lamblia
PEDIEERS

SEQ ID NO: 3126969 - protein, 5 aa, Giardia lamblia
PEDIS

SEQ ID NO: 3126970 - protein, 43 aa, Giardia lamblia
PEDKKSSLAQKSEVQASPSLEQSEQEQKGQGSDIQGTGELRQS

SEQ ID NO: 3126971 - protein, 5 aa, Giardia lamblia
PEDKL

SEQ ID NO: 3126972 - protein, 7 aa, Giardia lamblia
PEDKSYK

SEQ ID NO: 3126973 - protein, 53 aa, Giardia lamblia
PEDNAYNDPQELHNDEPKLEAGPIDDEPQDQPVDTCKDEAPRPENPDNDDVQP

SEQ ID NO: 3126974 - protein, 5 aa, Giardia lamblia
PEDPN

SEQ ID NO: 3126975 - protein, 13 aa, Giardia lamblia
PEDPPTKTQPDYL

SEQ ID NO: 3126976 - protein, 6 aa, Giardia lamblia
PEDPRL

SEQ ID NO: 3126977 - protein, 20 aa, Giardia lamblia
PEDQAEVYNERNDEVREAFC

SEQ ID NO: 3126978 - protein, 7 aa, Giardia lamblia
PEDQDTQ

SEQ ID NO: 3126979 - protein, 39 aa, Giardia lamblia
PEDQSQTHSRSAPESCEEDGIKVPESNVSTLSSVAMDES

SEQ ID NO: 3126980 - protein, 4 aa, Giardia lamblia
PEDR

SEQ ID NO: 3126981 - protein, 7 aa, Giardia lamblia
PEDRITA

SEQ ID NO: 3126982 - protein, 17 aa, Giardia lamblia
PEDRKEQSIQLLEQYER

SEQ ID NO: 3126983 - protein, 8 aa, Giardia lamblia
PEDRPSAA

SEQ ID NO: 3126984 - protein, 5 aa, Giardia lamblia
PEDSQ

SEQ ID NO: 3126985 - protein, 6 aa, Giardia lamblia
PEDSRD

SEQ ID NO: 3126986 - protein, 7 aa, Giardia lamblia
PEDTDRL

SEQ ID NO: 3126987 - protein, 9 aa, Giardia lamblia
PEDTDYSGT

SEQ ID NO: 3126988 - protein, 7 aa, Giardia lamblia
PEDTIPD

SEQ ID NO: 3126989 - protein, 8 aa, Giardia lamblia
PEDTRRNF

SEQ ID NO: 3126990 - protein, 6 aa, Giardia lamblia
PEDTVD

SEQ ID NO: 3126991 - protein, 13 aa, Giardia lamblia
PEDTVPSKSRSRP

SEQ ID NO: 3126992 - protein, 4 aa, Giardia lamblia
PEDV

SEQ ID NO: 3126993 - protein, 6 aa, Giardia lamblia
PEDYPA

SEQ ID NO: 3126994 - protein, 5 aa, Giardia lamblia
PEEAE

SEQ ID NO: 3126995 - protein, 6 aa, Giardia lamblia
PEEDRN

SEQ ID NO: 3126996 - protein, 12 aa, Giardia lamblia
PEEEISKSTEPV

SEQ ID NO: 3126997 - protein, 89 aa, Giardia lamblia
PEEEQVEEEPLEDVPEEELNDGEEKGEGEDAEEAEEKAEEDGDQEAHEDDAEGDDLGEDNHQAGEDNEEDKGEAEEAEEELHSDQSIEE

SEQ ID NO: 3126998 - protein, 10 aa, Giardia lamblia
PEEGHRKHKH

SEQ ID NO: 3126999 - protein, 11 aa, Giardia lamblia
PEEGPVSGYGK

SEQ ID NO: 3127000 - protein, 6 aa, Giardia lamblia
PEEIPW

SEQ ID NO: 3127001 - protein, 10 aa, Giardia lamblia
PEELKASSPV

SEQ ID NO: 3127002 - protein, 8 aa, Giardia lamblia
PEEQNGRV

SEQ ID NO: 3127003 - protein, 6 aa, Giardia lamblia
PEEQPA

SEQ ID NO: 3127004 - protein, 9 aa, Giardia lamblia
PEESNYQEA

SEQ ID NO: 3127005 - protein, 5 aa, Giardia lamblia
PEESP

SEQ ID NO: 3127006 - protein, 16 aa, Giardia lamblia
PEESQKADAKTAVRDV

SEQ ID NO: 3127007 - protein, 15 aa, Giardia lamblia
PEETDINDNSCISFA

SEQ ID NO: 3127008 - protein, 7 aa, Giardia lamblia
PEETEES

SEQ ID NO: 3127009 - protein, 5 aa, Giardia lamblia
PEETG

SEQ ID NO: 3127010 - protein, 16 aa, Giardia lamblia
PEETLGPPQGKTKQSA

SEQ ID NO: 3127011 - protein, 8 aa, Giardia lamblia
PEETSEEA

SEQ ID NO: 3127012 - protein, 8 aa, Giardia lamblia
PEEVNGER

SEQ ID NO: 3127013 - protein, 6 aa, Giardia lamblia
PEFDSE

SEQ ID NO: 3127014 - protein, 5 aa, Giardia lamblia
PEGDG

SEQ ID NO: 3127015 - protein, 8 aa, Giardia lamblia
PEGDQAEL

SEQ ID NO: 3127016 - protein, 10 aa, Giardia lamblia
PEGNESRLSD

SEQ ID NO: 3127017 - protein, 5 aa, Giardia lamblia
PEGNR

SEQ ID NO: 3127018 - protein, 6 aa, Giardia lamblia
PEGNTD

SEQ ID NO: 3127019 - protein, 8 aa, Giardia lamblia
PEGPAERP

SEQ ID NO: 3127020 - protein, 8 aa, Giardia lamblia
PEGPAERS

SEQ ID NO: 3127021 - protein, 10 aa, Giardia lamblia
PEGSPVSERA

SEQ ID NO: 3127022 - protein, 7 aa, Giardia lamblia
PEGTEPA

SEQ ID NO: 3127023 - protein, 7 aa, Giardia lamblia
PEGTTSI

SEQ ID NO: 3127024 - protein, 4 aa, Giardia lamblia
PEHA

SEQ ID NO: 3127025 - protein, 10 aa, Giardia lamblia
PEHGNVDDTR

SEQ ID NO: 3127026 - protein, 12 aa, Giardia lamblia
PEIAGPSATKAA

SEQ ID NO: 3127027 - protein, 4 aa, Giardia lamblia
PEIE

SEQ ID NO: 3127028 - protein, 4 aa, Giardia lamblia
PEIK

SEQ ID NO: 3127029 - protein, 10 aa, Giardia lamblia
PEISDDDDIS

SEQ ID NO: 3127030 - protein, 12 aa, Giardia lamblia
PEKATLDQNERS

SEQ ID NO: 3127031 - protein, 10 aa, Giardia lamblia
PEKDHPGKPM

SEQ ID NO: 3127032 - protein, 33 aa, Giardia lamblia
PEKDTSEEGAGKSSPAESPQTDDEGSVDEDGVT

SEQ ID NO: 3127033 - protein, 7 aa, Giardia lamblia
PEKEESE

SEQ ID NO: 3127034 - protein, 8 aa, Giardia lamblia
PEKEETIR

SEQ ID NO: 3127035 - protein, 5 aa, Giardia lamblia
PEKEI

SEQ ID NO: 3127036 - protein, 12 aa, Giardia lamblia
PEKFSGARSERE

SEQ ID NO: 3127037 - protein, 10 aa, Giardia lamblia
PEKGETGVPH

SEQ ID NO: 3127038 - protein, 6 aa, Giardia lamblia
PEKGSN

SEQ ID NO: 3127039 - protein, 10 aa, Giardia lamblia
PEKITRPPLS

SEQ ID NO: 3127040 - protein, 7 aa, Giardia lamblia
PEKKPTV

SEQ ID NO: 3127041 - protein, 5 aa, Giardia lamblia
PEKNG

SEQ ID NO: 3127042 - protein, 7 aa, Giardia lamblia
PEKNLTN

SEQ ID NO: 3127043 - protein, 10 aa, Giardia lamblia
PEKNNAVEAS

SEQ ID NO: 3127044 - protein, 6 aa, Giardia lamblia
PEKPNY

SEQ ID NO: 3127045 - protein, 6 aa, Giardia lamblia
PEKPVP

SEQ ID NO: 3127046 - protein, 10 aa, Giardia lamblia
PEKQLESGQI

SEQ ID NO: 3127047 - protein, 4 aa, Giardia lamblia
PEKR

SEQ ID NO: 3127048 - protein, 10 aa, Giardia lamblia
PEKRNKDDTY

SEQ ID NO: 3127049 - protein, 9 aa, Giardia lamblia
PEKRPSTTE

SEQ ID NO: 3127050 - protein, 9 aa, Giardia lamblia
PEKSNENAI

SEQ ID NO: 3127051 - protein, 7 aa, Giardia lamblia
PEKVDRE

SEQ ID NO: 3127052 - protein, 10 aa, Giardia lamblia
PELDGPSLTK

SEQ ID NO: 3127053 - protein, 18 aa, Giardia lamblia
PELDPEQIEGMGKGHSMS

SEQ ID NO: 3127054 - protein, 4 aa, Giardia lamblia
PELE

SEQ ID NO: 3127055 - protein, 12 aa, Giardia lamblia
PELNKDSQLSND

SEQ ID NO: 3127056 - protein, 4 aa, Giardia lamblia
PELP

SEQ ID NO: 3127057 - protein, 15 aa, Giardia lamblia
PELPEEEDVEGSQSL

SEQ ID NO: 3127058 - protein, 7 aa, Giardia lamblia
PELPGYS

SEQ ID NO: 3127059 - protein, 10 aa, Giardia lamblia
PELPSTLSQG

SEQ ID NO: 3127060 - protein, 8 aa, Giardia lamblia
PELQQGDG

SEQ ID NO: 3127061 - protein, 4 aa, Giardia lamblia
PELR

SEQ ID NO: 3127062 - protein, 8 aa, Giardia lamblia
PELSAGQR

SEQ ID NO: 3127063 - protein, 6 aa, Giardia lamblia
PELSTS

SEQ ID NO: 3127064 - protein, 6 aa, Giardia lamblia
PELTPH

SEQ ID NO: 3127065 - protein, 5 aa, Giardia lamblia
PEMQQ

SEQ ID NO: 3127066 - protein, 5 aa, Giardia lamblia
PEMSN

SEQ ID NO: 3127067 - protein, 12 aa, Giardia lamblia
PENERPKPGQQI

SEQ ID NO: 3127068 - protein, 5 aa, Giardia lamblia
PENEV

SEQ ID NO: 3127069 - protein, 14 aa, Giardia lamblia
PENIGQEDKDRRVQ

SEQ ID NO: 3127070 - protein, 5 aa, Giardia lamblia
PENMK

SEQ ID NO: 3127071 - protein, 6 aa, Giardia lamblia
PENNDQ

SEQ ID NO: 3127072 - protein, 9 aa, Giardia lamblia
PENNPSASI

SEQ ID NO: 3127073 - protein, 5 aa, Giardia lamblia
PENQH

SEQ ID NO: 3127074 - protein, 4 aa, Giardia lamblia
PENT

SEQ ID NO: 3127075 - protein, 4 aa, Giardia lamblia
PEPF

SEQ ID NO: 3127076 - protein, 11 aa, Giardia lamblia
PEPGSEDNGRV

SEQ ID NO: 3127077 - protein, 4 aa, Giardia lamblia
PEPI

SEQ ID NO: 3127078 - protein, 36 aa, Giardia lamblia
PEPPINMGPSPNMNYESGLSDEGNSGNYQGSQDNNY

SEQ ID NO: 3127079 - protein, 6 aa, Giardia lamblia
PEPPPV

SEQ ID NO: 3127080 - protein, 6 aa, Giardia lamblia
PEPSET

SEQ ID NO: 3127081 - protein, 5 aa, Giardia lamblia
PEPSI

SEQ ID NO: 3127082 - protein, 27 aa, Giardia lamblia
PEPSTLSISASKSQKPDQDGHSSDDDV

SEQ ID NO: 3127083 - protein, 5 aa, Giardia lamblia
PEPYR

SEQ ID NO: 3127084 - protein, 6 aa, Giardia lamblia
PEPYRR

SEQ ID NO: 3127085 - protein, 19 aa, Giardia lamblia
PEQLETNSNGDSVPGATNT

SEQ ID NO: 3127086 - protein, 5 aa, Giardia lamblia
PEQNL

SEQ ID NO: 3127087 - protein, 10 aa, Giardia lamblia
PEQPNPGIHQ

SEQ ID NO: 3127088 - protein, 14 aa, Giardia lamblia
PEQPRTAPAPQRKM

SEQ ID NO: 3127089 - protein, 5 aa, Giardia lamblia
PEQQA

SEQ ID NO: 3127090 - protein, 6 aa, Giardia lamblia
PEQQRG

SEQ ID NO: 3127091 - protein, 8 aa, Giardia lamblia
PEQTGQHG

SEQ ID NO: 3127092 - protein, 5 aa, Giardia lamblia
PEQYS

SEQ ID NO: 3127093 - protein, 6 aa, Giardia lamblia
PERASR

SEQ ID NO: 3127094 - protein, 4 aa, Giardia lamblia
PERD

SEQ ID NO: 3127095 - protein, 9 aa, Giardia lamblia
PERDSNGMG

SEQ ID NO: 3127096 - protein, 4 aa, Giardia lamblia
PERE

SEQ ID NO: 3127097 - protein, 17 aa, Giardia lamblia
PERFPDSSKVLRHDPTI

SEQ ID NO: 3127098 - protein, 12 aa, Giardia lamblia
PERGERGPRQME

SEQ ID NO: 3127099 - protein, 14 aa, Giardia lamblia
PERKRARTTSRIGS

SEQ ID NO: 3127100 - protein, 17 aa, Giardia lamblia
PERLPTKTTSPGLRGSI

SEQ ID NO: 3127101 - protein, 4 aa, Giardia lamblia
PERP

SEQ ID NO: 3127102 - protein, 7 aa, Giardia lamblia
PERPGPC

SEQ ID NO: 3127103 - protein, 8 aa, Giardia lamblia
PERPPFRP

SEQ ID NO: 3127104 - protein, 35 aa, Giardia lamblia
PERRRSSRQSANITNSEPSEPSRVSDKLSTSESIP

SEQ ID NO: 3127105 - protein, 8 aa, Giardia lamblia
PERSADQC

SEQ ID NO: 3127106 - protein, 5 aa, Giardia lamblia
PERVN

SEQ ID NO: 3127107 - protein, 10 aa, Giardia lamblia
PESDSESEDL

SEQ ID NO: 3127108 - protein, 30 aa, Giardia lamblia
PESGLESTTESEGDTNTNTEEKLTKTPGRG

SEQ ID NO: 3127109 - protein, 6 aa, Giardia lamblia
PESGND

SEQ ID NO: 3127110 - protein, 4 aa, Giardia lamblia
PESK

SEQ ID NO: 3127111 - protein, 9 aa, Giardia lamblia
PESKPLSDE

SEQ ID NO: 3127112 - protein, 4 aa, Giardia lamblia
PESL

SEQ ID NO: 3127113 - protein, 14 aa, Giardia lamblia
PESQSGYTRATGPE

SEQ ID NO: 3127114 - protein, 5 aa, Giardia lamblia
PESQY

SEQ ID NO: 3127115 - protein, 10 aa, Giardia lamblia
PESRLSATEA

SEQ ID NO: 3127116 - protein, 4 aa, Giardia lamblia
PESS

SEQ ID NO: 3127117 - protein, 4 aa, Giardia lamblia
PETA

SEQ ID NO: 3127118 - protein, 18 aa, Giardia lamblia
PETAQEIGATTESGLRPA

SEQ ID NO: 3127119 - protein, 12 aa, Giardia lamblia
PETETDKEPFED

SEQ ID NO: 3127120 - protein, 7 aa, Giardia lamblia
PETGEQR

SEQ ID NO: 3127121 - protein, 7 aa, Giardia lamblia
PETGQGI

SEQ ID NO: 3127122 - protein, 4 aa, Giardia lamblia
PETL

SEQ ID NO: 3127123 - protein, 11 aa, Giardia lamblia
PETNQESDTFK

SEQ ID NO: 3127124 - protein, 20 aa, Giardia lamblia
PETPGSDSGQHRGSQSSYNT

SEQ ID NO: 3127125 - protein, 5 aa, Giardia lamblia
PETSE

SEQ ID NO: 3127126 - protein, 11 aa, Giardia lamblia
PETSNNDNEQF

SEQ ID NO: 3127127 - protein, 8 aa, Giardia lamblia
PETSYTDR

SEQ ID NO: 3127128 - protein, 4 aa, Giardia lamblia
PETT

SEQ ID NO: 3127129 - protein, 5 aa, Giardia lamblia
PETTG

SEQ ID NO: 3127130 - protein, 7 aa, Giardia lamblia
PETTMSS

SEQ ID NO: 3127131 - protein, 36 aa, Giardia lamblia
PETTQAAVGRADALRSGTFPGNVRNQAASIAASQDF

SEQ ID NO: 3127132 - protein, 5 aa, Giardia lamblia
PETYE

SEQ ID NO: 3127133 - protein, 12 aa, Giardia lamblia
PEVAPASNTPIA

SEQ ID NO: 3127134 - protein, 18 aa, Giardia lamblia
PEVESNDRPTKSSQLTSN

SEQ ID NO: 3127135 - protein, 4 aa, Giardia lamblia
PEVK

SEQ ID NO: 3127136 - protein, 7 aa, Giardia lamblia
PEVPDAE

SEQ ID NO: 3127137 - protein, 62 aa, Giardia lamblia
PEVPPEEETSTSKAKKGSAKEDKKRGDKTSAKTSAKTSAKTSRRGSIRGGEPSETPNPDSIT

SEQ ID NO: 3127138 - protein, 6 aa, Giardia lamblia
PEVQPS

SEQ ID NO: 3127139 - protein, 6 aa, Giardia lamblia
PEVSGA

SEQ ID NO: 3127140 - protein, 14 aa, Giardia lamblia
PEVSQASKPSSISD

SEQ ID NO: 3127141 - protein, 4 aa, Giardia lamblia
PEVT

SEQ ID NO: 3127142 - protein, 5 aa, Giardia lamblia
PEYDV

SEQ ID NO: 3127143 - protein, 8 aa, Giardia lamblia
PEYIDSGS

SEQ ID NO: 3127144 - protein, 8 aa, Giardia lamblia
PEYNGSPG

SEQ ID NO: 3127145 - protein, 4 aa, Giardia lamblia
PEYP

SEQ ID NO: 3127146 - protein, 9 aa, Giardia lamblia
PEYRQSSSS

SEQ ID NO: 3127147 - protein, 9 aa, Giardia lamblia
PEYRRQGVS

SEQ ID NO: 3127148 - protein, 4 aa, Giardia lamblia
PEYS

SEQ ID NO: 3127149 - protein, 7 aa, Giardia lamblia
PEYTPDY

SEQ ID NO: 3127150 - protein, 11 aa, Giardia lamblia
PEYVPSGRLPR

SEQ ID NO: 3127151 - protein, 8 aa, Giardia lamblia
PFAPPEER

SEQ ID NO: 3127152 - protein, 11 aa, Giardia lamblia
PFDDSSPEQDE

SEQ ID NO: 3127153 - protein, 8 aa, Giardia lamblia
PFDEEDHT

SEQ ID NO: 3127154 - protein, 10 aa, Giardia lamblia
PFDGSTPNHL

SEQ ID NO: 3127155 - protein, 5 aa, Giardia lamblia
PFDSN

SEQ ID NO: 3127156 - protein, 12 aa, Giardia lamblia
PFGDPIPSSDAH

SEQ ID NO: 3127157 - protein, 11 aa, Giardia lamblia
PFGSDNPRDSV

SEQ ID NO: 3127158 - protein, 19 aa, Giardia lamblia
PFGTTSKQGTEPSNTSIER

SEQ ID NO: 3127159 - protein, 7 aa, Giardia lamblia
PFHGSKD

SEQ ID NO: 3127160 - protein, 7 aa, Giardia lamblia
PFHNGED

SEQ ID NO: 3127161 - protein, 16 aa, Giardia lamblia
PFKPGARGGAYTNPNM

SEQ ID NO: 3127162 - protein, 7 aa, Giardia lamblia
PFKPPKV

SEQ ID NO: 3127163 - protein, 12 aa, Giardia lamblia
PFKSALSNDTLD

SEQ ID NO: 3127164 - protein, 6 aa, Giardia lamblia
PFKTGQ

SEQ ID NO: 3127165 - protein, 9 aa, Giardia lamblia
PFNNDPPVP

SEQ ID NO: 3127166 - protein, 4 aa, Giardia lamblia
PFNQ

SEQ ID NO: 3127167 - protein, 6 aa, Giardia lamblia
PFPDPT

SEQ ID NO: 3127168 - protein, 10 aa, Giardia lamblia
PFPESRRPEV

SEQ ID NO: 3127169 - protein, 5 aa, Giardia lamblia
PFPGL

SEQ ID NO: 3127170 - protein, 10 aa, Giardia lamblia
PFPPGSSVSG

SEQ ID NO: 3127171 - protein, 13 aa, Giardia lamblia
PFPPTTSSQVKGT

SEQ ID NO: 3127172 - protein, 15 aa, Giardia lamblia
PFPQDADVAGKTREE

SEQ ID NO: 3127173 - protein, 13 aa, Giardia lamblia
PFPTRSLGGRKTA

SEQ ID NO: 3127174 - protein, 5 aa, Giardia lamblia
PFQRP

SEQ ID NO: 3127175 - protein, 31 aa, Giardia lamblia
PFQRSDPFGSSGYPEDMRGPRPRHNTGPSVE

SEQ ID NO: 3127176 - protein, 9 aa, Giardia lamblia
PFRQGGVPE

SEQ ID NO: 3127177 - protein, 12 aa, Giardia lamblia
PFRRRKPPTSLD

SEQ ID NO: 3127178 - protein, 17 aa, Giardia lamblia
PFSAQPAQPVYKPPPPL

SEQ ID NO: 3127179 - protein, 6 aa, Giardia lamblia
PFSSQQ

SEQ ID NO: 3127180 - protein, 5 aa, Giardia lamblia
PFTET

SEQ ID NO: 3127181 - protein, 4 aa, Giardia lamblia
PFTP

SEQ ID NO: 3127182 - protein, 5 aa, Giardia lamblia
PFTPA

SEQ ID NO: 3127183 - protein, 11 aa, Giardia lamblia
PFTSRKSTKMN

SEQ ID NO: 3127184 - protein, 9 aa, Giardia lamblia
PFTSTSSSE

SEQ ID NO: 3127185 - protein, 32 aa, Giardia lamblia
PFTTAGEQQEANLNAGASATPRKPDSDEDSPL

SEQ ID NO: 3127186 - protein, 6 aa, Giardia lamblia
PFTTGR

SEQ ID NO: 3127187 - protein, 5 aa, Giardia lamblia
PGADA

SEQ ID NO: 3127188 - protein, 10 aa, Giardia lamblia
PGADPTSYSF

SEQ ID NO: 3127189 - protein, 5 aa, Giardia lamblia
PGAGA

SEQ ID NO: 3127190 - protein, 6 aa, Giardia lamblia
PGAIPK

SEQ ID NO: 3127191 - protein, 9 aa, Giardia lamblia
PGAKNPPIF

SEQ ID NO: 3127192 - protein, 14 aa, Giardia lamblia
PGAPPKRTRTGTLH

SEQ ID NO: 3127193 - protein, 8 aa, Giardia lamblia
PGAPSVSK

SEQ ID NO: 3127194 - protein, 9 aa, Giardia lamblia
PGARVGPPL

SEQ ID NO: 3127195 - protein, 4 aa, Giardia lamblia
PGAS

SEQ ID NO: 3127196 - protein, 8 aa, Giardia lamblia
PGATAGDR

SEQ ID NO: 3127197 - protein, 8 aa, Giardia lamblia
PGATDSEA

SEQ ID NO: 3127198 - protein, 10 aa, Giardia lamblia
PGAVTASDEQ

SEQ ID NO: 3127199 - protein, 5 aa, Giardia lamblia
PGCAK

SEQ ID NO: 3127200 - protein, 8 aa, Giardia lamblia
PGCGKSAV
